United States Patent 7,655,785 (BIOINFORMATICALLY DETECTABLE GROUP OF NOVEL REGULATORY OLIGONUCLEOTIDES AND USES THEREOF) - sequence listing, part 52

SEQ ID NO: 2157802 - RNA, 19 nt, Homo sapiens
cuaguuuuuccugugcaaa

SEQ ID NO: 2157803 - RNA, 17 nt, Homo sapiens
accuuguuuugccagug

SEQ ID NO: 2157804 - RNA, 17 nt, Homo sapiens
aucuuaaaaaccugccu

SEQ ID NO: 2157805 - RNA, 18 nt, Homo sapiens
cuaacauuccauguuuca

SEQ ID NO: 2157806 - RNA, 18 nt, Homo sapiens
caagagugauauacucca

SEQ ID NO: 2157807 - RNA, 11 nt, Homo sapiens
gcugcuccaug

SEQ ID NO: 2157808 - RNA, 17 nt, Homo sapiens
auuccacuuacauccaa

SEQ ID NO: 2157809 - RNA, 14 nt, Homo sapiens
uugcucaaagggaa

SEQ ID NO: 2157810 - RNA, 14 nt, Homo sapiens
aauuguauaaguca

SEQ ID NO: 2157811 - RNA, 15 nt, Homo sapiens
accucgugcuuuaag

SEQ ID NO: 2157812 - RNA, 18 nt, Homo sapiens
agaucugcucgcugagaa

SEQ ID NO: 2157813 - RNA, 20 nt, Homo sapiens
caauaugggaggaacaaaga

SEQ ID NO: 2157814 - RNA, 16 nt, Homo sapiens
uuccuucaagccaagu

SEQ ID NO: 2157815 - RNA, 14 nt, Homo sapiens
cacgguuuccagau

SEQ ID NO: 2157816 - RNA, 17 nt, Homo sapiens
uaaacuuuauuuguaaa

SEQ ID NO: 2157817 - RNA, 15 nt, Homo sapiens
ccagucauuguacug

SEQ ID NO: 2157818 - RNA, 22 nt, Homo sapiens
cuugcauccaugcccagccaau

SEQ ID NO: 2157819 - RNA, 18 nt, Homo sapiens
gcuaugguucucucgcaa

SEQ ID NO: 2157820 - RNA, 17 nt, Homo sapiens
accugcugugaugacuu

SEQ ID NO: 2157821 - RNA, 16 nt, Homo sapiens
caaaauguuuaaguca

SEQ ID NO: 2157822 - RNA, 14 nt, Homo sapiens
gccaaucauugcaa

SEQ ID NO: 2157823 - RNA, 18 nt, Homo sapiens
cccucaguuugcaguaua

SEQ ID NO: 2157824 - RNA, 18 nt, Homo sapiens
uacaggugugagccacug

SEQ ID NO: 2157825 - RNA, 15 nt, Homo sapiens
ucccaagaaauggaa

SEQ ID NO: 2157826 - RNA, 15 nt, Homo sapiens
cuguuccaugucucc

SEQ ID NO: 2157827 - RNA, 12 nt, Homo sapiens
cuuuggaaaaua

SEQ ID NO: 2157828 - RNA, 19 nt, Homo sapiens
ccagccuggccaacauggc

SEQ ID NO: 2157829 - RNA, 22 nt, Homo sapiens
uagcuugagcuggauucacuug

SEQ ID NO: 2157830 - RNA, 23 nt, Homo sapiens
aaagguaaaacaugcuggugaac

SEQ ID NO: 2157831 - RNA, 23 nt, Homo sapiens
ugaccacucuucuuuaagccaua

SEQ ID NO: 2157832 - RNA, 22 nt, Homo sapiens
auuguuuuuuaucuuuucuaca

SEQ ID NO: 2157833 - RNA, 15 nt, Homo sapiens
ucaacauuacauuug

SEQ ID NO: 2157834 - RNA, 15 nt, Homo sapiens
gagcuggcaccagaa

SEQ ID NO: 2157835 - RNA, 20 nt, Homo sapiens
ccugucuugaguagacuugg

SEQ ID NO: 2157836 - RNA, 19 nt, Homo sapiens
uuuaaaaaauauuuucucu

SEQ ID NO: 2157837 - RNA, 13 nt, Homo sapiens
cuugguucuguca

SEQ ID NO: 2157838 - RNA, 21 nt, Homo sapiens
ucugcugauuaucacacauca

SEQ ID NO: 2157839 - RNA, 15 nt, Homo sapiens
gucacgcaugcagug

SEQ ID NO: 2157840 - RNA, 12 nt, Homo sapiens
auaggaggacag

SEQ ID NO: 2157841 - RNA, 16 nt, Homo sapiens
uguuuccuuuuaguug

SEQ ID NO: 2157842 - RNA, 15 nt, Homo sapiens
aaaugagugaucuca

SEQ ID NO: 2157843 - RNA, 16 nt, Homo sapiens
caucugcugagcucug

SEQ ID NO: 2157844 - RNA, 21 nt, Homo sapiens
acagcacacacaagugcacag

SEQ ID NO: 2157845 - RNA, 19 nt, Homo sapiens
caagguaagagccuuaaaa

SEQ ID NO: 2157846 - RNA, 13 nt, Homo sapiens
agacagagacaau

SEQ ID NO: 2157847 - RNA, 13 nt, Homo sapiens
uuaaguugcugua

SEQ ID NO: 2157848 - RNA, 23 nt, Homo sapiens
uuacaauaaaugaagauuacccu

SEQ ID NO: 2157849 - RNA, 16 nt, Homo sapiens
ccgguugcuucuggga

SEQ ID NO: 2157850 - RNA, 21 nt, Homo sapiens
aauuuugggggaaaaaaucca

SEQ ID NO: 2157851 - RNA, 12 nt, Homo sapiens
agguuugucaac

SEQ ID NO: 2157852 - RNA, 16 nt, Homo sapiens
ccgugcucacuaccaa

SEQ ID NO: 2157853 - RNA, 14 nt, Homo sapiens
agggaggucacugg

SEQ ID NO: 2157854 - RNA, 14 nt, Homo sapiens
ugcacccgugccac

SEQ ID NO: 2157855 - RNA, 17 nt, Homo sapiens
agauuggccauguucca

SEQ ID NO: 2157856 - RNA, 19 nt, Homo sapiens
uuucucugcaaaaugucau

SEQ ID NO: 2157857 - RNA, 20 nt, Homo sapiens
aaccuccaccuccuggguuc

SEQ ID NO: 2157858 - RNA, 20 nt, Homo sapiens
gccggaaggaaugucagggc

SEQ ID NO: 2157859 - RNA, 14 nt, Homo sapiens
gauuuccucuugaa

SEQ ID NO: 2157860 - RNA, 13 nt, Homo sapiens
aagcaccaaaaaa

SEQ ID NO: 2157861 - RNA, 23 nt, Homo sapiens
aaauacacuguuaucuucacuuu

SEQ ID NO: 2157862 - RNA, 23 nt, Homo sapiens
aauccagucccaaugguccugac

SEQ ID NO: 2157863 - RNA, 23 nt, Homo sapiens
cuagucauuaacccaucucugaa

SEQ ID NO: 2157864 - RNA, 22 nt, Homo sapiens
uugucaacaguauacaaaagaa

SEQ ID NO: 2157865 - RNA, 17 nt, Homo sapiens
gcagcuugaaacugaga

SEQ ID NO: 2157866 - RNA, 16 nt, Homo sapiens
gaaacauuagugaaaa

SEQ ID NO: 2157867 - RNA, 17 nt, Homo sapiens
ggacaucaucucuucca

SEQ ID NO: 2157868 - RNA, 15 nt, Homo sapiens
cagaggaacaagcau

SEQ ID NO: 2157869 - RNA, 23 nt, Homo sapiens
aagucaccaaauagugugaaaua

SEQ ID NO: 2157870 - RNA, 15 nt, Homo sapiens
cugccaggagcucuc

SEQ ID NO: 2157871 - RNA, 16 nt, Homo sapiens
acccagugugugcuca

SEQ ID NO: 2157872 - RNA, 19 nt, Homo sapiens
ucuggcuggaaagcagagc

SEQ ID NO: 2157873 - RNA, 16 nt, Homo sapiens
gagcuuucuuugcacu

SEQ ID NO: 2157874 - RNA, 21 nt, Homo sapiens
uuaucacuucauucacauuca

SEQ ID NO: 2157875 - RNA, 16 nt, Homo sapiens
gcccagaugacauccc

SEQ ID NO: 2157876 - RNA, 15 nt, Homo sapiens
aagauagagaaugcc

SEQ ID NO: 2157877 - RNA, 17 nt, Homo sapiens
accagucacacauuaua

SEQ ID NO: 2157878 - RNA, 20 nt, Homo sapiens
cuacuuacauaguugaaaua

SEQ ID NO: 2157879 - RNA, 12 nt, Homo sapiens
cugaaccagaga

SEQ ID NO: 2157880 - RNA, 20 nt, Homo sapiens
aggaagggaccccacuggaa

SEQ ID NO: 2157881 - RNA, 19 nt, Homo sapiens
auauggacacugugacaau

SEQ ID NO: 2157882 - RNA, 21 nt, Homo sapiens
cuugcccuuugagaaacccaa

SEQ ID NO: 2157883 - RNA, 20 nt, Homo sapiens
uggaauucuaacaagucaua

SEQ ID NO: 2157884 - RNA, 21 nt, Homo sapiens
ucccucuccacucuucucucc

SEQ ID NO: 2157885 - RNA, 21 nt, Homo sapiens
ggaugauacuuggaugcagcu

SEQ ID NO: 2157886 - RNA, 13 nt, Homo sapiens
cuagugcugugaa

SEQ ID NO: 2157887 - RNA, 15 nt, Homo sapiens
cacugccuccaugau

SEQ ID NO: 2157888 - RNA, 19 nt, Homo sapiens
uuguauauugucagauauu

SEQ ID NO: 2157889 - RNA, 17 nt, Homo sapiens
uuuuuguuucacuggaa

SEQ ID NO: 2157890 - RNA, 20 nt, Homo sapiens
gugaaggaacuagggauauu

SEQ ID NO: 2157891 - RNA, 16 nt, Homo sapiens
ucccugagccuaucgu

SEQ ID NO: 2157892 - RNA, 20 nt, Homo sapiens
uuuacuccucaguuccucac

SEQ ID NO: 2157893 - RNA, 19 nt, Homo sapiens
cagguaaagggcaaauaau

SEQ ID NO: 2157894 - RNA, 14 nt, Homo sapiens
agcugaacacaagc

SEQ ID NO: 2157895 - RNA, 15 nt, Homo sapiens
aagauuuucagaaaa

SEQ ID NO: 2157896 - RNA, 16 nt, Homo sapiens
aucuuucaaaccagcu

SEQ ID NO: 2157897 - RNA, 18 nt, Homo sapiens
aaacuuuuaaacaugaga

SEQ ID NO: 2157898 - RNA, 15 nt, Homo sapiens
ugaagaaucuguuuc

SEQ ID NO: 2157899 - RNA, 12 nt, Homo sapiens
aaaucacuauaa

SEQ ID NO: 2157900 - RNA, 13 nt, Homo sapiens
ccaaggagucaga

SEQ ID NO: 2157901 - RNA, 14 nt, Homo sapiens
ugagcacucuuauc

SEQ ID NO: 2157902 - RNA, 13 nt, Homo sapiens
uucauuaauacug

SEQ ID NO: 2157903 - RNA, 19 nt, Homo sapiens
cauaugagaauauaccuua

SEQ ID NO: 2157904 - RNA, 14 nt, Homo sapiens
guguagaauuugaa

SEQ ID NO: 2157905 - RNA, 16 nt, Homo sapiens
cucauccccacaaucu

SEQ ID NO: 2157906 - RNA, 17 nt, Homo sapiens
cuguaaaaacacugaaa

SEQ ID NO: 2157907 - RNA, 15 nt, Homo sapiens
aagcuaacuuccacu

SEQ ID NO: 2157908 - RNA, 13 nt, Homo sapiens
cuuuucaccuuua

SEQ ID NO: 2157909 - RNA, 13 nt, Homo sapiens
aaaaucacaaaaa

SEQ ID NO: 2157910 - RNA, 19 nt, Homo sapiens
aaaugcaguccagugagaa

SEQ ID NO: 2157911 - RNA, 15 nt, Homo sapiens
caggaaccucagggc

SEQ ID NO: 2157912 - RNA, 19 nt, Homo sapiens
aaaaagaccuaugagcaca

SEQ ID NO: 2157913 - RNA, 18 nt, Homo sapiens
uacagcacacacuuccau

SEQ ID NO: 2157914 - RNA, 15 nt, Homo sapiens
aauaauaaaugcaua

SEQ ID NO: 2157915 - RNA, 23 nt, Homo sapiens
acagaagaaacuacccucuggag

SEQ ID NO: 2157916 - RNA, 12 nt, Homo sapiens
aaaaaaagggag

SEQ ID NO: 2157917 - RNA, 21 nt, Homo sapiens
uuauacugauuaugucuuuua

SEQ ID NO: 2157918 - RNA, 10 nt, Homo sapiens
ccacaccaga

SEQ ID NO: 2157919 - RNA, 16 nt, Homo sapiens
agaauugugccucucc

SEQ ID NO: 2157920 - RNA, 22 nt, Homo sapiens
cauuuguuuaauaagcauacca

SEQ ID NO: 2157921 - RNA, 16 nt, Homo sapiens
cuugucccuguggaag

SEQ ID NO: 2157922 - RNA, 15 nt, Homo sapiens
acugcuugugcacug

SEQ ID NO: 2157923 - RNA, 14 nt, Homo sapiens
ucaggccacauaau

SEQ ID NO: 2157924 - RNA, 19 nt, Homo sapiens
gaaacuugaacuccaggau

SEQ ID NO: 2157925 - RNA, 22 nt, Homo sapiens
aagugaaccaucucagaccuuu

SEQ ID NO: 2157926 - RNA, 17 nt, Homo sapiens
agagauuauaacaaauu

SEQ ID NO: 2157927 - RNA, 15 nt, Homo sapiens
agugugcugaacaca

SEQ ID NO: 2157928 - RNA, 16 nt, Homo sapiens
auaaguccaucuguca

SEQ ID NO: 2157929 - RNA, 16 nt, Homo sapiens
aucacuauuuauaaac

SEQ ID NO: 2157930 - RNA, 16 nt, Homo sapiens
guacccccuuucccuu

SEQ ID NO: 2157931 - RNA, 22 nt, Homo sapiens
aagacagccacaccuuaguaua

SEQ ID NO: 2157932 - RNA, 22 nt, Homo sapiens
acaguccaggaacaagcuaauu

SEQ ID NO: 2157933 - RNA, 23 nt, Homo sapiens
auaccgcugcauaguauuccauu

SEQ ID NO: 2157934 - RNA, 16 nt, Homo sapiens
aaugguuccauucucu

SEQ ID NO: 2157935 - RNA, 11 nt, Homo sapiens
uuccuccauga

SEQ ID NO: 2157936 - RNA, 15 nt, Homo sapiens
aggcugccucugggu

SEQ ID NO: 2157937 - RNA, 19 nt, Homo sapiens
caguuucuaucauucugcu

SEQ ID NO: 2157938 - RNA, 13 nt, Homo sapiens
aagacaagagcug

SEQ ID NO: 2157939 - RNA, 18 nt, Homo sapiens
cccuagaucaacagauca

SEQ ID NO: 2157940 - RNA, 13 nt, Homo sapiens
ggcucccaggaca

SEQ ID NO: 2157941 - RNA, 18 nt, Homo sapiens
cuuccuaucccaucccau

SEQ ID NO: 2157942 - RNA, 15 nt, Homo sapiens
gggaccuauaucuca

SEQ ID NO: 2157943 - RNA, 21 nt, Homo sapiens
auuccauuuuacuuccaugau

SEQ ID NO: 2157944 - RNA, 11 nt, Homo sapiens
uuacuguagac

SEQ ID NO: 2157945 - RNA, 17 nt, Homo sapiens
gugcuuggaggccucag

SEQ ID NO: 2157946 - RNA, 15 nt, Homo sapiens
cacgcauguaugcau

SEQ ID NO: 2157947 - RNA, 20 nt, Homo sapiens
agacuaccugcccucagcuu

SEQ ID NO: 2157948 - RNA, 21 nt, Homo sapiens
caguauaaauuaucuuaugaa

SEQ ID NO: 2157949 - RNA, 21 nt, Homo sapiens
gucucuaacauaccuugucau

SEQ ID NO: 2157950 - RNA, 13 nt, Homo sapiens
acagcucucaccu

SEQ ID NO: 2157951 - RNA, 15 nt, Homo sapiens
cagcacccucuccag

SEQ ID NO: 2157952 - RNA, 21 nt, Homo sapiens
gaaaaauuguagagugcccau

SEQ ID NO: 2157953 - RNA, 19 nt, Homo sapiens
aggcagcuucuacuccugc

SEQ ID NO: 2157954 - RNA, 24 nt, Homo sapiens
cgcugcgcuuuauuucggagcgca

SEQ ID NO: 2157955 - RNA, 16 nt, Homo sapiens
agccacagcagccacu

SEQ ID NO: 2157956 - RNA, 12 nt, Homo sapiens
aggaaccuacca

SEQ ID NO: 2157957 - RNA, 14 nt, Homo sapiens
cgccauuccaaguc

SEQ ID NO: 2157958 - RNA, 20 nt, Homo sapiens
uccagcuagccaacuccucc

SEQ ID NO: 2157959 - RNA, 14 nt, Homo sapiens
ucauuuuugccagu

SEQ ID NO: 2157960 - RNA, 19 nt, Homo sapiens
aaaaguuccaagagucuaa

SEQ ID NO: 2157961 - RNA, 22 nt, Homo sapiens
agguggauuuggagaccgaaga

SEQ ID NO: 2157962 - RNA, 16 nt, Homo sapiens
ugauacgcacuuugca

SEQ ID NO: 2157963 - RNA, 18 nt, Homo sapiens
accugucauuuugcacug

SEQ ID NO: 2157964 - RNA, 15 nt, Homo sapiens
gcacuggugggccau

SEQ ID NO: 2157965 - RNA, 15 nt, Homo sapiens
uucuauugcugagaa

SEQ ID NO: 2157966 - RNA, 21 nt, Homo sapiens
cuaaguguugugaaacuguaa

SEQ ID NO: 2157967 - RNA, 23 nt, Homo sapiens
gaggguauuuguggaaacuguca

SEQ ID NO: 2157968 - RNA, 15 nt, Homo sapiens
ucuuucacacuucca

SEQ ID NO: 2157969 - RNA, 15 nt, Homo sapiens
uuaauaacauaacaa

SEQ ID NO: 2157970 - RNA, 16 nt, Homo sapiens
cauaaaaacuacugaa

SEQ ID NO: 2157971 - RNA, 19 nt, Homo sapiens
accugagcgggugccgaag

SEQ ID NO: 2157972 - RNA, 17 nt, Homo sapiens
accgugggcucccugac

SEQ ID NO: 2157973 - RNA, 15 nt, Homo sapiens
gucauaugcguuugu

SEQ ID NO: 2157974 - RNA, 17 nt, Homo sapiens
ucagcacuguaacuucg

SEQ ID NO: 2157975 - RNA, 22 nt, Homo sapiens
uguauaacuuggccgcuguaug

SEQ ID NO: 2157976 - RNA, 19 nt, Homo sapiens
caagugauccuuccaccuc

SEQ ID NO: 2157977 - RNA, 17 nt, Homo sapiens
aaccucauugcuaccac

SEQ ID NO: 2157978 - RNA, 12 nt, Homo sapiens
ucuugugauuga

SEQ ID NO: 2157979 - RNA, 12 nt, Homo sapiens
ccucucuccuuc

SEQ ID NO: 2157980 - RNA, 21 nt, Homo sapiens
cacauaggaaacuuuugauaa

SEQ ID NO: 2157981 - RNA, 14 nt, Homo sapiens
aaauauaugacuuu

SEQ ID NO: 2157982 - RNA, 15 nt, Homo sapiens
uaaaugacaguaaua

SEQ ID NO: 2157983 - RNA, 17 nt, Homo sapiens
uuauucaccaucaugua

SEQ ID NO: 2157984 - RNA, 13 nt, Homo sapiens
uuuucugugucaa

SEQ ID NO: 2157985 - RNA, 15 nt, Homo sapiens
ugauuauuaaagucc

SEQ ID NO: 2157986 - RNA, 22 nt, Homo sapiens
agcccuuccucccauuucccau

SEQ ID NO: 2157987 - RNA, 16 nt, Homo sapiens
ugagaucguccacugu

SEQ ID NO: 2157988 - RNA, 12 nt, Homo sapiens
acgaggugaaaa

SEQ ID NO: 2157989 - RNA, 13 nt, Homo sapiens
aauuacuuuguga

SEQ ID NO: 2157990 - RNA, 15 nt, Homo sapiens
ucacugcuacaugug

SEQ ID NO: 2157991 - RNA, 16 nt, Homo sapiens
acacucaguccuucca

SEQ ID NO: 2157992 - RNA, 13 nt, Homo sapiens
gcuggauaccugu

SEQ ID NO: 2157993 - RNA, 19 nt, Homo sapiens
cuuuaucauuaaacaugaa

SEQ ID NO: 2157994 - RNA, 21 nt, Homo sapiens
ucuuuuagucauuuugcuuca

SEQ ID NO: 2157995 - RNA, 16 nt, Homo sapiens
ugagcuguugccucag

SEQ ID NO: 2157996 - RNA, 20 nt, Homo sapiens
uuuucggaggccccacugau

SEQ ID NO: 2157997 - RNA, 21 nt, Homo sapiens
cagguuggaacuaugcagugu

SEQ ID NO: 2157998 - RNA, 20 nt, Homo sapiens
ugggagaguaaaccuugaag

SEQ ID NO: 2157999 - RNA, 14 nt, Homo sapiens
ucauuucauuccau

SEQ ID NO: 2158000 - RNA, 14 nt, Homo sapiens
ucauugcauuccag

SEQ ID NO: 2158001 - RNA, 17 nt, Homo sapiens
guuuuuaucauggguau

SEQ ID NO: 2158002 - RNA, 18 nt, Homo sapiens
aauaaaacaguaucucuu

SEQ ID NO: 2158003 - RNA, 22 nt, Homo sapiens
ugccucugagggaaagcccaga

SEQ ID NO: 2158004 - RNA, 19 nt, Homo sapiens
ggagaaugaagacuguuaa

SEQ ID NO: 2158005 - RNA, 18 nt, Homo sapiens
ugccauauucuguuggcc

SEQ ID NO: 2158006 - RNA, 12 nt, Homo sapiens
ccccuggccuca

SEQ ID NO: 2158007 - RNA, 22 nt, Homo sapiens
ccgcucuggauccugcacucua

SEQ ID NO: 2158008 - RNA, 17 nt, Homo sapiens
cagcagcccugccccac

SEQ ID NO: 2158009 - RNA, 17 nt, Homo sapiens
uguaacuucuuaaucua

SEQ ID NO: 2158010 - RNA, 23 nt, Homo sapiens
uuaaagaccugacagcuugagaa

SEQ ID NO: 2158011 - RNA, 23 nt, Homo sapiens
cagcugugugggucauaccgugu

SEQ ID NO: 2158012 - RNA, 23 nt, Homo sapiens
gccuggcccccgacccagcucua

SEQ ID NO: 2158013 - RNA, 19 nt, Homo sapiens
gaugaacgggcuggagcag

SEQ ID NO: 2158014 - RNA, 16 nt, Homo sapiens
agcgaggacauucucu

SEQ ID NO: 2158015 - RNA, 16 nt, Homo sapiens
ucggcacacacugugc

SEQ ID NO: 2158016 - RNA, 15 nt, Homo sapiens
ugauccugggggacc

SEQ ID NO: 2158017 - RNA, 13 nt, Homo sapiens
cucucugaucucc

SEQ ID NO: 2158018 - RNA, 21 nt, Homo sapiens
gccacacggagaggccacugu

SEQ ID NO: 2158019 - RNA, 22 nt, Homo sapiens
uaucucaaauuguaauuaauaa

SEQ ID NO: 2158020 - RNA, 23 nt, Homo sapiens
gccgccucaagggucuucagggg

SEQ ID NO: 2158021 - RNA, 14 nt, Homo sapiens
acauuuucuuucau

SEQ ID NO: 2158022 - RNA, 23 nt, Homo sapiens
ucccuucacaaaauuuuguuuca

SEQ ID NO: 2158023 - RNA, 14 nt, Homo sapiens
agaguuucacucuu

SEQ ID NO: 2158024 - RNA, 14 nt, Homo sapiens
ucaccaucugugca

SEQ ID NO: 2158025 - RNA, 19 nt, Homo sapiens
cgcuuuguacuuugugcaa

SEQ ID NO: 2158026 - RNA, 21 nt, Homo sapiens
gaagcuccugggggaugcucu

SEQ ID NO: 2158027 - RNA, 22 nt, Homo sapiens
ucccaacugaguguuauuugca

SEQ ID NO: 2158028 - RNA, 19 nt, Homo sapiens
uagauguguuauuacuucc

SEQ ID NO: 2158029 - RNA, 18 nt, Homo sapiens
ucuagauccugcacccca

SEQ ID NO: 2158030 - RNA, 23 nt, Homo sapiens
ugaacucugggcucaagcaaucc

SEQ ID NO: 2158031 - RNA, 13 nt, Homo sapiens
gucuuucaaugac

SEQ ID NO: 2158032 - RNA, 16 nt, Homo sapiens
ggccugacugcucaga

SEQ ID NO: 2158033 - RNA, 14 nt, Homo sapiens
aaaugugcuucucu

SEQ ID NO: 2158034 - RNA, 12 nt, Homo sapiens
agcaggggagcu

SEQ ID NO: 2158035 - RNA, 12 nt, Homo sapiens
cucuggggcuca

SEQ ID NO: 2158036 - RNA, 13 nt, Homo sapiens
uaaaacucaucaa

SEQ ID NO: 2158037 - RNA, 14 nt, Homo sapiens
ucucucucucaaaa

SEQ ID NO: 2158038 - RNA, 20 nt, Homo sapiens
agccauggacucuacacugu

SEQ ID NO: 2158039 - RNA, 15 nt, Homo sapiens
cucuucagagaucau

SEQ ID NO: 2158040 - RNA, 17 nt, Homo sapiens
gaagagaggaguucaau

SEQ ID NO: 2158041 - RNA, 13 nt, Homo sapiens
aacacuguacuga

SEQ ID NO: 2158042 - RNA, 14 nt, Homo sapiens
cuaaacuaucuuuu

SEQ ID NO: 2158043 - RNA, 17 nt, Homo sapiens
guaagcgggacauuuag

SEQ ID NO: 2158044 - RNA, 20 nt, Homo sapiens
ggaucaucuauugcuggcaa

SEQ ID NO: 2158045 - RNA, 20 nt, Homo sapiens
agcaugugugugucucuauc

SEQ ID NO: 2158046 - RNA, 17 nt, Homo sapiens
uguggacgugcacugac

SEQ ID NO: 2158047 - RNA, 16 nt, Homo sapiens
auucagaccagggaac

SEQ ID NO: 2158048 - RNA, 22 nt, Homo sapiens
ugaccaauauuauacuaagaaa

SEQ ID NO: 2158049 - RNA, 17 nt, Homo sapiens
aguugagacuugccagu

SEQ ID NO: 2158050 - RNA, 19 nt, Homo sapiens
ccaucuugcaucauugaaa

SEQ ID NO: 2158051 - RNA, 12 nt, Homo sapiens
acaauuuacuuu

SEQ ID NO: 2158052 - RNA, 13 nt, Homo sapiens
ucgccaacacuug

SEQ ID NO: 2158053 - RNA, 23 nt, Homo sapiens
gauacuaagugguggagccaaga

SEQ ID NO: 2158054 - RNA, 19 nt, Homo sapiens
uauuuuauucccuuucaca

SEQ ID NO: 2158055 - RNA, 23 nt, Homo sapiens
agugcagcugcugugccugaugu

SEQ ID NO: 2158056 - RNA, 21 nt, Homo sapiens
uucucucuuccauaggacaaa

SEQ ID NO: 2158057 - RNA, 18 nt, Homo sapiens
ugaaaggaucucugagac

SEQ ID NO: 2158058 - RNA, 22 nt, Homo sapiens
accauuggacagucucccugau

SEQ ID NO: 2158059 - RNA, 17 nt, Homo sapiens
ggaaauuaagacuuuau

SEQ ID NO: 2158060 - RNA, 20 nt, Homo sapiens
gcuccacuuucucauccgaa

SEQ ID NO: 2158061 - RNA, 14 nt, Homo sapiens
accagaauuucuaa

SEQ ID NO: 2158062 - RNA, 15 nt, Homo sapiens
ucagggcagggauac

SEQ ID NO: 2158063 - RNA, 18 nt, Homo sapiens
cacuguagcuacauuuuc

SEQ ID NO: 2158064 - RNA, 19 nt, Homo sapiens
gccucacgaaacuggaaua

SEQ ID NO: 2158065 - RNA, 15 nt, Homo sapiens
aauggcaugcugaaa

SEQ ID NO: 2158066 - RNA, 21 nt, Homo sapiens
aguuugugaucuguccuucca

SEQ ID NO: 2158067 - RNA, 12 nt, Homo sapiens
ggacaaucugca

SEQ ID NO: 2158068 - RNA, 11 nt, Homo sapiens
gagaaaauccc

SEQ ID NO: 2158069 - RNA, 16 nt, Homo sapiens
gggaagaugcccucaa

SEQ ID NO: 2158070 - RNA, 20 nt, Homo sapiens
ucaugaagcccaaccugcag

SEQ ID NO: 2158071 - RNA, 15 nt, Homo sapiens
guccagguccauuua

SEQ ID NO: 2158072 - RNA, 22 nt, Homo sapiens
ucacagaugaauauaaaacauu

SEQ ID NO: 2158073 - RNA, 15 nt, Homo sapiens
caaacuucaaagagg

SEQ ID NO: 2158074 - RNA, 15 nt, Homo sapiens
ccuacugcacugagu

SEQ ID NO: 2158075 - RNA, 20 nt, Homo sapiens
ugguucgugccaugcccuua

SEQ ID NO: 2158076 - RNA, 21 nt, Homo sapiens
uuguuaauacuguauugcugu

SEQ ID NO: 2158077 - RNA, 15 nt, Homo sapiens
uauuuuauaaauuag

SEQ ID NO: 2158078 - RNA, 19 nt, Homo sapiens
gcuuuaauuuucacucugg

SEQ ID NO: 2158079 - RNA, 15 nt, Homo sapiens
gaaacuguacuacau

SEQ ID NO: 2158080 - RNA, 13 nt, Homo sapiens
aggguacuuccac

SEQ ID NO: 2158081 - RNA, 13 nt, Homo sapiens
aguccgaaugaga

SEQ ID NO: 2158082 - RNA, 15 nt, Homo sapiens
ugaauauuuugcaau

SEQ ID NO: 2158083 - RNA, 15 nt, Homo sapiens
ugaaauauuugcuua

SEQ ID NO: 2158084 - RNA, 20 nt, Homo sapiens
ucuuccccuccccgcuccua

SEQ ID NO: 2158085 - RNA, 17 nt, Homo sapiens
aagugcaugaaauguau

SEQ ID NO: 2158086 - RNA, 14 nt, Homo sapiens
ugcagugggccauc

SEQ ID NO: 2158087 - RNA, 17 nt, Homo sapiens
uacuuaaaaugacaaag

SEQ ID NO: 2158088 - RNA, 19 nt, Homo sapiens
cuugaaaaugaaaugacug

SEQ ID NO: 2158089 - RNA, 14 nt, Homo sapiens
cugugaacauuugu

SEQ ID NO: 2158090 - RNA, 21 nt, Homo sapiens
ugcaggcugccucuucugccc

SEQ ID NO: 2158091 - RNA, 16 nt, Homo sapiens
aaagcaaugcacuccu

SEQ ID NO: 2158092 - RNA, 18 nt, Homo sapiens
ucuguacuuuuuggcaua

SEQ ID NO: 2158093 - RNA, 19 nt, Homo sapiens
ggagcagauuuuugcaaua

SEQ ID NO: 2158094 - RNA, 20 nt, Homo sapiens
ggguggacaucaccuuggag

SEQ ID NO: 2158095 - RNA, 19 nt, Homo sapiens
gaaagucaugcacauaccu

SEQ ID NO: 2158096 - RNA, 14 nt, Homo sapiens
aggagugagcccuu

SEQ ID NO: 2158097 - RNA, 22 nt, Homo sapiens
ccauaauuauuauuuccagugu

SEQ ID NO: 2158098 - RNA, 23 nt, Homo sapiens
gcuucgaggagauaaacugaaau

SEQ ID NO: 2158099 - RNA, 14 nt, Homo sapiens
ugcacgcacugcgu

SEQ ID NO: 2158100 - RNA, 18 nt, Homo sapiens
aucucaggccucccucaa

SEQ ID NO: 2158101 - RNA, 13 nt, Homo sapiens
acuaaugaucacu

SEQ ID NO: 2158102 - RNA, 16 nt, Homo sapiens
cucccaaaacagauua

SEQ ID NO: 2158103 - RNA, 21 nt, Homo sapiens
aauucagaaagaggucuuuca

SEQ ID NO: 2158104 - RNA, 16 nt, Homo sapiens
agugcgccuugcaaaa

SEQ ID NO: 2158105 - RNA, 22 nt, Homo sapiens
ggcaucaagggagacaccagug

SEQ ID NO: 2158106 - RNA, 17 nt, Homo sapiens
gcuucugggcagacucu

SEQ ID NO: 2158107 - RNA, 18 nt, Homo sapiens
cuccugagcgaugacuca

SEQ ID NO: 2158108 - RNA, 20 nt, Homo sapiens
ggcauccugcagugggccau

SEQ ID NO: 2158109 - RNA, 22 nt, Homo sapiens
acuguguuguaccaaaauucau

SEQ ID NO: 2158110 - RNA, 15 nt, Homo sapiens
agagccugacgcuca

SEQ ID NO: 2158111 - RNA, 16 nt, Homo sapiens
gauaucaccucucuuc

SEQ ID NO: 2158112 - RNA, 17 nt, Homo sapiens
ggcagucgcugcaggga

SEQ ID NO: 2158113 - RNA, 21 nt, Homo sapiens
aaauuagauuugugcaaacau

SEQ ID NO: 2158114 - RNA, 23 nt, Homo sapiens
acuuugaaaguuaacucuucaaa

SEQ ID NO: 2158115 - RNA, 14 nt, Homo sapiens
gugagccaaggagg

SEQ ID NO: 2158116 - RNA, 14 nt, Homo sapiens
agcgccgcugugag

SEQ ID NO: 2158117 - RNA, 14 nt, Homo sapiens
acuucaccaaagag

SEQ ID NO: 2158118 - RNA, 22 nt, Homo sapiens
uaaaauuuagaguagguauuaa

SEQ ID NO: 2158119 - RNA, 19 nt, Homo sapiens
uuguaucaacacuguuacu

SEQ ID NO: 2158120 - RNA, 16 nt, Homo sapiens
auuuagcacaguauuu

SEQ ID NO: 2158121 - RNA, 13 nt, Homo sapiens
auggacacuggug

SEQ ID NO: 2158122 - RNA, 15 nt, Homo sapiens
ucaggggucaccucc

SEQ ID NO: 2158123 - RNA, 20 nt, Homo sapiens
aagucauagggggcucaagu

SEQ ID NO: 2158124 - RNA, 15 nt, Homo sapiens
guuuucaggcuauca

SEQ ID NO: 2158125 - RNA, 17 nt, Homo sapiens
aauuagaagaaaaugga

SEQ ID NO: 2158126 - RNA, 20 nt, Homo sapiens
aucaucaaagcucacaccaa

SEQ ID NO: 2158127 - RNA, 19 nt, Homo sapiens
aucaacaaaaggagccaag

SEQ ID NO: 2158128 - RNA, 20 nt, Homo sapiens
ucauucagcaucuacucuaa

SEQ ID NO: 2158129 - RNA, 19 nt, Homo sapiens
gaaaaaggaacuaccuauc

SEQ ID NO: 2158130 - RNA, 17 nt, Homo sapiens
gaacaggauauucucac

SEQ ID NO: 2158131 - RNA, 11 nt, Homo sapiens
ccagcucugac

SEQ ID NO: 2158132 - RNA, 11 nt, Homo sapiens
caagcucugcc

SEQ ID NO: 2158133 - RNA, 13 nt, Homo sapiens
aaaaucaguuuug

SEQ ID NO: 2158134 - RNA, 20 nt, Homo sapiens
cccaggccuuuuccacuuug

SEQ ID NO: 2158135 - RNA, 22 nt, Homo sapiens
cuaucaggcagaagaaucuuuc

SEQ ID NO: 2158136 - RNA, 17 nt, Homo sapiens
uuuggacaggaguuaau

SEQ ID NO: 2158137 - RNA, 12 nt, Homo sapiens
aaaagcagugga

SEQ ID NO: 2158138 - RNA, 19 nt, Homo sapiens
agacccugagacuccagaa

SEQ ID NO: 2158139 - RNA, 22 nt, Homo sapiens
gagcauaucaaaaaguauuaaa

SEQ ID NO: 2158140 - RNA, 12 nt, Homo sapiens
uaagaaauucca

SEQ ID NO: 2158141 - RNA, 20 nt, Homo sapiens
aggaaccucgaagcuguucu

SEQ ID NO: 2158142 - RNA, 18 nt, Homo sapiens
ggcugcaagcgcacuuga

SEQ ID NO: 2158143 - RNA, 20 nt, Homo sapiens
agaggacaauaaauuugaug

SEQ ID NO: 2158144 - RNA, 14 nt, Homo sapiens
acacugcagcugaa

SEQ ID NO: 2158145 - RNA, 11 nt, Homo sapiens
agaucagggca

SEQ ID NO: 2158146 - RNA, 15 nt, Homo sapiens
uacccagagaccaag

SEQ ID NO: 2158147 - RNA, 15 nt, Homo sapiens
uuuuaaaaguuucaa

SEQ ID NO: 2158148 - RNA, 18 nt, Homo sapiens
cuggugggucugagcugg

SEQ ID NO: 2158149 - RNA, 21 nt, Homo sapiens
gccagcgggcacagggcacca

SEQ ID NO: 2158150 - RNA, 21 nt, Homo sapiens
cucuucccuuucuacccagua

SEQ ID NO: 2158151 - RNA, 17 nt, Homo sapiens
ucagauggcagcuuuua

SEQ ID NO: 2158152 - RNA, 15 nt, Homo sapiens
cuuguaccauauaga

SEQ ID NO: 2158153 - RNA, 22 nt, Homo sapiens
aggcagagagucagacccuuca

SEQ ID NO: 2158154 - RNA, 20 nt, Homo sapiens
cugucgguuuauucacugua

SEQ ID NO: 2158155 - RNA, 20 nt, Homo sapiens
uagcugcccaggaugcugcu

SEQ ID NO: 2158156 - RNA, 18 nt, Homo sapiens
ugccuccuucccucgggg

SEQ ID NO: 2158157 - RNA, 14 nt, Homo sapiens
ugauaaauucacau

SEQ ID NO: 2158158 - RNA, 22 nt, Homo sapiens
ucugagcgaggagugacugcca

SEQ ID NO: 2158159 - RNA, 13 nt, Homo sapiens
aaccaaaugcugu

SEQ ID NO: 2158160 - RNA, 15 nt, Homo sapiens
auauuaggucccauc

SEQ ID NO: 2158161 - RNA, 16 nt, Homo sapiens
uuaaaagucaguauca

SEQ ID NO: 2158162 - RNA, 22 nt, Homo sapiens
ccuagaaagcugcugugauccc

SEQ ID NO: 2158163 - RNA, 20 nt, Homo sapiens
auuguacaaauguaagcaaa

SEQ ID NO: 2158164 - RNA, 22 nt, Homo sapiens
ugccaucaauaaaaaauuauga

SEQ ID NO: 2158165 - RNA, 20 nt, Homo sapiens
agccagggcccagagcccuu

SEQ ID NO: 2158166 - RNA, 22 nt, Homo sapiens
guucugcuuuccucuuccugaa

SEQ ID NO: 2158167 - RNA, 20 nt, Homo sapiens
aguucucagaauaacuaccu

SEQ ID NO: 2158168 - RNA, 17 nt, Homo sapiens
cauaauugcauugacuu

SEQ ID NO: 2158169 - RNA, 13 nt, Homo sapiens
ucuaugggccaua

SEQ ID NO: 2158170 - RNA, 18 nt, Homo sapiens
augcaugcgaacauaaau

SEQ ID NO: 2158171 - RNA, 19 nt, Homo sapiens
cuguccguaguaucagaga

SEQ ID NO: 2158172 - RNA, 17 nt, Homo sapiens
uccucucccugcaccug

SEQ ID NO: 2158173 - RNA, 17 nt, Homo sapiens
ucccagauguugcaucc

SEQ ID NO: 2158174 - RNA, 21 nt, Homo sapiens
uccuccagcccagacccagug

SEQ ID NO: 2158175 - RNA, 16 nt, Homo sapiens
aauagaaauaaauucc

SEQ ID NO: 2158176 - RNA, 23 nt, Homo sapiens
augugggguugucaaaacuccac

SEQ ID NO: 2158177 - RNA, 22 nt, Homo sapiens
guauaugacugagcguagcaua

SEQ ID NO: 2158178 - RNA, 15 nt, Homo sapiens
cagagaugaaaaaga

SEQ ID NO: 2158179 - RNA, 15 nt, Homo sapiens
cuccuugagcccuug

SEQ ID NO: 2158180 - RNA, 18 nt, Homo sapiens
cugcugaaagacucgaga

SEQ ID NO: 2158181 - RNA, 15 nt, Homo sapiens
ucacagagccacucu

SEQ ID NO: 2158182 - RNA, 16 nt, Homo sapiens
ggguaggggcugggaa

SEQ ID NO: 2158183 - RNA, 15 nt, Homo sapiens
cugggagcauagcag

SEQ ID NO: 2158184 - RNA, 20 nt, Homo sapiens
uugacuuagaauaaugaagg

SEQ ID NO: 2158185 - RNA, 20 nt, Homo sapiens
gugcccauccugccauccuc

SEQ ID NO: 2158186 - RNA, 14 nt, Homo sapiens
cucuuaguccuccc

SEQ ID NO: 2158187 - RNA, 21 nt, Homo sapiens
guagguagugauuaacuguga

SEQ ID NO: 2158188 - RNA, 19 nt, Homo sapiens
cagaacagugagccaaaua

SEQ ID NO: 2158189 - RNA, 12 nt, Homo sapiens
ugaaaacagaua

SEQ ID NO: 2158190 - RNA, 19 nt, Homo sapiens
agcaauacagugcucgcca

SEQ ID NO: 2158191 - RNA, 14 nt, Homo sapiens
ggccuccaugaccu

SEQ ID NO: 2158192 - RNA, 14 nt, Homo sapiens
uuguugcugucaca

SEQ ID NO: 2158193 - RNA, 19 nt, Homo sapiens
cucaguuugugugucuuaa

SEQ ID NO: 2158194 - RNA, 14 nt, Homo sapiens
gagggaacuaagca

SEQ ID NO: 2158195 - RNA, 17 nt, Homo sapiens
acuuuacuguaauauaa

SEQ ID NO: 2158196 - RNA, 16 nt, Homo sapiens
uucaacuugcauccaa

SEQ ID NO: 2158197 - RNA, 19 nt, Homo sapiens
ucacaaucaucuucuccca

SEQ ID NO: 2158198 - RNA, 14 nt, Homo sapiens
ucauaccucagugg

SEQ ID NO: 2158199 - RNA, 16 nt, Homo sapiens
uuauucuacuacuugg

SEQ ID NO: 2158200 - RNA, 18 nt, Homo sapiens
uauggaagggacucccag

SEQ ID NO: 2158201 - RNA, 15 nt, Homo sapiens
caggcuaugguugcc

SEQ ID NO: 2158202 - RNA, 16 nt, Homo sapiens
cacgcuuuaugcccuu

SEQ ID NO: 2158203 - RNA, 15 nt, Homo sapiens
ugugccgacacuguu

SEQ ID NO: 2158204 - RNA, 18 nt, Homo sapiens
cauagaaaauuaaacaca

SEQ ID NO: 2158205 - RNA, 17 nt, Homo sapiens
agaaggcucacagauuu

SEQ ID NO: 2158206 - RNA, 23 nt, Homo sapiens
ucaaggauuuucauguugaugac

SEQ ID NO: 2158207 - RNA, 19 nt, Homo sapiens
ucccagcaugcugagauua

SEQ ID NO: 2158208 - RNA, 14 nt, Homo sapiens
auuguaaaacccca

SEQ ID NO: 2158209 - RNA, 15 nt, Homo sapiens
ggccauuaccaucuc

SEQ ID NO: 2158210 - RNA, 21 nt, Homo sapiens
gaucauguaaaugcucaaaga

SEQ ID NO: 2158211 - RNA, 21 nt, Homo sapiens
cccaugagggagaugccauga

SEQ ID NO: 2158212 - RNA, 15 nt, Homo sapiens
auauguacuuuucca

SEQ ID NO: 2158213 - RNA, 19 nt, Homo sapiens
ucuagccuauuuaccugca

SEQ ID NO: 2158214 - RNA, 20 nt, Homo sapiens
uaacauaaacuuguacuuac

SEQ ID NO: 2158215 - RNA, 19 nt, Homo sapiens
caggugggugaaaccuccu

SEQ ID NO: 2158216 - RNA, 23 nt, Homo sapiens
ccuuuaucaaaaaaagacucagc

SEQ ID NO: 2158217 - RNA, 18 nt, Homo sapiens
augggaacauacagaacu

SEQ ID NO: 2158218 - RNA, 16 nt, Homo sapiens
caguaaaaauccacua

SEQ ID NO: 2158219 - RNA, 19 nt, Homo sapiens
cuuguggggguccacggga

SEQ ID NO: 2158220 - RNA, 14 nt, Homo sapiens
aauauggaacauau

SEQ ID NO: 2158221 - RNA, 22 nt, Homo sapiens
cagaaagcuucauccacagccu

SEQ ID NO: 2158222 - RNA, 21 nt, Homo sapiens
uugagcaaaccacauaaucuc

SEQ ID NO: 2158223 - RNA, 21 nt, Homo sapiens
ccuuuaucaaaaaaagacuca

SEQ ID NO: 2158224 - RNA, 19 nt, Homo sapiens
gacuuauugauuaaguaua

SEQ ID NO: 2158225 - RNA, 17 nt, Homo sapiens
aaugguuaaauuuuaca

SEQ ID NO: 2158226 - RNA, 17 nt, Homo sapiens
caggcuacuguucuuga

SEQ ID NO: 2158227 - RNA, 14 nt, Homo sapiens
agcagacuacagcu

SEQ ID NO: 2158228 - RNA, 18 nt, Homo sapiens
ccuguguccccaaggagu

SEQ ID NO: 2158229 - RNA, 13 nt, Homo sapiens
auaagaacaaaga

SEQ ID NO: 2158230 - RNA, 14 nt, Homo sapiens
gccaggacuuggcc

SEQ ID NO: 2158231 - RNA, 22 nt, Homo sapiens
auuugauaccauggcacugaca

SEQ ID NO: 2158232 - RNA, 14 nt, Homo sapiens
uguuuccagaauug

SEQ ID NO: 2158233 - RNA, 20 nt, Homo sapiens
ugugaucuaucaauagucaa

SEQ ID NO: 2158234 - RNA, 17 nt, Homo sapiens
cugucuagagcaacuuu

SEQ ID NO: 2158235 - RNA, 21 nt, Homo sapiens
aaauuauaucugugaauugca

SEQ ID NO: 2158236 - RNA, 21 nt, Homo sapiens
cuugacaacaucccacagugg

SEQ ID NO: 2158237 - RNA, 16 nt, Homo sapiens
caaggugagugugacu

SEQ ID NO: 2158238 - RNA, 16 nt, Homo sapiens
ugagcacagcaaggga

SEQ ID NO: 2158239 - RNA, 12 nt, Homo sapiens
caucaugcaugu

SEQ ID NO: 2158240 - RNA, 14 nt, Homo sapiens
ucuggcuuugcucu

SEQ ID NO: 2158241 - RNA, 13 nt, Homo sapiens
uauacuuugccac

SEQ ID NO: 2158242 - RNA, 14 nt, Homo sapiens
auauuuucugugcc

SEQ ID NO: 2158243 - RNA, 20 nt, Homo sapiens
caaauuauauuugugugaaa

SEQ ID NO: 2158244 - RNA, 21 nt, Homo sapiens
ucauuagggcuuuugauuuau

SEQ ID NO: 2158245 - RNA, 15 nt, Homo sapiens
uuugugaauugccag

SEQ ID NO: 2158246 - RNA, 23 nt, Homo sapiens
auacuuccaucuggcugccuuug

SEQ ID NO: 2158247 - RNA, 21 nt, Homo sapiens
ggagccugguccuucccugau

SEQ ID NO: 2158248 - RNA, 18 nt, Homo sapiens
uccgacauacaucauucu

SEQ ID NO: 2158249 - RNA, 18 nt, Homo sapiens
cacgcccuucaaaaccug

SEQ ID NO: 2158250 - RNA, 15 nt, Homo sapiens
aguauacaacugccu

SEQ ID NO: 2158251 - RNA, 16 nt, Homo sapiens
aagcagaugaacuaau

SEQ ID NO: 2158252 - RNA, 22 nt, Homo sapiens
cccucuugaagggggauaugaa

SEQ ID NO: 2158253 - RNA, 17 nt, Homo sapiens
gaaccaucucaauguaa

SEQ ID NO: 2158254 - RNA, 18 nt, Homo sapiens
auggcacuaaaugcacaa

SEQ ID NO: 2158255 - RNA, 12 nt, Homo sapiens
uuaaagacacuu

SEQ ID NO: 2158256 - RNA, 17 nt, Homo sapiens
ucucuguuggucugccu

SEQ ID NO: 2158257 - RNA, 15 nt, Homo sapiens
ccaaaacuaauuucc

SEQ ID NO: 2158258 - RNA, 19 nt, Homo sapiens
gucuucuaacucugucuca

SEQ ID NO: 2158259 - RNA, 15 nt, Homo sapiens
uucacaucucuguag

SEQ ID NO: 2158260 - RNA, 21 nt, Homo sapiens
aauaaagacauuuccuaccug

SEQ ID NO: 2158261 - RNA, 20 nt, Homo sapiens
ucuaacuagaaaucugccaa

SEQ ID NO: 2158262 - RNA, 13 nt, Homo sapiens
uuauauaagcaaa

SEQ ID NO: 2158263 - RNA, 17 nt, Homo sapiens
ccacuuuucauugcaaa

SEQ ID NO: 2158264 - RNA, 22 nt, Homo sapiens
cucugccagccgcuggugccca

SEQ ID NO: 2158265 - RNA, 21 nt, Homo sapiens
agcauguggucuuauaguguu

SEQ ID NO: 2158266 - RNA, 15 nt, Homo sapiens
uauaauaaaugggaa

SEQ ID NO: 2158267 - RNA, 15 nt, Homo sapiens
uugaaagaaauggug

SEQ ID NO: 2158268 - RNA, 15 nt, Homo sapiens
ggagaccacacugca

SEQ ID NO: 2158269 - RNA, 21 nt, Homo sapiens
uggccacccgcccacagccag

SEQ ID NO: 2158270 - RNA, 13 nt, Homo sapiens
acuacauuccaaa

SEQ ID NO: 2158271 - RNA, 20 nt, Homo sapiens
accuggggcacaguccagga

SEQ ID NO: 2158272 - RNA, 22 nt, Homo sapiens
uaucaaacacaauuaaaucucu

SEQ ID NO: 2158273 - RNA, 14 nt, Homo sapiens
uccacuagugcaaa

SEQ ID NO: 2158274 - RNA, 18 nt, Homo sapiens
auauacacauacauauau

SEQ ID NO: 2158275 - RNA, 21 nt, Homo sapiens
gcuggagcggggaucugauga

SEQ ID NO: 2158276 - RNA, 15 nt, Homo sapiens
cuggagugcaauggc

SEQ ID NO: 2158277 - RNA, 13 nt, Homo sapiens
agagugggaccaa

SEQ ID NO: 2158278 - RNA, 15 nt, Homo sapiens
uucucuucccaguga

SEQ ID NO: 2158279 - RNA, 20 nt, Homo sapiens
aggguccaggaauggugcuu

SEQ ID NO: 2158280 - RNA, 19 nt, Homo sapiens
acugaaaccucuguucuca

SEQ ID NO: 2158281 - RNA, 21 nt, Homo sapiens
ugcgaaacgggggaagggagc

SEQ ID NO: 2158282 - RNA, 14 nt, Homo sapiens
gcugagaacacugu

SEQ ID NO: 2158283 - RNA, 18 nt, Homo sapiens
gaccucaggcaaucugcc

SEQ ID NO: 2158284 - RNA, 14 nt, Homo sapiens
cugagcuccagcuc

SEQ ID NO: 2158285 - RNA, 15 nt, Homo sapiens
uacaccccaacagca

SEQ ID NO: 2158286 - RNA, 23 nt, Homo sapiens
aggagugugugacauuccagggg

SEQ ID NO: 2158287 - RNA, 22 nt, Homo sapiens
cccuugcuuagccugugcugga

SEQ ID NO: 2158288 - RNA, 15 nt, Homo sapiens
ugauugucuuagaca

SEQ ID NO: 2158289 - RNA, 23 nt, Homo sapiens
gaagaggcaagcccugccucugg

SEQ ID NO: 2158290 - RNA, 22 nt, Homo sapiens
ucacacagcccauaaagcaaga

SEQ ID NO: 2158291 - RNA, 13 nt, Homo sapiens
uuaagauguguag

SEQ ID NO: 2158292 - RNA, 18 nt, Homo sapiens
gcaacaauaaaguacuuu

SEQ ID NO: 2158293 - RNA, 12 nt, Homo sapiens
agagaaaggagg

SEQ ID NO: 2158294 - RNA, 20 nt, Homo sapiens
aauaaaugaaucuuacuccu

SEQ ID NO: 2158295 - RNA, 19 nt, Homo sapiens
ggaccaauuagcauuccau

SEQ ID NO: 2158296 - RNA, 13 nt, Homo sapiens
ucuuuugcaggag

SEQ ID NO: 2158297 - RNA, 17 nt, Homo sapiens
gaggggcucucagcuca

SEQ ID NO: 2158298 - RNA, 19 nt, Homo sapiens
ccacagccugcaagucagu

SEQ ID NO: 2158299 - RNA, 21 nt, Homo sapiens
uugaucaggcacaguggcuca

SEQ ID NO: 2158300 - RNA, 23 nt, Homo sapiens
guuuacacugucaaacaucugga

SEQ ID NO: 2158301 - RNA, 14 nt, Homo sapiens
uuagcauaauguga

SEQ ID NO: 2158302 - RNA, 18 nt, Homo sapiens
uauuaaaauaagcacugu

SEQ ID NO: 2158303 - RNA, 13 nt, Homo sapiens
cugaauacugcag

SEQ ID NO: 2158304 - RNA, 23 nt, Homo sapiens
uguauaaccccaccuugccaagc

SEQ ID NO: 2158305 - RNA, 17 nt, Homo sapiens
cucacuccacacuggca

SEQ ID NO: 2158306 - RNA, 15 nt, Homo sapiens
cagcacccauccacc

SEQ ID NO: 2158307 - RNA, 18 nt, Homo sapiens
acuguaaauuccaaagau

SEQ ID NO: 2158308 - RNA, 19 nt, Homo sapiens
ccucaugcugcucaauucc

SEQ ID NO: 2158309 - RNA, 22 nt, Homo sapiens
gcaggacggguaccaugcugcc

SEQ ID NO: 2158310 - RNA, 22 nt, Homo sapiens
guuccugcuaauaauuugccau

SEQ ID NO: 2158311 - RNA, 22 nt, Homo sapiens
caggagucugucucugcuaugg

SEQ ID NO: 2158312 - RNA, 16 nt, Homo sapiens
cugccaggcacaggca

SEQ ID NO: 2158313 - RNA, 23 nt, Homo sapiens
gcugugggaaguccucccuggug

SEQ ID NO: 2158314 - RNA, 16 nt, Homo sapiens
gguacacaccaaauga

SEQ ID NO: 2158315 - RNA, 20 nt, Homo sapiens
uccuaacaaguagcacccug

SEQ ID NO: 2158316 - RNA, 20 nt, Homo sapiens
aggcaucugccucuggaaaa

SEQ ID NO: 2158317 - RNA, 20 nt, Homo sapiens
cuuuuuccuggcucaucucu

SEQ ID NO: 2158318 - RNA, 20 nt, Homo sapiens
caaagggagaaagaaauaca

SEQ ID NO: 2158319 - RNA, 23 nt, Homo sapiens
aaguuaggguuuaggcaucauuu

SEQ ID NO: 2158320 - RNA, 15 nt, Homo sapiens
cugacugacacaggc

SEQ ID NO: 2158321 - RNA, 20 nt, Homo sapiens
ugaauaacuuuagcuuuuac

SEQ ID NO: 2158322 - RNA, 23 nt, Homo sapiens
agggauguuccaguggaugaggg

SEQ ID NO: 2158323 - RNA, 16 nt, Homo sapiens
auacuaaaugugcaag

SEQ ID NO: 2158324 - RNA, 18 nt, Homo sapiens
ccuuuucaucuccagugu

SEQ ID NO: 2158325 - RNA, 15 nt, Homo sapiens
agggcuuucucagga

SEQ ID NO: 2158326 - RNA, 22 nt, Homo sapiens
agggucaggguuggaggccugu

SEQ ID NO: 2158327 - RNA, 23 nt, Homo sapiens
uaauauguaaaauuacacuuuga

SEQ ID NO: 2158328 - RNA, 15 nt, Homo sapiens
aguaaccauuuuccu

SEQ ID NO: 2158329 - RNA, 15 nt, Homo sapiens
aaauuaaaaugauuu

SEQ ID NO: 2158330 - RNA, 19 nt, Homo sapiens
uaaaauugaauaguuuauu

SEQ ID NO: 2158331 - RNA, 17 nt, Homo sapiens
guggcauuaaacauuug

SEQ ID NO: 2158332 - RNA, 21 nt, Homo sapiens
ugacagcaggagcagugauag

SEQ ID NO: 2158333 - RNA, 18 nt, Homo sapiens
gaaagacugagcucaagg

SEQ ID NO: 2158334 - RNA, 12 nt, Homo sapiens
aagaaacgucua

SEQ ID NO: 2158335 - RNA, 21 nt, Homo sapiens
agaaaaccaguggaagauuuc

SEQ ID NO: 2158336 - RNA, 13 nt, Homo sapiens
uguaugugcuugc

SEQ ID NO: 2158337 - RNA, 20 nt, Homo sapiens
cugaacaaaauaaaguguug

SEQ ID NO: 2158338 - RNA, 19 nt, Homo sapiens
acgaguuuucccucaguga

SEQ ID NO: 2158339 - RNA, 13 nt, Homo sapiens
ggggcagggcagc

SEQ ID NO: 2158340 - RNA, 19 nt, Homo sapiens
uuauacucacugagucuua

SEQ ID NO: 2158341 - RNA, 20 nt, Homo sapiens
cuucucauccccagucccaa

SEQ ID NO: 2158342 - RNA, 15 nt, Homo sapiens
cuuauguguugugua

SEQ ID NO: 2158343 - RNA, 12 nt, Homo sapiens
caugcauucaca

SEQ ID NO: 2158344 - RNA, 18 nt, Homo sapiens
caguuuuauuuuugccaa

SEQ ID NO: 2158345 - RNA, 20 nt, Homo sapiens
uggaugcugugaagagucua

SEQ ID NO: 2158346 - RNA, 14 nt, Homo sapiens
aaacaagccaaaga

SEQ ID NO: 2158347 - RNA, 14 nt, Homo sapiens
aguuuagcucugag

SEQ ID NO: 2158348 - RNA, 22 nt, Homo sapiens
cugucuuuggauaauaggaauu

SEQ ID NO: 2158349 - RNA, 22 nt, Homo sapiens
uugcgcucucaagaccagagac

SEQ ID NO: 2158350 - RNA, 14 nt, Homo sapiens
auaaaaauuacaua

SEQ ID NO: 2158351 - RNA, 15 nt, Homo sapiens
cuguguccucuccag

SEQ ID NO: 2158352 - RNA, 20 nt, Homo sapiens
ugacauaaaauuuacauuua

SEQ ID NO: 2158353 - RNA, 17 nt, Homo sapiens
uuuucaaaacugcuaaa

SEQ ID NO: 2158354 - RNA, 18 nt, Homo sapiens
uaguugauuacuuuucag

SEQ ID NO: 2158355 - RNA, 20 nt, Homo sapiens
uaaaauguuuguuaaagcua

SEQ ID NO: 2158356 - RNA, 19 nt, Homo sapiens
ucaccaggggugcucaccu

SEQ ID NO: 2158357 - RNA, 19 nt, Homo sapiens
aaugcuuuucccacucuca

SEQ ID NO: 2158358 - RNA, 14 nt, Homo sapiens
cuggaacuggaguu

SEQ ID NO: 2158359 - RNA, 19 nt, Homo sapiens
aaaaacacagacauucugc

SEQ ID NO: 2158360 - RNA, 15 nt, Homo sapiens
cuuuccucaaagaag

SEQ ID NO: 2158361 - RNA, 20 nt, Homo sapiens
uuguaaaacaaaauuugacu

SEQ ID NO: 2158362 - RNA, 11 nt, Homo sapiens
gcacucaugga

SEQ ID NO: 2158363 - RNA, 20 nt, Homo sapiens
gagcuggccucucuagcaca

SEQ ID NO: 2158364 - RNA, 13 nt, Homo sapiens
ugacauaauuuca

SEQ ID NO: 2158365 - RNA, 16 nt, Homo sapiens
gcuugcauuucuuuau

SEQ ID NO: 2158366 - RNA, 13 nt, Homo sapiens
ugguggcugccag

SEQ ID NO: 2158367 - RNA, 14 nt, Homo sapiens
uagaaguuacuuaa

SEQ ID NO: 2158368 - RNA, 14 nt, Homo sapiens
auaaguuuuugcca

SEQ ID NO: 2158369 - RNA, 16 nt, Homo sapiens
cuccuugcaggugaca

SEQ ID NO: 2158370 - RNA, 12 nt, Homo sapiens
uuuaguggcuca

SEQ ID NO: 2158371 - RNA, 15 nt, Homo sapiens
aucccuccaucucaa

SEQ ID NO: 2158372 - RNA, 15 nt, Homo sapiens
agucuuccaguuuaa

SEQ ID NO: 2158373 - RNA, 14 nt, Homo sapiens
uuuaaacauaggaa

SEQ ID NO: 2158374 - RNA, 22 nt, Homo sapiens
gaccugcccuggccccagcccu

SEQ ID NO: 2158375 - RNA, 17 nt, Homo sapiens
agguggcucagugccac

SEQ ID NO: 2158376 - RNA, 15 nt, Homo sapiens
guaaauucaaccacu

SEQ ID NO: 2158377 - RNA, 22 nt, Homo sapiens
ggcagccccuccccauggugca

SEQ ID NO: 2158378 - RNA, 18 nt, Homo sapiens
agaggcccugccacgucc

SEQ ID NO: 2158379 - RNA, 18 nt, Homo sapiens
uuuuaucuccaaguggca

SEQ ID NO: 2158380 - RNA, 18 nt, Homo sapiens
ugucuuuaauuucuguca

SEQ ID NO: 2158381 - RNA, 15 nt, Homo sapiens
aaaggagcuuucuca

SEQ ID NO: 2158382 - RNA, 20 nt, Homo sapiens
gcuuagcuaauauugcaaug

SEQ ID NO: 2158383 - RNA, 12 nt, Homo sapiens
uaagcugggaua

SEQ ID NO: 2158384 - RNA, 11 nt, Homo sapiens
cccaagcacaa

SEQ ID NO: 2158385 - RNA, 18 nt, Homo sapiens
ggacauuuuuucagucau

SEQ ID NO: 2158386 - RNA, 13 nt, Homo sapiens
uauguucaucuuc

SEQ ID NO: 2158387 - RNA, 21 nt, Homo sapiens
aucaccuguuagcauugccau

SEQ ID NO: 2158388 - RNA, 19 nt, Homo sapiens
aagugaggugacacuccag

SEQ ID NO: 2158389 - RNA, 15 nt, Homo sapiens
cucccuuucucucuc

SEQ ID NO: 2158390 - RNA, 21 nt, Homo sapiens
aauugauguuuuacgugcaaa

SEQ ID NO: 2158391 - RNA, 16 nt, Homo sapiens
uggugaccuuucacga

SEQ ID NO: 2158392 - RNA, 13 nt, Homo sapiens
agucaaagcuuug

SEQ ID NO: 2158393 - RNA, 20 nt, Homo sapiens
auacauuguguuuuccuaaa

SEQ ID NO: 2158394 - RNA, 17 nt, Homo sapiens
aaagcagaugagcugug

SEQ ID NO: 2158395 - RNA, 13 nt, Homo sapiens
uuaacacacauaa

SEQ ID NO: 2158396 - RNA, 14 nt, Homo sapiens
gcaacaaccagcau

SEQ ID NO: 2158397 - RNA, 17 nt, Homo sapiens
auauguauuucuauaua

SEQ ID NO: 2158398 - RNA, 21 nt, Homo sapiens
auagagcaaaaucaacaugac

SEQ ID NO: 2158399 - RNA, 17 nt, Homo sapiens
ggugcuuccgcugcuug

SEQ ID NO: 2158400 - RNA, 19 nt, Homo sapiens
ccacgaaagcacacacaaa

SEQ ID NO: 2158401 - RNA, 21 nt, Homo sapiens
cugacagaaggugccacuuua

SEQ ID NO: 2158402 - RNA, 20 nt, Homo sapiens
cucccagcguuaacacaaaa

SEQ ID NO: 2158403 - RNA, 23 nt, Homo sapiens
uaaguucauucaugccaaguauc

SEQ ID NO: 2158404 - RNA, 20 nt, Homo sapiens
ucccacugucccccaagaaa

SEQ ID NO: 2158405 - RNA, 17 nt, Homo sapiens
gcaggacuggauuuuaa

SEQ ID NO: 2158406 - RNA, 23 nt, Homo sapiens
agaacagaaguguucacauggcu

SEQ ID NO: 2158407 - RNA, 17 nt, Homo sapiens
aaagaagggaucccuaa

SEQ ID NO: 2158408 - RNA, 17 nt, Homo sapiens
ugcccaaccugacuuug

SEQ ID NO: 2158409 - RNA, 16 nt, Homo sapiens
uacaggugaagcacca

SEQ ID NO: 2158410 - RNA, 20 nt, Homo sapiens
ugccuuuugguuucaccuuc

SEQ ID NO: 2158411 - RNA, 13 nt, Homo sapiens
uaauuagcugugc

SEQ ID NO: 2158412 - RNA, 21 nt, Homo sapiens
guccuccucucucuacuugaa

SEQ ID NO: 2158413 - RNA, 18 nt, Homo sapiens
cgcaauggccgcuucaga

SEQ ID NO: 2158414 - RNA, 13 nt, Homo sapiens
uggguaaaugccu

SEQ ID NO: 2158415 - RNA, 17 nt, Homo sapiens
auucuuacauuuuacuu

SEQ ID NO: 2158416 - RNA, 21 nt, Homo sapiens
aaagacacccugucugcagca

SEQ ID NO: 2158417 - RNA, 20 nt, Homo sapiens
aguaacuuauuuuguacuag

SEQ ID NO: 2158418 - RNA, 16 nt, Homo sapiens
caccuuugcacaggau

SEQ ID NO: 2158419 - RNA, 21 nt, Homo sapiens
ccuccaaguccacaguggaac

SEQ ID NO: 2158420 - RNA, 18 nt, Homo sapiens
ucccuguguucugggcug

SEQ ID NO: 2158421 - RNA, 15 nt, Homo sapiens
auuacauccagaaag

SEQ ID NO: 2158422 - RNA, 15 nt, Homo sapiens
cagaaagcauuacau

SEQ ID NO: 2158423 - RNA, 16 nt, Homo sapiens
caccacaccaucaggc

SEQ ID NO: 2158424 - RNA, 19 nt, Homo sapiens
gugaaaccucccauuggcc

SEQ ID NO: 2158425 - RNA, 20 nt, Homo sapiens
gcgcgccuccgcuacuucca

SEQ ID NO: 2158426 - RNA, 11 nt, Homo sapiens
cugcacuggga

SEQ ID NO: 2158427 - RNA, 21 nt, Homo sapiens
caugacucggggguggggaaa

SEQ ID NO: 2158428 - RNA, 23 nt, Homo sapiens
aaguuucuuaaggaaaugguggc

SEQ ID NO: 2158429 - RNA, 21 nt, Homo sapiens
gcaaaaaaaugugcaugaccu

SEQ ID NO: 2158430 - RNA, 19 nt, Homo sapiens
aguuaaacauugaaguaau

SEQ ID NO: 2158431 - RNA, 23 nt, Homo sapiens
aaaugauaaguacuacauaccuc

SEQ ID NO: 2158432 - RNA, 12 nt, Homo sapiens
gccucccaaagu

SEQ ID NO: 2158433 - RNA, 16 nt, Homo sapiens
gcucccuagacugcau

SEQ ID NO: 2158434 - RNA, 16 nt, Homo sapiens
aaaaguuagucaaucc

SEQ ID NO: 2158435 - RNA, 20 nt, Homo sapiens
uccaauguuagagacuuuuu

SEQ ID NO: 2158436 - RNA, 22 nt, Homo sapiens
ugagugaaaauuuuuacauuca

SEQ ID NO: 2158437 - RNA, 19 nt, Homo sapiens
uaacuuuuuaaaacacaac

SEQ ID NO: 2158438 - RNA, 14 nt, Homo sapiens
uaauacaaacuaua

SEQ ID NO: 2158439 - RNA, 17 nt, Homo sapiens
uucuggccucccacaga

SEQ ID NO: 2158440 - RNA, 20 nt, Homo sapiens
cagcgcucgauggaccucag

SEQ ID NO: 2158441 - RNA, 19 nt, Homo sapiens
cucugaaacaaaaguauuu

SEQ ID NO: 2158442 - RNA, 22 nt, Homo sapiens
aagaucucaacauggaaaaauc

SEQ ID NO: 2158443 - RNA, 20 nt, Homo sapiens
agaaccaaaaguuuuccuga

SEQ ID NO: 2158444 - RNA, 22 nt, Homo sapiens
acaaauaaucaaaacccaacau

SEQ ID NO: 2158445 - RNA, 20 nt, Homo sapiens
cuugagccacagucacugga

SEQ ID NO: 2158446 - RNA, 16 nt, Homo sapiens
uaaggcuuuaguguau

SEQ ID NO: 2158447 - RNA, 20 nt, Homo sapiens
aguuuugcccuuuuuaagga

SEQ ID NO: 2158448 - RNA, 20 nt, Homo sapiens
cucaaaugaauuugcuaaau

SEQ ID NO: 2158449 - RNA, 15 nt, Homo sapiens
acauggcacauguau

SEQ ID NO: 2158450 - RNA, 22 nt, Homo sapiens
cuucucuggaaaggggggagcu

SEQ ID NO: 2158451 - RNA, 20 nt, Homo sapiens
ugaauauuuuauaaauuaga

SEQ ID NO: 2158452 - RNA, 22 nt, Homo sapiens
gucacuccaggcauauguuucc

SEQ ID NO: 2158453 - RNA, 11 nt, Homo sapiens
gagaguaccau

SEQ ID NO: 2158454 - RNA, 11 nt, Homo sapiens
ggagacucagg

SEQ ID NO: 2158455 - RNA, 15 nt, Homo sapiens
aacgauauguagcag

SEQ ID NO: 2158456 - RNA, 17 nt, Homo sapiens
agcauuccagacuucaa

SEQ ID NO: 2158457 - RNA, 21 nt, Homo sapiens
agugcugagauuauaggcaug

SEQ ID NO: 2158458 - RNA, 14 nt, Homo sapiens
gccuuguuuaaugu

SEQ ID NO: 2158459 - RNA, 17 nt, Homo sapiens
uccacagagacaucucc

SEQ ID NO: 2158460 - RNA, 18 nt, Homo sapiens
auaugcugcucaucccca

SEQ ID NO: 2158461 - RNA, 19 nt, Homo sapiens
aucucugguuuucuugcca

SEQ ID NO: 2158462 - RNA, 17 nt, Homo sapiens
ucuuucaaacuuggggu

SEQ ID NO: 2158463 - RNA, 12 nt, Homo sapiens
gauagacacugg

SEQ ID NO: 2158464 - RNA, 15 nt, Homo sapiens
guaccuguuccuccc

SEQ ID NO: 2158465 - RNA, 13 nt, Homo sapiens
cgggagcacagcu

SEQ ID NO: 2158466 - RNA, 19 nt, Homo sapiens
ccggaagaaaaagagccau

SEQ ID NO: 2158467 - RNA, 13 nt, Homo sapiens
cugugccuaauaa

SEQ ID NO: 2158468 - RNA, 17 nt, Homo sapiens
auguuuauuaagcauca

SEQ ID NO: 2158469 - RNA, 19 nt, Homo sapiens
caccauguuggccaggcug

SEQ ID NO: 2158470 - RNA, 20 nt, Homo sapiens
ccuaugggucuaggacacag

SEQ ID NO: 2158471 - RNA, 22 nt, Homo sapiens
cccaugaccguucucugaggca

SEQ ID NO: 2158472 - RNA, 15 nt, Homo sapiens
ucuccaaaacuaaau

SEQ ID NO: 2158473 - RNA, 21 nt, Homo sapiens
aagaaaaacaccgcuucugcc

SEQ ID NO: 2158474 - RNA, 22 nt, Homo sapiens
gcuguuggcugggggcaugggg

SEQ ID NO: 2158475 - RNA, 23 nt, Homo sapiens
aaauuuccaggggccucccaagg

SEQ ID NO: 2158476 - RNA, 15 nt, Homo sapiens
aauauuagcaaagaa

SEQ ID NO: 2158477 - RNA, 22 nt, Homo sapiens
ggaagaguuuguuaccuaccuu

SEQ ID NO: 2158478 - RNA, 19 nt, Homo sapiens
uaugcacaauuccaugaau

SEQ ID NO: 2158479 - RNA, 15 nt, Homo sapiens
ggauugugccuguau

SEQ ID NO: 2158480 - RNA, 13 nt, Homo sapiens
acuaggauacugc

SEQ ID NO: 2158481 - RNA, 23 nt, Homo sapiens
cccucucuuucuaagagaccuga

SEQ ID NO: 2158482 - RNA, 12 nt, Homo sapiens
aauuuugauuca

SEQ ID NO: 2158483 - RNA, 17 nt, Homo sapiens
augaaauuccauuugua

SEQ ID NO: 2158484 - RNA, 20 nt, Homo sapiens
acgguggucaccaugccaau

SEQ ID NO: 2158485 - RNA, 18 nt, Homo sapiens
gauaugagccuuugcaca

SEQ ID NO: 2158486 - RNA, 14 nt, Homo sapiens
uccuggucugugaa

SEQ ID NO: 2158487 - RNA, 16 nt, Homo sapiens
aguguuguacaauuac

SEQ ID NO: 2158488 - RNA, 16 nt, Homo sapiens
acuugcuucucuagcu

SEQ ID NO: 2158489 - RNA, 19 nt, Homo sapiens
gcaaaugccuccaagccau

SEQ ID NO: 2158490 - RNA, 14 nt, Homo sapiens
ugacuggccaaaaa

SEQ ID NO: 2158491 - RNA, 23 nt, Homo sapiens
ucucuaugccagcucagucccau

SEQ ID NO: 2158492 - RNA, 18 nt, Homo sapiens
uaagaagagacugggaag

SEQ ID NO: 2158493 - RNA, 23 nt, Homo sapiens
gacucacugacuccucacuggcu

SEQ ID NO: 2158494 - RNA, 20 nt, Homo sapiens
gcuauuacuaguacuauuac

SEQ ID NO: 2158495 - RNA, 23 nt, Homo sapiens
guuagucuccccaccucuucccu

SEQ ID NO: 2158496 - RNA, 12 nt, Homo sapiens
uucuagccuuuu

SEQ ID NO: 2158497 - RNA, 18 nt, Homo sapiens
aauccugaacuuucuccc

SEQ ID NO: 2158498 - RNA, 17 nt, Homo sapiens
aaccaaacccagguuca

SEQ ID NO: 2158499 - RNA, 22 nt, Homo sapiens
uacaguuauccugcaagggaca

SEQ ID NO: 2158500 - RNA, 19 nt, Homo sapiens
guagcugagacuacaggug

SEQ ID NO: 2158501 - RNA, 20 nt, Homo sapiens
aaaaauauauauagugcuau

SEQ ID NO: 2158502 - RNA, 18 nt, Homo sapiens
ggaaaccugugaaagcug

SEQ ID NO: 2158503 - RNA, 17 nt, Homo sapiens
gacugcacaggugacaa

SEQ ID NO: 2158504 - RNA, 21 nt, Homo sapiens
ucuguagcuauucuuugacca

SEQ ID NO: 2158505 - RNA, 21 nt, Homo sapiens
auuucuauuuuauuaugaaga

SEQ ID NO: 2158506 - RNA, 22 nt, Homo sapiens
uuuuauauauuaugucauucau

SEQ ID NO: 2158507 - RNA, 16 nt, Homo sapiens
ucggccccagcacaug

SEQ ID NO: 2158508 - RNA, 19 nt, Homo sapiens
auucgcuguccccucagcg

SEQ ID NO: 2158509 - RNA, 14 nt, Homo sapiens
ugucauaacaucca

SEQ ID NO: 2158510 - RNA, 14 nt, Homo sapiens
uuggcuuaaauaau

SEQ ID NO: 2158511 - RNA, 17 nt, Homo sapiens
ucucaaucagugcagug

SEQ ID NO: 2158512 - RNA, 20 nt, Homo sapiens
aaaccaaguaucacacuuua

SEQ ID NO: 2158513 - RNA, 22 nt, Homo sapiens
uccuuguauaaaaaaaauaguu

SEQ ID NO: 2158514 - RNA, 18 nt, Homo sapiens
ugaaacuguguacgacaa

SEQ ID NO: 2158515 - RNA, 18 nt, Homo sapiens
aggcugggcacugcugug

SEQ ID NO: 2158516 - RNA, 22 nt, Homo sapiens
aaccuagccuuagaagucacac

SEQ ID NO: 2158517 - RNA, 15 nt, Homo sapiens
uuuccauaccauugu

SEQ ID NO: 2158518 - RNA, 16 nt, Homo sapiens
ugaauuaaagucuaca

SEQ ID NO: 2158519 - RNA, 20 nt, Homo sapiens
acagaccgccgucuaacuca

SEQ ID NO: 2158520 - RNA, 20 nt, Homo sapiens
uaugucuuggacacuguaca

SEQ ID NO: 2158521 - RNA, 19 nt, Homo sapiens
aucucugucccacuuggca

SEQ ID NO: 2158522 - RNA, 15 nt, Homo sapiens
uuaaaugcucucuca

SEQ ID NO: 2158523 - RNA, 19 nt, Homo sapiens
uaucauaauucagcacuua

SEQ ID NO: 2158524 - RNA, 16 nt, Homo sapiens
aaaaggaacugcagca

SEQ ID NO: 2158525 - RNA, 18 nt, Homo sapiens
ccguccucucggcugcca

SEQ ID NO: 2158526 - RNA, 23 nt, Homo sapiens
uugcgagagauguguguugauac

SEQ ID NO: 2158527 - RNA, 19 nt, Homo sapiens
gaucuaauaaacuuccaaa

SEQ ID NO: 2158528 - RNA, 14 nt, Homo sapiens
aguaucccacaucc

SEQ ID NO: 2158529 - RNA, 15 nt, Homo sapiens
caaaggauaugaacu

SEQ ID NO: 2158530 - RNA, 22 nt, Homo sapiens
caacuacuguguuaugcaaaag

SEQ ID NO: 2158531 - RNA, 16 nt, Homo sapiens
acugacuccuguggag

SEQ ID NO: 2158532 - RNA, 20 nt, Homo sapiens
acaguagaacugucugugaa

SEQ ID NO: 2158533 - RNA, 22 nt, Homo sapiens
gugacugucccuucgacacgga

SEQ ID NO: 2158534 - RNA, 20 nt, Homo sapiens
gugaaaacgcuuaggccaug

SEQ ID NO: 2158535 - RNA, 14 nt, Homo sapiens
ccugucaccaucaa

SEQ ID NO: 2158536 - RNA, 17 nt, Homo sapiens
ugauuuugaccuuguau

SEQ ID NO: 2158537 - RNA, 14 nt, Homo sapiens
uccccagacucugc

SEQ ID NO: 2158538 - RNA, 18 nt, Homo sapiens
cagggcucagccuggugg

SEQ ID NO: 2158539 - RNA, 15 nt, Homo sapiens
agaucuggacagcag

SEQ ID NO: 2158540 - RNA, 21 nt, Homo sapiens
uguucugguagcuccacaaga

SEQ ID NO: 2158541 - RNA, 18 nt, Homo sapiens
aaagccacuuuuccaaau

SEQ ID NO: 2158542 - RNA, 23 nt, Homo sapiens
cugauagaagaaggacugaagaa

SEQ ID NO: 2158543 - RNA, 20 nt, Homo sapiens
cuuuggccaaaaccuuucaa

SEQ ID NO: 2158544 - RNA, 14 nt, Homo sapiens
uccugcugauccag

SEQ ID NO: 2158545 - RNA, 21 nt, Homo sapiens
caccuggaggaacugcuugug

SEQ ID NO: 2158546 - RNA, 16 nt, Homo sapiens
accaaagacaucaguc

SEQ ID NO: 2158547 - RNA, 22 nt, Homo sapiens
cucaccccagccucauugugcc

SEQ ID NO: 2158548 - RNA, 17 nt, Homo sapiens
gauuagaugacucucag

SEQ ID NO: 2158549 - RNA, 13 nt, Homo sapiens
gcaccugcucaac

SEQ ID NO: 2158550 - RNA, 17 nt, Homo sapiens
ccucgggcccuguggug

SEQ ID NO: 2158551 - RNA, 13 nt, Homo sapiens
ccuuuaccuacca

SEQ ID NO: 2158552 - RNA, 20 nt, Homo sapiens
gcucagugcucucuccacua

SEQ ID NO: 2158553 - RNA, 17 nt, Homo sapiens
cauucagggauagcacu

SEQ ID NO: 2158554 - RNA, 14 nt, Homo sapiens
ugagaucagucuuu

SEQ ID NO: 2158555 - RNA, 21 nt, Homo sapiens
guccugccccggcugugccag

SEQ ID NO: 2158556 - RNA, 20 nt, Homo sapiens
uuugccccuuccacuuugag

SEQ ID NO: 2158557 - RNA, 18 nt, Homo sapiens
caucuuacuguaccuguu

SEQ ID NO: 2158558 - RNA, 14 nt, Homo sapiens
uagcccagcacugu

SEQ ID NO: 2158559 - RNA, 17 nt, Homo sapiens
aguaaguuaauaaugua

SEQ ID NO: 2158560 - RNA, 16 nt, Homo sapiens
aguggucacugucagu

SEQ ID NO: 2158561 - RNA, 14 nt, Homo sapiens
aucccugcacauaa

SEQ ID NO: 2158562 - RNA, 12 nt, Homo sapiens
cuccucccuggg

SEQ ID NO: 2158563 - RNA, 17 nt, Homo sapiens
ucuccuaacucaaggac

SEQ ID NO: 2158564 - RNA, 16 nt, Homo sapiens
aguuuguauauauuau

SEQ ID NO: 2158565 - RNA, 21 nt, Homo sapiens
cugagaucuccaugacugugu

SEQ ID NO: 2158566 - RNA, 21 nt, Homo sapiens
uucuaucccacccaacagcuc

SEQ ID NO: 2158567 - RNA, 22 nt, Homo sapiens
uaggagcuuccagcucuaauaa

SEQ ID NO: 2158568 - RNA, 15 nt, Homo sapiens
cagaaggagagugag

SEQ ID NO: 2158569 - RNA, 19 nt, Homo sapiens
cacccuuggacaagacaaa

SEQ ID NO: 2158570 - RNA, 21 nt, Homo sapiens
ucagaacccaggacagccaca

SEQ ID NO: 2158571 - RNA, 13 nt, Homo sapiens
gcucagaugcugg

SEQ ID NO: 2158572 - RNA, 19 nt, Homo sapiens
cuccuugguuuugccucuu

SEQ ID NO: 2158573 - RNA, 22 nt, Homo sapiens
ugacaccaccacugugucccag

SEQ ID NO: 2158574 - RNA, 19 nt, Homo sapiens
cuggcccccggguguaaau

SEQ ID NO: 2158575 - RNA, 12 nt, Homo sapiens
cuggacuuuccu

SEQ ID NO: 2158576 - RNA, 21 nt, Homo sapiens
cagagugacccucagcuguca

SEQ ID NO: 2158577 - RNA, 20 nt, Homo sapiens
gucauugaauuuaaggccca

SEQ ID NO: 2158578 - RNA, 18 nt, Homo sapiens
acaagcgccgcugugagg

SEQ ID NO: 2158579 - RNA, 11 nt, Homo sapiens
aagagucucau

SEQ ID NO: 2158580 - RNA, 17 nt, Homo sapiens
uugcccugccacuuugc

SEQ ID NO: 2158581 - RNA, 19 nt, Homo sapiens
cagagucguuggagacuga

SEQ ID NO: 2158582 - RNA, 19 nt, Homo sapiens
uuuaaggguacaguuugau

SEQ ID NO: 2158583 - RNA, 13 nt, Homo sapiens
caucaagugcagu

SEQ ID NO: 2158584 - RNA, 20 nt, Homo sapiens
uccugaguuacuucccuuag

SEQ ID NO: 2158585 - RNA, 14 nt, Homo sapiens
uguuuauuuggacu

SEQ ID NO: 2158586 - RNA, 15 nt, Homo sapiens
aagcuccuccaguga

SEQ ID NO: 2158587 - RNA, 15 nt, Homo sapiens
uuaauaugguuguac

SEQ ID NO: 2158588 - RNA, 17 nt, Homo sapiens
gccuauugcuagagcuc

SEQ ID NO: 2158589 - RNA, 20 nt, Homo sapiens
ggacugguccaggcaugggu

SEQ ID NO: 2158590 - RNA, 13 nt, Homo sapiens
ugguccauuccau

SEQ ID NO: 2158591 - RNA, 19 nt, Homo sapiens
ugccacuugauggggccug

SEQ ID NO: 2158592 - RNA, 20 nt, Homo sapiens
cuggggccuacagcuuugau

SEQ ID NO: 2158593 - RNA, 17 nt, Homo sapiens
gaaagagaagcuuucag

SEQ ID NO: 2158594 - RNA, 21 nt, Homo sapiens
ucugacuaggugucaccauac

SEQ ID NO: 2158595 - RNA, 18 nt, Homo sapiens
uaauuggaagaaauuccu

SEQ ID NO: 2158596 - RNA, 15 nt, Homo sapiens
uauuuccacuugccc

SEQ ID NO: 2158597 - RNA, 14 nt, Homo sapiens
ugagauguguauca

SEQ ID NO: 2158598 - RNA, 15 nt, Homo sapiens
uugcuucaaugauua

SEQ ID NO: 2158599 - RNA, 12 nt, Homo sapiens
uagcccaaccua

SEQ ID NO: 2158600 - RNA, 15 nt, Homo sapiens
gaaaaagcccucuuc

SEQ ID NO: 2158601 - RNA, 14 nt, Homo sapiens
cccccaaguguccu

SEQ ID NO: 2158602 - RNA, 16 nt, Homo sapiens
uuuccauguugcugcc

SEQ ID NO: 2158603 - RNA, 21 nt, Homo sapiens
cagcacggacaauaaaccucc

SEQ ID NO: 2158604 - RNA, 23 nt, Homo sapiens
cucuguuucucuuuccuuggcuc

SEQ ID NO: 2158605 - RNA, 16 nt, Homo sapiens
cuuucuccugugccca

SEQ ID NO: 2158606 - RNA, 23 nt, Homo sapiens
ugaaagaaaaauaccaugucucu

SEQ ID NO: 2158607 - RNA, 13 nt, Homo sapiens
uugagccaagacc

SEQ ID NO: 2158608 - RNA, 19 nt, Homo sapiens
uaauaucaaaugcaguaua

SEQ ID NO: 2158609 - RNA, 18 nt, Homo sapiens
cugcaccugcagggagca

SEQ ID NO: 2158610 - RNA, 21 nt, Homo sapiens
uggugucccgguaccuuccau

SEQ ID NO: 2158611 - RNA, 21 nt, Homo sapiens
uccugcauuuuuuuaccuuaa

SEQ ID NO: 2158612 - RNA, 18 nt, Homo sapiens
aaaucagcacauuccucc

SEQ ID NO: 2158613 - RNA, 22 nt, Homo sapiens
ccuugcgauucugcagccacaa

SEQ ID NO: 2158614 - RNA, 13 nt, Homo sapiens
cagaguuugacac

SEQ ID NO: 2158615 - RNA, 13 nt, Homo sapiens
accucguggugug

SEQ ID NO: 2158616 - RNA, 23 nt, Homo sapiens
uagauauuagcccagaaauguua

SEQ ID NO: 2158617 - RNA, 18 nt, Homo sapiens
gcauuuucauauugcuac

SEQ ID NO: 2158618 - RNA, 13 nt, Homo sapiens
uccccagugauuu

SEQ ID NO: 2158619 - RNA, 23 nt, Homo sapiens
aacaaauucauauucugucugga

SEQ ID NO: 2158620 - RNA, 16 nt, Homo sapiens
uguacaugauugccaa

SEQ ID NO: 2158621 - RNA, 16 nt, Homo sapiens
uugggcagacccugag

SEQ ID NO: 2158622 - RNA, 15 nt, Homo sapiens
agcugucauaaaaag

SEQ ID NO: 2158623 - RNA, 17 nt, Homo sapiens
ucuuuccauuaugauuc

SEQ ID NO: 2158624 - RNA, 22 nt, Homo sapiens
ccgcuguuuuggggucuuaggg

SEQ ID NO: 2158625 - RNA, 16 nt, Homo sapiens
ucacaccugggggaca

SEQ ID NO: 2158626 - RNA, 17 nt, Homo sapiens
uacagugacagauuuua

SEQ ID NO: 2158627 - RNA, 20 nt, Homo sapiens
ucgaaagcuguuaaauucuc

SEQ ID NO: 2158628 - RNA, 15 nt, Homo sapiens
cagcggcaaucuuuu

SEQ ID NO: 2158629 - RNA, 19 nt, Homo sapiens
agcaaugggacuggaguca

SEQ ID NO: 2158630 - RNA, 22 nt, Homo sapiens
auaguaaaguuguuguaaaaau

SEQ ID NO: 2158631 - RNA, 21 nt, Homo sapiens
gcucagcccugcaccaugcug

SEQ ID NO: 2158632 - RNA, 15 nt, Homo sapiens
gauucuccugccuca

SEQ ID NO: 2158633 - RNA, 14 nt, Homo sapiens
aggucaaugccaga

SEQ ID NO: 2158634 - RNA, 16 nt, Homo sapiens
cagaaugucaagccaa

SEQ ID NO: 2158635 - RNA, 14 nt, Homo sapiens
aagacucagaugau

SEQ ID NO: 2158636 - RNA, 16 nt, Homo sapiens
gcuggcagaaagcaaa

SEQ ID NO: 2158637 - RNA, 23 nt, Homo sapiens
agguagcugcagauaaguggccu

SEQ ID NO: 2158638 - RNA, 16 nt, Homo sapiens
ucuccuuccccaggau

SEQ ID NO: 2158639 - RNA, 20 nt, Homo sapiens
cagggaugauucccacccaa

SEQ ID NO: 2158640 - RNA, 22 nt, Homo sapiens
uccugcauagcuuuucccuguc

SEQ ID NO: 2158641 - RNA, 23 nt, Homo sapiens
gccuggggucugacaauaccucg

SEQ ID NO: 2158642 - RNA, 21 nt, Homo sapiens
aagcugaggauccucacagga

SEQ ID NO: 2158643 - RNA, 17 nt, Homo sapiens
ggacauuuaaaauucaa

SEQ ID NO: 2158644 - RNA, 15 nt, Homo sapiens
ucagaauucaucuga

SEQ ID NO: 2158645 - RNA, 23 nt, Homo sapiens
ccugguguaguuucuucauuuca

SEQ ID NO: 2158646 - RNA, 16 nt, Homo sapiens
caagcugguuguccac

SEQ ID NO: 2158647 - RNA, 14 nt, Homo sapiens
accauacagacagc

SEQ ID NO: 2158648 - RNA, 22 nt, Homo sapiens
aggugauucugaucccugauca

SEQ ID NO: 2158649 - RNA, 22 nt, Homo sapiens
uuccccuuccuguguccaugug

SEQ ID NO: 2158650 - RNA, 17 nt, Homo sapiens
cuaugauaauuauuuac

SEQ ID NO: 2158651 - RNA, 19 nt, Homo sapiens
agcuaugaguugaaauguu

SEQ ID NO: 2158652 - RNA, 21 nt, Homo sapiens
ugagacuugaaaccagaagaa

SEQ ID NO: 2158653 - RNA, 22 nt, Homo sapiens
uuucaucucuuucuacucuccu

SEQ ID NO: 2158654 - RNA, 16 nt, Homo sapiens
ucugaacucaaaccag

SEQ ID NO: 2158655 - RNA, 19 nt, Homo sapiens
gugucuggcaggcuacucu

SEQ ID NO: 2158656 - RNA, 17 nt, Homo sapiens
acagccacuuggccuca

SEQ ID NO: 2158657 - RNA, 15 nt, Homo sapiens
cuuaaugacauuccc

SEQ ID NO: 2158658 - RNA, 20 nt, Homo sapiens
ccugcagcccaaaacccagg

SEQ ID NO: 2158659 - RNA, 19 nt, Homo sapiens
uacugguguuaacagucac

SEQ ID NO: 2158660 - RNA, 15 nt, Homo sapiens
auaaaaauaccucuu

SEQ ID NO: 2158661 - RNA, 16 nt, Homo sapiens
ugucuuuggugcuuuu

SEQ ID NO: 2158662 - RNA, 17 nt, Homo sapiens
aagagggagaagggaug

SEQ ID NO: 2158663 - RNA, 11 nt, Homo sapiens
gcucaagaaca

SEQ ID NO: 2158664 - RNA, 21 nt, Homo sapiens
ggguuccccaaccaaagacgg

SEQ ID NO: 2158665 - RNA, 22 nt, Homo sapiens
cuugugguggcugcuccaugag

SEQ ID NO: 2158666 - RNA, 19 nt, Homo sapiens
aaauuuccuuucauaccuu

SEQ ID NO: 2158667 - RNA, 17 nt, Homo sapiens
ggcacauugcccauggc

SEQ ID NO: 2158668 - RNA, 23 nt, Homo sapiens
agcucuucuccauccuaccacaa

SEQ ID NO: 2158669 - RNA, 21 nt, Homo sapiens
gauaaauugcugcgugacaua

SEQ ID NO: 2158670 - RNA, 19 nt, Homo sapiens
auaaugccccaaggacaag

SEQ ID NO: 2158671 - RNA, 15 nt, Homo sapiens
ugcagugaauucaua

SEQ ID NO: 2158672 - RNA, 13 nt, Homo sapiens
ugaacuccucuca

SEQ ID NO: 2158673 - RNA, 14 nt, Homo sapiens
guacccaccgggcc

SEQ ID NO: 2158674 - RNA, 20 nt, Homo sapiens
ggaaucauuuuagcuggugu

SEQ ID NO: 2158675 - RNA, 18 nt, Homo sapiens
aaugcacauagcuaucaa

SEQ ID NO: 2158676 - RNA, 20 nt, Homo sapiens
uauguuacuguauuuuucag

SEQ ID NO: 2158677 - RNA, 17 nt, Homo sapiens
augcuagaggcuuuuau

SEQ ID NO: 2158678 - RNA, 16 nt, Homo sapiens
uuaaguguguguauac

SEQ ID NO: 2158679 - RNA, 22 nt, Homo sapiens
ugagccccugggacugcugcuu

SEQ ID NO: 2158680 - RNA, 21 nt, Homo sapiens
gauccagccuuuccaagucac

SEQ ID NO: 2158681 - RNA, 14 nt, Homo sapiens
uauuuauaacauug

SEQ ID NO: 2158682 - RNA, 15 nt, Homo sapiens
caggaacuugcacaa

SEQ ID NO: 2158683 - RNA, 14 nt, Homo sapiens
acccugggugccau

SEQ ID NO: 2158684 - RNA, 21 nt, Homo sapiens
cuuucccccaccccagaguug

SEQ ID NO: 2158685 - RNA, 16 nt, Homo sapiens
uugcugccacaaacaa

SEQ ID NO: 2158686 - RNA, 13 nt, Homo sapiens
agaaggcuuuauu

SEQ ID NO: 2158687 - RNA, 13 nt, Homo sapiens
agcuggcuuucau

SEQ ID NO: 2158688 - RNA, 20 nt, Homo sapiens
aagaaguggcugccaaagag

SEQ ID NO: 2158689 - RNA, 18 nt, Homo sapiens
uccagaaugaucauuaaa

SEQ ID NO: 2158690 - RNA, 14 nt, Homo sapiens
uuauuuuggaucua

SEQ ID NO: 2158691 - RNA, 11 nt, Homo sapiens
cccacuugaag

SEQ ID NO: 2158692 - RNA, 12 nt, Homo sapiens
gauggccuggau

SEQ ID NO: 2158693 - RNA, 21 nt, Homo sapiens
cagauguuucacugacaguuu

SEQ ID NO: 2158694 - RNA, 22 nt, Homo sapiens
uggcauucgcagugcccaguga

SEQ ID NO: 2158695 - RNA, 16 nt, Homo sapiens
agguggaggugccagg

SEQ ID NO: 2158696 - RNA, 13 nt, Homo sapiens
cuuuugccauuga

SEQ ID NO: 2158697 - RNA, 15 nt, Homo sapiens
gccaagcuuccugug

SEQ ID NO: 2158698 - RNA, 21 nt, Homo sapiens
ucagcccagcaccugcuccca

SEQ ID NO: 2158699 - RNA, 14 nt, Homo sapiens
aauacacacaagua

SEQ ID NO: 2158700 - RNA, 14 nt, Homo sapiens
gaugaaucacuguu

SEQ ID NO: 2158701 - RNA, 13 nt, Homo sapiens
ggucaguugccaa

SEQ ID NO: 2158702 - RNA, 21 nt, Homo sapiens
uguuguacuuaaaugguaaua

SEQ ID NO: 2158703 - RNA, 17 nt, Homo sapiens
ccagaucugucuccaag

SEQ ID NO: 2158704 - RNA, 16 nt, Homo sapiens
agagagucgcaucuca

SEQ ID NO: 2158705 - RNA, 19 nt, Homo sapiens
agugcagcauauacaauaa

SEQ ID NO: 2158706 - RNA, 15 nt, Homo sapiens
aggguuccaaagggc

SEQ ID NO: 2158707 - RNA, 22 nt, Homo sapiens
auccaugccugggaaaugccac

SEQ ID NO: 2158708 - RNA, 16 nt, Homo sapiens
gagauuugccaaaaac

SEQ ID NO: 2158709 - RNA, 19 nt, Homo sapiens
gcgggaucccagcaucuca

SEQ ID NO: 2158710 - RNA, 22 nt, Homo sapiens
aagagcgguaaaaucuagaagc

SEQ ID NO: 2158711 - RNA, 15 nt, Homo sapiens
caccuggauucccug

SEQ ID NO: 2158712 - RNA, 22 nt, Homo sapiens
aucuuuguugaaagcagaagaa

SEQ ID NO: 2158713 - RNA, 16 nt, Homo sapiens
guucugggugcagcug

SEQ ID NO: 2158714 - RNA, 22 nt, Homo sapiens
cuuguucugucaccaauguacc

SEQ ID NO: 2158715 - RNA, 18 nt, Homo sapiens
cagagaguaagcacuuaa

SEQ ID NO: 2158716 - RNA, 16 nt, Homo sapiens
gcuccaaaccuucaca

SEQ ID NO: 2158717 - RNA, 19 nt, Homo sapiens
cugcuuuaggaauucugca

SEQ ID NO: 2158718 - RNA, 21 nt, Homo sapiens
ucauuuauuauuucaauguga

SEQ ID NO: 2158719 - RNA, 21 nt, Homo sapiens
caguuggggcuguucauggca

SEQ ID NO: 2158720 - RNA, 21 nt, Homo sapiens
ccuaacauucgaucucauuca

SEQ ID NO: 2158721 - RNA, 19 nt, Homo sapiens
auuaaauucugagccugau

SEQ ID NO: 2158722 - RNA, 20 nt, Homo sapiens
acuugagaaaauaucuugcu

SEQ ID NO: 2158723 - RNA, 22 nt, Homo sapiens
ccaaauccauccugcucuucca

SEQ ID NO: 2158724 - RNA, 23 nt, Homo sapiens
cagugagcuggggccgucugugu

SEQ ID NO: 2158725 - RNA, 11 nt, Homo sapiens
acaaugaauug

SEQ ID NO: 2158726 - RNA, 21 nt, Homo sapiens
ccagcagguagugggugaaug

SEQ ID NO: 2158727 - RNA, 12 nt, Homo sapiens
ccuucuccaaau

SEQ ID NO: 2158728 - RNA, 11 nt, Homo sapiens
gccagugcacc

SEQ ID NO: 2158729 - RNA, 11 nt, Homo sapiens
ggaagugcaga

SEQ ID NO: 2158730 - RNA, 21 nt, Homo sapiens
auuaucucaaggaauguacaa

SEQ ID NO: 2158731 - RNA, 20 nt, Homo sapiens
uaaaagccuuauucuaaggu

SEQ ID NO: 2158732 - RNA, 13 nt, Homo sapiens
aaggcuuggcaca

SEQ ID NO: 2158733 - RNA, 20 nt, Homo sapiens
cuuaacuauccuuccagggc

SEQ ID NO: 2158734 - RNA, 15 nt, Homo sapiens
aauugacuaaaaagu

SEQ ID NO: 2158735 - RNA, 14 nt, Homo sapiens
gaguucaguuuacu

SEQ ID NO: 2158736 - RNA, 18 nt, Homo sapiens
gcuauggggacauuccaa

SEQ ID NO: 2158737 - RNA, 18 nt, Homo sapiens
aaaacacaaaguguauaa

SEQ ID NO: 2158738 - RNA, 17 nt, Homo sapiens
cuaccauuauggcuuug

SEQ ID NO: 2158739 - RNA, 21 nt, Homo sapiens
uuguuuauauggauaaucuga

SEQ ID NO: 2158740 - RNA, 15 nt, Homo sapiens
cacacacggaugcac

SEQ ID NO: 2158741 - RNA, 14 nt, Homo sapiens
ugccaaucauugca

SEQ ID NO: 2158742 - RNA, 19 nt, Homo sapiens
ucaauauuucuaguagcac

SEQ ID NO: 2158743 - RNA, 18 nt, Homo sapiens
gaucucggcucacugcaa

SEQ ID NO: 2158744 - RNA, 21 nt, Homo sapiens
uuggaacuuuuauuacugggg

SEQ ID NO: 2158745 - RNA, 14 nt, Homo sapiens
gcugcugaccagca

SEQ ID NO: 2158746 - RNA, 15 nt, Homo sapiens
uuaugcccucagaug

SEQ ID NO: 2158747 - RNA, 15 nt, Homo sapiens
caaaaucacuuagca

SEQ ID NO: 2158748 - RNA, 13 nt, Homo sapiens
ucaaauauuucaa

SEQ ID NO: 2158749 - RNA, 13 nt, Homo sapiens
aaaaucugcacag

SEQ ID NO: 2158750 - RNA, 20 nt, Homo sapiens
auguuaggccuaagaggcuu

SEQ ID NO: 2158751 - RNA, 20 nt, Homo sapiens
cagaaaauaaucugguguuc

SEQ ID NO: 2158752 - RNA, 22 nt, Homo sapiens
ugagaccagccugggcagcaua

SEQ ID NO: 2158753 - RNA, 17 nt, Homo sapiens
acuguaauaauaccuca

SEQ ID NO: 2158754 - RNA, 14 nt, Homo sapiens
gaucaagcugugag

SEQ ID NO: 2158755 - RNA, 19 nt, Homo sapiens
acuucuggagaaagcucau

SEQ ID NO: 2158756 - RNA, 22 nt, Homo sapiens
ggaggagcuggccuguggcaca

SEQ ID NO: 2158757 - RNA, 16 nt, Homo sapiens
acauuuuaugucuuuc

SEQ ID NO: 2158758 - RNA, 14 nt, Homo sapiens
ugaggaauguauau

SEQ ID NO: 2158759 - RNA, 23 nt, Homo sapiens
cugaguccuuuccaggggccaau

SEQ ID NO: 2158760 - RNA, 14 nt, Homo sapiens
acacaggcacgggu

SEQ ID NO: 2158761 - RNA, 24 nt, Homo sapiens
cugaauauuuuuuauuucuaagua

SEQ ID NO: 2158762 - RNA, 17 nt, Homo sapiens
aaacuuuaucacuuaaa

SEQ ID NO: 2158763 - RNA, 14 nt, Homo sapiens
uccuuauuguucag

SEQ ID NO: 2158764 - RNA, 20 nt, Homo sapiens
aauuuuguucucugggagaa

SEQ ID NO: 2158765 - RNA, 12 nt, Homo sapiens
guuacagauuaa

SEQ ID NO: 2158766 - RNA, 21 nt, Homo sapiens
aaugcauacuguugauacaaa

SEQ ID NO: 2158767 - RNA, 15 nt, Homo sapiens
aaaucaucuuuguga

SEQ ID NO: 2158768 - RNA, 15 nt, Homo sapiens
aaaucuggcuuagua

SEQ ID NO: 2158769 - RNA, 21 nt, Homo sapiens
uggcuaugcaguacauuguau

SEQ ID NO: 2158770 - RNA, 16 nt, Homo sapiens
auucugucucccccaa

SEQ ID NO: 2158771 - RNA, 16 nt, Homo sapiens
uaaaucaaguccuuua

SEQ ID NO: 2158772 - RNA, 18 nt, Homo sapiens
uuuuaaauuuuccauuaa

SEQ ID NO: 2158773 - RNA, 18 nt, Homo sapiens
acaggcgcuguggcucac

SEQ ID NO: 2158774 - RNA, 18 nt, Homo sapiens
ugaacauguuuacagguu

SEQ ID NO: 2158775 - RNA, 13 nt, Homo sapiens
acuuauucauucc

SEQ ID NO: 2158776 - RNA, 13 nt, Homo sapiens
auuucuucacuca

SEQ ID NO: 2158777 - RNA, 13 nt, Homo sapiens
cuguggugcaaaa

SEQ ID NO: 2158778 - RNA, 14 nt, Homo sapiens
acaaauucaaauaa

SEQ ID NO: 2158779 - RNA, 15 nt, Homo sapiens
auuuaacucuuugaa

SEQ ID NO: 2158780 - RNA, 19 nt, Homo sapiens
acaccugggccgggcugua

SEQ ID NO: 2158781 - RNA, 17 nt, Homo sapiens
ggagccuucugccacca

SEQ ID NO: 2158782 - RNA, 20 nt, Homo sapiens
uucaagauccucuugccaca

SEQ ID NO: 2158783 - RNA, 18 nt, Homo sapiens
ucccaguguggcugaggc

SEQ ID NO: 2158784 - RNA, 15 nt, Homo sapiens
aucugccuaugucau

SEQ ID NO: 2158785 - RNA, 15 nt, Homo sapiens
agagucacaccuuag

SEQ ID NO: 2158786 - RNA, 16 nt, Homo sapiens
cugguugugugcacaa

SEQ ID NO: 2158787 - RNA, 17 nt, Homo sapiens
gcugcugggauugggaa

SEQ ID NO: 2158788 - RNA, 19 nt, Homo sapiens
ugugcuaauaacagugcau

SEQ ID NO: 2158789 - RNA, 13 nt, Homo sapiens
gggacacagcagu

SEQ ID NO: 2158790 - RNA, 15 nt, Homo sapiens
agcggaaacaggugu

SEQ ID NO: 2158791 - RNA, 13 nt, Homo sapiens
ggcauuugcaaua

SEQ ID NO: 2158792 - RNA, 15 nt, Homo sapiens
cuuccacaaacacca

SEQ ID NO: 2158793 - RNA, 17 nt, Homo sapiens
auuucccccuucaucca

SEQ ID NO: 2158794 - RNA, 16 nt, Homo sapiens
aaaauagaauauagca

SEQ ID NO: 2158795 - RNA, 13 nt, Homo sapiens
aucgaauagggaa

SEQ ID NO: 2158796 - RNA, 11 nt, Homo sapiens
gaccucaggua

SEQ ID NO: 2158797 - RNA, 17 nt, Homo sapiens
uuggcaugguuguugca

SEQ ID NO: 2158798 - RNA, 11 nt, Homo sapiens
cuaagcuuuau

SEQ ID NO: 2158799 - RNA, 20 nt, Homo sapiens
agaaaugaggaggaugcuaa

SEQ ID NO: 2158800 - RNA, 20 nt, Homo sapiens
auucugacauaaaauuccac

SEQ ID NO: 2158801 - RNA, 23 nt, Homo sapiens
ucaccaaggcagugcaugcaugu

SEQ ID NO: 2158802 - RNA, 14 nt, Homo sapiens
uuacauccuugugg

SEQ ID NO: 2158803 - RNA, 19 nt, Homo sapiens
ugaguguguccaagugugu

SEQ ID NO: 2158804 - RNA, 18 nt, Homo sapiens
cugcagagggcacagaaa

SEQ ID NO: 2158805 - RNA, 16 nt, Homo sapiens
ucugagacacuaggau

SEQ ID NO: 2158806 - RNA, 10 nt, Homo sapiens
ugcugccuaa

SEQ ID NO: 2158807 - RNA, 11 nt, Homo sapiens
cccccaacagc

SEQ ID NO: 2158808 - RNA, 16 nt, Homo sapiens
aucucuuuagauccaa

SEQ ID NO: 2158809 - RNA, 14 nt, Homo sapiens
cccuccaguccucu

SEQ ID NO: 2158810 - RNA, 19 nt, Homo sapiens
uaacauuggcuacaaagac

SEQ ID NO: 2158811 - RNA, 22 nt, Homo sapiens
gagaaggaacugauacaucuga

SEQ ID NO: 2158812 - RNA, 12 nt, Homo sapiens
gacucugugcug

SEQ ID NO: 2158813 - RNA, 16 nt, Homo sapiens
accuaccaugcugcuu

SEQ ID NO: 2158814 - RNA, 13 nt, Homo sapiens
ucaccaaacuuca

SEQ ID NO: 2158815 - RNA, 22 nt, Homo sapiens
gaguaguuguuggucuguagca

SEQ ID NO: 2158816 - RNA, 17 nt, Homo sapiens
cagaaaaccucuccuga

SEQ ID NO: 2158817 - RNA, 17 nt, Homo sapiens
caaauauuauucuuaau

SEQ ID NO: 2158818 - RNA, 14 nt, Homo sapiens
ucuuuuguucuaaa

SEQ ID NO: 2158819 - RNA, 14 nt, Homo sapiens
ucucuaauauggca

SEQ ID NO: 2158820 - RNA, 19 nt, Homo sapiens
cauuguuuucuuuuacaga

SEQ ID NO: 2158821 - RNA, 18 nt, Homo sapiens
agaaguuuuuuacuuugg

SEQ ID NO: 2158822 - RNA, 14 nt, Homo sapiens
ugaguagacauugu

SEQ ID NO: 2158823 - RNA, 17 nt, Homo sapiens
cuccagagauuugcuca

SEQ ID NO: 2158824 - RNA, 15 nt, Homo sapiens
agaucuuaugucaag

SEQ ID NO: 2158825 - RNA, 22 nt, Homo sapiens
uauguucuaacagcaucugccu

SEQ ID NO: 2158826 - RNA, 22 nt, Homo sapiens
cuuucuaagagaccugaacugg

SEQ ID NO: 2158827 - RNA, 17 nt, Homo sapiens
cugaauauaaagcuuaa

SEQ ID NO: 2158828 - RNA, 18 nt, Homo sapiens
cuuucauuauagcagaga

SEQ ID NO: 2158829 - RNA, 15 nt, Homo sapiens
cuccugggaaggcca

SEQ ID NO: 2158830 - RNA, 17 nt, Homo sapiens
gauuuccuccuggccuu

SEQ ID NO: 2158831 - RNA, 17 nt, Homo sapiens
gacaccaagaaaccacu

SEQ ID NO: 2158832 - RNA, 15 nt, Homo sapiens
gauacaaucugggau

SEQ ID NO: 2158833 - RNA, 16 nt, Homo sapiens
ucuuguuuucagaaaa

SEQ ID NO: 2158834 - RNA, 16 nt, Homo sapiens
agaaucacgauuucau

SEQ ID NO: 2158835 - RNA, 19 nt, Homo sapiens
gcaaaaauggauauuauua

SEQ ID NO: 2158836 - RNA, 10 nt, Homo sapiens
ucucauguca

SEQ ID NO: 2158837 - RNA, 16 nt, Homo sapiens
ugauagaauacaaaga

SEQ ID NO: 2158838 - RNA, 22 nt, Homo sapiens
cuggagccuacuaaaugcucaa

SEQ ID NO: 2158839 - RNA, 15 nt, Homo sapiens
uuaagucauggaauu

SEQ ID NO: 2158840 - RNA, 19 nt, Homo sapiens
uagggaauaauuagaaaca

SEQ ID NO: 2158841 - RNA, 15 nt, Homo sapiens
cagaacaacacuucc

SEQ ID NO: 2158842 - RNA, 19 nt, Homo sapiens
auaucaagagacaugguau

SEQ ID NO: 2158843 - RNA, 22 nt, Homo sapiens
ugagugggagaaggcagugauu

SEQ ID NO: 2158844 - RNA, 21 nt, Homo sapiens
gucccaaguuggaaauauuca

SEQ ID NO: 2158845 - RNA, 22 nt, Homo sapiens
uguucaaagucaaauaacuccu

SEQ ID NO: 2158846 - RNA, 11 nt, Homo sapiens
acagcauuuca

SEQ ID NO: 2158847 - RNA, 14 nt, Homo sapiens
ugguccaugucuau

SEQ ID NO: 2158848 - RNA, 18 nt, Homo sapiens
uguauacuaccauaguga

SEQ ID NO: 2158849 - RNA, 19 nt, Homo sapiens
ccugcugcuugggacgugu

SEQ ID NO: 2158850 - RNA, 14 nt, Homo sapiens
auaauguauuuuca

SEQ ID NO: 2158851 - RNA, 14 nt, Homo sapiens
uauugcuucaccau

SEQ ID NO: 2158852 - RNA, 15 nt, Homo sapiens
guggcacugccaugc

SEQ ID NO: 2158853 - RNA, 23 nt, Homo sapiens
gaauaauucaucuuugugccaau

SEQ ID NO: 2158854 - RNA, 14 nt, Homo sapiens
accacugacagaug

SEQ ID NO: 2158855 - RNA, 12 nt, Homo sapiens
guucaaugagau

SEQ ID NO: 2158856 - RNA, 17 nt, Homo sapiens
ggaaauguagugcucga

SEQ ID NO: 2158857 - RNA, 13 nt, Homo sapiens
gggugguguccuu

SEQ ID NO: 2158858 - RNA, 22 nt, Homo sapiens
ggcaaugcucaaacacccaagu

SEQ ID NO: 2158859 - RNA, 18 nt, Homo sapiens
ucaacugggaaccuucau

SEQ ID NO: 2158860 - RNA, 12 nt, Homo sapiens
caacugcuccau

SEQ ID NO: 2158861 - RNA, 12 nt, Homo sapiens
caucugcuccuu

SEQ ID NO: 2158862 - RNA, 19 nt, Homo sapiens
uggcauaugguccuagaca

SEQ ID NO: 2158863 - RNA, 17 nt, Homo sapiens
ugcuucaggauccaagu

SEQ ID NO: 2158864 - RNA, 17 nt, Homo sapiens
ugauggggaauccgugu

SEQ ID NO: 2158865 - RNA, 13 nt, Homo sapiens
caaccauauuugu

SEQ ID NO: 2158866 - RNA, 22 nt, Homo sapiens
gucaccaagguggcuucuccuu

SEQ ID NO: 2158867 - RNA, 20 nt, Homo sapiens
uguauuccuguagggggcga

SEQ ID NO: 2158868 - RNA, 17 nt, Homo sapiens
aaacaaugaagacaauu

SEQ ID NO: 2158869 - RNA, 14 nt, Homo sapiens
cuucccaguauuau

SEQ ID NO: 2158870 - RNA, 16 nt, Homo sapiens
aauuauuuuauaucau

SEQ ID NO: 2158871 - RNA, 20 nt, Homo sapiens
uauaaugccauuuuaaggaa

SEQ ID NO: 2158872 - RNA, 14 nt, Homo sapiens
ugagacuccaucuc

SEQ ID NO: 2158873 - RNA, 17 nt, Homo sapiens
caauggcuuguucauca

SEQ ID NO: 2158874 - RNA, 15 nt, Homo sapiens
ccacccagugcugaa

SEQ ID NO: 2158875 - RNA, 22 nt, Homo sapiens
acccagaagcaguaauaaucau

SEQ ID NO: 2158876 - RNA, 18 nt, Homo sapiens
gcaggagaaucacugcag

SEQ ID NO: 2158877 - RNA, 14 nt, Homo sapiens
gaucaguugccaaa

SEQ ID NO: 2158878 - RNA, 12 nt, Homo sapiens
uccauucccaag

SEQ ID NO: 2158879 - RNA, 17 nt, Homo sapiens
aggacuggaaguuugcc

SEQ ID NO: 2158880 - RNA, 16 nt, Homo sapiens
caggcccagccucuug

SEQ ID NO: 2158881 - RNA, 16 nt, Homo sapiens
cuguaugaacuuuauc

SEQ ID NO: 2158882 - RNA, 12 nt, Homo sapiens
acagagugccug

SEQ ID NO: 2158883 - RNA, 15 nt, Homo sapiens
gaugaauucuuccuc

SEQ ID NO: 2158884 - RNA, 14 nt, Homo sapiens
agauaugauucaaa

SEQ ID NO: 2158885 - RNA, 17 nt, Homo sapiens
cuuccuucucaucuugc

SEQ ID NO: 2158886 - RNA, 17 nt, Homo sapiens
ucagcagcgugcaauag

SEQ ID NO: 2158887 - RNA, 22 nt, Homo sapiens
uccagccacugcccaaagccau

SEQ ID NO: 2158888 - RNA, 16 nt, Homo sapiens
ugauucaccucuuccu

SEQ ID NO: 2158889 - RNA, 14 nt, Homo sapiens
guuuucccaaagag

SEQ ID NO: 2158890 - RNA, 21 nt, Homo sapiens
caagggaaggaagggacacac

SEQ ID NO: 2158891 - RNA, 19 nt, Homo sapiens
uggcaauuucacugaugua

SEQ ID NO: 2158892 - RNA, 16 nt, Homo sapiens
agaaaaucuuuuacua

SEQ ID NO: 2158893 - RNA, 16 nt, Homo sapiens
auuuccacugaacaaa

SEQ ID NO: 2158894 - RNA, 15 nt, Homo sapiens
gucacaugcuuuguu

SEQ ID NO: 2158895 - RNA, 16 nt, Homo sapiens
cccugaaucugaccac

SEQ ID NO: 2158896 - RNA, 12 nt, Homo sapiens
ucuccuacuuag

SEQ ID NO: 2158897 - RNA, 16 nt, Homo sapiens
agaguggcugagacuu

SEQ ID NO: 2158898 - RNA, 14 nt, Homo sapiens
gaaaaguugcuauu

SEQ ID NO: 2158899 - RNA, 21 nt, Homo sapiens
cagccucgcgggugucacauu

SEQ ID NO: 2158900 - RNA, 13 nt, Homo sapiens
cucucuguucccu

SEQ ID NO: 2158901 - RNA, 19 nt, Homo sapiens
uuaccagauccuuuuccag

SEQ ID NO: 2158902 - RNA, 17 nt, Homo sapiens
caucaaaccuuugccaa

SEQ ID NO: 2158903 - RNA, 20 nt, Homo sapiens
ucugggaacucccaagaaca

SEQ ID NO: 2158904 - RNA, 14 nt, Homo sapiens
auccuaggcuccug

SEQ ID NO: 2158905 - RNA, 15 nt, Homo sapiens
gaagaugauaccuga

SEQ ID NO: 2158906 - RNA, 18 nt, Homo sapiens
guaaauaauuugcacuga

SEQ ID NO: 2158907 - RNA, 17 nt, Homo sapiens
cugccuaugcacugaag

SEQ ID NO: 2158908 - RNA, 18 nt, Homo sapiens
cgugaaggccgagaagca

SEQ ID NO: 2158909 - RNA, 14 nt, Homo sapiens
ugcuuccuuccaga

SEQ ID NO: 2158910 - RNA, 16 nt, Homo sapiens
accacaaaacuuuucu

SEQ ID NO: 2158911 - RNA, 19 nt, Homo sapiens
gaaucccuaagccuagcug

SEQ ID NO: 2158912 - RNA, 23 nt, Homo sapiens
uacugucaaacaauaaagggaga

SEQ ID NO: 2158913 - RNA, 15 nt, Homo sapiens
uguacacuguuccca

SEQ ID NO: 2158914 - RNA, 19 nt, Homo sapiens
auggugucaucugcuccuu

SEQ ID NO: 2158915 - RNA, 22 nt, Homo sapiens
gguuauuguucagacauuccau

SEQ ID NO: 2158916 - RNA, 14 nt, Homo sapiens
ggcugacaagggac

SEQ ID NO: 2158917 - RNA, 21 nt, Homo sapiens
aauuauguaauugaaaaccaa

SEQ ID NO: 2158918 - RNA, 13 nt, Homo sapiens
agucggagccacu

SEQ ID NO: 2158919 - RNA, 16 nt, Homo sapiens
aggcgggggagccugg

SEQ ID NO: 2158920 - RNA, 23 nt, Homo sapiens
ggugacagagcgagaccgucuca

SEQ ID NO: 2158921 - RNA, 21 nt, Homo sapiens
acucuugcugcacuuauguaa

SEQ ID NO: 2158922 - RNA, 18 nt, Homo sapiens
cucucaagcagguuuuua

SEQ ID NO: 2158923 - RNA, 20 nt, Homo sapiens
gacagguggaaaaacugaga

SEQ ID NO: 2158924 - RNA, 20 nt, Homo sapiens
ccuucuccccugcacuguaa

SEQ ID NO: 2158925 - RNA, 15 nt, Homo sapiens
cuggucgccaaucca

SEQ ID NO: 2158926 - RNA, 16 nt, Homo sapiens
gcauuuagaaaucaag

SEQ ID NO: 2158927 - RNA, 21 nt, Homo sapiens
uuaaaauggugaaugacacua

SEQ ID NO: 2158928 - RNA, 15 nt, Homo sapiens
uggcauaggccugua

SEQ ID NO: 2158929 - RNA, 17 nt, Homo sapiens
aggaugccuuagcaugu

SEQ ID NO: 2158930 - RNA, 19 nt, Homo sapiens
ucucugugcccuccagcaa

SEQ ID NO: 2158931 - RNA, 15 nt, Homo sapiens
acaguuccugagacc

SEQ ID NO: 2158932 - RNA, 17 nt, Homo sapiens
accuccagugucagggu

SEQ ID NO: 2158933 - RNA, 12 nt, Homo sapiens
uacuaccccagc

SEQ ID NO: 2158934 - RNA, 14 nt, Homo sapiens
cacucuucuguaaa

SEQ ID NO: 2158935 - RNA, 16 nt, Homo sapiens
agagacgcagacaugu

SEQ ID NO: 2158936 - RNA, 21 nt, Homo sapiens
acuccauuuagaaaauguuca

SEQ ID NO: 2158937 - RNA, 13 nt, Homo sapiens
cagauaauagcaa

SEQ ID NO: 2158938 - RNA, 19 nt, Homo sapiens
uuuaaauuccacagauuau

SEQ ID NO: 2158939 - RNA, 17 nt, Homo sapiens
ccccaaaaugugaugcu

SEQ ID NO: 2158940 - RNA, 16 nt, Homo sapiens
aacuacuuccaucccu

SEQ ID NO: 2158941 - RNA, 12 nt, Homo sapiens
cagagugcaacc

SEQ ID NO: 2158942 - RNA, 19 nt, Homo sapiens
ucaaacaaccgguaaccaa

SEQ ID NO: 2158943 - RNA, 17 nt, Homo sapiens
cuuuaacaguggagcug

SEQ ID NO: 2158944 - RNA, 13 nt, Homo sapiens
gggggaugccuuc

SEQ ID NO: 2158945 - RNA, 15 nt, Homo sapiens
ucuguguauauuaca

SEQ ID NO: 2158946 - RNA, 17 nt, Homo sapiens
uauauuauaaucuucca

SEQ ID NO: 2158947 - RNA, 17 nt, Homo sapiens
cauccuccucuccaugc

SEQ ID NO: 2158948 - RNA, 18 nt, Homo sapiens
ccucuuagauauucacua

SEQ ID NO: 2158949 - RNA, 17 nt, Homo sapiens
gugaauagucaucuccu

SEQ ID NO: 2158950 - RNA, 12 nt, Homo sapiens
aaacccagacaa

SEQ ID NO: 2158951 - RNA, 12 nt, Homo sapiens
gcaaccaggaac

SEQ ID NO: 2158952 - RNA, 11 nt, Homo sapiens
ccaagcucaac

SEQ ID NO: 2158953 - RNA, 17 nt, Homo sapiens
agguggauuuacugaga

SEQ ID NO: 2158954 - RNA, 14 nt, Homo sapiens
guucugacuuugaa

SEQ ID NO: 2158955 - RNA, 18 nt, Homo sapiens
gagaggggagaauggagu

SEQ ID NO: 2158956 - RNA, 20 nt, Homo sapiens
agcugggcccgacauggcuc

SEQ ID NO: 2158957 - RNA, 23 nt, Homo sapiens
cuuuccuguuucuaucuuucauu

SEQ ID NO: 2158958 - RNA, 17 nt, Homo sapiens
agugggcugacaucaag

SEQ ID NO: 2158959 - RNA, 12 nt, Homo sapiens
uaaacaugauua

SEQ ID NO: 2158960 - RNA, 22 nt, Homo sapiens
cuggcugagugcgaccaccacu

SEQ ID NO: 2158961 - RNA, 13 nt, Homo sapiens
uaucuuaauuccu

SEQ ID NO: 2158962 - RNA, 23 nt, Homo sapiens
uauugguuuuaaaaaagcauuau

SEQ ID NO: 2158963 - RNA, 16 nt, Homo sapiens
uuuccucagugcauuu

SEQ ID NO: 2158964 - RNA, 22 nt, Homo sapiens
acaguucaauucucauuuguca

SEQ ID NO: 2158965 - RNA, 23 nt, Homo sapiens
ccucaggacaaggccuugcucac

SEQ ID NO: 2158966 - RNA, 19 nt, Homo sapiens
guuguccccgcuggcucac

SEQ ID NO: 2158967 - RNA, 16 nt, Homo sapiens
aacagaccagcauagu

SEQ ID NO: 2158968 - RNA, 22 nt, Homo sapiens
acauuaacucccuccaccagcc

SEQ ID NO: 2158969 - RNA, 15 nt, Homo sapiens
augggcagcucaucu

SEQ ID NO: 2158970 - RNA, 22 nt, Homo sapiens
ucugauuuguaacccacugaga

SEQ ID NO: 2158971 - RNA, 19 nt, Homo sapiens
guccccucccagggagcaa

SEQ ID NO: 2158972 - RNA, 16 nt, Homo sapiens
ucuucaggccucccuc

SEQ ID NO: 2158973 - RNA, 16 nt, Homo sapiens
uuccaccauugcugga

SEQ ID NO: 2158974 - RNA, 20 nt, Homo sapiens
ucagcaaaaaaguacuuaaa

SEQ ID NO: 2158975 - RNA, 18 nt, Homo sapiens
uaaauugcugcgugacau

SEQ ID NO: 2158976 - RNA, 15 nt, Homo sapiens
augaagggaugcugc

SEQ ID NO: 2158977 - RNA, 18 nt, Homo sapiens
cccaugagguacagcaga

SEQ ID NO: 2158978 - RNA, 20 nt, Homo sapiens
acuucucccgugagccaggc

SEQ ID NO: 2158979 - RNA, 20 nt, Homo sapiens
agagcguuacuguagaccuu

SEQ ID NO: 2158980 - RNA, 15 nt, Homo sapiens
agugugugcacaugu

SEQ ID NO: 2158981 - RNA, 21 nt, Homo sapiens
ugccucagccuuccaaagugc

SEQ ID NO: 2158982 - RNA, 15 nt, Homo sapiens
auaauucuuacuguu

SEQ ID NO: 2158983 - RNA, 17 nt, Homo sapiens
uaacuuuuuacauuaca

SEQ ID NO: 2158984 - RNA, 18 nt, Homo sapiens
agagugagacucgucuca

SEQ ID NO: 2158985 - RNA, 16 nt, Homo sapiens
uacuguaggcagcuga

SEQ ID NO: 2158986 - RNA, 14 nt, Homo sapiens
ccagccaguacagu

SEQ ID NO: 2158987 - RNA, 21 nt, Homo sapiens
auagcaacuccccuacaucaa

SEQ ID NO: 2158988 - RNA, 17 nt, Homo sapiens
agggcagaggccaugaa

SEQ ID NO: 2158989 - RNA, 16 nt, Homo sapiens
caugugguacuugagg

SEQ ID NO: 2158990 - RNA, 13 nt, Homo sapiens
ucauucuacugaa

SEQ ID NO: 2158991 - RNA, 18 nt, Homo sapiens
ugacagcugcaagccagg

SEQ ID NO: 2158992 - RNA, 20 nt, Homo sapiens
aagccuccuccuuuucugaa

SEQ ID NO: 2158993 - RNA, 19 nt, Homo sapiens
cuauuuuuuuucuguuaua

SEQ ID NO: 2158994 - RNA, 14 nt, Homo sapiens
gcugaagaccuaaa

SEQ ID NO: 2158995 - RNA, 13 nt, Homo sapiens
ggggauaccagcu

SEQ ID NO: 2158996 - RNA, 18 nt, Homo sapiens
uagugguugguggcaaca

SEQ ID NO: 2158997 - RNA, 13 nt, Homo sapiens
gcucucacucugu

SEQ ID NO: 2158998 - RNA, 22 nt, Homo sapiens
gcugugggcaagccuaagggau

SEQ ID NO: 2158999 - RNA, 15 nt, Homo sapiens
uaaaaagauauugua

SEQ ID NO: 2159000 - RNA, 12 nt, Homo sapiens
gccaagggauga

SEQ ID NO: 2159001 - RNA, 21 nt, Homo sapiens
aacccugggaacaauuuccaa

SEQ ID NO: 2159002 - RNA, 17 nt, Homo sapiens
uugagcacacuuuacac

SEQ ID NO: 2159003 - RNA, 14 nt, Homo sapiens
uggaggcaguccau

SEQ ID NO: 2159004 - RNA, 12 nt, Homo sapiens
aggccuuggacu

SEQ ID NO: 2159005 - RNA, 21 nt, Homo sapiens
ggcuugaauaaggaaaugaca

SEQ ID NO: 2159006 - RNA, 17 nt, Homo sapiens
auguagccagacaguuu

SEQ ID NO: 2159007 - RNA, 17 nt, Homo sapiens
cgccaacccuuccugaa

SEQ ID NO: 2159008 - RNA, 22 nt, Homo sapiens
cuauuagggaguuaugcaaaau

SEQ ID NO: 2159009 - RNA, 15 nt, Homo sapiens
gacauuuugaucacu

SEQ ID NO: 2159010 - RNA, 13 nt, Homo sapiens
cuaugacaucuaa

SEQ ID NO: 2159011 - RNA, 13 nt, Homo sapiens
cuuguaaguuauu

SEQ ID NO: 2159012 - RNA, 22 nt, Homo sapiens
aaucauagccaagaucccaucu

SEQ ID NO: 2159013 - RNA, 18 nt, Homo sapiens
auauugcucucauuucaa

SEQ ID NO: 2159014 - RNA, 14 nt, Homo sapiens
gugauguacuguaa

SEQ ID NO: 2159015 - RNA, 18 nt, Homo sapiens
uccccucuuccucucuuc

SEQ ID NO: 2159016 - RNA, 15 nt, Homo sapiens
gauaggcagcacuga

SEQ ID NO: 2159017 - RNA, 17 nt, Homo sapiens
ucucuuuacagcuuugu

SEQ ID NO: 2159018 - RNA, 17 nt, Homo sapiens
acuaaaugcagaaauaa

SEQ ID NO: 2159019 - RNA, 11 nt, Homo sapiens
caacacuggaa

SEQ ID NO: 2159020 - RNA, 13 nt, Homo sapiens
cagugagcacuag

SEQ ID NO: 2159021 - RNA, 16 nt, Homo sapiens
ccugcccugucuuucc

SEQ ID NO: 2159022 - RNA, 13 nt, Homo sapiens
ccugcagggccaa

SEQ ID NO: 2159023 - RNA, 13 nt, Homo sapiens
aaaugccaaugag

SEQ ID NO: 2159024 - RNA, 20 nt, Homo sapiens
agaaaagucuccaccccuac

SEQ ID NO: 2159025 - RNA, 21 nt, Homo sapiens
cggauggaccaaccugcucug

SEQ ID NO: 2159026 - RNA, 14 nt, Homo sapiens
uuggggacaggggc

SEQ ID NO: 2159027 - RNA, 15 nt, Homo sapiens
gaggucauacaugca

SEQ ID NO: 2159028 - RNA, 19 nt, Homo sapiens
ugguaaaccaagccuccca

SEQ ID NO: 2159029 - RNA, 19 nt, Homo sapiens
guuaaauaucacaucacuu

SEQ ID NO: 2159030 - RNA, 23 nt, Homo sapiens
uccugguuuucucuuacugcagu

SEQ ID NO: 2159031 - RNA, 19 nt, Homo sapiens
ggaaaucaaggaugcucag

SEQ ID NO: 2159032 - RNA, 15 nt, Homo sapiens
ccgugugaggacuga

SEQ ID NO: 2159033 - RNA, 19 nt, Homo sapiens
gugucgggaugucaugucc

SEQ ID NO: 2159034 - RNA, 23 nt, Homo sapiens
aaggaccauaaauuuaaauggag

SEQ ID NO: 2159035 - RNA, 18 nt, Homo sapiens
ucuacugcuaugugucac

SEQ ID NO: 2159036 - RNA, 23 nt, Homo sapiens
uuguaaucccaguuacucaggag

SEQ ID NO: 2159037 - RNA, 20 nt, Homo sapiens
cuagccaccaguguccucca

SEQ ID NO: 2159038 - RNA, 19 nt, Homo sapiens
gugcuacagaaagcacaaa

SEQ ID NO: 2159039 - RNA, 17 nt, Homo sapiens
aaugaggaaacugcacu

SEQ ID NO: 2159040 - RNA, 16 nt, Homo sapiens
uuucaucccauuuccc

SEQ ID NO: 2159041 - RNA, 16 nt, Homo sapiens
ucgccuaggccuguga

SEQ ID NO: 2159042 - RNA, 14 nt, Homo sapiens
uccccacgcccguc

SEQ ID NO: 2159043 - RNA, 15 nt, Homo sapiens
ugccuggucccaaga

SEQ ID NO: 2159044 - RNA, 23 nt, Homo sapiens
acccggaagaucagaugcaauug

SEQ ID NO: 2159045 - RNA, 13 nt, Homo sapiens
aaaguguacauga

SEQ ID NO: 2159046 - RNA, 23 nt, Homo sapiens
ucauggggugggguuggggcaaa

SEQ ID NO: 2159047 - RNA, 23 nt, Homo sapiens
gccugaucagcaggagccaauau

SEQ ID NO: 2159048 - RNA, 17 nt, Homo sapiens
uccaauauuggagcaua

SEQ ID NO: 2159049 - RNA, 18 nt, Homo sapiens
agcugcccucagccagag

SEQ ID NO: 2159050 - RNA, 17 nt, Homo sapiens
cuacacccagaccccag

SEQ ID NO: 2159051 - RNA, 13 nt, Homo sapiens
uggaacaccuccu

SEQ ID NO: 2159052 - RNA, 21 nt, Homo sapiens
agaaggccacuguuugucuca

SEQ ID NO: 2159053 - RNA, 19 nt, Homo sapiens
guauuuuuaguaaagacag

SEQ ID NO: 2159054 - RNA, 21 nt, Homo sapiens
caaauaauagcaaugguggug

SEQ ID NO: 2159055 - RNA, 14 nt, Homo sapiens
agcccaaagccaag

SEQ ID NO: 2159056 - RNA, 13 nt, Homo sapiens
acugcacacuucc

SEQ ID NO: 2159057 - RNA, 14 nt, Homo sapiens
uagaacuugagaac

SEQ ID NO: 2159058 - RNA, 13 nt, Homo sapiens
ggcuaucagagac

SEQ ID NO: 2159059 - RNA, 18 nt, Homo sapiens
uuuauuuccaauguuuca

SEQ ID NO: 2159060 - RNA, 21 nt, Homo sapiens
uuaagauuuuuuauuugaaaa

SEQ ID NO: 2159061 - RNA, 19 nt, Homo sapiens
aagcauuuugaaacauaca

SEQ ID NO: 2159062 - RNA, 17 nt, Homo sapiens
cagggguuaagagcuca

SEQ ID NO: 2159063 - RNA, 16 nt, Homo sapiens
uucucaaucuauguga

SEQ ID NO: 2159064 - RNA, 21 nt, Homo sapiens
cccucaugcugugugacucaa

SEQ ID NO: 2159065 - RNA, 13 nt, Homo sapiens
uggcccacccacu

SEQ ID NO: 2159066 - RNA, 17 nt, Homo sapiens
uagagcucuuguguuca

SEQ ID NO: 2159067 - RNA, 13 nt, Homo sapiens
cagacaaccaaaa

SEQ ID NO: 2159068 - RNA, 21 nt, Homo sapiens
uugcauugucuguuggcaaau

SEQ ID NO: 2159069 - RNA, 14 nt, Homo sapiens
cucuuuaaccacuc

SEQ ID NO: 2159070 - RNA, 18 nt, Homo sapiens
guuggacuaaaugccuag

SEQ ID NO: 2159071 - RNA, 19 nt, Homo sapiens
aaacucacaagugcucauc

SEQ ID NO: 2159072 - RNA, 16 nt, Homo sapiens
gauucagaggucacuu

SEQ ID NO: 2159073 - RNA, 20 nt, Homo sapiens
ugugguuaaauaaauucuua

SEQ ID NO: 2159074 - RNA, 17 nt, Homo sapiens
aacgagaagcagcauuu

SEQ ID NO: 2159075 - RNA, 14 nt, Homo sapiens
ggaggugcugcucu

SEQ ID NO: 2159076 - RNA, 19 nt, Homo sapiens
aauuuuguuuucuguggag

SEQ ID NO: 2159077 - RNA, 19 nt, Homo sapiens
cuacgaggccauccagucc

SEQ ID NO: 2159078 - RNA, 14 nt, Homo sapiens
cuuuuauuucauuc

SEQ ID NO: 2159079 - RNA, 21 nt, Homo sapiens
gauauaauuuuauuacauaug

SEQ ID NO: 2159080 - RNA, 17 nt, Homo sapiens
ccaggcagccacuccua

SEQ ID NO: 2159081 - RNA, 15 nt, Homo sapiens
cuuuuccucaccagu

SEQ ID NO: 2159082 - RNA, 20 nt, Homo sapiens
ucuacguauaaauaugaaau

SEQ ID NO: 2159083 - RNA, 20 nt, Homo sapiens
ucccuuugccuuaaaccuga

SEQ ID NO: 2159084 - RNA, 23 nt, Homo sapiens
ucuuccuuagcuaaaugcaauuu

SEQ ID NO: 2159085 - RNA, 22 nt, Homo sapiens
acagccccauggacaacacuaa

SEQ ID NO: 2159086 - RNA, 20 nt, Homo sapiens
ccuggccgggucacccugug

SEQ ID NO: 2159087 - RNA, 22 nt, Homo sapiens
ucaucauuucacuugucaggag

SEQ ID NO: 2159088 - RNA, 16 nt, Homo sapiens
gaccugguuaaacaaa

SEQ ID NO: 2159089 - RNA, 19 nt, Homo sapiens
cuaccugaguccugaagcu

SEQ ID NO: 2159090 - RNA, 20 nt, Homo sapiens
uagaaaucccugucuugcuu

SEQ ID NO: 2159091 - RNA, 19 nt, Homo sapiens
acagguuacagugagcaaa

SEQ ID NO: 2159092 - RNA, 23 nt, Homo sapiens
auuuagcaagguguuucugggcu

SEQ ID NO: 2159093 - RNA, 23 nt, Homo sapiens
agccuaggcuuggcuccuuucac

SEQ ID NO: 2159094 - RNA, 14 nt, Homo sapiens
caguugguuuugca

SEQ ID NO: 2159095 - RNA, 18 nt, Homo sapiens
cuuaucuauauccauaac

SEQ ID NO: 2159096 - RNA, 21 nt, Homo sapiens
uagcuuccaccucauggauug

SEQ ID NO: 2159097 - RNA, 15 nt, Homo sapiens
uuuguaaugcugcac

SEQ ID NO: 2159098 - RNA, 17 nt, Homo sapiens
cuccaaauagcauuagu

SEQ ID NO: 2159099 - RNA, 17 nt, Homo sapiens
gcuuuggucacuuuuag

SEQ ID NO: 2159100 - RNA, 14 nt, Homo sapiens
gcacugccggccca

SEQ ID NO: 2159101 - RNA, 18 nt, Homo sapiens
cccaaacagugggcugcu

SEQ ID NO: 2159102 - RNA, 20 nt, Homo sapiens
ugcaaaaggcugauuacuga

SEQ ID NO: 2159103 - RNA, 19 nt, Homo sapiens
cuucuuggucucaguguca

SEQ ID NO: 2159104 - RNA, 21 nt, Homo sapiens
guaaggacggacucacuucuc

SEQ ID NO: 2159105 - RNA, 14 nt, Homo sapiens
aaaucugcucagga

SEQ ID NO: 2159106 - RNA, 17 nt, Homo sapiens
ccaacaugucagaacua

SEQ ID NO: 2159107 - RNA, 13 nt, Homo sapiens
ucacuugcucaaa

SEQ ID NO: 2159108 - RNA, 16 nt, Homo sapiens
uucaaguaauugugaa

SEQ ID NO: 2159109 - RNA, 22 nt, Homo sapiens
auagacagauguggacaugcac

SEQ ID NO: 2159110 - RNA, 21 nt, Homo sapiens
ugcucccucagccucagagga

SEQ ID NO: 2159111 - RNA, 14 nt, Homo sapiens
gaggggaccaaagc

SEQ ID NO: 2159112 - RNA, 22 nt, Homo sapiens
aguuauagaagagaaaugcugc

SEQ ID NO: 2159113 - RNA, 14 nt, Homo sapiens
cagccuccugcuaa

SEQ ID NO: 2159114 - RNA, 15 nt, Homo sapiens
gccugugguuaacau

SEQ ID NO: 2159115 - RNA, 19 nt, Homo sapiens
gugccuccuccccaggugg

SEQ ID NO: 2159116 - RNA, 14 nt, Homo sapiens
uuauuaugacaaau

SEQ ID NO: 2159117 - RNA, 12 nt, Homo sapiens
cuguuaagcaau

SEQ ID NO: 2159118 - RNA, 12 nt, Homo sapiens
cugauaagcaaa

SEQ ID NO: 2159119 - RNA, 22 nt, Homo sapiens
acaaaaagaacaaaucagcuua

SEQ ID NO: 2159120 - RNA, 14 nt, Homo sapiens
agagaauucaugug

SEQ ID NO: 2159121 - RNA, 19 nt, Homo sapiens
uacaauuuucucccaggaa

SEQ ID NO: 2159122 - RNA, 20 nt, Homo sapiens
cugaggggauaucccuaugu

SEQ ID NO: 2159123 - RNA, 21 nt, Homo sapiens
gucauuaaaacagaagcaaau

SEQ ID NO: 2159124 - RNA, 19 nt, Homo sapiens
uaaguauucaagaaagcca

SEQ ID NO: 2159125 - RNA, 14 nt, Homo sapiens
agcucacccacccc

SEQ ID NO: 2159126 - RNA, 23 nt, Homo sapiens
agcaccucucagccccucagaga

SEQ ID NO: 2159127 - RNA, 22 nt, Homo sapiens
ugugacaauaauauuguuguau

SEQ ID NO: 2159128 - RNA, 19 nt, Homo sapiens
auagugauaccccaucucu

SEQ ID NO: 2159129 - RNA, 22 nt, Homo sapiens
ggaauaauccuaaacauaugaa

SEQ ID NO: 2159130 - RNA, 14 nt, Homo sapiens
cauauggacacugu

SEQ ID NO: 2159131 - RNA, 15 nt, Homo sapiens
aaccaggagugagcc

SEQ ID NO: 2159132 - RNA, 17 nt, Homo sapiens
ccagccuugaguuaucu

SEQ ID NO: 2159133 - RNA, 15 nt, Homo sapiens
agcagcaacuguguc

SEQ ID NO: 2159134 - RNA, 16 nt, Homo sapiens
aagggacucugggcug

SEQ ID NO: 2159135 - RNA, 22 nt, Homo sapiens
cuaaagaagguuucagaaagaa

SEQ ID NO: 2159136 - RNA, 21 nt, Homo sapiens
cacucuaggacucugcacuga

SEQ ID NO: 2159137 - RNA, 18 nt, Homo sapiens
acaauucauucauuugca

SEQ ID NO: 2159138 - RNA, 19 nt, Homo sapiens
cauuuauuaguaucuucca

SEQ ID NO: 2159139 - RNA, 14 nt, Homo sapiens
ugaaaguuuaacua

SEQ ID NO: 2159140 - RNA, 12 nt, Homo sapiens
acugaugaaggc

SEQ ID NO: 2159141 - RNA, 20 nt, Homo sapiens
aguuaaagugaauaaccacu

SEQ ID NO: 2159142 - RNA, 24 nt, Homo sapiens
augcauacuguugauacaaaccac

SEQ ID NO: 2159143 - RNA, 14 nt, Homo sapiens
cuggagcaugagcc

SEQ ID NO: 2159144 - RNA, 18 nt, Homo sapiens
acagagugccaucccuga

SEQ ID NO: 2159145 - RNA, 16 nt, Homo sapiens
agcaaaccucagucau

SEQ ID NO: 2159146 - RNA, 14 nt, Homo sapiens
gauaguccaaagac

SEQ ID NO: 2159147 - RNA, 13 nt, Homo sapiens
uuaaucaguguga

SEQ ID NO: 2159148 - RNA, 22 nt, Homo sapiens
uaaggcaacccccgguauauca

SEQ ID NO: 2159149 - RNA, 21 nt, Homo sapiens
caguuuauccugacauauuca

SEQ ID NO: 2159150 - RNA, 16 nt, Homo sapiens
cugaucagcaugggaa

SEQ ID NO: 2159151 - RNA, 23 nt, Homo sapiens
ugcggugcauacacccccaccuc

SEQ ID NO: 2159152 - RNA, 19 nt, Homo sapiens
aggcuccucacgggcgaug

SEQ ID NO: 2159153 - RNA, 14 nt, Homo sapiens
cucagccucugcca

SEQ ID NO: 2159154 - RNA, 17 nt, Homo sapiens
cauucugcauugcuaga

SEQ ID NO: 2159155 - RNA, 11 nt, Homo sapiens
gagaagccaua

SEQ ID NO: 2159156 - RNA, 23 nt, Homo sapiens
acuuccuuggaaaucaaauguaa

SEQ ID NO: 2159157 - RNA, 13 nt, Homo sapiens
uucaaggaggaaa

SEQ ID NO: 2159158 - RNA, 24 nt, Homo sapiens
uagcuuuacauuuucaguaccaaa

SEQ ID NO: 2159159 - RNA, 15 nt, Homo sapiens
ggagaguaccugugu

SEQ ID NO: 2159160 - RNA, 13 nt, Homo sapiens
uaaaauuacacuu

SEQ ID NO: 2159161 - RNA, 14 nt, Homo sapiens
caguccugcuccag

SEQ ID NO: 2159162 - RNA, 20 nt, Homo sapiens
uaaaugggagggcauuccau

SEQ ID NO: 2159163 - RNA, 20 nt, Homo sapiens
uuaauaggguaaauucucua

SEQ ID NO: 2159164 - RNA, 20 nt, Homo sapiens
uuaccucuauauaccaaagc

SEQ ID NO: 2159165 - RNA, 15 nt, Homo sapiens
cagggaucauagcug

SEQ ID NO: 2159166 - RNA, 15 nt, Homo sapiens
gaggcagccggccaa

SEQ ID NO: 2159167 - RNA, 18 nt, Homo sapiens
cuauucuuuccaugacac

SEQ ID NO: 2159168 - RNA, 17 nt, Homo sapiens
ucuuaugcuguacccag

SEQ ID NO: 2159169 - RNA, 15 nt, Homo sapiens
cuacuuuguugcuau

SEQ ID NO: 2159170 - RNA, 22 nt, Homo sapiens
aaucugggcagacauuauguaa

SEQ ID NO: 2159171 - RNA, 22 nt, Homo sapiens
auggcaucucauugaggacaaa

SEQ ID NO: 2159172 - RNA, 13 nt, Homo sapiens
ugcucacugcuca

SEQ ID NO: 2159173 - RNA, 17 nt, Homo sapiens
uuuuacugcucugagaa

SEQ ID NO: 2159174 - RNA, 21 nt, Homo sapiens
ucucucagagaucuugcauuu

SEQ ID NO: 2159175 - RNA, 14 nt, Homo sapiens
ggaaaaaugcugcu

SEQ ID NO: 2159176 - RNA, 19 nt, Homo sapiens
aauccaagacaaacuaaac

SEQ ID NO: 2159177 - RNA, 15 nt, Homo sapiens
cagagggaucaagca

SEQ ID NO: 2159178 - RNA, 15 nt, Homo sapiens
gaaagaugucccaca

SEQ ID NO: 2159179 - RNA, 12 nt, Homo sapiens
ucuacaaccuaa

SEQ ID NO: 2159180 - RNA, 20 nt, Homo sapiens
aguuggggcggcccacgcca

SEQ ID NO: 2159181 - RNA, 15 nt, Homo sapiens
cacugcaaccuccac

SEQ ID NO: 2159182 - RNA, 19 nt, Homo sapiens
gggguccugguaugucuca

SEQ ID NO: 2159183 - RNA, 23 nt, Homo sapiens
ccaaugccacccucaucuuugac

SEQ ID NO: 2159184 - RNA, 23 nt, Homo sapiens
cugaauaccucuuugaaagaagg

SEQ ID NO: 2159185 - RNA, 16 nt, Homo sapiens
aacccugccugucacc

SEQ ID NO: 2159186 - RNA, 22 nt, Homo sapiens
ccaaacucaguucgaccaaacu

SEQ ID NO: 2159187 - RNA, 16 nt, Homo sapiens
guccuuaggcuacugu

SEQ ID NO: 2159188 - RNA, 13 nt, Homo sapiens
auuaauuuucucu

SEQ ID NO: 2159189 - RNA, 18 nt, Homo sapiens
aauuacaauaacucacuc

SEQ ID NO: 2159190 - RNA, 15 nt, Homo sapiens
caaaggacagaucca

SEQ ID NO: 2159191 - RNA, 22 nt, Homo sapiens
uaaaaaguaccacauuccauga

SEQ ID NO: 2159192 - RNA, 15 nt, Homo sapiens
gccuauugugccucu

SEQ ID NO: 2159193 - RNA, 17 nt, Homo sapiens
uggcaggaaucuaucca

SEQ ID NO: 2159194 - RNA, 15 nt, Homo sapiens
auugaggcccugcug

SEQ ID NO: 2159195 - RNA, 21 nt, Homo sapiens
gcuuaaaaaagaaagauuuua

SEQ ID NO: 2159196 - RNA, 22 nt, Homo sapiens
cugucuccuuguugcccaacua

SEQ ID NO: 2159197 - RNA, 23 nt, Homo sapiens
guucgcacaaucuacacugccuu

SEQ ID NO: 2159198 - RNA, 18 nt, Homo sapiens
cuucugaggacauuccaa

SEQ ID NO: 2159199 - RNA, 14 nt, Homo sapiens
ugaauacugcuaca

SEQ ID NO: 2159200 - RNA, 18 nt, Homo sapiens
acauuucaaauaacugca

SEQ ID NO: 2159201 - RNA, 19 nt, Homo sapiens
aucauuccccgacacugcc

SEQ ID NO: 2159202 - RNA, 18 nt, Homo sapiens
ccugccagacggcaccca

SEQ ID NO: 2159203 - RNA, 15 nt, Homo sapiens
cccuguccugugaau

SEQ ID NO: 2159204 - RNA, 13 nt, Homo sapiens
ugauggccaguca

SEQ ID NO: 2159205 - RNA, 21 nt, Homo sapiens
gaggccauccaagauggcaug

SEQ ID NO: 2159206 - RNA, 13 nt, Homo sapiens
cacacccaugugu

SEQ ID NO: 2159207 - RNA, 20 nt, Homo sapiens
cuagucuguguaacuuuaaa

SEQ ID NO: 2159208 - RNA, 18 nt, Homo sapiens
ugucuccuuuaacuagca

SEQ ID NO: 2159209 - RNA, 17 nt, Homo sapiens
aaaggaaacauugccau

SEQ ID NO: 2159210 - RNA, 21 nt, Homo sapiens
agccauguaucaauauucacu

SEQ ID NO: 2159211 - RNA, 23 nt, Homo sapiens
aucuauuuggaaagcacuggaau

SEQ ID NO: 2159212 - RNA, 21 nt, Homo sapiens
cuggcaagucuuccaugaccc

SEQ ID NO: 2159213 - RNA, 22 nt, Homo sapiens
uugaaaucaaugcaagagugau

SEQ ID NO: 2159214 - RNA, 15 nt, Homo sapiens
ugcaucagcugcuga

SEQ ID NO: 2159215 - RNA, 15 nt, Homo sapiens
cugcagagugcaaca

SEQ ID NO: 2159216 - RNA, 22 nt, Homo sapiens
gaaagcuuuuauuccuuugaau

SEQ ID NO: 2159217 - RNA, 12 nt, Homo sapiens
ccaagagccauc

SEQ ID NO: 2159218 - RNA, 13 nt, Homo sapiens
ccaucaggguucu

SEQ ID NO: 2159219 - RNA, 23 nt, Homo sapiens
ugagaguacucacuuuucacuug

SEQ ID NO: 2159220 - RNA, 18 nt, Homo sapiens
gugaagugguacaaucug

SEQ ID NO: 2159221 - RNA, 18 nt, Homo sapiens
agaaacuugugaagugga

SEQ ID NO: 2159222 - RNA, 22 nt, Homo sapiens
gucauuuuuuuuuucugugcug

SEQ ID NO: 2159223 - RNA, 19 nt, Homo sapiens
cauuuuagugguagcauau

SEQ ID NO: 2159224 - RNA, 19 nt, Homo sapiens
ucugucacuuaauugcuac

SEQ ID NO: 2159225 - RNA, 14 nt, Homo sapiens
caaagugaccucca

SEQ ID NO: 2159226 - RNA, 16 nt, Homo sapiens
gaaucacugugcucag

SEQ ID NO: 2159227 - RNA, 14 nt, Homo sapiens
guucuaguuugcau

SEQ ID NO: 2159228 - RNA, 17 nt, Homo sapiens
uaucaacugcugcuuca

SEQ ID NO: 2159229 - RNA, 21 nt, Homo sapiens
ugcacuguucccccugugcag

SEQ ID NO: 2159230 - RNA, 18 nt, Homo sapiens
aguguaaugaauaccuua

SEQ ID NO: 2159231 - RNA, 15 nt, Homo sapiens
gacuccaaaaggccc

SEQ ID NO: 2159232 - RNA, 16 nt, Homo sapiens
uaaaaucccuccuuca

SEQ ID NO: 2159233 - RNA, 20 nt, Homo sapiens
gcucacuguccacaugugaa

SEQ ID NO: 2159234 - RNA, 19 nt, Homo sapiens
uuauaccaccauccuugua

SEQ ID NO: 2159235 - RNA, 12 nt, Homo sapiens
ugugaacacugg

SEQ ID NO: 2159236 - RNA, 19 nt, Homo sapiens
caucaauuggaaaucaauc

SEQ ID NO: 2159237 - RNA, 13 nt, Homo sapiens
uuuaacagccucu

SEQ ID NO: 2159238 - RNA, 14 nt, Homo sapiens
cccgcccccagauu

SEQ ID NO: 2159239 - RNA, 20 nt, Homo sapiens
gcccaggauggcuuugaaug

SEQ ID NO: 2159240 - RNA, 14 nt, Homo sapiens
aguuuugacaagcu

SEQ ID NO: 2159241 - RNA, 16 nt, Homo sapiens
auuccuucuuucacag

SEQ ID NO: 2159242 - RNA, 16 nt, Homo sapiens
cuuccauuugugugug

SEQ ID NO: 2159243 - RNA, 22 nt, Homo sapiens
uucaugugguacuacugaagaa

SEQ ID NO: 2159244 - RNA, 13 nt, Homo sapiens
aggaagagggauc

SEQ ID NO: 2159245 - RNA, 22 nt, Homo sapiens
ccuguggguuugguccuugaac

SEQ ID NO: 2159246 - RNA, 16 nt, Homo sapiens
agacaucaguauucug

SEQ ID NO: 2159247 - RNA, 19 nt, Homo sapiens
ccccacugccugucccaga

SEQ ID NO: 2159248 - RNA, 17 nt, Homo sapiens
acccugcccacucccau

SEQ ID NO: 2159249 - RNA, 15 nt, Homo sapiens
uuuuguuauugggca

SEQ ID NO: 2159250 - RNA, 21 nt, Homo sapiens
acuugugauagguaccugagu

SEQ ID NO: 2159251 - RNA, 22 nt, Homo sapiens
uggaaaagcacuuuacagauga

SEQ ID NO: 2159252 - RNA, 18 nt, Homo sapiens
agcugccaaaaagaacac

SEQ ID NO: 2159253 - RNA, 16 nt, Homo sapiens
cccacucggagggugc

SEQ ID NO: 2159254 - RNA, 21 nt, Homo sapiens
aaugucuuaaaaauauauuua

SEQ ID NO: 2159255 - RNA, 19 nt, Homo sapiens
aaauaugguuugaagugaa

SEQ ID NO: 2159256 - RNA, 19 nt, Homo sapiens
uuauaaaaucuuacuuugu

SEQ ID NO: 2159257 - RNA, 13 nt, Homo sapiens
uucccuggcucag

SEQ ID NO: 2159258 - RNA, 21 nt, Homo sapiens
cugaccuugcugauggugaca

SEQ ID NO: 2159259 - RNA, 23 nt, Homo sapiens
caggaaaaguugaugguauucau

SEQ ID NO: 2159260 - RNA, 17 nt, Homo sapiens
uuucuuucucacuaaau

SEQ ID NO: 2159261 - RNA, 16 nt, Homo sapiens
gaaguuaugcugucau

SEQ ID NO: 2159262 - RNA, 23 nt, Homo sapiens
agugugggggaggcgcacagugu

SEQ ID NO: 2159263 - RNA, 15 nt, Homo sapiens
agaaaauuaauuuca

SEQ ID NO: 2159264 - RNA, 17 nt, Homo sapiens
accuguuuuauagaauu

SEQ ID NO: 2159265 - RNA, 15 nt, Homo sapiens
cagugaaccaaagag

SEQ ID NO: 2159266 - RNA, 17 nt, Homo sapiens
gagcuguucaacaucac

SEQ ID NO: 2159267 - RNA, 19 nt, Homo sapiens
gucacaauacaguaaguaa

SEQ ID NO: 2159268 - RNA, 17 nt, Homo sapiens
agaaaauuagcaugaaa

SEQ ID NO: 2159269 - RNA, 15 nt, Homo sapiens
gagguaaaaacugaa

SEQ ID NO: 2159270 - RNA, 20 nt, Homo sapiens
uauacaaaccuuuagcugug

SEQ ID NO: 2159271 - RNA, 17 nt, Homo sapiens
gaaaagcccccaguuaa

SEQ ID NO: 2159272 - RNA, 23 nt, Homo sapiens
uuuuaaccucuagagucacugau

SEQ ID NO: 2159273 - RNA, 19 nt, Homo sapiens
cagccaggugcugugacac

SEQ ID NO: 2159274 - RNA, 22 nt, Homo sapiens
uaauuuugcagcagaagccaaa

SEQ ID NO: 2159275 - RNA, 21 nt, Homo sapiens
caugcugcuggggaagacagu

SEQ ID NO: 2159276 - RNA, 17 nt, Homo sapiens
uguguuggcuguggcag

SEQ ID NO: 2159277 - RNA, 17 nt, Homo sapiens
ccuuuucaaauccauuu

SEQ ID NO: 2159278 - RNA, 11 nt, Homo sapiens
gagacacaucu

SEQ ID NO: 2159279 - RNA, 17 nt, Homo sapiens
uaaaaaaauuacuguga

SEQ ID NO: 2159280 - RNA, 21 nt, Homo sapiens
uguauuuuguguuccuaucaa

SEQ ID NO: 2159281 - RNA, 18 nt, Homo sapiens
caaggaauuuucaccucc

SEQ ID NO: 2159282 - RNA, 17 nt, Homo sapiens
guagaguuagcugauaa

SEQ ID NO: 2159283 - RNA, 15 nt, Homo sapiens
ucuugaaguucaugg

SEQ ID NO: 2159284 - RNA, 19 nt, Homo sapiens
ugccgcucucucugagggg

SEQ ID NO: 2159285 - RNA, 19 nt, Homo sapiens
aagcuguugaagucucagg

SEQ ID NO: 2159286 - RNA, 17 nt, Homo sapiens
cacccaugcccagcugu

SEQ ID NO: 2159287 - RNA, 15 nt, Homo sapiens
cugauagaaccuccg

SEQ ID NO: 2159288 - RNA, 18 nt, Homo sapiens
aguuuucuuuccaaaauc

SEQ ID NO: 2159289 - RNA, 23 nt, Homo sapiens
caugaugauucucuaacacuguc

SEQ ID NO: 2159290 - RNA, 20 nt, Homo sapiens
aaccaaagggggacagugau

SEQ ID NO: 2159291 - RNA, 12 nt, Homo sapiens
caugucagcucc

SEQ ID NO: 2159292 - RNA, 17 nt, Homo sapiens
acacacaugaaguccaa

SEQ ID NO: 2159293 - RNA, 12 nt, Homo sapiens
uccagcaugugu

SEQ ID NO: 2159294 - RNA, 18 nt, Homo sapiens
ccaggcccccaccacaca

SEQ ID NO: 2159295 - RNA, 21 nt, Homo sapiens
uaagcccccacuacaagugau

SEQ ID NO: 2159296 - RNA, 23 nt, Homo sapiens
guaaaguauuuacugacugcuua

SEQ ID NO: 2159297 - RNA, 20 nt, Homo sapiens
guucccauuuuugcuuagcu

SEQ ID NO: 2159298 - RNA, 17 nt, Homo sapiens
caacucuguaucuccag

SEQ ID NO: 2159299 - RNA, 17 nt, Homo sapiens
ucuauuuggcaauucac

SEQ ID NO: 2159300 - RNA, 14 nt, Homo sapiens
caagcacuguggaa

SEQ ID NO: 2159301 - RNA, 14 nt, Homo sapiens
cagacacuguaaaa

SEQ ID NO: 2159302 - RNA, 15 nt, Homo sapiens
cugugagguucugua

SEQ ID NO: 2159303 - RNA, 20 nt, Homo sapiens
cucaaaaauuuuagcagugu

SEQ ID NO: 2159304 - RNA, 16 nt, Homo sapiens
uauuaguuccccaaau

SEQ ID NO: 2159305 - RNA, 18 nt, Homo sapiens
agccaggaaguacuucca

SEQ ID NO: 2159306 - RNA, 16 nt, Homo sapiens
uccaggagagagccag

SEQ ID NO: 2159307 - RNA, 10 nt, Homo sapiens
ccaggggaug

SEQ ID NO: 2159308 - RNA, 20 nt, Homo sapiens
cacuggcuccucccagcaca

SEQ ID NO: 2159309 - RNA, 17 nt, Homo sapiens
gcaugaaaccacuggaa

SEQ ID NO: 2159310 - RNA, 13 nt, Homo sapiens
cuuuauugccaaa

SEQ ID NO: 2159311 - RNA, 15 nt, Homo sapiens
acuauacagccauaa

SEQ ID NO: 2159312 - RNA, 13 nt, Homo sapiens
uccauuuucaagc

SEQ ID NO: 2159313 - RNA, 13 nt, Homo sapiens
auuugucuuucaa

SEQ ID NO: 2159314 - RNA, 20 nt, Homo sapiens
aacauuauuagcacuucccg

SEQ ID NO: 2159315 - RNA, 19 nt, Homo sapiens
aacuugcugcugugccugc

SEQ ID NO: 2159316 - RNA, 20 nt, Homo sapiens
acuugaaagcauccaugugu

SEQ ID NO: 2159317 - RNA, 20 nt, Homo sapiens
ucucuaccuucaacaugugc

SEQ ID NO: 2159318 - RNA, 17 nt, Homo sapiens
ugcaaauugccugcaaa

SEQ ID NO: 2159319 - RNA, 17 nt, Homo sapiens
ugauugucagcuacuaa

SEQ ID NO: 2159320 - RNA, 13 nt, Homo sapiens
gguagauuauuca

SEQ ID NO: 2159321 - RNA, 15 nt, Homo sapiens
accggaacugggcug

SEQ ID NO: 2159322 - RNA, 15 nt, Homo sapiens
aggucugcuccugaa

SEQ ID NO: 2159323 - RNA, 20 nt, Homo sapiens
cucacacugggacuugcaaa

SEQ ID NO: 2159324 - RNA, 18 nt, Homo sapiens
ugcucaaucccugaggac

SEQ ID NO: 2159325 - RNA, 15 nt, Homo sapiens
aucuaagcagcuuau

SEQ ID NO: 2159326 - RNA, 13 nt, Homo sapiens
cccucuccaaagg

SEQ ID NO: 2159327 - RNA, 17 nt, Homo sapiens
gaauaaaaacuuugcag

SEQ ID NO: 2159328 - RNA, 22 nt, Homo sapiens
agauaaauauugagcagaucua

SEQ ID NO: 2159329 - RNA, 16 nt, Homo sapiens
acuugcugauccauga

SEQ ID NO: 2159330 - RNA, 14 nt, Homo sapiens
caaauaaaacccaa

SEQ ID NO: 2159331 - RNA, 11 nt, Homo sapiens
uguuucuugcu

SEQ ID NO: 2159332 - RNA, 21 nt, Homo sapiens
cugaaaagaaaugcuaaugua

SEQ ID NO: 2159333 - RNA, 21 nt, Homo sapiens
ggacuccucucguacuugaac

SEQ ID NO: 2159334 - RNA, 16 nt, Homo sapiens
augaucagccuugcaa

SEQ ID NO: 2159335 - RNA, 18 nt, Homo sapiens
auacauauuuuuauuuga

SEQ ID NO: 2159336 - RNA, 14 nt, Homo sapiens
aaacaaaacaaaac

SEQ ID NO: 2159337 - RNA, 16 nt, Homo sapiens
ugcaaaaaacucagag

SEQ ID NO: 2159338 - RNA, 10 nt, Homo sapiens
gcugcugaua

SEQ ID NO: 2159339 - RNA, 20 nt, Homo sapiens
acauuuggggggaacagcag

SEQ ID NO: 2159340 - RNA, 12 nt, Homo sapiens
uuucugugaaua

SEQ ID NO: 2159341 - RNA, 12 nt, Homo sapiens
gaagauguauca

SEQ ID NO: 2159342 - RNA, 13 nt, Homo sapiens
cagcagcccucaa

SEQ ID NO: 2159343 - RNA, 13 nt, Homo sapiens
caccagcccugaa

SEQ ID NO: 2159344 - RNA, 21 nt, Homo sapiens
ugaauguguccacaguugaga

SEQ ID NO: 2159345 - RNA, 13 nt, Homo sapiens
acauugcugauau

SEQ ID NO: 2159346 - RNA, 17 nt, Homo sapiens
cucauucugcaaugagc

SEQ ID NO: 2159347 - RNA, 15 nt, Homo sapiens
gaaucacgauuuucu

SEQ ID NO: 2159348 - RNA, 20 nt, Homo sapiens
gcagcuccccaaaccaggcc

SEQ ID NO: 2159349 - RNA, 20 nt, Homo sapiens
agcauuaacagcagguguga

SEQ ID NO: 2159350 - RNA, 14 nt, Homo sapiens
aucugaaaauguau

SEQ ID NO: 2159351 - RNA, 14 nt, Homo sapiens
cugggaaccuagca

SEQ ID NO: 2159352 - RNA, 21 nt, Homo sapiens
ucacucuauuaaaucuugcaa

SEQ ID NO: 2159353 - RNA, 22 nt, Homo sapiens
gccacugggcucuggaccucag

SEQ ID NO: 2159354 - RNA, 21 nt, Homo sapiens
uuccugaauaauuuccaaaug

SEQ ID NO: 2159355 - RNA, 16 nt, Homo sapiens
cugguuccacugcuac

SEQ ID NO: 2159356 - RNA, 19 nt, Homo sapiens
uaugugaaauggccaaagc

SEQ ID NO: 2159357 - RNA, 22 nt, Homo sapiens
acccucagacagacuuauacac

SEQ ID NO: 2159358 - RNA, 18 nt, Homo sapiens
auucaggguuauacacag

SEQ ID NO: 2159359 - RNA, 18 nt, Homo sapiens
aaggacagccaccaagaa

SEQ ID NO: 2159360 - RNA, 19 nt, Homo sapiens
acugugugaagaaauggaa

SEQ ID NO: 2159361 - RNA, 14 nt, Homo sapiens
aggugaaagcuaua

SEQ ID NO: 2159362 - RNA, 13 nt, Homo sapiens
uugucuguuuauu

SEQ ID NO: 2159363 - RNA, 22 nt, Homo sapiens
gaaauuaugaaaguuaauuuga

SEQ ID NO: 2159364 - RNA, 21 nt, Homo sapiens
cucauacccaggaagagcuga

SEQ ID NO: 2159365 - RNA, 22 nt, Homo sapiens
agugcuugccaccaccagauga

SEQ ID NO: 2159366 - RNA, 15 nt, Homo sapiens
agcguguuuuugcuc

SEQ ID NO: 2159367 - RNA, 16 nt, Homo sapiens
aaggagagggacugga

SEQ ID NO: 2159368 - RNA, 15 nt, Homo sapiens
ucgacucagccucag

SEQ ID NO: 2159369 - RNA, 16 nt, Homo sapiens
uaccagugaaccaaag

SEQ ID NO: 2159370 - RNA, 19 nt, Homo sapiens
gaagaaaaugaaugcugcu

SEQ ID NO: 2159371 - RNA, 12 nt, Homo sapiens
gugauuuugccu

SEQ ID NO: 2159372 - RNA, 11 nt, Homo sapiens
aacuggcuguu

SEQ ID NO: 2159373 - RNA, 14 nt, Homo sapiens
ugcaaucacugaaa

SEQ ID NO: 2159374 - RNA, 15 nt, Homo sapiens
ccacccaccuuugcc

SEQ ID NO: 2159375 - RNA, 17 nt, Homo sapiens
cgacauggagaccaucu

SEQ ID NO: 2159376 - RNA, 22 nt, Homo sapiens
cuauuauuuggagccugccaag

SEQ ID NO: 2159377 - RNA, 22 nt, Homo sapiens
agcagaaaguaagcauuuccag

SEQ ID NO: 2159378 - RNA, 19 nt, Homo sapiens
ucaucauaauaaauaucua

SEQ ID NO: 2159379 - RNA, 23 nt, Homo sapiens
aacaggguggcccccugugccag

SEQ ID NO: 2159380 - RNA, 16 nt, Homo sapiens
acacaaccauagccug

SEQ ID NO: 2159381 - RNA, 19 nt, Homo sapiens
cagacggcuccacuaggac

SEQ ID NO: 2159382 - RNA, 23 nt, Homo sapiens
uuguauauauauuuuguguauaa

SEQ ID NO: 2159383 - RNA, 15 nt, Homo sapiens
agcuucucauccugc

SEQ ID NO: 2159384 - RNA, 18 nt, Homo sapiens
cacccuccaccucucacg

SEQ ID NO: 2159385 - RNA, 17 nt, Homo sapiens
cacccaaagcauggacu

SEQ ID NO: 2159386 - RNA, 19 nt, Homo sapiens
cgcugcccacgucccgggc

SEQ ID NO: 2159387 - RNA, 22 nt, Homo sapiens
caauggcacuguugcaaacuca

SEQ ID NO: 2159388 - RNA, 14 nt, Homo sapiens
auggaauuacaugu

SEQ ID NO: 2159389 - RNA, 22 nt, Homo sapiens
acuauagagaaccaagugaccg

SEQ ID NO: 2159390 - RNA, 21 nt, Homo sapiens
uacaaugcacauuuacuguuu

SEQ ID NO: 2159391 - RNA, 21 nt, Homo sapiens
agucuggaaaacagaaaccau

SEQ ID NO: 2159392 - RNA, 18 nt, Homo sapiens
aaucuauaaacaaugaaa

SEQ ID NO: 2159393 - RNA, 22 nt, Homo sapiens
cucaggcaaagaaaaugaaaug

SEQ ID NO: 2159394 - RNA, 22 nt, Homo sapiens
uuucauuccuaacacagcaugu

SEQ ID NO: 2159395 - RNA, 21 nt, Homo sapiens
augaaacuagaaagcagagau

SEQ ID NO: 2159396 - RNA, 13 nt, Homo sapiens
cuuugaaacaugc

SEQ ID NO: 2159397 - RNA, 21 nt, Homo sapiens
uuauuucucuuucaucaaaac

SEQ ID NO: 2159398 - RNA, 14 nt, Homo sapiens
uguuacccauuuga

SEQ ID NO: 2159399 - RNA, 19 nt, Homo sapiens
uggugacaggugugagucu

SEQ ID NO: 2159400 - RNA, 18 nt, Homo sapiens
ccuuguaaccagugcaga

SEQ ID NO: 2159401 - RNA, 20 nt, Homo sapiens
aguugguguucauaauuuca

SEQ ID NO: 2159402 - RNA, 18 nt, Homo sapiens
uaucccauugaaacaaaa

SEQ ID NO: 2159403 - RNA, 16 nt, Homo sapiens
cucacuggugcauuua

SEQ ID NO: 2159404 - RNA, 14 nt, Homo sapiens
gcaaaaggcagcuc

SEQ ID NO: 2159405 - RNA, 15 nt, Homo sapiens
aguuccgacugccau

SEQ ID NO: 2159406 - RNA, 18 nt, Homo sapiens
gauuaaaaucucuugauu

SEQ ID NO: 2159407 - RNA, 15 nt, Homo sapiens
aaauacaaacauucu

SEQ ID NO: 2159408 - RNA, 14 nt, Homo sapiens
cuaauacuacugca

SEQ ID NO: 2159409 - RNA, 16 nt, Homo sapiens
gaagagaaaggacuca

SEQ ID NO: 2159410 - RNA, 23 nt, Homo sapiens
aauauuguucuauuuguauauau

SEQ ID NO: 2159411 - RNA, 21 nt, Homo sapiens
acaacaaaccuguuucugcag

SEQ ID NO: 2159412 - RNA, 12 nt, Homo sapiens
gaaugucucagc

SEQ ID NO: 2159413 - RNA, 14 nt, Homo sapiens
cagggccacugagu

SEQ ID NO: 2159414 - RNA, 19 nt, Homo sapiens
uacauacucaagagcauaa

SEQ ID NO: 2159415 - RNA, 22 nt, Homo sapiens
gcuccauuucuacaaugcacau

SEQ ID NO: 2159416 - RNA, 22 nt, Homo sapiens
cgcaugugucuguauucauaca

SEQ ID NO: 2159417 - RNA, 13 nt, Homo sapiens
agugcccuuccug

SEQ ID NO: 2159418 - RNA, 15 nt, Homo sapiens
ugccugaaaguaaua

SEQ ID NO: 2159419 - RNA, 15 nt, Homo sapiens
cccacauaccaucug

SEQ ID NO: 2159420 - RNA, 20 nt, Homo sapiens
uuuaaauaccaguacuugag

SEQ ID NO: 2159421 - RNA, 13 nt, Homo sapiens
accaguaccugaa

SEQ ID NO: 2159422 - RNA, 13 nt, Homo sapiens
cugccaggcacca

SEQ ID NO: 2159423 - RNA, 13 nt, Homo sapiens
caccaaggcugcc

SEQ ID NO: 2159424 - RNA, 15 nt, Homo sapiens
cagcuaugcuggaaa

SEQ ID NO: 2159425 - RNA, 15 nt, Homo sapiens
ugaaaagcuucuuaa

SEQ ID NO: 2159426 - RNA, 18 nt, Homo sapiens
acuguuucaguagccaau

SEQ ID NO: 2159427 - RNA, 13 nt, Homo sapiens
gcuaggagccagu

SEQ ID NO: 2159428 - RNA, 23 nt, Homo sapiens
ccagccagggcaacacagugaga

SEQ ID NO: 2159429 - RNA, 21 nt, Homo sapiens
auucucucucauuauugagau

SEQ ID NO: 2159430 - RNA, 22 nt, Homo sapiens
aaaauauugcugugucuucauu

SEQ ID NO: 2159431 - RNA, 12 nt, Homo sapiens
agauucagcucc

SEQ ID NO: 2159432 - RNA, 23 nt, Homo sapiens
ccugcccaguuggaggagacugg

SEQ ID NO: 2159433 - RNA, 21 nt, Homo sapiens
gccucauugaugucaaaaacu

SEQ ID NO: 2159434 - RNA, 17 nt, Homo sapiens
acccaagggagugucag

SEQ ID NO: 2159435 - RNA, 21 nt, Homo sapiens
gaggcgggucuauaacaggca

SEQ ID NO: 2159436 - RNA, 19 nt, Homo sapiens
ucggcuccgggcaaauggc

SEQ ID NO: 2159437 - RNA, 23 nt, Homo sapiens
gcaccuauggcccagccacugca

SEQ ID NO: 2159438 - RNA, 14 nt, Homo sapiens
aaacagaguauguc

SEQ ID NO: 2159439 - RNA, 22 nt, Homo sapiens
uaggcaaagauaauuuauuuca

SEQ ID NO: 2159440 - RNA, 15 nt, Homo sapiens
ccaggcacuuugcau

SEQ ID NO: 2159441 - RNA, 19 nt, Homo sapiens
cuccucauagugcugaaaa

SEQ ID NO: 2159442 - RNA, 13 nt, Homo sapiens
cugccaacugucc

SEQ ID NO: 2159443 - RNA, 15 nt, Homo sapiens
uaaauguguuccuuu

SEQ ID NO: 2159444 - RNA, 20 nt, Homo sapiens
accaaagacaucagucucca

SEQ ID NO: 2159445 - RNA, 19 nt, Homo sapiens
gaagcacguucacuagacu

SEQ ID NO: 2159446 - RNA, 14 nt, Homo sapiens
acuauuccauugac

SEQ ID NO: 2159447 - RNA, 15 nt, Homo sapiens
cggcucaacuccucc

SEQ ID NO: 2159448 - RNA, 19 nt, Homo sapiens
augcacagggcugcaacac

SEQ ID NO: 2159449 - RNA, 16 nt, Homo sapiens
ccaccugccugcaucu

SEQ ID NO: 2159450 - RNA, 17 nt, Homo sapiens
gaaccuugagcaaauua

SEQ ID NO: 2159451 - RNA, 13 nt, Homo sapiens
acuuucaguuuug

SEQ ID NO: 2159452 - RNA, 22 nt, Homo sapiens
cugggccaggagcccacagugc

SEQ ID NO: 2159453 - RNA, 20 nt, Homo sapiens
guaaucccagcuaccuggga

SEQ ID NO: 2159454 - RNA, 21 nt, Homo sapiens
aacauuugguugcuacugugu

SEQ ID NO: 2159455 - RNA, 18 nt, Homo sapiens
caccaucuucuauucaaa

SEQ ID NO: 2159456 - RNA, 22 nt, Homo sapiens
gaccucacugugaccuugacuu

SEQ ID NO: 2159457 - RNA, 11 nt, Homo sapiens
aaacagucaaa

SEQ ID NO: 2159458 - RNA, 11 nt, Homo sapiens
caucaguccau

SEQ ID NO: 2159459 - RNA, 22 nt, Homo sapiens
cagauauacuugguucucucca

SEQ ID NO: 2159460 - RNA, 15 nt, Homo sapiens
agcauguacuccccu

SEQ ID NO: 2159461 - RNA, 19 nt, Homo sapiens
ugcuacuggggaaacuggc

SEQ ID NO: 2159462 - RNA, 20 nt, Homo sapiens
ucugcucuaauugcugccag

SEQ ID NO: 2159463 - RNA, 16 nt, Homo sapiens
ugagcacccauuccaa

SEQ ID NO: 2159464 - RNA, 15 nt, Homo sapiens
aaaagaagacucuga

SEQ ID NO: 2159465 - RNA, 13 nt, Homo sapiens
uaguuccugauga

SEQ ID NO: 2159466 - RNA, 14 nt, Homo sapiens
cuuugcagugucuu

SEQ ID NO: 2159467 - RNA, 20 nt, Homo sapiens
gaauaacuuuagcuuuuaca

SEQ ID NO: 2159468 - RNA, 19 nt, Homo sapiens
cauugagccaguggugcua

SEQ ID NO: 2159469 - RNA, 19 nt, Homo sapiens
uacuaauugcccaaaaugu

SEQ ID NO: 2159470 - RNA, 22 nt, Homo sapiens
uacuaaccuacagagaugcuaa

SEQ ID NO: 2159471 - RNA, 18 nt, Homo sapiens
aaagugcauauuuaucca

SEQ ID NO: 2159472 - RNA, 18 nt, Homo sapiens
cuguaauauuuagcugua

SEQ ID NO: 2159473 - RNA, 23 nt, Homo sapiens
uggaaacaugggaaggugccacu

SEQ ID NO: 2159474 - RNA, 15 nt, Homo sapiens
gagggugacagccac

SEQ ID NO: 2159475 - RNA, 18 nt, Homo sapiens
cuguucccauaaccccua

SEQ ID NO: 2159476 - RNA, 19 nt, Homo sapiens
gucgucagcuggcacuguc

SEQ ID NO: 2159477 - RNA, 23 nt, Homo sapiens
cgggacauccucugcuaccaucu

SEQ ID NO: 2159478 - RNA, 15 nt, Homo sapiens
ugucaucaacauucu

SEQ ID NO: 2159479 - RNA, 19 nt, Homo sapiens
aguuuauacccguuucaca

SEQ ID NO: 2159480 - RNA, 19 nt, Homo sapiens
agccugcucuagugggaca

SEQ ID NO: 2159481 - RNA, 23 nt, Homo sapiens
ucugucaccaacugaaguggcua

SEQ ID NO: 2159482 - RNA, 21 nt, Homo sapiens
aucagauaaugccaccaaagg

SEQ ID NO: 2159483 - RNA, 22 nt, Homo sapiens
gacauaucaucuguggacugac

SEQ ID NO: 2159484 - RNA, 15 nt, Homo sapiens
cuguaagccaaagaa

SEQ ID NO: 2159485 - RNA, 18 nt, Homo sapiens
gcuaaugaacucuuucaa

SEQ ID NO: 2159486 - RNA, 22 nt, Homo sapiens
caguuucccacucugaagaucc

SEQ ID NO: 2159487 - RNA, 20 nt, Homo sapiens
cuccagaagggcagcuccac

SEQ ID NO: 2159488 - RNA, 17 nt, Homo sapiens
uuaaauauauuguacuc

SEQ ID NO: 2159489 - RNA, 18 nt, Homo sapiens
uguuaacccacugcaugc

SEQ ID NO: 2159490 - RNA, 18 nt, Homo sapiens
uugucucauuguuuucuu

SEQ ID NO: 2159491 - RNA, 15 nt, Homo sapiens
aaauuacaauuguca

SEQ ID NO: 2159492 - RNA, 15 nt, Homo sapiens
cugagauuacaggug

SEQ ID NO: 2159493 - RNA, 20 nt, Homo sapiens
guauaaacacaauccuuugu

SEQ ID NO: 2159494 - RNA, 24 nt, Homo sapiens
uuccuucggaauccagugcuucca

SEQ ID NO: 2159495 - RNA, 16 nt, Homo sapiens
augugugugcaagugu

SEQ ID NO: 2159496 - RNA, 14 nt, Homo sapiens
uugcuucucuccac

SEQ ID NO: 2159497 - RNA, 16 nt, Homo sapiens
caagaaauauugagua

SEQ ID NO: 2159498 - RNA, 23 nt, Homo sapiens
cuuuugaaaaauaaugacucuua

SEQ ID NO: 2159499 - RNA, 14 nt, Homo sapiens
uaaauagugugaug

SEQ ID NO: 2159500 - RNA, 23 nt, Homo sapiens
aggacaugaacagacacuuuuca

SEQ ID NO: 2159501 - RNA, 20 nt, Homo sapiens
ucacuuaccacuugcacuau

SEQ ID NO: 2159502 - RNA, 18 nt, Homo sapiens
caacuauucucaggccaa

SEQ ID NO: 2159503 - RNA, 13 nt, Homo sapiens
ucaaauacugugu

SEQ ID NO: 2159504 - RNA, 20 nt, Homo sapiens
ugaucaugaugaugaugauu

SEQ ID NO: 2159505 - RNA, 17 nt, Homo sapiens
ccuccaggcccagcuga

SEQ ID NO: 2159506 - RNA, 21 nt, Homo sapiens
aauugaccuuuagguauuaca

SEQ ID NO: 2159507 - RNA, 23 nt, Homo sapiens
ugcacaacucuccaaaacacuua

SEQ ID NO: 2159508 - RNA, 22 nt, Homo sapiens
caggaaccuccuccacaccagc

SEQ ID NO: 2159509 - RNA, 15 nt, Homo sapiens
augaaagcacugcau

SEQ ID NO: 2159510 - RNA, 19 nt, Homo sapiens
ugucccccuuuagaucucu

SEQ ID NO: 2159511 - RNA, 17 nt, Homo sapiens
acuuucucaaaauggaa

SEQ ID NO: 2159512 - RNA, 17 nt, Homo sapiens
aaagcuauauguuguaa

SEQ ID NO: 2159513 - RNA, 15 nt, Homo sapiens
caugcgcagucccca

SEQ ID NO: 2159514 - RNA, 17 nt, Homo sapiens
gugagacuccaucucaa

SEQ ID NO: 2159515 - RNA, 22 nt, Homo sapiens
aaacugacuuaaugcucuucaa

SEQ ID NO: 2159516 - RNA, 16 nt, Homo sapiens
cucgcugaaagcacua

SEQ ID NO: 2159517 - RNA, 23 nt, Homo sapiens
gcugauuugauaccauggcacug

SEQ ID NO: 2159518 - RNA, 21 nt, Homo sapiens
gugugcaugugugugcucagg

SEQ ID NO: 2159519 - RNA, 14 nt, Homo sapiens
ugcccuuuggccaa

SEQ ID NO: 2159520 - RNA, 19 nt, Homo sapiens
uaaaguuuguucacuuaaa

SEQ ID NO: 2159521 - RNA, 20 nt, Homo sapiens
aagggaguggccucauuuca

SEQ ID NO: 2159522 - RNA, 16 nt, Homo sapiens
gcuuucagagccuccu

SEQ ID NO: 2159523 - RNA, 20 nt, Homo sapiens
gucccggggccagcacuucc

SEQ ID NO: 2159524 - RNA, 13 nt, Homo sapiens
gauguaaugcauu

SEQ ID NO: 2159525 - RNA, 22 nt, Homo sapiens
aauaauacaucuuuaucauuaa

SEQ ID NO: 2159526 - RNA, 19 nt, Homo sapiens
gacuacauccugaguguga

SEQ ID NO: 2159527 - RNA, 20 nt, Homo sapiens
agaggucaaggcugcaguga

SEQ ID NO: 2159528 - RNA, 14 nt, Homo sapiens
agcacuuccauggg

SEQ ID NO: 2159529 - RNA, 16 nt, Homo sapiens
agccccgccgugucug

SEQ ID NO: 2159530 - RNA, 21 nt, Homo sapiens
ccuguacugucaggugcacuu

SEQ ID NO: 2159531 - RNA, 19 nt, Homo sapiens
gacugcaagcugcuugccc

SEQ ID NO: 2159532 - RNA, 14 nt, Homo sapiens
acucggauuccagc

SEQ ID NO: 2159533 - RNA, 19 nt, Homo sapiens
uucuccuaggagaagcagc

SEQ ID NO: 2159534 - RNA, 20 nt, Homo sapiens
uugauucucuccuacuguuu

SEQ ID NO: 2159535 - RNA, 18 nt, Homo sapiens
auuccaguggacccugga

SEQ ID NO: 2159536 - RNA, 15 nt, Homo sapiens
aaaggagccuugaua

SEQ ID NO: 2159537 - RNA, 23 nt, Homo sapiens
gccucagcucccacaagccucug

SEQ ID NO: 2159538 - RNA, 12 nt, Homo sapiens
uaacuacauuua

SEQ ID NO: 2159539 - RNA, 12 nt, Homo sapiens
uaaauacauuuc

SEQ ID NO: 2159540 - RNA, 19 nt, Homo sapiens
uuaaaagugacauuugucu

SEQ ID NO: 2159541 - RNA, 21 nt, Homo sapiens
gauccuugauaaaugccucau

SEQ ID NO: 2159542 - RNA, 14 nt, Homo sapiens
gccuauuguugaau

SEQ ID NO: 2159543 - RNA, 16 nt, Homo sapiens
aguagauucuuacaag

SEQ ID NO: 2159544 - RNA, 15 nt, Homo sapiens
gauuuaucacacaaa

SEQ ID NO: 2159545 - RNA, 12 nt, Homo sapiens
guuaccauucac

SEQ ID NO: 2159546 - RNA, 20 nt, Homo sapiens
cauuuuaagaagacaugaca

SEQ ID NO: 2159547 - RNA, 23 nt, Homo sapiens
auuuugcuagcuaugagcuuuua

SEQ ID NO: 2159548 - RNA, 17 nt, Homo sapiens
ugcccacuucuguguag

SEQ ID NO: 2159549 - RNA, 14 nt, Homo sapiens
cccgggcugccugg

SEQ ID NO: 2159550 - RNA, 19 nt, Homo sapiens
aacccuuugugugcucucc

SEQ ID NO: 2159551 - RNA, 16 nt, Homo sapiens
cucuacccugcucccu

SEQ ID NO: 2159552 - RNA, 15 nt, Homo sapiens
aagauucaccugaga

SEQ ID NO: 2159553 - RNA, 17 nt, Homo sapiens
uaccuuauuaacaaaau

SEQ ID NO: 2159554 - RNA, 15 nt, Homo sapiens
aggcccuagacucau

SEQ ID NO: 2159555 - RNA, 18 nt, Homo sapiens
ccauuucagcuugaccuc

SEQ ID NO: 2159556 - RNA, 23 nt, Homo sapiens
auguggcaacugcugaugcucau

SEQ ID NO: 2159557 - RNA, 16 nt, Homo sapiens
guuacaucacaguguu

SEQ ID NO: 2159558 - RNA, 17 nt, Homo sapiens
caguauaaucuuuucau

SEQ ID NO: 2159559 - RNA, 18 nt, Homo sapiens
auauucugguuacugugg

SEQ ID NO: 2159560 - RNA, 17 nt, Homo sapiens
accuuuuuuaagauuuu

SEQ ID NO: 2159561 - RNA, 18 nt, Homo sapiens
ugcuguagacauuugcua

SEQ ID NO: 2159562 - RNA, 16 nt, Homo sapiens
auggauagucugucca

SEQ ID NO: 2159563 - RNA, 17 nt, Homo sapiens
cugcauccagagauuca

SEQ ID NO: 2159564 - RNA, 16 nt, Homo sapiens
cuuagagcagauucua

SEQ ID NO: 2159565 - RNA, 19 nt, Homo sapiens
uuauucugauaaaaauaau

SEQ ID NO: 2159566 - RNA, 15 nt, Homo sapiens
cccuccauacagugu

SEQ ID NO: 2159567 - RNA, 16 nt, Homo sapiens
auccccagcugggaag

SEQ ID NO: 2159568 - RNA, 23 nt, Homo sapiens
ggagacccaugugcuuccuugcu

SEQ ID NO: 2159569 - RNA, 16 nt, Homo sapiens
uuuccuccccaggaau

SEQ ID NO: 2159570 - RNA, 20 nt, Homo sapiens
gcaaugcauuugauggccac

SEQ ID NO: 2159571 - RNA, 20 nt, Homo sapiens
ucuucccuuccuccauugca

SEQ ID NO: 2159572 - RNA, 17 nt, Homo sapiens
aguagaagaaaguaaac

SEQ ID NO: 2159573 - RNA, 22 nt, Homo sapiens
acagacugugaguacagcagaa

SEQ ID NO: 2159574 - RNA, 17 nt, Homo sapiens
gucagcccaugugcacc

SEQ ID NO: 2159575 - RNA, 19 nt, Homo sapiens
guacaaucuuucaccaagu

SEQ ID NO: 2159576 - RNA, 22 nt, Homo sapiens
agggugaucgcacaaccugcau

SEQ ID NO: 2159577 - RNA, 14 nt, Homo sapiens
uauaaagcuguuau

SEQ ID NO: 2159578 - RNA, 18 nt, Homo sapiens
ucuuugcucccugcaaga

SEQ ID NO: 2159579 - RNA, 21 nt, Homo sapiens
gcucauaagcaauaccagcaa

SEQ ID NO: 2159580 - RNA, 13 nt, Homo sapiens
acccugugcucaa

SEQ ID NO: 2159581 - RNA, 20 nt, Homo sapiens
aagguugugcccuccaccua

SEQ ID NO: 2159582 - RNA, 23 nt, Homo sapiens
ggaacuccagagaugagugucug

SEQ ID NO: 2159583 - RNA, 22 nt, Homo sapiens
cuuuauuuguaaaccauuguaa

SEQ ID NO: 2159584 - RNA, 22 nt, Homo sapiens
uacaagagaaacaaauaaacua

SEQ ID NO: 2159585 - RNA, 16 nt, Homo sapiens
uuuuuaacauugcuga

SEQ ID NO: 2159586 - RNA, 16 nt, Homo sapiens
guagucauuuugccca

SEQ ID NO: 2159587 - RNA, 14 nt, Homo sapiens
ucaugaggagauuc

SEQ ID NO: 2159588 - RNA, 20 nt, Homo sapiens
uauuagucgcacauguauug

SEQ ID NO: 2159589 - RNA, 16 nt, Homo sapiens
aaagcaaaagcucugu

SEQ ID NO: 2159590 - RNA, 18 nt, Homo sapiens
aacuugauggcuaacuua

SEQ ID NO: 2159591 - RNA, 13 nt, Homo sapiens
ucaguuggugcug

SEQ ID NO: 2159592 - RNA, 14 nt, Homo sapiens
agacccaucucucc

SEQ ID NO: 2159593 - RNA, 19 nt, Homo sapiens
aagacuaugaucucauccc

SEQ ID NO: 2159594 - RNA, 15 nt, Homo sapiens
agaucaucagucacc

SEQ ID NO: 2159595 - RNA, 23 nt, Homo sapiens
ggagacacaacuauuuuuccaaa

SEQ ID NO: 2159596 - RNA, 12 nt, Homo sapiens
cauaugccuugg

SEQ ID NO: 2159597 - RNA, 16 nt, Homo sapiens
uccaugugugugccaa

SEQ ID NO: 2159598 - RNA, 13 nt, Homo sapiens
acaccaggcugug

SEQ ID NO: 2159599 - RNA, 13 nt, Homo sapiens
uauugaacauucu

SEQ ID NO: 2159600 - RNA, 12 nt, Homo sapiens
agggaagacaca

SEQ ID NO: 2159601 - RNA, 15 nt, Homo sapiens
cacacagauaugcac

SEQ ID NO: 2159602 - RNA, 18 nt, Homo sapiens
cucccgacugaccacugg

SEQ ID NO: 2159603 - RNA, 15 nt, Homo sapiens
caauaaacuuagagg

SEQ ID NO: 2159604 - RNA, 14 nt, Homo sapiens
ugauuuaguacuug

SEQ ID NO: 2159605 - RNA, 21 nt, Homo sapiens
ugaagugccuuaaauauagca

SEQ ID NO: 2159606 - RNA, 21 nt, Homo sapiens
agcguguuuuugcuccugagg

SEQ ID NO: 2159607 - RNA, 15 nt, Homo sapiens
ugaaauucucagagu

SEQ ID NO: 2159608 - RNA, 20 nt, Homo sapiens
cagauucagugcaauccuua

SEQ ID NO: 2159609 - RNA, 16 nt, Homo sapiens
acaugauacuuauuca

SEQ ID NO: 2159610 - RNA, 18 nt, Homo sapiens
ugucaaugccugucuuag

SEQ ID NO: 2159611 - RNA, 16 nt, Homo sapiens
uuagcugaacaaugaa

SEQ ID NO: 2159612 - RNA, 17 nt, Homo sapiens
aaauugugauguggcua

SEQ ID NO: 2159613 - RNA, 20 nt, Homo sapiens
uaaaacaccucagcugccuc

SEQ ID NO: 2159614 - RNA, 11 nt, Homo sapiens
uuucaggagag

SEQ ID NO: 2159615 - RNA, 18 nt, Homo sapiens
aggcagaugccucuagaa

SEQ ID NO: 2159616 - RNA, 13 nt, Homo sapiens
agcugaaugugau

SEQ ID NO: 2159617 - RNA, 22 nt, Homo sapiens
cuugagugaucccaaaccaaac

SEQ ID NO: 2159618 - RNA, 15 nt, Homo sapiens
ugauauucaaccuca

SEQ ID NO: 2159619 - RNA, 14 nt, Homo sapiens
cugaagaaaaugag

SEQ ID NO: 2159620 - RNA, 15 nt, Homo sapiens
caggagaauugcuug

SEQ ID NO: 2159621 - RNA, 14 nt, Homo sapiens
ucacaguccugucc

SEQ ID NO: 2159622 - RNA, 19 nt, Homo sapiens
cuggaggggcuguccuccu

SEQ ID NO: 2159623 - RNA, 15 nt, Homo sapiens
gcuaucucucaguga

SEQ ID NO: 2159624 - RNA, 18 nt, Homo sapiens
ucuccuaggaucccccca

SEQ ID NO: 2159625 - RNA, 15 nt, Homo sapiens
gacuaaacuaccacc

SEQ ID NO: 2159626 - RNA, 19 nt, Homo sapiens
cuucuggccuccagccuuu

SEQ ID NO: 2159627 - RNA, 13 nt, Homo sapiens
uccccauggugca

SEQ ID NO: 2159628 - RNA, 16 nt, Homo sapiens
ugagaaagacaucuga

SEQ ID NO: 2159629 - RNA, 17 nt, Homo sapiens
gccaagaaacacugccu

SEQ ID NO: 2159630 - RNA, 16 nt, Homo sapiens
ccagcaguuguaaaau

SEQ ID NO: 2159631 - RNA, 22 nt, Homo sapiens
acagccggcugcggcacugugc

SEQ ID NO: 2159632 - RNA, 18 nt, Homo sapiens
acaaucggcugcauugaa

SEQ ID NO: 2159633 - RNA, 15 nt, Homo sapiens
auguuuuauuuugcc

SEQ ID NO: 2159634 - RNA, 15 nt, Homo sapiens
ccugacccaacaccc

SEQ ID NO: 2159635 - RNA, 19 nt, Homo sapiens
agccaagcaagaaguugaa

SEQ ID NO: 2159636 - RNA, 14 nt, Homo sapiens
uggaauaaacuguc

SEQ ID NO: 2159637 - RNA, 20 nt, Homo sapiens
aauuuuagugucauuuccau

SEQ ID NO: 2159638 - RNA, 16 nt, Homo sapiens
ggaagcaucucucgag

SEQ ID NO: 2159639 - RNA, 18 nt, Homo sapiens
cauaauguuacauuauua

SEQ ID NO: 2159640 - RNA, 12 nt, Homo sapiens
ucaccuugcuca

SEQ ID NO: 2159641 - RNA, 12 nt, Homo sapiens
cuauguguacag

SEQ ID NO: 2159642 - RNA, 18 nt, Homo sapiens
auagacuucccacucuag

SEQ ID NO: 2159643 - RNA, 22 nt, Homo sapiens
uaugcuacaaucugugucauau

SEQ ID NO: 2159644 - RNA, 23 nt, Homo sapiens
uguuuggaaauaaacugugcaau

SEQ ID NO: 2159645 - RNA, 11 nt, Homo sapiens
agccuuuccag

SEQ ID NO: 2159646 - RNA, 20 nt, Homo sapiens
aucuuugggaaagcuuacug

SEQ ID NO: 2159647 - RNA, 18 nt, Homo sapiens
ucuugcaacucuguaaau

SEQ ID NO: 2159648 - RNA, 22 nt, Homo sapiens
uaccuugaaaugcuuagacucu

SEQ ID NO: 2159649 - RNA, 15 nt, Homo sapiens
ggcuuugggcccaag

SEQ ID NO: 2159650 - RNA, 19 nt, Homo sapiens
cucaaacucuuaaaaccca

SEQ ID NO: 2159651 - RNA, 24 nt, Homo sapiens
guucugcuucaauaaaucuuugga

SEQ ID NO: 2159652 - RNA, 12 nt, Homo sapiens
caaauacaauca

SEQ ID NO: 2159653 - RNA, 20 nt, Homo sapiens
guuccccauguguguguaca

SEQ ID NO: 2159654 - RNA, 19 nt, Homo sapiens
ccaagguaaacaguuugaa

SEQ ID NO: 2159655 - RNA, 18 nt, Homo sapiens
aaugcaauccaugccaua

SEQ ID NO: 2159656 - RNA, 15 nt, Homo sapiens
ugcugaaacaacaaa

SEQ ID NO: 2159657 - RNA, 12 nt, Homo sapiens
caagauuuccac

SEQ ID NO: 2159658 - RNA, 15 nt, Homo sapiens
caaauagucuaucaa

SEQ ID NO: 2159659 - RNA, 13 nt, Homo sapiens
ucuaggaugugau

SEQ ID NO: 2159660 - RNA, 20 nt, Homo sapiens
uccugggugcugucaugccc

SEQ ID NO: 2159661 - RNA, 17 nt, Homo sapiens
agugcagaggcugagca

SEQ ID NO: 2159662 - RNA, 16 nt, Homo sapiens
ccuuauuguaccucuc

SEQ ID NO: 2159663 - RNA, 22 nt, Homo sapiens
gagcauuuccaacaccacagac

SEQ ID NO: 2159664 - RNA, 17 nt, Homo sapiens
guagauuuacauagaau

SEQ ID NO: 2159665 - RNA, 23 nt, Homo sapiens
uccugguuaaauuugaauuucag

SEQ ID NO: 2159666 - RNA, 14 nt, Homo sapiens
ugcccugacaugca

SEQ ID NO: 2159667 - RNA, 17 nt, Homo sapiens
uuauaacguguucaaua

SEQ ID NO: 2159668 - RNA, 23 nt, Homo sapiens
uacccuccuguaaaugguguaca

SEQ ID NO: 2159669 - RNA, 18 nt, Homo sapiens
aauauuugacaggcuuau

SEQ ID NO: 2159670 - RNA, 22 nt, Homo sapiens
ggcagcccugccaugucacaau

SEQ ID NO: 2159671 - RNA, 24 nt, Homo sapiens
ugguuccagaacgucucucaccua

SEQ ID NO: 2159672 - RNA, 22 nt, Homo sapiens
aaagccuucagaggguuuggac

SEQ ID NO: 2159673 - RNA, 14 nt, Homo sapiens
cuggagaguucaau

SEQ ID NO: 2159674 - RNA, 16 nt, Homo sapiens
uacauucauacuguag

SEQ ID NO: 2159675 - RNA, 20 nt, Homo sapiens
cagaugaaauuuauuuccau

SEQ ID NO: 2159676 - RNA, 17 nt, Homo sapiens
auguaagcauaacuuau

SEQ ID NO: 2159677 - RNA, 15 nt, Homo sapiens
aggauaugcccuccu

SEQ ID NO: 2159678 - RNA, 23 nt, Homo sapiens
cuaugcuggauaagaaauggugg

SEQ ID NO: 2159679 - RNA, 18 nt, Homo sapiens
guaaaucaggacaggugg

SEQ ID NO: 2159680 - RNA, 19 nt, Homo sapiens
ugagaccuuggcgcuacaa

SEQ ID NO: 2159681 - RNA, 23 nt, Homo sapiens
aauugacagaucaagcugugaga

SEQ ID NO: 2159682 - RNA, 15 nt, Homo sapiens
aaaacuaagcacaaa

SEQ ID NO: 2159683 - RNA, 21 nt, Homo sapiens
cuguguuauucuuugcgugua

SEQ ID NO: 2159684 - RNA, 22 nt, Homo sapiens
cuggggugggcccugucauucg

SEQ ID NO: 2159685 - RNA, 22 nt, Homo sapiens
ccuuggaggcccugcacugcca

SEQ ID NO: 2159686 - RNA, 18 nt, Homo sapiens
cugcccaaucugagcaaa

SEQ ID NO: 2159687 - RNA, 21 nt, Homo sapiens
caagcuuuugcuugauccaga

SEQ ID NO: 2159688 - RNA, 14 nt, Homo sapiens
cuucuaguuugcaa

SEQ ID NO: 2159689 - RNA, 19 nt, Homo sapiens
uugguuugcagaugacaaa

SEQ ID NO: 2159690 - RNA, 23 nt, Homo sapiens
gaacacuaaugaggaaacugcac

SEQ ID NO: 2159691 - RNA, 20 nt, Homo sapiens
ccaugggggcucagccaggu

SEQ ID NO: 2159692 - RNA, 13 nt, Homo sapiens
uuuccaaaccauc

SEQ ID NO: 2159693 - RNA, 12 nt, Homo sapiens
cuaugugcaacu

SEQ ID NO: 2159694 - RNA, 21 nt, Homo sapiens
cucauccccaccugucuucaa

SEQ ID NO: 2159695 - RNA, 17 nt, Homo sapiens
auguauacacacauaua

SEQ ID NO: 2159696 - RNA, 17 nt, Homo sapiens
cuccccuccaucccugg

SEQ ID NO: 2159697 - RNA, 17 nt, Homo sapiens
gucuuguguauuugucu

SEQ ID NO: 2159698 - RNA, 17 nt, Homo sapiens
guaaaacuauauucuca

SEQ ID NO: 2159699 - RNA, 19 nt, Homo sapiens
acaguaacuuuauguguaa

SEQ ID NO: 2159700 - RNA, 22 nt, Homo sapiens
ucagccacuacaacagaauuuu

SEQ ID NO: 2159701 - RNA, 16 nt, Homo sapiens
ucugucagaaucacau

SEQ ID NO: 2159702 - RNA, 15 nt, Homo sapiens
uuaccuaccacaugc

SEQ ID NO: 2159703 - RNA, 18 nt, Homo sapiens
uauuuuaaaaaacacuga

SEQ ID NO: 2159704 - RNA, 20 nt, Homo sapiens
cccugugcugacggaagcca

SEQ ID NO: 2159705 - RNA, 19 nt, Homo sapiens
aaaucugacaagacugaaa

SEQ ID NO: 2159706 - RNA, 14 nt, Homo sapiens
accauuccaaaguu

SEQ ID NO: 2159707 - RNA, 15 nt, Homo sapiens
auaugggguguuugu

SEQ ID NO: 2159708 - RNA, 14 nt, Homo sapiens
ucacaccucacugu

SEQ ID NO: 2159709 - RNA, 16 nt, Homo sapiens
cugaggacuuugccca

SEQ ID NO: 2159710 - RNA, 13 nt, Homo sapiens
uuaucaaaaguga

SEQ ID NO: 2159711 - RNA, 23 nt, Homo sapiens
acaaccuccuccuccaguucuga

SEQ ID NO: 2159712 - RNA, 21 nt, Homo sapiens
ugugucaaacaguacacuauc

SEQ ID NO: 2159713 - RNA, 17 nt, Homo sapiens
aacaacaauacaacaag

SEQ ID NO: 2159714 - RNA, 18 nt, Homo sapiens
aaacugguuuagcacaau

SEQ ID NO: 2159715 - RNA, 19 nt, Homo sapiens
agcaaaucccaacauuucu

SEQ ID NO: 2159716 - RNA, 21 nt, Homo sapiens
aaccuggagggcuagaaccua

SEQ ID NO: 2159717 - RNA, 19 nt, Homo sapiens
ucauauauccgaacuacug

SEQ ID NO: 2159718 - RNA, 15 nt, Homo sapiens
augugcaaaucugac

SEQ ID NO: 2159719 - RNA, 17 nt, Homo sapiens
caaguggcucaucauca

SEQ ID NO: 2159720 - RNA, 17 nt, Homo sapiens
aacuuguuacuaaagaa

SEQ ID NO: 2159721 - RNA, 16 nt, Homo sapiens
caaaauuacacaguua

SEQ ID NO: 2159722 - RNA, 22 nt, Homo sapiens
ccauuccaaaguucuuaucucu

SEQ ID NO: 2159723 - RNA, 15 nt, Homo sapiens
cuagcauuacauuau

SEQ ID NO: 2159724 - RNA, 22 nt, Homo sapiens
auuuuacccugaggucacugcu

SEQ ID NO: 2159725 - RNA, 19 nt, Homo sapiens
gaugugccgauccuuguca

SEQ ID NO: 2159726 - RNA, 12 nt, Homo sapiens
guuuaacuuaau

SEQ ID NO: 2159727 - RNA, 22 nt, Homo sapiens
gauucaggagaguguauaugaa

SEQ ID NO: 2159728 - RNA, 15 nt, Homo sapiens
uuaguuacaaaguua

SEQ ID NO: 2159729 - RNA, 19 nt, Homo sapiens
agcuguaaucccagcacuu

SEQ ID NO: 2159730 - RNA, 22 nt, Homo sapiens
ccugugacgcacagcacuccug

SEQ ID NO: 2159731 - RNA, 15 nt, Homo sapiens
gagagugagacucag

SEQ ID NO: 2159732 - RNA, 13 nt, Homo sapiens
uucaguguucuga

SEQ ID NO: 2159733 - RNA, 14 nt, Homo sapiens
ggugggaggggcca

SEQ ID NO: 2159734 - RNA, 15 nt, Homo sapiens
ccucuuaaaucauag

SEQ ID NO: 2159735 - RNA, 22 nt, Homo sapiens
agggaggcggccuccaugcacu

SEQ ID NO: 2159736 - RNA, 18 nt, Homo sapiens
ucccaacuccauucucuu

SEQ ID NO: 2159737 - RNA, 17 nt, Homo sapiens
auucagaaaacuucaag

SEQ ID NO: 2159738 - RNA, 18 nt, Homo sapiens
gaagcagccagcucccca

SEQ ID NO: 2159739 - RNA, 13 nt, Homo sapiens
gcaucgagccacc

SEQ ID NO: 2159740 - RNA, 18 nt, Homo sapiens
cugguuguuaugugauca

SEQ ID NO: 2159741 - RNA, 23 nt, Homo sapiens
aaagagaaacuuugugcuacaug

SEQ ID NO: 2159742 - RNA, 21 nt, Homo sapiens
uauuaagucauuguuucccau

SEQ ID NO: 2159743 - RNA, 14 nt, Homo sapiens
guuuguccugagau

SEQ ID NO: 2159744 - RNA, 16 nt, Homo sapiens
cccaccauagggcaug

SEQ ID NO: 2159745 - RNA, 12 nt, Homo sapiens
uggcucuugcaa

SEQ ID NO: 2159746 - RNA, 21 nt, Homo sapiens
ccacaguuguguucaugcuga

SEQ ID NO: 2159747 - RNA, 21 nt, Homo sapiens
ucagcgucucuuccaccugcu

SEQ ID NO: 2159748 - RNA, 18 nt, Homo sapiens
auucuuaauagguucaaa

SEQ ID NO: 2159749 - RNA, 18 nt, Homo sapiens
gguaguuagccaucuaau

SEQ ID NO: 2159750 - RNA, 13 nt, Homo sapiens
gccccuacugcug

SEQ ID NO: 2159751 - RNA, 16 nt, Homo sapiens
auuguaggugcaagau

SEQ ID NO: 2159752 - RNA, 16 nt, Homo sapiens
aaagaaaaaagcacca

SEQ ID NO: 2159753 - RNA, 20 nt, Homo sapiens
cucuccacugcuggacauga

SEQ ID NO: 2159754 - RNA, 16 nt, Homo sapiens
acuccauuauuccucu

SEQ ID NO: 2159755 - RNA, 15 nt, Homo sapiens
cuccugcaggugucu

SEQ ID NO: 2159756 - RNA, 18 nt, Homo sapiens
ugaaagcgacuucagguc

SEQ ID NO: 2159757 - RNA, 18 nt, Homo sapiens
agccgccaguacuuguca

SEQ ID NO: 2159758 - RNA, 20 nt, Homo sapiens
ugaagaacucaugugauuua

SEQ ID NO: 2159759 - RNA, 18 nt, Homo sapiens
cagcaucuguccucauca

SEQ ID NO: 2159760 - RNA, 15 nt, Homo sapiens
accugauuugaugau

SEQ ID NO: 2159761 - RNA, 19 nt, Homo sapiens
gcaguagaaauaauaugca

SEQ ID NO: 2159762 - RNA, 19 nt, Homo sapiens
auuggccucaguguaguua

SEQ ID NO: 2159763 - RNA, 13 nt, Homo sapiens
gaccagagaucga

SEQ ID NO: 2159764 - RNA, 17 nt, Homo sapiens
uaauuuugucagauuca

SEQ ID NO: 2159765 - RNA, 18 nt, Homo sapiens
uaccuuuugugguucuca

SEQ ID NO: 2159766 - RNA, 12 nt, Homo sapiens
cccuuccagugg

SEQ ID NO: 2159767 - RNA, 21 nt, Homo sapiens
ugggaagggaucccuuuguau

SEQ ID NO: 2159768 - RNA, 18 nt, Homo sapiens
cuuuuacauacagugaua

SEQ ID NO: 2159769 - RNA, 23 nt, Homo sapiens
agcacugcuguguccgcuuucau

SEQ ID NO: 2159770 - RNA, 13 nt, Homo sapiens
cauguccagugag

SEQ ID NO: 2159771 - RNA, 20 nt, Homo sapiens
aggcccugcaccuuccccaa

SEQ ID NO: 2159772 - RNA, 13 nt, Homo sapiens
cuugaccauucuc

SEQ ID NO: 2159773 - RNA, 14 nt, Homo sapiens
uggccggcugguug

SEQ ID NO: 2159774 - RNA, 21 nt, Homo sapiens
guaacaagagugauucuugcu

SEQ ID NO: 2159775 - RNA, 22 nt, Homo sapiens
agcuucgucagcuccagcguuu

SEQ ID NO: 2159776 - RNA, 24 nt, Homo sapiens
cagccugcccucuucauuuagcca

SEQ ID NO: 2159777 - RNA, 15 nt, Homo sapiens
augauucucaagauc

SEQ ID NO: 2159778 - RNA, 14 nt, Homo sapiens
ucuggacauuucau

SEQ ID NO: 2159779 - RNA, 21 nt, Homo sapiens
ugauaaagcuuaacacuugac

SEQ ID NO: 2159780 - RNA, 19 nt, Homo sapiens
gccaggagcuucucugaug

SEQ ID NO: 2159781 - RNA, 13 nt, Homo sapiens
ugucuacauucag

SEQ ID NO: 2159782 - RNA, 19 nt, Homo sapiens
acggugaaaccccaucucu

SEQ ID NO: 2159783 - RNA, 22 nt, Homo sapiens
uuugaaagagaaauauaauucc

SEQ ID NO: 2159784 - RNA, 20 nt, Homo sapiens
caaguuuaaaagccauguau

SEQ ID NO: 2159785 - RNA, 16 nt, Homo sapiens
ucuguucugccuuccg

SEQ ID NO: 2159786 - RNA, 15 nt, Homo sapiens
agcccgggugugccu

SEQ ID NO: 2159787 - RNA, 11 nt, Homo sapiens
cuuugaaauga

SEQ ID NO: 2159788 - RNA, 19 nt, Homo sapiens
ugcucacagggacucucca

SEQ ID NO: 2159789 - RNA, 15 nt, Homo sapiens
augcugcuguuuaca

SEQ ID NO: 2159790 - RNA, 13 nt, Homo sapiens
gcuggacugagga

SEQ ID NO: 2159791 - RNA, 15 nt, Homo sapiens
agauccccagcuuuc

SEQ ID NO: 2159792 - RNA, 15 nt, Homo sapiens
agaaucucagcacuu

SEQ ID NO: 2159793 - RNA, 15 nt, Homo sapiens
cguuuagaccaagga

SEQ ID NO: 2159794 - RNA, 15 nt, Homo sapiens
gcugggacacugugu

SEQ ID NO: 2159795 - RNA, 17 nt, Homo sapiens
ucuauucuuuccaugac

SEQ ID NO: 2159796 - RNA, 19 nt, Homo sapiens
agaaacugcucuaauauca

SEQ ID NO: 2159797 - RNA, 12 nt, Homo sapiens
ugcuuacaggaa

SEQ ID NO: 2159798 - RNA, 18 nt, Homo sapiens
uauuuguaaaucugccac

SEQ ID NO: 2159799 - RNA, 22 nt, Homo sapiens
ucacaccugggcaaacuuucuu

SEQ ID NO: 2159800 - RNA, 15 nt, Homo sapiens
acccccugccaaugg

SEQ ID NO: 2159801 - RNA, 16 nt, Homo sapiens
auuauaacauccacaa

SEQ ID NO: 2159802 - RNA, 20 nt, Homo sapiens
auguaguuuuuauauguugu

SEQ ID NO: 2159803 - RNA, 16 nt, Homo sapiens
ccaguguggaaccacu

SEQ ID NO: 2159804 - RNA, 18 nt, Homo sapiens
gcaauaauuaacugcuuc

SEQ ID NO: 2159805 - RNA, 22 nt, Homo sapiens
uucauaucuggagaagacuauu

SEQ ID NO: 2159806 - RNA, 20 nt, Homo sapiens
ugucacaccagccauacuua

SEQ ID NO: 2159807 - RNA, 16 nt, Homo sapiens
cuguuccaccagagca

SEQ ID NO: 2159808 - RNA, 21 nt, Homo sapiens
aaaucaacagaagcauuugua

SEQ ID NO: 2159809 - RNA, 14 nt, Homo sapiens
ucuucuuacuguau

SEQ ID NO: 2159810 - RNA, 12 nt, Homo sapiens
auaaagauucca

SEQ ID NO: 2159811 - RNA, 23 nt, Homo sapiens
caggaaagacuggcccucuagcu

SEQ ID NO: 2159812 - RNA, 19 nt, Homo sapiens
aaccacccuaucaucaguu

SEQ ID NO: 2159813 - RNA, 20 nt, Homo sapiens
ucucuauuaaaauacaaaaa

SEQ ID NO: 2159814 - RNA, 22 nt, Homo sapiens
uacuuuuggccucaucucugcc

SEQ ID NO: 2159815 - RNA, 18 nt, Homo sapiens
auugccacaaguccagcu

SEQ ID NO: 2159816 - RNA, 11 nt, Homo sapiens
agcaacuguga

SEQ ID NO: 2159817 - RNA, 22 nt, Homo sapiens
acucuauuuuuguaaaaaggga

SEQ ID NO: 2159818 - RNA, 16 nt, Homo sapiens
gguguggccugcacug

SEQ ID NO: 2159819 - RNA, 22 nt, Homo sapiens
cauuuugagcugaaaugcugca

SEQ ID NO: 2159820 - RNA, 15 nt, Homo sapiens
cucuuccuccaggga

SEQ ID NO: 2159821 - RNA, 18 nt, Homo sapiens
cacaaaccuuacuaugga

SEQ ID NO: 2159822 - RNA, 13 nt, Homo sapiens
guuagucucugaa

SEQ ID NO: 2159823 - RNA, 22 nt, Homo sapiens
acaaaauuaucaugacaaauau

SEQ ID NO: 2159824 - RNA, 12 nt, Homo sapiens
aagcauuuugga

SEQ ID NO: 2159825 - RNA, 20 nt, Homo sapiens
uucaagugccuagacuguua

SEQ ID NO: 2159826 - RNA, 16 nt, Homo sapiens
cugguggugcugcacc

SEQ ID NO: 2159827 - RNA, 18 nt, Homo sapiens
gaaaacaccccucagcca

SEQ ID NO: 2159828 - RNA, 15 nt, Homo sapiens
auguaacuuguugca

SEQ ID NO: 2159829 - RNA, 22 nt, Homo sapiens
agccucuugacgcuggaagugu

SEQ ID NO: 2159830 - RNA, 22 nt, Homo sapiens
aggugcgcaguggcauguccac

SEQ ID NO: 2159831 - RNA, 14 nt, Homo sapiens
aacucaggugauuc

SEQ ID NO: 2159832 - RNA, 21 nt, Homo sapiens
agcauaaccccacccuuuaca

SEQ ID NO: 2159833 - RNA, 22 nt, Homo sapiens
ugugugacuuacagaaacugca

SEQ ID NO: 2159834 - RNA, 22 nt, Homo sapiens
guaacauuuugacaacugaaag

SEQ ID NO: 2159835 - RNA, 15 nt, Homo sapiens
ccaaggaccugccuc

SEQ ID NO: 2159836 - RNA, 14 nt, Homo sapiens
acaacugugugauu

SEQ ID NO: 2159837 - RNA, 18 nt, Homo sapiens
augccagcuuaucucagg

SEQ ID NO: 2159838 - RNA, 19 nt, Homo sapiens
cacaggcagccagugcccu

SEQ ID NO: 2159839 - RNA, 20 nt, Homo sapiens
gccugagaccaggguggcca

SEQ ID NO: 2159840 - RNA, 15 nt, Homo sapiens
uaaguacacaauaag

SEQ ID NO: 2159841 - RNA, 13 nt, Homo sapiens
uccuauccauucu

SEQ ID NO: 2159842 - RNA, 13 nt, Homo sapiens
cagauuuguaaca

SEQ ID NO: 2159843 - RNA, 17 nt, Homo sapiens
uugucaccccaagccau

SEQ ID NO: 2159844 - RNA, 15 nt, Homo sapiens
accaaaugagcauua

SEQ ID NO: 2159845 - RNA, 15 nt, Homo sapiens
cuuacuguacaugaa

SEQ ID NO: 2159846 - RNA, 19 nt, Homo sapiens
cgagcaugggggcugccag

SEQ ID NO: 2159847 - RNA, 19 nt, Homo sapiens
ugucaauugcaccaaaaga

SEQ ID NO: 2159848 - RNA, 17 nt, Homo sapiens
ccaggcugcggugggca

SEQ ID NO: 2159849 - RNA, 18 nt, Homo sapiens
acagaccggagaggacag

SEQ ID NO: 2159850 - RNA, 21 nt, Homo sapiens
accaggacucugccccuucug

SEQ ID NO: 2159851 - RNA, 14 nt, Homo sapiens
cucuuucuuuacaa

SEQ ID NO: 2159852 - RNA, 18 nt, Homo sapiens
uuugaaaaaaguacauau

SEQ ID NO: 2159853 - RNA, 14 nt, Homo sapiens
gcuacuugcuuuga

SEQ ID NO: 2159854 - RNA, 13 nt, Homo sapiens
uauuuuuugccau

SEQ ID NO: 2159855 - RNA, 18 nt, Homo sapiens
aaaucaguuaauggcuca

SEQ ID NO: 2159856 - RNA, 20 nt, Homo sapiens
aacaaacucuacuauccaau

SEQ ID NO: 2159857 - RNA, 14 nt, Homo sapiens
accuucuaccucuu

SEQ ID NO: 2159858 - RNA, 18 nt, Homo sapiens
aaccagccacaguacaua

SEQ ID NO: 2159859 - RNA, 23 nt, Homo sapiens
ucacgacgaaaagacaagacucu

SEQ ID NO: 2159860 - RNA, 21 nt, Homo sapiens
accauucguacauaauacuga

SEQ ID NO: 2159861 - RNA, 19 nt, Homo sapiens
ccaauaccguguggcccaa

SEQ ID NO: 2159862 - RNA, 22 nt, Homo sapiens
acagggaacucagaauacagac

SEQ ID NO: 2159863 - RNA, 20 nt, Homo sapiens
cagaauuugauuuugaacuu

SEQ ID NO: 2159864 - RNA, 17 nt, Homo sapiens
aaaucuagaagacuguc

SEQ ID NO: 2159865 - RNA, 14 nt, Homo sapiens
ccgcagaagcagac

SEQ ID NO: 2159866 - RNA, 22 nt, Homo sapiens
gacuauggagugcaccaaagag

SEQ ID NO: 2159867 - RNA, 17 nt, Homo sapiens
gccacaucacuacagua

SEQ ID NO: 2159868 - RNA, 22 nt, Homo sapiens
aaaauugagaccugagugaaga

SEQ ID NO: 2159869 - RNA, 22 nt, Homo sapiens
gaaccuguccuugcacacuccc

SEQ ID NO: 2159870 - RNA, 21 nt, Homo sapiens
ggcuuaucagaacuccuuucu

SEQ ID NO: 2159871 - RNA, 16 nt, Homo sapiens
agagacugucccugaa

SEQ ID NO: 2159872 - RNA, 23 nt, Homo sapiens
cacgcugcccaggcucugcugac

SEQ ID NO: 2159873 - RNA, 13 nt, Homo sapiens
gaaccauuucacc

SEQ ID NO: 2159874 - RNA, 14 nt, Homo sapiens
aauuuaaacucuga

SEQ ID NO: 2159875 - RNA, 12 nt, Homo sapiens
uaugccaugugc

SEQ ID NO: 2159876 - RNA, 22 nt, Homo sapiens
cauguugccucaccagcccuga

SEQ ID NO: 2159877 - RNA, 12 nt, Homo sapiens
auccccuguggg

SEQ ID NO: 2159878 - RNA, 18 nt, Homo sapiens
ccagauaacucucuuucc

SEQ ID NO: 2159879 - RNA, 11 nt, Homo sapiens
uuuaguucucc

SEQ ID NO: 2159880 - RNA, 14 nt, Homo sapiens
ggccaacuaggcag

SEQ ID NO: 2159881 - RNA, 20 nt, Homo sapiens
uaugugaaaggaaaugcacc

SEQ ID NO: 2159882 - RNA, 12 nt, Homo sapiens
uuugaugcuugu

SEQ ID NO: 2159883 - RNA, 19 nt, Homo sapiens
uagcccugccucaagcuau

SEQ ID NO: 2159884 - RNA, 16 nt, Homo sapiens
ucuaugucagcaguau

SEQ ID NO: 2159885 - RNA, 17 nt, Homo sapiens
agguuggauccaaggag

SEQ ID NO: 2159886 - RNA, 19 nt, Homo sapiens
aagcaacuuuacugagaca

SEQ ID NO: 2159887 - RNA, 16 nt, Homo sapiens
gugcagacagugucag

SEQ ID NO: 2159888 - RNA, 15 nt, Homo sapiens
gaaacuuggacauuu

SEQ ID NO: 2159889 - RNA, 12 nt, Homo sapiens
ucauacuuucca

SEQ ID NO: 2159890 - RNA, 19 nt, Homo sapiens
gaucauagcucauugcaag

SEQ ID NO: 2159891 - RNA, 18 nt, Homo sapiens
ugaaaggcaugugaaggg

SEQ ID NO: 2159892 - RNA, 22 nt, Homo sapiens
ugaaauuccaguuuaggagcuc

SEQ ID NO: 2159893 - RNA, 22 nt, Homo sapiens
uauggaaauaccaggaccaguu

SEQ ID NO: 2159894 - RNA, 14 nt, Homo sapiens
gaguaaaacuguau

SEQ ID NO: 2159895 - RNA, 14 nt, Homo sapiens
ccaucaccagacag

SEQ ID NO: 2159896 - RNA, 22 nt, Homo sapiens
cugggaacugguucaagagaca

SEQ ID NO: 2159897 - RNA, 14 nt, Homo sapiens
uuuuuaauuaacca

SEQ ID NO: 2159898 - RNA, 10 nt, Homo sapiens
aggggccaga

SEQ ID NO: 2159899 - RNA, 15 nt, Homo sapiens
agggacccauuccug

SEQ ID NO: 2159900 - RNA, 15 nt, Homo sapiens
aaauaagggcuuuaa

SEQ ID NO: 2159901 - RNA, 18 nt, Homo sapiens
ugacccuugugucucaua

SEQ ID NO: 2159902 - RNA, 22 nt, Homo sapiens
gcugcuugacuaucacauacaa

SEQ ID NO: 2159903 - RNA, 21 nt, Homo sapiens
uuuaauguugcccacauuaag

SEQ ID NO: 2159904 - RNA, 19 nt, Homo sapiens
ugcaugauccagcugugug

SEQ ID NO: 2159905 - RNA, 19 nt, Homo sapiens
acuuguagucuccaugcaa

SEQ ID NO: 2159906 - RNA, 19 nt, Homo sapiens
uauauuugcagauaauucu

SEQ ID NO: 2159907 - RNA, 11 nt, Homo sapiens
guuacuaaagg

SEQ ID NO: 2159908 - RNA, 16 nt, Homo sapiens
ucaaaggcacacagca

SEQ ID NO: 2159909 - RNA, 13 nt, Homo sapiens
aaccuugaggaaa

SEQ ID NO: 2159910 - RNA, 13 nt, Homo sapiens
uucaaaagcaauc

SEQ ID NO: 2159911 - RNA, 20 nt, Homo sapiens
acgucccgggcacugucaug

SEQ ID NO: 2159912 - RNA, 16 nt, Homo sapiens
cauguauuuguuugca

SEQ ID NO: 2159913 - RNA, 18 nt, Homo sapiens
ugucucaaaacaaacaaa

SEQ ID NO: 2159914 - RNA, 12 nt, Homo sapiens
gugcaacugaca

SEQ ID NO: 2159915 - RNA, 22 nt, Homo sapiens
uggagcaggcccaaugcugcuu

SEQ ID NO: 2159916 - RNA, 19 nt, Homo sapiens
auauuucacccaucucuca

SEQ ID NO: 2159917 - RNA, 13 nt, Homo sapiens
ucccucagcggag

SEQ ID NO: 2159918 - RNA, 22 nt, Homo sapiens
gcuguuuccagugguaugaccu

SEQ ID NO: 2159919 - RNA, 14 nt, Homo sapiens
acagcgguuguaaa

SEQ ID NO: 2159920 - RNA, 20 nt, Homo sapiens
uuuucagacugugcaauacu

SEQ ID NO: 2159921 - RNA, 14 nt, Homo sapiens
ugguacuuccucug

SEQ ID NO: 2159922 - RNA, 17 nt, Homo sapiens
auggacaacucaaugaa

SEQ ID NO: 2159923 - RNA, 12 nt, Homo sapiens
guuaaacugaga

SEQ ID NO: 2159924 - RNA, 21 nt, Homo sapiens
gaguuaguggauuacugccau

SEQ ID NO: 2159925 - RNA, 15 nt, Homo sapiens
ugucaugugucuguu

SEQ ID NO: 2159926 - RNA, 14 nt, Homo sapiens
cagagccugaguca

SEQ ID NO: 2159927 - RNA, 21 nt, Homo sapiens
acuuaauuaccuaagagccac

SEQ ID NO: 2159928 - RNA, 14 nt, Homo sapiens
gucuuccuucugcc

SEQ ID NO: 2159929 - RNA, 16 nt, Homo sapiens
cagagugaagcaucaa

SEQ ID NO: 2159930 - RNA, 15 nt, Homo sapiens
aggugaugugugagu

SEQ ID NO: 2159931 - RNA, 11 nt, Homo sapiens
gcuuucuuaua

SEQ ID NO: 2159932 - RNA, 18 nt, Homo sapiens
uuucucgccucacuuucc

SEQ ID NO: 2159933 - RNA, 18 nt, Homo sapiens
auaacuauuacaguguug

SEQ ID NO: 2159934 - RNA, 17 nt, Homo sapiens
uaaagacaacaaaagaa

SEQ ID NO: 2159935 - RNA, 13 nt, Homo sapiens
cuuucccuugugu

SEQ ID NO: 2159936 - RNA, 21 nt, Homo sapiens
ggaugguucucagaaccauuu

SEQ ID NO: 2159937 - RNA, 20 nt, Homo sapiens
ucacuccauuccuaggucac

SEQ ID NO: 2159938 - RNA, 16 nt, Homo sapiens
uaugguaaaauuuugu

SEQ ID NO: 2159939 - RNA, 23 nt, Homo sapiens
caguauuucuggagggcaauuug

SEQ ID NO: 2159940 - RNA, 19 nt, Homo sapiens
caggcugagugcaggccca

SEQ ID NO: 2159941 - RNA, 23 nt, Homo sapiens
ugugcugaaauaauuacugguaa

SEQ ID NO: 2159942 - RNA, 19 nt, Homo sapiens
uuggaaauauucuaugacc

SEQ ID NO: 2159943 - RNA, 18 nt, Homo sapiens
cuguaccucaucccauga

SEQ ID NO: 2159944 - RNA, 17 nt, Homo sapiens
ugacuagaacaacuuga

SEQ ID NO: 2159945 - RNA, 20 nt, Homo sapiens
ucccagccuggccaccagcu

SEQ ID NO: 2159946 - RNA, 17 nt, Homo sapiens
auaacaccagugggaau

SEQ ID NO: 2159947 - RNA, 18 nt, Homo sapiens
aaaaucauaggcacuuag

SEQ ID NO: 2159948 - RNA, 21 nt, Homo sapiens
acagucaucuagaauucacug

SEQ ID NO: 2159949 - RNA, 13 nt, Homo sapiens
auauuugugaaaa

SEQ ID NO: 2159950 - RNA, 21 nt, Homo sapiens
cauaauguuucuggauuucau

SEQ ID NO: 2159951 - RNA, 17 nt, Homo sapiens
accauguuagccuuaga

SEQ ID NO: 2159952 - RNA, 16 nt, Homo sapiens
gacagaaagaucuuca

SEQ ID NO: 2159953 - RNA, 14 nt, Homo sapiens
acaccacagaagcu

SEQ ID NO: 2159954 - RNA, 10 nt, Homo sapiens
guuguucauu

SEQ ID NO: 2159955 - RNA, 14 nt, Homo sapiens
uggcaggugccuug

SEQ ID NO: 2159956 - RNA, 22 nt, Homo sapiens
aggaguuacagggaaguggucu

SEQ ID NO: 2159957 - RNA, 22 nt, Homo sapiens
aggcagagcccgguacagggcc

SEQ ID NO: 2159958 - RNA, 23 nt, Homo sapiens
ccagcccauugcugccaaggugg

SEQ ID NO: 2159959 - RNA, 15 nt, Homo sapiens
cucuaccuucaaaua

SEQ ID NO: 2159960 - RNA, 22 nt, Homo sapiens
uguacauuccugauacugggua

SEQ ID NO: 2159961 - RNA, 14 nt, Homo sapiens
uguggaugauguug

SEQ ID NO: 2159962 - RNA, 16 nt, Homo sapiens
cccccaacagaacucc

SEQ ID NO: 2159963 - RNA, 17 nt, Homo sapiens
gaggcaggcggaucaug

SEQ ID NO: 2159964 - RNA, 23 nt, Homo sapiens
cuucaaauugucuuuugucaugu

SEQ ID NO: 2159965 - RNA, 17 nt, Homo sapiens
cggagccuccagcugcc

SEQ ID NO: 2159966 - RNA, 21 nt, Homo sapiens
auuauaccaccagacugcaau

SEQ ID NO: 2159967 - RNA, 13 nt, Homo sapiens
uccaaaagcacau

SEQ ID NO: 2159968 - RNA, 17 nt, Homo sapiens
uaccacaucacaccacu

SEQ ID NO: 2159969 - RNA, 13 nt, Homo sapiens
agcagucuugcuc

SEQ ID NO: 2159970 - RNA, 17 nt, Homo sapiens
aguaaaggccaugugaa

SEQ ID NO: 2159971 - RNA, 12 nt, Homo sapiens
uccguacauuca

SEQ ID NO: 2159972 - RNA, 19 nt, Homo sapiens
uaccaagaacagagucuca

SEQ ID NO: 2159973 - RNA, 18 nt, Homo sapiens
uaaaaaguuaaucuucau

SEQ ID NO: 2159974 - RNA, 17 nt, Homo sapiens
caggguugaaucuuguc

SEQ ID NO: 2159975 - RNA, 16 nt, Homo sapiens
ccaggcccugcuuacc

SEQ ID NO: 2159976 - RNA, 17 nt, Homo sapiens
uucucagacacugccga

SEQ ID NO: 2159977 - RNA, 22 nt, Homo sapiens
aggccccucuccuccguggcac

SEQ ID NO: 2159978 - RNA, 12 nt, Homo sapiens
ggggccaccauc

SEQ ID NO: 2159979 - RNA, 14 nt, Homo sapiens
uaauagacacauca

SEQ ID NO: 2159980 - RNA, 14 nt, Homo sapiens
aguugacaguauua

SEQ ID NO: 2159981 - RNA, 21 nt, Homo sapiens
guuauuucucccuuguguuag

SEQ ID NO: 2159982 - RNA, 22 nt, Homo sapiens
aguaaaauagaugaguguuaaa

SEQ ID NO: 2159983 - RNA, 17 nt, Homo sapiens
aguccuauucuauugca

SEQ ID NO: 2159984 - RNA, 16 nt, Homo sapiens
uauucagaguugaugg

SEQ ID NO: 2159985 - RNA, 12 nt, Homo sapiens
agacaagcauuu

SEQ ID NO: 2159986 - RNA, 16 nt, Homo sapiens
ggacauacacuugcau

SEQ ID NO: 2159987 - RNA, 14 nt, Homo sapiens
caagcauaaugaca

SEQ ID NO: 2159988 - RNA, 20 nt, Homo sapiens
uuuuaauuuauucaucuugc

SEQ ID NO: 2159989 - RNA, 17 nt, Homo sapiens
gccucccuugacuuugc

SEQ ID NO: 2159990 - RNA, 15 nt, Homo sapiens
agguccugcuaccca

SEQ ID NO: 2159991 - RNA, 17 nt, Homo sapiens
ggccagggcuauagcuc

SEQ ID NO: 2159992 - RNA, 16 nt, Homo sapiens
uauuuauccacuacuc

SEQ ID NO: 2159993 - RNA, 14 nt, Homo sapiens
gccuccuacuccag

SEQ ID NO: 2159994 - RNA, 13 nt, Homo sapiens
cagggcugggccu

SEQ ID NO: 2159995 - RNA, 15 nt, Homo sapiens
ugcaaucuucuacuu

SEQ ID NO: 2159996 - RNA, 15 nt, Homo sapiens
aauagauugugaaua

SEQ ID NO: 2159997 - RNA, 18 nt, Homo sapiens
augaauugacagacuguu

SEQ ID NO: 2159998 - RNA, 19 nt, Homo sapiens
cuguguuuaacugcugcag

SEQ ID NO: 2159999 - RNA, 17 nt, Homo sapiens
uggguugucacugagac

SEQ ID NO: 2160000 - RNA, 21 nt, Homo sapiens
ggcaggggguucugggaccca

SEQ ID NO: 2160001 - RNA, 17 nt, Homo sapiens
gaagaacugacuaguga

SEQ ID NO: 2160002 - RNA, 15 nt, Homo sapiens
ccuccucaguaugug

SEQ ID NO: 2160003 - RNA, 17 nt, Homo sapiens
aaugggccuccagagac

SEQ ID NO: 2160004 - RNA, 12 nt, Homo sapiens
caugcucugcag

SEQ ID NO: 2160005 - RNA, 21 nt, Homo sapiens
uuguacauaaugcgugcauac

SEQ ID NO: 2160006 - RNA, 15 nt, Homo sapiens
acagacagaagagaa

SEQ ID NO: 2160007 - RNA, 17 nt, Homo sapiens
cuaguauggggugggag

SEQ ID NO: 2160008 - RNA, 22 nt, Homo sapiens
aaaauauaagaacuugauauau

SEQ ID NO: 2160009 - RNA, 17 nt, Homo sapiens
ccagcuguuaccugaga

SEQ ID NO: 2160010 - RNA, 21 nt, Homo sapiens
auuacaggagggaacauuucc

SEQ ID NO: 2160011 - RNA, 13 nt, Homo sapiens
gcuggguggugua

SEQ ID NO: 2160012 - RNA, 14 nt, Homo sapiens
guugccacaggaca

SEQ ID NO: 2160013 - RNA, 15 nt, Homo sapiens
agucuaaacagaguc

SEQ ID NO: 2160014 - RNA, 17 nt, Homo sapiens
cuugcaccucagccucc

SEQ ID NO: 2160015 - RNA, 14 nt, Homo sapiens
agaaucucaaauaa

SEQ ID NO: 2160016 - RNA, 16 nt, Homo sapiens
gagggcacacacugug

SEQ ID NO: 2160017 - RNA, 13 nt, Homo sapiens
acagcaguaugaa

SEQ ID NO: 2160018 - RNA, 18 nt, Homo sapiens
cagccccaauccagagaa

SEQ ID NO: 2160019 - RNA, 11 nt, Homo sapiens
gcggggaccau

SEQ ID NO: 2160020 - RNA, 17 nt, Homo sapiens
aaagaauguuacugccu

SEQ ID NO: 2160021 - RNA, 15 nt, Homo sapiens
gguagaacacugcua

SEQ ID NO: 2160022 - RNA, 21 nt, Homo sapiens
cugaucauccacugugccaug

SEQ ID NO: 2160023 - RNA, 21 nt, Homo sapiens
cuggcccaagugaagcauggc

SEQ ID NO: 2160024 - RNA, 17 nt, Homo sapiens
uuguauuuugugugacc

SEQ ID NO: 2160025 - RNA, 13 nt, Homo sapiens
gauuccaaaaagc

SEQ ID NO: 2160026 - RNA, 22 nt, Homo sapiens
caucagaaauuuucuacaguac

SEQ ID NO: 2160027 - RNA, 22 nt, Homo sapiens
aauaaauucagccaacauguga

SEQ ID NO: 2160028 - RNA, 21 nt, Homo sapiens
auuuuucuuuugucuaaaaaa

SEQ ID NO: 2160029 - RNA, 14 nt, Homo sapiens
cauguguacuuaau

SEQ ID NO: 2160030 - RNA, 19 nt, Homo sapiens
auggacugcaccuugugaa

SEQ ID NO: 2160031 - RNA, 21 nt, Homo sapiens
cagauuaucuuguacagccuu

SEQ ID NO: 2160032 - RNA, 18 nt, Homo sapiens
aaccguggucucauguaa

SEQ ID NO: 2160033 - RNA, 15 nt, Homo sapiens
auucuguaguuucac

SEQ ID NO: 2160034 - RNA, 16 nt, Homo sapiens
uauuuuuaagacuuuu

SEQ ID NO: 2160035 - RNA, 14 nt, Homo sapiens
caacuacuaucuca

SEQ ID NO: 2160036 - RNA, 14 nt, Homo sapiens
ccuugauaauacuu

SEQ ID NO: 2160037 - RNA, 22 nt, Homo sapiens
cccuauuagggaguuaugcaaa

SEQ ID NO: 2160038 - RNA, 22 nt, Homo sapiens
ccaagaccugacucaggcauca

SEQ ID NO: 2160039 - RNA, 15 nt, Homo sapiens
cuggggaguuuacua

SEQ ID NO: 2160040 - RNA, 14 nt, Homo sapiens
uaccuaaacuguau

SEQ ID NO: 2160041 - RNA, 22 nt, Homo sapiens
aucaccuuuuugacuuuuccaa

SEQ ID NO: 2160042 - RNA, 15 nt, Homo sapiens
ccaggugaacuggaa

SEQ ID NO: 2160043 - RNA, 20 nt, Homo sapiens
uggacuuuguuacacuguua

SEQ ID NO: 2160044 - RNA, 13 nt, Homo sapiens
gucaagggccagu

SEQ ID NO: 2160045 - RNA, 19 nt, Homo sapiens
aucaaucuuugugccucaa

SEQ ID NO: 2160046 - RNA, 15 nt, Homo sapiens
uguuugguuuuccaa

SEQ ID NO: 2160047 - RNA, 22 nt, Homo sapiens
uuuguggaauggauuuuccuga

SEQ ID NO: 2160048 - RNA, 10 nt, Homo sapiens
ccccagagac

SEQ ID NO: 2160049 - RNA, 22 nt, Homo sapiens
uauccuggugucuaguuugcau

SEQ ID NO: 2160050 - RNA, 14 nt, Homo sapiens
cccuuuuacaguca

SEQ ID NO: 2160051 - RNA, 14 nt, Homo sapiens
uucuacagcagaua

SEQ ID NO: 2160052 - RNA, 20 nt, Homo sapiens
aggaaaugucaugugagguu

SEQ ID NO: 2160053 - RNA, 15 nt, Homo sapiens
agucggaacagcaga

SEQ ID NO: 2160054 - RNA, 23 nt, Homo sapiens
aacugaagaaagagaagucacaa

SEQ ID NO: 2160055 - RNA, 11 nt, Homo sapiens
ucuuccaugac

SEQ ID NO: 2160056 - RNA, 16 nt, Homo sapiens
acgucuggcucccugc

SEQ ID NO: 2160057 - RNA, 18 nt, Homo sapiens
acagcuguauuaucuuaa

SEQ ID NO: 2160058 - RNA, 20 nt, Homo sapiens
uggggggaguaaagaauuau

SEQ ID NO: 2160059 - RNA, 21 nt, Homo sapiens
caaaccccauggagcagccag

SEQ ID NO: 2160060 - RNA, 20 nt, Homo sapiens
cuggaagagccaaagaauau

SEQ ID NO: 2160061 - RNA, 17 nt, Homo sapiens
cagcuucaggugagcca

SEQ ID NO: 2160062 - RNA, 19 nt, Homo sapiens
uaguucuugugcauguuua

SEQ ID NO: 2160063 - RNA, 16 nt, Homo sapiens
accuguaauuaguuua

SEQ ID NO: 2160064 - RNA, 21 nt, Homo sapiens
cauucaggcuucucagguguu

SEQ ID NO: 2160065 - RNA, 20 nt, Homo sapiens
aacguugaauugaugaugca

SEQ ID NO: 2160066 - RNA, 14 nt, Homo sapiens
ugaucuaauuuaca

SEQ ID NO: 2160067 - RNA, 15 nt, Homo sapiens
uuaugauagugcaag

SEQ ID NO: 2160068 - RNA, 14 nt, Homo sapiens
cugaaaguggugcu

SEQ ID NO: 2160069 - RNA, 16 nt, Homo sapiens
cagucagaugaggcaa

SEQ ID NO: 2160070 - RNA, 23 nt, Homo sapiens
auuuuaucacuugccgugucauc

SEQ ID NO: 2160071 - RNA, 14 nt, Homo sapiens
uaaggaacauuuau

SEQ ID NO: 2160072 - RNA, 14 nt, Homo sapiens
aggggccacugacc

SEQ ID NO: 2160073 - RNA, 22 nt, Homo sapiens
ucaucucuucuuuuaaaccauu

SEQ ID NO: 2160074 - RNA, 15 nt, Homo sapiens
cagacaaccuaucau

SEQ ID NO: 2160075 - RNA, 23 nt, Homo sapiens
agucuucuuucuuagauucucuu

SEQ ID NO: 2160076 - RNA, 18 nt, Homo sapiens
aaaagucacacagacaca

SEQ ID NO: 2160077 - RNA, 16 nt, Homo sapiens
uacagaggacauacca

SEQ ID NO: 2160078 - RNA, 13 nt, Homo sapiens
uacuguguuucag

SEQ ID NO: 2160079 - RNA, 17 nt, Homo sapiens
cagcugagccugagcca

SEQ ID NO: 2160080 - RNA, 20 nt, Homo sapiens
gaaagcccucaugugcagua

SEQ ID NO: 2160081 - RNA, 14 nt, Homo sapiens
aguuaugaggguac

SEQ ID NO: 2160082 - RNA, 16 nt, Homo sapiens
aaaugaguuuucaccu

SEQ ID NO: 2160083 - RNA, 14 nt, Homo sapiens
gcuuaagccaucuu

SEQ ID NO: 2160084 - RNA, 18 nt, Homo sapiens
ugaaacacaauaucaucc

SEQ ID NO: 2160085 - RNA, 15 nt, Homo sapiens
uggugugugccucau

SEQ ID NO: 2160086 - RNA, 17 nt, Homo sapiens
agaacccauaaccauac

SEQ ID NO: 2160087 - RNA, 21 nt, Homo sapiens
auucagguauaaggcagggug

SEQ ID NO: 2160088 - RNA, 21 nt, Homo sapiens
acgcuuccagaccaccugcca

SEQ ID NO: 2160089 - RNA, 15 nt, Homo sapiens
aaugucuaaaaugga

SEQ ID NO: 2160090 - RNA, 23 nt, Homo sapiens
aacuccaacauccacucucucuu

SEQ ID NO: 2160091 - RNA, 19 nt, Homo sapiens
uucuuaaaacugacauuug

SEQ ID NO: 2160092 - RNA, 18 nt, Homo sapiens
auugagccuugcauguac

SEQ ID NO: 2160093 - RNA, 20 nt, Homo sapiens
gcaugacaaacacacaucca

SEQ ID NO: 2160094 - RNA, 22 nt, Homo sapiens
ugugugaaaccuacagcauauu

SEQ ID NO: 2160095 - RNA, 16 nt, Homo sapiens
acucaguuucuaggca

SEQ ID NO: 2160096 - RNA, 19 nt, Homo sapiens
auagaagcaaaugacaaaa

SEQ ID NO: 2160097 - RNA, 15 nt, Homo sapiens
aaagcuuuuuccucc

SEQ ID NO: 2160098 - RNA, 15 nt, Homo sapiens
augucagacuuugcu

SEQ ID NO: 2160099 - RNA, 14 nt, Homo sapiens
uguuccuuaccaag

SEQ ID NO: 2160100 - RNA, 13 nt, Homo sapiens
ucacucuguuaau

SEQ ID NO: 2160101 - RNA, 18 nt, Homo sapiens
ucuccaggggucuugcaa

SEQ ID NO: 2160102 - RNA, 16 nt, Homo sapiens
auucaccacccuggga

SEQ ID NO: 2160103 - RNA, 20 nt, Homo sapiens
guggccccagcugugacuga

SEQ ID NO: 2160104 - RNA, 22 nt, Homo sapiens
cucccuggacucuguggggcca

SEQ ID NO: 2160105 - RNA, 15 nt, Homo sapiens
aaaaaucaugugaua

SEQ ID NO: 2160106 - RNA, 14 nt, Homo sapiens
uuuacacauucuca

SEQ ID NO: 2160107 - RNA, 22 nt, Homo sapiens
ucuagaacacaggcaaaauccu

SEQ ID NO: 2160108 - RNA, 16 nt, Homo sapiens
gaccauuucucagcau

SEQ ID NO: 2160109 - RNA, 16 nt, Homo sapiens
accaccccuuccuguc

SEQ ID NO: 2160110 - RNA, 15 nt, Homo sapiens
caaauuauaaaaagc

SEQ ID NO: 2160111 - RNA, 15 nt, Homo sapiens
ugugcagauugcagu

SEQ ID NO: 2160112 - RNA, 12 nt, Homo sapiens
aaaaagugcagu

SEQ ID NO: 2160113 - RNA, 16 nt, Homo sapiens
ccuaagacugcugcug

SEQ ID NO: 2160114 - RNA, 15 nt, Homo sapiens
gccccuguuaccuaa

SEQ ID NO: 2160115 - RNA, 15 nt, Homo sapiens
aacuauuaaugauaa

SEQ ID NO: 2160116 - RNA, 20 nt, Homo sapiens
agcaaguuccugagugcgug

SEQ ID NO: 2160117 - RNA, 23 nt, Homo sapiens
aagcaauuuauaucuuuaugcaa

SEQ ID NO: 2160118 - RNA, 14 nt, Homo sapiens
caaaugucaucagg

SEQ ID NO: 2160119 - RNA, 17 nt, Homo sapiens
auuucugaguaccauua

SEQ ID NO: 2160120 - RNA, 18 nt, Homo sapiens
aaccuaauaucacuuaaa

SEQ ID NO: 2160121 - RNA, 16 nt, Homo sapiens
ugaaaagaaucagcau

SEQ ID NO: 2160122 - RNA, 21 nt, Homo sapiens
gucaugugccuugaacauaua

SEQ ID NO: 2160123 - RNA, 12 nt, Homo sapiens
agcccugaaccc

SEQ ID NO: 2160124 - RNA, 21 nt, Homo sapiens
uucaaaggcuuccaauguggu

SEQ ID NO: 2160125 - RNA, 18 nt, Homo sapiens
acagcugugcaugcucag

SEQ ID NO: 2160126 - RNA, 21 nt, Homo sapiens
aauacaauucaaaugcuuuuu

SEQ ID NO: 2160127 - RNA, 15 nt, Homo sapiens
caccugaaaugccuu

SEQ ID NO: 2160128 - RNA, 14 nt, Homo sapiens
cucaaaaccagaga

SEQ ID NO: 2160129 - RNA, 16 nt, Homo sapiens
aauugccacagcugua

SEQ ID NO: 2160130 - RNA, 18 nt, Homo sapiens
uaaaaucuguaaaccaua

SEQ ID NO: 2160131 - RNA, 16 nt, Homo sapiens
ucucauuaaaauccag

SEQ ID NO: 2160132 - RNA, 12 nt, Homo sapiens
agcuugcuugca

SEQ ID NO: 2160133 - RNA, 22 nt, Homo sapiens
uugcaacucacugauucucuac

SEQ ID NO: 2160134 - RNA, 22 nt, Homo sapiens
uaaucuguguaaacacaggaau

SEQ ID NO: 2160135 - RNA, 19 nt, Homo sapiens
caccuguccuucucaggcu

SEQ ID NO: 2160136 - RNA, 17 nt, Homo sapiens
agccugagaaugaccug

SEQ ID NO: 2160137 - RNA, 16 nt, Homo sapiens
uccuaauaauauccca

SEQ ID NO: 2160138 - RNA, 20 nt, Homo sapiens
cuacaggaaauacagagaug

SEQ ID NO: 2160139 - RNA, 18 nt, Homo sapiens
gccugauaggacccauau

SEQ ID NO: 2160140 - RNA, 23 nt, Homo sapiens
agucagaacuauaacauucaauu

SEQ ID NO: 2160141 - RNA, 18 nt, Homo sapiens
gaugacccuuuucaugau

SEQ ID NO: 2160142 - RNA, 23 nt, Homo sapiens
aguaucuguauguauauauacac

SEQ ID NO: 2160143 - RNA, 22 nt, Homo sapiens
ggagaauugacugaagcacagc

SEQ ID NO: 2160144 - RNA, 16 nt, Homo sapiens
guuuauuucauuuuau

SEQ ID NO: 2160145 - RNA, 14 nt, Homo sapiens
cuuauguguuuuaa

SEQ ID NO: 2160146 - RNA, 19 nt, Homo sapiens
accuuggaggaaugacaau

SEQ ID NO: 2160147 - RNA, 20 nt, Homo sapiens
aucaucucgaccacuuuuca

SEQ ID NO: 2160148 - RNA, 16 nt, Homo sapiens
ugacauacauccaaca

SEQ ID NO: 2160149 - RNA, 19 nt, Homo sapiens
ucaucacuggaugaagauu

SEQ ID NO: 2160150 - RNA, 14 nt, Homo sapiens
gcugagaccacuga

SEQ ID NO: 2160151 - RNA, 16 nt, Homo sapiens
auggaaaacagacuca

SEQ ID NO: 2160152 - RNA, 20 nt, Homo sapiens
uauuucugucaacuuguauu

SEQ ID NO: 2160153 - RNA, 22 nt, Homo sapiens
ugugggcauagcauuagcugcu

SEQ ID NO: 2160154 - RNA, 19 nt, Homo sapiens
ugaggccaucucaggagau

SEQ ID NO: 2160155 - RNA, 14 nt, Homo sapiens
aguuuaaacaaagg

SEQ ID NO: 2160156 - RNA, 13 nt, Homo sapiens
uggcaagaacuug

SEQ ID NO: 2160157 - RNA, 22 nt, Homo sapiens
uauggacucgauuuuaccauau

SEQ ID NO: 2160158 - RNA, 23 nt, Homo sapiens
aagccagcauuuccucagucucc

SEQ ID NO: 2160159 - RNA, 15 nt, Homo sapiens
acacagggcucuuug

SEQ ID NO: 2160160 - RNA, 22 nt, Homo sapiens
ccagaggcaggcggagguugaa

SEQ ID NO: 2160161 - RNA, 17 nt, Homo sapiens
ggcccuugucauugccu

SEQ ID NO: 2160162 - RNA, 17 nt, Homo sapiens
acaacugucuaacuuua

SEQ ID NO: 2160163 - RNA, 16 nt, Homo sapiens
ugguucagugccuucc

SEQ ID NO: 2160164 - RNA, 14 nt, Homo sapiens
aaguugcugagaaa

SEQ ID NO: 2160165 - RNA, 17 nt, Homo sapiens
cagcccuuuugugaacc

SEQ ID NO: 2160166 - RNA, 17 nt, Homo sapiens
uagauugcuaguuuauu

SEQ ID NO: 2160167 - RNA, 22 nt, Homo sapiens
cuuuuaaauguugaauauuccc

SEQ ID NO: 2160168 - RNA, 18 nt, Homo sapiens
ugucagccauugcaccca

SEQ ID NO: 2160169 - RNA, 14 nt, Homo sapiens
ugugugccacucag

SEQ ID NO: 2160170 - RNA, 14 nt, Homo sapiens
guccggacccaccu

SEQ ID NO: 2160171 - RNA, 18 nt, Homo sapiens
cugauccagucacagcca

SEQ ID NO: 2160172 - RNA, 23 nt, Homo sapiens
gagguccccucgucccauccagc

SEQ ID NO: 2160173 - RNA, 20 nt, Homo sapiens
ucuccacaugguugugaguc

SEQ ID NO: 2160174 - RNA, 20 nt, Homo sapiens
gcacauccauucccaagaaa

SEQ ID NO: 2160175 - RNA, 14 nt, Homo sapiens
ugauuucauuucaa

SEQ ID NO: 2160176 - RNA, 18 nt, Homo sapiens
ggauuuuagugcuugcca

SEQ ID NO: 2160177 - RNA, 22 nt, Homo sapiens
ugggggaucacagccucugaaa

SEQ ID NO: 2160178 - RNA, 14 nt, Homo sapiens
caaaaaaaugugca

SEQ ID NO: 2160179 - RNA, 16 nt, Homo sapiens
cugcacuuaacaagcu

SEQ ID NO: 2160180 - RNA, 16 nt, Homo sapiens
cauccggcuccuguca

SEQ ID NO: 2160181 - RNA, 12 nt, Homo sapiens
cuucuccaaagg

SEQ ID NO: 2160182 - RNA, 21 nt, Homo sapiens
ucuugcagaaugucuguagga

SEQ ID NO: 2160183 - RNA, 19 nt, Homo sapiens
guacaacagaauaaugcau

SEQ ID NO: 2160184 - RNA, 19 nt, Homo sapiens
cuuucugcuaucaaagagg

SEQ ID NO: 2160185 - RNA, 21 nt, Homo sapiens
uuaagaaauacucaugugcaa

SEQ ID NO: 2160186 - RNA, 17 nt, Homo sapiens
aauccccucccugugac

SEQ ID NO: 2160187 - RNA, 18 nt, Homo sapiens
ugcucuuccucaucucau

SEQ ID NO: 2160188 - RNA, 14 nt, Homo sapiens
guccuaagcacuuu

SEQ ID NO: 2160189 - RNA, 22 nt, Homo sapiens
aggaacccuuggucacauguga

SEQ ID NO: 2160190 - RNA, 16 nt, Homo sapiens
auaaucuguacaauga

SEQ ID NO: 2160191 - RNA, 20 nt, Homo sapiens
ccagccugggcaacauagua

SEQ ID NO: 2160192 - RNA, 16 nt, Homo sapiens
uuaaaaggagcacauu

SEQ ID NO: 2160193 - RNA, 18 nt, Homo sapiens
uuguacguuuugcacauu

SEQ ID NO: 2160194 - RNA, 21 nt, Homo sapiens
uuaggaguaccauaauucugg

SEQ ID NO: 2160195 - RNA, 18 nt, Homo sapiens
aaguagauuuuaaaagau

SEQ ID NO: 2160196 - RNA, 15 nt, Homo sapiens
ucacuugccaugcag

SEQ ID NO: 2160197 - RNA, 23 nt, Homo sapiens
cagugugaggcuguaacuuauac

SEQ ID NO: 2160198 - RNA, 24 nt, Homo sapiens
gccugcuuuugugucccauucaca

SEQ ID NO: 2160199 - RNA, 16 nt, Homo sapiens
auauugugucauagaa

SEQ ID NO: 2160200 - RNA, 24 nt, Homo sapiens
gguagaggugugugccuagugaug

SEQ ID NO: 2160201 - RNA, 17 nt, Homo sapiens
cagacguugccugagaa

SEQ ID NO: 2160202 - RNA, 13 nt, Homo sapiens
auugagguauaau

SEQ ID NO: 2160203 - RNA, 14 nt, Homo sapiens
uaugugaagacaga

SEQ ID NO: 2160204 - RNA, 14 nt, Homo sapiens
aagugaucuguccc

SEQ ID NO: 2160205 - RNA, 13 nt, Homo sapiens
aauauauagcauu

SEQ ID NO: 2160206 - RNA, 17 nt, Homo sapiens
aaucugcugaucucugu

SEQ ID NO: 2160207 - RNA, 15 nt, Homo sapiens
guuuguaaaauccac

SEQ ID NO: 2160208 - RNA, 13 nt, Homo sapiens
uuaaaugcugcau

SEQ ID NO: 2160209 - RNA, 23 nt, Homo sapiens
cauguguagagccccuacugugg

SEQ ID NO: 2160210 - RNA, 16 nt, Homo sapiens
aaguaaccauuugcac

SEQ ID NO: 2160211 - RNA, 18 nt, Homo sapiens
ugcaucugcuacuguguc

SEQ ID NO: 2160212 - RNA, 14 nt, Homo sapiens
uggcaucauugcau

SEQ ID NO: 2160213 - RNA, 16 nt, Homo sapiens
cuucagauuugccuua

SEQ ID NO: 2160214 - RNA, 20 nt, Homo sapiens
uaaugcuacugucucacuga

SEQ ID NO: 2160215 - RNA, 14 nt, Homo sapiens
acuuuauaaaucca

SEQ ID NO: 2160216 - RNA, 16 nt, Homo sapiens
ggaacucuuaagcaau

SEQ ID NO: 2160217 - RNA, 19 nt, Homo sapiens
ccagauacagcacauccac

SEQ ID NO: 2160218 - RNA, 20 nt, Homo sapiens
ugagugggaauccgggacac

SEQ ID NO: 2160219 - RNA, 13 nt, Homo sapiens
aaguacuuccucu

SEQ ID NO: 2160220 - RNA, 12 nt, Homo sapiens
uaaaacagucau

SEQ ID NO: 2160221 - RNA, 21 nt, Homo sapiens
ugaguugugugaauaccccaa

SEQ ID NO: 2160222 - RNA, 14 nt, Homo sapiens
gugugagcccagau

SEQ ID NO: 2160223 - RNA, 15 nt, Homo sapiens
uccugcaaaccucac

SEQ ID NO: 2160224 - RNA, 21 nt, Homo sapiens
gcuacuagagauauucuuauu

SEQ ID NO: 2160225 - RNA, 14 nt, Homo sapiens
gcccuacacugccu

SEQ ID NO: 2160226 - RNA, 17 nt, Homo sapiens
augacccggggcagcug

SEQ ID NO: 2160227 - RNA, 14 nt, Homo sapiens
uucuuauuugcaau

SEQ ID NO: 2160228 - RNA, 15 nt, Homo sapiens
uucaguuuucaggag

SEQ ID NO: 2160229 - RNA, 15 nt, Homo sapiens
cauuugaguuugcaa

SEQ ID NO: 2160230 - RNA, 20 nt, Homo sapiens
acagcauaguacuggcacaa

SEQ ID NO: 2160231 - RNA, 16 nt, Homo sapiens
gauccccccacugagc

SEQ ID NO: 2160232 - RNA, 20 nt, Homo sapiens
uacaaagggccaucguucau

SEQ ID NO: 2160233 - RNA, 18 nt, Homo sapiens
cuucucccgggucguguc

SEQ ID NO: 2160234 - RNA, 22 nt, Homo sapiens
agggauggagaaagaaguggag

SEQ ID NO: 2160235 - RNA, 21 nt, Homo sapiens
uaaucauguuaccauuacaaa

SEQ ID NO: 2160236 - RNA, 14 nt, Homo sapiens
gcaccaugcugcug

SEQ ID NO: 2160237 - RNA, 18 nt, Homo sapiens
agcugccugggaucccuc

SEQ ID NO: 2160238 - RNA, 20 nt, Homo sapiens
uguaguuaauuuaauuugca

SEQ ID NO: 2160239 - RNA, 15 nt, Homo sapiens
ccaggugcugugaca

SEQ ID NO: 2160240 - RNA, 23 nt, Homo sapiens
uucccccaagcagaagaccagau

SEQ ID NO: 2160241 - RNA, 18 nt, Homo sapiens
guuuuguaccaacacaca

SEQ ID NO: 2160242 - RNA, 22 nt, Homo sapiens
cuccagggaaaaugacuuuauu

SEQ ID NO: 2160243 - RNA, 19 nt, Homo sapiens
agcuccaagaggcuccuga

SEQ ID NO: 2160244 - RNA, 16 nt, Homo sapiens
agccagagacagagga

SEQ ID NO: 2160245 - RNA, 20 nt, Homo sapiens
aacaucccugccagcucuuc

SEQ ID NO: 2160246 - RNA, 13 nt, Homo sapiens
acuauuuccauug

SEQ ID NO: 2160247 - RNA, 23 nt, Homo sapiens
ugacacaguuaucaaaaaguauu

SEQ ID NO: 2160248 - RNA, 12 nt, Homo sapiens
aauaaugauuua

SEQ ID NO: 2160249 - RNA, 14 nt, Homo sapiens
uaaauuuagugcac

SEQ ID NO: 2160250 - RNA, 11 nt, Homo sapiens
aaguugcaguu

SEQ ID NO: 2160251 - RNA, 22 nt, Homo sapiens
ccaauuaaguccuacuuuacau

SEQ ID NO: 2160252 - RNA, 12 nt, Homo sapiens
gagccagacaga

SEQ ID NO: 2160253 - RNA, 17 nt, Homo sapiens
guaaccgauucaucucu

SEQ ID NO: 2160254 - RNA, 11 nt, Homo sapiens
caaacauggcc

SEQ ID NO: 2160255 - RNA, 19 nt, Homo sapiens
auaagcagaacauacuguu

SEQ ID NO: 2160256 - RNA, 17 nt, Homo sapiens
aaccauaguuacuguaa

SEQ ID NO: 2160257 - RNA, 20 nt, Homo sapiens
cucauccuuuuuaaaugaga

SEQ ID NO: 2160258 - RNA, 19 nt, Homo sapiens
uguuuuuagagacaggguc

SEQ ID NO: 2160259 - RNA, 23 nt, Homo sapiens
cauauucugaggaccuccaaaga

SEQ ID NO: 2160260 - RNA, 22 nt, Homo sapiens
acgguggucaccaugccaauga

SEQ ID NO: 2160261 - RNA, 18 nt, Homo sapiens
cauggcguaaugggccug

SEQ ID NO: 2160262 - RNA, 16 nt, Homo sapiens
caccugggguauggca

SEQ ID NO: 2160263 - RNA, 16 nt, Homo sapiens
ugucaaugacaguuuc

SEQ ID NO: 2160264 - RNA, 11 nt, Homo sapiens
agaaaaguaac

SEQ ID NO: 2160265 - RNA, 20 nt, Homo sapiens
ugguacaaucucaaauucuc

SEQ ID NO: 2160266 - RNA, 22 nt, Homo sapiens
gaugggguuucaccaucuuggc

SEQ ID NO: 2160267 - RNA, 14 nt, Homo sapiens
uaaauguauacuau

SEQ ID NO: 2160268 - RNA, 16 nt, Homo sapiens
ugcaauaaagaguaaa

SEQ ID NO: 2160269 - RNA, 16 nt, Homo sapiens
cauucucaguauccac

SEQ ID NO: 2160270 - RNA, 18 nt, Homo sapiens
uggcacuguggagcucag

SEQ ID NO: 2160271 - RNA, 20 nt, Homo sapiens
acucccuguuuuaauucaac

SEQ ID NO: 2160272 - RNA, 19 nt, Homo sapiens
aagccagcugcaggaauca

SEQ ID NO: 2160273 - RNA, 23 nt, Homo sapiens
cacccugagaaccccucugggaa

SEQ ID NO: 2160274 - RNA, 21 nt, Homo sapiens
cggccugcaccgacccgaggc

SEQ ID NO: 2160275 - RNA, 18 nt, Homo sapiens
gugacaccaccacugugu

SEQ ID NO: 2160276 - RNA, 14 nt, Homo sapiens
auggcuuucacuuu

SEQ ID NO: 2160277 - RNA, 13 nt, Homo sapiens
gcauuuguuugaa

SEQ ID NO: 2160278 - RNA, 22 nt, Homo sapiens
uagcaggcuaugaaguugcaau

SEQ ID NO: 2160279 - RNA, 20 nt, Homo sapiens
uuguucuuuggaaauacaca

SEQ ID NO: 2160280 - RNA, 19 nt, Homo sapiens
gcugguaaaaacaugggga

SEQ ID NO: 2160281 - RNA, 12 nt, Homo sapiens
agucccugugaa

SEQ ID NO: 2160282 - RNA, 15 nt, Homo sapiens
uaucccuaugcugcc

SEQ ID NO: 2160283 - RNA, 15 nt, Homo sapiens
cuggaacccagaaga

SEQ ID NO: 2160284 - RNA, 12 nt, Homo sapiens
auuaagcaugaa

SEQ ID NO: 2160285 - RNA, 16 nt, Homo sapiens
cucacacagcaggaac

SEQ ID NO: 2160286 - RNA, 13 nt, Homo sapiens
uaaagcagccagc

SEQ ID NO: 2160287 - RNA, 18 nt, Homo sapiens
cagaaacuaauccuuacu

SEQ ID NO: 2160288 - RNA, 19 nt, Homo sapiens
ucuauaaguguucaguguu

SEQ ID NO: 2160289 - RNA, 17 nt, Homo sapiens
cuuuuuaucuucuuagc

SEQ ID NO: 2160290 - RNA, 17 nt, Homo sapiens
ugauacuucgacacugu

SEQ ID NO: 2160291 - RNA, 16 nt, Homo sapiens
caggauguugcuccau

SEQ ID NO: 2160292 - RNA, 16 nt, Homo sapiens
aggcccuccaugggcu

SEQ ID NO: 2160293 - RNA, 18 nt, Homo sapiens
agcccgccuccagcacca

SEQ ID NO: 2160294 - RNA, 13 nt, Homo sapiens
cuggaaagaccca

SEQ ID NO: 2160295 - RNA, 16 nt, Homo sapiens
uacaauguucauccca

SEQ ID NO: 2160296 - RNA, 17 nt, Homo sapiens
cuaaacuauaugccaua

SEQ ID NO: 2160297 - RNA, 14 nt, Homo sapiens
ccugagcuuuaugg

SEQ ID NO: 2160298 - RNA, 21 nt, Homo sapiens
guuugucugauguggcaaaag

SEQ ID NO: 2160299 - RNA, 19 nt, Homo sapiens
ccagccuuauguguuacau

SEQ ID NO: 2160300 - RNA, 14 nt, Homo sapiens
gcucaggcauuuga

SEQ ID NO: 2160301 - RNA, 21 nt, Homo sapiens
agcugagaucacgccacugca

SEQ ID NO: 2160302 - RNA, 15 nt, Homo sapiens
caggacagguggugc

SEQ ID NO: 2160303 - RNA, 13 nt, Homo sapiens
uaggucucagaga

SEQ ID NO: 2160304 - RNA, 13 nt, Homo sapiens
acccaaucugccu

SEQ ID NO: 2160305 - RNA, 15 nt, Homo sapiens
aggaggaucacuuga

SEQ ID NO: 2160306 - RNA, 20 nt, Homo sapiens
ugacagcaggagcagugaua

SEQ ID NO: 2160307 - RNA, 21 nt, Homo sapiens
gccagagccuggggcauccca

SEQ ID NO: 2160308 - RNA, 16 nt, Homo sapiens
uuaaaauccaaaugag

SEQ ID NO: 2160309 - RNA, 20 nt, Homo sapiens
agccacugccacuccagucc

SEQ ID NO: 2160310 - RNA, 19 nt, Homo sapiens
uuacuugaaguaacuauaa

SEQ ID NO: 2160311 - RNA, 14 nt, Homo sapiens
cuaaaacuuaacau

SEQ ID NO: 2160312 - RNA, 14 nt, Homo sapiens
cagaaucuuugcaa

SEQ ID NO: 2160313 - RNA, 16 nt, Homo sapiens
gucaucaaagcagaag

SEQ ID NO: 2160314 - RNA, 21 nt, Homo sapiens
cugcauagcagaccacacaga

SEQ ID NO: 2160315 - RNA, 18 nt, Homo sapiens
aaccaguacuaaccugga

SEQ ID NO: 2160316 - RNA, 20 nt, Homo sapiens
cggccgcccggcagugcacg

SEQ ID NO: 2160317 - RNA, 21 nt, Homo sapiens
caaguccauguuauucucuca

SEQ ID NO: 2160318 - RNA, 17 nt, Homo sapiens
caguuguggugugagua

SEQ ID NO: 2160319 - RNA, 17 nt, Homo sapiens
cguagccagucuagaca

SEQ ID NO: 2160320 - RNA, 20 nt, Homo sapiens
auuucccccuaaaccaacug

SEQ ID NO: 2160321 - RNA, 16 nt, Homo sapiens
ggaggcacaagugccc

SEQ ID NO: 2160322 - RNA, 16 nt, Homo sapiens
aggagcauugcaguca

SEQ ID NO: 2160323 - RNA, 14 nt, Homo sapiens
augacccacccagu

SEQ ID NO: 2160324 - RNA, 17 nt, Homo sapiens
uaccuuucuucacugca

SEQ ID NO: 2160325 - RNA, 12 nt, Homo sapiens
aaucaugucagu

SEQ ID NO: 2160326 - RNA, 21 nt, Homo sapiens
gcucacccucucuuggugcau

SEQ ID NO: 2160327 - RNA, 14 nt, Homo sapiens
aggguggcacaucu

SEQ ID NO: 2160328 - RNA, 20 nt, Homo sapiens
uguagcuagcucgugacuac

SEQ ID NO: 2160329 - RNA, 20 nt, Homo sapiens
uauuuggcccucugcccaga

SEQ ID NO: 2160330 - RNA, 11 nt, Homo sapiens
aucccacucac

SEQ ID NO: 2160331 - RNA, 23 nt, Homo sapiens
gagcuauucucacucggaccugg

SEQ ID NO: 2160332 - RNA, 21 nt, Homo sapiens
caaaugauuuccacaaacaga

SEQ ID NO: 2160333 - RNA, 18 nt, Homo sapiens
uaaagauggauggcuguu

SEQ ID NO: 2160334 - RNA, 13 nt, Homo sapiens
aaacuccaucucu

SEQ ID NO: 2160335 - RNA, 16 nt, Homo sapiens
ucccuuccaugcccug

SEQ ID NO: 2160336 - RNA, 13 nt, Homo sapiens
aggcauguacaaa

SEQ ID NO: 2160337 - RNA, 23 nt, Homo sapiens
ggcagaguacaaaguaagccaug

SEQ ID NO: 2160338 - RNA, 21 nt, Homo sapiens
agccuuucacaggacucugca

SEQ ID NO: 2160339 - RNA, 23 nt, Homo sapiens
gacauguaugcuuccagggacaa

SEQ ID NO: 2160340 - RNA, 19 nt, Homo sapiens
acaaguuagaaaacauaau

SEQ ID NO: 2160341 - RNA, 22 nt, Homo sapiens
uuccagccguguuguagcuaau

SEQ ID NO: 2160342 - RNA, 14 nt, Homo sapiens
agcacauuccuccu

SEQ ID NO: 2160343 - RNA, 22 nt, Homo sapiens
uugguguuuuuuuuaagggcau

SEQ ID NO: 2160344 - RNA, 22 nt, Homo sapiens
uagaagcagagggacaaccaga

SEQ ID NO: 2160345 - RNA, 21 nt, Homo sapiens
ugcacaggcagauguuugccu

SEQ ID NO: 2160346 - RNA, 18 nt, Homo sapiens
auuuuugugaaguauuca

SEQ ID NO: 2160347 - RNA, 15 nt, Homo sapiens
agauuuccuuucaga

SEQ ID NO: 2160348 - RNA, 15 nt, Homo sapiens
aguacucaguacuau

SEQ ID NO: 2160349 - RNA, 17 nt, Homo sapiens
caauggggcggggcuuc

SEQ ID NO: 2160350 - RNA, 17 nt, Homo sapiens
acaauaaaaccaaacau

SEQ ID NO: 2160351 - RNA, 19 nt, Homo sapiens
gcucccaccaccagugaga

SEQ ID NO: 2160352 - RNA, 19 nt, Homo sapiens
uucuguuggaugacuuuga

SEQ ID NO: 2160353 - RNA, 18 nt, Homo sapiens
ugccacuuaauguauguu

SEQ ID NO: 2160354 - RNA, 16 nt, Homo sapiens
aaagucuauucaaaag

SEQ ID NO: 2160355 - RNA, 15 nt, Homo sapiens
agaaugaaccacugc

SEQ ID NO: 2160356 - RNA, 15 nt, Homo sapiens
agacaaaaccaaaac

SEQ ID NO: 2160357 - RNA, 18 nt, Homo sapiens
ugaacugaaguuucacau

SEQ ID NO: 2160358 - RNA, 19 nt, Homo sapiens
uguuagagaauuuccuuac

SEQ ID NO: 2160359 - RNA, 20 nt, Homo sapiens
aauacaagaguuucaaaaca

SEQ ID NO: 2160360 - RNA, 22 nt, Homo sapiens
gcuaaaaucauccuauuacuua

SEQ ID NO: 2160361 - RNA, 23 nt, Homo sapiens
uggacuauggagugcaccaaaga

SEQ ID NO: 2160362 - RNA, 15 nt, Homo sapiens
auuuuuuuaaacaua

SEQ ID NO: 2160363 - RNA, 20 nt, Homo sapiens
aaggaaaugaauuucucuac

SEQ ID NO: 2160364 - RNA, 12 nt, Homo sapiens
gucggucuugca

SEQ ID NO: 2160365 - RNA, 20 nt, Homo sapiens
cuuuucuuuccuuuucauaa

SEQ ID NO: 2160366 - RNA, 14 nt, Homo sapiens
ccuaauacagcaga

SEQ ID NO: 2160367 - RNA, 21 nt, Homo sapiens
uauuggcuauuauuugacuug

SEQ ID NO: 2160368 - RNA, 15 nt, Homo sapiens
acuuacaucaugugu

SEQ ID NO: 2160369 - RNA, 18 nt, Homo sapiens
gagaugcagcuacuggaa

SEQ ID NO: 2160370 - RNA, 13 nt, Homo sapiens
auuucucuugcaa

SEQ ID NO: 2160371 - RNA, 16 nt, Homo sapiens
ccucccccaguguccc

SEQ ID NO: 2160372 - RNA, 14 nt, Homo sapiens
augccuguccugaa

SEQ ID NO: 2160373 - RNA, 13 nt, Homo sapiens
cuacuacauucca

SEQ ID NO: 2160374 - RNA, 16 nt, Homo sapiens
ugcacaguagagcaaa

SEQ ID NO: 2160375 - RNA, 13 nt, Homo sapiens
ucuucuaacacaa

SEQ ID NO: 2160376 - RNA, 20 nt, Homo sapiens
gauaugccacuaacuucuaa

SEQ ID NO: 2160377 - RNA, 20 nt, Homo sapiens
gaaggaggcuaugcucaggg

SEQ ID NO: 2160378 - RNA, 23 nt, Homo sapiens
ugaaagguuggccuuacuguuga

SEQ ID NO: 2160379 - RNA, 15 nt, Homo sapiens
ugaauuccucucaaa

SEQ ID NO: 2160380 - RNA, 18 nt, Homo sapiens
cuagagaucuggcugugg

SEQ ID NO: 2160381 - RNA, 15 nt, Homo sapiens
uccaccuagacugua

SEQ ID NO: 2160382 - RNA, 12 nt, Homo sapiens
gcuuacccuuca

SEQ ID NO: 2160383 - RNA, 13 nt, Homo sapiens
agccacgggccac

SEQ ID NO: 2160384 - RNA, 17 nt, Homo sapiens
agaagaaaauuugccaa

SEQ ID NO: 2160385 - RNA, 22 nt, Homo sapiens
cucugugaccccuccuugucag

SEQ ID NO: 2160386 - RNA, 14 nt, Homo sapiens
agccagaacuugac

SEQ ID NO: 2160387 - RNA, 17 nt, Homo sapiens
caugagggcuggaugcu

SEQ ID NO: 2160388 - RNA, 22 nt, Homo sapiens
ucauguuugaaucuacauucac

SEQ ID NO: 2160389 - RNA, 15 nt, Homo sapiens
cuggaccacugggca

SEQ ID NO: 2160390 - RNA, 15 nt, Homo sapiens
cucuccuuguugccc

SEQ ID NO: 2160391 - RNA, 17 nt, Homo sapiens
aaagcugaguguuucac

SEQ ID NO: 2160392 - RNA, 19 nt, Homo sapiens
ggcagcuucuauuagccag

SEQ ID NO: 2160393 - RNA, 20 nt, Homo sapiens
accuccggccuccacaugac

SEQ ID NO: 2160394 - RNA, 17 nt, Homo sapiens
uuuaugugcacugccug

SEQ ID NO: 2160395 - RNA, 16 nt, Homo sapiens
caaaaugauauucaau

SEQ ID NO: 2160396 - RNA, 23 nt, Homo sapiens
cuccugguggcaggcaagcagau

SEQ ID NO: 2160397 - RNA, 18 nt, Homo sapiens
cggaccaugcgacacugg

SEQ ID NO: 2160398 - RNA, 20 nt, Homo sapiens
aagccagcugcagcugggcu

SEQ ID NO: 2160399 - RNA, 17 nt, Homo sapiens
agccaagaaaguccagu

SEQ ID NO: 2160400 - RNA, 13 nt, Homo sapiens
agccacacugugg

SEQ ID NO: 2160401 - RNA, 13 nt, Homo sapiens
acagaugucucug

SEQ ID NO: 2160402 - RNA, 13 nt, Homo sapiens
auuuuacauuaag

SEQ ID NO: 2160403 - RNA, 12 nt, Homo sapiens
ccuguuccucaa

SEQ ID NO: 2160404 - RNA, 21 nt, Homo sapiens
ggacaaaccgagugcaaugaa

SEQ ID NO: 2160405 - RNA, 13 nt, Homo sapiens
gcccucacugcag

SEQ ID NO: 2160406 - RNA, 14 nt, Homo sapiens
ugcuggcucugaga

SEQ ID NO: 2160407 - RNA, 13 nt, Homo sapiens
gacagcuucucau

SEQ ID NO: 2160408 - RNA, 20 nt, Homo sapiens
agccugcucccuagccagag

SEQ ID NO: 2160409 - RNA, 16 nt, Homo sapiens
aucguagacacaggga

SEQ ID NO: 2160410 - RNA, 15 nt, Homo sapiens
gacugaagauuucac

SEQ ID NO: 2160411 - RNA, 17 nt, Homo sapiens
ugggaggaacaaagaca

SEQ ID NO: 2160412 - RNA, 20 nt, Homo sapiens
caguguuuccagugacacaa

SEQ ID NO: 2160413 - RNA, 22 nt, Homo sapiens
agacaaggaggaguuccaccau

SEQ ID NO: 2160414 - RNA, 13 nt, Homo sapiens
cucacacugcaag

SEQ ID NO: 2160415 - RNA, 19 nt, Homo sapiens
ucuauguuuacaaauggac

SEQ ID NO: 2160416 - RNA, 13 nt, Homo sapiens
gaaagcuagaggu

SEQ ID NO: 2160417 - RNA, 17 nt, Homo sapiens
ccacuaacuccugagaa

SEQ ID NO: 2160418 - RNA, 15 nt, Homo sapiens
gccuuccacaauuca

SEQ ID NO: 2160419 - RNA, 14 nt, Homo sapiens
ugcuucugugcaau

SEQ ID NO: 2160420 - RNA, 23 nt, Homo sapiens
cauauuaccuguggaguugcaua

SEQ ID NO: 2160421 - RNA, 23 nt, Homo sapiens
agagcccuucaugcauuugcacu

SEQ ID NO: 2160422 - RNA, 11 nt, Homo sapiens
cagacccagug

SEQ ID NO: 2160423 - RNA, 21 nt, Homo sapiens
guccgccuggccggcuccagu

SEQ ID NO: 2160424 - RNA, 18 nt, Homo sapiens
uggauguaauucucauga

SEQ ID NO: 2160425 - RNA, 14 nt, Homo sapiens
ucccagcugccaug

SEQ ID NO: 2160426 - RNA, 15 nt, Homo sapiens
auuuucuacaaccua

SEQ ID NO: 2160427 - RNA, 22 nt, Homo sapiens
acaaaauggucauccaaacuca

SEQ ID NO: 2160428 - RNA, 22 nt, Homo sapiens
ucugcugagcagcccagcacaa

SEQ ID NO: 2160429 - RNA, 13 nt, Homo sapiens
ccuacuuuagcca

SEQ ID NO: 2160430 - RNA, 16 nt, Homo sapiens
uuuuggaaccuaauaa

SEQ ID NO: 2160431 - RNA, 13 nt, Homo sapiens
acugucagccuca

SEQ ID NO: 2160432 - RNA, 14 nt, Homo sapiens
gacacauugcccca

SEQ ID NO: 2160433 - RNA, 14 nt, Homo sapiens
aaaccgaaacugac

SEQ ID NO: 2160434 - RNA, 18 nt, Homo sapiens
caaaguaaaggccuccuc

SEQ ID NO: 2160435 - RNA, 18 nt, Homo sapiens
aaguaccuguagugagaa

SEQ ID NO: 2160436 - RNA, 12 nt, Homo sapiens
ccaggaccccau

SEQ ID NO: 2160437 - RNA, 23 nt, Homo sapiens
gcaccauacauuauuucuuccca

SEQ ID NO: 2160438 - RNA, 17 nt, Homo sapiens
aagagaauuuacuuuuc

SEQ ID NO: 2160439 - RNA, 12 nt, Homo sapiens
uccuacagccuc

SEQ ID NO: 2160440 - RNA, 17 nt, Homo sapiens
aggcucuguauuugcuc

SEQ ID NO: 2160441 - RNA, 12 nt, Homo sapiens
ugcuugugccac

SEQ ID NO: 2160442 - RNA, 21 nt, Homo sapiens
uucuuuguuuggauugcagca

SEQ ID NO: 2160443 - RNA, 21 nt, Homo sapiens
ucugaaggagccccauuccug

SEQ ID NO: 2160444 - RNA, 22 nt, Homo sapiens
uaacccuuugugugcucuccau

SEQ ID NO: 2160445 - RNA, 22 nt, Homo sapiens
gaggagggaugcugccugaguc

SEQ ID NO: 2160446 - RNA, 19 nt, Homo sapiens
auaaauagaugaguccugu

SEQ ID NO: 2160447 - RNA, 22 nt, Homo sapiens
guaauccuguacaauugcauca

SEQ ID NO: 2160448 - RNA, 14 nt, Homo sapiens
gguuaagagcucag

SEQ ID NO: 2160449 - RNA, 22 nt, Homo sapiens
gaauuguuguauuccuucugca

SEQ ID NO: 2160450 - RNA, 12 nt, Homo sapiens
cucugugcugca

SEQ ID NO: 2160451 - RNA, 19 nt, Homo sapiens
ccucagaauauuaagcaca

SEQ ID NO: 2160452 - RNA, 18 nt, Homo sapiens
gcagugugcaguggugca

SEQ ID NO: 2160453 - RNA, 14 nt, Homo sapiens
acauaggugcucuu

SEQ ID NO: 2160454 - RNA, 22 nt, Homo sapiens
gcaacaggaaucucagagacag

SEQ ID NO: 2160455 - RNA, 17 nt, Homo sapiens
gaguagcuuuacacugc

SEQ ID NO: 2160456 - RNA, 13 nt, Homo sapiens
uccuacaagacac

SEQ ID NO: 2160457 - RNA, 15 nt, Homo sapiens
uugcauuuguaaaaa

SEQ ID NO: 2160458 - RNA, 16 nt, Homo sapiens
acuucugcuggcauca

SEQ ID NO: 2160459 - RNA, 14 nt, Homo sapiens
aacuucccugaaaa

SEQ ID NO: 2160460 - RNA, 12 nt, Homo sapiens
uucucugccuca

SEQ ID NO: 2160461 - RNA, 17 nt, Homo sapiens
gaaugcagaagcaaaca

SEQ ID NO: 2160462 - RNA, 19 nt, Homo sapiens
cgcccuguguccacaguga

SEQ ID NO: 2160463 - RNA, 16 nt, Homo sapiens
uaacacgguuacugac

SEQ ID NO: 2160464 - RNA, 15 nt, Homo sapiens
ccuuccucuuccugc

SEQ ID NO: 2160465 - RNA, 23 nt, Homo sapiens
ugcucagaaauuuucugaucuca

SEQ ID NO: 2160466 - RNA, 19 nt, Homo sapiens
cccaagguucugguuccau

SEQ ID NO: 2160467 - RNA, 18 nt, Homo sapiens
auaacauuuaaauuccac

SEQ ID NO: 2160468 - RNA, 15 nt, Homo sapiens
ugaaacacagucaug

SEQ ID NO: 2160469 - RNA, 15 nt, Homo sapiens
uaacaugcaauaaca

SEQ ID NO: 2160470 - RNA, 14 nt, Homo sapiens
uagcauuccaucaa

SEQ ID NO: 2160471 - RNA, 19 nt, Homo sapiens
gccauacuuccagcgaaau

SEQ ID NO: 2160472 - RNA, 13 nt, Homo sapiens
cugaucugaugca

SEQ ID NO: 2160473 - RNA, 19 nt, Homo sapiens
gacuucagaguacauccau

SEQ ID NO: 2160474 - RNA, 16 nt, Homo sapiens
acuuucacacuaagaa

SEQ ID NO: 2160475 - RNA, 20 nt, Homo sapiens
guguccgaccuacguuccug

SEQ ID NO: 2160476 - RNA, 20 nt, Homo sapiens
uucaggccaucgacauguau

SEQ ID NO: 2160477 - RNA, 19 nt, Homo sapiens
uaugacuggaguaaaccau

SEQ ID NO: 2160478 - RNA, 15 nt, Homo sapiens
cucaccgugcugucu

SEQ ID NO: 2160479 - RNA, 18 nt, Homo sapiens
gaugucugccacaccucu

SEQ ID NO: 2160480 - RNA, 17 nt, Homo sapiens
uaggaaagcagugcagu

SEQ ID NO: 2160481 - RNA, 16 nt, Homo sapiens
gcuugggcuggagugg

SEQ ID NO: 2160482 - RNA, 15 nt, Homo sapiens
guuugaauguuaaau

SEQ ID NO: 2160483 - RNA, 15 nt, Homo sapiens
aaaguccuuggacug

SEQ ID NO: 2160484 - RNA, 17 nt, Homo sapiens
cuggaugugggccaagu

SEQ ID NO: 2160485 - RNA, 17 nt, Homo sapiens
guccuccggggcucagc

SEQ ID NO: 2160486 - RNA, 19 nt, Homo sapiens
auuuaauaugggugaacac

SEQ ID NO: 2160487 - RNA, 20 nt, Homo sapiens
uuucuuuugugcagaucacu

SEQ ID NO: 2160488 - RNA, 17 nt, Homo sapiens
uuggcuuaaauaaucuc

SEQ ID NO: 2160489 - RNA, 19 nt, Homo sapiens
ugguugccuuaaaagaaau

SEQ ID NO: 2160490 - RNA, 11 nt, Homo sapiens
cucaggaccau

SEQ ID NO: 2160491 - RNA, 17 nt, Homo sapiens
gugccauauucugugau

SEQ ID NO: 2160492 - RNA, 14 nt, Homo sapiens
gcucaucacuggau

SEQ ID NO: 2160493 - RNA, 18 nt, Homo sapiens
uaaucagcaauauugccu

SEQ ID NO: 2160494 - RNA, 16 nt, Homo sapiens
caaaucucauguucaa

SEQ ID NO: 2160495 - RNA, 16 nt, Homo sapiens
ucacauuugcguguau

SEQ ID NO: 2160496 - RNA, 19 nt, Homo sapiens
aacugugcuccucacuucc

SEQ ID NO: 2160497 - RNA, 19 nt, Homo sapiens
ggauucuuaaaguugaauu

SEQ ID NO: 2160498 - RNA, 18 nt, Homo sapiens
gcuuuacagugccacgac

SEQ ID NO: 2160499 - RNA, 22 nt, Homo sapiens
aaaagggucuugggaaauauga

SEQ ID NO: 2160500 - RNA, 17 nt, Homo sapiens
ccaauuugcacauuaaa

SEQ ID NO: 2160501 - RNA, 15 nt, Homo sapiens
agugcugcagcuuug

SEQ ID NO: 2160502 - RNA, 13 nt, Homo sapiens
gccaggcucaggc

SEQ ID NO: 2160503 - RNA, 17 nt, Homo sapiens
gaagcaaagugcccaug

SEQ ID NO: 2160504 - RNA, 13 nt, Homo sapiens
cagaccucaaggg

SEQ ID NO: 2160505 - RNA, 15 nt, Homo sapiens
caacugagauguuaa

SEQ ID NO: 2160506 - RNA, 23 nt, Homo sapiens
gcuuguauuaucuguccaaaagg

SEQ ID NO: 2160507 - RNA, 15 nt, Homo sapiens
uuugaauguaugcuu

SEQ ID NO: 2160508 - RNA, 15 nt, Homo sapiens
cacccaggcuccaug

SEQ ID NO: 2160509 - RNA, 20 nt, Homo sapiens
uuugcuccgcucccaccgcc

SEQ ID NO: 2160510 - RNA, 16 nt, Homo sapiens
gaaaacugaaugucaa

SEQ ID NO: 2160511 - RNA, 21 nt, Homo sapiens
ggauuacaggcaugagccacu

SEQ ID NO: 2160512 - RNA, 22 nt, Homo sapiens
ugauuuuuauccaaucuuguuu

SEQ ID NO: 2160513 - RNA, 18 nt, Homo sapiens
ccgaggccagaaggcaaa

SEQ ID NO: 2160514 - RNA, 21 nt, Homo sapiens
gaauuuucuugaaacugugaa

SEQ ID NO: 2160515 - RNA, 19 nt, Homo sapiens
aaaguaauauaaugaugcu

SEQ ID NO: 2160516 - RNA, 13 nt, Homo sapiens
uguaaaagaugca

SEQ ID NO: 2160517 - RNA, 19 nt, Homo sapiens
auuccaaggaguuccauga

SEQ ID NO: 2160518 - RNA, 11 nt, Homo sapiens
guugagcaauu

SEQ ID NO: 2160519 - RNA, 20 nt, Homo sapiens
caguuucccuaucugcaaaa

SEQ ID NO: 2160520 - RNA, 18 nt, Homo sapiens
caggacagaaccacugag

SEQ ID NO: 2160521 - RNA, 19 nt, Homo sapiens
aaauccugacaaaagggac

SEQ ID NO: 2160522 - RNA, 11 nt, Homo sapiens
aagaacacagg

SEQ ID NO: 2160523 - RNA, 21 nt, Homo sapiens
ccgaccacggggccgacauug

SEQ ID NO: 2160524 - RNA, 23 nt, Homo sapiens
uccggcccccgucuuguaaaaag

SEQ ID NO: 2160525 - RNA, 17 nt, Homo sapiens
uaaacugugucuguccc

SEQ ID NO: 2160526 - RNA, 16 nt, Homo sapiens
gcuguccugcugcccu

SEQ ID NO: 2160527 - RNA, 16 nt, Homo sapiens
cauacauacauauaua

SEQ ID NO: 2160528 - RNA, 15 nt, Homo sapiens
guguggucauaucua

SEQ ID NO: 2160529 - RNA, 20 nt, Homo sapiens
aucuccuuuggaaggugaca

SEQ ID NO: 2160530 - RNA, 12 nt, Homo sapiens
guggaaugagug

SEQ ID NO: 2160531 - RNA, 23 nt, Homo sapiens
cagcuguggccuaggcuaccuca

SEQ ID NO: 2160532 - RNA, 13 nt, Homo sapiens
ucaucauuuccau

SEQ ID NO: 2160533 - RNA, 11 nt, Homo sapiens
aacuuagccau

SEQ ID NO: 2160534 - RNA, 21 nt, Homo sapiens
ugcacagagauaugcacacac

SEQ ID NO: 2160535 - RNA, 13 nt, Homo sapiens
caaauugcacuga

SEQ ID NO: 2160536 - RNA, 16 nt, Homo sapiens
aguguugcucagcucc

SEQ ID NO: 2160537 - RNA, 18 nt, Homo sapiens
uucuccuuaccgucuuga

SEQ ID NO: 2160538 - RNA, 17 nt, Homo sapiens
cuucccucucaugacuu

SEQ ID NO: 2160539 - RNA, 21 nt, Homo sapiens
auccauccuuuugcuucaucu

SEQ ID NO: 2160540 - RNA, 17 nt, Homo sapiens
agcugguacugauguuc

SEQ ID NO: 2160541 - RNA, 20 nt, Homo sapiens
aaccauccauaguaguauga

SEQ ID NO: 2160542 - RNA, 15 nt, Homo sapiens
agggagaccaugccu

SEQ ID NO: 2160543 - RNA, 22 nt, Homo sapiens
cuggaagcacagaaaacuagaa

SEQ ID NO: 2160544 - RNA, 22 nt, Homo sapiens
gaaggcuuucaggcuaccuuuu

SEQ ID NO: 2160545 - RNA, 22 nt, Homo sapiens
caaaucucuccaccucuaguca

SEQ ID NO: 2160546 - RNA, 22 nt, Homo sapiens
uagacacaucuauaauuuuaca

SEQ ID NO: 2160547 - RNA, 21 nt, Homo sapiens
cuguacccaccccagcacagc

SEQ ID NO: 2160548 - RNA, 15 nt, Homo sapiens
ugcaacauacaggug

SEQ ID NO: 2160549 - RNA, 17 nt, Homo sapiens
cccuagcaauacaggga

SEQ ID NO: 2160550 - RNA, 19 nt, Homo sapiens
auuucuaauucaguucuga

SEQ ID NO: 2160551 - RNA, 19 nt, Homo sapiens
ggaggccagcuaucugccu

SEQ ID NO: 2160552 - RNA, 23 nt, Homo sapiens
gaaaugguccaguacaaaagcac

SEQ ID NO: 2160553 - RNA, 14 nt, Homo sapiens
agugucuuuugaca

SEQ ID NO: 2160554 - RNA, 23 nt, Homo sapiens
uaugauguaaucucucugcagcu

SEQ ID NO: 2160555 - RNA, 21 nt, Homo sapiens
aggcacuuuuuaacauucuca

SEQ ID NO: 2160556 - RNA, 14 nt, Homo sapiens
cuaauccacaaccu

SEQ ID NO: 2160557 - RNA, 12 nt, Homo sapiens
acagugaugauu

SEQ ID NO: 2160558 - RNA, 12 nt, Homo sapiens
acgauucaccug

SEQ ID NO: 2160559 - RNA, 14 nt, Homo sapiens
aguaaaagaugaag

SEQ ID NO: 2160560 - RNA, 12 nt, Homo sapiens
uuauaacccaaa

SEQ ID NO: 2160561 - RNA, 15 nt, Homo sapiens
caaaauacacauucu

SEQ ID NO: 2160562 - RNA, 18 nt, Homo sapiens
cucaguaaccaugcaaaa

SEQ ID NO: 2160563 - RNA, 20 nt, Homo sapiens
gugugguauucaacuaauac

SEQ ID NO: 2160564 - RNA, 20 nt, Homo sapiens
gggcacauuucuggauagaa

SEQ ID NO: 2160565 - RNA, 19 nt, Homo sapiens
uauauagaaaaugcuaaag

SEQ ID NO: 2160566 - RNA, 20 nt, Homo sapiens
acacauaguguuuguaacac

SEQ ID NO: 2160567 - RNA, 17 nt, Homo sapiens
aggcuucccacacugcc

SEQ ID NO: 2160568 - RNA, 19 nt, Homo sapiens
gguuucaaaucagccagcu

SEQ ID NO: 2160569 - RNA, 22 nt, Homo sapiens
ucccugcccaccuccuggagaa

SEQ ID NO: 2160570 - RNA, 19 nt, Homo sapiens
gaauuggcuaaaagacaug

SEQ ID NO: 2160571 - RNA, 14 nt, Homo sapiens
cugggguugccaga

SEQ ID NO: 2160572 - RNA, 18 nt, Homo sapiens
gcaacuggcucaaagaca

SEQ ID NO: 2160573 - RNA, 13 nt, Homo sapiens
ugugaagauuuca

SEQ ID NO: 2160574 - RNA, 16 nt, Homo sapiens
uaaaaauaaauucaaa

SEQ ID NO: 2160575 - RNA, 12 nt, Homo sapiens
acucacaugccg

SEQ ID NO: 2160576 - RNA, 15 nt, Homo sapiens
acuagcauccacuga

SEQ ID NO: 2160577 - RNA, 15 nt, Homo sapiens
uccccucaaggacaa

SEQ ID NO: 2160578 - RNA, 19 nt, Homo sapiens
uguaacaggaccccaagga

SEQ ID NO: 2160579 - RNA, 16 nt, Homo sapiens
gacucaaaacccaucu

SEQ ID NO: 2160580 - RNA, 20 nt, Homo sapiens
aaaagcaggcuucuaugaaa

SEQ ID NO: 2160581 - RNA, 17 nt, Homo sapiens
uuaaagaguaaagcagc

SEQ ID NO: 2160582 - RNA, 22 nt, Homo sapiens
auugaccaagaacugcauggac

SEQ ID NO: 2160583 - RNA, 18 nt, Homo sapiens
auucguuacuguugugaa

SEQ ID NO: 2160584 - RNA, 14 nt, Homo sapiens
gaaucauuaucuua

SEQ ID NO: 2160585 - RNA, 21 nt, Homo sapiens
ccaguaucauacguugauagu

SEQ ID NO: 2160586 - RNA, 19 nt, Homo sapiens
uggauguguucucuaggcc

SEQ ID NO: 2160587 - RNA, 18 nt, Homo sapiens
uggguuugccaagcccuu

SEQ ID NO: 2160588 - RNA, 17 nt, Homo sapiens
uggaaaaaaaccacagc

SEQ ID NO: 2160589 - RNA, 22 nt, Homo sapiens
uagcagauuucuugcuucauau

SEQ ID NO: 2160590 - RNA, 20 nt, Homo sapiens
cagaauucucagaaucucaa

SEQ ID NO: 2160591 - RNA, 16 nt, Homo sapiens
cauucucaaagccucu

SEQ ID NO: 2160592 - RNA, 19 nt, Homo sapiens
acuguuucuggacccuuau

SEQ ID NO: 2160593 - RNA, 20 nt, Homo sapiens
aaauucugccgucugagguu

SEQ ID NO: 2160594 - RNA, 16 nt, Homo sapiens
gcuguauaaagcaugu

SEQ ID NO: 2160595 - RNA, 22 nt, Homo sapiens
cugcaguagugcaccaucucac

SEQ ID NO: 2160596 - RNA, 15 nt, Homo sapiens
ugucgcgcacacagc

SEQ ID NO: 2160597 - RNA, 16 nt, Homo sapiens
agaaauucaauugaug

SEQ ID NO: 2160598 - RNA, 15 nt, Homo sapiens
acauaggcagcacua

SEQ ID NO: 2160599 - RNA, 20 nt, Homo sapiens
ggcugucuucucccagagca

SEQ ID NO: 2160600 - RNA, 23 nt, Homo sapiens
agggacuucccuagaagucuuca

SEQ ID NO: 2160601 - RNA, 21 nt, Homo sapiens
uuuuacaguagaacucaucua

SEQ ID NO: 2160602 - RNA, 17 nt, Homo sapiens
aggccugagacccagga

SEQ ID NO: 2160603 - RNA, 14 nt, Homo sapiens
aacugaucucaggu

SEQ ID NO: 2160604 - RNA, 21 nt, Homo sapiens
gugccugacucugugcugagc

SEQ ID NO: 2160605 - RNA, 22 nt, Homo sapiens
cagucucuucgaggcuuuacag

SEQ ID NO: 2160606 - RNA, 14 nt, Homo sapiens
cacugaacaggcug

SEQ ID NO: 2160607 - RNA, 17 nt, Homo sapiens
accccuaacauacugca

SEQ ID NO: 2160608 - RNA, 15 nt, Homo sapiens
gcuggccagauuucc

SEQ ID NO: 2160609 - RNA, 20 nt, Homo sapiens
cuugaggccaagauggcugc

SEQ ID NO: 2160610 - RNA, 15 nt, Homo sapiens
ugcaccguugacuca

SEQ ID NO: 2160611 - RNA, 18 nt, Homo sapiens
agacccauccugaacugg

SEQ ID NO: 2160612 - RNA, 23 nt, Homo sapiens
cauuuaaccccuugguacugaaa

SEQ ID NO: 2160613 - RNA, 21 nt, Homo sapiens
cacacagauaccccacguucu

SEQ ID NO: 2160614 - RNA, 18 nt, Homo sapiens
gccaggccagagggcagu

SEQ ID NO: 2160615 - RNA, 13 nt, Homo sapiens
gacuuacugucag

SEQ ID NO: 2160616 - RNA, 20 nt, Homo sapiens
guaaaacagaauauucugua

SEQ ID NO: 2160617 - RNA, 14 nt, Homo sapiens
acugagguuuacau

SEQ ID NO: 2160618 - RNA, 21 nt, Homo sapiens
ugauggccaggccucagggac

SEQ ID NO: 2160619 - RNA, 15 nt, Homo sapiens
caccugaaacacugg

SEQ ID NO: 2160620 - RNA, 16 nt, Homo sapiens
gauccucccaucucag

SEQ ID NO: 2160621 - RNA, 13 nt, Homo sapiens
caguuuaaugucu

SEQ ID NO: 2160622 - RNA, 15 nt, Homo sapiens
gcccaagaacugcag

SEQ ID NO: 2160623 - RNA, 13 nt, Homo sapiens
acuggaguccagu

SEQ ID NO: 2160624 - RNA, 13 nt, Homo sapiens
aauuauugauaca

SEQ ID NO: 2160625 - RNA, 15 nt, Homo sapiens
gagggccaccggugg

SEQ ID NO: 2160626 - RNA, 22 nt, Homo sapiens
auuguguucucuauugcugcuc

SEQ ID NO: 2160627 - RNA, 16 nt, Homo sapiens
ucucaucagacucuga

SEQ ID NO: 2160628 - RNA, 14 nt, Homo sapiens
caugccucugaggc

SEQ ID NO: 2160629 - RNA, 22 nt, Homo sapiens
cuucauaagauauucuuuacaa

SEQ ID NO: 2160630 - RNA, 23 nt, Homo sapiens
gcuucucugccgguggggccagc

SEQ ID NO: 2160631 - RNA, 22 nt, Homo sapiens
gccaagaucacgccauugcacu

SEQ ID NO: 2160632 - RNA, 13 nt, Homo sapiens
ggugucugcccug

SEQ ID NO: 2160633 - RNA, 22 nt, Homo sapiens
acaaagcaggaguggaagguga

SEQ ID NO: 2160634 - RNA, 22 nt, Homo sapiens
uucaucauugcuugcuugccuu

SEQ ID NO: 2160635 - RNA, 12 nt, Homo sapiens
guauuaaacuug

SEQ ID NO: 2160636 - RNA, 15 nt, Homo sapiens
uacaaaagcauguga

SEQ ID NO: 2160637 - RNA, 13 nt, Homo sapiens
cccaacagcacuu

SEQ ID NO: 2160638 - RNA, 18 nt, Homo sapiens
guuugacgacagugcauu

SEQ ID NO: 2160639 - RNA, 18 nt, Homo sapiens
gaaggccgagaagcaaga

SEQ ID NO: 2160640 - RNA, 13 nt, Homo sapiens
uccuaugcuauug

SEQ ID NO: 2160641 - RNA, 16 nt, Homo sapiens
agggccaccuccacac

SEQ ID NO: 2160642 - RNA, 16 nt, Homo sapiens
uaaaaaugucaucuca

SEQ ID NO: 2160643 - RNA, 20 nt, Homo sapiens
acccuuuggccccacuuuga

SEQ ID NO: 2160644 - RNA, 14 nt, Homo sapiens
accaucccaaagcc

SEQ ID NO: 2160645 - RNA, 22 nt, Homo sapiens
accccccagaaccuguccuugc

SEQ ID NO: 2160646 - RNA, 22 nt, Homo sapiens
cuggacaugccuguccugaaag

SEQ ID NO: 2160647 - RNA, 16 nt, Homo sapiens
uaccuuuccacccaga

SEQ ID NO: 2160648 - RNA, 22 nt, Homo sapiens
aguuucuccaaaaguggucagu

SEQ ID NO: 2160649 - RNA, 16 nt, Homo sapiens
gaggagcacaguuugu

SEQ ID NO: 2160650 - RNA, 12 nt, Homo sapiens
uuacaagugcag

SEQ ID NO: 2160651 - RNA, 23 nt, Homo sapiens
uggacacuuugaaauguguuucu

SEQ ID NO: 2160652 - RNA, 18 nt, Homo sapiens
cuucaucgggguggugca

SEQ ID NO: 2160653 - RNA, 13 nt, Homo sapiens
gauccgacuuugg

SEQ ID NO: 2160654 - RNA, 19 nt, Homo sapiens
aacccuuuugucugccucu

SEQ ID NO: 2160655 - RNA, 19 nt, Homo sapiens
cuaugaaugauacccugaa

SEQ ID NO: 2160656 - RNA, 23 nt, Homo sapiens
ugaacuguugguauuaaggcaga

SEQ ID NO: 2160657 - RNA, 22 nt, Homo sapiens
ucaagucuuccugauacaugac

SEQ ID NO: 2160658 - RNA, 23 nt, Homo sapiens
auuauuugguauguguuuugcuu

SEQ ID NO: 2160659 - RNA, 22 nt, Homo sapiens
cagagagaggggagaagccugg

SEQ ID NO: 2160660 - RNA, 18 nt, Homo sapiens
ccaggggggacaauaugu

SEQ ID NO: 2160661 - RNA, 14 nt, Homo sapiens
guagucaugcugug

SEQ ID NO: 2160662 - RNA, 18 nt, Homo sapiens
guuaucaaaaaguauuau

SEQ ID NO: 2160663 - RNA, 22 nt, Homo sapiens
ccugagccuuggggaguccaca

SEQ ID NO: 2160664 - RNA, 18 nt, Homo sapiens
uuaaaauggcuacacuca

SEQ ID NO: 2160665 - RNA, 18 nt, Homo sapiens
ccugugcccaucaucucu

SEQ ID NO: 2160666 - RNA, 18 nt, Homo sapiens
uuucugguucugaugcca

SEQ ID NO: 2160667 - RNA, 21 nt, Homo sapiens
acacugugcaggcccaggcag

SEQ ID NO: 2160668 - RNA, 12 nt, Homo sapiens
caggaaaacugg

SEQ ID NO: 2160669 - RNA, 21 nt, Homo sapiens
cucccaugugugaugcugaca

SEQ ID NO: 2160670 - RNA, 11 nt, Homo sapiens
cagcacccacu

SEQ ID NO: 2160671 - RNA, 22 nt, Homo sapiens
uuaacuuuaccaugcucaauga

SEQ ID NO: 2160672 - RNA, 18 nt, Homo sapiens
ugaaacuguccaccaaga

SEQ ID NO: 2160673 - RNA, 14 nt, Homo sapiens
ccaggacuguguuu

SEQ ID NO: 2160674 - RNA, 21 nt, Homo sapiens
uguaaaaaugaaagugacuuu

SEQ ID NO: 2160675 - RNA, 13 nt, Homo sapiens
cucucucucugaa

SEQ ID NO: 2160676 - RNA, 18 nt, Homo sapiens
gggaugccaauuuccucu

SEQ ID NO: 2160677 - RNA, 24 nt, Homo sapiens
gcucaaucucagcuaacauuccau

SEQ ID NO: 2160678 - RNA, 14 nt, Homo sapiens
ucagaggaagcaca

SEQ ID NO: 2160679 - RNA, 15 nt, Homo sapiens
aguaaagacuauucu

SEQ ID NO: 2160680 - RNA, 22 nt, Homo sapiens
aggguugggcgugcuaccugca

SEQ ID NO: 2160681 - RNA, 22 nt, Homo sapiens
cguugacaaguuuuguggggcu

SEQ ID NO: 2160682 - RNA, 14 nt, Homo sapiens
aaccagauugucag

SEQ ID NO: 2160683 - RNA, 12 nt, Homo sapiens
aucugacuucua

SEQ ID NO: 2160684 - RNA, 19 nt, Homo sapiens
cccacaugcuccagauuag

SEQ ID NO: 2160685 - RNA, 13 nt, Homo sapiens
agcuuacaagacc

SEQ ID NO: 2160686 - RNA, 12 nt, Homo sapiens
cauggaugcaca

SEQ ID NO: 2160687 - RNA, 13 nt, Homo sapiens
cuuuguuuacuua

SEQ ID NO: 2160688 - RNA, 19 nt, Homo sapiens
uacaugaagcuucaugcac

SEQ ID NO: 2160689 - RNA, 22 nt, Homo sapiens
acccccauagcagcagugcaug

SEQ ID NO: 2160690 - RNA, 20 nt, Homo sapiens
caagcauugcuucagaauga

SEQ ID NO: 2160691 - RNA, 17 nt, Homo sapiens
uuuuuauucuccuccuc

SEQ ID NO: 2160692 - RNA, 18 nt, Homo sapiens
ucuuccuacaugucuaca

SEQ ID NO: 2160693 - RNA, 23 nt, Homo sapiens
agaaauaauuuuauuccagacag

SEQ ID NO: 2160694 - RNA, 22 nt, Homo sapiens
cacccugcuacacauacaggau

SEQ ID NO: 2160695 - RNA, 20 nt, Homo sapiens
ugggauccuaagggcucacc

SEQ ID NO: 2160696 - RNA, 20 nt, Homo sapiens
uccauuuaaaaaugaucugu

SEQ ID NO: 2160697 - RNA, 19 nt, Homo sapiens
cugauauuuuaccucuuau

SEQ ID NO: 2160698 - RNA, 18 nt, Homo sapiens
uagucacucauccauccc

SEQ ID NO: 2160699 - RNA, 14 nt, Homo sapiens
cuugccacugcacu

SEQ ID NO: 2160700 - RNA, 19 nt, Homo sapiens
ggcagucuccccuuccugg

SEQ ID NO: 2160701 - RNA, 15 nt, Homo sapiens
cuccuugcugacccc

SEQ ID NO: 2160702 - RNA, 13 nt, Homo sapiens
uacugcauuucac

SEQ ID NO: 2160703 - RNA, 23 nt, Homo sapiens
uccaaaggaucuuuguuccucug

SEQ ID NO: 2160704 - RNA, 14 nt, Homo sapiens
uaaauauuaucuaa

SEQ ID NO: 2160705 - RNA, 23 nt, Homo sapiens
uagugccagaaagagagaaccaa

SEQ ID NO: 2160706 - RNA, 21 nt, Homo sapiens
uuaaucucugcugaaacucag

SEQ ID NO: 2160707 - RNA, 14 nt, Homo sapiens
ccccaaucccucaa

SEQ ID NO: 2160708 - RNA, 14 nt, Homo sapiens
cguccguccgcccg

SEQ ID NO: 2160709 - RNA, 20 nt, Homo sapiens
uguguaaagaucuacaugaa

SEQ ID NO: 2160710 - RNA, 16 nt, Homo sapiens
aaaucaaccccagacu

SEQ ID NO: 2160711 - RNA, 15 nt, Homo sapiens
gagauaguugcuaag

SEQ ID NO: 2160712 - RNA, 16 nt, Homo sapiens
uguugauaaaugacac

SEQ ID NO: 2160713 - RNA, 15 nt, Homo sapiens
cauggccugugcugg

SEQ ID NO: 2160714 - RNA, 14 nt, Homo sapiens
cuuagcaacagccg

SEQ ID NO: 2160715 - RNA, 18 nt, Homo sapiens
ucaacuaaaguuguacuu

SEQ ID NO: 2160716 - RNA, 11 nt, Homo sapiens
gagaagggaca

SEQ ID NO: 2160717 - RNA, 17 nt, Homo sapiens
uacuccaagccaaauac

SEQ ID NO: 2160718 - RNA, 14 nt, Homo sapiens
uaucauaugaacuu

SEQ ID NO: 2160719 - RNA, 14 nt, Homo sapiens
ucacuaaugcucaa

SEQ ID NO: 2160720 - RNA, 14 nt, Homo sapiens
uaacaaaugaucua

SEQ ID NO: 2160721 - RNA, 22 nt, Homo sapiens
aucuggaaaccucuacauauuu

SEQ ID NO: 2160722 - RNA, 20 nt, Homo sapiens
guuucagccguauaguggau

SEQ ID NO: 2160723 - RNA, 20 nt, Homo sapiens
cacaugguucaccaugcagu

SEQ ID NO: 2160724 - RNA, 17 nt, Homo sapiens
uucacuuaacaaacaaa

SEQ ID NO: 2160725 - RNA, 12 nt, Homo sapiens
aacauuugccaa

SEQ ID NO: 2160726 - RNA, 20 nt, Homo sapiens
acaaaacccucagcacuguu

SEQ ID NO: 2160727 - RNA, 23 nt, Homo sapiens
cuaaccacuuagcaugugugauu

SEQ ID NO: 2160728 - RNA, 16 nt, Homo sapiens
aggauaggaguucacu

SEQ ID NO: 2160729 - RNA, 19 nt, Homo sapiens
gagcagcuuuggaaacagg

SEQ ID NO: 2160730 - RNA, 20 nt, Homo sapiens
gaccauugagacauuugcca

SEQ ID NO: 2160731 - RNA, 15 nt, Homo sapiens
aagggaaagucagcu

SEQ ID NO: 2160732 - RNA, 13 nt, Homo sapiens
ccuuugcuucaaa

SEQ ID NO: 2160733 - RNA, 23 nt, Homo sapiens
cuuugauauuauguggcuuuuau

SEQ ID NO: 2160734 - RNA, 21 nt, Homo sapiens
uccaacccagccugagugcac

SEQ ID NO: 2160735 - RNA, 22 nt, Homo sapiens
auuagacuggaacuugaacuga

SEQ ID NO: 2160736 - RNA, 18 nt, Homo sapiens
agaguucuauuagaagcu

SEQ ID NO: 2160737 - RNA, 20 nt, Homo sapiens
ggcacauguauacauaugua

SEQ ID NO: 2160738 - RNA, 21 nt, Homo sapiens
agagaaauaaaauauggacuu

SEQ ID NO: 2160739 - RNA, 15 nt, Homo sapiens
gccagccaggaagau

SEQ ID NO: 2160740 - RNA, 13 nt, Homo sapiens
gaaacccaaccuu

SEQ ID NO: 2160741 - RNA, 18 nt, Homo sapiens
ucacagagugcauuguga

SEQ ID NO: 2160742 - RNA, 22 nt, Homo sapiens
uacuugggucacaugacucuca

SEQ ID NO: 2160743 - RNA, 21 nt, Homo sapiens
aaucagcauuagagaaaugaa

SEQ ID NO: 2160744 - RNA, 21 nt, Homo sapiens
cuaaaaaguggcuaauucaau

SEQ ID NO: 2160745 - RNA, 21 nt, Homo sapiens
caucucucugccccacauaau

SEQ ID NO: 2160746 - RNA, 19 nt, Homo sapiens
ugcaguacguucucaggau

SEQ ID NO: 2160747 - RNA, 16 nt, Homo sapiens
uuacuguaaaggcaag

SEQ ID NO: 2160748 - RNA, 15 nt, Homo sapiens
uacauuuguauuuau

SEQ ID NO: 2160749 - RNA, 15 nt, Homo sapiens
acagagaaagcagaa

SEQ ID NO: 2160750 - RNA, 17 nt, Homo sapiens
agccacaccuuuuccag

SEQ ID NO: 2160751 - RNA, 21 nt, Homo sapiens
uaauuacauccagaaagaagg

SEQ ID NO: 2160752 - RNA, 15 nt, Homo sapiens
cagagagacuggcca

SEQ ID NO: 2160753 - RNA, 12 nt, Homo sapiens
ucaggcuuucua

SEQ ID NO: 2160754 - RNA, 14 nt, Homo sapiens
gcucaaacacccaa

SEQ ID NO: 2160755 - RNA, 19 nt, Homo sapiens
ucuacugaaugucauugaa

SEQ ID NO: 2160756 - RNA, 22 nt, Homo sapiens
acagauccugcagucaauguuu

SEQ ID NO: 2160757 - RNA, 12 nt, Homo sapiens
acaaaaaccaaa

SEQ ID NO: 2160758 - RNA, 15 nt, Homo sapiens
aauuucuacuuugau

SEQ ID NO: 2160759 - RNA, 18 nt, Homo sapiens
cauuuuagaaacuacaaa

SEQ ID NO: 2160760 - RNA, 22 nt, Homo sapiens
caagaaacaaauaauagcaaug

SEQ ID NO: 2160761 - RNA, 22 nt, Homo sapiens
ugcccagagaugggacugggag

SEQ ID NO: 2160762 - RNA, 22 nt, Homo sapiens
cacagcacuaacacaugcacac

SEQ ID NO: 2160763 - RNA, 21 nt, Homo sapiens
ccaaauccaaggaaacaugca

SEQ ID NO: 2160764 - RNA, 13 nt, Homo sapiens
ccugcagacauga

SEQ ID NO: 2160765 - RNA, 14 nt, Homo sapiens
aagagcguguccag

SEQ ID NO: 2160766 - RNA, 20 nt, Homo sapiens
ucaaagaagucauucuuuaa

SEQ ID NO: 2160767 - RNA, 22 nt, Homo sapiens
accacugcacuucagucugugu

SEQ ID NO: 2160768 - RNA, 13 nt, Homo sapiens
aauacauguaucu

SEQ ID NO: 2160769 - RNA, 17 nt, Homo sapiens
ggcuucuccaaagggag

SEQ ID NO: 2160770 - RNA, 14 nt, Homo sapiens
gggaagaugagcau

SEQ ID NO: 2160771 - RNA, 15 nt, Homo sapiens
ugcuacugacccaga

SEQ ID NO: 2160772 - RNA, 22 nt, Homo sapiens
gaguucucagggcuccugccuu

SEQ ID NO: 2160773 - RNA, 21 nt, Homo sapiens
cugggauuacaggugugagcc

SEQ ID NO: 2160774 - RNA, 15 nt, Homo sapiens
cauuaggcaugccua

SEQ ID NO: 2160775 - RNA, 21 nt, Homo sapiens
gcaaaaagaugccuuuuacca

SEQ ID NO: 2160776 - RNA, 21 nt, Homo sapiens
gcaaggacggccuucaacuga

SEQ ID NO: 2160777 - RNA, 19 nt, Homo sapiens
ucagcggggcuacaguccu

SEQ ID NO: 2160778 - RNA, 17 nt, Homo sapiens
cagugugguuauguucc

SEQ ID NO: 2160779 - RNA, 21 nt, Homo sapiens
acagagauguccaaacugucg

SEQ ID NO: 2160780 - RNA, 21 nt, Homo sapiens
cacugaggaacucacaauucc

SEQ ID NO: 2160781 - RNA, 23 nt, Homo sapiens
ucaacuggggaauugaagccaau

SEQ ID NO: 2160782 - RNA, 23 nt, Homo sapiens
aagcuuuucuuuuuuaauuucca

SEQ ID NO: 2160783 - RNA, 15 nt, Homo sapiens
aauaugugccuuaag

SEQ ID NO: 2160784 - RNA, 13 nt, Homo sapiens
gaugaucuacuca

SEQ ID NO: 2160785 - RNA, 19 nt, Homo sapiens
ccaagguuuugaaauccca

SEQ ID NO: 2160786 - RNA, 19 nt, Homo sapiens
gccucacugaaacauggcu

SEQ ID NO: 2160787 - RNA, 13 nt, Homo sapiens
acuuguacuaugu

SEQ ID NO: 2160788 - RNA, 22 nt, Homo sapiens
uauuuaguuuuuaacaaucuaa

SEQ ID NO: 2160789 - RNA, 14 nt, Homo sapiens
gaaauaauagcaau

SEQ ID NO: 2160790 - RNA, 17 nt, Homo sapiens
aagcagcauucagcaca

SEQ ID NO: 2160791 - RNA, 24 nt, Homo sapiens
cuuccagggguuuacagucuauuu

SEQ ID NO: 2160792 - RNA, 15 nt, Homo sapiens
cacgccaaugcacac

SEQ ID NO: 2160793 - RNA, 15 nt, Homo sapiens
cacaccaaugcgcac

SEQ ID NO: 2160794 - RNA, 22 nt, Homo sapiens
auaaaugagcaaauggaacaau

SEQ ID NO: 2160795 - RNA, 20 nt, Homo sapiens
cugcuucacgauucuuaccc

SEQ ID NO: 2160796 - RNA, 18 nt, Homo sapiens
aaucccagcuacucagga

SEQ ID NO: 2160797 - RNA, 19 nt, Homo sapiens
caguucucacuccuaggag

SEQ ID NO: 2160798 - RNA, 22 nt, Homo sapiens
aauaugcccaauuucauaacua

SEQ ID NO: 2160799 - RNA, 17 nt, Homo sapiens
acagaccuacugcacug

SEQ ID NO: 2160800 - RNA, 20 nt, Homo sapiens
ccuccuggaaaaaacaaaaa

SEQ ID NO: 2160801 - RNA, 16 nt, Homo sapiens
ugacccucucacuuug

SEQ ID NO: 2160802 - RNA, 13 nt, Homo sapiens
agugucuaccugg

SEQ ID NO: 2160803 - RNA, 14 nt, Homo sapiens
uuccauauucugua

SEQ ID NO: 2160804 - RNA, 16 nt, Homo sapiens
agauggauagucuguc

SEQ ID NO: 2160805 - RNA, 14 nt, Homo sapiens
cuuucccaugguca

SEQ ID NO: 2160806 - RNA, 13 nt, Homo sapiens
aaaauacauauaa

SEQ ID NO: 2160807 - RNA, 13 nt, Homo sapiens
acaauacaucuaa

SEQ ID NO: 2160808 - RNA, 16 nt, Homo sapiens
agagaacaacuggcag

SEQ ID NO: 2160809 - RNA, 18 nt, Homo sapiens
ucuggauccagccaugcc

SEQ ID NO: 2160810 - RNA, 21 nt, Homo sapiens
accugguugcagcacauucac

SEQ ID NO: 2160811 - RNA, 21 nt, Homo sapiens
uggaccuuacgaucaggcaca

SEQ ID NO: 2160812 - RNA, 22 nt, Homo sapiens
ugccugugcacggccagcugca

SEQ ID NO: 2160813 - RNA, 21 nt, Homo sapiens
cucuggggucuuuuuaugcau

SEQ ID NO: 2160814 - RNA, 20 nt, Homo sapiens
uguuagcccaagacaccaug

SEQ ID NO: 2160815 - RNA, 20 nt, Homo sapiens
cucucugaagcgacucuccu

SEQ ID NO: 2160816 - RNA, 15 nt, Homo sapiens
ugugggccaccagag

SEQ ID NO: 2160817 - RNA, 13 nt, Homo sapiens
aucagagagccua

SEQ ID NO: 2160818 - RNA, 17 nt, Homo sapiens
acuaccccgacuauccc

SEQ ID NO: 2160819 - RNA, 17 nt, Homo sapiens
aguuaacacagaucaag

SEQ ID NO: 2160820 - RNA, 15 nt, Homo sapiens
ucccuggccacugaa

SEQ ID NO: 2160821 - RNA, 17 nt, Homo sapiens
aucuagcucuaguucaa

SEQ ID NO: 2160822 - RNA, 18 nt, Homo sapiens
cuccccuuguacucuugc

SEQ ID NO: 2160823 - RNA, 17 nt, Homo sapiens
aaggacaaagugccaaa

SEQ ID NO: 2160824 - RNA, 22 nt, Homo sapiens
guguguaugucuauguguauau

SEQ ID NO: 2160825 - RNA, 20 nt, Homo sapiens
uugaaauauaggaacuuaaa

SEQ ID NO: 2160826 - RNA, 24 nt, Homo sapiens
ucucagccuuagcacuauggacau

SEQ ID NO: 2160827 - RNA, 14 nt, Homo sapiens
cgcgcccggccuca

SEQ ID NO: 2160828 - RNA, 22 nt, Homo sapiens
agcugcagcucuccaccagcug

SEQ ID NO: 2160829 - RNA, 18 nt, Homo sapiens
ucacagaagggccuggau

SEQ ID NO: 2160830 - RNA, 16 nt, Homo sapiens
ucgccccucugggcug

SEQ ID NO: 2160831 - RNA, 11 nt, Homo sapiens
aucugaugaaa

SEQ ID NO: 2160832 - RNA, 18 nt, Homo sapiens
aagaugaaauugccaaaa

SEQ ID NO: 2160833 - RNA, 23 nt, Homo sapiens
ccuuccccagcgucccagucucu

SEQ ID NO: 2160834 - RNA, 17 nt, Homo sapiens
agggcaauuaauuccuu

SEQ ID NO: 2160835 - RNA, 20 nt, Homo sapiens
aaacacccaugaaucaaaga

SEQ ID NO: 2160836 - RNA, 20 nt, Homo sapiens
ugagucugcaucauccuccu

SEQ ID NO: 2160837 - RNA, 13 nt, Homo sapiens
guaaaacagucau

SEQ ID NO: 2160838 - RNA, 21 nt, Homo sapiens
aaagcaugugucaugcaugaa

SEQ ID NO: 2160839 - RNA, 20 nt, Homo sapiens
gagcauggagacagcaguuu

SEQ ID NO: 2160840 - RNA, 22 nt, Homo sapiens
aggacuccauuucuuucuucca

SEQ ID NO: 2160841 - RNA, 16 nt, Homo sapiens
ugcuuaggaaauugcu

SEQ ID NO: 2160842 - RNA, 13 nt, Homo sapiens
aacaauuuagcca

SEQ ID NO: 2160843 - RNA, 12 nt, Homo sapiens
aaacacugccau

SEQ ID NO: 2160844 - RNA, 21 nt, Homo sapiens
ggcucgucggggggacagcuc

SEQ ID NO: 2160845 - RNA, 22 nt, Homo sapiens
cugauuaauccauuuuaacaaa

SEQ ID NO: 2160846 - RNA, 14 nt, Homo sapiens
acaaauugaguuua

SEQ ID NO: 2160847 - RNA, 20 nt, Homo sapiens
ugagccaagaucgcaccacu

SEQ ID NO: 2160848 - RNA, 21 nt, Homo sapiens
aucugccuuaaaaccaaagag

SEQ ID NO: 2160849 - RNA, 22 nt, Homo sapiens
aauuggucauuccuaaugcauu

SEQ ID NO: 2160850 - RNA, 15 nt, Homo sapiens
cauucuauucuccag

SEQ ID NO: 2160851 - RNA, 15 nt, Homo sapiens
ugaaggcccugcuga

SEQ ID NO: 2160852 - RNA, 21 nt, Homo sapiens
gaaauauugacucaaaccaua

SEQ ID NO: 2160853 - RNA, 23 nt, Homo sapiens
acccaggugggucccggcucugu

SEQ ID NO: 2160854 - RNA, 19 nt, Homo sapiens
cacacacggaggccagaca

SEQ ID NO: 2160855 - RNA, 14 nt, Homo sapiens
cuacuacagcgcca

SEQ ID NO: 2160856 - RNA, 19 nt, Homo sapiens
uuucugaaauaacauggcc

SEQ ID NO: 2160857 - RNA, 17 nt, Homo sapiens
agcaggagugcucaaua

SEQ ID NO: 2160858 - RNA, 17 nt, Homo sapiens
gacugugguagccagca

SEQ ID NO: 2160859 - RNA, 20 nt, Homo sapiens
ucucaugaacuaccccacaa

SEQ ID NO: 2160860 - RNA, 14 nt, Homo sapiens
agagaauauuauaa

SEQ ID NO: 2160861 - RNA, 14 nt, Homo sapiens
cuuaauuuaaguca

SEQ ID NO: 2160862 - RNA, 13 nt, Homo sapiens
uuguacucaaagc

SEQ ID NO: 2160863 - RNA, 19 nt, Homo sapiens
ccuauacaaaacaccagac

SEQ ID NO: 2160864 - RNA, 22 nt, Homo sapiens
agugguauccuuacuagauuca

SEQ ID NO: 2160865 - RNA, 22 nt, Homo sapiens
ucaacacauuuuuaagaugcau

SEQ ID NO: 2160866 - RNA, 21 nt, Homo sapiens
cgcagacacaugugcuggcca

SEQ ID NO: 2160867 - RNA, 18 nt, Homo sapiens
aucacauuuuaagugcuu

SEQ ID NO: 2160868 - RNA, 19 nt, Homo sapiens
aaccaaagagggcuuccuc

SEQ ID NO: 2160869 - RNA, 21 nt, Homo sapiens
uaaaaucacaaacucauccau

SEQ ID NO: 2160870 - RNA, 14 nt, Homo sapiens
gugcacagccaugg

SEQ ID NO: 2160871 - RNA, 17 nt, Homo sapiens
augagaggacugaugaa

SEQ ID NO: 2160872 - RNA, 17 nt, Homo sapiens
ccagccccacugccagc

SEQ ID NO: 2160873 - RNA, 23 nt, Homo sapiens
uuaagccugauuuuccugaugcu

SEQ ID NO: 2160874 - RNA, 16 nt, Homo sapiens
uuccuacugggggcaa

SEQ ID NO: 2160875 - RNA, 15 nt, Homo sapiens
uguggcagcucuccc

SEQ ID NO: 2160876 - RNA, 17 nt, Homo sapiens
uccucaaucuuuuaccu

SEQ ID NO: 2160877 - RNA, 13 nt, Homo sapiens
aaacccucgaggc

SEQ ID NO: 2160878 - RNA, 16 nt, Homo sapiens
gcccuccccacuuccc

SEQ ID NO: 2160879 - RNA, 16 nt, Homo sapiens
uaucauguuaaauuag

SEQ ID NO: 2160880 - RNA, 15 nt, Homo sapiens
guguauaugaaugaa

SEQ ID NO: 2160881 - RNA, 14 nt, Homo sapiens
cuguauaaguaaca

SEQ ID NO: 2160882 - RNA, 24 nt, Homo sapiens
guauuguaaaaaauucacauaaua

SEQ ID NO: 2160883 - RNA, 16 nt, Homo sapiens
agccacuucacuuuuu

SEQ ID NO: 2160884 - RNA, 13 nt, Homo sapiens
auaaauauuuagu

SEQ ID NO: 2160885 - RNA, 14 nt, Homo sapiens
gccuaggguccugu

SEQ ID NO: 2160886 - RNA, 17 nt, Homo sapiens
ggcccagggacauugca

SEQ ID NO: 2160887 - RNA, 21 nt, Homo sapiens
agcugccaaauaagauuccca

SEQ ID NO: 2160888 - RNA, 12 nt, Homo sapiens
cagcagacugau

SEQ ID NO: 2160889 - RNA, 13 nt, Homo sapiens
cauccugugccac

SEQ ID NO: 2160890 - RNA, 18 nt, Homo sapiens
uaagacuagauacucgug

SEQ ID NO: 2160891 - RNA, 16 nt, Homo sapiens
ucaacaaugguugaau

SEQ ID NO: 2160892 - RNA, 11 nt, Homo sapiens
acagugcaguu

SEQ ID NO: 2160893 - RNA, 18 nt, Homo sapiens
aagcucacugcugaucgu

SEQ ID NO: 2160894 - RNA, 20 nt, Homo sapiens
augaucccagucacuccucu

SEQ ID NO: 2160895 - RNA, 17 nt, Homo sapiens
cuuaauauaaaucguaa

SEQ ID NO: 2160896 - RNA, 20 nt, Homo sapiens
ugcuguguuuaaucagggga

SEQ ID NO: 2160897 - RNA, 19 nt, Homo sapiens
cuucucuauuucuggauga

SEQ ID NO: 2160898 - RNA, 16 nt, Homo sapiens
cuguggugauguugcc

SEQ ID NO: 2160899 - RNA, 14 nt, Homo sapiens
ucauguccagugag

SEQ ID NO: 2160900 - RNA, 14 nt, Homo sapiens
ucuaggguuuucca

SEQ ID NO: 2160901 - RNA, 14 nt, Homo sapiens
uggggcccaaaugc

SEQ ID NO: 2160902 - RNA, 21 nt, Homo sapiens
uuuacuggaccccgccuccca

SEQ ID NO: 2160903 - RNA, 22 nt, Homo sapiens
ugagacauauuagucuuugaaa

SEQ ID NO: 2160904 - RNA, 18 nt, Homo sapiens
cuugaggauguaaugcau

SEQ ID NO: 2160905 - RNA, 18 nt, Homo sapiens
cuucacuguggucauccu

SEQ ID NO: 2160906 - RNA, 22 nt, Homo sapiens
ggcagucugaacccuugugcuu

SEQ ID NO: 2160907 - RNA, 20 nt, Homo sapiens
acuguaaugagucagugaag

SEQ ID NO: 2160908 - RNA, 14 nt, Homo sapiens
cagaguuugccuuc

SEQ ID NO: 2160909 - RNA, 16 nt, Homo sapiens
uuacuguugaacaaua

SEQ ID NO: 2160910 - RNA, 19 nt, Homo sapiens
ucuccaggacaaccugcug

SEQ ID NO: 2160911 - RNA, 18 nt, Homo sapiens
cagguugaagccaugucu

SEQ ID NO: 2160912 - RNA, 18 nt, Homo sapiens
ugcugcccugaugcgucu

SEQ ID NO: 2160913 - RNA, 16 nt, Homo sapiens
cuguuacuauuccuuu

SEQ ID NO: 2160914 - RNA, 16 nt, Homo sapiens
augaaaguugcaggaa

SEQ ID NO: 2160915 - RNA, 15 nt, Homo sapiens
cggggcccacgcacg

SEQ ID NO: 2160916 - RNA, 12 nt, Homo sapiens
guagaugcauua

SEQ ID NO: 2160917 - RNA, 14 nt, Homo sapiens
gccuguugaaucug

SEQ ID NO: 2160918 - RNA, 15 nt, Homo sapiens
caagcaaucaaauaa

SEQ ID NO: 2160919 - RNA, 20 nt, Homo sapiens
ucugaguaagcccucaggag

SEQ ID NO: 2160920 - RNA, 23 nt, Homo sapiens
uggucuaaaaauaaaccaaagga

SEQ ID NO: 2160921 - RNA, 23 nt, Homo sapiens
cucauucccaacgugcaaagcca

SEQ ID NO: 2160922 - RNA, 22 nt, Homo sapiens
cuauuuuuauuuguuugugcau

SEQ ID NO: 2160923 - RNA, 19 nt, Homo sapiens
gagcuauuuuccucuggcc

SEQ ID NO: 2160924 - RNA, 14 nt, Homo sapiens
acggggucuugcuc

SEQ ID NO: 2160925 - RNA, 22 nt, Homo sapiens
guucagaaccaagaugccaaca

SEQ ID NO: 2160926 - RNA, 17 nt, Homo sapiens
auucaacacacacaugc

SEQ ID NO: 2160927 - RNA, 19 nt, Homo sapiens
acccaauaaaacugauguu

SEQ ID NO: 2160928 - RNA, 23 nt, Homo sapiens
gcuuugccagagcgugcuuucaa

SEQ ID NO: 2160929 - RNA, 15 nt, Homo sapiens
caagcacuaccagua

SEQ ID NO: 2160930 - RNA, 18 nt, Homo sapiens
uuccugauugauuugggu

SEQ ID NO: 2160931 - RNA, 14 nt, Homo sapiens
auugugaugcuccu

SEQ ID NO: 2160932 - RNA, 19 nt, Homo sapiens
aaagaaaccuuccaaugcu

SEQ ID NO: 2160933 - RNA, 15 nt, Homo sapiens
ccuuucacacuggau

SEQ ID NO: 2160934 - RNA, 16 nt, Homo sapiens
gaaguucuggagaaag

SEQ ID NO: 2160935 - RNA, 23 nt, Homo sapiens
gaguuuuaaagaagucucuuaau

SEQ ID NO: 2160936 - RNA, 12 nt, Homo sapiens
gggaagggugca

SEQ ID NO: 2160937 - RNA, 19 nt, Homo sapiens
gcaaaucuacagauccuuu

SEQ ID NO: 2160938 - RNA, 23 nt, Homo sapiens
gcugaggcugucauuccaugagu

SEQ ID NO: 2160939 - RNA, 17 nt, Homo sapiens
uaacuuuccacucuucc

SEQ ID NO: 2160940 - RNA, 23 nt, Homo sapiens
cagugcgugcucccgaugcugcu

SEQ ID NO: 2160941 - RNA, 15 nt, Homo sapiens
ugcaaauacuuccaa

SEQ ID NO: 2160942 - RNA, 15 nt, Homo sapiens
cuuacuuaugccaua

SEQ ID NO: 2160943 - RNA, 14 nt, Homo sapiens
auggugaagggaag

SEQ ID NO: 2160944 - RNA, 22 nt, Homo sapiens
agcaggcagcuucuacuccugc

SEQ ID NO: 2160945 - RNA, 15 nt, Homo sapiens
ugcugauuuggugac

SEQ ID NO: 2160946 - RNA, 15 nt, Homo sapiens
cucaguuucugaguc

SEQ ID NO: 2160947 - RNA, 13 nt, Homo sapiens
gacagccaaaagu

SEQ ID NO: 2160948 - RNA, 15 nt, Homo sapiens
uuuucaagagcuccu

SEQ ID NO: 2160949 - RNA, 16 nt, Homo sapiens
cugaaaagccaugugu

SEQ ID NO: 2160950 - RNA, 20 nt, Homo sapiens
agaagaugaaagauucagug

SEQ ID NO: 2160951 - RNA, 15 nt, Homo sapiens
caugaucccacugac

SEQ ID NO: 2160952 - RNA, 12 nt, Homo sapiens
gguugcagucac

SEQ ID NO: 2160953 - RNA, 13 nt, Homo sapiens
agauaacacugac

SEQ ID NO: 2160954 - RNA, 19 nt, Homo sapiens
uuugcuauuagagcauuga

SEQ ID NO: 2160955 - RNA, 18 nt, Homo sapiens
uaauacaguuuucuauuc

SEQ ID NO: 2160956 - RNA, 22 nt, Homo sapiens
auccuagccccgagacaccauc

SEQ ID NO: 2160957 - RNA, 22 nt, Homo sapiens
gcaaauaaaugaacugacuuca

SEQ ID NO: 2160958 - RNA, 15 nt, Homo sapiens
aacguucaugcauuu

SEQ ID NO: 2160959 - RNA, 23 nt, Homo sapiens
agugaaucauccagacuccucau

SEQ ID NO: 2160960 - RNA, 18 nt, Homo sapiens
uuuucaaugcacauuagu

SEQ ID NO: 2160961 - RNA, 12 nt, Homo sapiens
gccucacugggg

SEQ ID NO: 2160962 - RNA, 18 nt, Homo sapiens
uuaucaaauacaucucca

SEQ ID NO: 2160963 - RNA, 22 nt, Homo sapiens
gaagauauaacauucaguuccc

SEQ ID NO: 2160964 - RNA, 20 nt, Homo sapiens
aaaugaggacuucuggaaca

SEQ ID NO: 2160965 - RNA, 21 nt, Homo sapiens
acagcaugagguguugugcau

SEQ ID NO: 2160966 - RNA, 12 nt, Homo sapiens
gaagcagcauuu

SEQ ID NO: 2160967 - RNA, 11 nt, Homo sapiens
aaaaguucuca

SEQ ID NO: 2160968 - RNA, 19 nt, Homo sapiens
gcauggcuucacacuguuu

SEQ ID NO: 2160969 - RNA, 15 nt, Homo sapiens
aaucaaucacgugua

SEQ ID NO: 2160970 - RNA, 20 nt, Homo sapiens
aacucaccagccccacugcc

SEQ ID NO: 2160971 - RNA, 14 nt, Homo sapiens
uuuuguugagccag

SEQ ID NO: 2160972 - RNA, 17 nt, Homo sapiens
aucucaucccaacaaac

SEQ ID NO: 2160973 - RNA, 16 nt, Homo sapiens
ugacgacagugcauuu

SEQ ID NO: 2160974 - RNA, 14 nt, Homo sapiens
cugcuuuugcaaau

SEQ ID NO: 2160975 - RNA, 16 nt, Homo sapiens
guacaagcuacauaug

SEQ ID NO: 2160976 - RNA, 22 nt, Homo sapiens
gaaacaacuuguguucuauuaa

SEQ ID NO: 2160977 - RNA, 17 nt, Homo sapiens
ccucuguccccauagcu

SEQ ID NO: 2160978 - RNA, 23 nt, Homo sapiens
uugcagguggggguugcuguaua

SEQ ID NO: 2160979 - RNA, 20 nt, Homo sapiens
agaccaaauucuauccugug

SEQ ID NO: 2160980 - RNA, 15 nt, Homo sapiens
ugaggaauccaaaag

SEQ ID NO: 2160981 - RNA, 19 nt, Homo sapiens
cugagaucgugccauuaca

SEQ ID NO: 2160982 - RNA, 19 nt, Homo sapiens
cuuccgaguagcugggauu

SEQ ID NO: 2160983 - RNA, 16 nt, Homo sapiens
acucccuccaccagcc

SEQ ID NO: 2160984 - RNA, 17 nt, Homo sapiens
uccagcagaugccacau

SEQ ID NO: 2160985 - RNA, 16 nt, Homo sapiens
ccacucccugcuccac

SEQ ID NO: 2160986 - RNA, 14 nt, Homo sapiens
uaucugcggcuuua

SEQ ID NO: 2160987 - RNA, 15 nt, Homo sapiens
cauuuuuacuugaca

SEQ ID NO: 2160988 - RNA, 13 nt, Homo sapiens
uguguagcuguga

SEQ ID NO: 2160989 - RNA, 21 nt, Homo sapiens
gguuccucaggugaccaaaac

SEQ ID NO: 2160990 - RNA, 19 nt, Homo sapiens
gaacuuaagagaggggcca

SEQ ID NO: 2160991 - RNA, 21 nt, Homo sapiens
cucauaaguaaguuuggcaag

SEQ ID NO: 2160992 - RNA, 19 nt, Homo sapiens
cuaaguguaugaugucaca

SEQ ID NO: 2160993 - RNA, 19 nt, Homo sapiens
gacugcugugaaauggaga

SEQ ID NO: 2160994 - RNA, 21 nt, Homo sapiens
uguaacacuguauaacauuua

SEQ ID NO: 2160995 - RNA, 13 nt, Homo sapiens
uuacugucuauau

SEQ ID NO: 2160996 - RNA, 16 nt, Homo sapiens
ccagguguguucagua

SEQ ID NO: 2160997 - RNA, 16 nt, Homo sapiens
gcaaauaaaccacuuu

SEQ ID NO: 2160998 - RNA, 15 nt, Homo sapiens
aggucuucucuccaa

SEQ ID NO: 2160999 - RNA, 20 nt, Homo sapiens
ucagcuggacugcauugaag

SEQ ID NO: 2161000 - RNA, 16 nt, Homo sapiens
agaggauccaucacag

SEQ ID NO: 2161001 - RNA, 17 nt, Homo sapiens
uggccaggcugguuuca

SEQ ID NO: 2161002 - RNA, 14 nt, Homo sapiens
cuaauaaacugugu

SEQ ID NO: 2161003 - RNA, 17 nt, Homo sapiens
ccuuaauagacuucucu

SEQ ID NO: 2161004 - RNA, 18 nt, Homo sapiens
aagagaaggaagagaaaa

SEQ ID NO: 2161005 - RNA, 21 nt, Homo sapiens
aggugacccaaugauucagcu

SEQ ID NO: 2161006 - RNA, 21 nt, Homo sapiens
aaggagcaguggcccauguga

SEQ ID NO: 2161007 - RNA, 19 nt, Homo sapiens
ccagagaguccugugcuga

SEQ ID NO: 2161008 - RNA, 11 nt, Homo sapiens
uccaucaccug

SEQ ID NO: 2161009 - RNA, 15 nt, Homo sapiens
uuuugccacauuagc

SEQ ID NO: 2161010 - RNA, 14 nt, Homo sapiens
ucccaaagugcagg

SEQ ID NO: 2161011 - RNA, 23 nt, Homo sapiens
aagugcgugccgugugaguguga

SEQ ID NO: 2161012 - RNA, 15 nt, Homo sapiens
uaaugagcagaugag

SEQ ID NO: 2161013 - RNA, 15 nt, Homo sapiens
aaccucacugccuca

SEQ ID NO: 2161014 - RNA, 16 nt, Homo sapiens
aggcucagaggagcca

SEQ ID NO: 2161015 - RNA, 18 nt, Homo sapiens
gugcuaaacgcacacagu

SEQ ID NO: 2161016 - RNA, 17 nt, Homo sapiens
aacagcacccucuccag

SEQ ID NO: 2161017 - RNA, 14 nt, Homo sapiens
cuccacauucaugu

SEQ ID NO: 2161018 - RNA, 15 nt, Homo sapiens
aaacuugcugguccu

SEQ ID NO: 2161019 - RNA, 20 nt, Homo sapiens
ugcuuguaaaauuucacuua

SEQ ID NO: 2161020 - RNA, 23 nt, Homo sapiens
agccagguucccaggaggccuca

SEQ ID NO: 2161021 - RNA, 22 nt, Homo sapiens
ucuggcaggaagggacugccaa

SEQ ID NO: 2161022 - RNA, 13 nt, Homo sapiens
cuuuauccaaaag

SEQ ID NO: 2161023 - RNA, 22 nt, Homo sapiens
aaaguauauguuaaaaagugag

SEQ ID NO: 2161024 - RNA, 22 nt, Homo sapiens
gugccuccaggugugcacgugg

SEQ ID NO: 2161025 - RNA, 16 nt, Homo sapiens
uccugaacucagcuga

SEQ ID NO: 2161026 - RNA, 15 nt, Homo sapiens
cugugaagcaaaaag

SEQ ID NO: 2161027 - RNA, 15 nt, Homo sapiens
caaaccgagugcaau

SEQ ID NO: 2161028 - RNA, 14 nt, Homo sapiens
ccauuaaagagcca

SEQ ID NO: 2161029 - RNA, 14 nt, Homo sapiens
uuuaaaaugaagcu

SEQ ID NO: 2161030 - RNA, 16 nt, Homo sapiens
gacucugcacaugucu

SEQ ID NO: 2161031 - RNA, 15 nt, Homo sapiens
uuaaagaauucucuu

SEQ ID NO: 2161032 - RNA, 16 nt, Homo sapiens
gaaugguguuuuguca

SEQ ID NO: 2161033 - RNA, 14 nt, Homo sapiens
ucucagaagggagg

SEQ ID NO: 2161034 - RNA, 14 nt, Homo sapiens
acaacagacugcau

SEQ ID NO: 2161035 - RNA, 13 nt, Homo sapiens
ugggugacauuug

SEQ ID NO: 2161036 - RNA, 19 nt, Homo sapiens
cguagcuucuaccaugaac

SEQ ID NO: 2161037 - RNA, 22 nt, Homo sapiens
cccaugugugagugugugcaag

SEQ ID NO: 2161038 - RNA, 17 nt, Homo sapiens
cugaugccuuuuggacc

SEQ ID NO: 2161039 - RNA, 17 nt, Homo sapiens
auguuuuuaugauaucc

SEQ ID NO: 2161040 - RNA, 16 nt, Homo sapiens
ugaauggacaggagaa

SEQ ID NO: 2161041 - RNA, 17 nt, Homo sapiens
aacaggcuuggcaaaga

SEQ ID NO: 2161042 - RNA, 13 nt, Homo sapiens
ccagcacucugaa

SEQ ID NO: 2161043 - RNA, 20 nt, Homo sapiens
ucuuaagcagauagcacaua

SEQ ID NO: 2161044 - RNA, 18 nt, Homo sapiens
gccugccgcugcaggaaa

SEQ ID NO: 2161045 - RNA, 23 nt, Homo sapiens
uagccucaacucacuagaugcca

SEQ ID NO: 2161046 - RNA, 19 nt, Homo sapiens
uauuaaggauguagcuuuu

SEQ ID NO: 2161047 - RNA, 18 nt, Homo sapiens
ucccaagauaaaugguac

SEQ ID NO: 2161048 - RNA, 21 nt, Homo sapiens
uuaggcgggauuuaugugcac

SEQ ID NO: 2161049 - RNA, 16 nt, Homo sapiens
gaggggcugacucagu

SEQ ID NO: 2161050 - RNA, 21 nt, Homo sapiens
ucauagaauaacaacugcugg

SEQ ID NO: 2161051 - RNA, 14 nt, Homo sapiens
caaaucgcccccuu

SEQ ID NO: 2161052 - RNA, 16 nt, Homo sapiens
auccaaucucaucucu

SEQ ID NO: 2161053 - RNA, 16 nt, Homo sapiens
ugcugaaggguaauau

SEQ ID NO: 2161054 - RNA, 19 nt, Homo sapiens
uuugacacaguuguuucag

SEQ ID NO: 2161055 - RNA, 14 nt, Homo sapiens
cugcacuaauauaa

SEQ ID NO: 2161056 - RNA, 23 nt, Homo sapiens
gcaagaggugugcacaccaaagc

SEQ ID NO: 2161057 - RNA, 11 nt, Homo sapiens
acaucauaaaa

SEQ ID NO: 2161058 - RNA, 13 nt, Homo sapiens
gaugguccacugu

SEQ ID NO: 2161059 - RNA, 18 nt, Homo sapiens
ugucugccuucacaaaug

SEQ ID NO: 2161060 - RNA, 17 nt, Homo sapiens
caaagcuacuugaagga

SEQ ID NO: 2161061 - RNA, 13 nt, Homo sapiens
gagcuuauuacuu

SEQ ID NO: 2161062 - RNA, 15 nt, Homo sapiens
accagugauaaguca

SEQ ID NO: 2161063 - RNA, 22 nt, Homo sapiens
uucugugggcuuggccuugugu

SEQ ID NO: 2161064 - RNA, 22 nt, Homo sapiens
gacaacugccggggguucaggg

SEQ ID NO: 2161065 - RNA, 16 nt, Homo sapiens
caacuauuaagauauc

SEQ ID NO: 2161066 - RNA, 21 nt, Homo sapiens
cggaacuugauuaacuccucc

SEQ ID NO: 2161067 - RNA, 19 nt, Homo sapiens
caaaucccuuucaugucuu

SEQ ID NO: 2161068 - RNA, 20 nt, Homo sapiens
aaagaaguacuuuauugcaa

SEQ ID NO: 2161069 - RNA, 20 nt, Homo sapiens
uuuaaagguuaguauggaau

SEQ ID NO: 2161070 - RNA, 23 nt, Homo sapiens
acagauguggacaugcacccgca

SEQ ID NO: 2161071 - RNA, 22 nt, Homo sapiens
ugguuucacaugguuacauauc

SEQ ID NO: 2161072 - RNA, 21 nt, Homo sapiens
auuucucuuccuaaauuucau

SEQ ID NO: 2161073 - RNA, 16 nt, Homo sapiens
ccugaaagcaacagcu

SEQ ID NO: 2161074 - RNA, 20 nt, Homo sapiens
uuuaucaagagacuccugaa

SEQ ID NO: 2161075 - RNA, 14 nt, Homo sapiens
uuguuccacugcaa

SEQ ID NO: 2161076 - RNA, 15 nt, Homo sapiens
aacccugugaucuau

SEQ ID NO: 2161077 - RNA, 19 nt, Homo sapiens
ugccccuugacaacuggca

SEQ ID NO: 2161078 - RNA, 19 nt, Homo sapiens
cagcucuccccaggcauuu

SEQ ID NO: 2161079 - RNA, 16 nt, Homo sapiens
acaguuuucugagaaa

SEQ ID NO: 2161080 - RNA, 22 nt, Homo sapiens
gcggagggagcggcaugggcga

SEQ ID NO: 2161081 - RNA, 13 nt, Homo sapiens
aauucaguacaac

SEQ ID NO: 2161082 - RNA, 13 nt, Homo sapiens
uucucuacaccca

SEQ ID NO: 2161083 - RNA, 19 nt, Homo sapiens
ucuggcuuccuaaacccau

SEQ ID NO: 2161084 - RNA, 14 nt, Homo sapiens
acugggaccaggca

SEQ ID NO: 2161085 - RNA, 15 nt, Homo sapiens
ggagugguugcuaua

SEQ ID NO: 2161086 - RNA, 16 nt, Homo sapiens
agcuauuuuaagccau

SEQ ID NO: 2161087 - RNA, 22 nt, Homo sapiens
ccaaucccugccacugggcucu

SEQ ID NO: 2161088 - RNA, 13 nt, Homo sapiens
acacucaaccaug

SEQ ID NO: 2161089 - RNA, 23 nt, Homo sapiens
acaauuauguaauugaaaaccaa

SEQ ID NO: 2161090 - RNA, 13 nt, Homo sapiens
uugaguacagaua

SEQ ID NO: 2161091 - RNA, 13 nt, Homo sapiens
agaaauacuugug

SEQ ID NO: 2161092 - RNA, 15 nt, Homo sapiens
uagcuaaacauugug

SEQ ID NO: 2161093 - RNA, 21 nt, Homo sapiens
agcgaucucuccacugugcuu

SEQ ID NO: 2161094 - RNA, 12 nt, Homo sapiens
aagacaaagccu

SEQ ID NO: 2161095 - RNA, 23 nt, Homo sapiens
uugucuacuucuggagucuauaa

SEQ ID NO: 2161096 - RNA, 22 nt, Homo sapiens
cugugcacgcgcgcgugcacac

SEQ ID NO: 2161097 - RNA, 22 nt, Homo sapiens
cugagggcagaaagguucugcc

SEQ ID NO: 2161098 - RNA, 23 nt, Homo sapiens
uauggaauuccucuacugcccag

SEQ ID NO: 2161099 - RNA, 16 nt, Homo sapiens
caaggaaaaaugcugc

SEQ ID NO: 2161100 - RNA, 20 nt, Homo sapiens
ccucauuaccuugugcuaau

SEQ ID NO: 2161101 - RNA, 16 nt, Homo sapiens
aaucucuugcacucaa

SEQ ID NO: 2161102 - RNA, 23 nt, Homo sapiens
cuguccugcagucccacacugug

SEQ ID NO: 2161103 - RNA, 23 nt, Homo sapiens
aagggucccuuuugcauugccaa

SEQ ID NO: 2161104 - RNA, 13 nt, Homo sapiens
cucacuagcacau

SEQ ID NO: 2161105 - RNA, 13 nt, Homo sapiens
agucaacaguauc

SEQ ID NO: 2161106 - RNA, 23 nt, Homo sapiens
ucccaaaagcccauucauuccau

SEQ ID NO: 2161107 - RNA, 14 nt, Homo sapiens
accgugacugcaag

SEQ ID NO: 2161108 - RNA, 15 nt, Homo sapiens
gauucugcagcaccg

SEQ ID NO: 2161109 - RNA, 22 nt, Homo sapiens
ccucuggcuucccuaaacugca

SEQ ID NO: 2161110 - RNA, 20 nt, Homo sapiens
agaugccuccucuccaaaga

SEQ ID NO: 2161111 - RNA, 18 nt, Homo sapiens
cugcucguccccaaguga

SEQ ID NO: 2161112 - RNA, 16 nt, Homo sapiens
ccuggucaacccgcug

SEQ ID NO: 2161113 - RNA, 15 nt, Homo sapiens
cugcagucucuauac

SEQ ID NO: 2161114 - RNA, 11 nt, Homo sapiens
agucacuguag

SEQ ID NO: 2161115 - RNA, 13 nt, Homo sapiens
ucaaaauuugcug

SEQ ID NO: 2161116 - RNA, 16 nt, Homo sapiens
gguccuacuccuggag

SEQ ID NO: 2161117 - RNA, 22 nt, Homo sapiens
ucucauccaucaaguugcacac

SEQ ID NO: 2161118 - RNA, 21 nt, Homo sapiens
aauguguauauggugauucaa

SEQ ID NO: 2161119 - RNA, 15 nt, Homo sapiens
cugaccugguacuga

SEQ ID NO: 2161120 - RNA, 16 nt, Homo sapiens
gacaccuuucagucuc

SEQ ID NO: 2161121 - RNA, 18 nt, Homo sapiens
caccgucccucagugaua

SEQ ID NO: 2161122 - RNA, 15 nt, Homo sapiens
ucaggcacauguguu

SEQ ID NO: 2161123 - RNA, 19 nt, Homo sapiens
acucugugucugaguggcu

SEQ ID NO: 2161124 - RNA, 22 nt, Homo sapiens
gaagauucccucuuccugccaa

SEQ ID NO: 2161125 - RNA, 17 nt, Homo sapiens
aacugcaggagcaguuu

SEQ ID NO: 2161126 - RNA, 21 nt, Homo sapiens
aguguuggagaacaacaaaua

SEQ ID NO: 2161127 - RNA, 18 nt, Homo sapiens
uagucuaucagcaucuga

SEQ ID NO: 2161128 - RNA, 17 nt, Homo sapiens
agcaaauagaucaugca

SEQ ID NO: 2161129 - RNA, 18 nt, Homo sapiens
cuguuuggagauccucau

SEQ ID NO: 2161130 - RNA, 14 nt, Homo sapiens
acugaauaaauuca

SEQ ID NO: 2161131 - RNA, 21 nt, Homo sapiens
acauuuauccccuuuccugcc

SEQ ID NO: 2161132 - RNA, 10 nt, Homo sapiens
gacucugcac

SEQ ID NO: 2161133 - RNA, 20 nt, Homo sapiens
aagaagaguuugcaaaugca

SEQ ID NO: 2161134 - RNA, 15 nt, Homo sapiens
auugucacuccaaac

SEQ ID NO: 2161135 - RNA, 22 nt, Homo sapiens
ggcauuucauuaugcuuugaac

SEQ ID NO: 2161136 - RNA, 13 nt, Homo sapiens
acgcuuaaaggaa

SEQ ID NO: 2161137 - RNA, 12 nt, Homo sapiens
uccagauggcaa

SEQ ID NO: 2161138 - RNA, 23 nt, Homo sapiens
uacaagacaggacccugggacca

SEQ ID NO: 2161139 - RNA, 17 nt, Homo sapiens
ugggucucagcugcuga

SEQ ID NO: 2161140 - RNA, 14 nt, Homo sapiens
ucaaagcauuugca

SEQ ID NO: 2161141 - RNA, 14 nt, Homo sapiens
aacaggcugaaauu

SEQ ID NO: 2161142 - RNA, 19 nt, Homo sapiens
aagggaaauaacaguauuu

SEQ ID NO: 2161143 - RNA, 21 nt, Homo sapiens
agaauagcauguucguauuac

SEQ ID NO: 2161144 - RNA, 12 nt, Homo sapiens
auuucaggcaua

SEQ ID NO: 2161145 - RNA, 22 nt, Homo sapiens
cuggcaggaaaguccuuguuga

SEQ ID NO: 2161146 - RNA, 20 nt, Homo sapiens
agugacucagaacuucugcc

SEQ ID NO: 2161147 - RNA, 19 nt, Homo sapiens
aacucccuccucacacucc

SEQ ID NO: 2161148 - RNA, 16 nt, Homo sapiens
cuccuggcacaacgcu

SEQ ID NO: 2161149 - RNA, 15 nt, Homo sapiens
cuuccuggaagcaga

SEQ ID NO: 2161150 - RNA, 19 nt, Homo sapiens
ggcacucagaagacacuga

SEQ ID NO: 2161151 - RNA, 20 nt, Homo sapiens
ugguggguacaaaaagucaa

SEQ ID NO: 2161152 - RNA, 17 nt, Homo sapiens
gaguccagaaccccugu

SEQ ID NO: 2161153 - RNA, 14 nt, Homo sapiens
uagccucuccgccc

SEQ ID NO: 2161154 - RNA, 14 nt, Homo sapiens
caauaucuucauac

SEQ ID NO: 2161155 - RNA, 23 nt, Homo sapiens
gucucccuuccuaugcuguucac

SEQ ID NO: 2161156 - RNA, 14 nt, Homo sapiens
uacagacgucucaa

SEQ ID NO: 2161157 - RNA, 19 nt, Homo sapiens
uaugaagcccacccagaaa

SEQ ID NO: 2161158 - RNA, 18 nt, Homo sapiens
agggaagccccacuugaa

SEQ ID NO: 2161159 - RNA, 11 nt, Homo sapiens
ugggaugccag

SEQ ID NO: 2161160 - RNA, 12 nt, Homo sapiens
gggaacaugccc

SEQ ID NO: 2161161 - RNA, 18 nt, Homo sapiens
acaugugcuggacacugu

SEQ ID NO: 2161162 - RNA, 22 nt, Homo sapiens
uggagggauugaacacaggcaa

SEQ ID NO: 2161163 - RNA, 19 nt, Homo sapiens
uuucauggucugcugagua

SEQ ID NO: 2161164 - RNA, 23 nt, Homo sapiens
caaaaugcuucugcacacaaaac

SEQ ID NO: 2161165 - RNA, 18 nt, Homo sapiens
caggggagcccggagcuu

SEQ ID NO: 2161166 - RNA, 12 nt, Homo sapiens
agucucuugacu

SEQ ID NO: 2161167 - RNA, 18 nt, Homo sapiens
ccgcccuggcuaacaugg

SEQ ID NO: 2161168 - RNA, 13 nt, Homo sapiens
auggauucacuuc

SEQ ID NO: 2161169 - RNA, 14 nt, Homo sapiens
uccucuuggagcug

SEQ ID NO: 2161170 - RNA, 15 nt, Homo sapiens
cagcucacuuccucc

SEQ ID NO: 2161171 - RNA, 17 nt, Homo sapiens
auagacuuagccccaug

SEQ ID NO: 2161172 - RNA, 15 nt, Homo sapiens
ggagggaagugugag

SEQ ID NO: 2161173 - RNA, 20 nt, Homo sapiens
auguggguggcuucuaguuu

SEQ ID NO: 2161174 - RNA, 12 nt, Homo sapiens
aaaaagacauuu

SEQ ID NO: 2161175 - RNA, 15 nt, Homo sapiens
gaacugcacaaugca

SEQ ID NO: 2161176 - RNA, 16 nt, Homo sapiens
guauuuaagaaaggga

SEQ ID NO: 2161177 - RNA, 20 nt, Homo sapiens
guuuucccuguucuggacau

SEQ ID NO: 2161178 - RNA, 17 nt, Homo sapiens
aaguuucuaacuuacaa

SEQ ID NO: 2161179 - RNA, 16 nt, Homo sapiens
gaauuuuucccuccac

SEQ ID NO: 2161180 - RNA, 19 nt, Homo sapiens
gauuuguagcauaacugua

SEQ ID NO: 2161181 - RNA, 22 nt, Homo sapiens
gcacaaauugaaaacacacuca

SEQ ID NO: 2161182 - RNA, 16 nt, Homo sapiens
uguaaaagcaacauca

SEQ ID NO: 2161183 - RNA, 18 nt, Homo sapiens
aguaacuagguguaaaaa

SEQ ID NO: 2161184 - RNA, 15 nt, Homo sapiens
aaauauggacuucca

SEQ ID NO: 2161185 - RNA, 16 nt, Homo sapiens
agauccuacucuuccu

SEQ ID NO: 2161186 - RNA, 18 nt, Homo sapiens
ccacaggagcguguccua

SEQ ID NO: 2161187 - RNA, 20 nt, Homo sapiens
aacuaccaccugacauuccu

SEQ ID NO: 2161188 - RNA, 17 nt, Homo sapiens
ugggcuaccaucugcau

SEQ ID NO: 2161189 - RNA, 13 nt, Homo sapiens
uguacauuucacc

SEQ ID NO: 2161190 - RNA, 20 nt, Homo sapiens
cucacugcccaugaugcaga

SEQ ID NO: 2161191 - RNA, 19 nt, Homo sapiens
cccagcugguccuguggau

SEQ ID NO: 2161192 - RNA, 14 nt, Homo sapiens
uaagcaucugccau

SEQ ID NO: 2161193 - RNA, 15 nt, Homo sapiens
ccucuaacagcacca

SEQ ID NO: 2161194 - RNA, 22 nt, Homo sapiens
caggaauaaagacuugugcauc

SEQ ID NO: 2161195 - RNA, 14 nt, Homo sapiens
auacucacugaguc

SEQ ID NO: 2161196 - RNA, 13 nt, Homo sapiens
accgagagacuca

SEQ ID NO: 2161197 - RNA, 17 nt, Homo sapiens
agugggagccagggcug

SEQ ID NO: 2161198 - RNA, 18 nt, Homo sapiens
cagaguuuguguguauuu

SEQ ID NO: 2161199 - RNA, 15 nt, Homo sapiens
ucccaaucggccuua

SEQ ID NO: 2161200 - RNA, 21 nt, Homo sapiens
uuuacuguugcccauugcacu

SEQ ID NO: 2161201 - RNA, 18 nt, Homo sapiens
uacaaaauauagcuuuca

SEQ ID NO: 2161202 - RNA, 15 nt, Homo sapiens
aggaaaggccugagg

SEQ ID NO: 2161203 - RNA, 16 nt, Homo sapiens
aucaccucuacugucu

SEQ ID NO: 2161204 - RNA, 18 nt, Homo sapiens
cuuguuguuuaauguuua

SEQ ID NO: 2161205 - RNA, 21 nt, Homo sapiens
cccaaacuugcuuuaugccuu

SEQ ID NO: 2161206 - RNA, 14 nt, Homo sapiens
agaaagaaugcauu

SEQ ID NO: 2161207 - RNA, 21 nt, Homo sapiens
agucugggcacaagugucccu

SEQ ID NO: 2161208 - RNA, 22 nt, Homo sapiens
ucagaaucucucuacucagaug

SEQ ID NO: 2161209 - RNA, 17 nt, Homo sapiens
gcuucuacacauuucau

SEQ ID NO: 2161210 - RNA, 15 nt, Homo sapiens
uuuaaaacaugcugu

SEQ ID NO: 2161211 - RNA, 15 nt, Homo sapiens
ccccuggccacagcc

SEQ ID NO: 2161212 - RNA, 17 nt, Homo sapiens
aaauguucuaacagauc

SEQ ID NO: 2161213 - RNA, 13 nt, Homo sapiens
auggugccuggga

SEQ ID NO: 2161214 - RNA, 21 nt, Homo sapiens
guauaaauauguauuuuguca

SEQ ID NO: 2161215 - RNA, 15 nt, Homo sapiens
uugcaguuuugccua

SEQ ID NO: 2161216 - RNA, 21 nt, Homo sapiens
cuuaauuucauagauuguguu

SEQ ID NO: 2161217 - RNA, 22 nt, Homo sapiens
cucacucucaggaaaugcugac

SEQ ID NO: 2161218 - RNA, 17 nt, Homo sapiens
aagugccaagacacagc

SEQ ID NO: 2161219 - RNA, 16 nt, Homo sapiens
ucaaacugcacaucua

SEQ ID NO: 2161220 - RNA, 16 nt, Homo sapiens
agcaaaugggggaaaa

SEQ ID NO: 2161221 - RNA, 14 nt, Homo sapiens
gauacugaaaaaua

SEQ ID NO: 2161222 - RNA, 15 nt, Homo sapiens
cuaacagcugaagua

SEQ ID NO: 2161223 - RNA, 23 nt, Homo sapiens
auucccaagguuacuuaauucaa

SEQ ID NO: 2161224 - RNA, 13 nt, Homo sapiens
ggcuaugcaaggg

SEQ ID NO: 2161225 - RNA, 15 nt, Homo sapiens
uccaucuucccuacc

SEQ ID NO: 2161226 - RNA, 14 nt, Homo sapiens
ugccugcccugaaa

SEQ ID NO: 2161227 - RNA, 14 nt, Homo sapiens
uuuuuauaaauauc

SEQ ID NO: 2161228 - RNA, 13 nt, Homo sapiens
uugugccuaccug

SEQ ID NO: 2161229 - RNA, 18 nt, Homo sapiens
aauuuuauuacauaugau

SEQ ID NO: 2161230 - RNA, 23 nt, Homo sapiens
agaacacuucagccugugcaggu

SEQ ID NO: 2161231 - RNA, 19 nt, Homo sapiens
acuaacuaugcauggugcc

SEQ ID NO: 2161232 - RNA, 16 nt, Homo sapiens
uuguuacaccacauua

SEQ ID NO: 2161233 - RNA, 15 nt, Homo sapiens
uccuaaccacaagau

SEQ ID NO: 2161234 - RNA, 16 nt, Homo sapiens
augaucccuaaugugu

SEQ ID NO: 2161235 - RNA, 21 nt, Homo sapiens
ggcacccagcccaaccgggaa

SEQ ID NO: 2161236 - RNA, 22 nt, Homo sapiens
agugagcacucacgcccuaagc

SEQ ID NO: 2161237 - RNA, 14 nt, Homo sapiens
acucugcuuugcau

SEQ ID NO: 2161238 - RNA, 13 nt, Homo sapiens
cugacaagcacug

SEQ ID NO: 2161239 - RNA, 21 nt, Homo sapiens
uuuuuauauauauaaagucag

SEQ ID NO: 2161240 - RNA, 17 nt, Homo sapiens
aaaacauaaaaaccaaa

SEQ ID NO: 2161241 - RNA, 23 nt, Homo sapiens
ucagaaggguuaacucaacuguc

SEQ ID NO: 2161242 - RNA, 21 nt, Homo sapiens
uacaaauaaauccaagacugu

SEQ ID NO: 2161243 - RNA, 15 nt, Homo sapiens
auauuauuccaaagu

SEQ ID NO: 2161244 - RNA, 14 nt, Homo sapiens
cuagaguguagccu

SEQ ID NO: 2161245 - RNA, 19 nt, Homo sapiens
caucuuauagcacuuugaa

SEQ ID NO: 2161246 - RNA, 17 nt, Homo sapiens
gaaugaagcguugccau

SEQ ID NO: 2161247 - RNA, 23 nt, Homo sapiens
gaggugacuugccuggggccaca

SEQ ID NO: 2161248 - RNA, 13 nt, Homo sapiens
cuuguauugguga

SEQ ID NO: 2161249 - RNA, 15 nt, Homo sapiens
uuuucuacaaccuaa

SEQ ID NO: 2161250 - RNA, 23 nt, Homo sapiens
gcugcugcuuagcuugcaccuug

SEQ ID NO: 2161251 - RNA, 22 nt, Homo sapiens
aaacauucaucaagcuguacau

SEQ ID NO: 2161252 - RNA, 18 nt, Homo sapiens
uguggccaaggcugagag

SEQ ID NO: 2161253 - RNA, 13 nt, Homo sapiens
aagugaggaugag

SEQ ID NO: 2161254 - RNA, 22 nt, Homo sapiens
uuuaaacaaaauuuaugucauu

SEQ ID NO: 2161255 - RNA, 14 nt, Homo sapiens
agucacaggaagaa

SEQ ID NO: 2161256 - RNA, 16 nt, Homo sapiens
cacacuacaccacaca

SEQ ID NO: 2161257 - RNA, 18 nt, Homo sapiens
uaccuuuacauaauugca

SEQ ID NO: 2161258 - RNA, 22 nt, Homo sapiens
aacuacccagguauuacacaag

SEQ ID NO: 2161259 - RNA, 16 nt, Homo sapiens
aacauuucuguucuca

SEQ ID NO: 2161260 - RNA, 19 nt, Homo sapiens
gacaagugacuuauuugcu

SEQ ID NO: 2161261 - RNA, 21 nt, Homo sapiens
acugcagucaucaacaaugau

SEQ ID NO: 2161262 - RNA, 13 nt, Homo sapiens
ugaagucucagga

SEQ ID NO: 2161263 - RNA, 14 nt, Homo sapiens
gucuuuacaccucg

SEQ ID NO: 2161264 - RNA, 22 nt, Homo sapiens
gcucacugugcuggggcacggc

SEQ ID NO: 2161265 - RNA, 19 nt, Homo sapiens
aauccuucuauucuagccu

SEQ ID NO: 2161266 - RNA, 21 nt, Homo sapiens
gcagccuggcucccaggacac

SEQ ID NO: 2161267 - RNA, 16 nt, Homo sapiens
uacauuguuaccucua

SEQ ID NO: 2161268 - RNA, 15 nt, Homo sapiens
auagcaagugaaagc

SEQ ID NO: 2161269 - RNA, 16 nt, Homo sapiens
gcacaggccuaggaga

SEQ ID NO: 2161270 - RNA, 19 nt, Homo sapiens
auuuguguuuuacaguaua

SEQ ID NO: 2161271 - RNA, 15 nt, Homo sapiens
ggauccugggucaaa

SEQ ID NO: 2161272 - RNA, 17 nt, Homo sapiens
gggcacugucaugccca

SEQ ID NO: 2161273 - RNA, 14 nt, Homo sapiens
agaaccacuuccug

SEQ ID NO: 2161274 - RNA, 19 nt, Homo sapiens
ucucaugcaagacuucacu

SEQ ID NO: 2161275 - RNA, 17 nt, Homo sapiens
augaaauuauaaucugu

SEQ ID NO: 2161276 - RNA, 11 nt, Homo sapiens
acucacacugg

SEQ ID NO: 2161277 - RNA, 18 nt, Homo sapiens
uguuugcugcucuauauu

SEQ ID NO: 2161278 - RNA, 22 nt, Homo sapiens
ucagccaucccgucuucuccaa

SEQ ID NO: 2161279 - RNA, 19 nt, Homo sapiens
gauggcuuuuucuccuugg

SEQ ID NO: 2161280 - RNA, 19 nt, Homo sapiens
uauaagauucauauuuacu

SEQ ID NO: 2161281 - RNA, 15 nt, Homo sapiens
gcucuaauguacaau

SEQ ID NO: 2161282 - RNA, 18 nt, Homo sapiens
augcacagauuaaacuuc

SEQ ID NO: 2161283 - RNA, 15 nt, Homo sapiens
uggcacacugccagu

SEQ ID NO: 2161284 - RNA, 20 nt, Homo sapiens
ugugcaugaaagagaaagac

SEQ ID NO: 2161285 - RNA, 16 nt, Homo sapiens
ugggaaggggaggacc

SEQ ID NO: 2161286 - RNA, 14 nt, Homo sapiens
guuucaaaaccaug

SEQ ID NO: 2161287 - RNA, 19 nt, Homo sapiens
aggaggggugugggcaccc

SEQ ID NO: 2161288 - RNA, 14 nt, Homo sapiens
gcaaaugcuguauu

SEQ ID NO: 2161289 - RNA, 20 nt, Homo sapiens
caccugcagcccauggugag

SEQ ID NO: 2161290 - RNA, 22 nt, Homo sapiens
cuauguuuuuguucaaagccag

SEQ ID NO: 2161291 - RNA, 16 nt, Homo sapiens
aagaaacccucacucu

SEQ ID NO: 2161292 - RNA, 21 nt, Homo sapiens
cacuuuguaggcauugcauga

SEQ ID NO: 2161293 - RNA, 18 nt, Homo sapiens
cuuucacggggccgugac

SEQ ID NO: 2161294 - RNA, 17 nt, Homo sapiens
acagacaugaaccacca

SEQ ID NO: 2161295 - RNA, 15 nt, Homo sapiens
auuuccuaaggcaug

SEQ ID NO: 2161296 - RNA, 17 nt, Homo sapiens
acauucacuacugcaaa

SEQ ID NO: 2161297 - RNA, 20 nt, Homo sapiens
aacucaucugaaauguuaca

SEQ ID NO: 2161298 - RNA, 22 nt, Homo sapiens
cagacuuuuuaaauuccugcuu

SEQ ID NO: 2161299 - RNA, 12 nt, Homo sapiens
ccccaacaugga

SEQ ID NO: 2161300 - RNA, 18 nt, Homo sapiens
cuucuaguggguuuaaug

SEQ ID NO: 2161301 - RNA, 23 nt, Homo sapiens
auaccagcuagaaucacuugacu

SEQ ID NO: 2161302 - RNA, 21 nt, Homo sapiens
uacauguuuauauuaaucucu

SEQ ID NO: 2161303 - RNA, 14 nt, Homo sapiens
acagauugccuguu

SEQ ID NO: 2161304 - RNA, 14 nt, Homo sapiens
acauuaugccuuaa

SEQ ID NO: 2161305 - RNA, 22 nt, Homo sapiens
aagccucccuccucguccccug

SEQ ID NO: 2161306 - RNA, 22 nt, Homo sapiens
auguucuaggauaguugaugca

SEQ ID NO: 2161307 - RNA, 19 nt, Homo sapiens
ugcauguacccuaagguca

SEQ ID NO: 2161308 - RNA, 23 nt, Homo sapiens
uguaaaaauuuuguuauuuuugc

SEQ ID NO: 2161309 - RNA, 20 nt, Homo sapiens
uggcugucaaugggaccugu

SEQ ID NO: 2161310 - RNA, 21 nt, Homo sapiens
uuuucacugccugaccuuuaa

SEQ ID NO: 2161311 - RNA, 22 nt, Homo sapiens
aaagaccaggucuacagugaua

SEQ ID NO: 2161312 - RNA, 16 nt, Homo sapiens
guaagggaacaaguug

SEQ ID NO: 2161313 - RNA, 14 nt, Homo sapiens
aauuccaacacuga

SEQ ID NO: 2161314 - RNA, 17 nt, Homo sapiens
gcaaaggaaaaauugau

SEQ ID NO: 2161315 - RNA, 17 nt, Homo sapiens
gcaguugauaagaggaa

SEQ ID NO: 2161316 - RNA, 16 nt, Homo sapiens
auugcaugcugcuuua

SEQ ID NO: 2161317 - RNA, 16 nt, Homo sapiens
aaagcaccaugacuuu

SEQ ID NO: 2161318 - RNA, 13 nt, Homo sapiens
gacugagcuugau

SEQ ID NO: 2161319 - RNA, 13 nt, Homo sapiens
aacccaggacaag

SEQ ID NO: 2161320 - RNA, 21 nt, Homo sapiens
uccucuaggaggcuccuccuc

SEQ ID NO: 2161321 - RNA, 22 nt, Homo sapiens
ccaguuccucuuuugugcugcu

SEQ ID NO: 2161322 - RNA, 17 nt, Homo sapiens
cuuugcucucuggccac

SEQ ID NO: 2161323 - RNA, 17 nt, Homo sapiens
auuucugaaaugacaga

SEQ ID NO: 2161324 - RNA, 19 nt, Homo sapiens
gccucccagcccaacaucu

SEQ ID NO: 2161325 - RNA, 13 nt, Homo sapiens
guauaacaugucg

SEQ ID NO: 2161326 - RNA, 13 nt, Homo sapiens
ccacugugcacca

SEQ ID NO: 2161327 - RNA, 16 nt, Homo sapiens
auccagagucaucuca

SEQ ID NO: 2161328 - RNA, 13 nt, Homo sapiens
ucaauguguacaa

SEQ ID NO: 2161329 - RNA, 23 nt, Homo sapiens
acacacaccugucugugcagaug

SEQ ID NO: 2161330 - RNA, 20 nt, Homo sapiens
caucugggguggacccauca

SEQ ID NO: 2161331 - RNA, 23 nt, Homo sapiens
caucaaaucaguccuuugauucc

SEQ ID NO: 2161332 - RNA, 24 nt, Homo sapiens
uaagaaguuccacuuaacacauga

SEQ ID NO: 2161333 - RNA, 14 nt, Homo sapiens
guauaaagccauua

SEQ ID NO: 2161334 - RNA, 14 nt, Homo sapiens
guuuuaagccuuaa

SEQ ID NO: 2161335 - RNA, 18 nt, Homo sapiens
cauguugcuucacucuau

SEQ ID NO: 2161336 - RNA, 19 nt, Homo sapiens
caugaccugcgcucucagc

SEQ ID NO: 2161337 - RNA, 23 nt, Homo sapiens
uguuuauucaacaacuacuacuu

SEQ ID NO: 2161338 - RNA, 18 nt, Homo sapiens
ggucccaucaauucuuag

SEQ ID NO: 2161339 - RNA, 21 nt, Homo sapiens
aauguuuaugccacagaauuu

SEQ ID NO: 2161340 - RNA, 16 nt, Homo sapiens
auauucuuuauucuca

SEQ ID NO: 2161341 - RNA, 19 nt, Homo sapiens
uuucauccacuagugcaaa

SEQ ID NO: 2161342 - RNA, 15 nt, Homo sapiens
acuuaaccugaagcu

SEQ ID NO: 2161343 - RNA, 17 nt, Homo sapiens
agcaugggauuauuaga

SEQ ID NO: 2161344 - RNA, 14 nt, Homo sapiens
gggcucgugcccug

SEQ ID NO: 2161345 - RNA, 15 nt, Homo sapiens
auaaaguacugcaaa

SEQ ID NO: 2161346 - RNA, 18 nt, Homo sapiens
uugaguaauucuagacau

SEQ ID NO: 2161347 - RNA, 19 nt, Homo sapiens
agucccaaugguccugacu

SEQ ID NO: 2161348 - RNA, 17 nt, Homo sapiens
cccugaacccacugcug

SEQ ID NO: 2161349 - RNA, 18 nt, Homo sapiens
gcagaauucaaaagugau

SEQ ID NO: 2161350 - RNA, 23 nt, Homo sapiens
uucaaccccgaggucccuguugu

SEQ ID NO: 2161351 - RNA, 22 nt, Homo sapiens
acauccucugcuaccaucucau

SEQ ID NO: 2161352 - RNA, 15 nt, Homo sapiens
gccuuuuguuuucau

SEQ ID NO: 2161353 - RNA, 18 nt, Homo sapiens
augaucuaggaagacuuu

SEQ ID NO: 2161354 - RNA, 16 nt, Homo sapiens
gcuccgugagcccuug

SEQ ID NO: 2161355 - RNA, 16 nt, Homo sapiens
guucacuaaugugguu

SEQ ID NO: 2161356 - RNA, 14 nt, Homo sapiens
aacuugugcugaga

SEQ ID NO: 2161357 - RNA, 19 nt, Homo sapiens
gcccuguaacaggcuugaa

SEQ ID NO: 2161358 - RNA, 16 nt, Homo sapiens
accgugcaacguguaa

SEQ ID NO: 2161359 - RNA, 17 nt, Homo sapiens
agagugacuaguacaaa

SEQ ID NO: 2161360 - RNA, 17 nt, Homo sapiens
aaggacucagauuguau

SEQ ID NO: 2161361 - RNA, 12 nt, Homo sapiens
auagugcucaga

SEQ ID NO: 2161362 - RNA, 17 nt, Homo sapiens
guuacugcuuugcaaag

SEQ ID NO: 2161363 - RNA, 23 nt, Homo sapiens
gcagaucaucuccaaaucuugcc

SEQ ID NO: 2161364 - RNA, 14 nt, Homo sapiens
uguguuugugccau

SEQ ID NO: 2161365 - RNA, 20 nt, Homo sapiens
ccuaguaagaacguacuuuc

SEQ ID NO: 2161366 - RNA, 22 nt, Homo sapiens
gguggccucuccuuguggccug

SEQ ID NO: 2161367 - RNA, 16 nt, Homo sapiens
caacaguauacaaaag

SEQ ID NO: 2161368 - RNA, 17 nt, Homo sapiens
agguuaaagaagcugca

SEQ ID NO: 2161369 - RNA, 19 nt, Homo sapiens
cugccuuguguucagugaa

SEQ ID NO: 2161370 - RNA, 22 nt, Homo sapiens
cucuguauguguucgucagugu

SEQ ID NO: 2161371 - RNA, 14 nt, Homo sapiens
ggggccuugcugag

SEQ ID NO: 2161372 - RNA, 21 nt, Homo sapiens
cagggcccugcagaggggaaa

SEQ ID NO: 2161373 - RNA, 19 nt, Homo sapiens
gugauuguugaaguacaaa

SEQ ID NO: 2161374 - RNA, 15 nt, Homo sapiens
aggugaagcacauac

SEQ ID NO: 2161375 - RNA, 14 nt, Homo sapiens
ugagaagccaugua

SEQ ID NO: 2161376 - RNA, 20 nt, Homo sapiens
gucuaggagacagagccaag

SEQ ID NO: 2161377 - RNA, 21 nt, Homo sapiens
auguuucgaguaaacuugaaa

SEQ ID NO: 2161378 - RNA, 16 nt, Homo sapiens
auuucccccaccccau

SEQ ID NO: 2161379 - RNA, 18 nt, Homo sapiens
cauucaaucauuaauuca

SEQ ID NO: 2161380 - RNA, 13 nt, Homo sapiens
gaugugcuuugug

SEQ ID NO: 2161381 - RNA, 18 nt, Homo sapiens
agcuacauuccucagcug

SEQ ID NO: 2161382 - RNA, 23 nt, Homo sapiens
aagcugcuugcuguaacugugug

SEQ ID NO: 2161383 - RNA, 17 nt, Homo sapiens
uaaacccuuaacuggca

SEQ ID NO: 2161384 - RNA, 18 nt, Homo sapiens
ugugcucuggcaccauca

SEQ ID NO: 2161385 - RNA, 12 nt, Homo sapiens
uuaauauuucua

SEQ ID NO: 2161386 - RNA, 17 nt, Homo sapiens
cccagcuggguggucca

SEQ ID NO: 2161387 - RNA, 17 nt, Homo sapiens
uccuaaggccacuguuu

SEQ ID NO: 2161388 - RNA, 14 nt, Homo sapiens
agcgagugcucuca

SEQ ID NO: 2161389 - RNA, 13 nt, Homo sapiens
accacucaggaau

SEQ ID NO: 2161390 - RNA, 18 nt, Homo sapiens
ugucuccuuucucuuaug

SEQ ID NO: 2161391 - RNA, 16 nt, Homo sapiens
uaaggugaaccaaaga

SEQ ID NO: 2161392 - RNA, 19 nt, Homo sapiens
uguagguuuucuguguuua

SEQ ID NO: 2161393 - RNA, 17 nt, Homo sapiens
cuaagguuaucuacuuu

SEQ ID NO: 2161394 - RNA, 16 nt, Homo sapiens
auuguuuuugaauuua

SEQ ID NO: 2161395 - RNA, 17 nt, Homo sapiens
ugagugucuuagcauau

SEQ ID NO: 2161396 - RNA, 14 nt, Homo sapiens
aguagaauuuacaa

SEQ ID NO: 2161397 - RNA, 19 nt, Homo sapiens
aaguccagagcuggaucuc

SEQ ID NO: 2161398 - RNA, 20 nt, Homo sapiens
aauccaacccaugaugagcu

SEQ ID NO: 2161399 - RNA, 13 nt, Homo sapiens
ccaguucuuuuaa

SEQ ID NO: 2161400 - RNA, 18 nt, Homo sapiens
auguguuucaaaaccaug

SEQ ID NO: 2161401 - RNA, 13 nt, Homo sapiens
acagacgucucaa

SEQ ID NO: 2161402 - RNA, 23 nt, Homo sapiens
uacuguggucugggcaccaccuc

SEQ ID NO: 2161403 - RNA, 21 nt, Homo sapiens
aauguuccauucagucugcag

SEQ ID NO: 2161404 - RNA, 14 nt, Homo sapiens
cauaucaacuugag

SEQ ID NO: 2161405 - RNA, 17 nt, Homo sapiens
ggaaaguguaaagcauu

SEQ ID NO: 2161406 - RNA, 17 nt, Homo sapiens
augagcguuaacacagu

SEQ ID NO: 2161407 - RNA, 17 nt, Homo sapiens
gaauaagaaaacaauca

SEQ ID NO: 2161408 - RNA, 17 nt, Homo sapiens
uggaugcgcagugccuu

SEQ ID NO: 2161409 - RNA, 19 nt, Homo sapiens
gauucaucucugguuuucu

SEQ ID NO: 2161410 - RNA, 15 nt, Homo sapiens
ugcacccacccagga

SEQ ID NO: 2161411 - RNA, 20 nt, Homo sapiens
gagacuuugaaacuaucuca

SEQ ID NO: 2161412 - RNA, 19 nt, Homo sapiens
cuugcccagggcagcuuug

SEQ ID NO: 2161413 - RNA, 22 nt, Homo sapiens
ucgauauaaauugggauaaaca

SEQ ID NO: 2161414 - RNA, 11 nt, Homo sapiens
aagaaagugag

SEQ ID NO: 2161415 - RNA, 20 nt, Homo sapiens
cuguuacuuuuuagucuuuu

SEQ ID NO: 2161416 - RNA, 14 nt, Homo sapiens
gcuggacagcacuc

SEQ ID NO: 2161417 - RNA, 23 nt, Homo sapiens
caucccugcagaggaaagacagg

SEQ ID NO: 2161418 - RNA, 19 nt, Homo sapiens
aaugucagacuuugcugca

SEQ ID NO: 2161419 - RNA, 15 nt, Homo sapiens
cuuguaaacuugaaa

SEQ ID NO: 2161420 - RNA, 13 nt, Homo sapiens
ucacccaggcaau

SEQ ID NO: 2161421 - RNA, 23 nt, Homo sapiens
uuaggauuuaacagucauuuaaa

SEQ ID NO: 2161422 - RNA, 14 nt, Homo sapiens
aaguuuaucuuuca

SEQ ID NO: 2161423 - RNA, 19 nt, Homo sapiens
cuauaaucaaaugauuuca

SEQ ID NO: 2161424 - RNA, 15 nt, Homo sapiens
uagaccuguuucaua

SEQ ID NO: 2161425 - RNA, 20 nt, Homo sapiens
cccagauucuucagcuugau

SEQ ID NO: 2161426 - RNA, 20 nt, Homo sapiens
uaaaaacaccaaaaagggau

SEQ ID NO: 2161427 - RNA, 21 nt, Homo sapiens
uucauuguuuuuaacuuugcu

SEQ ID NO: 2161428 - RNA, 12 nt, Homo sapiens
uugugguccaaa

SEQ ID NO: 2161429 - RNA, 16 nt, Homo sapiens
acuuggacuuguccuc

SEQ ID NO: 2161430 - RNA, 20 nt, Homo sapiens
uucugaaauuuaacugccua

SEQ ID NO: 2161431 - RNA, 15 nt, Homo sapiens
ugaccagacugcaca

SEQ ID NO: 2161432 - RNA, 16 nt, Homo sapiens
ucccagagucaucuga

SEQ ID NO: 2161433 - RNA, 14 nt, Homo sapiens
caacugucaguuca

SEQ ID NO: 2161434 - RNA, 17 nt, Homo sapiens
ucuguccucuucuguga

SEQ ID NO: 2161435 - RNA, 14 nt, Homo sapiens
aaugaauuaauuca

SEQ ID NO: 2161436 - RNA, 11 nt, Homo sapiens
aacuacuguac

SEQ ID NO: 2161437 - RNA, 11 nt, Homo sapiens
auauacuguua

SEQ ID NO: 2161438 - RNA, 24 nt, Homo sapiens
ugucagggguuugcuuacagugau

SEQ ID NO: 2161439 - RNA, 13 nt, Homo sapiens
uacuuuguugcua

SEQ ID NO: 2161440 - RNA, 21 nt, Homo sapiens
acaugaacguuuucucuucac

SEQ ID NO: 2161441 - RNA, 22 nt, Homo sapiens
augucuccacuuucacccgcag

SEQ ID NO: 2161442 - RNA, 18 nt, Homo sapiens
uccaaaggauuuuguauc

SEQ ID NO: 2161443 - RNA, 17 nt, Homo sapiens
ugugcacaaaguggcau

SEQ ID NO: 2161444 - RNA, 14 nt, Homo sapiens
gcuaaggcagcuga

SEQ ID NO: 2161445 - RNA, 11 nt, Homo sapiens
ccuaugcaagu

SEQ ID NO: 2161446 - RNA, 17 nt, Homo sapiens
uuuaccaguugccuuuu

SEQ ID NO: 2161447 - RNA, 17 nt, Homo sapiens
accuuugggacuaagcu

SEQ ID NO: 2161448 - RNA, 13 nt, Homo sapiens
ugagacugugcug

SEQ ID NO: 2161449 - RNA, 13 nt, Homo sapiens
ggcugcugggaga

SEQ ID NO: 2161450 - RNA, 13 nt, Homo sapiens
gaaggcuggacua

SEQ ID NO: 2161451 - RNA, 18 nt, Homo sapiens
gauuuucgacguuugacu

SEQ ID NO: 2161452 - RNA, 12 nt, Homo sapiens
caaauagcuuua

SEQ ID NO: 2161453 - RNA, 21 nt, Homo sapiens
auaaaccacccucuggggaca

SEQ ID NO: 2161454 - RNA, 23 nt, Homo sapiens
caggccucugguguuugcaaagg

SEQ ID NO: 2161455 - RNA, 19 nt, Homo sapiens
auugagcagaauucauuca

SEQ ID NO: 2161456 - RNA, 20 nt, Homo sapiens
acaguuuauuuucuguguaa

SEQ ID NO: 2161457 - RNA, 17 nt, Homo sapiens
uagcacuauuuacauac

SEQ ID NO: 2161458 - RNA, 17 nt, Homo sapiens
augaaaaacaucccaaa

SEQ ID NO: 2161459 - RNA, 19 nt, Homo sapiens
uccauacccgcaguugucu

SEQ ID NO: 2161460 - RNA, 16 nt, Homo sapiens
aauuaaccauugcuaa

SEQ ID NO: 2161461 - RNA, 15 nt, Homo sapiens
gggugguguccugaa

SEQ ID NO: 2161462 - RNA, 17 nt, Homo sapiens
cugcuggcuaagcauuu

SEQ ID NO: 2161463 - RNA, 18 nt, Homo sapiens
gauccgugacagcacuuu

SEQ ID NO: 2161464 - RNA, 18 nt, Homo sapiens
gaaggggacugccaccuc

SEQ ID NO: 2161465 - RNA, 16 nt, Homo sapiens
uagccuaugucuggca

SEQ ID NO: 2161466 - RNA, 21 nt, Homo sapiens
caaaagcccauucauuccauu

SEQ ID NO: 2161467 - RNA, 13 nt, Homo sapiens
ugugcaugugcug

SEQ ID NO: 2161468 - RNA, 17 nt, Homo sapiens
ugagaagaggcugcugc

SEQ ID NO: 2161469 - RNA, 23 nt, Homo sapiens
aguguguaaauaauuugcacuga

SEQ ID NO: 2161470 - RNA, 21 nt, Homo sapiens
cugcugccucccuggggacca

SEQ ID NO: 2161471 - RNA, 23 nt, Homo sapiens
gcagaaaaaauauuguaguuuga

SEQ ID NO: 2161472 - RNA, 23 nt, Homo sapiens
gccaugaggccuuuccccagugu

SEQ ID NO: 2161473 - RNA, 23 nt, Homo sapiens
ugggaguggggccuuugccagca

SEQ ID NO: 2161474 - RNA, 22 nt, Homo sapiens
augaagaucggcuuucauguaa

SEQ ID NO: 2161475 - RNA, 15 nt, Homo sapiens
ucuugucuccauuug

SEQ ID NO: 2161476 - RNA, 18 nt, Homo sapiens
gaguuggaacugcauucu

SEQ ID NO: 2161477 - RNA, 18 nt, Homo sapiens
aaggacagcccuccuuga

SEQ ID NO: 2161478 - RNA, 11 nt, Homo sapiens
uucacaucucu

SEQ ID NO: 2161479 - RNA, 15 nt, Homo sapiens
gcugccauccaugug

SEQ ID NO: 2161480 - RNA, 20 nt, Homo sapiens
ccagugcuguccaugcuucu

SEQ ID NO: 2161481 - RNA, 20 nt, Homo sapiens
cgaguggauuguaggugcaa

SEQ ID NO: 2161482 - RNA, 18 nt, Homo sapiens
uugauggugacagcugca

SEQ ID NO: 2161483 - RNA, 16 nt, Homo sapiens
cuccuuuugaccaaau

SEQ ID NO: 2161484 - RNA, 23 nt, Homo sapiens
uaagaccaagcugugcccugacc

SEQ ID NO: 2161485 - RNA, 19 nt, Homo sapiens
cugcucggggugcacagga

SEQ ID NO: 2161486 - RNA, 19 nt, Homo sapiens
agaaggacauuuuacugca

SEQ ID NO: 2161487 - RNA, 22 nt, Homo sapiens
uacuuugguuucugucuguaag

SEQ ID NO: 2161488 - RNA, 16 nt, Homo sapiens
uuuaaauaucugaaca

SEQ ID NO: 2161489 - RNA, 17 nt, Homo sapiens
cuauggcugccugcauc

SEQ ID NO: 2161490 - RNA, 14 nt, Homo sapiens
cuauagcucaggac

SEQ ID NO: 2161491 - RNA, 21 nt, Homo sapiens
caacagggaagaaacuuucug

SEQ ID NO: 2161492 - RNA, 21 nt, Homo sapiens
auugggaaaggacagcuuuga

SEQ ID NO: 2161493 - RNA, 14 nt, Homo sapiens
gcaaagacugcagu

SEQ ID NO: 2161494 - RNA, 17 nt, Homo sapiens
cuggccccauccuggcc

SEQ ID NO: 2161495 - RNA, 21 nt, Homo sapiens
agaugacuucccaacugcaag

SEQ ID NO: 2161496 - RNA, 17 nt, Homo sapiens
cacauacuugagacugu

SEQ ID NO: 2161497 - RNA, 18 nt, Homo sapiens
caccugagcugcugcaug

SEQ ID NO: 2161498 - RNA, 16 nt, Homo sapiens
cacugcuucuugggag

SEQ ID NO: 2161499 - RNA, 20 nt, Homo sapiens
cuccaucuuucuacagagau

SEQ ID NO: 2161500 - RNA, 23 nt, Homo sapiens
uauuuaggcaagaagagguguga

SEQ ID NO: 2161501 - RNA, 22 nt, Homo sapiens
accagcacuccaucacugagag

SEQ ID NO: 2161502 - RNA, 12 nt, Homo sapiens
gugaggggcccu

SEQ ID NO: 2161503 - RNA, 17 nt, Homo sapiens
agcaaggcauaccuguc

SEQ ID NO: 2161504 - RNA, 19 nt, Homo sapiens
cucuucccuuccuccauug

SEQ ID NO: 2161505 - RNA, 20 nt, Homo sapiens
uggagaccccaccagccuca

SEQ ID NO: 2161506 - RNA, 16 nt, Homo sapiens
gcuggaugggacucca

SEQ ID NO: 2161507 - RNA, 14 nt, Homo sapiens
auagugcuguuuaa

SEQ ID NO: 2161508 - RNA, 23 nt, Homo sapiens
cagagaagccugucuguacuuca

SEQ ID NO: 2161509 - RNA, 23 nt, Homo sapiens
uccggagggguugcgggggagcu

SEQ ID NO: 2161510 - RNA, 12 nt, Homo sapiens
agaaagccacaa

SEQ ID NO: 2161511 - RNA, 20 nt, Homo sapiens
gcucguugccugccacugag

SEQ ID NO: 2161512 - RNA, 14 nt, Homo sapiens
accuuuguguaaua

SEQ ID NO: 2161513 - RNA, 19 nt, Homo sapiens
cauacugucauauaaugca

SEQ ID NO: 2161514 - RNA, 20 nt, Homo sapiens
aaccuccccgcagagcuccc

SEQ ID NO: 2161515 - RNA, 14 nt, Homo sapiens
uugggugcauuugc

SEQ ID NO: 2161516 - RNA, 21 nt, Homo sapiens
uccaggugguaagcaccagga

SEQ ID NO: 2161517 - RNA, 20 nt, Homo sapiens
cuucccuguugaauugguga

SEQ ID NO: 2161518 - RNA, 23 nt, Homo sapiens
ccaaaucauacuuuuucuuugaa

SEQ ID NO: 2161519 - RNA, 16 nt, Homo sapiens
acauuuuaucauuaaa

SEQ ID NO: 2161520 - RNA, 16 nt, Homo sapiens
uucauugccauuguca

SEQ ID NO: 2161521 - RNA, 22 nt, Homo sapiens
agaucugucuugaugugucauc

SEQ ID NO: 2161522 - RNA, 19 nt, Homo sapiens
ugaaaauuauauauaccug

SEQ ID NO: 2161523 - RNA, 22 nt, Homo sapiens
auuuauaguguugcuuuccuug

SEQ ID NO: 2161524 - RNA, 18 nt, Homo sapiens
aaucaauaaacugugucu

SEQ ID NO: 2161525 - RNA, 14 nt, Homo sapiens
aucgaaaguaaaaa

SEQ ID NO: 2161526 - RNA, 15 nt, Homo sapiens
gaugaagaccaaaga

SEQ ID NO: 2161527 - RNA, 18 nt, Homo sapiens
ccuaugacauuacuguau

SEQ ID NO: 2161528 - RNA, 18 nt, Homo sapiens
ucucgacaggugcccuuu

SEQ ID NO: 2161529 - RNA, 21 nt, Homo sapiens
aacucuguugguuuacugugu

SEQ ID NO: 2161530 - RNA, 19 nt, Homo sapiens
guaauuuaaaaagugcuau

SEQ ID NO: 2161531 - RNA, 18 nt, Homo sapiens
gauacuugcuccauucau

SEQ ID NO: 2161532 - RNA, 15 nt, Homo sapiens
aucaaagaugacuug

SEQ ID NO: 2161533 - RNA, 21 nt, Homo sapiens
gggaggaggccaccucuccaa

SEQ ID NO: 2161534 - RNA, 17 nt, Homo sapiens
uaggaagaucucugcag

SEQ ID NO: 2161535 - RNA, 17 nt, Homo sapiens
cuguuggggaccucacc

SEQ ID NO: 2161536 - RNA, 18 nt, Homo sapiens
caggguagacuuggagcu

SEQ ID NO: 2161537 - RNA, 12 nt, Homo sapiens
uacaacuaucau

SEQ ID NO: 2161538 - RNA, 12 nt, Homo sapiens
gaguaugugcag

SEQ ID NO: 2161539 - RNA, 18 nt, Homo sapiens
uguuucaucccauguaca

SEQ ID NO: 2161540 - RNA, 16 nt, Homo sapiens
aguuucuaaccaaaga

SEQ ID NO: 2161541 - RNA, 23 nt, Homo sapiens
cuaaagaguuauucaaaugaagg

SEQ ID NO: 2161542 - RNA, 20 nt, Homo sapiens
gggcagcccagugcugccac

SEQ ID NO: 2161543 - RNA, 16 nt, Homo sapiens
gaaaucagaguuuuca

SEQ ID NO: 2161544 - RNA, 16 nt, Homo sapiens
uugaaaaaacaccaug

SEQ ID NO: 2161545 - RNA, 23 nt, Homo sapiens
cucuaagcacauuccaaacuuua

SEQ ID NO: 2161546 - RNA, 19 nt, Homo sapiens
gcaagacaguggcacuaaa

SEQ ID NO: 2161547 - RNA, 22 nt, Homo sapiens
guuguacuguaugugaugaauu

SEQ ID NO: 2161548 - RNA, 15 nt, Homo sapiens
cuggaaaugcaaaua

SEQ ID NO: 2161549 - RNA, 13 nt, Homo sapiens
ggucugggccagu

SEQ ID NO: 2161550 - RNA, 17 nt, Homo sapiens
cuaauuagagcagauga

SEQ ID NO: 2161551 - RNA, 16 nt, Homo sapiens
uauaaaucaaugucac

SEQ ID NO: 2161552 - RNA, 12 nt, Homo sapiens
aagaucuguuaa

SEQ ID NO: 2161553 - RNA, 13 nt, Homo sapiens
ccuggaaccaggc

SEQ ID NO: 2161554 - RNA, 16 nt, Homo sapiens
aauaaaucuaggaugu

SEQ ID NO: 2161555 - RNA, 15 nt, Homo sapiens
ugcugcuguaccaca

SEQ ID NO: 2161556 - RNA, 12 nt, Homo sapiens
agcuuaugccua

SEQ ID NO: 2161557 - RNA, 23 nt, Homo sapiens
aaacaugacccugggcuucugua

SEQ ID NO: 2161558 - RNA, 17 nt, Homo sapiens
cccacagaacugcuuac

SEQ ID NO: 2161559 - RNA, 14 nt, Homo sapiens
cagccucacuccau

SEQ ID NO: 2161560 - RNA, 14 nt, Homo sapiens
caggcuggccaguc

SEQ ID NO: 2161561 - RNA, 21 nt, Homo sapiens
uuuaguugacuaaugaggcau

SEQ ID NO: 2161562 - RNA, 20 nt, Homo sapiens
uuugaugugaaaaucaugaa

SEQ ID NO: 2161563 - RNA, 13 nt, Homo sapiens
cagacagcacccu

SEQ ID NO: 2161564 - RNA, 15 nt, Homo sapiens
gacucucaaaucuuu

SEQ ID NO: 2161565 - RNA, 13 nt, Homo sapiens
uccaugcuggaua

SEQ ID NO: 2161566 - RNA, 11 nt, Homo sapiens
aaucacaagaa

SEQ ID NO: 2161567 - RNA, 21 nt, Homo sapiens
cccgccaccucagggcacgca

SEQ ID NO: 2161568 - RNA, 15 nt, Homo sapiens
uugggcucugaugaa

SEQ ID NO: 2161569 - RNA, 17 nt, Homo sapiens
cuucuccugcugcuccu

SEQ ID NO: 2161570 - RNA, 17 nt, Homo sapiens
acuucuauauauacaau

SEQ ID NO: 2161571 - RNA, 20 nt, Homo sapiens
gaggcagcagaauugcuuga

SEQ ID NO: 2161572 - RNA, 15 nt, Homo sapiens
guuuuguauucucug

SEQ ID NO: 2161573 - RNA, 16 nt, Homo sapiens
acaguuuugauacaaa

SEQ ID NO: 2161574 - RNA, 18 nt, Homo sapiens
cccagcugggcucugcca

SEQ ID NO: 2161575 - RNA, 12 nt, Homo sapiens
aauaauaugcau

SEQ ID NO: 2161576 - RNA, 21 nt, Homo sapiens
acaguuugcuauuugcuuuag

SEQ ID NO: 2161577 - RNA, 14 nt, Homo sapiens
uauguuucacugug

SEQ ID NO: 2161578 - RNA, 15 nt, Homo sapiens
ucuacuaacaaucag

SEQ ID NO: 2161579 - RNA, 20 nt, Homo sapiens
aauuucuuuaaauaaaaccc

SEQ ID NO: 2161580 - RNA, 15 nt, Homo sapiens
ugaaaggucaucuca

SEQ ID NO: 2161581 - RNA, 15 nt, Homo sapiens
gcaaacaaaauggac

SEQ ID NO: 2161582 - RNA, 13 nt, Homo sapiens
agaauuauucucu

SEQ ID NO: 2161583 - RNA, 13 nt, Homo sapiens
ugacaaacuggca

SEQ ID NO: 2161584 - RNA, 22 nt, Homo sapiens
uaaucacucuaauuaauuguaa

SEQ ID NO: 2161585 - RNA, 15 nt, Homo sapiens
ucaugcgcacagagg

SEQ ID NO: 2161586 - RNA, 23 nt, Homo sapiens
ccuaguuugugagaaacaucuca

SEQ ID NO: 2161587 - RNA, 15 nt, Homo sapiens
ugugaaaacaucuca

SEQ ID NO: 2161588 - RNA, 18 nt, Homo sapiens
auaaaagagguccauuaa

SEQ ID NO: 2161589 - RNA, 19 nt, Homo sapiens
gaaaacuguuaccuaaagu

SEQ ID NO: 2161590 - RNA, 12 nt, Homo sapiens
gaaaacaugacu

SEQ ID NO: 2161591 - RNA, 12 nt, Homo sapiens
uaauacauuaca

SEQ ID NO: 2161592 - RNA, 17 nt, Homo sapiens
ugauaugcaagugcaaa

SEQ ID NO: 2161593 - RNA, 21 nt, Homo sapiens
cucagucauccugcaggcaca

SEQ ID NO: 2161594 - RNA, 22 nt, Homo sapiens
gaaagaaaaucaggcuggccaa

SEQ ID NO: 2161595 - RNA, 15 nt, Homo sapiens
caggagucagccaug

SEQ ID NO: 2161596 - RNA, 17 nt, Homo sapiens
cagggaugacagauuug

SEQ ID NO: 2161597 - RNA, 18 nt, Homo sapiens
gcucagaaaaucaaagag

SEQ ID NO: 2161598 - RNA, 15 nt, Homo sapiens
ucugcauccauuuga

SEQ ID NO: 2161599 - RNA, 15 nt, Homo sapiens
cccucugcagucucu

SEQ ID NO: 2161600 - RNA, 19 nt, Homo sapiens
cugguauuaacuuuauaca

SEQ ID NO: 2161601 - RNA, 14 nt, Homo sapiens
cagcccugagccau

SEQ ID NO: 2161602 - RNA, 22 nt, Homo sapiens
gcugagugggagcugucaggca

SEQ ID NO: 2161603 - RNA, 21 nt, Homo sapiens
cauaaaaaggaacaagacuga

SEQ ID NO: 2161604 - RNA, 21 nt, Homo sapiens
aaaugggagaaaacgccagug

SEQ ID NO: 2161605 - RNA, 18 nt, Homo sapiens
caucuuuugaagcuuucu

SEQ ID NO: 2161606 - RNA, 13 nt, Homo sapiens
acuagacauuacc

SEQ ID NO: 2161607 - RNA, 21 nt, Homo sapiens
gccagggggaugccacuccuc

SEQ ID NO: 2161608 - RNA, 18 nt, Homo sapiens
uccauuagagaguggcaa

SEQ ID NO: 2161609 - RNA, 21 nt, Homo sapiens
agaacaccuuuguuuugcacu

SEQ ID NO: 2161610 - RNA, 20 nt, Homo sapiens
acagaagccuggacucugcc

SEQ ID NO: 2161611 - RNA, 16 nt, Homo sapiens
aaaaaugcaccacuuu

SEQ ID NO: 2161612 - RNA, 18 nt, Homo sapiens
caauuauagaaagccaaa

SEQ ID NO: 2161613 - RNA, 19 nt, Homo sapiens
cauccuacccuaaugccag

SEQ ID NO: 2161614 - RNA, 20 nt, Homo sapiens
gaaauaggauuuugaaccca

SEQ ID NO: 2161615 - RNA, 15 nt, Homo sapiens
ccuucgaguccagga

SEQ ID NO: 2161616 - RNA, 20 nt, Homo sapiens
cagaggcuagucucuucuca

SEQ ID NO: 2161617 - RNA, 22 nt, Homo sapiens
uucuauuaauaucaacucugaa

SEQ ID NO: 2161618 - RNA, 18 nt, Homo sapiens
aagccaacccugugacug

SEQ ID NO: 2161619 - RNA, 13 nt, Homo sapiens
caguguuagcuua

SEQ ID NO: 2161620 - RNA, 23 nt, Homo sapiens
aguugugaucuguuguaauauca

SEQ ID NO: 2161621 - RNA, 22 nt, Homo sapiens
aguugcagaccaucgcacacca

SEQ ID NO: 2161622 - RNA, 20 nt, Homo sapiens
cucuuaucaaucccaaccau

SEQ ID NO: 2161623 - RNA, 14 nt, Homo sapiens
ugacucagugacca

SEQ ID NO: 2161624 - RNA, 19 nt, Homo sapiens
agagaagcuccugcuacuu

SEQ ID NO: 2161625 - RNA, 21 nt, Homo sapiens
aagaaauuccuguagcaucuu

SEQ ID NO: 2161626 - RNA, 21 nt, Homo sapiens
caacuggguuuucagcauaaa

SEQ ID NO: 2161627 - RNA, 17 nt, Homo sapiens
agcacaccaaguggcug

SEQ ID NO: 2161628 - RNA, 22 nt, Homo sapiens
ccugggcugggagaaggugcuu

SEQ ID NO: 2161629 - RNA, 19 nt, Homo sapiens
cuuauuuucucaaucuccu

SEQ ID NO: 2161630 - RNA, 20 nt, Homo sapiens
aauuaagcucucauagcuca

SEQ ID NO: 2161631 - RNA, 22 nt, Homo sapiens
gaccagaccccaaaccagcccu

SEQ ID NO: 2161632 - RNA, 21 nt, Homo sapiens
uauucuauaaacauaugcaaa

SEQ ID NO: 2161633 - RNA, 24 nt, Homo sapiens
aagaguuucuccuuuugaccaaau

SEQ ID NO: 2161634 - RNA, 22 nt, Homo sapiens
gaucauugcuggcaugaagcug

SEQ ID NO: 2161635 - RNA, 19 nt, Homo sapiens
uuuuaauuuauuucaucca

SEQ ID NO: 2161636 - RNA, 13 nt, Homo sapiens
agccgugcacucc

SEQ ID NO: 2161637 - RNA, 20 nt, Homo sapiens
ugcugcccagugcaaaccac

SEQ ID NO: 2161638 - RNA, 14 nt, Homo sapiens
aauguaaauguuau

SEQ ID NO: 2161639 - RNA, 12 nt, Homo sapiens
aagcaggauuuc

SEQ ID NO: 2161640 - RNA, 16 nt, Homo sapiens
guacuugggaggccaa

SEQ ID NO: 2161641 - RNA, 14 nt, Homo sapiens
auccuccuuucuau

SEQ ID NO: 2161642 - RNA, 13 nt, Homo sapiens
uucuguacaguaa

SEQ ID NO: 2161643 - RNA, 17 nt, Homo sapiens
acccagcuaauuuuugc

SEQ ID NO: 2161644 - RNA, 22 nt, Homo sapiens
acagacuauuccccaccugcuu

SEQ ID NO: 2161645 - RNA, 17 nt, Homo sapiens
gcccaaggcaguguucc

SEQ ID NO: 2161646 - RNA, 14 nt, Homo sapiens
guuggcacuguaag

SEQ ID NO: 2161647 - RNA, 16 nt, Homo sapiens
uuaugcuguacccagu

SEQ ID NO: 2161648 - RNA, 16 nt, Homo sapiens
acuguugucaaaaagu

SEQ ID NO: 2161649 - RNA, 16 nt, Homo sapiens
aaacuguuaucacuua

SEQ ID NO: 2161650 - RNA, 11 nt, Homo sapiens
cugaacacugc

SEQ ID NO: 2161651 - RNA, 19 nt, Homo sapiens
guauugaucaaugcauguu

SEQ ID NO: 2161652 - RNA, 22 nt, Homo sapiens
augagcuuucuuugcacuuaaa

SEQ ID NO: 2161653 - RNA, 16 nt, Homo sapiens
caccauuggaccccac

SEQ ID NO: 2161654 - RNA, 13 nt, Homo sapiens
cccuccccaugca

SEQ ID NO: 2161655 - RNA, 20 nt, Homo sapiens
aacacaguguuuccugagua

SEQ ID NO: 2161656 - RNA, 13 nt, Homo sapiens
ccaugggauacaa

SEQ ID NO: 2161657 - RNA, 14 nt, Homo sapiens
uggugcucuuugcu

SEQ ID NO: 2161658 - RNA, 20 nt, Homo sapiens
acccugccaggcugcuaaag

SEQ ID NO: 2161659 - RNA, 18 nt, Homo sapiens
aaaaguggcguuguucau

SEQ ID NO: 2161660 - RNA, 14 nt, Homo sapiens
caaacuuguucaaa

SEQ ID NO: 2161661 - RNA, 19 nt, Homo sapiens
ccugugcccuagaugcacg

SEQ ID NO: 2161662 - RNA, 22 nt, Homo sapiens
ugcuagccccagagaugccagc

SEQ ID NO: 2161663 - RNA, 14 nt, Homo sapiens
cguucccacugccc

SEQ ID NO: 2161664 - RNA, 16 nt, Homo sapiens
caucauugcauaacag

SEQ ID NO: 2161665 - RNA, 21 nt, Homo sapiens
ucucugaacuaggugaucuca

SEQ ID NO: 2161666 - RNA, 18 nt, Homo sapiens
aauuuaaaaaaugggcua

SEQ ID NO: 2161667 - RNA, 20 nt, Homo sapiens
cagaauguauggagaguuac

SEQ ID NO: 2161668 - RNA, 22 nt, Homo sapiens
uagcauggcauauuuuucacau

SEQ ID NO: 2161669 - RNA, 16 nt, Homo sapiens
ucaggaaaaaccagcc

SEQ ID NO: 2161670 - RNA, 15 nt, Homo sapiens
acucauauguggaau

SEQ ID NO: 2161671 - RNA, 15 nt, Homo sapiens
cugcugucauaacau

SEQ ID NO: 2161672 - RNA, 21 nt, Homo sapiens
uuccuauaauuuuagacauuc

SEQ ID NO: 2161673 - RNA, 21 nt, Homo sapiens
aaacuaugugggucugugaau

SEQ ID NO: 2161674 - RNA, 14 nt, Homo sapiens
agcaaugaugucca

SEQ ID NO: 2161675 - RNA, 18 nt, Homo sapiens
ucacugccugacauucac

SEQ ID NO: 2161676 - RNA, 20 nt, Homo sapiens
ccucuccugcccaagcacuu

SEQ ID NO: 2161677 - RNA, 19 nt, Homo sapiens
gaauucccuuucauuugaa

SEQ ID NO: 2161678 - RNA, 18 nt, Homo sapiens
cuuuuaagcagugaguua

SEQ ID NO: 2161679 - RNA, 17 nt, Homo sapiens
gguguccccaccaucug

SEQ ID NO: 2161680 - RNA, 19 nt, Homo sapiens
cccaggccagagugcagug

SEQ ID NO: 2161681 - RNA, 18 nt, Homo sapiens
gcaagugaacucaucccu

SEQ ID NO: 2161682 - RNA, 21 nt, Homo sapiens
acucguauagcaugcaucugu

SEQ ID NO: 2161683 - RNA, 20 nt, Homo sapiens
cuagguucuaaaaauuguga

SEQ ID NO: 2161684 - RNA, 13 nt, Homo sapiens
auuaccaguuuuc

SEQ ID NO: 2161685 - RNA, 21 nt, Homo sapiens
auaaauuauuaguuuacauca

SEQ ID NO: 2161686 - RNA, 13 nt, Homo sapiens
ugagugaguucuc

SEQ ID NO: 2161687 - RNA, 15 nt, Homo sapiens
gcuuugcucuauuaa

SEQ ID NO: 2161688 - RNA, 19 nt, Homo sapiens
acaguaugcauacuggugu

SEQ ID NO: 2161689 - RNA, 17 nt, Homo sapiens
ugacuauggaaagagua

SEQ ID NO: 2161690 - RNA, 16 nt, Homo sapiens
ccaguccuagcugcac

SEQ ID NO: 2161691 - RNA, 22 nt, Homo sapiens
uuguaucuuuaaagacuugaug

SEQ ID NO: 2161692 - RNA, 22 nt, Homo sapiens
aagugugcauuaccacacucag

SEQ ID NO: 2161693 - RNA, 16 nt, Homo sapiens
aagccugaacuauuua

SEQ ID NO: 2161694 - RNA, 16 nt, Homo sapiens
aaauuauaucucagua

SEQ ID NO: 2161695 - RNA, 23 nt, Homo sapiens
uccacugggacccccaacauucu

SEQ ID NO: 2161696 - RNA, 14 nt, Homo sapiens
cucuuuucaaugug

SEQ ID NO: 2161697 - RNA, 16 nt, Homo sapiens
gauggguggaccaaac

SEQ ID NO: 2161698 - RNA, 20 nt, Homo sapiens
ucugucuggaggggagcucu

SEQ ID NO: 2161699 - RNA, 21 nt, Homo sapiens
aggcggagggucucccugggc

SEQ ID NO: 2161700 - RNA, 16 nt, Homo sapiens
ucagucccccaccaca

SEQ ID NO: 2161701 - RNA, 17 nt, Homo sapiens
uagacugaaaagccaug

SEQ ID NO: 2161702 - RNA, 12 nt, Homo sapiens
aaaaacugcaca

SEQ ID NO: 2161703 - RNA, 20 nt, Homo sapiens
ugaucagacagcuugaauca

SEQ ID NO: 2161704 - RNA, 19 nt, Homo sapiens
uuccucgugggccgugugg

SEQ ID NO: 2161705 - RNA, 16 nt, Homo sapiens
uccuaagguccaacaa

SEQ ID NO: 2161706 - RNA, 14 nt, Homo sapiens
agaauuauacagua

SEQ ID NO: 2161707 - RNA, 19 nt, Homo sapiens
uccauauccgggugcucaa

SEQ ID NO: 2161708 - RNA, 20 nt, Homo sapiens
guacauuuuucaacuuugaa

SEQ ID NO: 2161709 - RNA, 14 nt, Homo sapiens
agaggacuccuuaa

SEQ ID NO: 2161710 - RNA, 13 nt, Homo sapiens
ucaguugccaaag

SEQ ID NO: 2161711 - RNA, 13 nt, Homo sapiens
caaggugcucaau

SEQ ID NO: 2161712 - RNA, 12 nt, Homo sapiens
gcuucucuccac

SEQ ID NO: 2161713 - RNA, 12 nt, Homo sapiens
aauaacugccuu

SEQ ID NO: 2161714 - RNA, 12 nt, Homo sapiens
guaccucucuuu

SEQ ID NO: 2161715 - RNA, 12 nt, Homo sapiens
acaaacugcaau

SEQ ID NO: 2161716 - RNA, 20 nt, Homo sapiens
cacaauuuuaauucaaaaga

SEQ ID NO: 2161717 - RNA, 17 nt, Homo sapiens
uaauuguguugauucuu

SEQ ID NO: 2161718 - RNA, 15 nt, Homo sapiens
gaacccucuugccau

SEQ ID NO: 2161719 - RNA, 17 nt, Homo sapiens
aaugcagcauguugccc

SEQ ID NO: 2161720 - RNA, 13 nt, Homo sapiens
cauuguugucuuc

SEQ ID NO: 2161721 - RNA, 16 nt, Homo sapiens
uacacauagcagagua

SEQ ID NO: 2161722 - RNA, 18 nt, Homo sapiens
gaaaaaaaaaacuaucaa

SEQ ID NO: 2161723 - RNA, 15 nt, Homo sapiens
acaaccugugaucaa

SEQ ID NO: 2161724 - RNA, 18 nt, Homo sapiens
cauccaugugcuagucac

SEQ ID NO: 2161725 - RNA, 21 nt, Homo sapiens
acuuggucagagccacucuau

SEQ ID NO: 2161726 - RNA, 17 nt, Homo sapiens
auuuguguaacugaaag

SEQ ID NO: 2161727 - RNA, 16 nt, Homo sapiens
gcugagaauguggaau

SEQ ID NO: 2161728 - RNA, 12 nt, Homo sapiens
uuuggagacaga

SEQ ID NO: 2161729 - RNA, 12 nt, Homo sapiens
aaagucacuuac

SEQ ID NO: 2161730 - RNA, 18 nt, Homo sapiens
uccaagugccccaccacu

SEQ ID NO: 2161731 - RNA, 22 nt, Homo sapiens
uuucaaaaaaucugaccaaaac

SEQ ID NO: 2161732 - RNA, 10 nt, Homo sapiens
ggggggcccg

SEQ ID NO: 2161733 - RNA, 20 nt, Homo sapiens
gacagcaugaaauguccucu

SEQ ID NO: 2161734 - RNA, 15 nt, Homo sapiens
uggagggucucuagu

SEQ ID NO: 2161735 - RNA, 12 nt, Homo sapiens
cuaaucagugau

SEQ ID NO: 2161736 - RNA, 15 nt, Homo sapiens
agagaggacuggaga

SEQ ID NO: 2161737 - RNA, 18 nt, Homo sapiens
ccuuccauaauaauucug

SEQ ID NO: 2161738 - RNA, 18 nt, Homo sapiens
acuugauggcuaacuuac

SEQ ID NO: 2161739 - RNA, 15 nt, Homo sapiens
ugugugugaaccacu

SEQ ID NO: 2161740 - RNA, 20 nt, Homo sapiens
cauaacucugugaucuugcu

SEQ ID NO: 2161741 - RNA, 22 nt, Homo sapiens
cuccucuucaaauaaacauguc

SEQ ID NO: 2161742 - RNA, 21 nt, Homo sapiens
caccugccaccacuauaaaau

SEQ ID NO: 2161743 - RNA, 14 nt, Homo sapiens
auuuuaaaaacaua

SEQ ID NO: 2161744 - RNA, 13 nt, Homo sapiens
cacuccccuaggg

SEQ ID NO: 2161745 - RNA, 18 nt, Homo sapiens
agucauauauaucaccca

SEQ ID NO: 2161746 - RNA, 13 nt, Homo sapiens
ucaagaaagccag

SEQ ID NO: 2161747 - RNA, 18 nt, Homo sapiens
aucagcaccccaguggag

SEQ ID NO: 2161748 - RNA, 20 nt, Homo sapiens
ugcuccuuaugaugcccuaa

SEQ ID NO: 2161749 - RNA, 17 nt, Homo sapiens
gaaugagcaaaaccaaa

SEQ ID NO: 2161750 - RNA, 14 nt, Homo sapiens
uagaugcugugaca

SEQ ID NO: 2161751 - RNA, 22 nt, Homo sapiens
acagacuauuaaaacuaauaau

SEQ ID NO: 2161752 - RNA, 16 nt, Homo sapiens
auuggaaucugauaua

SEQ ID NO: 2161753 - RNA, 14 nt, Homo sapiens
aagugccaucucaa

SEQ ID NO: 2161754 - RNA, 22 nt, Homo sapiens
caucuuuggggagguguucacu

SEQ ID NO: 2161755 - RNA, 19 nt, Homo sapiens
gaacuucugaacuuggaaa

SEQ ID NO: 2161756 - RNA, 23 nt, Homo sapiens
ucuucugcuggcagaaagcaaau

SEQ ID NO: 2161757 - RNA, 13 nt, Homo sapiens
ucgagacugaaag

SEQ ID NO: 2161758 - RNA, 16 nt, Homo sapiens
gcuggagaggaaccca

SEQ ID NO: 2161759 - RNA, 20 nt, Homo sapiens
ccaaugcugcuccacccucc

SEQ ID NO: 2161760 - RNA, 14 nt, Homo sapiens
uucuuuauauucaa

SEQ ID NO: 2161761 - RNA, 17 nt, Homo sapiens
auuuaugaauuuuacuu

SEQ ID NO: 2161762 - RNA, 13 nt, Homo sapiens
acgaggugcaaca

SEQ ID NO: 2161763 - RNA, 20 nt, Homo sapiens
gagaggugggcagcagcuca

SEQ ID NO: 2161764 - RNA, 15 nt, Homo sapiens
gagggccaagcccag

SEQ ID NO: 2161765 - RNA, 16 nt, Homo sapiens
acacgccuggcuucca

SEQ ID NO: 2161766 - RNA, 16 nt, Homo sapiens
agcugggagcacuggu

SEQ ID NO: 2161767 - RNA, 23 nt, Homo sapiens
ucagagcuccaguuugcauuugg

SEQ ID NO: 2161768 - RNA, 13 nt, Homo sapiens
cuaauuucuuaga

SEQ ID NO: 2161769 - RNA, 22 nt, Homo sapiens
gcaaguuaacuuggaaaucagu

SEQ ID NO: 2161770 - RNA, 19 nt, Homo sapiens
cagggcccagagcccagcu

SEQ ID NO: 2161771 - RNA, 15 nt, Homo sapiens
ggccuggcugcagcu

SEQ ID NO: 2161772 - RNA, 21 nt, Homo sapiens
cucucggaacugcaugcugcu

SEQ ID NO: 2161773 - RNA, 20 nt, Homo sapiens
cauuauucucugaugcacug

SEQ ID NO: 2161774 - RNA, 16 nt, Homo sapiens
gacaggccgggcagug

SEQ ID NO: 2161775 - RNA, 18 nt, Homo sapiens
ccaccuggggcuggggau

SEQ ID NO: 2161776 - RNA, 21 nt, Homo sapiens
cuguauucuguuugcguacuu

SEQ ID NO: 2161777 - RNA, 16 nt, Homo sapiens
aaccccaaacuguuga

SEQ ID NO: 2161778 - RNA, 16 nt, Homo sapiens
ccugcuggcaccucag

SEQ ID NO: 2161779 - RNA, 20 nt, Homo sapiens
agagcgagauucugccucaa

SEQ ID NO: 2161780 - RNA, 12 nt, Homo sapiens
uaacacaccaca

SEQ ID NO: 2161781 - RNA, 14 nt, Homo sapiens
agaauuagcugcuu

SEQ ID NO: 2161782 - RNA, 20 nt, Homo sapiens
cugaaucaucauaucuacua

SEQ ID NO: 2161783 - RNA, 22 nt, Homo sapiens
gcauagaucccauagugugcau

SEQ ID NO: 2161784 - RNA, 18 nt, Homo sapiens
uguggggugggcacauug

SEQ ID NO: 2161785 - RNA, 16 nt, Homo sapiens
uugagggugacagcca

SEQ ID NO: 2161786 - RNA, 21 nt, Homo sapiens
cagcagccacuugacuaauac

SEQ ID NO: 2161787 - RNA, 17 nt, Homo sapiens
cacuuccuacuguaaua

SEQ ID NO: 2161788 - RNA, 16 nt, Homo sapiens
uccuggcaauagucaa

SEQ ID NO: 2161789 - RNA, 19 nt, Homo sapiens
uaagacuguaaugaaucua

SEQ ID NO: 2161790 - RNA, 20 nt, Homo sapiens
gggaaccggcagcaucccag

SEQ ID NO: 2161791 - RNA, 21 nt, Homo sapiens
ucuuacaaccaagaacauuau

SEQ ID NO: 2161792 - RNA, 21 nt, Homo sapiens
auaacgauuuuaugaaaugac

SEQ ID NO: 2161793 - RNA, 15 nt, Homo sapiens
aaggucucugaacuc

SEQ ID NO: 2161794 - RNA, 14 nt, Homo sapiens
gaaacuggcacuga

SEQ ID NO: 2161795 - RNA, 18 nt, Homo sapiens
gaugcaaugacucaggac

SEQ ID NO: 2161796 - RNA, 15 nt, Homo sapiens
gaggaaagcaaagga

SEQ ID NO: 2161797 - RNA, 16 nt, Homo sapiens
uccagucuucuuuauc

SEQ ID NO: 2161798 - RNA, 14 nt, Homo sapiens
gcacuuuguuucau

SEQ ID NO: 2161799 - RNA, 12 nt, Homo sapiens
gaauaaagucaa

SEQ ID NO: 2161800 - RNA, 24 nt, Homo sapiens
aucaacuuuagcuaguaucuucaa

SEQ ID NO: 2161801 - RNA, 13 nt, Homo sapiens
uaaauuccacacu

SEQ ID NO: 2161802 - RNA, 17 nt, Homo sapiens
ugccccacuacaggccc

SEQ ID NO: 2161803 - RNA, 15 nt, Homo sapiens
uuuaaaauaaauucc

SEQ ID NO: 2161804 - RNA, 20 nt, Homo sapiens
gggaggcagagguugcagug

SEQ ID NO: 2161805 - RNA, 16 nt, Homo sapiens
cuuugaaaacaauuca

SEQ ID NO: 2161806 - RNA, 17 nt, Homo sapiens
auggagcucagguuucu

SEQ ID NO: 2161807 - RNA, 17 nt, Homo sapiens
auguggauuugauucau

SEQ ID NO: 2161808 - RNA, 20 nt, Homo sapiens
aggccaggacaaaaugcaga

SEQ ID NO: 2161809 - RNA, 19 nt, Homo sapiens
ggaaugugggucugcaccu

SEQ ID NO: 2161810 - RNA, 13 nt, Homo sapiens
gauuauuugcacg

SEQ ID NO: 2161811 - RNA, 21 nt, Homo sapiens
aaggacuuucugaagccucac

SEQ ID NO: 2161812 - RNA, 13 nt, Homo sapiens
cacagcacuucaa

SEQ ID NO: 2161813 - RNA, 18 nt, Homo sapiens
caggaggcuuaguccagu

SEQ ID NO: 2161814 - RNA, 15 nt, Homo sapiens
ccugaaccgugugcu

SEQ ID NO: 2161815 - RNA, 17 nt, Homo sapiens
cuaaaaguucucaaugu

SEQ ID NO: 2161816 - RNA, 16 nt, Homo sapiens
uuuggaaugcacacag

SEQ ID NO: 2161817 - RNA, 18 nt, Homo sapiens
ggccauugugaaccaaug

SEQ ID NO: 2161818 - RNA, 17 nt, Homo sapiens
ucccauuggcaaaagag

SEQ ID NO: 2161819 - RNA, 20 nt, Homo sapiens
ggagaguggccuggguccca

SEQ ID NO: 2161820 - RNA, 21 nt, Homo sapiens
ggagaucgcaucauugcacuc

SEQ ID NO: 2161821 - RNA, 19 nt, Homo sapiens
cucuuguuuacgacgugau

SEQ ID NO: 2161822 - RNA, 20 nt, Homo sapiens
uauugaaugaugugauacaa

SEQ ID NO: 2161823 - RNA, 20 nt, Homo sapiens
agauuacuucagggcuggaa

SEQ ID NO: 2161824 - RNA, 17 nt, Homo sapiens
aagccuuuaguaucagu

SEQ ID NO: 2161825 - RNA, 18 nt, Homo sapiens
uauuuuagagcaucucau

SEQ ID NO: 2161826 - RNA, 20 nt, Homo sapiens
uaccucauaucccauccuua

SEQ ID NO: 2161827 - RNA, 15 nt, Homo sapiens
caauucuucugucaa

SEQ ID NO: 2161828 - RNA, 22 nt, Homo sapiens
ucuaaucuuuuaauguauuugu

SEQ ID NO: 2161829 - RNA, 15 nt, Homo sapiens
ugugaccagggguga

SEQ ID NO: 2161830 - RNA, 22 nt, Homo sapiens
uugugaaauguaacaugaagca

SEQ ID NO: 2161831 - RNA, 17 nt, Homo sapiens
acguugcugccugugaa

SEQ ID NO: 2161832 - RNA, 13 nt, Homo sapiens
agagguccagccc

SEQ ID NO: 2161833 - RNA, 18 nt, Homo sapiens
gcaauccaccugccuugg

SEQ ID NO: 2161834 - RNA, 16 nt, Homo sapiens
gcuuuguuggcaagga

SEQ ID NO: 2161835 - RNA, 18 nt, Homo sapiens
auccccagcgauucccuc

SEQ ID NO: 2161836 - RNA, 18 nt, Homo sapiens
ucaagcuucuucacucac

SEQ ID NO: 2161837 - RNA, 16 nt, Homo sapiens
aaggaaaaaugcugcu

SEQ ID NO: 2161838 - RNA, 16 nt, Homo sapiens
cuggaaaacagcugcu

SEQ ID NO: 2161839 - RNA, 14 nt, Homo sapiens
gagccccgcaggga

SEQ ID NO: 2161840 - RNA, 15 nt, Homo sapiens
ccugauuucagggaa

SEQ ID NO: 2161841 - RNA, 13 nt, Homo sapiens
cuugcucaugagc

SEQ ID NO: 2161842 - RNA, 19 nt, Homo sapiens
ugauauaauuguacugugu

SEQ ID NO: 2161843 - RNA, 15 nt, Homo sapiens
aaaccuuaguuucaa

SEQ ID NO: 2161844 - RNA, 11 nt, Homo sapiens
cacaguuuaaa

SEQ ID NO: 2161845 - RNA, 22 nt, Homo sapiens
uauagaaaaggaacaguugcau

SEQ ID NO: 2161846 - RNA, 18 nt, Homo sapiens
aaucauuggggggagaaa

SEQ ID NO: 2161847 - RNA, 23 nt, Homo sapiens
agacuguugugaucuugcauuca

SEQ ID NO: 2161848 - RNA, 23 nt, Homo sapiens
cacagcuucugcagcagacuguc

SEQ ID NO: 2161849 - RNA, 20 nt, Homo sapiens
cuggccagcaaggcagguug

SEQ ID NO: 2161850 - RNA, 20 nt, Homo sapiens
cagaauauuuccuaguucau

SEQ ID NO: 2161851 - RNA, 22 nt, Homo sapiens
caguaaagaccauuuaguccuc

SEQ ID NO: 2161852 - RNA, 17 nt, Homo sapiens
auuuuaagguauucgaa

SEQ ID NO: 2161853 - RNA, 18 nt, Homo sapiens
aaucaccccucucagugc

SEQ ID NO: 2161854 - RNA, 14 nt, Homo sapiens
aguuucauaccaaa

SEQ ID NO: 2161855 - RNA, 17 nt, Homo sapiens
uaugugaauuuugccau

SEQ ID NO: 2161856 - RNA, 16 nt, Homo sapiens
ccaauuugcacuuuca

SEQ ID NO: 2161857 - RNA, 22 nt, Homo sapiens
cucccuauccuaaaggcccacu

SEQ ID NO: 2161858 - RNA, 16 nt, Homo sapiens
acuuucuaugugacau

SEQ ID NO: 2161859 - RNA, 16 nt, Homo sapiens
uaacacggugcucauu

SEQ ID NO: 2161860 - RNA, 13 nt, Homo sapiens
ccguccauuccag

SEQ ID NO: 2161861 - RNA, 23 nt, Homo sapiens
uauuauuuuucgucucaauggua

SEQ ID NO: 2161862 - RNA, 19 nt, Homo sapiens
cagagacaggcccaagaga

SEQ ID NO: 2161863 - RNA, 17 nt, Homo sapiens
aauauauucuauuccau

SEQ ID NO: 2161864 - RNA, 15 nt, Homo sapiens
auauaugucagugau

SEQ ID NO: 2161865 - RNA, 20 nt, Homo sapiens
ucauaauugccuacauuuau

SEQ ID NO: 2161866 - RNA, 22 nt, Homo sapiens
gggagcagccugguguccugcc

SEQ ID NO: 2161867 - RNA, 12 nt, Homo sapiens
uugugucagaga

SEQ ID NO: 2161868 - RNA, 18 nt, Homo sapiens
aaaagcccuuuccaaagg

SEQ ID NO: 2161869 - RNA, 21 nt, Homo sapiens
gcuccaaaccaacauggagua

SEQ ID NO: 2161870 - RNA, 12 nt, Homo sapiens
aaaaaguuccau

SEQ ID NO: 2161871 - RNA, 22 nt, Homo sapiens
gucuauacaaaggcuugcuaag

SEQ ID NO: 2161872 - RNA, 23 nt, Homo sapiens
uuacacacuggaaauugaaauaa

SEQ ID NO: 2161873 - RNA, 16 nt, Homo sapiens
ugucacuaaacugaaa

SEQ ID NO: 2161874 - RNA, 14 nt, Homo sapiens
cuuucccugguccc

SEQ ID NO: 2161875 - RNA, 13 nt, Homo sapiens
uacuuaacaaagu

SEQ ID NO: 2161876 - RNA, 14 nt, Homo sapiens
cugcuccaccacau

SEQ ID NO: 2161877 - RNA, 13 nt, Homo sapiens
aagaaagcuuuag

SEQ ID NO: 2161878 - RNA, 14 nt, Homo sapiens
gcuugaagcaaaca

SEQ ID NO: 2161879 - RNA, 23 nt, Homo sapiens
gaggcggaaaccuugcagcauuu

SEQ ID NO: 2161880 - RNA, 22 nt, Homo sapiens
uauguacaauauuuuaagcauu

SEQ ID NO: 2161881 - RNA, 14 nt, Homo sapiens
cagccacacccaga

SEQ ID NO: 2161882 - RNA, 15 nt, Homo sapiens
cggagguuccaguga

SEQ ID NO: 2161883 - RNA, 17 nt, Homo sapiens
ucagcagagucuaguag

SEQ ID NO: 2161884 - RNA, 20 nt, Homo sapiens
ugucccaccacagucccuca

SEQ ID NO: 2161885 - RNA, 14 nt, Homo sapiens
ggcugcuccaugag

SEQ ID NO: 2161886 - RNA, 17 nt, Homo sapiens
ccugauggagagugaga

SEQ ID NO: 2161887 - RNA, 12 nt, Homo sapiens
aacuugcuacag

SEQ ID NO: 2161888 - RNA, 14 nt, Homo sapiens
gaaguugaagcaca

SEQ ID NO: 2161889 - RNA, 22 nt, Homo sapiens
auguucaguccaacaaaccaca

SEQ ID NO: 2161890 - RNA, 19 nt, Homo sapiens
auaagaaaaggcaucacuu

SEQ ID NO: 2161891 - RNA, 13 nt, Homo sapiens
uuaucuuaugcca

SEQ ID NO: 2161892 - RNA, 20 nt, Homo sapiens
ggaagaguucugaucuguac

SEQ ID NO: 2161893 - RNA, 14 nt, Homo sapiens
uggaaagcagccau

SEQ ID NO: 2161894 - RNA, 23 nt, Homo sapiens
gggugaccagccacucaaaggaa

SEQ ID NO: 2161895 - RNA, 21 nt, Homo sapiens
uucuauuuuuaguuugcuaag

SEQ ID NO: 2161896 - RNA, 12 nt, Homo sapiens
cauggacaucua

SEQ ID NO: 2161897 - RNA, 16 nt, Homo sapiens
gcuauuuaacauuuua

SEQ ID NO: 2161898 - RNA, 10 nt, Homo sapiens
agagcacaga

SEQ ID NO: 2161899 - RNA, 22 nt, Homo sapiens
caaguauuauuuuacaaucaac

SEQ ID NO: 2161900 - RNA, 23 nt, Homo sapiens
guuucccgcuccaagagaauuca

SEQ ID NO: 2161901 - RNA, 14 nt, Homo sapiens
ucauaaaaaucuag

SEQ ID NO: 2161902 - RNA, 13 nt, Homo sapiens
aauccuucucauu

SEQ ID NO: 2161903 - RNA, 13 nt, Homo sapiens
acaucuucuaucu

SEQ ID NO: 2161904 - RNA, 20 nt, Homo sapiens
uuagauauugcuacuauaau

SEQ ID NO: 2161905 - RNA, 15 nt, Homo sapiens
uuucuccuucacagc

SEQ ID NO: 2161906 - RNA, 22 nt, Homo sapiens
guaccauuaucuuaucuaguaa

SEQ ID NO: 2161907 - RNA, 15 nt, Homo sapiens
gggccuuaaaagcca

SEQ ID NO: 2161908 - RNA, 21 nt, Homo sapiens
aguuauugaugagagggaaaa

SEQ ID NO: 2161909 - RNA, 17 nt, Homo sapiens
uccccucccuguauaag

SEQ ID NO: 2161910 - RNA, 21 nt, Homo sapiens
ccaacuuuuuguuacagauua

SEQ ID NO: 2161911 - RNA, 14 nt, Homo sapiens
agagggacuuugcc

SEQ ID NO: 2161912 - RNA, 18 nt, Homo sapiens
ccaacuacuacuggugau

SEQ ID NO: 2161913 - RNA, 13 nt, Homo sapiens
ucuacucccaagu

SEQ ID NO: 2161914 - RNA, 20 nt, Homo sapiens
accaauugucaugcuugaca

SEQ ID NO: 2161915 - RNA, 22 nt, Homo sapiens
gcugugucacacucuguguuuu

SEQ ID NO: 2161916 - RNA, 12 nt, Homo sapiens
agcuacugauga

SEQ ID NO: 2161917 - RNA, 22 nt, Homo sapiens
aaauuuuuuguugacauuaguc

SEQ ID NO: 2161918 - RNA, 16 nt, Homo sapiens
aagacucugccauuaa

SEQ ID NO: 2161919 - RNA, 23 nt, Homo sapiens
aggguggacuuagaaagcagggg

SEQ ID NO: 2161920 - RNA, 13 nt, Homo sapiens
cucccccagggag

SEQ ID NO: 2161921 - RNA, 20 nt, Homo sapiens
acuugcauuucugacuuuau

SEQ ID NO: 2161922 - RNA, 20 nt, Homo sapiens
aguaagcccggauagacuua

SEQ ID NO: 2161923 - RNA, 13 nt, Homo sapiens
gaucuuuacuacu

SEQ ID NO: 2161924 - RNA, 15 nt, Homo sapiens
uacaguguuuauccu

SEQ ID NO: 2161925 - RNA, 13 nt, Homo sapiens
ccucuccauuugc

SEQ ID NO: 2161926 - RNA, 20 nt, Homo sapiens
ucaggaacuauuaauuccau

SEQ ID NO: 2161927 - RNA, 15 nt, Homo sapiens
agagccuccuaaaau

SEQ ID NO: 2161928 - RNA, 17 nt, Homo sapiens
uucaaaaaauuauauga

SEQ ID NO: 2161929 - RNA, 12 nt, Homo sapiens
uuaacugaaugc

SEQ ID NO: 2161930 - RNA, 12 nt, Homo sapiens
augacugauuac

SEQ ID NO: 2161931 - RNA, 21 nt, Homo sapiens
acccuguggagaaauucguug

SEQ ID NO: 2161932 - RNA, 21 nt, Homo sapiens
uuucuguguaccacugggaua

SEQ ID NO: 2161933 - RNA, 22 nt, Homo sapiens
guuauggguacggcaaccacau

SEQ ID NO: 2161934 - RNA, 20 nt, Homo sapiens
ccauaauaauucugcuuuag

SEQ ID NO: 2161935 - RNA, 22 nt, Homo sapiens
uacuuauuuaaaaaugcaugau

SEQ ID NO: 2161936 - RNA, 15 nt, Homo sapiens
caguguccagacuuu

SEQ ID NO: 2161937 - RNA, 18 nt, Homo sapiens
aaagauaauucacuguac

SEQ ID NO: 2161938 - RNA, 18 nt, Homo sapiens
gccacaaagaagaaguuu

SEQ ID NO: 2161939 - RNA, 15 nt, Homo sapiens
aggaugcacuggccu

SEQ ID NO: 2161940 - RNA, 12 nt, Homo sapiens
ggcagcauuuag

SEQ ID NO: 2161941 - RNA, 20 nt, Homo sapiens
gaaaagagaaggaaagugau

SEQ ID NO: 2161942 - RNA, 14 nt, Homo sapiens
accacucaaaaaug

SEQ ID NO: 2161943 - RNA, 21 nt, Homo sapiens
agccucuguccuggcugugca

SEQ ID NO: 2161944 - RNA, 16 nt, Homo sapiens
gcggaugcuggccaca

SEQ ID NO: 2161945 - RNA, 22 nt, Homo sapiens
gccgggacccagggcccucggu

SEQ ID NO: 2161946 - RNA, 16 nt, Homo sapiens
gcucuagaaaguauag

SEQ ID NO: 2161947 - RNA, 16 nt, Homo sapiens
ggaauuaguugggaug

SEQ ID NO: 2161948 - RNA, 20 nt, Homo sapiens
uaaauucccaacuucucuug

SEQ ID NO: 2161949 - RNA, 23 nt, Homo sapiens
acccugauuuuacacacauuaaa

SEQ ID NO: 2161950 - RNA, 18 nt, Homo sapiens
aagaaacgaucagacaga

SEQ ID NO: 2161951 - RNA, 16 nt, Homo sapiens
ggauucuguaugccaa

SEQ ID NO: 2161952 - RNA, 19 nt, Homo sapiens
agaaauuccaacuccugau

SEQ ID NO: 2161953 - RNA, 14 nt, Homo sapiens
gcuauucaccaaua

SEQ ID NO: 2161954 - RNA, 21 nt, Homo sapiens
aaaccacuuuuuuuuccccaa

SEQ ID NO: 2161955 - RNA, 13 nt, Homo sapiens
ccugaggugcauu

SEQ ID NO: 2161956 - RNA, 21 nt, Homo sapiens
aaggguacagauuagguuugu

SEQ ID NO: 2161957 - RNA, 18 nt, Homo sapiens
gaugguuucuaucugcaa

SEQ ID NO: 2161958 - RNA, 17 nt, Homo sapiens
acccagacaaccaaaac

SEQ ID NO: 2161959 - RNA, 22 nt, Homo sapiens
agaagauggcaaaaucaucuua

SEQ ID NO: 2161960 - RNA, 19 nt, Homo sapiens
ucauaguauuggagcacau

SEQ ID NO: 2161961 - RNA, 21 nt, Homo sapiens
ccucugguucugacacuuucu

SEQ ID NO: 2161962 - RNA, 21 nt, Homo sapiens
aaaguguaaaucuaaacauaa

SEQ ID NO: 2161963 - RNA, 18 nt, Homo sapiens
gcuacugcuucaaucuca

SEQ ID NO: 2161964 - RNA, 16 nt, Homo sapiens
cauuuuacauagcaca

SEQ ID NO: 2161965 - RNA, 20 nt, Homo sapiens
guccuaucuccagcggcccu

SEQ ID NO: 2161966 - RNA, 15 nt, Homo sapiens
ugcucagcuguggcu

SEQ ID NO: 2161967 - RNA, 21 nt, Homo sapiens
aagagugucacugagcugugu

SEQ ID NO: 2161968 - RNA, 20 nt, Homo sapiens
ucccgaguagcuggaauuac

SEQ ID NO: 2161969 - RNA, 14 nt, Homo sapiens
aucccccuccuugc

SEQ ID NO: 2161970 - RNA, 23 nt, Homo sapiens
uuccggaagaaaaagagccauug

SEQ ID NO: 2161971 - RNA, 18 nt, Homo sapiens
uugaagugacuucacaga

SEQ ID NO: 2161972 - RNA, 13 nt, Homo sapiens
uguugagugccag

SEQ ID NO: 2161973 - RNA, 12 nt, Homo sapiens
accgagcacugu

SEQ ID NO: 2161974 - RNA, 13 nt, Homo sapiens
uaugaaugugcau

SEQ ID NO: 2161975 - RNA, 20 nt, Homo sapiens
cagcuguggcagaguuacag

SEQ ID NO: 2161976 - RNA, 16 nt, Homo sapiens
ggaguaaguguacaau

SEQ ID NO: 2161977 - RNA, 19 nt, Homo sapiens
cucaacugucaucauucua

SEQ ID NO: 2161978 - RNA, 21 nt, Homo sapiens
aagcugaggcccauggccaca

SEQ ID NO: 2161979 - RNA, 16 nt, Homo sapiens
cgagggauaauucaaa

SEQ ID NO: 2161980 - RNA, 21 nt, Homo sapiens
auuagcccaacuagaagccua

SEQ ID NO: 2161981 - RNA, 19 nt, Homo sapiens
gaagauuuuuucaguuacu

SEQ ID NO: 2161982 - RNA, 21 nt, Homo sapiens
ccaagcuaagcugcaggcaca

SEQ ID NO: 2161983 - RNA, 19 nt, Homo sapiens
cagaugaggggccacugac

SEQ ID NO: 2161984 - RNA, 16 nt, Homo sapiens
gcccgcaucagcugcu

SEQ ID NO: 2161985 - RNA, 22 nt, Homo sapiens
cucauauuucuuuucuaucuca

SEQ ID NO: 2161986 - RNA, 20 nt, Homo sapiens
aacugcagcgaguacuuccc

SEQ ID NO: 2161987 - RNA, 14 nt, Homo sapiens
cguugagcaucuau

SEQ ID NO: 2161988 - RNA, 20 nt, Homo sapiens
cuguggacaccacugagcuc

SEQ ID NO: 2161989 - RNA, 16 nt, Homo sapiens
uuggacuuccauuugg

SEQ ID NO: 2161990 - RNA, 16 nt, Homo sapiens
ccgugaggccagagac

SEQ ID NO: 2161991 - RNA, 14 nt, Homo sapiens
auaaugugagaugg

SEQ ID NO: 2161992 - RNA, 16 nt, Homo sapiens
uggcacuggaugcaga

SEQ ID NO: 2161993 - RNA, 13 nt, Homo sapiens
gauaucaaaggca

SEQ ID NO: 2161994 - RNA, 20 nt, Homo sapiens
uaacuucagauacuugugaa

SEQ ID NO: 2161995 - RNA, 17 nt, Homo sapiens
uguaacagguaaccaca

SEQ ID NO: 2161996 - RNA, 15 nt, Homo sapiens
aauuuauaauuacaa

SEQ ID NO: 2161997 - RNA, 15 nt, Homo sapiens
auuuuaaaaauacau

SEQ ID NO: 2161998 - RNA, 14 nt, Homo sapiens
uaucuaccuuccuu

SEQ ID NO: 2161999 - RNA, 17 nt, Homo sapiens
uuccacacagaaugcaa

SEQ ID NO: 2162000 - RNA, 14 nt, Homo sapiens
caccagguccugug

SEQ ID NO: 2162001 - RNA, 14 nt, Homo sapiens
gaccuggugcugag

SEQ ID NO: 2162002 - RNA, 14 nt, Homo sapiens
gaguauccuuguag

SEQ ID NO: 2162003 - RNA, 14 nt, Homo sapiens
aauauuaagcacau

SEQ ID NO: 2162004 - RNA, 21 nt, Homo sapiens
uucuuggaaccuaaauugaac

SEQ ID NO: 2162005 - RNA, 20 nt, Homo sapiens
agucacuggucuguuugcau

SEQ ID NO: 2162006 - RNA, 22 nt, Homo sapiens
ccuaaaucaaguuggcuucuaa

SEQ ID NO: 2162007 - RNA, 15 nt, Homo sapiens
acacuguacugcaau

SEQ ID NO: 2162008 - RNA, 15 nt, Homo sapiens
acauuguacuguaau

SEQ ID NO: 2162009 - RNA, 19 nt, Homo sapiens
cugugaauauccagaaaua

SEQ ID NO: 2162010 - RNA, 18 nt, Homo sapiens
guccugauguacuuuaaa

SEQ ID NO: 2162011 - RNA, 14 nt, Homo sapiens
gaguggggcuuccu

SEQ ID NO: 2162012 - RNA, 14 nt, Homo sapiens
ucacccuuugccua

SEQ ID NO: 2162013 - RNA, 15 nt, Homo sapiens
ucuaauuacauuuca

SEQ ID NO: 2162014 - RNA, 16 nt, Homo sapiens
ccaaauaugcacuuuc

SEQ ID NO: 2162015 - RNA, 12 nt, Homo sapiens
caggauccaaua

SEQ ID NO: 2162016 - RNA, 14 nt, Homo sapiens
accuuguugcagau

SEQ ID NO: 2162017 - RNA, 20 nt, Homo sapiens
uauaauauuguaacuugcau

SEQ ID NO: 2162018 - RNA, 17 nt, Homo sapiens
gccuuugggauuugccg

SEQ ID NO: 2162019 - RNA, 17 nt, Homo sapiens
cggugcaacagaagggu

SEQ ID NO: 2162020 - RNA, 12 nt, Homo sapiens
ggugguggcaca

SEQ ID NO: 2162021 - RNA, 16 nt, Homo sapiens
aaaccagccaucccau

SEQ ID NO: 2162022 - RNA, 19 nt, Homo sapiens
uuacuacagcuucagugau

SEQ ID NO: 2162023 - RNA, 15 nt, Homo sapiens
ugcaaaugugcauuu

SEQ ID NO: 2162024 - RNA, 15 nt, Homo sapiens
augucaggccagccu

SEQ ID NO: 2162025 - RNA, 15 nt, Homo sapiens
uccaguucugaugag

SEQ ID NO: 2162026 - RNA, 15 nt, Homo sapiens
cugccuuccagccac

SEQ ID NO: 2162027 - RNA, 16 nt, Homo sapiens
ggaggcucucaugucu

SEQ ID NO: 2162028 - RNA, 16 nt, Homo sapiens
cauuagugauuccauc

SEQ ID NO: 2162029 - RNA, 22 nt, Homo sapiens
caaaaguuaaacuuuaucucac

SEQ ID NO: 2162030 - RNA, 19 nt, Homo sapiens
uuaaacgauuagugauguc

SEQ ID NO: 2162031 - RNA, 22 nt, Homo sapiens
caaguuagaaaacauaaucuuc

SEQ ID NO: 2162032 - RNA, 15 nt, Homo sapiens
guuuuaaacauuaau

SEQ ID NO: 2162033 - RNA, 19 nt, Homo sapiens
augccucaccacacccagg

SEQ ID NO: 2162034 - RNA, 17 nt, Homo sapiens
agauucccaccuuccau

SEQ ID NO: 2162035 - RNA, 22 nt, Homo sapiens
ucaaagugucguaucugggaga

SEQ ID NO: 2162036 - RNA, 11 nt, Homo sapiens
cauuggcuuuc

SEQ ID NO: 2162037 - RNA, 23 nt, Homo sapiens
caccacacccagccucaguccuc

SEQ ID NO: 2162038 - RNA, 15 nt, Homo sapiens
caaauaaaguucaaa

SEQ ID NO: 2162039 - RNA, 14 nt, Homo sapiens
gaaugagaagaaug

SEQ ID NO: 2162040 - RNA, 11 nt, Homo sapiens
ugcacaugugc

SEQ ID NO: 2162041 - RNA, 11 nt, Homo sapiens
auuacaugauu

SEQ ID NO: 2162042 - RNA, 11 nt, Homo sapiens
uagacauguag

SEQ ID NO: 2162043 - RNA, 15 nt, Homo sapiens
cugugcccagcaguu

SEQ ID NO: 2162044 - RNA, 23 nt, Homo sapiens
auggcuugcaguuguuccuccac

SEQ ID NO: 2162045 - RNA, 13 nt, Homo sapiens
acaucuggcucaa

SEQ ID NO: 2162046 - RNA, 13 nt, Homo sapiens
cccagaauacuga

SEQ ID NO: 2162047 - RNA, 13 nt, Homo sapiens
ucucagagcaccu

SEQ ID NO: 2162048 - RNA, 16 nt, Homo sapiens
uuuuccucuuagauau

SEQ ID NO: 2162049 - RNA, 19 nt, Homo sapiens
uguuggaaaaugugcaaua

SEQ ID NO: 2162050 - RNA, 18 nt, Homo sapiens
cccagcgaguugcgcugg

SEQ ID NO: 2162051 - RNA, 17 nt, Homo sapiens
gaugugcauuucuguga

SEQ ID NO: 2162052 - RNA, 22 nt, Homo sapiens
auguuagaagaggccuuuggaa

SEQ ID NO: 2162053 - RNA, 14 nt, Homo sapiens
uuguguaacauauu

SEQ ID NO: 2162054 - RNA, 22 nt, Homo sapiens
uaaucuguuuauuuacaaggga

SEQ ID NO: 2162055 - RNA, 15 nt, Homo sapiens
ccucccuggucccuu

SEQ ID NO: 2162056 - RNA, 15 nt, Homo sapiens
caacuccuaguucua

SEQ ID NO: 2162057 - RNA, 15 nt, Homo sapiens
caaguagcugcaaca

SEQ ID NO: 2162058 - RNA, 19 nt, Homo sapiens
auccaggcgugguggcaca

SEQ ID NO: 2162059 - RNA, 23 nt, Homo sapiens
gaauguacauacugaaaaauaca

SEQ ID NO: 2162060 - RNA, 18 nt, Homo sapiens
uccacuguucuguucuca

SEQ ID NO: 2162061 - RNA, 14 nt, Homo sapiens
caaaugggggaaaa

SEQ ID NO: 2162062 - RNA, 17 nt, Homo sapiens
aaucaaaagugccucaa

SEQ ID NO: 2162063 - RNA, 12 nt, Homo sapiens
ccugauggccag

SEQ ID NO: 2162064 - RNA, 23 nt, Homo sapiens
ucauaggcaagucacacugcauu

SEQ ID NO: 2162065 - RNA, 21 nt, Homo sapiens
cauuaaugguuggaaaacacu

SEQ ID NO: 2162066 - RNA, 20 nt, Homo sapiens
acuccuguaacugucucaga

SEQ ID NO: 2162067 - RNA, 21 nt, Homo sapiens
caagacccaaguagcugcuac

SEQ ID NO: 2162068 - RNA, 19 nt, Homo sapiens
ugcuuagcccuucucugcu

SEQ ID NO: 2162069 - RNA, 13 nt, Homo sapiens
ggacccagugcag

SEQ ID NO: 2162070 - RNA, 22 nt, Homo sapiens
ccaagcaccaccaaacacagug

SEQ ID NO: 2162071 - RNA, 19 nt, Homo sapiens
cucaggggcccuggagcag

SEQ ID NO: 2162072 - RNA, 18 nt, Homo sapiens
ucaguaguucacauacaa

SEQ ID NO: 2162073 - RNA, 14 nt, Homo sapiens
uacauaaucuguac

SEQ ID NO: 2162074 - RNA, 16 nt, Homo sapiens
gcaucucuucuucccu

SEQ ID NO: 2162075 - RNA, 12 nt, Homo sapiens
gccuugaccucc

SEQ ID NO: 2162076 - RNA, 13 nt, Homo sapiens
ucaguuacucuga

SEQ ID NO: 2162077 - RNA, 17 nt, Homo sapiens
augaugucacacaagcu

SEQ ID NO: 2162078 - RNA, 13 nt, Homo sapiens
ucuaaaggugcua

SEQ ID NO: 2162079 - RNA, 20 nt, Homo sapiens
ugcagcggcaggaccgccau

SEQ ID NO: 2162080 - RNA, 16 nt, Homo sapiens
cuuucucauucuugcc

SEQ ID NO: 2162081 - RNA, 17 nt, Homo sapiens
agucuucuuugugccug

SEQ ID NO: 2162082 - RNA, 17 nt, Homo sapiens
ugacuuauguaaucaaa

SEQ ID NO: 2162083 - RNA, 14 nt, Homo sapiens
ucaugagccugcug

SEQ ID NO: 2162084 - RNA, 16 nt, Homo sapiens
agccagugccauucca

SEQ ID NO: 2162085 - RNA, 11 nt, Homo sapiens
uuccuguaaau

SEQ ID NO: 2162086 - RNA, 21 nt, Homo sapiens
ucaguucguguuugauuccau

SEQ ID NO: 2162087 - RNA, 18 nt, Homo sapiens
aaagccccaaaugguggu

SEQ ID NO: 2162088 - RNA, 18 nt, Homo sapiens
agacggaggacuggaacu

SEQ ID NO: 2162089 - RNA, 19 nt, Homo sapiens
gcucagucagugcacuaac

SEQ ID NO: 2162090 - RNA, 23 nt, Homo sapiens
acucauuucaaguuaugauucag

SEQ ID NO: 2162091 - RNA, 15 nt, Homo sapiens
cuuucucucuuucca

SEQ ID NO: 2162092 - RNA, 15 nt, Homo sapiens
ugcaccauugcacuc

SEQ ID NO: 2162093 - RNA, 19 nt, Homo sapiens
ucagaaucugauaccaaag

SEQ ID NO: 2162094 - RNA, 12 nt, Homo sapiens
aucacacugcgg

SEQ ID NO: 2162095 - RNA, 19 nt, Homo sapiens
uaacagaauuaaaguagau

SEQ ID NO: 2162096 - RNA, 21 nt, Homo sapiens
uaaucagaaaaguaauuuugu

SEQ ID NO: 2162097 - RNA, 13 nt, Homo sapiens
ucuccugucuaca

SEQ ID NO: 2162098 - RNA, 14 nt, Homo sapiens
caaauucaugugcc

SEQ ID NO: 2162099 - RNA, 18 nt, Homo sapiens
guuggucaaaaucugcaa

SEQ ID NO: 2162100 - RNA, 21 nt, Homo sapiens
uguuaggaagguacugucaug

SEQ ID NO: 2162101 - RNA, 21 nt, Homo sapiens
auuguugaugggcacuugaga

SEQ ID NO: 2162102 - RNA, 17 nt, Homo sapiens
ggcaugaaugagaccca

SEQ ID NO: 2162103 - RNA, 19 nt, Homo sapiens
agaaggggaggacacuggu

SEQ ID NO: 2162104 - RNA, 17 nt, Homo sapiens
acagagggagagacuaa

SEQ ID NO: 2162105 - RNA, 12 nt, Homo sapiens
aaggagaagcua

SEQ ID NO: 2162106 - RNA, 22 nt, Homo sapiens
cugaugcagugcuccauccaaa

SEQ ID NO: 2162107 - RNA, 19 nt, Homo sapiens
ucaagauuuuuuuugucag

SEQ ID NO: 2162108 - RNA, 20 nt, Homo sapiens
augauggugguggugguugu

SEQ ID NO: 2162109 - RNA, 20 nt, Homo sapiens
ccuccugucuaauuugcacc

SEQ ID NO: 2162110 - RNA, 21 nt, Homo sapiens
agggauacacaggacugaaaa

SEQ ID NO: 2162111 - RNA, 17 nt, Homo sapiens
gagcugggcagcuggaa

SEQ ID NO: 2162112 - RNA, 19 nt, Homo sapiens
gcccucagauuccgcacca

SEQ ID NO: 2162113 - RNA, 21 nt, Homo sapiens
gaaugauuaauuaaaacacaa

SEQ ID NO: 2162114 - RNA, 12 nt, Homo sapiens
caguaacacugg

SEQ ID NO: 2162115 - RNA, 15 nt, Homo sapiens
agccauggugacaca

SEQ ID NO: 2162116 - RNA, 23 nt, Homo sapiens
auaugcuguauuuuaaagggaca

SEQ ID NO: 2162117 - RNA, 11 nt, Homo sapiens
ugcagcuucca

SEQ ID NO: 2162118 - RNA, 22 nt, Homo sapiens
gcuugaagcuguggagggccac

SEQ ID NO: 2162119 - RNA, 15 nt, Homo sapiens
cacacacaugcuagg

SEQ ID NO: 2162120 - RNA, 19 nt, Homo sapiens
uauuccucuugcauuucac

SEQ ID NO: 2162121 - RNA, 17 nt, Homo sapiens
cuaguugagagcaccuu

SEQ ID NO: 2162122 - RNA, 19 nt, Homo sapiens
cucccacaacaacaaaagc

SEQ ID NO: 2162123 - RNA, 13 nt, Homo sapiens
cuauaacugccca

SEQ ID NO: 2162124 - RNA, 18 nt, Homo sapiens
agauguuacugugugaag

SEQ ID NO: 2162125 - RNA, 13 nt, Homo sapiens
aagcauguagcca

SEQ ID NO: 2162126 - RNA, 13 nt, Homo sapiens
uguugcugcaucu

SEQ ID NO: 2162127 - RNA, 19 nt, Homo sapiens
ucugaaauuuaacugccua

SEQ ID NO: 2162128 - RNA, 11 nt, Homo sapiens
auagauguuua

SEQ ID NO: 2162129 - RNA, 11 nt, Homo sapiens
aagugcauguu

SEQ ID NO: 2162130 - RNA, 22 nt, Homo sapiens
uguuuaaaagcaaaacugcaaa

SEQ ID NO: 2162131 - RNA, 14 nt, Homo sapiens
gcucccauucacuc

SEQ ID NO: 2162132 - RNA, 20 nt, Homo sapiens
uaaaaacaugagaaauguga

SEQ ID NO: 2162133 - RNA, 16 nt, Homo sapiens
aaaaauaaagcauuau

SEQ ID NO: 2162134 - RNA, 20 nt, Homo sapiens
ugcagcaccugccacugccg

SEQ ID NO: 2162135 - RNA, 13 nt, Homo sapiens
gauaaaaucuucc

SEQ ID NO: 2162136 - RNA, 17 nt, Homo sapiens
cccugucugugugcuga

SEQ ID NO: 2162137 - RNA, 18 nt, Homo sapiens
auccuccugucuuggccu

SEQ ID NO: 2162138 - RNA, 19 nt, Homo sapiens
ugagcaaagggaacaguga

SEQ ID NO: 2162139 - RNA, 21 nt, Homo sapiens
cuaucuacuacaaacuucaaa

SEQ ID NO: 2162140 - RNA, 22 nt, Homo sapiens
ucugagcccccugaccuuccaa

SEQ ID NO: 2162141 - RNA, 21 nt, Homo sapiens
ccucuuuagccagaaucucau

SEQ ID NO: 2162142 - RNA, 15 nt, Homo sapiens
cagggccuggcauag

SEQ ID NO: 2162143 - RNA, 22 nt, Homo sapiens
ugcgugcucccgaugcugcuau

SEQ ID NO: 2162144 - RNA, 18 nt, Homo sapiens
uggucaaccccacaagca

SEQ ID NO: 2162145 - RNA, 19 nt, Homo sapiens
ccuccauuuccacuuggug

SEQ ID NO: 2162146 - RNA, 14 nt, Homo sapiens
guaacuauaccucu

SEQ ID NO: 2162147 - RNA, 16 nt, Homo sapiens
auuuuaagaaggcauu

SEQ ID NO: 2162148 - RNA, 23 nt, Homo sapiens
aagucacugcacagugcaucuca

SEQ ID NO: 2162149 - RNA, 18 nt, Homo sapiens
cauauauaugucaggcaa

SEQ ID NO: 2162150 - RNA, 16 nt, Homo sapiens
gagaagucacagggca

SEQ ID NO: 2162151 - RNA, 20 nt, Homo sapiens
ucccugaggaccaccuccua

SEQ ID NO: 2162152 - RNA, 21 nt, Homo sapiens
caguuugugcucuacuguuac

SEQ ID NO: 2162153 - RNA, 12 nt, Homo sapiens
uuucuucuacug

SEQ ID NO: 2162154 - RNA, 13 nt, Homo sapiens
gcacugauuugau

SEQ ID NO: 2162155 - RNA, 15 nt, Homo sapiens
uauuuuauaagcauu

SEQ ID NO: 2162156 - RNA, 17 nt, Homo sapiens
aggacagcauggugcau

SEQ ID NO: 2162157 - RNA, 23 nt, Homo sapiens
uggccagauuuccucacuaccug

SEQ ID NO: 2162158 - RNA, 22 nt, Homo sapiens
uuagaguugcucuacaaugaca

SEQ ID NO: 2162159 - RNA, 13 nt, Homo sapiens
acucucgcugugg

SEQ ID NO: 2162160 - RNA, 17 nt, Homo sapiens
caaaauaaauguuuaaa

SEQ ID NO: 2162161 - RNA, 20 nt, Homo sapiens
cuggaacagauucacacugu

SEQ ID NO: 2162162 - RNA, 13 nt, Homo sapiens
ggaggcaguccau

SEQ ID NO: 2162163 - RNA, 20 nt, Homo sapiens
uccauucuuucugauaacua

SEQ ID NO: 2162164 - RNA, 15 nt, Homo sapiens
agccacaaaugccuu

SEQ ID NO: 2162165 - RNA, 16 nt, Homo sapiens
agcguguggagcagag

SEQ ID NO: 2162166 - RNA, 13 nt, Homo sapiens
uuguuucuacuuu

SEQ ID NO: 2162167 - RNA, 17 nt, Homo sapiens
acauuuaugcacauuca

SEQ ID NO: 2162168 - RNA, 15 nt, Homo sapiens
gcacugacucuggaa

SEQ ID NO: 2162169 - RNA, 22 nt, Homo sapiens
caugagcuauuuccauuccaga

SEQ ID NO: 2162170 - RNA, 20 nt, Homo sapiens
gacuuuuuagccagugacuu

SEQ ID NO: 2162171 - RNA, 20 nt, Homo sapiens
aaaugcaaaauccuggugau

SEQ ID NO: 2162172 - RNA, 21 nt, Homo sapiens
cugccugccuuccagccacau

SEQ ID NO: 2162173 - RNA, 15 nt, Homo sapiens
acgugaaaugcucaa

SEQ ID NO: 2162174 - RNA, 21 nt, Homo sapiens
uuguagggcuuuagcuuucuu

SEQ ID NO: 2162175 - RNA, 16 nt, Homo sapiens
uaccuuaauuauugca

SEQ ID NO: 2162176 - RNA, 13 nt, Homo sapiens
uuaaacagggcau

SEQ ID NO: 2162177 - RNA, 20 nt, Homo sapiens
cauuaauaauaguuauuucu

SEQ ID NO: 2162178 - RNA, 15 nt, Homo sapiens
aggugggaggaucac

SEQ ID NO: 2162179 - RNA, 22 nt, Homo sapiens
aacauagcacaguauuuacugu

SEQ ID NO: 2162180 - RNA, 15 nt, Homo sapiens
ugccaaaaacaacaa

SEQ ID NO: 2162181 - RNA, 23 nt, Homo sapiens
ccaauuuucuggaauacaugaaa

SEQ ID NO: 2162182 - RNA, 17 nt, Homo sapiens
uguuuucaacauuguau

SEQ ID NO: 2162183 - RNA, 17 nt, Homo sapiens
gccuuaaacacucaccu

SEQ ID NO: 2162184 - RNA, 16 nt, Homo sapiens
cucgaagucccggcuu

SEQ ID NO: 2162185 - RNA, 17 nt, Homo sapiens
aaugggagugaacauuu

SEQ ID NO: 2162186 - RNA, 20 nt, Homo sapiens
uaaguuuccuuccagcccag

SEQ ID NO: 2162187 - RNA, 19 nt, Homo sapiens
agcucucaucacuaccuuu

SEQ ID NO: 2162188 - RNA, 12 nt, Homo sapiens
ugagcaccucca

SEQ ID NO: 2162189 - RNA, 15 nt, Homo sapiens
uuguucauacauauu

SEQ ID NO: 2162190 - RNA, 16 nt, Homo sapiens
uccaaauggcuauuau

SEQ ID NO: 2162191 - RNA, 14 nt, Homo sapiens
cauucaucuugcaa

SEQ ID NO: 2162192 - RNA, 22 nt, Homo sapiens
aagagcccucaagcggcccuua

SEQ ID NO: 2162193 - RNA, 14 nt, Homo sapiens
caggggugagaccu

SEQ ID NO: 2162194 - RNA, 17 nt, Homo sapiens
aaugccaucacuggaau

SEQ ID NO: 2162195 - RNA, 17 nt, Homo sapiens
auauuuuugugcacauu

SEQ ID NO: 2162196 - RNA, 21 nt, Homo sapiens
uacacuccacuugaagcacuu

SEQ ID NO: 2162197 - RNA, 12 nt, Homo sapiens
ugcagcaguacc

SEQ ID NO: 2162198 - RNA, 13 nt, Homo sapiens
agccugaccugag

SEQ ID NO: 2162199 - RNA, 18 nt, Homo sapiens
ugaggaaaaaaugguaua

SEQ ID NO: 2162200 - RNA, 22 nt, Homo sapiens
auuaaacccugagccaccgugu

SEQ ID NO: 2162201 - RNA, 22 nt, Homo sapiens
uccagaacgcccuguguccaca

SEQ ID NO: 2162202 - RNA, 22 nt, Homo sapiens
gcacccgguacaaguggcucau

SEQ ID NO: 2162203 - RNA, 23 nt, Homo sapiens
ucuuuuuuuuuaaggugaaccaa

SEQ ID NO: 2162204 - RNA, 17 nt, Homo sapiens
auuuaggugauaccuaa

SEQ ID NO: 2162205 - RNA, 22 nt, Homo sapiens
ucucagcccgggacagggucuu

SEQ ID NO: 2162206 - RNA, 13 nt, Homo sapiens
uuggggacaaccu

SEQ ID NO: 2162207 - RNA, 13 nt, Homo sapiens
cuaacacaugcac

SEQ ID NO: 2162208 - RNA, 14 nt, Homo sapiens
gugagaaagcuaaa

SEQ ID NO: 2162209 - RNA, 19 nt, Homo sapiens
auuguaaacauuaguucua

SEQ ID NO: 2162210 - RNA, 12 nt, Homo sapiens
cagggaagggag

SEQ ID NO: 2162211 - RNA, 18 nt, Homo sapiens
cacugaaaauucgaacca

SEQ ID NO: 2162212 - RNA, 17 nt, Homo sapiens
gcagaaaaucuaccaag

SEQ ID NO: 2162213 - RNA, 14 nt, Homo sapiens
agcuucuuuugcca

SEQ ID NO: 2162214 - RNA, 23 nt, Homo sapiens
cucucugcaagacagaaaccucc

SEQ ID NO: 2162215 - RNA, 21 nt, Homo sapiens
gcuacugaugaaaucugcuag

SEQ ID NO: 2162216 - RNA, 19 nt, Homo sapiens
cacaucucugcuugaguca

SEQ ID NO: 2162217 - RNA, 21 nt, Homo sapiens
ccauuuucaacugcuuugaaa

SEQ ID NO: 2162218 - RNA, 13 nt, Homo sapiens
cagugugcuccag

SEQ ID NO: 2162219 - RNA, 17 nt, Homo sapiens
uaaauaaaaguacaguu

SEQ ID NO: 2162220 - RNA, 13 nt, Homo sapiens
cagaacgaugccu

SEQ ID NO: 2162221 - RNA, 14 nt, Homo sapiens
acaaaugacuguau

SEQ ID NO: 2162222 - RNA, 19 nt, Homo sapiens
ucuguuugggggaauuugu

SEQ ID NO: 2162223 - RNA, 20 nt, Homo sapiens
uggaacacuucgaguuccca

SEQ ID NO: 2162224 - RNA, 18 nt, Homo sapiens
auaauuuccuaugccugu

SEQ ID NO: 2162225 - RNA, 23 nt, Homo sapiens
acccggcggcccugcugaagcug

SEQ ID NO: 2162226 - RNA, 20 nt, Homo sapiens
ggcaccuauaauaccagcua

SEQ ID NO: 2162227 - RNA, 15 nt, Homo sapiens
uccucacuggucuac

SEQ ID NO: 2162228 - RNA, 23 nt, Homo sapiens
ucacuaaugugguuauuuuacau

SEQ ID NO: 2162229 - RNA, 14 nt, Homo sapiens
ccucuuaucacugg

SEQ ID NO: 2162230 - RNA, 15 nt, Homo sapiens
uggcugccaaagaga

SEQ ID NO: 2162231 - RNA, 18 nt, Homo sapiens
ugguuauuuguuacuaaa

SEQ ID NO: 2162232 - RNA, 18 nt, Homo sapiens
accaccuuuccagccaua

SEQ ID NO: 2162233 - RNA, 16 nt, Homo sapiens
auuaaaaugagugaaa

SEQ ID NO: 2162234 - RNA, 17 nt, Homo sapiens
cuauaaaaugacagauc

SEQ ID NO: 2162235 - RNA, 21 nt, Homo sapiens
caggcgggggguugucucagc

SEQ ID NO: 2162236 - RNA, 21 nt, Homo sapiens
ucauuuugccaaaaaggggua

SEQ ID NO: 2162237 - RNA, 17 nt, Homo sapiens
ugagaagcccgagguca

SEQ ID NO: 2162238 - RNA, 23 nt, Homo sapiens
acaauccaucucucaaguagugu

SEQ ID NO: 2162239 - RNA, 17 nt, Homo sapiens
aaauguuauugccuaau

SEQ ID NO: 2162240 - RNA, 15 nt, Homo sapiens
aaaugcucaaucuca

SEQ ID NO: 2162241 - RNA, 20 nt, Homo sapiens
acuggauugcagacuguucu

SEQ ID NO: 2162242 - RNA, 12 nt, Homo sapiens
gccagaccucaa

SEQ ID NO: 2162243 - RNA, 21 nt, Homo sapiens
gcagagugagacucgucucaa

SEQ ID NO: 2162244 - RNA, 22 nt, Homo sapiens
ugagaugcaggauuucuucaca

SEQ ID NO: 2162245 - RNA, 20 nt, Homo sapiens
cgucagauguuuaaaacacc

SEQ ID NO: 2162246 - RNA, 16 nt, Homo sapiens
augagcgccaccucuu

SEQ ID NO: 2162247 - RNA, 18 nt, Homo sapiens
ccaaagugcugagauuau

SEQ ID NO: 2162248 - RNA, 14 nt, Homo sapiens
ugcguggacaguca

SEQ ID NO: 2162249 - RNA, 19 nt, Homo sapiens
ugauucugauguacucuaa

SEQ ID NO: 2162250 - RNA, 21 nt, Homo sapiens
gacugcaaaugcuauugucag

SEQ ID NO: 2162251 - RNA, 22 nt, Homo sapiens
augcuucuauaauuuugccuuu

SEQ ID NO: 2162252 - RNA, 22 nt, Homo sapiens
auguccauuuuugaagugauuu

SEQ ID NO: 2162253 - RNA, 18 nt, Homo sapiens
ccagugaaucuguuucag

SEQ ID NO: 2162254 - RNA, 23 nt, Homo sapiens
acucaauggaguaugucugaugg

SEQ ID NO: 2162255 - RNA, 15 nt, Homo sapiens
aguuuauauuaucaa

SEQ ID NO: 2162256 - RNA, 23 nt, Homo sapiens
guacuggcaauaagauacacagc

SEQ ID NO: 2162257 - RNA, 13 nt, Homo sapiens
cagccauuuucca

SEQ ID NO: 2162258 - RNA, 10 nt, Homo sapiens
agggcccaac

SEQ ID NO: 2162259 - RNA, 16 nt, Homo sapiens
uggcuggaugugcauc

SEQ ID NO: 2162260 - RNA, 18 nt, Homo sapiens
ccaauacugccaaccaga

SEQ ID NO: 2162261 - RNA, 19 nt, Homo sapiens
gaacagucucuugaggcac

SEQ ID NO: 2162262 - RNA, 11 nt, Homo sapiens
aauaagcuuua

SEQ ID NO: 2162263 - RNA, 19 nt, Homo sapiens
aagugagacccccaucucu

SEQ ID NO: 2162264 - RNA, 16 nt, Homo sapiens
aucccugugagcaaaa

SEQ ID NO: 2162265 - RNA, 19 nt, Homo sapiens
ucuuucugaaggcuuugug

SEQ ID NO: 2162266 - RNA, 15 nt, Homo sapiens
aguucuuuucaugca

SEQ ID NO: 2162267 - RNA, 22 nt, Homo sapiens
uugacagauugaauuugccuaa

SEQ ID NO: 2162268 - RNA, 16 nt, Homo sapiens
aggucuccaagacaau

SEQ ID NO: 2162269 - RNA, 18 nt, Homo sapiens
ugugggcgcauacuacag

SEQ ID NO: 2162270 - RNA, 22 nt, Homo sapiens
ccacugggacccccaacauucu

SEQ ID NO: 2162271 - RNA, 20 nt, Homo sapiens
gggggaaagcaaagcacaga

SEQ ID NO: 2162272 - RNA, 21 nt, Homo sapiens
gcuguuuucaauaaugugaau

SEQ ID NO: 2162273 - RNA, 16 nt, Homo sapiens
gucucaaaccaagcaa

SEQ ID NO: 2162274 - RNA, 17 nt, Homo sapiens
gaagugcagaagcacau

SEQ ID NO: 2162275 - RNA, 21 nt, Homo sapiens
uuaagaagcaguuguaccaag

SEQ ID NO: 2162276 - RNA, 22 nt, Homo sapiens
uguaaaaaaaaaaaacauacau

SEQ ID NO: 2162277 - RNA, 17 nt, Homo sapiens
cauugugaucagcuagc

SEQ ID NO: 2162278 - RNA, 16 nt, Homo sapiens
uauuuauaucauauau

SEQ ID NO: 2162279 - RNA, 19 nt, Homo sapiens
cauucacagcuccuuguga

SEQ ID NO: 2162280 - RNA, 16 nt, Homo sapiens
auuucauuuccauuua

SEQ ID NO: 2162281 - RNA, 17 nt, Homo sapiens
accgcccaucaggguuc

SEQ ID NO: 2162282 - RNA, 22 nt, Homo sapiens
uggggaauacuggccaugccug

SEQ ID NO: 2162283 - RNA, 16 nt, Homo sapiens
cuuacuacacugagga

SEQ ID NO: 2162284 - RNA, 16 nt, Homo sapiens
auauuuaucauauccu

SEQ ID NO: 2162285 - RNA, 16 nt, Homo sapiens
ugaagauuuaaucuca

SEQ ID NO: 2162286 - RNA, 15 nt, Homo sapiens
uaucaggguauucca

SEQ ID NO: 2162287 - RNA, 17 nt, Homo sapiens
uuuaauaaaaguacuga

SEQ ID NO: 2162288 - RNA, 23 nt, Homo sapiens
aaacacuauccaugcauuacuua

SEQ ID NO: 2162289 - RNA, 18 nt, Homo sapiens
aaugcugucccuauacac

SEQ ID NO: 2162290 - RNA, 12 nt, Homo sapiens
gggaggacaaaa

SEQ ID NO: 2162291 - RNA, 15 nt, Homo sapiens
auugaagcccuccaa

SEQ ID NO: 2162292 - RNA, 21 nt, Homo sapiens
guaucaaaaugaaugccaguc

SEQ ID NO: 2162293 - RNA, 17 nt, Homo sapiens
ccgagccuggcuccaaa

SEQ ID NO: 2162294 - RNA, 21 nt, Homo sapiens
auucuccauguacuggcaaga

SEQ ID NO: 2162295 - RNA, 18 nt, Homo sapiens
cugagcacuccuggugca

SEQ ID NO: 2162296 - RNA, 13 nt, Homo sapiens
cuggccgggaccc

SEQ ID NO: 2162297 - RNA, 20 nt, Homo sapiens
ucugagugaaccuguauaag

SEQ ID NO: 2162298 - RNA, 23 nt, Homo sapiens
gauggagcagucuccugcccucu

SEQ ID NO: 2162299 - RNA, 22 nt, Homo sapiens
cugcucagaaucugauaccaaa

SEQ ID NO: 2162300 - RNA, 14 nt, Homo sapiens
ccauuuacaaauaa

SEQ ID NO: 2162301 - RNA, 12 nt, Homo sapiens
cacguguaugca

SEQ ID NO: 2162302 - RNA, 12 nt, Homo sapiens
cauauguaugug

SEQ ID NO: 2162303 - RNA, 19 nt, Homo sapiens
ccuuaauagccauaugcaa

SEQ ID NO: 2162304 - RNA, 15 nt, Homo sapiens
uauguacaaguguug

SEQ ID NO: 2162305 - RNA, 23 nt, Homo sapiens
cucaauauauaguuagcuuuauu

SEQ ID NO: 2162306 - RNA, 20 nt, Homo sapiens
guaauauuuugacccuuuau

SEQ ID NO: 2162307 - RNA, 15 nt, Homo sapiens
auacaccuggacaau

SEQ ID NO: 2162308 - RNA, 21 nt, Homo sapiens
uauuauuucugguucuaauga

SEQ ID NO: 2162309 - RNA, 19 nt, Homo sapiens
guaacacuguauaacauuu

SEQ ID NO: 2162310 - RNA, 12 nt, Homo sapiens
aauaucuagcau

SEQ ID NO: 2162311 - RNA, 20 nt, Homo sapiens
auauccuugcgauguacagu

SEQ ID NO: 2162312 - RNA, 17 nt, Homo sapiens
ggccccaccggggucua

SEQ ID NO: 2162313 - RNA, 16 nt, Homo sapiens
ucggagagcagcagca

SEQ ID NO: 2162314 - RNA, 18 nt, Homo sapiens
cugucuuuucuuugccau

SEQ ID NO: 2162315 - RNA, 15 nt, Homo sapiens
uagacaaacagcauc

SEQ ID NO: 2162316 - RNA, 14 nt, Homo sapiens
uagcaauacaggga

SEQ ID NO: 2162317 - RNA, 17 nt, Homo sapiens
augcuaguuugaccuca

SEQ ID NO: 2162318 - RNA, 16 nt, Homo sapiens
cuuagccccagacucu

SEQ ID NO: 2162319 - RNA, 18 nt, Homo sapiens
cuggagcugaagcguuac

SEQ ID NO: 2162320 - RNA, 22 nt, Homo sapiens
uuccuaacguuuucuacuuuga

SEQ ID NO: 2162321 - RNA, 21 nt, Homo sapiens
aguaccacugcacaucauguu

SEQ ID NO: 2162322 - RNA, 15 nt, Homo sapiens
auuccaggagauugg

SEQ ID NO: 2162323 - RNA, 20 nt, Homo sapiens
ugcucaccaugcuuccagcu

SEQ ID NO: 2162324 - RNA, 11 nt, Homo sapiens
acccagugcag

SEQ ID NO: 2162325 - RNA, 11 nt, Homo sapiens
acaaaugugaa

SEQ ID NO: 2162326 - RNA, 12 nt, Homo sapiens
cuugccaauggu

SEQ ID NO: 2162327 - RNA, 21 nt, Homo sapiens
ugaagcuuaggacuaccagcc

SEQ ID NO: 2162328 - RNA, 15 nt, Homo sapiens
ucauagugcugaaaa

SEQ ID NO: 2162329 - RNA, 19 nt, Homo sapiens
ggggagcaugcuauggcau

SEQ ID NO: 2162330 - RNA, 18 nt, Homo sapiens
cagaggggcagauggaaa

SEQ ID NO: 2162331 - RNA, 17 nt, Homo sapiens
ccaauacaggcaugaac

SEQ ID NO: 2162332 - RNA, 22 nt, Homo sapiens
uagaacacuguuaggguacaua

SEQ ID NO: 2162333 - RNA, 19 nt, Homo sapiens
aauucuccuguugcaauga

SEQ ID NO: 2162334 - RNA, 20 nt, Homo sapiens
aaugauggcaaaaacaaagg

SEQ ID NO: 2162335 - RNA, 21 nt, Homo sapiens
ugugaaauguacgucauuugu

SEQ ID NO: 2162336 - RNA, 16 nt, Homo sapiens
ccuuuagcuuugacag

SEQ ID NO: 2162337 - RNA, 19 nt, Homo sapiens
aacauacaggagucugucu

SEQ ID NO: 2162338 - RNA, 14 nt, Homo sapiens
agggcccguguaaa

SEQ ID NO: 2162339 - RNA, 14 nt, Homo sapiens
auguuucuauaugu

SEQ ID NO: 2162340 - RNA, 22 nt, Homo sapiens
aagcacauucgggccauuuccg

SEQ ID NO: 2162341 - RNA, 19 nt, Homo sapiens
cacuuuaacacagugucug

SEQ ID NO: 2162342 - RNA, 16 nt, Homo sapiens
guucuguccucaagua

SEQ ID NO: 2162343 - RNA, 19 nt, Homo sapiens
ccacuaccguaaaugucca

SEQ ID NO: 2162344 - RNA, 15 nt, Homo sapiens
cagaaacuucucagu

SEQ ID NO: 2162345 - RNA, 12 nt, Homo sapiens
ggccaagcauaa

SEQ ID NO: 2162346 - RNA, 15 nt, Homo sapiens
uuugccaccucuaaa

SEQ ID NO: 2162347 - RNA, 18 nt, Homo sapiens
ugcagaagcaaucgggau

SEQ ID NO: 2162348 - RNA, 18 nt, Homo sapiens
caaugagcuuucugaaca

SEQ ID NO: 2162349 - RNA, 18 nt, Homo sapiens
ucagcacuccucaucauc

SEQ ID NO: 2162350 - RNA, 13 nt, Homo sapiens
acugagcugagac

SEQ ID NO: 2162351 - RNA, 18 nt, Homo sapiens
cagaaguguucacauggc

SEQ ID NO: 2162352 - RNA, 22 nt, Homo sapiens
aaggucaggaguucgagaccag

SEQ ID NO: 2162353 - RNA, 16 nt, Homo sapiens
uaccuaaugaaaguga

SEQ ID NO: 2162354 - RNA, 18 nt, Homo sapiens
uuaaaugcaauauuccug

SEQ ID NO: 2162355 - RNA, 20 nt, Homo sapiens
cucuugggaagaccagcuuu

SEQ ID NO: 2162356 - RNA, 13 nt, Homo sapiens
aagacaaugcacc

SEQ ID NO: 2162357 - RNA, 20 nt, Homo sapiens
gauggaauggcagcaugcaa

SEQ ID NO: 2162358 - RNA, 15 nt, Homo sapiens
ggugcuacuuuauaa

SEQ ID NO: 2162359 - RNA, 16 nt, Homo sapiens
agguccgguguucuaa

SEQ ID NO: 2162360 - RNA, 16 nt, Homo sapiens
aaguaugguauuacaa

SEQ ID NO: 2162361 - RNA, 15 nt, Homo sapiens
ccucuccuaacauau

SEQ ID NO: 2162362 - RNA, 17 nt, Homo sapiens
cugcggggccugaggca

SEQ ID NO: 2162363 - RNA, 22 nt, Homo sapiens
auuauuaaaacugaacuugaag

SEQ ID NO: 2162364 - RNA, 18 nt, Homo sapiens
cucagcuagacauugcaa

SEQ ID NO: 2162365 - RNA, 18 nt, Homo sapiens
auaaccccaggcacuguu

SEQ ID NO: 2162366 - RNA, 9 nt, Homo sapiens
uuuuguaca

SEQ ID NO: 2162367 - RNA, 21 nt, Homo sapiens
cucauucuaugaacagugaca

SEQ ID NO: 2162368 - RNA, 12 nt, Homo sapiens
gaaggacuguga

SEQ ID NO: 2162369 - RNA, 13 nt, Homo sapiens
aauauaucuggaa

SEQ ID NO: 2162370 - RNA, 15 nt, Homo sapiens
guccuuuuagcacau

SEQ ID NO: 2162371 - RNA, 21 nt, Homo sapiens
cacgcaguaacuaaagcuuua

SEQ ID NO: 2162372 - RNA, 21 nt, Homo sapiens
uuaaaauagcaugccuuucuc

SEQ ID NO: 2162373 - RNA, 15 nt, Homo sapiens
ggagcucugaguucc

SEQ ID NO: 2162374 - RNA, 14 nt, Homo sapiens
ugacagccucugac

SEQ ID NO: 2162375 - RNA, 15 nt, Homo sapiens
gagggaaauguuucu

SEQ ID NO: 2162376 - RNA, 13 nt, Homo sapiens
cuagggagccauu

SEQ ID NO: 2162377 - RNA, 23 nt, Homo sapiens
cugccaaggaaacccccagugua

SEQ ID NO: 2162378 - RNA, 16 nt, Homo sapiens
aauacggucuggugua

SEQ ID NO: 2162379 - RNA, 22 nt, Homo sapiens
uugauaaaguaauaaugugcaa

SEQ ID NO: 2162380 - RNA, 14 nt, Homo sapiens
cacucucauguugc

SEQ ID NO: 2162381 - RNA, 14 nt, Homo sapiens
uuaccuaaacagau

SEQ ID NO: 2162382 - RNA, 14 nt, Homo sapiens
acugcaaauuucaa

SEQ ID NO: 2162383 - RNA, 16 nt, Homo sapiens
uagaugugucuuacca

SEQ ID NO: 2162384 - RNA, 14 nt, Homo sapiens
ccaauauuuugccu

SEQ ID NO: 2162385 - RNA, 23 nt, Homo sapiens
cuugcuggacggggacuggggau

SEQ ID NO: 2162386 - RNA, 20 nt, Homo sapiens
ggauucucgacucuuugcaa

SEQ ID NO: 2162387 - RNA, 16 nt, Homo sapiens
uugaauauaaacacua

SEQ ID NO: 2162388 - RNA, 16 nt, Homo sapiens
aucggcacuguacaaa

SEQ ID NO: 2162389 - RNA, 13 nt, Homo sapiens
acuaugagcugcu

SEQ ID NO: 2162390 - RNA, 16 nt, Homo sapiens
caccaugcuugccuga

SEQ ID NO: 2162391 - RNA, 19 nt, Homo sapiens
ucgggacuugaaaaccacu

SEQ ID NO: 2162392 - RNA, 23 nt, Homo sapiens
ccuguuaccuacuuugacuuuuu

SEQ ID NO: 2162393 - RNA, 16 nt, Homo sapiens
cccuguucccuguucu

SEQ ID NO: 2162394 - RNA, 20 nt, Homo sapiens
aguacagauguaaaugccac

SEQ ID NO: 2162395 - RNA, 14 nt, Homo sapiens
auauguauuacaaa

SEQ ID NO: 2162396 - RNA, 14 nt, Homo sapiens
aaauauauuucaga

SEQ ID NO: 2162397 - RNA, 16 nt, Homo sapiens
augggacucugagaac

SEQ ID NO: 2162398 - RNA, 12 nt, Homo sapiens
uuauuucauuca

SEQ ID NO: 2162399 - RNA, 14 nt, Homo sapiens
ggaacuucaucaua

SEQ ID NO: 2162400 - RNA, 17 nt, Homo sapiens
auuggagcaagcuugcc

SEQ ID NO: 2162401 - RNA, 16 nt, Homo sapiens
cuggaaaagcacuuua

SEQ ID NO: 2162402 - RNA, 15 nt, Homo sapiens
uuuguuuugcacuga

SEQ ID NO: 2162403 - RNA, 13 nt, Homo sapiens
aaguauugcuaau

SEQ ID NO: 2162404 - RNA, 20 nt, Homo sapiens
cccaggaggggaacacugcc

SEQ ID NO: 2162405 - RNA, 23 nt, Homo sapiens
cauaagcuucuugucauucuuca

SEQ ID NO: 2162406 - RNA, 18 nt, Homo sapiens
acaucuuucacacuucca

SEQ ID NO: 2162407 - RNA, 16 nt, Homo sapiens
cuucucuugagucaca

SEQ ID NO: 2162408 - RNA, 20 nt, Homo sapiens
agagacggguuucaccaugu

SEQ ID NO: 2162409 - RNA, 19 nt, Homo sapiens
auccugaagaugugauaca

SEQ ID NO: 2162410 - RNA, 19 nt, Homo sapiens
aaauacacaccccuaagaa

SEQ ID NO: 2162411 - RNA, 23 nt, Homo sapiens
acauuuguuuguauucauguuca

SEQ ID NO: 2162412 - RNA, 20 nt, Homo sapiens
uuaacugcauaauagccuaa

SEQ ID NO: 2162413 - RNA, 16 nt, Homo sapiens
aguaaugcacucucag

SEQ ID NO: 2162414 - RNA, 20 nt, Homo sapiens
aggggcccacccacaugacu

SEQ ID NO: 2162415 - RNA, 13 nt, Homo sapiens
acuaaaaauugug

SEQ ID NO: 2162416 - RNA, 22 nt, Homo sapiens
ugucacaucagcaauuucagaa

SEQ ID NO: 2162417 - RNA, 14 nt, Homo sapiens
cagugagccaagau

SEQ ID NO: 2162418 - RNA, 20 nt, Homo sapiens
gcagcccggcgccaccaucc

SEQ ID NO: 2162419 - RNA, 17 nt, Homo sapiens
uuccugaauaauuucca

SEQ ID NO: 2162420 - RNA, 14 nt, Homo sapiens
uccugaaagcuuac

SEQ ID NO: 2162421 - RNA, 18 nt, Homo sapiens
gccccucucucacuggcu

SEQ ID NO: 2162422 - RNA, 18 nt, Homo sapiens
agaaugcugaaaccaagg

SEQ ID NO: 2162423 - RNA, 19 nt, Homo sapiens
cugaguuuuguuucacuuu

SEQ ID NO: 2162424 - RNA, 12 nt, Homo sapiens
ccugagcagcuu

SEQ ID NO: 2162425 - RNA, 20 nt, Homo sapiens
caaaagaggcuuuugggcca

SEQ ID NO: 2162426 - RNA, 19 nt, Homo sapiens
ccacagaccugcucuggac

SEQ ID NO: 2162427 - RNA, 13 nt, Homo sapiens
uauucuccccacc

SEQ ID NO: 2162428 - RNA, 22 nt, Homo sapiens
cuccaagaauggaggcuguagg

SEQ ID NO: 2162429 - RNA, 16 nt, Homo sapiens
ccgcuuguggggaccc

SEQ ID NO: 2162430 - RNA, 20 nt, Homo sapiens
acuucaccuacauuaucuca

SEQ ID NO: 2162431 - RNA, 20 nt, Homo sapiens
aucgccuccaucagccagac

SEQ ID NO: 2162432 - RNA, 16 nt, Homo sapiens
uuagccauuucacucu

SEQ ID NO: 2162433 - RNA, 18 nt, Homo sapiens
aaauggugcuuaaguucc

SEQ ID NO: 2162434 - RNA, 22 nt, Homo sapiens
aaccucagggcucccagggguc

SEQ ID NO: 2162435 - RNA, 14 nt, Homo sapiens
uccaaccucaggga

SEQ ID NO: 2162436 - RNA, 13 nt, Homo sapiens
uuaagacagugua

SEQ ID NO: 2162437 - RNA, 13 nt, Homo sapiens
uuaugacagugaa

SEQ ID NO: 2162438 - RNA, 16 nt, Homo sapiens
caaauugcagacugug

SEQ ID NO: 2162439 - RNA, 13 nt, Homo sapiens
accccuagcccug

SEQ ID NO: 2162440 - RNA, 22 nt, Homo sapiens
agaaagacucugagauguggag

SEQ ID NO: 2162441 - RNA, 21 nt, Homo sapiens
uggugacauugcaccuggaug

SEQ ID NO: 2162442 - RNA, 18 nt, Homo sapiens
ucuaugcucuuuccuguc

SEQ ID NO: 2162443 - RNA, 14 nt, Homo sapiens
caaauugcauuugu

SEQ ID NO: 2162444 - RNA, 23 nt, Homo sapiens
gaaauauaguaaacacuuggaaa

SEQ ID NO: 2162445 - RNA, 16 nt, Homo sapiens
aaguacuuuaccugaa

SEQ ID NO: 2162446 - RNA, 14 nt, Homo sapiens
aaguagcugagacu

SEQ ID NO: 2162447 - RNA, 15 nt, Homo sapiens
aaugugcgucagcaa

SEQ ID NO: 2162448 - RNA, 17 nt, Homo sapiens
uggcagcauacacagau

SEQ ID NO: 2162449 - RNA, 13 nt, Homo sapiens
gaauaaacacugg

SEQ ID NO: 2162450 - RNA, 20 nt, Homo sapiens
uucaugugaaguguauauga

SEQ ID NO: 2162451 - RNA, 20 nt, Homo sapiens
aauauuuuguaacuauuaca

SEQ ID NO: 2162452 - RNA, 23 nt, Homo sapiens
uggcacaaaaaaauaucagacaa

SEQ ID NO: 2162453 - RNA, 13 nt, Homo sapiens
cauugacugucac

SEQ ID NO: 2162454 - RNA, 23 nt, Homo sapiens
gccccuccuuccuucaagccaag

SEQ ID NO: 2162455 - RNA, 12 nt, Homo sapiens
aacaacuguggu

SEQ ID NO: 2162456 - RNA, 15 nt, Homo sapiens
ucauacaaaacuguu

SEQ ID NO: 2162457 - RNA, 18 nt, Homo sapiens
caggcugcucuugaacuc

SEQ ID NO: 2162458 - RNA, 17 nt, Homo sapiens
agaccagggaugcugcc

SEQ ID NO: 2162459 - RNA, 23 nt, Homo sapiens
augacacccacucuccugugaga

SEQ ID NO: 2162460 - RNA, 19 nt, Homo sapiens
uccuauggcagagcauuca

SEQ ID NO: 2162461 - RNA, 12 nt, Homo sapiens
augucuucccac

SEQ ID NO: 2162462 - RNA, 12 nt, Homo sapiens
gaccucacagua

SEQ ID NO: 2162463 - RNA, 18 nt, Homo sapiens
aaaugggaacaauaucaa

SEQ ID NO: 2162464 - RNA, 20 nt, Homo sapiens
ugcuguccacaugaccucca

SEQ ID NO: 2162465 - RNA, 16 nt, Homo sapiens
augugcacacuuacag

SEQ ID NO: 2162466 - RNA, 19 nt, Homo sapiens
cacugcaggggccgagcca

SEQ ID NO: 2162467 - RNA, 14 nt, Homo sapiens
accauaugaaugaa

SEQ ID NO: 2162468 - RNA, 20 nt, Homo sapiens
aucaugcuucuacuccaugg

SEQ ID NO: 2162469 - RNA, 19 nt, Homo sapiens
uuauaauuuuaagauuccu

SEQ ID NO: 2162470 - RNA, 21 nt, Homo sapiens
ucccugcuuggcuuaugaaaa

SEQ ID NO: 2162471 - RNA, 20 nt, Homo sapiens
cuuucccuaauacaggguug

SEQ ID NO: 2162472 - RNA, 18 nt, Homo sapiens
guugcucaaaucuauuca

SEQ ID NO: 2162473 - RNA, 15 nt, Homo sapiens
cagggacugugaaca

SEQ ID NO: 2162474 - RNA, 14 nt, Homo sapiens
ugaaauuugauaaa

SEQ ID NO: 2162475 - RNA, 15 nt, Homo sapiens
guuccagacauucuc

SEQ ID NO: 2162476 - RNA, 15 nt, Homo sapiens
agggacgcacagcac

SEQ ID NO: 2162477 - RNA, 18 nt, Homo sapiens
uugacucuugcaauccac

SEQ ID NO: 2162478 - RNA, 14 nt, Homo sapiens
aggagcuuccagug

SEQ ID NO: 2162479 - RNA, 17 nt, Homo sapiens
ugaaaggaauauaguca

SEQ ID NO: 2162480 - RNA, 16 nt, Homo sapiens
aaacucaccucccaau

SEQ ID NO: 2162481 - RNA, 22 nt, Homo sapiens
agugaaacuauauguauucaca

SEQ ID NO: 2162482 - RNA, 16 nt, Homo sapiens
acauccuaugaaauac

SEQ ID NO: 2162483 - RNA, 19 nt, Homo sapiens
uggugagaaauuucuguga

SEQ ID NO: 2162484 - RNA, 17 nt, Homo sapiens
gagacagagagcuccuc

SEQ ID NO: 2162485 - RNA, 15 nt, Homo sapiens
agacugaugagcaca

SEQ ID NO: 2162486 - RNA, 18 nt, Homo sapiens
auguuuuaagaagcauuu

SEQ ID NO: 2162487 - RNA, 23 nt, Homo sapiens
gucacgcuuucaugaauucuguc

SEQ ID NO: 2162488 - RNA, 14 nt, Homo sapiens
ugauaaaguauuau

SEQ ID NO: 2162489 - RNA, 14 nt, Homo sapiens
agugauagaaagaa

SEQ ID NO: 2162490 - RNA, 16 nt, Homo sapiens
ugccuugcagccacau

SEQ ID NO: 2162491 - RNA, 22 nt, Homo sapiens
accagaggccucuuuuccugaa

SEQ ID NO: 2162492 - RNA, 15 nt, Homo sapiens
gucaggggagaagcu

SEQ ID NO: 2162493 - RNA, 12 nt, Homo sapiens
uaacuguucuca

SEQ ID NO: 2162494 - RNA, 17 nt, Homo sapiens
cucuugaaccagaacca

SEQ ID NO: 2162495 - RNA, 19 nt, Homo sapiens
agcccugccaugucacaau

SEQ ID NO: 2162496 - RNA, 13 nt, Homo sapiens
gucaaaugucauu

SEQ ID NO: 2162497 - RNA, 23 nt, Homo sapiens
ggaagugccaaagccuggggcaa

SEQ ID NO: 2162498 - RNA, 16 nt, Homo sapiens
caucucugguucaagg

SEQ ID NO: 2162499 - RNA, 21 nt, Homo sapiens
cauuggggggaccgucuuuac

SEQ ID NO: 2162500 - RNA, 17 nt, Homo sapiens
gauuugaugggccacaa

SEQ ID NO: 2162501 - RNA, 16 nt, Homo sapiens
gaauaauaguuuugag

SEQ ID NO: 2162502 - RNA, 23 nt, Homo sapiens
gaagccuuagccaggaggccagg

SEQ ID NO: 2162503 - RNA, 12 nt, Homo sapiens
augucauuuagu

SEQ ID NO: 2162504 - RNA, 14 nt, Homo sapiens
uuuaguagcaacua

SEQ ID NO: 2162505 - RNA, 13 nt, Homo sapiens
caucagcagugau

SEQ ID NO: 2162506 - RNA, 16 nt, Homo sapiens
ggugggacaacaaaga

SEQ ID NO: 2162507 - RNA, 18 nt, Homo sapiens
caaagccuucauugccuu

SEQ ID NO: 2162508 - RNA, 14 nt, Homo sapiens
accuuugguuuuaa

SEQ ID NO: 2162509 - RNA, 13 nt, Homo sapiens
gcugggggacugc

SEQ ID NO: 2162510 - RNA, 21 nt, Homo sapiens
caagaagaagagugacuccug

SEQ ID NO: 2162511 - RNA, 21 nt, Homo sapiens
ucagcucuuuggaucagucuu

SEQ ID NO: 2162512 - RNA, 16 nt, Homo sapiens
uuguugaaauugucaa

SEQ ID NO: 2162513 - RNA, 18 nt, Homo sapiens
auucucuacaugcucuuu

SEQ ID NO: 2162514 - RNA, 15 nt, Homo sapiens
acaaagaugagauaa

SEQ ID NO: 2162515 - RNA, 16 nt, Homo sapiens
uguuaaaaacauguga

SEQ ID NO: 2162516 - RNA, 21 nt, Homo sapiens
aauuuuugaaaaaaguacaua

SEQ ID NO: 2162517 - RNA, 21 nt, Homo sapiens
auagaggcaagaaagagauac

SEQ ID NO: 2162518 - RNA, 13 nt, Homo sapiens
ucacaagcugccu

SEQ ID NO: 2162519 - RNA, 16 nt, Homo sapiens
aaguucaauacucauu

SEQ ID NO: 2162520 - RNA, 12 nt, Homo sapiens
aaaauaaucuau

SEQ ID NO: 2162521 - RNA, 21 nt, Homo sapiens
gcaccucacaggccccaggaa

SEQ ID NO: 2162522 - RNA, 16 nt, Homo sapiens
gaagggccaauggaga

SEQ ID NO: 2162523 - RNA, 21 nt, Homo sapiens
ucacuuuuaaacucuagauca

SEQ ID NO: 2162524 - RNA, 14 nt, Homo sapiens
acaauaacacuaaa

SEQ ID NO: 2162525 - RNA, 21 nt, Homo sapiens
ugcaguguuuaagucagcaaa

SEQ ID NO: 2162526 - RNA, 17 nt, Homo sapiens
cacgcuggagugcagug

SEQ ID NO: 2162527 - RNA, 20 nt, Homo sapiens
agacccccaugguaauguaa

SEQ ID NO: 2162528 - RNA, 16 nt, Homo sapiens
aaauaguuaccuucaa

SEQ ID NO: 2162529 - RNA, 23 nt, Homo sapiens
agcacuccuguaacugucucaga

SEQ ID NO: 2162530 - RNA, 19 nt, Homo sapiens
auaguuuuucauuguacca

SEQ ID NO: 2162531 - RNA, 19 nt, Homo sapiens
auguauuuaaccagucuuc

SEQ ID NO: 2162532 - RNA, 16 nt, Homo sapiens
aaauauuugacaucua

SEQ ID NO: 2162533 - RNA, 14 nt, Homo sapiens
uagaccccauacaa

SEQ ID NO: 2162534 - RNA, 19 nt, Homo sapiens
acaggggccccagaucugc

SEQ ID NO: 2162535 - RNA, 17 nt, Homo sapiens
gauaacagccucuugcc

SEQ ID NO: 2162536 - RNA, 13 nt, Homo sapiens
gggugcagucccc

SEQ ID NO: 2162537 - RNA, 16 nt, Homo sapiens
caaaugaaaugccaaa

SEQ ID NO: 2162538 - RNA, 21 nt, Homo sapiens
ccagauuggcucacacugaga

SEQ ID NO: 2162539 - RNA, 20 nt, Homo sapiens
caacugaggauguggcuuau

SEQ ID NO: 2162540 - RNA, 15 nt, Homo sapiens
uaacaaugcuguauu

SEQ ID NO: 2162541 - RNA, 14 nt, Homo sapiens
agcagaugacaaaa

SEQ ID NO: 2162542 - RNA, 20 nt, Homo sapiens
gagacucaccucugccucaa

SEQ ID NO: 2162543 - RNA, 16 nt, Homo sapiens
uccuccccugcuaccu

SEQ ID NO: 2162544 - RNA, 13 nt, Homo sapiens
aacaaagugaagu

SEQ ID NO: 2162545 - RNA, 12 nt, Homo sapiens
uguauuugccau

SEQ ID NO: 2162546 - RNA, 12 nt, Homo sapiens
uguuuuugccaa

SEQ ID NO: 2162547 - RNA, 17 nt, Homo sapiens
uuuuaacacacauaaag

SEQ ID NO: 2162548 - RNA, 19 nt, Homo sapiens
uccgucccccaaacauguu

SEQ ID NO: 2162549 - RNA, 18 nt, Homo sapiens
agccaucuugaucugugu

SEQ ID NO: 2162550 - RNA, 20 nt, Homo sapiens
auccuugauaaaugccucau

SEQ ID NO: 2162551 - RNA, 15 nt, Homo sapiens
ugaaugcagaagcaa

SEQ ID NO: 2162552 - RNA, 14 nt, Homo sapiens
cucacuccauuucc

SEQ ID NO: 2162553 - RNA, 14 nt, Homo sapiens
uugagagccagugg

SEQ ID NO: 2162554 - RNA, 17 nt, Homo sapiens
auuguuauaaagacaca

SEQ ID NO: 2162555 - RNA, 17 nt, Homo sapiens
uuauacauuauuuuaca

SEQ ID NO: 2162556 - RNA, 21 nt, Homo sapiens
ucagguuuguuuugugaauuu

SEQ ID NO: 2162557 - RNA, 15 nt, Homo sapiens
aggcuggaaaugguu

SEQ ID NO: 2162558 - RNA, 20 nt, Homo sapiens
gccaaaggucccuccccaga

SEQ ID NO: 2162559 - RNA, 21 nt, Homo sapiens
aguaccccugguaaaccaagc

SEQ ID NO: 2162560 - RNA, 23 nt, Homo sapiens
gaucucggcucacugcaaccucc

SEQ ID NO: 2162561 - RNA, 12 nt, Homo sapiens
gcauacauucuu

SEQ ID NO: 2162562 - RNA, 14 nt, Homo sapiens
aaucugcugcaccu

SEQ ID NO: 2162563 - RNA, 21 nt, Homo sapiens
acuguaauggguaauucugac

SEQ ID NO: 2162564 - RNA, 22 nt, Homo sapiens
uuuacggacacccccucgcuug

SEQ ID NO: 2162565 - RNA, 14 nt, Homo sapiens
ugcuggcagaaagc

SEQ ID NO: 2162566 - RNA, 21 nt, Homo sapiens
ccugucgaaggggaggcacac

SEQ ID NO: 2162567 - RNA, 19 nt, Homo sapiens
gaaguuggccaccuugcuu

SEQ ID NO: 2162568 - RNA, 21 nt, Homo sapiens
ugaauaugccaaacacauuaa

SEQ ID NO: 2162569 - RNA, 21 nt, Homo sapiens
aaccucaucuacaagcauuug

SEQ ID NO: 2162570 - RNA, 11 nt, Homo sapiens
gaugacuguga

SEQ ID NO: 2162571 - RNA, 17 nt, Homo sapiens
ccuacugaguagcuuuc

SEQ ID NO: 2162572 - RNA, 15 nt, Homo sapiens
ccucccccagcuccu

SEQ ID NO: 2162573 - RNA, 15 nt, Homo sapiens
ggccugcacucuuau

SEQ ID NO: 2162574 - RNA, 22 nt, Homo sapiens
cuuaauucccccaagcagaaga

SEQ ID NO: 2162575 - RNA, 12 nt, Homo sapiens
cuguccuugccc

SEQ ID NO: 2162576 - RNA, 20 nt, Homo sapiens
accuccaaggaccucucuca

SEQ ID NO: 2162577 - RNA, 19 nt, Homo sapiens
aaguuuuuaaaaauucccu

SEQ ID NO: 2162578 - RNA, 22 nt, Homo sapiens
aaaagucauuuaauguagaaua

SEQ ID NO: 2162579 - RNA, 20 nt, Homo sapiens
ccuugcaaaccaucccagca

SEQ ID NO: 2162580 - RNA, 15 nt, Homo sapiens
ucagcucccaucuca

SEQ ID NO: 2162581 - RNA, 12 nt, Homo sapiens
gggcacugugcc

SEQ ID NO: 2162582 - RNA, 19 nt, Homo sapiens
uuauguaagggucauuaga

SEQ ID NO: 2162583 - RNA, 18 nt, Homo sapiens
cugugauuuuaagacaag

SEQ ID NO: 2162584 - RNA, 21 nt, Homo sapiens
cuggccauuuaacuagcacuu

SEQ ID NO: 2162585 - RNA, 14 nt, Homo sapiens
agugccaacuccuc

SEQ ID NO: 2162586 - RNA, 22 nt, Homo sapiens
auuuagccaggaccugccaaug

SEQ ID NO: 2162587 - RNA, 22 nt, Homo sapiens
uggacacuucacgcccuuggcc

SEQ ID NO: 2162588 - RNA, 17 nt, Homo sapiens
cuagucucuacccagua

SEQ ID NO: 2162589 - RNA, 16 nt, Homo sapiens
cuucaaggcccucaga

SEQ ID NO: 2162590 - RNA, 16 nt, Homo sapiens
ggagcccuggugcuac

SEQ ID NO: 2162591 - RNA, 15 nt, Homo sapiens
gugguacuugaggga

SEQ ID NO: 2162592 - RNA, 21 nt, Homo sapiens
cugccgcccuccacaccucua

SEQ ID NO: 2162593 - RNA, 13 nt, Homo sapiens
uuucaccuacuaa

SEQ ID NO: 2162594 - RNA, 19 nt, Homo sapiens
ccccucuucccuacacgau

SEQ ID NO: 2162595 - RNA, 15 nt, Homo sapiens
aagagccuccuucag

SEQ ID NO: 2162596 - RNA, 20 nt, Homo sapiens
acgauugguaugaugcugcc

SEQ ID NO: 2162597 - RNA, 13 nt, Homo sapiens
aauuaaagccuua

SEQ ID NO: 2162598 - RNA, 16 nt, Homo sapiens
aaaauggccauuugcu

SEQ ID NO: 2162599 - RNA, 16 nt, Homo sapiens
gccauguagcagacaa

SEQ ID NO: 2162600 - RNA, 15 nt, Homo sapiens
ucuucacuugcacug

SEQ ID NO: 2162601 - RNA, 21 nt, Homo sapiens
gguaaaauaaucaguguuucc

SEQ ID NO: 2162602 - RNA, 18 nt, Homo sapiens
uagaauuaucaagcuuuu

SEQ ID NO: 2162603 - RNA, 16 nt, Homo sapiens
agaggccgcucugggg

SEQ ID NO: 2162604 - RNA, 18 nt, Homo sapiens
auucugcucuuugauuca

SEQ ID NO: 2162605 - RNA, 20 nt, Homo sapiens
uggacuacacaauacaguau

SEQ ID NO: 2162606 - RNA, 12 nt, Homo sapiens
cuaaagauauca

SEQ ID NO: 2162607 - RNA, 13 nt, Homo sapiens
cugaaggcuuuca

SEQ ID NO: 2162608 - RNA, 18 nt, Homo sapiens
cacuuauguuauacaaua

SEQ ID NO: 2162609 - RNA, 23 nt, Homo sapiens
uaguaaaagccaucuauguauau

SEQ ID NO: 2162610 - RNA, 18 nt, Homo sapiens
cccgccacccugucucag

SEQ ID NO: 2162611 - RNA, 18 nt, Homo sapiens
ggccuugucugucucagc

SEQ ID NO: 2162612 - RNA, 14 nt, Homo sapiens
uuuuggguauuaau

SEQ ID NO: 2162613 - RNA, 19 nt, Homo sapiens
cuacagggcucacagaauu

SEQ ID NO: 2162614 - RNA, 19 nt, Homo sapiens
uuccugcuucaucuuccca

SEQ ID NO: 2162615 - RNA, 16 nt, Homo sapiens
gaaacucagugcaaaa

SEQ ID NO: 2162616 - RNA, 19 nt, Homo sapiens
aggcuccugugcuacuuug

SEQ ID NO: 2162617 - RNA, 16 nt, Homo sapiens
aaauauuucuuagcaa

SEQ ID NO: 2162618 - RNA, 22 nt, Homo sapiens
uuauguaugugaaaguuacaaa

SEQ ID NO: 2162619 - RNA, 21 nt, Homo sapiens
gaauaccaaguguguugggaa

SEQ ID NO: 2162620 - RNA, 23 nt, Homo sapiens
ccccaagagaacucgcgcucagu

SEQ ID NO: 2162621 - RNA, 20 nt, Homo sapiens
guuucugagacggagucuca

SEQ ID NO: 2162622 - RNA, 14 nt, Homo sapiens
auuauuauguucuu

SEQ ID NO: 2162623 - RNA, 17 nt, Homo sapiens
caagagaagcauucuca

SEQ ID NO: 2162624 - RNA, 20 nt, Homo sapiens
uaauguccaaauacucugaa

SEQ ID NO: 2162625 - RNA, 23 nt, Homo sapiens
ucugucacaauaaauggccagug

SEQ ID NO: 2162626 - RNA, 15 nt, Homo sapiens
cuucacucaaucucu

SEQ ID NO: 2162627 - RNA, 19 nt, Homo sapiens
acuugcagaggagcccagu

SEQ ID NO: 2162628 - RNA, 18 nt, Homo sapiens
cucagguagccaccaccg

SEQ ID NO: 2162629 - RNA, 17 nt, Homo sapiens
agcaguggcuggugccc

SEQ ID NO: 2162630 - RNA, 12 nt, Homo sapiens
cuaaacauguga

SEQ ID NO: 2162631 - RNA, 12 nt, Homo sapiens
ccgcacaugcac

SEQ ID NO: 2162632 - RNA, 21 nt, Homo sapiens
aguuaccucaaggccuacuga

SEQ ID NO: 2162633 - RNA, 18 nt, Homo sapiens
uucuuauaccuucugaca

SEQ ID NO: 2162634 - RNA, 17 nt, Homo sapiens
aaugaagaucauauacg

SEQ ID NO: 2162635 - RNA, 11 nt, Homo sapiens
ucaagugccau

SEQ ID NO: 2162636 - RNA, 21 nt, Homo sapiens
ggaaaaaaauaguaaagccaa

SEQ ID NO: 2162637 - RNA, 18 nt, Homo sapiens
gccaagaaacacuuucag

SEQ ID NO: 2162638 - RNA, 20 nt, Homo sapiens
caaagcaggggaguaugcaa

SEQ ID NO: 2162639 - RNA, 22 nt, Homo sapiens
ucaagauacauuucaucugcug

SEQ ID NO: 2162640 - RNA, 21 nt, Homo sapiens
ugccaggccugggaccuccca

SEQ ID NO: 2162641 - RNA, 22 nt, Homo sapiens
caggaccccagagggaccagcu

SEQ ID NO: 2162642 - RNA, 16 nt, Homo sapiens
uauuuuuauccaugac

SEQ ID NO: 2162643 - RNA, 17 nt, Homo sapiens
ccuuggcaugccuucca

SEQ ID NO: 2162644 - RNA, 18 nt, Homo sapiens
gggguuuuguaaugacag

SEQ ID NO: 2162645 - RNA, 21 nt, Homo sapiens
cagaaugcucagggucacuga

SEQ ID NO: 2162646 - RNA, 21 nt, Homo sapiens
aaccacacccacacucagauc

SEQ ID NO: 2162647 - RNA, 19 nt, Homo sapiens
uaagaaguccuaucucaua

SEQ ID NO: 2162648 - RNA, 14 nt, Homo sapiens
aaacccucugugaa

SEQ ID NO: 2162649 - RNA, 16 nt, Homo sapiens
ugggcaaacaggcagu

SEQ ID NO: 2162650 - RNA, 19 nt, Homo sapiens
auagacacaguauugacuu

SEQ ID NO: 2162651 - RNA, 15 nt, Homo sapiens
auaucauuucacugu

SEQ ID NO: 2162652 - RNA, 22 nt, Homo sapiens
uaaccucugagucaccaucuua

SEQ ID NO: 2162653 - RNA, 22 nt, Homo sapiens
agggaauauuuuagaaccacaa

SEQ ID NO: 2162654 - RNA, 17 nt, Homo sapiens
uccuuuuucuucacuua

SEQ ID NO: 2162655 - RNA, 13 nt, Homo sapiens
ucgagguggauca

SEQ ID NO: 2162656 - RNA, 22 nt, Homo sapiens
cacgccuguauucccacaccag

SEQ ID NO: 2162657 - RNA, 12 nt, Homo sapiens
auuauaacuuaa

SEQ ID NO: 2162658 - RNA, 12 nt, Homo sapiens
auauuaacuuuu

SEQ ID NO: 2162659 - RNA, 19 nt, Homo sapiens
aagaguacacucagccacu

SEQ ID NO: 2162660 - RNA, 15 nt, Homo sapiens
ugcuaaugugugaug

SEQ ID NO: 2162661 - RNA, 14 nt, Homo sapiens
gagaagccucaguc

SEQ ID NO: 2162662 - RNA, 18 nt, Homo sapiens
ggguggugagaaccggag

SEQ ID NO: 2162663 - RNA, 20 nt, Homo sapiens
ccuucagugcuacauuuugu

SEQ ID NO: 2162664 - RNA, 17 nt, Homo sapiens
auuugaagaacauguga

SEQ ID NO: 2162665 - RNA, 19 nt, Homo sapiens
acaaauucuuugacacuca

SEQ ID NO: 2162666 - RNA, 20 nt, Homo sapiens
guacuugaacucacucccuc

SEQ ID NO: 2162667 - RNA, 16 nt, Homo sapiens
gauuuuaucugugaau

SEQ ID NO: 2162668 - RNA, 15 nt, Homo sapiens
uggggcaugaccuca

SEQ ID NO: 2162669 - RNA, 14 nt, Homo sapiens
caaagaugacugug

SEQ ID NO: 2162670 - RNA, 16 nt, Homo sapiens
cucuacuacaugugac

SEQ ID NO: 2162671 - RNA, 14 nt, Homo sapiens
cgggguuugccaug

SEQ ID NO: 2162672 - RNA, 14 nt, Homo sapiens
aacuaugguaaaua

SEQ ID NO: 2162673 - RNA, 14 nt, Homo sapiens
cgagcaaaauucaa

SEQ ID NO: 2162674 - RNA, 19 nt, Homo sapiens
cacuacaaucgcuaccuga

SEQ ID NO: 2162675 - RNA, 19 nt, Homo sapiens
gcgguccuacugcugugag

SEQ ID NO: 2162676 - RNA, 11 nt, Homo sapiens
aggacccaagc

SEQ ID NO: 2162677 - RNA, 13 nt, Homo sapiens
gcugacuuuggga

SEQ ID NO: 2162678 - RNA, 15 nt, Homo sapiens
aaauacaauauuuaa

SEQ ID NO: 2162679 - RNA, 20 nt, Homo sapiens
ccaguauugaaaacuucaaa

SEQ ID NO: 2162680 - RNA, 17 nt, Homo sapiens
gauuaugccacugcuuu

SEQ ID NO: 2162681 - RNA, 16 nt, Homo sapiens
agauccaguucuugaa

SEQ ID NO: 2162682 - RNA, 21 nt, Homo sapiens
guuuauuuuuuuaaaacacaa

SEQ ID NO: 2162683 - RNA, 13 nt, Homo sapiens
caacaauuuaccu

SEQ ID NO: 2162684 - RNA, 13 nt, Homo sapiens
uuaaaauucucau

SEQ ID NO: 2162685 - RNA, 16 nt, Homo sapiens
ucaccaaugagccuua

SEQ ID NO: 2162686 - RNA, 19 nt, Homo sapiens
aacuguuguguccaauccc

SEQ ID NO: 2162687 - RNA, 19 nt, Homo sapiens
cuggaaauugcaguaacaa

SEQ ID NO: 2162688 - RNA, 21 nt, Homo sapiens
augcaugaaaugaaugucuga

SEQ ID NO: 2162689 - RNA, 21 nt, Homo sapiens
agcauagccugccugaucccu

SEQ ID NO: 2162690 - RNA, 13 nt, Homo sapiens
aggggcagccaca

SEQ ID NO: 2162691 - RNA, 14 nt, Homo sapiens
accuggguguuaca

SEQ ID NO: 2162692 - RNA, 19 nt, Homo sapiens
ccaaauucagccuacugcc

SEQ ID NO: 2162693 - RNA, 14 nt, Homo sapiens
aauaaaaccucagc

SEQ ID NO: 2162694 - RNA, 17 nt, Homo sapiens
cgcugaauaugaggcau

SEQ ID NO: 2162695 - RNA, 21 nt, Homo sapiens
ugccuuacaggguaacugugc

SEQ ID NO: 2162696 - RNA, 18 nt, Homo sapiens
aauucuccuaaaggugag

SEQ ID NO: 2162697 - RNA, 21 nt, Homo sapiens
cugaccuccuuacauaugcaa

SEQ ID NO: 2162698 - RNA, 17 nt, Homo sapiens
agugcagaucugugcuc

SEQ ID NO: 2162699 - RNA, 14 nt, Homo sapiens
agggaggcacuucc

SEQ ID NO: 2162700 - RNA, 15 nt, Homo sapiens
acuuaaaaugugcag

SEQ ID NO: 2162701 - RNA, 14 nt, Homo sapiens
gagaggcuguguca

SEQ ID NO: 2162702 - RNA, 14 nt, Homo sapiens
caaaacuccgucuc

SEQ ID NO: 2162703 - RNA, 12 nt, Homo sapiens
agaaguacuauc

SEQ ID NO: 2162704 - RNA, 15 nt, Homo sapiens
uuaaagaauaugacu

SEQ ID NO: 2162705 - RNA, 14 nt, Homo sapiens
aauauucauuguau

SEQ ID NO: 2162706 - RNA, 13 nt, Homo sapiens
acugcugugagca

SEQ ID NO: 2162707 - RNA, 23 nt, Homo sapiens
cucuugccaaaucaaaagacuuu

SEQ ID NO: 2162708 - RNA, 13 nt, Homo sapiens
aucacuaucaauu

SEQ ID NO: 2162709 - RNA, 14 nt, Homo sapiens
gcucacacauuuac

SEQ ID NO: 2162710 - RNA, 13 nt, Homo sapiens
aacaaagaacuga

SEQ ID NO: 2162711 - RNA, 19 nt, Homo sapiens
auggccccaucuggaugua

SEQ ID NO: 2162712 - RNA, 20 nt, Homo sapiens
aaauguauaauuaacuuaac

SEQ ID NO: 2162713 - RNA, 15 nt, Homo sapiens
aaauuauauagcaaa

SEQ ID NO: 2162714 - RNA, 19 nt, Homo sapiens
gcuguuauuuaauuagcca

SEQ ID NO: 2162715 - RNA, 13 nt, Homo sapiens
gacccuccagagg

SEQ ID NO: 2162716 - RNA, 14 nt, Homo sapiens
agagcgaccagcag

SEQ ID NO: 2162717 - RNA, 13 nt, Homo sapiens
gaacuacuuugaa

SEQ ID NO: 2162718 - RNA, 20 nt, Homo sapiens
agaugguguguucugcaaua

SEQ ID NO: 2162719 - RNA, 18 nt, Homo sapiens
aauuugauuuagcauuca

SEQ ID NO: 2162720 - RNA, 12 nt, Homo sapiens
auggcacuggca

SEQ ID NO: 2162721 - RNA, 13 nt, Homo sapiens
aaagaugagaucg

SEQ ID NO: 2162722 - RNA, 18 nt, Homo sapiens
caggguguguacugcaca

SEQ ID NO: 2162723 - RNA, 22 nt, Homo sapiens
aggucagagccugcaguuauua

SEQ ID NO: 2162724 - RNA, 21 nt, Homo sapiens
cccuucuuuaaaucaaaagcu

SEQ ID NO: 2162725 - RNA, 19 nt, Homo sapiens
acucucuucuuccauuaga

SEQ ID NO: 2162726 - RNA, 16 nt, Homo sapiens
guuuuuuaaauguaua

SEQ ID NO: 2162727 - RNA, 21 nt, Homo sapiens
cuaagaagcagauaauggugu

SEQ ID NO: 2162728 - RNA, 15 nt, Homo sapiens
cuuccaaaccucaau

SEQ ID NO: 2162729 - RNA, 15 nt, Homo sapiens
ggggugggauuugga

SEQ ID NO: 2162730 - RNA, 14 nt, Homo sapiens
acuggaaagcuuuu

SEQ ID NO: 2162731 - RNA, 13 nt, Homo sapiens
ugcauaaagccaa

SEQ ID NO: 2162732 - RNA, 18 nt, Homo sapiens
cugauaagagaaucaaca

SEQ ID NO: 2162733 - RNA, 13 nt, Homo sapiens
ccggcacugugca

SEQ ID NO: 2162734 - RNA, 16 nt, Homo sapiens
caaaagucacccaggg

SEQ ID NO: 2162735 - RNA, 15 nt, Homo sapiens
uagcagguuucacua

SEQ ID NO: 2162736 - RNA, 20 nt, Homo sapiens
ccaucaaacgcagacacugu

SEQ ID NO: 2162737 - RNA, 17 nt, Homo sapiens
acugugucuggccagaa

SEQ ID NO: 2162738 - RNA, 14 nt, Homo sapiens
ugggagacacugau

SEQ ID NO: 2162739 - RNA, 17 nt, Homo sapiens
ugacgauguucuguaca

SEQ ID NO: 2162740 - RNA, 18 nt, Homo sapiens
uagaagccccugucgccc

SEQ ID NO: 2162741 - RNA, 13 nt, Homo sapiens
aaguaugccucag

SEQ ID NO: 2162742 - RNA, 21 nt, Homo sapiens
aaccugugaaagcugcacuca

SEQ ID NO: 2162743 - RNA, 13 nt, Homo sapiens
acccuagucccuu

SEQ ID NO: 2162744 - RNA, 20 nt, Homo sapiens
cauuuugaaucaucauguga

SEQ ID NO: 2162745 - RNA, 15 nt, Homo sapiens
uaaugcuuccaggga

SEQ ID NO: 2162746 - RNA, 12 nt, Homo sapiens
ggaccaguuuau

SEQ ID NO: 2162747 - RNA, 15 nt, Homo sapiens
cgugauuguggcauu

SEQ ID NO: 2162748 - RNA, 11 nt, Homo sapiens
aguaugucuug

SEQ ID NO: 2162749 - RNA, 18 nt, Homo sapiens
uaggccccuuugaggcuc

SEQ ID NO: 2162750 - RNA, 13 nt, Homo sapiens
cugcuucuccagc

SEQ ID NO: 2162751 - RNA, 16 nt, Homo sapiens
auuucaugucacuaaa

SEQ ID NO: 2162752 - RNA, 14 nt, Homo sapiens
ggaggaucaaagaa

SEQ ID NO: 2162753 - RNA, 16 nt, Homo sapiens
gucgucuuaacucacc

SEQ ID NO: 2162754 - RNA, 21 nt, Homo sapiens
ugaagcaugaaacuguguauu

SEQ ID NO: 2162755 - RNA, 19 nt, Homo sapiens
cauugcuuccucccuggug

SEQ ID NO: 2162756 - RNA, 16 nt, Homo sapiens
uaaaauuguuaguaaa

SEQ ID NO: 2162757 - RNA, 15 nt, Homo sapiens
ccugaggguccccac

SEQ ID NO: 2162758 - RNA, 19 nt, Homo sapiens
gaagacuggagacugucca

SEQ ID NO: 2162759 - RNA, 17 nt, Homo sapiens
ccaauccccagacucaa

SEQ ID NO: 2162760 - RNA, 13 nt, Homo sapiens
auuauuuacugaa

SEQ ID NO: 2162761 - RNA, 12 nt, Homo sapiens
ugccaaugaguu

SEQ ID NO: 2162762 - RNA, 17 nt, Homo sapiens
aacucaguuccaaaguc

SEQ ID NO: 2162763 - RNA, 19 nt, Homo sapiens
acuaaacucugaauaagca

SEQ ID NO: 2162764 - RNA, 22 nt, Homo sapiens
cuuguuguugaacauggcuaaa

SEQ ID NO: 2162765 - RNA, 23 nt, Homo sapiens
uuuacuuauuuaaaaaugcauga

SEQ ID NO: 2162766 - RNA, 12 nt, Homo sapiens
ucggugugcacc

SEQ ID NO: 2162767 - RNA, 22 nt, Homo sapiens
aagugaggagaaaccugcauga

SEQ ID NO: 2162768 - RNA, 19 nt, Homo sapiens
agugcagccuucuccauau

SEQ ID NO: 2162769 - RNA, 14 nt, Homo sapiens
cugaccccaaagag

SEQ ID NO: 2162770 - RNA, 19 nt, Homo sapiens
agcugaagugcauccaaag

SEQ ID NO: 2162771 - RNA, 19 nt, Homo sapiens
ccagaagugcagaacugca

SEQ ID NO: 2162772 - RNA, 15 nt, Homo sapiens
uuaacuugaggguaa

SEQ ID NO: 2162773 - RNA, 14 nt, Homo sapiens
agcauucagaaagu

SEQ ID NO: 2162774 - RNA, 17 nt, Homo sapiens
auuuacauauagcugau

SEQ ID NO: 2162775 - RNA, 23 nt, Homo sapiens
uuccaugucugaaguuugcccca

SEQ ID NO: 2162776 - RNA, 12 nt, Homo sapiens
agccauugcacc

SEQ ID NO: 2162777 - RNA, 16 nt, Homo sapiens
guccugaccuugagaa

SEQ ID NO: 2162778 - RNA, 17 nt, Homo sapiens
uuaguaacauagacaaa

SEQ ID NO: 2162779 - RNA, 17 nt, Homo sapiens
uucaccaagccacugau

SEQ ID NO: 2162780 - RNA, 20 nt, Homo sapiens
gauaaucgagucuaccucuu

SEQ ID NO: 2162781 - RNA, 21 nt, Homo sapiens
ugggaacaggguuacuguaua

SEQ ID NO: 2162782 - RNA, 11 nt, Homo sapiens
gucauugcugu

SEQ ID NO: 2162783 - RNA, 13 nt, Homo sapiens
ucaaagugagcuc

SEQ ID NO: 2162784 - RNA, 16 nt, Homo sapiens
aaguggugaaugacac

SEQ ID NO: 2162785 - RNA, 15 nt, Homo sapiens
uggagaaaaugaaga

SEQ ID NO: 2162786 - RNA, 15 nt, Homo sapiens
agccagucaucaucu

SEQ ID NO: 2162787 - RNA, 17 nt, Homo sapiens
gcaaacaguucuuggac

SEQ ID NO: 2162788 - RNA, 14 nt, Homo sapiens
uggccuuacuguau

SEQ ID NO: 2162789 - RNA, 18 nt, Homo sapiens
cauuagccggacucgaaa

SEQ ID NO: 2162790 - RNA, 20 nt, Homo sapiens
uuagaggaucccucucugga

SEQ ID NO: 2162791 - RNA, 22 nt, Homo sapiens
acuacccgagcccagcuacauu

SEQ ID NO: 2162792 - RNA, 16 nt, Homo sapiens
gaugugacagcccuga

SEQ ID NO: 2162793 - RNA, 13 nt, Homo sapiens
cggggcccaggac

SEQ ID NO: 2162794 - RNA, 20 nt, Homo sapiens
uaauuacuuauuguauuuau

SEQ ID NO: 2162795 - RNA, 23 nt, Homo sapiens
ucacagcugacuccaagcugcau

SEQ ID NO: 2162796 - RNA, 15 nt, Homo sapiens
uauugacacugacua

SEQ ID NO: 2162797 - RNA, 19 nt, Homo sapiens
caguuggauucagaaccaa

SEQ ID NO: 2162798 - RNA, 19 nt, Homo sapiens
cugacugcaugaugagucu

SEQ ID NO: 2162799 - RNA, 21 nt, Homo sapiens
ucucuuuugagcuaaucuuca

SEQ ID NO: 2162800 - RNA, 21 nt, Homo sapiens
uuagaacuucuacagaagcca

SEQ ID NO: 2162801 - RNA, 22 nt, Homo sapiens
aucucaacuuagcacacgugaa

SEQ ID NO: 2162802 - RNA, 21 nt, Homo sapiens
aaguaacacuaguagcuguuu

SEQ ID NO: 2162803 - RNA, 19 nt, Homo sapiens
aagucacaggaagaaagca

SEQ ID NO: 2162804 - RNA, 14 nt, Homo sapiens
cuguggaacauaaa

SEQ ID NO: 2162805 - RNA, 18 nt, Homo sapiens
ccaguggauggauucauc

SEQ ID NO: 2162806 - RNA, 14 nt, Homo sapiens
ugucgugaaauugu

SEQ ID NO: 2162807 - RNA, 14 nt, Homo sapiens
cucccugaugacac

SEQ ID NO: 2162808 - RNA, 15 nt, Homo sapiens
ugaguuugugcuggu

SEQ ID NO: 2162809 - RNA, 14 nt, Homo sapiens
acaguagaagcuca

SEQ ID NO: 2162810 - RNA, 23 nt, Homo sapiens
uacagguuccuuuugaagcucaa

SEQ ID NO: 2162811 - RNA, 18 nt, Homo sapiens
uccuaaguauauuaauau

SEQ ID NO: 2162812 - RNA, 17 nt, Homo sapiens
aguucuuuuacaaauau

SEQ ID NO: 2162813 - RNA, 21 nt, Homo sapiens
ugcccagcaguuucccagaau

SEQ ID NO: 2162814 - RNA, 21 nt, Homo sapiens
guagcucccauauauggagau

SEQ ID NO: 2162815 - RNA, 14 nt, Homo sapiens
auugccucuacuuu

SEQ ID NO: 2162816 - RNA, 20 nt, Homo sapiens
agagaaaaguccacagugau

SEQ ID NO: 2162817 - RNA, 17 nt, Homo sapiens
cugguccuccacuuugc

SEQ ID NO: 2162818 - RNA, 22 nt, Homo sapiens
uguguaacuguaaaacauugaa

SEQ ID NO: 2162819 - RNA, 13 nt, Homo sapiens
augauuguucaaa

SEQ ID NO: 2162820 - RNA, 14 nt, Homo sapiens
ucuacaaugcacau

SEQ ID NO: 2162821 - RNA, 18 nt, Homo sapiens
cauuuguccaugugcaaa

SEQ ID NO: 2162822 - RNA, 20 nt, Homo sapiens
auauuuaauggcacugagaa

SEQ ID NO: 2162823 - RNA, 22 nt, Homo sapiens
uuuaaagcucauaaacugccaa

SEQ ID NO: 2162824 - RNA, 16 nt, Homo sapiens
uucacaaaaugucuca

SEQ ID NO: 2162825 - RNA, 14 nt, Homo sapiens
cccuguagggugcc

SEQ ID NO: 2162826 - RNA, 14 nt, Homo sapiens
gccucaaacucaac

SEQ ID NO: 2162827 - RNA, 12 nt, Homo sapiens
gcaccauugcac

SEQ ID NO: 2162828 - RNA, 12 nt, Homo sapiens
ccagcauuccag

SEQ ID NO: 2162829 - RNA, 15 nt, Homo sapiens
cugguagcucaggug

SEQ ID NO: 2162830 - RNA, 18 nt, Homo sapiens
ugcucaggguucaucuga

SEQ ID NO: 2162831 - RNA, 23 nt, Homo sapiens
cuacucuaggcagugacagugcc

SEQ ID NO: 2162832 - RNA, 11 nt, Homo sapiens
gaacaaaucag

SEQ ID NO: 2162833 - RNA, 19 nt, Homo sapiens
guacagaauuauaugacca

SEQ ID NO: 2162834 - RNA, 18 nt, Homo sapiens
guauacagcauugacuca

SEQ ID NO: 2162835 - RNA, 11 nt, Homo sapiens
caccuugugau

SEQ ID NO: 2162836 - RNA, 20 nt, Homo sapiens
ugaaaauguuuaugccacag

SEQ ID NO: 2162837 - RNA, 21 nt, Homo sapiens
uugaaagugaauaaacuucag

SEQ ID NO: 2162838 - RNA, 18 nt, Homo sapiens
gaauguuugaaaauuaga

SEQ ID NO: 2162839 - RNA, 22 nt, Homo sapiens
accuuuucaccuccaacuggau

SEQ ID NO: 2162840 - RNA, 23 nt, Homo sapiens
gcuagagguagaguuugaucaua

SEQ ID NO: 2162841 - RNA, 12 nt, Homo sapiens
uggacacuguca

SEQ ID NO: 2162842 - RNA, 18 nt, Homo sapiens
cuccuaaaguaacaucag

SEQ ID NO: 2162843 - RNA, 14 nt, Homo sapiens
ucccaaguaugccu

SEQ ID NO: 2162844 - RNA, 13 nt, Homo sapiens
auacaugcuacuu

SEQ ID NO: 2162845 - RNA, 19 nt, Homo sapiens
accuuauuggauauuugau

SEQ ID NO: 2162846 - RNA, 16 nt, Homo sapiens
cacacugaaaccaaaa

SEQ ID NO: 2162847 - RNA, 11 nt, Homo sapiens
uccgugcuuuu

SEQ ID NO: 2162848 - RNA, 22 nt, Homo sapiens
cagaaguaguuuuguucaugaa

SEQ ID NO: 2162849 - RNA, 14 nt, Homo sapiens
cacucccgcugagc

SEQ ID NO: 2162850 - RNA, 15 nt, Homo sapiens
ggagcagucugagga

SEQ ID NO: 2162851 - RNA, 15 nt, Homo sapiens
caagcagaugacaga

SEQ ID NO: 2162852 - RNA, 22 nt, Homo sapiens
cucugugucagcacaguguaau

SEQ ID NO: 2162853 - RNA, 18 nt, Homo sapiens
acccugaggucacugcua

SEQ ID NO: 2162854 - RNA, 14 nt, Homo sapiens
cuaaugaaauugag

SEQ ID NO: 2162855 - RNA, 14 nt, Homo sapiens
aaaaucaacaugac

SEQ ID NO: 2162856 - RNA, 14 nt, Homo sapiens
aaaauuaacaugau

SEQ ID NO: 2162857 - RNA, 17 nt, Homo sapiens
augaaucaguuuuggaa

SEQ ID NO: 2162858 - RNA, 21 nt, Homo sapiens
uaucguguacaagaagacaaa

SEQ ID NO: 2162859 - RNA, 16 nt, Homo sapiens
acuaaaucaaucugca

SEQ ID NO: 2162860 - RNA, 20 nt, Homo sapiens
ugcaaaagggcuuccuaaaa

SEQ ID NO: 2162861 - RNA, 15 nt, Homo sapiens
gcccaagaggacuga

SEQ ID NO: 2162862 - RNA, 21 nt, Homo sapiens
ugucucaaagcaucaaauaau

SEQ ID NO: 2162863 - RNA, 12 nt, Homo sapiens
aacaaaguaaua

SEQ ID NO: 2162864 - RNA, 15 nt, Homo sapiens
auggaaucaauucaa

SEQ ID NO: 2162865 - RNA, 23 nt, Homo sapiens
ugacuucauagauuaugcuuuaa

SEQ ID NO: 2162866 - RNA, 18 nt, Homo sapiens
uauuaacauaagaaaaga

SEQ ID NO: 2162867 - RNA, 18 nt, Homo sapiens
acagcucacugcagccuc

SEQ ID NO: 2162868 - RNA, 21 nt, Homo sapiens
ucaaaauauuacccagcugaa

SEQ ID NO: 2162869 - RNA, 21 nt, Homo sapiens
auguaaccgauucaucucuca

SEQ ID NO: 2162870 - RNA, 16 nt, Homo sapiens
ggcauucauauuucau

SEQ ID NO: 2162871 - RNA, 18 nt, Homo sapiens
aguugagagcaccuugca

SEQ ID NO: 2162872 - RNA, 13 nt, Homo sapiens
augguagaccuuu

SEQ ID NO: 2162873 - RNA, 15 nt, Homo sapiens
cggauggaaggagag

SEQ ID NO: 2162874 - RNA, 18 nt, Homo sapiens
cccuuggaaaacaaaagu

SEQ ID NO: 2162875 - RNA, 15 nt, Homo sapiens
ucaaaaccuacacag

SEQ ID NO: 2162876 - RNA, 15 nt, Homo sapiens
aagcuucgugccaac

SEQ ID NO: 2162877 - RNA, 13 nt, Homo sapiens
ugguagcucacac

SEQ ID NO: 2162878 - RNA, 14 nt, Homo sapiens
uccucucucuacca

SEQ ID NO: 2162879 - RNA, 24 nt, Homo sapiens
cuccggucccaaauguagcaggug

SEQ ID NO: 2162880 - RNA, 16 nt, Homo sapiens
gaaauaguaacuucua

SEQ ID NO: 2162881 - RNA, 21 nt, Homo sapiens
auuuuucaaguaauaaaacaa

SEQ ID NO: 2162882 - RNA, 17 nt, Homo sapiens
caggaaaacaaaucacu

SEQ ID NO: 2162883 - RNA, 14 nt, Homo sapiens
agcccccugaccuu

SEQ ID NO: 2162884 - RNA, 21 nt, Homo sapiens
ggggacccugggcccaucucu

SEQ ID NO: 2162885 - RNA, 22 nt, Homo sapiens
auuuuuaguuuaaaaucuugca

SEQ ID NO: 2162886 - RNA, 16 nt, Homo sapiens
ucacauggagcucuuc

SEQ ID NO: 2162887 - RNA, 18 nt, Homo sapiens
uuaacugaugacauucca

SEQ ID NO: 2162888 - RNA, 23 nt, Homo sapiens
uagggagagaguccguagguuua

SEQ ID NO: 2162889 - RNA, 17 nt, Homo sapiens
gcaagugaacuugggag

SEQ ID NO: 2162890 - RNA, 17 nt, Homo sapiens
cuagaacuuugugccag

SEQ ID NO: 2162891 - RNA, 19 nt, Homo sapiens
acaccguguaaaccaaagc

SEQ ID NO: 2162892 - RNA, 16 nt, Homo sapiens
cuccgaaaugcugucu

SEQ ID NO: 2162893 - RNA, 17 nt, Homo sapiens
uugaaauuauauuacau

SEQ ID NO: 2162894 - RNA, 12 nt, Homo sapiens
uuaacuggugaa

SEQ ID NO: 2162895 - RNA, 15 nt, Homo sapiens
ggcacuucauugaga

SEQ ID NO: 2162896 - RNA, 17 nt, Homo sapiens
ucucuuuuccacugaca

SEQ ID NO: 2162897 - RNA, 18 nt, Homo sapiens
augcucagggucacugaa

SEQ ID NO: 2162898 - RNA, 14 nt, Homo sapiens
gcuuucacauugua

SEQ ID NO: 2162899 - RNA, 11 nt, Homo sapiens
ugacuggccag

SEQ ID NO: 2162900 - RNA, 21 nt, Homo sapiens
caacccaauaaaacugauguu

SEQ ID NO: 2162901 - RNA, 16 nt, Homo sapiens
aguguuuagcauuaaa

SEQ ID NO: 2162902 - RNA, 19 nt, Homo sapiens
caucagaggaaaagggcaa

SEQ ID NO: 2162903 - RNA, 19 nt, Homo sapiens
ugggaccuguguucuugcu

SEQ ID NO: 2162904 - RNA, 22 nt, Homo sapiens
gcccccacaggagcguguacua

SEQ ID NO: 2162905 - RNA, 19 nt, Homo sapiens
gaugucccuugaugcacag

SEQ ID NO: 2162906 - RNA, 21 nt, Homo sapiens
cauccuaagugggaagugaag

SEQ ID NO: 2162907 - RNA, 17 nt, Homo sapiens
uucccaaaucccucuca

SEQ ID NO: 2162908 - RNA, 12 nt, Homo sapiens
ugucucuuuauu

SEQ ID NO: 2162909 - RNA, 23 nt, Homo sapiens
aacuugagcucuguaacuuacac

SEQ ID NO: 2162910 - RNA, 14 nt, Homo sapiens
gaaaagugcauauu

SEQ ID NO: 2162911 - RNA, 16 nt, Homo sapiens
aguugauucuugccuu

SEQ ID NO: 2162912 - RNA, 18 nt, Homo sapiens
ggaaauccauuccauuuu

SEQ ID NO: 2162913 - RNA, 12 nt, Homo sapiens
aagcccuugaac

SEQ ID NO: 2162914 - RNA, 18 nt, Homo sapiens
ucuuuacuaaacagauuu

SEQ ID NO: 2162915 - RNA, 13 nt, Homo sapiens
agccugcagucau

SEQ ID NO: 2162916 - RNA, 21 nt, Homo sapiens
gcaagaccaaaaugacaauga

SEQ ID NO: 2162917 - RNA, 15 nt, Homo sapiens
caucccugugaagga

SEQ ID NO: 2162918 - RNA, 16 nt, Homo sapiens
acuagugcaggguaug

SEQ ID NO: 2162919 - RNA, 20 nt, Homo sapiens
ucaggaaaucaaauaugcaa

SEQ ID NO: 2162920 - RNA, 23 nt, Homo sapiens
uuaugcaggcuuaacgugucuga

SEQ ID NO: 2162921 - RNA, 13 nt, Homo sapiens
auuuuacuugcac

SEQ ID NO: 2162922 - RNA, 14 nt, Homo sapiens
cgagucaagugauu

SEQ ID NO: 2162923 - RNA, 18 nt, Homo sapiens
uuuucucuuguaccauag

SEQ ID NO: 2162924 - RNA, 17 nt, Homo sapiens
gaaacauccuaugaaau

SEQ ID NO: 2162925 - RNA, 16 nt, Homo sapiens
guauugugaccacuga

SEQ ID NO: 2162926 - RNA, 16 nt, Homo sapiens
aaagcaagacagauua

SEQ ID NO: 2162927 - RNA, 17 nt, Homo sapiens
uauguuaggaauacucu

SEQ ID NO: 2162928 - RNA, 21 nt, Homo sapiens
acauagcacgaaucuguuacc

SEQ ID NO: 2162929 - RNA, 13 nt, Homo sapiens
accuaaacauuau

SEQ ID NO: 2162930 - RNA, 13 nt, Homo sapiens
aauagaacacagu

SEQ ID NO: 2162931 - RNA, 15 nt, Homo sapiens
augugaaacaucuuc

SEQ ID NO: 2162932 - RNA, 9 nt, Homo sapiens
augcacaaa

SEQ ID NO: 2162933 - RNA, 22 nt, Homo sapiens
uguagcaaagcacauagagcca

SEQ ID NO: 2162934 - RNA, 15 nt, Homo sapiens
guugcugaaacacac

SEQ ID NO: 2162935 - RNA, 18 nt, Homo sapiens
uuuaacaggaagaucuua

SEQ ID NO: 2162936 - RNA, 14 nt, Homo sapiens
cuuauuaaagcaaa

SEQ ID NO: 2162937 - RNA, 22 nt, Homo sapiens
aucauuaaggucauuacucuca

SEQ ID NO: 2162938 - RNA, 16 nt, Homo sapiens
gcagucccaaaacccu

SEQ ID NO: 2162939 - RNA, 16 nt, Homo sapiens
ugugcggagucauuuu

SEQ ID NO: 2162940 - RNA, 16 nt, Homo sapiens
cuauuaaacuauuuua

SEQ ID NO: 2162941 - RNA, 20 nt, Homo sapiens
gaccugaaugaccugcaguc

SEQ ID NO: 2162942 - RNA, 15 nt, Homo sapiens
ugggccuccagagac

SEQ ID NO: 2162943 - RNA, 18 nt, Homo sapiens
aucuaaucuaugcaugua

SEQ ID NO: 2162944 - RNA, 16 nt, Homo sapiens
aguaaugauacugugu

SEQ ID NO: 2162945 - RNA, 21 nt, Homo sapiens
ccacacacaccugucugugca

SEQ ID NO: 2162946 - RNA, 23 nt, Homo sapiens
uccuaaaagagaucugggcauua

SEQ ID NO: 2162947 - RNA, 16 nt, Homo sapiens
ucauucagaagaugcu

SEQ ID NO: 2162948 - RNA, 18 nt, Homo sapiens
cccucccuggaugacauu

SEQ ID NO: 2162949 - RNA, 13 nt, Homo sapiens
cggguaccugaag

SEQ ID NO: 2162950 - RNA, 18 nt, Homo sapiens
cuuucuccaggaccaaua

SEQ ID NO: 2162951 - RNA, 12 nt, Homo sapiens
gguuaaugcaga

SEQ ID NO: 2162952 - RNA, 17 nt, Homo sapiens
auuagccgggcauggug

SEQ ID NO: 2162953 - RNA, 11 nt, Homo sapiens
ccugccagcuc

SEQ ID NO: 2162954 - RNA, 22 nt, Homo sapiens
ucaacagagggaguuuaauaca

SEQ ID NO: 2162955 - RNA, 14 nt, Homo sapiens
cccgagagcucuua

SEQ ID NO: 2162956 - RNA, 15 nt, Homo sapiens
ugaugaugaucucau

SEQ ID NO: 2162957 - RNA, 20 nt, Homo sapiens
caguuaccucugccucagaa

SEQ ID NO: 2162958 - RNA, 17 nt, Homo sapiens
guuaucaugcauguuau

SEQ ID NO: 2162959 - RNA, 14 nt, Homo sapiens
accagcugccaaaa

SEQ ID NO: 2162960 - RNA, 20 nt, Homo sapiens
aauaacuaaugucucuacaa

SEQ ID NO: 2162961 - RNA, 17 nt, Homo sapiens
auuuucaucaaaaccaa

SEQ ID NO: 2162962 - RNA, 17 nt, Homo sapiens
caucauuucaggaguua

SEQ ID NO: 2162963 - RNA, 19 nt, Homo sapiens
uaccgugggucaaccuggg

SEQ ID NO: 2162964 - RNA, 17 nt, Homo sapiens
cugugccucugccuguc

SEQ ID NO: 2162965 - RNA, 17 nt, Homo sapiens
gggcuguugucauuugu

SEQ ID NO: 2162966 - RNA, 14 nt, Homo sapiens
agaugguccauuug

SEQ ID NO: 2162967 - RNA, 18 nt, Homo sapiens
ccccugaccucacuguga

SEQ ID NO: 2162968 - RNA, 20 nt, Homo sapiens
cauccgucccacaucagggc

SEQ ID NO: 2162969 - RNA, 19 nt, Homo sapiens
uguggucacagccaugaag

SEQ ID NO: 2162970 - RNA, 21 nt, Homo sapiens
uuaccaaagagauauugauau

SEQ ID NO: 2162971 - RNA, 22 nt, Homo sapiens
aaaagggccaaagaaccaaaga

SEQ ID NO: 2162972 - RNA, 20 nt, Homo sapiens
gcagaacugaagugugcugu

SEQ ID NO: 2162973 - RNA, 21 nt, Homo sapiens
guugcagugagccgagaucac

SEQ ID NO: 2162974 - RNA, 16 nt, Homo sapiens
accucaggcacuagcc

SEQ ID NO: 2162975 - RNA, 20 nt, Homo sapiens
cccugcuccccuacuucuca

SEQ ID NO: 2162976 - RNA, 23 nt, Homo sapiens
guuucaacaaauuucauugcacu

SEQ ID NO: 2162977 - RNA, 21 nt, Homo sapiens
caagaugugaauuauugacac

SEQ ID NO: 2162978 - RNA, 22 nt, Homo sapiens
uagcuauuuuuauacacuguaa

SEQ ID NO: 2162979 - RNA, 14 nt, Homo sapiens
accucaagcccuga

SEQ ID NO: 2162980 - RNA, 18 nt, Homo sapiens
ggccugccaaacuguaca

SEQ ID NO: 2162981 - RNA, 18 nt, Homo sapiens
gcuucaguuuuacucugc

SEQ ID NO: 2162982 - RNA, 13 nt, Homo sapiens
ccggggugggugu

SEQ ID NO: 2162983 - RNA, 22 nt, Homo sapiens
agucaagugaggugacacucca

SEQ ID NO: 2162984 - RNA, 17 nt, Homo sapiens
auucaggccagcccagc

SEQ ID NO: 2162985 - RNA, 17 nt, Homo sapiens
cggcucuauucucuaaa

SEQ ID NO: 2162986 - RNA, 20 nt, Homo sapiens
agagcuagguggaaaagccu

SEQ ID NO: 2162987 - RNA, 21 nt, Homo sapiens
auauucugaagcaacauuuua

SEQ ID NO: 2162988 - RNA, 14 nt, Homo sapiens
gcucaagacuggca

SEQ ID NO: 2162989 - RNA, 13 nt, Homo sapiens
uauacuugccauc

SEQ ID NO: 2162990 - RNA, 15 nt, Homo sapiens
aauccgccaauauua

SEQ ID NO: 2162991 - RNA, 15 nt, Homo sapiens
uauuucuaguagcac

SEQ ID NO: 2162992 - RNA, 21 nt, Homo sapiens
ggacaaccaccaggugucaaa

SEQ ID NO: 2162993 - RNA, 23 nt, Homo sapiens
uagaccagggcugcucuuuccac

SEQ ID NO: 2162994 - RNA, 22 nt, Homo sapiens
ccccaccccaucuuugcugcca

SEQ ID NO: 2162995 - RNA, 22 nt, Homo sapiens
ccacuuacagaucuaucuccuc

SEQ ID NO: 2162996 - RNA, 19 nt, Homo sapiens
aaacauccuguuuugcaaa

SEQ ID NO: 2162997 - RNA, 18 nt, Homo sapiens
acuagcccucuuucucuc

SEQ ID NO: 2162998 - RNA, 14 nt, Homo sapiens
ucauaaacugccaa

SEQ ID NO: 2162999 - RNA, 16 nt, Homo sapiens
aauaacaaagcacaua

SEQ ID NO: 2163000 - RNA, 23 nt, Homo sapiens
uaccaaaaauuuugugacauucc

SEQ ID NO: 2163001 - RNA, 22 nt, Homo sapiens
gcucuugugaacugucuuggcu

SEQ ID NO: 2163002 - RNA, 21 nt, Homo sapiens
aauuuugguuuucuacuguua

SEQ ID NO: 2163003 - RNA, 18 nt, Homo sapiens
gccucagcuucucaaagu

SEQ ID NO: 2163004 - RNA, 18 nt, Homo sapiens
agagaucucccuucucau

SEQ ID NO: 2163005 - RNA, 14 nt, Homo sapiens
acagugcaacacug

SEQ ID NO: 2163006 - RNA, 14 nt, Homo sapiens
ccucaccaccugac

SEQ ID NO: 2163007 - RNA, 15 nt, Homo sapiens
cuaaaugggacccaa

SEQ ID NO: 2163008 - RNA, 16 nt, Homo sapiens
cuuuagaaagcaguua

SEQ ID NO: 2163009 - RNA, 18 nt, Homo sapiens
cuuuacagauguagauau

SEQ ID NO: 2163010 - RNA, 23 nt, Homo sapiens
acauaggcucucaggugccaguc

SEQ ID NO: 2163011 - RNA, 19 nt, Homo sapiens
cccuuuucaguuucuuauc

SEQ ID NO: 2163012 - RNA, 12 nt, Homo sapiens
gacagcuuuauu

SEQ ID NO: 2163013 - RNA, 20 nt, Homo sapiens
aauguguuauuugucacaaa

SEQ ID NO: 2163014 - RNA, 21 nt, Homo sapiens
uuuguagaaugaaccacugcc

SEQ ID NO: 2163015 - RNA, 14 nt, Homo sapiens
ccuggcaucugugc

SEQ ID NO: 2163016 - RNA, 19 nt, Homo sapiens
acaaguuggaugcggccau

SEQ ID NO: 2163017 - RNA, 18 nt, Homo sapiens
ugcagccuccccaggugu

SEQ ID NO: 2163018 - RNA, 20 nt, Homo sapiens
aagcuacaauauucucucuu

SEQ ID NO: 2163019 - RNA, 23 nt, Homo sapiens
uaggggccccucucagcccucac

SEQ ID NO: 2163020 - RNA, 16 nt, Homo sapiens
acuccuuggccuagcc

SEQ ID NO: 2163021 - RNA, 23 nt, Homo sapiens
aucauuuacuuuuaaacuuugau

SEQ ID NO: 2163022 - RNA, 17 nt, Homo sapiens
agaagagugcugucauu

SEQ ID NO: 2163023 - RNA, 18 nt, Homo sapiens
ccagcuccucacucaccu

SEQ ID NO: 2163024 - RNA, 15 nt, Homo sapiens
uccgugguucacuuu

SEQ ID NO: 2163025 - RNA, 15 nt, Homo sapiens
aguaacauagcugug

SEQ ID NO: 2163026 - RNA, 13 nt, Homo sapiens
ccugaagacugag

SEQ ID NO: 2163027 - RNA, 15 nt, Homo sapiens
uauccugauuccaaa

SEQ ID NO: 2163028 - RNA, 17 nt, Homo sapiens
uauauagguugugcaaa

SEQ ID NO: 2163029 - RNA, 23 nt, Homo sapiens
guagaggaccaggacuugugcag

SEQ ID NO: 2163030 - RNA, 21 nt, Homo sapiens
ggcugacccagugugugcuca

SEQ ID NO: 2163031 - RNA, 20 nt, Homo sapiens
gagugauuagagcugcauaa

SEQ ID NO: 2163032 - RNA, 15 nt, Homo sapiens
uccucugaucuccau

SEQ ID NO: 2163033 - RNA, 16 nt, Homo sapiens
uaacaggauuagacag

SEQ ID NO: 2163034 - RNA, 16 nt, Homo sapiens
gccacuguggccagag

SEQ ID NO: 2163035 - RNA, 21 nt, Homo sapiens
ccacugauggaaacaaagugg

SEQ ID NO: 2163036 - RNA, 22 nt, Homo sapiens
cuuauauaaauguacaguauuc

SEQ ID NO: 2163037 - RNA, 21 nt, Homo sapiens
uuggacagacacuguugcaaa

SEQ ID NO: 2163038 - RNA, 14 nt, Homo sapiens
uggaaucugaugaa

SEQ ID NO: 2163039 - RNA, 17 nt, Homo sapiens
uuuaaucaguucugugu

SEQ ID NO: 2163040 - RNA, 20 nt, Homo sapiens
aguaguccuuggcauagaca

SEQ ID NO: 2163041 - RNA, 15 nt, Homo sapiens
uaauucuuaacagug

SEQ ID NO: 2163042 - RNA, 16 nt, Homo sapiens
cagauccccacugucc

SEQ ID NO: 2163043 - RNA, 13 nt, Homo sapiens
cauuagagugaga

SEQ ID NO: 2163044 - RNA, 17 nt, Homo sapiens
cuugaaccacaguucua

SEQ ID NO: 2163045 - RNA, 19 nt, Homo sapiens
uagguucaggaagaccaca

SEQ ID NO: 2163046 - RNA, 11 nt, Homo sapiens
uauacuguaaa

SEQ ID NO: 2163047 - RNA, 13 nt, Homo sapiens
auggugcaauuug

SEQ ID NO: 2163048 - RNA, 13 nt, Homo sapiens
aaggggcaaauuu

SEQ ID NO: 2163049 - RNA, 22 nt, Homo sapiens
ugccaguauauaagcuguuuag

SEQ ID NO: 2163050 - RNA, 18 nt, Homo sapiens
acuuagccuccucccaaa

SEQ ID NO: 2163051 - RNA, 15 nt, Homo sapiens
acaccuguaguccca

SEQ ID NO: 2163052 - RNA, 17 nt, Homo sapiens
uaucaguugcaauaaua

SEQ ID NO: 2163053 - RNA, 10 nt, Homo sapiens
cccacugcac

SEQ ID NO: 2163054 - RNA, 16 nt, Homo sapiens
gucuccuuaacacuga

SEQ ID NO: 2163055 - RNA, 19 nt, Homo sapiens
ugcaguauuuucaguguca

SEQ ID NO: 2163056 - RNA, 14 nt, Homo sapiens
auguuuacaggggu

SEQ ID NO: 2163057 - RNA, 20 nt, Homo sapiens
cucaagcaccacgcccucca

SEQ ID NO: 2163058 - RNA, 21 nt, Homo sapiens
uauuucuuucuuggagugcca

SEQ ID NO: 2163059 - RNA, 24 nt, Homo sapiens
uaccauaauuuauuuuguccauug

SEQ ID NO: 2163060 - RNA, 21 nt, Homo sapiens
aagacaugcuacaacuacuau

SEQ ID NO: 2163061 - RNA, 21 nt, Homo sapiens
augcccaagagaucugugcca

SEQ ID NO: 2163062 - RNA, 15 nt, Homo sapiens
guagaagcaaaggca

SEQ ID NO: 2163063 - RNA, 22 nt, Homo sapiens
guauguuuuaauugcauuuaaa

SEQ ID NO: 2163064 - RNA, 18 nt, Homo sapiens
ucagaaguuucuucuuua

SEQ ID NO: 2163065 - RNA, 15 nt, Homo sapiens
uuugcugacuuuaaa

SEQ ID NO: 2163066 - RNA, 19 nt, Homo sapiens
uuccaaauuggauacugcu

SEQ ID NO: 2163067 - RNA, 14 nt, Homo sapiens
aagaagucucuuaa

SEQ ID NO: 2163068 - RNA, 16 nt, Homo sapiens
aauuuucccagugaau

SEQ ID NO: 2163069 - RNA, 20 nt, Homo sapiens
uuaaguacugaaauacauau

SEQ ID NO: 2163070 - RNA, 14 nt, Homo sapiens
auuugggcagauau

SEQ ID NO: 2163071 - RNA, 16 nt, Homo sapiens
uuucuuguugcugcau

SEQ ID NO: 2163072 - RNA, 22 nt, Homo sapiens
uccaguuuuauaaaaaguggag

SEQ ID NO: 2163073 - RNA, 14 nt, Homo sapiens
agucagugcacuaa

SEQ ID NO: 2163074 - RNA, 14 nt, Homo sapiens
caccugugaguuua

SEQ ID NO: 2163075 - RNA, 23 nt, Homo sapiens
cauuuaaugauugauuauaucau

SEQ ID NO: 2163076 - RNA, 18 nt, Homo sapiens
uuuaggugauggccaguc

SEQ ID NO: 2163077 - RNA, 23 nt, Homo sapiens
aauucucaugugauccuuuuaug

SEQ ID NO: 2163078 - RNA, 12 nt, Homo sapiens
augguguucucu

SEQ ID NO: 2163079 - RNA, 15 nt, Homo sapiens
uggcuagacuugcca

SEQ ID NO: 2163080 - RNA, 21 nt, Homo sapiens
agcaugcugugauugugccua

SEQ ID NO: 2163081 - RNA, 20 nt, Homo sapiens
acaagcaauuagacaagaac

SEQ ID NO: 2163082 - RNA, 22 nt, Homo sapiens
ggaaugacuggggagggcugca

SEQ ID NO: 2163083 - RNA, 19 nt, Homo sapiens
cuggggagugguuaggcag

SEQ ID NO: 2163084 - RNA, 13 nt, Homo sapiens
caagaggaaaaac

SEQ ID NO: 2163085 - RNA, 22 nt, Homo sapiens
cccaauuucggauuuuuuccaa

SEQ ID NO: 2163086 - RNA, 17 nt, Homo sapiens
ucugcccgggagcucag

SEQ ID NO: 2163087 - RNA, 20 nt, Homo sapiens
gcucucugucaggugugaua

SEQ ID NO: 2163088 - RNA, 12 nt, Homo sapiens
aucagacuauga

SEQ ID NO: 2163089 - RNA, 14 nt, Homo sapiens
gcucaaaaccucca

SEQ ID NO: 2163090 - RNA, 23 nt, Homo sapiens
gauuauuuuaucacuacaagcuu

SEQ ID NO: 2163091 - RNA, 16 nt, Homo sapiens
ucagaucugaacacag

SEQ ID NO: 2163092 - RNA, 17 nt, Homo sapiens
auaugccugcaaucuga

SEQ ID NO: 2163093 - RNA, 20 nt, Homo sapiens
caacacaucucccuuuucca

SEQ ID NO: 2163094 - RNA, 21 nt, Homo sapiens
ccguuggcaccucugugccac

SEQ ID NO: 2163095 - RNA, 16 nt, Homo sapiens
gcccagcuugggccca

SEQ ID NO: 2163096 - RNA, 20 nt, Homo sapiens
gcaaaacuccgucucaaaaa

SEQ ID NO: 2163097 - RNA, 20 nt, Homo sapiens
uccagcaacugcccuuccag

SEQ ID NO: 2163098 - RNA, 18 nt, Homo sapiens
cgauuguuccugaaccga

SEQ ID NO: 2163099 - RNA, 23 nt, Homo sapiens
uuuuaauuuguaaagaaugugcu

SEQ ID NO: 2163100 - RNA, 18 nt, Homo sapiens
auauugccauuucuucca

SEQ ID NO: 2163101 - RNA, 12 nt, Homo sapiens
gcaaacaaguug

SEQ ID NO: 2163102 - RNA, 21 nt, Homo sapiens
gcugggguacacagugagagu

SEQ ID NO: 2163103 - RNA, 19 nt, Homo sapiens
aucugcuucuagugauugu

SEQ ID NO: 2163104 - RNA, 19 nt, Homo sapiens
uacaucuaguuaaucauag

SEQ ID NO: 2163105 - RNA, 20 nt, Homo sapiens
cccauaccacccaaaaucau

SEQ ID NO: 2163106 - RNA, 18 nt, Homo sapiens
caagugaggccauagcaa

SEQ ID NO: 2163107 - RNA, 19 nt, Homo sapiens
uguaugaggagagcuucag

SEQ ID NO: 2163108 - RNA, 16 nt, Homo sapiens
aagggcagaaggggaa

SEQ ID NO: 2163109 - RNA, 16 nt, Homo sapiens
auaaugaaauaaucag

SEQ ID NO: 2163110 - RNA, 16 nt, Homo sapiens
gcuaaccuccaacaca

SEQ ID NO: 2163111 - RNA, 16 nt, Homo sapiens
cagggcagcuuugccc

SEQ ID NO: 2163112 - RNA, 22 nt, Homo sapiens
uagcuuccugcaggacucuauc

SEQ ID NO: 2163113 - RNA, 18 nt, Homo sapiens
acacaaagacauugauuc

SEQ ID NO: 2163114 - RNA, 19 nt, Homo sapiens
uacauuuuaguuacugaag

SEQ ID NO: 2163115 - RNA, 22 nt, Homo sapiens
uucagggaaccguuauuauaau

SEQ ID NO: 2163116 - RNA, 14 nt, Homo sapiens
acauagcaugacau

SEQ ID NO: 2163117 - RNA, 13 nt, Homo sapiens
cauaggugcaguu

SEQ ID NO: 2163118 - RNA, 17 nt, Homo sapiens
cuaagggaggcacuucc

SEQ ID NO: 2163119 - RNA, 16 nt, Homo sapiens
uguaacuauaccucug

SEQ ID NO: 2163120 - RNA, 13 nt, Homo sapiens
auguguuuauuuc

SEQ ID NO: 2163121 - RNA, 16 nt, Homo sapiens
uguuuuuuaacuugca

SEQ ID NO: 2163122 - RNA, 22 nt, Homo sapiens
acuguaauuggugacaauguca

SEQ ID NO: 2163123 - RNA, 18 nt, Homo sapiens
agcaaacgggagaaauuu

SEQ ID NO: 2163124 - RNA, 16 nt, Homo sapiens
guccaaauacucugaa

SEQ ID NO: 2163125 - RNA, 20 nt, Homo sapiens
uugcaacagcuuucugagaa

SEQ ID NO: 2163126 - RNA, 15 nt, Homo sapiens
agugcuugggcucca

SEQ ID NO: 2163127 - RNA, 15 nt, Homo sapiens
gugacaccaccacug

SEQ ID NO: 2163128 - RNA, 20 nt, Homo sapiens
agguauugucuacucugaag

SEQ ID NO: 2163129 - RNA, 19 nt, Homo sapiens
acacagaugcacacacaga

SEQ ID NO: 2163130 - RNA, 15 nt, Homo sapiens
gccaacugcuuggac

SEQ ID NO: 2163131 - RNA, 18 nt, Homo sapiens
uagacuguaaaagauuca

SEQ ID NO: 2163132 - RNA, 15 nt, Homo sapiens
uacaaaugcauuucu

SEQ ID NO: 2163133 - RNA, 20 nt, Homo sapiens
ugacacaucaguuauaucuu

SEQ ID NO: 2163134 - RNA, 16 nt, Homo sapiens
ccgugacccaugcgau

SEQ ID NO: 2163135 - RNA, 13 nt, Homo sapiens
cacacagcugccc

SEQ ID NO: 2163136 - RNA, 23 nt, Homo sapiens
ucccuuuauauuucccugaaaua

SEQ ID NO: 2163137 - RNA, 21 nt, Homo sapiens
uccagaaauguuuuuggcaac

SEQ ID NO: 2163138 - RNA, 21 nt, Homo sapiens
cagcuuuuuauucccugccca

SEQ ID NO: 2163139 - RNA, 22 nt, Homo sapiens
agcugcaggugcccauuagcaa

SEQ ID NO: 2163140 - RNA, 14 nt, Homo sapiens
acauggcacaggcc

SEQ ID NO: 2163141 - RNA, 14 nt, Homo sapiens
aagucccaccaggg

SEQ ID NO: 2163142 - RNA, 14 nt, Homo sapiens
uauguauauacaca

SEQ ID NO: 2163143 - RNA, 24 nt, Homo sapiens
gaggauaugauggucacaugggga

SEQ ID NO: 2163144 - RNA, 19 nt, Homo sapiens
cuugaccucaggugaucca

SEQ ID NO: 2163145 - RNA, 20 nt, Homo sapiens
uguuacagcuuucugugcag

SEQ ID NO: 2163146 - RNA, 13 nt, Homo sapiens
gaaugcagggaag

SEQ ID NO: 2163147 - RNA, 17 nt, Homo sapiens
ucuuaaguaaggacaaa

SEQ ID NO: 2163148 - RNA, 13 nt, Homo sapiens
uccugggagacaa

SEQ ID NO: 2163149 - RNA, 21 nt, Homo sapiens
aucaaguuccaguaacccaaa

SEQ ID NO: 2163150 - RNA, 12 nt, Homo sapiens
cuccugcugcag

SEQ ID NO: 2163151 - RNA, 10 nt, Homo sapiens
ucugccaggc

SEQ ID NO: 2163152 - RNA, 15 nt, Homo sapiens
gaagcagcugcagca

SEQ ID NO: 2163153 - RNA, 17 nt, Homo sapiens
aaacaguuugaaaggga

SEQ ID NO: 2163154 - RNA, 15 nt, Homo sapiens
ucuuuagaacagugc

SEQ ID NO: 2163155 - RNA, 12 nt, Homo sapiens
uaaauccaauau

SEQ ID NO: 2163156 - RNA, 23 nt, Homo sapiens
aaaccuccaaggaccucucucaa

SEQ ID NO: 2163157 - RNA, 15 nt, Homo sapiens
ccauauuguucuuca

SEQ ID NO: 2163158 - RNA, 21 nt, Homo sapiens
gagcuggaaauaaaccuggag

SEQ ID NO: 2163159 - RNA, 18 nt, Homo sapiens
ugacuacugggcaaagag

SEQ ID NO: 2163160 - RNA, 21 nt, Homo sapiens
uauucuugagggacaaugcca

SEQ ID NO: 2163161 - RNA, 19 nt, Homo sapiens
gaguuguugaaagcugaaa

SEQ ID NO: 2163162 - RNA, 18 nt, Homo sapiens
auuguaacaauagcacaa

SEQ ID NO: 2163163 - RNA, 22 nt, Homo sapiens
caagaaagcucacuguagcuuu

SEQ ID NO: 2163164 - RNA, 18 nt, Homo sapiens
accgcugauaagcauuga

SEQ ID NO: 2163165 - RNA, 21 nt, Homo sapiens
agccuccuccaccucaccucc

SEQ ID NO: 2163166 - RNA, 20 nt, Homo sapiens
aauacugccaaaacauuuau

SEQ ID NO: 2163167 - RNA, 22 nt, Homo sapiens
cuaauuccuggcaugacacucu

SEQ ID NO: 2163168 - RNA, 13 nt, Homo sapiens
acccccaucuuua

SEQ ID NO: 2163169 - RNA, 17 nt, Homo sapiens
ucuuauagaaaguucaa

SEQ ID NO: 2163170 - RNA, 23 nt, Homo sapiens
agacugacuuguuugucuuccau

SEQ ID NO: 2163171 - RNA, 18 nt, Homo sapiens
acauacccucccuuugaa

SEQ ID NO: 2163172 - RNA, 23 nt, Homo sapiens
acagccuuucguucugcugacca

SEQ ID NO: 2163173 - RNA, 19 nt, Homo sapiens
augcugcccagccacucca

SEQ ID NO: 2163174 - RNA, 17 nt, Homo sapiens
cucaccuaacaguuacu

SEQ ID NO: 2163175 - RNA, 21 nt, Homo sapiens
acaagaaagaguaacacugag

SEQ ID NO: 2163176 - RNA, 21 nt, Homo sapiens
gcucugaacacacacgccagc

SEQ ID NO: 2163177 - RNA, 15 nt, Homo sapiens
uauucgauguacuuu

SEQ ID NO: 2163178 - RNA, 19 nt, Homo sapiens
aggcugagugagccacaga

SEQ ID NO: 2163179 - RNA, 15 nt, Homo sapiens
uucugucccuuccac

SEQ ID NO: 2163180 - RNA, 13 nt, Homo sapiens
ugcuucagugcag

SEQ ID NO: 2163181 - RNA, 13 nt, Homo sapiens
ugaagcagugauu

SEQ ID NO: 2163182 - RNA, 13 nt, Homo sapiens
aacagcagaacuu

SEQ ID NO: 2163183 - RNA, 18 nt, Homo sapiens
uuccaauaaagcagaguu

SEQ ID NO: 2163184 - RNA, 15 nt, Homo sapiens
caggagagucacuug

SEQ ID NO: 2163185 - RNA, 16 nt, Homo sapiens
cuauucugccauggga

SEQ ID NO: 2163186 - RNA, 16 nt, Homo sapiens
uucaaagaaaacagac

SEQ ID NO: 2163187 - RNA, 18 nt, Homo sapiens
uuccacucgaugaugcuu

SEQ ID NO: 2163188 - RNA, 18 nt, Homo sapiens
aaucaaccaaacaaagaa

SEQ ID NO: 2163189 - RNA, 20 nt, Homo sapiens
ucagcuauaccucauucaca

SEQ ID NO: 2163190 - RNA, 22 nt, Homo sapiens
uuaaguuuguaagacagugccc

SEQ ID NO: 2163191 - RNA, 16 nt, Homo sapiens
uuaacuuauugcauaa

SEQ ID NO: 2163192 - RNA, 19 nt, Homo sapiens
acaacauccuuaagucaaa

SEQ ID NO: 2163193 - RNA, 23 nt, Homo sapiens
ucauguaauacugaaccacuuug

SEQ ID NO: 2163194 - RNA, 17 nt, Homo sapiens
uuuucuccuugccuucg

SEQ ID NO: 2163195 - RNA, 16 nt, Homo sapiens
aaugccggugagaaua

SEQ ID NO: 2163196 - RNA, 19 nt, Homo sapiens
aacugaggccauuauuuca

SEQ ID NO: 2163197 - RNA, 19 nt, Homo sapiens
cccaguguuccauuugaac

SEQ ID NO: 2163198 - RNA, 19 nt, Homo sapiens
aagcaccuaaaugaugccu

SEQ ID NO: 2163199 - RNA, 22 nt, Homo sapiens
caggggcucuuaggcaaucaca

SEQ ID NO: 2163200 - RNA, 12 nt, Homo sapiens
auugaaccacua

SEQ ID NO: 2163201 - RNA, 21 nt, Homo sapiens
agaugguacggacuuccuuua

SEQ ID NO: 2163202 - RNA, 14 nt, Homo sapiens
uuuucauuuguaca

SEQ ID NO: 2163203 - RNA, 15 nt, Homo sapiens
cagaaggcaaagcaa

SEQ ID NO: 2163204 - RNA, 14 nt, Homo sapiens
uagaagccaagaca

SEQ ID NO: 2163205 - RNA, 23 nt, Homo sapiens
acacucuugagucucuuuaccua

SEQ ID NO: 2163206 - RNA, 14 nt, Homo sapiens
agcuuaucucaggg

SEQ ID NO: 2163207 - RNA, 22 nt, Homo sapiens
ucaucuuguaaauaaugcuuaa

SEQ ID NO: 2163208 - RNA, 21 nt, Homo sapiens
acacaugugcugauguuuaca

SEQ ID NO: 2163209 - RNA, 19 nt, Homo sapiens
cagucacuuccacuggugg

SEQ ID NO: 2163210 - RNA, 12 nt, Homo sapiens
cccccugcauuc

SEQ ID NO: 2163211 - RNA, 13 nt, Homo sapiens
guuuccaucugcu

SEQ ID NO: 2163212 - RNA, 14 nt, Homo sapiens
cagugaaaugugaa

SEQ ID NO: 2163213 - RNA, 16 nt, Homo sapiens
aaaaauauauaugcau

SEQ ID NO: 2163214 - RNA, 15 nt, Homo sapiens
ugcagagaugacugu

SEQ ID NO: 2163215 - RNA, 16 nt, Homo sapiens
agcagauaacaaugca

SEQ ID NO: 2163216 - RNA, 13 nt, Homo sapiens
cuacaaugcacau

SEQ ID NO: 2163217 - RNA, 14 nt, Homo sapiens
auuggagccugcaa

SEQ ID NO: 2163218 - RNA, 17 nt, Homo sapiens
aggucaucuaggagcaa

SEQ ID NO: 2163219 - RNA, 21 nt, Homo sapiens
augagcuuuacagcagaagcu

SEQ ID NO: 2163220 - RNA, 17 nt, Homo sapiens
aaugcuauaacuauguu

SEQ ID NO: 2163221 - RNA, 17 nt, Homo sapiens
aauugauguugaugcaa

SEQ ID NO: 2163222 - RNA, 19 nt, Homo sapiens
acauguauucccauugcac

SEQ ID NO: 2163223 - RNA, 21 nt, Homo sapiens
guagaggccuggggccgguag

SEQ ID NO: 2163224 - RNA, 20 nt, Homo sapiens
uggcagaagggaauugcuca

SEQ ID NO: 2163225 - RNA, 18 nt, Homo sapiens
aaugcuccauucaggccu

SEQ ID NO: 2163226 - RNA, 21 nt, Homo sapiens
uuuacaagagaagaaagugaa

SEQ ID NO: 2163227 - RNA, 19 nt, Homo sapiens
ugccacaucccuauccugu

SEQ ID NO: 2163228 - RNA, 13 nt, Homo sapiens
agagccagugaag

SEQ ID NO: 2163229 - RNA, 23 nt, Homo sapiens
uagcccaucccugccuggucaca

SEQ ID NO: 2163230 - RNA, 17 nt, Homo sapiens
uucaaacgaaauggcuc

SEQ ID NO: 2163231 - RNA, 15 nt, Homo sapiens
aaaugcaaauauugc

SEQ ID NO: 2163232 - RNA, 16 nt, Homo sapiens
ugacaauccugaggcu

SEQ ID NO: 2163233 - RNA, 18 nt, Homo sapiens
cuaucauuggccuccaaa

SEQ ID NO: 2163234 - RNA, 20 nt, Homo sapiens
ccauccaggucuugacucau

SEQ ID NO: 2163235 - RNA, 13 nt, Homo sapiens
aagaaucugcucu

SEQ ID NO: 2163236 - RNA, 12 nt, Homo sapiens
ugggaccccaaa

SEQ ID NO: 2163237 - RNA, 19 nt, Homo sapiens
uaaugaaucuaagcagcau

SEQ ID NO: 2163238 - RNA, 20 nt, Homo sapiens
uggcagggaagggugccugg

SEQ ID NO: 2163239 - RNA, 18 nt, Homo sapiens
auaauaaaugcccucuuc

SEQ ID NO: 2163240 - RNA, 19 nt, Homo sapiens
gcauaauuuucuaauuuca

SEQ ID NO: 2163241 - RNA, 21 nt, Homo sapiens
aaauuguacauaaguaccuca

SEQ ID NO: 2163242 - RNA, 21 nt, Homo sapiens
gcauguuuccugcucuucccu

SEQ ID NO: 2163243 - RNA, 20 nt, Homo sapiens
aaggguucagagacucaggg

SEQ ID NO: 2163244 - RNA, 14 nt, Homo sapiens
uuucaaaacuucag

SEQ ID NO: 2163245 - RNA, 15 nt, Homo sapiens
uuugggcaccuuaaa

SEQ ID NO: 2163246 - RNA, 14 nt, Homo sapiens
ugugugaacgugua

SEQ ID NO: 2163247 - RNA, 18 nt, Homo sapiens
cuccccuccggacuggug

SEQ ID NO: 2163248 - RNA, 15 nt, Homo sapiens
agcuugagcucagaa

SEQ ID NO: 2163249 - RNA, 15 nt, Homo sapiens
agcaggggcucuuag

SEQ ID NO: 2163250 - RNA, 15 nt, Homo sapiens
ucugugaaauaucau

SEQ ID NO: 2163251 - RNA, 23 nt, Homo sapiens
ccuuggccaagcugcugcuuuga

SEQ ID NO: 2163252 - RNA, 21 nt, Homo sapiens
gugugcuaaccucacugccuc

SEQ ID NO: 2163253 - RNA, 24 nt, Homo sapiens
ucacagagauuugguuaagcucac

SEQ ID NO: 2163254 - RNA, 23 nt, Homo sapiens
cagagcuuuacagugccacgaca

SEQ ID NO: 2163255 - RNA, 19 nt, Homo sapiens
aggcuaaaacaaaucucag

SEQ ID NO: 2163256 - RNA, 20 nt, Homo sapiens
agauuugagcacaaaggcaa

SEQ ID NO: 2163257 - RNA, 15 nt, Homo sapiens
uuaacaugucacaau

SEQ ID NO: 2163258 - RNA, 23 nt, Homo sapiens
ugcucuuuauuuuaaaaaacacu

SEQ ID NO: 2163259 - RNA, 20 nt, Homo sapiens
agacaggccaugugagccac

SEQ ID NO: 2163260 - RNA, 15 nt, Homo sapiens
uagaagguagugaag

SEQ ID NO: 2163261 - RNA, 15 nt, Homo sapiens
cuuucucuucagugc

SEQ ID NO: 2163262 - RNA, 15 nt, Homo sapiens
aaauuuucuggugcu

SEQ ID NO: 2163263 - RNA, 16 nt, Homo sapiens
aaauuaucugauccuu

SEQ ID NO: 2163264 - RNA, 20 nt, Homo sapiens
uguacuuuuggcaugaaagu

SEQ ID NO: 2163265 - RNA, 13 nt, Homo sapiens
uauacauuuacug

SEQ ID NO: 2163266 - RNA, 14 nt, Homo sapiens
ucaaauauuugcug

SEQ ID NO: 2163267 - RNA, 18 nt, Homo sapiens
cauuagagaaaugaauua

SEQ ID NO: 2163268 - RNA, 23 nt, Homo sapiens
cacuguuaagccauguguuccaa

SEQ ID NO: 2163269 - RNA, 18 nt, Homo sapiens
gcuuaaaaaauacuuuau

SEQ ID NO: 2163270 - RNA, 20 nt, Homo sapiens
cuaaggcucuaugagucuag

SEQ ID NO: 2163271 - RNA, 22 nt, Homo sapiens
auccuguaaaggucaacaauaa

SEQ ID NO: 2163272 - RNA, 20 nt, Homo sapiens
uugugauuccauggauugau

SEQ ID NO: 2163273 - RNA, 16 nt, Homo sapiens
caucagcccaucucaa

SEQ ID NO: 2163274 - RNA, 16 nt, Homo sapiens
ucugaccaucugugac

SEQ ID NO: 2163275 - RNA, 16 nt, Homo sapiens
cagaagaccagaucca

SEQ ID NO: 2163276 - RNA, 15 nt, Homo sapiens
ugggaauaaaucaua

SEQ ID NO: 2163277 - RNA, 22 nt, Homo sapiens
ucugccagcaucugcagccacu

SEQ ID NO: 2163278 - RNA, 21 nt, Homo sapiens
ccagcugggaccuaaugcugg

SEQ ID NO: 2163279 - RNA, 14 nt, Homo sapiens
cucuauuacagcuu

SEQ ID NO: 2163280 - RNA, 13 nt, Homo sapiens
gcagagcauuuaa

SEQ ID NO: 2163281 - RNA, 23 nt, Homo sapiens
augucuaacuuaaauagcuuuga

SEQ ID NO: 2163282 - RNA, 17 nt, Homo sapiens
gcugaaaaaucauccaa

SEQ ID NO: 2163283 - RNA, 18 nt, Homo sapiens
ucagaauugcucaaagaa

SEQ ID NO: 2163284 - RNA, 15 nt, Homo sapiens
acccagauuuccuaa

SEQ ID NO: 2163285 - RNA, 18 nt, Homo sapiens
caucgcucugagcauaug

SEQ ID NO: 2163286 - RNA, 14 nt, Homo sapiens
uuuaaaagacagac

SEQ ID NO: 2163287 - RNA, 22 nt, Homo sapiens
aucaagguggaaauggcccauu

SEQ ID NO: 2163288 - RNA, 20 nt, Homo sapiens
acccaggacuuccauuugcu

SEQ ID NO: 2163289 - RNA, 15 nt, Homo sapiens
caaaaaugaaaucca

SEQ ID NO: 2163290 - RNA, 18 nt, Homo sapiens
gcauggagucuucaggua

SEQ ID NO: 2163291 - RNA, 23 nt, Homo sapiens
cagaaguggagauuucaguucag

SEQ ID NO: 2163292 - RNA, 22 nt, Homo sapiens
acaggcagccagccguggccag

SEQ ID NO: 2163293 - RNA, 13 nt, Homo sapiens
guaaaacagggau

SEQ ID NO: 2163294 - RNA, 22 nt, Homo sapiens
cugauguguacaucccauguaa

SEQ ID NO: 2163295 - RNA, 23 nt, Homo sapiens
ucacugaggcauuuuuacuacua

SEQ ID NO: 2163296 - RNA, 20 nt, Homo sapiens
gaaauugcauauauguauau

SEQ ID NO: 2163297 - RNA, 23 nt, Homo sapiens
ccugggcuuggccugcugugauu

SEQ ID NO: 2163298 - RNA, 22 nt, Homo sapiens
aaauaugcucagccacccugug

SEQ ID NO: 2163299 - RNA, 19 nt, Homo sapiens
aggugcaaagggguugagg

SEQ ID NO: 2163300 - RNA, 20 nt, Homo sapiens
uaccauguggccauuaacaa

SEQ ID NO: 2163301 - RNA, 14 nt, Homo sapiens
aauguauagcugcu

SEQ ID NO: 2163302 - RNA, 20 nt, Homo sapiens
ucuccauuagaaaauuuugu

SEQ ID NO: 2163303 - RNA, 22 nt, Homo sapiens
cauaggacaggaaggaaugcaa

SEQ ID NO: 2163304 - RNA, 15 nt, Homo sapiens
aauaccuuuucucac

SEQ ID NO: 2163305 - RNA, 18 nt, Homo sapiens
gaucccagacccauuccu

SEQ ID NO: 2163306 - RNA, 13 nt, Homo sapiens
gugccagaccuca

SEQ ID NO: 2163307 - RNA, 20 nt, Homo sapiens
aguguuggagaagaacugaa

SEQ ID NO: 2163308 - RNA, 23 nt, Homo sapiens
accuguucacgugacuccucaau

SEQ ID NO: 2163309 - RNA, 20 nt, Homo sapiens
gccaagggaaaggggugcuu

SEQ ID NO: 2163310 - RNA, 22 nt, Homo sapiens
auuucuacuuucagaaacuaaa

SEQ ID NO: 2163311 - RNA, 15 nt, Homo sapiens
aguucaauaauccau

SEQ ID NO: 2163312 - RNA, 11 nt, Homo sapiens
agggaccaagg

SEQ ID NO: 2163313 - RNA, 15 nt, Homo sapiens
acauagcaucucagg

SEQ ID NO: 2163314 - RNA, 14 nt, Homo sapiens
ucaccuuccauguc

SEQ ID NO: 2163315 - RNA, 14 nt, Homo sapiens
uggccccacuuuga

SEQ ID NO: 2163316 - RNA, 19 nt, Homo sapiens
cucgucggaaggacacuca

SEQ ID NO: 2163317 - RNA, 15 nt, Homo sapiens
uacacauacauacau

SEQ ID NO: 2163318 - RNA, 15 nt, Homo sapiens
acagcccucagcaau

SEQ ID NO: 2163319 - RNA, 15 nt, Homo sapiens
caaaagagauuuacu

SEQ ID NO: 2163320 - RNA, 12 nt, Homo sapiens
aaaauacauaua

SEQ ID NO: 2163321 - RNA, 24 nt, Homo sapiens
gccuugggcacaaacaagcacaua

SEQ ID NO: 2163322 - RNA, 17 nt, Homo sapiens
accgaugguugagggau

SEQ ID NO: 2163323 - RNA, 15 nt, Homo sapiens
cagugaucuccauau

SEQ ID NO: 2163324 - RNA, 14 nt, Homo sapiens
agggacuaccucug

SEQ ID NO: 2163325 - RNA, 21 nt, Homo sapiens
acaugcugagucucccaaggc

SEQ ID NO: 2163326 - RNA, 12 nt, Homo sapiens
caagacauuucg

SEQ ID NO: 2163327 - RNA, 15 nt, Homo sapiens
cagagcaucuugcau

SEQ ID NO: 2163328 - RNA, 24 nt, Homo sapiens
agcaucaaucuuguuacugcugau

SEQ ID NO: 2163329 - RNA, 12 nt, Homo sapiens
uuaugucuauau

SEQ ID NO: 2163330 - RNA, 18 nt, Homo sapiens
accugaaauaaaauucau

SEQ ID NO: 2163331 - RNA, 16 nt, Homo sapiens
caucccagucugauau

SEQ ID NO: 2163332 - RNA, 20 nt, Homo sapiens
aaugccagggacauuuucaa

SEQ ID NO: 2163333 - RNA, 14 nt, Homo sapiens
cugaccccaggaag

SEQ ID NO: 2163334 - RNA, 23 nt, Homo sapiens
cugucacaggcauauucccugca

SEQ ID NO: 2163335 - RNA, 23 nt, Homo sapiens
aacaucaacuggggaauugaagc

SEQ ID NO: 2163336 - RNA, 23 nt, Homo sapiens
agaggaaauucccgccuaauaaa

SEQ ID NO: 2163337 - RNA, 18 nt, Homo sapiens
cacuuucccacacuguga

SEQ ID NO: 2163338 - RNA, 16 nt, Homo sapiens
gcacuuugcaucacag

SEQ ID NO: 2163339 - RNA, 18 nt, Homo sapiens
ucccccuuugugcacauu

SEQ ID NO: 2163340 - RNA, 21 nt, Homo sapiens
agauguagcaaauuccaauac

SEQ ID NO: 2163341 - RNA, 19 nt, Homo sapiens
ccgagaaaacaaacccagg

SEQ ID NO: 2163342 - RNA, 19 nt, Homo sapiens
agucuuccucccuguguau

SEQ ID NO: 2163343 - RNA, 22 nt, Homo sapiens
auugacacagaaaauguugaga

SEQ ID NO: 2163344 - RNA, 15 nt, Homo sapiens
uagagguuugucaac

SEQ ID NO: 2163345 - RNA, 18 nt, Homo sapiens
cccagguacccaugaaug

SEQ ID NO: 2163346 - RNA, 16 nt, Homo sapiens
auguaguugauguauc

SEQ ID NO: 2163347 - RNA, 14 nt, Homo sapiens
aaauuacuguguaa

SEQ ID NO: 2163348 - RNA, 20 nt, Homo sapiens
uuaauaccugaccucacaga

SEQ ID NO: 2163349 - RNA, 17 nt, Homo sapiens
gguccuaaagaugcuga

SEQ ID NO: 2163350 - RNA, 23 nt, Homo sapiens
aucucuugccugcuccaucucau

SEQ ID NO: 2163351 - RNA, 23 nt, Homo sapiens
ccugcgaaguggcucucaggggc

SEQ ID NO: 2163352 - RNA, 19 nt, Homo sapiens
cauuagugaauuauggaau

SEQ ID NO: 2163353 - RNA, 21 nt, Homo sapiens
aucuucuguugcucucugugu

SEQ ID NO: 2163354 - RNA, 21 nt, Homo sapiens
cggccugcaccgaccccgggc

SEQ ID NO: 2163355 - RNA, 17 nt, Homo sapiens
caaaauuuaugucauuu

SEQ ID NO: 2163356 - RNA, 18 nt, Homo sapiens
cccauaaucauguaaaug

SEQ ID NO: 2163357 - RNA, 20 nt, Homo sapiens
cagagcagagaggcugaaua

SEQ ID NO: 2163358 - RNA, 23 nt, Homo sapiens
ggaaaaaaaauaauguaaggguc

SEQ ID NO: 2163359 - RNA, 23 nt, Homo sapiens
aggaagguucauugccauuguca

SEQ ID NO: 2163360 - RNA, 12 nt, Homo sapiens
auagucacagga

SEQ ID NO: 2163361 - RNA, 16 nt, Homo sapiens
cuugaacugggcucaa

SEQ ID NO: 2163362 - RNA, 13 nt, Homo sapiens
uuauccuguucua

SEQ ID NO: 2163363 - RNA, 20 nt, Homo sapiens
ggggugucugucuuccuuug

SEQ ID NO: 2163364 - RNA, 13 nt, Homo sapiens
aauucaguucuga

SEQ ID NO: 2163365 - RNA, 18 nt, Homo sapiens
uguucaaagugugacauu

SEQ ID NO: 2163366 - RNA, 19 nt, Homo sapiens
aagacuuuggaaagacuuu

SEQ ID NO: 2163367 - RNA, 14 nt, Homo sapiens
gcaggcauuugcua

SEQ ID NO: 2163368 - RNA, 19 nt, Homo sapiens
ugggguccaggucaccagc

SEQ ID NO: 2163369 - RNA, 16 nt, Homo sapiens
uaagcuggagugcagu

SEQ ID NO: 2163370 - RNA, 23 nt, Homo sapiens
acauguuaggaagguacugucau

SEQ ID NO: 2163371 - RNA, 16 nt, Homo sapiens
uccgucaccucagaga

SEQ ID NO: 2163372 - RNA, 14 nt, Homo sapiens
ugggagacuuugaa

SEQ ID NO: 2163373 - RNA, 13 nt, Homo sapiens
auuauacaucaau

SEQ ID NO: 2163374 - RNA, 20 nt, Homo sapiens
cccagauccaggaacacaug

SEQ ID NO: 2163375 - RNA, 22 nt, Homo sapiens
gcuuugguggccagggaggcag

SEQ ID NO: 2163376 - RNA, 20 nt, Homo sapiens
ggaugauacgaaugauguca

SEQ ID NO: 2163377 - RNA, 17 nt, Homo sapiens
cccuuacccucccacca

SEQ ID NO: 2163378 - RNA, 19 nt, Homo sapiens
uaacucaaaggguggaaua

SEQ ID NO: 2163379 - RNA, 16 nt, Homo sapiens
ggacagaagcagcucu

SEQ ID NO: 2163380 - RNA, 19 nt, Homo sapiens
caucauugugacgugugug

SEQ ID NO: 2163381 - RNA, 14 nt, Homo sapiens
gccacccugcauuu

SEQ ID NO: 2163382 - RNA, 13 nt, Homo sapiens
cugggaaggccag

SEQ ID NO: 2163383 - RNA, 18 nt, Homo sapiens
auaaaguuguugcauucc

SEQ ID NO: 2163384 - RNA, 17 nt, Homo sapiens
aaacauauguauacaaa

SEQ ID NO: 2163385 - RNA, 13 nt, Homo sapiens
ucucccaucucuu

SEQ ID NO: 2163386 - RNA, 23 nt, Homo sapiens
agagucacuggaacacuaaugag

SEQ ID NO: 2163387 - RNA, 14 nt, Homo sapiens
uuuauuccauauuc

SEQ ID NO: 2163388 - RNA, 17 nt, Homo sapiens
gagaccuggaaccagag

SEQ ID NO: 2163389 - RNA, 13 nt, Homo sapiens
agcaggcauuugc

SEQ ID NO: 2163390 - RNA, 13 nt, Homo sapiens
uaaagucuugccu

SEQ ID NO: 2163391 - RNA, 18 nt, Homo sapiens
uuugaaacaaaguacucu

SEQ ID NO: 2163392 - RNA, 23 nt, Homo sapiens
ccccuacacacacccaggcccau

SEQ ID NO: 2163393 - RNA, 14 nt, Homo sapiens
ucuugcauucauuu

SEQ ID NO: 2163394 - RNA, 15 nt, Homo sapiens
uauuuuuauuugaua

SEQ ID NO: 2163395 - RNA, 18 nt, Homo sapiens
gaacaagcaauuacaaua

SEQ ID NO: 2163396 - RNA, 19 nt, Homo sapiens
auggugagcugaguucaug

SEQ ID NO: 2163397 - RNA, 14 nt, Homo sapiens
cuggcugugacaau

SEQ ID NO: 2163398 - RNA, 15 nt, Homo sapiens
gggcuggcaccagca

SEQ ID NO: 2163399 - RNA, 15 nt, Homo sapiens
uauuuauacuuugca

SEQ ID NO: 2163400 - RNA, 13 nt, Homo sapiens
gaucaauuguuaa

SEQ ID NO: 2163401 - RNA, 12 nt, Homo sapiens
caguccuacuca

SEQ ID NO: 2163402 - RNA, 15 nt, Homo sapiens
cccugacgugcagcc

SEQ ID NO: 2163403 - RNA, 20 nt, Homo sapiens
aguaauagauuguuuugcca

SEQ ID NO: 2163404 - RNA, 19 nt, Homo sapiens
uaccucuagaaucccagca

SEQ ID NO: 2163405 - RNA, 21 nt, Homo sapiens
accucugcucugaggcuucca

SEQ ID NO: 2163406 - RNA, 14 nt, Homo sapiens
cugucauuccauga

SEQ ID NO: 2163407 - RNA, 22 nt, Homo sapiens
ugggcagggguuccagcuuccc

SEQ ID NO: 2163408 - RNA, 20 nt, Homo sapiens
caacuuauuaacaauuaggc

SEQ ID NO: 2163409 - RNA, 18 nt, Homo sapiens
cuggucucaaacucccca

SEQ ID NO: 2163410 - RNA, 18 nt, Homo sapiens
ccagagcccugcagucac

SEQ ID NO: 2163411 - RNA, 15 nt, Homo sapiens
uucgucaucuucccu

SEQ ID NO: 2163412 - RNA, 18 nt, Homo sapiens
cccugaguggaucuccaa

SEQ ID NO: 2163413 - RNA, 14 nt, Homo sapiens
ggagguaugaauua

SEQ ID NO: 2163414 - RNA, 14 nt, Homo sapiens
guaauaaaucugag

SEQ ID NO: 2163415 - RNA, 12 nt, Homo sapiens
uagcaacaugcu

SEQ ID NO: 2163416 - RNA, 16 nt, Homo sapiens
ucuuccagguacugau

SEQ ID NO: 2163417 - RNA, 17 nt, Homo sapiens
cuugccucucucaggag

SEQ ID NO: 2163418 - RNA, 16 nt, Homo sapiens
ugccacaacagaauaa

SEQ ID NO: 2163419 - RNA, 19 nt, Homo sapiens
gauuggccggcuaguguuu

SEQ ID NO: 2163420 - RNA, 16 nt, Homo sapiens
cuaagauucuaaaggu

SEQ ID NO: 2163421 - RNA, 16 nt, Homo sapiens
gagaccucaagcccug

SEQ ID NO: 2163422 - RNA, 21 nt, Homo sapiens
uuccugaaauauaaacuguag

SEQ ID NO: 2163423 - RNA, 21 nt, Homo sapiens
ccugcgcagucauuggcccaa

SEQ ID NO: 2163424 - RNA, 16 nt, Homo sapiens
cuugauauaauaauua

SEQ ID NO: 2163425 - RNA, 22 nt, Homo sapiens
ggaacauguacuguuacugugu

SEQ ID NO: 2163426 - RNA, 20 nt, Homo sapiens
auaguagauuuuaaagacaa

SEQ ID NO: 2163427 - RNA, 20 nt, Homo sapiens
agggcaguaucucucugccu

SEQ ID NO: 2163428 - RNA, 13 nt, Homo sapiens
agggcugccugaa

SEQ ID NO: 2163429 - RNA, 11 nt, Homo sapiens
gaacucaggga

SEQ ID NO: 2163430 - RNA, 19 nt, Homo sapiens
caauugacucucacacuga

SEQ ID NO: 2163431 - RNA, 21 nt, Homo sapiens
ucauuucauacaaauuuuccc

SEQ ID NO: 2163432 - RNA, 16 nt, Homo sapiens
auucauuccaugucca

SEQ ID NO: 2163433 - RNA, 10 nt, Homo sapiens
gugcauuuag

SEQ ID NO: 2163434 - RNA, 13 nt, Homo sapiens
uaugcaauucuua

SEQ ID NO: 2163435 - RNA, 12 nt, Homo sapiens
acagggcuucuc

SEQ ID NO: 2163436 - RNA, 15 nt, Homo sapiens
aauucuuucacuuga

SEQ ID NO: 2163437 - RNA, 13 nt, Homo sapiens
auguguaagacaa

SEQ ID NO: 2163438 - RNA, 15 nt, Homo sapiens
uagcaaauguuuacu

SEQ ID NO: 2163439 - RNA, 14 nt, Homo sapiens
uuggacagcugcuu

SEQ ID NO: 2163440 - RNA, 18 nt, Homo sapiens
aguuucaaaugaguuuaa

SEQ ID NO: 2163441 - RNA, 17 nt, Homo sapiens
uaauguauaccagccua

SEQ ID NO: 2163442 - RNA, 15 nt, Homo sapiens
aucuggacacugggc

SEQ ID NO: 2163443 - RNA, 22 nt, Homo sapiens
aauauugcuccaugaugacuua

SEQ ID NO: 2163444 - RNA, 14 nt, Homo sapiens
uaacugcacaaaca

SEQ ID NO: 2163445 - RNA, 21 nt, Homo sapiens
auuccaaauauguaugcaccu

SEQ ID NO: 2163446 - RNA, 20 nt, Homo sapiens
aaugaucaaguccuuuguga

SEQ ID NO: 2163447 - RNA, 22 nt, Homo sapiens
ugugcuccuccuacccuuccag

SEQ ID NO: 2163448 - RNA, 18 nt, Homo sapiens
uggaaugcacagggcaau

SEQ ID NO: 2163449 - RNA, 15 nt, Homo sapiens
guaucagaggccuau

SEQ ID NO: 2163450 - RNA, 17 nt, Homo sapiens
ggcaccuguaaucccag

SEQ ID NO: 2163451 - RNA, 16 nt, Homo sapiens
aaacacagacauucug

SEQ ID NO: 2163452 - RNA, 18 nt, Homo sapiens
cuucuuuuggacaaaccu

SEQ ID NO: 2163453 - RNA, 15 nt, Homo sapiens
uucacaauauccuau

SEQ ID NO: 2163454 - RNA, 15 nt, Homo sapiens
cacuguauguuuacu

SEQ ID NO: 2163455 - RNA, 22 nt, Homo sapiens
guuugacauuuaauaacuuugc

SEQ ID NO: 2163456 - RNA, 16 nt, Homo sapiens
cugugaucuaagcagu

SEQ ID NO: 2163457 - RNA, 15 nt, Homo sapiens
auguuucaaauacuu

SEQ ID NO: 2163458 - RNA, 14 nt, Homo sapiens
acaagaaaucugac

SEQ ID NO: 2163459 - RNA, 14 nt, Homo sapiens
aagaugaugcuccu

SEQ ID NO: 2163460 - RNA, 18 nt, Homo sapiens
gcuguccugaucugugau

SEQ ID NO: 2163461 - RNA, 19 nt, Homo sapiens
acagugccucuuccaguga

SEQ ID NO: 2163462 - RNA, 18 nt, Homo sapiens
gccauuucggaagacacc

SEQ ID NO: 2163463 - RNA, 17 nt, Homo sapiens
acuacagcuauaccuca

SEQ ID NO: 2163464 - RNA, 21 nt, Homo sapiens
uagcaaccuccacauguucaa

SEQ ID NO: 2163465 - RNA, 17 nt, Homo sapiens
caguuacaguugauguu

SEQ ID NO: 2163466 - RNA, 11 nt, Homo sapiens
gcugcugcuac

SEQ ID NO: 2163467 - RNA, 21 nt, Homo sapiens
ugaccaaaaccagagggcagu

SEQ ID NO: 2163468 - RNA, 17 nt, Homo sapiens
agaaauugacagaucaa

SEQ ID NO: 2163469 - RNA, 15 nt, Homo sapiens
ggaggcccaaugagg

SEQ ID NO: 2163470 - RNA, 23 nt, Homo sapiens
gcuauuucagcaacaaccaucuc

SEQ ID NO: 2163471 - RNA, 22 nt, Homo sapiens
ggcaacuucaguccugggagac

SEQ ID NO: 2163472 - RNA, 21 nt, Homo sapiens
uggcuuaugccccugcacuga

SEQ ID NO: 2163473 - RNA, 16 nt, Homo sapiens
ucucgggugcauuuga

SEQ ID NO: 2163474 - RNA, 14 nt, Homo sapiens
cuguguccauguga

SEQ ID NO: 2163475 - RNA, 22 nt, Homo sapiens
acuuuaucuauaucucauuuca

SEQ ID NO: 2163476 - RNA, 13 nt, Homo sapiens
cugggcccagaag

SEQ ID NO: 2163477 - RNA, 18 nt, Homo sapiens
ugaugugcucaucagaaa

SEQ ID NO: 2163478 - RNA, 15 nt, Homo sapiens
uagaaaaugguccaa

SEQ ID NO: 2163479 - RNA, 21 nt, Homo sapiens
gcauuggguggcaacauuugg

SEQ ID NO: 2163480 - RNA, 21 nt, Homo sapiens
ugcuccauggcugccaucuca

SEQ ID NO: 2163481 - RNA, 17 nt, Homo sapiens
cgagaccccaucuucca

SEQ ID NO: 2163482 - RNA, 10 nt, Homo sapiens
ucaugaaauu

SEQ ID NO: 2163483 - RNA, 15 nt, Homo sapiens
cagcaggccagagaa

SEQ ID NO: 2163484 - RNA, 16 nt, Homo sapiens
gccaaggcucacaugc

SEQ ID NO: 2163485 - RNA, 15 nt, Homo sapiens
cuggaggagcccagg

SEQ ID NO: 2163486 - RNA, 14 nt, Homo sapiens
auuugacuguucaa

SEQ ID NO: 2163487 - RNA, 18 nt, Homo sapiens
aacagccccaaagucaau

SEQ ID NO: 2163488 - RNA, 20 nt, Homo sapiens
gcuccccagugcuaccucuc

SEQ ID NO: 2163489 - RNA, 20 nt, Homo sapiens
uugaggcuuaaacaagccaa

SEQ ID NO: 2163490 - RNA, 19 nt, Homo sapiens
caggcaugagucagucuga

SEQ ID NO: 2163491 - RNA, 13 nt, Homo sapiens
cuugcaagcaaau

SEQ ID NO: 2163492 - RNA, 22 nt, Homo sapiens
gaagucuucauggucucuucca

SEQ ID NO: 2163493 - RNA, 16 nt, Homo sapiens
agguguugccauuucu

SEQ ID NO: 2163494 - RNA, 14 nt, Homo sapiens
agaggaacugucca

SEQ ID NO: 2163495 - RNA, 19 nt, Homo sapiens
cugcuuaacccauggaucc

SEQ ID NO: 2163496 - RNA, 19 nt, Homo sapiens
gaccccaugguccaucccc

SEQ ID NO: 2163497 - RNA, 17 nt, Homo sapiens
aacuuuucaccaaugag

SEQ ID NO: 2163498 - RNA, 13 nt, Homo sapiens
cacguguggaccc

SEQ ID NO: 2163499 - RNA, 18 nt, Homo sapiens
auaaauuuuacaguagaa

SEQ ID NO: 2163500 - RNA, 17 nt, Homo sapiens
agggugccccugggaac

SEQ ID NO: 2163501 - RNA, 13 nt, Homo sapiens
cagacagcuauuu

SEQ ID NO: 2163502 - RNA, 22 nt, Homo sapiens
uguuccaaaagaguccaugugg

SEQ ID NO: 2163503 - RNA, 17 nt, Homo sapiens
uguucuggguccauaca

SEQ ID NO: 2163504 - RNA, 18 nt, Homo sapiens
augcugagcaaaguucag

SEQ ID NO: 2163505 - RNA, 17 nt, Homo sapiens
accacaggaugcauauu

SEQ ID NO: 2163506 - RNA, 17 nt, Homo sapiens
ucaggguagcugaagga

SEQ ID NO: 2163507 - RNA, 14 nt, Homo sapiens
aaucaccucucugu

SEQ ID NO: 2163508 - RNA, 19 nt, Homo sapiens
cuagucucuucucagagca

SEQ ID NO: 2163509 - RNA, 21 nt, Homo sapiens
ccuauggaauguaaagugcaa

SEQ ID NO: 2163510 - RNA, 13 nt, Homo sapiens
uuugucuugaaug

SEQ ID NO: 2163511 - RNA, 20 nt, Homo sapiens
cuuaaauguuuauacuguau

SEQ ID NO: 2163512 - RNA, 13 nt, Homo sapiens
ugguuccacagaa

SEQ ID NO: 2163513 - RNA, 17 nt, Homo sapiens
cccugccucacaucucc

SEQ ID NO: 2163514 - RNA, 22 nt, Homo sapiens
cuuaagaugcaaaucaacucuc

SEQ ID NO: 2163515 - RNA, 21 nt, Homo sapiens
acccagauugaagcuaaaaua

SEQ ID NO: 2163516 - RNA, 11 nt, Homo sapiens
uuacugugauc

SEQ ID NO: 2163517 - RNA, 12 nt, Homo sapiens
aaagccuuucag

SEQ ID NO: 2163518 - RNA, 15 nt, Homo sapiens
aagaagucaucuccu

SEQ ID NO: 2163519 - RNA, 14 nt, Homo sapiens
caaguucaauccua

SEQ ID NO: 2163520 - RNA, 20 nt, Homo sapiens
caaguuucugauaccacugc

SEQ ID NO: 2163521 - RNA, 18 nt, Homo sapiens
aacugagauuacaggcac

SEQ ID NO: 2163522 - RNA, 20 nt, Homo sapiens
gccauggggaaguccugggu

SEQ ID NO: 2163523 - RNA, 18 nt, Homo sapiens
auuuaagaaugacaggcu

SEQ ID NO: 2163524 - RNA, 21 nt, Homo sapiens
ucauagucauugugguuuaga

SEQ ID NO: 2163525 - RNA, 17 nt, Homo sapiens
uugcuacucuugcugca

SEQ ID NO: 2163526 - RNA, 17 nt, Homo sapiens
uucuuuccuucuuucau

SEQ ID NO: 2163527 - RNA, 14 nt, Homo sapiens
gagccugcagauga

SEQ ID NO: 2163528 - RNA, 12 nt, Homo sapiens
aggcccugagaa

SEQ ID NO: 2163529 - RNA, 15 nt, Homo sapiens
uaaauggggagacaa

SEQ ID NO: 2163530 - RNA, 17 nt, Homo sapiens
auaguuuguuauauccu

SEQ ID NO: 2163531 - RNA, 17 nt, Homo sapiens
caaaauuuaugcaaauc

SEQ ID NO: 2163532 - RNA, 15 nt, Homo sapiens
uggcacugccaugca

SEQ ID NO: 2163533 - RNA, 18 nt, Homo sapiens
gaccccgacaccggccag

SEQ ID NO: 2163534 - RNA, 12 nt, Homo sapiens
gagcaugcagcg

SEQ ID NO: 2163535 - RNA, 21 nt, Homo sapiens
auuuuaguguguaaaauuaau

SEQ ID NO: 2163536 - RNA, 14 nt, Homo sapiens
ugugcucacugggg

SEQ ID NO: 2163537 - RNA, 12 nt, Homo sapiens
gcaaaccuuccu

SEQ ID NO: 2163538 - RNA, 22 nt, Homo sapiens
ucuucaccuuaggaauaaucuc

SEQ ID NO: 2163539 - RNA, 19 nt, Homo sapiens
ugcuguacugagcacugaa

SEQ ID NO: 2163540 - RNA, 14 nt, Homo sapiens
ucuacagacuccaa

SEQ ID NO: 2163541 - RNA, 15 nt, Homo sapiens
acaagcuuacaaaga

SEQ ID NO: 2163542 - RNA, 15 nt, Homo sapiens
ccaggguuccagaca

SEQ ID NO: 2163543 - RNA, 18 nt, Homo sapiens
acccugcaauaaacugcu

SEQ ID NO: 2163544 - RNA, 21 nt, Homo sapiens
uauuucauaccuguacacacu

SEQ ID NO: 2163545 - RNA, 17 nt, Homo sapiens
accucuuuuucuuacca

SEQ ID NO: 2163546 - RNA, 23 nt, Homo sapiens
acaggacauggggcuccuggaaa

SEQ ID NO: 2163547 - RNA, 15 nt, Homo sapiens
agcaugaaccuuuag

SEQ ID NO: 2163548 - RNA, 17 nt, Homo sapiens
ccucgcaaaaugaugug

SEQ ID NO: 2163549 - RNA, 18 nt, Homo sapiens
acacgccacaacuccagu

SEQ ID NO: 2163550 - RNA, 19 nt, Homo sapiens
uuuacuagugugcaagugu

SEQ ID NO: 2163551 - RNA, 16 nt, Homo sapiens
gucccgggcacuguca

SEQ ID NO: 2163552 - RNA, 21 nt, Homo sapiens
agaauguuacugacuccucag

SEQ ID NO: 2163553 - RNA, 22 nt, Homo sapiens
cugaacuaaucgagcacuucuc

SEQ ID NO: 2163554 - RNA, 14 nt, Homo sapiens
caaggugaguguga

SEQ ID NO: 2163555 - RNA, 20 nt, Homo sapiens
ccaauuuucuucaucuuugc

SEQ ID NO: 2163556 - RNA, 21 nt, Homo sapiens
gcuuguuuuuucuccuggacu

SEQ ID NO: 2163557 - RNA, 20 nt, Homo sapiens
aguggcacgaucucgacuca

SEQ ID NO: 2163558 - RNA, 19 nt, Homo sapiens
agaguaucagaucuaucuu

SEQ ID NO: 2163559 - RNA, 21 nt, Homo sapiens
ccaacauaaaacaaaaccaag

SEQ ID NO: 2163560 - RNA, 15 nt, Homo sapiens
gcaaugaaagucaaa

SEQ ID NO: 2163561 - RNA, 19 nt, Homo sapiens
acaugaauuucauugaacu

SEQ ID NO: 2163562 - RNA, 13 nt, Homo sapiens
acaugaacugcca

SEQ ID NO: 2163563 - RNA, 19 nt, Homo sapiens
caguaaacgggaacaugcc

SEQ ID NO: 2163564 - RNA, 15 nt, Homo sapiens
uguccauucaucuca

SEQ ID NO: 2163565 - RNA, 15 nt, Homo sapiens
cacuccuuugcuuaa

SEQ ID NO: 2163566 - RNA, 21 nt, Homo sapiens
ccaaguucuuaguugcuguau

SEQ ID NO: 2163567 - RNA, 13 nt, Homo sapiens
ugccauaucagug

SEQ ID NO: 2163568 - RNA, 19 nt, Homo sapiens
ugaaaggcagggcaagaac

SEQ ID NO: 2163569 - RNA, 21 nt, Homo sapiens
gcugacaucuccucuaucaca

SEQ ID NO: 2163570 - RNA, 24 nt, Homo sapiens
guauuacccuccuaauagucauac

SEQ ID NO: 2163571 - RNA, 14 nt, Homo sapiens
gagacagauaccuc

SEQ ID NO: 2163572 - RNA, 22 nt, Homo sapiens
auucugucacccagacuggagu

SEQ ID NO: 2163573 - RNA, 19 nt, Homo sapiens
caaagaggauugagauaac

SEQ ID NO: 2163574 - RNA, 15 nt, Homo sapiens
aacaauugucuuaaa

SEQ ID NO: 2163575 - RNA, 14 nt, Homo sapiens
aauuuagggagaaa

SEQ ID NO: 2163576 - RNA, 15 nt, Homo sapiens
uuagucuugucucag

SEQ ID NO: 2163577 - RNA, 21 nt, Homo sapiens
cucccauccuugaugcaagug

SEQ ID NO: 2163578 - RNA, 15 nt, Homo sapiens
ucagccagcccugga

SEQ ID NO: 2163579 - RNA, 16 nt, Homo sapiens
aacuucuggugugaua

SEQ ID NO: 2163580 - RNA, 17 nt, Homo sapiens
aucuuacagagacucuc

SEQ ID NO: 2163581 - RNA, 16 nt, Homo sapiens
cacuuuuuuucuauau

SEQ ID NO: 2163582 - RNA, 15 nt, Homo sapiens
gcugucgcaucucag

SEQ ID NO: 2163583 - RNA, 17 nt, Homo sapiens
aagggauaguccaaaga

SEQ ID NO: 2163584 - RNA, 14 nt, Homo sapiens
agggagcuggaaaa

SEQ ID NO: 2163585 - RNA, 22 nt, Homo sapiens
cuuuuagggaauaauauucaau

SEQ ID NO: 2163586 - RNA, 14 nt, Homo sapiens
aagcauagugaaca

SEQ ID NO: 2163587 - RNA, 12 nt, Homo sapiens
augcugagacau

SEQ ID NO: 2163588 - RNA, 12 nt, Homo sapiens
agagaucuccaa

SEQ ID NO: 2163589 - RNA, 19 nt, Homo sapiens
ugccccuugcaagccauaa

SEQ ID NO: 2163590 - RNA, 13 nt, Homo sapiens
uauuuucccaugc

SEQ ID NO: 2163591 - RNA, 14 nt, Homo sapiens
ccagaaggugcagg

SEQ ID NO: 2163592 - RNA, 17 nt, Homo sapiens
ccccucagagacugaaa

SEQ ID NO: 2163593 - RNA, 22 nt, Homo sapiens
uagagaugagguuucaccauga

SEQ ID NO: 2163594 - RNA, 19 nt, Homo sapiens
aguccuugggcaguucuca

SEQ ID NO: 2163595 - RNA, 22 nt, Homo sapiens
uacggccaugagacugaucccu

SEQ ID NO: 2163596 - RNA, 16 nt, Homo sapiens
agcuggcucugugagg

SEQ ID NO: 2163597 - RNA, 19 nt, Homo sapiens
cccuguugccuugagcucu

SEQ ID NO: 2163598 - RNA, 20 nt, Homo sapiens
ugcacuugacaccaaccaga

SEQ ID NO: 2163599 - RNA, 15 nt, Homo sapiens
auucccauuggcucc

SEQ ID NO: 2163600 - RNA, 12 nt, Homo sapiens
agguuaacauua

SEQ ID NO: 2163601 - RNA, 22 nt, Homo sapiens
uucccaacuccagaaagugaca

SEQ ID NO: 2163602 - RNA, 18 nt, Homo sapiens
gagcagagcgggacucug

SEQ ID NO: 2163603 - RNA, 22 nt, Homo sapiens
agcuuuuguaaaauaaaaccac

SEQ ID NO: 2163604 - RNA, 19 nt, Homo sapiens
acaucagcaaacaggauca

SEQ ID NO: 2163605 - RNA, 13 nt, Homo sapiens
uuuuacacaggaa

SEQ ID NO: 2163606 - RNA, 13 nt, Homo sapiens
uguaucucaggaa

SEQ ID NO: 2163607 - RNA, 14 nt, Homo sapiens
guuguagaagacaa

SEQ ID NO: 2163608 - RNA, 14 nt, Homo sapiens
ccacgaggugaaaa

SEQ ID NO: 2163609 - RNA, 14 nt, Homo sapiens
ugguagacugugac

SEQ ID NO: 2163610 - RNA, 20 nt, Homo sapiens
gauuuuuuaaauugucauaa

SEQ ID NO: 2163611 - RNA, 22 nt, Homo sapiens
gacugcuggcaugcagugcccu

SEQ ID NO: 2163612 - RNA, 21 nt, Homo sapiens
ccugaacccagaaacaacaca

SEQ ID NO: 2163613 - RNA, 19 nt, Homo sapiens
aauaaaucugacccagugc

SEQ ID NO: 2163614 - RNA, 23 nt, Homo sapiens
caaaauccuucuccagaccccag

SEQ ID NO: 2163615 - RNA, 18 nt, Homo sapiens
guuauguguuuagaauca

SEQ ID NO: 2163616 - RNA, 20 nt, Homo sapiens
uuccagcugacaucuugcac

SEQ ID NO: 2163617 - RNA, 14 nt, Homo sapiens
uccuguguccugaa

SEQ ID NO: 2163618 - RNA, 23 nt, Homo sapiens
acagaaucuccauuucugcucag

SEQ ID NO: 2163619 - RNA, 19 nt, Homo sapiens
aucccauugcaaacauuau

SEQ ID NO: 2163620 - RNA, 15 nt, Homo sapiens
ugaagaaucugcucu

SEQ ID NO: 2163621 - RNA, 18 nt, Homo sapiens
gggaaaaggcaggugcuu

SEQ ID NO: 2163622 - RNA, 15 nt, Homo sapiens
gaaaugaaugcugau

SEQ ID NO: 2163623 - RNA, 15 nt, Homo sapiens
uaaacauuaaugaca

SEQ ID NO: 2163624 - RNA, 17 nt, Homo sapiens
agggucuccacacugcu

SEQ ID NO: 2163625 - RNA, 20 nt, Homo sapiens
uucugggugcgagugugaga

SEQ ID NO: 2163626 - RNA, 17 nt, Homo sapiens
aucauucaaguguaaaa

SEQ ID NO: 2163627 - RNA, 17 nt, Homo sapiens
aagauuauuuuuuauga

SEQ ID NO: 2163628 - RNA, 22 nt, Homo sapiens
guuaauguuugcauuuccucag

SEQ ID NO: 2163629 - RNA, 22 nt, Homo sapiens
cuuauagcacuuugaaauaccu

SEQ ID NO: 2163630 - RNA, 15 nt, Homo sapiens
aggcuucacccugaa

SEQ ID NO: 2163631 - RNA, 14 nt, Homo sapiens
cucucucugagggg

SEQ ID NO: 2163632 - RNA, 14 nt, Homo sapiens
cuuuucauugcaaa

SEQ ID NO: 2163633 - RNA, 23 nt, Homo sapiens
aaugauuucacagugugugguca

SEQ ID NO: 2163634 - RNA, 15 nt, Homo sapiens
aaacucauuggcuua

SEQ ID NO: 2163635 - RNA, 14 nt, Homo sapiens
aaauguuggugcaa

SEQ ID NO: 2163636 - RNA, 13 nt, Homo sapiens
guuucacaguggg

SEQ ID NO: 2163637 - RNA, 16 nt, Homo sapiens
gcaugacacuuccaaa

SEQ ID NO: 2163638 - RNA, 14 nt, Homo sapiens
ugcuguaugcugau

SEQ ID NO: 2163639 - RNA, 14 nt, Homo sapiens
uuauuacucugaua

SEQ ID NO: 2163640 - RNA, 15 nt, Homo sapiens
uacaagaguuucaaa

SEQ ID NO: 2163641 - RNA, 15 nt, Homo sapiens
ucaauuuugacuuaa

SEQ ID NO: 2163642 - RNA, 20 nt, Homo sapiens
gccuguaauccuagcacuuu

SEQ ID NO: 2163643 - RNA, 15 nt, Homo sapiens
uugagaccauuucaa

SEQ ID NO: 2163644 - RNA, 21 nt, Homo sapiens
ucaagucuacccugaucaccu

SEQ ID NO: 2163645 - RNA, 13 nt, Homo sapiens
acagauaccucuc

SEQ ID NO: 2163646 - RNA, 19 nt, Homo sapiens
ucaaauuuagaaacuaauu

SEQ ID NO: 2163647 - RNA, 16 nt, Homo sapiens
aauauaaacugugaga

SEQ ID NO: 2163648 - RNA, 15 nt, Homo sapiens
aaccaugagaauuug

SEQ ID NO: 2163649 - RNA, 17 nt, Homo sapiens
aaauauggacuuccaau

SEQ ID NO: 2163650 - RNA, 15 nt, Homo sapiens
gaacuuaacacuccc

SEQ ID NO: 2163651 - RNA, 20 nt, Homo sapiens
aauguuaaccguuucaggac

SEQ ID NO: 2163652 - RNA, 11 nt, Homo sapiens
cucacuauguu

SEQ ID NO: 2163653 - RNA, 14 nt, Homo sapiens
ucccucucaugacu

SEQ ID NO: 2163654 - RNA, 19 nt, Homo sapiens
cagaacacuuauguuauac

SEQ ID NO: 2163655 - RNA, 19 nt, Homo sapiens
ccucaagaaguaauaauuu

SEQ ID NO: 2163656 - RNA, 19 nt, Homo sapiens
gcugcggcugcaucuucca

SEQ ID NO: 2163657 - RNA, 16 nt, Homo sapiens
cucacacaugagaucu

SEQ ID NO: 2163658 - RNA, 21 nt, Homo sapiens
gcaccuguaaucccagcuacu

SEQ ID NO: 2163659 - RNA, 19 nt, Homo sapiens
agugagaaggcaaccaaag

SEQ ID NO: 2163660 - RNA, 20 nt, Homo sapiens
ugaauauuuauucagugacu

SEQ ID NO: 2163661 - RNA, 16 nt, Homo sapiens
auccaugccauaagca

SEQ ID NO: 2163662 - RNA, 21 nt, Homo sapiens
ccugccagaggccuggugccc

SEQ ID NO: 2163663 - RNA, 18 nt, Homo sapiens
aaaccaagugcuuauaaa

SEQ ID NO: 2163664 - RNA, 21 nt, Homo sapiens
agaaugccucugcugugggcu

SEQ ID NO: 2163665 - RNA, 18 nt, Homo sapiens
aagaggcuuuugggccaa

SEQ ID NO: 2163666 - RNA, 21 nt, Homo sapiens
aggaggugggauaucacuucc

SEQ ID NO: 2163667 - RNA, 20 nt, Homo sapiens
ucaguauuucaguguaguua

SEQ ID NO: 2163668 - RNA, 15 nt, Homo sapiens
agcagaacagugauu

SEQ ID NO: 2163669 - RNA, 15 nt, Homo sapiens
agagaaaagucuacc

SEQ ID NO: 2163670 - RNA, 23 nt, Homo sapiens
uggggcaugguauuugagacauu

SEQ ID NO: 2163671 - RNA, 16 nt, Homo sapiens
uaguugaugcuacaaa

SEQ ID NO: 2163672 - RNA, 23 nt, Homo sapiens
aaguauuuuuuaauccuaccuca

SEQ ID NO: 2163673 - RNA, 16 nt, Homo sapiens
ucuacaaaaugccaag

SEQ ID NO: 2163674 - RNA, 13 nt, Homo sapiens
cugccagggagcu

SEQ ID NO: 2163675 - RNA, 13 nt, Homo sapiens
ggaaggucuucaa

SEQ ID NO: 2163676 - RNA, 22 nt, Homo sapiens
aauuaacaaauucaguggacau

SEQ ID NO: 2163677 - RNA, 22 nt, Homo sapiens
cucagaaacugcgaggccaguu

SEQ ID NO: 2163678 - RNA, 14 nt, Homo sapiens
auaaaaagccaggg

SEQ ID NO: 2163679 - RNA, 18 nt, Homo sapiens
ucgucaggcugccagaga

SEQ ID NO: 2163680 - RNA, 17 nt, Homo sapiens
uguuuaugacacaauga

SEQ ID NO: 2163681 - RNA, 16 nt, Homo sapiens
cuauuuccuuuccagu

SEQ ID NO: 2163682 - RNA, 22 nt, Homo sapiens
uccucuacuacuuuuacuacag

SEQ ID NO: 2163683 - RNA, 21 nt, Homo sapiens
aaagaagacgcucagcacugu

SEQ ID NO: 2163684 - RNA, 12 nt, Homo sapiens
aaagaaguggau

SEQ ID NO: 2163685 - RNA, 19 nt, Homo sapiens
cuucccaaaucugucuccc

SEQ ID NO: 2163686 - RNA, 21 nt, Homo sapiens
cuuuuuucaaugguaugcaaa

SEQ ID NO: 2163687 - RNA, 16 nt, Homo sapiens
uauacugauucugugu

SEQ ID NO: 2163688 - RNA, 14 nt, Homo sapiens
gggccacuggggac

SEQ ID NO: 2163689 - RNA, 13 nt, Homo sapiens
aaauaugucacua

SEQ ID NO: 2163690 - RNA, 21 nt, Homo sapiens
uacaaggcccagaagccugau

SEQ ID NO: 2163691 - RNA, 14 nt, Homo sapiens
uccuuaucaaagga

SEQ ID NO: 2163692 - RNA, 16 nt, Homo sapiens
uggccuaugcacauau

SEQ ID NO: 2163693 - RNA, 20 nt, Homo sapiens
ucagaaguuaguuuguauau

SEQ ID NO: 2163694 - RNA, 21 nt, Homo sapiens
uuuguuaggaagggugagaau

SEQ ID NO: 2163695 - RNA, 16 nt, Homo sapiens
aaugaaccuucuggcc

SEQ ID NO: 2163696 - RNA, 20 nt, Homo sapiens
aacacuuugguauucaauuu

SEQ ID NO: 2163697 - RNA, 17 nt, Homo sapiens
aacauucagucugacaa

SEQ ID NO: 2163698 - RNA, 14 nt, Homo sapiens
uuuucucuucaaua

SEQ ID NO: 2163699 - RNA, 17 nt, Homo sapiens
aggcgggaggcuucucu

SEQ ID NO: 2163700 - RNA, 17 nt, Homo sapiens
acuaucauaguuauuaa

SEQ ID NO: 2163701 - RNA, 14 nt, Homo sapiens
gggccgcucugauu

SEQ ID NO: 2163702 - RNA, 22 nt, Homo sapiens
auguugcauuuaugaugcaguu

SEQ ID NO: 2163703 - RNA, 15 nt, Homo sapiens
uuagcagcauuccau

SEQ ID NO: 2163704 - RNA, 10 nt, Homo sapiens
uguuacauac

SEQ ID NO: 2163705 - RNA, 13 nt, Homo sapiens
uaucuaucuuaua

SEQ ID NO: 2163706 - RNA, 15 nt, Homo sapiens
augaagggcuccgug

SEQ ID NO: 2163707 - RNA, 15 nt, Homo sapiens
acuagccagcacaaa

SEQ ID NO: 2163708 - RNA, 12 nt, Homo sapiens
auaucugggcug

SEQ ID NO: 2163709 - RNA, 17 nt, Homo sapiens
aaaguuugggaagggau

SEQ ID NO: 2163710 - RNA, 15 nt, Homo sapiens
uauaaaaacaaaaac

SEQ ID NO: 2163711 - RNA, 14 nt, Homo sapiens
agcaugaacuggcc

SEQ ID NO: 2163712 - RNA, 21 nt, Homo sapiens
auuguuuauaaaacaaugacu

SEQ ID NO: 2163713 - RNA, 15 nt, Homo sapiens
ggauggucucugcca

SEQ ID NO: 2163714 - RNA, 16 nt, Homo sapiens
uuucgcauccaccgcc

SEQ ID NO: 2163715 - RNA, 21 nt, Homo sapiens
aacaguucugagcuguaauuu

SEQ ID NO: 2163716 - RNA, 21 nt, Homo sapiens
ggaggaacugcuugugcacug

SEQ ID NO: 2163717 - RNA, 17 nt, Homo sapiens
ggcaguuuuucuguauu

SEQ ID NO: 2163718 - RNA, 22 nt, Homo sapiens
aagcaagaucuacuacauccca

SEQ ID NO: 2163719 - RNA, 15 nt, Homo sapiens
gauugauuaccaagu

SEQ ID NO: 2163720 - RNA, 16 nt, Homo sapiens
uacacugccugccuua

SEQ ID NO: 2163721 - RNA, 20 nt, Homo sapiens
cuccaggaugaguuacuuga

SEQ ID NO: 2163722 - RNA, 19 nt, Homo sapiens
gcuccuuggcuuaccugac

SEQ ID NO: 2163723 - RNA, 13 nt, Homo sapiens
aauucagcacuga

SEQ ID NO: 2163724 - RNA, 22 nt, Homo sapiens
guggggcaagccugagugguga

SEQ ID NO: 2163725 - RNA, 14 nt, Homo sapiens
cggguuuguaacug

SEQ ID NO: 2163726 - RNA, 20 nt, Homo sapiens
auuccaggcgaugugcaagu

SEQ ID NO: 2163727 - RNA, 19 nt, Homo sapiens
uuaauuuuaguuucaugag

SEQ ID NO: 2163728 - RNA, 15 nt, Homo sapiens
ugcugccauccucac

SEQ ID NO: 2163729 - RNA, 13 nt, Homo sapiens
ccuggcaaucugu

SEQ ID NO: 2163730 - RNA, 16 nt, Homo sapiens
uuaugagacacaggau

SEQ ID NO: 2163731 - RNA, 18 nt, Homo sapiens
caucuuuuuuucuaugaa

SEQ ID NO: 2163732 - RNA, 18 nt, Homo sapiens
uauaaaggauuaauguca

SEQ ID NO: 2163733 - RNA, 22 nt, Homo sapiens
gucuuuagggguugggcuggau

SEQ ID NO: 2163734 - RNA, 12 nt, Homo sapiens
auccaggacagc

SEQ ID NO: 2163735 - RNA, 15 nt, Homo sapiens
cacuggaucaagaau

SEQ ID NO: 2163736 - RNA, 17 nt, Homo sapiens
cuaacuuuucuuaaggu

SEQ ID NO: 2163737 - RNA, 23 nt, Homo sapiens
guuaagcaaaaugcuucugcaca

SEQ ID NO: 2163738 - RNA, 16 nt, Homo sapiens
gacccauuccugugua

SEQ ID NO: 2163739 - RNA, 15 nt, Homo sapiens
aauuuguauaaccca

SEQ ID NO: 2163740 - RNA, 17 nt, Homo sapiens
gguuauuuuauauuuga

SEQ ID NO: 2163741 - RNA, 21 nt, Homo sapiens
ugaagccaauucagacaggca

SEQ ID NO: 2163742 - RNA, 14 nt, Homo sapiens
auucuacugaacag

SEQ ID NO: 2163743 - RNA, 17 nt, Homo sapiens
uggagaccgugaccagu

SEQ ID NO: 2163744 - RNA, 22 nt, Homo sapiens
gguuauggguacggcaaccaca

SEQ ID NO: 2163745 - RNA, 14 nt, Homo sapiens
ccauuuaacauugu

SEQ ID NO: 2163746 - RNA, 20 nt, Homo sapiens
uaaaaauaagccacauaucu

SEQ ID NO: 2163747 - RNA, 23 nt, Homo sapiens
ccaagcuggcacugccacugugg

SEQ ID NO: 2163748 - RNA, 16 nt, Homo sapiens
uuaaauauccauuuau

SEQ ID NO: 2163749 - RNA, 20 nt, Homo sapiens
agugaacauacuaauucuau

SEQ ID NO: 2163750 - RNA, 20 nt, Homo sapiens
aguuguguuccugacacuca

SEQ ID NO: 2163751 - RNA, 12 nt, Homo sapiens
cuuccugcagua

SEQ ID NO: 2163752 - RNA, 14 nt, Homo sapiens
aguucucuguggaa

SEQ ID NO: 2163753 - RNA, 18 nt, Homo sapiens
cagagcuucccucauuua

SEQ ID NO: 2163754 - RNA, 16 nt, Homo sapiens
augcaaugacucagga

SEQ ID NO: 2163755 - RNA, 20 nt, Homo sapiens
uggagccgagcggggagcca

SEQ ID NO: 2163756 - RNA, 17 nt, Homo sapiens
ucuaguguguccuguga

SEQ ID NO: 2163757 - RNA, 15 nt, Homo sapiens
aagcuuauuaaugcu

SEQ ID NO: 2163758 - RNA, 13 nt, Homo sapiens
caaagaugugcaa

SEQ ID NO: 2163759 - RNA, 20 nt, Homo sapiens
agacgcagacaugugcacuu

SEQ ID NO: 2163760 - RNA, 16 nt, Homo sapiens
auuuccccacucugag

SEQ ID NO: 2163761 - RNA, 14 nt, Homo sapiens
cagugaaguguucu

SEQ ID NO: 2163762 - RNA, 14 nt, Homo sapiens
auccuucuaaagug

SEQ ID NO: 2163763 - RNA, 15 nt, Homo sapiens
ccaguccucacuguc

SEQ ID NO: 2163764 - RNA, 15 nt, Homo sapiens
uuuuaacugccaaga

SEQ ID NO: 2163765 - RNA, 22 nt, Homo sapiens
uuuaugagacccauuccuauuu

SEQ ID NO: 2163766 - RNA, 16 nt, Homo sapiens
aagacaauuugauaca

SEQ ID NO: 2163767 - RNA, 12 nt, Homo sapiens
agaaagggaccc

SEQ ID NO: 2163768 - RNA, 16 nt, Homo sapiens
cacuggacaacacuga

SEQ ID NO: 2163769 - RNA, 21 nt, Homo sapiens
ccaacguggggcagcacagag

SEQ ID NO: 2163770 - RNA, 21 nt, Homo sapiens
acgccaaugcacacacacaga

SEQ ID NO: 2163771 - RNA, 12 nt, Homo sapiens
ccuguaaauaua

SEQ ID NO: 2163772 - RNA, 15 nt, Homo sapiens
guccuugcauggccu

SEQ ID NO: 2163773 - RNA, 20 nt, Homo sapiens
ucccagccccuccucccuca

SEQ ID NO: 2163774 - RNA, 15 nt, Homo sapiens
aaaaauaucuuugca

SEQ ID NO: 2163775 - RNA, 18 nt, Homo sapiens
cuggagcccacaaccuuc

SEQ ID NO: 2163776 - RNA, 14 nt, Homo sapiens
gugagacacucugg

SEQ ID NO: 2163777 - RNA, 16 nt, Homo sapiens
cauuuuagaaugucaa

SEQ ID NO: 2163778 - RNA, 16 nt, Homo sapiens
ggguuuauagauguga

SEQ ID NO: 2163779 - RNA, 15 nt, Homo sapiens
aucaagaaaauaugc

SEQ ID NO: 2163780 - RNA, 15 nt, Homo sapiens
aacuuccaauuuaca

SEQ ID NO: 2163781 - RNA, 17 nt, Homo sapiens
ucagcagagaaguuuuc

SEQ ID NO: 2163782 - RNA, 21 nt, Homo sapiens
ucuccugccucacccucccaa

SEQ ID NO: 2163783 - RNA, 23 nt, Homo sapiens
ccaggcuggucguaaacaucuca

SEQ ID NO: 2163784 - RNA, 22 nt, Homo sapiens
acaaaaaagaaaaaaaaacugg

SEQ ID NO: 2163785 - RNA, 17 nt, Homo sapiens
agguuagauucucauuc

SEQ ID NO: 2163786 - RNA, 18 nt, Homo sapiens
cagcacugugaugcuuua

SEQ ID NO: 2163787 - RNA, 14 nt, Homo sapiens
cuagaaggugcuua

SEQ ID NO: 2163788 - RNA, 15 nt, Homo sapiens
cguuucacugcaaac

SEQ ID NO: 2163789 - RNA, 19 nt, Homo sapiens
ucaaaaguuuuuucuaagu

SEQ ID NO: 2163790 - RNA, 14 nt, Homo sapiens
aaucuuccuuuuau

SEQ ID NO: 2163791 - RNA, 13 nt, Homo sapiens
uuacuuaggaaac

SEQ ID NO: 2163792 - RNA, 20 nt, Homo sapiens
aaaaguugaugucaauaaca

SEQ ID NO: 2163793 - RNA, 13 nt, Homo sapiens
uaccaacuuuuag

SEQ ID NO: 2163794 - RNA, 23 nt, Homo sapiens
auucuccagaccaaagcaaucau

SEQ ID NO: 2163795 - RNA, 21 nt, Homo sapiens
gggagaucaugucucacuuca

SEQ ID NO: 2163796 - RNA, 22 nt, Homo sapiens
acauguagggcaagaggaugaa

SEQ ID NO: 2163797 - RNA, 23 nt, Homo sapiens
cuccccagcccuggcucugcaau

SEQ ID NO: 2163798 - RNA, 21 nt, Homo sapiens
gacagacagccacccugagaa

SEQ ID NO: 2163799 - RNA, 13 nt, Homo sapiens
cuucgaaaaucua

SEQ ID NO: 2163800 - RNA, 20 nt, Homo sapiens
uugccuuugguuccccgcga

SEQ ID NO: 2163801 - RNA, 17 nt, Homo sapiens
cagaucgaaauuggacu

SEQ ID NO: 2163802 - RNA, 18 nt, Homo sapiens
augguguuaaagcuguac

SEQ ID NO: 2163803 - RNA, 15 nt, Homo sapiens
ucccugccccuuaac

SEQ ID NO: 2163804 - RNA, 21 nt, Homo sapiens
ugcccaggccucuggcuuuuu

SEQ ID NO: 2163805 - RNA, 21 nt, Homo sapiens
guuauacauccuauuuuguaa

SEQ ID NO: 2163806 - RNA, 22 nt, Homo sapiens
ucccaugugauuuaaacaaaca

SEQ ID NO: 2163807 - RNA, 20 nt, Homo sapiens
uaugcacaccaaauugcuga

SEQ ID NO: 2163808 - RNA, 18 nt, Homo sapiens
uuguuuuguguaacauau

SEQ ID NO: 2163809 - RNA, 22 nt, Homo sapiens
cucugagcgggaggcagaguuu

SEQ ID NO: 2163810 - RNA, 18 nt, Homo sapiens
uuuaaccaauaacuagcu

SEQ ID NO: 2163811 - RNA, 14 nt, Homo sapiens
gcuugucacaggaa

SEQ ID NO: 2163812 - RNA, 16 nt, Homo sapiens
ugcuggucuacaccgc

SEQ ID NO: 2163813 - RNA, 20 nt, Homo sapiens
caccuguaaucccagcacuu

SEQ ID NO: 2163814 - RNA, 21 nt, Homo sapiens
gcuacuuuauuuauacacugu

SEQ ID NO: 2163815 - RNA, 14 nt, Homo sapiens
cacgccaacagccc

SEQ ID NO: 2163816 - RNA, 22 nt, Homo sapiens
ggaccaucaagggucauggcag

SEQ ID NO: 2163817 - RNA, 14 nt, Homo sapiens
ucugucuuguucau

SEQ ID NO: 2163818 - RNA, 14 nt, Homo sapiens
acaaugcaugugcu

SEQ ID NO: 2163819 - RNA, 20 nt, Homo sapiens
uaucuccaaaugagacacau

SEQ ID NO: 2163820 - RNA, 19 nt, Homo sapiens
auaaaaagcgcugcaguag

SEQ ID NO: 2163821 - RNA, 17 nt, Homo sapiens
auuacacuuugaaguau

SEQ ID NO: 2163822 - RNA, 21 nt, Homo sapiens
agauccacuuuggcaggagcc

SEQ ID NO: 2163823 - RNA, 16 nt, Homo sapiens
aauaaauugcucaaau

SEQ ID NO: 2163824 - RNA, 13 nt, Homo sapiens
ugauauauuucag

SEQ ID NO: 2163825 - RNA, 18 nt, Homo sapiens
uccagcuccaaccugcaa

SEQ ID NO: 2163826 - RNA, 18 nt, Homo sapiens
ugcacaccgugugccaua

SEQ ID NO: 2163827 - RNA, 22 nt, Homo sapiens
gcuucucugcuccagguucacu

SEQ ID NO: 2163828 - RNA, 15 nt, Homo sapiens
uguuuuuaaacugga

SEQ ID NO: 2163829 - RNA, 13 nt, Homo sapiens
gggaggcuucccc

SEQ ID NO: 2163830 - RNA, 16 nt, Homo sapiens
auuugcaaaucaccca

SEQ ID NO: 2163831 - RNA, 23 nt, Homo sapiens
ggagugaggaugucugggccacu

SEQ ID NO: 2163832 - RNA, 19 nt, Homo sapiens
uugcucugagaaaguacaa

SEQ ID NO: 2163833 - RNA, 21 nt, Homo sapiens
gagacgggguuucaccauguu

SEQ ID NO: 2163834 - RNA, 19 nt, Homo sapiens
gcugagugccugauacugc

SEQ ID NO: 2163835 - RNA, 20 nt, Homo sapiens
ugcaccccugauguggcaua

SEQ ID NO: 2163836 - RNA, 13 nt, Homo sapiens
caccugaaucagc

SEQ ID NO: 2163837 - RNA, 17 nt, Homo sapiens
cugcauaaacuucaucu

SEQ ID NO: 2163838 - RNA, 23 nt, Homo sapiens
guaaaugcuuuuaaaugcucucu

SEQ ID NO: 2163839 - RNA, 21 nt, Homo sapiens
ucucacugacuucucccgggu

SEQ ID NO: 2163840 - RNA, 13 nt, Homo sapiens
ccucccuccagau

SEQ ID NO: 2163841 - RNA, 19 nt, Homo sapiens
aagagaacuuccagauccu

SEQ ID NO: 2163842 - RNA, 23 nt, Homo sapiens
agagccgccaaacauuccuccag

SEQ ID NO: 2163843 - RNA, 17 nt, Homo sapiens
uguauugaaaacacuua

SEQ ID NO: 2163844 - RNA, 24 nt, Homo sapiens
aucuucagcucuuuuuguggauau

SEQ ID NO: 2163845 - RNA, 14 nt, Homo sapiens
agcaguacacaacu

SEQ ID NO: 2163846 - RNA, 14 nt, Homo sapiens
ccauccaccgcugc

SEQ ID NO: 2163847 - RNA, 14 nt, Homo sapiens
ucagaguugugcac

SEQ ID NO: 2163848 - RNA, 19 nt, Homo sapiens
agccagggaaggcugugca

SEQ ID NO: 2163849 - RNA, 17 nt, Homo sapiens
gcaucuggguagcugua

SEQ ID NO: 2163850 - RNA, 17 nt, Homo sapiens
acaaacaaaccaaaaug

SEQ ID NO: 2163851 - RNA, 21 nt, Homo sapiens
accugagucugcaugugcacg

SEQ ID NO: 2163852 - RNA, 16 nt, Homo sapiens
gaccaauccuauguca

SEQ ID NO: 2163853 - RNA, 21 nt, Homo sapiens
acacugccccaggacugucau

SEQ ID NO: 2163854 - RNA, 17 nt, Homo sapiens
aacauuauuucuuuucu

SEQ ID NO: 2163855 - RNA, 13 nt, Homo sapiens
agcaggugguggu

SEQ ID NO: 2163856 - RNA, 13 nt, Homo sapiens
auauaauacugua

SEQ ID NO: 2163857 - RNA, 19 nt, Homo sapiens
aauacuuccaaagagucau

SEQ ID NO: 2163858 - RNA, 14 nt, Homo sapiens
uggccccaugucuc

SEQ ID NO: 2163859 - RNA, 15 nt, Homo sapiens
ggucacggcaaagga

SEQ ID NO: 2163860 - RNA, 13 nt, Homo sapiens
uccaagcuguuag

SEQ ID NO: 2163861 - RNA, 15 nt, Homo sapiens
gcaccuuuugcacau

SEQ ID NO: 2163862 - RNA, 17 nt, Homo sapiens
acagcucuugaggaugu

SEQ ID NO: 2163863 - RNA, 14 nt, Homo sapiens
cuuauuaauuugac

SEQ ID NO: 2163864 - RNA, 13 nt, Homo sapiens
acauuagugccau

SEQ ID NO: 2163865 - RNA, 19 nt, Homo sapiens
ccuugaugagcugugcaca

SEQ ID NO: 2163866 - RNA, 13 nt, Homo sapiens
gaguguuccugug

SEQ ID NO: 2163867 - RNA, 15 nt, Homo sapiens
uacauaugagaauau

SEQ ID NO: 2163868 - RNA, 15 nt, Homo sapiens
aaaagaugugcagau

SEQ ID NO: 2163869 - RNA, 11 nt, Homo sapiens
aacacuaccaa

SEQ ID NO: 2163870 - RNA, 15 nt, Homo sapiens
uucacuauguuacau

SEQ ID NO: 2163871 - RNA, 18 nt, Homo sapiens
uaccccagaacgcaugca

SEQ ID NO: 2163872 - RNA, 13 nt, Homo sapiens
aagcaggacagag

SEQ ID NO: 2163873 - RNA, 18 nt, Homo sapiens
agggucuccaguguuccc

SEQ ID NO: 2163874 - RNA, 12 nt, Homo sapiens
uuggaaugcuuu

SEQ ID NO: 2163875 - RNA, 12 nt, Homo sapiens
uaugaaugcagu

SEQ ID NO: 2163876 - RNA, 21 nt, Homo sapiens
agcauuucccucccgggagag

SEQ ID NO: 2163877 - RNA, 13 nt, Homo sapiens
acaugugcuucau

SEQ ID NO: 2163878 - RNA, 20 nt, Homo sapiens
aggaaguuuucuguagucau

SEQ ID NO: 2163879 - RNA, 20 nt, Homo sapiens
ggcccuuggaaaaacaggaa

SEQ ID NO: 2163880 - RNA, 13 nt, Homo sapiens
caucauugaucuu

SEQ ID NO: 2163881 - RNA, 15 nt, Homo sapiens
cagaaagccuuucau

SEQ ID NO: 2163882 - RNA, 22 nt, Homo sapiens
gaauuaaagucuacacugccuu

SEQ ID NO: 2163883 - RNA, 15 nt, Homo sapiens
auugaggacacugau

SEQ ID NO: 2163884 - RNA, 15 nt, Homo sapiens
uucccuguccugaca

SEQ ID NO: 2163885 - RNA, 17 nt, Homo sapiens
cuuauuaagaccaaaga

SEQ ID NO: 2163886 - RNA, 22 nt, Homo sapiens
ugccaggaccagucccagagca

SEQ ID NO: 2163887 - RNA, 18 nt, Homo sapiens
guauuugaaacacugguu

SEQ ID NO: 2163888 - RNA, 15 nt, Homo sapiens
uuuggcucaacuuca

SEQ ID NO: 2163889 - RNA, 18 nt, Homo sapiens
gaaacucccuuguguucc

SEQ ID NO: 2163890 - RNA, 20 nt, Homo sapiens
gccuuuguccccacacagcc

SEQ ID NO: 2163891 - RNA, 22 nt, Homo sapiens
ucauuuaggugaggaagcaaaa

SEQ ID NO: 2163892 - RNA, 19 nt, Homo sapiens
caucacccucuuccuguga

SEQ ID NO: 2163893 - RNA, 14 nt, Homo sapiens
auauugugcaauaa

SEQ ID NO: 2163894 - RNA, 18 nt, Homo sapiens
agaauaaggaacaacguu

SEQ ID NO: 2163895 - RNA, 16 nt, Homo sapiens
cacuaaagcaugaaau

SEQ ID NO: 2163896 - RNA, 20 nt, Homo sapiens
uguaauuaaaagcaaaucau

SEQ ID NO: 2163897 - RNA, 22 nt, Homo sapiens
uaggugaacguguucaaagcca

SEQ ID NO: 2163898 - RNA, 16 nt, Homo sapiens
agcccgcugaguggac

SEQ ID NO: 2163899 - RNA, 18 nt, Homo sapiens
gucucauuccuccaccug

SEQ ID NO: 2163900 - RNA, 20 nt, Homo sapiens
auccauaaagaagcaauaaa

SEQ ID NO: 2163901 - RNA, 19 nt, Homo sapiens
uaguucuacauuauucuuc

SEQ ID NO: 2163902 - RNA, 15 nt, Homo sapiens
gagcccccaccacaa

SEQ ID NO: 2163903 - RNA, 23 nt, Homo sapiens
uaccaucuuguauacacauauau

SEQ ID NO: 2163904 - RNA, 15 nt, Homo sapiens
gcagagagcagcagc

SEQ ID NO: 2163905 - RNA, 20 nt, Homo sapiens
ugcaaaagugaaacauacaa

SEQ ID NO: 2163906 - RNA, 16 nt, Homo sapiens
ucugaauaacauuugu

SEQ ID NO: 2163907 - RNA, 19 nt, Homo sapiens
ugagacccuuuucucagga

SEQ ID NO: 2163908 - RNA, 18 nt, Homo sapiens
caauucuccugccucagc

SEQ ID NO: 2163909 - RNA, 21 nt, Homo sapiens
caacuacagaauuucauucau

SEQ ID NO: 2163910 - RNA, 14 nt, Homo sapiens
ugccucugcccaga

SEQ ID NO: 2163911 - RNA, 17 nt, Homo sapiens
gggggccuggccuugca

SEQ ID NO: 2163912 - RNA, 18 nt, Homo sapiens
cuggagcaauaaaagaca

SEQ ID NO: 2163913 - RNA, 21 nt, Homo sapiens
agaaggcuuccuccagcggcu

SEQ ID NO: 2163914 - RNA, 13 nt, Homo sapiens
uuugggguuuugu

SEQ ID NO: 2163915 - RNA, 16 nt, Homo sapiens
cucagauuauuuuucc

SEQ ID NO: 2163916 - RNA, 16 nt, Homo sapiens
auuuuuaaccuuuuca

SEQ ID NO: 2163917 - RNA, 20 nt, Homo sapiens
cagggucugcucuuucucug

SEQ ID NO: 2163918 - RNA, 23 nt, Homo sapiens
gauuguagaacuuguugcugauu

SEQ ID NO: 2163919 - RNA, 17 nt, Homo sapiens
acccaguggaaccaaaa

SEQ ID NO: 2163920 - RNA, 12 nt, Homo sapiens
guucucugccaa

SEQ ID NO: 2163921 - RNA, 19 nt, Homo sapiens
uaucaggccaagaccccag

SEQ ID NO: 2163922 - RNA, 23 nt, Homo sapiens
ucugcaaggacauuucucaaggg

SEQ ID NO: 2163923 - RNA, 22 nt, Homo sapiens
auuguaaaaacugaacuauucc

SEQ ID NO: 2163924 - RNA, 14 nt, Homo sapiens
cagauggggcacca

SEQ ID NO: 2163925 - RNA, 22 nt, Homo sapiens
uaaaauggacuguggugacuuu

SEQ ID NO: 2163926 - RNA, 17 nt, Homo sapiens
cugucacggucacuuua

SEQ ID NO: 2163927 - RNA, 21 nt, Homo sapiens
ugacaacaaucucaauuccau

SEQ ID NO: 2163928 - RNA, 19 nt, Homo sapiens
aaauucaguggacauuugu

SEQ ID NO: 2163929 - RNA, 18 nt, Homo sapiens
cgaccccuaguucccucu

SEQ ID NO: 2163930 - RNA, 17 nt, Homo sapiens
gcaggggguucugggac

SEQ ID NO: 2163931 - RNA, 23 nt, Homo sapiens
auacauuauacuuuauaacuaau

SEQ ID NO: 2163932 - RNA, 15 nt, Homo sapiens
auguccuacuaucac

SEQ ID NO: 2163933 - RNA, 23 nt, Homo sapiens
auauccuuuuacugcagaucaag

SEQ ID NO: 2163934 - RNA, 19 nt, Homo sapiens
cagaccagaccccaaacca

SEQ ID NO: 2163935 - RNA, 21 nt, Homo sapiens
ccuggccaucucugaacuuca

SEQ ID NO: 2163936 - RNA, 14 nt, Homo sapiens
agaaugacgaugcc

SEQ ID NO: 2163937 - RNA, 20 nt, Homo sapiens
uuaucacuucauucacauuc

SEQ ID NO: 2163938 - RNA, 16 nt, Homo sapiens
cuuuucuaacucuccc

SEQ ID NO: 2163939 - RNA, 21 nt, Homo sapiens
aguugauugcgagaauuuuca

SEQ ID NO: 2163940 - RNA, 14 nt, Homo sapiens
ucaacacauuggaa

SEQ ID NO: 2163941 - RNA, 14 nt, Homo sapiens
uaagcaagccagga

SEQ ID NO: 2163942 - RNA, 18 nt, Homo sapiens
caacccauucacuacagg

SEQ ID NO: 2163943 - RNA, 19 nt, Homo sapiens
ugacuucagaguacaucca

SEQ ID NO: 2163944 - RNA, 23 nt, Homo sapiens
guggugucauagaauagcauguu

SEQ ID NO: 2163945 - RNA, 17 nt, Homo sapiens
augaccaguuuaccuga

SEQ ID NO: 2163946 - RNA, 13 nt, Homo sapiens
cagugaucuccau

SEQ ID NO: 2163947 - RNA, 19 nt, Homo sapiens
uaaauguaucuuauucaca

SEQ ID NO: 2163948 - RNA, 12 nt, Homo sapiens
cauacagaauua

SEQ ID NO: 2163949 - RNA, 17 nt, Homo sapiens
uaaccuuuugcuccuau

SEQ ID NO: 2163950 - RNA, 17 nt, Homo sapiens
auguuuagcagauuuaa

SEQ ID NO: 2163951 - RNA, 19 nt, Homo sapiens
gauuccagcagugaaugcu

SEQ ID NO: 2163952 - RNA, 14 nt, Homo sapiens
ugaccaugcaauuc

SEQ ID NO: 2163953 - RNA, 19 nt, Homo sapiens
uccugaaagccagcaaagc

SEQ ID NO: 2163954 - RNA, 19 nt, Homo sapiens
cuccccaccuggacacaca

SEQ ID NO: 2163955 - RNA, 15 nt, Homo sapiens
caaugacaucucagg

SEQ ID NO: 2163956 - RNA, 21 nt, Homo sapiens
cagcacuaaagcaguggacac

SEQ ID NO: 2163957 - RNA, 20 nt, Homo sapiens
cauuaccagcuuaaaacacu

SEQ ID NO: 2163958 - RNA, 17 nt, Homo sapiens
uaaaggucccuuagccc

SEQ ID NO: 2163959 - RNA, 18 nt, Homo sapiens
ucucugcuguccuaagaa

SEQ ID NO: 2163960 - RNA, 14 nt, Homo sapiens
guccaggcacagga

SEQ ID NO: 2163961 - RNA, 23 nt, Homo sapiens
ggguaucagcaucuguccucauc

SEQ ID NO: 2163962 - RNA, 15 nt, Homo sapiens
cugccugaguuucca

SEQ ID NO: 2163963 - RNA, 15 nt, Homo sapiens
agcagaaacaucgga

SEQ ID NO: 2163964 - RNA, 20 nt, Homo sapiens
cuguccacauguggggacag

SEQ ID NO: 2163965 - RNA, 16 nt, Homo sapiens
cccacuguucuuguau

SEQ ID NO: 2163966 - RNA, 13 nt, Homo sapiens
accagugcugcug

SEQ ID NO: 2163967 - RNA, 13 nt, Homo sapiens
caauuauuuugca

SEQ ID NO: 2163968 - RNA, 13 nt, Homo sapiens
gaccacacuguua

SEQ ID NO: 2163969 - RNA, 17 nt, Homo sapiens
ccaauuccaaagccaga

SEQ ID NO: 2163970 - RNA, 18 nt, Homo sapiens
aauggcuuuguauagaac

SEQ ID NO: 2163971 - RNA, 15 nt, Homo sapiens
cucuuuuggccaaau

SEQ ID NO: 2163972 - RNA, 21 nt, Homo sapiens
cucccauaucuccuuuaauga

SEQ ID NO: 2163973 - RNA, 20 nt, Homo sapiens
ccucagaaccccacggcaag

SEQ ID NO: 2163974 - RNA, 20 nt, Homo sapiens
gauuacuccuccauuacucu

SEQ ID NO: 2163975 - RNA, 14 nt, Homo sapiens
ugagucaugaucuc

SEQ ID NO: 2163976 - RNA, 20 nt, Homo sapiens
agacuguaaauuccaaagau

SEQ ID NO: 2163977 - RNA, 22 nt, Homo sapiens
uauuauugcuguuugguuuguu

SEQ ID NO: 2163978 - RNA, 16 nt, Homo sapiens
caaccucaggcuccua

SEQ ID NO: 2163979 - RNA, 17 nt, Homo sapiens
ucaaugggaccuguggc

SEQ ID NO: 2163980 - RNA, 23 nt, Homo sapiens
agaucucuucccuccugcuccca

SEQ ID NO: 2163981 - RNA, 22 nt, Homo sapiens
uuaccaggaagcagauacauau

SEQ ID NO: 2163982 - RNA, 14 nt, Homo sapiens
ggcuuagugccacc

SEQ ID NO: 2163983 - RNA, 13 nt, Homo sapiens
augcauaaacuau

SEQ ID NO: 2163984 - RNA, 22 nt, Homo sapiens
gacucuuugguggcuuugcauu

SEQ ID NO: 2163985 - RNA, 15 nt, Homo sapiens
cagcugguauggccu

SEQ ID NO: 2163986 - RNA, 18 nt, Homo sapiens
uguguuucaaguggggcu

SEQ ID NO: 2163987 - RNA, 17 nt, Homo sapiens
ggaccccaucugugaau

SEQ ID NO: 2163988 - RNA, 15 nt, Homo sapiens
cugcuuaagugccua

SEQ ID NO: 2163989 - RNA, 18 nt, Homo sapiens
cugauguaguaugcuuaa

SEQ ID NO: 2163990 - RNA, 14 nt, Homo sapiens
ccacaaaguuucag

SEQ ID NO: 2163991 - RNA, 19 nt, Homo sapiens
uauaaagauuaacacucau

SEQ ID NO: 2163992 - RNA, 13 nt, Homo sapiens
gcuugaacccuga

SEQ ID NO: 2163993 - RNA, 18 nt, Homo sapiens
augcaucuuuaauuccuu

SEQ ID NO: 2163994 - RNA, 15 nt, Homo sapiens
guuuguuuacuuuau

SEQ ID NO: 2163995 - RNA, 14 nt, Homo sapiens
caaagggcaugggu

SEQ ID NO: 2163996 - RNA, 19 nt, Homo sapiens
caaccaccuuuccagccau

SEQ ID NO: 2163997 - RNA, 16 nt, Homo sapiens
gggauacccagugaug

SEQ ID NO: 2163998 - RNA, 20 nt, Homo sapiens
ggccugccuggcaggugugc

SEQ ID NO: 2163999 - RNA, 13 nt, Homo sapiens
agggccaggugca

SEQ ID NO: 2164000 - RNA, 19 nt, Homo sapiens
ccaucaaaguggcaaaaau

SEQ ID NO: 2164001 - RNA, 22 nt, Homo sapiens
uuguucuccuaaugcucugaaa

SEQ ID NO: 2164002 - RNA, 18 nt, Homo sapiens
aaacuccucaacugggaa

SEQ ID NO: 2164003 - RNA, 15 nt, Homo sapiens
cacuuccagcauuua

SEQ ID NO: 2164004 - RNA, 15 nt, Homo sapiens
uaaagcuuugugcag

SEQ ID NO: 2164005 - RNA, 19 nt, Homo sapiens
caaauccuugaauguucuc

SEQ ID NO: 2164006 - RNA, 13 nt, Homo sapiens
cuuagaugcaguu

SEQ ID NO: 2164007 - RNA, 12 nt, Homo sapiens
caguucagugag

SEQ ID NO: 2164008 - RNA, 18 nt, Homo sapiens
gccauaagaaagcacuau

SEQ ID NO: 2164009 - RNA, 16 nt, Homo sapiens
guacuguaugccuuca

SEQ ID NO: 2164010 - RNA, 21 nt, Homo sapiens
auuugaacacuuggugaguag

SEQ ID NO: 2164011 - RNA, 14 nt, Homo sapiens
ugcaagugagcaaa

SEQ ID NO: 2164012 - RNA, 14 nt, Homo sapiens
auuaaguguuuaaa

SEQ ID NO: 2164013 - RNA, 22 nt, Homo sapiens
cagugaggacucggccacugug

SEQ ID NO: 2164014 - RNA, 19 nt, Homo sapiens
cuucccaacucacugugcu

SEQ ID NO: 2164015 - RNA, 16 nt, Homo sapiens
ucuguaaagaaaacca

SEQ ID NO: 2164016 - RNA, 16 nt, Homo sapiens
cuuccacuuccaagau

SEQ ID NO: 2164017 - RNA, 18 nt, Homo sapiens
ccgcccugacccagagga

SEQ ID NO: 2164018 - RNA, 16 nt, Homo sapiens
uguauccagaagccag

SEQ ID NO: 2164019 - RNA, 16 nt, Homo sapiens
ccuuucccuggagcug

SEQ ID NO: 2164020 - RNA, 21 nt, Homo sapiens
uaaaugaauauacugucgcau

SEQ ID NO: 2164021 - RNA, 24 nt, Homo sapiens
guuuucacauaugacaauguugca

SEQ ID NO: 2164022 - RNA, 17 nt, Homo sapiens
uguaauuuuacacaaau

SEQ ID NO: 2164023 - RNA, 21 nt, Homo sapiens
cuggacuacacccaagccuga

SEQ ID NO: 2164024 - RNA, 15 nt, Homo sapiens
uagauauaugcucug

SEQ ID NO: 2164025 - RNA, 23 nt, Homo sapiens
aucuaaacauaaaagaacaauua

SEQ ID NO: 2164026 - RNA, 14 nt, Homo sapiens
cugcccucucucag

SEQ ID NO: 2164027 - RNA, 14 nt, Homo sapiens
ccuagcugugugca

SEQ ID NO: 2164028 - RNA, 15 nt, Homo sapiens
cagacaaaacccugc

SEQ ID NO: 2164029 - RNA, 16 nt, Homo sapiens
gcuuuuuccaucucaa

SEQ ID NO: 2164030 - RNA, 16 nt, Homo sapiens
ccucaucuaugguucu

SEQ ID NO: 2164031 - RNA, 16 nt, Homo sapiens
cugggccgcugccacg

SEQ ID NO: 2164032 - RNA, 21 nt, Homo sapiens
caacaaccacagugccaccaa

SEQ ID NO: 2164033 - RNA, 15 nt, Homo sapiens
gcuaauugugcacau

SEQ ID NO: 2164034 - RNA, 17 nt, Homo sapiens
uagccagaggcucuaau

SEQ ID NO: 2164035 - RNA, 21 nt, Homo sapiens
auuucagccaaaacauaccau

SEQ ID NO: 2164036 - RNA, 14 nt, Homo sapiens
cuccacagcagcaa

SEQ ID NO: 2164037 - RNA, 17 nt, Homo sapiens
auaaaaccagagaagau

SEQ ID NO: 2164038 - RNA, 20 nt, Homo sapiens
cuuucccucucuggaccuca

SEQ ID NO: 2164039 - RNA, 15 nt, Homo sapiens
uucugcaauaugccu

SEQ ID NO: 2164040 - RNA, 15 nt, Homo sapiens
ccggaggcugcagug

SEQ ID NO: 2164041 - RNA, 14 nt, Homo sapiens
ugauauucucauua

SEQ ID NO: 2164042 - RNA, 15 nt, Homo sapiens
acaguguaguacuca

SEQ ID NO: 2164043 - RNA, 14 nt, Homo sapiens
cacaaacaaauggc

SEQ ID NO: 2164044 - RNA, 19 nt, Homo sapiens
cuuucccauggucaaugca

SEQ ID NO: 2164045 - RNA, 11 nt, Homo sapiens
gguugcaacaa

SEQ ID NO: 2164046 - RNA, 21 nt, Homo sapiens
ucaggaacacucugaauucca

SEQ ID NO: 2164047 - RNA, 15 nt, Homo sapiens
ccuguacgaaccccu

SEQ ID NO: 2164048 - RNA, 20 nt, Homo sapiens
auuguugaaagguaauuuga

SEQ ID NO: 2164049 - RNA, 15 nt, Homo sapiens
uauccuuucuaacaa

SEQ ID NO: 2164050 - RNA, 13 nt, Homo sapiens
cauguucauucag

SEQ ID NO: 2164051 - RNA, 11 nt, Homo sapiens
ucacucccacu

SEQ ID NO: 2164052 - RNA, 22 nt, Homo sapiens
gcccuucugacccaaagcaaaa

SEQ ID NO: 2164053 - RNA, 16 nt, Homo sapiens
cugugcacccagaaga

SEQ ID NO: 2164054 - RNA, 15 nt, Homo sapiens
gugguaccagcucac

SEQ ID NO: 2164055 - RNA, 18 nt, Homo sapiens
caaccagaccaaccgccu

SEQ ID NO: 2164056 - RNA, 14 nt, Homo sapiens
uuuuucaguugcag

SEQ ID NO: 2164057 - RNA, 20 nt, Homo sapiens
uucccugaaaacccagagag

SEQ ID NO: 2164058 - RNA, 18 nt, Homo sapiens
aacaaaguaacagccuuu

SEQ ID NO: 2164059 - RNA, 23 nt, Homo sapiens
uauuucagcaacaaccaucucau

SEQ ID NO: 2164060 - RNA, 20 nt, Homo sapiens
cccagaaugaggcugcuuuc

SEQ ID NO: 2164061 - RNA, 23 nt, Homo sapiens
cauuugcaaaauggaaauguaau

SEQ ID NO: 2164062 - RNA, 20 nt, Homo sapiens
cccauagcacugggcucuga

SEQ ID NO: 2164063 - RNA, 19 nt, Homo sapiens
gcuuuucuaaucuuguuaa

SEQ ID NO: 2164064 - RNA, 11 nt, Homo sapiens
ucucucucuuu

SEQ ID NO: 2164065 - RNA, 19 nt, Homo sapiens
uuauaaagauaaagcugcc

SEQ ID NO: 2164066 - RNA, 14 nt, Homo sapiens
caucuaucugguga

SEQ ID NO: 2164067 - RNA, 13 nt, Homo sapiens
aaaaacauucuua

SEQ ID NO: 2164068 - RNA, 22 nt, Homo sapiens
cucagguuuuugaggaaacaaa

SEQ ID NO: 2164069 - RNA, 20 nt, Homo sapiens
gcagcauccuccaaaacuua

SEQ ID NO: 2164070 - RNA, 19 nt, Homo sapiens
gaagcuccagaagaacaaa

SEQ ID NO: 2164071 - RNA, 16 nt, Homo sapiens
ccucccucuacucuuc

SEQ ID NO: 2164072 - RNA, 15 nt, Homo sapiens
aacguugacaaguuu

SEQ ID NO: 2164073 - RNA, 16 nt, Homo sapiens
ucucuggaucuaugau

SEQ ID NO: 2164074 - RNA, 15 nt, Homo sapiens
uuaaagagcacaggu

SEQ ID NO: 2164075 - RNA, 22 nt, Homo sapiens
cugaaggagagagucuuuuaac

SEQ ID NO: 2164076 - RNA, 19 nt, Homo sapiens
uaacauccggcaaaacuga

SEQ ID NO: 2164077 - RNA, 19 nt, Homo sapiens
cagcuuccuaaguagcugg

SEQ ID NO: 2164078 - RNA, 22 nt, Homo sapiens
uuaccaaaugaaaugccaaagg

SEQ ID NO: 2164079 - RNA, 11 nt, Homo sapiens
aacagcaauag

SEQ ID NO: 2164080 - RNA, 19 nt, Homo sapiens
ucuauuuuuguacaaaaga

SEQ ID NO: 2164081 - RNA, 23 nt, Homo sapiens
cucccuugggaagggcagggaau

SEQ ID NO: 2164082 - RNA, 22 nt, Homo sapiens
uuaguaguuuuuacaaaacugc

SEQ ID NO: 2164083 - RNA, 16 nt, Homo sapiens
gaacuccucaagggca

SEQ ID NO: 2164084 - RNA, 13 nt, Homo sapiens
gcccaaagucauu

SEQ ID NO: 2164085 - RNA, 16 nt, Homo sapiens
ucacugcaagcuccaa

SEQ ID NO: 2164086 - RNA, 15 nt, Homo sapiens
auccccgcuccuggu

SEQ ID NO: 2164087 - RNA, 13 nt, Homo sapiens
gauucacacuguc

SEQ ID NO: 2164088 - RNA, 16 nt, Homo sapiens
agagaaccugugggcu

SEQ ID NO: 2164089 - RNA, 16 nt, Homo sapiens
cucucugccugggaug

SEQ ID NO: 2164090 - RNA, 13 nt, Homo sapiens
gugacuugcaaua

SEQ ID NO: 2164091 - RNA, 15 nt, Homo sapiens
accccaacagcaccc

SEQ ID NO: 2164092 - RNA, 19 nt, Homo sapiens
gcccuugucgggcacagau

SEQ ID NO: 2164093 - RNA, 18 nt, Homo sapiens
cagggccuuaaaagccau

SEQ ID NO: 2164094 - RNA, 16 nt, Homo sapiens
ugcuggccugcucuua

SEQ ID NO: 2164095 - RNA, 22 nt, Homo sapiens
ugccuggggcggcaugaacccu

SEQ ID NO: 2164096 - RNA, 23 nt, Homo sapiens
gcccaaaucaauaaacugugucu

SEQ ID NO: 2164097 - RNA, 19 nt, Homo sapiens
acagcuucucuacagacuc

SEQ ID NO: 2164098 - RNA, 13 nt, Homo sapiens
ucuccaggucuca

SEQ ID NO: 2164099 - RNA, 19 nt, Homo sapiens
gaaauagauccagugcuga

SEQ ID NO: 2164100 - RNA, 22 nt, Homo sapiens
aggucaaggcugcagugagcca

SEQ ID NO: 2164101 - RNA, 15 nt, Homo sapiens
gaauaaauaccucuu

SEQ ID NO: 2164102 - RNA, 22 nt, Homo sapiens
ugcaccuucugacgcagccuga

SEQ ID NO: 2164103 - RNA, 15 nt, Homo sapiens
cccuucagcauccuc

SEQ ID NO: 2164104 - RNA, 18 nt, Homo sapiens
uucuagcucucacagaca

SEQ ID NO: 2164105 - RNA, 15 nt, Homo sapiens
agguuuuuacuguga

SEQ ID NO: 2164106 - RNA, 12 nt, Homo sapiens
cccauccagcua

SEQ ID NO: 2164107 - RNA, 12 nt, Homo sapiens
cuuuuccagucu

SEQ ID NO: 2164108 - RNA, 20 nt, Homo sapiens
gcuuauaagagggcauauac

SEQ ID NO: 2164109 - RNA, 19 nt, Homo sapiens
ugcaauaacaagcaugcau

SEQ ID NO: 2164110 - RNA, 20 nt, Homo sapiens
acuagaauaauaaugcccuu

SEQ ID NO: 2164111 - RNA, 16 nt, Homo sapiens
ucaaccugcacuucau

SEQ ID NO: 2164112 - RNA, 13 nt, Homo sapiens
aauaaauguaucu

SEQ ID NO: 2164113 - RNA, 15 nt, Homo sapiens
ggugagcuccagcug

SEQ ID NO: 2164114 - RNA, 23 nt, Homo sapiens
cgcugugguuucucguacuuuca

SEQ ID NO: 2164115 - RNA, 19 nt, Homo sapiens
auagggacuuggggcuugg

SEQ ID NO: 2164116 - RNA, 15 nt, Homo sapiens
accucuuucaggguu

SEQ ID NO: 2164117 - RNA, 15 nt, Homo sapiens
ggugugggggcugca

SEQ ID NO: 2164118 - RNA, 12 nt, Homo sapiens
ugcccaccuccu

SEQ ID NO: 2164119 - RNA, 20 nt, Homo sapiens
ccuugcucucccucuucuca

SEQ ID NO: 2164120 - RNA, 20 nt, Homo sapiens
acaagauccuccugcugcag

SEQ ID NO: 2164121 - RNA, 20 nt, Homo sapiens
auaaucuaaacaccaaaaac

SEQ ID NO: 2164122 - RNA, 20 nt, Homo sapiens
ucugagcccccugaccuucc

SEQ ID NO: 2164123 - RNA, 16 nt, Homo sapiens
gaauauucccaauauu

SEQ ID NO: 2164124 - RNA, 18 nt, Homo sapiens
acuucuuuaguacuuaca

SEQ ID NO: 2164125 - RNA, 18 nt, Homo sapiens
cucauucugcaaugagcc

SEQ ID NO: 2164126 - RNA, 11 nt, Homo sapiens
uucaaccacug

SEQ ID NO: 2164127 - RNA, 23 nt, Homo sapiens
uuuacacucaaccaugaccucac

SEQ ID NO: 2164128 - RNA, 22 nt, Homo sapiens
agaacuggaggaguuccuugau

SEQ ID NO: 2164129 - RNA, 20 nt, Homo sapiens
uucaagcuuguccagguuga

SEQ ID NO: 2164130 - RNA, 16 nt, Homo sapiens
ccugcaagcagaggug

SEQ ID NO: 2164131 - RNA, 19 nt, Homo sapiens
agaacagggaugcuaucuc

SEQ ID NO: 2164132 - RNA, 16 nt, Homo sapiens
caggaguuuugccccu

SEQ ID NO: 2164133 - RNA, 13 nt, Homo sapiens
caagggaccucuc

SEQ ID NO: 2164134 - RNA, 21 nt, Homo sapiens
uuuucuccugccugugcugug

SEQ ID NO: 2164135 - RNA, 17 nt, Homo sapiens
acagcauaccacgccac

SEQ ID NO: 2164136 - RNA, 16 nt, Homo sapiens
aucacauuaacauuuu

SEQ ID NO: 2164137 - RNA, 21 nt, Homo sapiens
uaguguauuuucugucacugu

SEQ ID NO: 2164138 - RNA, 12 nt, Homo sapiens
uugcuucacuca

SEQ ID NO: 2164139 - RNA, 20 nt, Homo sapiens
ugacaguggaacuacauuag

SEQ ID NO: 2164140 - RNA, 14 nt, Homo sapiens
aauuagaugaacuc

SEQ ID NO: 2164141 - RNA, 20 nt, Homo sapiens
guauuguugcuuuuuuucca

SEQ ID NO: 2164142 - RNA, 19 nt, Homo sapiens
cuuaacuuucccaugguca

SEQ ID NO: 2164143 - RNA, 15 nt, Homo sapiens
gaagccaccuuccca

SEQ ID NO: 2164144 - RNA, 23 nt, Homo sapiens
aagaaauauuagacaaaguucau

SEQ ID NO: 2164145 - RNA, 15 nt, Homo sapiens
gcugaguaccauggg

SEQ ID NO: 2164146 - RNA, 19 nt, Homo sapiens
accauugagacauuugcca

SEQ ID NO: 2164147 - RNA, 19 nt, Homo sapiens
ugaccugagaugugugauu

SEQ ID NO: 2164148 - RNA, 21 nt, Homo sapiens
gugucaccaggcccagcuaau

SEQ ID NO: 2164149 - RNA, 15 nt, Homo sapiens
cagaaucagaucuga

SEQ ID NO: 2164150 - RNA, 14 nt, Homo sapiens
gacugauagacacc

SEQ ID NO: 2164151 - RNA, 20 nt, Homo sapiens
acugguuuggucaguuacaa

SEQ ID NO: 2164152 - RNA, 17 nt, Homo sapiens
ucacaaccucucugauc

SEQ ID NO: 2164153 - RNA, 13 nt, Homo sapiens
agcccucaucccg

SEQ ID NO: 2164154 - RNA, 17 nt, Homo sapiens
uagaagcaaagauuuca

SEQ ID NO: 2164155 - RNA, 14 nt, Homo sapiens
gacaagacgcugcc

SEQ ID NO: 2164156 - RNA, 19 nt, Homo sapiens
auaauuugucuuaguugau

SEQ ID NO: 2164157 - RNA, 15 nt, Homo sapiens
gacuauaaaaacugc

SEQ ID NO: 2164158 - RNA, 16 nt, Homo sapiens
cuucacuguauaaaua

SEQ ID NO: 2164159 - RNA, 15 nt, Homo sapiens
gugaacugugcauag

SEQ ID NO: 2164160 - RNA, 16 nt, Homo sapiens
cucuuaaacuugugaa

SEQ ID NO: 2164161 - RNA, 23 nt, Homo sapiens
uuuggagacugggguggccucaa

SEQ ID NO: 2164162 - RNA, 19 nt, Homo sapiens
ugcaggacccuguccugca

SEQ ID NO: 2164163 - RNA, 15 nt, Homo sapiens
cauacgugugcaugu

SEQ ID NO: 2164164 - RNA, 19 nt, Homo sapiens
aacuauguagguaaauucu

SEQ ID NO: 2164165 - RNA, 13 nt, Homo sapiens
uaagaauaccaca

SEQ ID NO: 2164166 - RNA, 13 nt, Homo sapiens
aaauauugugacu

SEQ ID NO: 2164167 - RNA, 22 nt, Homo sapiens
caacaggcaccucuaaucagac

SEQ ID NO: 2164168 - RNA, 21 nt, Homo sapiens
ugucuccuccccuucccccac

SEQ ID NO: 2164169 - RNA, 20 nt, Homo sapiens
aaucaguuucucaaacugag

SEQ ID NO: 2164170 - RNA, 19 nt, Homo sapiens
gccuucccaggaguacacc

SEQ ID NO: 2164171 - RNA, 16 nt, Homo sapiens
uccaaaccaacaaacc

SEQ ID NO: 2164172 - RNA, 15 nt, Homo sapiens
ucaagggucauggca

SEQ ID NO: 2164173 - RNA, 20 nt, Homo sapiens
aaucuacagaacuacauauu

SEQ ID NO: 2164174 - RNA, 20 nt, Homo sapiens
ucaaguguacaugugugaaa

SEQ ID NO: 2164175 - RNA, 11 nt, Homo sapiens
uucuaagggaa

SEQ ID NO: 2164176 - RNA, 16 nt, Homo sapiens
uucaaauccugccacu

SEQ ID NO: 2164177 - RNA, 16 nt, Homo sapiens
aaaaggauaguaagca

SEQ ID NO: 2164178 - RNA, 19 nt, Homo sapiens
agauugcaccauugcgcuc

SEQ ID NO: 2164179 - RNA, 19 nt, Homo sapiens
agauugcgccauugcacuc

SEQ ID NO: 2164180 - RNA, 23 nt, Homo sapiens
cucauugacaagaacugaaacca

SEQ ID NO: 2164181 - RNA, 21 nt, Homo sapiens
cuucaagcaccugcagauucu

SEQ ID NO: 2164182 - RNA, 18 nt, Homo sapiens
guaccacauuccaugacg

SEQ ID NO: 2164183 - RNA, 13 nt, Homo sapiens
gcuucuccugacc

SEQ ID NO: 2164184 - RNA, 21 nt, Homo sapiens
agaguuaaaauguuuacugua

SEQ ID NO: 2164185 - RNA, 23 nt, Homo sapiens
agcaggggcauuaguuucaggca

SEQ ID NO: 2164186 - RNA, 20 nt, Homo sapiens
aucgugugugccuugggucu

SEQ ID NO: 2164187 - RNA, 14 nt, Homo sapiens
ccagcgauggugcu

SEQ ID NO: 2164188 - RNA, 18 nt, Homo sapiens
gaaucccucuaucucuaa

SEQ ID NO: 2164189 - RNA, 12 nt, Homo sapiens
augaagugcaau

SEQ ID NO: 2164190 - RNA, 12 nt, Homo sapiens
auaaagugcagu

SEQ ID NO: 2164191 - RNA, 23 nt, Homo sapiens
gccaacuccaugaccaggccacc

SEQ ID NO: 2164192 - RNA, 16 nt, Homo sapiens
ucugccccucaggggg

SEQ ID NO: 2164193 - RNA, 19 nt, Homo sapiens
cagccuugaacuguggcca

SEQ ID NO: 2164194 - RNA, 15 nt, Homo sapiens
aguagugucaucacu

SEQ ID NO: 2164195 - RNA, 20 nt, Homo sapiens
aggagauuaacacacugaac

SEQ ID NO: 2164196 - RNA, 20 nt, Homo sapiens
uaauccaauuggugucugua

SEQ ID NO: 2164197 - RNA, 21 nt, Homo sapiens
cauagcucacuguaaccucaa

SEQ ID NO: 2164198 - RNA, 16 nt, Homo sapiens
uuguaucuuuuauccu

SEQ ID NO: 2164199 - RNA, 23 nt, Homo sapiens
cuuccucucuuuugcucauccac

SEQ ID NO: 2164200 - RNA, 13 nt, Homo sapiens
gagcggcuucccc

SEQ ID NO: 2164201 - RNA, 17 nt, Homo sapiens
uaauuuuuuaguuuccc

SEQ ID NO: 2164202 - RNA, 13 nt, Homo sapiens
uugauauugucac

SEQ ID NO: 2164203 - RNA, 17 nt, Homo sapiens
augagaaaagaaauuag

SEQ ID NO: 2164204 - RNA, 17 nt, Homo sapiens
aaucccaacacuuugag

SEQ ID NO: 2164205 - RNA, 13 nt, Homo sapiens
aacagcuggaccc

SEQ ID NO: 2164206 - RNA, 13 nt, Homo sapiens
uacauugaugcca

SEQ ID NO: 2164207 - RNA, 16 nt, Homo sapiens
auuugcaaaugcacau

SEQ ID NO: 2164208 - RNA, 16 nt, Homo sapiens
cagcaccacauugccu

SEQ ID NO: 2164209 - RNA, 17 nt, Homo sapiens
agcgagacuccaucuca

SEQ ID NO: 2164210 - RNA, 18 nt, Homo sapiens
accccuguccucacugcu

SEQ ID NO: 2164211 - RNA, 19 nt, Homo sapiens
ugcacuccagccugggcaa

SEQ ID NO: 2164212 - RNA, 23 nt, Homo sapiens
acagaagucaggugucaucauca

SEQ ID NO: 2164213 - RNA, 18 nt, Homo sapiens
uaagauauuuaguaauau

SEQ ID NO: 2164214 - RNA, 16 nt, Homo sapiens
ucccaacacuuugaga

SEQ ID NO: 2164215 - RNA, 18 nt, Homo sapiens
gcuuuucagccaauuugu

SEQ ID NO: 2164216 - RNA, 13 nt, Homo sapiens
uuccaaaagcaaa

SEQ ID NO: 2164217 - RNA, 15 nt, Homo sapiens
gaagcauuuacuuug

SEQ ID NO: 2164218 - RNA, 13 nt, Homo sapiens
gagauuccacaca

SEQ ID NO: 2164219 - RNA, 15 nt, Homo sapiens
cuguucuggacauuu

SEQ ID NO: 2164220 - RNA, 23 nt, Homo sapiens
cuugcucaccaagaaguaacaaa

SEQ ID NO: 2164221 - RNA, 16 nt, Homo sapiens
ccaaaaagagacugau

SEQ ID NO: 2164222 - RNA, 21 nt, Homo sapiens
uuaguuucaaauuuaccucag

SEQ ID NO: 2164223 - RNA, 14 nt, Homo sapiens
uugcacugcuuuau

SEQ ID NO: 2164224 - RNA, 22 nt, Homo sapiens
gcugcugcgcugcaaagccaua

SEQ ID NO: 2164225 - RNA, 20 nt, Homo sapiens
caaauguuuuaaaguuuaau

SEQ ID NO: 2164226 - RNA, 14 nt, Homo sapiens
auuucauugcacuu

SEQ ID NO: 2164227 - RNA, 16 nt, Homo sapiens
cuccugagggagcucc

SEQ ID NO: 2164228 - RNA, 13 nt, Homo sapiens
uaguuaaaguaau

SEQ ID NO: 2164229 - RNA, 19 nt, Homo sapiens
cugccaggauaaagcuucc

SEQ ID NO: 2164230 - RNA, 21 nt, Homo sapiens
gaaagcaugucucugcuucca

SEQ ID NO: 2164231 - RNA, 14 nt, Homo sapiens
cacguggcaccucc

SEQ ID NO: 2164232 - RNA, 22 nt, Homo sapiens
gaaaaaacugugccuuguuuca

SEQ ID NO: 2164233 - RNA, 15 nt, Homo sapiens
cugcacgaccccuga

SEQ ID NO: 2164234 - RNA, 19 nt, Homo sapiens
cuaaugggaaucauuccac

SEQ ID NO: 2164235 - RNA, 16 nt, Homo sapiens
ggcaugagacucagug

SEQ ID NO: 2164236 - RNA, 21 nt, Homo sapiens
cauuuaugauuuaauaaaaua

SEQ ID NO: 2164237 - RNA, 17 nt, Homo sapiens
accucuuuacucucucc

SEQ ID NO: 2164238 - RNA, 18 nt, Homo sapiens
aauggaugugcucacugg

SEQ ID NO: 2164239 - RNA, 12 nt, Homo sapiens
acuuucauucaa

SEQ ID NO: 2164240 - RNA, 21 nt, Homo sapiens
acggccagcaccgcugcucac

SEQ ID NO: 2164241 - RNA, 19 nt, Homo sapiens
uaucaauaaaauacuuugg

SEQ ID NO: 2164242 - RNA, 13 nt, Homo sapiens
ugucucucuuuug

SEQ ID NO: 2164243 - RNA, 21 nt, Homo sapiens
acuauguucuaggucagucua

SEQ ID NO: 2164244 - RNA, 16 nt, Homo sapiens
gcaagacauaaagccu

SEQ ID NO: 2164245 - RNA, 19 nt, Homo sapiens
ugucugcaauggugacuga

SEQ ID NO: 2164246 - RNA, 22 nt, Homo sapiens
ucccacucagggcuggggccaa

SEQ ID NO: 2164247 - RNA, 21 nt, Homo sapiens
agucuguuuucuaaagccagg

SEQ ID NO: 2164248 - RNA, 21 nt, Homo sapiens
auuucugaccuuguaccucuc

SEQ ID NO: 2164249 - RNA, 14 nt, Homo sapiens
uaaucuuucauugg

SEQ ID NO: 2164250 - RNA, 14 nt, Homo sapiens
guagacauacuugu

SEQ ID NO: 2164251 - RNA, 15 nt, Homo sapiens
ucaaccaugaccuca

SEQ ID NO: 2164252 - RNA, 15 nt, Homo sapiens
uauguacugccuuag

SEQ ID NO: 2164253 - RNA, 21 nt, Homo sapiens
uguuuaaagcauuacaguauu

SEQ ID NO: 2164254 - RNA, 22 nt, Homo sapiens
augacagcuggcuagcauuccu

SEQ ID NO: 2164255 - RNA, 15 nt, Homo sapiens
cccugcccugaccuc

SEQ ID NO: 2164256 - RNA, 16 nt, Homo sapiens
ucacauccacaaaacc

SEQ ID NO: 2164257 - RNA, 13 nt, Homo sapiens
ugggcaaaacuga

SEQ ID NO: 2164258 - RNA, 18 nt, Homo sapiens
gcgugugggucucugggc

SEQ ID NO: 2164259 - RNA, 19 nt, Homo sapiens
agggggcugaaacuugaac

SEQ ID NO: 2164260 - RNA, 16 nt, Homo sapiens
agaaacaacacaguuu

SEQ ID NO: 2164261 - RNA, 23 nt, Homo sapiens
gagaugaccagugccuuggccac

SEQ ID NO: 2164262 - RNA, 23 nt, Homo sapiens
gaacucagagccagaucccuuau

SEQ ID NO: 2164263 - RNA, 14 nt, Homo sapiens
augcuugauuccag

SEQ ID NO: 2164264 - RNA, 15 nt, Homo sapiens
auaaggcagugcagu

SEQ ID NO: 2164265 - RNA, 23 nt, Homo sapiens
uaugaaaaaauuaguugagaaag

SEQ ID NO: 2164266 - RNA, 15 nt, Homo sapiens
caagugcuaccuuug

SEQ ID NO: 2164267 - RNA, 20 nt, Homo sapiens
ccacuaggaucccacuggcg

SEQ ID NO: 2164268 - RNA, 15 nt, Homo sapiens
uccccaacaugcacu

SEQ ID NO: 2164269 - RNA, 22 nt, Homo sapiens
acacagaucagauuaucugguc

SEQ ID NO: 2164270 - RNA, 12 nt, Homo sapiens
acagagcgagau

SEQ ID NO: 2164271 - RNA, 18 nt, Homo sapiens
gggcugauuuucaucaaa

SEQ ID NO: 2164272 - RNA, 19 nt, Homo sapiens
gccuacaggagugagcacu

SEQ ID NO: 2164273 - RNA, 14 nt, Homo sapiens
aggcaccaucauuu

SEQ ID NO: 2164274 - RNA, 14 nt, Homo sapiens
auuuaacaaauaca

SEQ ID NO: 2164275 - RNA, 17 nt, Homo sapiens
uguggagacuugaaccc

SEQ ID NO: 2164276 - RNA, 19 nt, Homo sapiens
ugaacauugcaauagaaau

SEQ ID NO: 2164277 - RNA, 15 nt, Homo sapiens
aacugcauggaccua

SEQ ID NO: 2164278 - RNA, 20 nt, Homo sapiens
ucaggcuuucagcugugcuu

SEQ ID NO: 2164279 - RNA, 19 nt, Homo sapiens
gggccauuucacauuccug

SEQ ID NO: 2164280 - RNA, 22 nt, Homo sapiens
cugucauagggauugucccugu

SEQ ID NO: 2164281 - RNA, 15 nt, Homo sapiens
ucagcugccuccugc

SEQ ID NO: 2164282 - RNA, 13 nt, Homo sapiens
gucacugaugaac

SEQ ID NO: 2164283 - RNA, 15 nt, Homo sapiens
aacagagacucugga

SEQ ID NO: 2164284 - RNA, 13 nt, Homo sapiens
aucagaucugucu

SEQ ID NO: 2164285 - RNA, 17 nt, Homo sapiens
cauuucuucagagggaa

SEQ ID NO: 2164286 - RNA, 16 nt, Homo sapiens
uuuccaauugaacuuu

SEQ ID NO: 2164287 - RNA, 15 nt, Homo sapiens
guucucggaguccaa

SEQ ID NO: 2164288 - RNA, 15 nt, Homo sapiens
gggccucacauucca

SEQ ID NO: 2164289 - RNA, 17 nt, Homo sapiens
gcccugcacgucauggg

SEQ ID NO: 2164290 - RNA, 21 nt, Homo sapiens
cacgagcuagcuucugcaaug

SEQ ID NO: 2164291 - RNA, 19 nt, Homo sapiens
aacugcaggagcaguuugc

SEQ ID NO: 2164292 - RNA, 18 nt, Homo sapiens
ucccaucuccccgcugaa

SEQ ID NO: 2164293 - RNA, 17 nt, Homo sapiens
ggcagguggccucugcu

SEQ ID NO: 2164294 - RNA, 23 nt, Homo sapiens
cuacucagacuguugcacucuaa

SEQ ID NO: 2164295 - RNA, 15 nt, Homo sapiens
ucaacacaaagacau

SEQ ID NO: 2164296 - RNA, 17 nt, Homo sapiens
ugggaaguccuggcaca

SEQ ID NO: 2164297 - RNA, 23 nt, Homo sapiens
aacacauucuuauuaauucuuca

SEQ ID NO: 2164298 - RNA, 15 nt, Homo sapiens
uuccgucaugaauuc

SEQ ID NO: 2164299 - RNA, 16 nt, Homo sapiens
uuccucccauuuccca

SEQ ID NO: 2164300 - RNA, 18 nt, Homo sapiens
cacagagggaaguuuaaa

SEQ ID NO: 2164301 - RNA, 17 nt, Homo sapiens
ucagcuuucccugccac

SEQ ID NO: 2164302 - RNA, 22 nt, Homo sapiens
gucacauguuggugcugccuug

SEQ ID NO: 2164303 - RNA, 17 nt, Homo sapiens
uauucugauuggucugg

SEQ ID NO: 2164304 - RNA, 15 nt, Homo sapiens
uaccuccacucaugu

SEQ ID NO: 2164305 - RNA, 15 nt, Homo sapiens
ugcuguacccagaug

SEQ ID NO: 2164306 - RNA, 14 nt, Homo sapiens
uaauagaguacuua

SEQ ID NO: 2164307 - RNA, 11 nt, Homo sapiens
aaaacauucac

SEQ ID NO: 2164308 - RNA, 19 nt, Homo sapiens
cugaagaagcaaacaugac

SEQ ID NO: 2164309 - RNA, 21 nt, Homo sapiens
aauuguuuauaaaacaaugac

SEQ ID NO: 2164310 - RNA, 16 nt, Homo sapiens
aauaaacucucuaggg

SEQ ID NO: 2164311 - RNA, 14 nt, Homo sapiens
cuccaauuccacag

SEQ ID NO: 2164312 - RNA, 22 nt, Homo sapiens
ccuggccuuauaucauuucaua

SEQ ID NO: 2164313 - RNA, 14 nt, Homo sapiens
uucagggucucccc

SEQ ID NO: 2164314 - RNA, 13 nt, Homo sapiens
guccccaaggcca

SEQ ID NO: 2164315 - RNA, 13 nt, Homo sapiens
uuacuacuugcca

SEQ ID NO: 2164316 - RNA, 21 nt, Homo sapiens
uucaucugggaaagacaucca

SEQ ID NO: 2164317 - RNA, 17 nt, Homo sapiens
cccacgaccuguccugu

SEQ ID NO: 2164318 - RNA, 20 nt, Homo sapiens
cauggagaaucugcugcaua

SEQ ID NO: 2164319 - RNA, 23 nt, Homo sapiens
aaccccaacaauugugugaauua

SEQ ID NO: 2164320 - RNA, 20 nt, Homo sapiens
cagccuuuuucaccauggca

SEQ ID NO: 2164321 - RNA, 19 nt, Homo sapiens
acgccugcccuccccagag

SEQ ID NO: 2164322 - RNA, 15 nt, Homo sapiens
aaagagucagcccuu

SEQ ID NO: 2164323 - RNA, 19 nt, Homo sapiens
aucuguaggucacucucca

SEQ ID NO: 2164324 - RNA, 20 nt, Homo sapiens
uacugucaguuguacuucug

SEQ ID NO: 2164325 - RNA, 15 nt, Homo sapiens
gauauuuuucaugau

SEQ ID NO: 2164326 - RNA, 19 nt, Homo sapiens
uugaacuucugacuacuug

SEQ ID NO: 2164327 - RNA, 18 nt, Homo sapiens
aaccuguuaaaacaacca

SEQ ID NO: 2164328 - RNA, 14 nt, Homo sapiens
augucuagcuuuca

SEQ ID NO: 2164329 - RNA, 23 nt, Homo sapiens
cuuuagucagggcaugcuuuauu

SEQ ID NO: 2164330 - RNA, 13 nt, Homo sapiens
ugaagacaaaaca

SEQ ID NO: 2164331 - RNA, 14 nt, Homo sapiens
gcaggauugauuau

SEQ ID NO: 2164332 - RNA, 17 nt, Homo sapiens
caauugcuuugcacuuu

SEQ ID NO: 2164333 - RNA, 18 nt, Homo sapiens
guggccuuugcaauugug

SEQ ID NO: 2164334 - RNA, 18 nt, Homo sapiens
ucaaggcagaggcaggaa

SEQ ID NO: 2164335 - RNA, 15 nt, Homo sapiens
caagagcuuacauaa

SEQ ID NO: 2164336 - RNA, 18 nt, Homo sapiens
agucuugaauaguacauu

SEQ ID NO: 2164337 - RNA, 16 nt, Homo sapiens
gagguguuggcuuugu

SEQ ID NO: 2164338 - RNA, 23 nt, Homo sapiens
ccccaucugcgggggcagugcuc

SEQ ID NO: 2164339 - RNA, 22 nt, Homo sapiens
aggaggaccuggggggggcaag

SEQ ID NO: 2164340 - RNA, 14 nt, Homo sapiens
cagccuagaccaag

SEQ ID NO: 2164341 - RNA, 20 nt, Homo sapiens
gcgcgugaguggucuucaaa

SEQ ID NO: 2164342 - RNA, 12 nt, Homo sapiens
uuuccucaguga

SEQ ID NO: 2164343 - RNA, 17 nt, Homo sapiens
uaaagacccaacuugcc

SEQ ID NO: 2164344 - RNA, 18 nt, Homo sapiens
gcuucuguugaucucagu

SEQ ID NO: 2164345 - RNA, 14 nt, Homo sapiens
cuagugauuugccu

SEQ ID NO: 2164346 - RNA, 18 nt, Homo sapiens
gcacuguauuaaauguaa

SEQ ID NO: 2164347 - RNA, 16 nt, Homo sapiens
gaaagaaggcauggac

SEQ ID NO: 2164348 - RNA, 13 nt, Homo sapiens
uuuccccuaucau

SEQ ID NO: 2164349 - RNA, 14 nt, Homo sapiens
cucuuaauucccaa

SEQ ID NO: 2164350 - RNA, 19 nt, Homo sapiens
uagaguauauaaccuucau

SEQ ID NO: 2164351 - RNA, 18 nt, Homo sapiens
uaauccuaaacauaugaa

SEQ ID NO: 2164352 - RNA, 14 nt, Homo sapiens
aguuaagcaaauag

SEQ ID NO: 2164353 - RNA, 22 nt, Homo sapiens
gaacagcgggagaccugugcua

SEQ ID NO: 2164354 - RNA, 13 nt, Homo sapiens
gccccacuuugaa

SEQ ID NO: 2164355 - RNA, 15 nt, Homo sapiens
uuugcauuccaugau

SEQ ID NO: 2164356 - RNA, 15 nt, Homo sapiens
uucagccugaggcug

SEQ ID NO: 2164357 - RNA, 21 nt, Homo sapiens
ccggacuccugccgcagugau

SEQ ID NO: 2164358 - RNA, 12 nt, Homo sapiens
uacuaaagacag

SEQ ID NO: 2164359 - RNA, 21 nt, Homo sapiens
acccauuuuuguuuauuuucc

SEQ ID NO: 2164360 - RNA, 16 nt, Homo sapiens
aaacuaaggucagaag

SEQ ID NO: 2164361 - RNA, 17 nt, Homo sapiens
gccagccauuugggaga

SEQ ID NO: 2164362 - RNA, 11 nt, Homo sapiens
agcuuaccugg

SEQ ID NO: 2164363 - RNA, 15 nt, Homo sapiens
ccaugagaguucugu

SEQ ID NO: 2164364 - RNA, 14 nt, Homo sapiens
augcuuauggaaag

SEQ ID NO: 2164365 - RNA, 19 nt, Homo sapiens
gguacaaggggcccagugc

SEQ ID NO: 2164366 - RNA, 18 nt, Homo sapiens
aggucuaggaacauacuu

SEQ ID NO: 2164367 - RNA, 19 nt, Homo sapiens
caguuccccuauguggaag

SEQ ID NO: 2164368 - RNA, 19 nt, Homo sapiens
caggcauuuuuccaaagga

SEQ ID NO: 2164369 - RNA, 23 nt, Homo sapiens
ccuguaugguggaagcuggguga

SEQ ID NO: 2164370 - RNA, 15 nt, Homo sapiens
aaaugucacaauaaa

SEQ ID NO: 2164371 - RNA, 12 nt, Homo sapiens
ugggacuuuuaa

SEQ ID NO: 2164372 - RNA, 18 nt, Homo sapiens
augcuguaguaacugccu

SEQ ID NO: 2164373 - RNA, 18 nt, Homo sapiens
uaugauguuagaagaaga

SEQ ID NO: 2164374 - RNA, 13 nt, Homo sapiens
aagagauggugcu

SEQ ID NO: 2164375 - RNA, 15 nt, Homo sapiens
uucccaggaguacac

SEQ ID NO: 2164376 - RNA, 22 nt, Homo sapiens
agagcauuuccaacaccacaga

SEQ ID NO: 2164377 - RNA, 15 nt, Homo sapiens
uuaauucuucaccug

SEQ ID NO: 2164378 - RNA, 20 nt, Homo sapiens
uagcaggaacuucuagcuca

SEQ ID NO: 2164379 - RNA, 15 nt, Homo sapiens
aacaggggccaaacu

SEQ ID NO: 2164380 - RNA, 14 nt, Homo sapiens
gcuugugguuuguu

SEQ ID NO: 2164381 - RNA, 15 nt, Homo sapiens
auuuaagaguccuga

SEQ ID NO: 2164382 - RNA, 16 nt, Homo sapiens
ucuggaggucucugaa

SEQ ID NO: 2164383 - RNA, 22 nt, Homo sapiens
ugggaacaggagacccaccuga

SEQ ID NO: 2164384 - RNA, 19 nt, Homo sapiens
ugaugugucaucuaauuaa

SEQ ID NO: 2164385 - RNA, 15 nt, Homo sapiens
cuuguuaguaaugcu

SEQ ID NO: 2164386 - RNA, 15 nt, Homo sapiens
ccauauagacaccaa

SEQ ID NO: 2164387 - RNA, 18 nt, Homo sapiens
ccauauuugugccauucu

SEQ ID NO: 2164388 - RNA, 18 nt, Homo sapiens
ccaucucucccacuuccu

SEQ ID NO: 2164389 - RNA, 16 nt, Homo sapiens
ggcaugcuaagaauaa

SEQ ID NO: 2164390 - RNA, 21 nt, Homo sapiens
aaggaacugcaauaauaucaa

SEQ ID NO: 2164391 - RNA, 19 nt, Homo sapiens
aacaccuucuuauuauaua

SEQ ID NO: 2164392 - RNA, 15 nt, Homo sapiens
uaucucccacaaaua

SEQ ID NO: 2164393 - RNA, 23 nt, Homo sapiens
uuuuacccugaggucacugcuag

SEQ ID NO: 2164394 - RNA, 18 nt, Homo sapiens
cauucagaaagcuucaaa

SEQ ID NO: 2164395 - RNA, 22 nt, Homo sapiens
uggccaucacuuucauucaauu

SEQ ID NO: 2164396 - RNA, 18 nt, Homo sapiens
cuccucagccucugcaac

SEQ ID NO: 2164397 - RNA, 21 nt, Homo sapiens
cccccuccccggccacaugcc

SEQ ID NO: 2164398 - RNA, 16 nt, Homo sapiens
auuauagaauugcaca

SEQ ID NO: 2164399 - RNA, 14 nt, Homo sapiens
caagaccccaaagg

SEQ ID NO: 2164400 - RNA, 15 nt, Homo sapiens
uuucagaagcauuca

SEQ ID NO: 2164401 - RNA, 14 nt, Homo sapiens
gaggcuacagcaga

SEQ ID NO: 2164402 - RNA, 15 nt, Homo sapiens
ugcccuccugaaugg

SEQ ID NO: 2164403 - RNA, 18 nt, Homo sapiens
cagcaauucaugguucaa

SEQ ID NO: 2164404 - RNA, 15 nt, Homo sapiens
uuucaaaauucucau

SEQ ID NO: 2164405 - RNA, 11 nt, Homo sapiens
uggaugcauuu

SEQ ID NO: 2164406 - RNA, 20 nt, Homo sapiens
gaauaaaagaugauuucuca

SEQ ID NO: 2164407 - RNA, 14 nt, Homo sapiens
gaaaaauaaugacu

SEQ ID NO: 2164408 - RNA, 18 nt, Homo sapiens
ucaucuguggagcugcca

SEQ ID NO: 2164409 - RNA, 20 nt, Homo sapiens
ucugggcacugaagggauau

SEQ ID NO: 2164410 - RNA, 19 nt, Homo sapiens
auaucuaucagaguaucca

SEQ ID NO: 2164411 - RNA, 20 nt, Homo sapiens
uuugaaauagucugugugaa

SEQ ID NO: 2164412 - RNA, 21 nt, Homo sapiens
accuuguaaucagcacauugu

SEQ ID NO: 2164413 - RNA, 22 nt, Homo sapiens
uucuggcuacugcacucuccac

SEQ ID NO: 2164414 - RNA, 20 nt, Homo sapiens
gaauacacaacuccacuguc

SEQ ID NO: 2164415 - RNA, 22 nt, Homo sapiens
agugaacaaaaaggggaaguau

SEQ ID NO: 2164416 - RNA, 23 nt, Homo sapiens
guccuccccuauugcgcucucaa

SEQ ID NO: 2164417 - RNA, 16 nt, Homo sapiens
cacuguguaaccagca

SEQ ID NO: 2164418 - RNA, 14 nt, Homo sapiens
ucuaucucucaaaa

SEQ ID NO: 2164419 - RNA, 17 nt, Homo sapiens
agaagcuguaggacugu

SEQ ID NO: 2164420 - RNA, 12 nt, Homo sapiens
uuuaaaauucac

SEQ ID NO: 2164421 - RNA, 15 nt, Homo sapiens
ucucaagaccaacag

SEQ ID NO: 2164422 - RNA, 12 nt, Homo sapiens
gaggaucacuug

SEQ ID NO: 2164423 - RNA, 12 nt, Homo sapiens
gaguaucacuuu

SEQ ID NO: 2164424 - RNA, 14 nt, Homo sapiens
auaauuucuacucu

SEQ ID NO: 2164425 - RNA, 16 nt, Homo sapiens
uucaaagaaguacuuu

SEQ ID NO: 2164426 - RNA, 17 nt, Homo sapiens
cgaaugauucuauuaaa

SEQ ID NO: 2164427 - RNA, 15 nt, Homo sapiens
uccccaaucccugac

SEQ ID NO: 2164428 - RNA, 22 nt, Homo sapiens
cacaaacugucgucuuuuucca

SEQ ID NO: 2164429 - RNA, 22 nt, Homo sapiens
caguuccuucaauaaccaugau

SEQ ID NO: 2164430 - RNA, 16 nt, Homo sapiens
uucuaugugucaucaa

SEQ ID NO: 2164431 - RNA, 22 nt, Homo sapiens
aacagaagcuuuuuguuugcau

SEQ ID NO: 2164432 - RNA, 14 nt, Homo sapiens
agaauagcuuugaa

SEQ ID NO: 2164433 - RNA, 21 nt, Homo sapiens
ucaccaggagcccggcuucca

SEQ ID NO: 2164434 - RNA, 19 nt, Homo sapiens
cagaaguccccucuacuuu

SEQ ID NO: 2164435 - RNA, 17 nt, Homo sapiens
cucuuugugauaauucu

SEQ ID NO: 2164436 - RNA, 21 nt, Homo sapiens
acaauuagauaaauguccauu

SEQ ID NO: 2164437 - RNA, 17 nt, Homo sapiens
ccuccuuuacuucccag

SEQ ID NO: 2164438 - RNA, 21 nt, Homo sapiens
gugcagauuuagguuacuuua

SEQ ID NO: 2164439 - RNA, 14 nt, Homo sapiens
uccaccgcacagac

SEQ ID NO: 2164440 - RNA, 19 nt, Homo sapiens
ucagugucguuuauauugu

SEQ ID NO: 2164441 - RNA, 19 nt, Homo sapiens
cugaauaaauugaacuaaa

SEQ ID NO: 2164442 - RNA, 16 nt, Homo sapiens
caaagacuuugaucca

SEQ ID NO: 2164443 - RNA, 16 nt, Homo sapiens
aucaaacuacugccau

SEQ ID NO: 2164444 - RNA, 22 nt, Homo sapiens
gccucucuuucacacaaugccc

SEQ ID NO: 2164445 - RNA, 18 nt, Homo sapiens
caggcuggagugcagugg

SEQ ID NO: 2164446 - RNA, 17 nt, Homo sapiens
cacuguucaggagucca

SEQ ID NO: 2164447 - RNA, 23 nt, Homo sapiens
cuucacuguccuccaagccagcg

SEQ ID NO: 2164448 - RNA, 17 nt, Homo sapiens
caacugcacccaugaga

SEQ ID NO: 2164449 - RNA, 12 nt, Homo sapiens
cugaaacuugaa

SEQ ID NO: 2164450 - RNA, 12 nt, Homo sapiens
cugcacauuccu

SEQ ID NO: 2164451 - RNA, 16 nt, Homo sapiens
guucaagcacacugga

SEQ ID NO: 2164452 - RNA, 23 nt, Homo sapiens
ggucacuuuacuguccccaucau

SEQ ID NO: 2164453 - RNA, 19 nt, Homo sapiens
ccccuaacccuacaugcau

SEQ ID NO: 2164454 - RNA, 22 nt, Homo sapiens
acugcauucuucugagcacugu

SEQ ID NO: 2164455 - RNA, 17 nt, Homo sapiens
gcugagcacagggcugu

SEQ ID NO: 2164456 - RNA, 18 nt, Homo sapiens
gcccauuuccauggugca

SEQ ID NO: 2164457 - RNA, 16 nt, Homo sapiens
ggucuaagguugccau

SEQ ID NO: 2164458 - RNA, 16 nt, Homo sapiens
gcuaaggauagggaaa

SEQ ID NO: 2164459 - RNA, 14 nt, Homo sapiens
gcaaugguggugca

SEQ ID NO: 2164460 - RNA, 22 nt, Homo sapiens
ccuguuccccaaggacucuucc

SEQ ID NO: 2164461 - RNA, 17 nt, Homo sapiens
auguuaaagaugcacag

SEQ ID NO: 2164462 - RNA, 22 nt, Homo sapiens
ccugcacagaucgauaccuuuc

SEQ ID NO: 2164463 - RNA, 17 nt, Homo sapiens
aguacaagagcuuaaca

SEQ ID NO: 2164464 - RNA, 10 nt, Homo sapiens
acugcaauaa

SEQ ID NO: 2164465 - RNA, 23 nt, Homo sapiens
cugguugauacggagccauguca

SEQ ID NO: 2164466 - RNA, 14 nt, Homo sapiens
ggcaaaaaagaaca

SEQ ID NO: 2164467 - RNA, 19 nt, Homo sapiens
cugcaccccugcaguuuga

SEQ ID NO: 2164468 - RNA, 20 nt, Homo sapiens
uacaauuuuauaggugaaag

SEQ ID NO: 2164469 - RNA, 22 nt, Homo sapiens
cuguccucagccuugccagaga

SEQ ID NO: 2164470 - RNA, 23 nt, Homo sapiens
augauucacccccaaacagugac

SEQ ID NO: 2164471 - RNA, 12 nt, Homo sapiens
ugcaccaaagag

SEQ ID NO: 2164472 - RNA, 17 nt, Homo sapiens
cuccagucauugcacaa

SEQ ID NO: 2164473 - RNA, 14 nt, Homo sapiens
uaccuaaacugagc

SEQ ID NO: 2164474 - RNA, 17 nt, Homo sapiens
ggauugcuaugaaugau

SEQ ID NO: 2164475 - RNA, 13 nt, Homo sapiens
ccugcacaagcca

SEQ ID NO: 2164476 - RNA, 14 nt, Homo sapiens
auucugaugagcaa

SEQ ID NO: 2164477 - RNA, 14 nt, Homo sapiens
gcucugaaggucca

SEQ ID NO: 2164478 - RNA, 14 nt, Homo sapiens
ucaaugaaugaaca

SEQ ID NO: 2164479 - RNA, 15 nt, Homo sapiens
cucuuacugcaguaa

SEQ ID NO: 2164480 - RNA, 13 nt, Homo sapiens
aagauccacccuc

SEQ ID NO: 2164481 - RNA, 21 nt, Homo sapiens
agcacauuuccucucuaucuu

SEQ ID NO: 2164482 - RNA, 19 nt, Homo sapiens
gaacacccuggaugcuguu

SEQ ID NO: 2164483 - RNA, 15 nt, Homo sapiens
gcagagaacaucugg

SEQ ID NO: 2164484 - RNA, 15 nt, Homo sapiens
gagcaugagccagcu

SEQ ID NO: 2164485 - RNA, 17 nt, Homo sapiens
uagauagguagaacuau

SEQ ID NO: 2164486 - RNA, 20 nt, Homo sapiens
gggcagccccacagucccau

SEQ ID NO: 2164487 - RNA, 11 nt, Homo sapiens
cagcuuugucu

SEQ ID NO: 2164488 - RNA, 20 nt, Homo sapiens
ugcuguggggaccacacuga

SEQ ID NO: 2164489 - RNA, 20 nt, Homo sapiens
aguacauggucaaguauuaa

SEQ ID NO: 2164490 - RNA, 18 nt, Homo sapiens
cauuuuuguuucugaaaa

SEQ ID NO: 2164491 - RNA, 18 nt, Homo sapiens
gcccaguuggguggaugc

SEQ ID NO: 2164492 - RNA, 16 nt, Homo sapiens
guuuccuggcacugga

SEQ ID NO: 2164493 - RNA, 19 nt, Homo sapiens
aauaugccuuuuugaagca

SEQ ID NO: 2164494 - RNA, 18 nt, Homo sapiens
uauaagauuccaaaaagc

SEQ ID NO: 2164495 - RNA, 16 nt, Homo sapiens
auauaauaauuacuua

SEQ ID NO: 2164496 - RNA, 17 nt, Homo sapiens
auggcuguggagugugg

SEQ ID NO: 2164497 - RNA, 19 nt, Homo sapiens
gcaaaccauggcagacuca

SEQ ID NO: 2164498 - RNA, 19 nt, Homo sapiens
uaaucggcuugaauuuuga

SEQ ID NO: 2164499 - RNA, 20 nt, Homo sapiens
gagagcaaucuugcugugaa

SEQ ID NO: 2164500 - RNA, 21 nt, Homo sapiens
ccuaaaacccaaagguggcag

SEQ ID NO: 2164501 - RNA, 15 nt, Homo sapiens
uauccuguauucuug

SEQ ID NO: 2164502 - RNA, 15 nt, Homo sapiens
aacaccauuucauca

SEQ ID NO: 2164503 - RNA, 20 nt, Homo sapiens
ggauccccagccuacugccu

SEQ ID NO: 2164504 - RNA, 15 nt, Homo sapiens
cggaccucaguuucu

SEQ ID NO: 2164505 - RNA, 13 nt, Homo sapiens
agccgugaugccu

SEQ ID NO: 2164506 - RNA, 18 nt, Homo sapiens
uacaauaaagucuuaccu

SEQ ID NO: 2164507 - RNA, 21 nt, Homo sapiens
agcuacaggcuugagcuuuaa

SEQ ID NO: 2164508 - RNA, 17 nt, Homo sapiens
cccaggagccucacugg

SEQ ID NO: 2164509 - RNA, 19 nt, Homo sapiens
agaguuagguugucuccag

SEQ ID NO: 2164510 - RNA, 21 nt, Homo sapiens
cuuugugugauuaaaugacac

SEQ ID NO: 2164511 - RNA, 18 nt, Homo sapiens
aaugccacauacuugcag

SEQ ID NO: 2164512 - RNA, 13 nt, Homo sapiens
ccauaggucuuaa

SEQ ID NO: 2164513 - RNA, 17 nt, Homo sapiens
gcuuuuguuuugcuuac

SEQ ID NO: 2164514 - RNA, 13 nt, Homo sapiens
uauauaccaaagc

SEQ ID NO: 2164515 - RNA, 20 nt, Homo sapiens
caacucugagaucuaaggau

SEQ ID NO: 2164516 - RNA, 18 nt, Homo sapiens
cccauuucccauuaaaga

SEQ ID NO: 2164517 - RNA, 19 nt, Homo sapiens
aaagcagggacuugaaccc

SEQ ID NO: 2164518 - RNA, 20 nt, Homo sapiens
uccuuguauuuaaauauuaa

SEQ ID NO: 2164519 - RNA, 22 nt, Homo sapiens
uugcuugacaacaaccuaugca

SEQ ID NO: 2164520 - RNA, 20 nt, Homo sapiens
uuucuccuugauaucauuca

SEQ ID NO: 2164521 - RNA, 18 nt, Homo sapiens
aggcaccaugcaaauguc

SEQ ID NO: 2164522 - RNA, 15 nt, Homo sapiens
ugaaauuuuuaucua

SEQ ID NO: 2164523 - RNA, 15 nt, Homo sapiens
uuuucauuuguaaaa

SEQ ID NO: 2164524 - RNA, 18 nt, Homo sapiens
cauuuggccuugugcggu

SEQ ID NO: 2164525 - RNA, 17 nt, Homo sapiens
auucucugucucaucca

SEQ ID NO: 2164526 - RNA, 13 nt, Homo sapiens
ggcuggacuugga

SEQ ID NO: 2164527 - RNA, 20 nt, Homo sapiens
cacacagcaagucaggguug

SEQ ID NO: 2164528 - RNA, 16 nt, Homo sapiens
uggagacgccucccca

SEQ ID NO: 2164529 - RNA, 18 nt, Homo sapiens
aauaaacuuaacaaagag

SEQ ID NO: 2164530 - RNA, 17 nt, Homo sapiens
caccagugcauccuuca

SEQ ID NO: 2164531 - RNA, 14 nt, Homo sapiens
auuugggucagccu

SEQ ID NO: 2164532 - RNA, 13 nt, Homo sapiens
ugaaagugguuug

SEQ ID NO: 2164533 - RNA, 14 nt, Homo sapiens
gaccucaggugauu

SEQ ID NO: 2164534 - RNA, 20 nt, Homo sapiens
gaguagucucauaucaggga

SEQ ID NO: 2164535 - RNA, 22 nt, Homo sapiens
caccuggauggaucugcuccau

SEQ ID NO: 2164536 - RNA, 13 nt, Homo sapiens
cccagugcuugca

SEQ ID NO: 2164537 - RNA, 14 nt, Homo sapiens
ugaccccuuuucag

SEQ ID NO: 2164538 - RNA, 18 nt, Homo sapiens
uacacguugaaaaucaac

SEQ ID NO: 2164539 - RNA, 17 nt, Homo sapiens
uugggaggaagcacaga

SEQ ID NO: 2164540 - RNA, 20 nt, Homo sapiens
ucuuaaccucaaaacuguau

SEQ ID NO: 2164541 - RNA, 16 nt, Homo sapiens
cucugcuucaguccac

SEQ ID NO: 2164542 - RNA, 20 nt, Homo sapiens
uuuucuguaaauaaccuauu

SEQ ID NO: 2164543 - RNA, 23 nt, Homo sapiens
aauuguauuauaauucauuguga

SEQ ID NO: 2164544 - RNA, 19 nt, Homo sapiens
ucuacugaaaauacaaaaa

SEQ ID NO: 2164545 - RNA, 18 nt, Homo sapiens
cauucauaaaaguuugca

SEQ ID NO: 2164546 - RNA, 18 nt, Homo sapiens
acuugcauguacagagcc

SEQ ID NO: 2164547 - RNA, 16 nt, Homo sapiens
uggaaaaugugcaaua

SEQ ID NO: 2164548 - RNA, 19 nt, Homo sapiens
cugcauagucuguuccuuu

SEQ ID NO: 2164549 - RNA, 15 nt, Homo sapiens
cugcauuacuccuuc

SEQ ID NO: 2164550 - RNA, 14 nt, Homo sapiens
gcagcuccugaccu

SEQ ID NO: 2164551 - RNA, 17 nt, Homo sapiens
guacuccuuaaauuuau

SEQ ID NO: 2164552 - RNA, 19 nt, Homo sapiens
gcugaccccucuggugugu

SEQ ID NO: 2164553 - RNA, 22 nt, Homo sapiens
ggaacccccagaauaaauaugc

SEQ ID NO: 2164554 - RNA, 17 nt, Homo sapiens
acuugcuuccaagcccu

SEQ ID NO: 2164555 - RNA, 13 nt, Homo sapiens
uacagacucugau

SEQ ID NO: 2164556 - RNA, 18 nt, Homo sapiens
aagauccuccugaccuca

SEQ ID NO: 2164557 - RNA, 14 nt, Homo sapiens
cuugguuguauaaa

SEQ ID NO: 2164558 - RNA, 14 nt, Homo sapiens
cacugggaaggcac

SEQ ID NO: 2164559 - RNA, 14 nt, Homo sapiens
uuacauguguaaag

SEQ ID NO: 2164560 - RNA, 11 nt, Homo sapiens
cacagcacauu

SEQ ID NO: 2164561 - RNA, 15 nt, Homo sapiens
cgauacaaaguguug

SEQ ID NO: 2164562 - RNA, 20 nt, Homo sapiens
uggugguggaaggguagaga

SEQ ID NO: 2164563 - RNA, 13 nt, Homo sapiens
cacgaacugaaau

SEQ ID NO: 2164564 - RNA, 16 nt, Homo sapiens
aauaauuugcacugaa

SEQ ID NO: 2164565 - RNA, 16 nt, Homo sapiens
ugaauuuuagcuuuug

SEQ ID NO: 2164566 - RNA, 14 nt, Homo sapiens
caucccagccucag

SEQ ID NO: 2164567 - RNA, 20 nt, Homo sapiens
cuggagggagaacccaaaga

SEQ ID NO: 2164568 - RNA, 22 nt, Homo sapiens
accaguguuagugggaagagcu

SEQ ID NO: 2164569 - RNA, 21 nt, Homo sapiens
aaaggaagccucuucaucucc

SEQ ID NO: 2164570 - RNA, 18 nt, Homo sapiens
uugcgcucaggggcucca

SEQ ID NO: 2164571 - RNA, 14 nt, Homo sapiens
cagaaacaugucuu

SEQ ID NO: 2164572 - RNA, 15 nt, Homo sapiens
ggccacccugugcag

SEQ ID NO: 2164573 - RNA, 21 nt, Homo sapiens
uuaaggaugggcauaagcaaa

SEQ ID NO: 2164574 - RNA, 22 nt, Homo sapiens
acuacaggagaugcugucacuu

SEQ ID NO: 2164575 - RNA, 15 nt, Homo sapiens
cucaaccaugaccuc

SEQ ID NO: 2164576 - RNA, 17 nt, Homo sapiens
cuuucuagccuuagaca

SEQ ID NO: 2164577 - RNA, 16 nt, Homo sapiens
guccccugcccaugcu

SEQ ID NO: 2164578 - RNA, 19 nt, Homo sapiens
agccuggccaacaugguga

SEQ ID NO: 2164579 - RNA, 18 nt, Homo sapiens
uuaauuugauaguauugu

SEQ ID NO: 2164580 - RNA, 18 nt, Homo sapiens
guucuuucuuacacaaga

SEQ ID NO: 2164581 - RNA, 19 nt, Homo sapiens
aagcugauuacugucaaua

SEQ ID NO: 2164582 - RNA, 22 nt, Homo sapiens
caccuuccguuccccgcuaggu

SEQ ID NO: 2164583 - RNA, 17 nt, Homo sapiens
ucucauaaugaagacau

SEQ ID NO: 2164584 - RNA, 17 nt, Homo sapiens
ggugcaaagacucugag

SEQ ID NO: 2164585 - RNA, 22 nt, Homo sapiens
gcaauggcgcgaucucagcuca

SEQ ID NO: 2164586 - RNA, 23 nt, Homo sapiens
cuuugccucuucuuugugccuuu

SEQ ID NO: 2164587 - RNA, 14 nt, Homo sapiens
gcuguacacugcac

SEQ ID NO: 2164588 - RNA, 21 nt, Homo sapiens
ccacugccaaagaacuuggaa

SEQ ID NO: 2164589 - RNA, 22 nt, Homo sapiens
agggguuccuccccuccagcuc

SEQ ID NO: 2164590 - RNA, 14 nt, Homo sapiens
gaaaaacaacaaau

SEQ ID NO: 2164591 - RNA, 15 nt, Homo sapiens
uccugagcucgugau

SEQ ID NO: 2164592 - RNA, 14 nt, Homo sapiens
ccaucaagcacuuc

SEQ ID NO: 2164593 - RNA, 12 nt, Homo sapiens
agaaucacuuga

SEQ ID NO: 2164594 - RNA, 13 nt, Homo sapiens
aucaguguugcaa

SEQ ID NO: 2164595 - RNA, 17 nt, Homo sapiens
cuccuguaccucagugg

SEQ ID NO: 2164596 - RNA, 23 nt, Homo sapiens
ccuaauccccauaacuuccagua

SEQ ID NO: 2164597 - RNA, 23 nt, Homo sapiens
aggaauaaagcuucucucugagc

SEQ ID NO: 2164598 - RNA, 18 nt, Homo sapiens
cuguuugauacaguauua

SEQ ID NO: 2164599 - RNA, 16 nt, Homo sapiens
uuuggcucagagucca

SEQ ID NO: 2164600 - RNA, 17 nt, Homo sapiens
auccaugggcaguauga

SEQ ID NO: 2164601 - RNA, 13 nt, Homo sapiens
gcacaccagagac

SEQ ID NO: 2164602 - RNA, 14 nt, Homo sapiens
cagaugauccauuu

SEQ ID NO: 2164603 - RNA, 13 nt, Homo sapiens
gccuuuccagggu

SEQ ID NO: 2164604 - RNA, 21 nt, Homo sapiens
agcagccucagaacaaaguga

SEQ ID NO: 2164605 - RNA, 15 nt, Homo sapiens
agaaggaauggugcu

SEQ ID NO: 2164606 - RNA, 15 nt, Homo sapiens
agcaucuguuuaccu

SEQ ID NO: 2164607 - RNA, 17 nt, Homo sapiens
cuuaaugcuucuuucau

SEQ ID NO: 2164608 - RNA, 22 nt, Homo sapiens
uagacuuuguaugaacucuuua

SEQ ID NO: 2164609 - RNA, 19 nt, Homo sapiens
gaacuguugccuaauugga

SEQ ID NO: 2164610 - RNA, 18 nt, Homo sapiens
caucuuugucaguuuaca

SEQ ID NO: 2164611 - RNA, 21 nt, Homo sapiens
agaggaaaugucacagaagca

SEQ ID NO: 2164612 - RNA, 23 nt, Homo sapiens
gagaugagccccacguggagcuc

SEQ ID NO: 2164613 - RNA, 22 nt, Homo sapiens
cugcacccucgacaagaccaca

SEQ ID NO: 2164614 - RNA, 21 nt, Homo sapiens
ucuuuguggggaagaggggcu

SEQ ID NO: 2164615 - RNA, 19 nt, Homo sapiens
ucaaaaauccuaacauuca

SEQ ID NO: 2164616 - RNA, 18 nt, Homo sapiens
uaccgcgucuacccuggg

SEQ ID NO: 2164617 - RNA, 18 nt, Homo sapiens
uacauaugccaaaauauc

SEQ ID NO: 2164618 - RNA, 23 nt, Homo sapiens
caguaaaaaacaacuucuuugua

SEQ ID NO: 2164619 - RNA, 13 nt, Homo sapiens
uaaaagugcauuu

SEQ ID NO: 2164620 - RNA, 15 nt, Homo sapiens
acuauggacuuaccc

SEQ ID NO: 2164621 - RNA, 14 nt, Homo sapiens
aauuaauauaucau

SEQ ID NO: 2164622 - RNA, 14 nt, Homo sapiens
aacccuuauacuca

SEQ ID NO: 2164623 - RNA, 14 nt, Homo sapiens
auuuauuauuucaa

SEQ ID NO: 2164624 - RNA, 18 nt, Homo sapiens
cuuguguccccaccucag

SEQ ID NO: 2164625 - RNA, 23 nt, Homo sapiens
caaggaaguagaaacaaaauaca

SEQ ID NO: 2164626 - RNA, 20 nt, Homo sapiens
ccuaacuuuucuacguauaa

SEQ ID NO: 2164627 - RNA, 16 nt, Homo sapiens
cuccagaacaaaccuc

SEQ ID NO: 2164628 - RNA, 14 nt, Homo sapiens
ugaaauaacacagc

SEQ ID NO: 2164629 - RNA, 19 nt, Homo sapiens
uuugucuuaaguguuucuc

SEQ ID NO: 2164630 - RNA, 19 nt, Homo sapiens
caguacaacccauaaucau

SEQ ID NO: 2164631 - RNA, 20 nt, Homo sapiens
ucucaaaauggaagcccuua

SEQ ID NO: 2164632 - RNA, 13 nt, Homo sapiens
aggcuuugcccug

SEQ ID NO: 2164633 - RNA, 18 nt, Homo sapiens
aaauauaauuccuuuaaa

SEQ ID NO: 2164634 - RNA, 13 nt, Homo sapiens
cuccugccaugua

SEQ ID NO: 2164635 - RNA, 16 nt, Homo sapiens
gccacucuuagcuaaa

SEQ ID NO: 2164636 - RNA, 21 nt, Homo sapiens
uggcaaaacagacaucaugcu

SEQ ID NO: 2164637 - RNA, 17 nt, Homo sapiens
cucaguuaugaguauaa

SEQ ID NO: 2164638 - RNA, 15 nt, Homo sapiens
uguggaagagcauua

SEQ ID NO: 2164639 - RNA, 11 nt, Homo sapiens
aucaaugucac

SEQ ID NO: 2164640 - RNA, 21 nt, Homo sapiens
cccaaguaugccuuaagcaga

SEQ ID NO: 2164641 - RNA, 18 nt, Homo sapiens
aucccaauccuuauccca

SEQ ID NO: 2164642 - RNA, 19 nt, Homo sapiens
caacuuccuaaauauuaug

SEQ ID NO: 2164643 - RNA, 20 nt, Homo sapiens
gcuccuuuauuauaaucaaa

SEQ ID NO: 2164644 - RNA, 15 nt, Homo sapiens
ugaauggccugccuu

SEQ ID NO: 2164645 - RNA, 15 nt, Homo sapiens
aaagauccacccuca

SEQ ID NO: 2164646 - RNA, 17 nt, Homo sapiens
gggcccuggagcucaag

SEQ ID NO: 2164647 - RNA, 23 nt, Homo sapiens
agcucaaaguacuacagcaaagc

SEQ ID NO: 2164648 - RNA, 14 nt, Homo sapiens
gaggaggccuccau

SEQ ID NO: 2164649 - RNA, 14 nt, Homo sapiens
ugaagacagaggca

SEQ ID NO: 2164650 - RNA, 19 nt, Homo sapiens
gcaccaucagccuguucca

SEQ ID NO: 2164651 - RNA, 16 nt, Homo sapiens
aaauauuuuucccucc

SEQ ID NO: 2164652 - RNA, 16 nt, Homo sapiens
uagaaagcuugaaaag

SEQ ID NO: 2164653 - RNA, 23 nt, Homo sapiens
ccagagccuuggaggacacuaag

SEQ ID NO: 2164654 - RNA, 20 nt, Homo sapiens
aauaaauggccagugcugcu

SEQ ID NO: 2164655 - RNA, 18 nt, Homo sapiens
accuacauuuuaaugcac

SEQ ID NO: 2164656 - RNA, 14 nt, Homo sapiens
aaccuacccucagu

SEQ ID NO: 2164657 - RNA, 19 nt, Homo sapiens
ccaacauugccuugcauuu

SEQ ID NO: 2164658 - RNA, 22 nt, Homo sapiens
guaauugcuuaaaguuuuacca

SEQ ID NO: 2164659 - RNA, 23 nt, Homo sapiens
uuuugagacugguugcauaacag

SEQ ID NO: 2164660 - RNA, 19 nt, Homo sapiens
ucugcuguuuacaacauca

SEQ ID NO: 2164661 - RNA, 15 nt, Homo sapiens
aauuugcaacauaua

SEQ ID NO: 2164662 - RNA, 15 nt, Homo sapiens
ggacaccaagccuug

SEQ ID NO: 2164663 - RNA, 22 nt, Homo sapiens
gccauuuuuugucugugauaac

SEQ ID NO: 2164664 - RNA, 18 nt, Homo sapiens
cagaauuuggaaauccua

SEQ ID NO: 2164665 - RNA, 22 nt, Homo sapiens
aauaagacaagagaucuacaca

SEQ ID NO: 2164666 - RNA, 21 nt, Homo sapiens
caguuggggaagccaggugag

SEQ ID NO: 2164667 - RNA, 23 nt, Homo sapiens
aacauaauaaaucacacauucag

SEQ ID NO: 2164668 - RNA, 11 nt, Homo sapiens
ucagcacugcc

SEQ ID NO: 2164669 - RNA, 23 nt, Homo sapiens
caaaaaauaccuucuaacuuaag

SEQ ID NO: 2164670 - RNA, 11 nt, Homo sapiens
uucaagugauu

SEQ ID NO: 2164671 - RNA, 18 nt, Homo sapiens
caucccaaccagugccaa

SEQ ID NO: 2164672 - RNA, 23 nt, Homo sapiens
acauguggugggacagggaccca

SEQ ID NO: 2164673 - RNA, 20 nt, Homo sapiens
acagaaucuccauuucugcu

SEQ ID NO: 2164674 - RNA, 15 nt, Homo sapiens
acacguuacuagcag

SEQ ID NO: 2164675 - RNA, 21 nt, Homo sapiens
auuucccuuuucugugugcau

SEQ ID NO: 2164676 - RNA, 15 nt, Homo sapiens
aucaaagaacaaaca

SEQ ID NO: 2164677 - RNA, 18 nt, Homo sapiens
aagcacuuggacucuugc

SEQ ID NO: 2164678 - RNA, 23 nt, Homo sapiens
auuuuuugguuaagcuuugacac

SEQ ID NO: 2164679 - RNA, 22 nt, Homo sapiens
augccuuaaaccuaccucccac

SEQ ID NO: 2164680 - RNA, 18 nt, Homo sapiens
ugugacccagggugcauu

SEQ ID NO: 2164681 - RNA, 17 nt, Homo sapiens
aggacaucaaaguggua

SEQ ID NO: 2164682 - RNA, 17 nt, Homo sapiens
agcggaaagcagcucaa

SEQ ID NO: 2164683 - RNA, 18 nt, Homo sapiens
guggcgagaaggugggga

SEQ ID NO: 2164684 - RNA, 19 nt, Homo sapiens
ugcaucaguucacugcugc

SEQ ID NO: 2164685 - RNA, 20 nt, Homo sapiens
auauuugaaauaguauacau

SEQ ID NO: 2164686 - RNA, 18 nt, Homo sapiens
uuuguuucaucaggacac

SEQ ID NO: 2164687 - RNA, 11 nt, Homo sapiens
ugacacuuuuu

SEQ ID NO: 2164688 - RNA, 22 nt, Homo sapiens
acugcgcccagcuauacuguau

SEQ ID NO: 2164689 - RNA, 13 nt, Homo sapiens
auuaugacacucc

SEQ ID NO: 2164690 - RNA, 21 nt, Homo sapiens
agaggcuaauucagugucaca

SEQ ID NO: 2164691 - RNA, 21 nt, Homo sapiens
auuggcuaugauggugacaug

SEQ ID NO: 2164692 - RNA, 23 nt, Homo sapiens
gaaaacucagaagaaagcucaga

SEQ ID NO: 2164693 - RNA, 15 nt, Homo sapiens
uacuuuauagcacau

SEQ ID NO: 2164694 - RNA, 23 nt, Homo sapiens
gcuugccugcagggccauggcuc

SEQ ID NO: 2164695 - RNA, 20 nt, Homo sapiens
guaauaucaguuacaguggc

SEQ ID NO: 2164696 - RNA, 18 nt, Homo sapiens
cugcagaacagcaucaug

SEQ ID NO: 2164697 - RNA, 18 nt, Homo sapiens
uuugagaauaugaucaug

SEQ ID NO: 2164698 - RNA, 16 nt, Homo sapiens
agucuggagugaacca

SEQ ID NO: 2164699 - RNA, 16 nt, Homo sapiens
gugcacaaaguggcau

SEQ ID NO: 2164700 - RNA, 19 nt, Homo sapiens
auacaauuaugaagauuua

SEQ ID NO: 2164701 - RNA, 17 nt, Homo sapiens
auucuccuguccuugua

SEQ ID NO: 2164702 - RNA, 17 nt, Homo sapiens
cagagccccucaugcca

SEQ ID NO: 2164703 - RNA, 22 nt, Homo sapiens
accuggggagugguuaggcagc

SEQ ID NO: 2164704 - RNA, 21 nt, Homo sapiens
cuguacugggccauguugugc

SEQ ID NO: 2164705 - RNA, 19 nt, Homo sapiens
ugcccagacugaugagcac

SEQ ID NO: 2164706 - RNA, 14 nt, Homo sapiens
aggaguugucuguc

SEQ ID NO: 2164707 - RNA, 22 nt, Homo sapiens
agugccauugucuuuauaugaa

SEQ ID NO: 2164708 - RNA, 15 nt, Homo sapiens
aagggcaucacuggg

SEQ ID NO: 2164709 - RNA, 17 nt, Homo sapiens
caguaauagcugaaccu

SEQ ID NO: 2164710 - RNA, 18 nt, Homo sapiens
cccaacccacgaggacca

SEQ ID NO: 2164711 - RNA, 18 nt, Homo sapiens
uggaguaaaccauguauu

SEQ ID NO: 2164712 - RNA, 22 nt, Homo sapiens
auagaggguacuugaaucuuca

SEQ ID NO: 2164713 - RNA, 22 nt, Homo sapiens
auguacgauaaaguaacaguau

SEQ ID NO: 2164714 - RNA, 20 nt, Homo sapiens
cuagaccauauaacugugau

SEQ ID NO: 2164715 - RNA, 22 nt, Homo sapiens
ugccucuacuuugauucugaua

SEQ ID NO: 2164716 - RNA, 21 nt, Homo sapiens
auacuguugauacaaaccacu

SEQ ID NO: 2164717 - RNA, 19 nt, Homo sapiens
cuuuccccaccucuuccuu

SEQ ID NO: 2164718 - RNA, 21 nt, Homo sapiens
ggacagagugcccuggggcau

SEQ ID NO: 2164719 - RNA, 21 nt, Homo sapiens
auuccugguguagcacuuaac

SEQ ID NO: 2164720 - RNA, 21 nt, Homo sapiens
ccucucaacacccaguuuccu

SEQ ID NO: 2164721 - RNA, 23 nt, Homo sapiens
gagucauuucugauuucagggga

SEQ ID NO: 2164722 - RNA, 20 nt, Homo sapiens
cucaaaggcauaagucauuc

SEQ ID NO: 2164723 - RNA, 15 nt, Homo sapiens
accuuguuuugccag

SEQ ID NO: 2164724 - RNA, 15 nt, Homo sapiens
acuuuauguacugcu

SEQ ID NO: 2164725 - RNA, 15 nt, Homo sapiens
agaacccagauuucc

SEQ ID NO: 2164726 - RNA, 17 nt, Homo sapiens
cucugcuguagagccau

SEQ ID NO: 2164727 - RNA, 18 nt, Homo sapiens
ucuacauuucacauuauu

SEQ ID NO: 2164728 - RNA, 15 nt, Homo sapiens
agccuuggccucaga

SEQ ID NO: 2164729 - RNA, 16 nt, Homo sapiens
uaccacgggucugcca

SEQ ID NO: 2164730 - RNA, 18 nt, Homo sapiens
auuauuuugugguccuuu

SEQ ID NO: 2164731 - RNA, 15 nt, Homo sapiens
auaaaaccacuguac

SEQ ID NO: 2164732 - RNA, 15 nt, Homo sapiens
ccucuggggcauuau

SEQ ID NO: 2164733 - RNA, 15 nt, Homo sapiens
uaauaaaccuccuuc

SEQ ID NO: 2164734 - RNA, 14 nt, Homo sapiens
cucuagaacagcca

SEQ ID NO: 2164735 - RNA, 21 nt, Homo sapiens
uaaguaauugcauuucugcuc

SEQ ID NO: 2164736 - RNA, 19 nt, Homo sapiens
uucauuccuucagauuugg

SEQ ID NO: 2164737 - RNA, 14 nt, Homo sapiens
aauagucuucucaa

SEQ ID NO: 2164738 - RNA, 18 nt, Homo sapiens
gagaggagcguguccuau

SEQ ID NO: 2164739 - RNA, 14 nt, Homo sapiens
ggcaaagugcugua

SEQ ID NO: 2164740 - RNA, 15 nt, Homo sapiens
cauaaaaacugugaa

SEQ ID NO: 2164741 - RNA, 13 nt, Homo sapiens
gagguuugcaaau

SEQ ID NO: 2164742 - RNA, 13 nt, Homo sapiens
gcaaaucagacac

SEQ ID NO: 2164743 - RNA, 16 nt, Homo sapiens
gacccuugucaucucu

SEQ ID NO: 2164744 - RNA, 17 nt, Homo sapiens
aggugaccauagggcuc

SEQ ID NO: 2164745 - RNA, 10 nt, Homo sapiens
gacagucauc

SEQ ID NO: 2164746 - RNA, 18 nt, Homo sapiens
guccagggcuagugacuu

SEQ ID NO: 2164747 - RNA, 20 nt, Homo sapiens
ccacgugugcuguggccagg

SEQ ID NO: 2164748 - RNA, 16 nt, Homo sapiens
uuaaagucuacacugc

SEQ ID NO: 2164749 - RNA, 19 nt, Homo sapiens
agcccagcccgcugcucac

SEQ ID NO: 2164750 - RNA, 18 nt, Homo sapiens
ugaccauaugcacaauuc

SEQ ID NO: 2164751 - RNA, 19 nt, Homo sapiens
aacuguaaaauacuucuuu

SEQ ID NO: 2164752 - RNA, 19 nt, Homo sapiens
uaccuuuuuauuugcaugu

SEQ ID NO: 2164753 - RNA, 17 nt, Homo sapiens
uacuguacuaauucuua

SEQ ID NO: 2164754 - RNA, 18 nt, Homo sapiens
uuguuaaaaugagcauug

SEQ ID NO: 2164755 - RNA, 19 nt, Homo sapiens
ggaucuccaaggaccaggu

SEQ ID NO: 2164756 - RNA, 21 nt, Homo sapiens
gcuuucaagugccuuucugca

SEQ ID NO: 2164757 - RNA, 13 nt, Homo sapiens
accaccuuuuuga

SEQ ID NO: 2164758 - RNA, 22 nt, Homo sapiens
uuuugucagaggcuccaaauag

SEQ ID NO: 2164759 - RNA, 15 nt, Homo sapiens
ccuuaaaacaauucu

SEQ ID NO: 2164760 - RNA, 14 nt, Homo sapiens
agcaccagccugag

SEQ ID NO: 2164761 - RNA, 19 nt, Homo sapiens
uguggacagcccgggagcu

SEQ ID NO: 2164762 - RNA, 22 nt, Homo sapiens
uaagaaaacaaaaucuaaaaca

SEQ ID NO: 2164763 - RNA, 20 nt, Homo sapiens
aagaacuuccccauacaaau

SEQ ID NO: 2164764 - RNA, 17 nt, Homo sapiens
auugauauaaagaaaua

SEQ ID NO: 2164765 - RNA, 21 nt, Homo sapiens
uugucagcugcagccacuuuc

SEQ ID NO: 2164766 - RNA, 16 nt, Homo sapiens
uguggguggcacugac

SEQ ID NO: 2164767 - RNA, 20 nt, Homo sapiens
cuaaccauucuguauugauu

SEQ ID NO: 2164768 - RNA, 13 nt, Homo sapiens
uaaaagacaagga

SEQ ID NO: 2164769 - RNA, 16 nt, Homo sapiens
guguuuugcaagggaa

SEQ ID NO: 2164770 - RNA, 22 nt, Homo sapiens
uacagacaagguucugcccuua

SEQ ID NO: 2164771 - RNA, 18 nt, Homo sapiens
caaggacaacaagauaca

SEQ ID NO: 2164772 - RNA, 19 nt, Homo sapiens
caagaggaaaauccaaaag

SEQ ID NO: 2164773 - RNA, 21 nt, Homo sapiens
cugugauggggucaucaaauu

SEQ ID NO: 2164774 - RNA, 16 nt, Homo sapiens
cacacuaaacucuggg

SEQ ID NO: 2164775 - RNA, 22 nt, Homo sapiens
ggaaaggcaucuaagacauuca

SEQ ID NO: 2164776 - RNA, 18 nt, Homo sapiens
cguaccaccaugcacugu

SEQ ID NO: 2164777 - RNA, 17 nt, Homo sapiens
agaugaacucuucucaa

SEQ ID NO: 2164778 - RNA, 18 nt, Homo sapiens
agcaauaccagcaauuca

SEQ ID NO: 2164779 - RNA, 21 nt, Homo sapiens
agaugucuuaaccucagggag

SEQ ID NO: 2164780 - RNA, 20 nt, Homo sapiens
uaguuuaccucauccaugca

SEQ ID NO: 2164781 - RNA, 11 nt, Homo sapiens
cuaaauuucca

SEQ ID NO: 2164782 - RNA, 20 nt, Homo sapiens
ccaccacugcuuaagugccu

SEQ ID NO: 2164783 - RNA, 16 nt, Homo sapiens
cugacauuucacuucc

SEQ ID NO: 2164784 - RNA, 13 nt, Homo sapiens
aagcacaguuuga

SEQ ID NO: 2164785 - RNA, 21 nt, Homo sapiens
cucauguuugugcauguauau

SEQ ID NO: 2164786 - RNA, 19 nt, Homo sapiens
accuugaagaaccucucac

SEQ ID NO: 2164787 - RNA, 22 nt, Homo sapiens
cuccucuguccaggcacugcug

SEQ ID NO: 2164788 - RNA, 18 nt, Homo sapiens
auguggcaaagugcugua

SEQ ID NO: 2164789 - RNA, 15 nt, Homo sapiens
cacccaggucuccag

SEQ ID NO: 2164790 - RNA, 13 nt, Homo sapiens
cccauccucacac

SEQ ID NO: 2164791 - RNA, 15 nt, Homo sapiens
ucaucucaagcuugc

SEQ ID NO: 2164792 - RNA, 18 nt, Homo sapiens
aaacuccuuaacuucagg

SEQ ID NO: 2164793 - RNA, 22 nt, Homo sapiens
cugaauaaaauugaugugcaug

SEQ ID NO: 2164794 - RNA, 16 nt, Homo sapiens
uaaugcaagcaaagua

SEQ ID NO: 2164795 - RNA, 20 nt, Homo sapiens
uuuuucuuuaaucaaaaguc

SEQ ID NO: 2164796 - RNA, 15 nt, Homo sapiens
uauggacacacaguc

SEQ ID NO: 2164797 - RNA, 18 nt, Homo sapiens
gacagauggaaaagggag

SEQ ID NO: 2164798 - RNA, 18 nt, Homo sapiens
ucugcauucucuagucag

SEQ ID NO: 2164799 - RNA, 12 nt, Homo sapiens
uaauuucagggu

SEQ ID NO: 2164800 - RNA, 20 nt, Homo sapiens
acaauacaguauuucuuugu

SEQ ID NO: 2164801 - RNA, 20 nt, Homo sapiens
ucaggggcggggagggugac

SEQ ID NO: 2164802 - RNA, 18 nt, Homo sapiens
gugaaggaaacagaaaaa

SEQ ID NO: 2164803 - RNA, 15 nt, Homo sapiens
caccugacagaauga

SEQ ID NO: 2164804 - RNA, 19 nt, Homo sapiens
augcucucagagcaccucu

SEQ ID NO: 2164805 - RNA, 21 nt, Homo sapiens
cagagaugacucugucucauu

SEQ ID NO: 2164806 - RNA, 16 nt, Homo sapiens
gaaaaaaagugcuaaa

SEQ ID NO: 2164807 - RNA, 23 nt, Homo sapiens
ucauucacucgggugcguguguu

SEQ ID NO: 2164808 - RNA, 16 nt, Homo sapiens
ccugagauuucaucug

SEQ ID NO: 2164809 - RNA, 20 nt, Homo sapiens
uaucugggagaugaccugcc

SEQ ID NO: 2164810 - RNA, 16 nt, Homo sapiens
ccccaccaccacuuac

SEQ ID NO: 2164811 - RNA, 15 nt, Homo sapiens
agagaagucacaggg

SEQ ID NO: 2164812 - RNA, 16 nt, Homo sapiens
cuguugggaaccagag

SEQ ID NO: 2164813 - RNA, 16 nt, Homo sapiens
uucuucaccucuucca

SEQ ID NO: 2164814 - RNA, 22 nt, Homo sapiens
cccgcagugcugggaccagagc

SEQ ID NO: 2164815 - RNA, 10 nt, Homo sapiens
auucuucaaa

SEQ ID NO: 2164816 - RNA, 18 nt, Homo sapiens
gcagcaccgcagccucug

SEQ ID NO: 2164817 - RNA, 16 nt, Homo sapiens
cugagagaaacugagg

SEQ ID NO: 2164818 - RNA, 22 nt, Homo sapiens
agagcccuucccagggcaccca

SEQ ID NO: 2164819 - RNA, 19 nt, Homo sapiens
ucuucaccaacacuguccc

SEQ ID NO: 2164820 - RNA, 19 nt, Homo sapiens
uagcuugcaccuugucaca

SEQ ID NO: 2164821 - RNA, 15 nt, Homo sapiens
gauaauuaaaauuca

SEQ ID NO: 2164822 - RNA, 15 nt, Homo sapiens
ugggguucaucuagg

SEQ ID NO: 2164823 - RNA, 19 nt, Homo sapiens
gugacacagcugucccaag

SEQ ID NO: 2164824 - RNA, 14 nt, Homo sapiens
agucuaaaguuuac

SEQ ID NO: 2164825 - RNA, 19 nt, Homo sapiens
auuggaaucuucaccucag

SEQ ID NO: 2164826 - RNA, 18 nt, Homo sapiens
accuguccuucucaggcu

SEQ ID NO: 2164827 - RNA, 21 nt, Homo sapiens
cagcugcugggucaggccacc

SEQ ID NO: 2164828 - RNA, 21 nt, Homo sapiens
augaucaauccuuuauuauua

SEQ ID NO: 2164829 - RNA, 22 nt, Homo sapiens
ggcccuguggcuccaggagcag

SEQ ID NO: 2164830 - RNA, 18 nt, Homo sapiens
cacacagcagcacugcag

SEQ ID NO: 2164831 - RNA, 18 nt, Homo sapiens
accacaauaccacuauca

SEQ ID NO: 2164832 - RNA, 18 nt, Homo sapiens
accaguugcccagaugaa

SEQ ID NO: 2164833 - RNA, 23 nt, Homo sapiens
cucgaggagguaaugaauuaaag

SEQ ID NO: 2164834 - RNA, 19 nt, Homo sapiens
ugauagcguggaggcugca

SEQ ID NO: 2164835 - RNA, 15 nt, Homo sapiens
uguguggcaccuuga

SEQ ID NO: 2164836 - RNA, 22 nt, Homo sapiens
caugaggugagagaaagccaca

SEQ ID NO: 2164837 - RNA, 22 nt, Homo sapiens
augcuaagugaugggauuuuca

SEQ ID NO: 2164838 - RNA, 16 nt, Homo sapiens
agggaauccagccaug

SEQ ID NO: 2164839 - RNA, 20 nt, Homo sapiens
agacucuuuaguugauuuaa

SEQ ID NO: 2164840 - RNA, 18 nt, Homo sapiens
cugaaugccucaauguga

SEQ ID NO: 2164841 - RNA, 22 nt, Homo sapiens
gcugaguguccagcacaccugc

SEQ ID NO: 2164842 - RNA, 16 nt, Homo sapiens
accagagccucaguga

SEQ ID NO: 2164843 - RNA, 12 nt, Homo sapiens
cauaucagcucu

SEQ ID NO: 2164844 - RNA, 22 nt, Homo sapiens
cacugucauaaucucuuuccau

SEQ ID NO: 2164845 - RNA, 18 nt, Homo sapiens
uacuuacauaucugacuu

SEQ ID NO: 2164846 - RNA, 19 nt, Homo sapiens
gcaaaguggggaguaguca

SEQ ID NO: 2164847 - RNA, 17 nt, Homo sapiens
gccugggaccugaaccu

SEQ ID NO: 2164848 - RNA, 23 nt, Homo sapiens
uagaacucugggcugccauguga

SEQ ID NO: 2164849 - RNA, 20 nt, Homo sapiens
gcuggggccgcugggguccg

SEQ ID NO: 2164850 - RNA, 13 nt, Homo sapiens
caauugugcugcc

SEQ ID NO: 2164851 - RNA, 18 nt, Homo sapiens
ccugcacacucaguuucu

SEQ ID NO: 2164852 - RNA, 15 nt, Homo sapiens
auugauauaauuucc

SEQ ID NO: 2164853 - RNA, 17 nt, Homo sapiens
cauacauauuaucucau

SEQ ID NO: 2164854 - RNA, 11 nt, Homo sapiens
gaucuggagaa

SEQ ID NO: 2164855 - RNA, 11 nt, Homo sapiens
gcaucuggccc

SEQ ID NO: 2164856 - RNA, 23 nt, Homo sapiens
cccaggacccugaaggggccaug

SEQ ID NO: 2164857 - RNA, 13 nt, Homo sapiens
ccugaacugcuuu

SEQ ID NO: 2164858 - RNA, 21 nt, Homo sapiens
auuaaucuucagcugaacaca

SEQ ID NO: 2164859 - RNA, 19 nt, Homo sapiens
gugaguuuaccuuguauac

SEQ ID NO: 2164860 - RNA, 17 nt, Homo sapiens
ucagacuucaucuucaa

SEQ ID NO: 2164861 - RNA, 14 nt, Homo sapiens
ccugcagaccucaa

SEQ ID NO: 2164862 - RNA, 15 nt, Homo sapiens
uggaucuaccagcau

SEQ ID NO: 2164863 - RNA, 21 nt, Homo sapiens
uaguugucacuuuccucuucc

SEQ ID NO: 2164864 - RNA, 12 nt, Homo sapiens
uucgaacuuaac

SEQ ID NO: 2164865 - RNA, 17 nt, Homo sapiens
ugauaugggucuugaua

SEQ ID NO: 2164866 - RNA, 20 nt, Homo sapiens
uuauucuccagaauaauucu

SEQ ID NO: 2164867 - RNA, 15 nt, Homo sapiens
cuugaacugcugcca

SEQ ID NO: 2164868 - RNA, 14 nt, Homo sapiens
auccacuccuuccu

SEQ ID NO: 2164869 - RNA, 14 nt, Homo sapiens
ccuuacucaccucu

SEQ ID NO: 2164870 - RNA, 21 nt, Homo sapiens
cugaagcuuaggacuaccagc

SEQ ID NO: 2164871 - RNA, 20 nt, Homo sapiens
ccaggacggaugggcccuau

SEQ ID NO: 2164872 - RNA, 14 nt, Homo sapiens
uaaugaaauacauc

SEQ ID NO: 2164873 - RNA, 14 nt, Homo sapiens
agaaggcggcacuu

SEQ ID NO: 2164874 - RNA, 16 nt, Homo sapiens
aauguaaguaagugac

SEQ ID NO: 2164875 - RNA, 22 nt, Homo sapiens
gaggacuuguuaaagagcacug

SEQ ID NO: 2164876 - RNA, 16 nt, Homo sapiens
uagacaaaguucaagu

SEQ ID NO: 2164877 - RNA, 13 nt, Homo sapiens
guuucggaaaaaa

SEQ ID NO: 2164878 - RNA, 18 nt, Homo sapiens
agagggcaaguguuccca

SEQ ID NO: 2164879 - RNA, 22 nt, Homo sapiens
auucccugauuuaauaugcaaa

SEQ ID NO: 2164880 - RNA, 14 nt, Homo sapiens
agcaaugguguugu

SEQ ID NO: 2164881 - RNA, 14 nt, Homo sapiens
aucagugguuuuau

SEQ ID NO: 2164882 - RNA, 14 nt, Homo sapiens
uaagauucauccau

SEQ ID NO: 2164883 - RNA, 18 nt, Homo sapiens
auauaugcagcugugaua

SEQ ID NO: 2164884 - RNA, 16 nt, Homo sapiens
aagagaugaauugcau

SEQ ID NO: 2164885 - RNA, 20 nt, Homo sapiens
uccucaacaacaaaccaaaa

SEQ ID NO: 2164886 - RNA, 21 nt, Homo sapiens
cucuuaauucccaaucccauu

SEQ ID NO: 2164887 - RNA, 21 nt, Homo sapiens
ugaaauuuucucaucuaaaau

SEQ ID NO: 2164888 - RNA, 23 nt, Homo sapiens
uaaacuuuuuuucuguaccaguu

SEQ ID NO: 2164889 - RNA, 17 nt, Homo sapiens
auccauaaggugcagua

SEQ ID NO: 2164890 - RNA, 13 nt, Homo sapiens
caacgaugaauuu

SEQ ID NO: 2164891 - RNA, 16 nt, Homo sapiens
cuuggaacucuugcua

SEQ ID NO: 2164892 - RNA, 11 nt, Homo sapiens
gccagugacag

SEQ ID NO: 2164893 - RNA, 18 nt, Homo sapiens
gacaaccuggacccagau

SEQ ID NO: 2164894 - RNA, 15 nt, Homo sapiens
auauggucauauaca

SEQ ID NO: 2164895 - RNA, 19 nt, Homo sapiens
accuccccagcccaggaaa

SEQ ID NO: 2164896 - RNA, 17 nt, Homo sapiens
acauuaaggcaguauga

SEQ ID NO: 2164897 - RNA, 21 nt, Homo sapiens
aaucgcugcccucucugccag

SEQ ID NO: 2164898 - RNA, 13 nt, Homo sapiens
ucgaaccacugag

SEQ ID NO: 2164899 - RNA, 13 nt, Homo sapiens
ugcugcuguacaa

SEQ ID NO: 2164900 - RNA, 18 nt, Homo sapiens
uuugccuccagugcaguc

SEQ ID NO: 2164901 - RNA, 15 nt, Homo sapiens
ugccaaaaaaagaca

SEQ ID NO: 2164902 - RNA, 18 nt, Homo sapiens
uuuccucuggcccaguga

SEQ ID NO: 2164903 - RNA, 21 nt, Homo sapiens
ucaaagcccugccucugugua

SEQ ID NO: 2164904 - RNA, 23 nt, Homo sapiens
ugguaagguguguacucagggca

SEQ ID NO: 2164905 - RNA, 19 nt, Homo sapiens
caaccccccagcacugagg

SEQ ID NO: 2164906 - RNA, 19 nt, Homo sapiens
cagcaucccagccuugaga

SEQ ID NO: 2164907 - RNA, 19 nt, Homo sapiens
uuccagugguccauggaau

SEQ ID NO: 2164908 - RNA, 15 nt, Homo sapiens
ucaucuuagcuuucc

SEQ ID NO: 2164909 - RNA, 17 nt, Homo sapiens
auguaacggaugaccau

SEQ ID NO: 2164910 - RNA, 14 nt, Homo sapiens
ucccuggucaccaa

SEQ ID NO: 2164911 - RNA, 16 nt, Homo sapiens
auuccuucucugaaca

SEQ ID NO: 2164912 - RNA, 14 nt, Homo sapiens
uauuuucagugcau

SEQ ID NO: 2164913 - RNA, 13 nt, Homo sapiens
ugguacuacugua

SEQ ID NO: 2164914 - RNA, 17 nt, Homo sapiens
ugucagcugcuguugaa

SEQ ID NO: 2164915 - RNA, 17 nt, Homo sapiens
ucccugaggauggguca

SEQ ID NO: 2164916 - RNA, 22 nt, Homo sapiens
aauuguccuggccucucagcca

SEQ ID NO: 2164917 - RNA, 22 nt, Homo sapiens
acacauucacgcauacuuggau

SEQ ID NO: 2164918 - RNA, 16 nt, Homo sapiens
caagcuuauaauguau

SEQ ID NO: 2164919 - RNA, 13 nt, Homo sapiens
caaauauucuccu

SEQ ID NO: 2164920 - RNA, 22 nt, Homo sapiens
uagccugccucuucucuacucu

SEQ ID NO: 2164921 - RNA, 23 nt, Homo sapiens
gcaccuaugagauggccaugcuc

SEQ ID NO: 2164922 - RNA, 18 nt, Homo sapiens
gacauuuuuucagucaua

SEQ ID NO: 2164923 - RNA, 18 nt, Homo sapiens
gaaaguuuuuaauucaua

SEQ ID NO: 2164924 - RNA, 19 nt, Homo sapiens
aauuuugggacauuugcau

SEQ ID NO: 2164925 - RNA, 14 nt, Homo sapiens
uagacgaacagcug

SEQ ID NO: 2164926 - RNA, 17 nt, Homo sapiens
ucaggacagaugccaca

SEQ ID NO: 2164927 - RNA, 16 nt, Homo sapiens
augugaacuugaagaa

SEQ ID NO: 2164928 - RNA, 15 nt, Homo sapiens
gaacaauugaaguaa

SEQ ID NO: 2164929 - RNA, 15 nt, Homo sapiens
auggucuuaugcaca

SEQ ID NO: 2164930 - RNA, 14 nt, Homo sapiens
ccaggagaccucca

SEQ ID NO: 2164931 - RNA, 14 nt, Homo sapiens
agaccagaagugga

SEQ ID NO: 2164932 - RNA, 17 nt, Homo sapiens
cuguauaagcacugaaa

SEQ ID NO: 2164933 - RNA, 19 nt, Homo sapiens
gcucauucauauuccugcc

SEQ ID NO: 2164934 - RNA, 17 nt, Homo sapiens
uucccaaucccauuccu

SEQ ID NO: 2164935 - RNA, 17 nt, Homo sapiens
ccuccgcgccuugccuc

SEQ ID NO: 2164936 - RNA, 22 nt, Homo sapiens
ggugaggggagauuugcaccua

SEQ ID NO: 2164937 - RNA, 14 nt, Homo sapiens
uguuaauaucuuga

SEQ ID NO: 2164938 - RNA, 18 nt, Homo sapiens
acuguguuucgcauuaag

SEQ ID NO: 2164939 - RNA, 18 nt, Homo sapiens
gcuccucccucugaccca

SEQ ID NO: 2164940 - RNA, 13 nt, Homo sapiens
acauaaacccagu

SEQ ID NO: 2164941 - RNA, 18 nt, Homo sapiens
cuuuaaauuucaucucag

SEQ ID NO: 2164942 - RNA, 21 nt, Homo sapiens
cgccuccgcuacuuccagggc

SEQ ID NO: 2164943 - RNA, 19 nt, Homo sapiens
augugaauaugccagugac

SEQ ID NO: 2164944 - RNA, 20 nt, Homo sapiens
ucucaaacuccugaccucag

SEQ ID NO: 2164945 - RNA, 22 nt, Homo sapiens
ccuccuagacucugugaucuga

SEQ ID NO: 2164946 - RNA, 13 nt, Homo sapiens
gcaccucuugaag

SEQ ID NO: 2164947 - RNA, 13 nt, Homo sapiens
ugcccucugccag

SEQ ID NO: 2164948 - RNA, 16 nt, Homo sapiens
aucaggcacaggucag

SEQ ID NO: 2164949 - RNA, 18 nt, Homo sapiens
gagaagaaugacuaugca

SEQ ID NO: 2164950 - RNA, 13 nt, Homo sapiens
aauaaacauugag

SEQ ID NO: 2164951 - RNA, 15 nt, Homo sapiens
ucaauaaaccuguca

SEQ ID NO: 2164952 - RNA, 23 nt, Homo sapiens
uacagcccagaggccaacacugu

SEQ ID NO: 2164953 - RNA, 14 nt, Homo sapiens
guggaagugacauu

SEQ ID NO: 2164954 - RNA, 18 nt, Homo sapiens
gacagaccagcagcaauc

SEQ ID NO: 2164955 - RNA, 18 nt, Homo sapiens
ugccaacuugauguucca

SEQ ID NO: 2164956 - RNA, 16 nt, Homo sapiens
cucacaucauguaaua

SEQ ID NO: 2164957 - RNA, 17 nt, Homo sapiens
cuuccuugaacugucua

SEQ ID NO: 2164958 - RNA, 15 nt, Homo sapiens
agcugggacuggcag

SEQ ID NO: 2164959 - RNA, 15 nt, Homo sapiens
uugcuauauugccca

SEQ ID NO: 2164960 - RNA, 15 nt, Homo sapiens
cucccaaacuccucu

SEQ ID NO: 2164961 - RNA, 17 nt, Homo sapiens
aauauuuagcaguauug

SEQ ID NO: 2164962 - RNA, 17 nt, Homo sapiens
ggacaagacaaaccaag

SEQ ID NO: 2164963 - RNA, 19 nt, Homo sapiens
uaugucacccaaugcauau

SEQ ID NO: 2164964 - RNA, 18 nt, Homo sapiens
ucucuaggccuguugccu

SEQ ID NO: 2164965 - RNA, 19 nt, Homo sapiens
acguguuaugacuccagaa

SEQ ID NO: 2164966 - RNA, 18 nt, Homo sapiens
uuuuuguucaaagccagc

SEQ ID NO: 2164967 - RNA, 15 nt, Homo sapiens
uggcacugacagccu

SEQ ID NO: 2164968 - RNA, 21 nt, Homo sapiens
uauuucagccaaaacauacca

SEQ ID NO: 2164969 - RNA, 17 nt, Homo sapiens
cgaagccaguccagaag

SEQ ID NO: 2164970 - RNA, 20 nt, Homo sapiens
uugaaaugcucuuuugcaca

SEQ ID NO: 2164971 - RNA, 18 nt, Homo sapiens
uacccaggcuuuagcauu

SEQ ID NO: 2164972 - RNA, 22 nt, Homo sapiens
ggcaagcguguucucagcacau

SEQ ID NO: 2164973 - RNA, 20 nt, Homo sapiens
ugaagcccuaacucagccaa

SEQ ID NO: 2164974 - RNA, 21 nt, Homo sapiens
uguaaguaauugccacagcug

SEQ ID NO: 2164975 - RNA, 20 nt, Homo sapiens
guauuaccuggucauuucaa

SEQ ID NO: 2164976 - RNA, 18 nt, Homo sapiens
gcaaugagggagcaugua

SEQ ID NO: 2164977 - RNA, 20 nt, Homo sapiens
aaacucauuuaggacuguau

SEQ ID NO: 2164978 - RNA, 14 nt, Homo sapiens
acgaugacaguguu

SEQ ID NO: 2164979 - RNA, 18 nt, Homo sapiens
cgcacacacagugauucc

SEQ ID NO: 2164980 - RNA, 16 nt, Homo sapiens
agacgugagagggacg

SEQ ID NO: 2164981 - RNA, 21 nt, Homo sapiens
cucguuucugauuaaugcuaa

SEQ ID NO: 2164982 - RNA, 18 nt, Homo sapiens
ucuugcucucaaugcagg

SEQ ID NO: 2164983 - RNA, 17 nt, Homo sapiens
ugugaauuaggcuguaa

SEQ ID NO: 2164984 - RNA, 16 nt, Homo sapiens
ggacuuauccaugcau

SEQ ID NO: 2164985 - RNA, 15 nt, Homo sapiens
gguuccauucagugc

SEQ ID NO: 2164986 - RNA, 14 nt, Homo sapiens
cucagacauuccaa

SEQ ID NO: 2164987 - RNA, 17 nt, Homo sapiens
aaauuuuaaccagaaaa

SEQ ID NO: 2164988 - RNA, 20 nt, Homo sapiens
cugaugggggacaggauuug

SEQ ID NO: 2164989 - RNA, 16 nt, Homo sapiens
ggcaauaguguguucu

SEQ ID NO: 2164990 - RNA, 18 nt, Homo sapiens
agauuacaucugccuuaa

SEQ ID NO: 2164991 - RNA, 15 nt, Homo sapiens
cugaaaacuaugcaa

SEQ ID NO: 2164992 - RNA, 23 nt, Homo sapiens
cugcucagaaucugauaccaaag

SEQ ID NO: 2164993 - RNA, 16 nt, Homo sapiens
cucaggucacuccagu

SEQ ID NO: 2164994 - RNA, 16 nt, Homo sapiens
gugcucuuaagccuaa

SEQ ID NO: 2164995 - RNA, 19 nt, Homo sapiens
uguaaauaaagacauucag

SEQ ID NO: 2164996 - RNA, 19 nt, Homo sapiens
acguggagauagugccagg

SEQ ID NO: 2164997 - RNA, 18 nt, Homo sapiens
acaaggcugaccaagaga

SEQ ID NO: 2164998 - RNA, 22 nt, Homo sapiens
aucacuuaaacuugcaucacuu

SEQ ID NO: 2164999 - RNA, 14 nt, Homo sapiens
ugcugcugucuaca

SEQ ID NO: 2165000 - RNA, 20 nt, Homo sapiens
caggagggugacgcccagcu

SEQ ID NO: 2165001 - RNA, 13 nt, Homo sapiens
gcuucacauuugu

SEQ ID NO: 2165002 - RNA, 22 nt, Homo sapiens
uauccugauaaacauuaaacac

SEQ ID NO: 2165003 - RNA, 15 nt, Homo sapiens
cagacuguguauuca

SEQ ID NO: 2165004 - RNA, 20 nt, Homo sapiens
aaguggacucucugacaaag

SEQ ID NO: 2165005 - RNA, 21 nt, Homo sapiens
aauuguguguuaaugucuuca

SEQ ID NO: 2165006 - RNA, 20 nt, Homo sapiens
ugggaacacaucuggcugca

SEQ ID NO: 2165007 - RNA, 19 nt, Homo sapiens
cacagacaacaguugcaca

SEQ ID NO: 2165008 - RNA, 18 nt, Homo sapiens
gaaaauaguucccuuugc

SEQ ID NO: 2165009 - RNA, 15 nt, Homo sapiens
uacaggcucaugcca

SEQ ID NO: 2165010 - RNA, 18 nt, Homo sapiens
ugauuugucccuaugcau

SEQ ID NO: 2165011 - RNA, 18 nt, Homo sapiens
uaaauguuuggcauguaa

SEQ ID NO: 2165012 - RNA, 19 nt, Homo sapiens
ucuuuugaaagaugguaau

SEQ ID NO: 2165013 - RNA, 21 nt, Homo sapiens
gcagaacagcuucauguuccc

SEQ ID NO: 2165014 - RNA, 20 nt, Homo sapiens
gaugcagcauuuuguauuug

SEQ ID NO: 2165015 - RNA, 15 nt, Homo sapiens
uauuuaugugugagg

SEQ ID NO: 2165016 - RNA, 17 nt, Homo sapiens
uccuccacaauagcaga

SEQ ID NO: 2165017 - RNA, 21 nt, Homo sapiens
uccuggagcagcagcugaggc

SEQ ID NO: 2165018 - RNA, 21 nt, Homo sapiens
aauucaugaugcuaguucuua

SEQ ID NO: 2165019 - RNA, 22 nt, Homo sapiens
guggaacgaacuuuccauggga

SEQ ID NO: 2165020 - RNA, 17 nt, Homo sapiens
ugccccagagaugggca

SEQ ID NO: 2165021 - RNA, 17 nt, Homo sapiens
gaacuuguucacagguu

SEQ ID NO: 2165022 - RNA, 20 nt, Homo sapiens
acaguguuauguaguauugu

SEQ ID NO: 2165023 - RNA, 12 nt, Homo sapiens
uagccuggaccu

SEQ ID NO: 2165024 - RNA, 19 nt, Homo sapiens
ucugcagagucacucacac

SEQ ID NO: 2165025 - RNA, 13 nt, Homo sapiens
guuugcuguucca

SEQ ID NO: 2165026 - RNA, 19 nt, Homo sapiens
agagcaggcuuugugagag

SEQ ID NO: 2165027 - RNA, 14 nt, Homo sapiens
cagcacaaacacaa

SEQ ID NO: 2165028 - RNA, 13 nt, Homo sapiens
aggccugaacuca

SEQ ID NO: 2165029 - RNA, 12 nt, Homo sapiens
accaccaucacc

SEQ ID NO: 2165030 - RNA, 22 nt, Homo sapiens
ugaaagcuagacugaaccauug

SEQ ID NO: 2165031 - RNA, 22 nt, Homo sapiens
auuccaacguaaauuauuacau

SEQ ID NO: 2165032 - RNA, 19 nt, Homo sapiens
ucagcuucucccaagccca

SEQ ID NO: 2165033 - RNA, 16 nt, Homo sapiens
cccuucccuggaucca

SEQ ID NO: 2165034 - RNA, 16 nt, Homo sapiens
acagacuggaagcaca

SEQ ID NO: 2165035 - RNA, 22 nt, Homo sapiens
caaccucauccucuccacagcu

SEQ ID NO: 2165036 - RNA, 15 nt, Homo sapiens
cagcagagcauucag

SEQ ID NO: 2165037 - RNA, 17 nt, Homo sapiens
cuguaggucacucucca

SEQ ID NO: 2165038 - RNA, 16 nt, Homo sapiens
ccucccaaguagcuag

SEQ ID NO: 2165039 - RNA, 19 nt, Homo sapiens
acccaucaaaagcaccagc

SEQ ID NO: 2165040 - RNA, 21 nt, Homo sapiens
ugcauggauucagcaugucca

SEQ ID NO: 2165041 - RNA, 13 nt, Homo sapiens
ugaagaugucucc

SEQ ID NO: 2165042 - RNA, 22 nt, Homo sapiens
gguccgagcugaggacucugca

SEQ ID NO: 2165043 - RNA, 18 nt, Homo sapiens
auaccagcauacgcucac

SEQ ID NO: 2165044 - RNA, 14 nt, Homo sapiens
aacuuucacuuuga

SEQ ID NO: 2165045 - RNA, 17 nt, Homo sapiens
gcuacuauguacugccu

SEQ ID NO: 2165046 - RNA, 23 nt, Homo sapiens
agaccaguggucuggaaacagcu

SEQ ID NO: 2165047 - RNA, 13 nt, Homo sapiens
uuacuugcuauaa

SEQ ID NO: 2165048 - RNA, 23 nt, Homo sapiens
aucauaguuacuguguaaacuca

SEQ ID NO: 2165049 - RNA, 13 nt, Homo sapiens
ugagccacagggc

SEQ ID NO: 2165050 - RNA, 13 nt, Homo sapiens
agaggcacugggg

SEQ ID NO: 2165051 - RNA, 17 nt, Homo sapiens
uagugccaccacagcuu

SEQ ID NO: 2165052 - RNA, 21 nt, Homo sapiens
ucauuuuuuuccccauuguga

SEQ ID NO: 2165053 - RNA, 22 nt, Homo sapiens
ugcauuuauggucaacacuuaa

SEQ ID NO: 2165054 - RNA, 20 nt, Homo sapiens
auuuguaauuaaaagcaaau

SEQ ID NO: 2165055 - RNA, 22 nt, Homo sapiens
uuucuggauggcaucuagccag

SEQ ID NO: 2165056 - RNA, 14 nt, Homo sapiens
ccucuuaagacacu

SEQ ID NO: 2165057 - RNA, 22 nt, Homo sapiens
augcaucucuuuagauccaaaa

SEQ ID NO: 2165058 - RNA, 16 nt, Homo sapiens
cuaaaaguucauaaca

SEQ ID NO: 2165059 - RNA, 16 nt, Homo sapiens
auugagaccugaguga

SEQ ID NO: 2165060 - RNA, 20 nt, Homo sapiens
caaggucaugccacugcacu

SEQ ID NO: 2165061 - RNA, 20 nt, Homo sapiens
guguuuucccaaagcacuuu

SEQ ID NO: 2165062 - RNA, 18 nt, Homo sapiens
cuugaagaggcaggucug

SEQ ID NO: 2165063 - RNA, 15 nt, Homo sapiens
cuuguuuucuucaca

SEQ ID NO: 2165064 - RNA, 22 nt, Homo sapiens
gugugaucuuaauauauuugaa

SEQ ID NO: 2165065 - RNA, 22 nt, Homo sapiens
aaguagggguugugggugacca

SEQ ID NO: 2165066 - RNA, 14 nt, Homo sapiens
agaagucuccucaa

SEQ ID NO: 2165067 - RNA, 18 nt, Homo sapiens
auucucaucaguccauug

SEQ ID NO: 2165068 - RNA, 15 nt, Homo sapiens
ugugacauucacuca

SEQ ID NO: 2165069 - RNA, 21 nt, Homo sapiens
ugugccccuuccgccacuggg

SEQ ID NO: 2165070 - RNA, 14 nt, Homo sapiens
ccagagcaaaauaa

SEQ ID NO: 2165071 - RNA, 13 nt, Homo sapiens
ggagugugccuug

SEQ ID NO: 2165072 - RNA, 14 nt, Homo sapiens
gucugagacugaaa

SEQ ID NO: 2165073 - RNA, 19 nt, Homo sapiens
ugcuauucuccauacucug

SEQ ID NO: 2165074 - RNA, 16 nt, Homo sapiens
agcugaccagccguga

SEQ ID NO: 2165075 - RNA, 18 nt, Homo sapiens
aauccugcccccagccau

SEQ ID NO: 2165076 - RNA, 16 nt, Homo sapiens
gaacgucuccuagcca

SEQ ID NO: 2165077 - RNA, 20 nt, Homo sapiens
cuuaaaguuugcaguauucu

SEQ ID NO: 2165078 - RNA, 13 nt, Homo sapiens
guuuagugauauu

SEQ ID NO: 2165079 - RNA, 17 nt, Homo sapiens
ggaauccagacccggcu

SEQ ID NO: 2165080 - RNA, 15 nt, Homo sapiens
acacacacaccucuu

SEQ ID NO: 2165081 - RNA, 14 nt, Homo sapiens
accugaagugugca

SEQ ID NO: 2165082 - RNA, 19 nt, Homo sapiens
aacagccauaauaauaauu

SEQ ID NO: 2165083 - RNA, 14 nt, Homo sapiens
uccuauacaguucu

SEQ ID NO: 2165084 - RNA, 18 nt, Homo sapiens
cucugcagacugcugcua

SEQ ID NO: 2165085 - RNA, 19 nt, Homo sapiens
guccucuacuuaaugagau

SEQ ID NO: 2165086 - RNA, 16 nt, Homo sapiens
uggcuggcuuguuuga

SEQ ID NO: 2165087 - RNA, 15 nt, Homo sapiens
agcuaggaacccugg

SEQ ID NO: 2165088 - RNA, 15 nt, Homo sapiens
acauuaaaagacaaa

SEQ ID NO: 2165089 - RNA, 19 nt, Homo sapiens
auuagcugaguguagugac

SEQ ID NO: 2165090 - RNA, 16 nt, Homo sapiens
uucuuugcugcaagag

SEQ ID NO: 2165091 - RNA, 17 nt, Homo sapiens
agcaaaaguaaucacuu

SEQ ID NO: 2165092 - RNA, 14 nt, Homo sapiens
acagagaacccugu

SEQ ID NO: 2165093 - RNA, 19 nt, Homo sapiens
aacugcuugugcacuggau

SEQ ID NO: 2165094 - RNA, 20 nt, Homo sapiens
cuuucgagguggguuuguac

SEQ ID NO: 2165095 - RNA, 16 nt, Homo sapiens
acaucacagcagccuc

SEQ ID NO: 2165096 - RNA, 20 nt, Homo sapiens
auccaaagaauuaugcaucu

SEQ ID NO: 2165097 - RNA, 23 nt, Homo sapiens
ucagcuuuuguuguuuauauaca

SEQ ID NO: 2165098 - RNA, 17 nt, Homo sapiens
ugcguguguacaugugc

SEQ ID NO: 2165099 - RNA, 21 nt, Homo sapiens
aagaagacuguugccacuuaa

SEQ ID NO: 2165100 - RNA, 17 nt, Homo sapiens
uuuuacucaugaucuug

SEQ ID NO: 2165101 - RNA, 21 nt, Homo sapiens
cuccagcacccccagugcagc

SEQ ID NO: 2165102 - RNA, 16 nt, Homo sapiens
auaaauuggagaugca

SEQ ID NO: 2165103 - RNA, 23 nt, Homo sapiens
gacacagaggacggcuuccccau

SEQ ID NO: 2165104 - RNA, 23 nt, Homo sapiens
ugucgguuugcuuugauuucccu

SEQ ID NO: 2165105 - RNA, 14 nt, Homo sapiens
ggaaauaugaguca

SEQ ID NO: 2165106 - RNA, 16 nt, Homo sapiens
cugccucccuuucaua

SEQ ID NO: 2165107 - RNA, 20 nt, Homo sapiens
agccagacuugcuuccugca

SEQ ID NO: 2165108 - RNA, 23 nt, Homo sapiens
aaacuauggaaauaauaccccaa

SEQ ID NO: 2165109 - RNA, 17 nt, Homo sapiens
caucuugcucugcauuu

SEQ ID NO: 2165110 - RNA, 11 nt, Homo sapiens
gccaagaccau

SEQ ID NO: 2165111 - RNA, 13 nt, Homo sapiens
uccugagaaggcc

SEQ ID NO: 2165112 - RNA, 13 nt, Homo sapiens
ccagcaaagugau

SEQ ID NO: 2165113 - RNA, 22 nt, Homo sapiens
ccuuguucccuaggggacacuu

SEQ ID NO: 2165114 - RNA, 14 nt, Homo sapiens
cagcagcagcacuu

SEQ ID NO: 2165115 - RNA, 15 nt, Homo sapiens
auauuugacuugcau

SEQ ID NO: 2165116 - RNA, 21 nt, Homo sapiens
aacagaaauguuucuguguca

SEQ ID NO: 2165117 - RNA, 15 nt, Homo sapiens
gguuggagugcagug

SEQ ID NO: 2165118 - RNA, 14 nt, Homo sapiens
gaccauaugcacaa

SEQ ID NO: 2165119 - RNA, 15 nt, Homo sapiens
ucaaccacucgccga

SEQ ID NO: 2165120 - RNA, 21 nt, Homo sapiens
gcuccauaauugcaagggaag

SEQ ID NO: 2165121 - RNA, 17 nt, Homo sapiens
uacagaggucagcacac

SEQ ID NO: 2165122 - RNA, 12 nt, Homo sapiens
uauuccuaucug

SEQ ID NO: 2165123 - RNA, 19 nt, Homo sapiens
caggcagcuuuuucucucc

SEQ ID NO: 2165124 - RNA, 23 nt, Homo sapiens
uauuccaugggauguuaagcaaa

SEQ ID NO: 2165125 - RNA, 15 nt, Homo sapiens
cugauuuaacacuau

SEQ ID NO: 2165126 - RNA, 14 nt, Homo sapiens
ggacaaaagggagc

SEQ ID NO: 2165127 - RNA, 21 nt, Homo sapiens
guagugucacucaaggcggug

SEQ ID NO: 2165128 - RNA, 21 nt, Homo sapiens
agggacucuuguuaacaguaa

SEQ ID NO: 2165129 - RNA, 19 nt, Homo sapiens
ugggcuucuucagaacaau

SEQ ID NO: 2165130 - RNA, 20 nt, Homo sapiens
ggcucugcuucuccaaggaa

SEQ ID NO: 2165131 - RNA, 22 nt, Homo sapiens
gugacagccucugacucaccac

SEQ ID NO: 2165132 - RNA, 22 nt, Homo sapiens
ggcaaaguaaaauuagagcaag

SEQ ID NO: 2165133 - RNA, 17 nt, Homo sapiens
uauguguauauauacau

SEQ ID NO: 2165134 - RNA, 16 nt, Homo sapiens
aauaugaugccacuuu

SEQ ID NO: 2165135 - RNA, 14 nt, Homo sapiens
aaagccaccacauu

SEQ ID NO: 2165136 - RNA, 18 nt, Homo sapiens
agcugcccuagcugaccc

SEQ ID NO: 2165137 - RNA, 14 nt, Homo sapiens
aaaaguauauauuc

SEQ ID NO: 2165138 - RNA, 17 nt, Homo sapiens
cugugugcucuccaagc

SEQ ID NO: 2165139 - RNA, 18 nt, Homo sapiens
acaucuucauuaauacug

SEQ ID NO: 2165140 - RNA, 13 nt, Homo sapiens
gccagaagacucc

SEQ ID NO: 2165141 - RNA, 19 nt, Homo sapiens
cuucggggaccagcccaca

SEQ ID NO: 2165142 - RNA, 20 nt, Homo sapiens
ccgggugcucagggcugaca

SEQ ID NO: 2165143 - RNA, 13 nt, Homo sapiens
uuuaagacacugu

SEQ ID NO: 2165144 - RNA, 22 nt, Homo sapiens
ggauagccccgucuggugccag

SEQ ID NO: 2165145 - RNA, 20 nt, Homo sapiens
ugaaaagagaaugaugcuca

SEQ ID NO: 2165146 - RNA, 13 nt, Homo sapiens
acauugugcuugg

SEQ ID NO: 2165147 - RNA, 18 nt, Homo sapiens
cauggaaacgcaaaugag

SEQ ID NO: 2165148 - RNA, 17 nt, Homo sapiens
ugaaacucccagccaca

SEQ ID NO: 2165149 - RNA, 22 nt, Homo sapiens
acccaacugacuuguaucuguc

SEQ ID NO: 2165150 - RNA, 19 nt, Homo sapiens
ccuuaagacagaguauccu

SEQ ID NO: 2165151 - RNA, 14 nt, Homo sapiens
ugaaacauuuggaa

SEQ ID NO: 2165152 - RNA, 17 nt, Homo sapiens
gaaacagauaacaccaa

SEQ ID NO: 2165153 - RNA, 13 nt, Homo sapiens
ugcuagugcauuu

SEQ ID NO: 2165154 - RNA, 16 nt, Homo sapiens
ugucagugacaguauu

SEQ ID NO: 2165155 - RNA, 17 nt, Homo sapiens
gucuagguacuucaggg

SEQ ID NO: 2165156 - RNA, 19 nt, Homo sapiens
ugguauuguaauaggcauu

SEQ ID NO: 2165157 - RNA, 13 nt, Homo sapiens
uggguaccuguau

SEQ ID NO: 2165158 - RNA, 18 nt, Homo sapiens
cucacgccuaugauccca

SEQ ID NO: 2165159 - RNA, 23 nt, Homo sapiens
aaccccuuccagaucacugccac

SEQ ID NO: 2165160 - RNA, 16 nt, Homo sapiens
ugucugcaccuuagaa

SEQ ID NO: 2165161 - RNA, 17 nt, Homo sapiens
ggaaaggggcaggccag

SEQ ID NO: 2165162 - RNA, 14 nt, Homo sapiens
aagcaaagcucuuu

SEQ ID NO: 2165163 - RNA, 17 nt, Homo sapiens
ccucuuuccccacugaa

SEQ ID NO: 2165164 - RNA, 17 nt, Homo sapiens
gcccuugagcuacuuca

SEQ ID NO: 2165165 - RNA, 13 nt, Homo sapiens
cugcaagggccag

SEQ ID NO: 2165166 - RNA, 23 nt, Homo sapiens
uugauaauguccaaauacucuga

SEQ ID NO: 2165167 - RNA, 16 nt, Homo sapiens
ucuaacauguuaucaa

SEQ ID NO: 2165168 - RNA, 16 nt, Homo sapiens
acuggcuaguguggaa

SEQ ID NO: 2165169 - RNA, 15 nt, Homo sapiens
ugguuacaugaauga

SEQ ID NO: 2165170 - RNA, 20 nt, Homo sapiens
ucauucagggauagcacuga

SEQ ID NO: 2165171 - RNA, 21 nt, Homo sapiens
ggucuuuuacauacagugaua

SEQ ID NO: 2165172 - RNA, 22 nt, Homo sapiens
ccgcucuguagugcuacagggu

SEQ ID NO: 2165173 - RNA, 22 nt, Homo sapiens
ugacaccgucccucagugauac

SEQ ID NO: 2165174 - RNA, 21 nt, Homo sapiens
agugcugggauuacaggcaug

SEQ ID NO: 2165175 - RNA, 21 nt, Homo sapiens
acccucaccuuccuucugccc

SEQ ID NO: 2165176 - RNA, 19 nt, Homo sapiens
aauuuagcagucagauuag

SEQ ID NO: 2165177 - RNA, 12 nt, Homo sapiens
gugagggguccc

SEQ ID NO: 2165178 - RNA, 14 nt, Homo sapiens
cugccuuaccgaga

SEQ ID NO: 2165179 - RNA, 21 nt, Homo sapiens
uguaagggauggcuggcugga

SEQ ID NO: 2165180 - RNA, 13 nt, Homo sapiens
uccagaacccauu

SEQ ID NO: 2165181 - RNA, 20 nt, Homo sapiens
ggaagaagggccacccugag

SEQ ID NO: 2165182 - RNA, 15 nt, Homo sapiens
guugcauuccuuugu

SEQ ID NO: 2165183 - RNA, 18 nt, Homo sapiens
gacaaaggagccugugaa

SEQ ID NO: 2165184 - RNA, 13 nt, Homo sapiens
agaauuuuagucc

SEQ ID NO: 2165185 - RNA, 13 nt, Homo sapiens
gcacaagccagac

SEQ ID NO: 2165186 - RNA, 22 nt, Homo sapiens
ucuuacagagacucucccugac

SEQ ID NO: 2165187 - RNA, 14 nt, Homo sapiens
ugucuucacuauuc

SEQ ID NO: 2165188 - RNA, 16 nt, Homo sapiens
augcuguuauguccag

SEQ ID NO: 2165189 - RNA, 16 nt, Homo sapiens
ucaggaugcacauuuc

SEQ ID NO: 2165190 - RNA, 19 nt, Homo sapiens
cauauguagacuauauaca

SEQ ID NO: 2165191 - RNA, 18 nt, Homo sapiens
aaaggauuuuaccaaagc

SEQ ID NO: 2165192 - RNA, 20 nt, Homo sapiens
caggaaagugugaagaccca

SEQ ID NO: 2165193 - RNA, 22 nt, Homo sapiens
uugcacaaacuugugagcauca

SEQ ID NO: 2165194 - RNA, 16 nt, Homo sapiens
ucacugugacaaaagc

SEQ ID NO: 2165195 - RNA, 16 nt, Homo sapiens
uuuacugaugauguag

SEQ ID NO: 2165196 - RNA, 16 nt, Homo sapiens
cuaaccccaccacacc

SEQ ID NO: 2165197 - RNA, 13 nt, Homo sapiens
cucuucaauauaa

SEQ ID NO: 2165198 - RNA, 15 nt, Homo sapiens
caauuccaacacuga

SEQ ID NO: 2165199 - RNA, 19 nt, Homo sapiens
agaauuccugaagccagau

SEQ ID NO: 2165200 - RNA, 17 nt, Homo sapiens
cacuguguauauuugau

SEQ ID NO: 2165201 - RNA, 18 nt, Homo sapiens
uuauuuauuuugugguaa

SEQ ID NO: 2165202 - RNA, 15 nt, Homo sapiens
ucagcuuuguuaaau

SEQ ID NO: 2165203 - RNA, 23 nt, Homo sapiens
augcuagaacaacgccugucaca

SEQ ID NO: 2165204 - RNA, 16 nt, Homo sapiens
uaugugcacugauaug

SEQ ID NO: 2165205 - RNA, 21 nt, Homo sapiens
gaccucauuaaccgaugcuuu

SEQ ID NO: 2165206 - RNA, 17 nt, Homo sapiens
gcggcugcacaacagcc

SEQ ID NO: 2165207 - RNA, 15 nt, Homo sapiens
caaacacacuguaaa

SEQ ID NO: 2165208 - RNA, 19 nt, Homo sapiens
agaaagaccaggccaaugu

SEQ ID NO: 2165209 - RNA, 15 nt, Homo sapiens
uuugggggcuucccu

SEQ ID NO: 2165210 - RNA, 18 nt, Homo sapiens
caucacaggcugugccaa

SEQ ID NO: 2165211 - RNA, 14 nt, Homo sapiens
cacaggcuccccau

SEQ ID NO: 2165212 - RNA, 17 nt, Homo sapiens
uaauacuagauugaucu

SEQ ID NO: 2165213 - RNA, 13 nt, Homo sapiens
ccuaacuucugua

SEQ ID NO: 2165214 - RNA, 17 nt, Homo sapiens
auuuuaucucuucuucc

SEQ ID NO: 2165215 - RNA, 18 nt, Homo sapiens
caaguuccugcacuccag

SEQ ID NO: 2165216 - RNA, 19 nt, Homo sapiens
cccucagacaucuccagug

SEQ ID NO: 2165217 - RNA, 20 nt, Homo sapiens
ucagugaaagccagauucaa

SEQ ID NO: 2165218 - RNA, 20 nt, Homo sapiens
uuauaauuuugaccauaaau

SEQ ID NO: 2165219 - RNA, 17 nt, Homo sapiens
agucccagcagccagcc

SEQ ID NO: 2165220 - RNA, 22 nt, Homo sapiens
ccacugauuuagccaugugaaa

SEQ ID NO: 2165221 - RNA, 16 nt, Homo sapiens
acaguuuccagaugcu

SEQ ID NO: 2165222 - RNA, 19 nt, Homo sapiens
uguuauguuucuacacauu

SEQ ID NO: 2165223 - RNA, 19 nt, Homo sapiens
cuccccaaugagacuugcc

SEQ ID NO: 2165224 - RNA, 17 nt, Homo sapiens
ggucaauaaaccacugu

SEQ ID NO: 2165225 - RNA, 19 nt, Homo sapiens
ucacugaaaacaucuggaa

SEQ ID NO: 2165226 - RNA, 20 nt, Homo sapiens
aaagaagguguuuuccugaa

SEQ ID NO: 2165227 - RNA, 12 nt, Homo sapiens
ccacagucugac

SEQ ID NO: 2165228 - RNA, 19 nt, Homo sapiens
augacuuuugaauuacaga

SEQ ID NO: 2165229 - RNA, 12 nt, Homo sapiens
auuaauuccaug

SEQ ID NO: 2165230 - RNA, 23 nt, Homo sapiens
agaaauuaauauggcuucaccaa

SEQ ID NO: 2165231 - RNA, 21 nt, Homo sapiens
gucccccccuaacuuucuugc

SEQ ID NO: 2165232 - RNA, 12 nt, Homo sapiens
ggagccagugaa

SEQ ID NO: 2165233 - RNA, 23 nt, Homo sapiens
guuaccauauuuauccauuugua

SEQ ID NO: 2165234 - RNA, 12 nt, Homo sapiens
aaaguuaugaaa

SEQ ID NO: 2165235 - RNA, 21 nt, Homo sapiens
ucaucaaaaacacuacuccuu

SEQ ID NO: 2165236 - RNA, 18 nt, Homo sapiens
uucacacaaagacuccuu

SEQ ID NO: 2165237 - RNA, 13 nt, Homo sapiens
uuuuauuacccuu

SEQ ID NO: 2165238 - RNA, 12 nt, Homo sapiens
acaucugcaaua

SEQ ID NO: 2165239 - RNA, 18 nt, Homo sapiens
caaaauguagaauauuca

SEQ ID NO: 2165240 - RNA, 15 nt, Homo sapiens
auccaugagauagcu

SEQ ID NO: 2165241 - RNA, 23 nt, Homo sapiens
cccuaucucgaacauggaacuca

SEQ ID NO: 2165242 - RNA, 18 nt, Homo sapiens
gcugaggccucucauucc

SEQ ID NO: 2165243 - RNA, 19 nt, Homo sapiens
cagcgagaaaacuucguaa

SEQ ID NO: 2165244 - RNA, 18 nt, Homo sapiens
gcuggcuagcauuccuca

SEQ ID NO: 2165245 - RNA, 12 nt, Homo sapiens
agagaagacaaa

SEQ ID NO: 2165246 - RNA, 12 nt, Homo sapiens
aggaaagacagg

SEQ ID NO: 2165247 - RNA, 17 nt, Homo sapiens
ccacuggccagcucugg

SEQ ID NO: 2165248 - RNA, 17 nt, Homo sapiens
ucuucagagaucaugga

SEQ ID NO: 2165249 - RNA, 21 nt, Homo sapiens
caggaaguaauuuucuucuca

SEQ ID NO: 2165250 - RNA, 20 nt, Homo sapiens
ucacaacgggccagcucuag

SEQ ID NO: 2165251 - RNA, 14 nt, Homo sapiens
ucuucaggcccagc

SEQ ID NO: 2165252 - RNA, 14 nt, Homo sapiens
gagacagagcucac

SEQ ID NO: 2165253 - RNA, 21 nt, Homo sapiens
caggauguucaacuuaaugaa

SEQ ID NO: 2165254 - RNA, 16 nt, Homo sapiens
cagaaacagggcagca

SEQ ID NO: 2165255 - RNA, 23 nt, Homo sapiens
aggugauccacccaccuuggccu

SEQ ID NO: 2165256 - RNA, 19 nt, Homo sapiens
auagauuucuacacugagg

SEQ ID NO: 2165257 - RNA, 17 nt, Homo sapiens
auacgaaaaucccauga

SEQ ID NO: 2165258 - RNA, 17 nt, Homo sapiens
cuuguagucuuggcuaa

SEQ ID NO: 2165259 - RNA, 16 nt, Homo sapiens
cugcugggacugagaa

SEQ ID NO: 2165260 - RNA, 19 nt, Homo sapiens
gcacugggcuuggggacca

SEQ ID NO: 2165261 - RNA, 17 nt, Homo sapiens
gcaauggugcgaucuca

SEQ ID NO: 2165262 - RNA, 20 nt, Homo sapiens
cugccgacggagccacuggg

SEQ ID NO: 2165263 - RNA, 22 nt, Homo sapiens
aaacuucaugguuugcauuuaa

SEQ ID NO: 2165264 - RNA, 15 nt, Homo sapiens
aaugccagucucauu

SEQ ID NO: 2165265 - RNA, 16 nt, Homo sapiens
uauauucaggaguugg

SEQ ID NO: 2165266 - RNA, 18 nt, Homo sapiens
ccagccuacacugccagc

SEQ ID NO: 2165267 - RNA, 19 nt, Homo sapiens
ugcccaucagccauuugcc

SEQ ID NO: 2165268 - RNA, 19 nt, Homo sapiens
gaggguaugucagugucac

SEQ ID NO: 2165269 - RNA, 18 nt, Homo sapiens
ucaagcauaaaucacuuc

SEQ ID NO: 2165270 - RNA, 16 nt, Homo sapiens
ccuccguguagugucu

SEQ ID NO: 2165271 - RNA, 15 nt, Homo sapiens
ccaggacugugacuc

SEQ ID NO: 2165272 - RNA, 12 nt, Homo sapiens
agguaccagcac

SEQ ID NO: 2165273 - RNA, 21 nt, Homo sapiens
uggucacacaccagcacuuua

SEQ ID NO: 2165274 - RNA, 18 nt, Homo sapiens
gaauagcaaggugcucac

SEQ ID NO: 2165275 - RNA, 21 nt, Homo sapiens
cacauaucugcuuaucagugu

SEQ ID NO: 2165276 - RNA, 18 nt, Homo sapiens
cuugcuauguuauuuuca

SEQ ID NO: 2165277 - RNA, 22 nt, Homo sapiens
uuuucaauaaaguacugcaaaa

SEQ ID NO: 2165278 - RNA, 23 nt, Homo sapiens
uucccaauagcacuuucauugcc

SEQ ID NO: 2165279 - RNA, 23 nt, Homo sapiens
agcaguccuuaucaccagccuca

SEQ ID NO: 2165280 - RNA, 14 nt, Homo sapiens
aacauggugugugu

SEQ ID NO: 2165281 - RNA, 22 nt, Homo sapiens
cgucagggagaggucaccagcu

SEQ ID NO: 2165282 - RNA, 22 nt, Homo sapiens
gacucuggaccaugcugagaca

SEQ ID NO: 2165283 - RNA, 13 nt, Homo sapiens
gauuagcacuuaa

SEQ ID NO: 2165284 - RNA, 17 nt, Homo sapiens
uggaauucccuccugag

SEQ ID NO: 2165285 - RNA, 14 nt, Homo sapiens
augccacuucucac

SEQ ID NO: 2165286 - RNA, 12 nt, Homo sapiens
uauaugucaaag

SEQ ID NO: 2165287 - RNA, 14 nt, Homo sapiens
caauuucucucaga

SEQ ID NO: 2165288 - RNA, 13 nt, Homo sapiens
agcuuucucaggg

SEQ ID NO: 2165289 - RNA, 15 nt, Homo sapiens
aaagcacuaccuaag

SEQ ID NO: 2165290 - RNA, 14 nt, Homo sapiens
uuucuguaguguga

SEQ ID NO: 2165291 - RNA, 17 nt, Homo sapiens
ucacaugucaguaccuu

SEQ ID NO: 2165292 - RNA, 15 nt, Homo sapiens
ccacucccugggaca

SEQ ID NO: 2165293 - RNA, 17 nt, Homo sapiens
gccucaguuacacagga

SEQ ID NO: 2165294 - RNA, 15 nt, Homo sapiens
cccaguguuugugca

SEQ ID NO: 2165295 - RNA, 21 nt, Homo sapiens
aagcuucagggccuugcugcu

SEQ ID NO: 2165296 - RNA, 17 nt, Homo sapiens
ucugcacaauaauaagu

SEQ ID NO: 2165297 - RNA, 21 nt, Homo sapiens
cucaacaaaucucagucccug

SEQ ID NO: 2165298 - RNA, 19 nt, Homo sapiens
agaacacagugauuuuauu

SEQ ID NO: 2165299 - RNA, 17 nt, Homo sapiens
gugggauaucacuucca

SEQ ID NO: 2165300 - RNA, 14 nt, Homo sapiens
guuaaauauuguca

SEQ ID NO: 2165301 - RNA, 19 nt, Homo sapiens
ccaagggcagguugaucag

SEQ ID NO: 2165302 - RNA, 13 nt, Homo sapiens
ccgagcacuguga

SEQ ID NO: 2165303 - RNA, 14 nt, Homo sapiens
agaccucaccucca

SEQ ID NO: 2165304 - RNA, 16 nt, Homo sapiens
ccucgcuccaacucca

SEQ ID NO: 2165305 - RNA, 13 nt, Homo sapiens
cuguagguuugua

SEQ ID NO: 2165306 - RNA, 20 nt, Homo sapiens
cuaccugcugcugcuauuau

SEQ ID NO: 2165307 - RNA, 16 nt, Homo sapiens
agcaccgugacaguuu

SEQ ID NO: 2165308 - RNA, 20 nt, Homo sapiens
uaucucucagugaacuguga

SEQ ID NO: 2165309 - RNA, 15 nt, Homo sapiens
aaccauuuugcagaa

SEQ ID NO: 2165310 - RNA, 16 nt, Homo sapiens
auaaccaaacauaaca

SEQ ID NO: 2165311 - RNA, 14 nt, Homo sapiens
ccuggccucacugg

SEQ ID NO: 2165312 - RNA, 14 nt, Homo sapiens
gcuggccugacugg

SEQ ID NO: 2165313 - RNA, 16 nt, Homo sapiens
uaguuuaccucaucca

SEQ ID NO: 2165314 - RNA, 13 nt, Homo sapiens
acccugcagagau

SEQ ID NO: 2165315 - RNA, 16 nt, Homo sapiens
cugucuacccagugcu

SEQ ID NO: 2165316 - RNA, 20 nt, Homo sapiens
aaaacuauuugcagaugaca

SEQ ID NO: 2165317 - RNA, 13 nt, Homo sapiens
auaacagaaugau

SEQ ID NO: 2165318 - RNA, 16 nt, Homo sapiens
cccugcugagaucugc

SEQ ID NO: 2165319 - RNA, 16 nt, Homo sapiens
caaccugccugugcau

SEQ ID NO: 2165320 - RNA, 22 nt, Homo sapiens
aaucccggucaugcuuuugcca

SEQ ID NO: 2165321 - RNA, 23 nt, Homo sapiens
gccaauaacuuuucaccaaugag

SEQ ID NO: 2165322 - RNA, 19 nt, Homo sapiens
acugaaggacacagcagug

SEQ ID NO: 2165323 - RNA, 23 nt, Homo sapiens
ucauucucuuauauaguauucau

SEQ ID NO: 2165324 - RNA, 15 nt, Homo sapiens
augguuacugaggac

SEQ ID NO: 2165325 - RNA, 21 nt, Homo sapiens
ugaauuuuggugauguaaaac

SEQ ID NO: 2165326 - RNA, 22 nt, Homo sapiens
aacucugucaggcauugaauga

SEQ ID NO: 2165327 - RNA, 14 nt, Homo sapiens
uacuguauugcugu

SEQ ID NO: 2165328 - RNA, 17 nt, Homo sapiens
gcugggcucacuacaug

SEQ ID NO: 2165329 - RNA, 14 nt, Homo sapiens
gccuagaacauccc

SEQ ID NO: 2165330 - RNA, 14 nt, Homo sapiens
ucuggcagguccuc

SEQ ID NO: 2165331 - RNA, 17 nt, Homo sapiens
gaaaaugaaaaacaacc

SEQ ID NO: 2165332 - RNA, 20 nt, Homo sapiens
acagauggcccaagggaugg

SEQ ID NO: 2165333 - RNA, 20 nt, Homo sapiens
cuguggcccccuguccccaa

SEQ ID NO: 2165334 - RNA, 15 nt, Homo sapiens
auaaagcccuugaac

SEQ ID NO: 2165335 - RNA, 14 nt, Homo sapiens
cuggaccauuccag

SEQ ID NO: 2165336 - RNA, 15 nt, Homo sapiens
cucagccacccugug

SEQ ID NO: 2165337 - RNA, 14 nt, Homo sapiens
uguccagcaccuug

SEQ ID NO: 2165338 - RNA, 15 nt, Homo sapiens
ccuugcacaggccac

SEQ ID NO: 2165339 - RNA, 13 nt, Homo sapiens
cucuaugugcaac

SEQ ID NO: 2165340 - RNA, 16 nt, Homo sapiens
gagggugaaaggcagg

SEQ ID NO: 2165341 - RNA, 17 nt, Homo sapiens
caagguggucaguaaau

SEQ ID NO: 2165342 - RNA, 16 nt, Homo sapiens
uuguuccagagcugcu

SEQ ID NO: 2165343 - RNA, 23 nt, Homo sapiens
uagugucuuuuuuuucuucaccu

SEQ ID NO: 2165344 - RNA, 16 nt, Homo sapiens
ccaguuuuuugaacau

SEQ ID NO: 2165345 - RNA, 15 nt, Homo sapiens
ugggaucugaauacc

SEQ ID NO: 2165346 - RNA, 12 nt, Homo sapiens
aaugcaauggaa

SEQ ID NO: 2165347 - RNA, 21 nt, Homo sapiens
aaaaugcaauuggcauuaaca

SEQ ID NO: 2165348 - RNA, 17 nt, Homo sapiens
cuguucuccaggcuuca

SEQ ID NO: 2165349 - RNA, 13 nt, Homo sapiens
guaaaauauuuau

SEQ ID NO: 2165350 - RNA, 15 nt, Homo sapiens
cccacuucacuguga

SEQ ID NO: 2165351 - RNA, 14 nt, Homo sapiens
cucaugugaucaca

SEQ ID NO: 2165352 - RNA, 17 nt, Homo sapiens
aaaaagaagagguucau

SEQ ID NO: 2165353 - RNA, 15 nt, Homo sapiens
auuuggucaagaaau

SEQ ID NO: 2165354 - RNA, 13 nt, Homo sapiens
cagccaggugcau

SEQ ID NO: 2165355 - RNA, 16 nt, Homo sapiens
cagcuaaccacuucgc

SEQ ID NO: 2165356 - RNA, 16 nt, Homo sapiens
agcaaucugggcacuu

SEQ ID NO: 2165357 - RNA, 14 nt, Homo sapiens
ugugccaauacaga

SEQ ID NO: 2165358 - RNA, 14 nt, Homo sapiens
caaaugcugaccca

SEQ ID NO: 2165359 - RNA, 16 nt, Homo sapiens
gcuggaaacuucugua

SEQ ID NO: 2165360 - RNA, 19 nt, Homo sapiens
gacugcugaauuaauguga

SEQ ID NO: 2165361 - RNA, 12 nt, Homo sapiens
uuacaugcauua

SEQ ID NO: 2165362 - RNA, 12 nt, Homo sapiens
acacaugcucua

SEQ ID NO: 2165363 - RNA, 15 nt, Homo sapiens
uucaaaugcuguaac

SEQ ID NO: 2165364 - RNA, 14 nt, Homo sapiens
gaggcccaugugac

SEQ ID NO: 2165365 - RNA, 23 nt, Homo sapiens
cuuaaaauuuuucuuaagacaga

SEQ ID NO: 2165366 - RNA, 18 nt, Homo sapiens
uauaaacagaacuccacu

SEQ ID NO: 2165367 - RNA, 16 nt, Homo sapiens
aggaaggacuguccca

SEQ ID NO: 2165368 - RNA, 17 nt, Homo sapiens
caaauuuagaaagcuua

SEQ ID NO: 2165369 - RNA, 16 nt, Homo sapiens
uuguaauaaugcuaaa

SEQ ID NO: 2165370 - RNA, 10 nt, Homo sapiens
gauggcccaa

SEQ ID NO: 2165371 - RNA, 19 nt, Homo sapiens
gcccucuagggcagggugg

SEQ ID NO: 2165372 - RNA, 20 nt, Homo sapiens
accaaugggccuccagagac

SEQ ID NO: 2165373 - RNA, 12 nt, Homo sapiens
uaugcacuucaa

SEQ ID NO: 2165374 - RNA, 19 nt, Homo sapiens
ucccacccuucucagggac

SEQ ID NO: 2165375 - RNA, 18 nt, Homo sapiens
gucucgaagcaguauucu

SEQ ID NO: 2165376 - RNA, 15 nt, Homo sapiens
cuauuuucugaccaa

SEQ ID NO: 2165377 - RNA, 21 nt, Homo sapiens
gccuucccuaaaaucagggaa

SEQ ID NO: 2165378 - RNA, 17 nt, Homo sapiens
aagccccugacccgcuc

SEQ ID NO: 2165379 - RNA, 14 nt, Homo sapiens
auucuugaaugagg

SEQ ID NO: 2165380 - RNA, 20 nt, Homo sapiens
auaauuuucuacaaccuaag

SEQ ID NO: 2165381 - RNA, 17 nt, Homo sapiens
ccuagaacacuaacuca

SEQ ID NO: 2165382 - RNA, 15 nt, Homo sapiens
uaaaguguuugccuc

SEQ ID NO: 2165383 - RNA, 24 nt, Homo sapiens
aaucagagauguacaugauugcca

SEQ ID NO: 2165384 - RNA, 15 nt, Homo sapiens
auuuaaguccaccuc

SEQ ID NO: 2165385 - RNA, 18 nt, Homo sapiens
gcaguagccuucuucccu

SEQ ID NO: 2165386 - RNA, 18 nt, Homo sapiens
augaagcccacccagaaa

SEQ ID NO: 2165387 - RNA, 19 nt, Homo sapiens
gcuucauucaagcuucaua

SEQ ID NO: 2165388 - RNA, 15 nt, Homo sapiens
cacuggccuugccuc

SEQ ID NO: 2165389 - RNA, 22 nt, Homo sapiens
uauuuucagugauaacuccuaa

SEQ ID NO: 2165390 - RNA, 17 nt, Homo sapiens
aggcuuuuucagggaaa

SEQ ID NO: 2165391 - RNA, 14 nt, Homo sapiens
agacuggaaggugg

SEQ ID NO: 2165392 - RNA, 22 nt, Homo sapiens
gaauauuuccuaguucauuuga

SEQ ID NO: 2165393 - RNA, 21 nt, Homo sapiens
aagcaacuagcugggcacagu

SEQ ID NO: 2165394 - RNA, 22 nt, Homo sapiens
ccagcaguucagagcugcccuc

SEQ ID NO: 2165395 - RNA, 13 nt, Homo sapiens
cuuccaagacuga

SEQ ID NO: 2165396 - RNA, 15 nt, Homo sapiens
agggugucuguaauc

SEQ ID NO: 2165397 - RNA, 20 nt, Homo sapiens
uauuccugggaggacucuga

SEQ ID NO: 2165398 - RNA, 19 nt, Homo sapiens
accaaauuugaugcgaucu

SEQ ID NO: 2165399 - RNA, 22 nt, Homo sapiens
agcuaauguuuaaaagcaaaac

SEQ ID NO: 2165400 - RNA, 19 nt, Homo sapiens
caccuaguggcuguccagu

SEQ ID NO: 2165401 - RNA, 17 nt, Homo sapiens
aucuccugagcucguga

SEQ ID NO: 2165402 - RNA, 17 nt, Homo sapiens
aacccagacccugaguc

SEQ ID NO: 2165403 - RNA, 17 nt, Homo sapiens
ucauggaaacuggccag

SEQ ID NO: 2165404 - RNA, 21 nt, Homo sapiens
uucucaucauauuguauguaa

SEQ ID NO: 2165405 - RNA, 15 nt, Homo sapiens
gugcuggaauuccac

SEQ ID NO: 2165406 - RNA, 22 nt, Homo sapiens
gcucggacuuggcacuccugga

SEQ ID NO: 2165407 - RNA, 16 nt, Homo sapiens
aagaaagaucaaagac

SEQ ID NO: 2165408 - RNA, 16 nt, Homo sapiens
uagaaaccccucugua

SEQ ID NO: 2165409 - RNA, 16 nt, Homo sapiens
aauucuccugccucag

SEQ ID NO: 2165410 - RNA, 21 nt, Homo sapiens
cagcacuuuggacauggcuca

SEQ ID NO: 2165411 - RNA, 22 nt, Homo sapiens
gagccccaagaggggcugggaa

SEQ ID NO: 2165412 - RNA, 23 nt, Homo sapiens
uggccucugcugaaugcagggaa

SEQ ID NO: 2165413 - RNA, 23 nt, Homo sapiens
acccugccucgcccccacuuuuc

SEQ ID NO: 2165414 - RNA, 21 nt, Homo sapiens
auucuacaaaaaaccaggaug

SEQ ID NO: 2165415 - RNA, 18 nt, Homo sapiens
gugaagagccacugccau

SEQ ID NO: 2165416 - RNA, 17 nt, Homo sapiens
ccuaugguaacugauga

SEQ ID NO: 2165417 - RNA, 21 nt, Homo sapiens
uucagacacgcacuucugggg

SEQ ID NO: 2165418 - RNA, 16 nt, Homo sapiens
caccaccuuauacauc

SEQ ID NO: 2165419 - RNA, 15 nt, Homo sapiens
guuacucucaccucg

SEQ ID NO: 2165420 - RNA, 17 nt, Homo sapiens
uaauuagggguugcuaa

SEQ ID NO: 2165421 - RNA, 21 nt, Homo sapiens
ccuuguuguuguuaaauauca

SEQ ID NO: 2165422 - RNA, 20 nt, Homo sapiens
cggaagucaucccagugcac

SEQ ID NO: 2165423 - RNA, 15 nt, Homo sapiens
aagcuccuuccagac

SEQ ID NO: 2165424 - RNA, 15 nt, Homo sapiens
aaacugaaagaucug

SEQ ID NO: 2165425 - RNA, 13 nt, Homo sapiens
uucgcaccgucca

SEQ ID NO: 2165426 - RNA, 12 nt, Homo sapiens
uugacugcugaa

SEQ ID NO: 2165427 - RNA, 17 nt, Homo sapiens
ccuggcccuggggccug

SEQ ID NO: 2165428 - RNA, 22 nt, Homo sapiens
caguccagaugccuuccugucu

SEQ ID NO: 2165429 - RNA, 17 nt, Homo sapiens
uuucuugcuaagcucca

SEQ ID NO: 2165430 - RNA, 21 nt, Homo sapiens
cauucagugagacacagagug

SEQ ID NO: 2165431 - RNA, 23 nt, Homo sapiens
cagcaauuuuuccaaaagccagu

SEQ ID NO: 2165432 - RNA, 13 nt, Homo sapiens
ggacaguggcacc

SEQ ID NO: 2165433 - RNA, 18 nt, Homo sapiens
auuuugaaaccaugaaga

SEQ ID NO: 2165434 - RNA, 12 nt, Homo sapiens
acacacacaaac

SEQ ID NO: 2165435 - RNA, 15 nt, Homo sapiens
ugaugaaacauucau

SEQ ID NO: 2165436 - RNA, 14 nt, Homo sapiens
ucuuguuacuguga

SEQ ID NO: 2165437 - RNA, 18 nt, Homo sapiens
cgaaauguucucaugaac

SEQ ID NO: 2165438 - RNA, 13 nt, Homo sapiens
uaaauccuuccau

SEQ ID NO: 2165439 - RNA, 20 nt, Homo sapiens
ugcuagcuauuggccuccca

SEQ ID NO: 2165440 - RNA, 13 nt, Homo sapiens
cucuuucuuguuu

SEQ ID NO: 2165441 - RNA, 13 nt, Homo sapiens
uauugugccucag

SEQ ID NO: 2165442 - RNA, 14 nt, Homo sapiens
auguuuuuucugca

SEQ ID NO: 2165443 - RNA, 21 nt, Homo sapiens
cugaggccuccggacuccucu

SEQ ID NO: 2165444 - RNA, 21 nt, Homo sapiens
auauucuuuugaucacauugu

SEQ ID NO: 2165445 - RNA, 13 nt, Homo sapiens
ucguacucaggag

SEQ ID NO: 2165446 - RNA, 18 nt, Homo sapiens
aucaaaccuacuauaaaa

SEQ ID NO: 2165447 - RNA, 18 nt, Homo sapiens
aauaagugcucugucaaa

SEQ ID NO: 2165448 - RNA, 18 nt, Homo sapiens
ugccaugggcaaagccau

SEQ ID NO: 2165449 - RNA, 18 nt, Homo sapiens
cuucuaaaaacuucucaa

SEQ ID NO: 2165450 - RNA, 13 nt, Homo sapiens
gagcacuuuucac

SEQ ID NO: 2165451 - RNA, 21 nt, Homo sapiens
ugaguuuggguucucugcugu

SEQ ID NO: 2165452 - RNA, 14 nt, Homo sapiens
uguagcaucuuccu

SEQ ID NO: 2165453 - RNA, 21 nt, Homo sapiens
cuaaagccaggacuauucccu

SEQ ID NO: 2165454 - RNA, 15 nt, Homo sapiens
gccaagaaacacuuu

SEQ ID NO: 2165455 - RNA, 12 nt, Homo sapiens
auggccacaucu

SEQ ID NO: 2165456 - RNA, 22 nt, Homo sapiens
acagcuggacccauuugccagg

SEQ ID NO: 2165457 - RNA, 16 nt, Homo sapiens
ccaggcgugguggcuc

SEQ ID NO: 2165458 - RNA, 18 nt, Homo sapiens
agaagccaagacaguggc

SEQ ID NO: 2165459 - RNA, 21 nt, Homo sapiens
ucagcgugacaauauacuuca

SEQ ID NO: 2165460 - RNA, 22 nt, Homo sapiens
gauggagaggcaugggggccca

SEQ ID NO: 2165461 - RNA, 15 nt, Homo sapiens
guguaugucaguggu

SEQ ID NO: 2165462 - RNA, 16 nt, Homo sapiens
aagauauucuuuacaa

SEQ ID NO: 2165463 - RNA, 21 nt, Homo sapiens
ucugagcccccugaccuucca

SEQ ID NO: 2165464 - RNA, 19 nt, Homo sapiens
gaaucuuauuuuuccuguc

SEQ ID NO: 2165465 - RNA, 13 nt, Homo sapiens
cucaguguaguua

SEQ ID NO: 2165466 - RNA, 12 nt, Homo sapiens
cucugagcaguu

SEQ ID NO: 2165467 - RNA, 20 nt, Homo sapiens
aaacacccuuucaucucaga

SEQ ID NO: 2165468 - RNA, 23 nt, Homo sapiens
ucagaaaaccacuuuauugcaau

SEQ ID NO: 2165469 - RNA, 22 nt, Homo sapiens
gucagucugaugagaacucuga

SEQ ID NO: 2165470 - RNA, 14 nt, Homo sapiens
ccugagaaggcaaa

SEQ ID NO: 2165471 - RNA, 14 nt, Homo sapiens
acaacgaugaugcu

SEQ ID NO: 2165472 - RNA, 15 nt, Homo sapiens
uugcggaagccauag

SEQ ID NO: 2165473 - RNA, 15 nt, Homo sapiens
accagaagccaaaga

SEQ ID NO: 2165474 - RNA, 22 nt, Homo sapiens
uagugccaaaaggccccuuccc

SEQ ID NO: 2165475 - RNA, 23 nt, Homo sapiens
caccaaggcugagacagugaauu

SEQ ID NO: 2165476 - RNA, 22 nt, Homo sapiens
ugaaaggaagcuccacugucac

SEQ ID NO: 2165477 - RNA, 13 nt, Homo sapiens
agguuucaagacu

SEQ ID NO: 2165478 - RNA, 14 nt, Homo sapiens
gaccacuccccuca

SEQ ID NO: 2165479 - RNA, 22 nt, Homo sapiens
ucucaaauucauggugcacuga

SEQ ID NO: 2165480 - RNA, 15 nt, Homo sapiens
aaagguucugaaaag

SEQ ID NO: 2165481 - RNA, 21 nt, Homo sapiens
gugugccuauagucgcagcua

SEQ ID NO: 2165482 - RNA, 16 nt, Homo sapiens
cagauggcacuuugaa

SEQ ID NO: 2165483 - RNA, 19 nt, Homo sapiens
cucagaggcugagcccugu

SEQ ID NO: 2165484 - RNA, 21 nt, Homo sapiens
guaagaauuuuaauauugcca

SEQ ID NO: 2165485 - RNA, 21 nt, Homo sapiens
caaggcuggccagcaaggcag

SEQ ID NO: 2165486 - RNA, 20 nt, Homo sapiens
aguugcagauguuagauauu

SEQ ID NO: 2165487 - RNA, 15 nt, Homo sapiens
ucucuuuauucuaaa

SEQ ID NO: 2165488 - RNA, 20 nt, Homo sapiens
aaagugcuugaggcuaccuc

SEQ ID NO: 2165489 - RNA, 18 nt, Homo sapiens
ccucgggggccuguggug

SEQ ID NO: 2165490 - RNA, 21 nt, Homo sapiens
acuaaucuuauucauuuucuc

SEQ ID NO: 2165491 - RNA, 16 nt, Homo sapiens
caacguggcccagaga

SEQ ID NO: 2165492 - RNA, 22 nt, Homo sapiens
aucuuguucuuuaaaaucacaa

SEQ ID NO: 2165493 - RNA, 22 nt, Homo sapiens
caagcaaugagaagaccaggaa

SEQ ID NO: 2165494 - RNA, 14 nt, Homo sapiens
gaagaaaacaucua

SEQ ID NO: 2165495 - RNA, 17 nt, Homo sapiens
aaauucccuucaucugg

SEQ ID NO: 2165496 - RNA, 13 nt, Homo sapiens
gcucagaucccac

SEQ ID NO: 2165497 - RNA, 15 nt, Homo sapiens
caaucuguccacaaa

SEQ ID NO: 2165498 - RNA, 21 nt, Homo sapiens
ggugccccucuuccaaaggca

SEQ ID NO: 2165499 - RNA, 14 nt, Homo sapiens
gccuguggcuugua

SEQ ID NO: 2165500 - RNA, 19 nt, Homo sapiens
gugggaggcggugcacuca

SEQ ID NO: 2165501 - RNA, 17 nt, Homo sapiens
uucuggcuucaugcaau

SEQ ID NO: 2165502 - RNA, 22 nt, Homo sapiens
cccuggcaccuguguuccagcc

SEQ ID NO: 2165503 - RNA, 19 nt, Homo sapiens
gcacuaccaggcugugggu

SEQ ID NO: 2165504 - RNA, 19 nt, Homo sapiens
gugcugauucaaaccaaag

SEQ ID NO: 2165505 - RNA, 18 nt, Homo sapiens
uucugccacuugcacugu

SEQ ID NO: 2165506 - RNA, 14 nt, Homo sapiens
agcauguggggaag

SEQ ID NO: 2165507 - RNA, 17 nt, Homo sapiens
aaggaccugcauuuucc

SEQ ID NO: 2165508 - RNA, 17 nt, Homo sapiens
gaaaguggaaauggaga

SEQ ID NO: 2165509 - RNA, 23 nt, Homo sapiens
cagaagaaauucugcaagcuuuu

SEQ ID NO: 2165510 - RNA, 18 nt, Homo sapiens
agcuggcccggccacucu

SEQ ID NO: 2165511 - RNA, 15 nt, Homo sapiens
uccugccuucaugga

SEQ ID NO: 2165512 - RNA, 19 nt, Homo sapiens
uaaguggaaaaugcaaugu

SEQ ID NO: 2165513 - RNA, 17 nt, Homo sapiens
augauauucucauuauu

SEQ ID NO: 2165514 - RNA, 17 nt, Homo sapiens
uacauauaaagauuaac

SEQ ID NO: 2165515 - RNA, 13 nt, Homo sapiens
uuauuaaucucau

SEQ ID NO: 2165516 - RNA, 16 nt, Homo sapiens
gcauagauuugcagcu

SEQ ID NO: 2165517 - RNA, 13 nt, Homo sapiens
agccaugcuuuau

SEQ ID NO: 2165518 - RNA, 22 nt, Homo sapiens
uuacacugccuguauacuuuag

SEQ ID NO: 2165519 - RNA, 18 nt, Homo sapiens
gcaggugcucaugcugcu

SEQ ID NO: 2165520 - RNA, 18 nt, Homo sapiens
ggaaaaaaacaguugcau

SEQ ID NO: 2165521 - RNA, 12 nt, Homo sapiens
gaaccaauaaug

SEQ ID NO: 2165522 - RNA, 21 nt, Homo sapiens
gccucaguuucuucaccugua

SEQ ID NO: 2165523 - RNA, 12 nt, Homo sapiens
cagguccuccau

SEQ ID NO: 2165524 - RNA, 15 nt, Homo sapiens
ugaaaugaacuuugu

SEQ ID NO: 2165525 - RNA, 15 nt, Homo sapiens
aucaaacaaccuuca

SEQ ID NO: 2165526 - RNA, 16 nt, Homo sapiens
guuugaacacaauucg

SEQ ID NO: 2165527 - RNA, 16 nt, Homo sapiens
uauuggauuuguccaa

SEQ ID NO: 2165528 - RNA, 18 nt, Homo sapiens
ccuuugauuuuuugccca

SEQ ID NO: 2165529 - RNA, 18 nt, Homo sapiens
acuccuccugcuccucac

SEQ ID NO: 2165530 - RNA, 23 nt, Homo sapiens
aauucugauacauuagcagcuau

SEQ ID NO: 2165531 - RNA, 19 nt, Homo sapiens
acucuaaaaauagaaucca

SEQ ID NO: 2165532 - RNA, 15 nt, Homo sapiens
cugagccccuacccc

SEQ ID NO: 2165533 - RNA, 18 nt, Homo sapiens
agggugcuuuguguaaua

SEQ ID NO: 2165534 - RNA, 15 nt, Homo sapiens
cucucgggugcccug

SEQ ID NO: 2165535 - RNA, 15 nt, Homo sapiens
ccacaucuguccuca

SEQ ID NO: 2165536 - RNA, 14 nt, Homo sapiens
aaugaaaaugcagu

SEQ ID NO: 2165537 - RNA, 18 nt, Homo sapiens
uccaucuuucacuaucug

SEQ ID NO: 2165538 - RNA, 16 nt, Homo sapiens
gaauuuaaucuuugag

SEQ ID NO: 2165539 - RNA, 13 nt, Homo sapiens
acaaugucccuuc

SEQ ID NO: 2165540 - RNA, 13 nt, Homo sapiens
ggcacuauuuauu

SEQ ID NO: 2165541 - RNA, 22 nt, Homo sapiens
aauaaaggcauauauaccaagg

SEQ ID NO: 2165542 - RNA, 23 nt, Homo sapiens
ggccccaccaagcacccuuccac

SEQ ID NO: 2165543 - RNA, 21 nt, Homo sapiens
aagaagggaauuuauugccuc

SEQ ID NO: 2165544 - RNA, 18 nt, Homo sapiens
aaagaaaaaaaaacuggg

SEQ ID NO: 2165545 - RNA, 17 nt, Homo sapiens
uccaacucagagcacag

SEQ ID NO: 2165546 - RNA, 23 nt, Homo sapiens
cacagaggccccaccugaagggu

SEQ ID NO: 2165547 - RNA, 13 nt, Homo sapiens
uuuugugguucuc

SEQ ID NO: 2165548 - RNA, 18 nt, Homo sapiens
agagacaggguuucacca

SEQ ID NO: 2165549 - RNA, 11 nt, Homo sapiens
uagcugcucac

SEQ ID NO: 2165550 - RNA, 23 nt, Homo sapiens
ugcauaaugcuuuggaaaaaugg

SEQ ID NO: 2165551 - RNA, 20 nt, Homo sapiens
ggaugcauucccuacagauu

SEQ ID NO: 2165552 - RNA, 23 nt, Homo sapiens
ugugcaccccuccccauucacag

SEQ ID NO: 2165553 - RNA, 13 nt, Homo sapiens
aaacuguggugcu

SEQ ID NO: 2165554 - RNA, 23 nt, Homo sapiens
uugugucaaucaugcuguguaau

SEQ ID NO: 2165555 - RNA, 20 nt, Homo sapiens
ucucccagggaugcucuuug

SEQ ID NO: 2165556 - RNA, 15 nt, Homo sapiens
gaggccaaacacacu

SEQ ID NO: 2165557 - RNA, 18 nt, Homo sapiens
cagaggaggccagccuca

SEQ ID NO: 2165558 - RNA, 21 nt, Homo sapiens
cuaagcacuuuauaaauauca

SEQ ID NO: 2165559 - RNA, 23 nt, Homo sapiens
aaggguaccuugaacacuggggg

SEQ ID NO: 2165560 - RNA, 22 nt, Homo sapiens
ccuccacgguccgcggccugca

SEQ ID NO: 2165561 - RNA, 14 nt, Homo sapiens
auaaguucauacau

SEQ ID NO: 2165562 - RNA, 20 nt, Homo sapiens
aucccagcagcccaagcuua

SEQ ID NO: 2165563 - RNA, 19 nt, Homo sapiens
auugcagaggggcccauga

SEQ ID NO: 2165564 - RNA, 23 nt, Homo sapiens
aaggcuuacacccacaguggaaa

SEQ ID NO: 2165565 - RNA, 19 nt, Homo sapiens
ucaagaacaauucacagua

SEQ ID NO: 2165566 - RNA, 13 nt, Homo sapiens
aaauccucauugu

SEQ ID NO: 2165567 - RNA, 20 nt, Homo sapiens
cucccgaacacgcacagaag

SEQ ID NO: 2165568 - RNA, 18 nt, Homo sapiens
cccuggggccuguacaaa

SEQ ID NO: 2165569 - RNA, 21 nt, Homo sapiens
guugugaaauaaaauggugaa

SEQ ID NO: 2165570 - RNA, 11 nt, Homo sapiens
guguugaucag

SEQ ID NO: 2165571 - RNA, 16 nt, Homo sapiens
gcaggacaacaucagc

SEQ ID NO: 2165572 - RNA, 23 nt, Homo sapiens
aagacgucacccuccauucugca

SEQ ID NO: 2165573 - RNA, 22 nt, Homo sapiens
uugcugauaaaacagauuguga

SEQ ID NO: 2165574 - RNA, 13 nt, Homo sapiens
ugggcugagccaa

SEQ ID NO: 2165575 - RNA, 14 nt, Homo sapiens
uacccagagagucc

SEQ ID NO: 2165576 - RNA, 14 nt, Homo sapiens
ugaggccauagcaa

SEQ ID NO: 2165577 - RNA, 20 nt, Homo sapiens
agugccaauauuucugauau

SEQ ID NO: 2165578 - RNA, 13 nt, Homo sapiens
uccgcccccaugc

SEQ ID NO: 2165579 - RNA, 13 nt, Homo sapiens
cuguguacugugg

SEQ ID NO: 2165580 - RNA, 11 nt, Homo sapiens
gcaucacuggg

SEQ ID NO: 2165581 - RNA, 20 nt, Homo sapiens
gcuggugacccagcaucuga

SEQ ID NO: 2165582 - RNA, 13 nt, Homo sapiens
uauuguggcacaa

SEQ ID NO: 2165583 - RNA, 23 nt, Homo sapiens
auagucaccuuuuaaauccuguu

SEQ ID NO: 2165584 - RNA, 20 nt, Homo sapiens
gaaaaucaguuauauucuuu

SEQ ID NO: 2165585 - RNA, 17 nt, Homo sapiens
acguaauaaaauuaacu

SEQ ID NO: 2165586 - RNA, 18 nt, Homo sapiens
acacguacaaaauccagc

SEQ ID NO: 2165587 - RNA, 20 nt, Homo sapiens
cuaauuagaucaauuacuua

SEQ ID NO: 2165588 - RNA, 13 nt, Homo sapiens
acuggaaaacugc

SEQ ID NO: 2165589 - RNA, 20 nt, Homo sapiens
guuuaaacaaaaaacccaca

SEQ ID NO: 2165590 - RNA, 11 nt, Homo sapiens
uggaaagaagg

SEQ ID NO: 2165591 - RNA, 16 nt, Homo sapiens
gucaggcccaguucuc

SEQ ID NO: 2165592 - RNA, 17 nt, Homo sapiens
uuaaucuuuucacaaau

SEQ ID NO: 2165593 - RNA, 18 nt, Homo sapiens
ccagcucaaugcaauggc

SEQ ID NO: 2165594 - RNA, 13 nt, Homo sapiens
gagaaaccagcuu

SEQ ID NO: 2165595 - RNA, 13 nt, Homo sapiens
ugcacauauuuga

SEQ ID NO: 2165596 - RNA, 13 nt, Homo sapiens
aaagcuuacacag

SEQ ID NO: 2165597 - RNA, 22 nt, Homo sapiens
cucuuacuucccccacccuggg

SEQ ID NO: 2165598 - RNA, 19 nt, Homo sapiens
aaaugugguuacacacuuu

SEQ ID NO: 2165599 - RNA, 15 nt, Homo sapiens
gccccagccccggcc

SEQ ID NO: 2165600 - RNA, 15 nt, Homo sapiens
uggagaggggacccu

SEQ ID NO: 2165601 - RNA, 17 nt, Homo sapiens
ugacagccagagccugu

SEQ ID NO: 2165602 - RNA, 17 nt, Homo sapiens
aucaauucuguauucca

SEQ ID NO: 2165603 - RNA, 14 nt, Homo sapiens
caaaagucagucuu

SEQ ID NO: 2165604 - RNA, 13 nt, Homo sapiens
uauugaauucuuc

SEQ ID NO: 2165605 - RNA, 14 nt, Homo sapiens
cagaggucuucagg

SEQ ID NO: 2165606 - RNA, 14 nt, Homo sapiens
uucggauccaggga

SEQ ID NO: 2165607 - RNA, 14 nt, Homo sapiens
agauaacacugacu

SEQ ID NO: 2165608 - RNA, 14 nt, Homo sapiens
uacccuuucauuca

SEQ ID NO: 2165609 - RNA, 14 nt, Homo sapiens
aaagccuguuccau

SEQ ID NO: 2165610 - RNA, 16 nt, Homo sapiens
uucacucaacaaacau

SEQ ID NO: 2165611 - RNA, 18 nt, Homo sapiens
cauugccuggacugacca

SEQ ID NO: 2165612 - RNA, 15 nt, Homo sapiens
ucucuugguaugcau

SEQ ID NO: 2165613 - RNA, 14 nt, Homo sapiens
ucucugagaacaga

SEQ ID NO: 2165614 - RNA, 22 nt, Homo sapiens
ugacugucacuugcugcuuuuu

SEQ ID NO: 2165615 - RNA, 15 nt, Homo sapiens
gcucccagugccaaa

SEQ ID NO: 2165616 - RNA, 18 nt, Homo sapiens
uaccgaugugugaugucu

SEQ ID NO: 2165617 - RNA, 19 nt, Homo sapiens
auagauuacugaugugaua

SEQ ID NO: 2165618 - RNA, 22 nt, Homo sapiens
auucuuuagagauuauaacaaa

SEQ ID NO: 2165619 - RNA, 21 nt, Homo sapiens
aacagagcaagacccaucuca

SEQ ID NO: 2165620 - RNA, 17 nt, Homo sapiens
cgaagcccuuccagugg

SEQ ID NO: 2165621 - RNA, 19 nt, Homo sapiens
gaacuaaugauaaucccac

SEQ ID NO: 2165622 - RNA, 12 nt, Homo sapiens
accuauacugaa

SEQ ID NO: 2165623 - RNA, 17 nt, Homo sapiens
ucccccgaguaccgccu

SEQ ID NO: 2165624 - RNA, 12 nt, Homo sapiens
guggguggugga

SEQ ID NO: 2165625 - RNA, 20 nt, Homo sapiens
cuggaccagaugcugaaaga

SEQ ID NO: 2165626 - RNA, 15 nt, Homo sapiens
aaaucauaggugaag

SEQ ID NO: 2165627 - RNA, 23 nt, Homo sapiens
ggagacaacagcccugucucaaa

SEQ ID NO: 2165628 - RNA, 20 nt, Homo sapiens
uauacugggcagaaugaagu

SEQ ID NO: 2165629 - RNA, 19 nt, Homo sapiens
uagacucaaagaaguacug

SEQ ID NO: 2165630 - RNA, 18 nt, Homo sapiens
ccucccagagagugaaua

SEQ ID NO: 2165631 - RNA, 19 nt, Homo sapiens
uuaaugcaaaugacuguca

SEQ ID NO: 2165632 - RNA, 18 nt, Homo sapiens
gcuccaggcaucacugau

SEQ ID NO: 2165633 - RNA, 21 nt, Homo sapiens
cucagcagaaacacacaguca

SEQ ID NO: 2165634 - RNA, 17 nt, Homo sapiens
cagcuuugauaaugucc

SEQ ID NO: 2165635 - RNA, 13 nt, Homo sapiens
auuggcaguguaa

SEQ ID NO: 2165636 - RNA, 19 nt, Homo sapiens
aaauguauucaaauaccaa

SEQ ID NO: 2165637 - RNA, 12 nt, Homo sapiens
aggaacaggugg

SEQ ID NO: 2165638 - RNA, 16 nt, Homo sapiens
gagccaccacauccag

SEQ ID NO: 2165639 - RNA, 18 nt, Homo sapiens
guuuuacccuauaucuau

SEQ ID NO: 2165640 - RNA, 19 nt, Homo sapiens
cucaccccugcccugggau

SEQ ID NO: 2165641 - RNA, 14 nt, Homo sapiens
acauccugucagug

SEQ ID NO: 2165642 - RNA, 16 nt, Homo sapiens
aggcagacuugcagag

SEQ ID NO: 2165643 - RNA, 19 nt, Homo sapiens
cauguggaagcacuuuaag

SEQ ID NO: 2165644 - RNA, 15 nt, Homo sapiens
gaacagggcaaaaug

SEQ ID NO: 2165645 - RNA, 17 nt, Homo sapiens
uugcuacauaguccaaa

SEQ ID NO: 2165646 - RNA, 22 nt, Homo sapiens
uguccuggcugugcacauucuc

SEQ ID NO: 2165647 - RNA, 14 nt, Homo sapiens
cauaaacacuucuc

SEQ ID NO: 2165648 - RNA, 18 nt, Homo sapiens
aacaagcuccaccuucca

SEQ ID NO: 2165649 - RNA, 20 nt, Homo sapiens
aaggacuucacugcaaguuu

SEQ ID NO: 2165650 - RNA, 19 nt, Homo sapiens
aacagcuuauugacuuaau

SEQ ID NO: 2165651 - RNA, 14 nt, Homo sapiens
uuguuucuguagaa

SEQ ID NO: 2165652 - RNA, 20 nt, Homo sapiens
auguuuggaaaccacaguca

SEQ ID NO: 2165653 - RNA, 15 nt, Homo sapiens
agaaaaacaugucau

SEQ ID NO: 2165654 - RNA, 15 nt, Homo sapiens
ugcacccacgugcau

SEQ ID NO: 2165655 - RNA, 14 nt, Homo sapiens
uuauuuauauauga

SEQ ID NO: 2165656 - RNA, 15 nt, Homo sapiens
agagcuggugccaga

SEQ ID NO: 2165657 - RNA, 12 nt, Homo sapiens
auuucagcacau

SEQ ID NO: 2165658 - RNA, 20 nt, Homo sapiens
gggaggcggagcuugcagug

SEQ ID NO: 2165659 - RNA, 15 nt, Homo sapiens
auuuaacccuucaca

SEQ ID NO: 2165660 - RNA, 16 nt, Homo sapiens
aaccaggccuccaagc

SEQ ID NO: 2165661 - RNA, 18 nt, Homo sapiens
aauuuuguaaauaugcaa

SEQ ID NO: 2165662 - RNA, 13 nt, Homo sapiens
gcugcucccucag

SEQ ID NO: 2165663 - RNA, 23 nt, Homo sapiens
auguguggaaguuauuaacuuua

SEQ ID NO: 2165664 - RNA, 16 nt, Homo sapiens
gacuagucaccugggg

SEQ ID NO: 2165665 - RNA, 17 nt, Homo sapiens
cuucauuaccucaguga

SEQ ID NO: 2165666 - RNA, 16 nt, Homo sapiens
uauuauaaaaguacua

SEQ ID NO: 2165667 - RNA, 16 nt, Homo sapiens
uagaccaggugcucag

SEQ ID NO: 2165668 - RNA, 14 nt, Homo sapiens
ucccucuucucucc

SEQ ID NO: 2165669 - RNA, 15 nt, Homo sapiens
guucaauacagugaa

SEQ ID NO: 2165670 - RNA, 21 nt, Homo sapiens
auggguccuugaugccagagg

SEQ ID NO: 2165671 - RNA, 23 nt, Homo sapiens
cucagaaaugucauguggcuacc

SEQ ID NO: 2165672 - RNA, 13 nt, Homo sapiens
uuuuaaauguguu

SEQ ID NO: 2165673 - RNA, 23 nt, Homo sapiens
gucacuguuuuuuucccaggugu

SEQ ID NO: 2165674 - RNA, 19 nt, Homo sapiens
auugauagaaaucaggccu

SEQ ID NO: 2165675 - RNA, 18 nt, Homo sapiens
uaaacuguggguuuuccu

SEQ ID NO: 2165676 - RNA, 19 nt, Homo sapiens
uaugauguauacugccacu

SEQ ID NO: 2165677 - RNA, 13 nt, Homo sapiens
cugacauccacau

SEQ ID NO: 2165678 - RNA, 18 nt, Homo sapiens
ggguggggggugacagug

SEQ ID NO: 2165679 - RNA, 17 nt, Homo sapiens
aggagcccacagugccu

SEQ ID NO: 2165680 - RNA, 13 nt, Homo sapiens
acaauaguauuuc

SEQ ID NO: 2165681 - RNA, 17 nt, Homo sapiens
aaaugcaaagcacaccu

SEQ ID NO: 2165682 - RNA, 17 nt, Homo sapiens
gucuugguguaguguaa

SEQ ID NO: 2165683 - RNA, 21 nt, Homo sapiens
uccgacaacaccguguccaaa

SEQ ID NO: 2165684 - RNA, 15 nt, Homo sapiens
ucuuccaggggacuc

SEQ ID NO: 2165685 - RNA, 21 nt, Homo sapiens
auuucacugaugcuucuguca

SEQ ID NO: 2165686 - RNA, 13 nt, Homo sapiens
aacauucugucau

SEQ ID NO: 2165687 - RNA, 12 nt, Homo sapiens
ccacacugaggc

SEQ ID NO: 2165688 - RNA, 12 nt, Homo sapiens
agaacaggguca

SEQ ID NO: 2165689 - RNA, 13 nt, Homo sapiens
aagaauuuugcuu

SEQ ID NO: 2165690 - RNA, 14 nt, Homo sapiens
aggaguaauggcau

SEQ ID NO: 2165691 - RNA, 14 nt, Homo sapiens
uaaaccaauugcag

SEQ ID NO: 2165692 - RNA, 20 nt, Homo sapiens
aacucuccuggccuggccau

SEQ ID NO: 2165693 - RNA, 17 nt, Homo sapiens
aaauggcuuguucaguc

SEQ ID NO: 2165694 - RNA, 20 nt, Homo sapiens
gaaccacuuguagauuugau

SEQ ID NO: 2165695 - RNA, 16 nt, Homo sapiens
aauccaccugcaguua

SEQ ID NO: 2165696 - RNA, 20 nt, Homo sapiens
accagucuccuccccuacuc

SEQ ID NO: 2165697 - RNA, 16 nt, Homo sapiens
cuucuacugcuaucua

SEQ ID NO: 2165698 - RNA, 22 nt, Homo sapiens
ucuccaaucaguguuuggugua

SEQ ID NO: 2165699 - RNA, 22 nt, Homo sapiens
cuucagucuugaauuucuaaaa

SEQ ID NO: 2165700 - RNA, 19 nt, Homo sapiens
agaaacagaagauuacaaa

SEQ ID NO: 2165701 - RNA, 19 nt, Homo sapiens
uuugguggggccauccaca

SEQ ID NO: 2165702 - RNA, 18 nt, Homo sapiens
uaaaagacagacauuccu

SEQ ID NO: 2165703 - RNA, 17 nt, Homo sapiens
cauagagacccauguca

SEQ ID NO: 2165704 - RNA, 20 nt, Homo sapiens
gcuaaaauaaaccagacuca

SEQ ID NO: 2165705 - RNA, 15 nt, Homo sapiens
aacuaucagaggaaa

SEQ ID NO: 2165706 - RNA, 14 nt, Homo sapiens
auauauuugauaca

SEQ ID NO: 2165707 - RNA, 19 nt, Homo sapiens
acuaaagguuuuacuauua

SEQ ID NO: 2165708 - RNA, 19 nt, Homo sapiens
acuucacccacgcauauac

SEQ ID NO: 2165709 - RNA, 17 nt, Homo sapiens
cuucagcuuuccugagc

SEQ ID NO: 2165710 - RNA, 19 nt, Homo sapiens
auuauaaaugacaaccuga

SEQ ID NO: 2165711 - RNA, 21 nt, Homo sapiens
aacugaaggggugcacccacc

SEQ ID NO: 2165712 - RNA, 11 nt, Homo sapiens
ucucaaagggg

SEQ ID NO: 2165713 - RNA, 20 nt, Homo sapiens
cucuaaacacaaauugugaa

SEQ ID NO: 2165714 - RNA, 16 nt, Homo sapiens
cccaggucacaugcac

SEQ ID NO: 2165715 - RNA, 14 nt, Homo sapiens
uuacagacucugau

SEQ ID NO: 2165716 - RNA, 22 nt, Homo sapiens
ugcaauuuuauuaaaugcauca

SEQ ID NO: 2165717 - RNA, 16 nt, Homo sapiens
uaucuguuugcuucua

SEQ ID NO: 2165718 - RNA, 22 nt, Homo sapiens
aaaauguuuuuaaacaguguca

SEQ ID NO: 2165719 - RNA, 15 nt, Homo sapiens
aauuuaagacaaguu

SEQ ID NO: 2165720 - RNA, 13 nt, Homo sapiens
aaauccaguucua

SEQ ID NO: 2165721 - RNA, 15 nt, Homo sapiens
uugaauuaccauaga

SEQ ID NO: 2165722 - RNA, 21 nt, Homo sapiens
ggcagcagacugaccaucucc

SEQ ID NO: 2165723 - RNA, 22 nt, Homo sapiens
ccagagccaagaaacacuuuca

SEQ ID NO: 2165724 - RNA, 21 nt, Homo sapiens
ccggcuaugggacugcagugc

SEQ ID NO: 2165725 - RNA, 16 nt, Homo sapiens
augauuuuggccacuu

SEQ ID NO: 2165726 - RNA, 17 nt, Homo sapiens
gccuugaugaaauaaca

SEQ ID NO: 2165727 - RNA, 18 nt, Homo sapiens
auuuuacaaagcauguga

SEQ ID NO: 2165728 - RNA, 14 nt, Homo sapiens
acgguaacauccaa

SEQ ID NO: 2165729 - RNA, 13 nt, Homo sapiens
cugaccccaaaga

SEQ ID NO: 2165730 - RNA, 13 nt, Homo sapiens
guggaugcugcug

SEQ ID NO: 2165731 - RNA, 20 nt, Homo sapiens
ugcacuccagccuaggcaac

SEQ ID NO: 2165732 - RNA, 15 nt, Homo sapiens
acuccuucacgagga

SEQ ID NO: 2165733 - RNA, 21 nt, Homo sapiens
gauuuacugcaagaaguacau

SEQ ID NO: 2165734 - RNA, 15 nt, Homo sapiens
uauucaaggaucuca

SEQ ID NO: 2165735 - RNA, 18 nt, Homo sapiens
aaggacuucuuccaggga

SEQ ID NO: 2165736 - RNA, 14 nt, Homo sapiens
guccagaccugggc

SEQ ID NO: 2165737 - RNA, 14 nt, Homo sapiens
cuuuggcauguuua

SEQ ID NO: 2165738 - RNA, 20 nt, Homo sapiens
cuuggugauuccgcagugag

SEQ ID NO: 2165739 - RNA, 18 nt, Homo sapiens
acuguauauagaagucua

SEQ ID NO: 2165740 - RNA, 16 nt, Homo sapiens
ccuuccuuaugccaua

SEQ ID NO: 2165741 - RNA, 20 nt, Homo sapiens
cuccugggggcauaucucag

SEQ ID NO: 2165742 - RNA, 20 nt, Homo sapiens
guugugugccucuagcugaa

SEQ ID NO: 2165743 - RNA, 12 nt, Homo sapiens
caccaggggugc

SEQ ID NO: 2165744 - RNA, 22 nt, Homo sapiens
aacaugcaagaccaguauucua

SEQ ID NO: 2165745 - RNA, 17 nt, Homo sapiens
ccuccccuccuugcacc

SEQ ID NO: 2165746 - RNA, 13 nt, Homo sapiens
gagccaugcucuu

SEQ ID NO: 2165747 - RNA, 23 nt, Homo sapiens
ucuaaagauggaguuucuaaggu

SEQ ID NO: 2165748 - RNA, 14 nt, Homo sapiens
cagcccuuccccau

SEQ ID NO: 2165749 - RNA, 21 nt, Homo sapiens
ggcucucccucucugcaccug

SEQ ID NO: 2165750 - RNA, 20 nt, Homo sapiens
uaucaguauucugacaugua

SEQ ID NO: 2165751 - RNA, 23 nt, Homo sapiens
guaaggauaugagccuuugcaca

SEQ ID NO: 2165752 - RNA, 17 nt, Homo sapiens
uaaauauagaaccauga

SEQ ID NO: 2165753 - RNA, 14 nt, Homo sapiens
uucagacauuccau

SEQ ID NO: 2165754 - RNA, 14 nt, Homo sapiens
ucacaaaaauuuga

SEQ ID NO: 2165755 - RNA, 20 nt, Homo sapiens
cugcguccugaggagugucc

SEQ ID NO: 2165756 - RNA, 22 nt, Homo sapiens
cauuggguccugggucuuucau

SEQ ID NO: 2165757 - RNA, 12 nt, Homo sapiens
uaaagauuuaua

SEQ ID NO: 2165758 - RNA, 15 nt, Homo sapiens
ugcauguccucaaaa

SEQ ID NO: 2165759 - RNA, 22 nt, Homo sapiens
gcaauacagacuacuucuuccc

SEQ ID NO: 2165760 - RNA, 20 nt, Homo sapiens
uauucugcuuccacaugugc

SEQ ID NO: 2165761 - RNA, 16 nt, Homo sapiens
ccugacuggugcugca

SEQ ID NO: 2165762 - RNA, 15 nt, Homo sapiens
guuccaguacugguu

SEQ ID NO: 2165763 - RNA, 20 nt, Homo sapiens
aaguccuguaugucugucau

SEQ ID NO: 2165764 - RNA, 17 nt, Homo sapiens
uuuggagugagaaauca

SEQ ID NO: 2165765 - RNA, 23 nt, Homo sapiens
auacuccacucccagcagcucaa

SEQ ID NO: 2165766 - RNA, 12 nt, Homo sapiens
agacccgugacc

SEQ ID NO: 2165767 - RNA, 19 nt, Homo sapiens
ugaacacuagucuguguaa

SEQ ID NO: 2165768 - RNA, 21 nt, Homo sapiens
uggucccucuucucuccucag

SEQ ID NO: 2165769 - RNA, 17 nt, Homo sapiens
uuuguaaaauguucucu

SEQ ID NO: 2165770 - RNA, 13 nt, Homo sapiens
gagccaagcccug

SEQ ID NO: 2165771 - RNA, 16 nt, Homo sapiens
ccaggagcgcaucuca

SEQ ID NO: 2165772 - RNA, 22 nt, Homo sapiens
agacgcucauucagcaucugac

SEQ ID NO: 2165773 - RNA, 12 nt, Homo sapiens
gcuucuccuucu

SEQ ID NO: 2165774 - RNA, 12 nt, Homo sapiens
gcuccuccuucc

SEQ ID NO: 2165775 - RNA, 14 nt, Homo sapiens
cuaaaaaacagagg

SEQ ID NO: 2165776 - RNA, 19 nt, Homo sapiens
cacaauguacuauauguau

SEQ ID NO: 2165777 - RNA, 14 nt, Homo sapiens
uaacaagccagauu

SEQ ID NO: 2165778 - RNA, 15 nt, Homo sapiens
ucacccagcucacgu

SEQ ID NO: 2165779 - RNA, 13 nt, Homo sapiens
cucauacaaugau

SEQ ID NO: 2165780 - RNA, 15 nt, Homo sapiens
auauuagaaagggaa

SEQ ID NO: 2165781 - RNA, 18 nt, Homo sapiens
aucucuuccauaauucag

SEQ ID NO: 2165782 - RNA, 21 nt, Homo sapiens
auguuuggaaaaaacucugaa

SEQ ID NO: 2165783 - RNA, 19 nt, Homo sapiens
ccaccuuugccacaaagcu

SEQ ID NO: 2165784 - RNA, 13 nt, Homo sapiens
gguggcacgugcc

SEQ ID NO: 2165785 - RNA, 14 nt, Homo sapiens
augccuugaugauu

SEQ ID NO: 2165786 - RNA, 17 nt, Homo sapiens
cacuuacagaacaaaga

SEQ ID NO: 2165787 - RNA, 13 nt, Homo sapiens
gcuacaagggaag

SEQ ID NO: 2165788 - RNA, 12 nt, Homo sapiens
cccaggcacaac

SEQ ID NO: 2165789 - RNA, 18 nt, Homo sapiens
uuucucagaugauggaua

SEQ ID NO: 2165790 - RNA, 19 nt, Homo sapiens
cucaggcccaggaguccag

SEQ ID NO: 2165791 - RNA, 16 nt, Homo sapiens
augccugcacugggaa

SEQ ID NO: 2165792 - RNA, 12 nt, Homo sapiens
aaagccagugaa

SEQ ID NO: 2165793 - RNA, 19 nt, Homo sapiens
gcucaaugaugcaggcaau

SEQ ID NO: 2165794 - RNA, 17 nt, Homo sapiens
uaaagagccaguuuauu

SEQ ID NO: 2165795 - RNA, 20 nt, Homo sapiens
uuauccaaucuuguuuccaa

SEQ ID NO: 2165796 - RNA, 24 nt, Homo sapiens
gaccugucacgauugucaucagga

SEQ ID NO: 2165797 - RNA, 16 nt, Homo sapiens
agaauuuagaaaugag

SEQ ID NO: 2165798 - RNA, 22 nt, Homo sapiens
uauuuucuucuccaguggucau

SEQ ID NO: 2165799 - RNA, 18 nt, Homo sapiens
uucacacucaauagucac

SEQ ID NO: 2165800 - RNA, 19 nt, Homo sapiens
cauuuuuguauuuuguaca

SEQ ID NO: 2165801 - RNA, 16 nt, Homo sapiens
gcuuccgccgucucaa

SEQ ID NO: 2165802 - RNA, 12 nt, Homo sapiens
uccaaccacuca

SEQ ID NO: 2165803 - RNA, 17 nt, Homo sapiens
caggcuuaugaauauau

SEQ ID NO: 2165804 - RNA, 15 nt, Homo sapiens
caucccugcagcuca

SEQ ID NO: 2165805 - RNA, 15 nt, Homo sapiens
gguuucuggggucca

SEQ ID NO: 2165806 - RNA, 21 nt, Homo sapiens
agaauaaaaaagaaauccaua

SEQ ID NO: 2165807 - RNA, 23 nt, Homo sapiens
aauacuucuuguguguaugcaca

SEQ ID NO: 2165808 - RNA, 20 nt, Homo sapiens
uuagauauaauaaauuugga

SEQ ID NO: 2165809 - RNA, 20 nt, Homo sapiens
ccaagguuuugaaaucccau

SEQ ID NO: 2165810 - RNA, 17 nt, Homo sapiens
caaagaggcuguuauaa

SEQ ID NO: 2165811 - RNA, 14 nt, Homo sapiens
uuuaucugugacca

SEQ ID NO: 2165812 - RNA, 16 nt, Homo sapiens
aaaaucacuucagauc

SEQ ID NO: 2165813 - RNA, 13 nt, Homo sapiens
ugauuguggcauu

SEQ ID NO: 2165814 - RNA, 20 nt, Homo sapiens
acaaauuagccauuucacuc

SEQ ID NO: 2165815 - RNA, 17 nt, Homo sapiens
agccuugcucucuucaa

SEQ ID NO: 2165816 - RNA, 13 nt, Homo sapiens
ucucuuuguccug

SEQ ID NO: 2165817 - RNA, 12 nt, Homo sapiens
gugaaagcaaau

SEQ ID NO: 2165818 - RNA, 17 nt, Homo sapiens
aucaaguccuuuaauua

SEQ ID NO: 2165819 - RNA, 22 nt, Homo sapiens
ucccuggaguguagaccugugu

SEQ ID NO: 2165820 - RNA, 24 nt, Homo sapiens
cgccaugugcugugcacccgugcc

SEQ ID NO: 2165821 - RNA, 15 nt, Homo sapiens
aguuaagaacaucaa

SEQ ID NO: 2165822 - RNA, 20 nt, Homo sapiens
uuucaugaagcaagaaugga

SEQ ID NO: 2165823 - RNA, 18 nt, Homo sapiens
gagggguaacuugcaccu

SEQ ID NO: 2165824 - RNA, 15 nt, Homo sapiens
ugccaugaguccaug

SEQ ID NO: 2165825 - RNA, 19 nt, Homo sapiens
cuaggaaucaugugccaag

SEQ ID NO: 2165826 - RNA, 16 nt, Homo sapiens
auuuaauaacuuugcu

SEQ ID NO: 2165827 - RNA, 15 nt, Homo sapiens
ugccucugagagcau

SEQ ID NO: 2165828 - RNA, 19 nt, Homo sapiens
ggucauaaagcauuggagu

SEQ ID NO: 2165829 - RNA, 16 nt, Homo sapiens
aucaauuuuuauacau

SEQ ID NO: 2165830 - RNA, 13 nt, Homo sapiens
aaaugaaagguga

SEQ ID NO: 2165831 - RNA, 17 nt, Homo sapiens
gaagaguuuacagacaa

SEQ ID NO: 2165832 - RNA, 22 nt, Homo sapiens
cuuuagagccagcccauggcuu

SEQ ID NO: 2165833 - RNA, 18 nt, Homo sapiens
caggagaaucacuggaac

SEQ ID NO: 2165834 - RNA, 16 nt, Homo sapiens
uuagcaguucugcaaa

SEQ ID NO: 2165835 - RNA, 21 nt, Homo sapiens
ugucuuggcauuaaaccacau

SEQ ID NO: 2165836 - RNA, 21 nt, Homo sapiens
gugcagaccuuacucagggga

SEQ ID NO: 2165837 - RNA, 22 nt, Homo sapiens
auguuguauaugguauugugag

SEQ ID NO: 2165838 - RNA, 18 nt, Homo sapiens
caagcgaccuaaacagcu

SEQ ID NO: 2165839 - RNA, 13 nt, Homo sapiens
acuuuucauuuca

SEQ ID NO: 2165840 - RNA, 21 nt, Homo sapiens
auaucugacaguuacucuuca

SEQ ID NO: 2165841 - RNA, 22 nt, Homo sapiens
ggaaaagaagaaacuuugccuc

SEQ ID NO: 2165842 - RNA, 16 nt, Homo sapiens
augacaaaaagccuuu

SEQ ID NO: 2165843 - RNA, 16 nt, Homo sapiens
uagacaauuugccuua

SEQ ID NO: 2165844 - RNA, 16 nt, Homo sapiens
augcugcacaccaguu

SEQ ID NO: 2165845 - RNA, 22 nt, Homo sapiens
ugagcaguguuggagugaggac

SEQ ID NO: 2165846 - RNA, 11 nt, Homo sapiens
agcuccaaagc

SEQ ID NO: 2165847 - RNA, 19 nt, Homo sapiens
acucgagaggcugaggcag

SEQ ID NO: 2165848 - RNA, 22 nt, Homo sapiens
acgcaaacacaccgaugcacac

SEQ ID NO: 2165849 - RNA, 14 nt, Homo sapiens
ggccuauuccggaa

SEQ ID NO: 2165850 - RNA, 22 nt, Homo sapiens
gccaacauuuuaguucuuugga

SEQ ID NO: 2165851 - RNA, 18 nt, Homo sapiens
acauaggcaucauuucac

SEQ ID NO: 2165852 - RNA, 15 nt, Homo sapiens
cccuccagccagaga

SEQ ID NO: 2165853 - RNA, 23 nt, Homo sapiens
ugagugugggugccaguccuccu

SEQ ID NO: 2165854 - RNA, 14 nt, Homo sapiens
cucaagcacuaaaa

SEQ ID NO: 2165855 - RNA, 14 nt, Homo sapiens
aaacagcaaaccaa

SEQ ID NO: 2165856 - RNA, 17 nt, Homo sapiens
ugaaauuuaaaauaagc

SEQ ID NO: 2165857 - RNA, 18 nt, Homo sapiens
uuuugcacaguuagcaaa

SEQ ID NO: 2165858 - RNA, 21 nt, Homo sapiens
ucaagcgauucuucugccuca

SEQ ID NO: 2165859 - RNA, 15 nt, Homo sapiens
acauuggcagugugu

SEQ ID NO: 2165860 - RNA, 13 nt, Homo sapiens
aacgcgacuucca

SEQ ID NO: 2165861 - RNA, 16 nt, Homo sapiens
aauccaccugccuugg

SEQ ID NO: 2165862 - RNA, 14 nt, Homo sapiens
cugaaucaugagcc

SEQ ID NO: 2165863 - RNA, 14 nt, Homo sapiens
uggauuuucuacug

SEQ ID NO: 2165864 - RNA, 21 nt, Homo sapiens
caggaaaugggaaugagagca

SEQ ID NO: 2165865 - RNA, 14 nt, Homo sapiens
uauuagaaauuaga

SEQ ID NO: 2165866 - RNA, 11 nt, Homo sapiens
aaaccaucaca

SEQ ID NO: 2165867 - RNA, 16 nt, Homo sapiens
cccagguaauggcaug

SEQ ID NO: 2165868 - RNA, 13 nt, Homo sapiens
uauuuaauuccau

SEQ ID NO: 2165869 - RNA, 21 nt, Homo sapiens
ucccuucggcgccagcagcuc

SEQ ID NO: 2165870 - RNA, 18 nt, Homo sapiens
ugaaaugcuguuaguaaa

SEQ ID NO: 2165871 - RNA, 18 nt, Homo sapiens
ugaggucuuucuccucag

SEQ ID NO: 2165872 - RNA, 17 nt, Homo sapiens
gcaccugcagggagcag

SEQ ID NO: 2165873 - RNA, 13 nt, Homo sapiens
gagagucauucag

SEQ ID NO: 2165874 - RNA, 13 nt, Homo sapiens
ggcuccacuggga

SEQ ID NO: 2165875 - RNA, 13 nt, Homo sapiens
caggaugaguuac

SEQ ID NO: 2165876 - RNA, 20 nt, Homo sapiens
cugauauacuugagugugca

SEQ ID NO: 2165877 - RNA, 17 nt, Homo sapiens
gaaacauuguaaauauu

SEQ ID NO: 2165878 - RNA, 20 nt, Homo sapiens
ccucagacaauccacucuca

SEQ ID NO: 2165879 - RNA, 16 nt, Homo sapiens
guuuuguuugaaaaag

SEQ ID NO: 2165880 - RNA, 13 nt, Homo sapiens
cugugccugcuca

SEQ ID NO: 2165881 - RNA, 15 nt, Homo sapiens
cagaaacaaaaucaa

SEQ ID NO: 2165882 - RNA, 14 nt, Homo sapiens
auucuucuacuugu

SEQ ID NO: 2165883 - RNA, 15 nt, Homo sapiens
ucuuuccaagaccaa

SEQ ID NO: 2165884 - RNA, 15 nt, Homo sapiens
acuguacuagucugu

SEQ ID NO: 2165885 - RNA, 17 nt, Homo sapiens
agaaaaggaaugcaaga

SEQ ID NO: 2165886 - RNA, 16 nt, Homo sapiens
guucaaauucuucuga

SEQ ID NO: 2165887 - RNA, 16 nt, Homo sapiens
ccgugacagaugccaa

SEQ ID NO: 2165888 - RNA, 11 nt, Homo sapiens
uugucaugaau

SEQ ID NO: 2165889 - RNA, 20 nt, Homo sapiens
ugaaaugccccgucagaaau

SEQ ID NO: 2165890 - RNA, 18 nt, Homo sapiens
gucaccaagcaugaccca

SEQ ID NO: 2165891 - RNA, 11 nt, Homo sapiens
cuccaguguug

SEQ ID NO: 2165892 - RNA, 14 nt, Homo sapiens
uuccuucacucauc

SEQ ID NO: 2165893 - RNA, 17 nt, Homo sapiens
ugaaaagacucaguguu

SEQ ID NO: 2165894 - RNA, 16 nt, Homo sapiens
cauuuccauguaugca

SEQ ID NO: 2165895 - RNA, 22 nt, Homo sapiens
ccucugguuuuccucugcuccu

SEQ ID NO: 2165896 - RNA, 14 nt, Homo sapiens
aaacaucuuuucac

SEQ ID NO: 2165897 - RNA, 20 nt, Homo sapiens
cugcucacaaaaucacuuua

SEQ ID NO: 2165898 - RNA, 14 nt, Homo sapiens
aacugaagccagaa

SEQ ID NO: 2165899 - RNA, 13 nt, Homo sapiens
acuugagaaaaua

SEQ ID NO: 2165900 - RNA, 18 nt, Homo sapiens
agcauguauaaugcaguu

SEQ ID NO: 2165901 - RNA, 19 nt, Homo sapiens
ccaauuggcucuagucacu

SEQ ID NO: 2165902 - RNA, 19 nt, Homo sapiens
aaaugcuggggucauauaa

SEQ ID NO: 2165903 - RNA, 19 nt, Homo sapiens
uugcagaaugaagccauuu

SEQ ID NO: 2165904 - RNA, 19 nt, Homo sapiens
uagcaguuuguaaaagugu

SEQ ID NO: 2165905 - RNA, 13 nt, Homo sapiens
gauuaauguacuu

SEQ ID NO: 2165906 - RNA, 15 nt, Homo sapiens
ccauuacaguguaaa

SEQ ID NO: 2165907 - RNA, 15 nt, Homo sapiens
cugauuggugauuca

SEQ ID NO: 2165908 - RNA, 19 nt, Homo sapiens
gagacucgagaacuuucau

SEQ ID NO: 2165909 - RNA, 20 nt, Homo sapiens
uguuccuguucgugcuugua

SEQ ID NO: 2165910 - RNA, 12 nt, Homo sapiens
ucuucaucccau

SEQ ID NO: 2165911 - RNA, 12 nt, Homo sapiens
ucugcaucccag

SEQ ID NO: 2165912 - RNA, 14 nt, Homo sapiens
gcuggagacgggug

SEQ ID NO: 2165913 - RNA, 21 nt, Homo sapiens
gcucagguuuugagaagccau

SEQ ID NO: 2165914 - RNA, 13 nt, Homo sapiens
ccccucugccuuu

SEQ ID NO: 2165915 - RNA, 16 nt, Homo sapiens
cuuuugcucuucauaa

SEQ ID NO: 2165916 - RNA, 14 nt, Homo sapiens
cacaggcuguaaau

SEQ ID NO: 2165917 - RNA, 20 nt, Homo sapiens
acauagcgagacuccaccuc

SEQ ID NO: 2165918 - RNA, 12 nt, Homo sapiens
ugagugccuuac

SEQ ID NO: 2165919 - RNA, 13 nt, Homo sapiens
caggcuucucacc

SEQ ID NO: 2165920 - RNA, 13 nt, Homo sapiens
cuaugugggacac

SEQ ID NO: 2165921 - RNA, 23 nt, Homo sapiens
cugcugcaggagccgcugcugag

SEQ ID NO: 2165922 - RNA, 13 nt, Homo sapiens
ucaagacaaugca

SEQ ID NO: 2165923 - RNA, 21 nt, Homo sapiens
ccccagcgucugcagggugac

SEQ ID NO: 2165924 - RNA, 13 nt, Homo sapiens
uagcaucucagga

SEQ ID NO: 2165925 - RNA, 15 nt, Homo sapiens
caggcagugugaguu

SEQ ID NO: 2165926 - RNA, 23 nt, Homo sapiens
cuuuucuuucucccuaaccacua

SEQ ID NO: 2165927 - RNA, 15 nt, Homo sapiens
agcuuacuuccauug

SEQ ID NO: 2165928 - RNA, 16 nt, Homo sapiens
ugacaaaauuggccag

SEQ ID NO: 2165929 - RNA, 13 nt, Homo sapiens
acuuccacauuau

SEQ ID NO: 2165930 - RNA, 19 nt, Homo sapiens
cuuccuuaaacuccuguga

SEQ ID NO: 2165931 - RNA, 22 nt, Homo sapiens
uggagacccgccuggcuaacaa

SEQ ID NO: 2165932 - RNA, 16 nt, Homo sapiens
cuaucauggcauauaa

SEQ ID NO: 2165933 - RNA, 22 nt, Homo sapiens
cacuguugucaaaaaguuccau

SEQ ID NO: 2165934 - RNA, 19 nt, Homo sapiens
gcagguuggaacuaugcag

SEQ ID NO: 2165935 - RNA, 15 nt, Homo sapiens
gcagugcagugcuca

SEQ ID NO: 2165936 - RNA, 15 nt, Homo sapiens
uuuaagcaacacaga

SEQ ID NO: 2165937 - RNA, 20 nt, Homo sapiens
augaauaaauguuauagcug

SEQ ID NO: 2165938 - RNA, 16 nt, Homo sapiens
ugcccuuguugucucu

SEQ ID NO: 2165939 - RNA, 18 nt, Homo sapiens
acagcuaugcacuguaaa

SEQ ID NO: 2165940 - RNA, 19 nt, Homo sapiens
acaaucuugucauacuuga

SEQ ID NO: 2165941 - RNA, 20 nt, Homo sapiens
aacaacacuggugugaccug

SEQ ID NO: 2165942 - RNA, 12 nt, Homo sapiens
cgcugggugguu

SEQ ID NO: 2165943 - RNA, 23 nt, Homo sapiens
uuaucuauggaaaugugagaaau

SEQ ID NO: 2165944 - RNA, 15 nt, Homo sapiens
cuacugccaaccucg

SEQ ID NO: 2165945 - RNA, 15 nt, Homo sapiens
acccagaacugggcu

SEQ ID NO: 2165946 - RNA, 17 nt, Homo sapiens
guuacuuagaaugccau

SEQ ID NO: 2165947 - RNA, 13 nt, Homo sapiens
ccacccuaguccc

SEQ ID NO: 2165948 - RNA, 18 nt, Homo sapiens
aaagaaaggaacuaaguc

SEQ ID NO: 2165949 - RNA, 16 nt, Homo sapiens
agagguuaacagauuu

SEQ ID NO: 2165950 - RNA, 19 nt, Homo sapiens
aaugugaauaugccaguga

SEQ ID NO: 2165951 - RNA, 15 nt, Homo sapiens
ugugggcuccauuca

SEQ ID NO: 2165952 - RNA, 14 nt, Homo sapiens
accaggcugcucag

SEQ ID NO: 2165953 - RNA, 22 nt, Homo sapiens
ucuagcuucuucagagaucaag

SEQ ID NO: 2165954 - RNA, 21 nt, Homo sapiens
gccugagccaaugggacaguu

SEQ ID NO: 2165955 - RNA, 14 nt, Homo sapiens
uuacaucuguaaag

SEQ ID NO: 2165956 - RNA, 23 nt, Homo sapiens
cccaaggccccacuuucaagaau

SEQ ID NO: 2165957 - RNA, 14 nt, Homo sapiens
ccugucacacaggg

SEQ ID NO: 2165958 - RNA, 21 nt, Homo sapiens
gacuaacccaaugccugugaa

SEQ ID NO: 2165959 - RNA, 13 nt, Homo sapiens
cugccuugcugcc

SEQ ID NO: 2165960 - RNA, 11 nt, Homo sapiens
uagaauaccac

SEQ ID NO: 2165961 - RNA, 21 nt, Homo sapiens
ggaauccuuggggagcacuug

SEQ ID NO: 2165962 - RNA, 16 nt, Homo sapiens
ugaagucagaucugcc

SEQ ID NO: 2165963 - RNA, 15 nt, Homo sapiens
gcaacugacuucauu

SEQ ID NO: 2165964 - RNA, 18 nt, Homo sapiens
cuuuauguauggagcucu

SEQ ID NO: 2165965 - RNA, 18 nt, Homo sapiens
aucauguugaaacaaacc

SEQ ID NO: 2165966 - RNA, 19 nt, Homo sapiens
caccaauuuagaaugaaua

SEQ ID NO: 2165967 - RNA, 18 nt, Homo sapiens
aaaaguaaauucauguaa

SEQ ID NO: 2165968 - RNA, 12 nt, Homo sapiens
cuuaaagcugcu

SEQ ID NO: 2165969 - RNA, 22 nt, Homo sapiens
guugcagcccuugugaugugau

SEQ ID NO: 2165970 - RNA, 17 nt, Homo sapiens
aagggaagagccuuuau

SEQ ID NO: 2165971 - RNA, 13 nt, Homo sapiens
gagggggcucagu

SEQ ID NO: 2165972 - RNA, 23 nt, Homo sapiens
gugccucuguuaccaccaccucu

SEQ ID NO: 2165973 - RNA, 20 nt, Homo sapiens
ggaagccccugggcccagua

SEQ ID NO: 2165974 - RNA, 18 nt, Homo sapiens
cugcaaggggacauucca

SEQ ID NO: 2165975 - RNA, 21 nt, Homo sapiens
agaguuucuccuuuugaccaa

SEQ ID NO: 2165976 - RNA, 22 nt, Homo sapiens
uccacuucugguauaauugugu

SEQ ID NO: 2165977 - RNA, 19 nt, Homo sapiens
gaauguccucuuggagaaa

SEQ ID NO: 2165978 - RNA, 15 nt, Homo sapiens
uuccugcuuauucau

SEQ ID NO: 2165979 - RNA, 20 nt, Homo sapiens
acuucucugggucccggggu

SEQ ID NO: 2165980 - RNA, 17 nt, Homo sapiens
ugcccccuacccggcuc

SEQ ID NO: 2165981 - RNA, 12 nt, Homo sapiens
ccugguggcuuc

SEQ ID NO: 2165982 - RNA, 17 nt, Homo sapiens
cggggacuuuaccugcu

SEQ ID NO: 2165983 - RNA, 22 nt, Homo sapiens
aucucuccagagagcaaacaua

SEQ ID NO: 2165984 - RNA, 19 nt, Homo sapiens
auugaagguuguauguaaa

SEQ ID NO: 2165985 - RNA, 21 nt, Homo sapiens
aguuguuuuaacagaugccaa

SEQ ID NO: 2165986 - RNA, 15 nt, Homo sapiens
gaauagcaguuucac

SEQ ID NO: 2165987 - RNA, 23 nt, Homo sapiens
cugaguccagcuccccccaagau

SEQ ID NO: 2165988 - RNA, 13 nt, Homo sapiens
ucagacauucaga

SEQ ID NO: 2165989 - RNA, 18 nt, Homo sapiens
guauaacuaggcuguuaa

SEQ ID NO: 2165990 - RNA, 19 nt, Homo sapiens
agaauuacaguacacaucc

SEQ ID NO: 2165991 - RNA, 20 nt, Homo sapiens
cuccuaaacugaacacauga

SEQ ID NO: 2165992 - RNA, 21 nt, Homo sapiens
acugcaguguaagaaaauugg

SEQ ID NO: 2165993 - RNA, 22 nt, Homo sapiens
acagcugugagccaugccuccc

SEQ ID NO: 2165994 - RNA, 18 nt, Homo sapiens
guuaucugaacuguggaa

SEQ ID NO: 2165995 - RNA, 19 nt, Homo sapiens
uucccuacuccaugggcug

SEQ ID NO: 2165996 - RNA, 16 nt, Homo sapiens
uguucccccugugcag

SEQ ID NO: 2165997 - RNA, 14 nt, Homo sapiens
ggaagacuugccac

SEQ ID NO: 2165998 - RNA, 14 nt, Homo sapiens
cucagagacuauuu

SEQ ID NO: 2165999 - RNA, 11 nt, Homo sapiens
uuucacagugg

SEQ ID NO: 2166000 - RNA, 21 nt, Homo sapiens
ugcugaugcuguuaaccaaag

SEQ ID NO: 2166001 - RNA, 20 nt, Homo sapiens
agaaggaaaugugggguaga

SEQ ID NO: 2166002 - RNA, 20 nt, Homo sapiens
acuucugagaucuguugauu

SEQ ID NO: 2166003 - RNA, 19 nt, Homo sapiens
gccuuuccccccagagggc

SEQ ID NO: 2166004 - RNA, 21 nt, Homo sapiens
cauuuccccucccaauccucu

SEQ ID NO: 2166005 - RNA, 14 nt, Homo sapiens
acagauacugugag

SEQ ID NO: 2166006 - RNA, 24 nt, Homo sapiens
acugcuagcuuucuccuuaccguc

SEQ ID NO: 2166007 - RNA, 17 nt, Homo sapiens
augaaaugacugucuaa

SEQ ID NO: 2166008 - RNA, 17 nt, Homo sapiens
uccaugccaugaaugag

SEQ ID NO: 2166009 - RNA, 22 nt, Homo sapiens
gaguuaaaagcaauccauguga

SEQ ID NO: 2166010 - RNA, 18 nt, Homo sapiens
ugacuuucuagcuucccu

SEQ ID NO: 2166011 - RNA, 13 nt, Homo sapiens
gccucacaguccu

SEQ ID NO: 2166012 - RNA, 13 nt, Homo sapiens
uuuucacaucucu

SEQ ID NO: 2166013 - RNA, 15 nt, Homo sapiens
agggacagucaguuu

SEQ ID NO: 2166014 - RNA, 15 nt, Homo sapiens
ccacaagucuuccag

SEQ ID NO: 2166015 - RNA, 17 nt, Homo sapiens
cagacuuuuguuugugu

SEQ ID NO: 2166016 - RNA, 18 nt, Homo sapiens
ccaauaaaagugacucuc

SEQ ID NO: 2166017 - RNA, 20 nt, Homo sapiens
aaaauuuuucuuaagacaga

SEQ ID NO: 2166018 - RNA, 15 nt, Homo sapiens
aagucaccuguauaa

SEQ ID NO: 2166019 - RNA, 23 nt, Homo sapiens
uuggaagcauacaaagcaguuua

SEQ ID NO: 2166020 - RNA, 16 nt, Homo sapiens
auuugccccaacuuaa

SEQ ID NO: 2166021 - RNA, 23 nt, Homo sapiens
augcaaacuuuauuuuguguuua

SEQ ID NO: 2166022 - RNA, 23 nt, Homo sapiens
agucugaagcucgcauccagaca

SEQ ID NO: 2166023 - RNA, 15 nt, Homo sapiens
acaccuuucagucuc

SEQ ID NO: 2166024 - RNA, 17 nt, Homo sapiens
aauggcuuaagcaauaa

SEQ ID NO: 2166025 - RNA, 13 nt, Homo sapiens
accuugagcagaa

SEQ ID NO: 2166026 - RNA, 18 nt, Homo sapiens
agacaagucuguggcuug

SEQ ID NO: 2166027 - RNA, 18 nt, Homo sapiens
ugcauguucauugcaaac

SEQ ID NO: 2166028 - RNA, 16 nt, Homo sapiens
cucaggugaucugccc

SEQ ID NO: 2166029 - RNA, 13 nt, Homo sapiens
gugugacaucaca

SEQ ID NO: 2166030 - RNA, 15 nt, Homo sapiens
aagcaucuggcucua

SEQ ID NO: 2166031 - RNA, 18 nt, Homo sapiens
auuuuuaguuacuugagu

SEQ ID NO: 2166032 - RNA, 21 nt, Homo sapiens
cagacaucuccagugugccag

SEQ ID NO: 2166033 - RNA, 16 nt, Homo sapiens
caggcagaucugugcc

SEQ ID NO: 2166034 - RNA, 18 nt, Homo sapiens
uauacuucaaaagccaua

SEQ ID NO: 2166035 - RNA, 17 nt, Homo sapiens
uacuguccccaucauca

SEQ ID NO: 2166036 - RNA, 18 nt, Homo sapiens
agccagagucaacaaauu

SEQ ID NO: 2166037 - RNA, 19 nt, Homo sapiens
caaaaccaaauauuccaga

SEQ ID NO: 2166038 - RNA, 19 nt, Homo sapiens
cuggggucaggugccacug

SEQ ID NO: 2166039 - RNA, 18 nt, Homo sapiens
cccaaacucuccagacau

SEQ ID NO: 2166040 - RNA, 19 nt, Homo sapiens
uccccuccuuggcuuuaug

SEQ ID NO: 2166041 - RNA, 21 nt, Homo sapiens
agcaauaaauaacacuuguca

SEQ ID NO: 2166042 - RNA, 13 nt, Homo sapiens
acaaccagccaca

SEQ ID NO: 2166043 - RNA, 16 nt, Homo sapiens
cccugagacaaaugga

SEQ ID NO: 2166044 - RNA, 18 nt, Homo sapiens
cauccccaccacugauau

SEQ ID NO: 2166045 - RNA, 19 nt, Homo sapiens
ucgucaagagcaugcacau

SEQ ID NO: 2166046 - RNA, 20 nt, Homo sapiens
gccauugaacagcugugagc

SEQ ID NO: 2166047 - RNA, 23 nt, Homo sapiens
ccuuucuuuuaaugaugccaugg

SEQ ID NO: 2166048 - RNA, 13 nt, Homo sapiens
agaagcucuuacu

SEQ ID NO: 2166049 - RNA, 16 nt, Homo sapiens
cagccaugauucuuuu

SEQ ID NO: 2166050 - RNA, 12 nt, Homo sapiens
cuuuaaucugca

SEQ ID NO: 2166051 - RNA, 19 nt, Homo sapiens
acuggccagcucuggcuca

SEQ ID NO: 2166052 - RNA, 23 nt, Homo sapiens
auugcauuuaaaaauauauagcu

SEQ ID NO: 2166053 - RNA, 19 nt, Homo sapiens
cggccuugaagacagagca

SEQ ID NO: 2166054 - RNA, 17 nt, Homo sapiens
ccaaauggcacuuuuga

SEQ ID NO: 2166055 - RNA, 19 nt, Homo sapiens
ccaaaucugaccuaaaagu

SEQ ID NO: 2166056 - RNA, 18 nt, Homo sapiens
cagaaaugugcugcaaag

SEQ ID NO: 2166057 - RNA, 19 nt, Homo sapiens
uguuagauagaauuuccaa

SEQ ID NO: 2166058 - RNA, 19 nt, Homo sapiens
uaacuuuuaauguggcaag

SEQ ID NO: 2166059 - RNA, 17 nt, Homo sapiens
cacucucccuggagcug

SEQ ID NO: 2166060 - RNA, 20 nt, Homo sapiens
cagucaccaaguguauugua

SEQ ID NO: 2166061 - RNA, 18 nt, Homo sapiens
agugccaauauuucugau

SEQ ID NO: 2166062 - RNA, 21 nt, Homo sapiens
aagacacauugacuccuuucc

SEQ ID NO: 2166063 - RNA, 14 nt, Homo sapiens
gugauucaccucuu

SEQ ID NO: 2166064 - RNA, 19 nt, Homo sapiens
cgagguuccaguaaucuga

SEQ ID NO: 2166065 - RNA, 19 nt, Homo sapiens
ugcuauauaaacuuuaaca

SEQ ID NO: 2166066 - RNA, 17 nt, Homo sapiens
caaaccaggugcaauua

SEQ ID NO: 2166067 - RNA, 17 nt, Homo sapiens
augcccacauacugucu

SEQ ID NO: 2166068 - RNA, 18 nt, Homo sapiens
uacuuagcagcuaucucu

SEQ ID NO: 2166069 - RNA, 17 nt, Homo sapiens
acccucuuccugugauc

SEQ ID NO: 2166070 - RNA, 23 nt, Homo sapiens
uuugucccagcgauggugccugc

SEQ ID NO: 2166071 - RNA, 21 nt, Homo sapiens
gacagcugcuucugugcauuu

SEQ ID NO: 2166072 - RNA, 22 nt, Homo sapiens
aaauagauuuauuuuccagcuu

SEQ ID NO: 2166073 - RNA, 22 nt, Homo sapiens
gaaaaugaagaagaaaauagaa

SEQ ID NO: 2166074 - RNA, 15 nt, Homo sapiens
aauuuagucacacca

SEQ ID NO: 2166075 - RNA, 21 nt, Homo sapiens
agugacaugcauucacauauc

SEQ ID NO: 2166076 - RNA, 18 nt, Homo sapiens
cuguaaacuuguagcauu

SEQ ID NO: 2166077 - RNA, 15 nt, Homo sapiens
augcagagagggcau

SEQ ID NO: 2166078 - RNA, 15 nt, Homo sapiens
gacaaaacacugugu

SEQ ID NO: 2166079 - RNA, 12 nt, Homo sapiens
aaaagugauuau

SEQ ID NO: 2166080 - RNA, 13 nt, Homo sapiens
cauuucacacccu

SEQ ID NO: 2166081 - RNA, 15 nt, Homo sapiens
ucuuggaaccacgaa

SEQ ID NO: 2166082 - RNA, 16 nt, Homo sapiens
ccccuccuccaugcug

SEQ ID NO: 2166083 - RNA, 16 nt, Homo sapiens
gcaguguaggcuuuac

SEQ ID NO: 2166084 - RNA, 19 nt, Homo sapiens
guaucuugccuaaggugcg

SEQ ID NO: 2166085 - RNA, 14 nt, Homo sapiens
gugaggucuugcag

SEQ ID NO: 2166086 - RNA, 12 nt, Homo sapiens
cuccugucuuca

SEQ ID NO: 2166087 - RNA, 19 nt, Homo sapiens
gcauacugccuuguuuaau

SEQ ID NO: 2166088 - RNA, 16 nt, Homo sapiens
gccuggaacaccagca

SEQ ID NO: 2166089 - RNA, 22 nt, Homo sapiens
aggccacccgcacaaaauucac

SEQ ID NO: 2166090 - RNA, 14 nt, Homo sapiens
gaauacugugcaua

SEQ ID NO: 2166091 - RNA, 14 nt, Homo sapiens
uauuaugucucaaa

SEQ ID NO: 2166092 - RNA, 21 nt, Homo sapiens
gugaaagaguaaaaccaaagg

SEQ ID NO: 2166093 - RNA, 16 nt, Homo sapiens
guguuuuuaacauguc

SEQ ID NO: 2166094 - RNA, 15 nt, Homo sapiens
uagguguucuaauca

SEQ ID NO: 2166095 - RNA, 15 nt, Homo sapiens
gcccuaccagcagcu

SEQ ID NO: 2166096 - RNA, 21 nt, Homo sapiens
agaaucagagcuggauucaau

SEQ ID NO: 2166097 - RNA, 16 nt, Homo sapiens
cucauggauugccaca

SEQ ID NO: 2166098 - RNA, 23 nt, Homo sapiens
agaaagugagcaguguuagcuua

SEQ ID NO: 2166099 - RNA, 22 nt, Homo sapiens
augcccccuguggaugcugcug

SEQ ID NO: 2166100 - RNA, 21 nt, Homo sapiens
ccaagagagggccaugcaauu

SEQ ID NO: 2166101 - RNA, 20 nt, Homo sapiens
ccauagucaaauuuguaaau

SEQ ID NO: 2166102 - RNA, 21 nt, Homo sapiens
ccaugcguguuucugacucug

SEQ ID NO: 2166103 - RNA, 12 nt, Homo sapiens
ucagaacaaaca

SEQ ID NO: 2166104 - RNA, 21 nt, Homo sapiens
ccguggugagguugugcugcc

SEQ ID NO: 2166105 - RNA, 14 nt, Homo sapiens
guuuucucucuccg

SEQ ID NO: 2166106 - RNA, 19 nt, Homo sapiens
cacagcuuagaagugcuau

SEQ ID NO: 2166107 - RNA, 15 nt, Homo sapiens
cuuccuauuagugac

SEQ ID NO: 2166108 - RNA, 14 nt, Homo sapiens
ucuguaaaugacac

SEQ ID NO: 2166109 - RNA, 11 nt, Homo sapiens
auuagccaaaa

SEQ ID NO: 2166110 - RNA, 13 nt, Homo sapiens
cagcauugcugga

SEQ ID NO: 2166111 - RNA, 17 nt, Homo sapiens
aaacuaccuguauuuaa

SEQ ID NO: 2166112 - RNA, 18 nt, Homo sapiens
cauuagagaaaaccuuaa

SEQ ID NO: 2166113 - RNA, 18 nt, Homo sapiens
caaaauagacaauuugca

SEQ ID NO: 2166114 - RNA, 16 nt, Homo sapiens
cagguucuucagggcc

SEQ ID NO: 2166115 - RNA, 17 nt, Homo sapiens
acaauaaaaaccaaacu

SEQ ID NO: 2166116 - RNA, 13 nt, Homo sapiens
augccauucuucc

SEQ ID NO: 2166117 - RNA, 15 nt, Homo sapiens
agagcucacuaaaau

SEQ ID NO: 2166118 - RNA, 19 nt, Homo sapiens
uggggagcccggaggacag

SEQ ID NO: 2166119 - RNA, 23 nt, Homo sapiens
ggggcaccuuaagauuuugcacc

SEQ ID NO: 2166120 - RNA, 16 nt, Homo sapiens
guuucuaaaacagaca

SEQ ID NO: 2166121 - RNA, 13 nt, Homo sapiens
acccacauuggaa

SEQ ID NO: 2166122 - RNA, 21 nt, Homo sapiens
cagauguaaauagaacaaccu

SEQ ID NO: 2166123 - RNA, 17 nt, Homo sapiens
ugcaguuucuuuucaca

SEQ ID NO: 2166124 - RNA, 15 nt, Homo sapiens
aucugauaugcagag

SEQ ID NO: 2166125 - RNA, 16 nt, Homo sapiens
ccacugucuagagcaa

SEQ ID NO: 2166126 - RNA, 19 nt, Homo sapiens
uuucuagauccuaugugaa

SEQ ID NO: 2166127 - RNA, 19 nt, Homo sapiens
aaugaaagggaaacuggga

SEQ ID NO: 2166128 - RNA, 18 nt, Homo sapiens
cagcaaccagagcacugu

SEQ ID NO: 2166129 - RNA, 22 nt, Homo sapiens
ucucucccagucuacccagaga

SEQ ID NO: 2166130 - RNA, 13 nt, Homo sapiens
cugcuugugcacu

SEQ ID NO: 2166131 - RNA, 14 nt, Homo sapiens
agccuucugaugag

SEQ ID NO: 2166132 - RNA, 15 nt, Homo sapiens
gcugaaaccauccgc

SEQ ID NO: 2166133 - RNA, 19 nt, Homo sapiens
ccaacugccuguucaauaa

SEQ ID NO: 2166134 - RNA, 17 nt, Homo sapiens
ugcuccuuagcugccaa

SEQ ID NO: 2166135 - RNA, 18 nt, Homo sapiens
cucacugaggguaucuga

SEQ ID NO: 2166136 - RNA, 20 nt, Homo sapiens
gugccagcaaugacaucuca

SEQ ID NO: 2166137 - RNA, 18 nt, Homo sapiens
gcucugaucauccacugu

SEQ ID NO: 2166138 - RNA, 22 nt, Homo sapiens
uugcacagcccacacaugaacc

SEQ ID NO: 2166139 - RNA, 14 nt, Homo sapiens
ggccaaggugucca

SEQ ID NO: 2166140 - RNA, 16 nt, Homo sapiens
ccgaggacuccagggg

SEQ ID NO: 2166141 - RNA, 15 nt, Homo sapiens
ugaccuccuccugcc

SEQ ID NO: 2166142 - RNA, 19 nt, Homo sapiens
aaguagaggaauccaugua

SEQ ID NO: 2166143 - RNA, 23 nt, Homo sapiens
uccggcgggugacagcuccggga

SEQ ID NO: 2166144 - RNA, 22 nt, Homo sapiens
uuaaguggggugggaaggggag

SEQ ID NO: 2166145 - RNA, 20 nt, Homo sapiens
ucucacccucaucacuagga

SEQ ID NO: 2166146 - RNA, 21 nt, Homo sapiens
gggcccugggguccccacucc

SEQ ID NO: 2166147 - RNA, 13 nt, Homo sapiens
cuacucugcaaac

SEQ ID NO: 2166148 - RNA, 18 nt, Homo sapiens
gugauacuguacauagcu

SEQ ID NO: 2166149 - RNA, 20 nt, Homo sapiens
cuggaauccagaaggaagcu

SEQ ID NO: 2166150 - RNA, 19 nt, Homo sapiens
gaucuugagcaaggcaaga

SEQ ID NO: 2166151 - RNA, 15 nt, Homo sapiens
ucgcaccacugcacu

SEQ ID NO: 2166152 - RNA, 22 nt, Homo sapiens
ccagaaggcagggaaaggcucu

SEQ ID NO: 2166153 - RNA, 18 nt, Homo sapiens
aaaaacagaaccaaauaa

SEQ ID NO: 2166154 - RNA, 17 nt, Homo sapiens
auacauuguauaggcca

SEQ ID NO: 2166155 - RNA, 19 nt, Homo sapiens
uggaaacgaagcaccauca

SEQ ID NO: 2166156 - RNA, 15 nt, Homo sapiens
guaggggcagugaug

SEQ ID NO: 2166157 - RNA, 14 nt, Homo sapiens
agcaucaagccacu

SEQ ID NO: 2166158 - RNA, 22 nt, Homo sapiens
ucagacuuuggaaaaugcauug

SEQ ID NO: 2166159 - RNA, 22 nt, Homo sapiens
ucugagacccuuuucucaggac

SEQ ID NO: 2166160 - RNA, 21 nt, Homo sapiens
gaaauauccacccagcaggca

SEQ ID NO: 2166161 - RNA, 13 nt, Homo sapiens
ugaaaacacauga

SEQ ID NO: 2166162 - RNA, 17 nt, Homo sapiens
caucuuaguauuugcau

SEQ ID NO: 2166163 - RNA, 15 nt, Homo sapiens
aaggaacucugcagu

SEQ ID NO: 2166164 - RNA, 21 nt, Homo sapiens
augggugauuccuucaauuca

SEQ ID NO: 2166165 - RNA, 22 nt, Homo sapiens
cagaaaaaaaaaaaaaagccuu

SEQ ID NO: 2166166 - RNA, 22 nt, Homo sapiens
auucauguucaucaauaccugc

SEQ ID NO: 2166167 - RNA, 23 nt, Homo sapiens
ccuguaauccgagcacuuuggga

SEQ ID NO: 2166168 - RNA, 14 nt, Homo sapiens
ugaaauaugugaag

SEQ ID NO: 2166169 - RNA, 12 nt, Homo sapiens
cauacuaugaaa

SEQ ID NO: 2166170 - RNA, 17 nt, Homo sapiens
cuugacauuuaaacuca

SEQ ID NO: 2166171 - RNA, 13 nt, Homo sapiens
ugaagaccagcug

SEQ ID NO: 2166172 - RNA, 23 nt, Homo sapiens
auauuuucuggguuaaaacccca

SEQ ID NO: 2166173 - RNA, 20 nt, Homo sapiens
cuuggaagucguuucaggac

SEQ ID NO: 2166174 - RNA, 23 nt, Homo sapiens
acugaucucaggggucuuaccuu

SEQ ID NO: 2166175 - RNA, 15 nt, Homo sapiens
caccagaugccauua

SEQ ID NO: 2166176 - RNA, 14 nt, Homo sapiens
aaaguaaaggcaaa

SEQ ID NO: 2166177 - RNA, 14 nt, Homo sapiens
gaaguaaaagcaaa

SEQ ID NO: 2166178 - RNA, 18 nt, Homo sapiens
ccauuuuacuuccaugau

SEQ ID NO: 2166179 - RNA, 18 nt, Homo sapiens
uucguuguuauuauucau

SEQ ID NO: 2166180 - RNA, 15 nt, Homo sapiens
cguggaaguguuccu

SEQ ID NO: 2166181 - RNA, 14 nt, Homo sapiens
aaccagaucaaauu

SEQ ID NO: 2166182 - RNA, 15 nt, Homo sapiens
uuaauucagcuugag

SEQ ID NO: 2166183 - RNA, 21 nt, Homo sapiens
acgcauguaugcaugcacaaa

SEQ ID NO: 2166184 - RNA, 12 nt, Homo sapiens
cucugagcucau

SEQ ID NO: 2166185 - RNA, 19 nt, Homo sapiens
ucucugaguacauugugcc

SEQ ID NO: 2166186 - RNA, 20 nt, Homo sapiens
cacgaauauuaugcccaguu

SEQ ID NO: 2166187 - RNA, 19 nt, Homo sapiens
uccacagggauaccuuaau

SEQ ID NO: 2166188 - RNA, 14 nt, Homo sapiens
cucagcaagccaug

SEQ ID NO: 2166189 - RNA, 20 nt, Homo sapiens
uggcucauucugcaaugagc

SEQ ID NO: 2166190 - RNA, 19 nt, Homo sapiens
gcccucaggaguuuuggga

SEQ ID NO: 2166191 - RNA, 14 nt, Homo sapiens
gcuuugccacugaa

SEQ ID NO: 2166192 - RNA, 18 nt, Homo sapiens
ccagagcaggaaugggaa

SEQ ID NO: 2166193 - RNA, 14 nt, Homo sapiens
aaggagaaaucugg

SEQ ID NO: 2166194 - RNA, 20 nt, Homo sapiens
ccugcucuaaggcaguagaa

SEQ ID NO: 2166195 - RNA, 13 nt, Homo sapiens
ugggcaugacauc

SEQ ID NO: 2166196 - RNA, 14 nt, Homo sapiens
gaaaacauugcuuu

SEQ ID NO: 2166197 - RNA, 15 nt, Homo sapiens
uucacagccaggaga

SEQ ID NO: 2166198 - RNA, 15 nt, Homo sapiens
cugaguggcuuguga

SEQ ID NO: 2166199 - RNA, 14 nt, Homo sapiens
ggugccaaccucuu

SEQ ID NO: 2166200 - RNA, 17 nt, Homo sapiens
caauuuuagauaucaug

SEQ ID NO: 2166201 - RNA, 14 nt, Homo sapiens
auauguauauacau

SEQ ID NO: 2166202 - RNA, 14 nt, Homo sapiens
agggaccccagaua

SEQ ID NO: 2166203 - RNA, 17 nt, Homo sapiens
caccuuugccacaaagc

SEQ ID NO: 2166204 - RNA, 20 nt, Homo sapiens
cccagcuccugaauaaagau

SEQ ID NO: 2166205 - RNA, 19 nt, Homo sapiens
gauaucaacugcuuguaaa

SEQ ID NO: 2166206 - RNA, 19 nt, Homo sapiens
ucagaggaccccagggugg

SEQ ID NO: 2166207 - RNA, 23 nt, Homo sapiens
ucaaggcccggccccaucagagg

SEQ ID NO: 2166208 - RNA, 22 nt, Homo sapiens
guugcugccugugaaugcugag

SEQ ID NO: 2166209 - RNA, 17 nt, Homo sapiens
uccugccuugcugugaa

SEQ ID NO: 2166210 - RNA, 21 nt, Homo sapiens
aacugcauggaccuaacauuc

SEQ ID NO: 2166211 - RNA, 13 nt, Homo sapiens
cuucccuucccag

SEQ ID NO: 2166212 - RNA, 16 nt, Homo sapiens
uccuaagguucuugcu

SEQ ID NO: 2166213 - RNA, 18 nt, Homo sapiens
uuaaaagccccagucuca

SEQ ID NO: 2166214 - RNA, 18 nt, Homo sapiens
cuuccuuuuaacugccaa

SEQ ID NO: 2166215 - RNA, 19 nt, Homo sapiens
gucagcccauggaggcaga

SEQ ID NO: 2166216 - RNA, 18 nt, Homo sapiens
acuggacauuuaacuuuu

SEQ ID NO: 2166217 - RNA, 15 nt, Homo sapiens
caauguuacuaucug

SEQ ID NO: 2166218 - RNA, 15 nt, Homo sapiens
augucauaaagugag

SEQ ID NO: 2166219 - RNA, 15 nt, Homo sapiens
auuccuagaaguuga

SEQ ID NO: 2166220 - RNA, 17 nt, Homo sapiens
aauggagcaucaagcca

SEQ ID NO: 2166221 - RNA, 22 nt, Homo sapiens
caccuuguuuucuguucuccuu

SEQ ID NO: 2166222 - RNA, 13 nt, Homo sapiens
agaaaugccccca

SEQ ID NO: 2166223 - RNA, 21 nt, Homo sapiens
augaccaguuguuauuuacag

SEQ ID NO: 2166224 - RNA, 18 nt, Homo sapiens
cccaacuucauacuggca

SEQ ID NO: 2166225 - RNA, 22 nt, Homo sapiens
agggcagaaccaagaacauaaa

SEQ ID NO: 2166226 - RNA, 23 nt, Homo sapiens
gcaaccaguuggcuaggggagca

SEQ ID NO: 2166227 - RNA, 16 nt, Homo sapiens
gccuuuccugaugaca

SEQ ID NO: 2166228 - RNA, 16 nt, Homo sapiens
gccccgccgccuggua

SEQ ID NO: 2166229 - RNA, 21 nt, Homo sapiens
aaugacacccaugccagagag

SEQ ID NO: 2166230 - RNA, 22 nt, Homo sapiens
aauccaaaugugaaagaugcau

SEQ ID NO: 2166231 - RNA, 23 nt, Homo sapiens
ugaacuaggugaucucaguucuc

SEQ ID NO: 2166232 - RNA, 21 nt, Homo sapiens
uguacucuuaggauauuugag

SEQ ID NO: 2166233 - RNA, 18 nt, Homo sapiens
aacuccuggagauuucag

SEQ ID NO: 2166234 - RNA, 16 nt, Homo sapiens
gugacuguguuugcau

SEQ ID NO: 2166235 - RNA, 22 nt, Homo sapiens
uuggagcucauucugucucuuu

SEQ ID NO: 2166236 - RNA, 12 nt, Homo sapiens
agauucugcuag

SEQ ID NO: 2166237 - RNA, 22 nt, Homo sapiens
gaaacuccaaaguccacacaaa

SEQ ID NO: 2166238 - RNA, 12 nt, Homo sapiens
cacugugacuua

SEQ ID NO: 2166239 - RNA, 12 nt, Homo sapiens
ucaccucaauau

SEQ ID NO: 2166240 - RNA, 19 nt, Homo sapiens
uugaguugacuucugacaa

SEQ ID NO: 2166241 - RNA, 20 nt, Homo sapiens
ggcacugauaauauguuuga

SEQ ID NO: 2166242 - RNA, 13 nt, Homo sapiens
ucauggacauuca

SEQ ID NO: 2166243 - RNA, 21 nt, Homo sapiens
agaguucugucuggacuuucc

SEQ ID NO: 2166244 - RNA, 17 nt, Homo sapiens
aauaguacccaaccaaa

SEQ ID NO: 2166245 - RNA, 23 nt, Homo sapiens
aaauaucccuccuguugggagag

SEQ ID NO: 2166246 - RNA, 16 nt, Homo sapiens
aagagucucuaaugag

SEQ ID NO: 2166247 - RNA, 16 nt, Homo sapiens
gaacauacuguucuca

SEQ ID NO: 2166248 - RNA, 15 nt, Homo sapiens
uacauaugaggacaa

SEQ ID NO: 2166249 - RNA, 13 nt, Homo sapiens
aaaauuucuacua

SEQ ID NO: 2166250 - RNA, 17 nt, Homo sapiens
uacuauguacugccuua

SEQ ID NO: 2166251 - RNA, 20 nt, Homo sapiens
uaacauggaagauauuccuu

SEQ ID NO: 2166252 - RNA, 15 nt, Homo sapiens
cauuaacuucucugg

SEQ ID NO: 2166253 - RNA, 16 nt, Homo sapiens
uguauugucugacaca

SEQ ID NO: 2166254 - RNA, 21 nt, Homo sapiens
gggcaaggugugguagcucac

SEQ ID NO: 2166255 - RNA, 20 nt, Homo sapiens
uguucauaauaucaugugca

SEQ ID NO: 2166256 - RNA, 20 nt, Homo sapiens
acacaaggcuccaagaccua

SEQ ID NO: 2166257 - RNA, 22 nt, Homo sapiens
aaagcagaguggacugcauuua

SEQ ID NO: 2166258 - RNA, 16 nt, Homo sapiens
acaaacuacauguaau

SEQ ID NO: 2166259 - RNA, 16 nt, Homo sapiens
acuggucacauugccu

SEQ ID NO: 2166260 - RNA, 20 nt, Homo sapiens
cucagggcagcgccaggcug

SEQ ID NO: 2166261 - RNA, 14 nt, Homo sapiens
ccucugcugccaug

SEQ ID NO: 2166262 - RNA, 15 nt, Homo sapiens
ucucaacacccaguu

SEQ ID NO: 2166263 - RNA, 12 nt, Homo sapiens
ugucacugcugu

SEQ ID NO: 2166264 - RNA, 15 nt, Homo sapiens
aauucugauguuucu

SEQ ID NO: 2166265 - RNA, 15 nt, Homo sapiens
ccuggcagcucugga

SEQ ID NO: 2166266 - RNA, 11 nt, Homo sapiens
gacugcaauga

SEQ ID NO: 2166267 - RNA, 16 nt, Homo sapiens
ggguuuugaacauaaa

SEQ ID NO: 2166268 - RNA, 12 nt, Homo sapiens
cuuccucugcag

SEQ ID NO: 2166269 - RNA, 14 nt, Homo sapiens
gucucauuuugaca

SEQ ID NO: 2166270 - RNA, 15 nt, Homo sapiens
ccacaagcaccugcu

SEQ ID NO: 2166271 - RNA, 23 nt, Homo sapiens
ccuaaagugccaggugaucuccu

SEQ ID NO: 2166272 - RNA, 19 nt, Homo sapiens
ggcuggggccaggggaccu

SEQ ID NO: 2166273 - RNA, 16 nt, Homo sapiens
ucagaacaacuugcua

SEQ ID NO: 2166274 - RNA, 20 nt, Homo sapiens
gcaucagucccccugugcau

SEQ ID NO: 2166275 - RNA, 18 nt, Homo sapiens
auuuugugaucuguaaca

SEQ ID NO: 2166276 - RNA, 13 nt, Homo sapiens
aaguccagcucau

SEQ ID NO: 2166277 - RNA, 12 nt, Homo sapiens
cagcugcugacu

SEQ ID NO: 2166278 - RNA, 12 nt, Homo sapiens
cuguugcugucc

SEQ ID NO: 2166279 - RNA, 12 nt, Homo sapiens
gugcugcucucu

SEQ ID NO: 2166280 - RNA, 18 nt, Homo sapiens
ucuaaaggcuaccuuugu

SEQ ID NO: 2166281 - RNA, 23 nt, Homo sapiens
uuucucuggccccaagggcaaaa

SEQ ID NO: 2166282 - RNA, 17 nt, Homo sapiens
ccaagcuccucaaucau

SEQ ID NO: 2166283 - RNA, 16 nt, Homo sapiens
auucuuagaauaucua

SEQ ID NO: 2166284 - RNA, 13 nt, Homo sapiens
gauuccugcauuu

SEQ ID NO: 2166285 - RNA, 14 nt, Homo sapiens
augagggcagagag

SEQ ID NO: 2166286 - RNA, 15 nt, Homo sapiens
cuucucugaaaacaa

SEQ ID NO: 2166287 - RNA, 23 nt, Homo sapiens
gucucaggcuugcgcuggaccug

SEQ ID NO: 2166288 - RNA, 13 nt, Homo sapiens
ugauuucaggaua

SEQ ID NO: 2166289 - RNA, 13 nt, Homo sapiens
gucauucauucaa

SEQ ID NO: 2166290 - RNA, 13 nt, Homo sapiens
uuauaucaguauu

SEQ ID NO: 2166291 - RNA, 18 nt, Homo sapiens
ucuuaaagacaucuuaau

SEQ ID NO: 2166292 - RNA, 15 nt, Homo sapiens
ucuuuugauaguauu

SEQ ID NO: 2166293 - RNA, 18 nt, Homo sapiens
aagugacacuuugaacuc

SEQ ID NO: 2166294 - RNA, 12 nt, Homo sapiens
aauaccauguac

SEQ ID NO: 2166295 - RNA, 23 nt, Homo sapiens
uacuuuaauucuuuucccagaag

SEQ ID NO: 2166296 - RNA, 14 nt, Homo sapiens
cugguacaauccuu

SEQ ID NO: 2166297 - RNA, 22 nt, Homo sapiens
auccagcaugugugugucucua

SEQ ID NO: 2166298 - RNA, 22 nt, Homo sapiens
ugauagguauaaguggugugug

SEQ ID NO: 2166299 - RNA, 12 nt, Homo sapiens
ucucuuuccaaa

SEQ ID NO: 2166300 - RNA, 17 nt, Homo sapiens
guuacaauuuacagugu

SEQ ID NO: 2166301 - RNA, 14 nt, Homo sapiens
aggaaggaugcaaa

SEQ ID NO: 2166302 - RNA, 15 nt, Homo sapiens
ccuccucugugaaac

SEQ ID NO: 2166303 - RNA, 16 nt, Homo sapiens
cucuagacugcaagaa

SEQ ID NO: 2166304 - RNA, 18 nt, Homo sapiens
uaaacucacaacucucug

SEQ ID NO: 2166305 - RNA, 15 nt, Homo sapiens
acccuugauuauacu

SEQ ID NO: 2166306 - RNA, 20 nt, Homo sapiens
aguucuguguggugcauucc

SEQ ID NO: 2166307 - RNA, 19 nt, Homo sapiens
ucccaggggagugugaagg

SEQ ID NO: 2166308 - RNA, 20 nt, Homo sapiens
gaacuuaagagaggggccaa

SEQ ID NO: 2166309 - RNA, 13 nt, Homo sapiens
ccucucaugacuu

SEQ ID NO: 2166310 - RNA, 13 nt, Homo sapiens
ccucgcaugacug

SEQ ID NO: 2166311 - RNA, 15 nt, Homo sapiens
ccacaauccacgcuu

SEQ ID NO: 2166312 - RNA, 23 nt, Homo sapiens
auauauggaauaaguguacauau

SEQ ID NO: 2166313 - RNA, 16 nt, Homo sapiens
gccucucuucacugcu

SEQ ID NO: 2166314 - RNA, 20 nt, Homo sapiens
ccucugagaauuccaaggag

SEQ ID NO: 2166315 - RNA, 15 nt, Homo sapiens
ucacauggcugucga

SEQ ID NO: 2166316 - RNA, 11 nt, Homo sapiens
cugaucugcag

SEQ ID NO: 2166317 - RNA, 12 nt, Homo sapiens
cagcuugcacau

SEQ ID NO: 2166318 - RNA, 18 nt, Homo sapiens
uccauuuuacuuccauga

SEQ ID NO: 2166319 - RNA, 11 nt, Homo sapiens
ccacucugagc

SEQ ID NO: 2166320 - RNA, 18 nt, Homo sapiens
agucuggcaacagagcaa

SEQ ID NO: 2166321 - RNA, 15 nt, Homo sapiens
aagucaccaugccug

SEQ ID NO: 2166322 - RNA, 19 nt, Homo sapiens
uguagaaaagaacuggaaa

SEQ ID NO: 2166323 - RNA, 20 nt, Homo sapiens
caagagccaaccucacagga

SEQ ID NO: 2166324 - RNA, 13 nt, Homo sapiens
uugggcuacugua

SEQ ID NO: 2166325 - RNA, 23 nt, Homo sapiens
auacaauucaaguugcuucucau

SEQ ID NO: 2166326 - RNA, 10 nt, Homo sapiens
uauugcccua

SEQ ID NO: 2166327 - RNA, 23 nt, Homo sapiens
uucaggccuuguugcaucucaga

SEQ ID NO: 2166328 - RNA, 19 nt, Homo sapiens
ucugggucagugguccaca

SEQ ID NO: 2166329 - RNA, 23 nt, Homo sapiens
cuuaugagcuccauguugcuuca

SEQ ID NO: 2166330 - RNA, 12 nt, Homo sapiens
ugauauugcagc

SEQ ID NO: 2166331 - RNA, 18 nt, Homo sapiens
acauaugccaaaauauca

SEQ ID NO: 2166332 - RNA, 14 nt, Homo sapiens
cuaaaacugcauuu

SEQ ID NO: 2166333 - RNA, 18 nt, Homo sapiens
uacuauacaacaauguuc

SEQ ID NO: 2166334 - RNA, 13 nt, Homo sapiens
cacaacugacaca

SEQ ID NO: 2166335 - RNA, 14 nt, Homo sapiens
caccacgugccaag

SEQ ID NO: 2166336 - RNA, 13 nt, Homo sapiens
ucuggggugcuaa

SEQ ID NO: 2166337 - RNA, 12 nt, Homo sapiens
uugccauucaag

SEQ ID NO: 2166338 - RNA, 20 nt, Homo sapiens
aauaacuuuucaccaaugag

SEQ ID NO: 2166339 - RNA, 14 nt, Homo sapiens
cacacugguacuua

SEQ ID NO: 2166340 - RNA, 21 nt, Homo sapiens
cugaaugaagccuucugaccu

SEQ ID NO: 2166341 - RNA, 22 nt, Homo sapiens
aagaauaacuaauacaauucau

SEQ ID NO: 2166342 - RNA, 20 nt, Homo sapiens
acagcuaaccacuucgcaca

SEQ ID NO: 2166343 - RNA, 16 nt, Homo sapiens
ccuacuguaggagaua

SEQ ID NO: 2166344 - RNA, 21 nt, Homo sapiens
ccaaaauuaguuuguguuacu

SEQ ID NO: 2166345 - RNA, 19 nt, Homo sapiens
cucuaauuagucuaucaaa

SEQ ID NO: 2166346 - RNA, 14 nt, Homo sapiens
caucccagugcaca

SEQ ID NO: 2166347 - RNA, 21 nt, Homo sapiens
aaacauuggauuuuuccuuaa

SEQ ID NO: 2166348 - RNA, 16 nt, Homo sapiens
gaaaaggauaugcagu

SEQ ID NO: 2166349 - RNA, 11 nt, Homo sapiens
gcccuggccag

SEQ ID NO: 2166350 - RNA, 14 nt, Homo sapiens
agguuuguaaaaug

SEQ ID NO: 2166351 - RNA, 15 nt, Homo sapiens
ucaagucuacccuga

SEQ ID NO: 2166352 - RNA, 14 nt, Homo sapiens
ugcuaacaggauau

SEQ ID NO: 2166353 - RNA, 20 nt, Homo sapiens
aauaauaagaggugcuacug

SEQ ID NO: 2166354 - RNA, 15 nt, Homo sapiens
aaaaauuugcucaua

SEQ ID NO: 2166355 - RNA, 13 nt, Homo sapiens
gaccuuacuccuc

SEQ ID NO: 2166356 - RNA, 13 nt, Homo sapiens
cagguaguacugg

SEQ ID NO: 2166357 - RNA, 18 nt, Homo sapiens
ucaaaugaugaagaccaa

SEQ ID NO: 2166358 - RNA, 19 nt, Homo sapiens
uuuuuaagugcugcauuua

SEQ ID NO: 2166359 - RNA, 22 nt, Homo sapiens
agcccagcauggaugugucuca

SEQ ID NO: 2166360 - RNA, 22 nt, Homo sapiens
cucagacuguggaaccaaagcu

SEQ ID NO: 2166361 - RNA, 11 nt, Homo sapiens
aaaccuguggg

SEQ ID NO: 2166362 - RNA, 17 nt, Homo sapiens
uauuauuuugcacuguu

SEQ ID NO: 2166363 - RNA, 19 nt, Homo sapiens
aggaggacuacuauuugaa

SEQ ID NO: 2166364 - RNA, 18 nt, Homo sapiens
ucuuagagagaagaucac

SEQ ID NO: 2166365 - RNA, 17 nt, Homo sapiens
aaauauguggaguucau

SEQ ID NO: 2166366 - RNA, 15 nt, Homo sapiens
ucacuuaaaccacac

SEQ ID NO: 2166367 - RNA, 15 nt, Homo sapiens
cuuguagcauccugu

SEQ ID NO: 2166368 - RNA, 14 nt, Homo sapiens
aguaugaguaaugc

SEQ ID NO: 2166369 - RNA, 20 nt, Homo sapiens
auuuguagcucuggaccugu

SEQ ID NO: 2166370 - RNA, 17 nt, Homo sapiens
uaauucuauacuguuga

SEQ ID NO: 2166371 - RNA, 18 nt, Homo sapiens
aggcuguguuuacaugga

SEQ ID NO: 2166372 - RNA, 21 nt, Homo sapiens
aggauagaauauuuacaauaa

SEQ ID NO: 2166373 - RNA, 12 nt, Homo sapiens
gccacgaggugg

SEQ ID NO: 2166374 - RNA, 13 nt, Homo sapiens
uaagaagcauuuu

SEQ ID NO: 2166375 - RNA, 11 nt, Homo sapiens
uucaucucaug

SEQ ID NO: 2166376 - RNA, 15 nt, Homo sapiens
aagcugggaggccaa

SEQ ID NO: 2166377 - RNA, 20 nt, Homo sapiens
aauuaaaacaugcacaaaaa

SEQ ID NO: 2166378 - RNA, 19 nt, Homo sapiens
ugaaagcccagggcuccag

SEQ ID NO: 2166379 - RNA, 22 nt, Homo sapiens
uaaacaagucauuuuucuugau

SEQ ID NO: 2166380 - RNA, 19 nt, Homo sapiens
gugaagauuucauggacac

SEQ ID NO: 2166381 - RNA, 23 nt, Homo sapiens
ccaucagugaaaaagauguacag

SEQ ID NO: 2166382 - RNA, 18 nt, Homo sapiens
uuugagcuggaaagcagc

SEQ ID NO: 2166383 - RNA, 15 nt, Homo sapiens
cagauggugucauuu

SEQ ID NO: 2166384 - RNA, 23 nt, Homo sapiens
ggguuguacugugaccaucccaa

SEQ ID NO: 2166385 - RNA, 15 nt, Homo sapiens
uugcagucacuguga

SEQ ID NO: 2166386 - RNA, 18 nt, Homo sapiens
ggaccaaaggguuuacuu

SEQ ID NO: 2166387 - RNA, 18 nt, Homo sapiens
cuuuugacggccuucuug

SEQ ID NO: 2166388 - RNA, 16 nt, Homo sapiens
guugccauugcugcua

SEQ ID NO: 2166389 - RNA, 20 nt, Homo sapiens
ccucaacaucacacaguaua

SEQ ID NO: 2166390 - RNA, 20 nt, Homo sapiens
aacaacagccaaaacaacca

SEQ ID NO: 2166391 - RNA, 23 nt, Homo sapiens
ugaaagaugaguaggaguuugcu

SEQ ID NO: 2166392 - RNA, 19 nt, Homo sapiens
guuuuuaaaaaggccuuug

SEQ ID NO: 2166393 - RNA, 16 nt, Homo sapiens
ugaauaaaagugcaca

SEQ ID NO: 2166394 - RNA, 15 nt, Homo sapiens
ccagggaugacaugu

SEQ ID NO: 2166395 - RNA, 20 nt, Homo sapiens
aggcaaaggcagaggaauuu

SEQ ID NO: 2166396 - RNA, 20 nt, Homo sapiens
gauagagagugaguacaugc

SEQ ID NO: 2166397 - RNA, 20 nt, Homo sapiens
ucuucagggcacugcugcug

SEQ ID NO: 2166398 - RNA, 21 nt, Homo sapiens
aagagacaugcugacuuucau

SEQ ID NO: 2166399 - RNA, 21 nt, Homo sapiens
guggaaugguagcaaugggau

SEQ ID NO: 2166400 - RNA, 17 nt, Homo sapiens
auuaauugucauuauuu

SEQ ID NO: 2166401 - RNA, 16 nt, Homo sapiens
uuccauuuuaugcaga

SEQ ID NO: 2166402 - RNA, 18 nt, Homo sapiens
aaucuguguacugaacau

SEQ ID NO: 2166403 - RNA, 21 nt, Homo sapiens
ucccagauuggcucacacuga

SEQ ID NO: 2166404 - RNA, 15 nt, Homo sapiens
uuuauguauugugcu

SEQ ID NO: 2166405 - RNA, 17 nt, Homo sapiens
caaaauguaaagccagc

SEQ ID NO: 2166406 - RNA, 18 nt, Homo sapiens
aaggucaagggaaaaccc

SEQ ID NO: 2166407 - RNA, 19 nt, Homo sapiens
gaagacuguugugcuccau

SEQ ID NO: 2166408 - RNA, 12 nt, Homo sapiens
cuauuugccaug

SEQ ID NO: 2166409 - RNA, 17 nt, Homo sapiens
uuccauaaugcuacugu

SEQ ID NO: 2166410 - RNA, 21 nt, Homo sapiens
ucaguugagaaacaguuccau

SEQ ID NO: 2166411 - RNA, 18 nt, Homo sapiens
aaacucaucuugaucaac

SEQ ID NO: 2166412 - RNA, 21 nt, Homo sapiens
aucaccccaaacaacucagcu

SEQ ID NO: 2166413 - RNA, 22 nt, Homo sapiens
gcuuauggauucauauaggcca

SEQ ID NO: 2166414 - RNA, 12 nt, Homo sapiens
gaguguacuuaa

SEQ ID NO: 2166415 - RNA, 16 nt, Homo sapiens
gaucugauucuaccag

SEQ ID NO: 2166416 - RNA, 21 nt, Homo sapiens
uaggcacaaauacauuccuuu

SEQ ID NO: 2166417 - RNA, 15 nt, Homo sapiens
uugauuacuuccacu

SEQ ID NO: 2166418 - RNA, 22 nt, Homo sapiens
cauuuguguuuugaaagcccaa

SEQ ID NO: 2166419 - RNA, 14 nt, Homo sapiens
guuucccuuccuua

SEQ ID NO: 2166420 - RNA, 14 nt, Homo sapiens
aacugugugucuca

SEQ ID NO: 2166421 - RNA, 19 nt, Homo sapiens
uuuggcuuuucuuuaccag

SEQ ID NO: 2166422 - RNA, 15 nt, Homo sapiens
ugacaccugcugaga

SEQ ID NO: 2166423 - RNA, 16 nt, Homo sapiens
guuuaagguucuugcu

SEQ ID NO: 2166424 - RNA, 15 nt, Homo sapiens
agcuggggacagaga

SEQ ID NO: 2166425 - RNA, 14 nt, Homo sapiens
uuugaggagcaugu

SEQ ID NO: 2166426 - RNA, 16 nt, Homo sapiens
gaauccuccaggcccu

SEQ ID NO: 2166427 - RNA, 14 nt, Homo sapiens
caggagaaagaagg

SEQ ID NO: 2166428 - RNA, 11 nt, Homo sapiens
ugacaaauggc

SEQ ID NO: 2166429 - RNA, 22 nt, Homo sapiens
aaaaggcuaagcuucacuguaa

SEQ ID NO: 2166430 - RNA, 12 nt, Homo sapiens
uuuaaagucaca

SEQ ID NO: 2166431 - RNA, 18 nt, Homo sapiens
gguuuuauuucaaaggga

SEQ ID NO: 2166432 - RNA, 18 nt, Homo sapiens
acccuucucccacucucc

SEQ ID NO: 2166433 - RNA, 21 nt, Homo sapiens
uuaaagucagguccaauuugu

SEQ ID NO: 2166434 - RNA, 18 nt, Homo sapiens
guaggaaaaugaagaaga

SEQ ID NO: 2166435 - RNA, 14 nt, Homo sapiens
aaaacagcugcaug

SEQ ID NO: 2166436 - RNA, 23 nt, Homo sapiens
caaagaaccuucucuauggggca

SEQ ID NO: 2166437 - RNA, 17 nt, Homo sapiens
ggagggucagugccaag

SEQ ID NO: 2166438 - RNA, 14 nt, Homo sapiens
ggagagacacuggu

SEQ ID NO: 2166439 - RNA, 13 nt, Homo sapiens
aucuuuccaaaua

SEQ ID NO: 2166440 - RNA, 18 nt, Homo sapiens
cagugccagccccugcug

SEQ ID NO: 2166441 - RNA, 15 nt, Homo sapiens
cuguaugugccaaag

SEQ ID NO: 2166442 - RNA, 15 nt, Homo sapiens
acuagaacucuccau

SEQ ID NO: 2166443 - RNA, 19 nt, Homo sapiens
uuaagcugaaggcauuuga

SEQ ID NO: 2166444 - RNA, 16 nt, Homo sapiens
uccccuggcacuggca

SEQ ID NO: 2166445 - RNA, 18 nt, Homo sapiens
cucuuucucucuucccuc

SEQ ID NO: 2166446 - RNA, 22 nt, Homo sapiens
auuuggucaccuuccucugccu

SEQ ID NO: 2166447 - RNA, 21 nt, Homo sapiens
aaucaccauguaacaaccaga

SEQ ID NO: 2166448 - RNA, 20 nt, Homo sapiens
acagcuccuccccugcuacc

SEQ ID NO: 2166449 - RNA, 20 nt, Homo sapiens
gaaggagauacucauguuga

SEQ ID NO: 2166450 - RNA, 18 nt, Homo sapiens
auguugcauguaugugua

SEQ ID NO: 2166451 - RNA, 20 nt, Homo sapiens
aaaacaaagaaauaaugguc

SEQ ID NO: 2166452 - RNA, 10 nt, Homo sapiens
cuguggcauu

SEQ ID NO: 2166453 - RNA, 17 nt, Homo sapiens
agagaaaauauuacuua

SEQ ID NO: 2166454 - RNA, 19 nt, Homo sapiens
gucucagaaccacuccugg

SEQ ID NO: 2166455 - RNA, 18 nt, Homo sapiens
gccugccaagcucacaca

SEQ ID NO: 2166456 - RNA, 13 nt, Homo sapiens
uagguagacuuug

SEQ ID NO: 2166457 - RNA, 22 nt, Homo sapiens
ucugcucuaugccaggcugugc

SEQ ID NO: 2166458 - RNA, 21 nt, Homo sapiens
cauggagacagguagacagac

SEQ ID NO: 2166459 - RNA, 21 nt, Homo sapiens
uacacacacacagacauauau

SEQ ID NO: 2166460 - RNA, 14 nt, Homo sapiens
ccauucacagagcc

SEQ ID NO: 2166461 - RNA, 20 nt, Homo sapiens
gaggggagagagaaccacca

SEQ ID NO: 2166462 - RNA, 16 nt, Homo sapiens
acuguccuacccaccc

SEQ ID NO: 2166463 - RNA, 13 nt, Homo sapiens
agcgcaccugcuu

SEQ ID NO: 2166464 - RNA, 18 nt, Homo sapiens
ucccccaggcuguucucc

SEQ ID NO: 2166465 - RNA, 16 nt, Homo sapiens
cguggauugcacgugg

SEQ ID NO: 2166466 - RNA, 22 nt, Homo sapiens
ucagccugcuuuccugcagcag

SEQ ID NO: 2166467 - RNA, 16 nt, Homo sapiens
cuggagaaauggcauc

SEQ ID NO: 2166468 - RNA, 18 nt, Homo sapiens
gaggcugcccugaggggc

SEQ ID NO: 2166469 - RNA, 21 nt, Homo sapiens
uugaaaugcucuuuugcacaa

SEQ ID NO: 2166470 - RNA, 18 nt, Homo sapiens
gauuuuguaauucuuaug

SEQ ID NO: 2166471 - RNA, 22 nt, Homo sapiens
uccuuugaccacugucuuuuuc

SEQ ID NO: 2166472 - RNA, 20 nt, Homo sapiens
ccacuuugucuguacauacu

SEQ ID NO: 2166473 - RNA, 16 nt, Homo sapiens
aaccacaguuucauua

SEQ ID NO: 2166474 - RNA, 17 nt, Homo sapiens
ucaaucucuguucugcu

SEQ ID NO: 2166475 - RNA, 17 nt, Homo sapiens
auucucuccgccauuga

SEQ ID NO: 2166476 - RNA, 15 nt, Homo sapiens
cuggagucucagagc

SEQ ID NO: 2166477 - RNA, 14 nt, Homo sapiens
aaagaagacuggaa

SEQ ID NO: 2166478 - RNA, 14 nt, Homo sapiens
caaagagaaugaga

SEQ ID NO: 2166479 - RNA, 18 nt, Homo sapiens
cacagugaugaauguacu

SEQ ID NO: 2166480 - RNA, 14 nt, Homo sapiens
caucacuuugccaa

SEQ ID NO: 2166481 - RNA, 15 nt, Homo sapiens
auuucagaccuagca

SEQ ID NO: 2166482 - RNA, 20 nt, Homo sapiens
guuccggggagaaacccaga

SEQ ID NO: 2166483 - RNA, 14 nt, Homo sapiens
gaugccccagggau

SEQ ID NO: 2166484 - RNA, 16 nt, Homo sapiens
gucuucucugucucag

SEQ ID NO: 2166485 - RNA, 13 nt, Homo sapiens
ggugcccaccuaa

SEQ ID NO: 2166486 - RNA, 18 nt, Homo sapiens
uuccacuucucuagagaa

SEQ ID NO: 2166487 - RNA, 23 nt, Homo sapiens
gcugggucaggcagggugcagua

SEQ ID NO: 2166488 - RNA, 17 nt, Homo sapiens
aagaaguuacuuugcuu

SEQ ID NO: 2166489 - RNA, 12 nt, Homo sapiens
ucauuaucucca

SEQ ID NO: 2166490 - RNA, 17 nt, Homo sapiens
agaaccacuuggcugcu

SEQ ID NO: 2166491 - RNA, 16 nt, Homo sapiens
uagaguucagacuuuu

SEQ ID NO: 2166492 - RNA, 22 nt, Homo sapiens
auauauuuuuaaaaaucuaccu

SEQ ID NO: 2166493 - RNA, 17 nt, Homo sapiens
ucccauaugggugaugu

SEQ ID NO: 2166494 - RNA, 22 nt, Homo sapiens
acuacuuagagauauguaucau

SEQ ID NO: 2166495 - RNA, 13 nt, Homo sapiens
aggcaaccuuccc

SEQ ID NO: 2166496 - RNA, 19 nt, Homo sapiens
uguuuguuuggcuguccag

SEQ ID NO: 2166497 - RNA, 19 nt, Homo sapiens
cuuuauuccuucauuucau

SEQ ID NO: 2166498 - RNA, 13 nt, Homo sapiens
ucugucucuauga

SEQ ID NO: 2166499 - RNA, 13 nt, Homo sapiens
ccucucuccauca

SEQ ID NO: 2166500 - RNA, 22 nt, Homo sapiens
agugauacucccaccucugccu

SEQ ID NO: 2166501 - RNA, 17 nt, Homo sapiens
acugacuuucugauuac

SEQ ID NO: 2166502 - RNA, 15 nt, Homo sapiens
cccagcugugcugug

SEQ ID NO: 2166503 - RNA, 14 nt, Homo sapiens
caaauaaaauauca

SEQ ID NO: 2166504 - RNA, 14 nt, Homo sapiens
accuugaaauggaa

SEQ ID NO: 2166505 - RNA, 17 nt, Homo sapiens
aagaucguucucugccu

SEQ ID NO: 2166506 - RNA, 22 nt, Homo sapiens
uacacauacaacuucauauaac

SEQ ID NO: 2166507 - RNA, 21 nt, Homo sapiens
agggguggcugggucuucaag

SEQ ID NO: 2166508 - RNA, 22 nt, Homo sapiens
uccaggguuaaccacuguggug

SEQ ID NO: 2166509 - RNA, 14 nt, Homo sapiens
gguaucccaaaaau

SEQ ID NO: 2166510 - RNA, 22 nt, Homo sapiens
uaaauguguuuccguucacaua

SEQ ID NO: 2166511 - RNA, 16 nt, Homo sapiens
agccggggcacuuuca

SEQ ID NO: 2166512 - RNA, 13 nt, Homo sapiens
acaucccacagug

SEQ ID NO: 2166513 - RNA, 16 nt, Homo sapiens
auauuuucacauaugu

SEQ ID NO: 2166514 - RNA, 16 nt, Homo sapiens
uccuuuuacuacagcu

SEQ ID NO: 2166515 - RNA, 23 nt, Homo sapiens
gaggaagaaguguaacucaccag

SEQ ID NO: 2166516 - RNA, 18 nt, Homo sapiens
uucgaccgacuuucccca

SEQ ID NO: 2166517 - RNA, 16 nt, Homo sapiens
cuucugaagucccugc

SEQ ID NO: 2166518 - RNA, 13 nt, Homo sapiens
uugcaagccagau

SEQ ID NO: 2166519 - RNA, 20 nt, Homo sapiens
cucucaguugcagcccugcu

SEQ ID NO: 2166520 - RNA, 20 nt, Homo sapiens
auacuauuuaauuauuucac

SEQ ID NO: 2166521 - RNA, 16 nt, Homo sapiens
auugcagaauucaaaa

SEQ ID NO: 2166522 - RNA, 20 nt, Homo sapiens
gugccauacuuguucuguau

SEQ ID NO: 2166523 - RNA, 17 nt, Homo sapiens
cuggaaaacagaaacca

SEQ ID NO: 2166524 - RNA, 18 nt, Homo sapiens
cuauuaagaaaaucacau

SEQ ID NO: 2166525 - RNA, 13 nt, Homo sapiens
ccuguagcacaaa

SEQ ID NO: 2166526 - RNA, 23 nt, Homo sapiens
guaucuaaagccaguggcagugu

SEQ ID NO: 2166527 - RNA, 17 nt, Homo sapiens
uuggcucacagggcuga

SEQ ID NO: 2166528 - RNA, 13 nt, Homo sapiens
acaggcacccacc

SEQ ID NO: 2166529 - RNA, 18 nt, Homo sapiens
cuaggaguacaggcauag

SEQ ID NO: 2166530 - RNA, 19 nt, Homo sapiens
uucucacccaggcaaucuu

SEQ ID NO: 2166531 - RNA, 16 nt, Homo sapiens
uccaacuuccuguggc

SEQ ID NO: 2166532 - RNA, 21 nt, Homo sapiens
ccucaugccuuuauacuuugc

SEQ ID NO: 2166533 - RNA, 14 nt, Homo sapiens
uucaagaaacugau

SEQ ID NO: 2166534 - RNA, 23 nt, Homo sapiens
cccugaaacacgaaacuuguuau

SEQ ID NO: 2166535 - RNA, 18 nt, Homo sapiens
aggaaguaugguuuuauu

SEQ ID NO: 2166536 - RNA, 23 nt, Homo sapiens
cauauguuaauaaacugcaaaug

SEQ ID NO: 2166537 - RNA, 13 nt, Homo sapiens
cuccagcaccaua

SEQ ID NO: 2166538 - RNA, 19 nt, Homo sapiens
agaucaugacauaugacuu

SEQ ID NO: 2166539 - RNA, 13 nt, Homo sapiens
caaccugggaugu

SEQ ID NO: 2166540 - RNA, 23 nt, Homo sapiens
gagccagcaggucaaaaaggcca

SEQ ID NO: 2166541 - RNA, 18 nt, Homo sapiens
ucuccucccaagguuuga

SEQ ID NO: 2166542 - RNA, 11 nt, Homo sapiens
gcaaacccaga

SEQ ID NO: 2166543 - RNA, 16 nt, Homo sapiens
gaucuugagaaccuuu

SEQ ID NO: 2166544 - RNA, 23 nt, Homo sapiens
agauauguugagggcccaucucu

SEQ ID NO: 2166545 - RNA, 15 nt, Homo sapiens
ccgugcacaccagug

SEQ ID NO: 2166546 - RNA, 20 nt, Homo sapiens
caugagugugauccacauug

SEQ ID NO: 2166547 - RNA, 15 nt, Homo sapiens
ucccaucugcauuug

SEQ ID NO: 2166548 - RNA, 14 nt, Homo sapiens
uuuaguuauaucac

SEQ ID NO: 2166549 - RNA, 13 nt, Homo sapiens
caccucauccuua

SEQ ID NO: 2166550 - RNA, 18 nt, Homo sapiens
caaaaucaggaaccacag

SEQ ID NO: 2166551 - RNA, 14 nt, Homo sapiens
aacauacuguucuc

SEQ ID NO: 2166552 - RNA, 14 nt, Homo sapiens
ugguucagugccac

SEQ ID NO: 2166553 - RNA, 14 nt, Homo sapiens
cgcaggucaccuua

SEQ ID NO: 2166554 - RNA, 21 nt, Homo sapiens
auuuuguagaauaaggaacaa

SEQ ID NO: 2166555 - RNA, 17 nt, Homo sapiens
uguugccaaaaccaaac

SEQ ID NO: 2166556 - RNA, 14 nt, Homo sapiens
gaaaaaacauuuua

SEQ ID NO: 2166557 - RNA, 20 nt, Homo sapiens
cuuaggaaggccuucaggag

SEQ ID NO: 2166558 - RNA, 22 nt, Homo sapiens
ucucccagcuucaaaugcaaau

SEQ ID NO: 2166559 - RNA, 15 nt, Homo sapiens
ccucugaaaugccuc

SEQ ID NO: 2166560 - RNA, 17 nt, Homo sapiens
ugccucugccacagcaa

SEQ ID NO: 2166561 - RNA, 16 nt, Homo sapiens
gagccuuccacaguga

SEQ ID NO: 2166562 - RNA, 16 nt, Homo sapiens
ggcccaaggccagggg

SEQ ID NO: 2166563 - RNA, 15 nt, Homo sapiens
auucagagugggcug

SEQ ID NO: 2166564 - RNA, 19 nt, Homo sapiens
ccacggaggaugaugccag

SEQ ID NO: 2166565 - RNA, 12 nt, Homo sapiens
aaugguauauaa

SEQ ID NO: 2166566 - RNA, 22 nt, Homo sapiens
ccacccaggauccccaaggcac

SEQ ID NO: 2166567 - RNA, 12 nt, Homo sapiens
ugacagccuccc

SEQ ID NO: 2166568 - RNA, 21 nt, Homo sapiens
cucaggccagucacccuguga

SEQ ID NO: 2166569 - RNA, 17 nt, Homo sapiens
uucucccagcacacggc

SEQ ID NO: 2166570 - RNA, 15 nt, Homo sapiens
uacaugcaacagaag

SEQ ID NO: 2166571 - RNA, 22 nt, Homo sapiens
aacugaaagcugaauccuucca

SEQ ID NO: 2166572 - RNA, 21 nt, Homo sapiens
augcacaccaaauugcugaga

SEQ ID NO: 2166573 - RNA, 22 nt, Homo sapiens
uccagaaccuuacuggcacugu

SEQ ID NO: 2166574 - RNA, 13 nt, Homo sapiens
ucuuuuuccuccc

SEQ ID NO: 2166575 - RNA, 14 nt, Homo sapiens
ucugcaaaccaaua

SEQ ID NO: 2166576 - RNA, 16 nt, Homo sapiens
acacugucuaccucac

SEQ ID NO: 2166577 - RNA, 22 nt, Homo sapiens
ugaccuuaguguuucugugcau

SEQ ID NO: 2166578 - RNA, 18 nt, Homo sapiens
augcuggggacacagcau

SEQ ID NO: 2166579 - RNA, 22 nt, Homo sapiens
auugaacuuucacauagcacag

SEQ ID NO: 2166580 - RNA, 18 nt, Homo sapiens
ucuccuuuugaccaaaua

SEQ ID NO: 2166581 - RNA, 16 nt, Homo sapiens
caggcaggugcaggga

SEQ ID NO: 2166582 - RNA, 15 nt, Homo sapiens
ugagauguuuuacca

SEQ ID NO: 2166583 - RNA, 22 nt, Homo sapiens
acaucucaacaggccucagggc

SEQ ID NO: 2166584 - RNA, 20 nt, Homo sapiens
augaccccuucucucuccag

SEQ ID NO: 2166585 - RNA, 19 nt, Homo sapiens
aagguuggugaauuucaca

SEQ ID NO: 2166586 - RNA, 17 nt, Homo sapiens
cuguccuaccaguugcc

SEQ ID NO: 2166587 - RNA, 22 nt, Homo sapiens
acgcagaggcggaaaccuugca

SEQ ID NO: 2166588 - RNA, 21 nt, Homo sapiens
auugcaugaauucacaaacaa

SEQ ID NO: 2166589 - RNA, 21 nt, Homo sapiens
gcaagcaagaaacacugggcu

SEQ ID NO: 2166590 - RNA, 15 nt, Homo sapiens
aacagccucuugccc

SEQ ID NO: 2166591 - RNA, 15 nt, Homo sapiens
aacaccuucuuggcu

SEQ ID NO: 2166592 - RNA, 21 nt, Homo sapiens
caaggcaggaggaucacuuga

SEQ ID NO: 2166593 - RNA, 14 nt, Homo sapiens
cuugacucauggca

SEQ ID NO: 2166594 - RNA, 22 nt, Homo sapiens
aaaguuguaguucuugugcaug

SEQ ID NO: 2166595 - RNA, 14 nt, Homo sapiens
ggagggagcucuga

SEQ ID NO: 2166596 - RNA, 15 nt, Homo sapiens
accagaagugccaug

SEQ ID NO: 2166597 - RNA, 13 nt, Homo sapiens
cacacacagaugg

SEQ ID NO: 2166598 - RNA, 14 nt, Homo sapiens
cacuaccuuuaaaa

SEQ ID NO: 2166599 - RNA, 12 nt, Homo sapiens
agccuacugucu

SEQ ID NO: 2166600 - RNA, 18 nt, Homo sapiens
cugaagugucacagccug

SEQ ID NO: 2166601 - RNA, 22 nt, Homo sapiens
gggugauuuuaugaucaguguu

SEQ ID NO: 2166602 - RNA, 15 nt, Homo sapiens
uggcuaacaugguga

SEQ ID NO: 2166603 - RNA, 19 nt, Homo sapiens
uuccccagguuccauacca

SEQ ID NO: 2166604 - RNA, 15 nt, Homo sapiens
uaaaauccauccaau

SEQ ID NO: 2166605 - RNA, 19 nt, Homo sapiens
gauuacuacuuugccucuu

SEQ ID NO: 2166606 - RNA, 17 nt, Homo sapiens
cagugaagcagcacugu

SEQ ID NO: 2166607 - RNA, 13 nt, Homo sapiens
cuucccgccuucc

SEQ ID NO: 2166608 - RNA, 12 nt, Homo sapiens
cugaaacuggag

SEQ ID NO: 2166609 - RNA, 19 nt, Homo sapiens
aagcacuacaccuugccuu

SEQ ID NO: 2166610 - RNA, 13 nt, Homo sapiens
ccaguggacucuu

SEQ ID NO: 2166611 - RNA, 16 nt, Homo sapiens
uuccaauuauuugacu

SEQ ID NO: 2166612 - RNA, 15 nt, Homo sapiens
acaacaguaccugaa

SEQ ID NO: 2166613 - RNA, 18 nt, Homo sapiens
aaaggacaacaguucuga

SEQ ID NO: 2166614 - RNA, 15 nt, Homo sapiens
acagaggucucugcc

SEQ ID NO: 2166615 - RNA, 20 nt, Homo sapiens
acauuuuugaauacauuaaa

SEQ ID NO: 2166616 - RNA, 23 nt, Homo sapiens
caagcaaaccaauggugauccuc

SEQ ID NO: 2166617 - RNA, 12 nt, Homo sapiens
guuuuagcugua

SEQ ID NO: 2166618 - RNA, 17 nt, Homo sapiens
ggaugcagcuucaagaa

SEQ ID NO: 2166619 - RNA, 13 nt, Homo sapiens
ccagaauagcuuu

SEQ ID NO: 2166620 - RNA, 23 nt, Homo sapiens
cacagucaggggcugggcauccc

SEQ ID NO: 2166621 - RNA, 15 nt, Homo sapiens
uucuggugggacaau

SEQ ID NO: 2166622 - RNA, 16 nt, Homo sapiens
agaugugaaaacaucu

SEQ ID NO: 2166623 - RNA, 19 nt, Homo sapiens
guugcaaacucaguuccaa

SEQ ID NO: 2166624 - RNA, 14 nt, Homo sapiens
auuuuggaggcaaa

SEQ ID NO: 2166625 - RNA, 20 nt, Homo sapiens
gaaaauuugaaaauguccuu

SEQ ID NO: 2166626 - RNA, 13 nt, Homo sapiens
cccacucuaggag

SEQ ID NO: 2166627 - RNA, 22 nt, Homo sapiens
ggccauuggaggggcuggcacu

SEQ ID NO: 2166628 - RNA, 19 nt, Homo sapiens
aauuuauuauuaacauacc

SEQ ID NO: 2166629 - RNA, 23 nt, Homo sapiens
acuccacccguucccacugcccu

SEQ ID NO: 2166630 - RNA, 13 nt, Homo sapiens
uuugcucagaaca

SEQ ID NO: 2166631 - RNA, 22 nt, Homo sapiens
cuuccuguuucucguugucaca

SEQ ID NO: 2166632 - RNA, 15 nt, Homo sapiens
gaaaugguacugccc

SEQ ID NO: 2166633 - RNA, 22 nt, Homo sapiens
ccaguugcacuacauaaucucu

SEQ ID NO: 2166634 - RNA, 22 nt, Homo sapiens
ccuucugaggagcuguugaggu

SEQ ID NO: 2166635 - RNA, 12 nt, Homo sapiens
cuuuagcuuauu

SEQ ID NO: 2166636 - RNA, 14 nt, Homo sapiens
cggugagccggggc

SEQ ID NO: 2166637 - RNA, 15 nt, Homo sapiens
gugcuugagccagga

SEQ ID NO: 2166638 - RNA, 14 nt, Homo sapiens
uaugcaaaugccuc

SEQ ID NO: 2166639 - RNA, 17 nt, Homo sapiens
acucagugcagcaauau

SEQ ID NO: 2166640 - RNA, 18 nt, Homo sapiens
ucuucacugucuuacuca

SEQ ID NO: 2166641 - RNA, 15 nt, Homo sapiens
uaaucagucauuucu

SEQ ID NO: 2166642 - RNA, 19 nt, Homo sapiens
gggcagugcccaccaugca

SEQ ID NO: 2166643 - RNA, 23 nt, Homo sapiens
aguccaaaggguuuuaagccagg

SEQ ID NO: 2166644 - RNA, 19 nt, Homo sapiens
agcauguaacuggccuuac

SEQ ID NO: 2166645 - RNA, 23 nt, Homo sapiens
cuagguggguugaaagccaagga

SEQ ID NO: 2166646 - RNA, 14 nt, Homo sapiens
ucaguaaaccuguc

SEQ ID NO: 2166647 - RNA, 15 nt, Homo sapiens
ugaaugcauguguga

SEQ ID NO: 2166648 - RNA, 15 nt, Homo sapiens
acccagccucugaga

SEQ ID NO: 2166649 - RNA, 16 nt, Homo sapiens
auuugcauuaaauuca

SEQ ID NO: 2166650 - RNA, 17 nt, Homo sapiens
ggcuauuuucagaugaa

SEQ ID NO: 2166651 - RNA, 17 nt, Homo sapiens
aagcuccagaagaacaa

SEQ ID NO: 2166652 - RNA, 16 nt, Homo sapiens
ugaaacuugaaaugag

SEQ ID NO: 2166653 - RNA, 21 nt, Homo sapiens
aacgauggaguacacagcuga

SEQ ID NO: 2166654 - RNA, 16 nt, Homo sapiens
acaggagcacugcaug

SEQ ID NO: 2166655 - RNA, 18 nt, Homo sapiens
cuccugaccaguugcagu

SEQ ID NO: 2166656 - RNA, 22 nt, Homo sapiens
uagcuucuuccauuggaaaauu

SEQ ID NO: 2166657 - RNA, 12 nt, Homo sapiens
agagucugagaa

SEQ ID NO: 2166658 - RNA, 20 nt, Homo sapiens
acucuauccaaagugucacu

SEQ ID NO: 2166659 - RNA, 17 nt, Homo sapiens
acugaccauguucuuca

SEQ ID NO: 2166660 - RNA, 16 nt, Homo sapiens
cuccagcacaaacaca

SEQ ID NO: 2166661 - RNA, 16 nt, Homo sapiens
guuucuuuuugcucgc

SEQ ID NO: 2166662 - RNA, 21 nt, Homo sapiens
acugaggccugagacccagga

SEQ ID NO: 2166663 - RNA, 20 nt, Homo sapiens
auuucagaaguuaguuugua

SEQ ID NO: 2166664 - RNA, 19 nt, Homo sapiens
uccauuucccacaucuuuc

SEQ ID NO: 2166665 - RNA, 22 nt, Homo sapiens
cauguucaagcgauucuccugc

SEQ ID NO: 2166666 - RNA, 15 nt, Homo sapiens
ucauuuuucaggaaa

SEQ ID NO: 2166667 - RNA, 16 nt, Homo sapiens
ucaccucuaacacgca

SEQ ID NO: 2166668 - RNA, 20 nt, Homo sapiens
cuguccaugaagcacugagc

SEQ ID NO: 2166669 - RNA, 20 nt, Homo sapiens
guuucagugaaggucaccug

SEQ ID NO: 2166670 - RNA, 18 nt, Homo sapiens
cuguaccuagaauagucu

SEQ ID NO: 2166671 - RNA, 15 nt, Homo sapiens
cucuuuggucauuga

SEQ ID NO: 2166672 - RNA, 22 nt, Homo sapiens
cuuggaacauacuguucacuca

SEQ ID NO: 2166673 - RNA, 19 nt, Homo sapiens
gcaccccagcaauuaugaa

SEQ ID NO: 2166674 - RNA, 17 nt, Homo sapiens
uaacacuauacucuaaa

SEQ ID NO: 2166675 - RNA, 17 nt, Homo sapiens
uugugccagcagaacau

SEQ ID NO: 2166676 - RNA, 22 nt, Homo sapiens
accucagaguauggagcucaga

SEQ ID NO: 2166677 - RNA, 14 nt, Homo sapiens
ggaggggugguccu

SEQ ID NO: 2166678 - RNA, 16 nt, Homo sapiens
uuaaaaaacguauuau

SEQ ID NO: 2166679 - RNA, 19 nt, Homo sapiens
ugaacaguuuggggacuca

SEQ ID NO: 2166680 - RNA, 19 nt, Homo sapiens
agauggcuaggccaucacc

SEQ ID NO: 2166681 - RNA, 19 nt, Homo sapiens
uuccaaagacucccuccau

SEQ ID NO: 2166682 - RNA, 18 nt, Homo sapiens
ugcaaggugauauauaau

SEQ ID NO: 2166683 - RNA, 22 nt, Homo sapiens
cuguccaugaagcacugagcag

SEQ ID NO: 2166684 - RNA, 17 nt, Homo sapiens
cccauuucaauuccugu

SEQ ID NO: 2166685 - RNA, 18 nt, Homo sapiens
uguaaaccaaacagacaa

SEQ ID NO: 2166686 - RNA, 13 nt, Homo sapiens
caccaacuccuaa

SEQ ID NO: 2166687 - RNA, 12 nt, Homo sapiens
gcccaaggcacu

SEQ ID NO: 2166688 - RNA, 18 nt, Homo sapiens
cagcccuccccaccugcu

SEQ ID NO: 2166689 - RNA, 19 nt, Homo sapiens
auuuauuauuaacauaccu

SEQ ID NO: 2166690 - RNA, 21 nt, Homo sapiens
agcaauugugaaauacaguau

SEQ ID NO: 2166691 - RNA, 17 nt, Homo sapiens
aucauauguauauguca

SEQ ID NO: 2166692 - RNA, 18 nt, Homo sapiens
cccuggagagugcacaug

SEQ ID NO: 2166693 - RNA, 20 nt, Homo sapiens
aggguccuuuaguaccugaa

SEQ ID NO: 2166694 - RNA, 23 nt, Homo sapiens
ccuuugucgcugggucagugcug

SEQ ID NO: 2166695 - RNA, 19 nt, Homo sapiens
uugaugguaggcuguauag

SEQ ID NO: 2166696 - RNA, 22 nt, Homo sapiens
caaacagaccccuguucaugcc

SEQ ID NO: 2166697 - RNA, 12 nt, Homo sapiens
auagcugagcac

SEQ ID NO: 2166698 - RNA, 15 nt, Homo sapiens
ucuggaaaagcacuu

SEQ ID NO: 2166699 - RNA, 13 nt, Homo sapiens
ugauuuuacuuaa

SEQ ID NO: 2166700 - RNA, 15 nt, Homo sapiens
cagaggccuugucau

SEQ ID NO: 2166701 - RNA, 18 nt, Homo sapiens
ggcuagcuagcuguguua

SEQ ID NO: 2166702 - RNA, 10 nt, Homo sapiens
aucacaaaaa

SEQ ID NO: 2166703 - RNA, 12 nt, Homo sapiens
acuccacuggac

SEQ ID NO: 2166704 - RNA, 13 nt, Homo sapiens
aaaaacaucccaa

SEQ ID NO: 2166705 - RNA, 18 nt, Homo sapiens
agacauggaauuaccuua

SEQ ID NO: 2166706 - RNA, 22 nt, Homo sapiens
cuaaaaaacagaggccauggca

SEQ ID NO: 2166707 - RNA, 18 nt, Homo sapiens
augaaaaucuccaucuca

SEQ ID NO: 2166708 - RNA, 19 nt, Homo sapiens
uaaguaucacacuguauau

SEQ ID NO: 2166709 - RNA, 22 nt, Homo sapiens
gugggacccacagucacacaga

SEQ ID NO: 2166710 - RNA, 14 nt, Homo sapiens
acugaaguggcuaa

SEQ ID NO: 2166711 - RNA, 12 nt, Homo sapiens
uauuauggaaaa

SEQ ID NO: 2166712 - RNA, 17 nt, Homo sapiens
cucugggccaagucaaa

SEQ ID NO: 2166713 - RNA, 14 nt, Homo sapiens
uggccugggguccc

SEQ ID NO: 2166714 - RNA, 17 nt, Homo sapiens
auuguccucuuugacua

SEQ ID NO: 2166715 - RNA, 11 nt, Homo sapiens
gagauugaacc

SEQ ID NO: 2166716 - RNA, 17 nt, Homo sapiens
aggaauauacauagucu

SEQ ID NO: 2166717 - RNA, 20 nt, Homo sapiens
aaaggaauaaaaaauacugu

SEQ ID NO: 2166718 - RNA, 21 nt, Homo sapiens
cccccuuggaggagggcugua

SEQ ID NO: 2166719 - RNA, 14 nt, Homo sapiens
ccugaaauuaauuu

SEQ ID NO: 2166720 - RNA, 14 nt, Homo sapiens
acccugcaaucacu

SEQ ID NO: 2166721 - RNA, 21 nt, Homo sapiens
gagagagcaaucuugcuguga

SEQ ID NO: 2166722 - RNA, 19 nt, Homo sapiens
aaagaaaaucucugugaaa

SEQ ID NO: 2166723 - RNA, 23 nt, Homo sapiens
ugcuaauauauguauaugcaaua

SEQ ID NO: 2166724 - RNA, 16 nt, Homo sapiens
caacuccucaugucuu

SEQ ID NO: 2166725 - RNA, 15 nt, Homo sapiens
guccuccuaucuccc

SEQ ID NO: 2166726 - RNA, 16 nt, Homo sapiens
ccgaagccugagcuca

SEQ ID NO: 2166727 - RNA, 24 nt, Homo sapiens
augugguuaaugccauggacagaa

SEQ ID NO: 2166728 - RNA, 15 nt, Homo sapiens
aauaguguucucugu

SEQ ID NO: 2166729 - RNA, 17 nt, Homo sapiens
gcaauacagacuacuuc

SEQ ID NO: 2166730 - RNA, 20 nt, Homo sapiens
acauuggcagugugucacac

SEQ ID NO: 2166731 - RNA, 18 nt, Homo sapiens
cugaaugucccaacccag

SEQ ID NO: 2166732 - RNA, 21 nt, Homo sapiens
ucccauucauauuaagacagu

SEQ ID NO: 2166733 - RNA, 15 nt, Homo sapiens
augguccuggcugga

SEQ ID NO: 2166734 - RNA, 15 nt, Homo sapiens
uccagagaguggcuc

SEQ ID NO: 2166735 - RNA, 13 nt, Homo sapiens
ucccccagcacuu

SEQ ID NO: 2166736 - RNA, 15 nt, Homo sapiens
ugauuaaauuaugaa

SEQ ID NO: 2166737 - RNA, 22 nt, Homo sapiens
ccuuugaguuuuguauucaaua

SEQ ID NO: 2166738 - RNA, 21 nt, Homo sapiens
uacagaaaauuugcaacauau

SEQ ID NO: 2166739 - RNA, 16 nt, Homo sapiens
aaccauguaaagucau

SEQ ID NO: 2166740 - RNA, 22 nt, Homo sapiens
ucucugauuaguugacaguauu

SEQ ID NO: 2166741 - RNA, 22 nt, Homo sapiens
ucucuaucuggaauuuaauuaa

SEQ ID NO: 2166742 - RNA, 19 nt, Homo sapiens
gucauauauggggggccaa

SEQ ID NO: 2166743 - RNA, 11 nt, Homo sapiens
agaagaugaau

SEQ ID NO: 2166744 - RNA, 18 nt, Homo sapiens
gaaaauaccaucaggccu

SEQ ID NO: 2166745 - RNA, 21 nt, Homo sapiens
ggaauauuuuuuaaagaggau

SEQ ID NO: 2166746 - RNA, 18 nt, Homo sapiens
gcuaauuagaaauauucu

SEQ ID NO: 2166747 - RNA, 19 nt, Homo sapiens
cugaggaggaggacacagc

SEQ ID NO: 2166748 - RNA, 20 nt, Homo sapiens
gcgagcccugguggcagugg

SEQ ID NO: 2166749 - RNA, 20 nt, Homo sapiens
agcccaacagacaccaucuu

SEQ ID NO: 2166750 - RNA, 20 nt, Homo sapiens
cuauaacauagaauugcaau

SEQ ID NO: 2166751 - RNA, 19 nt, Homo sapiens
aaccccaucgccaacuaag

SEQ ID NO: 2166752 - RNA, 23 nt, Homo sapiens
gaacagcgggagaccugugcuag

SEQ ID NO: 2166753 - RNA, 18 nt, Homo sapiens
uucaccuccauuaaccaa

SEQ ID NO: 2166754 - RNA, 17 nt, Homo sapiens
agcuacucuaguucugu

SEQ ID NO: 2166755 - RNA, 15 nt, Homo sapiens
caagcauuuuuccau

SEQ ID NO: 2166756 - RNA, 21 nt, Homo sapiens
aacucugccugagacuuucag

SEQ ID NO: 2166757 - RNA, 15 nt, Homo sapiens
auccagccuuuccaa

SEQ ID NO: 2166758 - RNA, 17 nt, Homo sapiens
uacaagggcugagauuc

SEQ ID NO: 2166759 - RNA, 17 nt, Homo sapiens
aagaauaugacuuuuua

SEQ ID NO: 2166760 - RNA, 15 nt, Homo sapiens
gcuggugaccggccu

SEQ ID NO: 2166761 - RNA, 19 nt, Homo sapiens
gacauacuuggagagcaaa

SEQ ID NO: 2166762 - RNA, 17 nt, Homo sapiens
ugcgacaccaccaacag

SEQ ID NO: 2166763 - RNA, 16 nt, Homo sapiens
cucuggacaugauuua

SEQ ID NO: 2166764 - RNA, 14 nt, Homo sapiens
agaagcucaucuca

SEQ ID NO: 2166765 - RNA, 21 nt, Homo sapiens
ugccaaacaggauguggaaaa

SEQ ID NO: 2166766 - RNA, 18 nt, Homo sapiens
uacuguaauuugugauac

SEQ ID NO: 2166767 - RNA, 12 nt, Homo sapiens
caauauacuuca

SEQ ID NO: 2166768 - RNA, 20 nt, Homo sapiens
augcauuuucuucacagugc

SEQ ID NO: 2166769 - RNA, 13 nt, Homo sapiens
cucuggaccagcc

SEQ ID NO: 2166770 - RNA, 23 nt, Homo sapiens
uccagaucugggauuauguagcu

SEQ ID NO: 2166771 - RNA, 19 nt, Homo sapiens
acaggaauagaauggaggg

SEQ ID NO: 2166772 - RNA, 13 nt, Homo sapiens
agcugcaccugau

SEQ ID NO: 2166773 - RNA, 18 nt, Homo sapiens
gaaagagaaaugauguga

SEQ ID NO: 2166774 - RNA, 14 nt, Homo sapiens
uugacauaaccaac

SEQ ID NO: 2166775 - RNA, 22 nt, Homo sapiens
caguauaccuggcaauucacaa

SEQ ID NO: 2166776 - RNA, 21 nt, Homo sapiens
ugggauguguagccuucuccc

SEQ ID NO: 2166777 - RNA, 18 nt, Homo sapiens
gcggggagccaucaccua

SEQ ID NO: 2166778 - RNA, 15 nt, Homo sapiens
ccuuccccucucuca

SEQ ID NO: 2166779 - RNA, 20 nt, Homo sapiens
caugccuugugcuguuaaua

SEQ ID NO: 2166780 - RNA, 13 nt, Homo sapiens
gcugcucuuccca

SEQ ID NO: 2166781 - RNA, 14 nt, Homo sapiens
aacaacaaagacau

SEQ ID NO: 2166782 - RNA, 14 nt, Homo sapiens
agcuucacaguacc

SEQ ID NO: 2166783 - RNA, 12 nt, Homo sapiens
cagccauuaaaa

SEQ ID NO: 2166784 - RNA, 21 nt, Homo sapiens
augcagccagcauuaccacag

SEQ ID NO: 2166785 - RNA, 23 nt, Homo sapiens
cccaagugauccuuccaccucag

SEQ ID NO: 2166786 - RNA, 22 nt, Homo sapiens
gagaugacaaaccauaacugac

SEQ ID NO: 2166787 - RNA, 14 nt, Homo sapiens
uugaucuacuugcc

SEQ ID NO: 2166788 - RNA, 17 nt, Homo sapiens
cagaaaaucuaccaaga

SEQ ID NO: 2166789 - RNA, 17 nt, Homo sapiens
uaagaaaauaaccuuua

SEQ ID NO: 2166790 - RNA, 18 nt, Homo sapiens
aaacauuccccuccccac

SEQ ID NO: 2166791 - RNA, 20 nt, Homo sapiens
cagugacuccagggugacaa

SEQ ID NO: 2166792 - RNA, 22 nt, Homo sapiens
acgcaaggugugcucugagcca

SEQ ID NO: 2166793 - RNA, 13 nt, Homo sapiens
gaauaaacucucc

SEQ ID NO: 2166794 - RNA, 22 nt, Homo sapiens
cuguuuuagauaucccuuacuc

SEQ ID NO: 2166795 - RNA, 21 nt, Homo sapiens
cuuguguucacccgugggugu

SEQ ID NO: 2166796 - RNA, 14 nt, Homo sapiens
cuuccuguguccau

SEQ ID NO: 2166797 - RNA, 15 nt, Homo sapiens
auggaaaacuguuaa

SEQ ID NO: 2166798 - RNA, 16 nt, Homo sapiens
aauccuuccauuccac

SEQ ID NO: 2166799 - RNA, 19 nt, Homo sapiens
uucucagaaaugucaugau

SEQ ID NO: 2166800 - RNA, 17 nt, Homo sapiens
aaagauucaugauuuau

SEQ ID NO: 2166801 - RNA, 13 nt, Homo sapiens
gcuccacugaaca

SEQ ID NO: 2166802 - RNA, 12 nt, Homo sapiens
aucuucucccca

SEQ ID NO: 2166803 - RNA, 15 nt, Homo sapiens
accuuuucccgggga

SEQ ID NO: 2166804 - RNA, 13 nt, Homo sapiens
uaauuugaugaaa

SEQ ID NO: 2166805 - RNA, 23 nt, Homo sapiens
cuuuuccaacauacaauuuacuu

SEQ ID NO: 2166806 - RNA, 23 nt, Homo sapiens
ccagccugggcaacacagugaga

SEQ ID NO: 2166807 - RNA, 20 nt, Homo sapiens
ggaggcagagcuugcaguga

SEQ ID NO: 2166808 - RNA, 20 nt, Homo sapiens
acgagcauaguccaaaaagc

SEQ ID NO: 2166809 - RNA, 15 nt, Homo sapiens
ccacagaugccucca

SEQ ID NO: 2166810 - RNA, 21 nt, Homo sapiens
ucucccugucacacacuggac

SEQ ID NO: 2166811 - RNA, 23 nt, Homo sapiens
guccucacccaucaaaagcacca

SEQ ID NO: 2166812 - RNA, 21 nt, Homo sapiens
ccgcagacggucugugugcug

SEQ ID NO: 2166813 - RNA, 14 nt, Homo sapiens
ucccauuuucaucc

SEQ ID NO: 2166814 - RNA, 13 nt, Homo sapiens
ggagcccagugaa

SEQ ID NO: 2166815 - RNA, 22 nt, Homo sapiens
ugacaacucauuuucauauugu

SEQ ID NO: 2166816 - RNA, 23 nt, Homo sapiens
ccugguggugggggcuucucugc

SEQ ID NO: 2166817 - RNA, 13 nt, Homo sapiens
gaaaagcaugaaa

SEQ ID NO: 2166818 - RNA, 21 nt, Homo sapiens
aucuaaaguugcuccauacaa

SEQ ID NO: 2166819 - RNA, 23 nt, Homo sapiens
ccucagucuuugggggauucaaa

SEQ ID NO: 2166820 - RNA, 16 nt, Homo sapiens
uaaguuaaaacaaagg

SEQ ID NO: 2166821 - RNA, 16 nt, Homo sapiens
aagucagaucuggucu

SEQ ID NO: 2166822 - RNA, 13 nt, Homo sapiens
agccugcuuucac

SEQ ID NO: 2166823 - RNA, 13 nt, Homo sapiens
aacccuuucuuca

SEQ ID NO: 2166824 - RNA, 17 nt, Homo sapiens
ucgaguuuuaaacuggu

SEQ ID NO: 2166825 - RNA, 18 nt, Homo sapiens
aacagcaucaugucauaa

SEQ ID NO: 2166826 - RNA, 19 nt, Homo sapiens
uauuuguauuccuuuucau

SEQ ID NO: 2166827 - RNA, 18 nt, Homo sapiens
guaccuauugaacaugug

SEQ ID NO: 2166828 - RNA, 14 nt, Homo sapiens
uggaggcagacagg

SEQ ID NO: 2166829 - RNA, 22 nt, Homo sapiens
acaucuuuuuaaagcuuaucca

SEQ ID NO: 2166830 - RNA, 15 nt, Homo sapiens
ucugucaaugucuug

SEQ ID NO: 2166831 - RNA, 15 nt, Homo sapiens
ccucccaacgugcug

SEQ ID NO: 2166832 - RNA, 13 nt, Homo sapiens
ucccaagugccaa

SEQ ID NO: 2166833 - RNA, 13 nt, Homo sapiens
uauaaagugauca

SEQ ID NO: 2166834 - RNA, 18 nt, Homo sapiens
aaggcugaaaaugugcau

SEQ ID NO: 2166835 - RNA, 14 nt, Homo sapiens
uuaauaaaauacug

SEQ ID NO: 2166836 - RNA, 20 nt, Homo sapiens
cccacgucccgggcacuguc

SEQ ID NO: 2166837 - RNA, 16 nt, Homo sapiens
ccagaagcuccgugag

SEQ ID NO: 2166838 - RNA, 13 nt, Homo sapiens
uccaguuggcuuu

SEQ ID NO: 2166839 - RNA, 13 nt, Homo sapiens
aacugaaggcaga

SEQ ID NO: 2166840 - RNA, 16 nt, Homo sapiens
gcccuacaaugcucau

SEQ ID NO: 2166841 - RNA, 14 nt, Homo sapiens
cucugucaacauca

SEQ ID NO: 2166842 - RNA, 16 nt, Homo sapiens
agcucaguuacggggu

SEQ ID NO: 2166843 - RNA, 18 nt, Homo sapiens
uggauuaugcccaugaac

SEQ ID NO: 2166844 - RNA, 21 nt, Homo sapiens
agaaauaaccaugaaaauagc

SEQ ID NO: 2166845 - RNA, 21 nt, Homo sapiens
auuuuaucacaaacuuaacau

SEQ ID NO: 2166846 - RNA, 13 nt, Homo sapiens
cagaaaagugaca

SEQ ID NO: 2166847 - RNA, 22 nt, Homo sapiens
acugugcuguacugagcacuga

SEQ ID NO: 2166848 - RNA, 18 nt, Homo sapiens
ccuuugcgcucuggguuu

SEQ ID NO: 2166849 - RNA, 14 nt, Homo sapiens
ugguuuaaaccaaa

SEQ ID NO: 2166850 - RNA, 15 nt, Homo sapiens
ucagccaagcuuguu

SEQ ID NO: 2166851 - RNA, 21 nt, Homo sapiens
ugggaguaagagcaaauuuca

SEQ ID NO: 2166852 - RNA, 18 nt, Homo sapiens
agcuguuacuuucuuuca

SEQ ID NO: 2166853 - RNA, 15 nt, Homo sapiens
acuagggaucccuca

SEQ ID NO: 2166854 - RNA, 22 nt, Homo sapiens
uaucaaguguucuaaaaugaaa

SEQ ID NO: 2166855 - RNA, 16 nt, Homo sapiens
cuuucgucuacugcaa

SEQ ID NO: 2166856 - RNA, 23 nt, Homo sapiens
ccaugaaacagcagcugaagcca

SEQ ID NO: 2166857 - RNA, 16 nt, Homo sapiens
uuuaaaagaaugauua

SEQ ID NO: 2166858 - RNA, 12 nt, Homo sapiens
cccaccagucuc

SEQ ID NO: 2166859 - RNA, 18 nt, Homo sapiens
cucugucuucacuauuca

SEQ ID NO: 2166860 - RNA, 20 nt, Homo sapiens
cccaguuguugguuuggcca

SEQ ID NO: 2166861 - RNA, 17 nt, Homo sapiens
ccucccagcugcacuuu

SEQ ID NO: 2166862 - RNA, 14 nt, Homo sapiens
aacuuugccaaaaa

SEQ ID NO: 2166863 - RNA, 20 nt, Homo sapiens
uaauuuuuuugagacagagu

SEQ ID NO: 2166864 - RNA, 17 nt, Homo sapiens
gcgaccuccuuucauca

SEQ ID NO: 2166865 - RNA, 19 nt, Homo sapiens
ugaguagauauuacuuuau

SEQ ID NO: 2166866 - RNA, 15 nt, Homo sapiens
cagcaauggcagauu

SEQ ID NO: 2166867 - RNA, 18 nt, Homo sapiens
gcaggaaaugaaaauguc

SEQ ID NO: 2166868 - RNA, 19 nt, Homo sapiens
cucuguugguccacugugu

SEQ ID NO: 2166869 - RNA, 13 nt, Homo sapiens
caaaccacuugcc

SEQ ID NO: 2166870 - RNA, 14 nt, Homo sapiens
cugggaggcacagc

SEQ ID NO: 2166871 - RNA, 18 nt, Homo sapiens
cacuauauugcacaggcu

SEQ ID NO: 2166872 - RNA, 17 nt, Homo sapiens
caaagugcugagauuac

SEQ ID NO: 2166873 - RNA, 22 nt, Homo sapiens
acuaugcccaaccuauccuguu

SEQ ID NO: 2166874 - RNA, 15 nt, Homo sapiens
uuauuuugcauucca

SEQ ID NO: 2166875 - RNA, 14 nt, Homo sapiens
aggccacaccacag

SEQ ID NO: 2166876 - RNA, 17 nt, Homo sapiens
uacugaugauguagaua

SEQ ID NO: 2166877 - RNA, 18 nt, Homo sapiens
ugggagggguccccaaca

SEQ ID NO: 2166878 - RNA, 17 nt, Homo sapiens
gcacauaugcaagccau

SEQ ID NO: 2166879 - RNA, 18 nt, Homo sapiens
uggggccuccagaacuca

SEQ ID NO: 2166880 - RNA, 23 nt, Homo sapiens
uccuguguccccugaccugucca

SEQ ID NO: 2166881 - RNA, 18 nt, Homo sapiens
ugcgagggaagcaauuga

SEQ ID NO: 2166882 - RNA, 21 nt, Homo sapiens
ucaaucuuuauguauuuguua

SEQ ID NO: 2166883 - RNA, 13 nt, Homo sapiens
aggcgagcagggc

SEQ ID NO: 2166884 - RNA, 16 nt, Homo sapiens
uucuacacauacaugu

SEQ ID NO: 2166885 - RNA, 23 nt, Homo sapiens
aguuggaaaaacaaaugccauau

SEQ ID NO: 2166886 - RNA, 15 nt, Homo sapiens
uaggagacuaaugga

SEQ ID NO: 2166887 - RNA, 13 nt, Homo sapiens
acggucugagcua

SEQ ID NO: 2166888 - RNA, 21 nt, Homo sapiens
ucuaaaccucaggccacaucu

SEQ ID NO: 2166889 - RNA, 23 nt, Homo sapiens
acagcaggcgccucgggucccag

SEQ ID NO: 2166890 - RNA, 13 nt, Homo sapiens
gcauaguccaaaa

SEQ ID NO: 2166891 - RNA, 21 nt, Homo sapiens
uccaugucagauaaguguaaa

SEQ ID NO: 2166892 - RNA, 17 nt, Homo sapiens
agaguaacucaguaauu

SEQ ID NO: 2166893 - RNA, 11 nt, Homo sapiens
caaaaagggaa

SEQ ID NO: 2166894 - RNA, 20 nt, Homo sapiens
acuucauuuugggggguauu

SEQ ID NO: 2166895 - RNA, 14 nt, Homo sapiens
ggucuagaaccacu

SEQ ID NO: 2166896 - RNA, 20 nt, Homo sapiens
gucucccccaaacauggccu

SEQ ID NO: 2166897 - RNA, 13 nt, Homo sapiens
gagauguacugca

SEQ ID NO: 2166898 - RNA, 21 nt, Homo sapiens
gagauguaagagcuuuacaaa

SEQ ID NO: 2166899 - RNA, 15 nt, Homo sapiens
uguucuugcugcuag

SEQ ID NO: 2166900 - RNA, 15 nt, Homo sapiens
cagguuuuucaauua

SEQ ID NO: 2166901 - RNA, 16 nt, Homo sapiens
uucucuccuucuuccc

SEQ ID NO: 2166902 - RNA, 20 nt, Homo sapiens
uaugugcaaaggugugcuuc

SEQ ID NO: 2166903 - RNA, 22 nt, Homo sapiens
uugucaacaaaaagacauggaa

SEQ ID NO: 2166904 - RNA, 14 nt, Homo sapiens
caguuggcuucuaa

SEQ ID NO: 2166905 - RNA, 15 nt, Homo sapiens
auauaauacuguauu

SEQ ID NO: 2166906 - RNA, 14 nt, Homo sapiens
cacacaaguuugag

SEQ ID NO: 2166907 - RNA, 20 nt, Homo sapiens
ccucucggugcuccaucucc

SEQ ID NO: 2166908 - RNA, 14 nt, Homo sapiens
uuuaauggggugca

SEQ ID NO: 2166909 - RNA, 14 nt, Homo sapiens
gcucuaaaccucag

SEQ ID NO: 2166910 - RNA, 20 nt, Homo sapiens
cagcucaacucacagcuucu

SEQ ID NO: 2166911 - RNA, 23 nt, Homo sapiens
cucuggcugcucccugacagcac

SEQ ID NO: 2166912 - RNA, 15 nt, Homo sapiens
ucugcuuuaauuuca

SEQ ID NO: 2166913 - RNA, 15 nt, Homo sapiens
accagaaccuggaca

SEQ ID NO: 2166914 - RNA, 19 nt, Homo sapiens
accugccucccuucaugca

SEQ ID NO: 2166915 - RNA, 16 nt, Homo sapiens
augugagcgagcaagc

SEQ ID NO: 2166916 - RNA, 15 nt, Homo sapiens
ucagaggccuaguca

SEQ ID NO: 2166917 - RNA, 19 nt, Homo sapiens
ucaucggaguugacaguga

SEQ ID NO: 2166918 - RNA, 18 nt, Homo sapiens
uacugcccaaggauaggu

SEQ ID NO: 2166919 - RNA, 15 nt, Homo sapiens
ugagaugugcuuugc

SEQ ID NO: 2166920 - RNA, 19 nt, Homo sapiens
gccagaguagugaagcuaa

SEQ ID NO: 2166921 - RNA, 18 nt, Homo sapiens
ggaccagcccuugaggga

SEQ ID NO: 2166922 - RNA, 18 nt, Homo sapiens
aauuaaaaaauaguugca

SEQ ID NO: 2166923 - RNA, 15 nt, Homo sapiens
caagaccccaaaggg

SEQ ID NO: 2166924 - RNA, 15 nt, Homo sapiens
cacugcugcauucca

SEQ ID NO: 2166925 - RNA, 22 nt, Homo sapiens
ccuucacuuccaucacaagaaa

SEQ ID NO: 2166926 - RNA, 17 nt, Homo sapiens
uuggccucugcuaaggu

SEQ ID NO: 2166927 - RNA, 19 nt, Homo sapiens
uauaauuauuuacucuuau

SEQ ID NO: 2166928 - RNA, 12 nt, Homo sapiens
acaaaaugccaa

SEQ ID NO: 2166929 - RNA, 22 nt, Homo sapiens
aaaagagcauggaugcauuuca

SEQ ID NO: 2166930 - RNA, 17 nt, Homo sapiens
aggcauuccagcuccuc

SEQ ID NO: 2166931 - RNA, 13 nt, Homo sapiens
aaauaaaacuguu

SEQ ID NO: 2166932 - RNA, 19 nt, Homo sapiens
caugaagguagguaaauag

SEQ ID NO: 2166933 - RNA, 19 nt, Homo sapiens
gccuuuuccaaaugcccaa

SEQ ID NO: 2166934 - RNA, 17 nt, Homo sapiens
uuguucuuggccaaaga

SEQ ID NO: 2166935 - RNA, 22 nt, Homo sapiens
gucccugaaaccuaguacugcc

SEQ ID NO: 2166936 - RNA, 21 nt, Homo sapiens
gcucuucucuccaguguuucu

SEQ ID NO: 2166937 - RNA, 18 nt, Homo sapiens
gaauguggauucuuccca

SEQ ID NO: 2166938 - RNA, 16 nt, Homo sapiens
uaugacuccauucaaa

SEQ ID NO: 2166939 - RNA, 18 nt, Homo sapiens
gauggaugggaugcacuc

SEQ ID NO: 2166940 - RNA, 23 nt, Homo sapiens
cuguguagcucucacaugcacag

SEQ ID NO: 2166941 - RNA, 21 nt, Homo sapiens
aacuaugcuguuaacagcugu

SEQ ID NO: 2166942 - RNA, 13 nt, Homo sapiens
gacagagugagug

SEQ ID NO: 2166943 - RNA, 20 nt, Homo sapiens
aguccaggguggaugaucuc

SEQ ID NO: 2166944 - RNA, 20 nt, Homo sapiens
uuaaucaugaaauuacuuau

SEQ ID NO: 2166945 - RNA, 17 nt, Homo sapiens
cuucacucaaucucuga

SEQ ID NO: 2166946 - RNA, 18 nt, Homo sapiens
cuucaggacuauuucacu

SEQ ID NO: 2166947 - RNA, 18 nt, Homo sapiens
uaacucaccagauuuacu

SEQ ID NO: 2166948 - RNA, 19 nt, Homo sapiens
uaugucccaugaccuugac

SEQ ID NO: 2166949 - RNA, 21 nt, Homo sapiens
uuaaaacauaagccacaggcc

SEQ ID NO: 2166950 - RNA, 14 nt, Homo sapiens
aguugugaucaaag

SEQ ID NO: 2166951 - RNA, 19 nt, Homo sapiens
ggucaggaccaucagagag

SEQ ID NO: 2166952 - RNA, 16 nt, Homo sapiens
uuaugagcuaucuacu

SEQ ID NO: 2166953 - RNA, 13 nt, Homo sapiens
uaugacucagaga

SEQ ID NO: 2166954 - RNA, 20 nt, Homo sapiens
uggagucggaucuagccaug

SEQ ID NO: 2166955 - RNA, 16 nt, Homo sapiens
agcuugccuaauggcu

SEQ ID NO: 2166956 - RNA, 21 nt, Homo sapiens
uauuuacugagcuucucugug

SEQ ID NO: 2166957 - RNA, 18 nt, Homo sapiens
ucccaggguuuuaacuuu

SEQ ID NO: 2166958 - RNA, 14 nt, Homo sapiens
cuguuucaaagcac

SEQ ID NO: 2166959 - RNA, 14 nt, Homo sapiens
ccaucccacuccac

SEQ ID NO: 2166960 - RNA, 11 nt, Homo sapiens
acacacugucu

SEQ ID NO: 2166961 - RNA, 20 nt, Homo sapiens
aguuggacuucagucuugcc

SEQ ID NO: 2166962 - RNA, 17 nt, Homo sapiens
aguucggugagcuacaa

SEQ ID NO: 2166963 - RNA, 20 nt, Homo sapiens
uuccaggcuggcgugcagca

SEQ ID NO: 2166964 - RNA, 13 nt, Homo sapiens
uguaaauguucaa

SEQ ID NO: 2166965 - RNA, 20 nt, Homo sapiens
ugaagauaucuugaaaugaa

SEQ ID NO: 2166966 - RNA, 20 nt, Homo sapiens
ugacaaucaguuaaacacac

SEQ ID NO: 2166967 - RNA, 17 nt, Homo sapiens
cacgugcauagaggucu

SEQ ID NO: 2166968 - RNA, 19 nt, Homo sapiens
gagauguccaaacugucgu

SEQ ID NO: 2166969 - RNA, 18 nt, Homo sapiens
ugccaucuguucauuucu

SEQ ID NO: 2166970 - RNA, 17 nt, Homo sapiens
uaacuugaaccuaugaa

SEQ ID NO: 2166971 - RNA, 22 nt, Homo sapiens
aaaacugaaggccucacuuaau

SEQ ID NO: 2166972 - RNA, 14 nt, Homo sapiens
aaagacugucuuaa

SEQ ID NO: 2166973 - RNA, 19 nt, Homo sapiens
ugauacaagaaagcaaugc

SEQ ID NO: 2166974 - RNA, 16 nt, Homo sapiens
ucugggggaaaaaaga

SEQ ID NO: 2166975 - RNA, 13 nt, Homo sapiens
acauuuuccugug

SEQ ID NO: 2166976 - RNA, 22 nt, Homo sapiens
aaaucuuucagaauacaauuca

SEQ ID NO: 2166977 - RNA, 19 nt, Homo sapiens
ucccaaaucccucucacaa

SEQ ID NO: 2166978 - RNA, 17 nt, Homo sapiens
caccacgccuagccuca

SEQ ID NO: 2166979 - RNA, 16 nt, Homo sapiens
gucuuaguaccagagc

SEQ ID NO: 2166980 - RNA, 17 nt, Homo sapiens
ugugaauuagacuugua

SEQ ID NO: 2166981 - RNA, 15 nt, Homo sapiens
ccugaagcaguucag

SEQ ID NO: 2166982 - RNA, 23 nt, Homo sapiens
auccucucccccuccuccaggga

SEQ ID NO: 2166983 - RNA, 18 nt, Homo sapiens
ccugggaaauuugccgau

SEQ ID NO: 2166984 - RNA, 13 nt, Homo sapiens
uacuaacacuggc

SEQ ID NO: 2166985 - RNA, 15 nt, Homo sapiens
uguugaagcacuguu

SEQ ID NO: 2166986 - RNA, 19 nt, Homo sapiens
uggaauaucaaugcccaac

SEQ ID NO: 2166987 - RNA, 21 nt, Homo sapiens
auccaaauaagccuugaaaaa

SEQ ID NO: 2166988 - RNA, 22 nt, Homo sapiens
gucagaaguucuggguggugcc

SEQ ID NO: 2166989 - RNA, 19 nt, Homo sapiens
acaaaguagaggaauccau

SEQ ID NO: 2166990 - RNA, 23 nt, Homo sapiens
auuuuacaauuuuuuaucaugca

SEQ ID NO: 2166991 - RNA, 21 nt, Homo sapiens
ccuuuuagccuaguucaucca

SEQ ID NO: 2166992 - RNA, 13 nt, Homo sapiens
uucuuugaaguuu

SEQ ID NO: 2166993 - RNA, 16 nt, Homo sapiens
agcuggccucucuagc

SEQ ID NO: 2166994 - RNA, 15 nt, Homo sapiens
ucuggagaacuauac

SEQ ID NO: 2166995 - RNA, 21 nt, Homo sapiens
aacccuccaggccucaguuuc

SEQ ID NO: 2166996 - RNA, 17 nt, Homo sapiens
ccuuuggaaggugacac

SEQ ID NO: 2166997 - RNA, 14 nt, Homo sapiens
cuguuaaucugaug

SEQ ID NO: 2166998 - RNA, 19 nt, Homo sapiens
gagacagaguuuucacucu

SEQ ID NO: 2166999 - RNA, 22 nt, Homo sapiens
ccaaauugggagauaauuauca

SEQ ID NO: 2167000 - RNA, 22 nt, Homo sapiens
cuguucaucaccagucuguaaa

SEQ ID NO: 2167001 - RNA, 17 nt, Homo sapiens
gcuccagaauaugcaua

SEQ ID NO: 2167002 - RNA, 23 nt, Homo sapiens
agagaccaggcaaagcaagugau

SEQ ID NO: 2167003 - RNA, 15 nt, Homo sapiens
auacucuagaugaag

SEQ ID NO: 2167004 - RNA, 15 nt, Homo sapiens
ugaaguauugcuaau

SEQ ID NO: 2167005 - RNA, 21 nt, Homo sapiens
gccagaggaucaccagugcau

SEQ ID NO: 2167006 - RNA, 23 nt, Homo sapiens
aauauuaucacgcagaucacuaa

SEQ ID NO: 2167007 - RNA, 17 nt, Homo sapiens
agaaguuuuguacagag

SEQ ID NO: 2167008 - RNA, 15 nt, Homo sapiens
gaaacuaaggucaga

SEQ ID NO: 2167009 - RNA, 14 nt, Homo sapiens
gcagaccaucgcac

SEQ ID NO: 2167010 - RNA, 13 nt, Homo sapiens
acacuuugaacuc

SEQ ID NO: 2167011 - RNA, 15 nt, Homo sapiens
uuccauuuacuugau

SEQ ID NO: 2167012 - RNA, 17 nt, Homo sapiens
cuugcuuccaagaccau

SEQ ID NO: 2167013 - RNA, 17 nt, Homo sapiens
uccuggcagucucaguc

SEQ ID NO: 2167014 - RNA, 16 nt, Homo sapiens
aaagcagggacuugaa

SEQ ID NO: 2167015 - RNA, 21 nt, Homo sapiens
auuauaccuggaugauucagg

SEQ ID NO: 2167016 - RNA, 14 nt, Homo sapiens
aagaauuacaguac

SEQ ID NO: 2167017 - RNA, 19 nt, Homo sapiens
acaggcuguucugcacuga

SEQ ID NO: 2167018 - RNA, 13 nt, Homo sapiens
agggacaagacaa

SEQ ID NO: 2167019 - RNA, 17 nt, Homo sapiens
uggcucaucaacaauca

SEQ ID NO: 2167020 - RNA, 19 nt, Homo sapiens
cuggaaacauucaggagcu

SEQ ID NO: 2167021 - RNA, 23 nt, Homo sapiens
ccugcugugggguauacagcauu

SEQ ID NO: 2167022 - RNA, 16 nt, Homo sapiens
uggcuuuacaaauaau

SEQ ID NO: 2167023 - RNA, 16 nt, Homo sapiens
aacccagucucagaca

SEQ ID NO: 2167024 - RNA, 14 nt, Homo sapiens
cugagguaaaaacu

SEQ ID NO: 2167025 - RNA, 20 nt, Homo sapiens
gacuuaucaccacaccacug

SEQ ID NO: 2167026 - RNA, 23 nt, Homo sapiens
ccaaucaaucuugcauguaacgc

SEQ ID NO: 2167027 - RNA, 21 nt, Homo sapiens
acauguguuggcagccucuuc

SEQ ID NO: 2167028 - RNA, 16 nt, Homo sapiens
cuaauucucuguggaa

SEQ ID NO: 2167029 - RNA, 17 nt, Homo sapiens
cauggcaagucacaugc

SEQ ID NO: 2167030 - RNA, 17 nt, Homo sapiens
agcccugccuccaucuc

SEQ ID NO: 2167031 - RNA, 18 nt, Homo sapiens
gccucauucuagcaccuu

SEQ ID NO: 2167032 - RNA, 23 nt, Homo sapiens
ugcuucuuugaaacuuguaugaa

SEQ ID NO: 2167033 - RNA, 14 nt, Homo sapiens
uuccuuuccauugu

SEQ ID NO: 2167034 - RNA, 20 nt, Homo sapiens
ccacuugccugugcuacaau

SEQ ID NO: 2167035 - RNA, 20 nt, Homo sapiens
uucaggacuuaacggcucca

SEQ ID NO: 2167036 - RNA, 19 nt, Homo sapiens
ugggucagagcuaaacucc

SEQ ID NO: 2167037 - RNA, 21 nt, Homo sapiens
ccagaaaauaaagauaguuaa

SEQ ID NO: 2167038 - RNA, 23 nt, Homo sapiens
gacagaaaaagauagcauugggg

SEQ ID NO: 2167039 - RNA, 19 nt, Homo sapiens
ugcaaucagcuaccauuca

SEQ ID NO: 2167040 - RNA, 18 nt, Homo sapiens
auggcuggaacacuguac

SEQ ID NO: 2167041 - RNA, 23 nt, Homo sapiens
uaaugaagacaaugauauugaca

SEQ ID NO: 2167042 - RNA, 17 nt, Homo sapiens
gucaucacacucuccau

SEQ ID NO: 2167043 - RNA, 23 nt, Homo sapiens
caugagagcagagcccccauggc

SEQ ID NO: 2167044 - RNA, 21 nt, Homo sapiens
aggccacauugacaguggugg

SEQ ID NO: 2167045 - RNA, 20 nt, Homo sapiens
acauucuaaaggcuugauau

SEQ ID NO: 2167046 - RNA, 22 nt, Homo sapiens
gacuacucugccugaacacugc

SEQ ID NO: 2167047 - RNA, 19 nt, Homo sapiens
cucccugguguaguguauu

SEQ ID NO: 2167048 - RNA, 15 nt, Homo sapiens
gaggcuuccagagag

SEQ ID NO: 2167049 - RNA, 20 nt, Homo sapiens
cugguugagaucaugucauu

SEQ ID NO: 2167050 - RNA, 16 nt, Homo sapiens
gggacuugaacaaaga

SEQ ID NO: 2167051 - RNA, 15 nt, Homo sapiens
uaacuaacugcauac

SEQ ID NO: 2167052 - RNA, 23 nt, Homo sapiens
ugagccaccgcgccuggccaggc

SEQ ID NO: 2167053 - RNA, 13 nt, Homo sapiens
gguaucugugaac

SEQ ID NO: 2167054 - RNA, 13 nt, Homo sapiens
ggauucuguguuc

SEQ ID NO: 2167055 - RNA, 15 nt, Homo sapiens
cugaaagugguuuga

SEQ ID NO: 2167056 - RNA, 17 nt, Homo sapiens
auggcaaaauuagucuu

SEQ ID NO: 2167057 - RNA, 21 nt, Homo sapiens
cggcaucuccccuagcucacc

SEQ ID NO: 2167058 - RNA, 20 nt, Homo sapiens
ugaaaguaccaggugaacaa

SEQ ID NO: 2167059 - RNA, 19 nt, Homo sapiens
uugguauaucuggccacac

SEQ ID NO: 2167060 - RNA, 18 nt, Homo sapiens
ggaagggaccccacugga

SEQ ID NO: 2167061 - RNA, 16 nt, Homo sapiens
auuugaagaugggaug

SEQ ID NO: 2167062 - RNA, 14 nt, Homo sapiens
ugggaaugacaaca

SEQ ID NO: 2167063 - RNA, 23 nt, Homo sapiens
ucaguuccaaacagacaaaacag

SEQ ID NO: 2167064 - RNA, 21 nt, Homo sapiens
agauacgaaaucaguuucuca

SEQ ID NO: 2167065 - RNA, 21 nt, Homo sapiens
aggaacagccacaaaauacac

SEQ ID NO: 2167066 - RNA, 15 nt, Homo sapiens
uuugaacaugcugaa

SEQ ID NO: 2167067 - RNA, 17 nt, Homo sapiens
agguucucagcaagugu

SEQ ID NO: 2167068 - RNA, 20 nt, Homo sapiens
cuguuuuguuuuuaaaucaa

SEQ ID NO: 2167069 - RNA, 14 nt, Homo sapiens
ccgggacgcagggg

SEQ ID NO: 2167070 - RNA, 13 nt, Homo sapiens
uccuuuaauccca

SEQ ID NO: 2167071 - RNA, 17 nt, Homo sapiens
ccaucugggcuucacag

SEQ ID NO: 2167072 - RNA, 16 nt, Homo sapiens
cagaacuaccaugaga

SEQ ID NO: 2167073 - RNA, 20 nt, Homo sapiens
guguacaaauacauguguau

SEQ ID NO: 2167074 - RNA, 16 nt, Homo sapiens
caaugcauucugaggu

SEQ ID NO: 2167075 - RNA, 23 nt, Homo sapiens
ccuacaauguuguauuuguuauu

SEQ ID NO: 2167076 - RNA, 15 nt, Homo sapiens
gggaaaggaggcaug

SEQ ID NO: 2167077 - RNA, 15 nt, Homo sapiens
aaaaaugggaacaag

SEQ ID NO: 2167078 - RNA, 23 nt, Homo sapiens
guugucaaacugaaauucagagc

SEQ ID NO: 2167079 - RNA, 16 nt, Homo sapiens
gcacagauuacuucag

SEQ ID NO: 2167080 - RNA, 14 nt, Homo sapiens
auuuucaagcaaau

SEQ ID NO: 2167081 - RNA, 12 nt, Homo sapiens
caaucacacuga

SEQ ID NO: 2167082 - RNA, 14 nt, Homo sapiens
auauuggaaugcac

SEQ ID NO: 2167083 - RNA, 15 nt, Homo sapiens
gugcccugagacaga

SEQ ID NO: 2167084 - RNA, 19 nt, Homo sapiens
ucuuuucauuuuugauuag

SEQ ID NO: 2167085 - RNA, 21 nt, Homo sapiens
ugccccaccuguuguccugaa

SEQ ID NO: 2167086 - RNA, 16 nt, Homo sapiens
auguuggaaaacauau

SEQ ID NO: 2167087 - RNA, 23 nt, Homo sapiens
cagggaaauguaugugugucuau

SEQ ID NO: 2167088 - RNA, 16 nt, Homo sapiens
ccagucccacacugug

SEQ ID NO: 2167089 - RNA, 13 nt, Homo sapiens
ugacuugccauga

SEQ ID NO: 2167090 - RNA, 21 nt, Homo sapiens
agguuuugagcauggguucau

SEQ ID NO: 2167091 - RNA, 20 nt, Homo sapiens
aagcuuuuuugccacaaaga

SEQ ID NO: 2167092 - RNA, 19 nt, Homo sapiens
ucuaucaaaugaaacucuu

SEQ ID NO: 2167093 - RNA, 18 nt, Homo sapiens
aaucauguaaaugcucau

SEQ ID NO: 2167094 - RNA, 15 nt, Homo sapiens
uaagcuuguaugugg

SEQ ID NO: 2167095 - RNA, 19 nt, Homo sapiens
caucaggaccacucaguua

SEQ ID NO: 2167096 - RNA, 15 nt, Homo sapiens
uuacagucacauuca

SEQ ID NO: 2167097 - RNA, 19 nt, Homo sapiens
cacacagacuuucugugac

SEQ ID NO: 2167098 - RNA, 15 nt, Homo sapiens
cgccagcucaguuuc

SEQ ID NO: 2167099 - RNA, 12 nt, Homo sapiens
uaugaauucauu

SEQ ID NO: 2167100 - RNA, 17 nt, Homo sapiens
ugaaaccaggacauuaa

SEQ ID NO: 2167101 - RNA, 16 nt, Homo sapiens
aaccaugacugugacc

SEQ ID NO: 2167102 - RNA, 15 nt, Homo sapiens
caauacucaaaagag

SEQ ID NO: 2167103 - RNA, 19 nt, Homo sapiens
aacgcaggagaaucacuug

SEQ ID NO: 2167104 - RNA, 17 nt, Homo sapiens
ggcggagggagcggcau

SEQ ID NO: 2167105 - RNA, 21 nt, Homo sapiens
ccuugcaaucuucuacuuuaa

SEQ ID NO: 2167106 - RNA, 23 nt, Homo sapiens
cuggucucaaacuccugggcuca

SEQ ID NO: 2167107 - RNA, 22 nt, Homo sapiens
gccauagagggccugaugacau

SEQ ID NO: 2167108 - RNA, 18 nt, Homo sapiens
cuggccuauguggucuaa

SEQ ID NO: 2167109 - RNA, 16 nt, Homo sapiens
guuacuccagugccaa

SEQ ID NO: 2167110 - RNA, 22 nt, Homo sapiens
caccuguccggcccagugccag

SEQ ID NO: 2167111 - RNA, 21 nt, Homo sapiens
gaggaauuuacuuucuucacc

SEQ ID NO: 2167112 - RNA, 19 nt, Homo sapiens
caauuuaauuccauaauca

SEQ ID NO: 2167113 - RNA, 20 nt, Homo sapiens
cuucuaguuucccacaauau

SEQ ID NO: 2167114 - RNA, 15 nt, Homo sapiens
ggucacacaaaggca

SEQ ID NO: 2167115 - RNA, 16 nt, Homo sapiens
aggggauccagccacu

SEQ ID NO: 2167116 - RNA, 13 nt, Homo sapiens
aaugacaguuuuu

SEQ ID NO: 2167117 - RNA, 14 nt, Homo sapiens
ggaccagaggugac

SEQ ID NO: 2167118 - RNA, 21 nt, Homo sapiens
uuuugaccagugaaacuauga

SEQ ID NO: 2167119 - RNA, 14 nt, Homo sapiens
auuggaaccuguua

SEQ ID NO: 2167120 - RNA, 15 nt, Homo sapiens
cgcugccccaugugu

SEQ ID NO: 2167121 - RNA, 17 nt, Homo sapiens
aguucaccugcacuuaa

SEQ ID NO: 2167122 - RNA, 15 nt, Homo sapiens
aacccaaauguucau

SEQ ID NO: 2167123 - RNA, 15 nt, Homo sapiens
uaucaaaaagcuaau

SEQ ID NO: 2167124 - RNA, 23 nt, Homo sapiens
ugagauuucucauugaucacaga

SEQ ID NO: 2167125 - RNA, 19 nt, Homo sapiens
cuggaaguuucacuggcug

SEQ ID NO: 2167126 - RNA, 15 nt, Homo sapiens
cugugagcagggauu

SEQ ID NO: 2167127 - RNA, 19 nt, Homo sapiens
ccccuaaucccagcacuuu

SEQ ID NO: 2167128 - RNA, 16 nt, Homo sapiens
uuuccucaccaggagc

SEQ ID NO: 2167129 - RNA, 21 nt, Homo sapiens
agacagucucacucuguugcc

SEQ ID NO: 2167130 - RNA, 21 nt, Homo sapiens
cagcacugccggcccagugac

SEQ ID NO: 2167131 - RNA, 22 nt, Homo sapiens
ucuccuuccccaccccaccaca

SEQ ID NO: 2167132 - RNA, 22 nt, Homo sapiens
aaaaggaacucuagaagaccaa

SEQ ID NO: 2167133 - RNA, 23 nt, Homo sapiens
ucaaauaugugguccaucucuga

SEQ ID NO: 2167134 - RNA, 20 nt, Homo sapiens
auggcaccuuuugcacauaa

SEQ ID NO: 2167135 - RNA, 20 nt, Homo sapiens
gaagaaaauggaugacaaag

SEQ ID NO: 2167136 - RNA, 17 nt, Homo sapiens
cccagaucaccaccuga

SEQ ID NO: 2167137 - RNA, 18 nt, Homo sapiens
gaaucuccccuccucaca

SEQ ID NO: 2167138 - RNA, 15 nt, Homo sapiens
aaguaccacucaggc

SEQ ID NO: 2167139 - RNA, 15 nt, Homo sapiens
aauuaggcuguaacu

SEQ ID NO: 2167140 - RNA, 15 nt, Homo sapiens
gacaagcuuaaugug

SEQ ID NO: 2167141 - RNA, 22 nt, Homo sapiens
auggccagugagaucaauguga

SEQ ID NO: 2167142 - RNA, 19 nt, Homo sapiens
gggcagauggcagggcuga

SEQ ID NO: 2167143 - RNA, 16 nt, Homo sapiens
guugaugguaggcugu

SEQ ID NO: 2167144 - RNA, 18 nt, Homo sapiens
ucgaucuuccagaagcug

SEQ ID NO: 2167145 - RNA, 23 nt, Homo sapiens
auggcaugaaucgggcuaagguc

SEQ ID NO: 2167146 - RNA, 22 nt, Homo sapiens
aaucccacuuaucaaaucauuc

SEQ ID NO: 2167147 - RNA, 22 nt, Homo sapiens
uaucccccgccuuuaguucucc

SEQ ID NO: 2167148 - RNA, 16 nt, Homo sapiens
uguccacagggacaca

SEQ ID NO: 2167149 - RNA, 16 nt, Homo sapiens
uaagguaccuuucaca

SEQ ID NO: 2167150 - RNA, 19 nt, Homo sapiens
cauuucaauugcuuuguga

SEQ ID NO: 2167151 - RNA, 17 nt, Homo sapiens
cuggcauggcaccuguc

SEQ ID NO: 2167152 - RNA, 12 nt, Homo sapiens
aaaucugaauaa

SEQ ID NO: 2167153 - RNA, 21 nt, Homo sapiens
uaguugcaugaaauuuugccu

SEQ ID NO: 2167154 - RNA, 15 nt, Homo sapiens
cggugcaugaugcug

SEQ ID NO: 2167155 - RNA, 16 nt, Homo sapiens
uuaauuuugcaguguu

SEQ ID NO: 2167156 - RNA, 16 nt, Homo sapiens
ucccuuccacugccuc

SEQ ID NO: 2167157 - RNA, 14 nt, Homo sapiens
uucccaauacauac

SEQ ID NO: 2167158 - RNA, 22 nt, Homo sapiens
aacugcauuagaaaccaugaaa

SEQ ID NO: 2167159 - RNA, 15 nt, Homo sapiens
acucugcaccuaauc

SEQ ID NO: 2167160 - RNA, 20 nt, Homo sapiens
uugcagcuggacuucuccac

SEQ ID NO: 2167161 - RNA, 17 nt, Homo sapiens
caugacacuuccaaaga

SEQ ID NO: 2167162 - RNA, 14 nt, Homo sapiens
ucagguaguacugg

SEQ ID NO: 2167163 - RNA, 15 nt, Homo sapiens
uuaaaaugacaaaca

SEQ ID NO: 2167164 - RNA, 15 nt, Homo sapiens
auauuaugucauuca

SEQ ID NO: 2167165 - RNA, 15 nt, Homo sapiens
uuuucaagacuuccu

SEQ ID NO: 2167166 - RNA, 13 nt, Homo sapiens
ccugggaauuuca

SEQ ID NO: 2167167 - RNA, 21 nt, Homo sapiens
agcaaguccucacucuucaag

SEQ ID NO: 2167168 - RNA, 23 nt, Homo sapiens
uaacaauguuuuuuauacuucaa

SEQ ID NO: 2167169 - RNA, 12 nt, Homo sapiens
accuuacucuga

SEQ ID NO: 2167170 - RNA, 18 nt, Homo sapiens
accggaucuacacccacc

SEQ ID NO: 2167171 - RNA, 22 nt, Homo sapiens
guuucuacacauugcuaccuca

SEQ ID NO: 2167172 - RNA, 21 nt, Homo sapiens
aacaaauucuuuaguacucaa

SEQ ID NO: 2167173 - RNA, 16 nt, Homo sapiens
gugcuauggugcucug

SEQ ID NO: 2167174 - RNA, 16 nt, Homo sapiens
cucccacacuccccca

SEQ ID NO: 2167175 - RNA, 16 nt, Homo sapiens
cuuuccuucuuucauu

SEQ ID NO: 2167176 - RNA, 18 nt, Homo sapiens
auauaaauucuaagccau

SEQ ID NO: 2167177 - RNA, 22 nt, Homo sapiens
ucuuuagagaauccguauugaa

SEQ ID NO: 2167178 - RNA, 17 nt, Homo sapiens
uccacuuuaucuugaau

SEQ ID NO: 2167179 - RNA, 23 nt, Homo sapiens
ugguggaaauauccagguucuaa

SEQ ID NO: 2167180 - RNA, 18 nt, Homo sapiens
uaaaauuaggacuguaua

SEQ ID NO: 2167181 - RNA, 20 nt, Homo sapiens
ugguggccugccccagcucu

SEQ ID NO: 2167182 - RNA, 19 nt, Homo sapiens
auuucucuaacuccugcca

SEQ ID NO: 2167183 - RNA, 17 nt, Homo sapiens
aagucuaaauaaaugaa

SEQ ID NO: 2167184 - RNA, 17 nt, Homo sapiens
gcaucuggcuaaggcau

SEQ ID NO: 2167185 - RNA, 10 nt, Homo sapiens
acucuaccuc

SEQ ID NO: 2167186 - RNA, 13 nt, Homo sapiens
guuuauauggaua

SEQ ID NO: 2167187 - RNA, 13 nt, Homo sapiens
gguuauauguaua

SEQ ID NO: 2167188 - RNA, 13 nt, Homo sapiens
uguacuauuuaac

SEQ ID NO: 2167189 - RNA, 15 nt, Homo sapiens
uucuggguuugccca

SEQ ID NO: 2167190 - RNA, 12 nt, Homo sapiens
gauuuucuugcc

SEQ ID NO: 2167191 - RNA, 18 nt, Homo sapiens
ugaauccaaacuaaucca

SEQ ID NO: 2167192 - RNA, 21 nt, Homo sapiens
ccucgcuguugucacaucuca

SEQ ID NO: 2167193 - RNA, 19 nt, Homo sapiens
agccugaauuuuguugcug

SEQ ID NO: 2167194 - RNA, 15 nt, Homo sapiens
guccaguacugggag

SEQ ID NO: 2167195 - RNA, 15 nt, Homo sapiens
cuuagugucacuuac

SEQ ID NO: 2167196 - RNA, 15 nt, Homo sapiens
ccuuaccaauaauaa

SEQ ID NO: 2167197 - RNA, 15 nt, Homo sapiens
ugcucgagacacagu

SEQ ID NO: 2167198 - RNA, 20 nt, Homo sapiens
caggcagaucaccugagguc

SEQ ID NO: 2167199 - RNA, 20 nt, Homo sapiens
accuccuccucuggacaaag

SEQ ID NO: 2167200 - RNA, 19 nt, Homo sapiens
uugucccguggcauuucaa

SEQ ID NO: 2167201 - RNA, 19 nt, Homo sapiens
gaacucaugucuuucucag

SEQ ID NO: 2167202 - RNA, 21 nt, Homo sapiens
cucagcagccucacugcaucu

SEQ ID NO: 2167203 - RNA, 18 nt, Homo sapiens
gucucaggaguagucuca

SEQ ID NO: 2167204 - RNA, 23 nt, Homo sapiens
gggaccagcagccccacaccagg

SEQ ID NO: 2167205 - RNA, 17 nt, Homo sapiens
gccaaggcucacaugcu

SEQ ID NO: 2167206 - RNA, 17 nt, Homo sapiens
gucaauuaguacaguag

SEQ ID NO: 2167207 - RNA, 15 nt, Homo sapiens
gagacacacacacag

SEQ ID NO: 2167208 - RNA, 16 nt, Homo sapiens
ugcagcuaagcucaaa

SEQ ID NO: 2167209 - RNA, 14 nt, Homo sapiens
ucaccacugcuuua

SEQ ID NO: 2167210 - RNA, 20 nt, Homo sapiens
ucuccauggcccugucccag

SEQ ID NO: 2167211 - RNA, 18 nt, Homo sapiens
cucagccucauccugaga

SEQ ID NO: 2167212 - RNA, 15 nt, Homo sapiens
agcuugucacuggaa

SEQ ID NO: 2167213 - RNA, 18 nt, Homo sapiens
ucuauggguaucaaacag

SEQ ID NO: 2167214 - RNA, 13 nt, Homo sapiens
uuucacucuuuag

SEQ ID NO: 2167215 - RNA, 16 nt, Homo sapiens
accuugaacacugggg

SEQ ID NO: 2167216 - RNA, 20 nt, Homo sapiens
gacacuuugucuaguguauu

SEQ ID NO: 2167217 - RNA, 20 nt, Homo sapiens
ccaggccgagaugugcaaca

SEQ ID NO: 2167218 - RNA, 14 nt, Homo sapiens
ugcugacaggugau

SEQ ID NO: 2167219 - RNA, 18 nt, Homo sapiens
ugccaggcagaaaacugg

SEQ ID NO: 2167220 - RNA, 14 nt, Homo sapiens
aaaacaaguacugg

SEQ ID NO: 2167221 - RNA, 13 nt, Homo sapiens
agagagcaaagau

SEQ ID NO: 2167222 - RNA, 18 nt, Homo sapiens
caguucuuaacccagugu

SEQ ID NO: 2167223 - RNA, 18 nt, Homo sapiens
agagguuaaggugcaaua

SEQ ID NO: 2167224 - RNA, 17 nt, Homo sapiens
gaggaaaaacagggaaa

SEQ ID NO: 2167225 - RNA, 21 nt, Homo sapiens
aguaugguucucggaguccaa

SEQ ID NO: 2167226 - RNA, 20 nt, Homo sapiens
ggaaacauuucugacaccgu

SEQ ID NO: 2167227 - RNA, 13 nt, Homo sapiens
acuaggugcugca

SEQ ID NO: 2167228 - RNA, 21 nt, Homo sapiens
uuaaagcagggauaugcugua

SEQ ID NO: 2167229 - RNA, 14 nt, Homo sapiens
acuguuagacaaaa

SEQ ID NO: 2167230 - RNA, 18 nt, Homo sapiens
ccgcagcccccacugacc

SEQ ID NO: 2167231 - RNA, 20 nt, Homo sapiens
gaaucagugaagaugccagu

SEQ ID NO: 2167232 - RNA, 14 nt, Homo sapiens
guagaggcauuugu

SEQ ID NO: 2167233 - RNA, 16 nt, Homo sapiens
agacacugagaucugu

SEQ ID NO: 2167234 - RNA, 13 nt, Homo sapiens
gugcagugucuug

SEQ ID NO: 2167235 - RNA, 14 nt, Homo sapiens
ucggccaccacaga

SEQ ID NO: 2167236 - RNA, 15 nt, Homo sapiens
uccuguaccacucac

SEQ ID NO: 2167237 - RNA, 14 nt, Homo sapiens
auccuucacugcuc

SEQ ID NO: 2167238 - RNA, 14 nt, Homo sapiens
aucuaccacuguau

SEQ ID NO: 2167239 - RNA, 14 nt, Homo sapiens
auuguaccaugaaa

SEQ ID NO: 2167240 - RNA, 21 nt, Homo sapiens
cuugaaucaggaggagauuaa

SEQ ID NO: 2167241 - RNA, 17 nt, Homo sapiens
aauguaacugugccagu

SEQ ID NO: 2167242 - RNA, 16 nt, Homo sapiens
uggcuaagaguguccu

SEQ ID NO: 2167243 - RNA, 20 nt, Homo sapiens
caagugugucuccugugcug

SEQ ID NO: 2167244 - RNA, 23 nt, Homo sapiens
uagcuagaaugcacaccaaaaaa

SEQ ID NO: 2167245 - RNA, 20 nt, Homo sapiens
ugaguuuccaaauggaugaa

SEQ ID NO: 2167246 - RNA, 18 nt, Homo sapiens
caacgagauaccaucuca

SEQ ID NO: 2167247 - RNA, 18 nt, Homo sapiens
ucaugacuuggcuguuaa

SEQ ID NO: 2167248 - RNA, 18 nt, Homo sapiens
gcucuuucagaacaaaca

SEQ ID NO: 2167249 - RNA, 13 nt, Homo sapiens
ccugugacuggca

SEQ ID NO: 2167250 - RNA, 16 nt, Homo sapiens
cgacguuugacuagcc

SEQ ID NO: 2167251 - RNA, 12 nt, Homo sapiens
acucugguggcu

SEQ ID NO: 2167252 - RNA, 17 nt, Homo sapiens
guacugacuuugcuugc

SEQ ID NO: 2167253 - RNA, 14 nt, Homo sapiens
augacugcucaggc

SEQ ID NO: 2167254 - RNA, 17 nt, Homo sapiens
gcuauuuucugaccaaa

SEQ ID NO: 2167255 - RNA, 18 nt, Homo sapiens
auuuauguucaucuucaa

SEQ ID NO: 2167256 - RNA, 17 nt, Homo sapiens
acuaguugaacaucuca

SEQ ID NO: 2167257 - RNA, 13 nt, Homo sapiens
ucauuuucuuucc

SEQ ID NO: 2167258 - RNA, 19 nt, Homo sapiens
ccggugcagggccuggcau

SEQ ID NO: 2167259 - RNA, 19 nt, Homo sapiens
uuacauauucuuucacuug

SEQ ID NO: 2167260 - RNA, 13 nt, Homo sapiens
acuuccaccagcc

SEQ ID NO: 2167261 - RNA, 18 nt, Homo sapiens
ugucucaagccuaucuau

SEQ ID NO: 2167262 - RNA, 18 nt, Homo sapiens
acucaaauacacauuugc

SEQ ID NO: 2167263 - RNA, 15 nt, Homo sapiens
acucccauuccugaa

SEQ ID NO: 2167264 - RNA, 20 nt, Homo sapiens
gagcugcagcugagccugag

SEQ ID NO: 2167265 - RNA, 18 nt, Homo sapiens
auuauagucuguacuuca

SEQ ID NO: 2167266 - RNA, 19 nt, Homo sapiens
agacucguucuucugggaa

SEQ ID NO: 2167267 - RNA, 17 nt, Homo sapiens
ccgucugauuguuccuc

SEQ ID NO: 2167268 - RNA, 14 nt, Homo sapiens
ugucccucuguaua

SEQ ID NO: 2167269 - RNA, 17 nt, Homo sapiens
cgaugcagguggaucuc

SEQ ID NO: 2167270 - RNA, 19 nt, Homo sapiens
ucaacuggcuacugaguca

SEQ ID NO: 2167271 - RNA, 22 nt, Homo sapiens
agcugaagccuauuuauuugaa

SEQ ID NO: 2167272 - RNA, 12 nt, Homo sapiens
uauguguaaaau

SEQ ID NO: 2167273 - RNA, 13 nt, Homo sapiens
uuacaggugugag

SEQ ID NO: 2167274 - RNA, 21 nt, Homo sapiens
aguuaaaaauuaaauauuuau

SEQ ID NO: 2167275 - RNA, 22 nt, Homo sapiens
aaauagggagacugacugagua

SEQ ID NO: 2167276 - RNA, 23 nt, Homo sapiens
ugcgcacacacagauaugcacac

SEQ ID NO: 2167277 - RNA, 20 nt, Homo sapiens
agggaggugguccuccuauc

SEQ ID NO: 2167278 - RNA, 14 nt, Homo sapiens
uuguaaugagccau

SEQ ID NO: 2167279 - RNA, 22 nt, Homo sapiens
aaugcaaaaaagccaagcccuc

SEQ ID NO: 2167280 - RNA, 19 nt, Homo sapiens
aggaguggccguugcuaca

SEQ ID NO: 2167281 - RNA, 21 nt, Homo sapiens
cgcagucugcuucagugcagu

SEQ ID NO: 2167282 - RNA, 15 nt, Homo sapiens
ugguauacuuuugcu

SEQ ID NO: 2167283 - RNA, 21 nt, Homo sapiens
cagcagcccgccgcacugggg

SEQ ID NO: 2167284 - RNA, 18 nt, Homo sapiens
cucaauagaucugggaga

SEQ ID NO: 2167285 - RNA, 19 nt, Homo sapiens
ucagggccuggggccugag

SEQ ID NO: 2167286 - RNA, 22 nt, Homo sapiens
uuguuucuuucugugcugguaa

SEQ ID NO: 2167287 - RNA, 16 nt, Homo sapiens
agccauugagugcagc

SEQ ID NO: 2167288 - RNA, 22 nt, Homo sapiens
cagagcaggggcuccagcaccu

SEQ ID NO: 2167289 - RNA, 22 nt, Homo sapiens
uaaaugugagaacuguucucau

SEQ ID NO: 2167290 - RNA, 19 nt, Homo sapiens
uucuucuaauuaacagcuc

SEQ ID NO: 2167291 - RNA, 15 nt, Homo sapiens
gacaggcaccaugcu

SEQ ID NO: 2167292 - RNA, 17 nt, Homo sapiens
acacagcacaugcacac

SEQ ID NO: 2167293 - RNA, 23 nt, Homo sapiens
caauauuguaauccuagcacuuu

SEQ ID NO: 2167294 - RNA, 20 nt, Homo sapiens
aggcccccgggugugaagca

SEQ ID NO: 2167295 - RNA, 15 nt, Homo sapiens
auccccagcugccug

SEQ ID NO: 2167296 - RNA, 14 nt, Homo sapiens
aucacauacaauuu

SEQ ID NO: 2167297 - RNA, 16 nt, Homo sapiens
aggaaccccaggagau

SEQ ID NO: 2167298 - RNA, 17 nt, Homo sapiens
ggccugcccucagggau

SEQ ID NO: 2167299 - RNA, 15 nt, Homo sapiens
cuaaauuugguucua

SEQ ID NO: 2167300 - RNA, 20 nt, Homo sapiens
gccuuacaucuggcuggaaa

SEQ ID NO: 2167301 - RNA, 17 nt, Homo sapiens
ugcaagaguggacugaa

SEQ ID NO: 2167302 - RNA, 21 nt, Homo sapiens
uugcauuuugauaaaauuaau

SEQ ID NO: 2167303 - RNA, 14 nt, Homo sapiens
uucucauuucucag

SEQ ID NO: 2167304 - RNA, 17 nt, Homo sapiens
augagcacuacucuacc

SEQ ID NO: 2167305 - RNA, 23 nt, Homo sapiens
ggaagcauuuguuucuacuuuga

SEQ ID NO: 2167306 - RNA, 14 nt, Homo sapiens
gcuauucuccauac

SEQ ID NO: 2167307 - RNA, 14 nt, Homo sapiens
cagccaggccgaga

SEQ ID NO: 2167308 - RNA, 19 nt, Homo sapiens
cagcuaacauggaaguacu

SEQ ID NO: 2167309 - RNA, 18 nt, Homo sapiens
aaaccuucagaagcuauu

SEQ ID NO: 2167310 - RNA, 15 nt, Homo sapiens
cuucuuugugccuuu

SEQ ID NO: 2167311 - RNA, 22 nt, Homo sapiens
cgcuuuugcuggucacugccau

SEQ ID NO: 2167312 - RNA, 23 nt, Homo sapiens
ggacagaaagagacuccgucuca

SEQ ID NO: 2167313 - RNA, 14 nt, Homo sapiens
uggaagcugauucc

SEQ ID NO: 2167314 - RNA, 15 nt, Homo sapiens
uuguugagugccagc

SEQ ID NO: 2167315 - RNA, 13 nt, Homo sapiens
uggugauuuagca

SEQ ID NO: 2167316 - RNA, 20 nt, Homo sapiens
aaccagacucuugccuguuu

SEQ ID NO: 2167317 - RNA, 22 nt, Homo sapiens
caucucuggccuguacccagua

SEQ ID NO: 2167318 - RNA, 13 nt, Homo sapiens
uucagcucuacag

SEQ ID NO: 2167319 - RNA, 15 nt, Homo sapiens
cauugaaacuguauu

SEQ ID NO: 2167320 - RNA, 17 nt, Homo sapiens
gucuaucuaaugacaug

SEQ ID NO: 2167321 - RNA, 13 nt, Homo sapiens
acugaugacacac

SEQ ID NO: 2167322 - RNA, 14 nt, Homo sapiens
gcgugugugcaagu

SEQ ID NO: 2167323 - RNA, 15 nt, Homo sapiens
gauggugcaugccug

SEQ ID NO: 2167324 - RNA, 18 nt, Homo sapiens
aagcauuccuucuuucac

SEQ ID NO: 2167325 - RNA, 15 nt, Homo sapiens
aaaauuuaaaucaua

SEQ ID NO: 2167326 - RNA, 14 nt, Homo sapiens
caagcguguucuca

SEQ ID NO: 2167327 - RNA, 20 nt, Homo sapiens
uuaagccuguaauuauguaa

SEQ ID NO: 2167328 - RNA, 22 nt, Homo sapiens
uuaaagcaaucuguugaaaugc

SEQ ID NO: 2167329 - RNA, 21 nt, Homo sapiens
uauuuuaauagaaagauacaa

SEQ ID NO: 2167330 - RNA, 15 nt, Homo sapiens
auguuucgcugauau

SEQ ID NO: 2167331 - RNA, 21 nt, Homo sapiens
guuuugcauuuuuugaauauu

SEQ ID NO: 2167332 - RNA, 11 nt, Homo sapiens
ucauguucuca

SEQ ID NO: 2167333 - RNA, 22 nt, Homo sapiens
ggucaacauagugagacacugu

SEQ ID NO: 2167334 - RNA, 23 nt, Homo sapiens
cgggggagaggggagaauggagu

SEQ ID NO: 2167335 - RNA, 18 nt, Homo sapiens
aaagacugugaacagcuu

SEQ ID NO: 2167336 - RNA, 16 nt, Homo sapiens
aacugggcaugguagu

SEQ ID NO: 2167337 - RNA, 18 nt, Homo sapiens
cagugccaggccagugac

SEQ ID NO: 2167338 - RNA, 21 nt, Homo sapiens
uggaccaccguucagucauuu

SEQ ID NO: 2167339 - RNA, 13 nt, Homo sapiens
aaacuuaacuuua

SEQ ID NO: 2167340 - RNA, 17 nt, Homo sapiens
gucuuacuuugugcaaa

SEQ ID NO: 2167341 - RNA, 20 nt, Homo sapiens
ccuggucgccaauccaugcu

SEQ ID NO: 2167342 - RNA, 16 nt, Homo sapiens
gcugauucaaaccaaa

SEQ ID NO: 2167343 - RNA, 23 nt, Homo sapiens
aauaagcaggcgugaccugccag

SEQ ID NO: 2167344 - RNA, 21 nt, Homo sapiens
cacacucauacacaugugcac

SEQ ID NO: 2167345 - RNA, 15 nt, Homo sapiens
ucuacaggcauuuaa

SEQ ID NO: 2167346 - RNA, 19 nt, Homo sapiens
cagcucgagcaugcccuga

SEQ ID NO: 2167347 - RNA, 20 nt, Homo sapiens
cuguaacacauaguggcuuc

SEQ ID NO: 2167348 - RNA, 15 nt, Homo sapiens
acaugagaaagggag

SEQ ID NO: 2167349 - RNA, 21 nt, Homo sapiens
auuuaaaauggaaagcugugu

SEQ ID NO: 2167350 - RNA, 16 nt, Homo sapiens
gacaggcaccaugcug

SEQ ID NO: 2167351 - RNA, 20 nt, Homo sapiens
guagguuggaagcuagcucc

SEQ ID NO: 2167352 - RNA, 15 nt, Homo sapiens
uccccucuguuuaca

SEQ ID NO: 2167353 - RNA, 19 nt, Homo sapiens
gagcucgcauuugucaaug

SEQ ID NO: 2167354 - RNA, 16 nt, Homo sapiens
auggagauagccccac

SEQ ID NO: 2167355 - RNA, 16 nt, Homo sapiens
uugugggggugucaca

SEQ ID NO: 2167356 - RNA, 18 nt, Homo sapiens
augaaagauucagugacg

SEQ ID NO: 2167357 - RNA, 20 nt, Homo sapiens
agcuuacaagccagcuggag

SEQ ID NO: 2167358 - RNA, 21 nt, Homo sapiens
caauuauagugucaugcagag

SEQ ID NO: 2167359 - RNA, 20 nt, Homo sapiens
agaguaaaccuugaagggcu

SEQ ID NO: 2167360 - RNA, 17 nt, Homo sapiens
cagagcaggaaugggaa

SEQ ID NO: 2167361 - RNA, 15 nt, Homo sapiens
cucucccugccaagu

SEQ ID NO: 2167362 - RNA, 14 nt, Homo sapiens
aaagcccagcuuga

SEQ ID NO: 2167363 - RNA, 21 nt, Homo sapiens
aaaugguucagaauuaaacuu

SEQ ID NO: 2167364 - RNA, 22 nt, Homo sapiens
cucucucccaacugcugcuuaa

SEQ ID NO: 2167365 - RNA, 14 nt, Homo sapiens
ggcccgccaccuug

SEQ ID NO: 2167366 - RNA, 19 nt, Homo sapiens
uucucuauuucuggaugaa

SEQ ID NO: 2167367 - RNA, 11 nt, Homo sapiens
cuaguuugcaa

SEQ ID NO: 2167368 - RNA, 16 nt, Homo sapiens
ucaaguugcuucucau

SEQ ID NO: 2167369 - RNA, 14 nt, Homo sapiens
augcugacauucac

SEQ ID NO: 2167370 - RNA, 20 nt, Homo sapiens
agucccuaaaaacacagaca

SEQ ID NO: 2167371 - RNA, 16 nt, Homo sapiens
uuaucagcaugaagaa

SEQ ID NO: 2167372 - RNA, 16 nt, Homo sapiens
uaaaaggcaagucaaa

SEQ ID NO: 2167373 - RNA, 20 nt, Homo sapiens
cugugugcaagugugugcac

SEQ ID NO: 2167374 - RNA, 22 nt, Homo sapiens
uauaaucuuccauacuucuuca

SEQ ID NO: 2167375 - RNA, 18 nt, Homo sapiens
cauucaacagagacugaa

SEQ ID NO: 2167376 - RNA, 13 nt, Homo sapiens
cuuugcagugggg

SEQ ID NO: 2167377 - RNA, 21 nt, Homo sapiens
uaaagaguacacucagccacu

SEQ ID NO: 2167378 - RNA, 15 nt, Homo sapiens
gcaagcuccaucucu

SEQ ID NO: 2167379 - RNA, 23 nt, Homo sapiens
auggcccaugggagccaggccca

SEQ ID NO: 2167380 - RNA, 20 nt, Homo sapiens
ugcagacucucucuuaucac

SEQ ID NO: 2167381 - RNA, 20 nt, Homo sapiens
aaagagcugcacagcaaaag

SEQ ID NO: 2167382 - RNA, 20 nt, Homo sapiens
ugucuugagguuuuguucau

SEQ ID NO: 2167383 - RNA, 19 nt, Homo sapiens
uagcuuagaccucagccug

SEQ ID NO: 2167384 - RNA, 15 nt, Homo sapiens
aucaagagaaucaac

SEQ ID NO: 2167385 - RNA, 19 nt, Homo sapiens
cucaccgggcuacuaccug

SEQ ID NO: 2167386 - RNA, 18 nt, Homo sapiens
uacgcaguuacugaaauc

SEQ ID NO: 2167387 - RNA, 19 nt, Homo sapiens
uuucuuuaacauaucauuc

SEQ ID NO: 2167388 - RNA, 21 nt, Homo sapiens
ucauggguuauguguaugugc

SEQ ID NO: 2167389 - RNA, 18 nt, Homo sapiens
gcagaugcuuuacaguca

SEQ ID NO: 2167390 - RNA, 19 nt, Homo sapiens
agucuuccagaaagcaagg

SEQ ID NO: 2167391 - RNA, 14 nt, Homo sapiens
aaccauucuggaca

SEQ ID NO: 2167392 - RNA, 18 nt, Homo sapiens
caucuucccacaguggcu

SEQ ID NO: 2167393 - RNA, 14 nt, Homo sapiens
aagaaaagaccuuu

SEQ ID NO: 2167394 - RNA, 12 nt, Homo sapiens
gcagggugaccc

SEQ ID NO: 2167395 - RNA, 16 nt, Homo sapiens
ucugcaucaaaggaga

SEQ ID NO: 2167396 - RNA, 13 nt, Homo sapiens
agaggaguucuuu

SEQ ID NO: 2167397 - RNA, 19 nt, Homo sapiens
caguuuacaaaugacaugg

SEQ ID NO: 2167398 - RNA, 23 nt, Homo sapiens
caggacacuaaugggaagaccaa

SEQ ID NO: 2167399 - RNA, 22 nt, Homo sapiens
caugugccagguuuuuggucug

SEQ ID NO: 2167400 - RNA, 16 nt, Homo sapiens
ugccccacuucuggca

SEQ ID NO: 2167401 - RNA, 15 nt, Homo sapiens
caccuagcaucucau

SEQ ID NO: 2167402 - RNA, 13 nt, Homo sapiens
gaagucacaucac

SEQ ID NO: 2167403 - RNA, 17 nt, Homo sapiens
aaauguugacauaccuu

SEQ ID NO: 2167404 - RNA, 20 nt, Homo sapiens
aauaacgucuuuuuauaucu

SEQ ID NO: 2167405 - RNA, 21 nt, Homo sapiens
augaugggaggugugccagaa

SEQ ID NO: 2167406 - RNA, 23 nt, Homo sapiens
acagccagugggagauguuagac

SEQ ID NO: 2167407 - RNA, 22 nt, Homo sapiens
uucacauucugggcugacucau

SEQ ID NO: 2167408 - RNA, 16 nt, Homo sapiens
ucacaaccagccacac

SEQ ID NO: 2167409 - RNA, 14 nt, Homo sapiens
acuucuguuccagg

SEQ ID NO: 2167410 - RNA, 21 nt, Homo sapiens
uccucauauggcccaguguca

SEQ ID NO: 2167411 - RNA, 21 nt, Homo sapiens
cuaaaugaaaaucgugacaac

SEQ ID NO: 2167412 - RNA, 15 nt, Homo sapiens
uggagcuaaaacugg

SEQ ID NO: 2167413 - RNA, 22 nt, Homo sapiens
uuucuucagagagcuaaauuac

SEQ ID NO: 2167414 - RNA, 19 nt, Homo sapiens
ccuguuaggccaacugccu

SEQ ID NO: 2167415 - RNA, 16 nt, Homo sapiens
aaccuauccuguucuu

SEQ ID NO: 2167416 - RNA, 13 nt, Homo sapiens
aagauuauacaau

SEQ ID NO: 2167417 - RNA, 13 nt, Homo sapiens
caaacaaaccauu

SEQ ID NO: 2167418 - RNA, 19 nt, Homo sapiens
acucugcggauagcauuug

SEQ ID NO: 2167419 - RNA, 13 nt, Homo sapiens
ucucugucucuca

SEQ ID NO: 2167420 - RNA, 13 nt, Homo sapiens
aaaaugugaacuu

SEQ ID NO: 2167421 - RNA, 13 nt, Homo sapiens
agaaugucagaaa

SEQ ID NO: 2167422 - RNA, 18 nt, Homo sapiens
uguggccaucaaccucug

SEQ ID NO: 2167423 - RNA, 16 nt, Homo sapiens
auauuugauacauaua

SEQ ID NO: 2167424 - RNA, 17 nt, Homo sapiens
cccccugaacacuguga

SEQ ID NO: 2167425 - RNA, 18 nt, Homo sapiens
auacagaugacaauggga

SEQ ID NO: 2167426 - RNA, 10 nt, Homo sapiens
cuacuuuaau

SEQ ID NO: 2167427 - RNA, 18 nt, Homo sapiens
uucaagauuaaacugagu

SEQ ID NO: 2167428 - RNA, 18 nt, Homo sapiens
ugccacuuuccaccaacu

SEQ ID NO: 2167429 - RNA, 18 nt, Homo sapiens
gguuugcaagaaugaaau

SEQ ID NO: 2167430 - RNA, 19 nt, Homo sapiens
uuaaacaugaaugaauucu

SEQ ID NO: 2167431 - RNA, 19 nt, Homo sapiens
aauggcacgaucucagcuc

SEQ ID NO: 2167432 - RNA, 22 nt, Homo sapiens
cuuaucugugcgugaaacacac

SEQ ID NO: 2167433 - RNA, 23 nt, Homo sapiens
gagauucuccauuacacgaucac

SEQ ID NO: 2167434 - RNA, 17 nt, Homo sapiens
aaaucugcaaacucuaa

SEQ ID NO: 2167435 - RNA, 22 nt, Homo sapiens
uugucuagaggugagaccaaag

SEQ ID NO: 2167436 - RNA, 11 nt, Homo sapiens
acccaccaucu

SEQ ID NO: 2167437 - RNA, 16 nt, Homo sapiens
cccacccugcugccuu

SEQ ID NO: 2167438 - RNA, 12 nt, Homo sapiens
uucauucaaaag

SEQ ID NO: 2167439 - RNA, 20 nt, Homo sapiens
gagcccgcagggccaugcag

SEQ ID NO: 2167440 - RNA, 23 nt, Homo sapiens
ugaagggaagugcaucugucagc

SEQ ID NO: 2167441 - RNA, 20 nt, Homo sapiens
ugccaaccucuggagcaaug

SEQ ID NO: 2167442 - RNA, 22 nt, Homo sapiens
cuaauccucaacaacaaaccaa

SEQ ID NO: 2167443 - RNA, 17 nt, Homo sapiens
auguuaacaccuaccuc

SEQ ID NO: 2167444 - RNA, 16 nt, Homo sapiens
uguuauuuauaguguu

SEQ ID NO: 2167445 - RNA, 11 nt, Homo sapiens
cagaacaguua

SEQ ID NO: 2167446 - RNA, 11 nt, Homo sapiens
uaaaacagcug

SEQ ID NO: 2167447 - RNA, 15 nt, Homo sapiens
uucaaaggugauuau

SEQ ID NO: 2167448 - RNA, 14 nt, Homo sapiens
auacuggcaaagca

SEQ ID NO: 2167449 - RNA, 17 nt, Homo sapiens
auggaaaacugccuguu

SEQ ID NO: 2167450 - RNA, 17 nt, Homo sapiens
gacaaaccgagugcaau

SEQ ID NO: 2167451 - RNA, 21 nt, Homo sapiens
aaugaacaaaccugugaucua

SEQ ID NO: 2167452 - RNA, 12 nt, Homo sapiens
cuggggccaaau

SEQ ID NO: 2167453 - RNA, 15 nt, Homo sapiens
aauuuaauuaccuua

SEQ ID NO: 2167454 - RNA, 19 nt, Homo sapiens
ccucucaucacugaaaucc

SEQ ID NO: 2167455 - RNA, 14 nt, Homo sapiens
ggagacacagggaa

SEQ ID NO: 2167456 - RNA, 23 nt, Homo sapiens
cuuuccuugugguugaaaaccac

SEQ ID NO: 2167457 - RNA, 18 nt, Homo sapiens
gaugugccaauaaccaag

SEQ ID NO: 2167458 - RNA, 22 nt, Homo sapiens
cuuuucaggguuuucugaggga

SEQ ID NO: 2167459 - RNA, 19 nt, Homo sapiens
uccacagaauacaagccac

SEQ ID NO: 2167460 - RNA, 22 nt, Homo sapiens
aucacugaaaacuaugcaagag

SEQ ID NO: 2167461 - RNA, 13 nt, Homo sapiens
agaaagagccuga

SEQ ID NO: 2167462 - RNA, 21 nt, Homo sapiens
cuuucaggggcugacucucca

SEQ ID NO: 2167463 - RNA, 21 nt, Homo sapiens
gaaaacauaacccacucuguc

SEQ ID NO: 2167464 - RNA, 15 nt, Homo sapiens
uaugggaaagacaug

SEQ ID NO: 2167465 - RNA, 16 nt, Homo sapiens
gcagugcuccauccaa

SEQ ID NO: 2167466 - RNA, 19 nt, Homo sapiens
uacauaaaguauccaugca

SEQ ID NO: 2167467 - RNA, 17 nt, Homo sapiens
guggccacagcgugcug

SEQ ID NO: 2167468 - RNA, 20 nt, Homo sapiens
cauaucguaaagcuguucaa

SEQ ID NO: 2167469 - RNA, 11 nt, Homo sapiens
cuguaccacaa

SEQ ID NO: 2167470 - RNA, 23 nt, Homo sapiens
augguccccugcccugucuuucc

SEQ ID NO: 2167471 - RNA, 18 nt, Homo sapiens
ucaccagaauugugcaaa

SEQ ID NO: 2167472 - RNA, 11 nt, Homo sapiens
cuagugccuuc

SEQ ID NO: 2167473 - RNA, 21 nt, Homo sapiens
cuggaucuaccagcauaaaua

SEQ ID NO: 2167474 - RNA, 14 nt, Homo sapiens
gacaagaacaaagc

SEQ ID NO: 2167475 - RNA, 16 nt, Homo sapiens
gaagugagaaguucau

SEQ ID NO: 2167476 - RNA, 16 nt, Homo sapiens
aagugccuuacagggu

SEQ ID NO: 2167477 - RNA, 21 nt, Homo sapiens
auaaagcuuucagguguuaca

SEQ ID NO: 2167478 - RNA, 22 nt, Homo sapiens
aagugccuuucaggaucuauuu

SEQ ID NO: 2167479 - RNA, 17 nt, Homo sapiens
uuugucuuggauauaua

SEQ ID NO: 2167480 - RNA, 14 nt, Homo sapiens
cagccuggccagac

SEQ ID NO: 2167481 - RNA, 15 nt, Homo sapiens
agaacaguugauuuc

SEQ ID NO: 2167482 - RNA, 14 nt, Homo sapiens
aggcagcgugggcu

SEQ ID NO: 2167483 - RNA, 21 nt, Homo sapiens
ugcuauaauuccgaaacauac

SEQ ID NO: 2167484 - RNA, 20 nt, Homo sapiens
cuucccaccuacugcacuuu

SEQ ID NO: 2167485 - RNA, 17 nt, Homo sapiens
aaaaauaaagcacuuau

SEQ ID NO: 2167486 - RNA, 23 nt, Homo sapiens
ccaaucuugcuuuguguaucuca

SEQ ID NO: 2167487 - RNA, 20 nt, Homo sapiens
cacuuaaaaauuaaauugga

SEQ ID NO: 2167488 - RNA, 16 nt, Homo sapiens
aucuuggggcugauga

SEQ ID NO: 2167489 - RNA, 18 nt, Homo sapiens
gccagucaugguggcaca

SEQ ID NO: 2167490 - RNA, 18 nt, Homo sapiens
ucuacuuuaaauugugga

SEQ ID NO: 2167491 - RNA, 19 nt, Homo sapiens
acgcggcuuuaagugugcu

SEQ ID NO: 2167492 - RNA, 22 nt, Homo sapiens
cuggaaaggaaagaugaugcuc

SEQ ID NO: 2167493 - RNA, 23 nt, Homo sapiens
cuguacaguuucuuccccaagag

SEQ ID NO: 2167494 - RNA, 22 nt, Homo sapiens
uucaagaucucauccaagcaaa

SEQ ID NO: 2167495 - RNA, 18 nt, Homo sapiens
accccuuguuucuauaca

SEQ ID NO: 2167496 - RNA, 16 nt, Homo sapiens
cuuauuuugcauucca

SEQ ID NO: 2167497 - RNA, 16 nt, Homo sapiens
cuuaccuugcaucuca

SEQ ID NO: 2167498 - RNA, 16 nt, Homo sapiens
ucaccgugacauucca

SEQ ID NO: 2167499 - RNA, 15 nt, Homo sapiens
ucacaucucaaggag

SEQ ID NO: 2167500 - RNA, 23 nt, Homo sapiens
ccugaguuggccaggcauggugg

SEQ ID NO: 2167501 - RNA, 23 nt, Homo sapiens
uaaaugcuauuuuuuauuuuacu

SEQ ID NO: 2167502 - RNA, 17 nt, Homo sapiens
uccaucuucccuacccu

SEQ ID NO: 2167503 - RNA, 17 nt, Homo sapiens
gaagauguuuugaaaug

SEQ ID NO: 2167504 - RNA, 22 nt, Homo sapiens
auaacaucucaccuucagucaa

SEQ ID NO: 2167505 - RNA, 22 nt, Homo sapiens
aagaucagagcugcagccaguc

SEQ ID NO: 2167506 - RNA, 20 nt, Homo sapiens
cuccaguccugccaccaccc

SEQ ID NO: 2167507 - RNA, 13 nt, Homo sapiens
uuuuauauagucu

SEQ ID NO: 2167508 - RNA, 16 nt, Homo sapiens
ugcugcggagcaagag

SEQ ID NO: 2167509 - RNA, 17 nt, Homo sapiens
caagagcguugucuacc

SEQ ID NO: 2167510 - RNA, 22 nt, Homo sapiens
agccauaagaaagcacuauuaa

SEQ ID NO: 2167511 - RNA, 19 nt, Homo sapiens
caaccuuuucccaaccaua

SEQ ID NO: 2167512 - RNA, 14 nt, Homo sapiens
ggauguaagccugg

SEQ ID NO: 2167513 - RNA, 19 nt, Homo sapiens
ucccagagggauugcugug

SEQ ID NO: 2167514 - RNA, 19 nt, Homo sapiens
uacaguuuauaaagccaag

SEQ ID NO: 2167515 - RNA, 18 nt, Homo sapiens
augagcacccauuccaaa

SEQ ID NO: 2167516 - RNA, 12 nt, Homo sapiens
guacaguauauu

SEQ ID NO: 2167517 - RNA, 17 nt, Homo sapiens
cuauuuugugaagccau

SEQ ID NO: 2167518 - RNA, 19 nt, Homo sapiens
acuaccucguucuugucuu

SEQ ID NO: 2167519 - RNA, 12 nt, Homo sapiens
gccggaugacag

SEQ ID NO: 2167520 - RNA, 19 nt, Homo sapiens
uacauauaucucugugucu

SEQ ID NO: 2167521 - RNA, 18 nt, Homo sapiens
caugauuaaugauuuagc

SEQ ID NO: 2167522 - RNA, 21 nt, Homo sapiens
cccccucagugaggaucuuca

SEQ ID NO: 2167523 - RNA, 15 nt, Homo sapiens
caaucuuacuuugua

SEQ ID NO: 2167524 - RNA, 21 nt, Homo sapiens
uggaaaugugaauaaguaaag

SEQ ID NO: 2167525 - RNA, 21 nt, Homo sapiens
auaugcacuuauucucaagaa

SEQ ID NO: 2167526 - RNA, 19 nt, Homo sapiens
caguagcaaacuuuucaca

SEQ ID NO: 2167527 - RNA, 19 nt, Homo sapiens
uuguaaauacugcuugacc

SEQ ID NO: 2167528 - RNA, 19 nt, Homo sapiens
agugcuaauuuaguucuca

SEQ ID NO: 2167529 - RNA, 12 nt, Homo sapiens
uuagaaacugag

SEQ ID NO: 2167530 - RNA, 19 nt, Homo sapiens
cuucaccccuauggugcuc

SEQ ID NO: 2167531 - RNA, 13 nt, Homo sapiens
agggacuggcaca

SEQ ID NO: 2167532 - RNA, 20 nt, Homo sapiens
cuacuuuauuugccuaaaua

SEQ ID NO: 2167533 - RNA, 19 nt, Homo sapiens
caaaguucaaaaauauuca

SEQ ID NO: 2167534 - RNA, 17 nt, Homo sapiens
aaagccucuucaaaaag

SEQ ID NO: 2167535 - RNA, 16 nt, Homo sapiens
acugcuugugcacugg

SEQ ID NO: 2167536 - RNA, 18 nt, Homo sapiens
gaccacaccaaccaggcc

SEQ ID NO: 2167537 - RNA, 22 nt, Homo sapiens
ucaguauuccaaacucuccagc

SEQ ID NO: 2167538 - RNA, 19 nt, Homo sapiens
acaauaaacaucugagcag

SEQ ID NO: 2167539 - RNA, 11 nt, Homo sapiens
aaaaaugauuu

SEQ ID NO: 2167540 - RNA, 12 nt, Homo sapiens
uuccaagacaga

SEQ ID NO: 2167541 - RNA, 16 nt, Homo sapiens
aacuccuuggccuagc

SEQ ID NO: 2167542 - RNA, 16 nt, Homo sapiens
uuucauaccacuugaa

SEQ ID NO: 2167543 - RNA, 23 nt, Homo sapiens
aaaccuguauaacccuguuacaa

SEQ ID NO: 2167544 - RNA, 23 nt, Homo sapiens
uacauauuguggaauugacucaa

SEQ ID NO: 2167545 - RNA, 13 nt, Homo sapiens
aggugacacucca

SEQ ID NO: 2167546 - RNA, 18 nt, Homo sapiens
ggccaaauaugcacuuuc

SEQ ID NO: 2167547 - RNA, 23 nt, Homo sapiens
agagauuggaaugggcagcucau

SEQ ID NO: 2167548 - RNA, 23 nt, Homo sapiens
ggaggcugaagcaggagauuugc

SEQ ID NO: 2167549 - RNA, 18 nt, Homo sapiens
aaaucuauagaacugaau

SEQ ID NO: 2167550 - RNA, 18 nt, Homo sapiens
ccuuaccuaaaucuguuu

SEQ ID NO: 2167551 - RNA, 19 nt, Homo sapiens
auucuaagcccuuugccau

SEQ ID NO: 2167552 - RNA, 16 nt, Homo sapiens
ggcccauaucugugaa

SEQ ID NO: 2167553 - RNA, 13 nt, Homo sapiens
ucccacuuggcau

SEQ ID NO: 2167554 - RNA, 19 nt, Homo sapiens
cagccuuuuucaccauggc

SEQ ID NO: 2167555 - RNA, 16 nt, Homo sapiens
augcaaucagacaagu

SEQ ID NO: 2167556 - RNA, 18 nt, Homo sapiens
uuagccgacugcgcugcu

SEQ ID NO: 2167557 - RNA, 22 nt, Homo sapiens
uucagauccuuuuauucuccag

SEQ ID NO: 2167558 - RNA, 17 nt, Homo sapiens
cuaucccuaacaggcug

SEQ ID NO: 2167559 - RNA, 21 nt, Homo sapiens
aaacauagacugaagauuuau

SEQ ID NO: 2167560 - RNA, 21 nt, Homo sapiens
cagugagccaagaucacgcca

SEQ ID NO: 2167561 - RNA, 17 nt, Homo sapiens
aagaaagcuaucucuga

SEQ ID NO: 2167562 - RNA, 18 nt, Homo sapiens
ucaagcuuuccgagucaa

SEQ ID NO: 2167563 - RNA, 17 nt, Homo sapiens
ucaagggcuuacuauuu

SEQ ID NO: 2167564 - RNA, 13 nt, Homo sapiens
gacucuaacagua

SEQ ID NO: 2167565 - RNA, 12 nt, Homo sapiens
ccaaacaccagu

SEQ ID NO: 2167566 - RNA, 21 nt, Homo sapiens
cacccuccugccccacacucc

SEQ ID NO: 2167567 - RNA, 22 nt, Homo sapiens
aaacaccguguuuucugacaca

SEQ ID NO: 2167568 - RNA, 11 nt, Homo sapiens
uggugucaaau

SEQ ID NO: 2167569 - RNA, 11 nt, Homo sapiens
gcuuuugccau

SEQ ID NO: 2167570 - RNA, 21 nt, Homo sapiens
auaacuuaaaaaaaugacaga

SEQ ID NO: 2167571 - RNA, 22 nt, Homo sapiens
cuaguagcuuuccucccaaagg

SEQ ID NO: 2167572 - RNA, 13 nt, Homo sapiens
auuuauaacaauu

SEQ ID NO: 2167573 - RNA, 18 nt, Homo sapiens
cccuccucccuccaagcc

SEQ ID NO: 2167574 - RNA, 20 nt, Homo sapiens
aauccugucauauaauaaaa

SEQ ID NO: 2167575 - RNA, 19 nt, Homo sapiens
caugcacagcuaacaugga

SEQ ID NO: 2167576 - RNA, 21 nt, Homo sapiens
accucuuaaagaaaacccacc

SEQ ID NO: 2167577 - RNA, 22 nt, Homo sapiens
uuacagguguacuauggcugua

SEQ ID NO: 2167578 - RNA, 19 nt, Homo sapiens
auucuaaaaaugguuauca

SEQ ID NO: 2167579 - RNA, 16 nt, Homo sapiens
uggauuuuuuaaauca

SEQ ID NO: 2167580 - RNA, 19 nt, Homo sapiens
aaauagcaugccuuucucu

SEQ ID NO: 2167581 - RNA, 14 nt, Homo sapiens
auauuaucauaaca

SEQ ID NO: 2167582 - RNA, 14 nt, Homo sapiens
uuucagagugacac

SEQ ID NO: 2167583 - RNA, 13 nt, Homo sapiens
aaaauaagccaca

SEQ ID NO: 2167584 - RNA, 13 nt, Homo sapiens
aauaaaagccucu

SEQ ID NO: 2167585 - RNA, 15 nt, Homo sapiens
acagucaaggugaua

SEQ ID NO: 2167586 - RNA, 22 nt, Homo sapiens
uauucaggaaauguucacugaa

SEQ ID NO: 2167587 - RNA, 15 nt, Homo sapiens
uuaaagaggcugugu

SEQ ID NO: 2167588 - RNA, 20 nt, Homo sapiens
cccuauuugauaugcugucc

SEQ ID NO: 2167589 - RNA, 23 nt, Homo sapiens
guuucugugaccuguaguguacc

SEQ ID NO: 2167590 - RNA, 17 nt, Homo sapiens
aaagaugucccacaggg

SEQ ID NO: 2167591 - RNA, 22 nt, Homo sapiens
uauaacuagacaucugcuguua

SEQ ID NO: 2167592 - RNA, 22 nt, Homo sapiens
aacaaacacuuagcaucccaca

SEQ ID NO: 2167593 - RNA, 18 nt, Homo sapiens
gccuugaaacaguuccau

SEQ ID NO: 2167594 - RNA, 22 nt, Homo sapiens
aauagaaggauguacauuucca

SEQ ID NO: 2167595 - RNA, 15 nt, Homo sapiens
auuacaggugugagc

SEQ ID NO: 2167596 - RNA, 13 nt, Homo sapiens
ugccaaacagccc

SEQ ID NO: 2167597 - RNA, 18 nt, Homo sapiens
aggugacaaaaggcagaa

SEQ ID NO: 2167598 - RNA, 17 nt, Homo sapiens
cuauucugauuacacaa

SEQ ID NO: 2167599 - RNA, 21 nt, Homo sapiens
agcucucaugaugcuacccga

SEQ ID NO: 2167600 - RNA, 21 nt, Homo sapiens
uagucgcccuacagaaaaccc

SEQ ID NO: 2167601 - RNA, 21 nt, Homo sapiens
uauggcuuuucacaugggcuu

SEQ ID NO: 2167602 - RNA, 21 nt, Homo sapiens
cucccugcucuauccugaaua

SEQ ID NO: 2167603 - RNA, 22 nt, Homo sapiens
auccccagggacagaaaccaag

SEQ ID NO: 2167604 - RNA, 18 nt, Homo sapiens
uguuccaaagccagugaa

SEQ ID NO: 2167605 - RNA, 18 nt, Homo sapiens
ucuagauagcugacucau

SEQ ID NO: 2167606 - RNA, 21 nt, Homo sapiens
uagcauugggaggaagcucag

SEQ ID NO: 2167607 - RNA, 15 nt, Homo sapiens
ccuucaaaacacuca

SEQ ID NO: 2167608 - RNA, 22 nt, Homo sapiens
uugaaacaacuuucucuuguaa

SEQ ID NO: 2167609 - RNA, 20 nt, Homo sapiens
gccuguaaucccagcuacuu

SEQ ID NO: 2167610 - RNA, 23 nt, Homo sapiens
uuguagaaauuaacaaaugugcu

SEQ ID NO: 2167611 - RNA, 14 nt, Homo sapiens
auugcaucaguuca

SEQ ID NO: 2167612 - RNA, 22 nt, Homo sapiens
auaggaagauaugccacuaacu

SEQ ID NO: 2167613 - RNA, 19 nt, Homo sapiens
cccacuuggcaucauucac

SEQ ID NO: 2167614 - RNA, 16 nt, Homo sapiens
uugugugaaaauguga

SEQ ID NO: 2167615 - RNA, 21 nt, Homo sapiens
agaauguauggagaguuacau

SEQ ID NO: 2167616 - RNA, 14 nt, Homo sapiens
auaaagcagcguuu

SEQ ID NO: 2167617 - RNA, 17 nt, Homo sapiens
gcuguggacacugagaa

SEQ ID NO: 2167618 - RNA, 14 nt, Homo sapiens
ugugauuagugucu

SEQ ID NO: 2167619 - RNA, 12 nt, Homo sapiens
uuuugcucugcc

SEQ ID NO: 2167620 - RNA, 22 nt, Homo sapiens
cgccacauagguaaaaacugga

SEQ ID NO: 2167621 - RNA, 20 nt, Homo sapiens
cuuuguaaagcauccucuac

SEQ ID NO: 2167622 - RNA, 23 nt, Homo sapiens
ggagcaaaggcugagaacacugu

SEQ ID NO: 2167623 - RNA, 16 nt, Homo sapiens
caguaucccacaucca

SEQ ID NO: 2167624 - RNA, 18 nt, Homo sapiens
cacagcaaggaaauucac

SEQ ID NO: 2167625 - RNA, 19 nt, Homo sapiens
gccacagggccuuuggcag

SEQ ID NO: 2167626 - RNA, 17 nt, Homo sapiens
uuuacagagaacagaaa

SEQ ID NO: 2167627 - RNA, 19 nt, Homo sapiens
ucaagggacaaguauuaau

SEQ ID NO: 2167628 - RNA, 13 nt, Homo sapiens
acacaguguuuca

SEQ ID NO: 2167629 - RNA, 15 nt, Homo sapiens
uuaauuaaaaagaau

SEQ ID NO: 2167630 - RNA, 23 nt, Homo sapiens
aaacauucauauuugcaauaaaa

SEQ ID NO: 2167631 - RNA, 16 nt, Homo sapiens
agauacauauacugau

SEQ ID NO: 2167632 - RNA, 21 nt, Homo sapiens
auguggagcucagcaacaagg

SEQ ID NO: 2167633 - RNA, 21 nt, Homo sapiens
aacauuucuaacucugaugua

SEQ ID NO: 2167634 - RNA, 21 nt, Homo sapiens
ucaggucuguaugucauggau

SEQ ID NO: 2167635 - RNA, 14 nt, Homo sapiens
agugcucaauagcu

SEQ ID NO: 2167636 - RNA, 16 nt, Homo sapiens
aaauauuuggucucua

SEQ ID NO: 2167637 - RNA, 19 nt, Homo sapiens
aacgucuaggaaaucuaga

SEQ ID NO: 2167638 - RNA, 16 nt, Homo sapiens
accaggagagcccugg

SEQ ID NO: 2167639 - RNA, 18 nt, Homo sapiens
augcacagcuaacaugga

SEQ ID NO: 2167640 - RNA, 22 nt, Homo sapiens
aaauauuuaaaaaaaaacauuc

SEQ ID NO: 2167641 - RNA, 17 nt, Homo sapiens
aagcagaaagugccuuu

SEQ ID NO: 2167642 - RNA, 17 nt, Homo sapiens
ucuucaaccucauugac

SEQ ID NO: 2167643 - RNA, 17 nt, Homo sapiens
aggcuguuguuggcuua

SEQ ID NO: 2167644 - RNA, 17 nt, Homo sapiens
aggucgagacauuccug

SEQ ID NO: 2167645 - RNA, 16 nt, Homo sapiens
auuuccuuagugccag

SEQ ID NO: 2167646 - RNA, 20 nt, Homo sapiens
aggccaggcgugguggcuca

SEQ ID NO: 2167647 - RNA, 12 nt, Homo sapiens
ucuccacugcuc

SEQ ID NO: 2167648 - RNA, 12 nt, Homo sapiens
gaaucacuuaau

SEQ ID NO: 2167649 - RNA, 12 nt, Homo sapiens
ugggcacugggg

SEQ ID NO: 2167650 - RNA, 17 nt, Homo sapiens
acucauccguuugccaa

SEQ ID NO: 2167651 - RNA, 23 nt, Homo sapiens
aaggcaccuauaaaacaggucaa

SEQ ID NO: 2167652 - RNA, 15 nt, Homo sapiens
caguccaggccucuc

SEQ ID NO: 2167653 - RNA, 18 nt, Homo sapiens
ugagagcucuucagagau

SEQ ID NO: 2167654 - RNA, 20 nt, Homo sapiens
ugagucugcuuucacuguga

SEQ ID NO: 2167655 - RNA, 23 nt, Homo sapiens
acuggcuccaugauucucugagu

SEQ ID NO: 2167656 - RNA, 16 nt, Homo sapiens
acaaauuuuucaaauc

SEQ ID NO: 2167657 - RNA, 20 nt, Homo sapiens
uccacacucaguagaaggag

SEQ ID NO: 2167658 - RNA, 16 nt, Homo sapiens
cuguggucacuuguac

SEQ ID NO: 2167659 - RNA, 21 nt, Homo sapiens
ccgacaggcaugcaccagugc

SEQ ID NO: 2167660 - RNA, 21 nt, Homo sapiens
cuuccaacugcugccccaaag

SEQ ID NO: 2167661 - RNA, 18 nt, Homo sapiens
aauggcccaggucucuca

SEQ ID NO: 2167662 - RNA, 19 nt, Homo sapiens
gagguuguggagaaaaaga

SEQ ID NO: 2167663 - RNA, 22 nt, Homo sapiens
uaaaauaggaaccuaugaaacu

SEQ ID NO: 2167664 - RNA, 15 nt, Homo sapiens
uggcucaacacauga

SEQ ID NO: 2167665 - RNA, 19 nt, Homo sapiens
augaucuaugcuauauuca

SEQ ID NO: 2167666 - RNA, 17 nt, Homo sapiens
ugcagugcuccauccaa

SEQ ID NO: 2167667 - RNA, 21 nt, Homo sapiens
gaucauuuguuggaaugaauu

SEQ ID NO: 2167668 - RNA, 22 nt, Homo sapiens
ugaauagaaguuuuccugauaa

SEQ ID NO: 2167669 - RNA, 13 nt, Homo sapiens
aguucucacuguu

SEQ ID NO: 2167670 - RNA, 13 nt, Homo sapiens
aggaugaacaguu

SEQ ID NO: 2167671 - RNA, 18 nt, Homo sapiens
acaaacugaacacugcag

SEQ ID NO: 2167672 - RNA, 16 nt, Homo sapiens
acauaccuucaugugg

SEQ ID NO: 2167673 - RNA, 20 nt, Homo sapiens
guccugaaaguaacucauaa

SEQ ID NO: 2167674 - RNA, 16 nt, Homo sapiens
ccuccuggguuuacuc

SEQ ID NO: 2167675 - RNA, 18 nt, Homo sapiens
ggcccucgggcccucucu

SEQ ID NO: 2167676 - RNA, 23 nt, Homo sapiens
ucacacugggacuugcaaaaagg

SEQ ID NO: 2167677 - RNA, 15 nt, Homo sapiens
ccaacuagaagccua

SEQ ID NO: 2167678 - RNA, 22 nt, Homo sapiens
acgagcaggcuacugucagcuc

SEQ ID NO: 2167679 - RNA, 21 nt, Homo sapiens
cuauuuaaaggaaaaucacau

SEQ ID NO: 2167680 - RNA, 19 nt, Homo sapiens
acauuucauuaaccaaaga

SEQ ID NO: 2167681 - RNA, 18 nt, Homo sapiens
aucuugccuccaggugca

SEQ ID NO: 2167682 - RNA, 23 nt, Homo sapiens
cacuugggccacacuacccaccu

SEQ ID NO: 2167683 - RNA, 14 nt, Homo sapiens
auccgcgugugccu

SEQ ID NO: 2167684 - RNA, 13 nt, Homo sapiens
acaauucuuuaaa

SEQ ID NO: 2167685 - RNA, 17 nt, Homo sapiens
auauuccuuucuaucau

SEQ ID NO: 2167686 - RNA, 21 nt, Homo sapiens
augcacacacacagaugucuu

SEQ ID NO: 2167687 - RNA, 22 nt, Homo sapiens
ccucaugaucauucucagugag

SEQ ID NO: 2167688 - RNA, 14 nt, Homo sapiens
gccugggagggcaa

SEQ ID NO: 2167689 - RNA, 11 nt, Homo sapiens
gagggucccaa

SEQ ID NO: 2167690 - RNA, 12 nt, Homo sapiens
auccucuugcca

SEQ ID NO: 2167691 - RNA, 23 nt, Homo sapiens
ggagccugggauuucuaugcagu

SEQ ID NO: 2167692 - RNA, 21 nt, Homo sapiens
ugaagcaagugaggccugaca

SEQ ID NO: 2167693 - RNA, 15 nt, Homo sapiens
ucaaugccugucuua

SEQ ID NO: 2167694 - RNA, 16 nt, Homo sapiens
ucaugcuucuacucca

SEQ ID NO: 2167695 - RNA, 15 nt, Homo sapiens
ggguuaggaagaaaa

SEQ ID NO: 2167696 - RNA, 14 nt, Homo sapiens
uggaaaauggugau

SEQ ID NO: 2167697 - RNA, 19 nt, Homo sapiens
ugggacggcccaucuuggc

SEQ ID NO: 2167698 - RNA, 16 nt, Homo sapiens
ugccuugccaugucuu

SEQ ID NO: 2167699 - RNA, 22 nt, Homo sapiens
ugagagaaaauacuauuucaag

SEQ ID NO: 2167700 - RNA, 18 nt, Homo sapiens
cuguucccuguucuggua

SEQ ID NO: 2167701 - RNA, 22 nt, Homo sapiens
gaacaugcccacaacuugucac

SEQ ID NO: 2167702 - RNA, 13 nt, Homo sapiens
cggccacagcacu

SEQ ID NO: 2167703 - RNA, 18 nt, Homo sapiens
agcugagaucgugccacu

SEQ ID NO: 2167704 - RNA, 21 nt, Homo sapiens
gggugucaauaaagcugugcu

SEQ ID NO: 2167705 - RNA, 16 nt, Homo sapiens
caaaggaagaacaucu

SEQ ID NO: 2167706 - RNA, 15 nt, Homo sapiens
uggaaucacagccaa

SEQ ID NO: 2167707 - RNA, 22 nt, Homo sapiens
uguacaggacauguacugagac

SEQ ID NO: 2167708 - RNA, 23 nt, Homo sapiens
uccgggaacuuugcagcauacca

SEQ ID NO: 2167709 - RNA, 20 nt, Homo sapiens
gugaggcaucucucugggau

SEQ ID NO: 2167710 - RNA, 16 nt, Homo sapiens
agaacucaugugauuu

SEQ ID NO: 2167711 - RNA, 13 nt, Homo sapiens
cccaaacccagcc

SEQ ID NO: 2167712 - RNA, 17 nt, Homo sapiens
acugguuguugccaaac

SEQ ID NO: 2167713 - RNA, 19 nt, Homo sapiens
gaaguuaucaacaugcaca

SEQ ID NO: 2167714 - RNA, 16 nt, Homo sapiens
cuugaaacugagaugu

SEQ ID NO: 2167715 - RNA, 21 nt, Homo sapiens
aguaacacccccaucaccuuc

SEQ ID NO: 2167716 - RNA, 11 nt, Homo sapiens
ggacacugggc

SEQ ID NO: 2167717 - RNA, 11 nt, Homo sapiens
acacacugacc

SEQ ID NO: 2167718 - RNA, 13 nt, Homo sapiens
caauuucuuccuu

SEQ ID NO: 2167719 - RNA, 14 nt, Homo sapiens
uguuggugcuuuag

SEQ ID NO: 2167720 - RNA, 22 nt, Homo sapiens
cccaccaugcaccccugauguu

SEQ ID NO: 2167721 - RNA, 23 nt, Homo sapiens
agaaagggguggaaacauaggga

SEQ ID NO: 2167722 - RNA, 23 nt, Homo sapiens
ccauuucucagcaucgugcuguu

SEQ ID NO: 2167723 - RNA, 19 nt, Homo sapiens
guaucaaauguaacuuacu

SEQ ID NO: 2167724 - RNA, 15 nt, Homo sapiens
agggcaggcuugcca

SEQ ID NO: 2167725 - RNA, 13 nt, Homo sapiens
gcuagaacauucc

SEQ ID NO: 2167726 - RNA, 14 nt, Homo sapiens
uaaagcugaaauuu

SEQ ID NO: 2167727 - RNA, 16 nt, Homo sapiens
guuggaugaugagcag

SEQ ID NO: 2167728 - RNA, 17 nt, Homo sapiens
acaccuaggucgccagu

SEQ ID NO: 2167729 - RNA, 22 nt, Homo sapiens
agcagucacugacaguuaauaa

SEQ ID NO: 2167730 - RNA, 16 nt, Homo sapiens
gcugucauuccaugag

SEQ ID NO: 2167731 - RNA, 21 nt, Homo sapiens
cccagcgacacagaagggggu

SEQ ID NO: 2167732 - RNA, 18 nt, Homo sapiens
cuucaaauuggucugaaa

SEQ ID NO: 2167733 - RNA, 13 nt, Homo sapiens
auuuucaucacug

SEQ ID NO: 2167734 - RNA, 11 nt, Homo sapiens
uggccuuggcc

SEQ ID NO: 2167735 - RNA, 13 nt, Homo sapiens
aucuagcaauuuc

SEQ ID NO: 2167736 - RNA, 13 nt, Homo sapiens
aaaggcuguuaaa

SEQ ID NO: 2167737 - RNA, 15 nt, Homo sapiens
ugccucaaccuccca

SEQ ID NO: 2167738 - RNA, 15 nt, Homo sapiens
ugccuucaccuccuc

SEQ ID NO: 2167739 - RNA, 21 nt, Homo sapiens
gcuuugugccaucacugagca

SEQ ID NO: 2167740 - RNA, 16 nt, Homo sapiens
cuugucucugguguuc

SEQ ID NO: 2167741 - RNA, 18 nt, Homo sapiens
gcccaaggagcuuaccca

SEQ ID NO: 2167742 - RNA, 17 nt, Homo sapiens
cuagaccagaggacaua

SEQ ID NO: 2167743 - RNA, 16 nt, Homo sapiens
ggacgcacagugcagu

SEQ ID NO: 2167744 - RNA, 14 nt, Homo sapiens
ugcauuacuuugaa

SEQ ID NO: 2167745 - RNA, 23 nt, Homo sapiens
cuccagccaccacccacaaucac

SEQ ID NO: 2167746 - RNA, 14 nt, Homo sapiens
guuucaaaccagga

SEQ ID NO: 2167747 - RNA, 20 nt, Homo sapiens
accucagccaaacacagagc

SEQ ID NO: 2167748 - RNA, 19 nt, Homo sapiens
uaacaaacaagagaagcuu

SEQ ID NO: 2167749 - RNA, 18 nt, Homo sapiens
agacauacagagauauac

SEQ ID NO: 2167750 - RNA, 22 nt, Homo sapiens
ucuagacacugccacacagggu

SEQ ID NO: 2167751 - RNA, 11 nt, Homo sapiens
aguccuacuca

SEQ ID NO: 2167752 - RNA, 15 nt, Homo sapiens
cccagucccauuccu

SEQ ID NO: 2167753 - RNA, 18 nt, Homo sapiens
aagcugaugguuggaaga

SEQ ID NO: 2167754 - RNA, 22 nt, Homo sapiens
gagaagugauauggugaaggga

SEQ ID NO: 2167755 - RNA, 16 nt, Homo sapiens
uauaauguucacuaau

SEQ ID NO: 2167756 - RNA, 18 nt, Homo sapiens
acaagucauuccaugaag

SEQ ID NO: 2167757 - RNA, 21 nt, Homo sapiens
ugggccggcugaguggcagca

SEQ ID NO: 2167758 - RNA, 10 nt, Homo sapiens
acacuccacu

SEQ ID NO: 2167759 - RNA, 23 nt, Homo sapiens
agauuauuaucuauuaucucaau

SEQ ID NO: 2167760 - RNA, 15 nt, Homo sapiens
caugcuuugcucuca

SEQ ID NO: 2167761 - RNA, 15 nt, Homo sapiens
uaauauuuaggcaag

SEQ ID NO: 2167762 - RNA, 17 nt, Homo sapiens
agguuucccccugucuc

SEQ ID NO: 2167763 - RNA, 14 nt, Homo sapiens
uguccaggcagcuc

SEQ ID NO: 2167764 - RNA, 23 nt, Homo sapiens
aaacuguucuuuugcauuuugcc

SEQ ID NO: 2167765 - RNA, 21 nt, Homo sapiens
ucacuccugccuccucagcuu

SEQ ID NO: 2167766 - RNA, 18 nt, Homo sapiens
cagggaacucuggcauuc

SEQ ID NO: 2167767 - RNA, 13 nt, Homo sapiens
ggccucccuagca

SEQ ID NO: 2167768 - RNA, 14 nt, Homo sapiens
ggccuaguacaauc

SEQ ID NO: 2167769 - RNA, 13 nt, Homo sapiens
auuauuuaacucu

SEQ ID NO: 2167770 - RNA, 20 nt, Homo sapiens
acaguuaagagaaaugagcu

SEQ ID NO: 2167771 - RNA, 16 nt, Homo sapiens
gaaaauugaaugcaaa

SEQ ID NO: 2167772 - RNA, 23 nt, Homo sapiens
aagguccaacaagaaugcauucc

SEQ ID NO: 2167773 - RNA, 23 nt, Homo sapiens
caggcuggguugucacugagacu

SEQ ID NO: 2167774 - RNA, 17 nt, Homo sapiens
gucccaguuaacuguua

SEQ ID NO: 2167775 - RNA, 15 nt, Homo sapiens
acaucuaagccuguu

SEQ ID NO: 2167776 - RNA, 12 nt, Homo sapiens
ucacugccaacg

SEQ ID NO: 2167777 - RNA, 21 nt, Homo sapiens
agucucacuuuuauugauaaa

SEQ ID NO: 2167778 - RNA, 18 nt, Homo sapiens
uuuagggcagcuugcccc

SEQ ID NO: 2167779 - RNA, 15 nt, Homo sapiens
ucacccuuaacccaa

SEQ ID NO: 2167780 - RNA, 21 nt, Homo sapiens
cccaugaaucaaagacaugga

SEQ ID NO: 2167781 - RNA, 15 nt, Homo sapiens
ccagagcaucugccc

SEQ ID NO: 2167782 - RNA, 12 nt, Homo sapiens
ucagcugcaugg

SEQ ID NO: 2167783 - RNA, 13 nt, Homo sapiens
gccguacugucua

SEQ ID NO: 2167784 - RNA, 14 nt, Homo sapiens
ugaaggggccauga

SEQ ID NO: 2167785 - RNA, 11 nt, Homo sapiens
augugccugua

SEQ ID NO: 2167786 - RNA, 21 nt, Homo sapiens
aggcacaaaccuuacuaugga

SEQ ID NO: 2167787 - RNA, 15 nt, Homo sapiens
cuucagcacauucca

SEQ ID NO: 2167788 - RNA, 20 nt, Homo sapiens
aaggaccugcucccacaggg

SEQ ID NO: 2167789 - RNA, 22 nt, Homo sapiens
agccugauuauccuauaggcag

SEQ ID NO: 2167790 - RNA, 13 nt, Homo sapiens
cagccaucaaggg

SEQ ID NO: 2167791 - RNA, 14 nt, Homo sapiens
auugauuaccaagu

SEQ ID NO: 2167792 - RNA, 13 nt, Homo sapiens
accuugcauguaa

SEQ ID NO: 2167793 - RNA, 20 nt, Homo sapiens
gucccaucgguagcuugaaa

SEQ ID NO: 2167794 - RNA, 21 nt, Homo sapiens
ccaacauagagccgggugucc

SEQ ID NO: 2167795 - RNA, 15 nt, Homo sapiens
acaggcucugagauu

SEQ ID NO: 2167796 - RNA, 16 nt, Homo sapiens
auuuuacuuugugcaa

SEQ ID NO: 2167797 - RNA, 19 nt, Homo sapiens
acaguuccccuauguggaa

SEQ ID NO: 2167798 - RNA, 18 nt, Homo sapiens
uuuacaugaguucaaaua

SEQ ID NO: 2167799 - RNA, 15 nt, Homo sapiens
ucuucccgcaaauca

SEQ ID NO: 2167800 - RNA, 15 nt, Homo sapiens
uagguagaugaacua

SEQ ID NO: 2167801 - RNA, 17 nt, Homo sapiens
uaaaguuuuaacuuuua

SEQ ID NO: 2167802 - RNA, 19 nt, Homo sapiens
uccacauccugugggaccu

SEQ ID NO: 2167803 - RNA, 20 nt, Homo sapiens
aagaaaugauggaaguucau

SEQ ID NO: 2167804 - RNA, 12 nt, Homo sapiens
aucccagugugu

SEQ ID NO: 2167805 - RNA, 15 nt, Homo sapiens
ggggcucuguggcaa

SEQ ID NO: 2167806 - RNA, 21 nt, Homo sapiens
auuuaacauaaugguugugaa

SEQ ID NO: 2167807 - RNA, 14 nt, Homo sapiens
aauaaauaucugua

SEQ ID NO: 2167808 - RNA, 19 nt, Homo sapiens
cagucucacccacuaggau

SEQ ID NO: 2167809 - RNA, 17 nt, Homo sapiens
guguguauuuagugaaa

SEQ ID NO: 2167810 - RNA, 19 nt, Homo sapiens
cagcaaaacaacggaugaa

SEQ ID NO: 2167811 - RNA, 13 nt, Homo sapiens
caaagaaauccuc

SEQ ID NO: 2167812 - RNA, 22 nt, Homo sapiens
ugucccagcgauggugccugcu

SEQ ID NO: 2167813 - RNA, 19 nt, Homo sapiens
uccagugcaguagugccaa

SEQ ID NO: 2167814 - RNA, 15 nt, Homo sapiens
uaaccucacugccuc

SEQ ID NO: 2167815 - RNA, 21 nt, Homo sapiens
gucucuagaagugccaucuca

SEQ ID NO: 2167816 - RNA, 21 nt, Homo sapiens
caggacuucucaccagcaguc

SEQ ID NO: 2167817 - RNA, 21 nt, Homo sapiens
ugaaauaagccagacaucaac

SEQ ID NO: 2167818 - RNA, 22 nt, Homo sapiens
aaagagccuucagaaugcuccu

SEQ ID NO: 2167819 - RNA, 20 nt, Homo sapiens
cucccucaggcucuguggag

SEQ ID NO: 2167820 - RNA, 23 nt, Homo sapiens
gcuccagggcagccuccaccuug

SEQ ID NO: 2167821 - RNA, 15 nt, Homo sapiens
cauaaccccuugaaa

SEQ ID NO: 2167822 - RNA, 24 nt, Homo sapiens
ggcucccaugucaagagucgcugu

SEQ ID NO: 2167823 - RNA, 17 nt, Homo sapiens
gcaaaaagauuuacuuu

SEQ ID NO: 2167824 - RNA, 15 nt, Homo sapiens
cccugggauggcuca

SEQ ID NO: 2167825 - RNA, 13 nt, Homo sapiens
gaaccgugacauc

SEQ ID NO: 2167826 - RNA, 23 nt, Homo sapiens
ucgaccauaaaggguguaggggc

SEQ ID NO: 2167827 - RNA, 22 nt, Homo sapiens
uaaugcuuucccacucucaggg

SEQ ID NO: 2167828 - RNA, 22 nt, Homo sapiens
gccuuaccuccugcccaggaga

SEQ ID NO: 2167829 - RNA, 17 nt, Homo sapiens
acuuuaaaagugaucua

SEQ ID NO: 2167830 - RNA, 20 nt, Homo sapiens
acuucaucucaauagugauu

SEQ ID NO: 2167831 - RNA, 19 nt, Homo sapiens
agacaagucuugcugugcu

SEQ ID NO: 2167832 - RNA, 21 nt, Homo sapiens
gcccagcucauguaggugagc

SEQ ID NO: 2167833 - RNA, 14 nt, Homo sapiens
ccacuccuguacac

SEQ ID NO: 2167834 - RNA, 17 nt, Homo sapiens
aggcauuuagcccucac

SEQ ID NO: 2167835 - RNA, 15 nt, Homo sapiens
aaagaggccaaacag

SEQ ID NO: 2167836 - RNA, 15 nt, Homo sapiens
acaaaggcccagcag

SEQ ID NO: 2167837 - RNA, 16 nt, Homo sapiens
uggcccugcagggucc

SEQ ID NO: 2167838 - RNA, 17 nt, Homo sapiens
ccucaaaccacuugccu

SEQ ID NO: 2167839 - RNA, 18 nt, Homo sapiens
acaucuuuucuaaucaca

SEQ ID NO: 2167840 - RNA, 19 nt, Homo sapiens
agaggcagggucucacucu

SEQ ID NO: 2167841 - RNA, 15 nt, Homo sapiens
uucuaucaaauauua

SEQ ID NO: 2167842 - RNA, 17 nt, Homo sapiens
cagugagccaagaucac

SEQ ID NO: 2167843 - RNA, 16 nt, Homo sapiens
uuaagguuaugcacug

SEQ ID NO: 2167844 - RNA, 22 nt, Homo sapiens
ugacuacagccugccccugacu

SEQ ID NO: 2167845 - RNA, 15 nt, Homo sapiens
gcgcuguuccacagu

SEQ ID NO: 2167846 - RNA, 20 nt, Homo sapiens
agauguuguguuuacguuac

SEQ ID NO: 2167847 - RNA, 17 nt, Homo sapiens
agauuuuguugaccuca

SEQ ID NO: 2167848 - RNA, 16 nt, Homo sapiens
agaaaggggcccaguc

SEQ ID NO: 2167849 - RNA, 21 nt, Homo sapiens
caucaagaugagagaacugga

SEQ ID NO: 2167850 - RNA, 16 nt, Homo sapiens
cugguggcaccagaug

SEQ ID NO: 2167851 - RNA, 19 nt, Homo sapiens
cuuccuggggcugguccug

SEQ ID NO: 2167852 - RNA, 14 nt, Homo sapiens
uuucaagugcuaaa

SEQ ID NO: 2167853 - RNA, 17 nt, Homo sapiens
aauacuaauagccuaaa

SEQ ID NO: 2167854 - RNA, 14 nt, Homo sapiens
ccgugaagucugcu

SEQ ID NO: 2167855 - RNA, 15 nt, Homo sapiens
cacaucucccagcca

SEQ ID NO: 2167856 - RNA, 18 nt, Homo sapiens
caauuuguugaaucucag

SEQ ID NO: 2167857 - RNA, 18 nt, Homo sapiens
uguaguauuuuugccaaa

SEQ ID NO: 2167858 - RNA, 14 nt, Homo sapiens
aauugaauaguuua

SEQ ID NO: 2167859 - RNA, 12 nt, Homo sapiens
cucuggaccaug

SEQ ID NO: 2167860 - RNA, 17 nt, Homo sapiens
gaacucacucacucugg

SEQ ID NO: 2167861 - RNA, 22 nt, Homo sapiens
caggagaagcucaguagccuuu

SEQ ID NO: 2167862 - RNA, 14 nt, Homo sapiens
gugggccgagguga

SEQ ID NO: 2167863 - RNA, 22 nt, Homo sapiens
acuaucuuuuugaaagcaauau

SEQ ID NO: 2167864 - RNA, 16 nt, Homo sapiens
cagccuccuccugacc

SEQ ID NO: 2167865 - RNA, 14 nt, Homo sapiens
cauauaaccaaaau

SEQ ID NO: 2167866 - RNA, 16 nt, Homo sapiens
uuuauuuaaaugucua

SEQ ID NO: 2167867 - RNA, 15 nt, Homo sapiens
ggcuuuaugcaaaua

SEQ ID NO: 2167868 - RNA, 21 nt, Homo sapiens
ugcagaauacaguaagcugcu

SEQ ID NO: 2167869 - RNA, 22 nt, Homo sapiens
cguuaagugccccacagagaca

SEQ ID NO: 2167870 - RNA, 12 nt, Homo sapiens
ccaguuugcaug

SEQ ID NO: 2167871 - RNA, 15 nt, Homo sapiens
cuaagccaguuuuca

SEQ ID NO: 2167872 - RNA, 20 nt, Homo sapiens
uuccucuccacacagugcuc

SEQ ID NO: 2167873 - RNA, 22 nt, Homo sapiens
agccuguuuuugugagagacuu

SEQ ID NO: 2167874 - RNA, 21 nt, Homo sapiens
uucuaugcugaguuugugcug

SEQ ID NO: 2167875 - RNA, 14 nt, Homo sapiens
cauagggugcucug

SEQ ID NO: 2167876 - RNA, 17 nt, Homo sapiens
agauuuaaagcacaugc

SEQ ID NO: 2167877 - RNA, 18 nt, Homo sapiens
caaagaugccacauucaa

SEQ ID NO: 2167878 - RNA, 18 nt, Homo sapiens
ugauaccauggcacugac

SEQ ID NO: 2167879 - RNA, 14 nt, Homo sapiens
aaguugacaccuuu

SEQ ID NO: 2167880 - RNA, 12 nt, Homo sapiens
ucauuguucucc

SEQ ID NO: 2167881 - RNA, 20 nt, Homo sapiens
cagcauagggucacuuugcc

SEQ ID NO: 2167882 - RNA, 15 nt, Homo sapiens
gcucacuugccuuag

SEQ ID NO: 2167883 - RNA, 16 nt, Homo sapiens
uauuacaucuuucaca

SEQ ID NO: 2167884 - RNA, 21 nt, Homo sapiens
auagguguugguuuugggggu

SEQ ID NO: 2167885 - RNA, 19 nt, Homo sapiens
agaguuggagacucagcau

SEQ ID NO: 2167886 - RNA, 20 nt, Homo sapiens
ccaggcugcuggagugcagu

SEQ ID NO: 2167887 - RNA, 20 nt, Homo sapiens
aaaugaaccacauagacuuu

SEQ ID NO: 2167888 - RNA, 17 nt, Homo sapiens
auuuuugccagucuguu

SEQ ID NO: 2167889 - RNA, 14 nt, Homo sapiens
auuuauugagcacc

SEQ ID NO: 2167890 - RNA, 19 nt, Homo sapiens
agugucgugucugcuguug

SEQ ID NO: 2167891 - RNA, 21 nt, Homo sapiens
cugccucggccucccaaagug

SEQ ID NO: 2167892 - RNA, 13 nt, Homo sapiens
gcuccacuacccg

SEQ ID NO: 2167893 - RNA, 14 nt, Homo sapiens
aaauugcaaucuac

SEQ ID NO: 2167894 - RNA, 14 nt, Homo sapiens
uccauuacuugcca

SEQ ID NO: 2167895 - RNA, 15 nt, Homo sapiens
ccuuccugagcuuua

SEQ ID NO: 2167896 - RNA, 15 nt, Homo sapiens
uuacuuaauucaacu

SEQ ID NO: 2167897 - RNA, 16 nt, Homo sapiens
ugauuuggugaccaac

SEQ ID NO: 2167898 - RNA, 15 nt, Homo sapiens
accgggcaagcuuuc

SEQ ID NO: 2167899 - RNA, 17 nt, Homo sapiens
aaagcucuacauuugca

SEQ ID NO: 2167900 - RNA, 21 nt, Homo sapiens
accagagaacaacaugggagc

SEQ ID NO: 2167901 - RNA, 20 nt, Homo sapiens
aucaaugaaguagcugagaa

SEQ ID NO: 2167902 - RNA, 15 nt, Homo sapiens
cuucuuaaucuaaga

SEQ ID NO: 2167903 - RNA, 15 nt, Homo sapiens
gcuagcaaauuugag

SEQ ID NO: 2167904 - RNA, 15 nt, Homo sapiens
ugccugaauccauca

SEQ ID NO: 2167905 - RNA, 17 nt, Homo sapiens
ggggugaaucuugucua

SEQ ID NO: 2167906 - RNA, 19 nt, Homo sapiens
acaagacccccagcacuug

SEQ ID NO: 2167907 - RNA, 19 nt, Homo sapiens
aagaaacacucaacaauaa

SEQ ID NO: 2167908 - RNA, 14 nt, Homo sapiens
uuuuacauggcugg

SEQ ID NO: 2167909 - RNA, 21 nt, Homo sapiens
acacuuuagguagaugaacua

SEQ ID NO: 2167910 - RNA, 14 nt, Homo sapiens
ccagaaugcuaaag

SEQ ID NO: 2167911 - RNA, 21 nt, Homo sapiens
aauaguacauaaucuuuauga

SEQ ID NO: 2167912 - RNA, 12 nt, Homo sapiens
cugagauuacag

SEQ ID NO: 2167913 - RNA, 20 nt, Homo sapiens
cuguuuuuagagcuuccaaa

SEQ ID NO: 2167914 - RNA, 14 nt, Homo sapiens
cuucacaacagauu

SEQ ID NO: 2167915 - RNA, 22 nt, Homo sapiens
auccugauaaacauuaaacacu

SEQ ID NO: 2167916 - RNA, 20 nt, Homo sapiens
cuacagaugucccauuuuca

SEQ ID NO: 2167917 - RNA, 13 nt, Homo sapiens
cccuuuuacauac

SEQ ID NO: 2167918 - RNA, 13 nt, Homo sapiens
cccuagcugaccc

SEQ ID NO: 2167919 - RNA, 16 nt, Homo sapiens
acauacgggaaguuua

SEQ ID NO: 2167920 - RNA, 22 nt, Homo sapiens
ccaguuauuuaaccuguaaaau

SEQ ID NO: 2167921 - RNA, 20 nt, Homo sapiens
ccuuaaauuuuuagccauuu

SEQ ID NO: 2167922 - RNA, 19 nt, Homo sapiens
uaugggugauguagagauu

SEQ ID NO: 2167923 - RNA, 17 nt, Homo sapiens
ccaccccauaaucucau

SEQ ID NO: 2167924 - RNA, 17 nt, Homo sapiens
cccacggugcugagacu

SEQ ID NO: 2167925 - RNA, 13 nt, Homo sapiens
uucugcacacagc

SEQ ID NO: 2167926 - RNA, 19 nt, Homo sapiens
gcagugccaacucuuggag

SEQ ID NO: 2167927 - RNA, 13 nt, Homo sapiens
gagagccuuccag

SEQ ID NO: 2167928 - RNA, 21 nt, Homo sapiens
uccuaaagcuuuuauuuaaca

SEQ ID NO: 2167929 - RNA, 18 nt, Homo sapiens
aguuacuuccuuccugcc

SEQ ID NO: 2167930 - RNA, 16 nt, Homo sapiens
augacauuuuugauaa

SEQ ID NO: 2167931 - RNA, 13 nt, Homo sapiens
ugucugucuuccu

SEQ ID NO: 2167932 - RNA, 13 nt, Homo sapiens
guuuaacauucac

SEQ ID NO: 2167933 - RNA, 12 nt, Homo sapiens
gguacugugaug

SEQ ID NO: 2167934 - RNA, 19 nt, Homo sapiens
acuccuuuuccacuuuaaa

SEQ ID NO: 2167935 - RNA, 16 nt, Homo sapiens
gagaccucaugccaug

SEQ ID NO: 2167936 - RNA, 12 nt, Homo sapiens
auuguagccuca

SEQ ID NO: 2167937 - RNA, 17 nt, Homo sapiens
ugggccucauucuagca

SEQ ID NO: 2167938 - RNA, 22 nt, Homo sapiens
auguucagaaagccuauuccau

SEQ ID NO: 2167939 - RNA, 13 nt, Homo sapiens
agcccucagcaau

SEQ ID NO: 2167940 - RNA, 23 nt, Homo sapiens
cuuuuuugucccccaacuugaga

SEQ ID NO: 2167941 - RNA, 20 nt, Homo sapiens
aaguuuagugcccucaucca

SEQ ID NO: 2167942 - RNA, 13 nt, Homo sapiens
aaaagacuuugau

SEQ ID NO: 2167943 - RNA, 13 nt, Homo sapiens
aaguuacuuuaug

SEQ ID NO: 2167944 - RNA, 15 nt, Homo sapiens
aagaccaucccugaa

SEQ ID NO: 2167945 - RNA, 15 nt, Homo sapiens
agauuuaaauccuuu

SEQ ID NO: 2167946 - RNA, 18 nt, Homo sapiens
cucaagaaaaauucacag

SEQ ID NO: 2167947 - RNA, 19 nt, Homo sapiens
gggcuuaccuguacacuga

SEQ ID NO: 2167948 - RNA, 22 nt, Homo sapiens
agcugggaccacaagugugcau

SEQ ID NO: 2167949 - RNA, 13 nt, Homo sapiens
aaggagaacccaa

SEQ ID NO: 2167950 - RNA, 19 nt, Homo sapiens
cccucucccugcauggcau

SEQ ID NO: 2167951 - RNA, 16 nt, Homo sapiens
uuauauuuuuagccua

SEQ ID NO: 2167952 - RNA, 22 nt, Homo sapiens
auacugcuugaccguacucuca

SEQ ID NO: 2167953 - RNA, 15 nt, Homo sapiens
uggucugagccaaag

SEQ ID NO: 2167954 - RNA, 16 nt, Homo sapiens
ugugauguuugcucag

SEQ ID NO: 2167955 - RNA, 18 nt, Homo sapiens
guaaaauuuaaaucauau

SEQ ID NO: 2167956 - RNA, 22 nt, Homo sapiens
ccaagcuaggcuuaaaccugga

SEQ ID NO: 2167957 - RNA, 19 nt, Homo sapiens
gcugugcuagcaacaccca

SEQ ID NO: 2167958 - RNA, 22 nt, Homo sapiens
gagauuuuauaugcacauuucu

SEQ ID NO: 2167959 - RNA, 14 nt, Homo sapiens
agcaaucaagaaac

SEQ ID NO: 2167960 - RNA, 14 nt, Homo sapiens
uaaucccauacucu

SEQ ID NO: 2167961 - RNA, 16 nt, Homo sapiens
aauuuaaaaacaugau

SEQ ID NO: 2167962 - RNA, 22 nt, Homo sapiens
cccauccaucugcuuacaauuc

SEQ ID NO: 2167963 - RNA, 22 nt, Homo sapiens
aauguuaagaauaacuaauaca

SEQ ID NO: 2167964 - RNA, 13 nt, Homo sapiens
augaauuauuaca

SEQ ID NO: 2167965 - RNA, 20 nt, Homo sapiens
acucaaguccuuaccucuuc

SEQ ID NO: 2167966 - RNA, 21 nt, Homo sapiens
ugagcccccccaacacugugc

SEQ ID NO: 2167967 - RNA, 22 nt, Homo sapiens
ggcaagcagcgggcuaacggga

SEQ ID NO: 2167968 - RNA, 14 nt, Homo sapiens
caccaugccaggcu

SEQ ID NO: 2167969 - RNA, 16 nt, Homo sapiens
ccaugugcuacagggg

SEQ ID NO: 2167970 - RNA, 14 nt, Homo sapiens
ggcacacucccucu

SEQ ID NO: 2167971 - RNA, 12 nt, Homo sapiens
ugugacauacau

SEQ ID NO: 2167972 - RNA, 16 nt, Homo sapiens
uuagacuuauguggaa

SEQ ID NO: 2167973 - RNA, 16 nt, Homo sapiens
gcccugaguccaagag

SEQ ID NO: 2167974 - RNA, 12 nt, Homo sapiens
cucgaguuaaag

SEQ ID NO: 2167975 - RNA, 22 nt, Homo sapiens
gaugccuguuaauuuauaaugu

SEQ ID NO: 2167976 - RNA, 19 nt, Homo sapiens
cccagacuggaaugcagug

SEQ ID NO: 2167977 - RNA, 13 nt, Homo sapiens
ggcagaaggcagu

SEQ ID NO: 2167978 - RNA, 20 nt, Homo sapiens
acgauguuaaaacaaauuaa

SEQ ID NO: 2167979 - RNA, 20 nt, Homo sapiens
cuggaauguaaucaauguuu

SEQ ID NO: 2167980 - RNA, 18 nt, Homo sapiens
gugugcuuccugcuguau

SEQ ID NO: 2167981 - RNA, 20 nt, Homo sapiens
uucuuaagauagcccuaaau

SEQ ID NO: 2167982 - RNA, 20 nt, Homo sapiens
ccgccuggccggcuccaguu

SEQ ID NO: 2167983 - RNA, 23 nt, Homo sapiens
cccaagaacacaagaagacccau

SEQ ID NO: 2167984 - RNA, 14 nt, Homo sapiens
uauucccccaaagc

SEQ ID NO: 2167985 - RNA, 15 nt, Homo sapiens
aaguaacuuuuacaa

SEQ ID NO: 2167986 - RNA, 18 nt, Homo sapiens
gacacacaaauuaucuua

SEQ ID NO: 2167987 - RNA, 13 nt, Homo sapiens
accaucugugacu

SEQ ID NO: 2167988 - RNA, 16 nt, Homo sapiens
gagcuauucacagugc

SEQ ID NO: 2167989 - RNA, 16 nt, Homo sapiens
caaaguggugauuaaa

SEQ ID NO: 2167990 - RNA, 19 nt, Homo sapiens
caccaucucuuuaccuccu

SEQ ID NO: 2167991 - RNA, 21 nt, Homo sapiens
gugaggacucggccacugugu

SEQ ID NO: 2167992 - RNA, 16 nt, Homo sapiens
ccugagggaagcccac

SEQ ID NO: 2167993 - RNA, 15 nt, Homo sapiens
auguauaucucucca

SEQ ID NO: 2167994 - RNA, 17 nt, Homo sapiens
cuagcccugggacauca

SEQ ID NO: 2167995 - RNA, 16 nt, Homo sapiens
ggagaugacauuugcu

SEQ ID NO: 2167996 - RNA, 22 nt, Homo sapiens
uuguugcagaugggugauauau

SEQ ID NO: 2167997 - RNA, 15 nt, Homo sapiens
ucacuugagcccagg

SEQ ID NO: 2167998 - RNA, 12 nt, Homo sapiens
acacaauaccua

SEQ ID NO: 2167999 - RNA, 17 nt, Homo sapiens
aguggaguuuucuguga

SEQ ID NO: 2168000 - RNA, 20 nt, Homo sapiens
gcauuccucaggaaggacau

SEQ ID NO: 2168001 - RNA, 16 nt, Homo sapiens
ccuccagcucccugug

SEQ ID NO: 2168002 - RNA, 15 nt, Homo sapiens
ucccaaagccagaac

SEQ ID NO: 2168003 - RNA, 15 nt, Homo sapiens
cuaacuauauuugcu

SEQ ID NO: 2168004 - RNA, 19 nt, Homo sapiens
ucaucaugucaguuccaau

SEQ ID NO: 2168005 - RNA, 16 nt, Homo sapiens
uaggcaagaagcacag

SEQ ID NO: 2168006 - RNA, 17 nt, Homo sapiens
cauggcaaaucaggggc

SEQ ID NO: 2168007 - RNA, 20 nt, Homo sapiens
cagaugacuagaaagugaau

SEQ ID NO: 2168008 - RNA, 16 nt, Homo sapiens
gaagaaagcaacaaag

SEQ ID NO: 2168009 - RNA, 18 nt, Homo sapiens
agaccccuguucaugccg

SEQ ID NO: 2168010 - RNA, 23 nt, Homo sapiens
auucguuuuguucauauucacua

SEQ ID NO: 2168011 - RNA, 23 nt, Homo sapiens
uccuacauaucccuuccagaugg

SEQ ID NO: 2168012 - RNA, 22 nt, Homo sapiens
accuuggcaccagacacccagg

SEQ ID NO: 2168013 - RNA, 23 nt, Homo sapiens
guuucuuuuuucauuuuugccag

SEQ ID NO: 2168014 - RNA, 14 nt, Homo sapiens
cugcacaaacaaua

SEQ ID NO: 2168015 - RNA, 15 nt, Homo sapiens
ugagacuauucauca

SEQ ID NO: 2168016 - RNA, 14 nt, Homo sapiens
auuaauugcugcaa

SEQ ID NO: 2168017 - RNA, 17 nt, Homo sapiens
uauuauguuaaugaaga

SEQ ID NO: 2168018 - RNA, 13 nt, Homo sapiens
auucucaggccaa

SEQ ID NO: 2168019 - RNA, 13 nt, Homo sapiens
aaagcagcugauu

SEQ ID NO: 2168020 - RNA, 14 nt, Homo sapiens
uccagugagcuuau

SEQ ID NO: 2168021 - RNA, 21 nt, Homo sapiens
cucuuaaugguccaaaggaca

SEQ ID NO: 2168022 - RNA, 19 nt, Homo sapiens
agcugcugcagcccugcca

SEQ ID NO: 2168023 - RNA, 15 nt, Homo sapiens
uaauuguauuucaaa

SEQ ID NO: 2168024 - RNA, 16 nt, Homo sapiens
ugacucacuuauccca

SEQ ID NO: 2168025 - RNA, 18 nt, Homo sapiens
gacaaggccuugcucacu

SEQ ID NO: 2168026 - RNA, 23 nt, Homo sapiens
ccccacaggagcccugcagugug

SEQ ID NO: 2168027 - RNA, 19 nt, Homo sapiens
agaacuuucuuauuuugcu

SEQ ID NO: 2168028 - RNA, 16 nt, Homo sapiens
cggacgccccccggcc

SEQ ID NO: 2168029 - RNA, 21 nt, Homo sapiens
uuuucuccagaccccaugccu

SEQ ID NO: 2168030 - RNA, 23 nt, Homo sapiens
agcacagagucgcuggcauguuu

SEQ ID NO: 2168031 - RNA, 14 nt, Homo sapiens
ucucaucacuacag

SEQ ID NO: 2168032 - RNA, 21 nt, Homo sapiens
aggagcaagggcacaaacugc

SEQ ID NO: 2168033 - RNA, 20 nt, Homo sapiens
uucauuaccuguagcuuugg

SEQ ID NO: 2168034 - RNA, 22 nt, Homo sapiens
uuugauugaggagcugcacuga

SEQ ID NO: 2168035 - RNA, 16 nt, Homo sapiens
ugagauuguacuguuc

SEQ ID NO: 2168036 - RNA, 14 nt, Homo sapiens
uuggaagauggcau

SEQ ID NO: 2168037 - RNA, 14 nt, Homo sapiens
ugugaagauuucau

SEQ ID NO: 2168038 - RNA, 16 nt, Homo sapiens
cuaguucuaauucccu

SEQ ID NO: 2168039 - RNA, 15 nt, Homo sapiens
agguucucaccucag

SEQ ID NO: 2168040 - RNA, 23 nt, Homo sapiens
ggacuccaucucucauccuccag

SEQ ID NO: 2168041 - RNA, 15 nt, Homo sapiens
augacugcauuuuac

SEQ ID NO: 2168042 - RNA, 22 nt, Homo sapiens
uguguacccacuccucacugcc

SEQ ID NO: 2168043 - RNA, 16 nt, Homo sapiens
aacugacucuguuauu

SEQ ID NO: 2168044 - RNA, 17 nt, Homo sapiens
aguugaaagggcaauau

SEQ ID NO: 2168045 - RNA, 14 nt, Homo sapiens
cugaccuuccaaac

SEQ ID NO: 2168046 - RNA, 18 nt, Homo sapiens
aaggacaggucucugaga

SEQ ID NO: 2168047 - RNA, 13 nt, Homo sapiens
gcugauguucacc

SEQ ID NO: 2168048 - RNA, 19 nt, Homo sapiens
aauuagccacauguacacu

SEQ ID NO: 2168049 - RNA, 18 nt, Homo sapiens
aaggaaaggcacauuaca

SEQ ID NO: 2168050 - RNA, 15 nt, Homo sapiens
caagggaucugccau

SEQ ID NO: 2168051 - RNA, 20 nt, Homo sapiens
acagccagacuggcacaguu

SEQ ID NO: 2168052 - RNA, 12 nt, Homo sapiens
ugacaacauguu

SEQ ID NO: 2168053 - RNA, 18 nt, Homo sapiens
cuucaagauuccauuucu

SEQ ID NO: 2168054 - RNA, 14 nt, Homo sapiens
auuuccauuuacuu

SEQ ID NO: 2168055 - RNA, 14 nt, Homo sapiens
gaacucccucugga

SEQ ID NO: 2168056 - RNA, 13 nt, Homo sapiens
ccuguccuuucag

SEQ ID NO: 2168057 - RNA, 18 nt, Homo sapiens
aaaacagccucacagaag

SEQ ID NO: 2168058 - RNA, 16 nt, Homo sapiens
uucauucccccuuccu

SEQ ID NO: 2168059 - RNA, 19 nt, Homo sapiens
gagcaaaaugcucuugucc

SEQ ID NO: 2168060 - RNA, 21 nt, Homo sapiens
ccugucaccaaggacguuaaa

SEQ ID NO: 2168061 - RNA, 13 nt, Homo sapiens
uggugugaccuga

SEQ ID NO: 2168062 - RNA, 18 nt, Homo sapiens
accuugccacccauucuu

SEQ ID NO: 2168063 - RNA, 15 nt, Homo sapiens
cauauuaagacauaa

SEQ ID NO: 2168064 - RNA, 18 nt, Homo sapiens
ccaaguccacaguggaac

SEQ ID NO: 2168065 - RNA, 20 nt, Homo sapiens
guaauaaaaggugucuuucc

SEQ ID NO: 2168066 - RNA, 20 nt, Homo sapiens
caacauauaaaauaaugcaa

SEQ ID NO: 2168067 - RNA, 15 nt, Homo sapiens
gcugcauacagggga

SEQ ID NO: 2168068 - RNA, 22 nt, Homo sapiens
uguauauugguugaaacuguua

SEQ ID NO: 2168069 - RNA, 18 nt, Homo sapiens
cuaaauaaucuuacucua

SEQ ID NO: 2168070 - RNA, 15 nt, Homo sapiens
gaaauuuuccauuac

SEQ ID NO: 2168071 - RNA, 15 nt, Homo sapiens
gacagucucccugau

SEQ ID NO: 2168072 - RNA, 21 nt, Homo sapiens
cugguugcuguagaaacacau

SEQ ID NO: 2168073 - RNA, 16 nt, Homo sapiens
uccagagaccccagga

SEQ ID NO: 2168074 - RNA, 16 nt, Homo sapiens
cagggguacauucuag

SEQ ID NO: 2168075 - RNA, 16 nt, Homo sapiens
cccugauuaaagugcc

SEQ ID NO: 2168076 - RNA, 20 nt, Homo sapiens
aaauauccacccagcaggca

SEQ ID NO: 2168077 - RNA, 18 nt, Homo sapiens
ugccgauaaccuguuuaa

SEQ ID NO: 2168078 - RNA, 18 nt, Homo sapiens
accacagugccaccaagc

SEQ ID NO: 2168079 - RNA, 14 nt, Homo sapiens
uugguaugagacag

SEQ ID NO: 2168080 - RNA, 13 nt, Homo sapiens
aaauauagccaaa

SEQ ID NO: 2168081 - RNA, 12 nt, Homo sapiens
uguaggccucag

SEQ ID NO: 2168082 - RNA, 17 nt, Homo sapiens
caggaggucagcacaag

SEQ ID NO: 2168083 - RNA, 20 nt, Homo sapiens
agguguugcagcccaaaggc

SEQ ID NO: 2168084 - RNA, 11 nt, Homo sapiens
uacuacuccuu

SEQ ID NO: 2168085 - RNA, 14 nt, Homo sapiens
ucccagaguuuuca

SEQ ID NO: 2168086 - RNA, 23 nt, Homo sapiens
gcgcaucucugucacacccgggg

SEQ ID NO: 2168087 - RNA, 18 nt, Homo sapiens
ugacucgguguucugucc

SEQ ID NO: 2168088 - RNA, 20 nt, Homo sapiens
gucuuccaggcacucaaaag

SEQ ID NO: 2168089 - RNA, 19 nt, Homo sapiens
gagccacugcgcccggcug

SEQ ID NO: 2168090 - RNA, 21 nt, Homo sapiens
uguacccucccucuagccuuu

SEQ ID NO: 2168091 - RNA, 13 nt, Homo sapiens
aauuuugugcuau

SEQ ID NO: 2168092 - RNA, 20 nt, Homo sapiens
gaguugcaacuuaaguauau

SEQ ID NO: 2168093 - RNA, 13 nt, Homo sapiens
cccaagaugaauu

SEQ ID NO: 2168094 - RNA, 16 nt, Homo sapiens
agaaaucugugccuga

SEQ ID NO: 2168095 - RNA, 16 nt, Homo sapiens
ugcuaacauagauuua

SEQ ID NO: 2168096 - RNA, 12 nt, Homo sapiens
gagacauauaau

SEQ ID NO: 2168097 - RNA, 21 nt, Homo sapiens
agagacaugcacacacaaaga

SEQ ID NO: 2168098 - RNA, 18 nt, Homo sapiens
cacaguaaaaguaaagac

SEQ ID NO: 2168099 - RNA, 14 nt, Homo sapiens
uacucuccuagaga

SEQ ID NO: 2168100 - RNA, 14 nt, Homo sapiens
uacccaagcugugg

SEQ ID NO: 2168101 - RNA, 15 nt, Homo sapiens
ccaugaacuuaaaau

SEQ ID NO: 2168102 - RNA, 14 nt, Homo sapiens
augucaacagaucc

SEQ ID NO: 2168103 - RNA, 15 nt, Homo sapiens
uuuuaaaaugcauca

SEQ ID NO: 2168104 - RNA, 17 nt, Homo sapiens
cuccugaccucgugauu

SEQ ID NO: 2168105 - RNA, 20 nt, Homo sapiens
cagagagacaacagauuuac

SEQ ID NO: 2168106 - RNA, 11 nt, Homo sapiens
auggcucuccc

SEQ ID NO: 2168107 - RNA, 17 nt, Homo sapiens
aauuugaagcucagaaa

SEQ ID NO: 2168108 - RNA, 14 nt, Homo sapiens
agaccuuaauuuau

SEQ ID NO: 2168109 - RNA, 14 nt, Homo sapiens
auuucauaagacaa

SEQ ID NO: 2168110 - RNA, 22 nt, Homo sapiens
ccuuccccucugcagcuuccag

SEQ ID NO: 2168111 - RNA, 19 nt, Homo sapiens
caugaagaccacugaauga

SEQ ID NO: 2168112 - RNA, 19 nt, Homo sapiens
caaggagagagugagugca

SEQ ID NO: 2168113 - RNA, 14 nt, Homo sapiens
aaaauuugcugcca

SEQ ID NO: 2168114 - RNA, 15 nt, Homo sapiens
ccuacagagcagcca

SEQ ID NO: 2168115 - RNA, 15 nt, Homo sapiens
ugucccgccuugugg

SEQ ID NO: 2168116 - RNA, 16 nt, Homo sapiens
uuucaguucacuguuc

SEQ ID NO: 2168117 - RNA, 16 nt, Homo sapiens
uagcccccaagccggu

SEQ ID NO: 2168118 - RNA, 17 nt, Homo sapiens
cgccuugccuccucacc

SEQ ID NO: 2168119 - RNA, 20 nt, Homo sapiens
aaacaggucgagcugugcuc

SEQ ID NO: 2168120 - RNA, 15 nt, Homo sapiens
aucagaaacaucuga

SEQ ID NO: 2168121 - RNA, 18 nt, Homo sapiens
cauaaagccaaauuucca

SEQ ID NO: 2168122 - RNA, 22 nt, Homo sapiens
ucugugcaaauccuugauacug

SEQ ID NO: 2168123 - RNA, 17 nt, Homo sapiens
guguuuuuaguugcuca

SEQ ID NO: 2168124 - RNA, 16 nt, Homo sapiens
cccgagccuggcucca

SEQ ID NO: 2168125 - RNA, 18 nt, Homo sapiens
aaauuuacaagagaagaa

SEQ ID NO: 2168126 - RNA, 15 nt, Homo sapiens
ucagauggugaagca

SEQ ID NO: 2168127 - RNA, 21 nt, Homo sapiens
uucuuggcccccuucccaagg

SEQ ID NO: 2168128 - RNA, 15 nt, Homo sapiens
gcagucaagcccugu

SEQ ID NO: 2168129 - RNA, 17 nt, Homo sapiens
cagaucaagaaaucccu

SEQ ID NO: 2168130 - RNA, 20 nt, Homo sapiens
cccacuguucugaaaggaga

SEQ ID NO: 2168131 - RNA, 21 nt, Homo sapiens
uggguaucgcugagacuaagu

SEQ ID NO: 2168132 - RNA, 23 nt, Homo sapiens
accaacaaaauccaugugaccau

SEQ ID NO: 2168133 - RNA, 16 nt, Homo sapiens
gauguccaaacugucg

SEQ ID NO: 2168134 - RNA, 19 nt, Homo sapiens
ccucaagcaugagaccuug

SEQ ID NO: 2168135 - RNA, 11 nt, Homo sapiens
ugcucuacugu

SEQ ID NO: 2168136 - RNA, 12 nt, Homo sapiens
ucccauuggcaa

SEQ ID NO: 2168137 - RNA, 20 nt, Homo sapiens
ugcgcuguggacacugagaa

SEQ ID NO: 2168138 - RNA, 11 nt, Homo sapiens
cacucagggau

SEQ ID NO: 2168139 - RNA, 18 nt, Homo sapiens
gugacuucccuucuaacc

SEQ ID NO: 2168140 - RNA, 16 nt, Homo sapiens
ugauugugccagugca

SEQ ID NO: 2168141 - RNA, 14 nt, Homo sapiens
guggcccaagacaa

SEQ ID NO: 2168142 - RNA, 14 nt, Homo sapiens
ccaacccaucagaa

SEQ ID NO: 2168143 - RNA, 23 nt, Homo sapiens
auucuguuuuguaaauguaagaa

SEQ ID NO: 2168144 - RNA, 18 nt, Homo sapiens
aaagggcccagagagggu

SEQ ID NO: 2168145 - RNA, 13 nt, Homo sapiens
augaagcaaugcu

SEQ ID NO: 2168146 - RNA, 20 nt, Homo sapiens
aaggacucuccaaauagcau

SEQ ID NO: 2168147 - RNA, 19 nt, Homo sapiens
aguagagcuguguauuaaa

SEQ ID NO: 2168148 - RNA, 17 nt, Homo sapiens
ggcuccagacaggagga

SEQ ID NO: 2168149 - RNA, 13 nt, Homo sapiens
uaagccuaaagau

SEQ ID NO: 2168150 - RNA, 20 nt, Homo sapiens
accucccugcucagugcuug

SEQ ID NO: 2168151 - RNA, 17 nt, Homo sapiens
uucaaagagacauauac

SEQ ID NO: 2168152 - RNA, 16 nt, Homo sapiens
ugaacauuccuaucaa

SEQ ID NO: 2168153 - RNA, 15 nt, Homo sapiens
uauucagacauugga

SEQ ID NO: 2168154 - RNA, 12 nt, Homo sapiens
ugaggacacuga

SEQ ID NO: 2168155 - RNA, 19 nt, Homo sapiens
aaaauuuuaaugcauuguu

SEQ ID NO: 2168156 - RNA, 15 nt, Homo sapiens
ucacugcacccucaa

SEQ ID NO: 2168157 - RNA, 16 nt, Homo sapiens
gauaaauuuguugaau

SEQ ID NO: 2168158 - RNA, 22 nt, Homo sapiens
accauuccauuuccaagcacuu

SEQ ID NO: 2168159 - RNA, 11 nt, Homo sapiens
ucuuuugcucu

SEQ ID NO: 2168160 - RNA, 14 nt, Homo sapiens
uccuugugcaugag

SEQ ID NO: 2168161 - RNA, 14 nt, Homo sapiens
agucucagcacuau

SEQ ID NO: 2168162 - RNA, 20 nt, Homo sapiens
ccuggcuucaccgcauucca

SEQ ID NO: 2168163 - RNA, 16 nt, Homo sapiens
ggagcuaaaacuggcc

SEQ ID NO: 2168164 - RNA, 16 nt, Homo sapiens
uaggauggcuauguga

SEQ ID NO: 2168165 - RNA, 22 nt, Homo sapiens
cuaugaaaccuuuuuccuagua

SEQ ID NO: 2168166 - RNA, 16 nt, Homo sapiens
agugcacuaaccccag

SEQ ID NO: 2168167 - RNA, 17 nt, Homo sapiens
acaaauuugugugacag

SEQ ID NO: 2168168 - RNA, 18 nt, Homo sapiens
caauucuuugaauuuccc

SEQ ID NO: 2168169 - RNA, 22 nt, Homo sapiens
gaaaugucacguacugucugau

SEQ ID NO: 2168170 - RNA, 14 nt, Homo sapiens
augagaaaugccag

SEQ ID NO: 2168171 - RNA, 14 nt, Homo sapiens
ucuuccaaaggcag

SEQ ID NO: 2168172 - RNA, 15 nt, Homo sapiens
uuauuccuugaucau

SEQ ID NO: 2168173 - RNA, 18 nt, Homo sapiens
caaagacaucagucucca

SEQ ID NO: 2168174 - RNA, 21 nt, Homo sapiens
caaguccuugaccucuauaaa

SEQ ID NO: 2168175 - RNA, 15 nt, Homo sapiens
caccacacccggcua

SEQ ID NO: 2168176 - RNA, 15 nt, Homo sapiens
caccacgcccggcug

SEQ ID NO: 2168177 - RNA, 17 nt, Homo sapiens
gcauaacuaaauuauuu

SEQ ID NO: 2168178 - RNA, 12 nt, Homo sapiens
gcuaaacaugug

SEQ ID NO: 2168179 - RNA, 22 nt, Homo sapiens
gauguuagcagacccagcuuag

SEQ ID NO: 2168180 - RNA, 14 nt, Homo sapiens
cccagcuccacuca

SEQ ID NO: 2168181 - RNA, 17 nt, Homo sapiens
ggacuugcuuccaagcc

SEQ ID NO: 2168182 - RNA, 17 nt, Homo sapiens
guguaucuuuaagaaaa

SEQ ID NO: 2168183 - RNA, 14 nt, Homo sapiens
aacugaagcucuaa

SEQ ID NO: 2168184 - RNA, 14 nt, Homo sapiens
aucagaagcacaaa

SEQ ID NO: 2168185 - RNA, 22 nt, Homo sapiens
gcaaaugcuacauauaugcaau

SEQ ID NO: 2168186 - RNA, 18 nt, Homo sapiens
uagucucucuaguaguua

SEQ ID NO: 2168187 - RNA, 21 nt, Homo sapiens
uacaacaaggcuagaguuugu

SEQ ID NO: 2168188 - RNA, 20 nt, Homo sapiens
ucagugccgaccugcgccaa

SEQ ID NO: 2168189 - RNA, 15 nt, Homo sapiens
ucacuagaugccaau

SEQ ID NO: 2168190 - RNA, 13 nt, Homo sapiens
uaaauugcuuauu

SEQ ID NO: 2168191 - RNA, 17 nt, Homo sapiens
aggcccaaaugauggau

SEQ ID NO: 2168192 - RNA, 15 nt, Homo sapiens
gaugucauagccaaa

SEQ ID NO: 2168193 - RNA, 19 nt, Homo sapiens
gauuuuguauucagggguu

SEQ ID NO: 2168194 - RNA, 12 nt, Homo sapiens
cccuaugucuca

SEQ ID NO: 2168195 - RNA, 15 nt, Homo sapiens
gagucauugcuguag

SEQ ID NO: 2168196 - RNA, 17 nt, Homo sapiens
uuuucaaaauccaaaaa

SEQ ID NO: 2168197 - RNA, 18 nt, Homo sapiens
uaucaguacucccacaau

SEQ ID NO: 2168198 - RNA, 15 nt, Homo sapiens
ucucuguacacugcc

SEQ ID NO: 2168199 - RNA, 21 nt, Homo sapiens
cucugacaagggcugaccugc

SEQ ID NO: 2168200 - RNA, 16 nt, Homo sapiens
acagugcauccuugaa

SEQ ID NO: 2168201 - RNA, 13 nt, Homo sapiens
uguguugccacag

SEQ ID NO: 2168202 - RNA, 13 nt, Homo sapiens
gucuuuguggacu

SEQ ID NO: 2168203 - RNA, 16 nt, Homo sapiens
agaauggcacauguca

SEQ ID NO: 2168204 - RNA, 22 nt, Homo sapiens
uuggaagugauuucagcacauu

SEQ ID NO: 2168205 - RNA, 17 nt, Homo sapiens
cuauauuuaaguauuca

SEQ ID NO: 2168206 - RNA, 14 nt, Homo sapiens
ugaugagcacgguu

SEQ ID NO: 2168207 - RNA, 18 nt, Homo sapiens
accaaagcugcugcacag

SEQ ID NO: 2168208 - RNA, 22 nt, Homo sapiens
uaaaaugcuaauuaggcaaaga

SEQ ID NO: 2168209 - RNA, 20 nt, Homo sapiens
ugcucccuagccagaggcuc

SEQ ID NO: 2168210 - RNA, 23 nt, Homo sapiens
ggccccucacauccucuccagga

SEQ ID NO: 2168211 - RNA, 23 nt, Homo sapiens
caguuguuaaaaugagcauugau

SEQ ID NO: 2168212 - RNA, 13 nt, Homo sapiens
ucagcgacugcca

SEQ ID NO: 2168213 - RNA, 15 nt, Homo sapiens
gagucagaggcagaa

SEQ ID NO: 2168214 - RNA, 12 nt, Homo sapiens
ucacagacauac

SEQ ID NO: 2168215 - RNA, 15 nt, Homo sapiens
gaaggugagccagac

SEQ ID NO: 2168216 - RNA, 17 nt, Homo sapiens
cucucagugaacuguga

SEQ ID NO: 2168217 - RNA, 23 nt, Homo sapiens
ccuugcggcuccucagggacuca

SEQ ID NO: 2168218 - RNA, 13 nt, Homo sapiens
ugcugcucaucca

SEQ ID NO: 2168219 - RNA, 18 nt, Homo sapiens
gaacugaaguuucacaug

SEQ ID NO: 2168220 - RNA, 19 nt, Homo sapiens
cccaggccacagagaaccu

SEQ ID NO: 2168221 - RNA, 14 nt, Homo sapiens
cacaugcacgugug

SEQ ID NO: 2168222 - RNA, 19 nt, Homo sapiens
aauucuuuguuuccucuuu

SEQ ID NO: 2168223 - RNA, 12 nt, Homo sapiens
uuguuucacucu

SEQ ID NO: 2168224 - RNA, 12 nt, Homo sapiens
uuccuucacugc

SEQ ID NO: 2168225 - RNA, 15 nt, Homo sapiens
ccaaaaauuacugau

SEQ ID NO: 2168226 - RNA, 17 nt, Homo sapiens
aagacaccguucauuca

SEQ ID NO: 2168227 - RNA, 12 nt, Homo sapiens
cuuucucugagg

SEQ ID NO: 2168228 - RNA, 20 nt, Homo sapiens
ugagcccucccucuucccag

SEQ ID NO: 2168229 - RNA, 21 nt, Homo sapiens
agcuuuguguuugguuuacau

SEQ ID NO: 2168230 - RNA, 16 nt, Homo sapiens
aggcccacacacaggu

SEQ ID NO: 2168231 - RNA, 22 nt, Homo sapiens
aaagaagaaauaguucugugac

SEQ ID NO: 2168232 - RNA, 18 nt, Homo sapiens
agucuucccagcaauuau

SEQ ID NO: 2168233 - RNA, 19 nt, Homo sapiens
ucagucauuuuuaaccucu

SEQ ID NO: 2168234 - RNA, 16 nt, Homo sapiens
accccucagcaaauac

SEQ ID NO: 2168235 - RNA, 20 nt, Homo sapiens
agaacucagcuguccagcug

SEQ ID NO: 2168236 - RNA, 21 nt, Homo sapiens
aaauccuuucauaaagcacca

SEQ ID NO: 2168237 - RNA, 15 nt, Homo sapiens
cugucaguggagcag

SEQ ID NO: 2168238 - RNA, 13 nt, Homo sapiens
augaucucauccc

SEQ ID NO: 2168239 - RNA, 17 nt, Homo sapiens
gcucuucugucaucccg

SEQ ID NO: 2168240 - RNA, 19 nt, Homo sapiens
acuccaugcuuagucacug

SEQ ID NO: 2168241 - RNA, 22 nt, Homo sapiens
caccucauuauuaucuagcuaa

SEQ ID NO: 2168242 - RNA, 20 nt, Homo sapiens
ccagggcugggcacuccucc

SEQ ID NO: 2168243 - RNA, 21 nt, Homo sapiens
cccauuuagaauaucuagcau

SEQ ID NO: 2168244 - RNA, 23 nt, Homo sapiens
caauucugcccgcuccauggaaa

SEQ ID NO: 2168245 - RNA, 12 nt, Homo sapiens
ggcuuuugccac

SEQ ID NO: 2168246 - RNA, 14 nt, Homo sapiens
caaaaauaguauuc

SEQ ID NO: 2168247 - RNA, 14 nt, Homo sapiens
uagcaaucauuuua

SEQ ID NO: 2168248 - RNA, 17 nt, Homo sapiens
cugacaaauuuuaauua

SEQ ID NO: 2168249 - RNA, 19 nt, Homo sapiens
gcugauauuaacugucaau

SEQ ID NO: 2168250 - RNA, 23 nt, Homo sapiens
cuggagugcaauggcgugaucuc

SEQ ID NO: 2168251 - RNA, 15 nt, Homo sapiens
cuauuauaaaaccau

SEQ ID NO: 2168252 - RNA, 13 nt, Homo sapiens
caucaaagcccuc

SEQ ID NO: 2168253 - RNA, 13 nt, Homo sapiens
accucagcaauau

SEQ ID NO: 2168254 - RNA, 24 nt, Homo sapiens
aguaccaguauaagcaucugccau

SEQ ID NO: 2168255 - RNA, 18 nt, Homo sapiens
cuggugguggcucgggag

SEQ ID NO: 2168256 - RNA, 13 nt, Homo sapiens
ucccaggaucucc

SEQ ID NO: 2168257 - RNA, 13 nt, Homo sapiens
ucagguaauacaa

SEQ ID NO: 2168258 - RNA, 17 nt, Homo sapiens
cucaguucuacacugau

SEQ ID NO: 2168259 - RNA, 18 nt, Homo sapiens
gacccaaguagcugcuac

SEQ ID NO: 2168260 - RNA, 10 nt, Homo sapiens
uguagagugg

SEQ ID NO: 2168261 - RNA, 21 nt, Homo sapiens
ccaucccuggcugaccugcug

SEQ ID NO: 2168262 - RNA, 18 nt, Homo sapiens
guaggcacaaaaccagaa

SEQ ID NO: 2168263 - RNA, 20 nt, Homo sapiens
cuauuuuugacuguagccac

SEQ ID NO: 2168264 - RNA, 20 nt, Homo sapiens
uggaacagauucacacuguc

SEQ ID NO: 2168265 - RNA, 21 nt, Homo sapiens
cuuuuucugugauaacucugc

SEQ ID NO: 2168266 - RNA, 20 nt, Homo sapiens
uacacauguauccuuucaca

SEQ ID NO: 2168267 - RNA, 19 nt, Homo sapiens
uaccccgauggccaagcaa

SEQ ID NO: 2168268 - RNA, 23 nt, Homo sapiens
acagcaaauguguguagauuuca

SEQ ID NO: 2168269 - RNA, 14 nt, Homo sapiens
aagacgugauucaa

SEQ ID NO: 2168270 - RNA, 16 nt, Homo sapiens
cuaacuaauucuguca

SEQ ID NO: 2168271 - RNA, 11 nt, Homo sapiens
ggagaggaccc

SEQ ID NO: 2168272 - RNA, 19 nt, Homo sapiens
aaugugugaaggucuugcc

SEQ ID NO: 2168273 - RNA, 13 nt, Homo sapiens
gucccucucaggc

SEQ ID NO: 2168274 - RNA, 12 nt, Homo sapiens
ugagagugcaga

SEQ ID NO: 2168275 - RNA, 14 nt, Homo sapiens
agaugucucugugu

SEQ ID NO: 2168276 - RNA, 15 nt, Homo sapiens
cuccaaaacauuucu

SEQ ID NO: 2168277 - RNA, 14 nt, Homo sapiens
cugcgagcauuucc

SEQ ID NO: 2168278 - RNA, 15 nt, Homo sapiens
aggagggcagccacg

SEQ ID NO: 2168279 - RNA, 16 nt, Homo sapiens
acacuuugugaucuca

SEQ ID NO: 2168280 - RNA, 21 nt, Homo sapiens
gcagaacugcagucacugcac

SEQ ID NO: 2168281 - RNA, 14 nt, Homo sapiens
gacuaucacauaca

SEQ ID NO: 2168282 - RNA, 18 nt, Homo sapiens
caucccucguggucccca

SEQ ID NO: 2168283 - RNA, 23 nt, Homo sapiens
aaugacaucuucaaagcuugaag

SEQ ID NO: 2168284 - RNA, 21 nt, Homo sapiens
ccaugggggcagggcaugacu

SEQ ID NO: 2168285 - RNA, 10 nt, Homo sapiens
cuccuaggcc

SEQ ID NO: 2168286 - RNA, 14 nt, Homo sapiens
gcaaagggaaauca

SEQ ID NO: 2168287 - RNA, 23 nt, Homo sapiens
cagggagcagggcagaaaacaca

SEQ ID NO: 2168288 - RNA, 16 nt, Homo sapiens
cccacuggucugcuua

SEQ ID NO: 2168289 - RNA, 16 nt, Homo sapiens
cuuaucauaaauucaa

SEQ ID NO: 2168290 - RNA, 13 nt, Homo sapiens
gccgcugcugacc

SEQ ID NO: 2168291 - RNA, 14 nt, Homo sapiens
aucgaagucuuccc

SEQ ID NO: 2168292 - RNA, 20 nt, Homo sapiens
acuuuugugcuccccuuugc

SEQ ID NO: 2168293 - RNA, 21 nt, Homo sapiens
cucuguuaugcaagcacaaau

SEQ ID NO: 2168294 - RNA, 21 nt, Homo sapiens
ugaggguguuucuuccugcac

SEQ ID NO: 2168295 - RNA, 12 nt, Homo sapiens
ugggacacugaa

SEQ ID NO: 2168296 - RNA, 16 nt, Homo sapiens
caaaguccacacaaag

SEQ ID NO: 2168297 - RNA, 22 nt, Homo sapiens
uugauauauucuuuccaugcag

SEQ ID NO: 2168298 - RNA, 21 nt, Homo sapiens
ccgcuuugagucccccagaga

SEQ ID NO: 2168299 - RNA, 11 nt, Homo sapiens
acuuccagugg

SEQ ID NO: 2168300 - RNA, 21 nt, Homo sapiens
caugauccaagcaagacugag

SEQ ID NO: 2168301 - RNA, 20 nt, Homo sapiens
agugcgggauucaaaggugg

SEQ ID NO: 2168302 - RNA, 12 nt, Homo sapiens
aucccagcacug

SEQ ID NO: 2168303 - RNA, 13 nt, Homo sapiens
ucccuaaguccac

SEQ ID NO: 2168304 - RNA, 22 nt, Homo sapiens
ugaccaaaaaaaagcaugaaua

SEQ ID NO: 2168305 - RNA, 16 nt, Homo sapiens
aauaacugaaccaaau

SEQ ID NO: 2168306 - RNA, 23 nt, Homo sapiens
aaguauucuucaucagcauuuaa

SEQ ID NO: 2168307 - RNA, 14 nt, Homo sapiens
uggaguaaaccaug

SEQ ID NO: 2168308 - RNA, 21 nt, Homo sapiens
auacaugucuuucuccaggga

SEQ ID NO: 2168309 - RNA, 18 nt, Homo sapiens
gucccagccacaguguua

SEQ ID NO: 2168310 - RNA, 16 nt, Homo sapiens
accuccaagccacuga

SEQ ID NO: 2168311 - RNA, 11 nt, Homo sapiens
acuuuugacuu

SEQ ID NO: 2168312 - RNA, 12 nt, Homo sapiens
aggccaggguca

SEQ ID NO: 2168313 - RNA, 22 nt, Homo sapiens
uaguagagcaguauauuaaaac

SEQ ID NO: 2168314 - RNA, 12 nt, Homo sapiens
aaguucccugaa

SEQ ID NO: 2168315 - RNA, 16 nt, Homo sapiens
cugacuggcaaaggac

SEQ ID NO: 2168316 - RNA, 15 nt, Homo sapiens
uaugaauacagcagc

SEQ ID NO: 2168317 - RNA, 15 nt, Homo sapiens
uuuguacacugcugu

SEQ ID NO: 2168318 - RNA, 22 nt, Homo sapiens
gaugaucuuuaaaauacacacu

SEQ ID NO: 2168319 - RNA, 22 nt, Homo sapiens
uuuaggaaugguucucucaaca

SEQ ID NO: 2168320 - RNA, 16 nt, Homo sapiens
uaagaguaugugccag

SEQ ID NO: 2168321 - RNA, 21 nt, Homo sapiens
ccugaucuuugggcaucagaa

SEQ ID NO: 2168322 - RNA, 22 nt, Homo sapiens
auugucuccuuccacaaugacu

SEQ ID NO: 2168323 - RNA, 14 nt, Homo sapiens
cugcacuacugaca

SEQ ID NO: 2168324 - RNA, 19 nt, Homo sapiens
ccucugcaguuuugacauu

SEQ ID NO: 2168325 - RNA, 13 nt, Homo sapiens
ccuuauggccaau

SEQ ID NO: 2168326 - RNA, 20 nt, Homo sapiens
acuucgcgcaccuucucacc

SEQ ID NO: 2168327 - RNA, 21 nt, Homo sapiens
uuguuuuuaagcuucuagaca

SEQ ID NO: 2168328 - RNA, 22 nt, Homo sapiens
agcugugugugcccguggugag

SEQ ID NO: 2168329 - RNA, 20 nt, Homo sapiens
uucuauugaaaaaucaccac

SEQ ID NO: 2168330 - RNA, 13 nt, Homo sapiens
gauagauguuugg

SEQ ID NO: 2168331 - RNA, 19 nt, Homo sapiens
aauuucuaaaaaacagagg

SEQ ID NO: 2168332 - RNA, 13 nt, Homo sapiens
caugcuuguugca

SEQ ID NO: 2168333 - RNA, 19 nt, Homo sapiens
agcuggggcugagggaugg

SEQ ID NO: 2168334 - RNA, 16 nt, Homo sapiens
agaccugugugccagg

SEQ ID NO: 2168335 - RNA, 14 nt, Homo sapiens
agaaacacuugaac

SEQ ID NO: 2168336 - RNA, 12 nt, Homo sapiens
ggauagccuuug

SEQ ID NO: 2168337 - RNA, 20 nt, Homo sapiens
accgucacacucuucaguga

SEQ ID NO: 2168338 - RNA, 13 nt, Homo sapiens
aaaagacugacca

SEQ ID NO: 2168339 - RNA, 23 nt, Homo sapiens
gauuagguagacuuugcuuagua

SEQ ID NO: 2168340 - RNA, 16 nt, Homo sapiens
gagccuggcacaggac

SEQ ID NO: 2168341 - RNA, 15 nt, Homo sapiens
cuccagcugauccag

SEQ ID NO: 2168342 - RNA, 20 nt, Homo sapiens
gccuguuuggugaggaccug

SEQ ID NO: 2168343 - RNA, 21 nt, Homo sapiens
gcccaugaugcagagcuuuca

SEQ ID NO: 2168344 - RNA, 13 nt, Homo sapiens
cagggccaacuug

SEQ ID NO: 2168345 - RNA, 13 nt, Homo sapiens
caucauuacagau

SEQ ID NO: 2168346 - RNA, 16 nt, Homo sapiens
ucaacacucuucuuga

SEQ ID NO: 2168347 - RNA, 15 nt, Homo sapiens
agcugcucuccuuca

SEQ ID NO: 2168348 - RNA, 15 nt, Homo sapiens
aguggauaaccacag

SEQ ID NO: 2168349 - RNA, 20 nt, Homo sapiens
aauaugucugccacagagag

SEQ ID NO: 2168350 - RNA, 17 nt, Homo sapiens
ggcuggauagguaugca

SEQ ID NO: 2168351 - RNA, 22 nt, Homo sapiens
acagggcacugucuguguccuu

SEQ ID NO: 2168352 - RNA, 19 nt, Homo sapiens
uccugacaacgucucuuca

SEQ ID NO: 2168353 - RNA, 16 nt, Homo sapiens
uagagcugagcacuuu

SEQ ID NO: 2168354 - RNA, 16 nt, Homo sapiens
aaauauaaacugugag

SEQ ID NO: 2168355 - RNA, 12 nt, Homo sapiens
ugagacaggccc

SEQ ID NO: 2168356 - RNA, 19 nt, Homo sapiens
ucagugaagccaaagggac

SEQ ID NO: 2168357 - RNA, 12 nt, Homo sapiens
aauccaaugaca

SEQ ID NO: 2168358 - RNA, 17 nt, Homo sapiens
aaauucugguauacauu

SEQ ID NO: 2168359 - RNA, 18 nt, Homo sapiens
aacacuggugugaccuga

SEQ ID NO: 2168360 - RNA, 17 nt, Homo sapiens
gacauuuugugacugaa

SEQ ID NO: 2168361 - RNA, 11 nt, Homo sapiens
ccagcaaaaac

SEQ ID NO: 2168362 - RNA, 18 nt, Homo sapiens
aguuacagaugcacccca

SEQ ID NO: 2168363 - RNA, 24 nt, Homo sapiens
cuacagaaauugaaaaugaccaaa

SEQ ID NO: 2168364 - RNA, 19 nt, Homo sapiens
uguauuuuucuguuagcug

SEQ ID NO: 2168365 - RNA, 21 nt, Homo sapiens
uagcuauauuuauauauaucc

SEQ ID NO: 2168366 - RNA, 18 nt, Homo sapiens
uuguucaaguuugcugca

SEQ ID NO: 2168367 - RNA, 16 nt, Homo sapiens
acuucacaauguauau

SEQ ID NO: 2168368 - RNA, 19 nt, Homo sapiens
cagccuguggauuugauac

SEQ ID NO: 2168369 - RNA, 21 nt, Homo sapiens
uagucuacuugaggcugcaau

SEQ ID NO: 2168370 - RNA, 16 nt, Homo sapiens
ccuggacgcagccaca

SEQ ID NO: 2168371 - RNA, 16 nt, Homo sapiens
ccgagucuugcucugu

SEQ ID NO: 2168372 - RNA, 15 nt, Homo sapiens
uuaaguuuaucuuuc

SEQ ID NO: 2168373 - RNA, 14 nt, Homo sapiens
uucauucucucuca

SEQ ID NO: 2168374 - RNA, 19 nt, Homo sapiens
ggcuggaugugguggcaua

SEQ ID NO: 2168375 - RNA, 15 nt, Homo sapiens
auucauuuuacucag

SEQ ID NO: 2168376 - RNA, 23 nt, Homo sapiens
ccugagcauauguacacagacaa

SEQ ID NO: 2168377 - RNA, 19 nt, Homo sapiens
acuaaggugcuaaaucugc

SEQ ID NO: 2168378 - RNA, 15 nt, Homo sapiens
acugauucacugcau

SEQ ID NO: 2168379 - RNA, 23 nt, Homo sapiens
ucuuccguggucagagugccacu

SEQ ID NO: 2168380 - RNA, 18 nt, Homo sapiens
aggcagugcugagaggga

SEQ ID NO: 2168381 - RNA, 13 nt, Homo sapiens
cuggauauuucaa

SEQ ID NO: 2168382 - RNA, 17 nt, Homo sapiens
ggaaacuuaaccaccua

SEQ ID NO: 2168383 - RNA, 17 nt, Homo sapiens
agccccuagaaacccaa

SEQ ID NO: 2168384 - RNA, 21 nt, Homo sapiens
gcugcaccccaaguccagguc

SEQ ID NO: 2168385 - RNA, 23 nt, Homo sapiens
aguaacugugagaacccaguuuc

SEQ ID NO: 2168386 - RNA, 18 nt, Homo sapiens
caauaaagcauuuugcaa

SEQ ID NO: 2168387 - RNA, 20 nt, Homo sapiens
caucuauuuccucugugcaa

SEQ ID NO: 2168388 - RNA, 21 nt, Homo sapiens
acagauguucccccaucucgc

SEQ ID NO: 2168389 - RNA, 17 nt, Homo sapiens
aaagacaaucacugcca

SEQ ID NO: 2168390 - RNA, 13 nt, Homo sapiens
uguucccaugaga

SEQ ID NO: 2168391 - RNA, 18 nt, Homo sapiens
cuguaaguaauugccaca

SEQ ID NO: 2168392 - RNA, 16 nt, Homo sapiens
uaguaagaugcacuga

SEQ ID NO: 2168393 - RNA, 21 nt, Homo sapiens
cagccuggccuguggcugccc

SEQ ID NO: 2168394 - RNA, 11 nt, Homo sapiens
cugacuuagau

SEQ ID NO: 2168395 - RNA, 15 nt, Homo sapiens
uagaucauaagacug

SEQ ID NO: 2168396 - RNA, 21 nt, Homo sapiens
gcagguugaccgggacuucaa

SEQ ID NO: 2168397 - RNA, 19 nt, Homo sapiens
uugcuuauaauaaaauaau

SEQ ID NO: 2168398 - RNA, 17 nt, Homo sapiens
caaaauggauacauaaa

SEQ ID NO: 2168399 - RNA, 21 nt, Homo sapiens
ucugaggccugagugauccac

SEQ ID NO: 2168400 - RNA, 14 nt, Homo sapiens
caaggccuugccug

SEQ ID NO: 2168401 - RNA, 14 nt, Homo sapiens
cuuuaaagacuuaa

SEQ ID NO: 2168402 - RNA, 18 nt, Homo sapiens
aagggggggcuacauuau

SEQ ID NO: 2168403 - RNA, 19 nt, Homo sapiens
auuuucaacauaacugaag

SEQ ID NO: 2168404 - RNA, 18 nt, Homo sapiens
auguacgcugcgugccau

SEQ ID NO: 2168405 - RNA, 17 nt, Homo sapiens
gagacgggguuucucca

SEQ ID NO: 2168406 - RNA, 16 nt, Homo sapiens
aauccagugagcacua

SEQ ID NO: 2168407 - RNA, 17 nt, Homo sapiens
auuuuauaagaugacug

SEQ ID NO: 2168408 - RNA, 18 nt, Homo sapiens
ugcugguagcugagggga

SEQ ID NO: 2168409 - RNA, 18 nt, Homo sapiens
guaucuuccauauuugga

SEQ ID NO: 2168410 - RNA, 12 nt, Homo sapiens
ggggauuguaca

SEQ ID NO: 2168411 - RNA, 19 nt, Homo sapiens
uccaggcuggcgugcagca

SEQ ID NO: 2168412 - RNA, 18 nt, Homo sapiens
cuguaaucccagcauuuu

SEQ ID NO: 2168413 - RNA, 17 nt, Homo sapiens
aauagaguuccaaauaa

SEQ ID NO: 2168414 - RNA, 20 nt, Homo sapiens
uuuuucugcacuauaugcaa

SEQ ID NO: 2168415 - RNA, 15 nt, Homo sapiens
agugcgucugagggg

SEQ ID NO: 2168416 - RNA, 20 nt, Homo sapiens
guugccaccauguauucauc

SEQ ID NO: 2168417 - RNA, 19 nt, Homo sapiens
cccaaagaccuccacuugc

SEQ ID NO: 2168418 - RNA, 17 nt, Homo sapiens
gcacugagaagcaauca

SEQ ID NO: 2168419 - RNA, 22 nt, Homo sapiens
gagagucuuaucugagcugagc

SEQ ID NO: 2168420 - RNA, 13 nt, Homo sapiens
ggcugcagauaac

SEQ ID NO: 2168421 - RNA, 21 nt, Homo sapiens
agcaccugggccccacuggac

SEQ ID NO: 2168422 - RNA, 20 nt, Homo sapiens
gcaaauguccaagcaucagc

SEQ ID NO: 2168423 - RNA, 14 nt, Homo sapiens
gaguugacucggug

SEQ ID NO: 2168424 - RNA, 15 nt, Homo sapiens
ccacauaaucucucu

SEQ ID NO: 2168425 - RNA, 18 nt, Homo sapiens
acuacagcuggggugcag

SEQ ID NO: 2168426 - RNA, 21 nt, Homo sapiens
acagauucagaaaccaaggcu

SEQ ID NO: 2168427 - RNA, 17 nt, Homo sapiens
caaauaaaguaccauua

SEQ ID NO: 2168428 - RNA, 23 nt, Homo sapiens
guaaauugcaaauaaaccacuuu

SEQ ID NO: 2168429 - RNA, 18 nt, Homo sapiens
gauuccuuuucuuguuua

SEQ ID NO: 2168430 - RNA, 14 nt, Homo sapiens
uguauuuguagcca

SEQ ID NO: 2168431 - RNA, 12 nt, Homo sapiens
ugcaagauucca

SEQ ID NO: 2168432 - RNA, 13 nt, Homo sapiens
caucugagaauga

SEQ ID NO: 2168433 - RNA, 18 nt, Homo sapiens
ugggguacccacugcucu

SEQ ID NO: 2168434 - RNA, 16 nt, Homo sapiens
aaauacggauccugca

SEQ ID NO: 2168435 - RNA, 14 nt, Homo sapiens
cucuucacacggac

SEQ ID NO: 2168436 - RNA, 23 nt, Homo sapiens
ccucacucuuuauagugcacaaa

SEQ ID NO: 2168437 - RNA, 21 nt, Homo sapiens
auguaugcuuugaaugcaaaa

SEQ ID NO: 2168438 - RNA, 17 nt, Homo sapiens
uugucuucaaacuguga

SEQ ID NO: 2168439 - RNA, 16 nt, Homo sapiens
cacuaagcuuucuccu

SEQ ID NO: 2168440 - RNA, 16 nt, Homo sapiens
aaucauacuuagcaaa

SEQ ID NO: 2168441 - RNA, 20 nt, Homo sapiens
acacauaauuaaagugucca

SEQ ID NO: 2168442 - RNA, 21 nt, Homo sapiens
caaaaauaaugugagcuuuuu

SEQ ID NO: 2168443 - RNA, 14 nt, Homo sapiens
agacaaugcagaua

SEQ ID NO: 2168444 - RNA, 16 nt, Homo sapiens
ccuggccccucagggu

SEQ ID NO: 2168445 - RNA, 21 nt, Homo sapiens
gcuccugauauaacacuuucc

SEQ ID NO: 2168446 - RNA, 13 nt, Homo sapiens
aguugaugacugu

SEQ ID NO: 2168447 - RNA, 14 nt, Homo sapiens
ggacccccucagga

SEQ ID NO: 2168448 - RNA, 19 nt, Homo sapiens
agaauaccaccuaauccuu

SEQ ID NO: 2168449 - RNA, 19 nt, Homo sapiens
auuuaucaagcauuuacca

SEQ ID NO: 2168450 - RNA, 18 nt, Homo sapiens
uaccaaaauguccaccaa

SEQ ID NO: 2168451 - RNA, 13 nt, Homo sapiens
cuguggcuuucag

SEQ ID NO: 2168452 - RNA, 23 nt, Homo sapiens
ggaggcaccagcucuguggccug

SEQ ID NO: 2168453 - RNA, 13 nt, Homo sapiens
aaauaacugagaa

SEQ ID NO: 2168454 - RNA, 13 nt, Homo sapiens
auaaaacugugua

SEQ ID NO: 2168455 - RNA, 17 nt, Homo sapiens
guuauggcuuaaaagca

SEQ ID NO: 2168456 - RNA, 13 nt, Homo sapiens
uaccccuuucucc

SEQ ID NO: 2168457 - RNA, 18 nt, Homo sapiens
aaagcccgcuugcucgcu

SEQ ID NO: 2168458 - RNA, 13 nt, Homo sapiens
ccuuggaccucca

SEQ ID NO: 2168459 - RNA, 17 nt, Homo sapiens
ugugucccccccagugc

SEQ ID NO: 2168460 - RNA, 21 nt, Homo sapiens
guauuuuaggcagggauuuga

SEQ ID NO: 2168461 - RNA, 17 nt, Homo sapiens
guacaguuauacauacc

SEQ ID NO: 2168462 - RNA, 15 nt, Homo sapiens
aaagccauggugugu

SEQ ID NO: 2168463 - RNA, 23 nt, Homo sapiens
cugagcccuccuucuugcccuga

SEQ ID NO: 2168464 - RNA, 22 nt, Homo sapiens
ucaaugacaugaauuuuagcuu

SEQ ID NO: 2168465 - RNA, 14 nt, Homo sapiens
acccucccaccacu

SEQ ID NO: 2168466 - RNA, 12 nt, Homo sapiens
aggguaauuucc

SEQ ID NO: 2168467 - RNA, 19 nt, Homo sapiens
augcaagccccaacuuucu

SEQ ID NO: 2168468 - RNA, 10 nt, Homo sapiens
caucccaugg

SEQ ID NO: 2168469 - RNA, 16 nt, Homo sapiens
agucaauucaucuagu

SEQ ID NO: 2168470 - RNA, 16 nt, Homo sapiens
ccgugccugagcugca

SEQ ID NO: 2168471 - RNA, 22 nt, Homo sapiens
cugaggguccccaccugggacc

SEQ ID NO: 2168472 - RNA, 16 nt, Homo sapiens
gggaaacacuccuugc

SEQ ID NO: 2168473 - RNA, 15 nt, Homo sapiens
aagccauguguucca

SEQ ID NO: 2168474 - RNA, 18 nt, Homo sapiens
cuacccacuuaggcuuug

SEQ ID NO: 2168475 - RNA, 15 nt, Homo sapiens
uuucucuagcuugau

SEQ ID NO: 2168476 - RNA, 16 nt, Homo sapiens
uggccugacaauauga

SEQ ID NO: 2168477 - RNA, 21 nt, Homo sapiens
acuuuuugaaugucauaaaga

SEQ ID NO: 2168478 - RNA, 15 nt, Homo sapiens
aaggagccuauggca

SEQ ID NO: 2168479 - RNA, 21 nt, Homo sapiens
ccuguucugguagcuccacaa

SEQ ID NO: 2168480 - RNA, 20 nt, Homo sapiens
agaagacauccugagcagug

SEQ ID NO: 2168481 - RNA, 18 nt, Homo sapiens
caggcuggucuugaacuc

SEQ ID NO: 2168482 - RNA, 20 nt, Homo sapiens
cugagccaaacacacuguaa

SEQ ID NO: 2168483 - RNA, 14 nt, Homo sapiens
ucauuucaaauaca

SEQ ID NO: 2168484 - RNA, 20 nt, Homo sapiens
uccaauugcauuuauuuauc

SEQ ID NO: 2168485 - RNA, 16 nt, Homo sapiens
cugggcagaaugaagu

SEQ ID NO: 2168486 - RNA, 16 nt, Homo sapiens
gcugguagcucaggug

SEQ ID NO: 2168487 - RNA, 15 nt, Homo sapiens
augauccagaacagu

SEQ ID NO: 2168488 - RNA, 19 nt, Homo sapiens
ccaauccuuuauagcuuug

SEQ ID NO: 2168489 - RNA, 23 nt, Homo sapiens
augagcugugcacaaaguggcau

SEQ ID NO: 2168490 - RNA, 20 nt, Homo sapiens
acauuaacucaggcauuuca

SEQ ID NO: 2168491 - RNA, 21 nt, Homo sapiens
uauaaggcugagggcugccag

SEQ ID NO: 2168492 - RNA, 18 nt, Homo sapiens
uuccugcgcauggugcag

SEQ ID NO: 2168493 - RNA, 16 nt, Homo sapiens
ccuuguuaaaauccaa

SEQ ID NO: 2168494 - RNA, 16 nt, Homo sapiens
ucuuggcccucccacc

SEQ ID NO: 2168495 - RNA, 19 nt, Homo sapiens
gaaaguguucauugcacaa

SEQ ID NO: 2168496 - RNA, 12 nt, Homo sapiens
augucuguuuac

SEQ ID NO: 2168497 - RNA, 21 nt, Homo sapiens
cuggaguuagggacugaccag

SEQ ID NO: 2168498 - RNA, 21 nt, Homo sapiens
ucuaagaaaagccuaaucaca

SEQ ID NO: 2168499 - RNA, 13 nt, Homo sapiens
aaucauggcucac

SEQ ID NO: 2168500 - RNA, 13 nt, Homo sapiens
cuucaucucauga

SEQ ID NO: 2168501 - RNA, 16 nt, Homo sapiens
uuuacuuuguacuugu

SEQ ID NO: 2168502 - RNA, 17 nt, Homo sapiens
ucuuuuuugugugauuu

SEQ ID NO: 2168503 - RNA, 16 nt, Homo sapiens
uaguacuaagcuuaau

SEQ ID NO: 2168504 - RNA, 20 nt, Homo sapiens
ucccaaguagcuggaauuac

SEQ ID NO: 2168505 - RNA, 17 nt, Homo sapiens
accaauaccuacugaau

SEQ ID NO: 2168506 - RNA, 13 nt, Homo sapiens
acucugagcugcu

SEQ ID NO: 2168507 - RNA, 16 nt, Homo sapiens
cucacuguucugcaaa

SEQ ID NO: 2168508 - RNA, 13 nt, Homo sapiens
aauuguaauugac

SEQ ID NO: 2168509 - RNA, 14 nt, Homo sapiens
acaaaccacuguac

SEQ ID NO: 2168510 - RNA, 17 nt, Homo sapiens
ccucuguccagccagcu

SEQ ID NO: 2168511 - RNA, 19 nt, Homo sapiens
cuggguuugggcaguggag

SEQ ID NO: 2168512 - RNA, 15 nt, Homo sapiens
auggugcgaucucag

SEQ ID NO: 2168513 - RNA, 17 nt, Homo sapiens
uagugauuuccuguaua

SEQ ID NO: 2168514 - RNA, 19 nt, Homo sapiens
auuccaugugauacauuag

SEQ ID NO: 2168515 - RNA, 21 nt, Homo sapiens
augcccaugguacuccaugca

SEQ ID NO: 2168516 - RNA, 21 nt, Homo sapiens
guuuuauuuugguguccuauu

SEQ ID NO: 2168517 - RNA, 13 nt, Homo sapiens
guaaucacuguug

SEQ ID NO: 2168518 - RNA, 17 nt, Homo sapiens
acaauggagugggagau

SEQ ID NO: 2168519 - RNA, 18 nt, Homo sapiens
uacaugguugaaacccca

SEQ ID NO: 2168520 - RNA, 17 nt, Homo sapiens
gggggaaaaguuaguca

SEQ ID NO: 2168521 - RNA, 21 nt, Homo sapiens
ccuguacccaguguuacccuc

SEQ ID NO: 2168522 - RNA, 23 nt, Homo sapiens
gauugccucugaagccuauguau

SEQ ID NO: 2168523 - RNA, 21 nt, Homo sapiens
gaaaccguaucucuaauaaaa

SEQ ID NO: 2168524 - RNA, 21 nt, Homo sapiens
cucggucaggagggugcagua

SEQ ID NO: 2168525 - RNA, 18 nt, Homo sapiens
gcagaagguuacuaccua

SEQ ID NO: 2168526 - RNA, 17 nt, Homo sapiens
cauguuguucucauuga

SEQ ID NO: 2168527 - RNA, 23 nt, Homo sapiens
gaggcuccacuuggucugugaga

SEQ ID NO: 2168528 - RNA, 15 nt, Homo sapiens
guaaucucggcucac

SEQ ID NO: 2168529 - RNA, 15 nt, Homo sapiens
gcauggagaaugcac

SEQ ID NO: 2168530 - RNA, 20 nt, Homo sapiens
auuauuuggagccugccaag

SEQ ID NO: 2168531 - RNA, 18 nt, Homo sapiens
gaaucuucaagaccaaag

SEQ ID NO: 2168532 - RNA, 14 nt, Homo sapiens
agagacagaauuca

SEQ ID NO: 2168533 - RNA, 18 nt, Homo sapiens
aaaugauuaagugcuuga

SEQ ID NO: 2168534 - RNA, 18 nt, Homo sapiens
guaaaaaugagaacaugu

SEQ ID NO: 2168535 - RNA, 14 nt, Homo sapiens
aaguaaagugcuua

SEQ ID NO: 2168536 - RNA, 18 nt, Homo sapiens
uugugaaugugagguguu

SEQ ID NO: 2168537 - RNA, 17 nt, Homo sapiens
cacagcagcaauaugcu

SEQ ID NO: 2168538 - RNA, 13 nt, Homo sapiens
aacacccuuucau

SEQ ID NO: 2168539 - RNA, 21 nt, Homo sapiens
cuggaauuguggcuauccuga

SEQ ID NO: 2168540 - RNA, 14 nt, Homo sapiens
guaaucaacauucc

SEQ ID NO: 2168541 - RNA, 23 nt, Homo sapiens
aauucugguauacauugaauuca

SEQ ID NO: 2168542 - RNA, 12 nt, Homo sapiens
uaaaaaauuuga

SEQ ID NO: 2168543 - RNA, 21 nt, Homo sapiens
gagaugguguguucugcaaua

SEQ ID NO: 2168544 - RNA, 18 nt, Homo sapiens
caaagauugaacacugcg

SEQ ID NO: 2168545 - RNA, 21 nt, Homo sapiens
ugaacuuggaaagaaaugccc

SEQ ID NO: 2168546 - RNA, 15 nt, Homo sapiens
guucccacuuaaaaa

SEQ ID NO: 2168547 - RNA, 15 nt, Homo sapiens
cagcccacccugcug

SEQ ID NO: 2168548 - RNA, 16 nt, Homo sapiens
agugauaugcauuucc

SEQ ID NO: 2168549 - RNA, 22 nt, Homo sapiens
acaaccugcaucuuuagugcuu

SEQ ID NO: 2168550 - RNA, 19 nt, Homo sapiens
augcacaaaacuuugauuc

SEQ ID NO: 2168551 - RNA, 19 nt, Homo sapiens
gcaucaucucuuccucaca

SEQ ID NO: 2168552 - RNA, 21 nt, Homo sapiens
aaugcuaugacuguaucuuga

SEQ ID NO: 2168553 - RNA, 23 nt, Homo sapiens
ccuguccuccaacaccaagcaca

SEQ ID NO: 2168554 - RNA, 18 nt, Homo sapiens
gagcacuguguaaccagc

SEQ ID NO: 2168555 - RNA, 15 nt, Homo sapiens
uccaaggucucauga

SEQ ID NO: 2168556 - RNA, 22 nt, Homo sapiens
uguuaucgaacacauucaguga

SEQ ID NO: 2168557 - RNA, 22 nt, Homo sapiens
aagcacuguggaacugcuauuu

SEQ ID NO: 2168558 - RNA, 22 nt, Homo sapiens
ugcuuugaaaacaugacucaau

SEQ ID NO: 2168559 - RNA, 15 nt, Homo sapiens
acucuaaguguaaaa

SEQ ID NO: 2168560 - RNA, 21 nt, Homo sapiens
ucaaaguagguauacaaaaga

SEQ ID NO: 2168561 - RNA, 15 nt, Homo sapiens
auuggccuguucccc

SEQ ID NO: 2168562 - RNA, 15 nt, Homo sapiens
agccaucucuaauaa

SEQ ID NO: 2168563 - RNA, 15 nt, Homo sapiens
uucauaaugugagau

SEQ ID NO: 2168564 - RNA, 9 nt, Homo sapiens
ugugugaga

SEQ ID NO: 2168565 - RNA, 20 nt, Homo sapiens
agaauucacuuuaugugaga

SEQ ID NO: 2168566 - RNA, 17 nt, Homo sapiens
acugccaaaaugcucua

SEQ ID NO: 2168567 - RNA, 17 nt, Homo sapiens
gcagcgggcuaacggga

SEQ ID NO: 2168568 - RNA, 15 nt, Homo sapiens
aaugccaaugucagc

SEQ ID NO: 2168569 - RNA, 23 nt, Homo sapiens
gugucucugcgccugaguaacga

SEQ ID NO: 2168570 - RNA, 20 nt, Homo sapiens
acugggugaaucuggcagga

SEQ ID NO: 2168571 - RNA, 17 nt, Homo sapiens
ugugaguuuccacugca

SEQ ID NO: 2168572 - RNA, 14 nt, Homo sapiens
cuggaacacaaaac

SEQ ID NO: 2168573 - RNA, 21 nt, Homo sapiens
uccucugggcagcgcuaucua

SEQ ID NO: 2168574 - RNA, 21 nt, Homo sapiens
gcucaaaaccuccaaggaccu

SEQ ID NO: 2168575 - RNA, 22 nt, Homo sapiens
acaguuggggcuguucauggca

SEQ ID NO: 2168576 - RNA, 20 nt, Homo sapiens
guguccugaccaggcccugc

SEQ ID NO: 2168577 - RNA, 18 nt, Homo sapiens
gcccucggguccaugugu

SEQ ID NO: 2168578 - RNA, 15 nt, Homo sapiens
auuccaauacauuga

SEQ ID NO: 2168579 - RNA, 22 nt, Homo sapiens
aaauacacagugcugaccagac

SEQ ID NO: 2168580 - RNA, 21 nt, Homo sapiens
ggucuagucacgcaugcagug

SEQ ID NO: 2168581 - RNA, 13 nt, Homo sapiens
cauauuaucucau

SEQ ID NO: 2168582 - RNA, 17 nt, Homo sapiens
gauaaucagaagcuaua

SEQ ID NO: 2168583 - RNA, 15 nt, Homo sapiens
agucucaguucucuu

SEQ ID NO: 2168584 - RNA, 19 nt, Homo sapiens
aauauaggcacauuaccau

SEQ ID NO: 2168585 - RNA, 23 nt, Homo sapiens
ccaggcuggagugcaguggcaca

SEQ ID NO: 2168586 - RNA, 19 nt, Homo sapiens
acggaguacagacgucuca

SEQ ID NO: 2168587 - RNA, 15 nt, Homo sapiens
uaaugaaaacauuaa

SEQ ID NO: 2168588 - RNA, 22 nt, Homo sapiens
auaggugaaggaacuagggaua

SEQ ID NO: 2168589 - RNA, 17 nt, Homo sapiens
ggccuaccccaguuccu

SEQ ID NO: 2168590 - RNA, 23 nt, Homo sapiens
agcacauguugcuaaugacagug

SEQ ID NO: 2168591 - RNA, 17 nt, Homo sapiens
cuuuaacaagacuucaa

SEQ ID NO: 2168592 - RNA, 13 nt, Homo sapiens
ggacagaaugugu

SEQ ID NO: 2168593 - RNA, 16 nt, Homo sapiens
guucagaggugcagcu

SEQ ID NO: 2168594 - RNA, 18 nt, Homo sapiens
aaauaugcccaauuucau

SEQ ID NO: 2168595 - RNA, 16 nt, Homo sapiens
uuugcccuuuggccag

SEQ ID NO: 2168596 - RNA, 13 nt, Homo sapiens
acugagcaugcag

SEQ ID NO: 2168597 - RNA, 19 nt, Homo sapiens
acccacucaugacugcaug

SEQ ID NO: 2168598 - RNA, 23 nt, Homo sapiens
aaaguuugggaagggaugggaga

SEQ ID NO: 2168599 - RNA, 16 nt, Homo sapiens
acggugaauggcuuug

SEQ ID NO: 2168600 - RNA, 17 nt, Homo sapiens
gccccggaccuaccucc

SEQ ID NO: 2168601 - RNA, 18 nt, Homo sapiens
uugagcccaggaguucaa

SEQ ID NO: 2168602 - RNA, 20 nt, Homo sapiens
ggccucccaaagugcuggga

SEQ ID NO: 2168603 - RNA, 15 nt, Homo sapiens
cugugaugacauucc

SEQ ID NO: 2168604 - RNA, 16 nt, Homo sapiens
uaaaaugguucauauu

SEQ ID NO: 2168605 - RNA, 20 nt, Homo sapiens
uaagcagguaacuagcugag

SEQ ID NO: 2168606 - RNA, 15 nt, Homo sapiens
uauaauguugccagc

SEQ ID NO: 2168607 - RNA, 22 nt, Homo sapiens
ccaguauuuuuauuucuuuaau

SEQ ID NO: 2168608 - RNA, 15 nt, Homo sapiens
uauucuucauaacaa

SEQ ID NO: 2168609 - RNA, 20 nt, Homo sapiens
cagccaagccagucaaggau

SEQ ID NO: 2168610 - RNA, 21 nt, Homo sapiens
uaucaauguucuaguucugug

SEQ ID NO: 2168611 - RNA, 20 nt, Homo sapiens
cuccgagaggugggccaguc

SEQ ID NO: 2168612 - RNA, 14 nt, Homo sapiens
cacacacacgcacg

SEQ ID NO: 2168613 - RNA, 14 nt, Homo sapiens
ucauucaacacauu

SEQ ID NO: 2168614 - RNA, 18 nt, Homo sapiens
uuaaacagugaacuuguc

SEQ ID NO: 2168615 - RNA, 15 nt, Homo sapiens
gaguauaccaugaga

SEQ ID NO: 2168616 - RNA, 20 nt, Homo sapiens
uggcuuaaugcuucuuucau

SEQ ID NO: 2168617 - RNA, 23 nt, Homo sapiens
uuaaagugaacacacacaaggga

SEQ ID NO: 2168618 - RNA, 21 nt, Homo sapiens
cugaggguccccaccugggac

SEQ ID NO: 2168619 - RNA, 23 nt, Homo sapiens
aacagacaaagcugggauuucag

SEQ ID NO: 2168620 - RNA, 19 nt, Homo sapiens
uagaguuccuuucugggaa

SEQ ID NO: 2168621 - RNA, 13 nt, Homo sapiens
uacacaaagaaua

SEQ ID NO: 2168622 - RNA, 22 nt, Homo sapiens
uuucaaggaaaaaugcugcuuc

SEQ ID NO: 2168623 - RNA, 14 nt, Homo sapiens
cuuuuguguagcuc

SEQ ID NO: 2168624 - RNA, 19 nt, Homo sapiens
cagaagcagcagaccuccu

SEQ ID NO: 2168625 - RNA, 17 nt, Homo sapiens
ccugaugacacccaccc

SEQ ID NO: 2168626 - RNA, 14 nt, Homo sapiens
gauggggcaucggu

SEQ ID NO: 2168627 - RNA, 13 nt, Homo sapiens
agauugauacuuu

SEQ ID NO: 2168628 - RNA, 18 nt, Homo sapiens
guuggacccgcucuggac

SEQ ID NO: 2168629 - RNA, 22 nt, Homo sapiens
ccucccagaaagcaaaccugua

SEQ ID NO: 2168630 - RNA, 16 nt, Homo sapiens
uauaaugugcccaaag

SEQ ID NO: 2168631 - RNA, 13 nt, Homo sapiens
cagauagaccugu

SEQ ID NO: 2168632 - RNA, 16 nt, Homo sapiens
gcuauugucuguaaua

SEQ ID NO: 2168633 - RNA, 11 nt, Homo sapiens
ccucugcauuu

SEQ ID NO: 2168634 - RNA, 14 nt, Homo sapiens
gugauaucuuucuc

SEQ ID NO: 2168635 - RNA, 19 nt, Homo sapiens
uccauauuuuuugcacagc

SEQ ID NO: 2168636 - RNA, 16 nt, Homo sapiens
ugguuauaaaagugau

SEQ ID NO: 2168637 - RNA, 14 nt, Homo sapiens
uacucaauggagua

SEQ ID NO: 2168638 - RNA, 22 nt, Homo sapiens
ucccuuaauauugaggcugcag

SEQ ID NO: 2168639 - RNA, 19 nt, Homo sapiens
gagggcgaguucagcaaag

SEQ ID NO: 2168640 - RNA, 15 nt, Homo sapiens
auaggaagaaaauuu

SEQ ID NO: 2168641 - RNA, 22 nt, Homo sapiens
cauuuauauugcagauugaaua

SEQ ID NO: 2168642 - RNA, 21 nt, Homo sapiens
aguagaucuguggcgauauga

SEQ ID NO: 2168643 - RNA, 17 nt, Homo sapiens
uguauuuuuaauagaga

SEQ ID NO: 2168644 - RNA, 15 nt, Homo sapiens
aaaguuuaccagaaa

SEQ ID NO: 2168645 - RNA, 17 nt, Homo sapiens
uaaagguuuauguggaa

SEQ ID NO: 2168646 - RNA, 18 nt, Homo sapiens
uucuacccuguugcaaag

SEQ ID NO: 2168647 - RNA, 12 nt, Homo sapiens
agccacaugccc

SEQ ID NO: 2168648 - RNA, 21 nt, Homo sapiens
gaaaagcugaauccagaucau

SEQ ID NO: 2168649 - RNA, 23 nt, Homo sapiens
auucucaugccucagccucccag

SEQ ID NO: 2168650 - RNA, 19 nt, Homo sapiens
uccaaacauucuccaguaa

SEQ ID NO: 2168651 - RNA, 21 nt, Homo sapiens
cugccuagucgggacuuguaa

SEQ ID NO: 2168652 - RNA, 15 nt, Homo sapiens
caacuguggacucca

SEQ ID NO: 2168653 - RNA, 20 nt, Homo sapiens
gcuauuucuucuacugcuau

SEQ ID NO: 2168654 - RNA, 15 nt, Homo sapiens
aacuauuuaaaggaa

SEQ ID NO: 2168655 - RNA, 21 nt, Homo sapiens
cuggagggaagcaccaugaau

SEQ ID NO: 2168656 - RNA, 15 nt, Homo sapiens
cuuggagcucugagu

SEQ ID NO: 2168657 - RNA, 18 nt, Homo sapiens
ccuguccugaaagccaca

SEQ ID NO: 2168658 - RNA, 14 nt, Homo sapiens
agaaaacuaaguca

SEQ ID NO: 2168659 - RNA, 17 nt, Homo sapiens
aaggaaggacuaugaca

SEQ ID NO: 2168660 - RNA, 13 nt, Homo sapiens
aaaacaauccuga

SEQ ID NO: 2168661 - RNA, 16 nt, Homo sapiens
gcucauuuuugcuguu

SEQ ID NO: 2168662 - RNA, 14 nt, Homo sapiens
auaaacauuccaga

SEQ ID NO: 2168663 - RNA, 19 nt, Homo sapiens
ggcuguucuagacacagug

SEQ ID NO: 2168664 - RNA, 18 nt, Homo sapiens
ucccugggccaacagacc

SEQ ID NO: 2168665 - RNA, 22 nt, Homo sapiens
auacauccccaucccucuacuu

SEQ ID NO: 2168666 - RNA, 16 nt, Homo sapiens
cgggaagcaaaugcga

SEQ ID NO: 2168667 - RNA, 22 nt, Homo sapiens
aaguuuugcucuugucacccag

SEQ ID NO: 2168668 - RNA, 17 nt, Homo sapiens
gccuccaauugcagugg

SEQ ID NO: 2168669 - RNA, 23 nt, Homo sapiens
cggcuuggcuagucacauaucaa

SEQ ID NO: 2168670 - RNA, 12 nt, Homo sapiens
aucccaccaaau

SEQ ID NO: 2168671 - RNA, 14 nt, Homo sapiens
cgcucaaugcccag

SEQ ID NO: 2168672 - RNA, 22 nt, Homo sapiens
ugcuuacuaugaccuuccaagu

SEQ ID NO: 2168673 - RNA, 17 nt, Homo sapiens
gccaggacaaaaugcaa

SEQ ID NO: 2168674 - RNA, 16 nt, Homo sapiens
agauucuaaucccaac

SEQ ID NO: 2168675 - RNA, 18 nt, Homo sapiens
aaagaaauacaguacugu

SEQ ID NO: 2168676 - RNA, 19 nt, Homo sapiens
uuucugcucuauacugugg

SEQ ID NO: 2168677 - RNA, 13 nt, Homo sapiens
agcaaauugauua

SEQ ID NO: 2168678 - RNA, 14 nt, Homo sapiens
aaauacagcacuuu

SEQ ID NO: 2168679 - RNA, 21 nt, Homo sapiens
cauucuuauggccacaagcaa

SEQ ID NO: 2168680 - RNA, 19 nt, Homo sapiens
uccccucgcccaucagugc

SEQ ID NO: 2168681 - RNA, 18 nt, Homo sapiens
caugguuuagggugauca

SEQ ID NO: 2168682 - RNA, 16 nt, Homo sapiens
guugaccacuccagag

SEQ ID NO: 2168683 - RNA, 13 nt, Homo sapiens
ggagcgcuaccca

SEQ ID NO: 2168684 - RNA, 16 nt, Homo sapiens
aaggaaauaucaucgu

SEQ ID NO: 2168685 - RNA, 14 nt, Homo sapiens
auuuaaaaacauuu

SEQ ID NO: 2168686 - RNA, 24 nt, Homo sapiens
aaaucaucaucaugaugaugauaa

SEQ ID NO: 2168687 - RNA, 16 nt, Homo sapiens
ccugagcaacauggug

SEQ ID NO: 2168688 - RNA, 17 nt, Homo sapiens
agaucacaccacuacac

SEQ ID NO: 2168689 - RNA, 17 nt, Homo sapiens
agaucgcaccacugcac

SEQ ID NO: 2168690 - RNA, 19 nt, Homo sapiens
auuuagaaaaacaucccaa

SEQ ID NO: 2168691 - RNA, 23 nt, Homo sapiens
acuccaccgaccaacugcccuaa

SEQ ID NO: 2168692 - RNA, 16 nt, Homo sapiens
accugcucugugccca

SEQ ID NO: 2168693 - RNA, 22 nt, Homo sapiens
augaugugugaguguaauucca

SEQ ID NO: 2168694 - RNA, 20 nt, Homo sapiens
ucccaaguagcugagauuac

SEQ ID NO: 2168695 - RNA, 19 nt, Homo sapiens
uccugaauccaaacuaauc

SEQ ID NO: 2168696 - RNA, 23 nt, Homo sapiens
gccaguacucgggacagacuaag

SEQ ID NO: 2168697 - RNA, 14 nt, Homo sapiens
caaugcuuugauaa

SEQ ID NO: 2168698 - RNA, 14 nt, Homo sapiens
uugagaacauuccc

SEQ ID NO: 2168699 - RNA, 13 nt, Homo sapiens
uacuuacagcaua

SEQ ID NO: 2168700 - RNA, 22 nt, Homo sapiens
uccauguuugcaccugugcauu

SEQ ID NO: 2168701 - RNA, 13 nt, Homo sapiens
gcaggacuugcac

SEQ ID NO: 2168702 - RNA, 22 nt, Homo sapiens
augcucuuuuguuuggguuaca

SEQ ID NO: 2168703 - RNA, 15 nt, Homo sapiens
agcacaaacacaagg

SEQ ID NO: 2168704 - RNA, 15 nt, Homo sapiens
uccccuucuagccuu

SEQ ID NO: 2168705 - RNA, 16 nt, Homo sapiens
gccacccaccccaagc

SEQ ID NO: 2168706 - RNA, 21 nt, Homo sapiens
uaagaauaauugaacaauaaa

SEQ ID NO: 2168707 - RNA, 22 nt, Homo sapiens
gucuuuauuauuuacuuugcau

SEQ ID NO: 2168708 - RNA, 16 nt, Homo sapiens
ucaauuuuauaucuag

SEQ ID NO: 2168709 - RNA, 15 nt, Homo sapiens
gugacaggcaguguu

SEQ ID NO: 2168710 - RNA, 20 nt, Homo sapiens
ugaaguaggugugacuugaa

SEQ ID NO: 2168711 - RNA, 16 nt, Homo sapiens
ugcuugguugucucca

SEQ ID NO: 2168712 - RNA, 23 nt, Homo sapiens
uaaugcacucugggucuggccag

SEQ ID NO: 2168713 - RNA, 12 nt, Homo sapiens
uugaggggagca

SEQ ID NO: 2168714 - RNA, 15 nt, Homo sapiens
gucccagcuacucag

SEQ ID NO: 2168715 - RNA, 12 nt, Homo sapiens
uccacuguaaau

SEQ ID NO: 2168716 - RNA, 16 nt, Homo sapiens
cuuaaaaaaagcacau

SEQ ID NO: 2168717 - RNA, 19 nt, Homo sapiens
ucucaagcucuuccuuacu

SEQ ID NO: 2168718 - RNA, 20 nt, Homo sapiens
gucaaucccaaaagucacca

SEQ ID NO: 2168719 - RNA, 18 nt, Homo sapiens
cacaauaccuacaauaaa

SEQ ID NO: 2168720 - RNA, 19 nt, Homo sapiens
uauaaaauuuacugucuaa

SEQ ID NO: 2168721 - RNA, 15 nt, Homo sapiens
ccccauccuggccca

SEQ ID NO: 2168722 - RNA, 12 nt, Homo sapiens
aaaagcaacuuu

SEQ ID NO: 2168723 - RNA, 13 nt, Homo sapiens
auuauucccauga

SEQ ID NO: 2168724 - RNA, 17 nt, Homo sapiens
agagcccgcagggccau

SEQ ID NO: 2168725 - RNA, 14 nt, Homo sapiens
aacuacaucugccu

SEQ ID NO: 2168726 - RNA, 19 nt, Homo sapiens
aaguaguccagccuuccag

SEQ ID NO: 2168727 - RNA, 21 nt, Homo sapiens
gcaaccuccgccuccuggguu

SEQ ID NO: 2168728 - RNA, 19 nt, Homo sapiens
guacaccacuuucccacac

SEQ ID NO: 2168729 - RNA, 12 nt, Homo sapiens
uaagccaaaaaa

SEQ ID NO: 2168730 - RNA, 17 nt, Homo sapiens
agcuggacugcagggga

SEQ ID NO: 2168731 - RNA, 23 nt, Homo sapiens
auucugaaaggaaauacacuucu

SEQ ID NO: 2168732 - RNA, 13 nt, Homo sapiens
aaaaaucuuugau

SEQ ID NO: 2168733 - RNA, 22 nt, Homo sapiens
aaugauguuaucuuaacacuga

SEQ ID NO: 2168734 - RNA, 12 nt, Homo sapiens
ucaaacucccua

SEQ ID NO: 2168735 - RNA, 22 nt, Homo sapiens
uccagcaucgucucauguaaaa

SEQ ID NO: 2168736 - RNA, 18 nt, Homo sapiens
uucuugggaguauguugu

SEQ ID NO: 2168737 - RNA, 19 nt, Homo sapiens
acuggacagucacugccac

SEQ ID NO: 2168738 - RNA, 17 nt, Homo sapiens
auccaugcggccggccu

SEQ ID NO: 2168739 - RNA, 19 nt, Homo sapiens
gguuaaaggaaaagcacaa

SEQ ID NO: 2168740 - RNA, 20 nt, Homo sapiens
agaugcauguuacugccaaa

SEQ ID NO: 2168741 - RNA, 10 nt, Homo sapiens
caacugauga

SEQ ID NO: 2168742 - RNA, 14 nt, Homo sapiens
acagaaccacugag

SEQ ID NO: 2168743 - RNA, 14 nt, Homo sapiens
aauucagcaaagaa

SEQ ID NO: 2168744 - RNA, 19 nt, Homo sapiens
gaagccagaucuaugccac

SEQ ID NO: 2168745 - RNA, 18 nt, Homo sapiens
uggcuucaaaaagccaca

SEQ ID NO: 2168746 - RNA, 18 nt, Homo sapiens
aguguuauaugaacauac

SEQ ID NO: 2168747 - RNA, 15 nt, Homo sapiens
gaucgacgugaucaa

SEQ ID NO: 2168748 - RNA, 18 nt, Homo sapiens
gagaagauuuuauucuua

SEQ ID NO: 2168749 - RNA, 14 nt, Homo sapiens
ugagaaacugggaa

SEQ ID NO: 2168750 - RNA, 14 nt, Homo sapiens
auacauacaugcau

SEQ ID NO: 2168751 - RNA, 13 nt, Homo sapiens
agggaacaaggaa

SEQ ID NO: 2168752 - RNA, 13 nt, Homo sapiens
ugugcacauguac

SEQ ID NO: 2168753 - RNA, 13 nt, Homo sapiens
cugaaacacugga

SEQ ID NO: 2168754 - RNA, 14 nt, Homo sapiens
cagugugaugcaau

SEQ ID NO: 2168755 - RNA, 16 nt, Homo sapiens
ugacaggauguggcac

SEQ ID NO: 2168756 - RNA, 11 nt, Homo sapiens
cucugaaaugc

SEQ ID NO: 2168757 - RNA, 21 nt, Homo sapiens
caucaugcccucucucgggag

SEQ ID NO: 2168758 - RNA, 21 nt, Homo sapiens
cuaggacucaggccugccaau

SEQ ID NO: 2168759 - RNA, 15 nt, Homo sapiens
ugggccccaccauuu

SEQ ID NO: 2168760 - RNA, 18 nt, Homo sapiens
auugcuaaaagcauguau

SEQ ID NO: 2168761 - RNA, 21 nt, Homo sapiens
gacuagaauagugcauuguau

SEQ ID NO: 2168762 - RNA, 17 nt, Homo sapiens
aaaacauaauguaucau

SEQ ID NO: 2168763 - RNA, 18 nt, Homo sapiens
acuccucuuauuugcuca

SEQ ID NO: 2168764 - RNA, 22 nt, Homo sapiens
acauugauuugcucuuacuaca

SEQ ID NO: 2168765 - RNA, 14 nt, Homo sapiens
cuguguuacuugaa

SEQ ID NO: 2168766 - RNA, 17 nt, Homo sapiens
cgccaggcugaccacag

SEQ ID NO: 2168767 - RNA, 12 nt, Homo sapiens
ugcuaaccugga

SEQ ID NO: 2168768 - RNA, 16 nt, Homo sapiens
cugaccuccuccuuca

SEQ ID NO: 2168769 - RNA, 15 nt, Homo sapiens
guuucuuagauauga

SEQ ID NO: 2168770 - RNA, 20 nt, Homo sapiens
agguggcaaaguacuuguca

SEQ ID NO: 2168771 - RNA, 15 nt, Homo sapiens
aggaaggaaacagau

SEQ ID NO: 2168772 - RNA, 20 nt, Homo sapiens
ccaaaguccuuuuuuuccau

SEQ ID NO: 2168773 - RNA, 22 nt, Homo sapiens
augccgucucauauuuuuacaa

SEQ ID NO: 2168774 - RNA, 12 nt, Homo sapiens
uuaaaucauuca

SEQ ID NO: 2168775 - RNA, 18 nt, Homo sapiens
agaauucugguguuuaca

SEQ ID NO: 2168776 - RNA, 11 nt, Homo sapiens
gaaagcacuac

SEQ ID NO: 2168777 - RNA, 18 nt, Homo sapiens
ucuuccuuuucuuucucc

SEQ ID NO: 2168778 - RNA, 16 nt, Homo sapiens
gccccucuuagaagaa

SEQ ID NO: 2168779 - RNA, 18 nt, Homo sapiens
uaaagugacccuguucuc

SEQ ID NO: 2168780 - RNA, 18 nt, Homo sapiens
cucauagauuauuaucua

SEQ ID NO: 2168781 - RNA, 20 nt, Homo sapiens
uaccucauccaugcacuuua

SEQ ID NO: 2168782 - RNA, 14 nt, Homo sapiens
uacuuuuuacauac

SEQ ID NO: 2168783 - RNA, 18 nt, Homo sapiens
ggcaauuguccccaggga

SEQ ID NO: 2168784 - RNA, 22 nt, Homo sapiens
caacaugaugagguaguaccuu

SEQ ID NO: 2168785 - RNA, 22 nt, Homo sapiens
uugucugucaaauguuuccuua

SEQ ID NO: 2168786 - RNA, 18 nt, Homo sapiens
uacaccuuccuacauuuu

SEQ ID NO: 2168787 - RNA, 18 nt, Homo sapiens
cucgaacuccugaccuca

SEQ ID NO: 2168788 - RNA, 24 nt, Homo sapiens
cugacacuguguaagaagcuguga

SEQ ID NO: 2168789 - RNA, 21 nt, Homo sapiens
aaauaguucuaaacuaucaau

SEQ ID NO: 2168790 - RNA, 21 nt, Homo sapiens
cuuugcuuuaaguguaacugg

SEQ ID NO: 2168791 - RNA, 18 nt, Homo sapiens
cuugaagaauaaauucua

SEQ ID NO: 2168792 - RNA, 13 nt, Homo sapiens
ucauuucuggaaa

SEQ ID NO: 2168793 - RNA, 13 nt, Homo sapiens
agcaggccaggga

SEQ ID NO: 2168794 - RNA, 21 nt, Homo sapiens
aucacauucuguuuaucaagc

SEQ ID NO: 2168795 - RNA, 16 nt, Homo sapiens
caagaggcuccugucc

SEQ ID NO: 2168796 - RNA, 17 nt, Homo sapiens
aaaauacaugcaucuca

SEQ ID NO: 2168797 - RNA, 17 nt, Homo sapiens
cagggugaagcagcuca

SEQ ID NO: 2168798 - RNA, 18 nt, Homo sapiens
cacagucauacaagucau

SEQ ID NO: 2168799 - RNA, 15 nt, Homo sapiens
uacuaauuaaucaca

SEQ ID NO: 2168800 - RNA, 18 nt, Homo sapiens
cugcucugcucagagucu

SEQ ID NO: 2168801 - RNA, 12 nt, Homo sapiens
uccccaccucag

SEQ ID NO: 2168802 - RNA, 24 nt, Homo sapiens
caucagcccaggucccagugccau

SEQ ID NO: 2168803 - RNA, 16 nt, Homo sapiens
ucuguuucaggcuucc

SEQ ID NO: 2168804 - RNA, 13 nt, Homo sapiens
auauauagcacau

SEQ ID NO: 2168805 - RNA, 23 nt, Homo sapiens
guacucuuuugggcaacggcccu

SEQ ID NO: 2168806 - RNA, 17 nt, Homo sapiens
cuccaccgccuauccca

SEQ ID NO: 2168807 - RNA, 21 nt, Homo sapiens
caaaggcucccuguguucuca

SEQ ID NO: 2168808 - RNA, 16 nt, Homo sapiens
uaaaaccaaacaugcu

SEQ ID NO: 2168809 - RNA, 20 nt, Homo sapiens
ggcccccaucuuggggguca

SEQ ID NO: 2168810 - RNA, 21 nt, Homo sapiens
uagcauucuuaaacugagaau

SEQ ID NO: 2168811 - RNA, 15 nt, Homo sapiens
cacagaggacucacu

SEQ ID NO: 2168812 - RNA, 21 nt, Homo sapiens
uuuaguagagacgggguuuca

SEQ ID NO: 2168813 - RNA, 13 nt, Homo sapiens
ccuaauucucuuc

SEQ ID NO: 2168814 - RNA, 19 nt, Homo sapiens
aacuaaacgucaccaaggu

SEQ ID NO: 2168815 - RNA, 16 nt, Homo sapiens
uucauaaguauuucaa

SEQ ID NO: 2168816 - RNA, 23 nt, Homo sapiens
cuagguucuaaaaauugugauca

SEQ ID NO: 2168817 - RNA, 16 nt, Homo sapiens
cuuuuccuuugcuagu

SEQ ID NO: 2168818 - RNA, 17 nt, Homo sapiens
ucauuguacaaguauua

SEQ ID NO: 2168819 - RNA, 17 nt, Homo sapiens
acauaaaauaagagauc

SEQ ID NO: 2168820 - RNA, 16 nt, Homo sapiens
agaacuguuuucucaa

SEQ ID NO: 2168821 - RNA, 19 nt, Homo sapiens
acagacuuaacagcccagc

SEQ ID NO: 2168822 - RNA, 19 nt, Homo sapiens
uaauucacucaagcacuga

SEQ ID NO: 2168823 - RNA, 20 nt, Homo sapiens
auaggugcuacaaaaacaca

SEQ ID NO: 2168824 - RNA, 18 nt, Homo sapiens
ccaaugagacucuagggu

SEQ ID NO: 2168825 - RNA, 16 nt, Homo sapiens
gauuaacggccuggau

SEQ ID NO: 2168826 - RNA, 19 nt, Homo sapiens
ugucacugccugacauuca

SEQ ID NO: 2168827 - RNA, 18 nt, Homo sapiens
guuuaggcauccugugug

SEQ ID NO: 2168828 - RNA, 17 nt, Homo sapiens
ccuucccauuggcuuuc

SEQ ID NO: 2168829 - RNA, 15 nt, Homo sapiens
cuuuuacuaagcacu

SEQ ID NO: 2168830 - RNA, 18 nt, Homo sapiens
cagacuauaaaaucugga

SEQ ID NO: 2168831 - RNA, 23 nt, Homo sapiens
ggcguuuggacccaguucaguga

SEQ ID NO: 2168832 - RNA, 23 nt, Homo sapiens
gaccuucccagcuagaauucacu

SEQ ID NO: 2168833 - RNA, 21 nt, Homo sapiens
guauuuguauuaauaaagcau

SEQ ID NO: 2168834 - RNA, 14 nt, Homo sapiens
ccauguauucccuu

SEQ ID NO: 2168835 - RNA, 14 nt, Homo sapiens
uuuuuguaauguga

SEQ ID NO: 2168836 - RNA, 20 nt, Homo sapiens
cugaaggggaggucacagcc

SEQ ID NO: 2168837 - RNA, 22 nt, Homo sapiens
aauguuaucggcucuauucucu

SEQ ID NO: 2168838 - RNA, 16 nt, Homo sapiens
acaucaucucuuccau

SEQ ID NO: 2168839 - RNA, 17 nt, Homo sapiens
aauaagcaggacagagg

SEQ ID NO: 2168840 - RNA, 15 nt, Homo sapiens
aggccuggagggcac

SEQ ID NO: 2168841 - RNA, 14 nt, Homo sapiens
ucaauguccaguga

SEQ ID NO: 2168842 - RNA, 19 nt, Homo sapiens
auauuuaucucuuccugcu

SEQ ID NO: 2168843 - RNA, 18 nt, Homo sapiens
ucaauaaagcacugagca

SEQ ID NO: 2168844 - RNA, 22 nt, Homo sapiens
uuccauguucugggugauggaa

SEQ ID NO: 2168845 - RNA, 14 nt, Homo sapiens
ucuauaaacagaca

SEQ ID NO: 2168846 - RNA, 18 nt, Homo sapiens
acaggagcccugcuauga

SEQ ID NO: 2168847 - RNA, 15 nt, Homo sapiens
aggucuuucuccuca

SEQ ID NO: 2168848 - RNA, 15 nt, Homo sapiens
guuuuaacauuauuu

SEQ ID NO: 2168849 - RNA, 16 nt, Homo sapiens
guauucgcuugagaaa

SEQ ID NO: 2168850 - RNA, 14 nt, Homo sapiens
auccagcaguccaa

SEQ ID NO: 2168851 - RNA, 21 nt, Homo sapiens
aagaacaguuugguugaugca

SEQ ID NO: 2168852 - RNA, 12 nt, Homo sapiens
aaguacuuccac

SEQ ID NO: 2168853 - RNA, 21 nt, Homo sapiens
cagaaacccuucagugcuaca

SEQ ID NO: 2168854 - RNA, 14 nt, Homo sapiens
caaaagcagaacac

SEQ ID NO: 2168855 - RNA, 15 nt, Homo sapiens
uguccacauaaucca

SEQ ID NO: 2168856 - RNA, 15 nt, Homo sapiens
cuauggccuaugugc

SEQ ID NO: 2168857 - RNA, 14 nt, Homo sapiens
uuuccucugcagca

SEQ ID NO: 2168858 - RNA, 22 nt, Homo sapiens
guggcucuugccuguaauccca

SEQ ID NO: 2168859 - RNA, 13 nt, Homo sapiens
agagacugaguca

SEQ ID NO: 2168860 - RNA, 21 nt, Homo sapiens
ucacauucugcauacuaaccu

SEQ ID NO: 2168861 - RNA, 14 nt, Homo sapiens
uuuccguuuugccu

SEQ ID NO: 2168862 - RNA, 15 nt, Homo sapiens
ucccacugcacucca

SEQ ID NO: 2168863 - RNA, 15 nt, Homo sapiens
uugaaccagugaucc

SEQ ID NO: 2168864 - RNA, 17 nt, Homo sapiens
uagcugaggcugagaaa

SEQ ID NO: 2168865 - RNA, 16 nt, Homo sapiens
uccucugggcccuguc

SEQ ID NO: 2168866 - RNA, 17 nt, Homo sapiens
cacaaagggaauugccu

SEQ ID NO: 2168867 - RNA, 18 nt, Homo sapiens
agccagugcugucuggga

SEQ ID NO: 2168868 - RNA, 18 nt, Homo sapiens
cgcagauguccuugaugc

SEQ ID NO: 2168869 - RNA, 15 nt, Homo sapiens
gaaucacaguauugu

SEQ ID NO: 2168870 - RNA, 16 nt, Homo sapiens
uguguugcccucugcc

SEQ ID NO: 2168871 - RNA, 14 nt, Homo sapiens
guacucaauggagu

SEQ ID NO: 2168872 - RNA, 20 nt, Homo sapiens
cucacgccuguaaucccagc

SEQ ID NO: 2168873 - RNA, 12 nt, Homo sapiens
uaauugcauucu

SEQ ID NO: 2168874 - RNA, 12 nt, Homo sapiens
aacaugcaauaa

SEQ ID NO: 2168875 - RNA, 15 nt, Homo sapiens
uggaaaccguguaaa

SEQ ID NO: 2168876 - RNA, 18 nt, Homo sapiens
cugcacacccuccagaga

SEQ ID NO: 2168877 - RNA, 19 nt, Homo sapiens
uuauauauuugauacauau

SEQ ID NO: 2168878 - RNA, 16 nt, Homo sapiens
ucccaucugugguuuu

SEQ ID NO: 2168879 - RNA, 13 nt, Homo sapiens
uguaaacagcucu

SEQ ID NO: 2168880 - RNA, 12 nt, Homo sapiens
auuuucacauau

SEQ ID NO: 2168881 - RNA, 16 nt, Homo sapiens
uccauccacguggccu

SEQ ID NO: 2168882 - RNA, 15 nt, Homo sapiens
acucaccccuagccc

SEQ ID NO: 2168883 - RNA, 14 nt, Homo sapiens
uguauauugucuag

SEQ ID NO: 2168884 - RNA, 21 nt, Homo sapiens
agaaaaucaucaagaagggcu

SEQ ID NO: 2168885 - RNA, 19 nt, Homo sapiens
cauucuugcuaauucucag

SEQ ID NO: 2168886 - RNA, 16 nt, Homo sapiens
cauguuguaaauggca

SEQ ID NO: 2168887 - RNA, 21 nt, Homo sapiens
auggggcagaaaucugaggaa

SEQ ID NO: 2168888 - RNA, 15 nt, Homo sapiens
aaagccaacagucaa

SEQ ID NO: 2168889 - RNA, 20 nt, Homo sapiens
ucuaucacccaggaaucuca

SEQ ID NO: 2168890 - RNA, 23 nt, Homo sapiens
ccaucuuuuguuacucuugggac

SEQ ID NO: 2168891 - RNA, 21 nt, Homo sapiens
caagugauccuuccaccucag

SEQ ID NO: 2168892 - RNA, 19 nt, Homo sapiens
gcacaaauacggauccugc

SEQ ID NO: 2168893 - RNA, 17 nt, Homo sapiens
aaaaugagauucaguga

SEQ ID NO: 2168894 - RNA, 23 nt, Homo sapiens
augaagaaauuuaugaagcagau

SEQ ID NO: 2168895 - RNA, 17 nt, Homo sapiens
ggcuccauccguggcug

SEQ ID NO: 2168896 - RNA, 19 nt, Homo sapiens
gagcgagauuccgucucaa

SEQ ID NO: 2168897 - RNA, 20 nt, Homo sapiens
agaaauuccuuccuuaccug

SEQ ID NO: 2168898 - RNA, 14 nt, Homo sapiens
cuccagucuuccac

SEQ ID NO: 2168899 - RNA, 15 nt, Homo sapiens
accaaguaucacacu

SEQ ID NO: 2168900 - RNA, 16 nt, Homo sapiens
aaugugcucuaugucc

SEQ ID NO: 2168901 - RNA, 17 nt, Homo sapiens
uuuguggaaacugucau

SEQ ID NO: 2168902 - RNA, 13 nt, Homo sapiens
gagguuguaguga

SEQ ID NO: 2168903 - RNA, 20 nt, Homo sapiens
cuaaugccucuuaauugcau

SEQ ID NO: 2168904 - RNA, 17 nt, Homo sapiens
agaguccacuguggcac

SEQ ID NO: 2168905 - RNA, 20 nt, Homo sapiens
uuuccagcuacuuuugccaa

SEQ ID NO: 2168906 - RNA, 22 nt, Homo sapiens
agcaggccggaaccacagggcc

SEQ ID NO: 2168907 - RNA, 12 nt, Homo sapiens
aaaccucugggu

SEQ ID NO: 2168908 - RNA, 16 nt, Homo sapiens
uaaaauugaguucuca

SEQ ID NO: 2168909 - RNA, 20 nt, Homo sapiens
uaguucccuuugccaacaga

SEQ ID NO: 2168910 - RNA, 17 nt, Homo sapiens
aggcacagcaaacuguc

SEQ ID NO: 2168911 - RNA, 20 nt, Homo sapiens
accagccugggcaacauagu

SEQ ID NO: 2168912 - RNA, 23 nt, Homo sapiens
uggcagagcuuuuaccuguuauu

SEQ ID NO: 2168913 - RNA, 13 nt, Homo sapiens
augaaccacauua

SEQ ID NO: 2168914 - RNA, 12 nt, Homo sapiens
cccaaucccauu

SEQ ID NO: 2168915 - RNA, 16 nt, Homo sapiens
gguugagggaaauugc

SEQ ID NO: 2168916 - RNA, 21 nt, Homo sapiens
cugaauuuaucuuugauaaca

SEQ ID NO: 2168917 - RNA, 18 nt, Homo sapiens
cugccccugccccaaguc

SEQ ID NO: 2168918 - RNA, 22 nt, Homo sapiens
caucgcuucuuuuucaaaacua

SEQ ID NO: 2168919 - RNA, 18 nt, Homo sapiens
caagcagaauguacuuga

SEQ ID NO: 2168920 - RNA, 20 nt, Homo sapiens
auaugauauauauguauaau

SEQ ID NO: 2168921 - RNA, 15 nt, Homo sapiens
ucugggccauucaga

SEQ ID NO: 2168922 - RNA, 12 nt, Homo sapiens
cuugagacccuc

SEQ ID NO: 2168923 - RNA, 17 nt, Homo sapiens
ucgucugucaaugacau

SEQ ID NO: 2168924 - RNA, 13 nt, Homo sapiens
auuuccagacaaa

SEQ ID NO: 2168925 - RNA, 19 nt, Homo sapiens
cuaaugucucuucuaacau

SEQ ID NO: 2168926 - RNA, 13 nt, Homo sapiens
cuagccugugcac

SEQ ID NO: 2168927 - RNA, 19 nt, Homo sapiens
agcgccacacacugcacau

SEQ ID NO: 2168928 - RNA, 12 nt, Homo sapiens
cugaaagacaga

SEQ ID NO: 2168929 - RNA, 19 nt, Homo sapiens
cucaauauuuacuauuuca

SEQ ID NO: 2168930 - RNA, 17 nt, Homo sapiens
uuccuuuauacugugaa

SEQ ID NO: 2168931 - RNA, 22 nt, Homo sapiens
cauuuuaucauagccuauugug

SEQ ID NO: 2168932 - RNA, 13 nt, Homo sapiens
gacccacugugcu

SEQ ID NO: 2168933 - RNA, 19 nt, Homo sapiens
auaggcauagaucuuugua

SEQ ID NO: 2168934 - RNA, 14 nt, Homo sapiens
gcugcagaaggcca

SEQ ID NO: 2168935 - RNA, 13 nt, Homo sapiens
gauaugcuguauu

SEQ ID NO: 2168936 - RNA, 15 nt, Homo sapiens
ucaacucacaccugc

SEQ ID NO: 2168937 - RNA, 22 nt, Homo sapiens
cuucucuacagacuccaaaagg

SEQ ID NO: 2168938 - RNA, 19 nt, Homo sapiens
auaaaucagccuaaauguc

SEQ ID NO: 2168939 - RNA, 23 nt, Homo sapiens
auggucacccccacucugcauac

SEQ ID NO: 2168940 - RNA, 13 nt, Homo sapiens
cuuauucauuccu

SEQ ID NO: 2168941 - RNA, 14 nt, Homo sapiens
gaaguucacaucag

SEQ ID NO: 2168942 - RNA, 23 nt, Homo sapiens
uauugcacuaggaauucuuugca

SEQ ID NO: 2168943 - RNA, 22 nt, Homo sapiens
cacccuugaaaauauaugacuu

SEQ ID NO: 2168944 - RNA, 15 nt, Homo sapiens
aaacugcuuuuccac

SEQ ID NO: 2168945 - RNA, 16 nt, Homo sapiens
aagugaaagacuugaa

SEQ ID NO: 2168946 - RNA, 15 nt, Homo sapiens
uaaagacagaaggcc

SEQ ID NO: 2168947 - RNA, 20 nt, Homo sapiens
ugccauccucacccagcacc

SEQ ID NO: 2168948 - RNA, 19 nt, Homo sapiens
ucacauuuuuuuaugcucu

SEQ ID NO: 2168949 - RNA, 20 nt, Homo sapiens
gucuccaaggaggugacacu

SEQ ID NO: 2168950 - RNA, 17 nt, Homo sapiens
uuaaacuuuaucucaca

SEQ ID NO: 2168951 - RNA, 15 nt, Homo sapiens
auaauaaaauuauca

SEQ ID NO: 2168952 - RNA, 15 nt, Homo sapiens
aaugcaaaaaagcca

SEQ ID NO: 2168953 - RNA, 12 nt, Homo sapiens
uuuacaauccau

SEQ ID NO: 2168954 - RNA, 13 nt, Homo sapiens
ccacaacugacac

SEQ ID NO: 2168955 - RNA, 16 nt, Homo sapiens
auuuaagguacuuaaa

SEQ ID NO: 2168956 - RNA, 21 nt, Homo sapiens
ggaaaucauugugugucuuca

SEQ ID NO: 2168957 - RNA, 14 nt, Homo sapiens
cuguggaacugcca

SEQ ID NO: 2168958 - RNA, 20 nt, Homo sapiens
gguagcagggggagugcugg

SEQ ID NO: 2168959 - RNA, 23 nt, Homo sapiens
gccuuacaaagggaaagccucug

SEQ ID NO: 2168960 - RNA, 19 nt, Homo sapiens
aacugccuuccccagggug

SEQ ID NO: 2168961 - RNA, 14 nt, Homo sapiens
cuguuggauaauua

SEQ ID NO: 2168962 - RNA, 18 nt, Homo sapiens
uugcaugaccacauagaa

SEQ ID NO: 2168963 - RNA, 23 nt, Homo sapiens
accccucaguuaauugcagucua

SEQ ID NO: 2168964 - RNA, 11 nt, Homo sapiens
uggcugaugau

SEQ ID NO: 2168965 - RNA, 17 nt, Homo sapiens
cagggcccccaucucau

SEQ ID NO: 2168966 - RNA, 13 nt, Homo sapiens
accagcccacccc

SEQ ID NO: 2168967 - RNA, 16 nt, Homo sapiens
augcccccuguggaug

SEQ ID NO: 2168968 - RNA, 16 nt, Homo sapiens
cccugccucacaucuc

SEQ ID NO: 2168969 - RNA, 16 nt, Homo sapiens
uaguaaacacagggaa

SEQ ID NO: 2168970 - RNA, 14 nt, Homo sapiens
cuuccacucuggaa

SEQ ID NO: 2168971 - RNA, 20 nt, Homo sapiens
uuucaaccuauacaaccuaa

SEQ ID NO: 2168972 - RNA, 17 nt, Homo sapiens
ucuaaaccauaugaaca

SEQ ID NO: 2168973 - RNA, 13 nt, Homo sapiens
auccuuccaacau

SEQ ID NO: 2168974 - RNA, 20 nt, Homo sapiens
ccacaauaagaguucuugcc

SEQ ID NO: 2168975 - RNA, 20 nt, Homo sapiens
augaugcccugcuccaggga

SEQ ID NO: 2168976 - RNA, 16 nt, Homo sapiens
ccaccagcaaugcccu

SEQ ID NO: 2168977 - RNA, 22 nt, Homo sapiens
uaaaauggcaacaaacugcaca

SEQ ID NO: 2168978 - RNA, 15 nt, Homo sapiens
cuauuaaaacucuuu

SEQ ID NO: 2168979 - RNA, 23 nt, Homo sapiens
gccaccuucccuccucaugccuu

SEQ ID NO: 2168980 - RNA, 23 nt, Homo sapiens
auugcgagagauguguguugaua

SEQ ID NO: 2168981 - RNA, 22 nt, Homo sapiens
aauaucuaccccauuuggugaa

SEQ ID NO: 2168982 - RNA, 13 nt, Homo sapiens
augcuguugugaa

SEQ ID NO: 2168983 - RNA, 23 nt, Homo sapiens
gggugccacgguggacuuagcuc

SEQ ID NO: 2168984 - RNA, 12 nt, Homo sapiens
ggauguacuuaa

SEQ ID NO: 2168985 - RNA, 22 nt, Homo sapiens
aaacagcuuccuguuacugaga

SEQ ID NO: 2168986 - RNA, 20 nt, Homo sapiens
uccgcuccugcgcucugcca

SEQ ID NO: 2168987 - RNA, 16 nt, Homo sapiens
aggcucugaggggcac

SEQ ID NO: 2168988 - RNA, 23 nt, Homo sapiens
gaggcuccaggacuccacuggac

SEQ ID NO: 2168989 - RNA, 17 nt, Homo sapiens
gaugcuuguucuuuggc

SEQ ID NO: 2168990 - RNA, 15 nt, Homo sapiens
cucuuggcaccugcc

SEQ ID NO: 2168991 - RNA, 16 nt, Homo sapiens
augccagcuuaucuca

SEQ ID NO: 2168992 - RNA, 14 nt, Homo sapiens
ccugaaaguaauuu

SEQ ID NO: 2168993 - RNA, 13 nt, Homo sapiens
cacauaugcaccu

SEQ ID NO: 2168994 - RNA, 22 nt, Homo sapiens
auuuaacugauuaaaaauaccu

SEQ ID NO: 2168995 - RNA, 15 nt, Homo sapiens
aucaugcuguuuuau

SEQ ID NO: 2168996 - RNA, 16 nt, Homo sapiens
uauugcauaauuuaua

SEQ ID NO: 2168997 - RNA, 18 nt, Homo sapiens
auuggugcucacugccag

SEQ ID NO: 2168998 - RNA, 14 nt, Homo sapiens
agcaugacugugca

SEQ ID NO: 2168999 - RNA, 12 nt, Homo sapiens
cgggaaaggagc

SEQ ID NO: 2169000 - RNA, 22 nt, Homo sapiens
ucugccagggcaccuacugaga

SEQ ID NO: 2169001 - RNA, 12 nt, Homo sapiens
cagccagcacuu

SEQ ID NO: 2169002 - RNA, 11 nt, Homo sapiens
ugaucucagcu

SEQ ID NO: 2169003 - RNA, 18 nt, Homo sapiens
ugucacuacacacuaaaa

SEQ ID NO: 2169004 - RNA, 17 nt, Homo sapiens
aguggguccaaguggcu

SEQ ID NO: 2169005 - RNA, 20 nt, Homo sapiens
gugguucucugggccucagu

SEQ ID NO: 2169006 - RNA, 20 nt, Homo sapiens
cuagagugcagggauuacag

SEQ ID NO: 2169007 - RNA, 22 nt, Homo sapiens
ugucacuucuucaccucuucca

SEQ ID NO: 2169008 - RNA, 16 nt, Homo sapiens
augcaagcuuggucaa

SEQ ID NO: 2169009 - RNA, 20 nt, Homo sapiens
uaauaauuugccauuaucug

SEQ ID NO: 2169010 - RNA, 15 nt, Homo sapiens
auguguaguguugcu

SEQ ID NO: 2169011 - RNA, 16 nt, Homo sapiens
cauaagauaguuacau

SEQ ID NO: 2169012 - RNA, 15 nt, Homo sapiens
aaacaccacugaaca

SEQ ID NO: 2169013 - RNA, 13 nt, Homo sapiens
agucauugcacaa

SEQ ID NO: 2169014 - RNA, 20 nt, Homo sapiens
agggcaucgagccaccaagc

SEQ ID NO: 2169015 - RNA, 12 nt, Homo sapiens
ggaggguggcca

SEQ ID NO: 2169016 - RNA, 16 nt, Homo sapiens
aacaaccugaaugucc

SEQ ID NO: 2169017 - RNA, 22 nt, Homo sapiens
cagaaaaguuucaaaccuacua

SEQ ID NO: 2169018 - RNA, 19 nt, Homo sapiens
agugcuggcucacaguaca

SEQ ID NO: 2169019 - RNA, 16 nt, Homo sapiens
accccgucaacaaauc

SEQ ID NO: 2169020 - RNA, 13 nt, Homo sapiens
ugcuggcugugac

SEQ ID NO: 2169021 - RNA, 15 nt, Homo sapiens
ugguuuugcuucccc

SEQ ID NO: 2169022 - RNA, 23 nt, Homo sapiens
auucuuggcuaaaggaucagcug

SEQ ID NO: 2169023 - RNA, 17 nt, Homo sapiens
acuccagaguguucuca

SEQ ID NO: 2169024 - RNA, 20 nt, Homo sapiens
cuggaaggugccacuccagu

SEQ ID NO: 2169025 - RNA, 20 nt, Homo sapiens
aucaaguguaauuagcuuuu

SEQ ID NO: 2169026 - RNA, 15 nt, Homo sapiens
ccagauagcugcauu

SEQ ID NO: 2169027 - RNA, 13 nt, Homo sapiens
aaucauacugucu

SEQ ID NO: 2169028 - RNA, 13 nt, Homo sapiens
aagguuacuggga

SEQ ID NO: 2169029 - RNA, 15 nt, Homo sapiens
cuaucaggucccauc

SEQ ID NO: 2169030 - RNA, 20 nt, Homo sapiens
uguguuuuauugacaucucu

SEQ ID NO: 2169031 - RNA, 13 nt, Homo sapiens
agacugaauuuaa

SEQ ID NO: 2169032 - RNA, 13 nt, Homo sapiens
auaaugaauguca

SEQ ID NO: 2169033 - RNA, 15 nt, Homo sapiens
auuguuccaagacau

SEQ ID NO: 2169034 - RNA, 20 nt, Homo sapiens
augcugggcucaucuucuag

SEQ ID NO: 2169035 - RNA, 14 nt, Homo sapiens
aagggucuguuuaa

SEQ ID NO: 2169036 - RNA, 22 nt, Homo sapiens
aaacaucacaccugcccuaaac

SEQ ID NO: 2169037 - RNA, 17 nt, Homo sapiens
acaggaugaccuggaua

SEQ ID NO: 2169038 - RNA, 19 nt, Homo sapiens
uggaacaagagaaguacua

SEQ ID NO: 2169039 - RNA, 15 nt, Homo sapiens
cugucauuaaacuca

SEQ ID NO: 2169040 - RNA, 21 nt, Homo sapiens
cucucaggcaugccuguguga

SEQ ID NO: 2169041 - RNA, 20 nt, Homo sapiens
aagugugauauacaaagugu

SEQ ID NO: 2169042 - RNA, 20 nt, Homo sapiens
auagagagguacacauuuau

SEQ ID NO: 2169043 - RNA, 12 nt, Homo sapiens
aaaagaguaugu

SEQ ID NO: 2169044 - RNA, 12 nt, Homo sapiens
cuaaaacaugau

SEQ ID NO: 2169045 - RNA, 22 nt, Homo sapiens
cacauaaugaaugcuauugaaa

SEQ ID NO: 2169046 - RNA, 18 nt, Homo sapiens
gugugauuuccuacagaa

SEQ ID NO: 2169047 - RNA, 17 nt, Homo sapiens
gaauacauggaaauauu

SEQ ID NO: 2169048 - RNA, 19 nt, Homo sapiens
cuguauauuuaucuuucaa

SEQ ID NO: 2169049 - RNA, 14 nt, Homo sapiens
uguauuaagccaau

SEQ ID NO: 2169050 - RNA, 18 nt, Homo sapiens
aguaucaugaagccuaaa

SEQ ID NO: 2169051 - RNA, 23 nt, Homo sapiens
ugcccuucucuuaucugccaugu

SEQ ID NO: 2169052 - RNA, 13 nt, Homo sapiens
aacugaaggcaua

SEQ ID NO: 2169053 - RNA, 21 nt, Homo sapiens
aaucagugccugguguucuga

SEQ ID NO: 2169054 - RNA, 19 nt, Homo sapiens
acacgguuuaacuguccca

SEQ ID NO: 2169055 - RNA, 13 nt, Homo sapiens
aucaguccugucc

SEQ ID NO: 2169056 - RNA, 12 nt, Homo sapiens
ggcuguucucca

SEQ ID NO: 2169057 - RNA, 19 nt, Homo sapiens
uggauccgugacagcacuu

SEQ ID NO: 2169058 - RNA, 15 nt, Homo sapiens
aaaaauaaauugcuc

SEQ ID NO: 2169059 - RNA, 16 nt, Homo sapiens
acacaauacaguauua

SEQ ID NO: 2169060 - RNA, 15 nt, Homo sapiens
uuuauucaaacuacc

SEQ ID NO: 2169061 - RNA, 16 nt, Homo sapiens
agaugugccuagacac

SEQ ID NO: 2169062 - RNA, 21 nt, Homo sapiens
gaaauuggaaaggacuuugug

SEQ ID NO: 2169063 - RNA, 19 nt, Homo sapiens
caagaagaccagacugugg

SEQ ID NO: 2169064 - RNA, 23 nt, Homo sapiens
auguucugggaaaauccacuaug

SEQ ID NO: 2169065 - RNA, 22 nt, Homo sapiens
uaacaaagguuacuguugagaa

SEQ ID NO: 2169066 - RNA, 22 nt, Homo sapiens
uuucauuaguauuccucauucu

SEQ ID NO: 2169067 - RNA, 22 nt, Homo sapiens
aauagcauuguuuuugucaugu

SEQ ID NO: 2169068 - RNA, 21 nt, Homo sapiens
ucuugaauccuuccauuccac

SEQ ID NO: 2169069 - RNA, 17 nt, Homo sapiens
uuccaaacucuucccuc

SEQ ID NO: 2169070 - RNA, 15 nt, Homo sapiens
gaaguaggcauauau

SEQ ID NO: 2169071 - RNA, 20 nt, Homo sapiens
cuccaaaugagacacauuaa

SEQ ID NO: 2169072 - RNA, 20 nt, Homo sapiens
ugucuucaccugccaccaca

SEQ ID NO: 2169073 - RNA, 22 nt, Homo sapiens
cuggacaccgggccaguaucua

SEQ ID NO: 2169074 - RNA, 12 nt, Homo sapiens
agaugucugugu

SEQ ID NO: 2169075 - RNA, 20 nt, Homo sapiens
ucucugcagaaacuacugac

SEQ ID NO: 2169076 - RNA, 17 nt, Homo sapiens
uuaucacuucauucaca

SEQ ID NO: 2169077 - RNA, 17 nt, Homo sapiens
gaagggacuagcuaucu

SEQ ID NO: 2169078 - RNA, 19 nt, Homo sapiens
auuggagaguaaaaacuga

SEQ ID NO: 2169079 - RNA, 18 nt, Homo sapiens
aauaaguauuuauugcau

SEQ ID NO: 2169080 - RNA, 13 nt, Homo sapiens
uacucaacauuau

SEQ ID NO: 2169081 - RNA, 13 nt, Homo sapiens
ccugggguucuca

SEQ ID NO: 2169082 - RNA, 19 nt, Homo sapiens
cacuacauuguacaaggaa

SEQ ID NO: 2169083 - RNA, 17 nt, Homo sapiens
ccuuggacugagaaauu

SEQ ID NO: 2169084 - RNA, 15 nt, Homo sapiens
guggcccguggcuug

SEQ ID NO: 2169085 - RNA, 23 nt, Homo sapiens
augaagugcuuuguaucaggaaa

SEQ ID NO: 2169086 - RNA, 18 nt, Homo sapiens
ucuccuuugcaggcucau

SEQ ID NO: 2169087 - RNA, 21 nt, Homo sapiens
accugaacacaucgugaugau

SEQ ID NO: 2169088 - RNA, 14 nt, Homo sapiens
acaaacaaguggau

SEQ ID NO: 2169089 - RNA, 18 nt, Homo sapiens
ggcagagguugcagugaa

SEQ ID NO: 2169090 - RNA, 18 nt, Homo sapiens
uacuuccucugcaaaaag

SEQ ID NO: 2169091 - RNA, 23 nt, Homo sapiens
gacuucccuaacacuuaccccau

SEQ ID NO: 2169092 - RNA, 16 nt, Homo sapiens
agaaaccccacuucca

SEQ ID NO: 2169093 - RNA, 17 nt, Homo sapiens
cauccacuucacaguuc

SEQ ID NO: 2169094 - RNA, 11 nt, Homo sapiens
aauuuaugcaa

SEQ ID NO: 2169095 - RNA, 15 nt, Homo sapiens
agaucauccuuucca

SEQ ID NO: 2169096 - RNA, 16 nt, Homo sapiens
agagggugacugugug

SEQ ID NO: 2169097 - RNA, 21 nt, Homo sapiens
acaaauccauggaccuaugac

SEQ ID NO: 2169098 - RNA, 23 nt, Homo sapiens
auuuaaaaaacauuuuacagauu

SEQ ID NO: 2169099 - RNA, 23 nt, Homo sapiens
ucuuggggacuaacccaaugccu

SEQ ID NO: 2169100 - RNA, 14 nt, Homo sapiens
agacaagcgccgcu

SEQ ID NO: 2169101 - RNA, 17 nt, Homo sapiens
gccaaggugggauuugu

SEQ ID NO: 2169102 - RNA, 12 nt, Homo sapiens
acuugugugaug

SEQ ID NO: 2169103 - RNA, 18 nt, Homo sapiens
aacguaucaauacaguuu

SEQ ID NO: 2169104 - RNA, 16 nt, Homo sapiens
ucagggagugggcuaa

SEQ ID NO: 2169105 - RNA, 21 nt, Homo sapiens
gucauugaugaacugccaaag

SEQ ID NO: 2169106 - RNA, 17 nt, Homo sapiens
gucucacaguguugccc

SEQ ID NO: 2169107 - RNA, 15 nt, Homo sapiens
guuccaguugcuuga

SEQ ID NO: 2169108 - RNA, 23 nt, Homo sapiens
aaaauguucuguuugcuguggaa

SEQ ID NO: 2169109 - RNA, 20 nt, Homo sapiens
ggcuaagucaagaucaacau

SEQ ID NO: 2169110 - RNA, 18 nt, Homo sapiens
aguggagcuuacacuuaa

SEQ ID NO: 2169111 - RNA, 20 nt, Homo sapiens
gccauucuugcauugauaua

SEQ ID NO: 2169112 - RNA, 20 nt, Homo sapiens
agcccagucauauguucuca

SEQ ID NO: 2169113 - RNA, 18 nt, Homo sapiens
aaguccaagcauaccaac

SEQ ID NO: 2169114 - RNA, 15 nt, Homo sapiens
uuauucuugcaaaga

SEQ ID NO: 2169115 - RNA, 21 nt, Homo sapiens
agaaacaagguguacaacuuc

SEQ ID NO: 2169116 - RNA, 12 nt, Homo sapiens
cccaagccaugg

SEQ ID NO: 2169117 - RNA, 16 nt, Homo sapiens
acacauuccagccagg

SEQ ID NO: 2169118 - RNA, 16 nt, Homo sapiens
uucacuggcaaaugga

SEQ ID NO: 2169119 - RNA, 14 nt, Homo sapiens
ggagaagugauaug

SEQ ID NO: 2169120 - RNA, 13 nt, Homo sapiens
gaucacagcucac

SEQ ID NO: 2169121 - RNA, 12 nt, Homo sapiens
uauugugugagu

SEQ ID NO: 2169122 - RNA, 14 nt, Homo sapiens
caaugauaaugcua

SEQ ID NO: 2169123 - RNA, 18 nt, Homo sapiens
cuaggcaaagacuggccu

SEQ ID NO: 2169124 - RNA, 16 nt, Homo sapiens
acaccuuagguugaca

SEQ ID NO: 2169125 - RNA, 22 nt, Homo sapiens
cauggcagcuguuucucaugaa

SEQ ID NO: 2169126 - RNA, 14 nt, Homo sapiens
aaaugccacaaaga

SEQ ID NO: 2169127 - RNA, 14 nt, Homo sapiens
gaaauccauuugag

SEQ ID NO: 2169128 - RNA, 15 nt, Homo sapiens
ucaaaguguuuuuca

SEQ ID NO: 2169129 - RNA, 18 nt, Homo sapiens
cauugaaauuuacuguga

SEQ ID NO: 2169130 - RNA, 12 nt, Homo sapiens
cauaacugccuu

SEQ ID NO: 2169131 - RNA, 12 nt, Homo sapiens
caaaacugccau

SEQ ID NO: 2169132 - RNA, 12 nt, Homo sapiens
uauaacugucuu

SEQ ID NO: 2169133 - RNA, 21 nt, Homo sapiens
ccucagcacauccgacaccuc

SEQ ID NO: 2169134 - RNA, 13 nt, Homo sapiens
acuacuacaggaa

SEQ ID NO: 2169135 - RNA, 21 nt, Homo sapiens
ggagguuacagugagccaaga

SEQ ID NO: 2169136 - RNA, 20 nt, Homo sapiens
cucacagagugcauugugag

SEQ ID NO: 2169137 - RNA, 15 nt, Homo sapiens
auguaaauacaucaa

SEQ ID NO: 2169138 - RNA, 20 nt, Homo sapiens
agugccacuugacauuccuu

SEQ ID NO: 2169139 - RNA, 18 nt, Homo sapiens
uacuuagagaugcuacug

SEQ ID NO: 2169140 - RNA, 19 nt, Homo sapiens
guacauuuaaaauugcuau

SEQ ID NO: 2169141 - RNA, 14 nt, Homo sapiens
uaaaauuucuacua

SEQ ID NO: 2169142 - RNA, 15 nt, Homo sapiens
aaaguuugugacauu

SEQ ID NO: 2169143 - RNA, 20 nt, Homo sapiens
ccugcaaagcuaaaauugaa

SEQ ID NO: 2169144 - RNA, 21 nt, Homo sapiens
cauuuauuuauucauguguac

SEQ ID NO: 2169145 - RNA, 13 nt, Homo sapiens
acaacauaucuca

SEQ ID NO: 2169146 - RNA, 12 nt, Homo sapiens
cucaagacugaa

SEQ ID NO: 2169147 - RNA, 12 nt, Homo sapiens
caaugaaaugga

SEQ ID NO: 2169148 - RNA, 13 nt, Homo sapiens
uuucugugagaau

SEQ ID NO: 2169149 - RNA, 13 nt, Homo sapiens
agucaguguuaaa

SEQ ID NO: 2169150 - RNA, 20 nt, Homo sapiens
ucaaacuccuggacucaugc

SEQ ID NO: 2169151 - RNA, 18 nt, Homo sapiens
ccacuggggcaagcuccu

SEQ ID NO: 2169152 - RNA, 16 nt, Homo sapiens
cuacucucaugcugca

SEQ ID NO: 2169153 - RNA, 14 nt, Homo sapiens
uaucacacaaagca

SEQ ID NO: 2169154 - RNA, 19 nt, Homo sapiens
acauuuguacauuccugau

SEQ ID NO: 2169155 - RNA, 16 nt, Homo sapiens
cacuguuugcccagug

SEQ ID NO: 2169156 - RNA, 14 nt, Homo sapiens
aaugaacauguuaa

SEQ ID NO: 2169157 - RNA, 18 nt, Homo sapiens
uucuggccugcuaugucu

SEQ ID NO: 2169158 - RNA, 18 nt, Homo sapiens
ucugaaacuuaauuacau

SEQ ID NO: 2169159 - RNA, 22 nt, Homo sapiens
cauaucaucaaugugacauuua

SEQ ID NO: 2169160 - RNA, 22 nt, Homo sapiens
uaaucucuguuauguacuguac

SEQ ID NO: 2169161 - RNA, 23 nt, Homo sapiens
gguagaaccacuuggcugcucau

SEQ ID NO: 2169162 - RNA, 23 nt, Homo sapiens
agauaggaaacugaagcauaaag

SEQ ID NO: 2169163 - RNA, 20 nt, Homo sapiens
cucauggcagcuaagccaca

SEQ ID NO: 2169164 - RNA, 20 nt, Homo sapiens
cccagaagcucaaggcugca

SEQ ID NO: 2169165 - RNA, 13 nt, Homo sapiens
agucuuugauuau

SEQ ID NO: 2169166 - RNA, 16 nt, Homo sapiens
gccagccacacuugaa

SEQ ID NO: 2169167 - RNA, 12 nt, Homo sapiens
ugugauuuagaa

SEQ ID NO: 2169168 - RNA, 22 nt, Homo sapiens
ugaauagcagguaguuagcuuc

SEQ ID NO: 2169169 - RNA, 11 nt, Homo sapiens
cccucaugcaa

SEQ ID NO: 2169170 - RNA, 21 nt, Homo sapiens
acaggugugagccaccacucc

SEQ ID NO: 2169171 - RNA, 18 nt, Homo sapiens
uggaaugauuuuggugga

SEQ ID NO: 2169172 - RNA, 21 nt, Homo sapiens
ucacuuccacacaauuauuua

SEQ ID NO: 2169173 - RNA, 19 nt, Homo sapiens
caaaagcauaaaaaaccac

SEQ ID NO: 2169174 - RNA, 15 nt, Homo sapiens
acaaagggauguuca

SEQ ID NO: 2169175 - RNA, 22 nt, Homo sapiens
aggagacucaccucugccucaa

SEQ ID NO: 2169176 - RNA, 15 nt, Homo sapiens
ccagagcuguggugu

SEQ ID NO: 2169177 - RNA, 22 nt, Homo sapiens
aaauaaagcguccucucaguaa

SEQ ID NO: 2169178 - RNA, 19 nt, Homo sapiens
caaacaagaggacuguguu

SEQ ID NO: 2169179 - RNA, 19 nt, Homo sapiens
auuuuaaggaaaguagcaa

SEQ ID NO: 2169180 - RNA, 22 nt, Homo sapiens
gcaucaugcauuacgcucggaa

SEQ ID NO: 2169181 - RNA, 17 nt, Homo sapiens
aguagcucgugugcuua

SEQ ID NO: 2169182 - RNA, 19 nt, Homo sapiens
ggcugcacaggcacugucc

SEQ ID NO: 2169183 - RNA, 18 nt, Homo sapiens
gacagaaaaccucaaggg

SEQ ID NO: 2169184 - RNA, 19 nt, Homo sapiens
ucauaugucaccuuugcua

SEQ ID NO: 2169185 - RNA, 19 nt, Homo sapiens
cccgagaaggaauggugcu

SEQ ID NO: 2169186 - RNA, 19 nt, Homo sapiens
aaagacacgguugcucuau

SEQ ID NO: 2169187 - RNA, 22 nt, Homo sapiens
caaaacuucuugucagacauaa

SEQ ID NO: 2169188 - RNA, 21 nt, Homo sapiens
uagcagcaggcucaggcacau

SEQ ID NO: 2169189 - RNA, 18 nt, Homo sapiens
cugggcgucuaugcugcu

SEQ ID NO: 2169190 - RNA, 21 nt, Homo sapiens
gcuucauggcaguaauucucg

SEQ ID NO: 2169191 - RNA, 11 nt, Homo sapiens
uccuucccaac

SEQ ID NO: 2169192 - RNA, 23 nt, Homo sapiens
gauacagcuuuuugcaguauggu

SEQ ID NO: 2169193 - RNA, 13 nt, Homo sapiens
gaugcauuucaaa

SEQ ID NO: 2169194 - RNA, 20 nt, Homo sapiens
uguucucuaggccuucagga

SEQ ID NO: 2169195 - RNA, 20 nt, Homo sapiens
uuacauuuauuuauccagaa

SEQ ID NO: 2169196 - RNA, 12 nt, Homo sapiens
augccauugcac

SEQ ID NO: 2169197 - RNA, 16 nt, Homo sapiens
gcccagcaagaugaaa

SEQ ID NO: 2169198 - RNA, 15 nt, Homo sapiens
aggcuugcagucucc

SEQ ID NO: 2169199 - RNA, 20 nt, Homo sapiens
acggaccuuuuugcuguuua

SEQ ID NO: 2169200 - RNA, 17 nt, Homo sapiens
gcaagcguugugcagag

SEQ ID NO: 2169201 - RNA, 14 nt, Homo sapiens
cagugagaugcauu

SEQ ID NO: 2169202 - RNA, 13 nt, Homo sapiens
ggggacacuuccc

SEQ ID NO: 2169203 - RNA, 18 nt, Homo sapiens
ggucgcagcuacauaaga

SEQ ID NO: 2169204 - RNA, 20 nt, Homo sapiens
ucugugugguucagcuacuu

SEQ ID NO: 2169205 - RNA, 18 nt, Homo sapiens
agcaauacguuugugcag

SEQ ID NO: 2169206 - RNA, 22 nt, Homo sapiens
ggcuacuaccuagggcacuuua

SEQ ID NO: 2169207 - RNA, 13 nt, Homo sapiens
aaggucacuguuu

SEQ ID NO: 2169208 - RNA, 14 nt, Homo sapiens
ucuccaaccacugu

SEQ ID NO: 2169209 - RNA, 15 nt, Homo sapiens
caggaugaggucucg

SEQ ID NO: 2169210 - RNA, 15 nt, Homo sapiens
cucaacucacagcuu

SEQ ID NO: 2169211 - RNA, 22 nt, Homo sapiens
auuuuugucgaguuuacuucau

SEQ ID NO: 2169212 - RNA, 20 nt, Homo sapiens
auuucaaagggaaacuuuaa

SEQ ID NO: 2169213 - RNA, 22 nt, Homo sapiens
gaucugagucagagccaugucu

SEQ ID NO: 2169214 - RNA, 15 nt, Homo sapiens
cccaugaaucaaaga

SEQ ID NO: 2169215 - RNA, 18 nt, Homo sapiens
acuaauaaaauauauacu

SEQ ID NO: 2169216 - RNA, 22 nt, Homo sapiens
gaacugggagcagcucugugac

SEQ ID NO: 2169217 - RNA, 17 nt, Homo sapiens
uaccauguggaugcagc

SEQ ID NO: 2169218 - RNA, 22 nt, Homo sapiens
ugcugucccaaacaugcacuuc

SEQ ID NO: 2169219 - RNA, 16 nt, Homo sapiens
cuuuccaaacaccacu

SEQ ID NO: 2169220 - RNA, 20 nt, Homo sapiens
ccuccagccgcuggcaacaa

SEQ ID NO: 2169221 - RNA, 22 nt, Homo sapiens
ucaguucugcucuaagaagcug

SEQ ID NO: 2169222 - RNA, 22 nt, Homo sapiens
uuccuaugcuguucacuggaca

SEQ ID NO: 2169223 - RNA, 15 nt, Homo sapiens
aaauauuauuugcua

SEQ ID NO: 2169224 - RNA, 17 nt, Homo sapiens
aaauggccagugcugcu

SEQ ID NO: 2169225 - RNA, 19 nt, Homo sapiens
ucuggaagccucuauugcc

SEQ ID NO: 2169226 - RNA, 17 nt, Homo sapiens
auccagagauaauugcc

SEQ ID NO: 2169227 - RNA, 20 nt, Homo sapiens
uccucuuccauuaaccagug

SEQ ID NO: 2169228 - RNA, 14 nt, Homo sapiens
ucccagagcaccug

SEQ ID NO: 2169229 - RNA, 13 nt, Homo sapiens
cucucccagauuu

SEQ ID NO: 2169230 - RNA, 21 nt, Homo sapiens
cuaagcgcucauucuauuuua

SEQ ID NO: 2169231 - RNA, 16 nt, Homo sapiens
agaaagccagucuuaa

SEQ ID NO: 2169232 - RNA, 14 nt, Homo sapiens
accuauacauuaua

SEQ ID NO: 2169233 - RNA, 16 nt, Homo sapiens
uggguggcacaccacc

SEQ ID NO: 2169234 - RNA, 23 nt, Homo sapiens
ggaacugaaagaauaagaacuuu

SEQ ID NO: 2169235 - RNA, 21 nt, Homo sapiens
auccaggccggcuugccacac

SEQ ID NO: 2169236 - RNA, 22 nt, Homo sapiens
aucaaccuggcaaaaaugcaac

SEQ ID NO: 2169237 - RNA, 13 nt, Homo sapiens
uuuaaaugauuua

SEQ ID NO: 2169238 - RNA, 18 nt, Homo sapiens
augcaacaacauguauaa

SEQ ID NO: 2169239 - RNA, 15 nt, Homo sapiens
gcacaggcugggaug

SEQ ID NO: 2169240 - RNA, 21 nt, Homo sapiens
guaauaccuuaguuuuuucca

SEQ ID NO: 2169241 - RNA, 22 nt, Homo sapiens
aucuugcaucuaccugcuccuu

SEQ ID NO: 2169242 - RNA, 17 nt, Homo sapiens
acuuggcuaacauagca

SEQ ID NO: 2169243 - RNA, 14 nt, Homo sapiens
cugccuuuuaguuc

SEQ ID NO: 2169244 - RNA, 17 nt, Homo sapiens
cgaagugcugagauuac

SEQ ID NO: 2169245 - RNA, 13 nt, Homo sapiens
agugccauguuag

SEQ ID NO: 2169246 - RNA, 17 nt, Homo sapiens
auguuacacuaagggug

SEQ ID NO: 2169247 - RNA, 21 nt, Homo sapiens
auguugaucgcgguaugucaa

SEQ ID NO: 2169248 - RNA, 12 nt, Homo sapiens
cagcuuuccauc

SEQ ID NO: 2169249 - RNA, 12 nt, Homo sapiens
aaacugccuguu

SEQ ID NO: 2169250 - RNA, 17 nt, Homo sapiens
ugacagaauauguuuca

SEQ ID NO: 2169251 - RNA, 18 nt, Homo sapiens
gccgucugugugguggga

SEQ ID NO: 2169252 - RNA, 19 nt, Homo sapiens
ggauugcuaaucaccaaag

SEQ ID NO: 2169253 - RNA, 20 nt, Homo sapiens
cauaaaaauaaaaucuguaa

SEQ ID NO: 2169254 - RNA, 23 nt, Homo sapiens
uaaaguccuuggacuguuuugaa

SEQ ID NO: 2169255 - RNA, 23 nt, Homo sapiens
cucugugucaaggugaagcacau

SEQ ID NO: 2169256 - RNA, 16 nt, Homo sapiens
auaaugcuuuguuaaa

SEQ ID NO: 2169257 - RNA, 15 nt, Homo sapiens
uauugcuuggacuac

SEQ ID NO: 2169258 - RNA, 21 nt, Homo sapiens
aacugucccugcuuucuggua

SEQ ID NO: 2169259 - RNA, 14 nt, Homo sapiens
gcauacacacaggu

SEQ ID NO: 2169260 - RNA, 14 nt, Homo sapiens
ggaugcacagagau

SEQ ID NO: 2169261 - RNA, 20 nt, Homo sapiens
uagugaccaaauucagccua

SEQ ID NO: 2169262 - RNA, 18 nt, Homo sapiens
aacuucuuucuauuugac

SEQ ID NO: 2169263 - RNA, 16 nt, Homo sapiens
aaaaaggcauaugcaa

SEQ ID NO: 2169264 - RNA, 20 nt, Homo sapiens
ccuuaacucaucuguuaucc

SEQ ID NO: 2169265 - RNA, 21 nt, Homo sapiens
cuacuuugguuucugucugua

SEQ ID NO: 2169266 - RNA, 16 nt, Homo sapiens
acacgcuuguucacac

SEQ ID NO: 2169267 - RNA, 13 nt, Homo sapiens
guccuuucuugca

SEQ ID NO: 2169268 - RNA, 20 nt, Homo sapiens
ucccuuaggcauuauuuaau

SEQ ID NO: 2169269 - RNA, 16 nt, Homo sapiens
gguugaucaguuaaaa

SEQ ID NO: 2169270 - RNA, 23 nt, Homo sapiens
gugggacuuugcaccucugcuga

SEQ ID NO: 2169271 - RNA, 12 nt, Homo sapiens
aggacucuggca

SEQ ID NO: 2169272 - RNA, 18 nt, Homo sapiens
cuguucugccuuccgcag

SEQ ID NO: 2169273 - RNA, 18 nt, Homo sapiens
acaaaugguagcauacuu

SEQ ID NO: 2169274 - RNA, 13 nt, Homo sapiens
agcaacguguuaa

SEQ ID NO: 2169275 - RNA, 14 nt, Homo sapiens
caaaucaccacaaa

SEQ ID NO: 2169276 - RNA, 16 nt, Homo sapiens
ccacgugaaacugcug

SEQ ID NO: 2169277 - RNA, 23 nt, Homo sapiens
guuuaugagaacugguucuugcc

SEQ ID NO: 2169278 - RNA, 16 nt, Homo sapiens
gaagcacauguguauu

SEQ ID NO: 2169279 - RNA, 18 nt, Homo sapiens
guucuggaccugggcaug

SEQ ID NO: 2169280 - RNA, 13 nt, Homo sapiens
aguuucacuggcu

SEQ ID NO: 2169281 - RNA, 19 nt, Homo sapiens
cauugaugaacugccaaag

SEQ ID NO: 2169282 - RNA, 20 nt, Homo sapiens
gcacauaacuggauuuugaa

SEQ ID NO: 2169283 - RNA, 13 nt, Homo sapiens
ugccuucugccaa

SEQ ID NO: 2169284 - RNA, 23 nt, Homo sapiens
caagcucaaagcguggacaggug

SEQ ID NO: 2169285 - RNA, 22 nt, Homo sapiens
aaaccucacaugcauacauaca

SEQ ID NO: 2169286 - RNA, 15 nt, Homo sapiens
ccaguuugugcucua

SEQ ID NO: 2169287 - RNA, 15 nt, Homo sapiens
gcccuccaugguccu

SEQ ID NO: 2169288 - RNA, 18 nt, Homo sapiens
ugggaaacuugucacuug

SEQ ID NO: 2169289 - RNA, 13 nt, Homo sapiens
auacaaguaauau

SEQ ID NO: 2169290 - RNA, 15 nt, Homo sapiens
gugacacacagcagc

SEQ ID NO: 2169291 - RNA, 18 nt, Homo sapiens
ggcccuccucagcacggu

SEQ ID NO: 2169292 - RNA, 23 nt, Homo sapiens
cagcacccaugccccacucugcu

SEQ ID NO: 2169293 - RNA, 13 nt, Homo sapiens
acuagacaugcca

SEQ ID NO: 2169294 - RNA, 15 nt, Homo sapiens
aacaggaaucucaga

SEQ ID NO: 2169295 - RNA, 18 nt, Homo sapiens
acuuccuuuaggaucuca

SEQ ID NO: 2169296 - RNA, 17 nt, Homo sapiens
aauaucgagaacugcca

SEQ ID NO: 2169297 - RNA, 22 nt, Homo sapiens
acccauugggcccuuccggcau

SEQ ID NO: 2169298 - RNA, 15 nt, Homo sapiens
aaggauuucuuguau

SEQ ID NO: 2169299 - RNA, 13 nt, Homo sapiens
acagaaacagaga

SEQ ID NO: 2169300 - RNA, 12 nt, Homo sapiens
uguaaccacugc

SEQ ID NO: 2169301 - RNA, 22 nt, Homo sapiens
acugcacuuuccaaugccacag

SEQ ID NO: 2169302 - RNA, 21 nt, Homo sapiens
gccucuuaacuccuucacgag

SEQ ID NO: 2169303 - RNA, 23 nt, Homo sapiens
aaagccuucccuugcccauguga

SEQ ID NO: 2169304 - RNA, 19 nt, Homo sapiens
accacccagaguggcccaa

SEQ ID NO: 2169305 - RNA, 21 nt, Homo sapiens
gccucugcagucgcuugccaa

SEQ ID NO: 2169306 - RNA, 17 nt, Homo sapiens
uuuaaaccccgagauag

SEQ ID NO: 2169307 - RNA, 15 nt, Homo sapiens
caauacguuugauaa

SEQ ID NO: 2169308 - RNA, 21 nt, Homo sapiens
accuuuauugugaucuaucaa

SEQ ID NO: 2169309 - RNA, 23 nt, Homo sapiens
accccuccaguuuugccugagaa

SEQ ID NO: 2169310 - RNA, 21 nt, Homo sapiens
uggcuguguccucuccagcuu

SEQ ID NO: 2169311 - RNA, 19 nt, Homo sapiens
uggacacuuaguuauuuac

SEQ ID NO: 2169312 - RNA, 13 nt, Homo sapiens
uccacucuggaga

SEQ ID NO: 2169313 - RNA, 15 nt, Homo sapiens
auggaaggccuuuug

SEQ ID NO: 2169314 - RNA, 23 nt, Homo sapiens
uaccaccccccacccuccuccag

SEQ ID NO: 2169315 - RNA, 12 nt, Homo sapiens
ggcacugucaug

SEQ ID NO: 2169316 - RNA, 19 nt, Homo sapiens
cauuugcgaaugguuccau

SEQ ID NO: 2169317 - RNA, 15 nt, Homo sapiens
guuccagauguggau

SEQ ID NO: 2169318 - RNA, 14 nt, Homo sapiens
ugccuuaaaccuga

SEQ ID NO: 2169319 - RNA, 17 nt, Homo sapiens
caaaaguuuguuugcuu

SEQ ID NO: 2169320 - RNA, 22 nt, Homo sapiens
aucucaccugcuggggaccuca

SEQ ID NO: 2169321 - RNA, 15 nt, Homo sapiens
aagcagaacacacuc

SEQ ID NO: 2169322 - RNA, 22 nt, Homo sapiens
ccaggacuggggcuugccaggc

SEQ ID NO: 2169323 - RNA, 17 nt, Homo sapiens
acuucuuauacauuuga

SEQ ID NO: 2169324 - RNA, 18 nt, Homo sapiens
ucccacauucccaugaau

SEQ ID NO: 2169325 - RNA, 18 nt, Homo sapiens
cuggaccagccucuccac

SEQ ID NO: 2169326 - RNA, 16 nt, Homo sapiens
uguagagcaagccagu

SEQ ID NO: 2169327 - RNA, 19 nt, Homo sapiens
aaucccaguacgauuugca

SEQ ID NO: 2169328 - RNA, 19 nt, Homo sapiens
cacacaccugccugcagag

SEQ ID NO: 2169329 - RNA, 17 nt, Homo sapiens
gucuaccuggagccccu

SEQ ID NO: 2169330 - RNA, 16 nt, Homo sapiens
acauuaaaucuaugaa

SEQ ID NO: 2169331 - RNA, 19 nt, Homo sapiens
caguagugcaccaucucac

SEQ ID NO: 2169332 - RNA, 11 nt, Homo sapiens
agacugugcug

SEQ ID NO: 2169333 - RNA, 17 nt, Homo sapiens
uggaagaagcacugaug

SEQ ID NO: 2169334 - RNA, 20 nt, Homo sapiens
cagaaucgcuaauagaacca

SEQ ID NO: 2169335 - RNA, 22 nt, Homo sapiens
agugacuggggaugggacaaga

SEQ ID NO: 2169336 - RNA, 19 nt, Homo sapiens
aagccagcaggcucucagg

SEQ ID NO: 2169337 - RNA, 19 nt, Homo sapiens
uugcacaaaaucacacagc

SEQ ID NO: 2169338 - RNA, 13 nt, Homo sapiens
aaccagcaucucu

SEQ ID NO: 2169339 - RNA, 17 nt, Homo sapiens
gaaacauuucugacacc

SEQ ID NO: 2169340 - RNA, 14 nt, Homo sapiens
cuucguacaguucu

SEQ ID NO: 2169341 - RNA, 13 nt, Homo sapiens
ugaguaugugcac

SEQ ID NO: 2169342 - RNA, 14 nt, Homo sapiens
uucuuuggaggcag

SEQ ID NO: 2169343 - RNA, 14 nt, Homo sapiens
ugggacccuugaga

SEQ ID NO: 2169344 - RNA, 22 nt, Homo sapiens
uauagaacagugcuugccacag

SEQ ID NO: 2169345 - RNA, 23 nt, Homo sapiens
ugaaggguguucacccaucccac

SEQ ID NO: 2169346 - RNA, 15 nt, Homo sapiens
gacacauuuuuuugc

SEQ ID NO: 2169347 - RNA, 18 nt, Homo sapiens
cccugacgugcagccaca

SEQ ID NO: 2169348 - RNA, 22 nt, Homo sapiens
ggucacuuuccuauuacacgga

SEQ ID NO: 2169349 - RNA, 21 nt, Homo sapiens
auaaagcaguauuuuucuuga

SEQ ID NO: 2169350 - RNA, 22 nt, Homo sapiens
aguauaauuuaaaaaaagcaaa

SEQ ID NO: 2169351 - RNA, 16 nt, Homo sapiens
caaauacccaaauguc

SEQ ID NO: 2169352 - RNA, 16 nt, Homo sapiens
uauauguuuauauacu

SEQ ID NO: 2169353 - RNA, 15 nt, Homo sapiens
cugacccggccccua

SEQ ID NO: 2169354 - RNA, 22 nt, Homo sapiens
ucccagcacuuugggagaccaa

SEQ ID NO: 2169355 - RNA, 21 nt, Homo sapiens
cugccaguugucuuaugugaa

SEQ ID NO: 2169356 - RNA, 15 nt, Homo sapiens
cuccucuaucacauu

SEQ ID NO: 2169357 - RNA, 23 nt, Homo sapiens
auuucuacucuuaaguuucucag

SEQ ID NO: 2169358 - RNA, 18 nt, Homo sapiens
uagcagggaaacagcuaa

SEQ ID NO: 2169359 - RNA, 19 nt, Homo sapiens
cuauuuuaagacgugaaug

SEQ ID NO: 2169360 - RNA, 22 nt, Homo sapiens
agagaaugagaagaggcugcug

SEQ ID NO: 2169361 - RNA, 15 nt, Homo sapiens
aguuuuucacuuugg

SEQ ID NO: 2169362 - RNA, 20 nt, Homo sapiens
caagggugcuuguggucaca

SEQ ID NO: 2169363 - RNA, 22 nt, Homo sapiens
auagcuuccccaccagcuuuau

SEQ ID NO: 2169364 - RNA, 18 nt, Homo sapiens
cucccggguucacgccau

SEQ ID NO: 2169365 - RNA, 21 nt, Homo sapiens
gugaaaaucgaggaagcaccu

SEQ ID NO: 2169366 - RNA, 16 nt, Homo sapiens
aauaaauuguguuucc

SEQ ID NO: 2169367 - RNA, 12 nt, Homo sapiens
aauaaaacugaa

SEQ ID NO: 2169368 - RNA, 19 nt, Homo sapiens
aaggcgucucuucaaacag

SEQ ID NO: 2169369 - RNA, 21 nt, Homo sapiens
ugaaugaaauauaaacuguga

SEQ ID NO: 2169370 - RNA, 19 nt, Homo sapiens
acccuggucucaucagucc

SEQ ID NO: 2169371 - RNA, 13 nt, Homo sapiens
aaacaaagccaga

SEQ ID NO: 2169372 - RNA, 12 nt, Homo sapiens
gaagaccaaagu

SEQ ID NO: 2169373 - RNA, 13 nt, Homo sapiens
gaauuaugugcac

SEQ ID NO: 2169374 - RNA, 15 nt, Homo sapiens
gagaaacccagagau

SEQ ID NO: 2169375 - RNA, 16 nt, Homo sapiens
acccucgcaugacugu

SEQ ID NO: 2169376 - RNA, 19 nt, Homo sapiens
agcagagggaguagggcuc

SEQ ID NO: 2169377 - RNA, 21 nt, Homo sapiens
gaaguuugcagauacucgcca

SEQ ID NO: 2169378 - RNA, 19 nt, Homo sapiens
cugcauuugugucaucuug

SEQ ID NO: 2169379 - RNA, 15 nt, Homo sapiens
ugucccucaauuaca

SEQ ID NO: 2169380 - RNA, 20 nt, Homo sapiens
uaggcaguggccccuauuga

SEQ ID NO: 2169381 - RNA, 16 nt, Homo sapiens
ugguaauaaaccuuga

SEQ ID NO: 2169382 - RNA, 23 nt, Homo sapiens
auagucacaggaaacuacuucac

SEQ ID NO: 2169383 - RNA, 23 nt, Homo sapiens
ucucauuuuccugggugcaucaa

SEQ ID NO: 2169384 - RNA, 14 nt, Homo sapiens
uucuaaaccacaaa

SEQ ID NO: 2169385 - RNA, 21 nt, Homo sapiens
cccagcacuuugggagaccaa

SEQ ID NO: 2169386 - RNA, 17 nt, Homo sapiens
uuccacaagagugaauu

SEQ ID NO: 2169387 - RNA, 13 nt, Homo sapiens
guccagggcggga

SEQ ID NO: 2169388 - RNA, 23 nt, Homo sapiens
gacuuucuacaccuguugcaccu

SEQ ID NO: 2169389 - RNA, 17 nt, Homo sapiens
gaaacagccauguccaa

SEQ ID NO: 2169390 - RNA, 18 nt, Homo sapiens
aaaaugagcuuccauuaa

SEQ ID NO: 2169391 - RNA, 21 nt, Homo sapiens
acugauagaugucuauucuug

SEQ ID NO: 2169392 - RNA, 15 nt, Homo sapiens
uaugguccucagauc

SEQ ID NO: 2169393 - RNA, 18 nt, Homo sapiens
cugcuucacgauucuuac

SEQ ID NO: 2169394 - RNA, 14 nt, Homo sapiens
uaaagcuauuuccu

SEQ ID NO: 2169395 - RNA, 20 nt, Homo sapiens
cugccuacacacacagccua

SEQ ID NO: 2169396 - RNA, 21 nt, Homo sapiens
guguguaugugcgugugugca

SEQ ID NO: 2169397 - RNA, 19 nt, Homo sapiens
aauuuggggcagauuuuag

SEQ ID NO: 2169398 - RNA, 12 nt, Homo sapiens
auugaaaacacu

SEQ ID NO: 2169399 - RNA, 15 nt, Homo sapiens
gcgcagcgcgugcac

SEQ ID NO: 2169400 - RNA, 15 nt, Homo sapiens
guauuaaguuguuaa

SEQ ID NO: 2169401 - RNA, 22 nt, Homo sapiens
aaucucaguagcugauucugaa

SEQ ID NO: 2169402 - RNA, 14 nt, Homo sapiens
cgagggcagcugcu

SEQ ID NO: 2169403 - RNA, 19 nt, Homo sapiens
ugcuguuuuguuauauaau

SEQ ID NO: 2169404 - RNA, 13 nt, Homo sapiens
agcagaucugaaa

SEQ ID NO: 2169405 - RNA, 22 nt, Homo sapiens
uuacauaaaaccaaguuuuacu

SEQ ID NO: 2169406 - RNA, 11 nt, Homo sapiens
aacacuguuau

SEQ ID NO: 2169407 - RNA, 21 nt, Homo sapiens
acacauuucuuaaaacacaug

SEQ ID NO: 2169408 - RNA, 15 nt, Homo sapiens
uguuuuuugccuaaa

SEQ ID NO: 2169409 - RNA, 20 nt, Homo sapiens
uauacuuucaucuaaauuac

SEQ ID NO: 2169410 - RNA, 15 nt, Homo sapiens
agcaaacauaaugcu

SEQ ID NO: 2169411 - RNA, 16 nt, Homo sapiens
aggucauuacuaacca

SEQ ID NO: 2169412 - RNA, 18 nt, Homo sapiens
caaacguguuauauucca

SEQ ID NO: 2169413 - RNA, 20 nt, Homo sapiens
gaaauuauacguacauacac

SEQ ID NO: 2169414 - RNA, 14 nt, Homo sapiens
aaagaugauuucuc

SEQ ID NO: 2169415 - RNA, 16 nt, Homo sapiens
aggcaucuaucugugc

SEQ ID NO: 2169416 - RNA, 16 nt, Homo sapiens
acccccacaccuggaa

SEQ ID NO: 2169417 - RNA, 22 nt, Homo sapiens
aaucucuaaacacaaauuguga

SEQ ID NO: 2169418 - RNA, 21 nt, Homo sapiens
auuagauuuuaaaacuucauc

SEQ ID NO: 2169419 - RNA, 11 nt, Homo sapiens
caaaguuuaag

SEQ ID NO: 2169420 - RNA, 19 nt, Homo sapiens
agacuauucccuucuaacc

SEQ ID NO: 2169421 - RNA, 12 nt, Homo sapiens
aaaaguacugaa

SEQ ID NO: 2169422 - RNA, 17 nt, Homo sapiens
aaggucccuuguuucca

SEQ ID NO: 2169423 - RNA, 13 nt, Homo sapiens
acuauaaacauuu

SEQ ID NO: 2169424 - RNA, 23 nt, Homo sapiens
cacuccagccugagcgacaguga

SEQ ID NO: 2169425 - RNA, 11 nt, Homo sapiens
uuaaauuugaa

SEQ ID NO: 2169426 - RNA, 15 nt, Homo sapiens
ugauggcuggaucuu

SEQ ID NO: 2169427 - RNA, 15 nt, Homo sapiens
uccaauguagcucag

SEQ ID NO: 2169428 - RNA, 16 nt, Homo sapiens
cuccugucuacaguuu

SEQ ID NO: 2169429 - RNA, 17 nt, Homo sapiens
cugcugcuggaucacag

SEQ ID NO: 2169430 - RNA, 18 nt, Homo sapiens
uuauccuuaagaauucca

SEQ ID NO: 2169431 - RNA, 20 nt, Homo sapiens
augcauggaaacauggagga

SEQ ID NO: 2169432 - RNA, 13 nt, Homo sapiens
aaugucucccaca

SEQ ID NO: 2169433 - RNA, 23 nt, Homo sapiens
ggguccacugaagggacccuggg

SEQ ID NO: 2169434 - RNA, 18 nt, Homo sapiens
gaaaucagucuaccaagg

SEQ ID NO: 2169435 - RNA, 18 nt, Homo sapiens
caguagagcacuuuucac

SEQ ID NO: 2169436 - RNA, 23 nt, Homo sapiens
auuugauucuccagccaaccuca

SEQ ID NO: 2169437 - RNA, 16 nt, Homo sapiens
cucccucucucuggga

SEQ ID NO: 2169438 - RNA, 22 nt, Homo sapiens
uagacaccuucauuuugagggg

SEQ ID NO: 2169439 - RNA, 17 nt, Homo sapiens
auuuauuaacuaaucaa

SEQ ID NO: 2169440 - RNA, 16 nt, Homo sapiens
aucuuguuuacaauaa

SEQ ID NO: 2169441 - RNA, 20 nt, Homo sapiens
auguacaauaaagcaaugug

SEQ ID NO: 2169442 - RNA, 13 nt, Homo sapiens
acugguaaagccu

SEQ ID NO: 2169443 - RNA, 15 nt, Homo sapiens
caacuaacucacuca

SEQ ID NO: 2169444 - RNA, 22 nt, Homo sapiens
gggaacauguaccacugagccu

SEQ ID NO: 2169445 - RNA, 11 nt, Homo sapiens
ugaaagccaug

SEQ ID NO: 2169446 - RNA, 21 nt, Homo sapiens
ggagucccaaaugucaucagg

SEQ ID NO: 2169447 - RNA, 17 nt, Homo sapiens
auugcuaaccacugucu

SEQ ID NO: 2169448 - RNA, 18 nt, Homo sapiens
augaacuuagucauuaau

SEQ ID NO: 2169449 - RNA, 16 nt, Homo sapiens
gaccguuugcuauauu

SEQ ID NO: 2169450 - RNA, 12 nt, Homo sapiens
gucgcagacucc

SEQ ID NO: 2169451 - RNA, 13 nt, Homo sapiens
ugaccucuugccu

SEQ ID NO: 2169452 - RNA, 15 nt, Homo sapiens
aaagugugguuugca

SEQ ID NO: 2169453 - RNA, 15 nt, Homo sapiens
aaguuacagcuguga

SEQ ID NO: 2169454 - RNA, 16 nt, Homo sapiens
uucaguucccaggugg

SEQ ID NO: 2169455 - RNA, 22 nt, Homo sapiens
aucuuguuuuuccacuacugcu

SEQ ID NO: 2169456 - RNA, 13 nt, Homo sapiens
uaacucuugcuca

SEQ ID NO: 2169457 - RNA, 14 nt, Homo sapiens
agacagcuucucau

SEQ ID NO: 2169458 - RNA, 12 nt, Homo sapiens
augauucaucuu

SEQ ID NO: 2169459 - RNA, 21 nt, Homo sapiens
uggagacaucacuugccaaug

SEQ ID NO: 2169460 - RNA, 23 nt, Homo sapiens
aauccuuuacauucaacuuuucu

SEQ ID NO: 2169461 - RNA, 18 nt, Homo sapiens
gccaggauggucuugauc

SEQ ID NO: 2169462 - RNA, 19 nt, Homo sapiens
guguucacaggcugcuaau

SEQ ID NO: 2169463 - RNA, 21 nt, Homo sapiens
acugcauccuguaaggucugu

SEQ ID NO: 2169464 - RNA, 18 nt, Homo sapiens
gacauguacauacuguau

SEQ ID NO: 2169465 - RNA, 19 nt, Homo sapiens
ugagauguauuucaacuug

SEQ ID NO: 2169466 - RNA, 21 nt, Homo sapiens
cuggcgauuuuacucauuguc

SEQ ID NO: 2169467 - RNA, 17 nt, Homo sapiens
ucuccuauguggcagcu

SEQ ID NO: 2169468 - RNA, 19 nt, Homo sapiens
guuuaagcuuaacauuuca

SEQ ID NO: 2169469 - RNA, 16 nt, Homo sapiens
ucuucagaagacacug

SEQ ID NO: 2169470 - RNA, 19 nt, Homo sapiens
aucagugaauaaaccauca

SEQ ID NO: 2169471 - RNA, 19 nt, Homo sapiens
ugacacuagcuaauaucaa

SEQ ID NO: 2169472 - RNA, 21 nt, Homo sapiens
aauuaaaauucguuuuugcaa

SEQ ID NO: 2169473 - RNA, 13 nt, Homo sapiens
agauugugcccag

SEQ ID NO: 2169474 - RNA, 14 nt, Homo sapiens
uggcagcugcaaua

SEQ ID NO: 2169475 - RNA, 16 nt, Homo sapiens
ccuguccuugcccuuu

SEQ ID NO: 2169476 - RNA, 17 nt, Homo sapiens
ucugggugcagcugaga

SEQ ID NO: 2169477 - RNA, 21 nt, Homo sapiens
uacaaauuguucauguuacca

SEQ ID NO: 2169478 - RNA, 16 nt, Homo sapiens
uguuaaaauggggaua

SEQ ID NO: 2169479 - RNA, 15 nt, Homo sapiens
guguaaaaagcaaag

SEQ ID NO: 2169480 - RNA, 23 nt, Homo sapiens
ccauuccccagccucucuuccua

SEQ ID NO: 2169481 - RNA, 18 nt, Homo sapiens
uuaacuuaacucaugaau

SEQ ID NO: 2169482 - RNA, 16 nt, Homo sapiens
uaaagcaauacugccg

SEQ ID NO: 2169483 - RNA, 17 nt, Homo sapiens
ucauccuuggucuuugu

SEQ ID NO: 2169484 - RNA, 18 nt, Homo sapiens
ugggagccagggcugucu

SEQ ID NO: 2169485 - RNA, 14 nt, Homo sapiens
uguuuacacuguca

SEQ ID NO: 2169486 - RNA, 15 nt, Homo sapiens
uaugagaucacugaa

SEQ ID NO: 2169487 - RNA, 17 nt, Homo sapiens
gggcacaugaucuggcc

SEQ ID NO: 2169488 - RNA, 20 nt, Homo sapiens
uggaagaaagcaacaaagau

SEQ ID NO: 2169489 - RNA, 22 nt, Homo sapiens
agaaguugaggggagcaugcuu

SEQ ID NO: 2169490 - RNA, 20 nt, Homo sapiens
ucccaaguacccugagauac

SEQ ID NO: 2169491 - RNA, 22 nt, Homo sapiens
caccaaggcagugcaugcaugu

SEQ ID NO: 2169492 - RNA, 12 nt, Homo sapiens
uuauccuagauc

SEQ ID NO: 2169493 - RNA, 15 nt, Homo sapiens
ccugaaaugacauuu

SEQ ID NO: 2169494 - RNA, 15 nt, Homo sapiens
gagagcuguauuaag

SEQ ID NO: 2169495 - RNA, 15 nt, Homo sapiens
uuucucuuacuauau

SEQ ID NO: 2169496 - RNA, 16 nt, Homo sapiens
acugugccagcacaaa

SEQ ID NO: 2169497 - RNA, 21 nt, Homo sapiens
caugguaaugaaggacaguga

SEQ ID NO: 2169498 - RNA, 15 nt, Homo sapiens
ucucauuucuagaga

SEQ ID NO: 2169499 - RNA, 13 nt, Homo sapiens
cccuggaagcuua

SEQ ID NO: 2169500 - RNA, 13 nt, Homo sapiens
uaaugaacagugu

SEQ ID NO: 2169501 - RNA, 20 nt, Homo sapiens
cccaaccuguccuuacucag

SEQ ID NO: 2169502 - RNA, 19 nt, Homo sapiens
cuaauuauuuacucaaaga

SEQ ID NO: 2169503 - RNA, 16 nt, Homo sapiens
aaaucuaaaucuucag

SEQ ID NO: 2169504 - RNA, 23 nt, Homo sapiens
uugcuguagaaacacauaacaaa

SEQ ID NO: 2169505 - RNA, 21 nt, Homo sapiens
acauuuugccaaaauuauuaa

SEQ ID NO: 2169506 - RNA, 16 nt, Homo sapiens
aucuguuugaacacuu

SEQ ID NO: 2169507 - RNA, 21 nt, Homo sapiens
uucagcaccaaauacaugaua

SEQ ID NO: 2169508 - RNA, 20 nt, Homo sapiens
agcagugcacaucugaccca

SEQ ID NO: 2169509 - RNA, 18 nt, Homo sapiens
ugcaaaauuuuacaguaa

SEQ ID NO: 2169510 - RNA, 18 nt, Homo sapiens
aaggugcuaaaaggaaua

SEQ ID NO: 2169511 - RNA, 14 nt, Homo sapiens
caugcccaccaucg

SEQ ID NO: 2169512 - RNA, 14 nt, Homo sapiens
aguuggcacuguaa

SEQ ID NO: 2169513 - RNA, 14 nt, Homo sapiens
ccgucuacuggaaa

SEQ ID NO: 2169514 - RNA, 22 nt, Homo sapiens
gacucagggcugguucagggcu

SEQ ID NO: 2169515 - RNA, 22 nt, Homo sapiens
uuuacacugaguuucuauuuag

SEQ ID NO: 2169516 - RNA, 16 nt, Homo sapiens
uucaacuggaacauuu

SEQ ID NO: 2169517 - RNA, 16 nt, Homo sapiens
cgcaaaucaaccccag

SEQ ID NO: 2169518 - RNA, 16 nt, Homo sapiens
cuguaacuacaaugau

SEQ ID NO: 2169519 - RNA, 18 nt, Homo sapiens
uggaaauagugauuucca

SEQ ID NO: 2169520 - RNA, 16 nt, Homo sapiens
gacucauugcuucaca

SEQ ID NO: 2169521 - RNA, 15 nt, Homo sapiens
cuucuagacacugaa

SEQ ID NO: 2169522 - RNA, 21 nt, Homo sapiens
uaugaguauaauacauuacau

SEQ ID NO: 2169523 - RNA, 15 nt, Homo sapiens
uggcaauacauuuga

SEQ ID NO: 2169524 - RNA, 19 nt, Homo sapiens
accuuuuuuaugaugcuau

SEQ ID NO: 2169525 - RNA, 18 nt, Homo sapiens
aauaauuacuuaaugugg

SEQ ID NO: 2169526 - RNA, 22 nt, Homo sapiens
cugcauuuuaauuuuaaccaaa

SEQ ID NO: 2169527 - RNA, 20 nt, Homo sapiens
ucuacaacauaaugauacug

SEQ ID NO: 2169528 - RNA, 18 nt, Homo sapiens
uaaauuuuauaucuugua

SEQ ID NO: 2169529 - RNA, 18 nt, Homo sapiens
guaauuuuguaucuugau

SEQ ID NO: 2169530 - RNA, 14 nt, Homo sapiens
ucuuuugucccaga

SEQ ID NO: 2169531 - RNA, 13 nt, Homo sapiens
agcccacagugcu

SEQ ID NO: 2169532 - RNA, 20 nt, Homo sapiens
cuaccuugcuagcuagccag

SEQ ID NO: 2169533 - RNA, 22 nt, Homo sapiens
agaccuuugauuuuuugcccag

SEQ ID NO: 2169534 - RNA, 21 nt, Homo sapiens
aguuauguggauuucaucacu

SEQ ID NO: 2169535 - RNA, 23 nt, Homo sapiens
aagccuccgcugggcuucauucc

SEQ ID NO: 2169536 - RNA, 23 nt, Homo sapiens
ucaguaagucacaguuaucucca

SEQ ID NO: 2169537 - RNA, 17 nt, Homo sapiens
cauguggagaaggugac

SEQ ID NO: 2169538 - RNA, 17 nt, Homo sapiens
cuacaggugagugccac

SEQ ID NO: 2169539 - RNA, 10 nt, Homo sapiens
cugggccaug

SEQ ID NO: 2169540 - RNA, 15 nt, Homo sapiens
guccugcuggcaccu

SEQ ID NO: 2169541 - RNA, 15 nt, Homo sapiens
auccugcuagcaccu

SEQ ID NO: 2169542 - RNA, 14 nt, Homo sapiens
auuguagccucaau

SEQ ID NO: 2169543 - RNA, 19 nt, Homo sapiens
uuggaaggccucccugggc

SEQ ID NO: 2169544 - RNA, 17 nt, Homo sapiens
cuauauuuauacuguau

SEQ ID NO: 2169545 - RNA, 21 nt, Homo sapiens
uucugucccucacagcacuag

SEQ ID NO: 2169546 - RNA, 17 nt, Homo sapiens
uccacccacucacauuc

SEQ ID NO: 2169547 - RNA, 15 nt, Homo sapiens
aaagcauaaaaaggu

SEQ ID NO: 2169548 - RNA, 12 nt, Homo sapiens
accauuccacau

SEQ ID NO: 2169549 - RNA, 16 nt, Homo sapiens
gcuguuauucuuccac

SEQ ID NO: 2169550 - RNA, 20 nt, Homo sapiens
uagcaauuuccgccugguga

SEQ ID NO: 2169551 - RNA, 15 nt, Homo sapiens
gccacacguuguaua

SEQ ID NO: 2169552 - RNA, 20 nt, Homo sapiens
ucccacuuugcuguuccuua

SEQ ID NO: 2169553 - RNA, 20 nt, Homo sapiens
ggguucaccauguugcccag

SEQ ID NO: 2169554 - RNA, 18 nt, Homo sapiens
aagacugggugaggauaa

SEQ ID NO: 2169555 - RNA, 17 nt, Homo sapiens
cagcaugggaaugugcc

SEQ ID NO: 2169556 - RNA, 16 nt, Homo sapiens
ugaguuguuaccccaa

SEQ ID NO: 2169557 - RNA, 18 nt, Homo sapiens
cuuuaccuccuuuucucu

SEQ ID NO: 2169558 - RNA, 21 nt, Homo sapiens
cuugcagcggcuccugcaaaa

SEQ ID NO: 2169559 - RNA, 19 nt, Homo sapiens
guacuuugcucuccuugcg

SEQ ID NO: 2169560 - RNA, 21 nt, Homo sapiens
ccuguauacuuuaguaugacg

SEQ ID NO: 2169561 - RNA, 12 nt, Homo sapiens
agggaggcucag

SEQ ID NO: 2169562 - RNA, 14 nt, Homo sapiens
acgagcccuuuuag

SEQ ID NO: 2169563 - RNA, 20 nt, Homo sapiens
gcuagagugcaguggugcga

SEQ ID NO: 2169564 - RNA, 16 nt, Homo sapiens
caggaggugccugaaa

SEQ ID NO: 2169565 - RNA, 16 nt, Homo sapiens
guaggacccaagcaga

SEQ ID NO: 2169566 - RNA, 18 nt, Homo sapiens
uuaaaauuguaaccugca

SEQ ID NO: 2169567 - RNA, 15 nt, Homo sapiens
uaugacuugaucacu

SEQ ID NO: 2169568 - RNA, 17 nt, Homo sapiens
uucucacacuauggcag

SEQ ID NO: 2169569 - RNA, 12 nt, Homo sapiens
gucaaauugcaa

SEQ ID NO: 2169570 - RNA, 23 nt, Homo sapiens
uuguaguugcaauagaacagaga

SEQ ID NO: 2169571 - RNA, 11 nt, Homo sapiens
gagcuccgccu

SEQ ID NO: 2169572 - RNA, 22 nt, Homo sapiens
ugaaguuuugguucuucagugc

SEQ ID NO: 2169573 - RNA, 16 nt, Homo sapiens
ccaccaccccuaccac

SEQ ID NO: 2169574 - RNA, 21 nt, Homo sapiens
ugauggcucauuuacacucag

SEQ ID NO: 2169575 - RNA, 13 nt, Homo sapiens
caaagcaccagcu

SEQ ID NO: 2169576 - RNA, 17 nt, Homo sapiens
cuccuuccagcacugac

SEQ ID NO: 2169577 - RNA, 21 nt, Homo sapiens
ucauaagaaugaauaauaauu

SEQ ID NO: 2169578 - RNA, 17 nt, Homo sapiens
gcaguuccugucccuuc

SEQ ID NO: 2169579 - RNA, 13 nt, Homo sapiens
uaggaauugcauu

SEQ ID NO: 2169580 - RNA, 12 nt, Homo sapiens
guaaaccuggag

SEQ ID NO: 2169581 - RNA, 16 nt, Homo sapiens
uucagaguggacuaca

SEQ ID NO: 2169582 - RNA, 17 nt, Homo sapiens
cagugcucuuuguagcu

SEQ ID NO: 2169583 - RNA, 20 nt, Homo sapiens
cucgugguuagcaagauaca

SEQ ID NO: 2169584 - RNA, 13 nt, Homo sapiens
ucuucacuaaaau

SEQ ID NO: 2169585 - RNA, 12 nt, Homo sapiens
gacacaggccag

SEQ ID NO: 2169586 - RNA, 16 nt, Homo sapiens
aaacugacaguauuaa

SEQ ID NO: 2169587 - RNA, 21 nt, Homo sapiens
ccuucuggacacugagagggc

SEQ ID NO: 2169588 - RNA, 17 nt, Homo sapiens
gagcccugcucuucucu

SEQ ID NO: 2169589 - RNA, 16 nt, Homo sapiens
cugcaagucagaggau

SEQ ID NO: 2169590 - RNA, 15 nt, Homo sapiens
ccauugguguugaca

SEQ ID NO: 2169591 - RNA, 18 nt, Homo sapiens
gcgaggggugaguguuca

SEQ ID NO: 2169592 - RNA, 13 nt, Homo sapiens
aggauggcuugag

SEQ ID NO: 2169593 - RNA, 20 nt, Homo sapiens
agcauuuaagagugaaguca

SEQ ID NO: 2169594 - RNA, 17 nt, Homo sapiens
gauuguaaaguagcugu

SEQ ID NO: 2169595 - RNA, 15 nt, Homo sapiens
ugaaccuauaagcag

SEQ ID NO: 2169596 - RNA, 14 nt, Homo sapiens
ggcuuccagcucag

SEQ ID NO: 2169597 - RNA, 23 nt, Homo sapiens
gggucuugcucugucucccaggc

SEQ ID NO: 2169598 - RNA, 17 nt, Homo sapiens
aaccaucacugguugca

SEQ ID NO: 2169599 - RNA, 22 nt, Homo sapiens
ggacuugguuuguuauaucagg

SEQ ID NO: 2169600 - RNA, 21 nt, Homo sapiens
cauuauucucugaugcacugu

SEQ ID NO: 2169601 - RNA, 20 nt, Homo sapiens
caacaagcccugcuuuugca

SEQ ID NO: 2169602 - RNA, 16 nt, Homo sapiens
agaccuagcagggaag

SEQ ID NO: 2169603 - RNA, 20 nt, Homo sapiens
gccuccuauccaccacugcu

SEQ ID NO: 2169604 - RNA, 20 nt, Homo sapiens
uuaaagaccaauaaacuucc

SEQ ID NO: 2169605 - RNA, 14 nt, Homo sapiens
aagucaacaguaaa

SEQ ID NO: 2169606 - RNA, 12 nt, Homo sapiens
aggaaucauucc

SEQ ID NO: 2169607 - RNA, 19 nt, Homo sapiens
gccuuaauucuuaccucau

SEQ ID NO: 2169608 - RNA, 12 nt, Homo sapiens
acuuagcucaca

SEQ ID NO: 2169609 - RNA, 12 nt, Homo sapiens
acagaugaaggu

SEQ ID NO: 2169610 - RNA, 14 nt, Homo sapiens
cauaugaacacaga

SEQ ID NO: 2169611 - RNA, 24 nt, Homo sapiens
ccaaaacuuuaaugaacuaacuga

SEQ ID NO: 2169612 - RNA, 18 nt, Homo sapiens
aaaggcacauuacauuua

SEQ ID NO: 2169613 - RNA, 14 nt, Homo sapiens
uaauuucagugccu

SEQ ID NO: 2169614 - RNA, 17 nt, Homo sapiens
caaggaguacuccaaga

SEQ ID NO: 2169615 - RNA, 21 nt, Homo sapiens
uuuuaggaaaagugaaucuug

SEQ ID NO: 2169616 - RNA, 18 nt, Homo sapiens
gagucaacuccuuucuca

SEQ ID NO: 2169617 - RNA, 19 nt, Homo sapiens
gcaggaucucaccaggcag

SEQ ID NO: 2169618 - RNA, 20 nt, Homo sapiens
caauuaauugagcagcauga

SEQ ID NO: 2169619 - RNA, 18 nt, Homo sapiens
ucaauuucuugguauuau

SEQ ID NO: 2169620 - RNA, 23 nt, Homo sapiens
uuucauggaaugcaauuugacuu

SEQ ID NO: 2169621 - RNA, 14 nt, Homo sapiens
cugaaggugcaguu

SEQ ID NO: 2169622 - RNA, 21 nt, Homo sapiens
gaauucagaccuggaauguaa

SEQ ID NO: 2169623 - RNA, 14 nt, Homo sapiens
ugaaacugcacauu

SEQ ID NO: 2169624 - RNA, 12 nt, Homo sapiens
ugcuccaugcag

SEQ ID NO: 2169625 - RNA, 18 nt, Homo sapiens
aauagcaguuauaacaga

SEQ ID NO: 2169626 - RNA, 14 nt, Homo sapiens
cuugugaucacuua

SEQ ID NO: 2169627 - RNA, 19 nt, Homo sapiens
agauaauaacugucuucug

SEQ ID NO: 2169628 - RNA, 17 nt, Homo sapiens
acacaguaaaauauuca

SEQ ID NO: 2169629 - RNA, 18 nt, Homo sapiens
gaaccauuauagccucag

SEQ ID NO: 2169630 - RNA, 15 nt, Homo sapiens
uugauuuacagugcc

SEQ ID NO: 2169631 - RNA, 18 nt, Homo sapiens
cuagaagcugaucugauu

SEQ ID NO: 2169632 - RNA, 20 nt, Homo sapiens
aucucugccauaucagugaa

SEQ ID NO: 2169633 - RNA, 19 nt, Homo sapiens
cuucagaguuuguguguau

SEQ ID NO: 2169634 - RNA, 18 nt, Homo sapiens
auugugauauuuuuacuu

SEQ ID NO: 2169635 - RNA, 18 nt, Homo sapiens
aucagaugacucucucca

SEQ ID NO: 2169636 - RNA, 21 nt, Homo sapiens
cuggcagaaagcaaaugugac

SEQ ID NO: 2169637 - RNA, 14 nt, Homo sapiens
cauguucccaaaau

SEQ ID NO: 2169638 - RNA, 14 nt, Homo sapiens
aaugagccaaaaug

SEQ ID NO: 2169639 - RNA, 17 nt, Homo sapiens
gucuuucuuacaaggaa

SEQ ID NO: 2169640 - RNA, 16 nt, Homo sapiens
auuuguuuucaacaau

SEQ ID NO: 2169641 - RNA, 14 nt, Homo sapiens
aaacuuaacaugga

SEQ ID NO: 2169642 - RNA, 22 nt, Homo sapiens
aagcuuucauuugccgggacac

SEQ ID NO: 2169643 - RNA, 16 nt, Homo sapiens
cucccugcuugcacac

SEQ ID NO: 2169644 - RNA, 18 nt, Homo sapiens
agcauucaggcacugcca

SEQ ID NO: 2169645 - RNA, 22 nt, Homo sapiens
cugggucacaggaaggaaacaa

SEQ ID NO: 2169646 - RNA, 14 nt, Homo sapiens
caaaggcaggcacu

SEQ ID NO: 2169647 - RNA, 15 nt, Homo sapiens
agucuuauuuauuca

SEQ ID NO: 2169648 - RNA, 22 nt, Homo sapiens
aagguuuuguugcuagcccuuc

SEQ ID NO: 2169649 - RNA, 13 nt, Homo sapiens
gccauacugccuu

SEQ ID NO: 2169650 - RNA, 13 nt, Homo sapiens
uuuuaacuuuuaa

SEQ ID NO: 2169651 - RNA, 13 nt, Homo sapiens
gagucacugagac

SEQ ID NO: 2169652 - RNA, 14 nt, Homo sapiens
cagucgagaccuca

SEQ ID NO: 2169653 - RNA, 20 nt, Homo sapiens
gcacucuaaaagguucaggg

SEQ ID NO: 2169654 - RNA, 20 nt, Homo sapiens
uuccauacagugacaauaca

SEQ ID NO: 2169655 - RNA, 13 nt, Homo sapiens
uuacaugauucau

SEQ ID NO: 2169656 - RNA, 16 nt, Homo sapiens
ugucaggauucuucaa

SEQ ID NO: 2169657 - RNA, 15 nt, Homo sapiens
acacagauuguauuc

SEQ ID NO: 2169658 - RNA, 14 nt, Homo sapiens
uuucaccaguuucu

SEQ ID NO: 2169659 - RNA, 23 nt, Homo sapiens
uauaacuuuguggagcaguguuu

SEQ ID NO: 2169660 - RNA, 19 nt, Homo sapiens
agacaaacuuugcaucuca

SEQ ID NO: 2169661 - RNA, 15 nt, Homo sapiens
gagaggaggggacca

SEQ ID NO: 2169662 - RNA, 15 nt, Homo sapiens
aauacaguacuguuu

SEQ ID NO: 2169663 - RNA, 14 nt, Homo sapiens
cagcuagcuuauuc

SEQ ID NO: 2169664 - RNA, 15 nt, Homo sapiens
cuggucuguggguca

SEQ ID NO: 2169665 - RNA, 15 nt, Homo sapiens
agacagggucaucga

SEQ ID NO: 2169666 - RNA, 12 nt, Homo sapiens
uuuuauaugauu

SEQ ID NO: 2169667 - RNA, 21 nt, Homo sapiens
ggccaucuggggcuccuucuc

SEQ ID NO: 2169668 - RNA, 16 nt, Homo sapiens
ucacuaugaagguaaa

SEQ ID NO: 2169669 - RNA, 17 nt, Homo sapiens
cacgguggucacuggaa

SEQ ID NO: 2169670 - RNA, 15 nt, Homo sapiens
aagugaagagguuuu

SEQ ID NO: 2169671 - RNA, 20 nt, Homo sapiens
gaccugauucccugugguga

SEQ ID NO: 2169672 - RNA, 23 nt, Homo sapiens
ugacaugccuauaugagaagaau

SEQ ID NO: 2169673 - RNA, 15 nt, Homo sapiens
gaaucauaugggaua

SEQ ID NO: 2169674 - RNA, 21 nt, Homo sapiens
aaguccugcuggaucuugccu

SEQ ID NO: 2169675 - RNA, 17 nt, Homo sapiens
uaauuuccccacucuga

SEQ ID NO: 2169676 - RNA, 21 nt, Homo sapiens
ugaagugaaugaaacacucag

SEQ ID NO: 2169677 - RNA, 16 nt, Homo sapiens
aacuaggugaucucag

SEQ ID NO: 2169678 - RNA, 21 nt, Homo sapiens
ccaacuaaaaacaaacccuuu

SEQ ID NO: 2169679 - RNA, 20 nt, Homo sapiens
gggcaccuauaauaccagcu

SEQ ID NO: 2169680 - RNA, 14 nt, Homo sapiens
ucuucagaggagca

SEQ ID NO: 2169681 - RNA, 19 nt, Homo sapiens
cugccaggugcuuggcucu

SEQ ID NO: 2169682 - RNA, 21 nt, Homo sapiens
ucaaauaaaucuaaaucuuca

SEQ ID NO: 2169683 - RNA, 20 nt, Homo sapiens
ucuguuuccaggucagaaac

SEQ ID NO: 2169684 - RNA, 22 nt, Homo sapiens
ucaguacccacucuggagcauu

SEQ ID NO: 2169685 - RNA, 14 nt, Homo sapiens
agccugauccagcc

SEQ ID NO: 2169686 - RNA, 19 nt, Homo sapiens
aaauuccacagauuaucaa

SEQ ID NO: 2169687 - RNA, 19 nt, Homo sapiens
cacaccucuaggacuccac

SEQ ID NO: 2169688 - RNA, 19 nt, Homo sapiens
gaaagcucacuguagcuuu

SEQ ID NO: 2169689 - RNA, 24 nt, Homo sapiens
ggagaggggccucaaaugcaccau

SEQ ID NO: 2169690 - RNA, 14 nt, Homo sapiens
uucuuuaguauuau

SEQ ID NO: 2169691 - RNA, 20 nt, Homo sapiens
ucccugcuaaagaguguuca

SEQ ID NO: 2169692 - RNA, 15 nt, Homo sapiens
gaaguuuaauucaua

SEQ ID NO: 2169693 - RNA, 19 nt, Homo sapiens
gaaacagugacaccugcau

SEQ ID NO: 2169694 - RNA, 17 nt, Homo sapiens
agugacccugcucucac

SEQ ID NO: 2169695 - RNA, 21 nt, Homo sapiens
gagggugucguccugcagugu

SEQ ID NO: 2169696 - RNA, 15 nt, Homo sapiens
auuugcuaaacauuu

SEQ ID NO: 2169697 - RNA, 16 nt, Homo sapiens
uaaaacugcacugcca

SEQ ID NO: 2169698 - RNA, 23 nt, Homo sapiens
uagaaaacccacacccacugucc

SEQ ID NO: 2169699 - RNA, 12 nt, Homo sapiens
gauuauguugcu

SEQ ID NO: 2169700 - RNA, 19 nt, Homo sapiens
guaugauccuaaugaaugc

SEQ ID NO: 2169701 - RNA, 15 nt, Homo sapiens
uggaagcacagagug

SEQ ID NO: 2169702 - RNA, 23 nt, Homo sapiens
ccucgcccuuucuuaaagugcag

SEQ ID NO: 2169703 - RNA, 16 nt, Homo sapiens
cagcccgacaggcaug

SEQ ID NO: 2169704 - RNA, 22 nt, Homo sapiens
caacucauugcaucauuuacaa

SEQ ID NO: 2169705 - RNA, 13 nt, Homo sapiens
uccugacccuccc

SEQ ID NO: 2169706 - RNA, 17 nt, Homo sapiens
cgggagccguagagggu

SEQ ID NO: 2169707 - RNA, 21 nt, Homo sapiens
cuagucagauggauguagaua

SEQ ID NO: 2169708 - RNA, 17 nt, Homo sapiens
caccuuaucuggaagau

SEQ ID NO: 2169709 - RNA, 20 nt, Homo sapiens
cgcccaggcuggagugcagu

SEQ ID NO: 2169710 - RNA, 20 nt, Homo sapiens
ugcccaggcuggaguguagu

SEQ ID NO: 2169711 - RNA, 16 nt, Homo sapiens
uuccuuaggucugccc

SEQ ID NO: 2169712 - RNA, 14 nt, Homo sapiens
ucuaggaugugaug

SEQ ID NO: 2169713 - RNA, 22 nt, Homo sapiens
auaaugcacugggguaccacau

SEQ ID NO: 2169714 - RNA, 23 nt, Homo sapiens
uggaguacuuagcuaguuuuauu

SEQ ID NO: 2169715 - RNA, 17 nt, Homo sapiens
cauacaugucacauuua

SEQ ID NO: 2169716 - RNA, 20 nt, Homo sapiens
gcacucacacgcgaaaguau

SEQ ID NO: 2169717 - RNA, 16 nt, Homo sapiens
uggagcaaaacaaagc

SEQ ID NO: 2169718 - RNA, 20 nt, Homo sapiens
ggagaugcugcaguuccaaa

SEQ ID NO: 2169719 - RNA, 13 nt, Homo sapiens
uggaaugcaguga

SEQ ID NO: 2169720 - RNA, 13 nt, Homo sapiens
uggagugcagugg

SEQ ID NO: 2169721 - RNA, 13 nt, Homo sapiens
uauauugcaaggu

SEQ ID NO: 2169722 - RNA, 13 nt, Homo sapiens
cuguaaacauuca

SEQ ID NO: 2169723 - RNA, 19 nt, Homo sapiens
gauuuagcaaguucuagaa

SEQ ID NO: 2169724 - RNA, 19 nt, Homo sapiens
gaaaauuauugacagcaau

SEQ ID NO: 2169725 - RNA, 20 nt, Homo sapiens
aauuugcucauaugaacuuu

SEQ ID NO: 2169726 - RNA, 16 nt, Homo sapiens
agguuugccugugauu

SEQ ID NO: 2169727 - RNA, 15 nt, Homo sapiens
auuuguaugaauaug

SEQ ID NO: 2169728 - RNA, 22 nt, Homo sapiens
caacuuguguuuauggcauuua

SEQ ID NO: 2169729 - RNA, 14 nt, Homo sapiens
uguaagagacauga

SEQ ID NO: 2169730 - RNA, 15 nt, Homo sapiens
agaugucagucuguc

SEQ ID NO: 2169731 - RNA, 14 nt, Homo sapiens
gaauuugguaaauu

SEQ ID NO: 2169732 - RNA, 17 nt, Homo sapiens
cugccaaaaccaaauug

SEQ ID NO: 2169733 - RNA, 13 nt, Homo sapiens
uucuaaaacugcc

SEQ ID NO: 2169734 - RNA, 16 nt, Homo sapiens
uuugaucacacagcca

SEQ ID NO: 2169735 - RNA, 22 nt, Homo sapiens
uuucaggaucagaucaauacaa

SEQ ID NO: 2169736 - RNA, 19 nt, Homo sapiens
augaugugguuuuuugcca

SEQ ID NO: 2169737 - RNA, 15 nt, Homo sapiens
cagagguugcaauga

SEQ ID NO: 2169738 - RNA, 22 nt, Homo sapiens
acuuucuuaucccaugagagag

SEQ ID NO: 2169739 - RNA, 14 nt, Homo sapiens
uggcaauagucaaa

SEQ ID NO: 2169740 - RNA, 20 nt, Homo sapiens
ucucagggaacugacccuca

SEQ ID NO: 2169741 - RNA, 16 nt, Homo sapiens
ucauccauguccaacc

SEQ ID NO: 2169742 - RNA, 19 nt, Homo sapiens
cgucccuauaucagggccu

SEQ ID NO: 2169743 - RNA, 16 nt, Homo sapiens
augagaagucacucac

SEQ ID NO: 2169744 - RNA, 14 nt, Homo sapiens
uuaugccaaagugu

SEQ ID NO: 2169745 - RNA, 21 nt, Homo sapiens
aacuuauucuuugaguaaugu

SEQ ID NO: 2169746 - RNA, 19 nt, Homo sapiens
acuccccuuaaucuaaucu

SEQ ID NO: 2169747 - RNA, 17 nt, Homo sapiens
gccaagggacacaggag

SEQ ID NO: 2169748 - RNA, 23 nt, Homo sapiens
agauugcgccauugcacuccagc

SEQ ID NO: 2169749 - RNA, 16 nt, Homo sapiens
aaguuccaaaagcaca

SEQ ID NO: 2169750 - RNA, 13 nt, Homo sapiens
acuuuggggacag

SEQ ID NO: 2169751 - RNA, 19 nt, Homo sapiens
gcccagcuuggagugccac

SEQ ID NO: 2169752 - RNA, 18 nt, Homo sapiens
gaagaaccaaauaccuca

SEQ ID NO: 2169753 - RNA, 22 nt, Homo sapiens
ccagacucagguuccagaacag

SEQ ID NO: 2169754 - RNA, 19 nt, Homo sapiens
ugacuagaauuuagucucu

SEQ ID NO: 2169755 - RNA, 16 nt, Homo sapiens
gguaacuugcaccucu

SEQ ID NO: 2169756 - RNA, 14 nt, Homo sapiens
uucuuuucacuucg

SEQ ID NO: 2169757 - RNA, 15 nt, Homo sapiens
ccuacugagcauuug

SEQ ID NO: 2169758 - RNA, 18 nt, Homo sapiens
gcacugaagcagaauugu

SEQ ID NO: 2169759 - RNA, 22 nt, Homo sapiens
agcccagcuuuuccugggacau

SEQ ID NO: 2169760 - RNA, 15 nt, Homo sapiens
aaaugcuucugcaca

SEQ ID NO: 2169761 - RNA, 21 nt, Homo sapiens
ugccucagugagaucagucag

SEQ ID NO: 2169762 - RNA, 15 nt, Homo sapiens
uguaagguaauuucu

SEQ ID NO: 2169763 - RNA, 20 nt, Homo sapiens
acccagcccugaacaaagca

SEQ ID NO: 2169764 - RNA, 23 nt, Homo sapiens
agucuuaaaauaacuuauaucau

SEQ ID NO: 2169765 - RNA, 22 nt, Homo sapiens
cuucccuccucccaugucacug

SEQ ID NO: 2169766 - RNA, 17 nt, Homo sapiens
caggguguuaaggcagu

SEQ ID NO: 2169767 - RNA, 19 nt, Homo sapiens
ccuucuccugccuacauuc

SEQ ID NO: 2169768 - RNA, 17 nt, Homo sapiens
cugauaacauuuuccca

SEQ ID NO: 2169769 - RNA, 21 nt, Homo sapiens
aucucaaacucccuuuggccc

SEQ ID NO: 2169770 - RNA, 17 nt, Homo sapiens
ggcuucaaauuguaagc

SEQ ID NO: 2169771 - RNA, 12 nt, Homo sapiens
gaaaaugccuca

SEQ ID NO: 2169772 - RNA, 22 nt, Homo sapiens
auuggcaucucuccccauauau

SEQ ID NO: 2169773 - RNA, 15 nt, Homo sapiens
accuuuauagcucau

SEQ ID NO: 2169774 - RNA, 12 nt, Homo sapiens
aucuuacucuac

SEQ ID NO: 2169775 - RNA, 23 nt, Homo sapiens
gugagaagucacucacacuggcc

SEQ ID NO: 2169776 - RNA, 17 nt, Homo sapiens
uaaacuuggcuguaugu

SEQ ID NO: 2169777 - RNA, 15 nt, Homo sapiens
agaugccuguugaag

SEQ ID NO: 2169778 - RNA, 14 nt, Homo sapiens
ucuuauccuuugua

SEQ ID NO: 2169779 - RNA, 13 nt, Homo sapiens
caagcauuacuuu

SEQ ID NO: 2169780 - RNA, 14 nt, Homo sapiens
gaucaucaagguga

SEQ ID NO: 2169781 - RNA, 19 nt, Homo sapiens
cuuugucgugguucuuaaa

SEQ ID NO: 2169782 - RNA, 20 nt, Homo sapiens
uuagaaaugucaguugcugc

SEQ ID NO: 2169783 - RNA, 14 nt, Homo sapiens
ucaaccagugcaag

SEQ ID NO: 2169784 - RNA, 16 nt, Homo sapiens
uuuucucuauucuuuc

SEQ ID NO: 2169785 - RNA, 15 nt, Homo sapiens
agagucuaccuugaa

SEQ ID NO: 2169786 - RNA, 17 nt, Homo sapiens
cguugauggccaaagca

SEQ ID NO: 2169787 - RNA, 13 nt, Homo sapiens
gucccacugugca

SEQ ID NO: 2169788 - RNA, 13 nt, Homo sapiens
cuggaggcucugu

SEQ ID NO: 2169789 - RNA, 14 nt, Homo sapiens
uguaugguuccaaa

SEQ ID NO: 2169790 - RNA, 17 nt, Homo sapiens
caaaggagccuuuucaa

SEQ ID NO: 2169791 - RNA, 13 nt, Homo sapiens
aaugcaaugugaa

SEQ ID NO: 2169792 - RNA, 17 nt, Homo sapiens
gaccaugaaacauugua

SEQ ID NO: 2169793 - RNA, 12 nt, Homo sapiens
uugaggcuuuca

SEQ ID NO: 2169794 - RNA, 21 nt, Homo sapiens
gcaguaucaugcccugugcaa

SEQ ID NO: 2169795 - RNA, 21 nt, Homo sapiens
gacugcagggguuauguggaa

SEQ ID NO: 2169796 - RNA, 18 nt, Homo sapiens
ccaaaaucugucacuaca

SEQ ID NO: 2169797 - RNA, 20 nt, Homo sapiens
cuuuauuuaaaaagaaugga

SEQ ID NO: 2169798 - RNA, 13 nt, Homo sapiens
cucgucuuugcag

SEQ ID NO: 2169799 - RNA, 15 nt, Homo sapiens
augcuuucaucaucc

SEQ ID NO: 2169800 - RNA, 15 nt, Homo sapiens
accaucaaaugcugu

SEQ ID NO: 2169801 - RNA, 18 nt, Homo sapiens
ccagcgugugacuacucc

SEQ ID NO: 2169802 - RNA, 16 nt, Homo sapiens
uaaaaaaauuagugag

SEQ ID NO: 2169803 - RNA, 16 nt, Homo sapiens
agcccaugucaaucaa

SEQ ID NO: 2169804 - RNA, 14 nt, Homo sapiens
aauauuacucucaa

SEQ ID NO: 2169805 - RNA, 18 nt, Homo sapiens
gccugucaguuucaugga

SEQ ID NO: 2169806 - RNA, 18 nt, Homo sapiens
auuucuggaaaacugccu

SEQ ID NO: 2169807 - RNA, 18 nt, Homo sapiens
cuuggucccacaggccac

SEQ ID NO: 2169808 - RNA, 16 nt, Homo sapiens
auguccugacuuugcc

SEQ ID NO: 2169809 - RNA, 14 nt, Homo sapiens
caugcuuuucugcc

SEQ ID NO: 2169810 - RNA, 14 nt, Homo sapiens
ucucccuucauccu

SEQ ID NO: 2169811 - RNA, 14 nt, Homo sapiens
ucaacccagcaauc

SEQ ID NO: 2169812 - RNA, 14 nt, Homo sapiens
ugagcucaggaguu

SEQ ID NO: 2169813 - RNA, 17 nt, Homo sapiens
aaccaagaguauuccau

SEQ ID NO: 2169814 - RNA, 12 nt, Homo sapiens
uuagugcacuga

SEQ ID NO: 2169815 - RNA, 23 nt, Homo sapiens
auuuugugauucuauaaaacaca

SEQ ID NO: 2169816 - RNA, 12 nt, Homo sapiens
uucucagcacuu

SEQ ID NO: 2169817 - RNA, 12 nt, Homo sapiens
uucacagcacua

SEQ ID NO: 2169818 - RNA, 22 nt, Homo sapiens
ucacagcugggaagacauuucu

SEQ ID NO: 2169819 - RNA, 17 nt, Homo sapiens
gucaugcugugcauuuu

SEQ ID NO: 2169820 - RNA, 15 nt, Homo sapiens
ccuccgucuucccag

SEQ ID NO: 2169821 - RNA, 18 nt, Homo sapiens
augguguguguucagcuc

SEQ ID NO: 2169822 - RNA, 19 nt, Homo sapiens
auuccguugucuguggaug

SEQ ID NO: 2169823 - RNA, 18 nt, Homo sapiens
caugcagacccucagacc

SEQ ID NO: 2169824 - RNA, 13 nt, Homo sapiens
uuaccaaaacaua

SEQ ID NO: 2169825 - RNA, 20 nt, Homo sapiens
gaucucgaacuccuaaccuc

SEQ ID NO: 2169826 - RNA, 13 nt, Homo sapiens
aaaacuagcauua

SEQ ID NO: 2169827 - RNA, 20 nt, Homo sapiens
cacagaugggcaaggccuuu

SEQ ID NO: 2169828 - RNA, 20 nt, Homo sapiens
acaaaccagcaacuaauaaa

SEQ ID NO: 2169829 - RNA, 20 nt, Homo sapiens
cugccgccucagcuucucaa

SEQ ID NO: 2169830 - RNA, 17 nt, Homo sapiens
agaugaccugccuuauc

SEQ ID NO: 2169831 - RNA, 19 nt, Homo sapiens
gaaugugcuuuguaagauc

SEQ ID NO: 2169832 - RNA, 21 nt, Homo sapiens
cuggccguguccaccuuucag

SEQ ID NO: 2169833 - RNA, 13 nt, Homo sapiens
auaucacacaaua

SEQ ID NO: 2169834 - RNA, 13 nt, Homo sapiens
aaggaacacuggc

SEQ ID NO: 2169835 - RNA, 16 nt, Homo sapiens
cuuuauaauggcucug

SEQ ID NO: 2169836 - RNA, 16 nt, Homo sapiens
cacaugcugagucucc

SEQ ID NO: 2169837 - RNA, 21 nt, Homo sapiens
uagcagauuucuugcuucaua

SEQ ID NO: 2169838 - RNA, 17 nt, Homo sapiens
uguaaacaaaccacagc

SEQ ID NO: 2169839 - RNA, 18 nt, Homo sapiens
cacguggcuucugaugaa

SEQ ID NO: 2169840 - RNA, 14 nt, Homo sapiens
cagcacaaggccau

SEQ ID NO: 2169841 - RNA, 16 nt, Homo sapiens
cagcugaacacaagca

SEQ ID NO: 2169842 - RNA, 14 nt, Homo sapiens
ccaaggaacaagac

SEQ ID NO: 2169843 - RNA, 19 nt, Homo sapiens
accuugugaacaucagaag

SEQ ID NO: 2169844 - RNA, 15 nt, Homo sapiens
gagggagaagcauga

SEQ ID NO: 2169845 - RNA, 18 nt, Homo sapiens
ccacucuauacuagggac

SEQ ID NO: 2169846 - RNA, 16 nt, Homo sapiens
cuuggaggaaugacaa

SEQ ID NO: 2169847 - RNA, 14 nt, Homo sapiens
uaucagcucuaugu

SEQ ID NO: 2169848 - RNA, 23 nt, Homo sapiens
cggugucaucccucccaaugcca

SEQ ID NO: 2169849 - RNA, 22 nt, Homo sapiens
ugcuuauuuuguuggaguauua

SEQ ID NO: 2169850 - RNA, 16 nt, Homo sapiens
ugggauuggcugugag

SEQ ID NO: 2169851 - RNA, 15 nt, Homo sapiens
cauuaauaauccuuc

SEQ ID NO: 2169852 - RNA, 16 nt, Homo sapiens
gagauuugguguacaa

SEQ ID NO: 2169853 - RNA, 19 nt, Homo sapiens
ggauguccuacuaucacug

SEQ ID NO: 2169854 - RNA, 14 nt, Homo sapiens
auaugcagugauau

SEQ ID NO: 2169855 - RNA, 15 nt, Homo sapiens
acaagcaauuacaau

SEQ ID NO: 2169856 - RNA, 13 nt, Homo sapiens
ucaaguguccuga

SEQ ID NO: 2169857 - RNA, 20 nt, Homo sapiens
cuuuaaccacuccucaggaa

SEQ ID NO: 2169858 - RNA, 20 nt, Homo sapiens
aauucuuauugacucauaca

SEQ ID NO: 2169859 - RNA, 15 nt, Homo sapiens
caugcugcuaugaag

SEQ ID NO: 2169860 - RNA, 21 nt, Homo sapiens
ccgagcgggugcaagcacucg

SEQ ID NO: 2169861 - RNA, 17 nt, Homo sapiens
aauaaaucacacauuca

SEQ ID NO: 2169862 - RNA, 20 nt, Homo sapiens
agcuauuuugugaagccaug

SEQ ID NO: 2169863 - RNA, 18 nt, Homo sapiens
aucaaccaaacaaagaaa

SEQ ID NO: 2169864 - RNA, 23 nt, Homo sapiens
aagcugagucucccuaaggcaug

SEQ ID NO: 2169865 - RNA, 18 nt, Homo sapiens
cugguucucucucuuagc

SEQ ID NO: 2169866 - RNA, 17 nt, Homo sapiens
cagccuguuugggaugu

SEQ ID NO: 2169867 - RNA, 17 nt, Homo sapiens
auccagaccccaugccu

SEQ ID NO: 2169868 - RNA, 19 nt, Homo sapiens
cacacagggugguggcaca

SEQ ID NO: 2169869 - RNA, 24 nt, Homo sapiens
ugcagaagcgcuccaguaucucca

SEQ ID NO: 2169870 - RNA, 13 nt, Homo sapiens
uuuucuucauuca

SEQ ID NO: 2169871 - RNA, 18 nt, Homo sapiens
caaacagaccccuguuca

SEQ ID NO: 2169872 - RNA, 17 nt, Homo sapiens
cacagagauaugcacac

SEQ ID NO: 2169873 - RNA, 18 nt, Homo sapiens
augcccagcucagugcca

SEQ ID NO: 2169874 - RNA, 17 nt, Homo sapiens
aacacuuucugcacuua

SEQ ID NO: 2169875 - RNA, 21 nt, Homo sapiens
caaaugcuuuaacagcugaua

SEQ ID NO: 2169876 - RNA, 23 nt, Homo sapiens
gaugauuaagugcacaccgugug

SEQ ID NO: 2169877 - RNA, 22 nt, Homo sapiens
aagaaaacuaacaaccaaccaa

SEQ ID NO: 2169878 - RNA, 15 nt, Homo sapiens
cuucacacaguucaa

SEQ ID NO: 2169879 - RNA, 15 nt, Homo sapiens
agugaccuuuuaauc

SEQ ID NO: 2169880 - RNA, 17 nt, Homo sapiens
acaugcgguagccagca

SEQ ID NO: 2169881 - RNA, 15 nt, Homo sapiens
guuuauaauuuucug

SEQ ID NO: 2169882 - RNA, 15 nt, Homo sapiens
aaaggccucuuguaa

SEQ ID NO: 2169883 - RNA, 12 nt, Homo sapiens
caagcaggcacu

SEQ ID NO: 2169884 - RNA, 17 nt, Homo sapiens
caucuaagacauucacc

SEQ ID NO: 2169885 - RNA, 23 nt, Homo sapiens
uuacaaacauggaaaacagagua

SEQ ID NO: 2169886 - RNA, 21 nt, Homo sapiens
uacuuaaaaaauccugcccaa

SEQ ID NO: 2169887 - RNA, 16 nt, Homo sapiens
ugugccuugaacauau

SEQ ID NO: 2169888 - RNA, 19 nt, Homo sapiens
aguaugagaagaaaaaugg

SEQ ID NO: 2169889 - RNA, 20 nt, Homo sapiens
aaacauuauucucaaccaga

SEQ ID NO: 2169890 - RNA, 22 nt, Homo sapiens
aagcccaccugcacgugaucug

SEQ ID NO: 2169891 - RNA, 16 nt, Homo sapiens
gggcagccgccaagag

SEQ ID NO: 2169892 - RNA, 18 nt, Homo sapiens
ucauucacgggacuaguu

SEQ ID NO: 2169893 - RNA, 22 nt, Homo sapiens
gagaaguccccuuccaucccag

SEQ ID NO: 2169894 - RNA, 18 nt, Homo sapiens
uuucucucagauuuccac

SEQ ID NO: 2169895 - RNA, 22 nt, Homo sapiens
ugucauguggcuaccuguaacu

SEQ ID NO: 2169896 - RNA, 14 nt, Homo sapiens
ucaagagacaguau

SEQ ID NO: 2169897 - RNA, 19 nt, Homo sapiens
uuaagaucccagugugaag

SEQ ID NO: 2169898 - RNA, 15 nt, Homo sapiens
cauauaaagugcaau

SEQ ID NO: 2169899 - RNA, 18 nt, Homo sapiens
aggaauugggaccugguu

SEQ ID NO: 2169900 - RNA, 17 nt, Homo sapiens
ggccugcaaacugggaa

SEQ ID NO: 2169901 - RNA, 22 nt, Homo sapiens
uguacguuacagcuuucacaga

SEQ ID NO: 2169902 - RNA, 15 nt, Homo sapiens
aagaaucaccucaaa

SEQ ID NO: 2169903 - RNA, 12 nt, Homo sapiens
aauauaaacugu

SEQ ID NO: 2169904 - RNA, 16 nt, Homo sapiens
gaaguguuuccuuacc

SEQ ID NO: 2169905 - RNA, 22 nt, Homo sapiens
cugagaggaagccugagguuga

SEQ ID NO: 2169906 - RNA, 17 nt, Homo sapiens
aauuuaaaccagcagaa

SEQ ID NO: 2169907 - RNA, 15 nt, Homo sapiens
cagggugguggcaca

SEQ ID NO: 2169908 - RNA, 20 nt, Homo sapiens
uauuucuucuucacauccau

SEQ ID NO: 2169909 - RNA, 20 nt, Homo sapiens
acccuuucuucaauacaaaa

SEQ ID NO: 2169910 - RNA, 23 nt, Homo sapiens
cugugugcaagugugugcacaug

SEQ ID NO: 2169911 - RNA, 15 nt, Homo sapiens
ccagugggguggagu

SEQ ID NO: 2169912 - RNA, 16 nt, Homo sapiens
agcucucaucuaguuu

SEQ ID NO: 2169913 - RNA, 16 nt, Homo sapiens
aguagcuuuccuccca

SEQ ID NO: 2169914 - RNA, 21 nt, Homo sapiens
cagguuccuuaucugucacac

SEQ ID NO: 2169915 - RNA, 14 nt, Homo sapiens
acuccugagcucaa

SEQ ID NO: 2169916 - RNA, 15 nt, Homo sapiens
ggcagagagggucac

SEQ ID NO: 2169917 - RNA, 19 nt, Homo sapiens
aauuuccagaacugcacaa

SEQ ID NO: 2169918 - RNA, 19 nt, Homo sapiens
gcacgccaacauggcacau

SEQ ID NO: 2169919 - RNA, 16 nt, Homo sapiens
uuucuuuaacauauca

SEQ ID NO: 2169920 - RNA, 20 nt, Homo sapiens
guugcauuaaaaaugcauau

SEQ ID NO: 2169921 - RNA, 22 nt, Homo sapiens
agugugggugacagcaugguaa

SEQ ID NO: 2169922 - RNA, 19 nt, Homo sapiens
agguacucuggacuuucuc

SEQ ID NO: 2169923 - RNA, 14 nt, Homo sapiens
uggccucccgccaa

SEQ ID NO: 2169924 - RNA, 21 nt, Homo sapiens
ugcugccaaacacccaugccc

SEQ ID NO: 2169925 - RNA, 18 nt, Homo sapiens
uagaauauccuauacugg

SEQ ID NO: 2169926 - RNA, 23 nt, Homo sapiens
gacauggguagcaauucuaccca

SEQ ID NO: 2169927 - RNA, 13 nt, Homo sapiens
uuuaacuguccca

SEQ ID NO: 2169928 - RNA, 17 nt, Homo sapiens
cacucauguacuuaaua

SEQ ID NO: 2169929 - RNA, 18 nt, Homo sapiens
auuuuuugguagcuugua

SEQ ID NO: 2169930 - RNA, 14 nt, Homo sapiens
uaaaguauucucca

SEQ ID NO: 2169931 - RNA, 21 nt, Homo sapiens
uaaauaaacucaaugagcucu

SEQ ID NO: 2169932 - RNA, 14 nt, Homo sapiens
ucugauacguguau

SEQ ID NO: 2169933 - RNA, 17 nt, Homo sapiens
gcacuguauugcuccuc

SEQ ID NO: 2169934 - RNA, 21 nt, Homo sapiens
ucuccccucccagucucuacu

SEQ ID NO: 2169935 - RNA, 17 nt, Homo sapiens
augauucagagcuuuca

SEQ ID NO: 2169936 - RNA, 14 nt, Homo sapiens
guaugccaagugaa

SEQ ID NO: 2169937 - RNA, 18 nt, Homo sapiens
ugaccacgucaucgggcc

SEQ ID NO: 2169938 - RNA, 17 nt, Homo sapiens
gcuuaagcgauucucau

SEQ ID NO: 2169939 - RNA, 14 nt, Homo sapiens
cugcaagccaggga

SEQ ID NO: 2169940 - RNA, 19 nt, Homo sapiens
cauuuauaugaauuuccac

SEQ ID NO: 2169941 - RNA, 15 nt, Homo sapiens
aggcagguugaucac

SEQ ID NO: 2169942 - RNA, 17 nt, Homo sapiens
aggaauuugcauuuagu

SEQ ID NO: 2169943 - RNA, 19 nt, Homo sapiens
gauaucccuuacuccagag

SEQ ID NO: 2169944 - RNA, 22 nt, Homo sapiens
aaaguaacagccuuucaauuca

SEQ ID NO: 2169945 - RNA, 22 nt, Homo sapiens
aagcuuuuuguuugcaucauuu

SEQ ID NO: 2169946 - RNA, 14 nt, Homo sapiens
cccauuuccugcuu

SEQ ID NO: 2169947 - RNA, 16 nt, Homo sapiens
ugacacugccagucac

SEQ ID NO: 2169948 - RNA, 15 nt, Homo sapiens
cgacuggcugugaga

SEQ ID NO: 2169949 - RNA, 22 nt, Homo sapiens
ucaucugcacaacugacuucca

SEQ ID NO: 2169950 - RNA, 18 nt, Homo sapiens
augcuaagacucaguggg

SEQ ID NO: 2169951 - RNA, 19 nt, Homo sapiens
gcaagucccaugauuucuu

SEQ ID NO: 2169952 - RNA, 19 nt, Homo sapiens
ugcaaagcaaaacagacug

SEQ ID NO: 2169953 - RNA, 19 nt, Homo sapiens
augccaccaacuuacaaaa

SEQ ID NO: 2169954 - RNA, 20 nt, Homo sapiens
agcuaaggaggccguucagc

SEQ ID NO: 2169955 - RNA, 18 nt, Homo sapiens
ggcaauuuuugacauuaa

SEQ ID NO: 2169956 - RNA, 18 nt, Homo sapiens
guaauauuggcauagaaa

SEQ ID NO: 2169957 - RNA, 20 nt, Homo sapiens
ugugucgcgcacacagcuua

SEQ ID NO: 2169958 - RNA, 16 nt, Homo sapiens
gccacggccuggcugg

SEQ ID NO: 2169959 - RNA, 20 nt, Homo sapiens
uuugugauucaaacuucugu

SEQ ID NO: 2169960 - RNA, 18 nt, Homo sapiens
ucagauuccgcaccaaua

SEQ ID NO: 2169961 - RNA, 21 nt, Homo sapiens
agccuccugaaguugcugcug

SEQ ID NO: 2169962 - RNA, 17 nt, Homo sapiens
aucgauuugcacccacc

SEQ ID NO: 2169963 - RNA, 15 nt, Homo sapiens
gacuauguaaacuac

SEQ ID NO: 2169964 - RNA, 18 nt, Homo sapiens
gcuuguuucucauuccca

SEQ ID NO: 2169965 - RNA, 14 nt, Homo sapiens
aggcguucuccugc

SEQ ID NO: 2169966 - RNA, 14 nt, Homo sapiens
ggauaaguagaauu

SEQ ID NO: 2169967 - RNA, 14 nt, Homo sapiens
aauuaugugauaua

SEQ ID NO: 2169968 - RNA, 18 nt, Homo sapiens
ucugccagccagcagcca

SEQ ID NO: 2169969 - RNA, 14 nt, Homo sapiens
aaauuaccugugga

SEQ ID NO: 2169970 - RNA, 19 nt, Homo sapiens
caaggaaauaaugugaaug

SEQ ID NO: 2169971 - RNA, 13 nt, Homo sapiens
agcucgugugccu

SEQ ID NO: 2169972 - RNA, 13 nt, Homo sapiens
agcuugugugccc

SEQ ID NO: 2169973 - RNA, 14 nt, Homo sapiens
ucgaagcuccguga

SEQ ID NO: 2169974 - RNA, 12 nt, Homo sapiens
uaccucccagca

SEQ ID NO: 2169975 - RNA, 12 nt, Homo sapiens
acauuugaauaa

SEQ ID NO: 2169976 - RNA, 19 nt, Homo sapiens
gcccaugcccaccugccca

SEQ ID NO: 2169977 - RNA, 19 nt, Homo sapiens
uccccuacaucaaaugcuc

SEQ ID NO: 2169978 - RNA, 18 nt, Homo sapiens
cgcaguggcucacaccug

SEQ ID NO: 2169979 - RNA, 18 nt, Homo sapiens
acguaaaauuuacaguca

SEQ ID NO: 2169980 - RNA, 22 nt, Homo sapiens
caccugcaggcuuagguccuca

SEQ ID NO: 2169981 - RNA, 19 nt, Homo sapiens
ugacaugcauucacauauc

SEQ ID NO: 2169982 - RNA, 13 nt, Homo sapiens
agccugucuuuca

SEQ ID NO: 2169983 - RNA, 21 nt, Homo sapiens
ucugauuuucuuguaaccugg

SEQ ID NO: 2169984 - RNA, 18 nt, Homo sapiens
uauuaagauucuugacuu

SEQ ID NO: 2169985 - RNA, 23 nt, Homo sapiens
uguagcacuuaacagauugccau

SEQ ID NO: 2169986 - RNA, 17 nt, Homo sapiens
aagaaccaaaagagauc

SEQ ID NO: 2169987 - RNA, 16 nt, Homo sapiens
uuggcucuagucacug

SEQ ID NO: 2169988 - RNA, 15 nt, Homo sapiens
aggcagccuccuuaa

SEQ ID NO: 2169989 - RNA, 21 nt, Homo sapiens
uagaaaaaaagugcuuaauau

SEQ ID NO: 2169990 - RNA, 19 nt, Homo sapiens
cauauaucaagguuucaau

SEQ ID NO: 2169991 - RNA, 23 nt, Homo sapiens
acauggagcuugacuucaugcca

SEQ ID NO: 2169992 - RNA, 20 nt, Homo sapiens
aaacaaaauguuaguggcau

SEQ ID NO: 2169993 - RNA, 22 nt, Homo sapiens
gcacagcccacacaugaaccau

SEQ ID NO: 2169994 - RNA, 13 nt, Homo sapiens
uacccaaacguga

SEQ ID NO: 2169995 - RNA, 21 nt, Homo sapiens
cuguacccaauuuaauuccau

SEQ ID NO: 2169996 - RNA, 21 nt, Homo sapiens
augaauuccaacucacuuuuu

SEQ ID NO: 2169997 - RNA, 17 nt, Homo sapiens
auaaagagccauaguuu

SEQ ID NO: 2169998 - RNA, 19 nt, Homo sapiens
ugaugagacaacacacaca

SEQ ID NO: 2169999 - RNA, 20 nt, Homo sapiens
cugcuggcuuccagcuucag

SEQ ID NO: 2170000 - RNA, 17 nt, Homo sapiens
cuggugaugcccaaaga

SEQ ID NO: 2170001 - RNA, 22 nt, Homo sapiens
ucaccacagggauccccaggau

SEQ ID NO: 2170002 - RNA, 16 nt, Homo sapiens
uccaguuugcaccugu

SEQ ID NO: 2170003 - RNA, 16 nt, Homo sapiens
ugacccggggcagcug

SEQ ID NO: 2170004 - RNA, 15 nt, Homo sapiens
cccuuacuguuucac

SEQ ID NO: 2170005 - RNA, 21 nt, Homo sapiens
uaugcugcaacaaaauguaga

SEQ ID NO: 2170006 - RNA, 14 nt, Homo sapiens
augaaggugugcua

SEQ ID NO: 2170007 - RNA, 20 nt, Homo sapiens
ucuauaccaaccaaaccaau

SEQ ID NO: 2170008 - RNA, 22 nt, Homo sapiens
uaacuggguaaugaaacaaaga

SEQ ID NO: 2170009 - RNA, 22 nt, Homo sapiens
gcaggcuccuuuguucuguauu

SEQ ID NO: 2170010 - RNA, 13 nt, Homo sapiens
ucagccccacuga

SEQ ID NO: 2170011 - RNA, 19 nt, Homo sapiens
augauaaaaagaaauguga

SEQ ID NO: 2170012 - RNA, 19 nt, Homo sapiens
agugauaaaauguuuguua

SEQ ID NO: 2170013 - RNA, 19 nt, Homo sapiens
uucuccagggaauucuuac

SEQ ID NO: 2170014 - RNA, 17 nt, Homo sapiens
gguguaaauauguuuca

SEQ ID NO: 2170015 - RNA, 20 nt, Homo sapiens
agucacggcugcgcacugug

SEQ ID NO: 2170016 - RNA, 18 nt, Homo sapiens
gugccguaacaacugugg

SEQ ID NO: 2170017 - RNA, 24 nt, Homo sapiens
gaaggugccacuccagugcccauc

SEQ ID NO: 2170018 - RNA, 16 nt, Homo sapiens
uggaacagaagacagc

SEQ ID NO: 2170019 - RNA, 22 nt, Homo sapiens
guuuuuaaauuuuguaugccaa

SEQ ID NO: 2170020 - RNA, 19 nt, Homo sapiens
gguuggaugggagugggca

SEQ ID NO: 2170021 - RNA, 23 nt, Homo sapiens
aauaaaaauuaucuauaaucuca

SEQ ID NO: 2170022 - RNA, 20 nt, Homo sapiens
agacgggguuucaccauguu

SEQ ID NO: 2170023 - RNA, 17 nt, Homo sapiens
uggauaccauuauaugu

SEQ ID NO: 2170024 - RNA, 21 nt, Homo sapiens
auaaauuggugauaaguggaa

SEQ ID NO: 2170025 - RNA, 14 nt, Homo sapiens
aaaaauuaucuaua

SEQ ID NO: 2170026 - RNA, 22 nt, Homo sapiens
gacuauaggcaugcgccaccau

SEQ ID NO: 2170027 - RNA, 21 nt, Homo sapiens
auuauuccucagaacaaugaa

SEQ ID NO: 2170028 - RNA, 22 nt, Homo sapiens
cuccugggagacaaagcaauaa

SEQ ID NO: 2170029 - RNA, 12 nt, Homo sapiens
gugccacacagu

SEQ ID NO: 2170030 - RNA, 12 nt, Homo sapiens
cagccacagugu

SEQ ID NO: 2170031 - RNA, 15 nt, Homo sapiens
gucccucacguuucu

SEQ ID NO: 2170032 - RNA, 15 nt, Homo sapiens
ugccaaucauugcaa

SEQ ID NO: 2170033 - RNA, 17 nt, Homo sapiens
ucccucucucuggaaag

SEQ ID NO: 2170034 - RNA, 17 nt, Homo sapiens
cacuugccuugugauau

SEQ ID NO: 2170035 - RNA, 12 nt, Homo sapiens
ggaagacugcuc

SEQ ID NO: 2170036 - RNA, 23 nt, Homo sapiens
uccccauccccacccagucucau

SEQ ID NO: 2170037 - RNA, 15 nt, Homo sapiens
gacaaaccauugaaa

SEQ ID NO: 2170038 - RNA, 16 nt, Homo sapiens
uuaaaacauaaacaca

SEQ ID NO: 2170039 - RNA, 15 nt, Homo sapiens
uuggggccaccaaag

SEQ ID NO: 2170040 - RNA, 19 nt, Homo sapiens
ucuucccacaccugucagc

SEQ ID NO: 2170041 - RNA, 20 nt, Homo sapiens
aauggcaaagacuggaucca

SEQ ID NO: 2170042 - RNA, 20 nt, Homo sapiens
aaaucucgcacuacaucuga

SEQ ID NO: 2170043 - RNA, 19 nt, Homo sapiens
ccugagcacuccuggugca

SEQ ID NO: 2170044 - RNA, 23 nt, Homo sapiens
uauccacagcuuacagcaauuug

SEQ ID NO: 2170045 - RNA, 16 nt, Homo sapiens
uccgcagcuucagggg

SEQ ID NO: 2170046 - RNA, 22 nt, Homo sapiens
gcuuaacgugucugagagccau

SEQ ID NO: 2170047 - RNA, 23 nt, Homo sapiens
ucccguuucuuaaaaaacauaua

SEQ ID NO: 2170048 - RNA, 14 nt, Homo sapiens
auuuuaaacauuuu

SEQ ID NO: 2170049 - RNA, 13 nt, Homo sapiens
ccacccagucuca

SEQ ID NO: 2170050 - RNA, 21 nt, Homo sapiens
guuacagccauaugcaggaca

SEQ ID NO: 2170051 - RNA, 20 nt, Homo sapiens
aaaaagagaucgagucacaa

SEQ ID NO: 2170052 - RNA, 23 nt, Homo sapiens
acuauugaauuggauacaaggau

SEQ ID NO: 2170053 - RNA, 14 nt, Homo sapiens
gaguucugggugga

SEQ ID NO: 2170054 - RNA, 12 nt, Homo sapiens
cacaggcagcuu

SEQ ID NO: 2170055 - RNA, 13 nt, Homo sapiens
gaaacauuugcca

SEQ ID NO: 2170056 - RNA, 14 nt, Homo sapiens
uguagauuugaaaa

SEQ ID NO: 2170057 - RNA, 17 nt, Homo sapiens
cagaaugccgcaugaca

SEQ ID NO: 2170058 - RNA, 23 nt, Homo sapiens
guguccccugacagggccagugc

SEQ ID NO: 2170059 - RNA, 15 nt, Homo sapiens
aggugucugccuuca

SEQ ID NO: 2170060 - RNA, 20 nt, Homo sapiens
accaguacacuccuaucuca

SEQ ID NO: 2170061 - RNA, 14 nt, Homo sapiens
cauuuggaaccaaa

SEQ ID NO: 2170062 - RNA, 17 nt, Homo sapiens
cuuaaagcugcugucac

SEQ ID NO: 2170063 - RNA, 13 nt, Homo sapiens
uguuuaugcaaga

SEQ ID NO: 2170064 - RNA, 15 nt, Homo sapiens
accauuguccccaag

SEQ ID NO: 2170065 - RNA, 22 nt, Homo sapiens
accccacuuuuuguuguucauu

SEQ ID NO: 2170066 - RNA, 20 nt, Homo sapiens
gcccccacagauccauccuu

SEQ ID NO: 2170067 - RNA, 17 nt, Homo sapiens
gacagugucagagucau

SEQ ID NO: 2170068 - RNA, 13 nt, Homo sapiens
aaaccuaccaaaa

SEQ ID NO: 2170069 - RNA, 17 nt, Homo sapiens
caggcugggauggagca

SEQ ID NO: 2170070 - RNA, 14 nt, Homo sapiens
cucucauucucacu

SEQ ID NO: 2170071 - RNA, 14 nt, Homo sapiens
ugcucuuuugcaca

SEQ ID NO: 2170072 - RNA, 20 nt, Homo sapiens
cagcauauguuguugcuugu

SEQ ID NO: 2170073 - RNA, 15 nt, Homo sapiens
ucucaaagcaucaaa

SEQ ID NO: 2170074 - RNA, 13 nt, Homo sapiens
aagggccaggugc

SEQ ID NO: 2170075 - RNA, 15 nt, Homo sapiens
uuucuccagggucag

SEQ ID NO: 2170076 - RNA, 19 nt, Homo sapiens
uauuuccuauaccauuucc

SEQ ID NO: 2170077 - RNA, 15 nt, Homo sapiens
cagugauagagcaaa

SEQ ID NO: 2170078 - RNA, 13 nt, Homo sapiens
auagagccucguc

SEQ ID NO: 2170079 - RNA, 16 nt, Homo sapiens
ggcuccacuacagacc

SEQ ID NO: 2170080 - RNA, 20 nt, Homo sapiens
augguucucagaucuugaca

SEQ ID NO: 2170081 - RNA, 14 nt, Homo sapiens
cugcaggaaauaua

SEQ ID NO: 2170082 - RNA, 16 nt, Homo sapiens
gagucuguuucaggag

SEQ ID NO: 2170083 - RNA, 17 nt, Homo sapiens
ugaaaagggggugggau

SEQ ID NO: 2170084 - RNA, 14 nt, Homo sapiens
gaaaauacauugug

SEQ ID NO: 2170085 - RNA, 23 nt, Homo sapiens
aagugauccuccugucuuggccu

SEQ ID NO: 2170086 - RNA, 18 nt, Homo sapiens
aaacaaugacauccagaa

SEQ ID NO: 2170087 - RNA, 16 nt, Homo sapiens
uagcccucaccacagc

SEQ ID NO: 2170088 - RNA, 12 nt, Homo sapiens
uacucuauguau

SEQ ID NO: 2170089 - RNA, 15 nt, Homo sapiens
augugcuugugugua

SEQ ID NO: 2170090 - RNA, 21 nt, Homo sapiens
gaaaugcuacaaacauaucaa

SEQ ID NO: 2170091 - RNA, 18 nt, Homo sapiens
cucuuguugagugccagc

SEQ ID NO: 2170092 - RNA, 22 nt, Homo sapiens
aauauuaagacagacgccugcu

SEQ ID NO: 2170093 - RNA, 14 nt, Homo sapiens
uugaaugcacuuuu

SEQ ID NO: 2170094 - RNA, 20 nt, Homo sapiens
cgcaaauacaugccuuucca

SEQ ID NO: 2170095 - RNA, 13 nt, Homo sapiens
acacuggauccau

SEQ ID NO: 2170096 - RNA, 16 nt, Homo sapiens
uauacuagauguuaag

SEQ ID NO: 2170097 - RNA, 22 nt, Homo sapiens
aggaaggcucucggguggggga

SEQ ID NO: 2170098 - RNA, 22 nt, Homo sapiens
uccgcugccaccacgucugcca

SEQ ID NO: 2170099 - RNA, 19 nt, Homo sapiens
agaugucuuaaccuauucc

SEQ ID NO: 2170100 - RNA, 20 nt, Homo sapiens
aagguaaugaccaguuguua

SEQ ID NO: 2170101 - RNA, 14 nt, Homo sapiens
uacuuuuuuacacu

SEQ ID NO: 2170102 - RNA, 23 nt, Homo sapiens
aaaucccuuucaugucuuuccac

SEQ ID NO: 2170103 - RNA, 14 nt, Homo sapiens
ccacaaacuccagg

SEQ ID NO: 2170104 - RNA, 13 nt, Homo sapiens
aacucugagcagu

SEQ ID NO: 2170105 - RNA, 21 nt, Homo sapiens
gagacugcagggguccacugu

SEQ ID NO: 2170106 - RNA, 12 nt, Homo sapiens
auauuucugcac

SEQ ID NO: 2170107 - RNA, 13 nt, Homo sapiens
agcacuggucaca

SEQ ID NO: 2170108 - RNA, 14 nt, Homo sapiens
uacacuugugcacc

SEQ ID NO: 2170109 - RNA, 18 nt, Homo sapiens
cauguacuacacuucuga

SEQ ID NO: 2170110 - RNA, 17 nt, Homo sapiens
cagggaagagggcagua

SEQ ID NO: 2170111 - RNA, 19 nt, Homo sapiens
ucuucacucugaauccuca

SEQ ID NO: 2170112 - RNA, 18 nt, Homo sapiens
uaaauguacuacauuugc

SEQ ID NO: 2170113 - RNA, 10 nt, Homo sapiens
cucauaauag

SEQ ID NO: 2170114 - RNA, 11 nt, Homo sapiens
ucagcacugua

SEQ ID NO: 2170115 - RNA, 17 nt, Homo sapiens
aauccuuaaagaacugu

SEQ ID NO: 2170116 - RNA, 17 nt, Homo sapiens
ucccccaguauguccuu

SEQ ID NO: 2170117 - RNA, 22 nt, Homo sapiens
ccaacucuaacaggcacuuuga

SEQ ID NO: 2170118 - RNA, 21 nt, Homo sapiens
ugauucaucuucacagcacau

SEQ ID NO: 2170119 - RNA, 14 nt, Homo sapiens
aguucccagaauca

SEQ ID NO: 2170120 - RNA, 20 nt, Homo sapiens
accauguucauuauaaucuc

SEQ ID NO: 2170121 - RNA, 15 nt, Homo sapiens
cucucuugacaucaa

SEQ ID NO: 2170122 - RNA, 21 nt, Homo sapiens
aggggcagccacaccacugcc

SEQ ID NO: 2170123 - RNA, 21 nt, Homo sapiens
guacaugccuguuaauauuca

SEQ ID NO: 2170124 - RNA, 12 nt, Homo sapiens
cagugagcucuu

SEQ ID NO: 2170125 - RNA, 22 nt, Homo sapiens
uauuagagauaauuuacuuagu

SEQ ID NO: 2170126 - RNA, 12 nt, Homo sapiens
uuacuuuggacu

SEQ ID NO: 2170127 - RNA, 24 nt, Homo sapiens
agaggcagcagagcauucagacuc

SEQ ID NO: 2170128 - RNA, 16 nt, Homo sapiens
cugcauuuucuucacu

SEQ ID NO: 2170129 - RNA, 18 nt, Homo sapiens
cagcuguugcaggcagug

SEQ ID NO: 2170130 - RNA, 14 nt, Homo sapiens
aaauccagaacuca

SEQ ID NO: 2170131 - RNA, 16 nt, Homo sapiens
ccaaccucgcccucuc

SEQ ID NO: 2170132 - RNA, 17 nt, Homo sapiens
agauacuaucauuaaca

SEQ ID NO: 2170133 - RNA, 20 nt, Homo sapiens
gaagcaugaauaacauuuaa

SEQ ID NO: 2170134 - RNA, 17 nt, Homo sapiens
cauucacuacaggugaa

SEQ ID NO: 2170135 - RNA, 18 nt, Homo sapiens
auacugcacuuuagugua

SEQ ID NO: 2170136 - RNA, 18 nt, Homo sapiens
gugcugagauuacaggug

SEQ ID NO: 2170137 - RNA, 14 nt, Homo sapiens
gcaagccacagaaa

SEQ ID NO: 2170138 - RNA, 17 nt, Homo sapiens
cuaaacuugcaccucau

SEQ ID NO: 2170139 - RNA, 14 nt, Homo sapiens
agcguagcagcuca

SEQ ID NO: 2170140 - RNA, 12 nt, Homo sapiens
cugcagaccaug

SEQ ID NO: 2170141 - RNA, 21 nt, Homo sapiens
agggggaaagguguaggcugg

SEQ ID NO: 2170142 - RNA, 20 nt, Homo sapiens
aaugauuucauauugaucuu

SEQ ID NO: 2170143 - RNA, 14 nt, Homo sapiens
ggaugcugugccuc

SEQ ID NO: 2170144 - RNA, 19 nt, Homo sapiens
aaauccuuuugaaugaugc

SEQ ID NO: 2170145 - RNA, 22 nt, Homo sapiens
agaggccgcgcguccagcugcc

SEQ ID NO: 2170146 - RNA, 13 nt, Homo sapiens
gugccucuuccca

SEQ ID NO: 2170147 - RNA, 17 nt, Homo sapiens
ggggguuuuuaaucuuu

SEQ ID NO: 2170148 - RNA, 17 nt, Homo sapiens
ucaauauacauaauaca

SEQ ID NO: 2170149 - RNA, 22 nt, Homo sapiens
uuuauaaaagaaggaaaagaua

SEQ ID NO: 2170150 - RNA, 22 nt, Homo sapiens
agaugaacuauuagacaugaaa

SEQ ID NO: 2170151 - RNA, 10 nt, Homo sapiens
ggcacugggc

SEQ ID NO: 2170152 - RNA, 17 nt, Homo sapiens
gcugaaauaaaaauaca

SEQ ID NO: 2170153 - RNA, 16 nt, Homo sapiens
caaaaacauaguuugu

SEQ ID NO: 2170154 - RNA, 21 nt, Homo sapiens
agaacaugaaucaaaagugcc

SEQ ID NO: 2170155 - RNA, 19 nt, Homo sapiens
cuacaguauacuugguuga

SEQ ID NO: 2170156 - RNA, 12 nt, Homo sapiens
uacagugauaua

SEQ ID NO: 2170157 - RNA, 13 nt, Homo sapiens
uuauugagauuca

SEQ ID NO: 2170158 - RNA, 21 nt, Homo sapiens
agauugcaaagggacauugaa

SEQ ID NO: 2170159 - RNA, 13 nt, Homo sapiens
cacaagagcugga

SEQ ID NO: 2170160 - RNA, 18 nt, Homo sapiens
ccaggauuacuagucaaa

SEQ ID NO: 2170161 - RNA, 15 nt, Homo sapiens
acaaaccucucagca

SEQ ID NO: 2170162 - RNA, 18 nt, Homo sapiens
guauaucuucuacaugca

SEQ ID NO: 2170163 - RNA, 14 nt, Homo sapiens
aauuacagccuuau

SEQ ID NO: 2170164 - RNA, 15 nt, Homo sapiens
gcugaccugguacug

SEQ ID NO: 2170165 - RNA, 18 nt, Homo sapiens
aggugcuacaacauguga

SEQ ID NO: 2170166 - RNA, 14 nt, Homo sapiens
gauggggaacauuu

SEQ ID NO: 2170167 - RNA, 15 nt, Homo sapiens
uccuucucacacaca

SEQ ID NO: 2170168 - RNA, 16 nt, Homo sapiens
uggaugucaccaagaa

SEQ ID NO: 2170169 - RNA, 15 nt, Homo sapiens
cugguuuucuugcca

SEQ ID NO: 2170170 - RNA, 16 nt, Homo sapiens
accauaugaacauaua

SEQ ID NO: 2170171 - RNA, 13 nt, Homo sapiens
cugaauuuugcuu

SEQ ID NO: 2170172 - RNA, 19 nt, Homo sapiens
ugcauagagccacguaugu

SEQ ID NO: 2170173 - RNA, 20 nt, Homo sapiens
ccacaauucacuagaccaga

SEQ ID NO: 2170174 - RNA, 17 nt, Homo sapiens
aagcaugucaaguggau

SEQ ID NO: 2170175 - RNA, 18 nt, Homo sapiens
caggcagguuugccagug

SEQ ID NO: 2170176 - RNA, 18 nt, Homo sapiens
cuucccagaggccaggaa

SEQ ID NO: 2170177 - RNA, 10 nt, Homo sapiens
gugaggccaa

SEQ ID NO: 2170178 - RNA, 22 nt, Homo sapiens
ggaaaaguguaauagcauacau

SEQ ID NO: 2170179 - RNA, 14 nt, Homo sapiens
auucaaaagcacaa

SEQ ID NO: 2170180 - RNA, 19 nt, Homo sapiens
acugacaaaggagccuuga

SEQ ID NO: 2170181 - RNA, 15 nt, Homo sapiens
agauuaacacucauu

SEQ ID NO: 2170182 - RNA, 17 nt, Homo sapiens
aaaagacaagacuucag

SEQ ID NO: 2170183 - RNA, 14 nt, Homo sapiens
guguacaaugccuu

SEQ ID NO: 2170184 - RNA, 18 nt, Homo sapiens
cagagugaaauucaauuc

SEQ ID NO: 2170185 - RNA, 16 nt, Homo sapiens
uccaggaaggcagcug

SEQ ID NO: 2170186 - RNA, 19 nt, Homo sapiens
acuucuagagauaguacau

SEQ ID NO: 2170187 - RNA, 18 nt, Homo sapiens
uaugcaaauacaaucagc

SEQ ID NO: 2170188 - RNA, 17 nt, Homo sapiens
auccugcaaggugaaac

SEQ ID NO: 2170189 - RNA, 17 nt, Homo sapiens
caggacuuauccaugca

SEQ ID NO: 2170190 - RNA, 21 nt, Homo sapiens
agugucucuugacuggcucaa

SEQ ID NO: 2170191 - RNA, 23 nt, Homo sapiens
ugguguuuugcacuucuguaaac

SEQ ID NO: 2170192 - RNA, 17 nt, Homo sapiens
guguccaggguccucua

SEQ ID NO: 2170193 - RNA, 23 nt, Homo sapiens
cucaacuucuuuccucuggagac

SEQ ID NO: 2170194 - RNA, 22 nt, Homo sapiens
aaauaugauuuuuagaaaucag

SEQ ID NO: 2170195 - RNA, 19 nt, Homo sapiens
guaucaguugcaggugcca

SEQ ID NO: 2170196 - RNA, 20 nt, Homo sapiens
ccuuuagaaacucaaaaacu

SEQ ID NO: 2170197 - RNA, 18 nt, Homo sapiens
cuucuugggggcagacca

SEQ ID NO: 2170198 - RNA, 14 nt, Homo sapiens
auuugcauacuuaa

SEQ ID NO: 2170199 - RNA, 22 nt, Homo sapiens
cucagcucugguccaggcccug

SEQ ID NO: 2170200 - RNA, 11 nt, Homo sapiens
uuuauucacau

SEQ ID NO: 2170201 - RNA, 20 nt, Homo sapiens
gauggaaugcuugcagagca

SEQ ID NO: 2170202 - RNA, 22 nt, Homo sapiens
uuggcauuggaauucuacugga

SEQ ID NO: 2170203 - RNA, 15 nt, Homo sapiens
gaagacaucaagaua

SEQ ID NO: 2170204 - RNA, 16 nt, Homo sapiens
ccagggagguggcagg

SEQ ID NO: 2170205 - RNA, 16 nt, Homo sapiens
auggcacaguaccaua

SEQ ID NO: 2170206 - RNA, 22 nt, Homo sapiens
aaaacuguggguagagacuuug

SEQ ID NO: 2170207 - RNA, 17 nt, Homo sapiens
acaaagggcacuuagca

SEQ ID NO: 2170208 - RNA, 16 nt, Homo sapiens
ucacugccucuuugca

SEQ ID NO: 2170209 - RNA, 16 nt, Homo sapiens
cauccucccaaucuca

SEQ ID NO: 2170210 - RNA, 16 nt, Homo sapiens
acaucugcacuccuga

SEQ ID NO: 2170211 - RNA, 23 nt, Homo sapiens
gggauacuuuuaugcaaccauaa

SEQ ID NO: 2170212 - RNA, 15 nt, Homo sapiens
accuuuuguauuuaa

SEQ ID NO: 2170213 - RNA, 17 nt, Homo sapiens
cccaggaggugcagugg

SEQ ID NO: 2170214 - RNA, 14 nt, Homo sapiens
uuaaacacaaagug

SEQ ID NO: 2170215 - RNA, 16 nt, Homo sapiens
aggccauggugcacaa

SEQ ID NO: 2170216 - RNA, 16 nt, Homo sapiens
cugaucacucccagca

SEQ ID NO: 2170217 - RNA, 23 nt, Homo sapiens
ugacagugaagcagcacugugag

SEQ ID NO: 2170218 - RNA, 16 nt, Homo sapiens
cuugcuacucauggca

SEQ ID NO: 2170219 - RNA, 14 nt, Homo sapiens
gccacauggccgcu

SEQ ID NO: 2170220 - RNA, 16 nt, Homo sapiens
ccuguccacacccagc

SEQ ID NO: 2170221 - RNA, 18 nt, Homo sapiens
uccaggcgugguggcaca

SEQ ID NO: 2170222 - RNA, 18 nt, Homo sapiens
aaggaaucuggcauucua

SEQ ID NO: 2170223 - RNA, 13 nt, Homo sapiens
aggcucugggaag

SEQ ID NO: 2170224 - RNA, 13 nt, Homo sapiens
ccuugauguuucu

SEQ ID NO: 2170225 - RNA, 21 nt, Homo sapiens
auucagcaaggcgcuaacuug

SEQ ID NO: 2170226 - RNA, 19 nt, Homo sapiens
uuccccccaccccccagca

SEQ ID NO: 2170227 - RNA, 17 nt, Homo sapiens
cacagaugggaucacag

SEQ ID NO: 2170228 - RNA, 16 nt, Homo sapiens
ucccgguucaccuugc

SEQ ID NO: 2170229 - RNA, 20 nt, Homo sapiens
gaagugagcaaggugcucuu

SEQ ID NO: 2170230 - RNA, 18 nt, Homo sapiens
ucagaccaguacugggaa

SEQ ID NO: 2170231 - RNA, 17 nt, Homo sapiens
uauugagcagaauucau

SEQ ID NO: 2170232 - RNA, 13 nt, Homo sapiens
gauccagcucauc

SEQ ID NO: 2170233 - RNA, 22 nt, Homo sapiens
ccagauucaaucgacuggguuu

SEQ ID NO: 2170234 - RNA, 19 nt, Homo sapiens
ggugagagcacccacugaa

SEQ ID NO: 2170235 - RNA, 22 nt, Homo sapiens
gcuccacuacccggcaggguac

SEQ ID NO: 2170236 - RNA, 20 nt, Homo sapiens
uauuccgauacaaaguguug

SEQ ID NO: 2170237 - RNA, 16 nt, Homo sapiens
gcagagccaggaagau

SEQ ID NO: 2170238 - RNA, 17 nt, Homo sapiens
cccacccccuucucugc

SEQ ID NO: 2170239 - RNA, 20 nt, Homo sapiens
auucauugucucuagagauu

SEQ ID NO: 2170240 - RNA, 15 nt, Homo sapiens
uccacacagccaaua

SEQ ID NO: 2170241 - RNA, 16 nt, Homo sapiens
gacaacaauccaaaaa

SEQ ID NO: 2170242 - RNA, 16 nt, Homo sapiens
uauuuaaagcuuucaa

SEQ ID NO: 2170243 - RNA, 18 nt, Homo sapiens
ccgaauuuagucacacca

SEQ ID NO: 2170244 - RNA, 13 nt, Homo sapiens
uccagugcaggag

SEQ ID NO: 2170245 - RNA, 19 nt, Homo sapiens
ccuggagcauggacagugu

SEQ ID NO: 2170246 - RNA, 20 nt, Homo sapiens
gguggaggguggggggcgcu

SEQ ID NO: 2170247 - RNA, 19 nt, Homo sapiens
ugcucuugaucuguguuuc

SEQ ID NO: 2170248 - RNA, 15 nt, Homo sapiens
guccaguaagaucac

SEQ ID NO: 2170249 - RNA, 19 nt, Homo sapiens
ccuuguugaugaagcacau

SEQ ID NO: 2170250 - RNA, 17 nt, Homo sapiens
gcugguugagguuucaa

SEQ ID NO: 2170251 - RNA, 18 nt, Homo sapiens
guuacagaguucugggau

SEQ ID NO: 2170252 - RNA, 14 nt, Homo sapiens
cuagacaguuaaac

SEQ ID NO: 2170253 - RNA, 14 nt, Homo sapiens
ccucccuucugucc

SEQ ID NO: 2170254 - RNA, 13 nt, Homo sapiens
auuucagcacauu

SEQ ID NO: 2170255 - RNA, 14 nt, Homo sapiens
accaacccugcagg

SEQ ID NO: 2170256 - RNA, 23 nt, Homo sapiens
gcccagaccucugacacauuagc

SEQ ID NO: 2170257 - RNA, 14 nt, Homo sapiens
agaacuuguuuaca

SEQ ID NO: 2170258 - RNA, 13 nt, Homo sapiens
ugaaagaugcagu

SEQ ID NO: 2170259 - RNA, 11 nt, Homo sapiens
uggcuguguug

SEQ ID NO: 2170260 - RNA, 19 nt, Homo sapiens
caauuacuggcucacuggc

SEQ ID NO: 2170261 - RNA, 21 nt, Homo sapiens
uuuauguuuggaauaaaguca

SEQ ID NO: 2170262 - RNA, 21 nt, Homo sapiens
uccugucuaaaaaugauucuc

SEQ ID NO: 2170263 - RNA, 22 nt, Homo sapiens
auucuauuuuauaaaacaaaua

SEQ ID NO: 2170264 - RNA, 19 nt, Homo sapiens
aauguauuuuagacuuccu

SEQ ID NO: 2170265 - RNA, 23 nt, Homo sapiens
gugcacauuucuuugcauuccag

SEQ ID NO: 2170266 - RNA, 14 nt, Homo sapiens
acguuuuguaaaug

SEQ ID NO: 2170267 - RNA, 21 nt, Homo sapiens
guccaucccgucgacguagaa

SEQ ID NO: 2170268 - RNA, 15 nt, Homo sapiens
uucaggccagugugg

SEQ ID NO: 2170269 - RNA, 21 nt, Homo sapiens
acccuaugugggugggaccac

SEQ ID NO: 2170270 - RNA, 21 nt, Homo sapiens
cuagaugagcccagcccuguu

SEQ ID NO: 2170271 - RNA, 14 nt, Homo sapiens
gagcaccucucaga

SEQ ID NO: 2170272 - RNA, 14 nt, Homo sapiens
uugaugacuaccuc

SEQ ID NO: 2170273 - RNA, 12 nt, Homo sapiens
gaaggacacuca

SEQ ID NO: 2170274 - RNA, 20 nt, Homo sapiens
augaguuucacuguacugca

SEQ ID NO: 2170275 - RNA, 19 nt, Homo sapiens
augugacaguguucaguaa

SEQ ID NO: 2170276 - RNA, 23 nt, Homo sapiens
ucucaggaggagggcgcaugugu

SEQ ID NO: 2170277 - RNA, 15 nt, Homo sapiens
uuauucuugguuuuc

SEQ ID NO: 2170278 - RNA, 16 nt, Homo sapiens
uaaaauacacacucaa

SEQ ID NO: 2170279 - RNA, 17 nt, Homo sapiens
uauacuucacuggugua

SEQ ID NO: 2170280 - RNA, 17 nt, Homo sapiens
cuggagcaugagccagc

SEQ ID NO: 2170281 - RNA, 16 nt, Homo sapiens
caaguuucaucaguca

SEQ ID NO: 2170282 - RNA, 19 nt, Homo sapiens
cuguccuaacucuccucgc

SEQ ID NO: 2170283 - RNA, 19 nt, Homo sapiens
cagucagguccaugugcac

SEQ ID NO: 2170284 - RNA, 14 nt, Homo sapiens
aagugcuaugacag

SEQ ID NO: 2170285 - RNA, 15 nt, Homo sapiens
uaccuuguugcagau

SEQ ID NO: 2170286 - RNA, 15 nt, Homo sapiens
auaaaaucagaguug

SEQ ID NO: 2170287 - RNA, 15 nt, Homo sapiens
accuccauuccccug

SEQ ID NO: 2170288 - RNA, 22 nt, Homo sapiens
uaaggaauuauagaccucuagu

SEQ ID NO: 2170289 - RNA, 15 nt, Homo sapiens
uaaaagugcuuuaug

SEQ ID NO: 2170290 - RNA, 21 nt, Homo sapiens
aacauuagaagaaaacauaua

SEQ ID NO: 2170291 - RNA, 22 nt, Homo sapiens
gugccuugucacgccagacuuc

SEQ ID NO: 2170292 - RNA, 20 nt, Homo sapiens
uauuuguaauagugacauau

SEQ ID NO: 2170293 - RNA, 20 nt, Homo sapiens
aacauaaaggacaggccaca

SEQ ID NO: 2170294 - RNA, 13 nt, Homo sapiens
ugguaucugcaug

SEQ ID NO: 2170295 - RNA, 19 nt, Homo sapiens
uuagaugcagcgacuguuu

SEQ ID NO: 2170296 - RNA, 20 nt, Homo sapiens
gcaguucugcacccagccaa

SEQ ID NO: 2170297 - RNA, 16 nt, Homo sapiens
gacacucauauugccc

SEQ ID NO: 2170298 - RNA, 17 nt, Homo sapiens
cauguuuccagcacuau

SEQ ID NO: 2170299 - RNA, 14 nt, Homo sapiens
ugagacaucaggga

SEQ ID NO: 2170300 - RNA, 14 nt, Homo sapiens
cuugucuccauuug

SEQ ID NO: 2170301 - RNA, 13 nt, Homo sapiens
gugaagaccaaca

SEQ ID NO: 2170302 - RNA, 14 nt, Homo sapiens
auuuuaaacauauc

SEQ ID NO: 2170303 - RNA, 14 nt, Homo sapiens
aucaaaaacacuac

SEQ ID NO: 2170304 - RNA, 23 nt, Homo sapiens
ggaacaugagccuuuguugcuau

SEQ ID NO: 2170305 - RNA, 16 nt, Homo sapiens
aagauucuauguuaau

SEQ ID NO: 2170306 - RNA, 14 nt, Homo sapiens
ugugucccaugacc

SEQ ID NO: 2170307 - RNA, 22 nt, Homo sapiens
ucaagggucauggcagugccug

SEQ ID NO: 2170308 - RNA, 15 nt, Homo sapiens
uguucagaucucaua

SEQ ID NO: 2170309 - RNA, 13 nt, Homo sapiens
cagcucucugcaa

SEQ ID NO: 2170310 - RNA, 18 nt, Homo sapiens
auagacacugaucuggcu

SEQ ID NO: 2170311 - RNA, 19 nt, Homo sapiens
gaggcuucccuaguuuaca

SEQ ID NO: 2170312 - RNA, 18 nt, Homo sapiens
auuguacauuuuuuacuu

SEQ ID NO: 2170313 - RNA, 19 nt, Homo sapiens
uccaggcccuucucuacac

SEQ ID NO: 2170314 - RNA, 15 nt, Homo sapiens
auugacuccuuucca

SEQ ID NO: 2170315 - RNA, 15 nt, Homo sapiens
aggggugucuugucu

SEQ ID NO: 2170316 - RNA, 23 nt, Homo sapiens
acucaauaaaaguuuccuuucaa

SEQ ID NO: 2170317 - RNA, 12 nt, Homo sapiens
ucuccauguugg

SEQ ID NO: 2170318 - RNA, 22 nt, Homo sapiens
cacccauagugcacacuuguau

SEQ ID NO: 2170319 - RNA, 16 nt, Homo sapiens
auaauaaauacucagu

SEQ ID NO: 2170320 - RNA, 17 nt, Homo sapiens
auuugagaaaugcauau

SEQ ID NO: 2170321 - RNA, 20 nt, Homo sapiens
auugaaagagucugggaccc

SEQ ID NO: 2170322 - RNA, 20 nt, Homo sapiens
cauggaguuaacaucaugaa

SEQ ID NO: 2170323 - RNA, 13 nt, Homo sapiens
gugagagugcaga

SEQ ID NO: 2170324 - RNA, 21 nt, Homo sapiens
auuagaaacugaaaacuguaa

SEQ ID NO: 2170325 - RNA, 21 nt, Homo sapiens
agcaugugaugggcuguuuaa

SEQ ID NO: 2170326 - RNA, 15 nt, Homo sapiens
agggagcugggagac

SEQ ID NO: 2170327 - RNA, 13 nt, Homo sapiens
caguauucucaga

SEQ ID NO: 2170328 - RNA, 20 nt, Homo sapiens
gcagcaucucugaacauuuc

SEQ ID NO: 2170329 - RNA, 19 nt, Homo sapiens
gggaagaucugguauuucc

SEQ ID NO: 2170330 - RNA, 13 nt, Homo sapiens
aagagacacucca

SEQ ID NO: 2170331 - RNA, 12 nt, Homo sapiens
ggaaaauggagc

SEQ ID NO: 2170332 - RNA, 19 nt, Homo sapiens
uuuauauaaagaaaaucaa

SEQ ID NO: 2170333 - RNA, 15 nt, Homo sapiens
gcagcccacugccug

SEQ ID NO: 2170334 - RNA, 17 nt, Homo sapiens
cacugacagauuuccau

SEQ ID NO: 2170335 - RNA, 23 nt, Homo sapiens
ugugaaagaaccaaaagagauca

SEQ ID NO: 2170336 - RNA, 23 nt, Homo sapiens
gcagaugaccucguacucaggag

SEQ ID NO: 2170337 - RNA, 20 nt, Homo sapiens
uuaaggaaaugugcaggaua

SEQ ID NO: 2170338 - RNA, 16 nt, Homo sapiens
aucugggccuuggccu

SEQ ID NO: 2170339 - RNA, 19 nt, Homo sapiens
aacugaguguuauuugcac

SEQ ID NO: 2170340 - RNA, 17 nt, Homo sapiens
ugaagcguuacuacagc

SEQ ID NO: 2170341 - RNA, 19 nt, Homo sapiens
aaugagucccuguccccac

SEQ ID NO: 2170342 - RNA, 20 nt, Homo sapiens
cgaggacuguauuugugacu

SEQ ID NO: 2170343 - RNA, 20 nt, Homo sapiens
uuaacagagcaaauuugaau

SEQ ID NO: 2170344 - RNA, 20 nt, Homo sapiens
uucucaguaaauauuaaccu

SEQ ID NO: 2170345 - RNA, 12 nt, Homo sapiens
gagaaacauuuu

SEQ ID NO: 2170346 - RNA, 22 nt, Homo sapiens
acaggcuggcaguugguacuga

SEQ ID NO: 2170347 - RNA, 21 nt, Homo sapiens
caggguugugcuuucuagcaa

SEQ ID NO: 2170348 - RNA, 21 nt, Homo sapiens
acucuaaagucuguugauuaa

SEQ ID NO: 2170349 - RNA, 19 nt, Homo sapiens
gaagacagcugcuggguca

SEQ ID NO: 2170350 - RNA, 15 nt, Homo sapiens
augaagaccaugccu

SEQ ID NO: 2170351 - RNA, 22 nt, Homo sapiens
agcagagacgggguuugccaug

SEQ ID NO: 2170352 - RNA, 20 nt, Homo sapiens
cauccuacaacucacauuag

SEQ ID NO: 2170353 - RNA, 17 nt, Homo sapiens
ucuauguguaugcagaa

SEQ ID NO: 2170354 - RNA, 16 nt, Homo sapiens
cuuauaggaauugacc

SEQ ID NO: 2170355 - RNA, 13 nt, Homo sapiens
uccucucugcaaa

SEQ ID NO: 2170356 - RNA, 19 nt, Homo sapiens
uuugauagaaagaugagau

SEQ ID NO: 2170357 - RNA, 14 nt, Homo sapiens
uuuagaacaccaaa

SEQ ID NO: 2170358 - RNA, 17 nt, Homo sapiens
ucccuccaaucuugaga

SEQ ID NO: 2170359 - RNA, 14 nt, Homo sapiens
caggaaaaugccag

SEQ ID NO: 2170360 - RNA, 22 nt, Homo sapiens
caguaaauaacuggaaaacaga

SEQ ID NO: 2170361 - RNA, 18 nt, Homo sapiens
gacaacagaaaaacaauc

SEQ ID NO: 2170362 - RNA, 15 nt, Homo sapiens
gagugcaccaaagag

SEQ ID NO: 2170363 - RNA, 18 nt, Homo sapiens
cucaaacuccugagcuca

SEQ ID NO: 2170364 - RNA, 23 nt, Homo sapiens
cgacagagcaagacuccauuuca

SEQ ID NO: 2170365 - RNA, 14 nt, Homo sapiens
aguagcugcuuccu

SEQ ID NO: 2170366 - RNA, 16 nt, Homo sapiens
ggccgaggccaugugc

SEQ ID NO: 2170367 - RNA, 20 nt, Homo sapiens
uuaccuggcagugaugucaa

SEQ ID NO: 2170368 - RNA, 17 nt, Homo sapiens
uccuggaaaaaacaaaa

SEQ ID NO: 2170369 - RNA, 14 nt, Homo sapiens
cuuuugucugcaau

SEQ ID NO: 2170370 - RNA, 23 nt, Homo sapiens
gggccccuuggcgggcagcccag

SEQ ID NO: 2170371 - RNA, 15 nt, Homo sapiens
aaaagcccacgucag

SEQ ID NO: 2170372 - RNA, 18 nt, Homo sapiens
agagccagacugucucaa

SEQ ID NO: 2170373 - RNA, 17 nt, Homo sapiens
cuuuugugcaaagccaa

SEQ ID NO: 2170374 - RNA, 23 nt, Homo sapiens
aguccuguccugucccacucagg

SEQ ID NO: 2170375 - RNA, 17 nt, Homo sapiens
cagauaaguguucuuca

SEQ ID NO: 2170376 - RNA, 11 nt, Homo sapiens
caacuuuucaa

SEQ ID NO: 2170377 - RNA, 13 nt, Homo sapiens
caucuccugagua

SEQ ID NO: 2170378 - RNA, 12 nt, Homo sapiens
aagaacuucccc

SEQ ID NO: 2170379 - RNA, 14 nt, Homo sapiens
aaauucccauucca

SEQ ID NO: 2170380 - RNA, 19 nt, Homo sapiens
agagcaagacccaucucaa

SEQ ID NO: 2170381 - RNA, 21 nt, Homo sapiens
caguggggugaucucaucucc

SEQ ID NO: 2170382 - RNA, 17 nt, Homo sapiens
ccagggcuuugcuccag

SEQ ID NO: 2170383 - RNA, 16 nt, Homo sapiens
ccaccucuccuuuggc

SEQ ID NO: 2170384 - RNA, 16 nt, Homo sapiens
auaauaaaaugcaaau

SEQ ID NO: 2170385 - RNA, 19 nt, Homo sapiens
gacaagaaacacauucuua

SEQ ID NO: 2170386 - RNA, 19 nt, Homo sapiens
uagaaaauugugcuggaaa

SEQ ID NO: 2170387 - RNA, 14 nt, Homo sapiens
acaagugauuuuca

SEQ ID NO: 2170388 - RNA, 20 nt, Homo sapiens
uaacuaguggcucucaguua

SEQ ID NO: 2170389 - RNA, 22 nt, Homo sapiens
cuccuuuugguuccucacauau

SEQ ID NO: 2170390 - RNA, 17 nt, Homo sapiens
aaagcugccugugccau

SEQ ID NO: 2170391 - RNA, 19 nt, Homo sapiens
cacuaagagaauacaggaa

SEQ ID NO: 2170392 - RNA, 15 nt, Homo sapiens
uggauucgugacaac

SEQ ID NO: 2170393 - RNA, 19 nt, Homo sapiens
ucacuagaguucuuugaac

SEQ ID NO: 2170394 - RNA, 13 nt, Homo sapiens
ucggaucucucca

SEQ ID NO: 2170395 - RNA, 21 nt, Homo sapiens
caaguggaacgagacaagcag

SEQ ID NO: 2170396 - RNA, 24 nt, Homo sapiens
uguguucaagugcgugacuguaug

SEQ ID NO: 2170397 - RNA, 23 nt, Homo sapiens
ucuuguaaaacugugacauucca

SEQ ID NO: 2170398 - RNA, 16 nt, Homo sapiens
cuuccauaauguauaa

SEQ ID NO: 2170399 - RNA, 16 nt, Homo sapiens
gaaauaaaagcuuugc

SEQ ID NO: 2170400 - RNA, 14 nt, Homo sapiens
uaagcaaaaugcca

SEQ ID NO: 2170401 - RNA, 17 nt, Homo sapiens
ccccugcccugggaugu

SEQ ID NO: 2170402 - RNA, 14 nt, Homo sapiens
uuuaguaguuuaau

SEQ ID NO: 2170403 - RNA, 14 nt, Homo sapiens
auuugaagauuuaa

SEQ ID NO: 2170404 - RNA, 14 nt, Homo sapiens
acacgcagacacac

SEQ ID NO: 2170405 - RNA, 20 nt, Homo sapiens
cugaaacaugaacccaaaaa

SEQ ID NO: 2170406 - RNA, 12 nt, Homo sapiens
acgguaccagug

SEQ ID NO: 2170407 - RNA, 16 nt, Homo sapiens
ccccagccuaccucuc

SEQ ID NO: 2170408 - RNA, 22 nt, Homo sapiens
agcugcaguucuuguggaagac

SEQ ID NO: 2170409 - RNA, 22 nt, Homo sapiens
cugggauuacaauugugagcca

SEQ ID NO: 2170410 - RNA, 23 nt, Homo sapiens
cauguuucccgcuccaagagaau

SEQ ID NO: 2170411 - RNA, 19 nt, Homo sapiens
aggaucuugccugcaugaa

SEQ ID NO: 2170412 - RNA, 13 nt, Homo sapiens
aauuucugugaaa

SEQ ID NO: 2170413 - RNA, 21 nt, Homo sapiens
acuucuccccuccucuugccu

SEQ ID NO: 2170414 - RNA, 21 nt, Homo sapiens
aauucauaacugguagcuaua

SEQ ID NO: 2170415 - RNA, 19 nt, Homo sapiens
cuaauaauaguacuauuac

SEQ ID NO: 2170416 - RNA, 22 nt, Homo sapiens
acuacugauuuuaaaaugaaua

SEQ ID NO: 2170417 - RNA, 16 nt, Homo sapiens
cuauuuggaacccaag

SEQ ID NO: 2170418 - RNA, 23 nt, Homo sapiens
aaggcaaaaaacucuuaaucugu

SEQ ID NO: 2170419 - RNA, 12 nt, Homo sapiens
cuguaacagggu

SEQ ID NO: 2170420 - RNA, 22 nt, Homo sapiens
aggcuacuauagguccagaagu

SEQ ID NO: 2170421 - RNA, 14 nt, Homo sapiens
cauggcugaaguca

SEQ ID NO: 2170422 - RNA, 13 nt, Homo sapiens
caggacagcacac

SEQ ID NO: 2170423 - RNA, 13 nt, Homo sapiens
agggccagagcaa

SEQ ID NO: 2170424 - RNA, 16 nt, Homo sapiens
cuuuuuuaucuugcac

SEQ ID NO: 2170425 - RNA, 19 nt, Homo sapiens
ucuuuucuugcaugaggcu

SEQ ID NO: 2170426 - RNA, 21 nt, Homo sapiens
uguuggccaggauggucucga

SEQ ID NO: 2170427 - RNA, 16 nt, Homo sapiens
ugacugauggugaaau

SEQ ID NO: 2170428 - RNA, 16 nt, Homo sapiens
aggaaggaaagcacag

SEQ ID NO: 2170429 - RNA, 18 nt, Homo sapiens
auauuucuaccugaguga

SEQ ID NO: 2170430 - RNA, 15 nt, Homo sapiens
ucuaaaauacuugag

SEQ ID NO: 2170431 - RNA, 16 nt, Homo sapiens
ugggaggaagcaaaag

SEQ ID NO: 2170432 - RNA, 14 nt, Homo sapiens
ugaccauagcuccu

SEQ ID NO: 2170433 - RNA, 24 nt, Homo sapiens
caucaaauggaagacacauugaaa

SEQ ID NO: 2170434 - RNA, 22 nt, Homo sapiens
aaggcagagggaugaaaugcca

SEQ ID NO: 2170435 - RNA, 22 nt, Homo sapiens
gaacacuugcccagggcagcuu

SEQ ID NO: 2170436 - RNA, 21 nt, Homo sapiens
acucuucccccucucccaguu

SEQ ID NO: 2170437 - RNA, 21 nt, Homo sapiens
gagauugcgccauugcacucc

SEQ ID NO: 2170438 - RNA, 12 nt, Homo sapiens
aauaugugaaug

SEQ ID NO: 2170439 - RNA, 16 nt, Homo sapiens
guguuucuggggacac

SEQ ID NO: 2170440 - RNA, 16 nt, Homo sapiens
cugcuccuucuuguuc

SEQ ID NO: 2170441 - RNA, 14 nt, Homo sapiens
uuuugagaacuuaa

SEQ ID NO: 2170442 - RNA, 16 nt, Homo sapiens
augcccagagaaucag

SEQ ID NO: 2170443 - RNA, 20 nt, Homo sapiens
cucccagagugcugggauua

SEQ ID NO: 2170444 - RNA, 20 nt, Homo sapiens
ccagugaaauagaacacaga

SEQ ID NO: 2170445 - RNA, 15 nt, Homo sapiens
accaauaaagccuuc

SEQ ID NO: 2170446 - RNA, 13 nt, Homo sapiens
uguuaucugggaa

SEQ ID NO: 2170447 - RNA, 22 nt, Homo sapiens
gacuccaccuuggaccucagug

SEQ ID NO: 2170448 - RNA, 20 nt, Homo sapiens
ccugacccuccuccacucca

SEQ ID NO: 2170449 - RNA, 17 nt, Homo sapiens
cugcuuuuuaaguguua

SEQ ID NO: 2170450 - RNA, 21 nt, Homo sapiens
aaacuggcugcuuuguucaau

SEQ ID NO: 2170451 - RNA, 18 nt, Homo sapiens
cagaugccauuuuguaca

SEQ ID NO: 2170452 - RNA, 12 nt, Homo sapiens
ucuggagcauuu

SEQ ID NO: 2170453 - RNA, 19 nt, Homo sapiens
agcuggggggcaccggcuc

SEQ ID NO: 2170454 - RNA, 16 nt, Homo sapiens
cucacuggcaggaaag

SEQ ID NO: 2170455 - RNA, 17 nt, Homo sapiens
gcugcagucagcacaga

SEQ ID NO: 2170456 - RNA, 19 nt, Homo sapiens
caaaaaggggaaguaucaa

SEQ ID NO: 2170457 - RNA, 19 nt, Homo sapiens
gcuauucccuggggcugcu

SEQ ID NO: 2170458 - RNA, 18 nt, Homo sapiens
uuacaauuuaaugcacua

SEQ ID NO: 2170459 - RNA, 12 nt, Homo sapiens
gcagaaguauaa

SEQ ID NO: 2170460 - RNA, 17 nt, Homo sapiens
gaaguaagcaacuagcu

SEQ ID NO: 2170461 - RNA, 18 nt, Homo sapiens
uguggcaguuacagggcc

SEQ ID NO: 2170462 - RNA, 14 nt, Homo sapiens
gcuguuugucuaua

SEQ ID NO: 2170463 - RNA, 16 nt, Homo sapiens
cagauuuacuaaauca

SEQ ID NO: 2170464 - RNA, 19 nt, Homo sapiens
aaagacacucccaccagca

SEQ ID NO: 2170465 - RNA, 18 nt, Homo sapiens
gagauagccaaggccaaa

SEQ ID NO: 2170466 - RNA, 17 nt, Homo sapiens
gagacaagaucuugaac

SEQ ID NO: 2170467 - RNA, 13 nt, Homo sapiens
uucaaaagugauu

SEQ ID NO: 2170468 - RNA, 12 nt, Homo sapiens
acaaaagaauaa

SEQ ID NO: 2170469 - RNA, 15 nt, Homo sapiens
uuaauuuucuaugaa

SEQ ID NO: 2170470 - RNA, 18 nt, Homo sapiens
guugccugacuccugggu

SEQ ID NO: 2170471 - RNA, 15 nt, Homo sapiens
guaucccuacaucua

SEQ ID NO: 2170472 - RNA, 23 nt, Homo sapiens
aaggagagucuugcagugauuaa

SEQ ID NO: 2170473 - RNA, 11 nt, Homo sapiens
ccacacuauuc

SEQ ID NO: 2170474 - RNA, 14 nt, Homo sapiens
aagucccuuuguga

SEQ ID NO: 2170475 - RNA, 21 nt, Homo sapiens
uuuucuuuuuugagacagggu

SEQ ID NO: 2170476 - RNA, 12 nt, Homo sapiens
auaaaacauuca

SEQ ID NO: 2170477 - RNA, 12 nt, Homo sapiens
uaaaaacaaaca

SEQ ID NO: 2170478 - RNA, 22 nt, Homo sapiens
caacucuugugaauuauucuga

SEQ ID NO: 2170479 - RNA, 15 nt, Homo sapiens
uauggaacuguaaua

SEQ ID NO: 2170480 - RNA, 22 nt, Homo sapiens
uaaaugaaguaacuugucuuaa

SEQ ID NO: 2170481 - RNA, 14 nt, Homo sapiens
gcuguugcuugaau

SEQ ID NO: 2170482 - RNA, 15 nt, Homo sapiens
gagaagaaagaagca

SEQ ID NO: 2170483 - RNA, 15 nt, Homo sapiens
ccacuucauccccuc

SEQ ID NO: 2170484 - RNA, 21 nt, Homo sapiens
ucuugggaaacggaaugaccu

SEQ ID NO: 2170485 - RNA, 17 nt, Homo sapiens
agcaggacugaugucuc

SEQ ID NO: 2170486 - RNA, 12 nt, Homo sapiens
cuugucuucccc

SEQ ID NO: 2170487 - RNA, 23 nt, Homo sapiens
cauauguuugcuuauauguuaaa

SEQ ID NO: 2170488 - RNA, 13 nt, Homo sapiens
cugugaagcauuu

SEQ ID NO: 2170489 - RNA, 18 nt, Homo sapiens
caucccacgcuugcuuua

SEQ ID NO: 2170490 - RNA, 11 nt, Homo sapiens
aagaaggguug

SEQ ID NO: 2170491 - RNA, 21 nt, Homo sapiens
gucaaacccaaguuaguucaa

SEQ ID NO: 2170492 - RNA, 16 nt, Homo sapiens
uuuguaaaaauacugu

SEQ ID NO: 2170493 - RNA, 18 nt, Homo sapiens
agccuugcaucaagggcu

SEQ ID NO: 2170494 - RNA, 14 nt, Homo sapiens
auguaaaacaagaa

SEQ ID NO: 2170495 - RNA, 19 nt, Homo sapiens
cuaggucaaccccacugua

SEQ ID NO: 2170496 - RNA, 17 nt, Homo sapiens
agucucuuaauucugau

SEQ ID NO: 2170497 - RNA, 21 nt, Homo sapiens
agcccuacucggauggggcac

SEQ ID NO: 2170498 - RNA, 19 nt, Homo sapiens
uucuuacaauugcacugcu

SEQ ID NO: 2170499 - RNA, 21 nt, Homo sapiens
accaagauuaugugacuugca

SEQ ID NO: 2170500 - RNA, 14 nt, Homo sapiens
aaagaaucagucuu

SEQ ID NO: 2170501 - RNA, 23 nt, Homo sapiens
acuagauuuauaaaugcacugua

SEQ ID NO: 2170502 - RNA, 22 nt, Homo sapiens
cucagauuccccccaucuccau

SEQ ID NO: 2170503 - RNA, 14 nt, Homo sapiens
aucuaggccacccc

SEQ ID NO: 2170504 - RNA, 22 nt, Homo sapiens
gccugcaucugucuguccuucc

SEQ ID NO: 2170505 - RNA, 14 nt, Homo sapiens
ggaagggagguggc

SEQ ID NO: 2170506 - RNA, 15 nt, Homo sapiens
cuuggauuaaauaca

SEQ ID NO: 2170507 - RNA, 18 nt, Homo sapiens
uguaaugccaauaugaca

SEQ ID NO: 2170508 - RNA, 20 nt, Homo sapiens
uacagaaucguuuuguacug

SEQ ID NO: 2170509 - RNA, 17 nt, Homo sapiens
auuucucuuugucagaa

SEQ ID NO: 2170510 - RNA, 21 nt, Homo sapiens
uugagagaggccacacuacac

SEQ ID NO: 2170511 - RNA, 24 nt, Homo sapiens
caggaacuggcuccuuugccucug

SEQ ID NO: 2170512 - RNA, 20 nt, Homo sapiens
ccauuucuacaaugcacauu

SEQ ID NO: 2170513 - RNA, 19 nt, Homo sapiens
aagcagucuugcucuguua

SEQ ID NO: 2170514 - RNA, 15 nt, Homo sapiens
aucaaugucacuuaa

SEQ ID NO: 2170515 - RNA, 12 nt, Homo sapiens
cguccuggucaa

SEQ ID NO: 2170516 - RNA, 16 nt, Homo sapiens
ugggguggagugggaa

SEQ ID NO: 2170517 - RNA, 22 nt, Homo sapiens
cauuaaauggugauuucuugcu

SEQ ID NO: 2170518 - RNA, 16 nt, Homo sapiens
uaaccuggaacuggag

SEQ ID NO: 2170519 - RNA, 22 nt, Homo sapiens
gggacucugaccacagcccgcu

SEQ ID NO: 2170520 - RNA, 18 nt, Homo sapiens
augccaagcuuuuuugcc

SEQ ID NO: 2170521 - RNA, 19 nt, Homo sapiens
caauacagaugccuucccu

SEQ ID NO: 2170522 - RNA, 19 nt, Homo sapiens
ugggaaaccaguucaugca

SEQ ID NO: 2170523 - RNA, 17 nt, Homo sapiens
ugggcagugagugccau

SEQ ID NO: 2170524 - RNA, 19 nt, Homo sapiens
acucucuucccuuucccca

SEQ ID NO: 2170525 - RNA, 16 nt, Homo sapiens
cagaaaacaagaugag

SEQ ID NO: 2170526 - RNA, 19 nt, Homo sapiens
ugacugggcaacacugcag

SEQ ID NO: 2170527 - RNA, 19 nt, Homo sapiens
cucuacagacuccaaaagg

SEQ ID NO: 2170528 - RNA, 19 nt, Homo sapiens
uuccuuucauuuacugugg

SEQ ID NO: 2170529 - RNA, 13 nt, Homo sapiens
aauaaccaguuaa

SEQ ID NO: 2170530 - RNA, 19 nt, Homo sapiens
gcaaccccaucauccucag

SEQ ID NO: 2170531 - RNA, 16 nt, Homo sapiens
aagugccaucucaauu

SEQ ID NO: 2170532 - RNA, 14 nt, Homo sapiens
uuaaagaugguuua

SEQ ID NO: 2170533 - RNA, 17 nt, Homo sapiens
ugguuacuaguacaggu

SEQ ID NO: 2170534 - RNA, 15 nt, Homo sapiens
agugcuaugccaagc

SEQ ID NO: 2170535 - RNA, 15 nt, Homo sapiens
gcugaaagacaguaa

SEQ ID NO: 2170536 - RNA, 17 nt, Homo sapiens
auguggaaugcauccaa

SEQ ID NO: 2170537 - RNA, 13 nt, Homo sapiens
cacuuauccugac

SEQ ID NO: 2170538 - RNA, 16 nt, Homo sapiens
aguuggugacugggaa

SEQ ID NO: 2170539 - RNA, 17 nt, Homo sapiens
cacuguauguguugcac

SEQ ID NO: 2170540 - RNA, 13 nt, Homo sapiens
auauauggaccua

SEQ ID NO: 2170541 - RNA, 15 nt, Homo sapiens
uuccugcgccccaga

SEQ ID NO: 2170542 - RNA, 14 nt, Homo sapiens
cucacgccuguaau

SEQ ID NO: 2170543 - RNA, 22 nt, Homo sapiens
cuagcaucucaugagugccaag

SEQ ID NO: 2170544 - RNA, 19 nt, Homo sapiens
uaccccuuuaagguucaga

SEQ ID NO: 2170545 - RNA, 14 nt, Homo sapiens
auugcucccuacca

SEQ ID NO: 2170546 - RNA, 15 nt, Homo sapiens
uaguggucauuuggu

SEQ ID NO: 2170547 - RNA, 14 nt, Homo sapiens
acccaauuguuuca

SEQ ID NO: 2170548 - RNA, 20 nt, Homo sapiens
ucugcagcucugacccaaau

SEQ ID NO: 2170549 - RNA, 19 nt, Homo sapiens
ucaaaaguuuguuugcuua

SEQ ID NO: 2170550 - RNA, 15 nt, Homo sapiens
uuaguauaguuuucg

SEQ ID NO: 2170551 - RNA, 18 nt, Homo sapiens
aguagggccccugcacac

SEQ ID NO: 2170552 - RNA, 18 nt, Homo sapiens
auuucuagggcugggaaa

SEQ ID NO: 2170553 - RNA, 16 nt, Homo sapiens
acacuacgcacuggac

SEQ ID NO: 2170554 - RNA, 16 nt, Homo sapiens
gugauuuuaagacaag

SEQ ID NO: 2170555 - RNA, 18 nt, Homo sapiens
auuuucagugcuuugccc

SEQ ID NO: 2170556 - RNA, 18 nt, Homo sapiens
aaggaagaagaguauuaa

SEQ ID NO: 2170557 - RNA, 22 nt, Homo sapiens
caucugcucuagauucauaaau

SEQ ID NO: 2170558 - RNA, 11 nt, Homo sapiens
gcaaaagugaa

SEQ ID NO: 2170559 - RNA, 15 nt, Homo sapiens
guucccaccauuccc

SEQ ID NO: 2170560 - RNA, 16 nt, Homo sapiens
acagaaaagaaauuag

SEQ ID NO: 2170561 - RNA, 17 nt, Homo sapiens
gaucugaugcaagcaag

SEQ ID NO: 2170562 - RNA, 15 nt, Homo sapiens
gcauuuagcacagua

SEQ ID NO: 2170563 - RNA, 19 nt, Homo sapiens
uagauauuguuuugugacu

SEQ ID NO: 2170564 - RNA, 18 nt, Homo sapiens
auaaugaagaauggccau

SEQ ID NO: 2170565 - RNA, 15 nt, Homo sapiens
ccacccgaggggggc

SEQ ID NO: 2170566 - RNA, 21 nt, Homo sapiens
aaugucaauuuaaguuaauaa

SEQ ID NO: 2170567 - RNA, 13 nt, Homo sapiens
agaccgccaaaua

SEQ ID NO: 2170568 - RNA, 21 nt, Homo sapiens
cuggucaggcccuggugcgaa

SEQ ID NO: 2170569 - RNA, 15 nt, Homo sapiens
uaauauuuugcacag

SEQ ID NO: 2170570 - RNA, 12 nt, Homo sapiens
agccaguauuuc

SEQ ID NO: 2170571 - RNA, 22 nt, Homo sapiens
cagguucaagugcuucuccagc

SEQ ID NO: 2170572 - RNA, 20 nt, Homo sapiens
cuaauaaaaauuggagcuca

SEQ ID NO: 2170573 - RNA, 14 nt, Homo sapiens
caggccaggaccac

SEQ ID NO: 2170574 - RNA, 16 nt, Homo sapiens
cugcaagcacagcaua

SEQ ID NO: 2170575 - RNA, 12 nt, Homo sapiens
cuaguuugcacu

SEQ ID NO: 2170576 - RNA, 17 nt, Homo sapiens
uagacaggaaagccagg

SEQ ID NO: 2170577 - RNA, 16 nt, Homo sapiens
auuugcugaauacaga

SEQ ID NO: 2170578 - RNA, 13 nt, Homo sapiens
uguaaugagcucc

SEQ ID NO: 2170579 - RNA, 18 nt, Homo sapiens
ucucuaaacugcuguuaa

SEQ ID NO: 2170580 - RNA, 20 nt, Homo sapiens
aggcugcauugagcuaugau

SEQ ID NO: 2170581 - RNA, 20 nt, Homo sapiens
auaaauuauuucaaguuuca

SEQ ID NO: 2170582 - RNA, 13 nt, Homo sapiens
auguauacuucaa

SEQ ID NO: 2170583 - RNA, 16 nt, Homo sapiens
cccugcgggccagggu

SEQ ID NO: 2170584 - RNA, 17 nt, Homo sapiens
cugccucagacguugcc

SEQ ID NO: 2170585 - RNA, 17 nt, Homo sapiens
acuaacacuuuaguuau

SEQ ID NO: 2170586 - RNA, 18 nt, Homo sapiens
ucaacuuuuccuuugaau

SEQ ID NO: 2170587 - RNA, 17 nt, Homo sapiens
agagcuguuauacugug

SEQ ID NO: 2170588 - RNA, 15 nt, Homo sapiens
acuccggcacugggu

SEQ ID NO: 2170589 - RNA, 17 nt, Homo sapiens
gcuguucucuucuucau

SEQ ID NO: 2170590 - RNA, 18 nt, Homo sapiens
ggcccugaggcugcugga

SEQ ID NO: 2170591 - RNA, 15 nt, Homo sapiens
gugauaugcacaaug

SEQ ID NO: 2170592 - RNA, 21 nt, Homo sapiens
ucuccacaggcaggcucauuu

SEQ ID NO: 2170593 - RNA, 18 nt, Homo sapiens
gacagcaucccuucccac

SEQ ID NO: 2170594 - RNA, 23 nt, Homo sapiens
gucuugauccuccaaugucuaau

SEQ ID NO: 2170595 - RNA, 15 nt, Homo sapiens
cuaaggacacagugg

SEQ ID NO: 2170596 - RNA, 21 nt, Homo sapiens
uauuucuuuuagaaaaggcca

SEQ ID NO: 2170597 - RNA, 23 nt, Homo sapiens
gauugcccauccaucugcuuaca

SEQ ID NO: 2170598 - RNA, 21 nt, Homo sapiens
guguacauuugauuugauaua

SEQ ID NO: 2170599 - RNA, 13 nt, Homo sapiens
cugccuucuuuau

SEQ ID NO: 2170600 - RNA, 19 nt, Homo sapiens
cugcaccuuuuugcaugau

SEQ ID NO: 2170601 - RNA, 21 nt, Homo sapiens
cacccuggggcugcuuaggaa

SEQ ID NO: 2170602 - RNA, 22 nt, Homo sapiens
uaugacacccacucuccuguga

SEQ ID NO: 2170603 - RNA, 10 nt, Homo sapiens
ccuuuugcca

SEQ ID NO: 2170604 - RNA, 17 nt, Homo sapiens
cucccuucucuaccuca

SEQ ID NO: 2170605 - RNA, 16 nt, Homo sapiens
uuacaguuccuucaau

SEQ ID NO: 2170606 - RNA, 13 nt, Homo sapiens
ucuuuugaauuca

SEQ ID NO: 2170607 - RNA, 23 nt, Homo sapiens
ggacuugcaaagcuucacuucau

SEQ ID NO: 2170608 - RNA, 17 nt, Homo sapiens
cauauauuuaauauguc

SEQ ID NO: 2170609 - RNA, 15 nt, Homo sapiens
uuuuuaaauggaauu

SEQ ID NO: 2170610 - RNA, 14 nt, Homo sapiens
aaaugauuuccucu

SEQ ID NO: 2170611 - RNA, 12 nt, Homo sapiens
ggcccucccucu

SEQ ID NO: 2170612 - RNA, 18 nt, Homo sapiens
uauuucacuggagcacaa

SEQ ID NO: 2170613 - RNA, 22 nt, Homo sapiens
accaggcaccucuuccuugaug

SEQ ID NO: 2170614 - RNA, 14 nt, Homo sapiens
acugacgcucagua

SEQ ID NO: 2170615 - RNA, 21 nt, Homo sapiens
acucuaaucaguccuuauuau

SEQ ID NO: 2170616 - RNA, 15 nt, Homo sapiens
gaggaggauccgggc

SEQ ID NO: 2170617 - RNA, 20 nt, Homo sapiens
uacaaacuuuuaagauuucu

SEQ ID NO: 2170618 - RNA, 21 nt, Homo sapiens
cuguugauuucuuuccagagg

SEQ ID NO: 2170619 - RNA, 16 nt, Homo sapiens
uagucugcauugcugg

SEQ ID NO: 2170620 - RNA, 22 nt, Homo sapiens
acuugguuuguuauaucaggga

SEQ ID NO: 2170621 - RNA, 14 nt, Homo sapiens
ugugcacauugugc

SEQ ID NO: 2170622 - RNA, 16 nt, Homo sapiens
caugugcgcacacaca

SEQ ID NO: 2170623 - RNA, 13 nt, Homo sapiens
agauuaaaaccaa

SEQ ID NO: 2170624 - RNA, 17 nt, Homo sapiens
cagcagucuaguucuuu

SEQ ID NO: 2170625 - RNA, 14 nt, Homo sapiens
cagcugaggaccag

SEQ ID NO: 2170626 - RNA, 15 nt, Homo sapiens
aaagugugacauuca

SEQ ID NO: 2170627 - RNA, 13 nt, Homo sapiens
ccaaaaauaucuu

SEQ ID NO: 2170628 - RNA, 21 nt, Homo sapiens
aggauauuugagucacuugug

SEQ ID NO: 2170629 - RNA, 22 nt, Homo sapiens
auuagcuuuaauuaagcucuca

SEQ ID NO: 2170630 - RNA, 20 nt, Homo sapiens
ugccaacauugccuauuuca

SEQ ID NO: 2170631 - RNA, 15 nt, Homo sapiens
uguguacauugaggu

SEQ ID NO: 2170632 - RNA, 14 nt, Homo sapiens
cagcccugcugcag

SEQ ID NO: 2170633 - RNA, 14 nt, Homo sapiens
auaaauuauggcau

SEQ ID NO: 2170634 - RNA, 15 nt, Homo sapiens
gauauuucaagcuca

SEQ ID NO: 2170635 - RNA, 18 nt, Homo sapiens
aagggaccccagauaccu

SEQ ID NO: 2170636 - RNA, 13 nt, Homo sapiens
ccagagaugcugg

SEQ ID NO: 2170637 - RNA, 18 nt, Homo sapiens
uacaggugugcaccacca

SEQ ID NO: 2170638 - RNA, 18 nt, Homo sapiens
cagauuuacacugggaga

SEQ ID NO: 2170639 - RNA, 22 nt, Homo sapiens
uggaccaaaggguuuacuugac

SEQ ID NO: 2170640 - RNA, 22 nt, Homo sapiens
acacauuugcuuuuugugauau

SEQ ID NO: 2170641 - RNA, 22 nt, Homo sapiens
caauaaaaaaaaaccuagcauc

SEQ ID NO: 2170642 - RNA, 15 nt, Homo sapiens
ggauucaauuuuaag

SEQ ID NO: 2170643 - RNA, 22 nt, Homo sapiens
uagcaaugugccuugauugauu

SEQ ID NO: 2170644 - RNA, 20 nt, Homo sapiens
cuuuuuuaaucuacuuuugc

SEQ ID NO: 2170645 - RNA, 20 nt, Homo sapiens
uuguauuuaccuucuaccuc

SEQ ID NO: 2170646 - RNA, 17 nt, Homo sapiens
ugcuuuccaaagccaau

SEQ ID NO: 2170647 - RNA, 18 nt, Homo sapiens
cagcauucccaccaacaa

SEQ ID NO: 2170648 - RNA, 14 nt, Homo sapiens
ccuagauuccauac

SEQ ID NO: 2170649 - RNA, 16 nt, Homo sapiens
guaaagcuuugugcag

SEQ ID NO: 2170650 - RNA, 24 nt, Homo sapiens
ggagugagggguaaaagcugaucu

SEQ ID NO: 2170651 - RNA, 12 nt, Homo sapiens
gaucuacacucu

SEQ ID NO: 2170652 - RNA, 17 nt, Homo sapiens
gcucacugcaaccucug

SEQ ID NO: 2170653 - RNA, 15 nt, Homo sapiens
cugugcccagcaugc

SEQ ID NO: 2170654 - RNA, 18 nt, Homo sapiens
ugaguaaacuguuucuca

SEQ ID NO: 2170655 - RNA, 17 nt, Homo sapiens
agugccugccuaugaaa

SEQ ID NO: 2170656 - RNA, 17 nt, Homo sapiens
agggaaugagcuuccau

SEQ ID NO: 2170657 - RNA, 20 nt, Homo sapiens
acaugaaaaacaggugacau

SEQ ID NO: 2170658 - RNA, 18 nt, Homo sapiens
ggugcuuuuauuuucaca

SEQ ID NO: 2170659 - RNA, 18 nt, Homo sapiens
caaguucuggaucuuaua

SEQ ID NO: 2170660 - RNA, 22 nt, Homo sapiens
ugccaaggcaaaaaacucuuaa

SEQ ID NO: 2170661 - RNA, 14 nt, Homo sapiens
aggcugcaaugagc

SEQ ID NO: 2170662 - RNA, 19 nt, Homo sapiens
gcuagcgauuucagaccua

SEQ ID NO: 2170663 - RNA, 14 nt, Homo sapiens
ugcugccugccugg

SEQ ID NO: 2170664 - RNA, 15 nt, Homo sapiens
gaacgcguguguaca

SEQ ID NO: 2170665 - RNA, 22 nt, Homo sapiens
cacauguucuagguuucagcaa

SEQ ID NO: 2170666 - RNA, 16 nt, Homo sapiens
cuaaugcucucaggga

SEQ ID NO: 2170667 - RNA, 20 nt, Homo sapiens
uaucaucuucucauuuugca

SEQ ID NO: 2170668 - RNA, 13 nt, Homo sapiens
cauucaguauuaa

SEQ ID NO: 2170669 - RNA, 21 nt, Homo sapiens
auccacaccguacaucugcaa

SEQ ID NO: 2170670 - RNA, 17 nt, Homo sapiens
cagggucucgcucuguu

SEQ ID NO: 2170671 - RNA, 17 nt, Homo sapiens
cagggucuugcucuguc

SEQ ID NO: 2170672 - RNA, 16 nt, Homo sapiens
accuggcaacccagga

SEQ ID NO: 2170673 - RNA, 14 nt, Homo sapiens
ccuuuuauaccugc

SEQ ID NO: 2170674 - RNA, 20 nt, Homo sapiens
gcccagccaacugccccggg

SEQ ID NO: 2170675 - RNA, 23 nt, Homo sapiens
uguauacucuugaauuccucuca

SEQ ID NO: 2170676 - RNA, 17 nt, Homo sapiens
cagaaauauuugcucaa

SEQ ID NO: 2170677 - RNA, 14 nt, Homo sapiens
gugagccacugcgu

SEQ ID NO: 2170678 - RNA, 17 nt, Homo sapiens
aagacggagaugcaugg

SEQ ID NO: 2170679 - RNA, 12 nt, Homo sapiens
guugguuuugac

SEQ ID NO: 2170680 - RNA, 16 nt, Homo sapiens
uccuucccccaucccc

SEQ ID NO: 2170681 - RNA, 20 nt, Homo sapiens
aaacgucuucuaaacuuccc

SEQ ID NO: 2170682 - RNA, 21 nt, Homo sapiens
uuaguagagacgggauuuccc

SEQ ID NO: 2170683 - RNA, 11 nt, Homo sapiens
ccaauuccuca

SEQ ID NO: 2170684 - RNA, 20 nt, Homo sapiens
uguuuuuguacaguuaucau

SEQ ID NO: 2170685 - RNA, 14 nt, Homo sapiens
cgagccucugucac

SEQ ID NO: 2170686 - RNA, 18 nt, Homo sapiens
gggcccuuguacaaccga

SEQ ID NO: 2170687 - RNA, 12 nt, Homo sapiens
aaaugucaguaa

SEQ ID NO: 2170688 - RNA, 22 nt, Homo sapiens
aaaacuguuaagggaagcugau

SEQ ID NO: 2170689 - RNA, 17 nt, Homo sapiens
uacuuccaugauacuuu

SEQ ID NO: 2170690 - RNA, 19 nt, Homo sapiens
gaggcuuuuaauugcacca

SEQ ID NO: 2170691 - RNA, 12 nt, Homo sapiens
uccccucuagga

SEQ ID NO: 2170692 - RNA, 19 nt, Homo sapiens
aaagauaugcuaagcagua

SEQ ID NO: 2170693 - RNA, 16 nt, Homo sapiens
ucccuggaugacauua

SEQ ID NO: 2170694 - RNA, 19 nt, Homo sapiens
cuggguggacuuugggacc

SEQ ID NO: 2170695 - RNA, 15 nt, Homo sapiens
cacgacugccaugua

SEQ ID NO: 2170696 - RNA, 23 nt, Homo sapiens
uuaaacacccagaagcaguaaua

SEQ ID NO: 2170697 - RNA, 13 nt, Homo sapiens
acaaaugacuggu

SEQ ID NO: 2170698 - RNA, 16 nt, Homo sapiens
caauccaaauucccuc

SEQ ID NO: 2170699 - RNA, 18 nt, Homo sapiens
ugggacccaggcucccag

SEQ ID NO: 2170700 - RNA, 12 nt, Homo sapiens
uauuuagugauu

SEQ ID NO: 2170701 - RNA, 15 nt, Homo sapiens
agcaaggugcucuug

SEQ ID NO: 2170702 - RNA, 14 nt, Homo sapiens
cguuuggcauuucu

SEQ ID NO: 2170703 - RNA, 21 nt, Homo sapiens
cuugaaaugcucuuuugcaca

SEQ ID NO: 2170704 - RNA, 19 nt, Homo sapiens
uccagaaauuuaccacaaa

SEQ ID NO: 2170705 - RNA, 16 nt, Homo sapiens
aaacauucacaccucu

SEQ ID NO: 2170706 - RNA, 18 nt, Homo sapiens
ccucgaacccacacugca

SEQ ID NO: 2170707 - RNA, 18 nt, Homo sapiens
agaagaaaucaugauaua

SEQ ID NO: 2170708 - RNA, 20 nt, Homo sapiens
cccaaaaacaagcaaaacca

SEQ ID NO: 2170709 - RNA, 12 nt, Homo sapiens
uccaccaugagg

SEQ ID NO: 2170710 - RNA, 13 nt, Homo sapiens
uguguguacucug

SEQ ID NO: 2170711 - RNA, 20 nt, Homo sapiens
uuuaacccugauucauacuc

SEQ ID NO: 2170712 - RNA, 13 nt, Homo sapiens
aacacgcugccug

SEQ ID NO: 2170713 - RNA, 21 nt, Homo sapiens
ccauaaccaagaaauacuaau

SEQ ID NO: 2170714 - RNA, 16 nt, Homo sapiens
ucacugaaaagacuau

SEQ ID NO: 2170715 - RNA, 12 nt, Homo sapiens
cagaaugaauuc

SEQ ID NO: 2170716 - RNA, 20 nt, Homo sapiens
ugaugugaaacacuuugccu

SEQ ID NO: 2170717 - RNA, 15 nt, Homo sapiens
ugggaaucauuccac

SEQ ID NO: 2170718 - RNA, 17 nt, Homo sapiens
uggggagauuugccaca

SEQ ID NO: 2170719 - RNA, 12 nt, Homo sapiens
cacauugcccau

SEQ ID NO: 2170720 - RNA, 19 nt, Homo sapiens
cacacggggugcgucuccc

SEQ ID NO: 2170721 - RNA, 15 nt, Homo sapiens
cuggucgagagccaa

SEQ ID NO: 2170722 - RNA, 23 nt, Homo sapiens
cacccauggagagguuugucaac

SEQ ID NO: 2170723 - RNA, 14 nt, Homo sapiens
uuggaccacagcau

SEQ ID NO: 2170724 - RNA, 12 nt, Homo sapiens
uagacugccagg

SEQ ID NO: 2170725 - RNA, 22 nt, Homo sapiens
aagaguaacagucaucauuuau

SEQ ID NO: 2170726 - RNA, 21 nt, Homo sapiens
cagcuagcaaaauuacuacca

SEQ ID NO: 2170727 - RNA, 13 nt, Homo sapiens
auauaugucucuu

SEQ ID NO: 2170728 - RNA, 16 nt, Homo sapiens
auggaaauucugaaaa

SEQ ID NO: 2170729 - RNA, 13 nt, Homo sapiens
ucgaaaugagcuc

SEQ ID NO: 2170730 - RNA, 15 nt, Homo sapiens
acuauuuaccaggga

SEQ ID NO: 2170731 - RNA, 19 nt, Homo sapiens
ugauuuaccuauacauuau

SEQ ID NO: 2170732 - RNA, 22 nt, Homo sapiens
uuaaguguguguauacuguaau

SEQ ID NO: 2170733 - RNA, 16 nt, Homo sapiens
gcagggguuaugugga

SEQ ID NO: 2170734 - RNA, 19 nt, Homo sapiens
aacucaguccuguacucug

SEQ ID NO: 2170735 - RNA, 16 nt, Homo sapiens
caguacaggacauaua

SEQ ID NO: 2170736 - RNA, 16 nt, Homo sapiens
ggggccaggugcacag

SEQ ID NO: 2170737 - RNA, 16 nt, Homo sapiens
caauggagacugucuc

SEQ ID NO: 2170738 - RNA, 18 nt, Homo sapiens
gagucccuuccaggccau

SEQ ID NO: 2170739 - RNA, 20 nt, Homo sapiens
aucugcugcaguuaccacag

SEQ ID NO: 2170740 - RNA, 15 nt, Homo sapiens
ugaaauuggaaagga

SEQ ID NO: 2170741 - RNA, 21 nt, Homo sapiens
auugcugauuuugucugccca

SEQ ID NO: 2170742 - RNA, 21 nt, Homo sapiens
gaaaugcugauuuaaacuucu

SEQ ID NO: 2170743 - RNA, 13 nt, Homo sapiens
gugacagcuguau

SEQ ID NO: 2170744 - RNA, 19 nt, Homo sapiens
agauaguugcuaaguugcu

SEQ ID NO: 2170745 - RNA, 21 nt, Homo sapiens
gccuaauauugaaaaugucac

SEQ ID NO: 2170746 - RNA, 16 nt, Homo sapiens
gaauagagguccucau

SEQ ID NO: 2170747 - RNA, 13 nt, Homo sapiens
uucugacuuauga

SEQ ID NO: 2170748 - RNA, 15 nt, Homo sapiens
uuugaaccugugcaa

SEQ ID NO: 2170749 - RNA, 16 nt, Homo sapiens
caaugcaaugcaucug

SEQ ID NO: 2170750 - RNA, 21 nt, Homo sapiens
caauaucaugucuugugcaua

SEQ ID NO: 2170751 - RNA, 20 nt, Homo sapiens
ccugccuggcggcagggguc

SEQ ID NO: 2170752 - RNA, 21 nt, Homo sapiens
uuacguggagagugcacugac

SEQ ID NO: 2170753 - RNA, 22 nt, Homo sapiens
uaaaccuguaagcccagcauuu

SEQ ID NO: 2170754 - RNA, 15 nt, Homo sapiens
uaucugucauauagu

SEQ ID NO: 2170755 - RNA, 17 nt, Homo sapiens
aauauuauuugcuaauu

SEQ ID NO: 2170756 - RNA, 12 nt, Homo sapiens
gcagcuccuucc

SEQ ID NO: 2170757 - RNA, 12 nt, Homo sapiens
caaagccaagca

SEQ ID NO: 2170758 - RNA, 18 nt, Homo sapiens
auagcgaaucaucucaaa

SEQ ID NO: 2170759 - RNA, 12 nt, Homo sapiens
augaaaugccaa

SEQ ID NO: 2170760 - RNA, 23 nt, Homo sapiens
cauggcugggauuuaaagccuuu

SEQ ID NO: 2170761 - RNA, 15 nt, Homo sapiens
ucuacaauacaacac

SEQ ID NO: 2170762 - RNA, 16 nt, Homo sapiens
gucuuuucuuugccau

SEQ ID NO: 2170763 - RNA, 21 nt, Homo sapiens
ccauggcuguuggugggaccc

SEQ ID NO: 2170764 - RNA, 13 nt, Homo sapiens
guggagguucugu

SEQ ID NO: 2170765 - RNA, 15 nt, Homo sapiens
gccauccucacccag

SEQ ID NO: 2170766 - RNA, 17 nt, Homo sapiens
cagcuccugaguagcug

SEQ ID NO: 2170767 - RNA, 17 nt, Homo sapiens
cccagucuggaugugga

SEQ ID NO: 2170768 - RNA, 16 nt, Homo sapiens
auuuuguaaauaugca

SEQ ID NO: 2170769 - RNA, 14 nt, Homo sapiens
gccauauuaccccu

SEQ ID NO: 2170770 - RNA, 22 nt, Homo sapiens
cagggaagugacaggacuuuca

SEQ ID NO: 2170771 - RNA, 17 nt, Homo sapiens
gauaucccuaugcugcc

SEQ ID NO: 2170772 - RNA, 15 nt, Homo sapiens
aggaaaacugggaca

SEQ ID NO: 2170773 - RNA, 18 nt, Homo sapiens
augagugauucuugacau

SEQ ID NO: 2170774 - RNA, 20 nt, Homo sapiens
cucagacauccacauaaccc

SEQ ID NO: 2170775 - RNA, 13 nt, Homo sapiens
ugcauuuguuacu

SEQ ID NO: 2170776 - RNA, 14 nt, Homo sapiens
uugaacaaccagau

SEQ ID NO: 2170777 - RNA, 19 nt, Homo sapiens
ggaaacagcucgacuuuaa

SEQ ID NO: 2170778 - RNA, 19 nt, Homo sapiens
cccacaugugacacauaug

SEQ ID NO: 2170779 - RNA, 13 nt, Homo sapiens
ggaacauacuguu

SEQ ID NO: 2170780 - RNA, 20 nt, Homo sapiens
acccucagacagacuuauac

SEQ ID NO: 2170781 - RNA, 15 nt, Homo sapiens
gcgauguaugcagcu

SEQ ID NO: 2170782 - RNA, 15 nt, Homo sapiens
aguuucucaaacuga

SEQ ID NO: 2170783 - RNA, 19 nt, Homo sapiens
uaguaaagugauaauuucu

SEQ ID NO: 2170784 - RNA, 14 nt, Homo sapiens
cuugacuuccugcc

SEQ ID NO: 2170785 - RNA, 16 nt, Homo sapiens
uuggauggagacucca

SEQ ID NO: 2170786 - RNA, 23 nt, Homo sapiens
aagcccaacugggguugcgucug

SEQ ID NO: 2170787 - RNA, 22 nt, Homo sapiens
ucccaacaacauccauguccua

SEQ ID NO: 2170788 - RNA, 13 nt, Homo sapiens
ggugacagaucau

SEQ ID NO: 2170789 - RNA, 16 nt, Homo sapiens
caugggggcccaaagg

SEQ ID NO: 2170790 - RNA, 21 nt, Homo sapiens
ugcauaacagcagaugccaaa

SEQ ID NO: 2170791 - RNA, 20 nt, Homo sapiens
gcaaaaccucaucauuacua

SEQ ID NO: 2170792 - RNA, 12 nt, Homo sapiens
aggcccagugac

SEQ ID NO: 2170793 - RNA, 12 nt, Homo sapiens
aggaccagugaa

SEQ ID NO: 2170794 - RNA, 20 nt, Homo sapiens
cgacaagaccaccaacgugu

SEQ ID NO: 2170795 - RNA, 15 nt, Homo sapiens
uaauucagauuucua

SEQ ID NO: 2170796 - RNA, 21 nt, Homo sapiens
cccaguuuuuugaacauggaa

SEQ ID NO: 2170797 - RNA, 13 nt, Homo sapiens
ucaaauggaugua

SEQ ID NO: 2170798 - RNA, 15 nt, Homo sapiens
uucaaaaccagcucc

SEQ ID NO: 2170799 - RNA, 23 nt, Homo sapiens
cugcaagaagaaaucaugauaua

SEQ ID NO: 2170800 - RNA, 15 nt, Homo sapiens
auauuauauauacau

SEQ ID NO: 2170801 - RNA, 19 nt, Homo sapiens
caguuugaagaccaaucaa

SEQ ID NO: 2170802 - RNA, 15 nt, Homo sapiens
ggcaggaacggugga

SEQ ID NO: 2170803 - RNA, 20 nt, Homo sapiens
ccucacccccagcuuugcua

SEQ ID NO: 2170804 - RNA, 21 nt, Homo sapiens
ugcauuugugucauugacaaa

SEQ ID NO: 2170805 - RNA, 20 nt, Homo sapiens
caggagugcugcccucuccc

SEQ ID NO: 2170806 - RNA, 16 nt, Homo sapiens
ucucuacugaauguca

SEQ ID NO: 2170807 - RNA, 21 nt, Homo sapiens
aaagcgugguggacaugcaca

SEQ ID NO: 2170808 - RNA, 21 nt, Homo sapiens
guccaaccagaccuggaagaa

SEQ ID NO: 2170809 - RNA, 22 nt, Homo sapiens
cuccugaagggaaggcaaaggc

SEQ ID NO: 2170810 - RNA, 18 nt, Homo sapiens
uagauauuguuuugugac

SEQ ID NO: 2170811 - RNA, 21 nt, Homo sapiens
agacaacuuccucucacuguu

SEQ ID NO: 2170812 - RNA, 21 nt, Homo sapiens
agaugacucugucucauugac

SEQ ID NO: 2170813 - RNA, 22 nt, Homo sapiens
cagggggauucugagcagugcc

SEQ ID NO: 2170814 - RNA, 15 nt, Homo sapiens
uugccuuaauucuua

SEQ ID NO: 2170815 - RNA, 17 nt, Homo sapiens
ucucuacccacuaugca

SEQ ID NO: 2170816 - RNA, 19 nt, Homo sapiens
aucauaauuaauguaguag

SEQ ID NO: 2170817 - RNA, 15 nt, Homo sapiens
ugauauuguucucca

SEQ ID NO: 2170818 - RNA, 18 nt, Homo sapiens
cuggcucucuaauuccac

SEQ ID NO: 2170819 - RNA, 20 nt, Homo sapiens
ggccaguagcuaaagugcaa

SEQ ID NO: 2170820 - RNA, 18 nt, Homo sapiens
aagguacugucaugggcu

SEQ ID NO: 2170821 - RNA, 15 nt, Homo sapiens
aggagaugacaggaa

SEQ ID NO: 2170822 - RNA, 16 nt, Homo sapiens
agaaauuaaguaucug

SEQ ID NO: 2170823 - RNA, 13 nt, Homo sapiens
aguuaacuaugau

SEQ ID NO: 2170824 - RNA, 16 nt, Homo sapiens
uauaagaaagaucaaa

SEQ ID NO: 2170825 - RNA, 22 nt, Homo sapiens
ccaguuagauagaagaauuuua

SEQ ID NO: 2170826 - RNA, 16 nt, Homo sapiens
uuaauaguuucuaaac

SEQ ID NO: 2170827 - RNA, 13 nt, Homo sapiens
uguguacaaagug

SEQ ID NO: 2170828 - RNA, 10 nt, Homo sapiens
uguacuugug

SEQ ID NO: 2170829 - RNA, 21 nt, Homo sapiens
aggagccuauggcaucuuccc

SEQ ID NO: 2170830 - RNA, 19 nt, Homo sapiens
acuccauuggaucugcaag

SEQ ID NO: 2170831 - RNA, 22 nt, Homo sapiens
guuuaaaaaggcaguuugcaaa

SEQ ID NO: 2170832 - RNA, 12 nt, Homo sapiens
auuucaucucuu

SEQ ID NO: 2170833 - RNA, 13 nt, Homo sapiens
agcaggagccagc

SEQ ID NO: 2170834 - RNA, 15 nt, Homo sapiens
gacccaccacuggaa

SEQ ID NO: 2170835 - RNA, 19 nt, Homo sapiens
cccuggagaugucacagau

SEQ ID NO: 2170836 - RNA, 12 nt, Homo sapiens
uucacugcugag

SEQ ID NO: 2170837 - RNA, 22 nt, Homo sapiens
accucagugucauuuaugaaaa

SEQ ID NO: 2170838 - RNA, 22 nt, Homo sapiens
ucagccaacugcccuaacugua

SEQ ID NO: 2170839 - RNA, 15 nt, Homo sapiens
aaccaggaacaugua

SEQ ID NO: 2170840 - RNA, 20 nt, Homo sapiens
gcuucucuacagacuccaaa

SEQ ID NO: 2170841 - RNA, 22 nt, Homo sapiens
cuguaacuacaaugaugguaaa

SEQ ID NO: 2170842 - RNA, 15 nt, Homo sapiens
cauuucccacuucca

SEQ ID NO: 2170843 - RNA, 18 nt, Homo sapiens
uucauuguguuaccugua

SEQ ID NO: 2170844 - RNA, 14 nt, Homo sapiens
aaaguucuagugac

SEQ ID NO: 2170845 - RNA, 19 nt, Homo sapiens
uguuauauagccaauauaa

SEQ ID NO: 2170846 - RNA, 21 nt, Homo sapiens
gugggaauaaaauuucuacua

SEQ ID NO: 2170847 - RNA, 22 nt, Homo sapiens
aagaaaucauggcauucacaca

SEQ ID NO: 2170848 - RNA, 22 nt, Homo sapiens
gaaaauauuauuuuuaugccug

SEQ ID NO: 2170849 - RNA, 19 nt, Homo sapiens
guucuguauauaguauaaa

SEQ ID NO: 2170850 - RNA, 21 nt, Homo sapiens
ucccaggugagaauucaggca

SEQ ID NO: 2170851 - RNA, 17 nt, Homo sapiens
aggggaaggccuuuuca

SEQ ID NO: 2170852 - RNA, 17 nt, Homo sapiens
cuguacugagacauuac

SEQ ID NO: 2170853 - RNA, 21 nt, Homo sapiens
ccaucguuacccauuucuuac

SEQ ID NO: 2170854 - RNA, 15 nt, Homo sapiens
uguagccccagucag

SEQ ID NO: 2170855 - RNA, 15 nt, Homo sapiens
uggagugcagugcca

SEQ ID NO: 2170856 - RNA, 18 nt, Homo sapiens
gcccuuccucuccacugc

SEQ ID NO: 2170857 - RNA, 18 nt, Homo sapiens
acuucaguugcuuugcag

SEQ ID NO: 2170858 - RNA, 17 nt, Homo sapiens
cgugacacaugcucuaa

SEQ ID NO: 2170859 - RNA, 17 nt, Homo sapiens
acaacuguuuuugaaga

SEQ ID NO: 2170860 - RNA, 17 nt, Homo sapiens
gacuucaucccaaagga

SEQ ID NO: 2170861 - RNA, 20 nt, Homo sapiens
uuccaauuuuguugcaucau

SEQ ID NO: 2170862 - RNA, 19 nt, Homo sapiens
aaugcuuguaauagucugu

SEQ ID NO: 2170863 - RNA, 20 nt, Homo sapiens
caagcacagugccugcaugu

SEQ ID NO: 2170864 - RNA, 20 nt, Homo sapiens
cccugcagcacggacaauaa

SEQ ID NO: 2170865 - RNA, 19 nt, Homo sapiens
caaaguucuucauaucauc

SEQ ID NO: 2170866 - RNA, 20 nt, Homo sapiens
uacaaggccccaagguuuac

SEQ ID NO: 2170867 - RNA, 15 nt, Homo sapiens
cgaucgacugccaag

SEQ ID NO: 2170868 - RNA, 13 nt, Homo sapiens
uccugacacccca

SEQ ID NO: 2170869 - RNA, 18 nt, Homo sapiens
aguagacuauaagcagaa

SEQ ID NO: 2170870 - RNA, 19 nt, Homo sapiens
uggcuuauauucuaaguca

SEQ ID NO: 2170871 - RNA, 13 nt, Homo sapiens
uguauuacugcuu

SEQ ID NO: 2170872 - RNA, 13 nt, Homo sapiens
uuuuauacuucaa

SEQ ID NO: 2170873 - RNA, 14 nt, Homo sapiens
cugagaaggcuaaa

SEQ ID NO: 2170874 - RNA, 14 nt, Homo sapiens
uugauuuugugaua

SEQ ID NO: 2170875 - RNA, 17 nt, Homo sapiens
uaucugccaaauugaga

SEQ ID NO: 2170876 - RNA, 13 nt, Homo sapiens
cauaauguaauga

SEQ ID NO: 2170877 - RNA, 18 nt, Homo sapiens
ggccuggcccugcuuucu

SEQ ID NO: 2170878 - RNA, 14 nt, Homo sapiens
aauaaguugcagaa

SEQ ID NO: 2170879 - RNA, 22 nt, Homo sapiens
agggacuucugucuucacaaca

SEQ ID NO: 2170880 - RNA, 18 nt, Homo sapiens
uggggaguaccuguccaa

SEQ ID NO: 2170881 - RNA, 16 nt, Homo sapiens
caugaugcccugcuga

SEQ ID NO: 2170882 - RNA, 20 nt, Homo sapiens
ccacugggccauuguggugu

SEQ ID NO: 2170883 - RNA, 20 nt, Homo sapiens
guguccguccacccuuccau

SEQ ID NO: 2170884 - RNA, 15 nt, Homo sapiens
ggguuuaaauaucca

SEQ ID NO: 2170885 - RNA, 17 nt, Homo sapiens
aacuagacauucugucg

SEQ ID NO: 2170886 - RNA, 16 nt, Homo sapiens
gacagagcuggugaua

SEQ ID NO: 2170887 - RNA, 16 nt, Homo sapiens
agagaaacuagaaaca

SEQ ID NO: 2170888 - RNA, 16 nt, Homo sapiens
accugacagcuuuauc

SEQ ID NO: 2170889 - RNA, 22 nt, Homo sapiens
agauccuaccccaauuccuugu

SEQ ID NO: 2170890 - RNA, 18 nt, Homo sapiens
ugugguuauuuucuccau

SEQ ID NO: 2170891 - RNA, 18 nt, Homo sapiens
caaaacccaggacaucuc

SEQ ID NO: 2170892 - RNA, 15 nt, Homo sapiens
agccuguccccagac

SEQ ID NO: 2170893 - RNA, 15 nt, Homo sapiens
aucuaacguguucca

SEQ ID NO: 2170894 - RNA, 14 nt, Homo sapiens
gaugaguuuugcca

SEQ ID NO: 2170895 - RNA, 18 nt, Homo sapiens
ugccugacaagugccuga

SEQ ID NO: 2170896 - RNA, 17 nt, Homo sapiens
uaauuuccuggugugaa

SEQ ID NO: 2170897 - RNA, 12 nt, Homo sapiens
ugucccagaugg

SEQ ID NO: 2170898 - RNA, 13 nt, Homo sapiens
uccuguuacugaa

SEQ ID NO: 2170899 - RNA, 13 nt, Homo sapiens
aauaaagcuuuau

SEQ ID NO: 2170900 - RNA, 16 nt, Homo sapiens
agcuuauggcaucuca

SEQ ID NO: 2170901 - RNA, 23 nt, Homo sapiens
cuuuaugaugacugcuuaacucc

SEQ ID NO: 2170902 - RNA, 21 nt, Homo sapiens
cuguccaggaacuuuccagca

SEQ ID NO: 2170903 - RNA, 16 nt, Homo sapiens
gaucacuugaacccgg

SEQ ID NO: 2170904 - RNA, 15 nt, Homo sapiens
ccuagagcuccaguu

SEQ ID NO: 2170905 - RNA, 18 nt, Homo sapiens
uauacuccucaagcugaa

SEQ ID NO: 2170906 - RNA, 19 nt, Homo sapiens
ugucuuaaggagacuggua

SEQ ID NO: 2170907 - RNA, 14 nt, Homo sapiens
aacaauucaaguga

SEQ ID NO: 2170908 - RNA, 17 nt, Homo sapiens
gggaugaagcucacugg

SEQ ID NO: 2170909 - RNA, 19 nt, Homo sapiens
uauucucuuuucaagaagu

SEQ ID NO: 2170910 - RNA, 21 nt, Homo sapiens
aucugagcugcagccuggcug

SEQ ID NO: 2170911 - RNA, 19 nt, Homo sapiens
aucauuguuuauuguauac

SEQ ID NO: 2170912 - RNA, 22 nt, Homo sapiens
ccaaucugagcaaacaccagug

SEQ ID NO: 2170913 - RNA, 16 nt, Homo sapiens
aaagcugauagccaga

SEQ ID NO: 2170914 - RNA, 22 nt, Homo sapiens
agucuuguagcuagaacuucuc

SEQ ID NO: 2170915 - RNA, 15 nt, Homo sapiens
ggacucaguggacac

SEQ ID NO: 2170916 - RNA, 15 nt, Homo sapiens
ucccaaaccagacac

SEQ ID NO: 2170917 - RNA, 23 nt, Homo sapiens
acuuuaugagcagcaagauugcu

SEQ ID NO: 2170918 - RNA, 18 nt, Homo sapiens
uuaagcuucuuaacugcc

SEQ ID NO: 2170919 - RNA, 21 nt, Homo sapiens
gugcugugcacaccugcucuc

SEQ ID NO: 2170920 - RNA, 21 nt, Homo sapiens
auaccccggugugccugugga

SEQ ID NO: 2170921 - RNA, 17 nt, Homo sapiens
gauguuuuacuuuucac

SEQ ID NO: 2170922 - RNA, 12 nt, Homo sapiens
aagccagguuac

SEQ ID NO: 2170923 - RNA, 15 nt, Homo sapiens
gccgagugcacugca

SEQ ID NO: 2170924 - RNA, 14 nt, Homo sapiens
acugcuugugagac

SEQ ID NO: 2170925 - RNA, 19 nt, Homo sapiens
acaauuauauaaaucauuu

SEQ ID NO: 2170926 - RNA, 17 nt, Homo sapiens
agccugaacagaagcuc

SEQ ID NO: 2170927 - RNA, 16 nt, Homo sapiens
ucccccuuucucugcc

SEQ ID NO: 2170928 - RNA, 23 nt, Homo sapiens
uccugggccucagcaagccaugc

SEQ ID NO: 2170929 - RNA, 13 nt, Homo sapiens
uuucuugcuuuca

SEQ ID NO: 2170930 - RNA, 11 nt, Homo sapiens
auacuaaaaag

SEQ ID NO: 2170931 - RNA, 12 nt, Homo sapiens
agacaagcacua

SEQ ID NO: 2170932 - RNA, 15 nt, Homo sapiens
aggaaaagccaacag

SEQ ID NO: 2170933 - RNA, 23 nt, Homo sapiens
agaagugccaucucaauugugcu

SEQ ID NO: 2170934 - RNA, 18 nt, Homo sapiens
cugaauuaaagucuacac

SEQ ID NO: 2170935 - RNA, 17 nt, Homo sapiens
ucacccaggcacugggc

SEQ ID NO: 2170936 - RNA, 18 nt, Homo sapiens
acaguucuugugugguuu

SEQ ID NO: 2170937 - RNA, 16 nt, Homo sapiens
guccucucagaacucc

SEQ ID NO: 2170938 - RNA, 13 nt, Homo sapiens
gcccuacagaaaa

SEQ ID NO: 2170939 - RNA, 20 nt, Homo sapiens
caucaugagccguugcuaau

SEQ ID NO: 2170940 - RNA, 18 nt, Homo sapiens
ccugaccgugcuaacugu

SEQ ID NO: 2170941 - RNA, 12 nt, Homo sapiens
caaaagaagauu

SEQ ID NO: 2170942 - RNA, 19 nt, Homo sapiens
gcuauaccugcacguucau

SEQ ID NO: 2170943 - RNA, 15 nt, Homo sapiens
gagauuggauuugcu

SEQ ID NO: 2170944 - RNA, 17 nt, Homo sapiens
ggguggugugucucagg

SEQ ID NO: 2170945 - RNA, 15 nt, Homo sapiens
guugugagcuuugaa

SEQ ID NO: 2170946 - RNA, 14 nt, Homo sapiens
uauuucaucugguu

SEQ ID NO: 2170947 - RNA, 17 nt, Homo sapiens
cccauuugugaagcuua

SEQ ID NO: 2170948 - RNA, 15 nt, Homo sapiens
auucagaacuauuua

SEQ ID NO: 2170949 - RNA, 22 nt, Homo sapiens
uauccguagaguagucaugaca

SEQ ID NO: 2170950 - RNA, 16 nt, Homo sapiens
cugcaguucuacucag

SEQ ID NO: 2170951 - RNA, 17 nt, Homo sapiens
aaauuggucacuuuccu

SEQ ID NO: 2170952 - RNA, 13 nt, Homo sapiens
gcgcuuacuccuc

SEQ ID NO: 2170953 - RNA, 19 nt, Homo sapiens
ccaugugaaacucaucuca

SEQ ID NO: 2170954 - RNA, 15 nt, Homo sapiens
acgcagguguaccuc

SEQ ID NO: 2170955 - RNA, 15 nt, Homo sapiens
cacagccugucuuca

SEQ ID NO: 2170956 - RNA, 19 nt, Homo sapiens
agcaugagguguugugcau

SEQ ID NO: 2170957 - RNA, 12 nt, Homo sapiens
aaaucauugugu

SEQ ID NO: 2170958 - RNA, 16 nt, Homo sapiens
caaaauuaugguguuc

SEQ ID NO: 2170959 - RNA, 21 nt, Homo sapiens
guacacagacuauugacauca

SEQ ID NO: 2170960 - RNA, 17 nt, Homo sapiens
ccugugcuucugcuuau

SEQ ID NO: 2170961 - RNA, 22 nt, Homo sapiens
agccagaguuggauaagccaau

SEQ ID NO: 2170962 - RNA, 13 nt, Homo sapiens
cacaucuguuuca

SEQ ID NO: 2170963 - RNA, 21 nt, Homo sapiens
cuguccuggcauuuguggcca

SEQ ID NO: 2170964 - RNA, 23 nt, Homo sapiens
accuccuauccuuggagagcagc

SEQ ID NO: 2170965 - RNA, 23 nt, Homo sapiens
cguuaguguauuuuauguguggc

SEQ ID NO: 2170966 - RNA, 22 nt, Homo sapiens
ucuuccuaccuugauugagggu

SEQ ID NO: 2170967 - RNA, 23 nt, Homo sapiens
cucuaucggggucacuugcaauu

SEQ ID NO: 2170968 - RNA, 17 nt, Homo sapiens
agcaacuccccuacauc

SEQ ID NO: 2170969 - RNA, 21 nt, Homo sapiens
aacugaauucugaacuuuuca

SEQ ID NO: 2170970 - RNA, 17 nt, Homo sapiens
ccugugaaucauauguu

SEQ ID NO: 2170971 - RNA, 24 nt, Homo sapiens
aaucaaggcauaaaauacaauuaa

SEQ ID NO: 2170972 - RNA, 12 nt, Homo sapiens
acugacuacccu

SEQ ID NO: 2170973 - RNA, 15 nt, Homo sapiens
guugagcuaugauau

SEQ ID NO: 2170974 - RNA, 17 nt, Homo sapiens
aaaucaauucauugugu

SEQ ID NO: 2170975 - RNA, 18 nt, Homo sapiens
cuuauacgucuagccuaa

SEQ ID NO: 2170976 - RNA, 15 nt, Homo sapiens
acaggcaaauguacu

SEQ ID NO: 2170977 - RNA, 21 nt, Homo sapiens
ucuuuaagguagcaucauuga

SEQ ID NO: 2170978 - RNA, 14 nt, Homo sapiens
uguaauaguuuuaa

SEQ ID NO: 2170979 - RNA, 15 nt, Homo sapiens
ccuguugucaagaau

SEQ ID NO: 2170980 - RNA, 13 nt, Homo sapiens
uaaaaaauuauua

SEQ ID NO: 2170981 - RNA, 15 nt, Homo sapiens
uccuuucauccucag

SEQ ID NO: 2170982 - RNA, 20 nt, Homo sapiens
gauuuuacauguggcccaac

SEQ ID NO: 2170983 - RNA, 15 nt, Homo sapiens
aaauaguuacaagca

SEQ ID NO: 2170984 - RNA, 13 nt, Homo sapiens
uguggaguuuaca

SEQ ID NO: 2170985 - RNA, 24 nt, Homo sapiens
acagggucugcucuuucucugcca

SEQ ID NO: 2170986 - RNA, 15 nt, Homo sapiens
gcucagcucccacaa

SEQ ID NO: 2170987 - RNA, 17 nt, Homo sapiens
aguaaaagugcuuucca

SEQ ID NO: 2170988 - RNA, 20 nt, Homo sapiens
agcacucccuuaggcauuau

SEQ ID NO: 2170989 - RNA, 16 nt, Homo sapiens
uauuaacugcucagug

SEQ ID NO: 2170990 - RNA, 10 nt, Homo sapiens
cccagaacac

SEQ ID NO: 2170991 - RNA, 23 nt, Homo sapiens
auggcugagggaacauagacuca

SEQ ID NO: 2170992 - RNA, 14 nt, Homo sapiens
uauuuauucccugu

SEQ ID NO: 2170993 - RNA, 16 nt, Homo sapiens
cagccacuuauuucca

SEQ ID NO: 2170994 - RNA, 20 nt, Homo sapiens
acugugaaauaccacaagcc

SEQ ID NO: 2170995 - RNA, 19 nt, Homo sapiens
ugcccccacccaccuguac

SEQ ID NO: 2170996 - RNA, 17 nt, Homo sapiens
cucccuggccccaguga

SEQ ID NO: 2170997 - RNA, 20 nt, Homo sapiens
auguauggagcucuaaccca

SEQ ID NO: 2170998 - RNA, 12 nt, Homo sapiens
ccaaauagcaaa

SEQ ID NO: 2170999 - RNA, 14 nt, Homo sapiens
ggcugcgcacugug

SEQ ID NO: 2171000 - RNA, 16 nt, Homo sapiens
uuacuuggcaaauucu

SEQ ID NO: 2171001 - RNA, 20 nt, Homo sapiens
cuuagggcaucgaucuuccu

SEQ ID NO: 2171002 - RNA, 21 nt, Homo sapiens
aaaaacagguauauacuuuga

SEQ ID NO: 2171003 - RNA, 19 nt, Homo sapiens
aaacuacccucuggagaua

SEQ ID NO: 2171004 - RNA, 23 nt, Homo sapiens
caacaacgagauaccaucucaca

SEQ ID NO: 2171005 - RNA, 22 nt, Homo sapiens
ucaguuuuaacaaaugcuauua

SEQ ID NO: 2171006 - RNA, 17 nt, Homo sapiens
gaaucaucuccuuugca

SEQ ID NO: 2171007 - RNA, 20 nt, Homo sapiens
cugguaauuuaagauuccag

SEQ ID NO: 2171008 - RNA, 15 nt, Homo sapiens
uucugaaaauuuaua

SEQ ID NO: 2171009 - RNA, 20 nt, Homo sapiens
aguuuuuccugugcaaaaau

SEQ ID NO: 2171010 - RNA, 17 nt, Homo sapiens
auacccugaauuuggcc

SEQ ID NO: 2171011 - RNA, 13 nt, Homo sapiens
ccugggcauuccu

SEQ ID NO: 2171012 - RNA, 18 nt, Homo sapiens
guggacucucugccugcu

SEQ ID NO: 2171013 - RNA, 18 nt, Homo sapiens
acuguucaaacucaggcc

SEQ ID NO: 2171014 - RNA, 18 nt, Homo sapiens
agaaaaucugaauuggaa

SEQ ID NO: 2171015 - RNA, 15 nt, Homo sapiens
acaucuggacacugg

SEQ ID NO: 2171016 - RNA, 21 nt, Homo sapiens
agauacaugguugugaccuga

SEQ ID NO: 2171017 - RNA, 15 nt, Homo sapiens
caaaacacuguggaa

SEQ ID NO: 2171018 - RNA, 23 nt, Homo sapiens
acagugcauauuccuuucuauca

SEQ ID NO: 2171019 - RNA, 15 nt, Homo sapiens
uucauucccucccca

SEQ ID NO: 2171020 - RNA, 14 nt, Homo sapiens
aaucucuccaccuu

SEQ ID NO: 2171021 - RNA, 15 nt, Homo sapiens
acagauggcauaccu

SEQ ID NO: 2171022 - RNA, 21 nt, Homo sapiens
aaaacgaugaaguuaugcugu

SEQ ID NO: 2171023 - RNA, 17 nt, Homo sapiens
uggaaauguggucauca

SEQ ID NO: 2171024 - RNA, 23 nt, Homo sapiens
uauugugaugcauuuaucuuaau

SEQ ID NO: 2171025 - RNA, 14 nt, Homo sapiens
gcugcagugaccca

SEQ ID NO: 2171026 - RNA, 13 nt, Homo sapiens
ucagagagacugu

SEQ ID NO: 2171027 - RNA, 15 nt, Homo sapiens
caucuucacuacaaa

SEQ ID NO: 2171028 - RNA, 13 nt, Homo sapiens
ggagccugugcag

SEQ ID NO: 2171029 - RNA, 13 nt, Homo sapiens
uuaacguggcuug

SEQ ID NO: 2171030 - RNA, 15 nt, Homo sapiens
augcugcuucuccuc

SEQ ID NO: 2171031 - RNA, 17 nt, Homo sapiens
acuucauucacauucag

SEQ ID NO: 2171032 - RNA, 23 nt, Homo sapiens
agguguucuucauuaccucagug

SEQ ID NO: 2171033 - RNA, 14 nt, Homo sapiens
uuaaaccauguaaa

SEQ ID NO: 2171034 - RNA, 22 nt, Homo sapiens
auacagaacccauuccauuuau

SEQ ID NO: 2171035 - RNA, 20 nt, Homo sapiens
aagauucuggggcuguguua

SEQ ID NO: 2171036 - RNA, 16 nt, Homo sapiens
guuaaggcaacauucc

SEQ ID NO: 2171037 - RNA, 18 nt, Homo sapiens
aagcuaaaauaaagaaau

SEQ ID NO: 2171038 - RNA, 12 nt, Homo sapiens
ggugcuuuccag

SEQ ID NO: 2171039 - RNA, 17 nt, Homo sapiens
aggcuucugaugaucau

SEQ ID NO: 2171040 - RNA, 13 nt, Homo sapiens
ccggugaagugca

SEQ ID NO: 2171041 - RNA, 16 nt, Homo sapiens
uugaagauuagcuuuu

SEQ ID NO: 2171042 - RNA, 17 nt, Homo sapiens
gaacaucuggauuucau

SEQ ID NO: 2171043 - RNA, 19 nt, Homo sapiens
uaauguaaaauccauccaa

SEQ ID NO: 2171044 - RNA, 16 nt, Homo sapiens
caaaacugacaguaaa

SEQ ID NO: 2171045 - RNA, 23 nt, Homo sapiens
aaagcaggcuuuucuagacuuua

SEQ ID NO: 2171046 - RNA, 13 nt, Homo sapiens
agcagcugccaga

SEQ ID NO: 2171047 - RNA, 14 nt, Homo sapiens
accuugugccuugg

SEQ ID NO: 2171048 - RNA, 22 nt, Homo sapiens
augaggugagagaaagccacaa

SEQ ID NO: 2171049 - RNA, 14 nt, Homo sapiens
acucauauguggaa

SEQ ID NO: 2171050 - RNA, 15 nt, Homo sapiens
aaaagccucagcuca

SEQ ID NO: 2171051 - RNA, 20 nt, Homo sapiens
ccaauguccugaaacaugaa

SEQ ID NO: 2171052 - RNA, 22 nt, Homo sapiens
cucucuggcuggucuucacuuu

SEQ ID NO: 2171053 - RNA, 21 nt, Homo sapiens
ugucaucucagcuggaucucc

SEQ ID NO: 2171054 - RNA, 15 nt, Homo sapiens
caagcagauucccug

SEQ ID NO: 2171055 - RNA, 17 nt, Homo sapiens
ugaacuaaucugauguu

SEQ ID NO: 2171056 - RNA, 18 nt, Homo sapiens
gcaggaagccuacuauuu

SEQ ID NO: 2171057 - RNA, 23 nt, Homo sapiens
aacccuaaggugagugugcagua

SEQ ID NO: 2171058 - RNA, 17 nt, Homo sapiens
agaaacuagcagauuug

SEQ ID NO: 2171059 - RNA, 21 nt, Homo sapiens
cuccuuguuccuagaguagag

SEQ ID NO: 2171060 - RNA, 15 nt, Homo sapiens
auaaucuuuagucau

SEQ ID NO: 2171061 - RNA, 18 nt, Homo sapiens
ucaucacaucaugcuguu

SEQ ID NO: 2171062 - RNA, 17 nt, Homo sapiens
cuaugucaacaguauaa

SEQ ID NO: 2171063 - RNA, 23 nt, Homo sapiens
uccucuguucacaaacuaccucu

SEQ ID NO: 2171064 - RNA, 15 nt, Homo sapiens
guguuagaauugccu

SEQ ID NO: 2171065 - RNA, 22 nt, Homo sapiens
cuauuuucagagcaugauacaa

SEQ ID NO: 2171066 - RNA, 17 nt, Homo sapiens
guccuuguuccccuaau

SEQ ID NO: 2171067 - RNA, 19 nt, Homo sapiens
cugagguugggcugagacc

SEQ ID NO: 2171068 - RNA, 13 nt, Homo sapiens
gacauucaugccu

SEQ ID NO: 2171069 - RNA, 17 nt, Homo sapiens
uauauuacaagccuaca

SEQ ID NO: 2171070 - RNA, 14 nt, Homo sapiens
guugcugcaucucc

SEQ ID NO: 2171071 - RNA, 22 nt, Homo sapiens
aacgcaaagggcugaaagccau

SEQ ID NO: 2171072 - RNA, 15 nt, Homo sapiens
guguaacagauauca

SEQ ID NO: 2171073 - RNA, 15 nt, Homo sapiens
guacaggaacugcau

SEQ ID NO: 2171074 - RNA, 13 nt, Homo sapiens
ugcugcugcucau

SEQ ID NO: 2171075 - RNA, 14 nt, Homo sapiens
cuguagggggcgau

SEQ ID NO: 2171076 - RNA, 14 nt, Homo sapiens
ugaaugcuccauua

SEQ ID NO: 2171077 - RNA, 14 nt, Homo sapiens
ucccccaaccucag

SEQ ID NO: 2171078 - RNA, 23 nt, Homo sapiens
caauacaaaaauaccuacugcug

SEQ ID NO: 2171079 - RNA, 22 nt, Homo sapiens
gcuguggagagggucaaggagu

SEQ ID NO: 2171080 - RNA, 18 nt, Homo sapiens
aaugagguccuucuguag

SEQ ID NO: 2171081 - RNA, 19 nt, Homo sapiens
auacauguuugcaguguua

SEQ ID NO: 2171082 - RNA, 14 nt, Homo sapiens
uaugcacugaauaa

SEQ ID NO: 2171083 - RNA, 15 nt, Homo sapiens
ccuaauaucacuuaa

SEQ ID NO: 2171084 - RNA, 17 nt, Homo sapiens
ucuuccagcccagacau

SEQ ID NO: 2171085 - RNA, 18 nt, Homo sapiens
uuagagauauagauauua

SEQ ID NO: 2171086 - RNA, 18 nt, Homo sapiens
gaagggagcuagccagag

SEQ ID NO: 2171087 - RNA, 14 nt, Homo sapiens
aacugggcacugga

SEQ ID NO: 2171088 - RNA, 21 nt, Homo sapiens
aagaaugagcauugagacggu

SEQ ID NO: 2171089 - RNA, 23 nt, Homo sapiens
ggaagugagccagcaguggccuu

SEQ ID NO: 2171090 - RNA, 12 nt, Homo sapiens
acugggugacca

SEQ ID NO: 2171091 - RNA, 15 nt, Homo sapiens
auuuuugaaggcaua

SEQ ID NO: 2171092 - RNA, 14 nt, Homo sapiens
cuuggggucaccac

SEQ ID NO: 2171093 - RNA, 17 nt, Homo sapiens
agacugggggcaggaug

SEQ ID NO: 2171094 - RNA, 16 nt, Homo sapiens
aaauauuuauaucuca

SEQ ID NO: 2171095 - RNA, 16 nt, Homo sapiens
uaaaccugaacaaacc

SEQ ID NO: 2171096 - RNA, 19 nt, Homo sapiens
aauucauagcauccugauu

SEQ ID NO: 2171097 - RNA, 19 nt, Homo sapiens
aaucuaacagugacuucau

SEQ ID NO: 2171098 - RNA, 19 nt, Homo sapiens
uugcccaggcuggagugca

SEQ ID NO: 2171099 - RNA, 13 nt, Homo sapiens
cacgaaugaucuu

SEQ ID NO: 2171100 - RNA, 13 nt, Homo sapiens
cuaguaugaaaua

SEQ ID NO: 2171101 - RNA, 17 nt, Homo sapiens
auguaacuuuuuaauca

SEQ ID NO: 2171102 - RNA, 17 nt, Homo sapiens
ugaccccuaaugcugca

SEQ ID NO: 2171103 - RNA, 15 nt, Homo sapiens
caaauaaaguaccau

SEQ ID NO: 2171104 - RNA, 14 nt, Homo sapiens
acagcauaaagcac

SEQ ID NO: 2171105 - RNA, 16 nt, Homo sapiens
gacuucuugguuuucu

SEQ ID NO: 2171106 - RNA, 17 nt, Homo sapiens
agagugugauguucacu

SEQ ID NO: 2171107 - RNA, 18 nt, Homo sapiens
acuaugcagcucaucacc

SEQ ID NO: 2171108 - RNA, 16 nt, Homo sapiens
uuuccuaugugcugua

SEQ ID NO: 2171109 - RNA, 16 nt, Homo sapiens
aaugucuccacuucac

SEQ ID NO: 2171110 - RNA, 16 nt, Homo sapiens
cgcuaaagagugaaug

SEQ ID NO: 2171111 - RNA, 18 nt, Homo sapiens
ccaauaaaccagugugaa

SEQ ID NO: 2171112 - RNA, 11 nt, Homo sapiens
agccucugggg

SEQ ID NO: 2171113 - RNA, 23 nt, Homo sapiens
gcacacuccaucuccugcucacc

SEQ ID NO: 2171114 - RNA, 23 nt, Homo sapiens
uccuucaccccuauggugcucag

SEQ ID NO: 2171115 - RNA, 23 nt, Homo sapiens
uucucaagcccugcagucacagc

SEQ ID NO: 2171116 - RNA, 16 nt, Homo sapiens
gaccaccuuucacaaa

SEQ ID NO: 2171117 - RNA, 19 nt, Homo sapiens
ggaguucugcucauucuaa

SEQ ID NO: 2171118 - RNA, 18 nt, Homo sapiens
cugugagggagugcagaa

SEQ ID NO: 2171119 - RNA, 13 nt, Homo sapiens
auagaauugcaau

SEQ ID NO: 2171120 - RNA, 15 nt, Homo sapiens
auagcucucaucacu

SEQ ID NO: 2171121 - RNA, 19 nt, Homo sapiens
augauucagaaauuuucau

SEQ ID NO: 2171122 - RNA, 11 nt, Homo sapiens
ggaagggucaa

SEQ ID NO: 2171123 - RNA, 11 nt, Homo sapiens
ugaagcacuuu

SEQ ID NO: 2171124 - RNA, 14 nt, Homo sapiens
gauccacugugcag

SEQ ID NO: 2171125 - RNA, 17 nt, Homo sapiens
aacugagcgaaauccaa

SEQ ID NO: 2171126 - RNA, 22 nt, Homo sapiens
cauaaaaagccugcaauuucau

SEQ ID NO: 2171127 - RNA, 23 nt, Homo sapiens
gaaagaaguuaacuacaguguuu

SEQ ID NO: 2171128 - RNA, 20 nt, Homo sapiens
gugauuguuaugccuugcua

SEQ ID NO: 2171129 - RNA, 13 nt, Homo sapiens
ggcugaagaggcu

SEQ ID NO: 2171130 - RNA, 14 nt, Homo sapiens
cuuaucaacaacuu

SEQ ID NO: 2171131 - RNA, 21 nt, Homo sapiens
aggucuguggaaaguggugca

SEQ ID NO: 2171132 - RNA, 19 nt, Homo sapiens
ucucauagggaugcuguga

SEQ ID NO: 2171133 - RNA, 15 nt, Homo sapiens
uuuagcacaguauuu

SEQ ID NO: 2171134 - RNA, 15 nt, Homo sapiens
cucugcaggacacag

SEQ ID NO: 2171135 - RNA, 15 nt, Homo sapiens
uuaucuugucucugg

SEQ ID NO: 2171136 - RNA, 14 nt, Homo sapiens
aguaauucugucau

SEQ ID NO: 2171137 - RNA, 12 nt, Homo sapiens
agucucugugaa

SEQ ID NO: 2171138 - RNA, 12 nt, Homo sapiens
aaacucuguaua

SEQ ID NO: 2171139 - RNA, 19 nt, Homo sapiens
cccauuaaaauaguuacaa

SEQ ID NO: 2171140 - RNA, 17 nt, Homo sapiens
auuaucauguguaauca

SEQ ID NO: 2171141 - RNA, 20 nt, Homo sapiens
ucucucaagagugcugagaa

SEQ ID NO: 2171142 - RNA, 15 nt, Homo sapiens
aggucaaaacugaag

SEQ ID NO: 2171143 - RNA, 17 nt, Homo sapiens
accaaguaccaguauaa

SEQ ID NO: 2171144 - RNA, 14 nt, Homo sapiens
uuccuccucaugaa

SEQ ID NO: 2171145 - RNA, 19 nt, Homo sapiens
acguggagagugcacugac

SEQ ID NO: 2171146 - RNA, 20 nt, Homo sapiens
aacuuuugguaucuacuucu

SEQ ID NO: 2171147 - RNA, 15 nt, Homo sapiens
agcccuugggcaguu

SEQ ID NO: 2171148 - RNA, 23 nt, Homo sapiens
ugaaagucacggcugcgcacugu

SEQ ID NO: 2171149 - RNA, 21 nt, Homo sapiens
uauuccacuggcgcaucauau

SEQ ID NO: 2171150 - RNA, 13 nt, Homo sapiens
cugcuggugaaua

SEQ ID NO: 2171151 - RNA, 14 nt, Homo sapiens
acuauguggcugaa

SEQ ID NO: 2171152 - RNA, 15 nt, Homo sapiens
auguuguuagcuuuu

SEQ ID NO: 2171153 - RNA, 19 nt, Homo sapiens
uucaauaaaaguaaacuca

SEQ ID NO: 2171154 - RNA, 23 nt, Homo sapiens
cagacuaugucacccaaugcaua

SEQ ID NO: 2171155 - RNA, 12 nt, Homo sapiens
aaucauggagcu

SEQ ID NO: 2171156 - RNA, 20 nt, Homo sapiens
ucauaccaguuguucauuga

SEQ ID NO: 2171157 - RNA, 17 nt, Homo sapiens
gucugcuuaccaaaaca

SEQ ID NO: 2171158 - RNA, 17 nt, Homo sapiens
guucaguggugugaucu

SEQ ID NO: 2171159 - RNA, 17 nt, Homo sapiens
ugaccacugaauucacu

SEQ ID NO: 2171160 - RNA, 23 nt, Homo sapiens
cuacacaaaauacagcacuuuga

SEQ ID NO: 2171161 - RNA, 22 nt, Homo sapiens
uaguaauuguaaguaccccuga

SEQ ID NO: 2171162 - RNA, 22 nt, Homo sapiens
aacaaauuagguuuuguacaau

SEQ ID NO: 2171163 - RNA, 14 nt, Homo sapiens
gaugcggcccugag

SEQ ID NO: 2171164 - RNA, 17 nt, Homo sapiens
ugcuuagucccucaugc

SEQ ID NO: 2171165 - RNA, 19 nt, Homo sapiens
ugcacacgugugcauuugu

SEQ ID NO: 2171166 - RNA, 16 nt, Homo sapiens
ugucucuucugagcua

SEQ ID NO: 2171167 - RNA, 14 nt, Homo sapiens
acaucuacaaacag

SEQ ID NO: 2171168 - RNA, 22 nt, Homo sapiens
gauuagccucgucuuucagcga

SEQ ID NO: 2171169 - RNA, 18 nt, Homo sapiens
ucccuuuguggacaaguu

SEQ ID NO: 2171170 - RNA, 13 nt, Homo sapiens
gucccaucugccc

SEQ ID NO: 2171171 - RNA, 22 nt, Homo sapiens
aaggugcucaaagauguacuga

SEQ ID NO: 2171172 - RNA, 18 nt, Homo sapiens
augcugaauaucuguuca

SEQ ID NO: 2171173 - RNA, 20 nt, Homo sapiens
ugcccagcuuggagugccac

SEQ ID NO: 2171174 - RNA, 21 nt, Homo sapiens
uucuuuacuuaucucucaaaa

SEQ ID NO: 2171175 - RNA, 15 nt, Homo sapiens
uuaaucauuauccuu

SEQ ID NO: 2171176 - RNA, 13 nt, Homo sapiens
ccuaagcacuuua

SEQ ID NO: 2171177 - RNA, 17 nt, Homo sapiens
gaagaaaaaggacaaau

SEQ ID NO: 2171178 - RNA, 23 nt, Homo sapiens
gccuuucggcuuugggcuuuuau

SEQ ID NO: 2171179 - RNA, 21 nt, Homo sapiens
ccucugacuuaagcugccuca

SEQ ID NO: 2171180 - RNA, 14 nt, Homo sapiens
aguucucauccaca

SEQ ID NO: 2171181 - RNA, 15 nt, Homo sapiens
ccaagucaugugcau

SEQ ID NO: 2171182 - RNA, 22 nt, Homo sapiens
caaggaaacccccaguguaaua

SEQ ID NO: 2171183 - RNA, 16 nt, Homo sapiens
uccuacguauccugca

SEQ ID NO: 2171184 - RNA, 18 nt, Homo sapiens
aaagaguggaacuaucca

SEQ ID NO: 2171185 - RNA, 22 nt, Homo sapiens
acucucaauugaguuaaaucag

SEQ ID NO: 2171186 - RNA, 18 nt, Homo sapiens
uugaauggucuucugcca

SEQ ID NO: 2171187 - RNA, 13 nt, Homo sapiens
caugucauugccc

SEQ ID NO: 2171188 - RNA, 17 nt, Homo sapiens
agauuauuccaugagga

SEQ ID NO: 2171189 - RNA, 17 nt, Homo sapiens
uccuuuguugcuguugc

SEQ ID NO: 2171190 - RNA, 19 nt, Homo sapiens
aauuuaauauacugcauau

SEQ ID NO: 2171191 - RNA, 19 nt, Homo sapiens
auaagaaacuuauuucuca

SEQ ID NO: 2171192 - RNA, 16 nt, Homo sapiens
ugcaauccuuccaaau

SEQ ID NO: 2171193 - RNA, 17 nt, Homo sapiens
gggcccagcgcucuccu

SEQ ID NO: 2171194 - RNA, 20 nt, Homo sapiens
uccuucuacauguaaugaca

SEQ ID NO: 2171195 - RNA, 12 nt, Homo sapiens
caugcacaguca

SEQ ID NO: 2171196 - RNA, 20 nt, Homo sapiens
ucagacaaauguaacacaca

SEQ ID NO: 2171197 - RNA, 14 nt, Homo sapiens
aaacuguuacuguc

SEQ ID NO: 2171198 - RNA, 18 nt, Homo sapiens
guguaagggcucacacau

SEQ ID NO: 2171199 - RNA, 18 nt, Homo sapiens
aguacaaacacaggauuu

SEQ ID NO: 2171200 - RNA, 23 nt, Homo sapiens
gguggguaagacuaaaucuguaa

SEQ ID NO: 2171201 - RNA, 17 nt, Homo sapiens
gacaaauuuugcauauu

SEQ ID NO: 2171202 - RNA, 17 nt, Homo sapiens
auauuggaaaaaucaca

SEQ ID NO: 2171203 - RNA, 14 nt, Homo sapiens
uucccccacaguuu

SEQ ID NO: 2171204 - RNA, 14 nt, Homo sapiens
uacuagcaguguuu

SEQ ID NO: 2171205 - RNA, 22 nt, Homo sapiens
caagaauaccaagacaaauuca

SEQ ID NO: 2171206 - RNA, 22 nt, Homo sapiens
ucuagguaggggcccacuucac

SEQ ID NO: 2171207 - RNA, 15 nt, Homo sapiens
agugugaagugcaga

SEQ ID NO: 2171208 - RNA, 13 nt, Homo sapiens
ucaaauaaaaagu

SEQ ID NO: 2171209 - RNA, 21 nt, Homo sapiens
uuaaaaggaaauguaaaagca

SEQ ID NO: 2171210 - RNA, 18 nt, Homo sapiens
cuuuaacacagugucugg

SEQ ID NO: 2171211 - RNA, 12 nt, Homo sapiens
uauagacaccaa

SEQ ID NO: 2171212 - RNA, 10 nt, Homo sapiens
uacagcagca

SEQ ID NO: 2171213 - RNA, 19 nt, Homo sapiens
auuuccagagccagcucaa

SEQ ID NO: 2171214 - RNA, 18 nt, Homo sapiens
gaaacaugggcugugauu

SEQ ID NO: 2171215 - RNA, 16 nt, Homo sapiens
cagauuggccaauuaa

SEQ ID NO: 2171216 - RNA, 19 nt, Homo sapiens
gaaauucuauaagagacaa

SEQ ID NO: 2171217 - RNA, 14 nt, Homo sapiens
aaacgaaagcuggg

SEQ ID NO: 2171218 - RNA, 13 nt, Homo sapiens
agaccaaaaucuu

SEQ ID NO: 2171219 - RNA, 13 nt, Homo sapiens
gauagagucuugc

SEQ ID NO: 2171220 - RNA, 13 nt, Homo sapiens
caggcagugugag

SEQ ID NO: 2171221 - RNA, 17 nt, Homo sapiens
agggggcccuggcuugg

SEQ ID NO: 2171222 - RNA, 16 nt, Homo sapiens
ugauacgacagcucuc

SEQ ID NO: 2171223 - RNA, 18 nt, Homo sapiens
ugcucccccugguggugg

SEQ ID NO: 2171224 - RNA, 23 nt, Homo sapiens
caguuccccuguuugccucugaa

SEQ ID NO: 2171225 - RNA, 12 nt, Homo sapiens
aggggaccaugc

SEQ ID NO: 2171226 - RNA, 21 nt, Homo sapiens
uccucugagcuguuaucuugu

SEQ ID NO: 2171227 - RNA, 21 nt, Homo sapiens
gcccgcucugcagacugcugc

SEQ ID NO: 2171228 - RNA, 14 nt, Homo sapiens
gaaccuuccaucuc

SEQ ID NO: 2171229 - RNA, 22 nt, Homo sapiens
ccuggaauuuucagucaucuca

SEQ ID NO: 2171230 - RNA, 13 nt, Homo sapiens
guaaucugagaaa

SEQ ID NO: 2171231 - RNA, 13 nt, Homo sapiens
gggaucugaugaa

SEQ ID NO: 2171232 - RNA, 16 nt, Homo sapiens
gcccuuaaggacaaaa

SEQ ID NO: 2171233 - RNA, 21 nt, Homo sapiens
cuuuccugucugcacaaguga

SEQ ID NO: 2171234 - RNA, 22 nt, Homo sapiens
aauagugucaccaauuccacca

SEQ ID NO: 2171235 - RNA, 21 nt, Homo sapiens
agagccuucugaugucucuaa

SEQ ID NO: 2171236 - RNA, 16 nt, Homo sapiens
aauauaauuugaucuu

SEQ ID NO: 2171237 - RNA, 21 nt, Homo sapiens
accacugacagcuagacaccu

SEQ ID NO: 2171238 - RNA, 18 nt, Homo sapiens
cuuucccuuaaauaacac

SEQ ID NO: 2171239 - RNA, 21 nt, Homo sapiens
uucaaaauuccauuuacuuga

SEQ ID NO: 2171240 - RNA, 18 nt, Homo sapiens
ggcgggguuagagccaag

SEQ ID NO: 2171241 - RNA, 14 nt, Homo sapiens
ucuguuaaccaaau

SEQ ID NO: 2171242 - RNA, 14 nt, Homo sapiens
gagagccugugauc

SEQ ID NO: 2171243 - RNA, 11 nt, Homo sapiens
acccaggugau

SEQ ID NO: 2171244 - RNA, 17 nt, Homo sapiens
gcccaauuucauaacua

SEQ ID NO: 2171245 - RNA, 18 nt, Homo sapiens
accuggaauuguggggca

SEQ ID NO: 2171246 - RNA, 16 nt, Homo sapiens
aaacugaaucaagaaa

SEQ ID NO: 2171247 - RNA, 22 nt, Homo sapiens
aaagcugcugagaaucuagccu

SEQ ID NO: 2171248 - RNA, 18 nt, Homo sapiens
gugauccuuuugugccau

SEQ ID NO: 2171249 - RNA, 20 nt, Homo sapiens
auuaacuuuuauaaacuuua

SEQ ID NO: 2171250 - RNA, 18 nt, Homo sapiens
guaagggagcagacuuuu

SEQ ID NO: 2171251 - RNA, 22 nt, Homo sapiens
uguagguaaaucuaguuuacuu

SEQ ID NO: 2171252 - RNA, 17 nt, Homo sapiens
accagcccuacuccugc

SEQ ID NO: 2171253 - RNA, 18 nt, Homo sapiens
caccaagggcgcaagagu

SEQ ID NO: 2171254 - RNA, 14 nt, Homo sapiens
ggccuuuuuugcca

SEQ ID NO: 2171255 - RNA, 14 nt, Homo sapiens
guguuuuuugcuca

SEQ ID NO: 2171256 - RNA, 21 nt, Homo sapiens
acacauuuggccacaaaacac

SEQ ID NO: 2171257 - RNA, 19 nt, Homo sapiens
guacucuggagagacugug

SEQ ID NO: 2171258 - RNA, 21 nt, Homo sapiens
uacauguuuauuauguucaau

SEQ ID NO: 2171259 - RNA, 13 nt, Homo sapiens
auccacacugaga

SEQ ID NO: 2171260 - RNA, 18 nt, Homo sapiens
gucagacuuccaaauccu

SEQ ID NO: 2171261 - RNA, 17 nt, Homo sapiens
cacuucuggcuucagcc

SEQ ID NO: 2171262 - RNA, 17 nt, Homo sapiens
cauggagucacagccac

SEQ ID NO: 2171263 - RNA, 19 nt, Homo sapiens
uuaaaguuguuugugccuu

SEQ ID NO: 2171264 - RNA, 15 nt, Homo sapiens
cagcugacagccaca

SEQ ID NO: 2171265 - RNA, 18 nt, Homo sapiens
caggacucuggcacuucc

SEQ ID NO: 2171266 - RNA, 17 nt, Homo sapiens
uacuaucauucucagug

SEQ ID NO: 2171267 - RNA, 18 nt, Homo sapiens
uuaaaaguccacuuuuaa

SEQ ID NO: 2171268 - RNA, 20 nt, Homo sapiens
ugacccccaucgcucugagc

SEQ ID NO: 2171269 - RNA, 17 nt, Homo sapiens
aggauuccagaaugauc

SEQ ID NO: 2171270 - RNA, 22 nt, Homo sapiens
agcugggggagaggugaccuag

SEQ ID NO: 2171271 - RNA, 13 nt, Homo sapiens
guaauuuaugcaa

SEQ ID NO: 2171272 - RNA, 12 nt, Homo sapiens
cuaccacucaca

SEQ ID NO: 2171273 - RNA, 20 nt, Homo sapiens
aguggcaggacccugucagg

SEQ ID NO: 2171274 - RNA, 17 nt, Homo sapiens
caggccaggacucugca

SEQ ID NO: 2171275 - RNA, 19 nt, Homo sapiens
ucauagaauacucagggaa

SEQ ID NO: 2171276 - RNA, 22 nt, Homo sapiens
agaacugggcaacuauucauga

SEQ ID NO: 2171277 - RNA, 23 nt, Homo sapiens
uguccacguacuuaauuuacuua

SEQ ID NO: 2171278 - RNA, 13 nt, Homo sapiens
agcugaagugaag

SEQ ID NO: 2171279 - RNA, 16 nt, Homo sapiens
uugagugcacuaaaca

SEQ ID NO: 2171280 - RNA, 15 nt, Homo sapiens
aaaguguuaaagcuu

SEQ ID NO: 2171281 - RNA, 16 nt, Homo sapiens
aauuaucaccaugaca

SEQ ID NO: 2171282 - RNA, 23 nt, Homo sapiens
accaccugacgcugcaugagaca

SEQ ID NO: 2171283 - RNA, 19 nt, Homo sapiens
ugccccuauagaaacacca

SEQ ID NO: 2171284 - RNA, 18 nt, Homo sapiens
auucucugagcugugcag

SEQ ID NO: 2171285 - RNA, 16 nt, Homo sapiens
cuccuagggcauugua

SEQ ID NO: 2171286 - RNA, 12 nt, Homo sapiens
caaauccagugg

SEQ ID NO: 2171287 - RNA, 14 nt, Homo sapiens
cucagaauccacaa

SEQ ID NO: 2171288 - RNA, 21 nt, Homo sapiens
cuucuccucuuguagccagaa

SEQ ID NO: 2171289 - RNA, 22 nt, Homo sapiens
agggcaagcccugcccacagaa

SEQ ID NO: 2171290 - RNA, 21 nt, Homo sapiens
caguucuaaaaagauguaaua

SEQ ID NO: 2171291 - RNA, 10 nt, Homo sapiens
cucaaggugg

SEQ ID NO: 2171292 - RNA, 23 nt, Homo sapiens
auugacauguugucacauucuca

SEQ ID NO: 2171293 - RNA, 18 nt, Homo sapiens
cucguauaauauucacac

SEQ ID NO: 2171294 - RNA, 15 nt, Homo sapiens
cugcacaggcacugu

SEQ ID NO: 2171295 - RNA, 21 nt, Homo sapiens
uuugggaaugagaacaugcaa

SEQ ID NO: 2171296 - RNA, 14 nt, Homo sapiens
uguugcugccucau

SEQ ID NO: 2171297 - RNA, 13 nt, Homo sapiens
ccuccugugcuau

SEQ ID NO: 2171298 - RNA, 14 nt, Homo sapiens
cuguugaugccguu

SEQ ID NO: 2171299 - RNA, 17 nt, Homo sapiens
ugaaccaugaagucaua

SEQ ID NO: 2171300 - RNA, 13 nt, Homo sapiens
aaauucauuauuc

SEQ ID NO: 2171301 - RNA, 18 nt, Homo sapiens
gggaaggcugucuaccug

SEQ ID NO: 2171302 - RNA, 19 nt, Homo sapiens
aacagaggaguacagguga

SEQ ID NO: 2171303 - RNA, 19 nt, Homo sapiens
uaaacuuugacaguuugau

SEQ ID NO: 2171304 - RNA, 21 nt, Homo sapiens
uugccacugauuuagccaugu

SEQ ID NO: 2171305 - RNA, 15 nt, Homo sapiens
aaaccaauucaccaa

SEQ ID NO: 2171306 - RNA, 14 nt, Homo sapiens
uaagggucucucau

SEQ ID NO: 2171307 - RNA, 14 nt, Homo sapiens
uggugggcauguga

SEQ ID NO: 2171308 - RNA, 15 nt, Homo sapiens
cagcuuuaucuguca

SEQ ID NO: 2171309 - RNA, 20 nt, Homo sapiens
guaccuucucaccugugaga

SEQ ID NO: 2171310 - RNA, 12 nt, Homo sapiens
cucauuaauucu

SEQ ID NO: 2171311 - RNA, 23 nt, Homo sapiens
uccacuauuauagaaauucugaa

SEQ ID NO: 2171312 - RNA, 16 nt, Homo sapiens
agcgauggcagugaga

SEQ ID NO: 2171313 - RNA, 23 nt, Homo sapiens
cauggauauguuauacugaacca

SEQ ID NO: 2171314 - RNA, 18 nt, Homo sapiens
ccauuucagcuguuucac

SEQ ID NO: 2171315 - RNA, 17 nt, Homo sapiens
uacuccuuuuaaaacaa

SEQ ID NO: 2171316 - RNA, 13 nt, Homo sapiens
gcuuugcaggcuc

SEQ ID NO: 2171317 - RNA, 13 nt, Homo sapiens
ccucccgaaaaau

SEQ ID NO: 2171318 - RNA, 13 nt, Homo sapiens
caggacauaggca

SEQ ID NO: 2171319 - RNA, 19 nt, Homo sapiens
uacaaugacuuuauugcau

SEQ ID NO: 2171320 - RNA, 15 nt, Homo sapiens
gcuaccuacugauaa

SEQ ID NO: 2171321 - RNA, 22 nt, Homo sapiens
gggcacacucugccagcaaaga

SEQ ID NO: 2171322 - RNA, 23 nt, Homo sapiens
aacccccuuccccgcucuugccc

SEQ ID NO: 2171323 - RNA, 13 nt, Homo sapiens
ugccaugugaaga

SEQ ID NO: 2171324 - RNA, 19 nt, Homo sapiens
aacacaugugcagucacug

SEQ ID NO: 2171325 - RNA, 22 nt, Homo sapiens
uaucuguucuauggaccaaaug

SEQ ID NO: 2171326 - RNA, 18 nt, Homo sapiens
cacugauuguccauuuac

SEQ ID NO: 2171327 - RNA, 22 nt, Homo sapiens
ccuccccuuuucuauguugcua

SEQ ID NO: 2171328 - RNA, 21 nt, Homo sapiens
uuccuggagcccgaggcacca

SEQ ID NO: 2171329 - RNA, 13 nt, Homo sapiens
aguuauuuuuaca

SEQ ID NO: 2171330 - RNA, 19 nt, Homo sapiens
cuuucaagaagugccaguu

SEQ ID NO: 2171331 - RNA, 15 nt, Homo sapiens
gagcucuucauuuau

SEQ ID NO: 2171332 - RNA, 16 nt, Homo sapiens
cagaagggaauugcuc

SEQ ID NO: 2171333 - RNA, 14 nt, Homo sapiens
agcaaauuaguaau

SEQ ID NO: 2171334 - RNA, 14 nt, Homo sapiens
cuuucauucucucu

SEQ ID NO: 2171335 - RNA, 13 nt, Homo sapiens
gccagccuggucc

SEQ ID NO: 2171336 - RNA, 23 nt, Homo sapiens
aacacauauugauagaugcaaga

SEQ ID NO: 2171337 - RNA, 22 nt, Homo sapiens
ucagaacuauuuaaaauaaaga

SEQ ID NO: 2171338 - RNA, 16 nt, Homo sapiens
aagcccuuuauuuccu

SEQ ID NO: 2171339 - RNA, 15 nt, Homo sapiens
guucuguuaggaguu

SEQ ID NO: 2171340 - RNA, 19 nt, Homo sapiens
acuagcuuuuaaguuuuaa

SEQ ID NO: 2171341 - RNA, 23 nt, Homo sapiens
gagaaucccacauuagcuuguua

SEQ ID NO: 2171342 - RNA, 22 nt, Homo sapiens
aauguauagacucagugcacau

SEQ ID NO: 2171343 - RNA, 18 nt, Homo sapiens
uucuuuuguuacuguucu

SEQ ID NO: 2171344 - RNA, 14 nt, Homo sapiens
acuuugggcccaga

SEQ ID NO: 2171345 - RNA, 19 nt, Homo sapiens
gaaauuuugccugccauuu

SEQ ID NO: 2171346 - RNA, 19 nt, Homo sapiens
auuacccuucuuuccauuu

SEQ ID NO: 2171347 - RNA, 10 nt, Homo sapiens
uacucagcuu

SEQ ID NO: 2171348 - RNA, 20 nt, Homo sapiens
aaauuucuucgaucccaagg

SEQ ID NO: 2171349 - RNA, 15 nt, Homo sapiens
uaaaacaugcacaaa

SEQ ID NO: 2171350 - RNA, 13 nt, Homo sapiens
gaacauccuccac

SEQ ID NO: 2171351 - RNA, 23 nt, Homo sapiens
cuuaaguucuaugaagaguauua

SEQ ID NO: 2171352 - RNA, 15 nt, Homo sapiens
ccuguccagcuccaa

SEQ ID NO: 2171353 - RNA, 15 nt, Homo sapiens
augugcaguauuuau

SEQ ID NO: 2171354 - RNA, 17 nt, Homo sapiens
ggcucccagggccauga

SEQ ID NO: 2171355 - RNA, 17 nt, Homo sapiens
augcuguugauugcuaa

SEQ ID NO: 2171356 - RNA, 15 nt, Homo sapiens
uguuauuuagacuca

SEQ ID NO: 2171357 - RNA, 22 nt, Homo sapiens
uuauuuguguuuaaaugcugcu

SEQ ID NO: 2171358 - RNA, 14 nt, Homo sapiens
uaaaauauaucauc

SEQ ID NO: 2171359 - RNA, 14 nt, Homo sapiens
uaaaguaaugccuc

SEQ ID NO: 2171360 - RNA, 15 nt, Homo sapiens
caguucuacuuuuau

SEQ ID NO: 2171361 - RNA, 21 nt, Homo sapiens
ccucugacauuuauccaagac

SEQ ID NO: 2171362 - RNA, 18 nt, Homo sapiens
gucauuagacgguaccaa

SEQ ID NO: 2171363 - RNA, 13 nt, Homo sapiens
aauuugggcagcu

SEQ ID NO: 2171364 - RNA, 20 nt, Homo sapiens
ugcaggccaaaccguacugu

SEQ ID NO: 2171365 - RNA, 18 nt, Homo sapiens
ucaauaccgcucaguauu

SEQ ID NO: 2171366 - RNA, 15 nt, Homo sapiens
gaaaaaguugcaguc

SEQ ID NO: 2171367 - RNA, 17 nt, Homo sapiens
uacugucaguuguacuu

SEQ ID NO: 2171368 - RNA, 17 nt, Homo sapiens
aggcucuaauguacaau

SEQ ID NO: 2171369 - RNA, 20 nt, Homo sapiens
uuacuugcccugaacauaca

SEQ ID NO: 2171370 - RNA, 17 nt, Homo sapiens
ccuugaccagcagaucc

SEQ ID NO: 2171371 - RNA, 23 nt, Homo sapiens
aaaaccuacacacauaccuucau

SEQ ID NO: 2171372 - RNA, 14 nt, Homo sapiens
uuacaacacuuuaa

SEQ ID NO: 2171373 - RNA, 15 nt, Homo sapiens
aaacggacucagugg

SEQ ID NO: 2171374 - RNA, 10 nt, Homo sapiens
augugcaaua

SEQ ID NO: 2171375 - RNA, 20 nt, Homo sapiens
aagcugcucuccuucacucu

SEQ ID NO: 2171376 - RNA, 17 nt, Homo sapiens
cucugggaccacugggu

SEQ ID NO: 2171377 - RNA, 19 nt, Homo sapiens
cagagccucugggggaaaa

SEQ ID NO: 2171378 - RNA, 23 nt, Homo sapiens
cuccccucaaaagcuucgugcca

SEQ ID NO: 2171379 - RNA, 17 nt, Homo sapiens
caacaacaacaaaaagc

SEQ ID NO: 2171380 - RNA, 16 nt, Homo sapiens
cucaugggccuagcau

SEQ ID NO: 2171381 - RNA, 21 nt, Homo sapiens
uugucaaaaggaagucucuag

SEQ ID NO: 2171382 - RNA, 15 nt, Homo sapiens
uggaggcugcaguga

SEQ ID NO: 2171383 - RNA, 18 nt, Homo sapiens
gcccccaggggcaggacu

SEQ ID NO: 2171384 - RNA, 15 nt, Homo sapiens
cuuuaaaucaagucc

SEQ ID NO: 2171385 - RNA, 19 nt, Homo sapiens
cuucaaucucuugcacuca

SEQ ID NO: 2171386 - RNA, 13 nt, Homo sapiens
ggaauuccagucu

SEQ ID NO: 2171387 - RNA, 14 nt, Homo sapiens
aggcagugcaauau

SEQ ID NO: 2171388 - RNA, 18 nt, Homo sapiens
ccaugugauuaaguuccu

SEQ ID NO: 2171389 - RNA, 15 nt, Homo sapiens
uggcaaccuguucuu

SEQ ID NO: 2171390 - RNA, 19 nt, Homo sapiens
ggcuuaugaauauauuuaa

SEQ ID NO: 2171391 - RNA, 17 nt, Homo sapiens
aagcuuuuccuaauaaa

SEQ ID NO: 2171392 - RNA, 14 nt, Homo sapiens
ugucuuaccaaaca

SEQ ID NO: 2171393 - RNA, 16 nt, Homo sapiens
aaguuggagugcaaug

SEQ ID NO: 2171394 - RNA, 14 nt, Homo sapiens
uuacugguugacau

SEQ ID NO: 2171395 - RNA, 21 nt, Homo sapiens
caugcugcuagaucuuuauua

SEQ ID NO: 2171396 - RNA, 15 nt, Homo sapiens
cacuagcccaaugaa

SEQ ID NO: 2171397 - RNA, 21 nt, Homo sapiens
gaggguccuuuaguaccugaa

SEQ ID NO: 2171398 - RNA, 21 nt, Homo sapiens
uucuuccaucaucacuguaaa

SEQ ID NO: 2171399 - RNA, 20 nt, Homo sapiens
ccacaauccuccuggggaga

SEQ ID NO: 2171400 - RNA, 21 nt, Homo sapiens
gccgggcucaguggcucacac

SEQ ID NO: 2171401 - RNA, 18 nt, Homo sapiens
cccuuguggcuugggaca

SEQ ID NO: 2171402 - RNA, 20 nt, Homo sapiens
uggaaauuguuguauaucac

SEQ ID NO: 2171403 - RNA, 17 nt, Homo sapiens
uaggaaaagugaaucuu

SEQ ID NO: 2171404 - RNA, 16 nt, Homo sapiens
acuguaaacuucugca

SEQ ID NO: 2171405 - RNA, 13 nt, Homo sapiens
uugacaguuucaa

SEQ ID NO: 2171406 - RNA, 16 nt, Homo sapiens
uauagaugugagccag

SEQ ID NO: 2171407 - RNA, 14 nt, Homo sapiens
aauaacuacuucca

SEQ ID NO: 2171408 - RNA, 23 nt, Homo sapiens
ggccaaucacugaguuuguggug

SEQ ID NO: 2171409 - RNA, 23 nt, Homo sapiens
gccagccucagaaggccccagag

SEQ ID NO: 2171410 - RNA, 21 nt, Homo sapiens
accaggcucuuccccugcucc

SEQ ID NO: 2171411 - RNA, 23 nt, Homo sapiens
acucaccaguguccccuccacug

SEQ ID NO: 2171412 - RNA, 13 nt, Homo sapiens
caguacucaguaa

SEQ ID NO: 2171413 - RNA, 18 nt, Homo sapiens
cugcgcagggcucuuuga

SEQ ID NO: 2171414 - RNA, 14 nt, Homo sapiens
gcuuacuacaguga

SEQ ID NO: 2171415 - RNA, 20 nt, Homo sapiens
cuggagugcaguggugcuau

SEQ ID NO: 2171416 - RNA, 20 nt, Homo sapiens
caaagcuguuaaacuguuag

SEQ ID NO: 2171417 - RNA, 22 nt, Homo sapiens
caauuuccaagaaugaugccuu

SEQ ID NO: 2171418 - RNA, 19 nt, Homo sapiens
uccugugcccucaccccaa

SEQ ID NO: 2171419 - RNA, 14 nt, Homo sapiens
caacuaaggacaaa

SEQ ID NO: 2171420 - RNA, 21 nt, Homo sapiens
aagggagaagggugguaaaua

SEQ ID NO: 2171421 - RNA, 17 nt, Homo sapiens
cagaccucuacaagcaa

SEQ ID NO: 2171422 - RNA, 22 nt, Homo sapiens
agugauugaagcccagugaauu

SEQ ID NO: 2171423 - RNA, 16 nt, Homo sapiens
gaacuucaccugcaaa

SEQ ID NO: 2171424 - RNA, 18 nt, Homo sapiens
ggaaccuggcaggcccug

SEQ ID NO: 2171425 - RNA, 22 nt, Homo sapiens
uucuuggcccucaguuugcagu

SEQ ID NO: 2171426 - RNA, 22 nt, Homo sapiens
uucuuauagaaccccuucugac

SEQ ID NO: 2171427 - RNA, 14 nt, Homo sapiens
ccauacuucucuca

SEQ ID NO: 2171428 - RNA, 21 nt, Homo sapiens
aacugcuggagucuggcuuua

SEQ ID NO: 2171429 - RNA, 12 nt, Homo sapiens
aagccaggguuc

SEQ ID NO: 2171430 - RNA, 19 nt, Homo sapiens
agcugucccucacuguuga

SEQ ID NO: 2171431 - RNA, 16 nt, Homo sapiens
ccuggcuggugacaga

SEQ ID NO: 2171432 - RNA, 20 nt, Homo sapiens
ucauaccuacauucaaggag

SEQ ID NO: 2171433 - RNA, 18 nt, Homo sapiens
caggucaaagauguguuc

SEQ ID NO: 2171434 - RNA, 18 nt, Homo sapiens
aucgugggccgcacuggg

SEQ ID NO: 2171435 - RNA, 16 nt, Homo sapiens
cugaguacuggaauaa

SEQ ID NO: 2171436 - RNA, 15 nt, Homo sapiens
accagaaaccuucca

SEQ ID NO: 2171437 - RNA, 21 nt, Homo sapiens
cuuuaugcaaauacaaucagc

SEQ ID NO: 2171438 - RNA, 16 nt, Homo sapiens
gaucacagacacugca

SEQ ID NO: 2171439 - RNA, 12 nt, Homo sapiens
uucuguguccuc

SEQ ID NO: 2171440 - RNA, 20 nt, Homo sapiens
uagcagaggagccauguccu

SEQ ID NO: 2171441 - RNA, 15 nt, Homo sapiens
acgagggucccgauc

SEQ ID NO: 2171442 - RNA, 19 nt, Homo sapiens
ccucaaaacaaucuuguca

SEQ ID NO: 2171443 - RNA, 14 nt, Homo sapiens
cagcccaucucaac

SEQ ID NO: 2171444 - RNA, 21 nt, Homo sapiens
aggcauguggccuuuaucuca

SEQ ID NO: 2171445 - RNA, 17 nt, Homo sapiens
auuguguuuaugcauuu

SEQ ID NO: 2171446 - RNA, 11 nt, Homo sapiens
cuuacaguggg

SEQ ID NO: 2171447 - RNA, 11 nt, Homo sapiens
aaacaaauggc

SEQ ID NO: 2171448 - RNA, 16 nt, Homo sapiens
uccucccaagcugugc

SEQ ID NO: 2171449 - RNA, 16 nt, Homo sapiens
cagguuggagugcagu

SEQ ID NO: 2171450 - RNA, 11 nt, Homo sapiens
uacuagccucu

SEQ ID NO: 2171451 - RNA, 18 nt, Homo sapiens
acauaucuaguaugaaau

SEQ ID NO: 2171452 - RNA, 20 nt, Homo sapiens
uuaucuuaaccucaaaacug

SEQ ID NO: 2171453 - RNA, 13 nt, Homo sapiens
aaccacucugugg

SEQ ID NO: 2171454 - RNA, 22 nt, Homo sapiens
ugcaugcccuccccacuucccc

SEQ ID NO: 2171455 - RNA, 13 nt, Homo sapiens
gaaaaugauuuua

SEQ ID NO: 2171456 - RNA, 12 nt, Homo sapiens
caauccugugga

SEQ ID NO: 2171457 - RNA, 16 nt, Homo sapiens
guacucacuuuuucca

SEQ ID NO: 2171458 - RNA, 21 nt, Homo sapiens
ucugcaaaggcaccugaaugu

SEQ ID NO: 2171459 - RNA, 15 nt, Homo sapiens
auuuuaauagcuuua

SEQ ID NO: 2171460 - RNA, 21 nt, Homo sapiens
auuugggaggccccuccugcc

SEQ ID NO: 2171461 - RNA, 19 nt, Homo sapiens
ggcaacccucacuguguug

SEQ ID NO: 2171462 - RNA, 15 nt, Homo sapiens
cagcgccauccugag

SEQ ID NO: 2171463 - RNA, 16 nt, Homo sapiens
ucuugaucagugugcu

SEQ ID NO: 2171464 - RNA, 15 nt, Homo sapiens
ucaacaucuagugag

SEQ ID NO: 2171465 - RNA, 16 nt, Homo sapiens
uucuugugaaaccaca

SEQ ID NO: 2171466 - RNA, 15 nt, Homo sapiens
auuaauauaagccca

SEQ ID NO: 2171467 - RNA, 16 nt, Homo sapiens
uuccugagcuuuaugg

SEQ ID NO: 2171468 - RNA, 17 nt, Homo sapiens
uuccucccauuucccau

SEQ ID NO: 2171469 - RNA, 14 nt, Homo sapiens
acuguagcuuuuag

SEQ ID NO: 2171470 - RNA, 21 nt, Homo sapiens
accaaggccucggcagaacuc

SEQ ID NO: 2171471 - RNA, 16 nt, Homo sapiens
aaccaggaaccuccuc

SEQ ID NO: 2171472 - RNA, 23 nt, Homo sapiens
cccguggccauuacugcauaaaa

SEQ ID NO: 2171473 - RNA, 15 nt, Homo sapiens
uucuguaugugacua

SEQ ID NO: 2171474 - RNA, 19 nt, Homo sapiens
guacuggagaaaauggacg

SEQ ID NO: 2171475 - RNA, 22 nt, Homo sapiens
aacaugucucuguguaguucca

SEQ ID NO: 2171476 - RNA, 18 nt, Homo sapiens
uguuccaaaagaguccau

SEQ ID NO: 2171477 - RNA, 17 nt, Homo sapiens
accaugguagccuuagg

SEQ ID NO: 2171478 - RNA, 17 nt, Homo sapiens
ccagcuacucaggaggc

SEQ ID NO: 2171479 - RNA, 17 nt, Homo sapiens
aggcugggcucagcuca

SEQ ID NO: 2171480 - RNA, 21 nt, Homo sapiens
ccguguaaauauguacauuuc

SEQ ID NO: 2171481 - RNA, 19 nt, Homo sapiens
gcuccugaacccuaugugu

SEQ ID NO: 2171482 - RNA, 23 nt, Homo sapiens
augcccacugccuguaacagcca

SEQ ID NO: 2171483 - RNA, 20 nt, Homo sapiens
aaucaccuaauuaauuucag

SEQ ID NO: 2171484 - RNA, 18 nt, Homo sapiens
acuugcccugagcacucc

SEQ ID NO: 2171485 - RNA, 16 nt, Homo sapiens
auuuucauguauaugu

SEQ ID NO: 2171486 - RNA, 16 nt, Homo sapiens
uuuagaaauuacaagu

SEQ ID NO: 2171487 - RNA, 15 nt, Homo sapiens
auagaguauaugcac

SEQ ID NO: 2171488 - RNA, 15 nt, Homo sapiens
gcuaccuugucauau

SEQ ID NO: 2171489 - RNA, 12 nt, Homo sapiens
cccaucuagcaa

SEQ ID NO: 2171490 - RNA, 13 nt, Homo sapiens
ggccucaccuuuc

SEQ ID NO: 2171491 - RNA, 14 nt, Homo sapiens
uucuugacucugaa

SEQ ID NO: 2171492 - RNA, 14 nt, Homo sapiens
uccuugacuuugaa

SEQ ID NO: 2171493 - RNA, 19 nt, Homo sapiens
uuuggcaggcuuuuuucca

SEQ ID NO: 2171494 - RNA, 14 nt, Homo sapiens
uuuuucugccuugg

SEQ ID NO: 2171495 - RNA, 14 nt, Homo sapiens
aacagccugagaaa

SEQ ID NO: 2171496 - RNA, 17 nt, Homo sapiens
caagcauuuagauguau

SEQ ID NO: 2171497 - RNA, 19 nt, Homo sapiens
aaugucugaccuagccuau

SEQ ID NO: 2171498 - RNA, 22 nt, Homo sapiens
cggcuguugauacgauugucug

SEQ ID NO: 2171499 - RNA, 20 nt, Homo sapiens
ggguaacugggguugagggc

SEQ ID NO: 2171500 - RNA, 19 nt, Homo sapiens
auaccucucuuguagcucu

SEQ ID NO: 2171501 - RNA, 12 nt, Homo sapiens
cacagugcugcc

SEQ ID NO: 2171502 - RNA, 22 nt, Homo sapiens
aaacucugcauccagagauuca

SEQ ID NO: 2171503 - RNA, 12 nt, Homo sapiens
agaaucaaagau

SEQ ID NO: 2171504 - RNA, 10 nt, Homo sapiens
ugauuuacag

SEQ ID NO: 2171505 - RNA, 17 nt, Homo sapiens
caaggcagaggcaggaa

SEQ ID NO: 2171506 - RNA, 12 nt, Homo sapiens
gucucuucaucu

SEQ ID NO: 2171507 - RNA, 16 nt, Homo sapiens
gucacucacauugaga

SEQ ID NO: 2171508 - RNA, 22 nt, Homo sapiens
ccccaccuccugucguccugcc

SEQ ID NO: 2171509 - RNA, 16 nt, Homo sapiens
ccaucucacugcagua

SEQ ID NO: 2171510 - RNA, 20 nt, Homo sapiens
cauagguauauauaugccau

SEQ ID NO: 2171511 - RNA, 19 nt, Homo sapiens
uguucuccggguguggccu

SEQ ID NO: 2171512 - RNA, 16 nt, Homo sapiens
auuuuggaucuaucac

SEQ ID NO: 2171513 - RNA, 23 nt, Homo sapiens
guucauaccuaaguacuguaaua

SEQ ID NO: 2171514 - RNA, 21 nt, Homo sapiens
ugaugcccagcucagugccac

SEQ ID NO: 2171515 - RNA, 17 nt, Homo sapiens
uccaugaucaaaaugca

SEQ ID NO: 2171516 - RNA, 21 nt, Homo sapiens
uauuauauauauauaucuaua

SEQ ID NO: 2171517 - RNA, 20 nt, Homo sapiens
aacuaagucaggauguuaac

SEQ ID NO: 2171518 - RNA, 15 nt, Homo sapiens
cuccagcagcuuucc

SEQ ID NO: 2171519 - RNA, 17 nt, Homo sapiens
ucaagagauagagacca

SEQ ID NO: 2171520 - RNA, 14 nt, Homo sapiens
gucuugccuuccac

SEQ ID NO: 2171521 - RNA, 22 nt, Homo sapiens
accuuugggucuacaaguauau

SEQ ID NO: 2171522 - RNA, 19 nt, Homo sapiens
auaggauuaaacacacaca

SEQ ID NO: 2171523 - RNA, 23 nt, Homo sapiens
ucuuuguaauacuuucuauguga

SEQ ID NO: 2171524 - RNA, 18 nt, Homo sapiens
auggcauaaccugucuca

SEQ ID NO: 2171525 - RNA, 23 nt, Homo sapiens
ccuugacucugccguuuccuaau

SEQ ID NO: 2171526 - RNA, 14 nt, Homo sapiens
gcugcaagggccag

SEQ ID NO: 2171527 - RNA, 23 nt, Homo sapiens
gaaauuugccaauuuacuuuguu

SEQ ID NO: 2171528 - RNA, 15 nt, Homo sapiens
uuaagccagcacuca

SEQ ID NO: 2171529 - RNA, 15 nt, Homo sapiens
gccagcucaccuuuu

SEQ ID NO: 2171530 - RNA, 18 nt, Homo sapiens
ccucugggcacugguaau

SEQ ID NO: 2171531 - RNA, 14 nt, Homo sapiens
aauguggauuugau

SEQ ID NO: 2171532 - RNA, 21 nt, Homo sapiens
uggggaucuagggaauucagu

SEQ ID NO: 2171533 - RNA, 15 nt, Homo sapiens
cuuguguuaugaagc

SEQ ID NO: 2171534 - RNA, 22 nt, Homo sapiens
guaugaccuaguaaacuuugua

SEQ ID NO: 2171535 - RNA, 15 nt, Homo sapiens
uuacugagaugucuu

SEQ ID NO: 2171536 - RNA, 16 nt, Homo sapiens
cuuaggauggggcucc

SEQ ID NO: 2171537 - RNA, 22 nt, Homo sapiens
agguacugucaugggcuaggca

SEQ ID NO: 2171538 - RNA, 13 nt, Homo sapiens
cuuaugauacuug

SEQ ID NO: 2171539 - RNA, 14 nt, Homo sapiens
cuccuggccucaua

SEQ ID NO: 2171540 - RNA, 21 nt, Homo sapiens
ugacuuucuguguaccacugg

SEQ ID NO: 2171541 - RNA, 23 nt, Homo sapiens
ucugccagggcagugcuagugag

SEQ ID NO: 2171542 - RNA, 14 nt, Homo sapiens
ccccaucugugaau

SEQ ID NO: 2171543 - RNA, 22 nt, Homo sapiens
gacuuuguucacuagacugugc

SEQ ID NO: 2171544 - RNA, 20 nt, Homo sapiens
uccacgaagccuuaagccau

SEQ ID NO: 2171545 - RNA, 18 nt, Homo sapiens
gaccuucuccagggacag

SEQ ID NO: 2171546 - RNA, 19 nt, Homo sapiens
cauugcgauuuaucuugcu

SEQ ID NO: 2171547 - RNA, 19 nt, Homo sapiens
uacagauugcugcuucugc

SEQ ID NO: 2171548 - RNA, 14 nt, Homo sapiens
ugauaucaguccag

SEQ ID NO: 2171549 - RNA, 23 nt, Homo sapiens
aaccuacaguuuuaacuguggau

SEQ ID NO: 2171550 - RNA, 15 nt, Homo sapiens
ccaaaugcuucuaaa

SEQ ID NO: 2171551 - RNA, 22 nt, Homo sapiens
ggcuacuaaaauauuaguguua

SEQ ID NO: 2171552 - RNA, 20 nt, Homo sapiens
cuucuccaaggagcauguca

SEQ ID NO: 2171553 - RNA, 21 nt, Homo sapiens
uguacaaauugugauguggcu

SEQ ID NO: 2171554 - RNA, 16 nt, Homo sapiens
cuugccucccuccuaa

SEQ ID NO: 2171555 - RNA, 15 nt, Homo sapiens
gugggccacagccau

SEQ ID NO: 2171556 - RNA, 17 nt, Homo sapiens
ugguggcucacaccugu

SEQ ID NO: 2171557 - RNA, 15 nt, Homo sapiens
ucagcacucagagac

SEQ ID NO: 2171558 - RNA, 15 nt, Homo sapiens
uggcuugccccagga

SEQ ID NO: 2171559 - RNA, 18 nt, Homo sapiens
ggacugugccagcacaaa

SEQ ID NO: 2171560 - RNA, 15 nt, Homo sapiens
auauuaucaucaaau

SEQ ID NO: 2171561 - RNA, 15 nt, Homo sapiens
uaaugcaauuagaua

SEQ ID NO: 2171562 - RNA, 17 nt, Homo sapiens
aguguugcuauguguac

SEQ ID NO: 2171563 - RNA, 18 nt, Homo sapiens
gucugcuuugguacuaau

SEQ ID NO: 2171564 - RNA, 13 nt, Homo sapiens
ugcaacagacugu

SEQ ID NO: 2171565 - RNA, 22 nt, Homo sapiens
gaaaauuuuacacaguucauca

SEQ ID NO: 2171566 - RNA, 15 nt, Homo sapiens
auucuuuccuaccuu

SEQ ID NO: 2171567 - RNA, 15 nt, Homo sapiens
auuuucaccuaucca

SEQ ID NO: 2171568 - RNA, 15 nt, Homo sapiens
gcucauuugaaaaug

SEQ ID NO: 2171569 - RNA, 12 nt, Homo sapiens
uccuacaaagaa

SEQ ID NO: 2171570 - RNA, 16 nt, Homo sapiens
cagguucacccagcgc

SEQ ID NO: 2171571 - RNA, 14 nt, Homo sapiens
aaguagcacaggcu

SEQ ID NO: 2171572 - RNA, 15 nt, Homo sapiens
aaaaauacaacacug

SEQ ID NO: 2171573 - RNA, 16 nt, Homo sapiens
ucuaggggugccucug

SEQ ID NO: 2171574 - RNA, 11 nt, Homo sapiens
gccuccagggc

SEQ ID NO: 2171575 - RNA, 14 nt, Homo sapiens
uucaucccacaauc

SEQ ID NO: 2171576 - RNA, 14 nt, Homo sapiens
ggaaccaugaagcu

SEQ ID NO: 2171577 - RNA, 13 nt, Homo sapiens
augguccaaaaau

SEQ ID NO: 2171578 - RNA, 19 nt, Homo sapiens
caagaaaauaagagcucag

SEQ ID NO: 2171579 - RNA, 19 nt, Homo sapiens
gucacuauucaucaaugaa

SEQ ID NO: 2171580 - RNA, 22 nt, Homo sapiens
gcccacauguguccaucccagc

SEQ ID NO: 2171581 - RNA, 23 nt, Homo sapiens
acagacaauaauuuaacaagcuc

SEQ ID NO: 2171582 - RNA, 18 nt, Homo sapiens
uaaacgguuccuggugac

SEQ ID NO: 2171583 - RNA, 20 nt, Homo sapiens
agggaagccugggugucaag

SEQ ID NO: 2171584 - RNA, 20 nt, Homo sapiens
agucacgagcccgcucugca

SEQ ID NO: 2171585 - RNA, 21 nt, Homo sapiens
ccagaggcucuaauguacaau

SEQ ID NO: 2171586 - RNA, 12 nt, Homo sapiens
uuucuugcagau

SEQ ID NO: 2171587 - RNA, 15 nt, Homo sapiens
gccagagaugcaaua

SEQ ID NO: 2171588 - RNA, 12 nt, Homo sapiens
uuaugcugucau

SEQ ID NO: 2171589 - RNA, 21 nt, Homo sapiens
aacugcagaauuuugcacagu

SEQ ID NO: 2171590 - RNA, 11 nt, Homo sapiens
ccaugagacac

SEQ ID NO: 2171591 - RNA, 18 nt, Homo sapiens
acguggugaaugugcaca

SEQ ID NO: 2171592 - RNA, 18 nt, Homo sapiens
uuaaagcaaaaaacuuca

SEQ ID NO: 2171593 - RNA, 13 nt, Homo sapiens
uagaaaugcaaaa

SEQ ID NO: 2171594 - RNA, 13 nt, Homo sapiens
uuguuaugcuauu

SEQ ID NO: 2171595 - RNA, 18 nt, Homo sapiens
accacuuucaccugggau

SEQ ID NO: 2171596 - RNA, 21 nt, Homo sapiens
cucuuguauaugaugaucugg

SEQ ID NO: 2171597 - RNA, 20 nt, Homo sapiens
augaaauaaagucaaaucaa

SEQ ID NO: 2171598 - RNA, 18 nt, Homo sapiens
agacaggaggauugccug

SEQ ID NO: 2171599 - RNA, 15 nt, Homo sapiens
acccccagcucaaug

SEQ ID NO: 2171600 - RNA, 16 nt, Homo sapiens
uaaauguauuggcaca

SEQ ID NO: 2171601 - RNA, 13 nt, Homo sapiens
aucugucuuguca

SEQ ID NO: 2171602 - RNA, 13 nt, Homo sapiens
cacaugugcugca

SEQ ID NO: 2171603 - RNA, 15 nt, Homo sapiens
cuuaacaagacuuuu

SEQ ID NO: 2171604 - RNA, 19 nt, Homo sapiens
aagcauuaccacucaggca

SEQ ID NO: 2171605 - RNA, 12 nt, Homo sapiens
uaacauguguau

SEQ ID NO: 2171606 - RNA, 14 nt, Homo sapiens
ucaaaaagaacaac

SEQ ID NO: 2171607 - RNA, 12 nt, Homo sapiens
ugaaagaugcaa

SEQ ID NO: 2171608 - RNA, 21 nt, Homo sapiens
acacauuagauguuacugugu

SEQ ID NO: 2171609 - RNA, 16 nt, Homo sapiens
ggauugcuaugaauga

SEQ ID NO: 2171610 - RNA, 22 nt, Homo sapiens
uagcuauuuauagaaagcuuca

SEQ ID NO: 2171611 - RNA, 23 nt, Homo sapiens
aggcuccagaaauguuugcugag

SEQ ID NO: 2171612 - RNA, 18 nt, Homo sapiens
cuuauuggccaaaugccu

SEQ ID NO: 2171613 - RNA, 10 nt, Homo sapiens
agaucacugc

SEQ ID NO: 2171614 - RNA, 23 nt, Homo sapiens
cuguaaucccagcuauuugggag

SEQ ID NO: 2171615 - RNA, 23 nt, Homo sapiens
aggaauggaggcucuaauugaau

SEQ ID NO: 2171616 - RNA, 16 nt, Homo sapiens
gcccuguugugccaca

SEQ ID NO: 2171617 - RNA, 20 nt, Homo sapiens
agacuuuaccacuaugcaau

SEQ ID NO: 2171618 - RNA, 18 nt, Homo sapiens
ugcauuuuuacuugacag

SEQ ID NO: 2171619 - RNA, 11 nt, Homo sapiens
cacaggcaaug

SEQ ID NO: 2171620 - RNA, 17 nt, Homo sapiens
cccuaagaacuuugaga

SEQ ID NO: 2171621 - RNA, 22 nt, Homo sapiens
auugcucccuaccagcugaaca

SEQ ID NO: 2171622 - RNA, 17 nt, Homo sapiens
gugguggcuagagggaa

SEQ ID NO: 2171623 - RNA, 16 nt, Homo sapiens
ugaguggagguuuaua

SEQ ID NO: 2171624 - RNA, 19 nt, Homo sapiens
uggcacuugccuguagucu

SEQ ID NO: 2171625 - RNA, 23 nt, Homo sapiens
uucccuaucugcaaaaugggaug

SEQ ID NO: 2171626 - RNA, 19 nt, Homo sapiens
ucuccuaaaguacugggau

SEQ ID NO: 2171627 - RNA, 22 nt, Homo sapiens
aacgggacccccuggcccugcc

SEQ ID NO: 2171628 - RNA, 22 nt, Homo sapiens
guagccuuagagcaucucugcc

SEQ ID NO: 2171629 - RNA, 21 nt, Homo sapiens
gcaggcagccccacacccgcc

SEQ ID NO: 2171630 - RNA, 19 nt, Homo sapiens
uaauagucaauuucuacuu

SEQ ID NO: 2171631 - RNA, 19 nt, Homo sapiens
ugggaacaggguuacugua

SEQ ID NO: 2171632 - RNA, 18 nt, Homo sapiens
uaguguuguggacacugc

SEQ ID NO: 2171633 - RNA, 17 nt, Homo sapiens
aauggcgugaaccuggg

SEQ ID NO: 2171634 - RNA, 14 nt, Homo sapiens
gugcaaaguauaaa

SEQ ID NO: 2171635 - RNA, 18 nt, Homo sapiens
cugagaaauguuaaaggu

SEQ ID NO: 2171636 - RNA, 21 nt, Homo sapiens
aauaugucaaaggucuaaaaa

SEQ ID NO: 2171637 - RNA, 17 nt, Homo sapiens
acucaugucuuucucag

SEQ ID NO: 2171638 - RNA, 22 nt, Homo sapiens
gcaucuuuguugcuuauuacau

SEQ ID NO: 2171639 - RNA, 17 nt, Homo sapiens
auuccuuacuugcacug

SEQ ID NO: 2171640 - RNA, 13 nt, Homo sapiens
uaauaugucuuca

SEQ ID NO: 2171641 - RNA, 17 nt, Homo sapiens
cuuucggaauuccugca

SEQ ID NO: 2171642 - RNA, 23 nt, Homo sapiens
accagccucaucaacacagugaa

SEQ ID NO: 2171643 - RNA, 15 nt, Homo sapiens
cauauuaaucccucg

SEQ ID NO: 2171644 - RNA, 15 nt, Homo sapiens
caaaauuacuggaca

SEQ ID NO: 2171645 - RNA, 14 nt, Homo sapiens
accaaugucauaac

SEQ ID NO: 2171646 - RNA, 11 nt, Homo sapiens
uucugacccac

SEQ ID NO: 2171647 - RNA, 18 nt, Homo sapiens
uaguuauuuuauaaucaa

SEQ ID NO: 2171648 - RNA, 20 nt, Homo sapiens
aguccacaucuucucagugu

SEQ ID NO: 2171649 - RNA, 16 nt, Homo sapiens
gcagacucacuguggg

SEQ ID NO: 2171650 - RNA, 14 nt, Homo sapiens
ugucaggggcuccc

SEQ ID NO: 2171651 - RNA, 17 nt, Homo sapiens
ggcaguccagccagcuc

SEQ ID NO: 2171652 - RNA, 11 nt, Homo sapiens
cuucuugucag

SEQ ID NO: 2171653 - RNA, 13 nt, Homo sapiens
cacagucauuucu

SEQ ID NO: 2171654 - RNA, 17 nt, Homo sapiens
aaagacauucuuccaaa

SEQ ID NO: 2171655 - RNA, 13 nt, Homo sapiens
uaaugcaaugcau

SEQ ID NO: 2171656 - RNA, 22 nt, Homo sapiens
aaaugcaauguaagcauacuuu

SEQ ID NO: 2171657 - RNA, 20 nt, Homo sapiens
uuucagauguggcaauucag

SEQ ID NO: 2171658 - RNA, 12 nt, Homo sapiens
aaccugcuuccu

SEQ ID NO: 2171659 - RNA, 17 nt, Homo sapiens
caacuaucucauuucca

SEQ ID NO: 2171660 - RNA, 21 nt, Homo sapiens
augcagcaaggggacaucuua

SEQ ID NO: 2171661 - RNA, 16 nt, Homo sapiens
agaccuccaccuccuc

SEQ ID NO: 2171662 - RNA, 18 nt, Homo sapiens
ugaaagaguagugcauuu

SEQ ID NO: 2171663 - RNA, 13 nt, Homo sapiens
aauaaccaaaaaa

SEQ ID NO: 2171664 - RNA, 19 nt, Homo sapiens
agucggcuuguucuugcag

SEQ ID NO: 2171665 - RNA, 13 nt, Homo sapiens
uucacagugcaag

SEQ ID NO: 2171666 - RNA, 14 nt, Homo sapiens
gaaaggaucacaga

SEQ ID NO: 2171667 - RNA, 21 nt, Homo sapiens
agagaaaucaccaaaugcuuu

SEQ ID NO: 2171668 - RNA, 17 nt, Homo sapiens
gaugaagcacacaggaa

SEQ ID NO: 2171669 - RNA, 16 nt, Homo sapiens
ucauuuugcauucaaa

SEQ ID NO: 2171670 - RNA, 18 nt, Homo sapiens
uucugaauguuaaacuac

SEQ ID NO: 2171671 - RNA, 19 nt, Homo sapiens
aauuuuucagcuccuucaa

SEQ ID NO: 2171672 - RNA, 19 nt, Homo sapiens
cugagggaauuuaaccagc

SEQ ID NO: 2171673 - RNA, 17 nt, Homo sapiens
aaaccuuaaaacagcug

SEQ ID NO: 2171674 - RNA, 21 nt, Homo sapiens
uggaggaacugcuugugcacu

SEQ ID NO: 2171675 - RNA, 19 nt, Homo sapiens
aaguucugaagaugaugcg

SEQ ID NO: 2171676 - RNA, 14 nt, Homo sapiens
ugaccaucugugac

SEQ ID NO: 2171677 - RNA, 18 nt, Homo sapiens
aggcggauggcugugacc

SEQ ID NO: 2171678 - RNA, 18 nt, Homo sapiens
cugucacaggcuggguca

SEQ ID NO: 2171679 - RNA, 16 nt, Homo sapiens
aaccucuucaugagcu

SEQ ID NO: 2171680 - RNA, 19 nt, Homo sapiens
cuuggagccccagugccaa

SEQ ID NO: 2171681 - RNA, 17 nt, Homo sapiens
cacaugcaucaucagcc

SEQ ID NO: 2171682 - RNA, 17 nt, Homo sapiens
uuccaaaccaacaaacc

SEQ ID NO: 2171683 - RNA, 15 nt, Homo sapiens
uuauaaauagcauuu

SEQ ID NO: 2171684 - RNA, 17 nt, Homo sapiens
aaacuucacuccaaaga

SEQ ID NO: 2171685 - RNA, 22 nt, Homo sapiens
ugccucugagagcaucaggccu

SEQ ID NO: 2171686 - RNA, 21 nt, Homo sapiens
agcaggauaaacauuccagag

SEQ ID NO: 2171687 - RNA, 22 nt, Homo sapiens
caguuguagcagaaaccaacaa

SEQ ID NO: 2171688 - RNA, 15 nt, Homo sapiens
ugaggaccacuccug

SEQ ID NO: 2171689 - RNA, 15 nt, Homo sapiens
agaccugcucuggac

SEQ ID NO: 2171690 - RNA, 18 nt, Homo sapiens
auggaugggggaacucag

SEQ ID NO: 2171691 - RNA, 19 nt, Homo sapiens
gauccuaagcaucuaaguu

SEQ ID NO: 2171692 - RNA, 19 nt, Homo sapiens
auacaugaaucauagccaa

SEQ ID NO: 2171693 - RNA, 19 nt, Homo sapiens
acagcccaacagcuguucc

SEQ ID NO: 2171694 - RNA, 20 nt, Homo sapiens
uuguccugcccuguggaaug

SEQ ID NO: 2171695 - RNA, 12 nt, Homo sapiens
uaagcuuuuugg

SEQ ID NO: 2171696 - RNA, 12 nt, Homo sapiens
cagucuuucuau

SEQ ID NO: 2171697 - RNA, 12 nt, Homo sapiens
uaaacuuuuuga

SEQ ID NO: 2171698 - RNA, 23 nt, Homo sapiens
uggauuuuaagcaaaagcaucca

SEQ ID NO: 2171699 - RNA, 19 nt, Homo sapiens
cugagcguuuaaaguacug

SEQ ID NO: 2171700 - RNA, 21 nt, Homo sapiens
cccuaccagacacugcugcug

SEQ ID NO: 2171701 - RNA, 19 nt, Homo sapiens
gaguguuuuaaaacauuca

SEQ ID NO: 2171702 - RNA, 15 nt, Homo sapiens
ccuugugucucauau

SEQ ID NO: 2171703 - RNA, 23 nt, Homo sapiens
ugaaugaaauauaaacugugaga

SEQ ID NO: 2171704 - RNA, 19 nt, Homo sapiens
guuugauucaaagcccuua

SEQ ID NO: 2171705 - RNA, 18 nt, Homo sapiens
uugaugccacccagaacu

SEQ ID NO: 2171706 - RNA, 20 nt, Homo sapiens
gaaaacugccacaagcacaa

SEQ ID NO: 2171707 - RNA, 21 nt, Homo sapiens
agcagggggggaaaugcauuu

SEQ ID NO: 2171708 - RNA, 16 nt, Homo sapiens
uaaauauuagugcagu

SEQ ID NO: 2171709 - RNA, 18 nt, Homo sapiens
cuuugagcugagugcuga

SEQ ID NO: 2171710 - RNA, 21 nt, Homo sapiens
uuuccaccaucaaaugcugua

SEQ ID NO: 2171711 - RNA, 21 nt, Homo sapiens
gccugaagagcgagacucugu

SEQ ID NO: 2171712 - RNA, 17 nt, Homo sapiens
uccaaagcugaagacuu

SEQ ID NO: 2171713 - RNA, 15 nt, Homo sapiens
gccagcuaucugccu

SEQ ID NO: 2171714 - RNA, 21 nt, Homo sapiens
ccagaguuccccaugcagaca

SEQ ID NO: 2171715 - RNA, 18 nt, Homo sapiens
cacuuuugcuugaauuua

SEQ ID NO: 2171716 - RNA, 16 nt, Homo sapiens
ugacacuucaagguga

SEQ ID NO: 2171717 - RNA, 17 nt, Homo sapiens
uuuguagacauuuugaa

SEQ ID NO: 2171718 - RNA, 16 nt, Homo sapiens
aucuggcucaccgggu

SEQ ID NO: 2171719 - RNA, 15 nt, Homo sapiens
agcgucugugcauuu

SEQ ID NO: 2171720 - RNA, 22 nt, Homo sapiens
aacauuaucuaguucauugaau

SEQ ID NO: 2171721 - RNA, 19 nt, Homo sapiens
auuugggaugaaauacuua

SEQ ID NO: 2171722 - RNA, 13 nt, Homo sapiens
auuuuaauaaaga

SEQ ID NO: 2171723 - RNA, 20 nt, Homo sapiens
auuucaaaggaaaguuuuaa

SEQ ID NO: 2171724 - RNA, 23 nt, Homo sapiens
acaucaccuuuuugacuuuucca

SEQ ID NO: 2171725 - RNA, 14 nt, Homo sapiens
ggcugggcagcuac

SEQ ID NO: 2171726 - RNA, 22 nt, Homo sapiens
gaaauaaaauauggacuuccaa

SEQ ID NO: 2171727 - RNA, 14 nt, Homo sapiens
uguaauaugcacaa

SEQ ID NO: 2171728 - RNA, 19 nt, Homo sapiens
cauuuaagcugccuguaca

SEQ ID NO: 2171729 - RNA, 15 nt, Homo sapiens
cucccuuuaguggag

SEQ ID NO: 2171730 - RNA, 19 nt, Homo sapiens
gacucuuuccuaaagccaa

SEQ ID NO: 2171731 - RNA, 18 nt, Homo sapiens
agcucuggggcagaggaa

SEQ ID NO: 2171732 - RNA, 18 nt, Homo sapiens
caggaaagaucccaaguc

SEQ ID NO: 2171733 - RNA, 16 nt, Homo sapiens
cauuauuugauaacau

SEQ ID NO: 2171734 - RNA, 21 nt, Homo sapiens
uguccucucuuuaugcuugcu

SEQ ID NO: 2171735 - RNA, 23 nt, Homo sapiens
uuccagguauuuuauaauucugg

SEQ ID NO: 2171736 - RNA, 19 nt, Homo sapiens
cauaaguaccucagcauuu

SEQ ID NO: 2171737 - RNA, 19 nt, Homo sapiens
cucauuuucaucuucuucc

SEQ ID NO: 2171738 - RNA, 12 nt, Homo sapiens
gagagccuuaac

SEQ ID NO: 2171739 - RNA, 17 nt, Homo sapiens
aaagcuagauaugccuu

SEQ ID NO: 2171740 - RNA, 20 nt, Homo sapiens
gcugauuauuuaugaccuga

SEQ ID NO: 2171741 - RNA, 14 nt, Homo sapiens
auuuauucugaaga

SEQ ID NO: 2171742 - RNA, 15 nt, Homo sapiens
acaguaaaauuaacu

SEQ ID NO: 2171743 - RNA, 15 nt, Homo sapiens
ggacuguuuccugag

SEQ ID NO: 2171744 - RNA, 15 nt, Homo sapiens
cacuccccacgggaa

SEQ ID NO: 2171745 - RNA, 12 nt, Homo sapiens
gacuuucccuga

SEQ ID NO: 2171746 - RNA, 22 nt, Homo sapiens
acuccuccagccaccacccaca

SEQ ID NO: 2171747 - RNA, 14 nt, Homo sapiens
cagacugugcaaua

SEQ ID NO: 2171748 - RNA, 15 nt, Homo sapiens
guuuuucuggugcuu

SEQ ID NO: 2171749 - RNA, 13 nt, Homo sapiens
cugugacuccccu

SEQ ID NO: 2171750 - RNA, 20 nt, Homo sapiens
gauuuauauuuagcaaaaug

SEQ ID NO: 2171751 - RNA, 21 nt, Homo sapiens
cugggcugucugucaccagcu

SEQ ID NO: 2171752 - RNA, 11 nt, Homo sapiens
uagaguggaau

SEQ ID NO: 2171753 - RNA, 19 nt, Homo sapiens
uguacgcacuggagcugca

SEQ ID NO: 2171754 - RNA, 21 nt, Homo sapiens
auguuaauuuuuugguacaaa

SEQ ID NO: 2171755 - RNA, 19 nt, Homo sapiens
ggaugcuguugagggccaa

SEQ ID NO: 2171756 - RNA, 17 nt, Homo sapiens
auaaaugcaaaugugca

SEQ ID NO: 2171757 - RNA, 17 nt, Homo sapiens
uaauaaaaauaagaaau

SEQ ID NO: 2171758 - RNA, 15 nt, Homo sapiens
agggugagaugaagu

SEQ ID NO: 2171759 - RNA, 13 nt, Homo sapiens
cuguacaguuuug

SEQ ID NO: 2171760 - RNA, 17 nt, Homo sapiens
agugaggaauggcagug

SEQ ID NO: 2171761 - RNA, 17 nt, Homo sapiens
cuuugccccacugggag

SEQ ID NO: 2171762 - RNA, 14 nt, Homo sapiens
agagcucagcuuuc

SEQ ID NO: 2171763 - RNA, 20 nt, Homo sapiens
uuauaacuugcauuacaugu

SEQ ID NO: 2171764 - RNA, 13 nt, Homo sapiens
ugagacuacaggu

SEQ ID NO: 2171765 - RNA, 12 nt, Homo sapiens
auaaaguggaaa

SEQ ID NO: 2171766 - RNA, 13 nt, Homo sapiens
ccagcagagccag

SEQ ID NO: 2171767 - RNA, 18 nt, Homo sapiens
cagaaugugucucaggaa

SEQ ID NO: 2171768 - RNA, 17 nt, Homo sapiens
acaagaccccgucucaa

SEQ ID NO: 2171769 - RNA, 12 nt, Homo sapiens
cacuuucaccag

SEQ ID NO: 2171770 - RNA, 15 nt, Homo sapiens
auaugauuguauaau

SEQ ID NO: 2171771 - RNA, 15 nt, Homo sapiens
acacggaugcacaga

SEQ ID NO: 2171772 - RNA, 21 nt, Homo sapiens
auucacccccaaacagugaca

SEQ ID NO: 2171773 - RNA, 22 nt, Homo sapiens
ucucaaaaaaaaaaaaaugcac

SEQ ID NO: 2171774 - RNA, 21 nt, Homo sapiens
cuguaaauaccauugacacau

SEQ ID NO: 2171775 - RNA, 20 nt, Homo sapiens
uuaaaaaucuuguacauuau

SEQ ID NO: 2171776 - RNA, 20 nt, Homo sapiens
agugguguuuagaaugucag

SEQ ID NO: 2171777 - RNA, 14 nt, Homo sapiens
gagaugagaagcca

SEQ ID NO: 2171778 - RNA, 23 nt, Homo sapiens
uaguguuggaaaaugugcaauau

SEQ ID NO: 2171779 - RNA, 21 nt, Homo sapiens
cuuccaaugaaaucucaggaa

SEQ ID NO: 2171780 - RNA, 17 nt, Homo sapiens
gagacuggauacugccc

SEQ ID NO: 2171781 - RNA, 18 nt, Homo sapiens
augcccacugcuggugcc

SEQ ID NO: 2171782 - RNA, 19 nt, Homo sapiens
gagaaggaaggagacucac

SEQ ID NO: 2171783 - RNA, 13 nt, Homo sapiens
uggcucugggaau

SEQ ID NO: 2171784 - RNA, 11 nt, Homo sapiens
gauucaccucu

SEQ ID NO: 2171785 - RNA, 14 nt, Homo sapiens
cuacagaugugcug

SEQ ID NO: 2171786 - RNA, 14 nt, Homo sapiens
aaugaucaacucau

SEQ ID NO: 2171787 - RNA, 14 nt, Homo sapiens
caacaacaccagaa

SEQ ID NO: 2171788 - RNA, 20 nt, Homo sapiens
gaaauagauccagugcugag

SEQ ID NO: 2171789 - RNA, 15 nt, Homo sapiens
accgucccacguggu

SEQ ID NO: 2171790 - RNA, 15 nt, Homo sapiens
caaagaaaggagaua

SEQ ID NO: 2171791 - RNA, 17 nt, Homo sapiens
aguaaggcagugcagua

SEQ ID NO: 2171792 - RNA, 12 nt, Homo sapiens
acaaugcagaua

SEQ ID NO: 2171793 - RNA, 20 nt, Homo sapiens
aagauuuaguugaguuauuc

SEQ ID NO: 2171794 - RNA, 12 nt, Homo sapiens
aaugaucuuucu

SEQ ID NO: 2171795 - RNA, 13 nt, Homo sapiens
agccagucaugga

SEQ ID NO: 2171796 - RNA, 14 nt, Homo sapiens
agucuuguguucac

SEQ ID NO: 2171797 - RNA, 17 nt, Homo sapiens
augagcucccacaagcc

SEQ ID NO: 2171798 - RNA, 19 nt, Homo sapiens
aauuauuguagacaugccc

SEQ ID NO: 2171799 - RNA, 14 nt, Homo sapiens
augggggaugcuuc

SEQ ID NO: 2171800 - RNA, 15 nt, Homo sapiens
uccuuaaaguuuucc

SEQ ID NO: 2171801 - RNA, 12 nt, Homo sapiens
gcauccugugaa

SEQ ID NO: 2171802 - RNA, 15 nt, Homo sapiens
aaaucaaaacagaga

SEQ ID NO: 2171803 - RNA, 13 nt, Homo sapiens
uucuuccacaaga

SEQ ID NO: 2171804 - RNA, 17 nt, Homo sapiens
cuuuuaucuucuagcca

SEQ ID NO: 2171805 - RNA, 19 nt, Homo sapiens
aaaaacuauuaacaacuug

SEQ ID NO: 2171806 - RNA, 17 nt, Homo sapiens
agcugauaaagccuaaa

SEQ ID NO: 2171807 - RNA, 19 nt, Homo sapiens
gccuccuggaaucaguauu

SEQ ID NO: 2171808 - RNA, 15 nt, Homo sapiens
caaaaaaauugugcc

SEQ ID NO: 2171809 - RNA, 17 nt, Homo sapiens
cccuugucgugggaugg

SEQ ID NO: 2171810 - RNA, 18 nt, Homo sapiens
augccuguguacugccuu

SEQ ID NO: 2171811 - RNA, 22 nt, Homo sapiens
gaaguagauucuggacagucag

SEQ ID NO: 2171812 - RNA, 21 nt, Homo sapiens
cacaaugucaugucugugauu

SEQ ID NO: 2171813 - RNA, 15 nt, Homo sapiens
aaaaucuucacuuuc

SEQ ID NO: 2171814 - RNA, 13 nt, Homo sapiens
auaagagauucac

SEQ ID NO: 2171815 - RNA, 20 nt, Homo sapiens
cugcacuccagccuggggga

SEQ ID NO: 2171816 - RNA, 18 nt, Homo sapiens
caggcuggagugcagugc

SEQ ID NO: 2171817 - RNA, 13 nt, Homo sapiens
auaggguggcaca

SEQ ID NO: 2171818 - RNA, 17 nt, Homo sapiens
acccaugaaucaaagac

SEQ ID NO: 2171819 - RNA, 16 nt, Homo sapiens
aacuuuucgacauauu

SEQ ID NO: 2171820 - RNA, 13 nt, Homo sapiens
aaauggcacugca

SEQ ID NO: 2171821 - RNA, 20 nt, Homo sapiens
caaauugaaaacacacucaa

SEQ ID NO: 2171822 - RNA, 20 nt, Homo sapiens
cuggucccccacgugugaag

SEQ ID NO: 2171823 - RNA, 22 nt, Homo sapiens
aaugcuaaacuuggcuguaugu

SEQ ID NO: 2171824 - RNA, 19 nt, Homo sapiens
cacaauuacauacuauucu

SEQ ID NO: 2171825 - RNA, 14 nt, Homo sapiens
aauguccucuuuga

SEQ ID NO: 2171826 - RNA, 21 nt, Homo sapiens
cgcaaaagcgacucccagcuc

SEQ ID NO: 2171827 - RNA, 15 nt, Homo sapiens
ugagacuccaucuca

SEQ ID NO: 2171828 - RNA, 15 nt, Homo sapiens
caagacucugucuca

SEQ ID NO: 2171829 - RNA, 19 nt, Homo sapiens
ugacuucagaauaacagca

SEQ ID NO: 2171830 - RNA, 20 nt, Homo sapiens
ugaucugaggguauaaagac

SEQ ID NO: 2171831 - RNA, 23 nt, Homo sapiens
gugaccccggguacgagcuggcc

SEQ ID NO: 2171832 - RNA, 14 nt, Homo sapiens
ugccuucaaaucaa

SEQ ID NO: 2171833 - RNA, 13 nt, Homo sapiens
ugagcccucccca

SEQ ID NO: 2171834 - RNA, 15 nt, Homo sapiens
agcaugggaagugac

SEQ ID NO: 2171835 - RNA, 22 nt, Homo sapiens
aagcagagcggguaaagugcaa

SEQ ID NO: 2171836 - RNA, 17 nt, Homo sapiens
uggaaugucaguguuca

SEQ ID NO: 2171837 - RNA, 15 nt, Homo sapiens
uggcuaagauaccaa

SEQ ID NO: 2171838 - RNA, 13 nt, Homo sapiens
aguuacacuugac

SEQ ID NO: 2171839 - RNA, 16 nt, Homo sapiens
ucucacagauugcugc

SEQ ID NO: 2171840 - RNA, 19 nt, Homo sapiens
uuauacugauugcacaccc

SEQ ID NO: 2171841 - RNA, 19 nt, Homo sapiens
aagguggggacagggauga

SEQ ID NO: 2171842 - RNA, 15 nt, Homo sapiens
ggugccgcucucucu

SEQ ID NO: 2171843 - RNA, 20 nt, Homo sapiens
guaacuuauuuuaaauaugc

SEQ ID NO: 2171844 - RNA, 23 nt, Homo sapiens
aacuccccuguuucaaucacugu

SEQ ID NO: 2171845 - RNA, 18 nt, Homo sapiens
aagcugcacaugacuaca

SEQ ID NO: 2171846 - RNA, 20 nt, Homo sapiens
aaaauuguuuucacuuguau

SEQ ID NO: 2171847 - RNA, 18 nt, Homo sapiens
auuuuauaggcauaccuc

SEQ ID NO: 2171848 - RNA, 15 nt, Homo sapiens
gauuuaaaauaucac

SEQ ID NO: 2171849 - RNA, 21 nt, Homo sapiens
gcuggucagagagaccucauc

SEQ ID NO: 2171850 - RNA, 11 nt, Homo sapiens
ggaagcucucc

SEQ ID NO: 2171851 - RNA, 17 nt, Homo sapiens
ugggguccccuccagca

SEQ ID NO: 2171852 - RNA, 17 nt, Homo sapiens
ccuagcucuuacacaua

SEQ ID NO: 2171853 - RNA, 21 nt, Homo sapiens
ucucacccgaccggugcauga

SEQ ID NO: 2171854 - RNA, 12 nt, Homo sapiens
agagaguaccau

SEQ ID NO: 2171855 - RNA, 23 nt, Homo sapiens
aggcuaguccggacccaccucac

SEQ ID NO: 2171856 - RNA, 19 nt, Homo sapiens
ccuacaugguccauugcua

SEQ ID NO: 2171857 - RNA, 13 nt, Homo sapiens
cugaguguuguuu

SEQ ID NO: 2171858 - RNA, 20 nt, Homo sapiens
aucuugaucucccuuuccua

SEQ ID NO: 2171859 - RNA, 16 nt, Homo sapiens
cucuuccuaaguauau

SEQ ID NO: 2171860 - RNA, 21 nt, Homo sapiens
uuucuacacuuuauacuugcc

SEQ ID NO: 2171861 - RNA, 15 nt, Homo sapiens
aguuucagacuugga

SEQ ID NO: 2171862 - RNA, 13 nt, Homo sapiens
guaaaauugaaag

SEQ ID NO: 2171863 - RNA, 21 nt, Homo sapiens
aacgcaggagaaucacugcag

SEQ ID NO: 2171864 - RNA, 22 nt, Homo sapiens
uagaaagaauguguugccuccu

SEQ ID NO: 2171865 - RNA, 22 nt, Homo sapiens
aguaucauguacuacacuucug

SEQ ID NO: 2171866 - RNA, 22 nt, Homo sapiens
gccacccugcauuugugucauu

SEQ ID NO: 2171867 - RNA, 18 nt, Homo sapiens
uuucaggguccaaacaaa

SEQ ID NO: 2171868 - RNA, 19 nt, Homo sapiens
cagcacucccuuuuuuaua

SEQ ID NO: 2171869 - RNA, 18 nt, Homo sapiens
ugggugucagucagggac

SEQ ID NO: 2171870 - RNA, 22 nt, Homo sapiens
aaacaccagccgaggccacaga

SEQ ID NO: 2171871 - RNA, 14 nt, Homo sapiens
uccccagagcacug

SEQ ID NO: 2171872 - RNA, 23 nt, Homo sapiens
cucaauaaaguuccccugugaca

SEQ ID NO: 2171873 - RNA, 19 nt, Homo sapiens
ucaauaaaagagcugucug

SEQ ID NO: 2171874 - RNA, 18 nt, Homo sapiens
aucuccauuucugcucag

SEQ ID NO: 2171875 - RNA, 15 nt, Homo sapiens
auacacacaugcccu

SEQ ID NO: 2171876 - RNA, 16 nt, Homo sapiens
auaacuucagauacuu

SEQ ID NO: 2171877 - RNA, 20 nt, Homo sapiens
agaugcugcaaauaaauuca

SEQ ID NO: 2171878 - RNA, 19 nt, Homo sapiens
augaucagacauacagcug

SEQ ID NO: 2171879 - RNA, 17 nt, Homo sapiens
uguuuagcuuccuccag

SEQ ID NO: 2171880 - RNA, 15 nt, Homo sapiens
augagcauuacuauu

SEQ ID NO: 2171881 - RNA, 18 nt, Homo sapiens
gaaaacuuaguuugugaa

SEQ ID NO: 2171882 - RNA, 15 nt, Homo sapiens
uauacugacaaacca

SEQ ID NO: 2171883 - RNA, 23 nt, Homo sapiens
gaaccagccguauuuuacaugaa

SEQ ID NO: 2171884 - RNA, 13 nt, Homo sapiens
ucuucugccucag

SEQ ID NO: 2171885 - RNA, 23 nt, Homo sapiens
cuuccaauuauuacaguccuuca

SEQ ID NO: 2171886 - RNA, 22 nt, Homo sapiens
gguuucccuacugaagcccuug

SEQ ID NO: 2171887 - RNA, 21 nt, Homo sapiens
cacuguuuaaucauaguuacu

SEQ ID NO: 2171888 - RNA, 14 nt, Homo sapiens
aaucauacaguucc

SEQ ID NO: 2171889 - RNA, 14 nt, Homo sapiens
gcucucgacaguau

SEQ ID NO: 2171890 - RNA, 21 nt, Homo sapiens
agucauucuucccuaaucuuc

SEQ ID NO: 2171891 - RNA, 23 nt, Homo sapiens
auaaaaucuuucugauaaugcau

SEQ ID NO: 2171892 - RNA, 15 nt, Homo sapiens
cuauaccucauucac

SEQ ID NO: 2171893 - RNA, 23 nt, Homo sapiens
gguauaguuuugucacaauuaua

SEQ ID NO: 2171894 - RNA, 17 nt, Homo sapiens
accagccucuccacuca

SEQ ID NO: 2171895 - RNA, 14 nt, Homo sapiens
cccagauaacuuuc

SEQ ID NO: 2171896 - RNA, 13 nt, Homo sapiens
accugaaccagcc

SEQ ID NO: 2171897 - RNA, 23 nt, Homo sapiens
cuccugagauaauaaugaaggca

SEQ ID NO: 2171898 - RNA, 18 nt, Homo sapiens
agaggucccucagcugcg

SEQ ID NO: 2171899 - RNA, 17 nt, Homo sapiens
gucaucaucacauucag

SEQ ID NO: 2171900 - RNA, 19 nt, Homo sapiens
gucuguuuggacugcagaa

SEQ ID NO: 2171901 - RNA, 12 nt, Homo sapiens
ucacugcugauu

SEQ ID NO: 2171902 - RNA, 19 nt, Homo sapiens
cagagcuaacauaaaggac

SEQ ID NO: 2171903 - RNA, 22 nt, Homo sapiens
caacucugccuuuaugaugcua

SEQ ID NO: 2171904 - RNA, 17 nt, Homo sapiens
acauguacgauucacuc

SEQ ID NO: 2171905 - RNA, 16 nt, Homo sapiens
gcuuacaaaugucuag

SEQ ID NO: 2171906 - RNA, 18 nt, Homo sapiens
gaaggugacucugaccuu

SEQ ID NO: 2171907 - RNA, 19 nt, Homo sapiens
aaguuucuaguaucacaua

SEQ ID NO: 2171908 - RNA, 21 nt, Homo sapiens
gacuuagcgucaagacauuug

SEQ ID NO: 2171909 - RNA, 20 nt, Homo sapiens
auaccucaauuuucacugug

SEQ ID NO: 2171910 - RNA, 16 nt, Homo sapiens
aaacuuuaucgcucua

SEQ ID NO: 2171911 - RNA, 20 nt, Homo sapiens
auggaauuagaaauauaucu

SEQ ID NO: 2171912 - RNA, 14 nt, Homo sapiens
aggaaccagcacuc

SEQ ID NO: 2171913 - RNA, 17 nt, Homo sapiens
gagcagugccucuuguc

SEQ ID NO: 2171914 - RNA, 14 nt, Homo sapiens
ugcggaagccauag

SEQ ID NO: 2171915 - RNA, 16 nt, Homo sapiens
uagagagcuguuccca

SEQ ID NO: 2171916 - RNA, 18 nt, Homo sapiens
ugaggcaggugacaguga

SEQ ID NO: 2171917 - RNA, 22 nt, Homo sapiens
ggcccgugggagucaucucaac

SEQ ID NO: 2171918 - RNA, 20 nt, Homo sapiens
auacaaaacccuuucugccc

SEQ ID NO: 2171919 - RNA, 18 nt, Homo sapiens
ugggaucugugcccagag

SEQ ID NO: 2171920 - RNA, 14 nt, Homo sapiens
cccuuccagaccca

SEQ ID NO: 2171921 - RNA, 13 nt, Homo sapiens
cucuguacagcaa

SEQ ID NO: 2171922 - RNA, 18 nt, Homo sapiens
gcaccuaccaucagggac

SEQ ID NO: 2171923 - RNA, 17 nt, Homo sapiens
cacauagguaaaaacug

SEQ ID NO: 2171924 - RNA, 16 nt, Homo sapiens
guuucgacugguccag

SEQ ID NO: 2171925 - RNA, 16 nt, Homo sapiens
uguuuuggggcuguau

SEQ ID NO: 2171926 - RNA, 16 nt, Homo sapiens
cacuguucaaaccucu

SEQ ID NO: 2171927 - RNA, 20 nt, Homo sapiens
gcacaccuguuauugccaau

SEQ ID NO: 2171928 - RNA, 21 nt, Homo sapiens
cacaaauggaacuccccaggg

SEQ ID NO: 2171929 - RNA, 18 nt, Homo sapiens
guugcagugaauucauau

SEQ ID NO: 2171930 - RNA, 19 nt, Homo sapiens
ccgagcgggugcaagcacu

SEQ ID NO: 2171931 - RNA, 10 nt, Homo sapiens
acuguugaaa

SEQ ID NO: 2171932 - RNA, 23 nt, Homo sapiens
uucaugggccccuucaaaccuca

SEQ ID NO: 2171933 - RNA, 15 nt, Homo sapiens
cagucaccucaugga

SEQ ID NO: 2171934 - RNA, 14 nt, Homo sapiens
agccaaaaagugga

SEQ ID NO: 2171935 - RNA, 23 nt, Homo sapiens
accuaauaaauauuuagucugca

SEQ ID NO: 2171936 - RNA, 17 nt, Homo sapiens
gaugagacagacauuca

SEQ ID NO: 2171937 - RNA, 15 nt, Homo sapiens
uacaccuuuaucuca

SEQ ID NO: 2171938 - RNA, 15 nt, Homo sapiens
ugucuauuugcacaa

SEQ ID NO: 2171939 - RNA, 19 nt, Homo sapiens
agacucugagcugcucacc

SEQ ID NO: 2171940 - RNA, 18 nt, Homo sapiens
uuagagacuaaggggcag

SEQ ID NO: 2171941 - RNA, 18 nt, Homo sapiens
caacucugauguggaaug

SEQ ID NO: 2171942 - RNA, 16 nt, Homo sapiens
ugucaauaaaaccacu

SEQ ID NO: 2171943 - RNA, 15 nt, Homo sapiens
ugaaacccccaucuc

SEQ ID NO: 2171944 - RNA, 16 nt, Homo sapiens
ucauggauuauguuga

SEQ ID NO: 2171945 - RNA, 16 nt, Homo sapiens
ccauuggaaacauuua

SEQ ID NO: 2171946 - RNA, 20 nt, Homo sapiens
agcuaacccucacaagcaug

SEQ ID NO: 2171947 - RNA, 15 nt, Homo sapiens
gccacgagacgucac

SEQ ID NO: 2171948 - RNA, 16 nt, Homo sapiens
ggcuucauccuccuca

SEQ ID NO: 2171949 - RNA, 19 nt, Homo sapiens
aaacauuuuucacaucucu

SEQ ID NO: 2171950 - RNA, 14 nt, Homo sapiens
gcuggaagugccaa

SEQ ID NO: 2171951 - RNA, 20 nt, Homo sapiens
aaauaaaaaucucuuuucca

SEQ ID NO: 2171952 - RNA, 16 nt, Homo sapiens
ugauggcucauuuaca

SEQ ID NO: 2171953 - RNA, 17 nt, Homo sapiens
caggccgggguggagca

SEQ ID NO: 2171954 - RNA, 22 nt, Homo sapiens
cagugagucgagauugcacugc

SEQ ID NO: 2171955 - RNA, 14 nt, Homo sapiens
caacaaccuaugca

SEQ ID NO: 2171956 - RNA, 20 nt, Homo sapiens
aguagaaacgggguuucacc

SEQ ID NO: 2171957 - RNA, 20 nt, Homo sapiens
agcacuaccauuguacccug

SEQ ID NO: 2171958 - RNA, 16 nt, Homo sapiens
ugcuggcucaggagga

SEQ ID NO: 2171959 - RNA, 23 nt, Homo sapiens
acaucuccucuaucacauuacau

SEQ ID NO: 2171960 - RNA, 13 nt, Homo sapiens
caauuuauccaac

SEQ ID NO: 2171961 - RNA, 12 nt, Homo sapiens
ugccugugaaau

SEQ ID NO: 2171962 - RNA, 20 nt, Homo sapiens
gagaagccagcuuuccucau

SEQ ID NO: 2171963 - RNA, 22 nt, Homo sapiens
agcccugucccugcccucaggc

SEQ ID NO: 2171964 - RNA, 19 nt, Homo sapiens
agcuccccugcgccuccau

SEQ ID NO: 2171965 - RNA, 19 nt, Homo sapiens
acagaagaaaaacacugag

SEQ ID NO: 2171966 - RNA, 11 nt, Homo sapiens
uuuucaucuaa

SEQ ID NO: 2171967 - RNA, 20 nt, Homo sapiens
guuuuacagugaauuucuga

SEQ ID NO: 2171968 - RNA, 19 nt, Homo sapiens
aagucucccaauauccaau

SEQ ID NO: 2171969 - RNA, 13 nt, Homo sapiens
caucagugaaaga

SEQ ID NO: 2171970 - RNA, 14 nt, Homo sapiens
gaaauauccaggaa

SEQ ID NO: 2171971 - RNA, 21 nt, Homo sapiens
ccaaaucauacuuuuucuuug

SEQ ID NO: 2171972 - RNA, 15 nt, Homo sapiens
ugagccuaauauuug

SEQ ID NO: 2171973 - RNA, 23 nt, Homo sapiens
cuaacacacuuuauaacccaaaa

SEQ ID NO: 2171974 - RNA, 20 nt, Homo sapiens
cagauguaauuauguuuuca

SEQ ID NO: 2171975 - RNA, 15 nt, Homo sapiens
guuuccucagccuca

SEQ ID NO: 2171976 - RNA, 13 nt, Homo sapiens
agucuuguagcua

SEQ ID NO: 2171977 - RNA, 18 nt, Homo sapiens
cagaccccacacuccaug

SEQ ID NO: 2171978 - RNA, 22 nt, Homo sapiens
aacuguuaguauuaacuauuag

SEQ ID NO: 2171979 - RNA, 18 nt, Homo sapiens
cuggaagucaucucauuc

SEQ ID NO: 2171980 - RNA, 15 nt, Homo sapiens
ucugggacccacaga

SEQ ID NO: 2171981 - RNA, 21 nt, Homo sapiens
aacaugucuccuacugaggau

SEQ ID NO: 2171982 - RNA, 16 nt, Homo sapiens
cugaaaaagauggaau

SEQ ID NO: 2171983 - RNA, 17 nt, Homo sapiens
cucgcccagcggcauca

SEQ ID NO: 2171984 - RNA, 22 nt, Homo sapiens
accuucaaaauguucuauuuaa

SEQ ID NO: 2171985 - RNA, 14 nt, Homo sapiens
cuucaauggaauac

SEQ ID NO: 2171986 - RNA, 15 nt, Homo sapiens
guuauugacagcgau

SEQ ID NO: 2171987 - RNA, 16 nt, Homo sapiens
agaagccauugagcuc

SEQ ID NO: 2171988 - RNA, 23 nt, Homo sapiens
ccugccuugaaaaagacauucag

SEQ ID NO: 2171989 - RNA, 19 nt, Homo sapiens
gcaaauaaaacagugaaag

SEQ ID NO: 2171990 - RNA, 15 nt, Homo sapiens
caggccccuccaguu

SEQ ID NO: 2171991 - RNA, 12 nt, Homo sapiens
acagugccugua

SEQ ID NO: 2171992 - RNA, 12 nt, Homo sapiens
aguaugccucag

SEQ ID NO: 2171993 - RNA, 12 nt, Homo sapiens
cuacuugaugua

SEQ ID NO: 2171994 - RNA, 13 nt, Homo sapiens
aacuuugaggaua

SEQ ID NO: 2171995 - RNA, 21 nt, Homo sapiens
acccuuggcacugaugggcac

SEQ ID NO: 2171996 - RNA, 11 nt, Homo sapiens
cuaacaaaaga

SEQ ID NO: 2171997 - RNA, 17 nt, Homo sapiens
uacaauucaggcuuugg

SEQ ID NO: 2171998 - RNA, 20 nt, Homo sapiens
ucugacuauaaccuuguucc

SEQ ID NO: 2171999 - RNA, 23 nt, Homo sapiens
cuuaauggaugggcagucauuuu

SEQ ID NO: 2172000 - RNA, 13 nt, Homo sapiens
cuggcuuugcaag

SEQ ID NO: 2172001 - RNA, 17 nt, Homo sapiens
uuucucucuuacugcuu

SEQ ID NO: 2172002 - RNA, 19 nt, Homo sapiens
aacaacagucagccagcuu

SEQ ID NO: 2172003 - RNA, 18 nt, Homo sapiens
cucccugucuuagacuuu

SEQ ID NO: 2172004 - RNA, 16 nt, Homo sapiens
cauguacauacccugg

SEQ ID NO: 2172005 - RNA, 20 nt, Homo sapiens
uguagagauggggucucaca

SEQ ID NO: 2172006 - RNA, 20 nt, Homo sapiens
ccaggaaacucuugcuauug

SEQ ID NO: 2172007 - RNA, 15 nt, Homo sapiens
uuuaauaucugagaa

SEQ ID NO: 2172008 - RNA, 15 nt, Homo sapiens
accagucuauuucca

SEQ ID NO: 2172009 - RNA, 18 nt, Homo sapiens
augauuggaauauuacaa

SEQ ID NO: 2172010 - RNA, 11 nt, Homo sapiens
auaaagcauuc

SEQ ID NO: 2172011 - RNA, 14 nt, Homo sapiens
cucccccacucuau

SEQ ID NO: 2172012 - RNA, 13 nt, Homo sapiens
auacaaagugaug

SEQ ID NO: 2172013 - RNA, 18 nt, Homo sapiens
ucccuuggucuuccaugg

SEQ ID NO: 2172014 - RNA, 13 nt, Homo sapiens
gcuccuccuccau

SEQ ID NO: 2172015 - RNA, 14 nt, Homo sapiens
ucuuagacauuuau

SEQ ID NO: 2172016 - RNA, 14 nt, Homo sapiens
acccuuacuuccug

SEQ ID NO: 2172017 - RNA, 20 nt, Homo sapiens
cccaaacccuuaacugacau

SEQ ID NO: 2172018 - RNA, 23 nt, Homo sapiens
aacagcucccuaguggcuuccuc

SEQ ID NO: 2172019 - RNA, 15 nt, Homo sapiens
ccugggcuggcacag

SEQ ID NO: 2172020 - RNA, 13 nt, Homo sapiens
uucuacguuucuu

SEQ ID NO: 2172021 - RNA, 18 nt, Homo sapiens
ggagaccucuacugccuu

SEQ ID NO: 2172022 - RNA, 19 nt, Homo sapiens
cgucugggguggcucugca

SEQ ID NO: 2172023 - RNA, 13 nt, Homo sapiens
aucuuuucaaggc

SEQ ID NO: 2172024 - RNA, 14 nt, Homo sapiens
uuguaggguuucua

SEQ ID NO: 2172025 - RNA, 18 nt, Homo sapiens
cccuuacagccucugacu

SEQ ID NO: 2172026 - RNA, 21 nt, Homo sapiens
ccaaccuucuugucauugaaa

SEQ ID NO: 2172027 - RNA, 19 nt, Homo sapiens
caaguagaggcaaugcaaa

SEQ ID NO: 2172028 - RNA, 23 nt, Homo sapiens
ugaugcugggauuuacacuugag

SEQ ID NO: 2172029 - RNA, 21 nt, Homo sapiens
cauauuuauuuuuauguucuu

SEQ ID NO: 2172030 - RNA, 19 nt, Homo sapiens
aacuucuggugugauacuu

SEQ ID NO: 2172031 - RNA, 21 nt, Homo sapiens
ccuccuagaggugggcagcug

SEQ ID NO: 2172032 - RNA, 21 nt, Homo sapiens
cucaggccugaggugugugcc

SEQ ID NO: 2172033 - RNA, 21 nt, Homo sapiens
guuagaaaaauagcugugaac

SEQ ID NO: 2172034 - RNA, 16 nt, Homo sapiens
ugugagcucugguuau

SEQ ID NO: 2172035 - RNA, 19 nt, Homo sapiens
uugcaaagguuccaacugu

SEQ ID NO: 2172036 - RNA, 16 nt, Homo sapiens
aaagaaauaauacaaa

SEQ ID NO: 2172037 - RNA, 22 nt, Homo sapiens
caagccgagaugcccauucucu

SEQ ID NO: 2172038 - RNA, 20 nt, Homo sapiens
cuacgugugccccucucaug

SEQ ID NO: 2172039 - RNA, 22 nt, Homo sapiens
guuuauuccaaaugccauccag

SEQ ID NO: 2172040 - RNA, 21 nt, Homo sapiens
cguguaaaggaaaauaauguu

SEQ ID NO: 2172041 - RNA, 19 nt, Homo sapiens
ucuaguuguggacuuuucc

SEQ ID NO: 2172042 - RNA, 18 nt, Homo sapiens
gucgaugcguucacucca

SEQ ID NO: 2172043 - RNA, 17 nt, Homo sapiens
cuuggcuccacugggau

SEQ ID NO: 2172044 - RNA, 14 nt, Homo sapiens
cuaacucuggugcu

SEQ ID NO: 2172045 - RNA, 19 nt, Homo sapiens
ggcaacaggggcacaagcc

SEQ ID NO: 2172046 - RNA, 20 nt, Homo sapiens
gaaccuccuuucucuucucu

SEQ ID NO: 2172047 - RNA, 22 nt, Homo sapiens
uuugugggaucagggcauugcc

SEQ ID NO: 2172048 - RNA, 21 nt, Homo sapiens
aacuuacugcgacuaaacuua

SEQ ID NO: 2172049 - RNA, 15 nt, Homo sapiens
aguuauaucagugaa

SEQ ID NO: 2172050 - RNA, 21 nt, Homo sapiens
aaauaauagacagcaaucaaa

SEQ ID NO: 2172051 - RNA, 16 nt, Homo sapiens
cucaccuggacuccag

SEQ ID NO: 2172052 - RNA, 22 nt, Homo sapiens
ccaguuugaagacuacaugaac

SEQ ID NO: 2172053 - RNA, 15 nt, Homo sapiens
cugucuuugcauaaa

SEQ ID NO: 2172054 - RNA, 17 nt, Homo sapiens
aguggcaguguaugcuc

SEQ ID NO: 2172055 - RNA, 20 nt, Homo sapiens
auuauucaguaguggaaaug

SEQ ID NO: 2172056 - RNA, 16 nt, Homo sapiens
aauuuauuacugaaaa

SEQ ID NO: 2172057 - RNA, 12 nt, Homo sapiens
guauaauggaga

SEQ ID NO: 2172058 - RNA, 14 nt, Homo sapiens
gugaggcuucccac

SEQ ID NO: 2172059 - RNA, 22 nt, Homo sapiens
aacauuguuuuguguaacauau

SEQ ID NO: 2172060 - RNA, 13 nt, Homo sapiens
ggccuccagagac

SEQ ID NO: 2172061 - RNA, 13 nt, Homo sapiens
gugcccacaaaau

SEQ ID NO: 2172062 - RNA, 20 nt, Homo sapiens
gaauuggccagagccugugg

SEQ ID NO: 2172063 - RNA, 16 nt, Homo sapiens
uccauuucucugggac

SEQ ID NO: 2172064 - RNA, 13 nt, Homo sapiens
acaggucccucac

SEQ ID NO: 2172065 - RNA, 18 nt, Homo sapiens
ugaagagggagaagcaug

SEQ ID NO: 2172066 - RNA, 12 nt, Homo sapiens
aguaaagacagg

SEQ ID NO: 2172067 - RNA, 15 nt, Homo sapiens
guaaaggccuuuaau

SEQ ID NO: 2172068 - RNA, 12 nt, Homo sapiens
cgcucuguggau

SEQ ID NO: 2172069 - RNA, 23 nt, Homo sapiens
augauaguccaauuuuuacucag

SEQ ID NO: 2172070 - RNA, 13 nt, Homo sapiens
uaaaugcccaguu

SEQ ID NO: 2172071 - RNA, 22 nt, Homo sapiens
ugcucuuccauuucuuccacga

SEQ ID NO: 2172072 - RNA, 20 nt, Homo sapiens
uauaccuguguuucuugccu

SEQ ID NO: 2172073 - RNA, 16 nt, Homo sapiens
caauggcgugaucucg

SEQ ID NO: 2172074 - RNA, 17 nt, Homo sapiens
cacaagcaaaaucugga

SEQ ID NO: 2172075 - RNA, 21 nt, Homo sapiens
ugggggccuuguggcacucca

SEQ ID NO: 2172076 - RNA, 15 nt, Homo sapiens
ucacuaaacuuuauu

SEQ ID NO: 2172077 - RNA, 14 nt, Homo sapiens
ugaagcccagugaa

SEQ ID NO: 2172078 - RNA, 19 nt, Homo sapiens
uuuaaaaaaagagcuaaga

SEQ ID NO: 2172079 - RNA, 21 nt, Homo sapiens
gacuaagggcgcuugucccau

SEQ ID NO: 2172080 - RNA, 22 nt, Homo sapiens
uggaggaggcaagauacaacag

SEQ ID NO: 2172081 - RNA, 20 nt, Homo sapiens
guuccuuuuaacggaugguu

SEQ ID NO: 2172082 - RNA, 14 nt, Homo sapiens
gcaggcccacuguc

SEQ ID NO: 2172083 - RNA, 20 nt, Homo sapiens
uggaugauucagaaauugga

SEQ ID NO: 2172084 - RNA, 13 nt, Homo sapiens
gugacaacaugcg

SEQ ID NO: 2172085 - RNA, 21 nt, Homo sapiens
ucaaggacagccaccaagaag

SEQ ID NO: 2172086 - RNA, 22 nt, Homo sapiens
uccccaaaggccaacagcauug

SEQ ID NO: 2172087 - RNA, 10 nt, Homo sapiens
auucauucca

SEQ ID NO: 2172088 - RNA, 16 nt, Homo sapiens
ccaggcacugcugcac

SEQ ID NO: 2172089 - RNA, 22 nt, Homo sapiens
cauaucauucagaaugugcaaa

SEQ ID NO: 2172090 - RNA, 13 nt, Homo sapiens
ggcaccuguggug

SEQ ID NO: 2172091 - RNA, 19 nt, Homo sapiens
agccaaagagaaugccauu

SEQ ID NO: 2172092 - RNA, 20 nt, Homo sapiens
cuuaagguacgcuugcuugu

SEQ ID NO: 2172093 - RNA, 18 nt, Homo sapiens
uugacauaauuucacuga

SEQ ID NO: 2172094 - RNA, 20 nt, Homo sapiens
guccccccuguggucugugu

SEQ ID NO: 2172095 - RNA, 21 nt, Homo sapiens
aucucuuaaaaaaugaauuug

SEQ ID NO: 2172096 - RNA, 23 nt, Homo sapiens
auggacagacagaggaugagcuc

SEQ ID NO: 2172097 - RNA, 12 nt, Homo sapiens
aaggucucucuu

SEQ ID NO: 2172098 - RNA, 12 nt, Homo sapiens
gcagccuggcau

SEQ ID NO: 2172099 - RNA, 19 nt, Homo sapiens
auugcuguugaaagcaaaa

SEQ ID NO: 2172100 - RNA, 16 nt, Homo sapiens
agagagguuuuucuga

SEQ ID NO: 2172101 - RNA, 15 nt, Homo sapiens
aaaugggugcccgua

SEQ ID NO: 2172102 - RNA, 17 nt, Homo sapiens
agauucccagcuuccag

SEQ ID NO: 2172103 - RNA, 16 nt, Homo sapiens
ggccuggcccaaagca

SEQ ID NO: 2172104 - RNA, 17 nt, Homo sapiens
aaaauauuuuacccaaa

SEQ ID NO: 2172105 - RNA, 16 nt, Homo sapiens
cuaaaaguguaagaaa

SEQ ID NO: 2172106 - RNA, 19 nt, Homo sapiens
gacucuggguccuuccuga

SEQ ID NO: 2172107 - RNA, 15 nt, Homo sapiens
ccccucggcauucac

SEQ ID NO: 2172108 - RNA, 19 nt, Homo sapiens
acaaagcuaaauacaugga

SEQ ID NO: 2172109 - RNA, 19 nt, Homo sapiens
aaaggucauaugcacguua

SEQ ID NO: 2172110 - RNA, 13 nt, Homo sapiens
agcuggcacugac

SEQ ID NO: 2172111 - RNA, 14 nt, Homo sapiens
ugugaaauucucag

SEQ ID NO: 2172112 - RNA, 19 nt, Homo sapiens
uauuauuuacaucacuuug

SEQ ID NO: 2172113 - RNA, 16 nt, Homo sapiens
acuggaaccauuggca

SEQ ID NO: 2172114 - RNA, 13 nt, Homo sapiens
cacaguguuuuaa

SEQ ID NO: 2172115 - RNA, 12 nt, Homo sapiens
ucaccucaggcc

SEQ ID NO: 2172116 - RNA, 16 nt, Homo sapiens
ucaaagacugugaaca

SEQ ID NO: 2172117 - RNA, 13 nt, Homo sapiens
agccagugccauu

SEQ ID NO: 2172118 - RNA, 17 nt, Homo sapiens
uucuaugcaaaugccuc

SEQ ID NO: 2172119 - RNA, 21 nt, Homo sapiens
auaagaguugagauuuugcaa

SEQ ID NO: 2172120 - RNA, 23 nt, Homo sapiens
cuuggauagcuaauaaugagcua

SEQ ID NO: 2172121 - RNA, 15 nt, Homo sapiens
acauaugggaacuau

SEQ ID NO: 2172122 - RNA, 21 nt, Homo sapiens
agcuuucuuuuuaaagcuuuu

SEQ ID NO: 2172123 - RNA, 21 nt, Homo sapiens
caugggcgcaggcccagugac

SEQ ID NO: 2172124 - RNA, 18 nt, Homo sapiens
ugagcagcccagcacaac

SEQ ID NO: 2172125 - RNA, 17 nt, Homo sapiens
aucuacaugucuagaga

SEQ ID NO: 2172126 - RNA, 12 nt, Homo sapiens
ggaacacugccc

SEQ ID NO: 2172127 - RNA, 21 nt, Homo sapiens
gaaggucccaccuccauuugc

SEQ ID NO: 2172128 - RNA, 22 nt, Homo sapiens
aauugcauacaacugugcauua

SEQ ID NO: 2172129 - RNA, 18 nt, Homo sapiens
aauuuggucgugguauaa

SEQ ID NO: 2172130 - RNA, 15 nt, Homo sapiens
aauacauucacccag

SEQ ID NO: 2172131 - RNA, 15 nt, Homo sapiens
uuaaaacauguaaua

SEQ ID NO: 2172132 - RNA, 18 nt, Homo sapiens
ggcaucagaaacaucuga

SEQ ID NO: 2172133 - RNA, 15 nt, Homo sapiens
ugaggagcugacaua

SEQ ID NO: 2172134 - RNA, 13 nt, Homo sapiens
gagagcacaguga

SEQ ID NO: 2172135 - RNA, 14 nt, Homo sapiens
uguacaauaaagca

SEQ ID NO: 2172136 - RNA, 21 nt, Homo sapiens
uuuucauuagauacaguagug

SEQ ID NO: 2172137 - RNA, 15 nt, Homo sapiens
auuuugcccuugaca

SEQ ID NO: 2172138 - RNA, 21 nt, Homo sapiens
uggaugacauuaaagaagggu

SEQ ID NO: 2172139 - RNA, 18 nt, Homo sapiens
agucucugacucuugccu

SEQ ID NO: 2172140 - RNA, 21 nt, Homo sapiens
cacucccuugguggcaagagc

SEQ ID NO: 2172141 - RNA, 20 nt, Homo sapiens
aaauacgguaaggauacuuu

SEQ ID NO: 2172142 - RNA, 13 nt, Homo sapiens
gccucuauugcca

SEQ ID NO: 2172143 - RNA, 18 nt, Homo sapiens
gcucuacguuacaggugg

SEQ ID NO: 2172144 - RNA, 13 nt, Homo sapiens
gugguugucaugu

SEQ ID NO: 2172145 - RNA, 13 nt, Homo sapiens
cugcuugugaucu

SEQ ID NO: 2172146 - RNA, 17 nt, Homo sapiens
uaacugcagaguaaauu

SEQ ID NO: 2172147 - RNA, 15 nt, Homo sapiens
caacuugccaaaaug

SEQ ID NO: 2172148 - RNA, 12 nt, Homo sapiens
ccaggaauuuga

SEQ ID NO: 2172149 - RNA, 20 nt, Homo sapiens
caugguggggcaugccugua

SEQ ID NO: 2172150 - RNA, 13 nt, Homo sapiens
ggcgccuguaauu

SEQ ID NO: 2172151 - RNA, 18 nt, Homo sapiens
uuaauuagggguugcuaa

SEQ ID NO: 2172152 - RNA, 13 nt, Homo sapiens
cacuguacugcau

SEQ ID NO: 2172153 - RNA, 15 nt, Homo sapiens
ccagauguagucuca

SEQ ID NO: 2172154 - RNA, 18 nt, Homo sapiens
uuuaaaaaaacacauaau

SEQ ID NO: 2172155 - RNA, 19 nt, Homo sapiens
ccugcuggagaaaccuuca

SEQ ID NO: 2172156 - RNA, 23 nt, Homo sapiens
agaaaguguuuuauuuucaaauc

SEQ ID NO: 2172157 - RNA, 23 nt, Homo sapiens
aacaauauuguauacuaccauag

SEQ ID NO: 2172158 - RNA, 15 nt, Homo sapiens
uaaucugaacugacc

SEQ ID NO: 2172159 - RNA, 19 nt, Homo sapiens
ucccugcgccugugaugcu

SEQ ID NO: 2172160 - RNA, 13 nt, Homo sapiens
cuaggcccuguga

SEQ ID NO: 2172161 - RNA, 21 nt, Homo sapiens
agccuauuuuauaugcacaaa

SEQ ID NO: 2172162 - RNA, 14 nt, Homo sapiens
uaugcauacaguaa

SEQ ID NO: 2172163 - RNA, 15 nt, Homo sapiens
ccauuaucuauuuaa

SEQ ID NO: 2172164 - RNA, 19 nt, Homo sapiens
ugguauacauuuacuguga

SEQ ID NO: 2172165 - RNA, 16 nt, Homo sapiens
gccuuuguaagacaca

SEQ ID NO: 2172166 - RNA, 17 nt, Homo sapiens
acauggccuaugcacau

SEQ ID NO: 2172167 - RNA, 22 nt, Homo sapiens
ggccccaccugcucuuuccucc

SEQ ID NO: 2172168 - RNA, 20 nt, Homo sapiens
aaaucuuccaaagacaagaa

SEQ ID NO: 2172169 - RNA, 20 nt, Homo sapiens
cacuuucaucugagcuuuua

SEQ ID NO: 2172170 - RNA, 17 nt, Homo sapiens
cugccauaaagccauuc

SEQ ID NO: 2172171 - RNA, 22 nt, Homo sapiens
acucguucucgugacccagugg

SEQ ID NO: 2172172 - RNA, 20 nt, Homo sapiens
cugugccuucagcuguugca

SEQ ID NO: 2172173 - RNA, 19 nt, Homo sapiens
uagccagaggcucuaaugu

SEQ ID NO: 2172174 - RNA, 23 nt, Homo sapiens
uucagccauucacaacacaauca

SEQ ID NO: 2172175 - RNA, 22 nt, Homo sapiens
auuauaaaaucuuuccaucuca

SEQ ID NO: 2172176 - RNA, 15 nt, Homo sapiens
gaaagcaucacugcc

SEQ ID NO: 2172177 - RNA, 18 nt, Homo sapiens
aauguauucauauuacaa

SEQ ID NO: 2172178 - RNA, 12 nt, Homo sapiens
acugaccaaauc

SEQ ID NO: 2172179 - RNA, 12 nt, Homo sapiens
acggaccaaagc

SEQ ID NO: 2172180 - RNA, 17 nt, Homo sapiens
uccaaggguacuaagga

SEQ ID NO: 2172181 - RNA, 14 nt, Homo sapiens
uguaccacugggau

SEQ ID NO: 2172182 - RNA, 17 nt, Homo sapiens
ugaccaggcgcccggga

SEQ ID NO: 2172183 - RNA, 17 nt, Homo sapiens
uaaaugccaacauaccc

SEQ ID NO: 2172184 - RNA, 21 nt, Homo sapiens
gcacaauguggauuuggggac

SEQ ID NO: 2172185 - RNA, 13 nt, Homo sapiens
ccauuucaaagac

SEQ ID NO: 2172186 - RNA, 13 nt, Homo sapiens
cauauaauguugu

SEQ ID NO: 2172187 - RNA, 21 nt, Homo sapiens
gggaucacacccacgggugcu

SEQ ID NO: 2172188 - RNA, 16 nt, Homo sapiens
ugagaccuccacucca

SEQ ID NO: 2172189 - RNA, 13 nt, Homo sapiens
cuauccugggacc

SEQ ID NO: 2172190 - RNA, 15 nt, Homo sapiens
gcccuuggagcugcc

SEQ ID NO: 2172191 - RNA, 18 nt, Homo sapiens
agugaaaggaagauaaac

SEQ ID NO: 2172192 - RNA, 14 nt, Homo sapiens
acuuucccucugca

SEQ ID NO: 2172193 - RNA, 14 nt, Homo sapiens
uuuuccccauugua

SEQ ID NO: 2172194 - RNA, 19 nt, Homo sapiens
cagcccaggaagucucauc

SEQ ID NO: 2172195 - RNA, 16 nt, Homo sapiens
cacagggcggugcuag

SEQ ID NO: 2172196 - RNA, 14 nt, Homo sapiens
caugaaauuguuca

SEQ ID NO: 2172197 - RNA, 15 nt, Homo sapiens
ggcaguuccauuuca

SEQ ID NO: 2172198 - RNA, 14 nt, Homo sapiens
cucggggucccugg

SEQ ID NO: 2172199 - RNA, 12 nt, Homo sapiens
cacacagguguu

SEQ ID NO: 2172200 - RNA, 17 nt, Homo sapiens
acugcccccuccacugg

SEQ ID NO: 2172201 - RNA, 22 nt, Homo sapiens
agccuaugaggggguuuggcac

SEQ ID NO: 2172202 - RNA, 18 nt, Homo sapiens
ccugguacugagguuggg

SEQ ID NO: 2172203 - RNA, 16 nt, Homo sapiens
uaccuugaacaaucaa

SEQ ID NO: 2172204 - RNA, 16 nt, Homo sapiens
ugcaguauaaauaacu

SEQ ID NO: 2172205 - RNA, 12 nt, Homo sapiens
ucuacuagucaa

SEQ ID NO: 2172206 - RNA, 20 nt, Homo sapiens
aaauaauagccauccuuggc

SEQ ID NO: 2172207 - RNA, 17 nt, Homo sapiens
acuauaauuugacuuga

SEQ ID NO: 2172208 - RNA, 13 nt, Homo sapiens
cauugaugacccu

SEQ ID NO: 2172209 - RNA, 15 nt, Homo sapiens
auuccuaugacaaaa

SEQ ID NO: 2172210 - RNA, 21 nt, Homo sapiens
guuuggacuuuuauuuuggca

SEQ ID NO: 2172211 - RNA, 16 nt, Homo sapiens
auuauuggacagucuc

SEQ ID NO: 2172212 - RNA, 18 nt, Homo sapiens
caggucucccuggaucag

SEQ ID NO: 2172213 - RNA, 18 nt, Homo sapiens
caacccucucaggugacc

SEQ ID NO: 2172214 - RNA, 12 nt, Homo sapiens
ggaaccaaacac

SEQ ID NO: 2172215 - RNA, 14 nt, Homo sapiens
caguaaauaccuug

SEQ ID NO: 2172216 - RNA, 20 nt, Homo sapiens
uucagcuauuuagugauaua

SEQ ID NO: 2172217 - RNA, 17 nt, Homo sapiens
aacaaaucauuucuaaa

SEQ ID NO: 2172218 - RNA, 19 nt, Homo sapiens
auucugcuuccacaugugc

SEQ ID NO: 2172219 - RNA, 15 nt, Homo sapiens
ugaaaaaaacauauc

SEQ ID NO: 2172220 - RNA, 23 nt, Homo sapiens
cugcaggugggacuuuguuguuu

SEQ ID NO: 2172221 - RNA, 20 nt, Homo sapiens
gcaaugacucaggacauccc

SEQ ID NO: 2172222 - RNA, 14 nt, Homo sapiens
uacauuaugcuuga

SEQ ID NO: 2172223 - RNA, 13 nt, Homo sapiens
agccaagcacagu

SEQ ID NO: 2172224 - RNA, 17 nt, Homo sapiens
gugcacaggccucugcc

SEQ ID NO: 2172225 - RNA, 15 nt, Homo sapiens
uucugcccuccagag

SEQ ID NO: 2172226 - RNA, 16 nt, Homo sapiens
gucaacagcgugcagg

SEQ ID NO: 2172227 - RNA, 12 nt, Homo sapiens
aaguuacuugaa

SEQ ID NO: 2172228 - RNA, 20 nt, Homo sapiens
acgcuuaaaggugucuuccu

SEQ ID NO: 2172229 - RNA, 14 nt, Homo sapiens
gugcauuaaacaaa

SEQ ID NO: 2172230 - RNA, 20 nt, Homo sapiens
gugacaaaaugauacuguga

SEQ ID NO: 2172231 - RNA, 18 nt, Homo sapiens
ugcaguuccaaaagagaa

SEQ ID NO: 2172232 - RNA, 14 nt, Homo sapiens
agagauucauuauu

SEQ ID NO: 2172233 - RNA, 16 nt, Homo sapiens
uuaccagguucacuua

SEQ ID NO: 2172234 - RNA, 22 nt, Homo sapiens
uggauuuuacauguggcccaac

SEQ ID NO: 2172235 - RNA, 21 nt, Homo sapiens
cccugcagagccaauggugca

SEQ ID NO: 2172236 - RNA, 21 nt, Homo sapiens
ugcauguuacauaagauaaau

SEQ ID NO: 2172237 - RNA, 17 nt, Homo sapiens
auagguugagcaauuuc

SEQ ID NO: 2172238 - RNA, 21 nt, Homo sapiens
aagguuuuaaccgcacaugca

SEQ ID NO: 2172239 - RNA, 20 nt, Homo sapiens
gagagucccacugccucagg

SEQ ID NO: 2172240 - RNA, 10 nt, Homo sapiens
ccucuucucu

SEQ ID NO: 2172241 - RNA, 21 nt, Homo sapiens
cauccugccacaggacccaga

SEQ ID NO: 2172242 - RNA, 16 nt, Homo sapiens
aaguagacauggaauu

SEQ ID NO: 2172243 - RNA, 19 nt, Homo sapiens
ggguuuacagucuauuuga

SEQ ID NO: 2172244 - RNA, 16 nt, Homo sapiens
cagcucugggaacuga

SEQ ID NO: 2172245 - RNA, 23 nt, Homo sapiens
ggugaugaaaauguaacuugaaa

SEQ ID NO: 2172246 - RNA, 14 nt, Homo sapiens
ugaccucaggugau

SEQ ID NO: 2172247 - RNA, 14 nt, Homo sapiens
gaagcccauaucac

SEQ ID NO: 2172248 - RNA, 22 nt, Homo sapiens
auccuggaaggaaacugucugu

SEQ ID NO: 2172249 - RNA, 23 nt, Homo sapiens
ccagcaucugaagacucaggcag

SEQ ID NO: 2172250 - RNA, 21 nt, Homo sapiens
gauucaucuauggagggcaga

SEQ ID NO: 2172251 - RNA, 16 nt, Homo sapiens
ugcucauaugaacuuu

SEQ ID NO: 2172252 - RNA, 18 nt, Homo sapiens
cggaugaagauauggaau

SEQ ID NO: 2172253 - RNA, 14 nt, Homo sapiens
accguuguuugcaa

SEQ ID NO: 2172254 - RNA, 16 nt, Homo sapiens
ccucucggugaccucc

SEQ ID NO: 2172255 - RNA, 15 nt, Homo sapiens
caaagacuuaacugg

SEQ ID NO: 2172256 - RNA, 22 nt, Homo sapiens
auuugcuauagaaaacaauaca

SEQ ID NO: 2172257 - RNA, 17 nt, Homo sapiens
ggcaaaaauaaugacau

SEQ ID NO: 2172258 - RNA, 15 nt, Homo sapiens
aguauugcaugcuca

SEQ ID NO: 2172259 - RNA, 16 nt, Homo sapiens
augauaguuaaacuac

SEQ ID NO: 2172260 - RNA, 14 nt, Homo sapiens
agacagaaagcaga

SEQ ID NO: 2172261 - RNA, 19 nt, Homo sapiens
cauuggacacguggugcau

SEQ ID NO: 2172262 - RNA, 23 nt, Homo sapiens
guuuucauuuacaggaaauugca

SEQ ID NO: 2172263 - RNA, 24 nt, Homo sapiens
uggagcugagcagguguucuucau

SEQ ID NO: 2172264 - RNA, 14 nt, Homo sapiens
uuuacaggcaaaga

SEQ ID NO: 2172265 - RNA, 22 nt, Homo sapiens
ugacugcuaguuuauauagaaa

SEQ ID NO: 2172266 - RNA, 21 nt, Homo sapiens
ccaacacugcugcuccagugc

SEQ ID NO: 2172267 - RNA, 14 nt, Homo sapiens
uccugggcacccca

SEQ ID NO: 2172268 - RNA, 23 nt, Homo sapiens
gcaaucuaaucugaacugaccuu

SEQ ID NO: 2172269 - RNA, 19 nt, Homo sapiens
cauuucccacccuccaucu

SEQ ID NO: 2172270 - RNA, 22 nt, Homo sapiens
gcucaccucuucuuuaccagaa

SEQ ID NO: 2172271 - RNA, 14 nt, Homo sapiens
agccagugccauuc

SEQ ID NO: 2172272 - RNA, 19 nt, Homo sapiens
gcaugagaaagaauuugag

SEQ ID NO: 2172273 - RNA, 21 nt, Homo sapiens
acaacuugcuacugacuggac

SEQ ID NO: 2172274 - RNA, 17 nt, Homo sapiens
aaacacucgugugccca

SEQ ID NO: 2172275 - RNA, 13 nt, Homo sapiens
uguuucaguguga

SEQ ID NO: 2172276 - RNA, 18 nt, Homo sapiens
ucuaggcaucccagggga

SEQ ID NO: 2172277 - RNA, 14 nt, Homo sapiens
uaugugaagcccag

SEQ ID NO: 2172278 - RNA, 11 nt, Homo sapiens
guacaacugaa

SEQ ID NO: 2172279 - RNA, 15 nt, Homo sapiens
cugaaaaaugcaaau

SEQ ID NO: 2172280 - RNA, 17 nt, Homo sapiens
gcauaaauauuagcaaa

SEQ ID NO: 2172281 - RNA, 16 nt, Homo sapiens
ggccacccccauggaa

SEQ ID NO: 2172282 - RNA, 13 nt, Homo sapiens
cagggcaucccau

SEQ ID NO: 2172283 - RNA, 15 nt, Homo sapiens
gacacauaugcaccu

SEQ ID NO: 2172284 - RNA, 19 nt, Homo sapiens
caauaaaaacaacuuucac

SEQ ID NO: 2172285 - RNA, 11 nt, Homo sapiens
ggcacugggau

SEQ ID NO: 2172286 - RNA, 20 nt, Homo sapiens
cuucaucuugacauguaaug

SEQ ID NO: 2172287 - RNA, 16 nt, Homo sapiens
gcuacaaaaacacagc

SEQ ID NO: 2172288 - RNA, 20 nt, Homo sapiens
uuguauauuuuuuucuuaau

SEQ ID NO: 2172289 - RNA, 20 nt, Homo sapiens
agcugcugucaggucugaua

SEQ ID NO: 2172290 - RNA, 15 nt, Homo sapiens
auuuguaaaagcuaa

SEQ ID NO: 2172291 - RNA, 23 nt, Homo sapiens
auccugcugcaugaccuaucagu

SEQ ID NO: 2172292 - RNA, 18 nt, Homo sapiens
caaguccaagcauaccaa

SEQ ID NO: 2172293 - RNA, 14 nt, Homo sapiens
aguccaggacaccc

SEQ ID NO: 2172294 - RNA, 18 nt, Homo sapiens
cagaccuuaaccaccagg

SEQ ID NO: 2172295 - RNA, 15 nt, Homo sapiens
acaccuaagcccaaa

SEQ ID NO: 2172296 - RNA, 13 nt, Homo sapiens
aagguagaacuua

SEQ ID NO: 2172297 - RNA, 11 nt, Homo sapiens
ugaaaauaacu

SEQ ID NO: 2172298 - RNA, 21 nt, Homo sapiens
ccuguggggccuggggagccc

SEQ ID NO: 2172299 - RNA, 23 nt, Homo sapiens
accugcuaaaggagauuuacaca

SEQ ID NO: 2172300 - RNA, 23 nt, Homo sapiens
acucuuguggucaucauggccag

SEQ ID NO: 2172301 - RNA, 18 nt, Homo sapiens
gaguaaauauauauguca

SEQ ID NO: 2172302 - RNA, 10 nt, Homo sapiens
augggccagc

SEQ ID NO: 2172303 - RNA, 21 nt, Homo sapiens
auuuuuuaagugggcuccuga

SEQ ID NO: 2172304 - RNA, 20 nt, Homo sapiens
gggaugcaaagguugcagug

SEQ ID NO: 2172305 - RNA, 21 nt, Homo sapiens
ccagucacaugaccugaucac

SEQ ID NO: 2172306 - RNA, 19 nt, Homo sapiens
agcauuuguucuuugccag

SEQ ID NO: 2172307 - RNA, 16 nt, Homo sapiens
auuuuggucacagggu

SEQ ID NO: 2172308 - RNA, 17 nt, Homo sapiens
uuucauauuuuccaaau

SEQ ID NO: 2172309 - RNA, 18 nt, Homo sapiens
gucagcugcagccacuuu

SEQ ID NO: 2172310 - RNA, 14 nt, Homo sapiens
auaaauuuugacuu

SEQ ID NO: 2172311 - RNA, 22 nt, Homo sapiens
cauggaacucagcugucugugg

SEQ ID NO: 2172312 - RNA, 14 nt, Homo sapiens
ucacaugugacaaa

SEQ ID NO: 2172313 - RNA, 19 nt, Homo sapiens
cuauauguauguacuuuau

SEQ ID NO: 2172314 - RNA, 17 nt, Homo sapiens
aaugcacauccauuccc

SEQ ID NO: 2172315 - RNA, 23 nt, Homo sapiens
ugauuauauggguauauauucau

SEQ ID NO: 2172316 - RNA, 21 nt, Homo sapiens
auuuucacuagguuugaauga

SEQ ID NO: 2172317 - RNA, 15 nt, Homo sapiens
cuucugaaugcugcu

SEQ ID NO: 2172318 - RNA, 17 nt, Homo sapiens
aaauggcugcuuugaca

SEQ ID NO: 2172319 - RNA, 22 nt, Homo sapiens
gaaucuggcaggaaucuaucca

SEQ ID NO: 2172320 - RNA, 12 nt, Homo sapiens
cucucugcucca

SEQ ID NO: 2172321 - RNA, 23 nt, Homo sapiens
uuugggggugcuaauccaggaca

SEQ ID NO: 2172322 - RNA, 23 nt, Homo sapiens
auacuaugacaaucuuauuguca

SEQ ID NO: 2172323 - RNA, 21 nt, Homo sapiens
ucacaaguaggagacacagau

SEQ ID NO: 2172324 - RNA, 21 nt, Homo sapiens
cucaucacauuuguaaauguc

SEQ ID NO: 2172325 - RNA, 12 nt, Homo sapiens
uauguucugggc

SEQ ID NO: 2172326 - RNA, 16 nt, Homo sapiens
gguugcuucaaugauu

SEQ ID NO: 2172327 - RNA, 11 nt, Homo sapiens
cuggggccacc

SEQ ID NO: 2172328 - RNA, 17 nt, Homo sapiens
ugagcugagauggaguc

SEQ ID NO: 2172329 - RNA, 17 nt, Homo sapiens
gaaagugguucuaugau

SEQ ID NO: 2172330 - RNA, 17 nt, Homo sapiens
aggacuuuuauugugaa

SEQ ID NO: 2172331 - RNA, 15 nt, Homo sapiens
ucuccuaacaaaaga

SEQ ID NO: 2172332 - RNA, 15 nt, Homo sapiens
cucaugaccuugaaa

SEQ ID NO: 2172333 - RNA, 21 nt, Homo sapiens
caguccccagguaucugauga

SEQ ID NO: 2172334 - RNA, 20 nt, Homo sapiens
aucccaagcccugcauugua

SEQ ID NO: 2172335 - RNA, 16 nt, Homo sapiens
cucaagcccugcaguc

SEQ ID NO: 2172336 - RNA, 18 nt, Homo sapiens
auuucuuuucuacacauu

SEQ ID NO: 2172337 - RNA, 16 nt, Homo sapiens
gaacaauuuggucuua

SEQ ID NO: 2172338 - RNA, 14 nt, Homo sapiens
aaaaccccucccac

SEQ ID NO: 2172339 - RNA, 17 nt, Homo sapiens
guauuuugguacuguga

SEQ ID NO: 2172340 - RNA, 13 nt, Homo sapiens
ccagcuggcagac

SEQ ID NO: 2172341 - RNA, 20 nt, Homo sapiens
aauuuuuaaaagacuuugau

SEQ ID NO: 2172342 - RNA, 14 nt, Homo sapiens
agguucuguguguc

SEQ ID NO: 2172343 - RNA, 23 nt, Homo sapiens
uuccugcuaauaauuugccauua

SEQ ID NO: 2172344 - RNA, 15 nt, Homo sapiens
gagccugcuaaggaa

SEQ ID NO: 2172345 - RNA, 15 nt, Homo sapiens
cugacugaugcuuuc

SEQ ID NO: 2172346 - RNA, 15 nt, Homo sapiens
auugcuaguuuauuu

SEQ ID NO: 2172347 - RNA, 20 nt, Homo sapiens
uuuuugucacggaaagcauc

SEQ ID NO: 2172348 - RNA, 19 nt, Homo sapiens
cauguucuugucauaaaau

SEQ ID NO: 2172349 - RNA, 12 nt, Homo sapiens
uuuuuacuguug

SEQ ID NO: 2172350 - RNA, 18 nt, Homo sapiens
ccagagacggaagccuuu

SEQ ID NO: 2172351 - RNA, 22 nt, Homo sapiens
agcugcugugaacauuugugua

SEQ ID NO: 2172352 - RNA, 15 nt, Homo sapiens
gucagcauccagguu

SEQ ID NO: 2172353 - RNA, 18 nt, Homo sapiens
uuaaacuauaagcaagaa

SEQ ID NO: 2172354 - RNA, 12 nt, Homo sapiens
guuuguguuacc

SEQ ID NO: 2172355 - RNA, 17 nt, Homo sapiens
guuacuuccuuccugcc

SEQ ID NO: 2172356 - RNA, 17 nt, Homo sapiens
ggaaaauccgacaagcc

SEQ ID NO: 2172357 - RNA, 13 nt, Homo sapiens
gagaacuacucag

SEQ ID NO: 2172358 - RNA, 18 nt, Homo sapiens
guacguggagagggauga

SEQ ID NO: 2172359 - RNA, 14 nt, Homo sapiens
gacuguacuccucc

SEQ ID NO: 2172360 - RNA, 17 nt, Homo sapiens
cacauucgaguguuuca

SEQ ID NO: 2172361 - RNA, 14 nt, Homo sapiens
auucccuguacaau

SEQ ID NO: 2172362 - RNA, 14 nt, Homo sapiens
uucaccugaaucau

SEQ ID NO: 2172363 - RNA, 18 nt, Homo sapiens
aaauggugauuucuugcu

SEQ ID NO: 2172364 - RNA, 13 nt, Homo sapiens
cagaaucugauac

SEQ ID NO: 2172365 - RNA, 14 nt, Homo sapiens
ucauauugcaucau

SEQ ID NO: 2172366 - RNA, 13 nt, Homo sapiens
ugaaaugcucuuu

SEQ ID NO: 2172367 - RNA, 18 nt, Homo sapiens
ugucugcuaucauuauuc

SEQ ID NO: 2172368 - RNA, 17 nt, Homo sapiens
agggaauccagccauga

SEQ ID NO: 2172369 - RNA, 22 nt, Homo sapiens
ugcguaggagagaacagggaug

SEQ ID NO: 2172370 - RNA, 22 nt, Homo sapiens
uauguacaaauaauauugccuu

SEQ ID NO: 2172371 - RNA, 20 nt, Homo sapiens
aguggcugauucugaacaau

SEQ ID NO: 2172372 - RNA, 16 nt, Homo sapiens
acccuccccuagucac

SEQ ID NO: 2172373 - RNA, 17 nt, Homo sapiens
aaccugaagaugaguaa

SEQ ID NO: 2172374 - RNA, 19 nt, Homo sapiens
uccauaucagaagugccaa

SEQ ID NO: 2172375 - RNA, 20 nt, Homo sapiens
cucauuucuggaaagugcaa

SEQ ID NO: 2172376 - RNA, 11 nt, Homo sapiens
gguacuuucau

SEQ ID NO: 2172377 - RNA, 17 nt, Homo sapiens
uaaaugauuauauucac

SEQ ID NO: 2172378 - RNA, 17 nt, Homo sapiens
ucagugaagucuagaau

SEQ ID NO: 2172379 - RNA, 18 nt, Homo sapiens
uuaaauccaacuuucaca

SEQ ID NO: 2172380 - RNA, 19 nt, Homo sapiens
cagagucucacuguugccc

SEQ ID NO: 2172381 - RNA, 21 nt, Homo sapiens
caauuguuauguguuuagaau

SEQ ID NO: 2172382 - RNA, 16 nt, Homo sapiens
aaacaccucagcugcc

SEQ ID NO: 2172383 - RNA, 14 nt, Homo sapiens
cccagcauguugag

SEQ ID NO: 2172384 - RNA, 16 nt, Homo sapiens
gcuuauauuguucacu

SEQ ID NO: 2172385 - RNA, 14 nt, Homo sapiens
aaauuccagaagaa

SEQ ID NO: 2172386 - RNA, 19 nt, Homo sapiens
ucuaacuuuugugugaaau

SEQ ID NO: 2172387 - RNA, 21 nt, Homo sapiens
ugaaaaucuacacuccaguga

SEQ ID NO: 2172388 - RNA, 18 nt, Homo sapiens
uuuggggcaggaaauacu

SEQ ID NO: 2172389 - RNA, 15 nt, Homo sapiens
agcaaucucuugcau

SEQ ID NO: 2172390 - RNA, 13 nt, Homo sapiens
cauuguaugugcu

SEQ ID NO: 2172391 - RNA, 20 nt, Homo sapiens
gcauuguuucaaaauaguca

SEQ ID NO: 2172392 - RNA, 21 nt, Homo sapiens
caugcuacaaaaaaguagcaa

SEQ ID NO: 2172393 - RNA, 14 nt, Homo sapiens
aucuguagucuuuu

SEQ ID NO: 2172394 - RNA, 13 nt, Homo sapiens
cuuacaucaggaa

SEQ ID NO: 2172395 - RNA, 20 nt, Homo sapiens
uagaagauguguaaacaggu

SEQ ID NO: 2172396 - RNA, 13 nt, Homo sapiens
auuuccaucagcc

SEQ ID NO: 2172397 - RNA, 17 nt, Homo sapiens
ucaucgggccucugggg

SEQ ID NO: 2172398 - RNA, 15 nt, Homo sapiens
ugggcggcacagccu

SEQ ID NO: 2172399 - RNA, 17 nt, Homo sapiens
gaaaauguccaggaaag

SEQ ID NO: 2172400 - RNA, 12 nt, Homo sapiens
uccaucugaccg

SEQ ID NO: 2172401 - RNA, 19 nt, Homo sapiens
cgagcugggggccaugagc

SEQ ID NO: 2172402 - RNA, 15 nt, Homo sapiens
gguugccugggccac

SEQ ID NO: 2172403 - RNA, 16 nt, Homo sapiens
uucaaucauaauaccu

SEQ ID NO: 2172404 - RNA, 16 nt, Homo sapiens
auauuuaaaacaucau

SEQ ID NO: 2172405 - RNA, 12 nt, Homo sapiens
cuccccauggag

SEQ ID NO: 2172406 - RNA, 22 nt, Homo sapiens
ugaguaacgacauggaacugaa

SEQ ID NO: 2172407 - RNA, 14 nt, Homo sapiens
uguaauuccagcua

SEQ ID NO: 2172408 - RNA, 12 nt, Homo sapiens
gauggaauauca

SEQ ID NO: 2172409 - RNA, 17 nt, Homo sapiens
augcacacucaugugca

SEQ ID NO: 2172410 - RNA, 15 nt, Homo sapiens
cccuuuggccaguga

SEQ ID NO: 2172411 - RNA, 14 nt, Homo sapiens
uggagguugcagug

SEQ ID NO: 2172412 - RNA, 20 nt, Homo sapiens
cugucugagaauuuccaaaa

SEQ ID NO: 2172413 - RNA, 11 nt, Homo sapiens
uuccugugauu

SEQ ID NO: 2172414 - RNA, 11 nt, Homo sapiens
auucuguguuc

SEQ ID NO: 2172415 - RNA, 15 nt, Homo sapiens
aguggcuucuuucca

SEQ ID NO: 2172416 - RNA, 18 nt, Homo sapiens
ucaugucuaauugcuuaa

SEQ ID NO: 2172417 - RNA, 20 nt, Homo sapiens
uuucagaauuuaaucuuuga

SEQ ID NO: 2172418 - RNA, 19 nt, Homo sapiens
guuucaccaugcuggucag

SEQ ID NO: 2172419 - RNA, 18 nt, Homo sapiens
ugggagcaggaacaauga

SEQ ID NO: 2172420 - RNA, 15 nt, Homo sapiens
agucacaguucaaaa

SEQ ID NO: 2172421 - RNA, 15 nt, Homo sapiens
ucuuuaaggaucucu

SEQ ID NO: 2172422 - RNA, 15 nt, Homo sapiens
gauccuauugaacca

SEQ ID NO: 2172423 - RNA, 19 nt, Homo sapiens
gcagcucacggaacuggag

SEQ ID NO: 2172424 - RNA, 22 nt, Homo sapiens
agccucucaguacagcacuccu

SEQ ID NO: 2172425 - RNA, 23 nt, Homo sapiens
caguuguugauugacugcaugaa

SEQ ID NO: 2172426 - RNA, 22 nt, Homo sapiens
aacaauuuugcacuguagauuu

SEQ ID NO: 2172427 - RNA, 17 nt, Homo sapiens
ggcagggcccagugaca

SEQ ID NO: 2172428 - RNA, 21 nt, Homo sapiens
uuucacagagugugcugcuau

SEQ ID NO: 2172429 - RNA, 17 nt, Homo sapiens
gacuaacccaaugccug

SEQ ID NO: 2172430 - RNA, 17 nt, Homo sapiens
auauuuuucaaccagca

SEQ ID NO: 2172431 - RNA, 15 nt, Homo sapiens
ccuucuccugaccua

SEQ ID NO: 2172432 - RNA, 15 nt, Homo sapiens
ucuuacuggugcuau

SEQ ID NO: 2172433 - RNA, 16 nt, Homo sapiens
uuuauguaacuaucaa

SEQ ID NO: 2172434 - RNA, 15 nt, Homo sapiens
auaccugaaugcucu

SEQ ID NO: 2172435 - RNA, 13 nt, Homo sapiens
ccacgaauauucu

SEQ ID NO: 2172436 - RNA, 20 nt, Homo sapiens
cucaguaaggcagugcagua

SEQ ID NO: 2172437 - RNA, 17 nt, Homo sapiens
cauauuacaacacuuua

SEQ ID NO: 2172438 - RNA, 16 nt, Homo sapiens
cgccugacaaccacug

SEQ ID NO: 2172439 - RNA, 21 nt, Homo sapiens
uauuaacgcgacugaacuaca

SEQ ID NO: 2172440 - RNA, 21 nt, Homo sapiens
gagaaaguuggugcugcucau

SEQ ID NO: 2172441 - RNA, 20 nt, Homo sapiens
aauggggguauccugugcau

SEQ ID NO: 2172442 - RNA, 20 nt, Homo sapiens
guacguuaauuaaacaaauu

SEQ ID NO: 2172443 - RNA, 18 nt, Homo sapiens
cugucuuaaggcaucuga

SEQ ID NO: 2172444 - RNA, 17 nt, Homo sapiens
cuucacuuaaaaucaaa

SEQ ID NO: 2172445 - RNA, 19 nt, Homo sapiens
caaguuggagugcaauggu

SEQ ID NO: 2172446 - RNA, 21 nt, Homo sapiens
agagacagaggcgcccugggu

SEQ ID NO: 2172447 - RNA, 19 nt, Homo sapiens
gauaaagaugucaaauauc

SEQ ID NO: 2172448 - RNA, 23 nt, Homo sapiens
aauaugugaugauuaauacaaua

SEQ ID NO: 2172449 - RNA, 10 nt, Homo sapiens
ccuugcuaau

SEQ ID NO: 2172450 - RNA, 16 nt, Homo sapiens
aauuuugaaaugauuc

SEQ ID NO: 2172451 - RNA, 23 nt, Homo sapiens
ccuacagucaucugccaccacac

SEQ ID NO: 2172452 - RNA, 17 nt, Homo sapiens
uaauggggacacagauc

SEQ ID NO: 2172453 - RNA, 19 nt, Homo sapiens
aggaccucagcugcuucuc

SEQ ID NO: 2172454 - RNA, 20 nt, Homo sapiens
uggcugggaggaagccagaa

SEQ ID NO: 2172455 - RNA, 14 nt, Homo sapiens
gguguguucugcaa

SEQ ID NO: 2172456 - RNA, 21 nt, Homo sapiens
uugagaccuuugauuuuugcc

SEQ ID NO: 2172457 - RNA, 15 nt, Homo sapiens
uccacguacuuaauu

SEQ ID NO: 2172458 - RNA, 14 nt, Homo sapiens
uuagauugaaucug

SEQ ID NO: 2172459 - RNA, 15 nt, Homo sapiens
ccguuccugacauca

SEQ ID NO: 2172460 - RNA, 23 nt, Homo sapiens
acugccuccucccuggcugcagc

SEQ ID NO: 2172461 - RNA, 22 nt, Homo sapiens
aucuaauuaaauggcaucagca

SEQ ID NO: 2172462 - RNA, 20 nt, Homo sapiens
uguaugugcgugugugcaag

SEQ ID NO: 2172463 - RNA, 18 nt, Homo sapiens
aggaaaaucaugugcuca

SEQ ID NO: 2172464 - RNA, 23 nt, Homo sapiens
uaaaggcaaugguuugugucaaa

SEQ ID NO: 2172465 - RNA, 15 nt, Homo sapiens
cuuaaaggacauaaa

SEQ ID NO: 2172466 - RNA, 15 nt, Homo sapiens
uuuggauaucuguua

SEQ ID NO: 2172467 - RNA, 16 nt, Homo sapiens
uuucauaucuacagau

SEQ ID NO: 2172468 - RNA, 20 nt, Homo sapiens
uccaagcaaaaacaaauggg

SEQ ID NO: 2172469 - RNA, 23 nt, Homo sapiens
ccaaauuuaauuaaagccuuaag

SEQ ID NO: 2172470 - RNA, 23 nt, Homo sapiens
ggaucaauuauggcaguaccuuu

SEQ ID NO: 2172471 - RNA, 16 nt, Homo sapiens
accacauagcaugagg

SEQ ID NO: 2172472 - RNA, 22 nt, Homo sapiens
agcugagacuacaagugugugc

SEQ ID NO: 2172473 - RNA, 11 nt, Homo sapiens
cuuuaauuuca

SEQ ID NO: 2172474 - RNA, 20 nt, Homo sapiens
agcgauucuccugccucagc

SEQ ID NO: 2172475 - RNA, 19 nt, Homo sapiens
cccucauccuuuuacuuuu

SEQ ID NO: 2172476 - RNA, 15 nt, Homo sapiens
agaaaagaagacauu

SEQ ID NO: 2172477 - RNA, 15 nt, Homo sapiens
gggccagagggacuu

SEQ ID NO: 2172478 - RNA, 13 nt, Homo sapiens
acagaaauaacag

SEQ ID NO: 2172479 - RNA, 19 nt, Homo sapiens
cuggggcagaaagccacaa

SEQ ID NO: 2172480 - RNA, 17 nt, Homo sapiens
guccgacaaagcuacuu

SEQ ID NO: 2172481 - RNA, 21 nt, Homo sapiens
gcucucugggccuggguucca

SEQ ID NO: 2172482 - RNA, 21 nt, Homo sapiens
uaagcagaacuaagcucagua

SEQ ID NO: 2172483 - RNA, 22 nt, Homo sapiens
ucgauauaugacuuuuucucag

SEQ ID NO: 2172484 - RNA, 15 nt, Homo sapiens
cauguuggggcucuu

SEQ ID NO: 2172485 - RNA, 15 nt, Homo sapiens
aaagcugcuauccaa

SEQ ID NO: 2172486 - RNA, 22 nt, Homo sapiens
aggcagugacagcagucaggga

SEQ ID NO: 2172487 - RNA, 16 nt, Homo sapiens
gcccacuaaaagaauu

SEQ ID NO: 2172488 - RNA, 20 nt, Homo sapiens
uauugacugggcaacacugc

SEQ ID NO: 2172489 - RNA, 19 nt, Homo sapiens
gauaugcacacacauggau

SEQ ID NO: 2172490 - RNA, 16 nt, Homo sapiens
gauaaucccauacucu

SEQ ID NO: 2172491 - RNA, 13 nt, Homo sapiens
ucagugcaguuuc

SEQ ID NO: 2172492 - RNA, 15 nt, Homo sapiens
ggaaguauaaaguaa

SEQ ID NO: 2172493 - RNA, 23 nt, Homo sapiens
ucuguacaaugaacccccaugau

SEQ ID NO: 2172494 - RNA, 21 nt, Homo sapiens
ucaguugccaaggaucccuga

SEQ ID NO: 2172495 - RNA, 16 nt, Homo sapiens
uucaauaacuggaaca

SEQ ID NO: 2172496 - RNA, 18 nt, Homo sapiens
cuugguacugaaaaugag

SEQ ID NO: 2172497 - RNA, 20 nt, Homo sapiens
aaucaguaaauaccuugaaa

SEQ ID NO: 2172498 - RNA, 19 nt, Homo sapiens
uguauucaccccacaccca

SEQ ID NO: 2172499 - RNA, 19 nt, Homo sapiens
ggcuggaagauagcuguga

SEQ ID NO: 2172500 - RNA, 19 nt, Homo sapiens
ucuuaucaaagaaauaacc

SEQ ID NO: 2172501 - RNA, 13 nt, Homo sapiens
ugagaugaaggaa

SEQ ID NO: 2172502 - RNA, 13 nt, Homo sapiens
gagugcacuacug

SEQ ID NO: 2172503 - RNA, 14 nt, Homo sapiens
gccaggugcuguga

SEQ ID NO: 2172504 - RNA, 15 nt, Homo sapiens
ucuugaauguggucu

SEQ ID NO: 2172505 - RNA, 16 nt, Homo sapiens
uucaccauguugccca

SEQ ID NO: 2172506 - RNA, 23 nt, Homo sapiens
ccaguguauuuucuguguuguuc

SEQ ID NO: 2172507 - RNA, 12 nt, Homo sapiens
aaacaacucuuu

SEQ ID NO: 2172508 - RNA, 21 nt, Homo sapiens
uuuacugaugaaacagccucu

SEQ ID NO: 2172509 - RNA, 18 nt, Homo sapiens
agcaaauaguaaucugua

SEQ ID NO: 2172510 - RNA, 21 nt, Homo sapiens
gcaugucagacagaacuugaa

SEQ ID NO: 2172511 - RNA, 21 nt, Homo sapiens
auggaaacauuuuauacugua

SEQ ID NO: 2172512 - RNA, 22 nt, Homo sapiens
ucuuccuacuggucucucuaug

SEQ ID NO: 2172513 - RNA, 20 nt, Homo sapiens
gaacuguaaauaugucacua

SEQ ID NO: 2172514 - RNA, 18 nt, Homo sapiens
cugaauagugucaccaau

SEQ ID NO: 2172515 - RNA, 15 nt, Homo sapiens
gcccagcugcaccug

SEQ ID NO: 2172516 - RNA, 15 nt, Homo sapiens
cugguuacucagggu

SEQ ID NO: 2172517 - RNA, 14 nt, Homo sapiens
acauggaaagggag

SEQ ID NO: 2172518 - RNA, 18 nt, Homo sapiens
acauugacccagacauau

SEQ ID NO: 2172519 - RNA, 20 nt, Homo sapiens
acaacauccucagaaccauu

SEQ ID NO: 2172520 - RNA, 19 nt, Homo sapiens
uggauucagaaccaagacc

SEQ ID NO: 2172521 - RNA, 13 nt, Homo sapiens
caacuuagcucac

SEQ ID NO: 2172522 - RNA, 17 nt, Homo sapiens
gucaaaacaagacuccu

SEQ ID NO: 2172523 - RNA, 13 nt, Homo sapiens
uaccugcaccucu

SEQ ID NO: 2172524 - RNA, 14 nt, Homo sapiens
guguucugcugaga

SEQ ID NO: 2172525 - RNA, 16 nt, Homo sapiens
acugcuguacugcaau

SEQ ID NO: 2172526 - RNA, 19 nt, Homo sapiens
gaaccaaggaaucauguca

SEQ ID NO: 2172527 - RNA, 14 nt, Homo sapiens
auacaacaggauuu

SEQ ID NO: 2172528 - RNA, 14 nt, Homo sapiens
ucugaaauuuccca

SEQ ID NO: 2172529 - RNA, 19 nt, Homo sapiens
caagcaacugguugacuaa

SEQ ID NO: 2172530 - RNA, 12 nt, Homo sapiens
agugcucagcua

SEQ ID NO: 2172531 - RNA, 23 nt, Homo sapiens
uccuaagccuguugcugaaguca

SEQ ID NO: 2172532 - RNA, 17 nt, Homo sapiens
aucccaacuacucagaa

SEQ ID NO: 2172533 - RNA, 22 nt, Homo sapiens
ugaugaaagugcuucauugacu

SEQ ID NO: 2172534 - RNA, 17 nt, Homo sapiens
ccgaggaaccuacugcc

SEQ ID NO: 2172535 - RNA, 18 nt, Homo sapiens
gugaagggagagccagcu

SEQ ID NO: 2172536 - RNA, 14 nt, Homo sapiens
acugugaccaaagc

SEQ ID NO: 2172537 - RNA, 20 nt, Homo sapiens
auuuauccagaaaacuguga

SEQ ID NO: 2172538 - RNA, 19 nt, Homo sapiens
uagaaugagggaaacaaaa

SEQ ID NO: 2172539 - RNA, 15 nt, Homo sapiens
ugcugggacugagaa

SEQ ID NO: 2172540 - RNA, 18 nt, Homo sapiens
uucagacaaauuacugau

SEQ ID NO: 2172541 - RNA, 20 nt, Homo sapiens
cgguuugguagacuuggaca

SEQ ID NO: 2172542 - RNA, 20 nt, Homo sapiens
auaaaguaccacacauauug

SEQ ID NO: 2172543 - RNA, 21 nt, Homo sapiens
auauauuuuaaagcacuuuaa

SEQ ID NO: 2172544 - RNA, 19 nt, Homo sapiens
uuagaaggcagacuuucua

SEQ ID NO: 2172545 - RNA, 17 nt, Homo sapiens
cgaauucgcuguuaccg

SEQ ID NO: 2172546 - RNA, 13 nt, Homo sapiens
aguuugagaccag

SEQ ID NO: 2172547 - RNA, 21 nt, Homo sapiens
gcguuucaggaacguugccac

SEQ ID NO: 2172548 - RNA, 15 nt, Homo sapiens
ugaaggcauguaagg

SEQ ID NO: 2172549 - RNA, 15 nt, Homo sapiens
caagaacuugcaaua

SEQ ID NO: 2172550 - RNA, 20 nt, Homo sapiens
ugucauggaaaagcccagug

SEQ ID NO: 2172551 - RNA, 16 nt, Homo sapiens
cuuugagaagcucagc

SEQ ID NO: 2172552 - RNA, 17 nt, Homo sapiens
augagcaccccuaugcc

SEQ ID NO: 2172553 - RNA, 20 nt, Homo sapiens
cuaaguagucaucaaugcaa

SEQ ID NO: 2172554 - RNA, 18 nt, Homo sapiens
cagaccuguuucuuguaa

SEQ ID NO: 2172555 - RNA, 15 nt, Homo sapiens
guucaauuguguauu

SEQ ID NO: 2172556 - RNA, 12 nt, Homo sapiens
gcaucuagccag

SEQ ID NO: 2172557 - RNA, 17 nt, Homo sapiens
ccaaucagcgcucugua

SEQ ID NO: 2172558 - RNA, 18 nt, Homo sapiens
auagagucacagcuuucc

SEQ ID NO: 2172559 - RNA, 13 nt, Homo sapiens
uaaagaugagaug

SEQ ID NO: 2172560 - RNA, 18 nt, Homo sapiens
gacccagucccacacugu

SEQ ID NO: 2172561 - RNA, 21 nt, Homo sapiens
augucucucagaauucuucag

SEQ ID NO: 2172562 - RNA, 14 nt, Homo sapiens
acauugauucaugu

SEQ ID NO: 2172563 - RNA, 16 nt, Homo sapiens
acagccugcacagugg

SEQ ID NO: 2172564 - RNA, 22 nt, Homo sapiens
gcauggauccagaacugcacuc

SEQ ID NO: 2172565 - RNA, 16 nt, Homo sapiens
cugagccacagcagca

SEQ ID NO: 2172566 - RNA, 13 nt, Homo sapiens
aaaggaggggaua

SEQ ID NO: 2172567 - RNA, 21 nt, Homo sapiens
cucuagccuggcaacagagcg

SEQ ID NO: 2172568 - RNA, 23 nt, Homo sapiens
aacaauuuuaggaggaccagagc

SEQ ID NO: 2172569 - RNA, 18 nt, Homo sapiens
cagaauauacccauccau

SEQ ID NO: 2172570 - RNA, 12 nt, Homo sapiens
ccagcaccacuu

SEQ ID NO: 2172571 - RNA, 14 nt, Homo sapiens
ucuaggugcccuug

SEQ ID NO: 2172572 - RNA, 21 nt, Homo sapiens
ucucauaccuuccccacaucu

SEQ ID NO: 2172573 - RNA, 16 nt, Homo sapiens
agaacugcagaccuca

SEQ ID NO: 2172574 - RNA, 13 nt, Homo sapiens
ggcacagucucca

SEQ ID NO: 2172575 - RNA, 10 nt, Homo sapiens
uuauguuugc

SEQ ID NO: 2172576 - RNA, 10 nt, Homo sapiens
ucauguuugu

SEQ ID NO: 2172577 - RNA, 21 nt, Homo sapiens
cugccaucucucccacucugc

SEQ ID NO: 2172578 - RNA, 19 nt, Homo sapiens
ugaaauaaaacuacauggu

SEQ ID NO: 2172579 - RNA, 15 nt, Homo sapiens
aauugauacuucagg

SEQ ID NO: 2172580 - RNA, 18 nt, Homo sapiens
ucuuuuucccccaaccuc

SEQ ID NO: 2172581 - RNA, 19 nt, Homo sapiens
agccuccuagggcuuauca

SEQ ID NO: 2172582 - RNA, 14 nt, Homo sapiens
agauggcacuuuga

SEQ ID NO: 2172583 - RNA, 17 nt, Homo sapiens
aauuugggcuuggacca

SEQ ID NO: 2172584 - RNA, 21 nt, Homo sapiens
cagcgagaacuacgcacagcu

SEQ ID NO: 2172585 - RNA, 21 nt, Homo sapiens
ccuuuccggcacacugccaaa

SEQ ID NO: 2172586 - RNA, 11 nt, Homo sapiens
uuaaagcaaaa

SEQ ID NO: 2172587 - RNA, 14 nt, Homo sapiens
aaguugugccaaac

SEQ ID NO: 2172588 - RNA, 16 nt, Homo sapiens
ucugagugucucugcc

SEQ ID NO: 2172589 - RNA, 21 nt, Homo sapiens
agugguucaauaccuguuuag

SEQ ID NO: 2172590 - RNA, 19 nt, Homo sapiens
caccugccugcgucuuccg

SEQ ID NO: 2172591 - RNA, 18 nt, Homo sapiens
aaagcugggaaccagcau

SEQ ID NO: 2172592 - RNA, 19 nt, Homo sapiens
gaccucagcaagcugccca

SEQ ID NO: 2172593 - RNA, 19 nt, Homo sapiens
aacuuauaucaucagcaua

SEQ ID NO: 2172594 - RNA, 20 nt, Homo sapiens
uuaauaaagcauucuuuaac

SEQ ID NO: 2172595 - RNA, 16 nt, Homo sapiens
guagaaacucuacaua

SEQ ID NO: 2172596 - RNA, 17 nt, Homo sapiens
auauccaacaugugcuc

SEQ ID NO: 2172597 - RNA, 18 nt, Homo sapiens
cucacugagcugggugua

SEQ ID NO: 2172598 - RNA, 19 nt, Homo sapiens
gaagcccgaggucaucacc

SEQ ID NO: 2172599 - RNA, 22 nt, Homo sapiens
uuccuugcuuaugagaccaaga

SEQ ID NO: 2172600 - RNA, 19 nt, Homo sapiens
gauuacaggcgugagccac

SEQ ID NO: 2172601 - RNA, 20 nt, Homo sapiens
aguacuaucuuuguguugca

SEQ ID NO: 2172602 - RNA, 16 nt, Homo sapiens
agacccaguacauccu

SEQ ID NO: 2172603 - RNA, 15 nt, Homo sapiens
auuuccugacuugag

SEQ ID NO: 2172604 - RNA, 14 nt, Homo sapiens
cgaggccacgcacc

SEQ ID NO: 2172605 - RNA, 22 nt, Homo sapiens
aucacagggaauggccacaaac

SEQ ID NO: 2172606 - RNA, 16 nt, Homo sapiens
ucuucuggugucaugg

SEQ ID NO: 2172607 - RNA, 17 nt, Homo sapiens
ucagucuuuuccaucuc

SEQ ID NO: 2172608 - RNA, 16 nt, Homo sapiens
ugagguaaguggaauu

SEQ ID NO: 2172609 - RNA, 17 nt, Homo sapiens
cccuucacauacccucc

SEQ ID NO: 2172610 - RNA, 21 nt, Homo sapiens
ucaaaguccagauaccaagca

SEQ ID NO: 2172611 - RNA, 16 nt, Homo sapiens
gagcuuugggugacca

SEQ ID NO: 2172612 - RNA, 16 nt, Homo sapiens
augcagacugcugcaa

SEQ ID NO: 2172613 - RNA, 18 nt, Homo sapiens
guaaucuuuuucuccacc

SEQ ID NO: 2172614 - RNA, 17 nt, Homo sapiens
accauaagcuacugcca

SEQ ID NO: 2172615 - RNA, 19 nt, Homo sapiens
augcagaccucaugcccag

SEQ ID NO: 2172616 - RNA, 13 nt, Homo sapiens
ucaggcauuucau

SEQ ID NO: 2172617 - RNA, 12 nt, Homo sapiens
aggaccacaggc

SEQ ID NO: 2172618 - RNA, 22 nt, Homo sapiens
aaugaggcugcuuuccaaagcc

SEQ ID NO: 2172619 - RNA, 15 nt, Homo sapiens
uaauuaaauuucaca

SEQ ID NO: 2172620 - RNA, 15 nt, Homo sapiens
gccaaacuaaauacu

SEQ ID NO: 2172621 - RNA, 13 nt, Homo sapiens
gugacaaucugcc

SEQ ID NO: 2172622 - RNA, 15 nt, Homo sapiens
cggaaccacagggcc

SEQ ID NO: 2172623 - RNA, 15 nt, Homo sapiens
ccugguggugugugg

SEQ ID NO: 2172624 - RNA, 17 nt, Homo sapiens
guguugccagugcuaag

SEQ ID NO: 2172625 - RNA, 16 nt, Homo sapiens
ggccacccgggcugcc

SEQ ID NO: 2172626 - RNA, 21 nt, Homo sapiens
auuugaauuauuucugucaca

SEQ ID NO: 2172627 - RNA, 11 nt, Homo sapiens
agcagggucag

SEQ ID NO: 2172628 - RNA, 20 nt, Homo sapiens
auaagauauauaugugcucu

SEQ ID NO: 2172629 - RNA, 15 nt, Homo sapiens
uucuacucugucuua

SEQ ID NO: 2172630 - RNA, 15 nt, Homo sapiens
accaagcauguccca

SEQ ID NO: 2172631 - RNA, 17 nt, Homo sapiens
uaacucuguaaaagugu

SEQ ID NO: 2172632 - RNA, 14 nt, Homo sapiens
uaaacuuuaucuca

SEQ ID NO: 2172633 - RNA, 22 nt, Homo sapiens
cuaaagauaauauuacuguuua

SEQ ID NO: 2172634 - RNA, 16 nt, Homo sapiens
acagcauaauugccuu

SEQ ID NO: 2172635 - RNA, 15 nt, Homo sapiens
ugccagugucauccg

SEQ ID NO: 2172636 - RNA, 17 nt, Homo sapiens
acaaauaaaugagccca

SEQ ID NO: 2172637 - RNA, 11 nt, Homo sapiens
uucacauucau

SEQ ID NO: 2172638 - RNA, 14 nt, Homo sapiens
ggacuggggggcca

SEQ ID NO: 2172639 - RNA, 16 nt, Homo sapiens
cucuaagguacacacu

SEQ ID NO: 2172640 - RNA, 17 nt, Homo sapiens
ugaaggcuuaauugacu

SEQ ID NO: 2172641 - RNA, 21 nt, Homo sapiens
ccaccuaugccagugcucaag

SEQ ID NO: 2172642 - RNA, 15 nt, Homo sapiens
gguuuuuaaaccuuc

SEQ ID NO: 2172643 - RNA, 18 nt, Homo sapiens
uguacauguucuugucau

SEQ ID NO: 2172644 - RNA, 12 nt, Homo sapiens
uuuucuuggcag

SEQ ID NO: 2172645 - RNA, 20 nt, Homo sapiens
gcagaaggaagacuucaucc

SEQ ID NO: 2172646 - RNA, 21 nt, Homo sapiens
acagagcaagacccugucuca

SEQ ID NO: 2172647 - RNA, 18 nt, Homo sapiens
acagguggcaacaaugcc

SEQ ID NO: 2172648 - RNA, 12 nt, Homo sapiens
cuuucuuugcac

SEQ ID NO: 2172649 - RNA, 15 nt, Homo sapiens
aagcaucagacuggu

SEQ ID NO: 2172650 - RNA, 18 nt, Homo sapiens
uaaaugcucuaacuggac

SEQ ID NO: 2172651 - RNA, 21 nt, Homo sapiens
auacccauaaagaaugcucau

SEQ ID NO: 2172652 - RNA, 18 nt, Homo sapiens
ccaggccgccugccauac

SEQ ID NO: 2172653 - RNA, 19 nt, Homo sapiens
acguaugagaaaccuauau

SEQ ID NO: 2172654 - RNA, 17 nt, Homo sapiens
uguaagaagaaacugcu

SEQ ID NO: 2172655 - RNA, 19 nt, Homo sapiens
ccauaauuuauuuugucca

SEQ ID NO: 2172656 - RNA, 21 nt, Homo sapiens
gaaauaauugaagagagaaau

SEQ ID NO: 2172657 - RNA, 16 nt, Homo sapiens
gugggaacauggucac

SEQ ID NO: 2172658 - RNA, 18 nt, Homo sapiens
cgugaaucuguaucuugc

SEQ ID NO: 2172659 - RNA, 17 nt, Homo sapiens
auuaauugacaaugacc

SEQ ID NO: 2172660 - RNA, 16 nt, Homo sapiens
ugacucgaaacugaca

SEQ ID NO: 2172661 - RNA, 19 nt, Homo sapiens
aacuagggaagauaauauu

SEQ ID NO: 2172662 - RNA, 16 nt, Homo sapiens
accaaauuacaaguau

SEQ ID NO: 2172663 - RNA, 23 nt, Homo sapiens
accaggcuucccaaaccaagugc

SEQ ID NO: 2172664 - RNA, 21 nt, Homo sapiens
aaccaugaaaacaaugccuca

SEQ ID NO: 2172665 - RNA, 22 nt, Homo sapiens
aaaugagaaucugugcagucau

SEQ ID NO: 2172666 - RNA, 21 nt, Homo sapiens
ugagacagugggggugccugg

SEQ ID NO: 2172667 - RNA, 18 nt, Homo sapiens
uuccacccacgagcacuu

SEQ ID NO: 2172668 - RNA, 21 nt, Homo sapiens
gucuacauagugacaugcaca

SEQ ID NO: 2172669 - RNA, 20 nt, Homo sapiens
uggaccggcccacacuccca

SEQ ID NO: 2172670 - RNA, 16 nt, Homo sapiens
aaagccaucaugccuu

SEQ ID NO: 2172671 - RNA, 15 nt, Homo sapiens
uucucgaacuccuga

SEQ ID NO: 2172672 - RNA, 16 nt, Homo sapiens
ggugacauugcaccug

SEQ ID NO: 2172673 - RNA, 15 nt, Homo sapiens
ugggaaggugaccac

SEQ ID NO: 2172674 - RNA, 16 nt, Homo sapiens
guagcccauccuuccc

SEQ ID NO: 2172675 - RNA, 14 nt, Homo sapiens
augaaacauguucu

SEQ ID NO: 2172676 - RNA, 22 nt, Homo sapiens
gagacugacaaccucauccagg

SEQ ID NO: 2172677 - RNA, 18 nt, Homo sapiens
caucuugucaacaugcau

SEQ ID NO: 2172678 - RNA, 15 nt, Homo sapiens
aggccagacauggug

SEQ ID NO: 2172679 - RNA, 13 nt, Homo sapiens
agcaucacugccc

SEQ ID NO: 2172680 - RNA, 21 nt, Homo sapiens
uccccucccgaacacugagaa

SEQ ID NO: 2172681 - RNA, 19 nt, Homo sapiens
uuacaacccgguucacucu

SEQ ID NO: 2172682 - RNA, 13 nt, Homo sapiens
aguuaagugugga

SEQ ID NO: 2172683 - RNA, 12 nt, Homo sapiens
uacuaaggagcc

SEQ ID NO: 2172684 - RNA, 20 nt, Homo sapiens
caaaagcuguaaauuacuau

SEQ ID NO: 2172685 - RNA, 16 nt, Homo sapiens
ccuaugugauuuuaac

SEQ ID NO: 2172686 - RNA, 18 nt, Homo sapiens
guaagaguucacauggaa

SEQ ID NO: 2172687 - RNA, 19 nt, Homo sapiens
uuuucucaguguugguaua

SEQ ID NO: 2172688 - RNA, 17 nt, Homo sapiens
cucgacauuuggugaga

SEQ ID NO: 2172689 - RNA, 22 nt, Homo sapiens
ggagucuuagagcuuuaccuaa

SEQ ID NO: 2172690 - RNA, 14 nt, Homo sapiens
ccugcuggugccca

SEQ ID NO: 2172691 - RNA, 15 nt, Homo sapiens
guacgaugacagugu

SEQ ID NO: 2172692 - RNA, 16 nt, Homo sapiens
cugacagggccagugc

SEQ ID NO: 2172693 - RNA, 22 nt, Homo sapiens
cuaguacagguuuugcccugau

SEQ ID NO: 2172694 - RNA, 14 nt, Homo sapiens
guauuaacuauuag

SEQ ID NO: 2172695 - RNA, 21 nt, Homo sapiens
agaaaaaauuccacaaugaaa

SEQ ID NO: 2172696 - RNA, 15 nt, Homo sapiens
gaaaaaaaugucaaa

SEQ ID NO: 2172697 - RNA, 13 nt, Homo sapiens
cuucagguggaug

SEQ ID NO: 2172698 - RNA, 14 nt, Homo sapiens
uuaauggcacugau

SEQ ID NO: 2172699 - RNA, 21 nt, Homo sapiens
gaauucauuuucaucacuggg

SEQ ID NO: 2172700 - RNA, 19 nt, Homo sapiens
uagacucucuaguuuuauc

SEQ ID NO: 2172701 - RNA, 21 nt, Homo sapiens
ccaugagcaccccaaggcugc

SEQ ID NO: 2172702 - RNA, 15 nt, Homo sapiens
uaaaguuuugucaga

SEQ ID NO: 2172703 - RNA, 22 nt, Homo sapiens
guaaccggauggcggacaccug

SEQ ID NO: 2172704 - RNA, 18 nt, Homo sapiens
ugggggcugcugcacugc

SEQ ID NO: 2172705 - RNA, 14 nt, Homo sapiens
ucugagaauuucca

SEQ ID NO: 2172706 - RNA, 18 nt, Homo sapiens
accccuccuuccuugacc

SEQ ID NO: 2172707 - RNA, 12 nt, Homo sapiens
agcuuccaugag

SEQ ID NO: 2172708 - RNA, 14 nt, Homo sapiens
gugcaccaucucac

SEQ ID NO: 2172709 - RNA, 19 nt, Homo sapiens
uaugccuucacuacaacau

SEQ ID NO: 2172710 - RNA, 21 nt, Homo sapiens
gacagguggcaacaaugcccc

SEQ ID NO: 2172711 - RNA, 13 nt, Homo sapiens
cauaaaucuauuc

SEQ ID NO: 2172712 - RNA, 16 nt, Homo sapiens
gcacuauggacauuuu

SEQ ID NO: 2172713 - RNA, 17 nt, Homo sapiens
ucucucccacucugcca

SEQ ID NO: 2172714 - RNA, 15 nt, Homo sapiens
cgagcaaaauucaaa

SEQ ID NO: 2172715 - RNA, 23 nt, Homo sapiens
ggcaacaaggugcacagaccuca

SEQ ID NO: 2172716 - RNA, 14 nt, Homo sapiens
ucucucgggagccc

SEQ ID NO: 2172717 - RNA, 20 nt, Homo sapiens
acuucaugcuggccugugug

SEQ ID NO: 2172718 - RNA, 16 nt, Homo sapiens
cugauaguuucccaua

SEQ ID NO: 2172719 - RNA, 17 nt, Homo sapiens
uccucgggggaaagcac

SEQ ID NO: 2172720 - RNA, 21 nt, Homo sapiens
uucagaccuuuuaacuccuca

SEQ ID NO: 2172721 - RNA, 10 nt, Homo sapiens
cacacugaga

SEQ ID NO: 2172722 - RNA, 16 nt, Homo sapiens
ccaccagggcuucugg

SEQ ID NO: 2172723 - RNA, 17 nt, Homo sapiens
aagcaugaagucuuaag

SEQ ID NO: 2172724 - RNA, 21 nt, Homo sapiens
acaggagcguguacuacccca

SEQ ID NO: 2172725 - RNA, 12 nt, Homo sapiens
ggaaugcucaau

SEQ ID NO: 2172726 - RNA, 18 nt, Homo sapiens
acugggaggcagggcucu

SEQ ID NO: 2172727 - RNA, 16 nt, Homo sapiens
cugguugccaaauacu

SEQ ID NO: 2172728 - RNA, 17 nt, Homo sapiens
aagaccaaaguuugcaa

SEQ ID NO: 2172729 - RNA, 13 nt, Homo sapiens
augcagcucugau

SEQ ID NO: 2172730 - RNA, 19 nt, Homo sapiens
uuugcugcacaaacaugaa

SEQ ID NO: 2172731 - RNA, 16 nt, Homo sapiens
ccaccccaaauuaaaa

SEQ ID NO: 2172732 - RNA, 13 nt, Homo sapiens
agagaugauacug

SEQ ID NO: 2172733 - RNA, 12 nt, Homo sapiens
uguuauguacaa

SEQ ID NO: 2172734 - RNA, 13 nt, Homo sapiens
gccagcugcaggg

SEQ ID NO: 2172735 - RNA, 19 nt, Homo sapiens
uccuuagcuuagaccucag

SEQ ID NO: 2172736 - RNA, 15 nt, Homo sapiens
cuauuuuaaaaccau

SEQ ID NO: 2172737 - RNA, 18 nt, Homo sapiens
ccaggucugggugaaagg

SEQ ID NO: 2172738 - RNA, 21 nt, Homo sapiens
ggaacaagcagcuaagcaaua

SEQ ID NO: 2172739 - RNA, 18 nt, Homo sapiens
aauguggccguguucaaa

SEQ ID NO: 2172740 - RNA, 18 nt, Homo sapiens
gccugcugcugagaaccu

SEQ ID NO: 2172741 - RNA, 16 nt, Homo sapiens
auugcaagaguuuaau

SEQ ID NO: 2172742 - RNA, 21 nt, Homo sapiens
uauuaaggcagaucuuugaug

SEQ ID NO: 2172743 - RNA, 13 nt, Homo sapiens
aaaugaugaagac

SEQ ID NO: 2172744 - RNA, 17 nt, Homo sapiens
cuucuuagcaccacaaa

SEQ ID NO: 2172745 - RNA, 22 nt, Homo sapiens
agcugagugacugcagcuugcc

SEQ ID NO: 2172746 - RNA, 18 nt, Homo sapiens
caaacauuguguugacau

SEQ ID NO: 2172747 - RNA, 17 nt, Homo sapiens
cugucucaccauguaca

SEQ ID NO: 2172748 - RNA, 22 nt, Homo sapiens
agccuuggaagcaaacuuauaa

SEQ ID NO: 2172749 - RNA, 15 nt, Homo sapiens
cacuuuucccacucc

SEQ ID NO: 2172750 - RNA, 20 nt, Homo sapiens
gcacagcaggcugccagugc

SEQ ID NO: 2172751 - RNA, 16 nt, Homo sapiens
acugccuccuugccag

SEQ ID NO: 2172752 - RNA, 20 nt, Homo sapiens
ugauuucaguucacuguuca

SEQ ID NO: 2172753 - RNA, 22 nt, Homo sapiens
uaaaugagagggaaucgacugu

SEQ ID NO: 2172754 - RNA, 20 nt, Homo sapiens
uacuuacaaguuucuagcuc

SEQ ID NO: 2172755 - RNA, 20 nt, Homo sapiens
uaaauaguuuaacacuuucu

SEQ ID NO: 2172756 - RNA, 19 nt, Homo sapiens
aggcccuuauuuucaagaa

SEQ ID NO: 2172757 - RNA, 14 nt, Homo sapiens
ggagaagcacagcu

SEQ ID NO: 2172758 - RNA, 21 nt, Homo sapiens
uagaacguuuccgcugcagua

SEQ ID NO: 2172759 - RNA, 19 nt, Homo sapiens
ugaccaccgauuccagcug

SEQ ID NO: 2172760 - RNA, 20 nt, Homo sapiens
ucaacaauaaagacugagac

SEQ ID NO: 2172761 - RNA, 19 nt, Homo sapiens
cagcuuccccaguagcugg

SEQ ID NO: 2172762 - RNA, 20 nt, Homo sapiens
uagcauaguaccucugcuau

SEQ ID NO: 2172763 - RNA, 14 nt, Homo sapiens
uucaucaagcugua

SEQ ID NO: 2172764 - RNA, 20 nt, Homo sapiens
ccagcugccuuggacugugu

SEQ ID NO: 2172765 - RNA, 14 nt, Homo sapiens
aaauaaacaucuga

SEQ ID NO: 2172766 - RNA, 14 nt, Homo sapiens
ugaauccccuaucc

SEQ ID NO: 2172767 - RNA, 12 nt, Homo sapiens
uuaauucuuaag

SEQ ID NO: 2172768 - RNA, 23 nt, Homo sapiens
ugcuaccucagugcuccuggaaa

SEQ ID NO: 2172769 - RNA, 14 nt, Homo sapiens
uacagaauguucua

SEQ ID NO: 2172770 - RNA, 22 nt, Homo sapiens
ccaacaaacaaugccaucacug

SEQ ID NO: 2172771 - RNA, 17 nt, Homo sapiens
ucccauuucaucagcaa

SEQ ID NO: 2172772 - RNA, 19 nt, Homo sapiens
agugacaagggcacaagcu

SEQ ID NO: 2172773 - RNA, 20 nt, Homo sapiens
gaaauaugugguuuccacga

SEQ ID NO: 2172774 - RNA, 15 nt, Homo sapiens
augccacccucaucu

SEQ ID NO: 2172775 - RNA, 22 nt, Homo sapiens
uaaaaaacauaaauuucuuuaa

SEQ ID NO: 2172776 - RNA, 15 nt, Homo sapiens
agauucugaacuaaa

SEQ ID NO: 2172777 - RNA, 19 nt, Homo sapiens
uuauauuuuggguacugga

SEQ ID NO: 2172778 - RNA, 18 nt, Homo sapiens
uaagcauuuagugcucag

SEQ ID NO: 2172779 - RNA, 16 nt, Homo sapiens
uugugauguacuguaa

SEQ ID NO: 2172780 - RNA, 17 nt, Homo sapiens
gaucacacacaugcaca

SEQ ID NO: 2172781 - RNA, 20 nt, Homo sapiens
ugccccaccccauccagcca

SEQ ID NO: 2172782 - RNA, 13 nt, Homo sapiens
cugagugcugaaa

SEQ ID NO: 2172783 - RNA, 14 nt, Homo sapiens
ccugacagugccca

SEQ ID NO: 2172784 - RNA, 13 nt, Homo sapiens
acugaagaccucc

SEQ ID NO: 2172785 - RNA, 13 nt, Homo sapiens
acugcagaccuca

SEQ ID NO: 2172786 - RNA, 22 nt, Homo sapiens
uuaauaaacaugucacaauaca

SEQ ID NO: 2172787 - RNA, 14 nt, Homo sapiens
gaccagccugucac

SEQ ID NO: 2172788 - RNA, 15 nt, Homo sapiens
cugcaagcaauguau

SEQ ID NO: 2172789 - RNA, 20 nt, Homo sapiens
gacaauauaagagcuuccaa

SEQ ID NO: 2172790 - RNA, 17 nt, Homo sapiens
ggagggaagggagccaa

SEQ ID NO: 2172791 - RNA, 23 nt, Homo sapiens
uaaagcuuguuuguucuaguuag

SEQ ID NO: 2172792 - RNA, 16 nt, Homo sapiens
gcaucuacacaauuua

SEQ ID NO: 2172793 - RNA, 23 nt, Homo sapiens
caaaugggggaaaaguuagucaa

SEQ ID NO: 2172794 - RNA, 15 nt, Homo sapiens
uugauaaacuuugaa

SEQ ID NO: 2172795 - RNA, 13 nt, Homo sapiens
accagaaguggac

SEQ ID NO: 2172796 - RNA, 15 nt, Homo sapiens
aggacucugcuucag

SEQ ID NO: 2172797 - RNA, 14 nt, Homo sapiens
cucugaugcacugu

SEQ ID NO: 2172798 - RNA, 22 nt, Homo sapiens
uuccagacuuugaaacuauuaa

SEQ ID NO: 2172799 - RNA, 21 nt, Homo sapiens
uguucgacucagccucaggga

SEQ ID NO: 2172800 - RNA, 18 nt, Homo sapiens
gccuuuugcuacgugccu

SEQ ID NO: 2172801 - RNA, 23 nt, Homo sapiens
aaggucugaaauccagcaucuau

SEQ ID NO: 2172802 - RNA, 15 nt, Homo sapiens
uaaagugccagguga

SEQ ID NO: 2172803 - RNA, 22 nt, Homo sapiens
gaccagagcucuggagccaccu

SEQ ID NO: 2172804 - RNA, 12 nt, Homo sapiens
acucugugcaag

SEQ ID NO: 2172805 - RNA, 12 nt, Homo sapiens
uaguucugugac

SEQ ID NO: 2172806 - RNA, 20 nt, Homo sapiens
uaaaauuaucaauaucuaau

SEQ ID NO: 2172807 - RNA, 16 nt, Homo sapiens
ugguguugacauacau

SEQ ID NO: 2172808 - RNA, 17 nt, Homo sapiens
uuacagaggacccuuac

SEQ ID NO: 2172809 - RNA, 16 nt, Homo sapiens
uccagaauaaaacgca

SEQ ID NO: 2172810 - RNA, 16 nt, Homo sapiens
aaguguuuuuacauau

SEQ ID NO: 2172811 - RNA, 14 nt, Homo sapiens
uuagcugcucacuu

SEQ ID NO: 2172812 - RNA, 16 nt, Homo sapiens
gauucucuugccucag

SEQ ID NO: 2172813 - RNA, 23 nt, Homo sapiens
caggcacgaacccaccugcugag

SEQ ID NO: 2172814 - RNA, 21 nt, Homo sapiens
uuaaaaguguauuuuauucag

SEQ ID NO: 2172815 - RNA, 13 nt, Homo sapiens
aacuccuuucuaa

SEQ ID NO: 2172816 - RNA, 21 nt, Homo sapiens
ucaaaaacauggccacaucca

SEQ ID NO: 2172817 - RNA, 16 nt, Homo sapiens
cuuucauaaaaacacu

SEQ ID NO: 2172818 - RNA, 22 nt, Homo sapiens
caagagagccucuuguggaccc

SEQ ID NO: 2172819 - RNA, 22 nt, Homo sapiens
acuggcuaccgaaguaaacuga

SEQ ID NO: 2172820 - RNA, 12 nt, Homo sapiens
cucuugccuuaa

SEQ ID NO: 2172821 - RNA, 18 nt, Homo sapiens
ugguuucaguugacaaaa

SEQ ID NO: 2172822 - RNA, 16 nt, Homo sapiens
ccugcaggcaggcaga

SEQ ID NO: 2172823 - RNA, 21 nt, Homo sapiens
ccuguaugcaacaggcacuca

SEQ ID NO: 2172824 - RNA, 21 nt, Homo sapiens
caaauuaucuugauacauuca

SEQ ID NO: 2172825 - RNA, 16 nt, Homo sapiens
auucaauuuggcaaaa

SEQ ID NO: 2172826 - RNA, 17 nt, Homo sapiens
cuggagacucguggacu

SEQ ID NO: 2172827 - RNA, 18 nt, Homo sapiens
augugugaaaacugguua

SEQ ID NO: 2172828 - RNA, 20 nt, Homo sapiens
aggauaggcuuuauucugca

SEQ ID NO: 2172829 - RNA, 14 nt, Homo sapiens
augauaaugaaacu

SEQ ID NO: 2172830 - RNA, 20 nt, Homo sapiens
ugagucaugaucucccugcc

SEQ ID NO: 2172831 - RNA, 16 nt, Homo sapiens
guucagggcugugauc

SEQ ID NO: 2172832 - RNA, 22 nt, Homo sapiens
gugugugguggggacaacagca

SEQ ID NO: 2172833 - RNA, 14 nt, Homo sapiens
auucaaccacugua

SEQ ID NO: 2172834 - RNA, 17 nt, Homo sapiens
cuucuccaagcuuucag

SEQ ID NO: 2172835 - RNA, 20 nt, Homo sapiens
auuacaguacacauccccag

SEQ ID NO: 2172836 - RNA, 17 nt, Homo sapiens
cuguaacugucucagaa

SEQ ID NO: 2172837 - RNA, 19 nt, Homo sapiens
cacugaaauagagugaauu

SEQ ID NO: 2172838 - RNA, 15 nt, Homo sapiens
aaagagaaccaugug

SEQ ID NO: 2172839 - RNA, 13 nt, Homo sapiens
aggacaugugcuc

SEQ ID NO: 2172840 - RNA, 13 nt, Homo sapiens
aucuuauguugau

SEQ ID NO: 2172841 - RNA, 13 nt, Homo sapiens
uacaaaugaagua

SEQ ID NO: 2172842 - RNA, 17 nt, Homo sapiens
cugagggcagugcccuu

SEQ ID NO: 2172843 - RNA, 12 nt, Homo sapiens
aagcauuugccc

SEQ ID NO: 2172844 - RNA, 21 nt, Homo sapiens
cccuaaugccuaucugaccaa

SEQ ID NO: 2172845 - RNA, 22 nt, Homo sapiens
ggggcuguccugguugcagcca

SEQ ID NO: 2172846 - RNA, 22 nt, Homo sapiens
aaaaugauauucaaucuuaaca

SEQ ID NO: 2172847 - RNA, 20 nt, Homo sapiens
ccuccaccuucuggguucaa

SEQ ID NO: 2172848 - RNA, 13 nt, Homo sapiens
ucgaagcucagcc

SEQ ID NO: 2172849 - RNA, 16 nt, Homo sapiens
caaaggcucuacacau

SEQ ID NO: 2172850 - RNA, 19 nt, Homo sapiens
aguuuuugcuuccugcuau

SEQ ID NO: 2172851 - RNA, 12 nt, Homo sapiens
ggaagaccaaga

SEQ ID NO: 2172852 - RNA, 16 nt, Homo sapiens
cuugugccauagucac

SEQ ID NO: 2172853 - RNA, 14 nt, Homo sapiens
guucauucugugac

SEQ ID NO: 2172854 - RNA, 16 nt, Homo sapiens
gaaugaugguuuccaa

SEQ ID NO: 2172855 - RNA, 12 nt, Homo sapiens
agguaaagcuau

SEQ ID NO: 2172856 - RNA, 16 nt, Homo sapiens
acguggcacacacuga

SEQ ID NO: 2172857 - RNA, 13 nt, Homo sapiens
uuuuaauuuaaca

SEQ ID NO: 2172858 - RNA, 16 nt, Homo sapiens
aucugauuucauuaca

SEQ ID NO: 2172859 - RNA, 13 nt, Homo sapiens
guccacacccagc

SEQ ID NO: 2172860 - RNA, 14 nt, Homo sapiens
ucuaagaaccaaaa

SEQ ID NO: 2172861 - RNA, 20 nt, Homo sapiens
gaaaaaaagguuaacaguaa

SEQ ID NO: 2172862 - RNA, 15 nt, Homo sapiens
auuauauaacuguau

SEQ ID NO: 2172863 - RNA, 16 nt, Homo sapiens
cacugaagugcuugca

SEQ ID NO: 2172864 - RNA, 19 nt, Homo sapiens
cugcaaagucgccagucac

SEQ ID NO: 2172865 - RNA, 14 nt, Homo sapiens
agacucauggauug

SEQ ID NO: 2172866 - RNA, 16 nt, Homo sapiens
aucuugaaaaugccac

SEQ ID NO: 2172867 - RNA, 15 nt, Homo sapiens
ugucccuucucccau

SEQ ID NO: 2172868 - RNA, 17 nt, Homo sapiens
aggcagaauggugggcu

SEQ ID NO: 2172869 - RNA, 22 nt, Homo sapiens
gcugggauuacaggugugggcc

SEQ ID NO: 2172870 - RNA, 16 nt, Homo sapiens
aaaugccaguggugga

SEQ ID NO: 2172871 - RNA, 13 nt, Homo sapiens
cagaacacugucu

SEQ ID NO: 2172872 - RNA, 12 nt, Homo sapiens
gaaagguggugu

SEQ ID NO: 2172873 - RNA, 14 nt, Homo sapiens
cagcaggcauuugc

SEQ ID NO: 2172874 - RNA, 15 nt, Homo sapiens
auaaaggcauuucaa

SEQ ID NO: 2172875 - RNA, 21 nt, Homo sapiens
ggauuugcccacguacccagg

SEQ ID NO: 2172876 - RNA, 11 nt, Homo sapiens
caugugccuuu

SEQ ID NO: 2172877 - RNA, 18 nt, Homo sapiens
uuauaauaaauauauaca

SEQ ID NO: 2172878 - RNA, 17 nt, Homo sapiens
gucccucuaacaucucc

SEQ ID NO: 2172879 - RNA, 15 nt, Homo sapiens
agaguuaaaucucaa

SEQ ID NO: 2172880 - RNA, 21 nt, Homo sapiens
uucuuuaccaaaaccauccau

SEQ ID NO: 2172881 - RNA, 15 nt, Homo sapiens
uggcgaccaccaaag

SEQ ID NO: 2172882 - RNA, 13 nt, Homo sapiens
agcccugccucaa

SEQ ID NO: 2172883 - RNA, 15 nt, Homo sapiens
ggaaugccagggaca

SEQ ID NO: 2172884 - RNA, 13 nt, Homo sapiens
gagagucaaggga

SEQ ID NO: 2172885 - RNA, 19 nt, Homo sapiens
ugaccacguuuauguuuaa

SEQ ID NO: 2172886 - RNA, 13 nt, Homo sapiens
ucccagucuguga

SEQ ID NO: 2172887 - RNA, 14 nt, Homo sapiens
ccagccaugcauug

SEQ ID NO: 2172888 - RNA, 16 nt, Homo sapiens
cuguccccacugcccc

SEQ ID NO: 2172889 - RNA, 21 nt, Homo sapiens
accucgugauccgccuaccuc

SEQ ID NO: 2172890 - RNA, 14 nt, Homo sapiens
ggagccacugggag

SEQ ID NO: 2172891 - RNA, 15 nt, Homo sapiens
ugacucaggauuuaa

SEQ ID NO: 2172892 - RNA, 12 nt, Homo sapiens
ggauuccucacc

SEQ ID NO: 2172893 - RNA, 17 nt, Homo sapiens
ucauucccucucaucuc

SEQ ID NO: 2172894 - RNA, 14 nt, Homo sapiens
ucaugcaugaagga

SEQ ID NO: 2172895 - RNA, 14 nt, Homo sapiens
agugcucucagcug

SEQ ID NO: 2172896 - RNA, 19 nt, Homo sapiens
accuguuuucgcaccuacc

SEQ ID NO: 2172897 - RNA, 18 nt, Homo sapiens
agagauugugguggugcu

SEQ ID NO: 2172898 - RNA, 17 nt, Homo sapiens
uaagagacuggugacau

SEQ ID NO: 2172899 - RNA, 17 nt, Homo sapiens
ucuacuucugucuuccu

SEQ ID NO: 2172900 - RNA, 17 nt, Homo sapiens
uaccucuaaguacauau

SEQ ID NO: 2172901 - RNA, 14 nt, Homo sapiens
agcuugaagcccaa

SEQ ID NO: 2172902 - RNA, 13 nt, Homo sapiens
gcccugaaggcac

SEQ ID NO: 2172903 - RNA, 15 nt, Homo sapiens
acauccaaugcauag

SEQ ID NO: 2172904 - RNA, 12 nt, Homo sapiens
caaauaaacuca

SEQ ID NO: 2172905 - RNA, 21 nt, Homo sapiens
acugaauugaggacuauggaa

SEQ ID NO: 2172906 - RNA, 19 nt, Homo sapiens
augacccaggccuggccag

SEQ ID NO: 2172907 - RNA, 16 nt, Homo sapiens
aucagaaugaaagcuc

SEQ ID NO: 2172908 - RNA, 13 nt, Homo sapiens
uuauaacuguugu

SEQ ID NO: 2172909 - RNA, 13 nt, Homo sapiens
ccacuuaccucaa

SEQ ID NO: 2172910 - RNA, 13 nt, Homo sapiens
cacccugagggug

SEQ ID NO: 2172911 - RNA, 16 nt, Homo sapiens
gaaaaaccacucccag

SEQ ID NO: 2172912 - RNA, 18 nt, Homo sapiens
ccuauaccccucaucaca

SEQ ID NO: 2172913 - RNA, 18 nt, Homo sapiens
auacaguaagcugcucua

SEQ ID NO: 2172914 - RNA, 15 nt, Homo sapiens
uuugcuucucuccac

SEQ ID NO: 2172915 - RNA, 22 nt, Homo sapiens
gccguggcugcugugggaaaug

SEQ ID NO: 2172916 - RNA, 20 nt, Homo sapiens
acuuaaguuuuagaaaugag

SEQ ID NO: 2172917 - RNA, 19 nt, Homo sapiens
cuucacauuuguaugugug

SEQ ID NO: 2172918 - RNA, 19 nt, Homo sapiens
gaagagccugacuguguuc

SEQ ID NO: 2172919 - RNA, 14 nt, Homo sapiens
gaagaagaaaauca

SEQ ID NO: 2172920 - RNA, 13 nt, Homo sapiens
gacucagcacugu

SEQ ID NO: 2172921 - RNA, 16 nt, Homo sapiens
gccaacucacucuuau

SEQ ID NO: 2172922 - RNA, 19 nt, Homo sapiens
ucacagaacuauguacuuu

SEQ ID NO: 2172923 - RNA, 22 nt, Homo sapiens
aacuggacuugucuuccuuggc

SEQ ID NO: 2172924 - RNA, 19 nt, Homo sapiens
uggcaacagagcaagacuc

SEQ ID NO: 2172925 - RNA, 15 nt, Homo sapiens
gccagaugcaggaca

SEQ ID NO: 2172926 - RNA, 20 nt, Homo sapiens
uauucuuuacaaacugaaga

SEQ ID NO: 2172927 - RNA, 16 nt, Homo sapiens
cuggccacagccuucc

SEQ ID NO: 2172928 - RNA, 11 nt, Homo sapiens
agccaccacug

SEQ ID NO: 2172929 - RNA, 22 nt, Homo sapiens
caugugacaugaacccauccaa

SEQ ID NO: 2172930 - RNA, 15 nt, Homo sapiens
augacaacaaucuca

SEQ ID NO: 2172931 - RNA, 20 nt, Homo sapiens
aggguccugaguggcugaaa

SEQ ID NO: 2172932 - RNA, 15 nt, Homo sapiens
cggacugaccaaauc

SEQ ID NO: 2172933 - RNA, 12 nt, Homo sapiens
aguucaguuugu

SEQ ID NO: 2172934 - RNA, 16 nt, Homo sapiens
aguucaauggcugcug

SEQ ID NO: 2172935 - RNA, 17 nt, Homo sapiens
cuuuccaaggaagcaga

SEQ ID NO: 2172936 - RNA, 23 nt, Homo sapiens
cacuuugugaucucauggcuuug

SEQ ID NO: 2172937 - RNA, 20 nt, Homo sapiens
acagggucucuagugcugug

SEQ ID NO: 2172938 - RNA, 19 nt, Homo sapiens
gcuuauuuugguugcaguu

SEQ ID NO: 2172939 - RNA, 21 nt, Homo sapiens
uguguaaaaaaaccaccaaaa

SEQ ID NO: 2172940 - RNA, 17 nt, Homo sapiens
agcauuaauaaaacugu

SEQ ID NO: 2172941 - RNA, 12 nt, Homo sapiens
gccugccccuga

SEQ ID NO: 2172942 - RNA, 17 nt, Homo sapiens
ugcauugugaauugccu

SEQ ID NO: 2172943 - RNA, 22 nt, Homo sapiens
uaaaggagaaaagugggcugca

SEQ ID NO: 2172944 - RNA, 19 nt, Homo sapiens
uuucagcuccuucaaugca

SEQ ID NO: 2172945 - RNA, 20 nt, Homo sapiens
cugcccugacccuuccacag

SEQ ID NO: 2172946 - RNA, 16 nt, Homo sapiens
cuaaaugaacuaauga

SEQ ID NO: 2172947 - RNA, 16 nt, Homo sapiens
acugucucgaacuauu

SEQ ID NO: 2172948 - RNA, 19 nt, Homo sapiens
augcggccugcaugguggg

SEQ ID NO: 2172949 - RNA, 16 nt, Homo sapiens
gcaugguaaugaagga

SEQ ID NO: 2172950 - RNA, 20 nt, Homo sapiens
gauauugggacacacaucaa

SEQ ID NO: 2172951 - RNA, 20 nt, Homo sapiens
auccagggcccccaucucau

SEQ ID NO: 2172952 - RNA, 18 nt, Homo sapiens
uauauguguauacauaca

SEQ ID NO: 2172953 - RNA, 19 nt, Homo sapiens
cccuucuuacaaugcauuc

SEQ ID NO: 2172954 - RNA, 21 nt, Homo sapiens
uccauggugauuccugggaag

SEQ ID NO: 2172955 - RNA, 20 nt, Homo sapiens
ggugcagucuuggcucacua

SEQ ID NO: 2172956 - RNA, 22 nt, Homo sapiens
auucaguucuuacacauuccau

SEQ ID NO: 2172957 - RNA, 19 nt, Homo sapiens
gcagggcccacccauguca

SEQ ID NO: 2172958 - RNA, 21 nt, Homo sapiens
auauaugcuaagcauaauuaa

SEQ ID NO: 2172959 - RNA, 22 nt, Homo sapiens
uucaaucugaagauacaugucu

SEQ ID NO: 2172960 - RNA, 22 nt, Homo sapiens
uuuagauccuaagucucuuaca

SEQ ID NO: 2172961 - RNA, 20 nt, Homo sapiens
cauuucaaaucuguagcaua

SEQ ID NO: 2172962 - RNA, 20 nt, Homo sapiens
aaaugcagucuuaccaauga

SEQ ID NO: 2172963 - RNA, 20 nt, Homo sapiens
ccugacaggcugugacucuu

SEQ ID NO: 2172964 - RNA, 18 nt, Homo sapiens
gcuccccucgacagcucu

SEQ ID NO: 2172965 - RNA, 23 nt, Homo sapiens
accuuaaauacacugaauugaau

SEQ ID NO: 2172966 - RNA, 13 nt, Homo sapiens
aaaacuguauuua

SEQ ID NO: 2172967 - RNA, 15 nt, Homo sapiens
aaguacuguaacugu

SEQ ID NO: 2172968 - RNA, 22 nt, Homo sapiens
gccgugcucgcccacaaacuga

SEQ ID NO: 2172969 - RNA, 13 nt, Homo sapiens
gcuccggggccag

SEQ ID NO: 2172970 - RNA, 21 nt, Homo sapiens
uccaaaguucuuaucucuagc

SEQ ID NO: 2172971 - RNA, 14 nt, Homo sapiens
gcuacuccacugac

SEQ ID NO: 2172972 - RNA, 17 nt, Homo sapiens
uccaacaccacagacac

SEQ ID NO: 2172973 - RNA, 22 nt, Homo sapiens
acugagaagaucaaugaucacc

SEQ ID NO: 2172974 - RNA, 15 nt, Homo sapiens
gaagguauaucagga

SEQ ID NO: 2172975 - RNA, 15 nt, Homo sapiens
ucaguaacacagugc

SEQ ID NO: 2172976 - RNA, 13 nt, Homo sapiens
gaggugaaauuca

SEQ ID NO: 2172977 - RNA, 14 nt, Homo sapiens
aagggugcugugau

SEQ ID NO: 2172978 - RNA, 13 nt, Homo sapiens
ugcagcacgccaa

SEQ ID NO: 2172979 - RNA, 16 nt, Homo sapiens
uacuagggagccauuu

SEQ ID NO: 2172980 - RNA, 21 nt, Homo sapiens
cacugaaccacauucagggaa

SEQ ID NO: 2172981 - RNA, 19 nt, Homo sapiens
auuuauuuccuaguucugu

SEQ ID NO: 2172982 - RNA, 12 nt, Homo sapiens
ccugaacaagaa

SEQ ID NO: 2172983 - RNA, 23 nt, Homo sapiens
guuaguugugaaagaaagcugag

SEQ ID NO: 2172984 - RNA, 23 nt, Homo sapiens
ucuggggcuggcaccagcaggca

SEQ ID NO: 2172985 - RNA, 13 nt, Homo sapiens
caggccacugacc

SEQ ID NO: 2172986 - RNA, 17 nt, Homo sapiens
aagcuguuguacauuua

SEQ ID NO: 2172987 - RNA, 22 nt, Homo sapiens
gcacuaaaagugaugugauuua

SEQ ID NO: 2172988 - RNA, 20 nt, Homo sapiens
aacuccuaaauaaacuagua

SEQ ID NO: 2172989 - RNA, 15 nt, Homo sapiens
ugcuccugcaucuca

SEQ ID NO: 2172990 - RNA, 18 nt, Homo sapiens
cucucuaccagucuauuu

SEQ ID NO: 2172991 - RNA, 21 nt, Homo sapiens
ugcuugugucccuccugggau

SEQ ID NO: 2172992 - RNA, 18 nt, Homo sapiens
ucucuuuacuugaaauuu

SEQ ID NO: 2172993 - RNA, 17 nt, Homo sapiens
aaauacuggacucagga

SEQ ID NO: 2172994 - RNA, 13 nt, Homo sapiens
auuacacauuuca

SEQ ID NO: 2172995 - RNA, 22 nt, Homo sapiens
gcuggggacacacauucugccu

SEQ ID NO: 2172996 - RNA, 18 nt, Homo sapiens
gaggacucuauucuuuaa

SEQ ID NO: 2172997 - RNA, 14 nt, Homo sapiens
gccccacacucccc

SEQ ID NO: 2172998 - RNA, 14 nt, Homo sapiens
cccucccagucuca

SEQ ID NO: 2172999 - RNA, 15 nt, Homo sapiens
auaaacacucuugaa

SEQ ID NO: 2173000 - RNA, 14 nt, Homo sapiens
aaaacaagccuuaa

SEQ ID NO: 2173001 - RNA, 22 nt, Homo sapiens
gccccuggggccuagacucugu

SEQ ID NO: 2173002 - RNA, 13 nt, Homo sapiens
aggaaguugcuga

SEQ ID NO: 2173003 - RNA, 18 nt, Homo sapiens
ugcagaaggcaggaucaa

SEQ ID NO: 2173004 - RNA, 16 nt, Homo sapiens
acggggcuugcaacuu

SEQ ID NO: 2173005 - RNA, 21 nt, Homo sapiens
cucccagggucccugcccacu

SEQ ID NO: 2173006 - RNA, 22 nt, Homo sapiens
cugaaacauuuggaagccccau

SEQ ID NO: 2173007 - RNA, 15 nt, Homo sapiens
agccugacuguguuc

SEQ ID NO: 2173008 - RNA, 17 nt, Homo sapiens
aauuccugcagcaguua

SEQ ID NO: 2173009 - RNA, 20 nt, Homo sapiens
acaugacauucuuagcugua

SEQ ID NO: 2173010 - RNA, 15 nt, Homo sapiens
ccucccaaaguacug

SEQ ID NO: 2173011 - RNA, 20 nt, Homo sapiens
uccccuccacucucuaccag

SEQ ID NO: 2173012 - RNA, 17 nt, Homo sapiens
uaucagaaucuugucca

SEQ ID NO: 2173013 - RNA, 18 nt, Homo sapiens
cuuaaauguuuauacugu

SEQ ID NO: 2173014 - RNA, 15 nt, Homo sapiens
gaaugcccacugccu

SEQ ID NO: 2173015 - RNA, 23 nt, Homo sapiens
uuaaaucaccauagggcugggga

SEQ ID NO: 2173016 - RNA, 17 nt, Homo sapiens
ccagaacuguuuucuca

SEQ ID NO: 2173017 - RNA, 13 nt, Homo sapiens
caggccccaugac

SEQ ID NO: 2173018 - RNA, 12 nt, Homo sapiens
uuuuagucacua

SEQ ID NO: 2173019 - RNA, 22 nt, Homo sapiens
aaauaugagaugcguuguuaca

SEQ ID NO: 2173020 - RNA, 21 nt, Homo sapiens
gccggacugggcagauccuca

SEQ ID NO: 2173021 - RNA, 15 nt, Homo sapiens
agaguaaacagacag

SEQ ID NO: 2173022 - RNA, 14 nt, Homo sapiens
uaauaugcugccaa

SEQ ID NO: 2173023 - RNA, 21 nt, Homo sapiens
cagguagaacacaaggucauu

SEQ ID NO: 2173024 - RNA, 21 nt, Homo sapiens
aaauggcauuuuuuuaguaaa

SEQ ID NO: 2173025 - RNA, 16 nt, Homo sapiens
gagagagugcugagaa

SEQ ID NO: 2173026 - RNA, 16 nt, Homo sapiens
uauuaaaaaaguggug

SEQ ID NO: 2173027 - RNA, 17 nt, Homo sapiens
gggugccaaguccuagc

SEQ ID NO: 2173028 - RNA, 21 nt, Homo sapiens
uggaaaaagcgcuguuuccuu

SEQ ID NO: 2173029 - RNA, 14 nt, Homo sapiens
cuauuaaaauugcc

SEQ ID NO: 2173030 - RNA, 19 nt, Homo sapiens
agccaaacccuugucagug

SEQ ID NO: 2173031 - RNA, 15 nt, Homo sapiens
gaguuugcauucuua

SEQ ID NO: 2173032 - RNA, 18 nt, Homo sapiens
ucuuauuaaucauacaaa

SEQ ID NO: 2173033 - RNA, 14 nt, Homo sapiens
ccuucccuccucau

SEQ ID NO: 2173034 - RNA, 16 nt, Homo sapiens
aguagaucauguucac

SEQ ID NO: 2173035 - RNA, 13 nt, Homo sapiens
acucgcgcuacaa

SEQ ID NO: 2173036 - RNA, 20 nt, Homo sapiens
agucacuguucgucacucaa

SEQ ID NO: 2173037 - RNA, 19 nt, Homo sapiens
ugcuuauguaugccuauuc

SEQ ID NO: 2173038 - RNA, 10 nt, Homo sapiens
aaucccucaa

SEQ ID NO: 2173039 - RNA, 13 nt, Homo sapiens
caacaaaccacac

SEQ ID NO: 2173040 - RNA, 13 nt, Homo sapiens
caaccaaccacaa

SEQ ID NO: 2173041 - RNA, 20 nt, Homo sapiens
gcuggagugcaguggugcaa

SEQ ID NO: 2173042 - RNA, 16 nt, Homo sapiens
agaaaauuagacugug

SEQ ID NO: 2173043 - RNA, 19 nt, Homo sapiens
agaguugaggauguggcac

SEQ ID NO: 2173044 - RNA, 15 nt, Homo sapiens
caggcacacacugug

SEQ ID NO: 2173045 - RNA, 18 nt, Homo sapiens
auccacaacuuguaccaa

SEQ ID NO: 2173046 - RNA, 14 nt, Homo sapiens
uuuccugcuacuua

SEQ ID NO: 2173047 - RNA, 16 nt, Homo sapiens
cuuccaggcacucaaa

SEQ ID NO: 2173048 - RNA, 20 nt, Homo sapiens
aagaaagacucuauucucaa

SEQ ID NO: 2173049 - RNA, 22 nt, Homo sapiens
uaggccuggggacggcuuuuac

SEQ ID NO: 2173050 - RNA, 23 nt, Homo sapiens
aaagcuuggagggaagccgugaa

SEQ ID NO: 2173051 - RNA, 14 nt, Homo sapiens
ucuuauauauguga

SEQ ID NO: 2173052 - RNA, 15 nt, Homo sapiens
uacaaauacaugugu

SEQ ID NO: 2173053 - RNA, 13 nt, Homo sapiens
gugcacauucucc

SEQ ID NO: 2173054 - RNA, 21 nt, Homo sapiens
auccacauuguagccuaauau

SEQ ID NO: 2173055 - RNA, 20 nt, Homo sapiens
auguguagccuucuccccaa

SEQ ID NO: 2173056 - RNA, 16 nt, Homo sapiens
gacagggucucacucu

SEQ ID NO: 2173057 - RNA, 23 nt, Homo sapiens
agaccaggccugagcaacaaagc

SEQ ID NO: 2173058 - RNA, 21 nt, Homo sapiens
acaaucccuggggcugugcau

SEQ ID NO: 2173059 - RNA, 20 nt, Homo sapiens
auguuuuuuuucugcuggaa

SEQ ID NO: 2173060 - RNA, 18 nt, Homo sapiens
aauguauagacucagugc

SEQ ID NO: 2173061 - RNA, 19 nt, Homo sapiens
aggccaguguggugucuug

SEQ ID NO: 2173062 - RNA, 20 nt, Homo sapiens
guggcaugaucauagcucac

SEQ ID NO: 2173063 - RNA, 15 nt, Homo sapiens
aguccacccugccug

SEQ ID NO: 2173064 - RNA, 23 nt, Homo sapiens
gcaggccuccaacgccccugugg

SEQ ID NO: 2173065 - RNA, 22 nt, Homo sapiens
aaaaguucaaccucuuacaaua

SEQ ID NO: 2173066 - RNA, 22 nt, Homo sapiens
gaccaaaauaccuuggucauuu

SEQ ID NO: 2173067 - RNA, 16 nt, Homo sapiens
cagguaaaauagucau

SEQ ID NO: 2173068 - RNA, 19 nt, Homo sapiens
caucaaauaaacucaaagu

SEQ ID NO: 2173069 - RNA, 18 nt, Homo sapiens
accugaaaacacugugca

SEQ ID NO: 2173070 - RNA, 19 nt, Homo sapiens
cuugcaacacacagacaca

SEQ ID NO: 2173071 - RNA, 15 nt, Homo sapiens
uggugagcaccugua

SEQ ID NO: 2173072 - RNA, 18 nt, Homo sapiens
aucacaaaccaagccaug

SEQ ID NO: 2173073 - RNA, 16 nt, Homo sapiens
uuuacuaucauucuca

SEQ ID NO: 2173074 - RNA, 21 nt, Homo sapiens
uuauguugaauccacccaaau

SEQ ID NO: 2173075 - RNA, 20 nt, Homo sapiens
gugcaaagauuugcuuuaau

SEQ ID NO: 2173076 - RNA, 19 nt, Homo sapiens
uaacagucugcaucaucau

SEQ ID NO: 2173077 - RNA, 18 nt, Homo sapiens
cuccucacuuggcugucu

SEQ ID NO: 2173078 - RNA, 14 nt, Homo sapiens
uauuaucacaucaa

SEQ ID NO: 2173079 - RNA, 22 nt, Homo sapiens
auggccaggccucagggaccaa

SEQ ID NO: 2173080 - RNA, 20 nt, Homo sapiens
caguccuggguuguuuccag

SEQ ID NO: 2173081 - RNA, 15 nt, Homo sapiens
gauuccaaaccaaca

SEQ ID NO: 2173082 - RNA, 16 nt, Homo sapiens
cauccagccacugccc

SEQ ID NO: 2173083 - RNA, 13 nt, Homo sapiens
aaaggacccugug

SEQ ID NO: 2173084 - RNA, 17 nt, Homo sapiens
uaucccugcccauuuca

SEQ ID NO: 2173085 - RNA, 18 nt, Homo sapiens
uaaccccugccuggauuu

SEQ ID NO: 2173086 - RNA, 19 nt, Homo sapiens
ugugauuauaaaaucauga

SEQ ID NO: 2173087 - RNA, 19 nt, Homo sapiens
cgugugcgugcaugugcac

SEQ ID NO: 2173088 - RNA, 16 nt, Homo sapiens
auuucccauuuuggaa

SEQ ID NO: 2173089 - RNA, 20 nt, Homo sapiens
accucuagacugguucauuc

SEQ ID NO: 2173090 - RNA, 16 nt, Homo sapiens
uaucaagaggaucuga

SEQ ID NO: 2173091 - RNA, 16 nt, Homo sapiens
ucaugcaaaugcugua

SEQ ID NO: 2173092 - RNA, 21 nt, Homo sapiens
accugucccccacucucucac

SEQ ID NO: 2173093 - RNA, 19 nt, Homo sapiens
gaguaaaaauucauauaaa

SEQ ID NO: 2173094 - RNA, 18 nt, Homo sapiens
aguauuccuguaauacua

SEQ ID NO: 2173095 - RNA, 15 nt, Homo sapiens
cuacuuaaugagaua

SEQ ID NO: 2173096 - RNA, 16 nt, Homo sapiens
acccaggcacugggca

SEQ ID NO: 2173097 - RNA, 20 nt, Homo sapiens
acuagacugccacaaggaag

SEQ ID NO: 2173098 - RNA, 22 nt, Homo sapiens
uauuaaaauaagcacugugcua

SEQ ID NO: 2173099 - RNA, 12 nt, Homo sapiens
uucuauauccaa

SEQ ID NO: 2173100 - RNA, 21 nt, Homo sapiens
ggcgcaguggcucaugccugu

SEQ ID NO: 2173101 - RNA, 14 nt, Homo sapiens
cagccucugccagc

SEQ ID NO: 2173102 - RNA, 17 nt, Homo sapiens
ugcauaaccgcacagac

SEQ ID NO: 2173103 - RNA, 22 nt, Homo sapiens
aaaaccugaugcagugcuccau

SEQ ID NO: 2173104 - RNA, 18 nt, Homo sapiens
agaagcagcaacuugcaa

SEQ ID NO: 2173105 - RNA, 21 nt, Homo sapiens
gagauucccaccuuccauagc

SEQ ID NO: 2173106 - RNA, 15 nt, Homo sapiens
auuucugaccuugua

SEQ ID NO: 2173107 - RNA, 13 nt, Homo sapiens
agcuaacaccaga

SEQ ID NO: 2173108 - RNA, 16 nt, Homo sapiens
uuuuaaaaccauuuaa

SEQ ID NO: 2173109 - RNA, 15 nt, Homo sapiens
guggcauuuucacuu

SEQ ID NO: 2173110 - RNA, 19 nt, Homo sapiens
ugcgccucaccagaaccag

SEQ ID NO: 2173111 - RNA, 23 nt, Homo sapiens
auaaagggugucuaucauaugaa

SEQ ID NO: 2173112 - RNA, 15 nt, Homo sapiens
gccuauuguugaaua

SEQ ID NO: 2173113 - RNA, 20 nt, Homo sapiens
augaccagguaacaucauca

SEQ ID NO: 2173114 - RNA, 15 nt, Homo sapiens
ccagcaggacacuga

SEQ ID NO: 2173115 - RNA, 16 nt, Homo sapiens
uuucuucaccaagugc

SEQ ID NO: 2173116 - RNA, 20 nt, Homo sapiens
caaggccaaaggaagcacau

SEQ ID NO: 2173117 - RNA, 14 nt, Homo sapiens
gauuaucugucauu

SEQ ID NO: 2173118 - RNA, 18 nt, Homo sapiens
uccuggugucaccccaga

SEQ ID NO: 2173119 - RNA, 19 nt, Homo sapiens
caaaugccuuucuagcaau

SEQ ID NO: 2173120 - RNA, 18 nt, Homo sapiens
caagaagaaaguguucaa

SEQ ID NO: 2173121 - RNA, 13 nt, Homo sapiens
cauacucauuuaa

SEQ ID NO: 2173122 - RNA, 19 nt, Homo sapiens
agccagguucacacucaga

SEQ ID NO: 2173123 - RNA, 15 nt, Homo sapiens
uaaauuccccuuccc

SEQ ID NO: 2173124 - RNA, 17 nt, Homo sapiens
aaaaugagugugaaggg

SEQ ID NO: 2173125 - RNA, 16 nt, Homo sapiens
gacugugccagcacaa

SEQ ID NO: 2173126 - RNA, 14 nt, Homo sapiens
gccacacacugagu

SEQ ID NO: 2173127 - RNA, 13 nt, Homo sapiens
auucacccugugu

SEQ ID NO: 2173128 - RNA, 21 nt, Homo sapiens
gacaucaaagugguaaauacu

SEQ ID NO: 2173129 - RNA, 23 nt, Homo sapiens
uaugguguggaugggaaacugcu

SEQ ID NO: 2173130 - RNA, 19 nt, Homo sapiens
aguuucuguaaaugacacu

SEQ ID NO: 2173131 - RNA, 17 nt, Homo sapiens
uacugugaaacuggcac

SEQ ID NO: 2173132 - RNA, 16 nt, Homo sapiens
auuuuccugaaagugu

SEQ ID NO: 2173133 - RNA, 20 nt, Homo sapiens
agaacgagacuccaccucaa

SEQ ID NO: 2173134 - RNA, 20 nt, Homo sapiens
gaagaaguuaucaacaugca

SEQ ID NO: 2173135 - RNA, 22 nt, Homo sapiens
agaaaaugaagcccuauuacuu

SEQ ID NO: 2173136 - RNA, 12 nt, Homo sapiens
gagguggcugcu

SEQ ID NO: 2173137 - RNA, 12 nt, Homo sapiens
uuacuucaugag

SEQ ID NO: 2173138 - RNA, 15 nt, Homo sapiens
uuugggcaggucuga

SEQ ID NO: 2173139 - RNA, 21 nt, Homo sapiens
agaaaugcuuuccaaaaccgc

SEQ ID NO: 2173140 - RNA, 15 nt, Homo sapiens
ccccagcccugugga

SEQ ID NO: 2173141 - RNA, 18 nt, Homo sapiens
ugugaagauuuaaucuca

SEQ ID NO: 2173142 - RNA, 15 nt, Homo sapiens
agugaggugacacuc

SEQ ID NO: 2173143 - RNA, 17 nt, Homo sapiens
guaggagcccuucucuu

SEQ ID NO: 2173144 - RNA, 16 nt, Homo sapiens
auugaauauaacuuuu

SEQ ID NO: 2173145 - RNA, 13 nt, Homo sapiens
cagggaggcugug

SEQ ID NO: 2173146 - RNA, 22 nt, Homo sapiens
cuguguguuuucccaaagcacu

SEQ ID NO: 2173147 - RNA, 14 nt, Homo sapiens
gaaugcuauguucu

SEQ ID NO: 2173148 - RNA, 21 nt, Homo sapiens
uuucucuuagaaaagcuaaga

SEQ ID NO: 2173149 - RNA, 23 nt, Homo sapiens
aaggugaggucugggaugcugcg

SEQ ID NO: 2173150 - RNA, 18 nt, Homo sapiens
cuaccauucaaaauugcu

SEQ ID NO: 2173151 - RNA, 20 nt, Homo sapiens
uccuuuacaaccauacuuua

SEQ ID NO: 2173152 - RNA, 22 nt, Homo sapiens
aucagaaaaccaaagggugcua

SEQ ID NO: 2173153 - RNA, 22 nt, Homo sapiens
gcucaaagaguggcuugaauau

SEQ ID NO: 2173154 - RNA, 13 nt, Homo sapiens
ggaaaaucucagc

SEQ ID NO: 2173155 - RNA, 16 nt, Homo sapiens
gugcgcgaugugacag

SEQ ID NO: 2173156 - RNA, 13 nt, Homo sapiens
cuagcuaaaugac

SEQ ID NO: 2173157 - RNA, 23 nt, Homo sapiens
aauacagauagauauaugcucug

SEQ ID NO: 2173158 - RNA, 18 nt, Homo sapiens
ccaaaaggccuuuggaaa

SEQ ID NO: 2173159 - RNA, 21 nt, Homo sapiens
guuauuucaaccagcacauuc

SEQ ID NO: 2173160 - RNA, 14 nt, Homo sapiens
ugacaggcaguguu

SEQ ID NO: 2173161 - RNA, 19 nt, Homo sapiens
ugaggacauaaaucuucca

SEQ ID NO: 2173162 - RNA, 11 nt, Homo sapiens
aaacacuguuu

SEQ ID NO: 2173163 - RNA, 13 nt, Homo sapiens
uauuaacucugca

SEQ ID NO: 2173164 - RNA, 21 nt, Homo sapiens
gaauucaccuugguguuucuc

SEQ ID NO: 2173165 - RNA, 18 nt, Homo sapiens
auaugccagugacugcug

SEQ ID NO: 2173166 - RNA, 22 nt, Homo sapiens
auggugcguggcuucccugucc

SEQ ID NO: 2173167 - RNA, 13 nt, Homo sapiens
cucuauuaucuca

SEQ ID NO: 2173168 - RNA, 21 nt, Homo sapiens
agggcccucugaggcucagcc

SEQ ID NO: 2173169 - RNA, 15 nt, Homo sapiens
uacguuggugcaagu

SEQ ID NO: 2173170 - RNA, 15 nt, Homo sapiens
uauauuugugugagg

SEQ ID NO: 2173171 - RNA, 21 nt, Homo sapiens
uugacucgauuuaaacuccag

SEQ ID NO: 2173172 - RNA, 16 nt, Homo sapiens
uaguuaauccaaacau

SEQ ID NO: 2173173 - RNA, 16 nt, Homo sapiens
acuguggccugaaaua

SEQ ID NO: 2173174 - RNA, 21 nt, Homo sapiens
uguucacgcucacccagucac

SEQ ID NO: 2173175 - RNA, 22 nt, Homo sapiens
gcuucucuugcuaccugugagc

SEQ ID NO: 2173176 - RNA, 15 nt, Homo sapiens
aggcucccacugccc

SEQ ID NO: 2173177 - RNA, 22 nt, Homo sapiens
cuggaagaucauggaccuggug

SEQ ID NO: 2173178 - RNA, 15 nt, Homo sapiens
aaaaggugucuugcu

SEQ ID NO: 2173179 - RNA, 15 nt, Homo sapiens
aaaucaaaugugcau

SEQ ID NO: 2173180 - RNA, 19 nt, Homo sapiens
gcuguggcucacgccugua

SEQ ID NO: 2173181 - RNA, 18 nt, Homo sapiens
acccauuucuuaccaugc

SEQ ID NO: 2173182 - RNA, 17 nt, Homo sapiens
uucccagcuacaccuuu

SEQ ID NO: 2173183 - RNA, 18 nt, Homo sapiens
agcggagagagccaagac

SEQ ID NO: 2173184 - RNA, 15 nt, Homo sapiens
ugaauagaacucuga

SEQ ID NO: 2173185 - RNA, 18 nt, Homo sapiens
ucaccugcuggggaccuc

SEQ ID NO: 2173186 - RNA, 17 nt, Homo sapiens
uauuucagauucaccuc

SEQ ID NO: 2173187 - RNA, 15 nt, Homo sapiens
aauaaucuaaauuca

SEQ ID NO: 2173188 - RNA, 21 nt, Homo sapiens
caaugagccacagcaaaaagu

SEQ ID NO: 2173189 - RNA, 13 nt, Homo sapiens
guaggauugcugu

SEQ ID NO: 2173190 - RNA, 22 nt, Homo sapiens
aaggacaccuccuuccucaguc

SEQ ID NO: 2173191 - RNA, 22 nt, Homo sapiens
uuuaaagguagagaugugugug

SEQ ID NO: 2173192 - RNA, 12 nt, Homo sapiens
gcucuccauacu

SEQ ID NO: 2173193 - RNA, 14 nt, Homo sapiens
cuucagauguggag

SEQ ID NO: 2173194 - RNA, 15 nt, Homo sapiens
cccaccaucaugucu

SEQ ID NO: 2173195 - RNA, 18 nt, Homo sapiens
uggggcaauaacaaauca

SEQ ID NO: 2173196 - RNA, 14 nt, Homo sapiens
cagucuaaagaaga

SEQ ID NO: 2173197 - RNA, 16 nt, Homo sapiens
uugaaaccugauguca

SEQ ID NO: 2173198 - RNA, 19 nt, Homo sapiens
agccaaaauagagaguaua

SEQ ID NO: 2173199 - RNA, 15 nt, Homo sapiens
aaaugauagcagaau

SEQ ID NO: 2173200 - RNA, 16 nt, Homo sapiens
aggggcucucugugca

SEQ ID NO: 2173201 - RNA, 10 nt, Homo sapiens
caaguagcca

SEQ ID NO: 2173202 - RNA, 15 nt, Homo sapiens
gugucaaccccaaau

SEQ ID NO: 2173203 - RNA, 19 nt, Homo sapiens
caaugaaauauuugcuuau

SEQ ID NO: 2173204 - RNA, 21 nt, Homo sapiens
aacuguagccugaguguccac

SEQ ID NO: 2173205 - RNA, 16 nt, Homo sapiens
uacauguucuugucau

SEQ ID NO: 2173206 - RNA, 19 nt, Homo sapiens
cuugaaaagaagcaaggaa

SEQ ID NO: 2173207 - RNA, 21 nt, Homo sapiens
aauucucauaaguagcauuca

SEQ ID NO: 2173208 - RNA, 15 nt, Homo sapiens
guugaagaaggguua

SEQ ID NO: 2173209 - RNA, 15 nt, Homo sapiens
cucaccucucgcaag

SEQ ID NO: 2173210 - RNA, 17 nt, Homo sapiens
ucaauccuaucacaguc

SEQ ID NO: 2173211 - RNA, 20 nt, Homo sapiens
aguuuugguuccuccacugg

SEQ ID NO: 2173212 - RNA, 14 nt, Homo sapiens
cuccaggauuuccu

SEQ ID NO: 2173213 - RNA, 23 nt, Homo sapiens
acaaauuggagcagggacagauc

SEQ ID NO: 2173214 - RNA, 20 nt, Homo sapiens
aaauccccauugaagauguc

SEQ ID NO: 2173215 - RNA, 17 nt, Homo sapiens
aagaccagccuggucaa

SEQ ID NO: 2173216 - RNA, 20 nt, Homo sapiens
caguuuaugcagugcugcuu

SEQ ID NO: 2173217 - RNA, 13 nt, Homo sapiens
agauauggaguua

SEQ ID NO: 2173218 - RNA, 17 nt, Homo sapiens
uaauuuggaaacuaaua

SEQ ID NO: 2173219 - RNA, 19 nt, Homo sapiens
gcauucccagcucuacccu

SEQ ID NO: 2173220 - RNA, 17 nt, Homo sapiens
agccuuggcucuacccu

SEQ ID NO: 2173221 - RNA, 14 nt, Homo sapiens
caucugucugcucu

SEQ ID NO: 2173222 - RNA, 24 nt, Homo sapiens
ugcccguucuugaaauguaggcau

SEQ ID NO: 2173223 - RNA, 19 nt, Homo sapiens
uacuuacacaauucaguua

SEQ ID NO: 2173224 - RNA, 18 nt, Homo sapiens
caauuccauuucuuucug

SEQ ID NO: 2173225 - RNA, 13 nt, Homo sapiens
agccuggccuaau

SEQ ID NO: 2173226 - RNA, 22 nt, Homo sapiens
aggauuuguguuuuacaguaua

SEQ ID NO: 2173227 - RNA, 22 nt, Homo sapiens
uuuguccacacaagacagcaga

SEQ ID NO: 2173228 - RNA, 17 nt, Homo sapiens
ucaaaauggcagaacca

SEQ ID NO: 2173229 - RNA, 19 nt, Homo sapiens
ucgauauuagaagcuauau

SEQ ID NO: 2173230 - RNA, 20 nt, Homo sapiens
ccccagugacuccaggguga

SEQ ID NO: 2173231 - RNA, 18 nt, Homo sapiens
uguaucagagggcuuuga

SEQ ID NO: 2173232 - RNA, 23 nt, Homo sapiens
uguuucaaacaagaaacauuuca

SEQ ID NO: 2173233 - RNA, 23 nt, Homo sapiens
gagucugccccacauguggccau

SEQ ID NO: 2173234 - RNA, 21 nt, Homo sapiens
cccugcgggugaacaaagcag

SEQ ID NO: 2173235 - RNA, 13 nt, Homo sapiens
agguggaaugugu

SEQ ID NO: 2173236 - RNA, 15 nt, Homo sapiens
aauccuuccauucca

SEQ ID NO: 2173237 - RNA, 13 nt, Homo sapiens
auaaaccaguuga

SEQ ID NO: 2173238 - RNA, 23 nt, Homo sapiens
agauggcucaacguuuuuggaca

SEQ ID NO: 2173239 - RNA, 22 nt, Homo sapiens
agguacaaucuuucaccaagua

SEQ ID NO: 2173240 - RNA, 17 nt, Homo sapiens
ggaaagaugauggugac

SEQ ID NO: 2173241 - RNA, 14 nt, Homo sapiens
ggccuauuccagga

SEQ ID NO: 2173242 - RNA, 22 nt, Homo sapiens
cccaggcucugggaaggggugc

SEQ ID NO: 2173243 - RNA, 16 nt, Homo sapiens
uauacauugaauucau

SEQ ID NO: 2173244 - RNA, 12 nt, Homo sapiens
ugaaaaaagcca

SEQ ID NO: 2173245 - RNA, 15 nt, Homo sapiens
uuaaaauuuuguaug

SEQ ID NO: 2173246 - RNA, 16 nt, Homo sapiens
aaaccguaaagugccu

SEQ ID NO: 2173247 - RNA, 18 nt, Homo sapiens
uuuaaaauauuugaauga

SEQ ID NO: 2173248 - RNA, 18 nt, Homo sapiens
aacugaggugcaaagggg

SEQ ID NO: 2173249 - RNA, 16 nt, Homo sapiens
ugccaaccagcuuccc

SEQ ID NO: 2173250 - RNA, 19 nt, Homo sapiens
uugauacaacaggauuuuc

SEQ ID NO: 2173251 - RNA, 21 nt, Homo sapiens
cucugaaaggauguagaaaca

SEQ ID NO: 2173252 - RNA, 19 nt, Homo sapiens
ucaaacugacaaccugugc

SEQ ID NO: 2173253 - RNA, 14 nt, Homo sapiens
gcuuccuaacugcu

SEQ ID NO: 2173254 - RNA, 16 nt, Homo sapiens
ucauguguucccuuug

SEQ ID NO: 2173255 - RNA, 14 nt, Homo sapiens
cagauccaccugca

SEQ ID NO: 2173256 - RNA, 21 nt, Homo sapiens
cgagaucucgccacugcacuc

SEQ ID NO: 2173257 - RNA, 18 nt, Homo sapiens
uagaaggggaggacacug

SEQ ID NO: 2173258 - RNA, 14 nt, Homo sapiens
uaucuagcccaaag

SEQ ID NO: 2173259 - RNA, 20 nt, Homo sapiens
auggaagguuagagguuugu

SEQ ID NO: 2173260 - RNA, 19 nt, Homo sapiens
cuaaaugagucacugagca

SEQ ID NO: 2173261 - RNA, 19 nt, Homo sapiens
acucaaaacacccaaaaau

SEQ ID NO: 2173262 - RNA, 14 nt, Homo sapiens
cuuguugcugcauc

SEQ ID NO: 2173263 - RNA, 24 nt, Homo sapiens
uguucuccuaaugcucugaaagga

SEQ ID NO: 2173264 - RNA, 15 nt, Homo sapiens
ugcuauuacuaguac

SEQ ID NO: 2173265 - RNA, 23 nt, Homo sapiens
aggcuuuuauuagaaagccauau

SEQ ID NO: 2173266 - RNA, 19 nt, Homo sapiens
uauccugggagcacugcgu

SEQ ID NO: 2173267 - RNA, 14 nt, Homo sapiens
aaaacacugccugc

SEQ ID NO: 2173268 - RNA, 17 nt, Homo sapiens
guaguuacuguggucac

SEQ ID NO: 2173269 - RNA, 13 nt, Homo sapiens
ugugccagaguua

SEQ ID NO: 2173270 - RNA, 21 nt, Homo sapiens
uccaccucccauuacuuugau

SEQ ID NO: 2173271 - RNA, 18 nt, Homo sapiens
uguaauaaauaugagugc

SEQ ID NO: 2173272 - RNA, 15 nt, Homo sapiens
uggcaucaucucagc

SEQ ID NO: 2173273 - RNA, 19 nt, Homo sapiens
aaauagagaucuuauguca

SEQ ID NO: 2173274 - RNA, 19 nt, Homo sapiens
gaguuacuaauuaguuuau

SEQ ID NO: 2173275 - RNA, 19 nt, Homo sapiens
auuuaggagaagccaggaa

SEQ ID NO: 2173276 - RNA, 20 nt, Homo sapiens
aaacaugcugaaaacuacac

SEQ ID NO: 2173277 - RNA, 20 nt, Homo sapiens
ugaaauauaaacugugagau

SEQ ID NO: 2173278 - RNA, 12 nt, Homo sapiens
cccaaugaauua

SEQ ID NO: 2173279 - RNA, 23 nt, Homo sapiens
aaccagcagaacagccauuuuuc

SEQ ID NO: 2173280 - RNA, 22 nt, Homo sapiens
gcacaauuaauuaaaagugaaa

SEQ ID NO: 2173281 - RNA, 18 nt, Homo sapiens
cuccccagacucucaggu

SEQ ID NO: 2173282 - RNA, 23 nt, Homo sapiens
caaaccaauaaauggcuuacaug

SEQ ID NO: 2173283 - RNA, 14 nt, Homo sapiens
ccacaguugagagg

SEQ ID NO: 2173284 - RNA, 22 nt, Homo sapiens
cuuuuuauggguuuugcuuaaa

SEQ ID NO: 2173285 - RNA, 12 nt, Homo sapiens
aaagaaguacuu

SEQ ID NO: 2173286 - RNA, 13 nt, Homo sapiens
uauaacacaguuu

SEQ ID NO: 2173287 - RNA, 22 nt, Homo sapiens
auuugggcagauauagcauuaa

SEQ ID NO: 2173288 - RNA, 18 nt, Homo sapiens
uguugcuaggacauauac

SEQ ID NO: 2173289 - RNA, 22 nt, Homo sapiens
acagaaaggaauggccuuucac

SEQ ID NO: 2173290 - RNA, 24 nt, Homo sapiens
cuacaauuuggcuaagguagguga

SEQ ID NO: 2173291 - RNA, 16 nt, Homo sapiens
auaaaauucauuaguu

SEQ ID NO: 2173292 - RNA, 15 nt, Homo sapiens
caaaguacauuguaa

SEQ ID NO: 2173293 - RNA, 21 nt, Homo sapiens
cccuggggcuucuccugaccc

SEQ ID NO: 2173294 - RNA, 19 nt, Homo sapiens
aacuuucucauaagcaccu

SEQ ID NO: 2173295 - RNA, 12 nt, Homo sapiens
augucauaucau

SEQ ID NO: 2173296 - RNA, 12 nt, Homo sapiens
uaaucccaguuu

SEQ ID NO: 2173297 - RNA, 20 nt, Homo sapiens
aaccugaugccccuucccca

SEQ ID NO: 2173298 - RNA, 20 nt, Homo sapiens
gccccucucaggcugugcuu

SEQ ID NO: 2173299 - RNA, 21 nt, Homo sapiens
acccgcccuuagaccaggcag

SEQ ID NO: 2173300 - RNA, 22 nt, Homo sapiens
aucacagaugaguuaucuaaga

SEQ ID NO: 2173301 - RNA, 23 nt, Homo sapiens
agucccuccgacuucucuagaca

SEQ ID NO: 2173302 - RNA, 17 nt, Homo sapiens
ugggggcuguccugcuc

SEQ ID NO: 2173303 - RNA, 17 nt, Homo sapiens
aggcgccuauaauccca

SEQ ID NO: 2173304 - RNA, 23 nt, Homo sapiens
aaaggaugcuuacuccacuucgc

SEQ ID NO: 2173305 - RNA, 16 nt, Homo sapiens
aggcaugagccacugc

SEQ ID NO: 2173306 - RNA, 21 nt, Homo sapiens
aaugauucuugugucaucaag

SEQ ID NO: 2173307 - RNA, 17 nt, Homo sapiens
ugcccccaauccaugaa

SEQ ID NO: 2173308 - RNA, 11 nt, Homo sapiens
ucucugugcuc

SEQ ID NO: 2173309 - RNA, 23 nt, Homo sapiens
acugaguauugauaaacuuugaa

SEQ ID NO: 2173310 - RNA, 12 nt, Homo sapiens
gcugcaugaccu

SEQ ID NO: 2173311 - RNA, 13 nt, Homo sapiens
uaauuaguuccag

SEQ ID NO: 2173312 - RNA, 15 nt, Homo sapiens
accacaacugacaca

SEQ ID NO: 2173313 - RNA, 18 nt, Homo sapiens
uucuuguaaaacugugac

SEQ ID NO: 2173314 - RNA, 16 nt, Homo sapiens
cauguccagugagcag

SEQ ID NO: 2173315 - RNA, 23 nt, Homo sapiens
ucaaguggaaacaugcugaaauc

SEQ ID NO: 2173316 - RNA, 17 nt, Homo sapiens
aguguaacauaugcaaa

SEQ ID NO: 2173317 - RNA, 18 nt, Homo sapiens
ucauaaacuucaggcaau

SEQ ID NO: 2173318 - RNA, 22 nt, Homo sapiens
uugcagcaagcaauaaacacaa

SEQ ID NO: 2173319 - RNA, 14 nt, Homo sapiens
agugucuaccugga

SEQ ID NO: 2173320 - RNA, 19 nt, Homo sapiens
uuuaagauauauacaugga

SEQ ID NO: 2173321 - RNA, 19 nt, Homo sapiens
gaauacccuauaagccaga

SEQ ID NO: 2173322 - RNA, 19 nt, Homo sapiens
ugugccaguucuuuccaua

SEQ ID NO: 2173323 - RNA, 19 nt, Homo sapiens
cugaugucccagugcucac

SEQ ID NO: 2173324 - RNA, 13 nt, Homo sapiens
gagcagcacagga

SEQ ID NO: 2173325 - RNA, 17 nt, Homo sapiens
uuaagugagcagaacag

SEQ ID NO: 2173326 - RNA, 18 nt, Homo sapiens
acuuaccuagauuuacag

SEQ ID NO: 2173327 - RNA, 18 nt, Homo sapiens
uagaaagccaugugcuaa

SEQ ID NO: 2173328 - RNA, 23 nt, Homo sapiens
uggcucccucuuggucuucccag

SEQ ID NO: 2173329 - RNA, 20 nt, Homo sapiens
ccuucucugcagucaagccc

SEQ ID NO: 2173330 - RNA, 15 nt, Homo sapiens
uaagacggauuuauu

SEQ ID NO: 2173331 - RNA, 15 nt, Homo sapiens
cucccagagaccuug

SEQ ID NO: 2173332 - RNA, 19 nt, Homo sapiens
gggaaguacuacuccucaa

SEQ ID NO: 2173333 - RNA, 20 nt, Homo sapiens
uucaugugugugaguuugcu

SEQ ID NO: 2173334 - RNA, 13 nt, Homo sapiens
gaccccucuaccu

SEQ ID NO: 2173335 - RNA, 17 nt, Homo sapiens
aaccuggcuuauuccca

SEQ ID NO: 2173336 - RNA, 12 nt, Homo sapiens
agaggacuggag

SEQ ID NO: 2173337 - RNA, 12 nt, Homo sapiens
aggggacugggg

SEQ ID NO: 2173338 - RNA, 20 nt, Homo sapiens
cuucuaggauuuauuguuau

SEQ ID NO: 2173339 - RNA, 20 nt, Homo sapiens
gcuaccacagacuugcacug

SEQ ID NO: 2173340 - RNA, 12 nt, Homo sapiens
cuccuccaugca

SEQ ID NO: 2173341 - RNA, 22 nt, Homo sapiens
auucaugcagcaaauaugggcu

SEQ ID NO: 2173342 - RNA, 20 nt, Homo sapiens
uaggccagaggugaacauuc

SEQ ID NO: 2173343 - RNA, 14 nt, Homo sapiens
aguccuaugucuca

SEQ ID NO: 2173344 - RNA, 17 nt, Homo sapiens
uggcugcuuuguucaau

SEQ ID NO: 2173345 - RNA, 16 nt, Homo sapiens
ucagugguagcucugg

SEQ ID NO: 2173346 - RNA, 20 nt, Homo sapiens
uuuagccaguuguugccaac

SEQ ID NO: 2173347 - RNA, 21 nt, Homo sapiens
ugacuagaauugguggugaga

SEQ ID NO: 2173348 - RNA, 22 nt, Homo sapiens
cagccuggauucuuuccuguau

SEQ ID NO: 2173349 - RNA, 20 nt, Homo sapiens
uagugagcagugagcacuga

SEQ ID NO: 2173350 - RNA, 13 nt, Homo sapiens
ugugguuuacuag

SEQ ID NO: 2173351 - RNA, 12 nt, Homo sapiens
uagaaccagcag

SEQ ID NO: 2173352 - RNA, 16 nt, Homo sapiens
auuuguagcacugagg

SEQ ID NO: 2173353 - RNA, 16 nt, Homo sapiens
ucccagcuauugggaa

SEQ ID NO: 2173354 - RNA, 15 nt, Homo sapiens
agacacuuuaccucu

SEQ ID NO: 2173355 - RNA, 15 nt, Homo sapiens
aaaauauuugcaaau

SEQ ID NO: 2173356 - RNA, 17 nt, Homo sapiens
auuguugucaggccaua

SEQ ID NO: 2173357 - RNA, 17 nt, Homo sapiens
uuaccggcgugagccac

SEQ ID NO: 2173358 - RNA, 14 nt, Homo sapiens
uacccagacucaga

SEQ ID NO: 2173359 - RNA, 21 nt, Homo sapiens
uagugguuuuaggauacuuaa

SEQ ID NO: 2173360 - RNA, 15 nt, Homo sapiens
auagugagcauauau

SEQ ID NO: 2173361 - RNA, 16 nt, Homo sapiens
auuuucuucacuugca

SEQ ID NO: 2173362 - RNA, 16 nt, Homo sapiens
uggacacugugcuacu

SEQ ID NO: 2173363 - RNA, 14 nt, Homo sapiens
ccugucacuacugg

SEQ ID NO: 2173364 - RNA, 21 nt, Homo sapiens
ucagcacugccggcccaguga

SEQ ID NO: 2173365 - RNA, 13 nt, Homo sapiens
cccgguacagggc

SEQ ID NO: 2173366 - RNA, 21 nt, Homo sapiens
cuuaaaaauuagcaugcugcu

SEQ ID NO: 2173367 - RNA, 22 nt, Homo sapiens
uucaucagcugugugcauuuca

SEQ ID NO: 2173368 - RNA, 21 nt, Homo sapiens
acaaagcuggcaauauuacaa

SEQ ID NO: 2173369 - RNA, 19 nt, Homo sapiens
aacagucauuaauuuucaa

SEQ ID NO: 2173370 - RNA, 17 nt, Homo sapiens
cauguauguuaugauau

SEQ ID NO: 2173371 - RNA, 13 nt, Homo sapiens
cuagagugacuca

SEQ ID NO: 2173372 - RNA, 19 nt, Homo sapiens
acugcugcuccagugcagg

SEQ ID NO: 2173373 - RNA, 16 nt, Homo sapiens
uuucaacaaauuucau

SEQ ID NO: 2173374 - RNA, 15 nt, Homo sapiens
aauguugacaggcaa

SEQ ID NO: 2173375 - RNA, 16 nt, Homo sapiens
aucggcucacaaagag

SEQ ID NO: 2173376 - RNA, 23 nt, Homo sapiens
guaaauccugagcucaaaucucu

SEQ ID NO: 2173377 - RNA, 18 nt, Homo sapiens
aaggcaggaaggaacuca

SEQ ID NO: 2173378 - RNA, 20 nt, Homo sapiens
cacccaggcuggagugcagu

SEQ ID NO: 2173379 - RNA, 20 nt, Homo sapiens
cacccaggcuagagugcaau

SEQ ID NO: 2173380 - RNA, 22 nt, Homo sapiens
gcccagccaggccaacagcacc

SEQ ID NO: 2173381 - RNA, 17 nt, Homo sapiens
uagaaaauaaccuuuua

SEQ ID NO: 2173382 - RNA, 20 nt, Homo sapiens
agcccaacaucuccagcugg

SEQ ID NO: 2173383 - RNA, 18 nt, Homo sapiens
agucaaagaugccccauu

SEQ ID NO: 2173384 - RNA, 14 nt, Homo sapiens
agaagccagccaca

SEQ ID NO: 2173385 - RNA, 15 nt, Homo sapiens
uuaacauguguuaaa

SEQ ID NO: 2173386 - RNA, 21 nt, Homo sapiens
ucagccugggacaccuaggug

SEQ ID NO: 2173387 - RNA, 22 nt, Homo sapiens
cuuuuuugaggccuuuuuugcc

SEQ ID NO: 2173388 - RNA, 17 nt, Homo sapiens
agaccugaagugugcac

SEQ ID NO: 2173389 - RNA, 16 nt, Homo sapiens
uugcaccucuguucau

SEQ ID NO: 2173390 - RNA, 23 nt, Homo sapiens
ccucugcaaaggaaauaccaguu

SEQ ID NO: 2173391 - RNA, 13 nt, Homo sapiens
acaugugguggga

SEQ ID NO: 2173392 - RNA, 17 nt, Homo sapiens
ucgcuuguaaauaccag

SEQ ID NO: 2173393 - RNA, 13 nt, Homo sapiens
aacacaaacacau

SEQ ID NO: 2173394 - RNA, 21 nt, Homo sapiens
uccaguggaacagucuuccca

SEQ ID NO: 2173395 - RNA, 16 nt, Homo sapiens
cuuugauucaccaaac

SEQ ID NO: 2173396 - RNA, 14 nt, Homo sapiens
cucagugacugugu

SEQ ID NO: 2173397 - RNA, 15 nt, Homo sapiens
cucacucccagucca

SEQ ID NO: 2173398 - RNA, 16 nt, Homo sapiens
uuaaauagggccucac

SEQ ID NO: 2173399 - RNA, 18 nt, Homo sapiens
aggcgggcggaucacuua

SEQ ID NO: 2173400 - RNA, 14 nt, Homo sapiens
gaucaacucugucu

SEQ ID NO: 2173401 - RNA, 23 nt, Homo sapiens
gacgggcaaaauaaagugacaga

SEQ ID NO: 2173402 - RNA, 19 nt, Homo sapiens
uggggcuuguccugugcuu

SEQ ID NO: 2173403 - RNA, 15 nt, Homo sapiens
cauuaguguguuguc

SEQ ID NO: 2173404 - RNA, 16 nt, Homo sapiens
ugcccugggaugucca

SEQ ID NO: 2173405 - RNA, 16 nt, Homo sapiens
ccugguccacagggca

SEQ ID NO: 2173406 - RNA, 19 nt, Homo sapiens
cuugagguggccuccuugc

SEQ ID NO: 2173407 - RNA, 14 nt, Homo sapiens
aucugaaauucaaa

SEQ ID NO: 2173408 - RNA, 16 nt, Homo sapiens
ggaagacauugcaaug

SEQ ID NO: 2173409 - RNA, 17 nt, Homo sapiens
gcccgcaggaucaggug

SEQ ID NO: 2173410 - RNA, 13 nt, Homo sapiens
cacuggagucucu

SEQ ID NO: 2173411 - RNA, 21 nt, Homo sapiens
gaagggguguuuauucuucca

SEQ ID NO: 2173412 - RNA, 18 nt, Homo sapiens
cuugggaggacaugcgug

SEQ ID NO: 2173413 - RNA, 23 nt, Homo sapiens
cacuaaagaaaaacuaaugucag

SEQ ID NO: 2173414 - RNA, 21 nt, Homo sapiens
ucccacacuguccauucuucc

SEQ ID NO: 2173415 - RNA, 12 nt, Homo sapiens
uugguugugaau

SEQ ID NO: 2173416 - RNA, 12 nt, Homo sapiens
uaauuugugugg

SEQ ID NO: 2173417 - RNA, 15 nt, Homo sapiens
cucucaucacuaccu

SEQ ID NO: 2173418 - RNA, 21 nt, Homo sapiens
ugguuauuguucagacauucc

SEQ ID NO: 2173419 - RNA, 23 nt, Homo sapiens
cagccucccgaguagcugggauu

SEQ ID NO: 2173420 - RNA, 17 nt, Homo sapiens
acacuaggaaucaaaac

SEQ ID NO: 2173421 - RNA, 19 nt, Homo sapiens
aauucaggaagcagcaaaa

SEQ ID NO: 2173422 - RNA, 21 nt, Homo sapiens
cagcauaccugcuggugcaga

SEQ ID NO: 2173423 - RNA, 15 nt, Homo sapiens
gagagucugggucca

SEQ ID NO: 2173424 - RNA, 14 nt, Homo sapiens
cucaucauuccuug

SEQ ID NO: 2173425 - RNA, 12 nt, Homo sapiens
ucuguuccacau

SEQ ID NO: 2173426 - RNA, 12 nt, Homo sapiens
uauuuuccaaag

SEQ ID NO: 2173427 - RNA, 15 nt, Homo sapiens
uccagguacauauca

SEQ ID NO: 2173428 - RNA, 22 nt, Homo sapiens
ucuaggaaauauacuuuuacaa

SEQ ID NO: 2173429 - RNA, 22 nt, Homo sapiens
agcugugaugugccuacuccca

SEQ ID NO: 2173430 - RNA, 18 nt, Homo sapiens
guuaaccccauguccuca

SEQ ID NO: 2173431 - RNA, 15 nt, Homo sapiens
ugugggcacgugugg

SEQ ID NO: 2173432 - RNA, 13 nt, Homo sapiens
uccagggcccaaa

SEQ ID NO: 2173433 - RNA, 21 nt, Homo sapiens
cauaucaaacauauguauaca

SEQ ID NO: 2173434 - RNA, 20 nt, Homo sapiens
cacugaauuuuguguguacc

SEQ ID NO: 2173435 - RNA, 22 nt, Homo sapiens
uggguauauacccaaaggaaua

SEQ ID NO: 2173436 - RNA, 14 nt, Homo sapiens
aaugaaaagcaaua

SEQ ID NO: 2173437 - RNA, 11 nt, Homo sapiens
ggcaguugcau

SEQ ID NO: 2173438 - RNA, 15 nt, Homo sapiens
uugcauugacuguca

SEQ ID NO: 2173439 - RNA, 14 nt, Homo sapiens
guuauaacagggaa

SEQ ID NO: 2173440 - RNA, 15 nt, Homo sapiens
agacaguucaagaaa

SEQ ID NO: 2173441 - RNA, 21 nt, Homo sapiens
acaugacacaguuggauuuau

SEQ ID NO: 2173442 - RNA, 23 nt, Homo sapiens
ccugcugagggaccagccaagag

SEQ ID NO: 2173443 - RNA, 18 nt, Homo sapiens
agucccgcgugcaaagga

SEQ ID NO: 2173444 - RNA, 16 nt, Homo sapiens
cugugguccagaguca

SEQ ID NO: 2173445 - RNA, 22 nt, Homo sapiens
uuuaaaaauguuucuggucuga

SEQ ID NO: 2173446 - RNA, 13 nt, Homo sapiens
cuucaaccaguga

SEQ ID NO: 2173447 - RNA, 22 nt, Homo sapiens
ggcucgucggggggacagcucc

SEQ ID NO: 2173448 - RNA, 21 nt, Homo sapiens
cuacugaacaguccaucuucu

SEQ ID NO: 2173449 - RNA, 14 nt, Homo sapiens
acaaaugacuuuau

SEQ ID NO: 2173450 - RNA, 18 nt, Homo sapiens
uacugcuugaccaaagag

SEQ ID NO: 2173451 - RNA, 21 nt, Homo sapiens
ccagagccccccacaaugaug

SEQ ID NO: 2173452 - RNA, 15 nt, Homo sapiens
acccaacucaaggac

SEQ ID NO: 2173453 - RNA, 19 nt, Homo sapiens
uauggcagagcauccucuc

SEQ ID NO: 2173454 - RNA, 21 nt, Homo sapiens
gcacacagggugguggcacau

SEQ ID NO: 2173455 - RNA, 20 nt, Homo sapiens
aaacaccuggaggugaaggc

SEQ ID NO: 2173456 - RNA, 18 nt, Homo sapiens
gcaauuuucgaacauucu

SEQ ID NO: 2173457 - RNA, 17 nt, Homo sapiens
aaaauaaagcaaugugu

SEQ ID NO: 2173458 - RNA, 22 nt, Homo sapiens
caagauacacucaagcaugaag

SEQ ID NO: 2173459 - RNA, 13 nt, Homo sapiens
aauacuaccucug

SEQ ID NO: 2173460 - RNA, 19 nt, Homo sapiens
agggcgccuacucuucagg

SEQ ID NO: 2173461 - RNA, 11 nt, Homo sapiens
acugaaucuau

SEQ ID NO: 2173462 - RNA, 17 nt, Homo sapiens
gauaaacuaaaagcaua

SEQ ID NO: 2173463 - RNA, 18 nt, Homo sapiens
uuugagcaggagcagaaa

SEQ ID NO: 2173464 - RNA, 20 nt, Homo sapiens
aaagaauaguaguaacuguu

SEQ ID NO: 2173465 - RNA, 18 nt, Homo sapiens
gacuuaacauagccaaaa

SEQ ID NO: 2173466 - RNA, 14 nt, Homo sapiens
uggcccuucugccc

SEQ ID NO: 2173467 - RNA, 19 nt, Homo sapiens
aauaguuagaucuacccug

SEQ ID NO: 2173468 - RNA, 11 nt, Homo sapiens
cccccuagugg

SEQ ID NO: 2173469 - RNA, 18 nt, Homo sapiens
cucaaaugacccaaagac

SEQ ID NO: 2173470 - RNA, 21 nt, Homo sapiens
ugucuuaauuaaaagaauauu

SEQ ID NO: 2173471 - RNA, 20 nt, Homo sapiens
gaguaacaugccagcuuccu

SEQ ID NO: 2173472 - RNA, 15 nt, Homo sapiens
gaaaacuuugaaaag

SEQ ID NO: 2173473 - RNA, 22 nt, Homo sapiens
uuuuaccuggauauaaauuaau

SEQ ID NO: 2173474 - RNA, 16 nt, Homo sapiens
ccuuucccaccauucc

SEQ ID NO: 2173475 - RNA, 20 nt, Homo sapiens
caucugucucggcucugcau

SEQ ID NO: 2173476 - RNA, 20 nt, Homo sapiens
ucccugccaagaacucuggg

SEQ ID NO: 2173477 - RNA, 15 nt, Homo sapiens
ccucaagugccuuau

SEQ ID NO: 2173478 - RNA, 18 nt, Homo sapiens
auccugacaccaccaucu

SEQ ID NO: 2173479 - RNA, 18 nt, Homo sapiens
gacugaugggacaucaaa

SEQ ID NO: 2173480 - RNA, 20 nt, Homo sapiens
agauuuugcaaucuguguuc

SEQ ID NO: 2173481 - RNA, 15 nt, Homo sapiens
ugaauaaaguguaag

SEQ ID NO: 2173482 - RNA, 15 nt, Homo sapiens
acauguacaugcauu

SEQ ID NO: 2173483 - RNA, 14 nt, Homo sapiens
ucaacagcuaugcu

SEQ ID NO: 2173484 - RNA, 14 nt, Homo sapiens
uauacagcucagcu

SEQ ID NO: 2173485 - RNA, 21 nt, Homo sapiens
aaauguacagaguaaccuaua

SEQ ID NO: 2173486 - RNA, 16 nt, Homo sapiens
gacucugucucaaaaa

SEQ ID NO: 2173487 - RNA, 14 nt, Homo sapiens
uucuaguuaccaca

SEQ ID NO: 2173488 - RNA, 18 nt, Homo sapiens
aacugccagaacauggau

SEQ ID NO: 2173489 - RNA, 21 nt, Homo sapiens
gaagaggugagaguaagccuu

SEQ ID NO: 2173490 - RNA, 14 nt, Homo sapiens
cuaauuuuccagag

SEQ ID NO: 2173491 - RNA, 13 nt, Homo sapiens
acagucugcucaa

SEQ ID NO: 2173492 - RNA, 14 nt, Homo sapiens
agagcagagaagua

SEQ ID NO: 2173493 - RNA, 15 nt, Homo sapiens
agagucaucuaccug

SEQ ID NO: 2173494 - RNA, 12 nt, Homo sapiens
gugcagugccgc

SEQ ID NO: 2173495 - RNA, 15 nt, Homo sapiens
ucauucugccaaagu

SEQ ID NO: 2173496 - RNA, 22 nt, Homo sapiens
accuuccuccuccucuucacuu

SEQ ID NO: 2173497 - RNA, 17 nt, Homo sapiens
cauuauuuugucauaaa

SEQ ID NO: 2173498 - RNA, 17 nt, Homo sapiens
guguaaccagcagucac

SEQ ID NO: 2173499 - RNA, 15 nt, Homo sapiens
gugcuguuuugccag

SEQ ID NO: 2173500 - RNA, 13 nt, Homo sapiens
auucagcaagaca

SEQ ID NO: 2173501 - RNA, 14 nt, Homo sapiens
gccuuagcaguaac

SEQ ID NO: 2173502 - RNA, 19 nt, Homo sapiens
cacuccauuucccacuucc

SEQ ID NO: 2173503 - RNA, 16 nt, Homo sapiens
caaaaaaaucuuccaa

SEQ ID NO: 2173504 - RNA, 17 nt, Homo sapiens
gacgcccccaaauccuu

SEQ ID NO: 2173505 - RNA, 20 nt, Homo sapiens
acuguuaauaguacuauuaa

SEQ ID NO: 2173506 - RNA, 14 nt, Homo sapiens
aaaagccucagcuc

SEQ ID NO: 2173507 - RNA, 18 nt, Homo sapiens
ccguuugaccaauuugca

SEQ ID NO: 2173508 - RNA, 23 nt, Homo sapiens
guauccugcgaccuugcaaccuc

SEQ ID NO: 2173509 - RNA, 20 nt, Homo sapiens
aaaaucauucuacugaacag

SEQ ID NO: 2173510 - RNA, 16 nt, Homo sapiens
guuccaagacauuguc

SEQ ID NO: 2173511 - RNA, 10 nt, Homo sapiens
aacacugaga

SEQ ID NO: 2173512 - RNA, 10 nt, Homo sapiens
agcacugagg

SEQ ID NO: 2173513 - RNA, 22 nt, Homo sapiens
cugcauacuuagaugaucuuca

SEQ ID NO: 2173514 - RNA, 21 nt, Homo sapiens
aagaugcagaguaaguauuau

SEQ ID NO: 2173515 - RNA, 19 nt, Homo sapiens
acauucugaguaacaucag

SEQ ID NO: 2173516 - RNA, 22 nt, Homo sapiens
agccuugucuucuuagcuguca

SEQ ID NO: 2173517 - RNA, 12 nt, Homo sapiens
cagcauucucag

SEQ ID NO: 2173518 - RNA, 17 nt, Homo sapiens
aagaugguucuagcaug

SEQ ID NO: 2173519 - RNA, 22 nt, Homo sapiens
cuguccuuuuggcacugagaua

SEQ ID NO: 2173520 - RNA, 21 nt, Homo sapiens
accucccccuuccccuaccca

SEQ ID NO: 2173521 - RNA, 18 nt, Homo sapiens
uacacuaggaaacguguu

SEQ ID NO: 2173522 - RNA, 17 nt, Homo sapiens
uacauaucccuuccaga

SEQ ID NO: 2173523 - RNA, 17 nt, Homo sapiens
uucucgaacuccugacc

SEQ ID NO: 2173524 - RNA, 14 nt, Homo sapiens
auagguacauugga

SEQ ID NO: 2173525 - RNA, 18 nt, Homo sapiens
agugcagggaaccgugau

SEQ ID NO: 2173526 - RNA, 21 nt, Homo sapiens
aaaagcacagccucagaauaa

SEQ ID NO: 2173527 - RNA, 20 nt, Homo sapiens
auugagaucacuacucagug

SEQ ID NO: 2173528 - RNA, 23 nt, Homo sapiens
aacacugcuggguuuuacaucca

SEQ ID NO: 2173529 - RNA, 13 nt, Homo sapiens
cgcagagcacaga

SEQ ID NO: 2173530 - RNA, 19 nt, Homo sapiens
uacaucacucucaccuucc

SEQ ID NO: 2173531 - RNA, 14 nt, Homo sapiens
auaaccccaggcau

SEQ ID NO: 2173532 - RNA, 19 nt, Homo sapiens
ccuggcccuccucugguca

SEQ ID NO: 2173533 - RNA, 18 nt, Homo sapiens
uaaacuuuccaaaaccuu

SEQ ID NO: 2173534 - RNA, 20 nt, Homo sapiens
aaacuuucuacucauuuuaa

SEQ ID NO: 2173535 - RNA, 22 nt, Homo sapiens
acauaaguguugguagcacuua

SEQ ID NO: 2173536 - RNA, 22 nt, Homo sapiens
acacuaacgaaauaucaaaguc

SEQ ID NO: 2173537 - RNA, 13 nt, Homo sapiens
uaugcaaaccuca

SEQ ID NO: 2173538 - RNA, 22 nt, Homo sapiens
ccucgugcccaucaagugcagu

SEQ ID NO: 2173539 - RNA, 23 nt, Homo sapiens
cuggcugaaccaaagaaacaauu

SEQ ID NO: 2173540 - RNA, 13 nt, Homo sapiens
guggaacugcugc

SEQ ID NO: 2173541 - RNA, 16 nt, Homo sapiens
caaccccagacacugg

SEQ ID NO: 2173542 - RNA, 18 nt, Homo sapiens
ccuggguaacaaagugag

SEQ ID NO: 2173543 - RNA, 15 nt, Homo sapiens
uuuuaguggaagcuu

SEQ ID NO: 2173544 - RNA, 19 nt, Homo sapiens
cuggaagacaacccaggca

SEQ ID NO: 2173545 - RNA, 15 nt, Homo sapiens
gcccaggugugcagg

SEQ ID NO: 2173546 - RNA, 12 nt, Homo sapiens
auaaugcuguuc

SEQ ID NO: 2173547 - RNA, 18 nt, Homo sapiens
uccccugcccugucuuuc

SEQ ID NO: 2173548 - RNA, 20 nt, Homo sapiens
aauguagacugaaaagccau

SEQ ID NO: 2173549 - RNA, 21 nt, Homo sapiens
ccuguuggauaaagaccuucc

SEQ ID NO: 2173550 - RNA, 19 nt, Homo sapiens
uuuucccaggaggcuccag

SEQ ID NO: 2173551 - RNA, 15 nt, Homo sapiens
aacaacaaaauaaag

SEQ ID NO: 2173552 - RNA, 20 nt, Homo sapiens
aagccuguguauaaaaaaga

SEQ ID NO: 2173553 - RNA, 15 nt, Homo sapiens
gaggcaaaguaguga

SEQ ID NO: 2173554 - RNA, 13 nt, Homo sapiens
ugcaaacgcugcc

SEQ ID NO: 2173555 - RNA, 15 nt, Homo sapiens
aaagcccgccugaca

SEQ ID NO: 2173556 - RNA, 15 nt, Homo sapiens
cuacacagacauuaa

SEQ ID NO: 2173557 - RNA, 16 nt, Homo sapiens
auauauaguagcauuu

SEQ ID NO: 2173558 - RNA, 18 nt, Homo sapiens
gccggaggucaugaugau

SEQ ID NO: 2173559 - RNA, 13 nt, Homo sapiens
ccacuggucugua

SEQ ID NO: 2173560 - RNA, 13 nt, Homo sapiens
uggggaaaacaga

SEQ ID NO: 2173561 - RNA, 19 nt, Homo sapiens
aaugauaaagaugucaaau

SEQ ID NO: 2173562 - RNA, 14 nt, Homo sapiens
ucucaguucagagu

SEQ ID NO: 2173563 - RNA, 22 nt, Homo sapiens
ccuggaugcagccucacagucc

SEQ ID NO: 2173564 - RNA, 15 nt, Homo sapiens
gugaauaaaccauca

SEQ ID NO: 2173565 - RNA, 17 nt, Homo sapiens
acaccuguuauugccaa

SEQ ID NO: 2173566 - RNA, 20 nt, Homo sapiens
ucccguugaacgucacaucu

SEQ ID NO: 2173567 - RNA, 22 nt, Homo sapiens
uggagagauuuaaagaauucuc

SEQ ID NO: 2173568 - RNA, 20 nt, Homo sapiens
gaggggagaggaagcacaag

SEQ ID NO: 2173569 - RNA, 20 nt, Homo sapiens
cuguuuucuaguguaucaaa

SEQ ID NO: 2173570 - RNA, 15 nt, Homo sapiens
uuaauuuugauucag

SEQ ID NO: 2173571 - RNA, 13 nt, Homo sapiens
gggacucugagaa

SEQ ID NO: 2173572 - RNA, 14 nt, Homo sapiens
ucugagugggccca

SEQ ID NO: 2173573 - RNA, 17 nt, Homo sapiens
ccugaaucuaucaccca

SEQ ID NO: 2173574 - RNA, 11 nt, Homo sapiens
gaaacugaguc

SEQ ID NO: 2173575 - RNA, 20 nt, Homo sapiens
guuugcaaucuuauguugau

SEQ ID NO: 2173576 - RNA, 14 nt, Homo sapiens
gcgaagaauagagg

SEQ ID NO: 2173577 - RNA, 15 nt, Homo sapiens
caaagcaguggcuua

SEQ ID NO: 2173578 - RNA, 16 nt, Homo sapiens
ucugugaaaccuguga

SEQ ID NO: 2173579 - RNA, 22 nt, Homo sapiens
acaacaggcaguggaagcaguu

SEQ ID NO: 2173580 - RNA, 17 nt, Homo sapiens
gauagagcagaacugaa

SEQ ID NO: 2173581 - RNA, 12 nt, Homo sapiens
gaccaugcauuc

SEQ ID NO: 2173582 - RNA, 14 nt, Homo sapiens
uuaggagaaaccag

SEQ ID NO: 2173583 - RNA, 19 nt, Homo sapiens
aaacccaccaaaaccaaga

SEQ ID NO: 2173584 - RNA, 16 nt, Homo sapiens
acaucaauaaauacuu

SEQ ID NO: 2173585 - RNA, 17 nt, Homo sapiens
ucaauaccuggccucau

SEQ ID NO: 2173586 - RNA, 15 nt, Homo sapiens
guggaaaguguaaag

SEQ ID NO: 2173587 - RNA, 13 nt, Homo sapiens
cugugauuuugcc

SEQ ID NO: 2173588 - RNA, 16 nt, Homo sapiens
gaguauuugaacacag

SEQ ID NO: 2173589 - RNA, 16 nt, Homo sapiens
agcccugcaccaugcu

SEQ ID NO: 2173590 - RNA, 20 nt, Homo sapiens
cucagccacacccaggcacu

SEQ ID NO: 2173591 - RNA, 22 nt, Homo sapiens
gucaucaaauauuaccaaaaaa

SEQ ID NO: 2173592 - RNA, 19 nt, Homo sapiens
ccaugggguagggugagaa

SEQ ID NO: 2173593 - RNA, 13 nt, Homo sapiens
uuugauauuugca

SEQ ID NO: 2173594 - RNA, 19 nt, Homo sapiens
uggucacgacuucuucgga

SEQ ID NO: 2173595 - RNA, 15 nt, Homo sapiens
acauuuuuuaccaaa

SEQ ID NO: 2173596 - RNA, 21 nt, Homo sapiens
uagccuucucuguucauuucc

SEQ ID NO: 2173597 - RNA, 19 nt, Homo sapiens
aacacgccuaaaacucaaa

SEQ ID NO: 2173598 - RNA, 14 nt, Homo sapiens
uugaagcagauuuc

SEQ ID NO: 2173599 - RNA, 23 nt, Homo sapiens
uaccuaacuguuccuuggucuau

SEQ ID NO: 2173600 - RNA, 16 nt, Homo sapiens
ugcagaaagcccuuca

SEQ ID NO: 2173601 - RNA, 16 nt, Homo sapiens
uaaguucuuaugagga

SEQ ID NO: 2173602 - RNA, 23 nt, Homo sapiens
uuugaauuucaguaaacaaugaa

SEQ ID NO: 2173603 - RNA, 15 nt, Homo sapiens
uauguucuaagaagu

SEQ ID NO: 2173604 - RNA, 14 nt, Homo sapiens
agcauugugcaaua

SEQ ID NO: 2173605 - RNA, 14 nt, Homo sapiens
agaacugugccaca

SEQ ID NO: 2173606 - RNA, 16 nt, Homo sapiens
ccgcauccuagucucu

SEQ ID NO: 2173607 - RNA, 13 nt, Homo sapiens
gccaaggcuugga

SEQ ID NO: 2173608 - RNA, 21 nt, Homo sapiens
uuuugauguauaaaacuugau

SEQ ID NO: 2173609 - RNA, 21 nt, Homo sapiens
aucaagcucaaggcaaugggc

SEQ ID NO: 2173610 - RNA, 13 nt, Homo sapiens
gccggguguagug

SEQ ID NO: 2173611 - RNA, 15 nt, Homo sapiens
acuauuaagcaguaa

SEQ ID NO: 2173612 - RNA, 23 nt, Homo sapiens
aucaucuccaucauaugccugac

SEQ ID NO: 2173613 - RNA, 20 nt, Homo sapiens
acacuauuuaucugugcaaa

SEQ ID NO: 2173614 - RNA, 16 nt, Homo sapiens
gagccaccucacccag

SEQ ID NO: 2173615 - RNA, 15 nt, Homo sapiens
aaccuuaccaaaaaa

SEQ ID NO: 2173616 - RNA, 19 nt, Homo sapiens
ccagggaugucuguugaaa

SEQ ID NO: 2173617 - RNA, 19 nt, Homo sapiens
acuguucuugcugcuagaa

SEQ ID NO: 2173618 - RNA, 13 nt, Homo sapiens
ccagcugcacuga

SEQ ID NO: 2173619 - RNA, 15 nt, Homo sapiens
uaauucccaauccca

SEQ ID NO: 2173620 - RNA, 14 nt, Homo sapiens
aaugcuuaauucaa

SEQ ID NO: 2173621 - RNA, 20 nt, Homo sapiens
uggaaguuggcugcacuuga

SEQ ID NO: 2173622 - RNA, 17 nt, Homo sapiens
auuaaaauacauuuuaa

SEQ ID NO: 2173623 - RNA, 17 nt, Homo sapiens
cuugaauaaacaccacu

SEQ ID NO: 2173624 - RNA, 13 nt, Homo sapiens
aucuuaguguuca

SEQ ID NO: 2173625 - RNA, 20 nt, Homo sapiens
cauagaguauagcucuguag

SEQ ID NO: 2173626 - RNA, 20 nt, Homo sapiens
ucugcaagaauuaaaacuga

SEQ ID NO: 2173627 - RNA, 12 nt, Homo sapiens
uuucucacugaa

SEQ ID NO: 2173628 - RNA, 20 nt, Homo sapiens
uuagcuccaaagcauuuccc

SEQ ID NO: 2173629 - RNA, 18 nt, Homo sapiens
ggagggggaggcgccaag

SEQ ID NO: 2173630 - RNA, 22 nt, Homo sapiens
uugacguaagcucuaucugcaa

SEQ ID NO: 2173631 - RNA, 13 nt, Homo sapiens
caugaagugcaca

SEQ ID NO: 2173632 - RNA, 15 nt, Homo sapiens
cugggaguguccuua

SEQ ID NO: 2173633 - RNA, 14 nt, Homo sapiens
gcagaggaugucuc

SEQ ID NO: 2173634 - RNA, 13 nt, Homo sapiens
aaaccaaauuaca

SEQ ID NO: 2173635 - RNA, 18 nt, Homo sapiens
augaugagccuucgugcc

SEQ ID NO: 2173636 - RNA, 22 nt, Homo sapiens
cuccaaaguauuguacaaauaa

SEQ ID NO: 2173637 - RNA, 15 nt, Homo sapiens
cuuuugcacaaggaa

SEQ ID NO: 2173638 - RNA, 15 nt, Homo sapiens
cccugccugggucuc

SEQ ID NO: 2173639 - RNA, 19 nt, Homo sapiens
aucuuuccaaauacccaaa

SEQ ID NO: 2173640 - RNA, 13 nt, Homo sapiens
gacauuagcauug

SEQ ID NO: 2173641 - RNA, 20 nt, Homo sapiens
gaaaccaguuaagaauggaa

SEQ ID NO: 2173642 - RNA, 16 nt, Homo sapiens
augcccuccaugugua

SEQ ID NO: 2173643 - RNA, 15 nt, Homo sapiens
gaaccccucugggaa

SEQ ID NO: 2173644 - RNA, 15 nt, Homo sapiens
gggaaguaagcaaac

SEQ ID NO: 2173645 - RNA, 13 nt, Homo sapiens
agacagauauuuc

SEQ ID NO: 2173646 - RNA, 14 nt, Homo sapiens
cgaggacaagugag

SEQ ID NO: 2173647 - RNA, 17 nt, Homo sapiens
cuaguagcggaucucac

SEQ ID NO: 2173648 - RNA, 15 nt, Homo sapiens
auauugaccauguga

SEQ ID NO: 2173649 - RNA, 19 nt, Homo sapiens
cugaggaguaaguguacaa

SEQ ID NO: 2173650 - RNA, 15 nt, Homo sapiens
ucacauaugugcaua

SEQ ID NO: 2173651 - RNA, 15 nt, Homo sapiens
uugucaaugcaucaa

SEQ ID NO: 2173652 - RNA, 21 nt, Homo sapiens
gccuugggaaggaaggcagug

SEQ ID NO: 2173653 - RNA, 22 nt, Homo sapiens
caaugggaaaacuucacuccaa

SEQ ID NO: 2173654 - RNA, 22 nt, Homo sapiens
uucugguuuaagaguaacaguu

SEQ ID NO: 2173655 - RNA, 14 nt, Homo sapiens
gccauccauucaca

SEQ ID NO: 2173656 - RNA, 23 nt, Homo sapiens
aauaaacgaggaaaagguccuug

SEQ ID NO: 2173657 - RNA, 23 nt, Homo sapiens
cccaaguauugauuuaacuucau

SEQ ID NO: 2173658 - RNA, 20 nt, Homo sapiens
aaacauuggauuuuuccuua

SEQ ID NO: 2173659 - RNA, 14 nt, Homo sapiens
uaacuccagucucc

SEQ ID NO: 2173660 - RNA, 11 nt, Homo sapiens
agaaacucaau

SEQ ID NO: 2173661 - RNA, 19 nt, Homo sapiens
ugaggguuucugagcugcu

SEQ ID NO: 2173662 - RNA, 19 nt, Homo sapiens
aaguaaucucacagcauuu

SEQ ID NO: 2173663 - RNA, 14 nt, Homo sapiens
uuaaacagccaaau

SEQ ID NO: 2173664 - RNA, 17 nt, Homo sapiens
cuugcacaaacuccauc

SEQ ID NO: 2173665 - RNA, 21 nt, Homo sapiens
ggagcugccuuggcucagaca

SEQ ID NO: 2173666 - RNA, 17 nt, Homo sapiens
ucaacaacacagcaaaa

SEQ ID NO: 2173667 - RNA, 18 nt, Homo sapiens
cccuguaacaggcuugaa

SEQ ID NO: 2173668 - RNA, 18 nt, Homo sapiens
caaaugaugccacuuccc

SEQ ID NO: 2173669 - RNA, 15 nt, Homo sapiens
uacacacacacuccc

SEQ ID NO: 2173670 - RNA, 15 nt, Homo sapiens
ucuucacaccuaccc

SEQ ID NO: 2173671 - RNA, 15 nt, Homo sapiens
agcaaagcaaaacaa

SEQ ID NO: 2173672 - RNA, 20 nt, Homo sapiens
uuagguuucagcagagcuga

SEQ ID NO: 2173673 - RNA, 15 nt, Homo sapiens
ccugaccaacaggcc

SEQ ID NO: 2173674 - RNA, 16 nt, Homo sapiens
uguguaccugugacua

SEQ ID NO: 2173675 - RNA, 23 nt, Homo sapiens
aggcaugauggcccauacuugua

SEQ ID NO: 2173676 - RNA, 23 nt, Homo sapiens
ucuaccagucuauuuccacugaa

SEQ ID NO: 2173677 - RNA, 14 nt, Homo sapiens
gccugcuuuucacu

SEQ ID NO: 2173678 - RNA, 15 nt, Homo sapiens
cuguaccaugugcua

SEQ ID NO: 2173679 - RNA, 16 nt, Homo sapiens
gaaaucuuuaugugau

SEQ ID NO: 2173680 - RNA, 19 nt, Homo sapiens
agaaacaccacuuaaucuu

SEQ ID NO: 2173681 - RNA, 16 nt, Homo sapiens
aaacagggauuaucau

SEQ ID NO: 2173682 - RNA, 21 nt, Homo sapiens
aauuaacaguauuucuuuaca

SEQ ID NO: 2173683 - RNA, 18 nt, Homo sapiens
ccaugucucgacucaucc

SEQ ID NO: 2173684 - RNA, 18 nt, Homo sapiens
ugaaggaaggacuaugac

SEQ ID NO: 2173685 - RNA, 22 nt, Homo sapiens
gauacugccugacaagugccug

SEQ ID NO: 2173686 - RNA, 13 nt, Homo sapiens
ggaugauguuucg

SEQ ID NO: 2173687 - RNA, 16 nt, Homo sapiens
uagcuugcaccuuguc

SEQ ID NO: 2173688 - RNA, 15 nt, Homo sapiens
gccacuucggccagg

SEQ ID NO: 2173689 - RNA, 13 nt, Homo sapiens
aaaaaaacagcuc

SEQ ID NO: 2173690 - RNA, 20 nt, Homo sapiens
gggcaauuuuuguauccaag

SEQ ID NO: 2173691 - RNA, 18 nt, Homo sapiens
uuccuuggccaugcagaa

SEQ ID NO: 2173692 - RNA, 23 nt, Homo sapiens
acacugggccuggagcccugggc

SEQ ID NO: 2173693 - RNA, 22 nt, Homo sapiens
aaugucuuguuucaguccauga

SEQ ID NO: 2173694 - RNA, 23 nt, Homo sapiens
uccugcucacccgccucuugccc

SEQ ID NO: 2173695 - RNA, 23 nt, Homo sapiens
uguuucauaaugcagaaguauuc

SEQ ID NO: 2173696 - RNA, 21 nt, Homo sapiens
gccuuccaggagcaauuugca

SEQ ID NO: 2173697 - RNA, 19 nt, Homo sapiens
ugguagaaaaugcaccaaa

SEQ ID NO: 2173698 - RNA, 19 nt, Homo sapiens
aauuuucuaugaauugcua

SEQ ID NO: 2173699 - RNA, 22 nt, Homo sapiens
ucuuguaccagcccaggcaaua

SEQ ID NO: 2173700 - RNA, 20 nt, Homo sapiens
cagaacacaccgaguuucca

SEQ ID NO: 2173701 - RNA, 17 nt, Homo sapiens
aaacacuuacagaauua

SEQ ID NO: 2173702 - RNA, 17 nt, Homo sapiens
acagcccagaaccacag

SEQ ID NO: 2173703 - RNA, 15 nt, Homo sapiens
agacaggcagagauc

SEQ ID NO: 2173704 - RNA, 17 nt, Homo sapiens
ugaacccaauuacacac

SEQ ID NO: 2173705 - RNA, 18 nt, Homo sapiens
aaagugugacauucagug

SEQ ID NO: 2173706 - RNA, 12 nt, Homo sapiens
caaauguuauag

SEQ ID NO: 2173707 - RNA, 16 nt, Homo sapiens
cauuucuuaccaugca

SEQ ID NO: 2173708 - RNA, 16 nt, Homo sapiens
ucugcuguauacugua

SEQ ID NO: 2173709 - RNA, 14 nt, Homo sapiens
guuaugugcauuau

SEQ ID NO: 2173710 - RNA, 16 nt, Homo sapiens
aacugcugcuucacca

SEQ ID NO: 2173711 - RNA, 19 nt, Homo sapiens
gcccggugguuugccaugu

SEQ ID NO: 2173712 - RNA, 15 nt, Homo sapiens
uguaucucacacuca

SEQ ID NO: 2173713 - RNA, 19 nt, Homo sapiens
uagcuugaguccaggaguu

SEQ ID NO: 2173714 - RNA, 13 nt, Homo sapiens
ccucacaguccca

SEQ ID NO: 2173715 - RNA, 13 nt, Homo sapiens
gcagaccacugau

SEQ ID NO: 2173716 - RNA, 23 nt, Homo sapiens
cuuuucggaacacuaaaaccaua

SEQ ID NO: 2173717 - RNA, 16 nt, Homo sapiens
guccagaagaccccac

SEQ ID NO: 2173718 - RNA, 18 nt, Homo sapiens
aggcacugggcaagugaa

SEQ ID NO: 2173719 - RNA, 15 nt, Homo sapiens
gaccuucagagccag

SEQ ID NO: 2173720 - RNA, 15 nt, Homo sapiens
auuuuauuaguuguu

SEQ ID NO: 2173721 - RNA, 15 nt, Homo sapiens
acacuggaacauucc

SEQ ID NO: 2173722 - RNA, 14 nt, Homo sapiens
augacaaacccagg

SEQ ID NO: 2173723 - RNA, 19 nt, Homo sapiens
ccucuuugcccaaaauacu

SEQ ID NO: 2173724 - RNA, 12 nt, Homo sapiens
cuggcugcuagg

SEQ ID NO: 2173725 - RNA, 21 nt, Homo sapiens
uucacuugguucaguaccaca

SEQ ID NO: 2173726 - RNA, 14 nt, Homo sapiens
uuuucauacucuua

SEQ ID NO: 2173727 - RNA, 12 nt, Homo sapiens
cagguuugccag

SEQ ID NO: 2173728 - RNA, 22 nt, Homo sapiens
cauugaacuguaccaugugcua

SEQ ID NO: 2173729 - RNA, 15 nt, Homo sapiens
caaguguaagcagaa

SEQ ID NO: 2173730 - RNA, 21 nt, Homo sapiens
aaaugucuguuucaaugaccu

SEQ ID NO: 2173731 - RNA, 14 nt, Homo sapiens
ugcacauuccaaaa

SEQ ID NO: 2173732 - RNA, 20 nt, Homo sapiens
uguuuuugcuuuuccuucag

SEQ ID NO: 2173733 - RNA, 17 nt, Homo sapiens
ucaaaagcaguauuuca

SEQ ID NO: 2173734 - RNA, 15 nt, Homo sapiens
uggacucugccuuca

SEQ ID NO: 2173735 - RNA, 18 nt, Homo sapiens
gcaggugagcaagcccag

SEQ ID NO: 2173736 - RNA, 15 nt, Homo sapiens
ucuagaacacaggca

SEQ ID NO: 2173737 - RNA, 15 nt, Homo sapiens
ucaagcacacuggaa

SEQ ID NO: 2173738 - RNA, 15 nt, Homo sapiens
uuagccccauuacac

SEQ ID NO: 2173739 - RNA, 19 nt, Homo sapiens
uguguauuuccagugcaau

SEQ ID NO: 2173740 - RNA, 23 nt, Homo sapiens
ccugccuccacccacaguggaga

SEQ ID NO: 2173741 - RNA, 23 nt, Homo sapiens
cucuaagcucagugcucucucca

SEQ ID NO: 2173742 - RNA, 14 nt, Homo sapiens
ucggugaugacucu

SEQ ID NO: 2173743 - RNA, 23 nt, Homo sapiens
cuuucuggaaguuucuggugcca

SEQ ID NO: 2173744 - RNA, 21 nt, Homo sapiens
auugccaugagaguucuguca

SEQ ID NO: 2173745 - RNA, 18 nt, Homo sapiens
uggaucacagacacugca

SEQ ID NO: 2173746 - RNA, 18 nt, Homo sapiens
agauuggcauggcuuuau

SEQ ID NO: 2173747 - RNA, 21 nt, Homo sapiens
ggugucaucccucccaaugcc

SEQ ID NO: 2173748 - RNA, 20 nt, Homo sapiens
acaagcgugagccacugcac

SEQ ID NO: 2173749 - RNA, 18 nt, Homo sapiens
uccuauuuuucaauggga

SEQ ID NO: 2173750 - RNA, 22 nt, Homo sapiens
uccucguggagcuuagcaggca

SEQ ID NO: 2173751 - RNA, 16 nt, Homo sapiens
caaaaacagcuacuua

SEQ ID NO: 2173752 - RNA, 18 nt, Homo sapiens
cguuacugcauacugauc

SEQ ID NO: 2173753 - RNA, 23 nt, Homo sapiens
cucccugaccuuagcguucugga

SEQ ID NO: 2173754 - RNA, 18 nt, Homo sapiens
cacauggccuaugcacau

SEQ ID NO: 2173755 - RNA, 18 nt, Homo sapiens
ggaguguaaaauguauau

SEQ ID NO: 2173756 - RNA, 19 nt, Homo sapiens
cagagagacccgggaagga

SEQ ID NO: 2173757 - RNA, 16 nt, Homo sapiens
aaauugcuugacccag

SEQ ID NO: 2173758 - RNA, 22 nt, Homo sapiens
aauaccuuggcugauguugcag

SEQ ID NO: 2173759 - RNA, 17 nt, Homo sapiens
uucuaaaaacacacaca

SEQ ID NO: 2173760 - RNA, 22 nt, Homo sapiens
cauuuuuguaauauaagacaag

SEQ ID NO: 2173761 - RNA, 23 nt, Homo sapiens
agcugggggguuggcagcccacu

SEQ ID NO: 2173762 - RNA, 19 nt, Homo sapiens
ucuuaaaacuauaacauua

SEQ ID NO: 2173763 - RNA, 19 nt, Homo sapiens
acuaagaaaaaaagcacaa

SEQ ID NO: 2173764 - RNA, 11 nt, Homo sapiens
agacuccucag

SEQ ID NO: 2173765 - RNA, 15 nt, Homo sapiens
aagcugaguauuaaa

SEQ ID NO: 2173766 - RNA, 20 nt, Homo sapiens
uccaauccuuuauagcuuug

SEQ ID NO: 2173767 - RNA, 21 nt, Homo sapiens
uuacuucuagucagucaucca

SEQ ID NO: 2173768 - RNA, 13 nt, Homo sapiens
cagccuguagcuc

SEQ ID NO: 2173769 - RNA, 23 nt, Homo sapiens
cuauuuuggggucaaaugcuaga

SEQ ID NO: 2173770 - RNA, 16 nt, Homo sapiens
aggcagagacaucuuu

SEQ ID NO: 2173771 - RNA, 17 nt, Homo sapiens
uacaggaagaaagagcu

SEQ ID NO: 2173772 - RNA, 18 nt, Homo sapiens
augccuuuauauacuuag

SEQ ID NO: 2173773 - RNA, 17 nt, Homo sapiens
caguuuauacccuaguu

SEQ ID NO: 2173774 - RNA, 16 nt, Homo sapiens
ugcuccccuacuucuc

SEQ ID NO: 2173775 - RNA, 15 nt, Homo sapiens
uccaggaaccaaaaa

SEQ ID NO: 2173776 - RNA, 16 nt, Homo sapiens
aaauacucagcaacug

SEQ ID NO: 2173777 - RNA, 22 nt, Homo sapiens
gaaaaagccaaggugucauuua

SEQ ID NO: 2173778 - RNA, 22 nt, Homo sapiens
uggaaagucaugcaaucccauu

SEQ ID NO: 2173779 - RNA, 13 nt, Homo sapiens
uuuccacuggagu

SEQ ID NO: 2173780 - RNA, 18 nt, Homo sapiens
aucccaagcaucauauca

SEQ ID NO: 2173781 - RNA, 13 nt, Homo sapiens
acagugcauuuac

SEQ ID NO: 2173782 - RNA, 20 nt, Homo sapiens
gaggcuuccugacugacaca

SEQ ID NO: 2173783 - RNA, 18 nt, Homo sapiens
cucaaucucccuggggca

SEQ ID NO: 2173784 - RNA, 16 nt, Homo sapiens
acuuuugauaaguauc

SEQ ID NO: 2173785 - RNA, 17 nt, Homo sapiens
gccaaacacacuguaaa

SEQ ID NO: 2173786 - RNA, 22 nt, Homo sapiens
uaacuuuuaaaaugaagcuuug

SEQ ID NO: 2173787 - RNA, 20 nt, Homo sapiens
gcuagaguuuccuuauccag

SEQ ID NO: 2173788 - RNA, 11 nt, Homo sapiens
uggcuuucaua

SEQ ID NO: 2173789 - RNA, 21 nt, Homo sapiens
aguucccccaaccaucuucac

SEQ ID NO: 2173790 - RNA, 18 nt, Homo sapiens
ugugaucuaucaauaguc

SEQ ID NO: 2173791 - RNA, 16 nt, Homo sapiens
cgaaauagauccagug

SEQ ID NO: 2173792 - RNA, 14 nt, Homo sapiens
acugcaacacugga

SEQ ID NO: 2173793 - RNA, 20 nt, Homo sapiens
ccuggaggccgggugcucag

SEQ ID NO: 2173794 - RNA, 12 nt, Homo sapiens
aacaucaaagag

SEQ ID NO: 2173795 - RNA, 18 nt, Homo sapiens
aaacacuggcucugggac

SEQ ID NO: 2173796 - RNA, 18 nt, Homo sapiens
uaugccauagcaagauug

SEQ ID NO: 2173797 - RNA, 20 nt, Homo sapiens
acaguuuauauuguggaaua

SEQ ID NO: 2173798 - RNA, 16 nt, Homo sapiens
acuaacacaugcacac

SEQ ID NO: 2173799 - RNA, 17 nt, Homo sapiens
uccagccugacaacagc

SEQ ID NO: 2173800 - RNA, 18 nt, Homo sapiens
aagguucgacuagugaua

SEQ ID NO: 2173801 - RNA, 19 nt, Homo sapiens
ugcuguauccacaaaucau

SEQ ID NO: 2173802 - RNA, 20 nt, Homo sapiens
uuucauuuugagaacauucc

SEQ ID NO: 2173803 - RNA, 13 nt, Homo sapiens
auaaagcuaaaau

SEQ ID NO: 2173804 - RNA, 15 nt, Homo sapiens
acacuggugccaugu

SEQ ID NO: 2173805 - RNA, 21 nt, Homo sapiens
gucauuuuuauaaaacuuuga

SEQ ID NO: 2173806 - RNA, 19 nt, Homo sapiens
auccaaccccccaccugcc

SEQ ID NO: 2173807 - RNA, 20 nt, Homo sapiens
gcacauucuuaaauauuucc

SEQ ID NO: 2173808 - RNA, 13 nt, Homo sapiens
accaugugacaca

SEQ ID NO: 2173809 - RNA, 15 nt, Homo sapiens
agaccaucugaggaa

SEQ ID NO: 2173810 - RNA, 15 nt, Homo sapiens
uaaacuuuaucucac

SEQ ID NO: 2173811 - RNA, 17 nt, Homo sapiens
ggauaucaaaagcaaau

SEQ ID NO: 2173812 - RNA, 16 nt, Homo sapiens
ucugcaugaaaggcga

SEQ ID NO: 2173813 - RNA, 23 nt, Homo sapiens
ucccucucagaggccugcugcca

SEQ ID NO: 2173814 - RNA, 16 nt, Homo sapiens
ucccagacacauucac

SEQ ID NO: 2173815 - RNA, 21 nt, Homo sapiens
uuaaaauggacuuuuguucau

SEQ ID NO: 2173816 - RNA, 21 nt, Homo sapiens
acauucccucuaauuugaacu

SEQ ID NO: 2173817 - RNA, 13 nt, Homo sapiens
gacaaucaucucc

SEQ ID NO: 2173818 - RNA, 19 nt, Homo sapiens
acugauccagucacagcca

SEQ ID NO: 2173819 - RNA, 16 nt, Homo sapiens
agauuucaugccuggu

SEQ ID NO: 2173820 - RNA, 12 nt, Homo sapiens
uccaggggccac

SEQ ID NO: 2173821 - RNA, 16 nt, Homo sapiens
acuucuguauguguau

SEQ ID NO: 2173822 - RNA, 14 nt, Homo sapiens
caaugcacagggcu

SEQ ID NO: 2173823 - RNA, 17 nt, Homo sapiens
ggugggggaugcugagg

SEQ ID NO: 2173824 - RNA, 14 nt, Homo sapiens
cauuaguugcacua

SEQ ID NO: 2173825 - RNA, 22 nt, Homo sapiens
uccuccacaauaaggucaaugc

SEQ ID NO: 2173826 - RNA, 13 nt, Homo sapiens
uaacauuaccuua

SEQ ID NO: 2173827 - RNA, 14 nt, Homo sapiens
ucaucucccagauc

SEQ ID NO: 2173828 - RNA, 21 nt, Homo sapiens
ugcgcugcacccacuaaugug

SEQ ID NO: 2173829 - RNA, 15 nt, Homo sapiens
guaccucacuuuaca

SEQ ID NO: 2173830 - RNA, 17 nt, Homo sapiens
ugcuauaacuauguuga

SEQ ID NO: 2173831 - RNA, 16 nt, Homo sapiens
aagccuuuugcucaca

SEQ ID NO: 2173832 - RNA, 20 nt, Homo sapiens
gccucccucaaaggaccugc

SEQ ID NO: 2173833 - RNA, 16 nt, Homo sapiens
ccaucuccauuucaca

SEQ ID NO: 2173834 - RNA, 15 nt, Homo sapiens
cggcgaagaggaccc

SEQ ID NO: 2173835 - RNA, 16 nt, Homo sapiens
gugcuagucacuggca

SEQ ID NO: 2173836 - RNA, 16 nt, Homo sapiens
auugagucuuccaggg

SEQ ID NO: 2173837 - RNA, 17 nt, Homo sapiens
uggauugccaguuacau

SEQ ID NO: 2173838 - RNA, 15 nt, Homo sapiens
ucacuuaaacuuuua

SEQ ID NO: 2173839 - RNA, 22 nt, Homo sapiens
gcacuuaucaaacguguuauau

SEQ ID NO: 2173840 - RNA, 12 nt, Homo sapiens
aacaacauuuau

SEQ ID NO: 2173841 - RNA, 22 nt, Homo sapiens
auguggggguggggguggagaa

SEQ ID NO: 2173842 - RNA, 13 nt, Homo sapiens
uuacuagugccaa

SEQ ID NO: 2173843 - RNA, 16 nt, Homo sapiens
uacauacaaccuaugu

SEQ ID NO: 2173844 - RNA, 12 nt, Homo sapiens
agucuucuggau

SEQ ID NO: 2173845 - RNA, 13 nt, Homo sapiens
uggaaggugcugu

SEQ ID NO: 2173846 - RNA, 18 nt, Homo sapiens
cucugcagucaagcccug

SEQ ID NO: 2173847 - RNA, 22 nt, Homo sapiens
cagacucuugggccguccccau

SEQ ID NO: 2173848 - RNA, 15 nt, Homo sapiens
cuccacgaagccuua

SEQ ID NO: 2173849 - RNA, 21 nt, Homo sapiens
ugcguagaauugcaggucucu

SEQ ID NO: 2173850 - RNA, 19 nt, Homo sapiens
aauagaacuaucugcauua

SEQ ID NO: 2173851 - RNA, 20 nt, Homo sapiens
aguguggggauuuucacuga

SEQ ID NO: 2173852 - RNA, 22 nt, Homo sapiens
cugcacuuaguagcuaugugau

SEQ ID NO: 2173853 - RNA, 21 nt, Homo sapiens
ucccuuauucuaaagcugccc

SEQ ID NO: 2173854 - RNA, 19 nt, Homo sapiens
ugagcaguuguuauauuca

SEQ ID NO: 2173855 - RNA, 23 nt, Homo sapiens
aacacuggcuuuggguagugcca

SEQ ID NO: 2173856 - RNA, 22 nt, Homo sapiens
ccacuguaauuaaaacuauuua

SEQ ID NO: 2173857 - RNA, 15 nt, Homo sapiens
guagcauacauuuau

SEQ ID NO: 2173858 - RNA, 17 nt, Homo sapiens
gcuaccuacauacaauu

SEQ ID NO: 2173859 - RNA, 14 nt, Homo sapiens
ggaggcugcagcca

SEQ ID NO: 2173860 - RNA, 14 nt, Homo sapiens
cccaugugugagug

SEQ ID NO: 2173861 - RNA, 17 nt, Homo sapiens
aggccuggccucggggc

SEQ ID NO: 2173862 - RNA, 17 nt, Homo sapiens
agcugaauuuucuggaa

SEQ ID NO: 2173863 - RNA, 18 nt, Homo sapiens
ugcuaucuuuuuuagugu

SEQ ID NO: 2173864 - RNA, 20 nt, Homo sapiens
aaugaucagcaucugugaug

SEQ ID NO: 2173865 - RNA, 17 nt, Homo sapiens
uuuucuauuuaccuccu

SEQ ID NO: 2173866 - RNA, 17 nt, Homo sapiens
uauuuaguucaacugua

SEQ ID NO: 2173867 - RNA, 16 nt, Homo sapiens
gcaaucuggaagaaag

SEQ ID NO: 2173868 - RNA, 18 nt, Homo sapiens
ccuacucucuuaugcauu

SEQ ID NO: 2173869 - RNA, 15 nt, Homo sapiens
cacagacaaagugcu

SEQ ID NO: 2173870 - RNA, 18 nt, Homo sapiens
cacagcaaugacauuuau

SEQ ID NO: 2173871 - RNA, 16 nt, Homo sapiens
aauuuggguucugccu

SEQ ID NO: 2173872 - RNA, 14 nt, Homo sapiens
auuugaggaucuca

SEQ ID NO: 2173873 - RNA, 23 nt, Homo sapiens
auaguuuuucagucuauggguuu

SEQ ID NO: 2173874 - RNA, 21 nt, Homo sapiens
gagagaacugagcaucuccag

SEQ ID NO: 2173875 - RNA, 14 nt, Homo sapiens
cagaaccuuuguca

SEQ ID NO: 2173876 - RNA, 20 nt, Homo sapiens
gcccuucccagggcacccag

SEQ ID NO: 2173877 - RNA, 15 nt, Homo sapiens
guaaugccaauauga

SEQ ID NO: 2173878 - RNA, 10 nt, Homo sapiens
uugagcugca

SEQ ID NO: 2173879 - RNA, 16 nt, Homo sapiens
uuuuuccaaaagccag

SEQ ID NO: 2173880 - RNA, 15 nt, Homo sapiens
ggcuucacuguauaa

SEQ ID NO: 2173881 - RNA, 21 nt, Homo sapiens
aguuuaugcugugcuaaauau

SEQ ID NO: 2173882 - RNA, 21 nt, Homo sapiens
aauuccagaaugaagaauuca

SEQ ID NO: 2173883 - RNA, 15 nt, Homo sapiens
cugggggacacuuuc

SEQ ID NO: 2173884 - RNA, 21 nt, Homo sapiens
ggagcaggaccuacuaggaga

SEQ ID NO: 2173885 - RNA, 14 nt, Homo sapiens
ucaauaaacuaaag

SEQ ID NO: 2173886 - RNA, 14 nt, Homo sapiens
agaugaaugucagu

SEQ ID NO: 2173887 - RNA, 13 nt, Homo sapiens
cagaacucuuccu

SEQ ID NO: 2173888 - RNA, 23 nt, Homo sapiens
gacuugaaauucucaucagucca

SEQ ID NO: 2173889 - RNA, 15 nt, Homo sapiens
cgcaaacacaccgau

SEQ ID NO: 2173890 - RNA, 15 nt, Homo sapiens
gcuauguccuaauaa

SEQ ID NO: 2173891 - RNA, 20 nt, Homo sapiens
uaauacaauaaacaugucaa

SEQ ID NO: 2173892 - RNA, 17 nt, Homo sapiens
aauugugaucagaccau

SEQ ID NO: 2173893 - RNA, 16 nt, Homo sapiens
cuacuaagauacucca

SEQ ID NO: 2173894 - RNA, 19 nt, Homo sapiens
auuugaagcaucacauaaa

SEQ ID NO: 2173895 - RNA, 22 nt, Homo sapiens
gaucuggggaggcaggcauucc

SEQ ID NO: 2173896 - RNA, 19 nt, Homo sapiens
uuugaaugaacacuaugca

SEQ ID NO: 2173897 - RNA, 17 nt, Homo sapiens
uaaaauguaaagccaug

SEQ ID NO: 2173898 - RNA, 17 nt, Homo sapiens
uucaaaaaccacguucu

SEQ ID NO: 2173899 - RNA, 15 nt, Homo sapiens
aaggcaaaaaugugc

SEQ ID NO: 2173900 - RNA, 23 nt, Homo sapiens
uaacagaccacuguauguuuacu

SEQ ID NO: 2173901 - RNA, 10 nt, Homo sapiens
aaaaccaaaa

SEQ ID NO: 2173902 - RNA, 17 nt, Homo sapiens
cccccuccaggccaguu

SEQ ID NO: 2173903 - RNA, 16 nt, Homo sapiens
caaaggaagcuuucuc

SEQ ID NO: 2173904 - RNA, 22 nt, Homo sapiens
agacagcacagccaaccuagcu

SEQ ID NO: 2173905 - RNA, 23 nt, Homo sapiens
gggcagacacuguuugcccagug

SEQ ID NO: 2173906 - RNA, 22 nt, Homo sapiens
aagcaaacuuauaaaucauauu

SEQ ID NO: 2173907 - RNA, 18 nt, Homo sapiens
acaaucguauuacauaaa

SEQ ID NO: 2173908 - RNA, 23 nt, Homo sapiens
aaacuauuuaacuugagcuuuaa

SEQ ID NO: 2173909 - RNA, 23 nt, Homo sapiens
acaauaaagauuguuuuaaagag

SEQ ID NO: 2173910 - RNA, 16 nt, Homo sapiens
uucuaccaacuggaag

SEQ ID NO: 2173911 - RNA, 18 nt, Homo sapiens
aucaagaaaaaaagggag

SEQ ID NO: 2173912 - RNA, 15 nt, Homo sapiens
gcugaggccugugaa

SEQ ID NO: 2173913 - RNA, 14 nt, Homo sapiens
acaugugcacuccc

SEQ ID NO: 2173914 - RNA, 20 nt, Homo sapiens
caaaugcuucuaaauaugaa

SEQ ID NO: 2173915 - RNA, 22 nt, Homo sapiens
ccagaguuucuugguugcuuuu

SEQ ID NO: 2173916 - RNA, 16 nt, Homo sapiens
cccauuagaaugugau

SEQ ID NO: 2173917 - RNA, 21 nt, Homo sapiens
gucuucaccaagugaucaaaa

SEQ ID NO: 2173918 - RNA, 12 nt, Homo sapiens
augguccagaaa

SEQ ID NO: 2173919 - RNA, 19 nt, Homo sapiens
cauccccgaaagaggugaa

SEQ ID NO: 2173920 - RNA, 19 nt, Homo sapiens
ccucugaaauuucccacac

SEQ ID NO: 2173921 - RNA, 22 nt, Homo sapiens
cuugauauuuccuucaccaccu

SEQ ID NO: 2173922 - RNA, 18 nt, Homo sapiens
gugccccccuccuccagu

SEQ ID NO: 2173923 - RNA, 15 nt, Homo sapiens
acucugggaagccaa

SEQ ID NO: 2173924 - RNA, 20 nt, Homo sapiens
agagcaaaacucugucucaa

SEQ ID NO: 2173925 - RNA, 20 nt, Homo sapiens
uuccacaccuagcaucucau

SEQ ID NO: 2173926 - RNA, 20 nt, Homo sapiens
uucacgccuguaaucccagc

SEQ ID NO: 2173927 - RNA, 11 nt, Homo sapiens
auuugcuccug

SEQ ID NO: 2173928 - RNA, 20 nt, Homo sapiens
gaggcgggaaaaucauuuga

SEQ ID NO: 2173929 - RNA, 20 nt, Homo sapiens
gguuuuugaggaaacaaaga

SEQ ID NO: 2173930 - RNA, 18 nt, Homo sapiens
agcccuccaaaagcacuu

SEQ ID NO: 2173931 - RNA, 15 nt, Homo sapiens
cuccuccacagucac

SEQ ID NO: 2173932 - RNA, 18 nt, Homo sapiens
guuuaacugaguuagaau

SEQ ID NO: 2173933 - RNA, 13 nt, Homo sapiens
cacaccaaucagc

SEQ ID NO: 2173934 - RNA, 20 nt, Homo sapiens
agcccuuccccauccugggg

SEQ ID NO: 2173935 - RNA, 14 nt, Homo sapiens
ucagagaaaacacu

SEQ ID NO: 2173936 - RNA, 14 nt, Homo sapiens
auggcgucuaccag

SEQ ID NO: 2173937 - RNA, 19 nt, Homo sapiens
aaagauuaaaugugucauu

SEQ ID NO: 2173938 - RNA, 15 nt, Homo sapiens
auuuaguucucagcu

SEQ ID NO: 2173939 - RNA, 13 nt, Homo sapiens
aguagccaugaca

SEQ ID NO: 2173940 - RNA, 12 nt, Homo sapiens
gaaggaaaccag

SEQ ID NO: 2173941 - RNA, 17 nt, Homo sapiens
aagugaggugacacucc

SEQ ID NO: 2173942 - RNA, 15 nt, Homo sapiens
agcugucuucacaug

SEQ ID NO: 2173943 - RNA, 17 nt, Homo sapiens
uugaacaaagacuacua

SEQ ID NO: 2173944 - RNA, 19 nt, Homo sapiens
aauccccagauauuuaugu

SEQ ID NO: 2173945 - RNA, 12 nt, Homo sapiens
accuguuuucac

SEQ ID NO: 2173946 - RNA, 16 nt, Homo sapiens
auuaauaaagcauucu

SEQ ID NO: 2173947 - RNA, 15 nt, Homo sapiens
gacuguccccuugaa

SEQ ID NO: 2173948 - RNA, 17 nt, Homo sapiens
uuggauuuauucugcca

SEQ ID NO: 2173949 - RNA, 21 nt, Homo sapiens
acccauuugaaagaauauuag

SEQ ID NO: 2173950 - RNA, 19 nt, Homo sapiens
uggagauggcugcugcuca

SEQ ID NO: 2173951 - RNA, 18 nt, Homo sapiens
agucucugcccaaacaua

SEQ ID NO: 2173952 - RNA, 22 nt, Homo sapiens
guaaacuauaaacuacuguaau

SEQ ID NO: 2173953 - RNA, 18 nt, Homo sapiens
aguuuuauuuuuguagag

SEQ ID NO: 2173954 - RNA, 13 nt, Homo sapiens
aacacauucaaua

SEQ ID NO: 2173955 - RNA, 17 nt, Homo sapiens
gcguaccguacacagag

SEQ ID NO: 2173956 - RNA, 11 nt, Homo sapiens
uguuacauaca

SEQ ID NO: 2173957 - RNA, 17 nt, Homo sapiens
ggcccuaugucucagga

SEQ ID NO: 2173958 - RNA, 20 nt, Homo sapiens
gggagcacuguucacaucau

SEQ ID NO: 2173959 - RNA, 20 nt, Homo sapiens
aggcccaagagcagagucug

SEQ ID NO: 2173960 - RNA, 17 nt, Homo sapiens
cacuggaaaaguguaau

SEQ ID NO: 2173961 - RNA, 14 nt, Homo sapiens
aaaaugagcaaaag

SEQ ID NO: 2173962 - RNA, 14 nt, Homo sapiens
auguaaagcuguua

SEQ ID NO: 2173963 - RNA, 18 nt, Homo sapiens
uucccacggccuuucuag

SEQ ID NO: 2173964 - RNA, 22 nt, Homo sapiens
aauuaguuuaccucauccaugc

SEQ ID NO: 2173965 - RNA, 20 nt, Homo sapiens
guaccuuugucugccauuga

SEQ ID NO: 2173966 - RNA, 22 nt, Homo sapiens
gaagcagucaauuuucacauca

SEQ ID NO: 2173967 - RNA, 23 nt, Homo sapiens
gucaucgggaggagcagccugaa

SEQ ID NO: 2173968 - RNA, 16 nt, Homo sapiens
aaguaugacaaccucu

SEQ ID NO: 2173969 - RNA, 21 nt, Homo sapiens
cgguuucuccccggacacucg

SEQ ID NO: 2173970 - RNA, 17 nt, Homo sapiens
caccaugcccggccuaa

SEQ ID NO: 2173971 - RNA, 22 nt, Homo sapiens
aaagacuugaauagacacuuca

SEQ ID NO: 2173972 - RNA, 14 nt, Homo sapiens
ucgccuguggagcu

SEQ ID NO: 2173973 - RNA, 18 nt, Homo sapiens
cuuccaucuagucacaaa

SEQ ID NO: 2173974 - RNA, 16 nt, Homo sapiens
cugcacaugugccaca

SEQ ID NO: 2173975 - RNA, 15 nt, Homo sapiens
cuguauacugagucu

SEQ ID NO: 2173976 - RNA, 24 nt, Homo sapiens
caucaucugcugcacauagcagac

SEQ ID NO: 2173977 - RNA, 20 nt, Homo sapiens
uugaaaauuuuuaaauauuc

SEQ ID NO: 2173978 - RNA, 11 nt, Homo sapiens
uaauagccauc

SEQ ID NO: 2173979 - RNA, 11 nt, Homo sapiens
aaacaguucug

SEQ ID NO: 2173980 - RNA, 12 nt, Homo sapiens
aauuuuacuucu

SEQ ID NO: 2173981 - RNA, 20 nt, Homo sapiens
aaaacuguuguagaaauucu

SEQ ID NO: 2173982 - RNA, 15 nt, Homo sapiens
gccucccacagugac

SEQ ID NO: 2173983 - RNA, 16 nt, Homo sapiens
ucuguaaguaacuuca

SEQ ID NO: 2173984 - RNA, 12 nt, Homo sapiens
acacaacaugua

SEQ ID NO: 2173985 - RNA, 22 nt, Homo sapiens
gccugcaaacucacugcucaag

SEQ ID NO: 2173986 - RNA, 13 nt, Homo sapiens
cauagagacuuug

SEQ ID NO: 2173987 - RNA, 16 nt, Homo sapiens
uggggcacuugcugag

SEQ ID NO: 2173988 - RNA, 15 nt, Homo sapiens
ugcacaggcagcaag

SEQ ID NO: 2173989 - RNA, 17 nt, Homo sapiens
cagaaagcauccuaaau

SEQ ID NO: 2173990 - RNA, 20 nt, Homo sapiens
uuagaaauauucuacuucuc

SEQ ID NO: 2173991 - RNA, 13 nt, Homo sapiens
cagaguugugcau

SEQ ID NO: 2173992 - RNA, 14 nt, Homo sapiens
aucacuacaagcuu

SEQ ID NO: 2173993 - RNA, 23 nt, Homo sapiens
agauauaucccggaugaggcuga

SEQ ID NO: 2173994 - RNA, 15 nt, Homo sapiens
gaaagaaacuugaua

SEQ ID NO: 2173995 - RNA, 15 nt, Homo sapiens
uguguucaggcauuc

SEQ ID NO: 2173996 - RNA, 12 nt, Homo sapiens
gucuaacgcuga

SEQ ID NO: 2173997 - RNA, 21 nt, Homo sapiens
cuccuuccuagccuugcacuu

SEQ ID NO: 2173998 - RNA, 17 nt, Homo sapiens
uuucuaacucugaugua

SEQ ID NO: 2173999 - RNA, 17 nt, Homo sapiens
ugucauauacaauuguc

SEQ ID NO: 2174000 - RNA, 18 nt, Homo sapiens
aauuuccuuucauaccuu

SEQ ID NO: 2174001 - RNA, 19 nt, Homo sapiens
ugaugucuccuaagcaccu

SEQ ID NO: 2174002 - RNA, 18 nt, Homo sapiens
guaugugugugugugaac

SEQ ID NO: 2174003 - RNA, 15 nt, Homo sapiens
ccuuauuugucugua

SEQ ID NO: 2174004 - RNA, 15 nt, Homo sapiens
acacgaauugcucaa

SEQ ID NO: 2174005 - RNA, 20 nt, Homo sapiens
gauguagauuacugaaaaau

SEQ ID NO: 2174006 - RNA, 20 nt, Homo sapiens
cccaaauuucauaccuauca

SEQ ID NO: 2174007 - RNA, 15 nt, Homo sapiens
uaagcuagucccaaa

SEQ ID NO: 2174008 - RNA, 10 nt, Homo sapiens
cuucugccau

SEQ ID NO: 2174009 - RNA, 10 nt, Homo sapiens
ccucugccac

SEQ ID NO: 2174010 - RNA, 18 nt, Homo sapiens
aucauagaaaaugugagu

SEQ ID NO: 2174011 - RNA, 16 nt, Homo sapiens
ucauuauuuaugucca

SEQ ID NO: 2174012 - RNA, 14 nt, Homo sapiens
gcuguauggaaaug

SEQ ID NO: 2174013 - RNA, 15 nt, Homo sapiens
aacacccaugaauca

SEQ ID NO: 2174014 - RNA, 12 nt, Homo sapiens
cguggucccuga

SEQ ID NO: 2174015 - RNA, 14 nt, Homo sapiens
cuaaugugcauuaa

SEQ ID NO: 2174016 - RNA, 16 nt, Homo sapiens
acuucuggugugauac

SEQ ID NO: 2174017 - RNA, 13 nt, Homo sapiens
uggcucccugugu

SEQ ID NO: 2174018 - RNA, 16 nt, Homo sapiens
caccacuguugccuuu

SEQ ID NO: 2174019 - RNA, 19 nt, Homo sapiens
uaaagacgucucuuuuugg

SEQ ID NO: 2174020 - RNA, 17 nt, Homo sapiens
accugagaaauggccaa

SEQ ID NO: 2174021 - RNA, 18 nt, Homo sapiens
agauuuucuuuugccuuu

SEQ ID NO: 2174022 - RNA, 17 nt, Homo sapiens
aacuggguuaaauauuu

SEQ ID NO: 2174023 - RNA, 13 nt, Homo sapiens
aggaaaacacagc

SEQ ID NO: 2174024 - RNA, 15 nt, Homo sapiens
ugaucccagcucacu

SEQ ID NO: 2174025 - RNA, 20 nt, Homo sapiens
aacccucacaagcaugaagu

SEQ ID NO: 2174026 - RNA, 19 nt, Homo sapiens
ucaaagacuuccucuggcu

SEQ ID NO: 2174027 - RNA, 21 nt, Homo sapiens
gagaaaaucaaagcagucaua

SEQ ID NO: 2174028 - RNA, 14 nt, Homo sapiens
guuuuacaaagggg

SEQ ID NO: 2174029 - RNA, 18 nt, Homo sapiens
aauuuaauggacugugaa

SEQ ID NO: 2174030 - RNA, 19 nt, Homo sapiens
ucaggagagaguugaaccu

SEQ ID NO: 2174031 - RNA, 11 nt, Homo sapiens
gcaugcacaaa

SEQ ID NO: 2174032 - RNA, 14 nt, Homo sapiens
gaaagccucaguga

SEQ ID NO: 2174033 - RNA, 14 nt, Homo sapiens
caguuacugaaauc

SEQ ID NO: 2174034 - RNA, 18 nt, Homo sapiens
aaggugcuggaaagggag

SEQ ID NO: 2174035 - RNA, 14 nt, Homo sapiens
aguggaaagugauu

SEQ ID NO: 2174036 - RNA, 22 nt, Homo sapiens
uuagcuuccugccccagacaga

SEQ ID NO: 2174037 - RNA, 17 nt, Homo sapiens
ccaaaaauaugguugau

SEQ ID NO: 2174038 - RNA, 18 nt, Homo sapiens
auauagcuaggugacaua

SEQ ID NO: 2174039 - RNA, 19 nt, Homo sapiens
agucugcaugugcacggug

SEQ ID NO: 2174040 - RNA, 20 nt, Homo sapiens
gaugaaauuaaacagauuag

SEQ ID NO: 2174041 - RNA, 22 nt, Homo sapiens
gaaaacugauucucuaugacau

SEQ ID NO: 2174042 - RNA, 21 nt, Homo sapiens
acaaaaucuuuucauaauuaa

SEQ ID NO: 2174043 - RNA, 21 nt, Homo sapiens
caguggcgugaucucagcuca

SEQ ID NO: 2174044 - RNA, 16 nt, Homo sapiens
gucaaauaaacacugu

SEQ ID NO: 2174045 - RNA, 17 nt, Homo sapiens
ucaguguggacugggaa

SEQ ID NO: 2174046 - RNA, 20 nt, Homo sapiens
cacagugaaaccccgucucu

SEQ ID NO: 2174047 - RNA, 14 nt, Homo sapiens
ugagaauaguuuuc

SEQ ID NO: 2174048 - RNA, 12 nt, Homo sapiens
gaugcugaccuc

SEQ ID NO: 2174049 - RNA, 17 nt, Homo sapiens
cugcgugguugaugauc

SEQ ID NO: 2174050 - RNA, 17 nt, Homo sapiens
ucacugguccaccuccu

SEQ ID NO: 2174051 - RNA, 20 nt, Homo sapiens
cucagccugcacugggagca

SEQ ID NO: 2174052 - RNA, 16 nt, Homo sapiens
cauucugcucuuugau

SEQ ID NO: 2174053 - RNA, 13 nt, Homo sapiens
cgauuucuuugua

SEQ ID NO: 2174054 - RNA, 18 nt, Homo sapiens
agcaauacagacuacuuc

SEQ ID NO: 2174055 - RNA, 23 nt, Homo sapiens
caaacaccuccuagcaagaccug

SEQ ID NO: 2174056 - RNA, 22 nt, Homo sapiens
ugcgaaugguagucuaaccaaa

SEQ ID NO: 2174057 - RNA, 16 nt, Homo sapiens
cucccugggccugucu

SEQ ID NO: 2174058 - RNA, 19 nt, Homo sapiens
cuuggucucuuucuuucca

SEQ ID NO: 2174059 - RNA, 19 nt, Homo sapiens
cuucccuuuauuacaagaa

SEQ ID NO: 2174060 - RNA, 15 nt, Homo sapiens
ucccaccgaacacua

SEQ ID NO: 2174061 - RNA, 20 nt, Homo sapiens
aggucaaacuaauucucaca

SEQ ID NO: 2174062 - RNA, 13 nt, Homo sapiens
ugggggacugggg

SEQ ID NO: 2174063 - RNA, 13 nt, Homo sapiens
caucugaccaucu

SEQ ID NO: 2174064 - RNA, 14 nt, Homo sapiens
agucucagucugau

SEQ ID NO: 2174065 - RNA, 15 nt, Homo sapiens
auuucacaagcuauu

SEQ ID NO: 2174066 - RNA, 21 nt, Homo sapiens
uagaucccauagugugcauca

SEQ ID NO: 2174067 - RNA, 18 nt, Homo sapiens
cucacgcuucacagugau

SEQ ID NO: 2174068 - RNA, 21 nt, Homo sapiens
ugccucugacagcagccugug

SEQ ID NO: 2174069 - RNA, 19 nt, Homo sapiens
ccugcccgagagcucuuag

SEQ ID NO: 2174070 - RNA, 19 nt, Homo sapiens
aaagagguagcacuacaaa

SEQ ID NO: 2174071 - RNA, 20 nt, Homo sapiens
aauggcugagccucgugucc

SEQ ID NO: 2174072 - RNA, 19 nt, Homo sapiens
uugcuguuggcaucuugcu

SEQ ID NO: 2174073 - RNA, 21 nt, Homo sapiens
uuuuauaccgcugcauaguau

SEQ ID NO: 2174074 - RNA, 14 nt, Homo sapiens
caauaauuucaggu

SEQ ID NO: 2174075 - RNA, 15 nt, Homo sapiens
ugacauuacaauccu

SEQ ID NO: 2174076 - RNA, 23 nt, Homo sapiens
uauggccgacagacauggacaag

SEQ ID NO: 2174077 - RNA, 19 nt, Homo sapiens
acaugggggaacaaugagc

SEQ ID NO: 2174078 - RNA, 17 nt, Homo sapiens
uggauagcuaauaauga

SEQ ID NO: 2174079 - RNA, 17 nt, Homo sapiens
agaaaauguaguuagcu

SEQ ID NO: 2174080 - RNA, 14 nt, Homo sapiens
caguuucucuccaa

SEQ ID NO: 2174081 - RNA, 13 nt, Homo sapiens
guauuaacuauua

SEQ ID NO: 2174082 - RNA, 14 nt, Homo sapiens
auugaacauucuag

SEQ ID NO: 2174083 - RNA, 14 nt, Homo sapiens
aagagcuugucagc

SEQ ID NO: 2174084 - RNA, 19 nt, Homo sapiens
uaaaagaugauuucucaaa

SEQ ID NO: 2174085 - RNA, 15 nt, Homo sapiens
accgggcaagcacug

SEQ ID NO: 2174086 - RNA, 22 nt, Homo sapiens
guaugcagggagcacuguucac

SEQ ID NO: 2174087 - RNA, 20 nt, Homo sapiens
aaaagacucugaccagagau

SEQ ID NO: 2174088 - RNA, 13 nt, Homo sapiens
cuugaaaagccuu

SEQ ID NO: 2174089 - RNA, 12 nt, Homo sapiens
aagcuggaagaa

SEQ ID NO: 2174090 - RNA, 22 nt, Homo sapiens
auauaaaacuguuucaagcccu

SEQ ID NO: 2174091 - RNA, 15 nt, Homo sapiens
aauuuggcuaauaac

SEQ ID NO: 2174092 - RNA, 15 nt, Homo sapiens
gaaggaaauaaugca

SEQ ID NO: 2174093 - RNA, 20 nt, Homo sapiens
uugcaucucuaauagagauu

SEQ ID NO: 2174094 - RNA, 22 nt, Homo sapiens
gcaucuucuggagucuccagug

SEQ ID NO: 2174095 - RNA, 22 nt, Homo sapiens
aaucucccaaguauugauuuaa

SEQ ID NO: 2174096 - RNA, 19 nt, Homo sapiens
aaggcaagucaaauaccac

SEQ ID NO: 2174097 - RNA, 14 nt, Homo sapiens
auauuuguauacac

SEQ ID NO: 2174098 - RNA, 12 nt, Homo sapiens
uuuacuuugaac

SEQ ID NO: 2174099 - RNA, 21 nt, Homo sapiens
cuuucaggccacauggcuaaa

SEQ ID NO: 2174100 - RNA, 15 nt, Homo sapiens
cugagaggucacaaa

SEQ ID NO: 2174101 - RNA, 15 nt, Homo sapiens
caugcauugagcugc

SEQ ID NO: 2174102 - RNA, 15 nt, Homo sapiens
auguccucucuuaau

SEQ ID NO: 2174103 - RNA, 13 nt, Homo sapiens
acaggaaauugac

SEQ ID NO: 2174104 - RNA, 18 nt, Homo sapiens
ucccucgacauuuucucc

SEQ ID NO: 2174105 - RNA, 15 nt, Homo sapiens
agagcagaaccaaag

SEQ ID NO: 2174106 - RNA, 19 nt, Homo sapiens
cugccuucaaagccacuga

SEQ ID NO: 2174107 - RNA, 13 nt, Homo sapiens
guuaaugccacaa

SEQ ID NO: 2174108 - RNA, 21 nt, Homo sapiens
aguagccucugggaucugcca

SEQ ID NO: 2174109 - RNA, 23 nt, Homo sapiens
ggaacauacagaacucuaaaaga

SEQ ID NO: 2174110 - RNA, 20 nt, Homo sapiens
caccagagagagauucuucc

SEQ ID NO: 2174111 - RNA, 20 nt, Homo sapiens
cuaucauaauucagcacuua

SEQ ID NO: 2174112 - RNA, 13 nt, Homo sapiens
ucuaccauuacca

SEQ ID NO: 2174113 - RNA, 16 nt, Homo sapiens
uuaucuaucaacuaua

SEQ ID NO: 2174114 - RNA, 15 nt, Homo sapiens
ugcuugucauauucg

SEQ ID NO: 2174115 - RNA, 19 nt, Homo sapiens
ucuguuagccauguggcug

SEQ ID NO: 2174116 - RNA, 22 nt, Homo sapiens
gcuggauugagcagaacccaga

SEQ ID NO: 2174117 - RNA, 19 nt, Homo sapiens
uucuucagagacuccugca

SEQ ID NO: 2174118 - RNA, 16 nt, Homo sapiens
uccaucagcacaaaga

SEQ ID NO: 2174119 - RNA, 13 nt, Homo sapiens
acauucaugccug

SEQ ID NO: 2174120 - RNA, 13 nt, Homo sapiens
agguuagcacagc

SEQ ID NO: 2174121 - RNA, 15 nt, Homo sapiens
gaagguuacuaccua

SEQ ID NO: 2174122 - RNA, 17 nt, Homo sapiens
agucaagcuccaagagg

SEQ ID NO: 2174123 - RNA, 15 nt, Homo sapiens
auguauguacuucau

SEQ ID NO: 2174124 - RNA, 13 nt, Homo sapiens
cuuccgugagaca

SEQ ID NO: 2174125 - RNA, 19 nt, Homo sapiens
acacuuaauucuguucuga

SEQ ID NO: 2174126 - RNA, 14 nt, Homo sapiens
ugaaauaugcaucu

SEQ ID NO: 2174127 - RNA, 18 nt, Homo sapiens
augggguggaauagggaa

SEQ ID NO: 2174128 - RNA, 14 nt, Homo sapiens
cuauucugcugaga

SEQ ID NO: 2174129 - RNA, 12 nt, Homo sapiens
agaaugcugcuu

SEQ ID NO: 2174130 - RNA, 16 nt, Homo sapiens
cuucaacaugucacac

SEQ ID NO: 2174131 - RNA, 16 nt, Homo sapiens
cccagagaacaaucac

SEQ ID NO: 2174132 - RNA, 22 nt, Homo sapiens
gcuuuuucucccuuuguuuaaa

SEQ ID NO: 2174133 - RNA, 15 nt, Homo sapiens
guuaucaaccauaug

SEQ ID NO: 2174134 - RNA, 15 nt, Homo sapiens
accguacacagaggg

SEQ ID NO: 2174135 - RNA, 18 nt, Homo sapiens
ggcugaaauaaaagccuc

SEQ ID NO: 2174136 - RNA, 13 nt, Homo sapiens
caucugaugccuu

SEQ ID NO: 2174137 - RNA, 21 nt, Homo sapiens
acacaacauauccguauauau

SEQ ID NO: 2174138 - RNA, 21 nt, Homo sapiens
uccuggagaguaucugagaac

SEQ ID NO: 2174139 - RNA, 23 nt, Homo sapiens
cagcaucugccaggacacugccu

SEQ ID NO: 2174140 - RNA, 12 nt, Homo sapiens
cccuguguuaau

SEQ ID NO: 2174141 - RNA, 19 nt, Homo sapiens
gagaugggaugcuugccua

SEQ ID NO: 2174142 - RNA, 14 nt, Homo sapiens
uaacaguguucuca

SEQ ID NO: 2174143 - RNA, 14 nt, Homo sapiens
guugaaagacauca

SEQ ID NO: 2174144 - RNA, 23 nt, Homo sapiens
ugcuccaacccccgccaccucag

SEQ ID NO: 2174145 - RNA, 15 nt, Homo sapiens
agucugccacccagg

SEQ ID NO: 2174146 - RNA, 18 nt, Homo sapiens
cccaagcagaagaccaga

SEQ ID NO: 2174147 - RNA, 11 nt, Homo sapiens
gggcacuuuuu

SEQ ID NO: 2174148 - RNA, 17 nt, Homo sapiens
uacaaucugcacuuuaa

SEQ ID NO: 2174149 - RNA, 15 nt, Homo sapiens
ugugucaaugccaca

SEQ ID NO: 2174150 - RNA, 16 nt, Homo sapiens
uaacagccucuugccc

SEQ ID NO: 2174151 - RNA, 23 nt, Homo sapiens
agcagggggggaaaugcauuuau

SEQ ID NO: 2174152 - RNA, 21 nt, Homo sapiens
cuauuuuauaagggcacuaac

SEQ ID NO: 2174153 - RNA, 21 nt, Homo sapiens
gccgcuccccuuggaccucca

SEQ ID NO: 2174154 - RNA, 18 nt, Homo sapiens
cugggcacugcucucacc

SEQ ID NO: 2174155 - RNA, 15 nt, Homo sapiens
uaaugagaagauaua

SEQ ID NO: 2174156 - RNA, 23 nt, Homo sapiens
uuacuauucacugaugcagaaag

SEQ ID NO: 2174157 - RNA, 23 nt, Homo sapiens
gccaugacaagaacaaagccacu

SEQ ID NO: 2174158 - RNA, 15 nt, Homo sapiens
uauuggcaauaugaa

SEQ ID NO: 2174159 - RNA, 14 nt, Homo sapiens
agauucaccuccau

SEQ ID NO: 2174160 - RNA, 17 nt, Homo sapiens
ugcucuaaaaaccuuca

SEQ ID NO: 2174161 - RNA, 18 nt, Homo sapiens
aaacauucugauuuggaa

SEQ ID NO: 2174162 - RNA, 13 nt, Homo sapiens
uuauuuauuguau

SEQ ID NO: 2174163 - RNA, 13 nt, Homo sapiens
uguucuauuuaac

SEQ ID NO: 2174164 - RNA, 15 nt, Homo sapiens
uugauuucuuuccag

SEQ ID NO: 2174165 - RNA, 19 nt, Homo sapiens
uucauagguuacuaccuau

SEQ ID NO: 2174166 - RNA, 18 nt, Homo sapiens
aagugaguggaaauggaa

SEQ ID NO: 2174167 - RNA, 15 nt, Homo sapiens
gccaacuacuacugg

SEQ ID NO: 2174168 - RNA, 24 nt, Homo sapiens
cugugcaguccugggauguggcug

SEQ ID NO: 2174169 - RNA, 19 nt, Homo sapiens
caucuuguaggaucuacuu

SEQ ID NO: 2174170 - RNA, 21 nt, Homo sapiens
ccuggcaaagcagcaacacac

SEQ ID NO: 2174171 - RNA, 23 nt, Homo sapiens
cuuuagcagagauaacuuaucag

SEQ ID NO: 2174172 - RNA, 16 nt, Homo sapiens
caaagagaauguauuu

SEQ ID NO: 2174173 - RNA, 20 nt, Homo sapiens
ucacaaguaggagacacaga

SEQ ID NO: 2174174 - RNA, 17 nt, Homo sapiens
ggugcaguaucaugccc

SEQ ID NO: 2174175 - RNA, 17 nt, Homo sapiens
uguaaaguagaauaagc

SEQ ID NO: 2174176 - RNA, 16 nt, Homo sapiens
ugaagcaugcucugua

SEQ ID NO: 2174177 - RNA, 16 nt, Homo sapiens
cuguaagagacaugaa

SEQ ID NO: 2174178 - RNA, 16 nt, Homo sapiens
caguaggauccaaaga

SEQ ID NO: 2174179 - RNA, 16 nt, Homo sapiens
uggccucugcaacugc

SEQ ID NO: 2174180 - RNA, 20 nt, Homo sapiens
auaacuugugauuccagggc

SEQ ID NO: 2174181 - RNA, 15 nt, Homo sapiens
agaagcuguccuuga

SEQ ID NO: 2174182 - RNA, 17 nt, Homo sapiens
gccaagagugcacuacu

SEQ ID NO: 2174183 - RNA, 23 nt, Homo sapiens
uucccaauuaucaaaaaacagaa

SEQ ID NO: 2174184 - RNA, 17 nt, Homo sapiens
agccaguggggaugagg

SEQ ID NO: 2174185 - RNA, 20 nt, Homo sapiens
cacugccugcagcugagauu

SEQ ID NO: 2174186 - RNA, 18 nt, Homo sapiens
ugcauaagcugaacuaaa

SEQ ID NO: 2174187 - RNA, 15 nt, Homo sapiens
gcccuggaggugcca

SEQ ID NO: 2174188 - RNA, 20 nt, Homo sapiens
cugaagagugacggacuucu

SEQ ID NO: 2174189 - RNA, 20 nt, Homo sapiens
guaaaauuuugucauauacc

SEQ ID NO: 2174190 - RNA, 13 nt, Homo sapiens
uuguuucuugaua

SEQ ID NO: 2174191 - RNA, 13 nt, Homo sapiens
auuucugcucaga

SEQ ID NO: 2174192 - RNA, 15 nt, Homo sapiens
gauacugaugcauug

SEQ ID NO: 2174193 - RNA, 19 nt, Homo sapiens
gcugaauaaaguugcacug

SEQ ID NO: 2174194 - RNA, 12 nt, Homo sapiens
aauauaauacug

SEQ ID NO: 2174195 - RNA, 17 nt, Homo sapiens
auguccugacaccugcu

SEQ ID NO: 2174196 - RNA, 18 nt, Homo sapiens
auacacaacuccacuguc

SEQ ID NO: 2174197 - RNA, 19 nt, Homo sapiens
caucaaugcugaguuaaua

SEQ ID NO: 2174198 - RNA, 19 nt, Homo sapiens
ucccccagcccugucaugu

SEQ ID NO: 2174199 - RNA, 20 nt, Homo sapiens
accacaaaaaagaaacuugc

SEQ ID NO: 2174200 - RNA, 20 nt, Homo sapiens
uugugaccuugacuugccau

SEQ ID NO: 2174201 - RNA, 15 nt, Homo sapiens
cuaauccaucuucau

SEQ ID NO: 2174202 - RNA, 20 nt, Homo sapiens
uuuccagaacuaccaugaga

SEQ ID NO: 2174203 - RNA, 15 nt, Homo sapiens
agaauaaccaacacc

SEQ ID NO: 2174204 - RNA, 16 nt, Homo sapiens
auugccuacaauaaaa

SEQ ID NO: 2174205 - RNA, 20 nt, Homo sapiens
acacugagauauucagccca

SEQ ID NO: 2174206 - RNA, 14 nt, Homo sapiens
ccucugcuugccau

SEQ ID NO: 2174207 - RNA, 19 nt, Homo sapiens
cggcuccccucgacagcuc

SEQ ID NO: 2174208 - RNA, 18 nt, Homo sapiens
cuaucuuuaucaaaugga

SEQ ID NO: 2174209 - RNA, 23 nt, Homo sapiens
guggcagcugucucaaaccucca

SEQ ID NO: 2174210 - RNA, 15 nt, Homo sapiens
gcugggauuugaacu

SEQ ID NO: 2174211 - RNA, 15 nt, Homo sapiens
cagcccugagccaug

SEQ ID NO: 2174212 - RNA, 12 nt, Homo sapiens
cacacaccacca

SEQ ID NO: 2174213 - RNA, 13 nt, Homo sapiens
uuucuugcugcag

SEQ ID NO: 2174214 - RNA, 22 nt, Homo sapiens
aagccuaucaaagaccuugugu

SEQ ID NO: 2174215 - RNA, 17 nt, Homo sapiens
acuaacugcuucaucuc

SEQ ID NO: 2174216 - RNA, 15 nt, Homo sapiens
cgggacacagaauua

SEQ ID NO: 2174217 - RNA, 21 nt, Homo sapiens
auaugguccuagacaaaccau

SEQ ID NO: 2174218 - RNA, 15 nt, Homo sapiens
acucaugaagcauac

SEQ ID NO: 2174219 - RNA, 15 nt, Homo sapiens
aucaggucauuauuu

SEQ ID NO: 2174220 - RNA, 22 nt, Homo sapiens
cuuucaagugagacccaaagga

SEQ ID NO: 2174221 - RNA, 12 nt, Homo sapiens
caaugacuguga

SEQ ID NO: 2174222 - RNA, 13 nt, Homo sapiens
agaugucauuaca

SEQ ID NO: 2174223 - RNA, 20 nt, Homo sapiens
aucugcaaggacauuucuca

SEQ ID NO: 2174224 - RNA, 14 nt, Homo sapiens
aagagaccuagcua

SEQ ID NO: 2174225 - RNA, 14 nt, Homo sapiens
ucccugccaccagg

SEQ ID NO: 2174226 - RNA, 20 nt, Homo sapiens
cugcugggcucugccuuaaa

SEQ ID NO: 2174227 - RNA, 15 nt, Homo sapiens
ccggacacuucucag

SEQ ID NO: 2174228 - RNA, 17 nt, Homo sapiens
gcuaaacugaugacuua

SEQ ID NO: 2174229 - RNA, 20 nt, Homo sapiens
guucccaaggacagucagca

SEQ ID NO: 2174230 - RNA, 17 nt, Homo sapiens
gugucuuacauugccaa

SEQ ID NO: 2174231 - RNA, 18 nt, Homo sapiens
uucuaaguagauagaaag

SEQ ID NO: 2174232 - RNA, 15 nt, Homo sapiens
uuagugaaaaacugc

SEQ ID NO: 2174233 - RNA, 16 nt, Homo sapiens
ugaagauacaugucuu

SEQ ID NO: 2174234 - RNA, 15 nt, Homo sapiens
uuacuacaugcacuu

SEQ ID NO: 2174235 - RNA, 17 nt, Homo sapiens
ucagcaagaagauccua

SEQ ID NO: 2174236 - RNA, 14 nt, Homo sapiens
cccucuccuuguca

SEQ ID NO: 2174237 - RNA, 19 nt, Homo sapiens
agacacuucccugcauuaa

SEQ ID NO: 2174238 - RNA, 22 nt, Homo sapiens
auacacugaaguuaacagagac

SEQ ID NO: 2174239 - RNA, 18 nt, Homo sapiens
ucccucccccccaugcac

SEQ ID NO: 2174240 - RNA, 17 nt, Homo sapiens
gaaaacaguauuuucca

SEQ ID NO: 2174241 - RNA, 13 nt, Homo sapiens
augcagcauacaa

SEQ ID NO: 2174242 - RNA, 21 nt, Homo sapiens
ucacuuagugaggaccugaca

SEQ ID NO: 2174243 - RNA, 22 nt, Homo sapiens
ccaagauguaaaacaagaaaug

SEQ ID NO: 2174244 - RNA, 15 nt, Homo sapiens
uaauuuguuguacuu

SEQ ID NO: 2174245 - RNA, 14 nt, Homo sapiens
gagauugaacucca

SEQ ID NO: 2174246 - RNA, 22 nt, Homo sapiens
aaacaggcaguuggccagagag

SEQ ID NO: 2174247 - RNA, 19 nt, Homo sapiens
acaguguuuuuauugcucg

SEQ ID NO: 2174248 - RNA, 13 nt, Homo sapiens
ccugggaccacag

SEQ ID NO: 2174249 - RNA, 17 nt, Homo sapiens
ucccaucagcgugcauu

SEQ ID NO: 2174250 - RNA, 15 nt, Homo sapiens
cuuugagauuauucu

SEQ ID NO: 2174251 - RNA, 20 nt, Homo sapiens
ucgaaaccuacaagauuucc

SEQ ID NO: 2174252 - RNA, 19 nt, Homo sapiens
cauggguggcacucagucu

SEQ ID NO: 2174253 - RNA, 12 nt, Homo sapiens
uugacacaccca

SEQ ID NO: 2174254 - RNA, 16 nt, Homo sapiens
ucaccaccccuuacaa

SEQ ID NO: 2174255 - RNA, 14 nt, Homo sapiens
ugccccagccugcu

SEQ ID NO: 2174256 - RNA, 15 nt, Homo sapiens
acuaaugaacaaaua

SEQ ID NO: 2174257 - RNA, 16 nt, Homo sapiens
agugaaaaacuauuaa

SEQ ID NO: 2174258 - RNA, 14 nt, Homo sapiens
cccauuuacacuuu

SEQ ID NO: 2174259 - RNA, 17 nt, Homo sapiens
cagggcacugugccuga

SEQ ID NO: 2174260 - RNA, 21 nt, Homo sapiens
cacuaccuuuauagcucucau

SEQ ID NO: 2174261 - RNA, 22 nt, Homo sapiens
gcugaugugcccaccaccgugu

SEQ ID NO: 2174262 - RNA, 22 nt, Homo sapiens
uggggggcaauuuugcacugaa

SEQ ID NO: 2174263 - RNA, 18 nt, Homo sapiens
gucaagugggaucuguca

SEQ ID NO: 2174264 - RNA, 13 nt, Homo sapiens
aucuacccugcug

SEQ ID NO: 2174265 - RNA, 13 nt, Homo sapiens
uguugcccauuua

SEQ ID NO: 2174266 - RNA, 15 nt, Homo sapiens
augcauuucuaucaa

SEQ ID NO: 2174267 - RNA, 16 nt, Homo sapiens
uccugggcagcugccu

SEQ ID NO: 2174268 - RNA, 18 nt, Homo sapiens
caaaagauuguguuccca

SEQ ID NO: 2174269 - RNA, 15 nt, Homo sapiens
auuggcucugugaaa

SEQ ID NO: 2174270 - RNA, 15 nt, Homo sapiens
auuuacucuguugaa

SEQ ID NO: 2174271 - RNA, 20 nt, Homo sapiens
guuuuuucaucauaacauaa

SEQ ID NO: 2174272 - RNA, 18 nt, Homo sapiens
uccacuccuccuacugua

SEQ ID NO: 2174273 - RNA, 20 nt, Homo sapiens
ucagaaggccccagagagac

SEQ ID NO: 2174274 - RNA, 20 nt, Homo sapiens
cccugagcucggggacaggu

SEQ ID NO: 2174275 - RNA, 14 nt, Homo sapiens
aauaacacuuguca

SEQ ID NO: 2174276 - RNA, 16 nt, Homo sapiens
auuuccaacaccacag

SEQ ID NO: 2174277 - RNA, 18 nt, Homo sapiens
auuuuacuugcaccuuau

SEQ ID NO: 2174278 - RNA, 18 nt, Homo sapiens
cugagaaagacuauucaa

SEQ ID NO: 2174279 - RNA, 19 nt, Homo sapiens
aggccaucugcuuaccaca

SEQ ID NO: 2174280 - RNA, 23 nt, Homo sapiens
ggccaggaguucccaaaugugag

SEQ ID NO: 2174281 - RNA, 14 nt, Homo sapiens
ucaccaggggagga

SEQ ID NO: 2174282 - RNA, 20 nt, Homo sapiens
acacaaguggguagugucau

SEQ ID NO: 2174283 - RNA, 14 nt, Homo sapiens
accucccccaggga

SEQ ID NO: 2174284 - RNA, 18 nt, Homo sapiens
caaucuauuuguuuuuaa

SEQ ID NO: 2174285 - RNA, 20 nt, Homo sapiens
caauggcugcugaagcugcc

SEQ ID NO: 2174286 - RNA, 13 nt, Homo sapiens
acacucacuggca

SEQ ID NO: 2174287 - RNA, 14 nt, Homo sapiens
uuaaagaagcuuua

SEQ ID NO: 2174288 - RNA, 19 nt, Homo sapiens
agcagaggcguacuaccca

SEQ ID NO: 2174289 - RNA, 14 nt, Homo sapiens
cagccauacaaaua

SEQ ID NO: 2174290 - RNA, 14 nt, Homo sapiens
cuuccugugaucca

SEQ ID NO: 2174291 - RNA, 19 nt, Homo sapiens
ucauguaaccaagaguauu

SEQ ID NO: 2174292 - RNA, 13 nt, Homo sapiens
agcccgugucaca

SEQ ID NO: 2174293 - RNA, 17 nt, Homo sapiens
augaagaaagauacuaa

SEQ ID NO: 2174294 - RNA, 16 nt, Homo sapiens
aaauugcagaagcagg

SEQ ID NO: 2174295 - RNA, 17 nt, Homo sapiens
cagauguuggugcaaua

SEQ ID NO: 2174296 - RNA, 16 nt, Homo sapiens
acacaauggcaccucu

SEQ ID NO: 2174297 - RNA, 20 nt, Homo sapiens
uuucaaacauugagacugcu

SEQ ID NO: 2174298 - RNA, 20 nt, Homo sapiens
aauaaagcuaccauuuauca

SEQ ID NO: 2174299 - RNA, 15 nt, Homo sapiens
aacaacuucagucca

SEQ ID NO: 2174300 - RNA, 15 nt, Homo sapiens
cugucauuaucaaaa

SEQ ID NO: 2174301 - RNA, 13 nt, Homo sapiens
uauuggacuucca

SEQ ID NO: 2174302 - RNA, 20 nt, Homo sapiens
ggugucaucuuggccaucua

SEQ ID NO: 2174303 - RNA, 17 nt, Homo sapiens
cagcaggggauggcgcu

SEQ ID NO: 2174304 - RNA, 21 nt, Homo sapiens
ggcuggauugccuuguaugca

SEQ ID NO: 2174305 - RNA, 16 nt, Homo sapiens
ucccaucuccagggaa

SEQ ID NO: 2174306 - RNA, 13 nt, Homo sapiens
ggccauuuccgug

SEQ ID NO: 2174307 - RNA, 14 nt, Homo sapiens
ucuaggcuaagcac

SEQ ID NO: 2174308 - RNA, 15 nt, Homo sapiens
aguacuagagauauu

SEQ ID NO: 2174309 - RNA, 23 nt, Homo sapiens
caggcaaauguaaagucuagaaa

SEQ ID NO: 2174310 - RNA, 13 nt, Homo sapiens
agaaaugucaugu

SEQ ID NO: 2174311 - RNA, 19 nt, Homo sapiens
uucuacugucaaaugaugu

SEQ ID NO: 2174312 - RNA, 20 nt, Homo sapiens
auuuuaggagcuaaggcucu

SEQ ID NO: 2174313 - RNA, 15 nt, Homo sapiens
ggcucacaccuguaa

SEQ ID NO: 2174314 - RNA, 19 nt, Homo sapiens
caauuagucugucacucca

SEQ ID NO: 2174315 - RNA, 23 nt, Homo sapiens
uuucucagacuuuggaaaaugca

SEQ ID NO: 2174316 - RNA, 14 nt, Homo sapiens
ccccaccaccccag

SEQ ID NO: 2174317 - RNA, 19 nt, Homo sapiens
aguuucugaaaccgcucag

SEQ ID NO: 2174318 - RNA, 21 nt, Homo sapiens
uaagaagggugggaguggggc

SEQ ID NO: 2174319 - RNA, 22 nt, Homo sapiens
aacuuacaucacgacuuucucu

SEQ ID NO: 2174320 - RNA, 23 nt, Homo sapiens
ucuuuaaauauauauuauucuca

SEQ ID NO: 2174321 - RNA, 13 nt, Homo sapiens
ucugacauuuaua

SEQ ID NO: 2174322 - RNA, 16 nt, Homo sapiens
acugaaugaauccauu

SEQ ID NO: 2174323 - RNA, 18 nt, Homo sapiens
ugcccgagagcucuuagu

SEQ ID NO: 2174324 - RNA, 18 nt, Homo sapiens
ggaacaaggaaggugaug

SEQ ID NO: 2174325 - RNA, 12 nt, Homo sapiens
agucaccaaaau

SEQ ID NO: 2174326 - RNA, 12 nt, Homo sapiens
agacaccaaauu

SEQ ID NO: 2174327 - RNA, 12 nt, Homo sapiens
ccuaacuuucuu

SEQ ID NO: 2174328 - RNA, 22 nt, Homo sapiens
ccccacuucucuacucuggaag

SEQ ID NO: 2174329 - RNA, 22 nt, Homo sapiens
ggucucagcccgggacaggguc

SEQ ID NO: 2174330 - RNA, 14 nt, Homo sapiens
cuccuggugcugcc

SEQ ID NO: 2174331 - RNA, 16 nt, Homo sapiens
ugcuagcugcaaguga

SEQ ID NO: 2174332 - RNA, 13 nt, Homo sapiens
agacacaagguga

SEQ ID NO: 2174333 - RNA, 14 nt, Homo sapiens
ucacauaaccuuaa

SEQ ID NO: 2174334 - RNA, 15 nt, Homo sapiens
ccaacagaacacuug

SEQ ID NO: 2174335 - RNA, 14 nt, Homo sapiens
uccacacccagcuc

SEQ ID NO: 2174336 - RNA, 23 nt, Homo sapiens
auucauuaaagaaaaaccacaga

SEQ ID NO: 2174337 - RNA, 21 nt, Homo sapiens
acugcauaugaaaggacacua

SEQ ID NO: 2174338 - RNA, 14 nt, Homo sapiens
uaaaagcuucugca

SEQ ID NO: 2174339 - RNA, 22 nt, Homo sapiens
uacucuggagagacugugcugg

SEQ ID NO: 2174340 - RNA, 17 nt, Homo sapiens
gcccaggucaacaucua

SEQ ID NO: 2174341 - RNA, 13 nt, Homo sapiens
agcaucugacuca

SEQ ID NO: 2174342 - RNA, 22 nt, Homo sapiens
cagauucauaaaguaaugauga

SEQ ID NO: 2174343 - RNA, 14 nt, Homo sapiens
aaauucaguuauaa

SEQ ID NO: 2174344 - RNA, 23 nt, Homo sapiens
caguuggcuaagaagugacucuu

SEQ ID NO: 2174345 - RNA, 15 nt, Homo sapiens
caaacauuucauccg

SEQ ID NO: 2174346 - RNA, 16 nt, Homo sapiens
caagcuucuucacuca

SEQ ID NO: 2174347 - RNA, 19 nt, Homo sapiens
cauuugaaugcuuaauuca

SEQ ID NO: 2174348 - RNA, 19 nt, Homo sapiens
caauuuugcuucacuuugc

SEQ ID NO: 2174349 - RNA, 19 nt, Homo sapiens
uccauucuguuccacugcu

SEQ ID NO: 2174350 - RNA, 16 nt, Homo sapiens
uauuuauuugagguca

SEQ ID NO: 2174351 - RNA, 20 nt, Homo sapiens
augaaucauauucauaugca

SEQ ID NO: 2174352 - RNA, 15 nt, Homo sapiens
uaaggaauaccuguc

SEQ ID NO: 2174353 - RNA, 13 nt, Homo sapiens
cuuguucagauua

SEQ ID NO: 2174354 - RNA, 18 nt, Homo sapiens
aaguaaguuaauaaugua

SEQ ID NO: 2174355 - RNA, 21 nt, Homo sapiens
cuggccuugguaugugccagg

SEQ ID NO: 2174356 - RNA, 15 nt, Homo sapiens
cuagagcucaguaua

SEQ ID NO: 2174357 - RNA, 13 nt, Homo sapiens
uuagaaaacuaga

SEQ ID NO: 2174358 - RNA, 14 nt, Homo sapiens
cucuacgugcuccu

SEQ ID NO: 2174359 - RNA, 20 nt, Homo sapiens
cuucauaagauauucuuuac

SEQ ID NO: 2174360 - RNA, 14 nt, Homo sapiens
gccagggucucacu

SEQ ID NO: 2174361 - RNA, 12 nt, Homo sapiens
uggccagcauuu

SEQ ID NO: 2174362 - RNA, 20 nt, Homo sapiens
guuccucccccaguuccucc

SEQ ID NO: 2174363 - RNA, 23 nt, Homo sapiens
ucaucuuuugaagagcaaaggga

SEQ ID NO: 2174364 - RNA, 10 nt, Homo sapiens
cuacagcaga

SEQ ID NO: 2174365 - RNA, 19 nt, Homo sapiens
gcuccaaaugucuacugaa

SEQ ID NO: 2174366 - RNA, 14 nt, Homo sapiens
aagauucaguuuca

SEQ ID NO: 2174367 - RNA, 21 nt, Homo sapiens
acacuacacagcacaccagcc

SEQ ID NO: 2174368 - RNA, 16 nt, Homo sapiens
aggaugggaaggaggg

SEQ ID NO: 2174369 - RNA, 15 nt, Homo sapiens
uugaauagucucauc

SEQ ID NO: 2174370 - RNA, 16 nt, Homo sapiens
aggccagaagaccucc

SEQ ID NO: 2174371 - RNA, 20 nt, Homo sapiens
accacauacguaaaaaucuc

SEQ ID NO: 2174372 - RNA, 15 nt, Homo sapiens
ugucagcaauuuaac

SEQ ID NO: 2174373 - RNA, 20 nt, Homo sapiens
uucacacccuuuugugagac

SEQ ID NO: 2174374 - RNA, 15 nt, Homo sapiens
gguagaaaugucuau

SEQ ID NO: 2174375 - RNA, 18 nt, Homo sapiens
gcaggagaauggugugaa

SEQ ID NO: 2174376 - RNA, 21 nt, Homo sapiens
agccaaacucugccagccaca

SEQ ID NO: 2174377 - RNA, 20 nt, Homo sapiens
uuaaaguuacauuaugugua

SEQ ID NO: 2174378 - RNA, 23 nt, Homo sapiens
gcaccugagggugcuuuguguaa

SEQ ID NO: 2174379 - RNA, 15 nt, Homo sapiens
ccaagcaggacagug

SEQ ID NO: 2174380 - RNA, 22 nt, Homo sapiens
ugcucucgcaccuuuccaaagu

SEQ ID NO: 2174381 - RNA, 20 nt, Homo sapiens
accccgagcacgguugccug

SEQ ID NO: 2174382 - RNA, 21 nt, Homo sapiens
agucucaaauuuuucaucucu

SEQ ID NO: 2174383 - RNA, 23 nt, Homo sapiens
gcucuggcuguuugucuauaugu

SEQ ID NO: 2174384 - RNA, 14 nt, Homo sapiens
gcauagcaaacaga

SEQ ID NO: 2174385 - RNA, 22 nt, Homo sapiens
ccaaagguuuaaacuaccucaa

SEQ ID NO: 2174386 - RNA, 12 nt, Homo sapiens
agaucauuucag

SEQ ID NO: 2174387 - RNA, 14 nt, Homo sapiens
uggcccuggacaag

SEQ ID NO: 2174388 - RNA, 13 nt, Homo sapiens
aaguaaugaauuu

SEQ ID NO: 2174389 - RNA, 22 nt, Homo sapiens
ccugcccuacagaggucucugc

SEQ ID NO: 2174390 - RNA, 19 nt, Homo sapiens
uucuccuguuuauucccau

SEQ ID NO: 2174391 - RNA, 13 nt, Homo sapiens
auuuuaaaaguca

SEQ ID NO: 2174392 - RNA, 21 nt, Homo sapiens
gauucucuugccucaaccucc

SEQ ID NO: 2174393 - RNA, 22 nt, Homo sapiens
cuaaccacuggucaugccccca

SEQ ID NO: 2174394 - RNA, 15 nt, Homo sapiens
aaguacaauaauuca

SEQ ID NO: 2174395 - RNA, 22 nt, Homo sapiens
uguguccuaaaugcaaagcaca

SEQ ID NO: 2174396 - RNA, 18 nt, Homo sapiens
cgccuggugcugagugca

SEQ ID NO: 2174397 - RNA, 18 nt, Homo sapiens
uaauguagcagcucauaa

SEQ ID NO: 2174398 - RNA, 17 nt, Homo sapiens
uuagaggaccagugagu

SEQ ID NO: 2174399 - RNA, 19 nt, Homo sapiens
gugcuggagcaaaagucau

SEQ ID NO: 2174400 - RNA, 20 nt, Homo sapiens
ugcaucccugaaacaucuca

SEQ ID NO: 2174401 - RNA, 13 nt, Homo sapiens
acacuaugugcaa

SEQ ID NO: 2174402 - RNA, 13 nt, Homo sapiens
acaauaugugcca

SEQ ID NO: 2174403 - RNA, 15 nt, Homo sapiens
gucugagucuugggu

SEQ ID NO: 2174404 - RNA, 21 nt, Homo sapiens
uccccuacccccaguaaaauc

SEQ ID NO: 2174405 - RNA, 12 nt, Homo sapiens
aaaaaucucuca

SEQ ID NO: 2174406 - RNA, 16 nt, Homo sapiens
cucuucggaugaggcc

SEQ ID NO: 2174407 - RNA, 22 nt, Homo sapiens
ugcaagaauugaagcaggacua

SEQ ID NO: 2174408 - RNA, 12 nt, Homo sapiens
ccuuuuucauaa

SEQ ID NO: 2174409 - RNA, 21 nt, Homo sapiens
agcaggagcagcugugcugca

SEQ ID NO: 2174410 - RNA, 20 nt, Homo sapiens
cuggagucuccugaggacac

SEQ ID NO: 2174411 - RNA, 14 nt, Homo sapiens
ugauuucuucucau

SEQ ID NO: 2174412 - RNA, 20 nt, Homo sapiens
aacccaggagguggagguug

SEQ ID NO: 2174413 - RNA, 21 nt, Homo sapiens
caagagaauuuggggcuucca

SEQ ID NO: 2174414 - RNA, 18 nt, Homo sapiens
ccuggcaccuguguucca

SEQ ID NO: 2174415 - RNA, 17 nt, Homo sapiens
gucuucauccuuagcaa

SEQ ID NO: 2174416 - RNA, 19 nt, Homo sapiens
ugugguaacuguagucauc

SEQ ID NO: 2174417 - RNA, 22 nt, Homo sapiens
agcacguauccauuauucuucu

SEQ ID NO: 2174418 - RNA, 19 nt, Homo sapiens
acugcagagagacaacaga

SEQ ID NO: 2174419 - RNA, 23 nt, Homo sapiens
cuugucagacauaaagccauguu

SEQ ID NO: 2174420 - RNA, 20 nt, Homo sapiens
uuauaugaaauguuucacua

SEQ ID NO: 2174421 - RNA, 21 nt, Homo sapiens
gaccccugccuacuuccuucc

SEQ ID NO: 2174422 - RNA, 15 nt, Homo sapiens
acaaaaaaacagacc

SEQ ID NO: 2174423 - RNA, 15 nt, Homo sapiens
ccagacaaccaaaac

SEQ ID NO: 2174424 - RNA, 16 nt, Homo sapiens
uccuguauauuccaug

SEQ ID NO: 2174425 - RNA, 13 nt, Homo sapiens
cccauccuuguga

SEQ ID NO: 2174426 - RNA, 17 nt, Homo sapiens
caggcggcccucagugc

SEQ ID NO: 2174427 - RNA, 13 nt, Homo sapiens
uaaagagcaaucc

SEQ ID NO: 2174428 - RNA, 18 nt, Homo sapiens
cugaguaguugggauuac

SEQ ID NO: 2174429 - RNA, 16 nt, Homo sapiens
uuaugacuaugcacua

SEQ ID NO: 2174430 - RNA, 19 nt, Homo sapiens
uaacugccuggccuggcac

SEQ ID NO: 2174431 - RNA, 17 nt, Homo sapiens
cuaucauggaaugagac

SEQ ID NO: 2174432 - RNA, 20 nt, Homo sapiens
cugcugggccccaucuccac

SEQ ID NO: 2174433 - RNA, 14 nt, Homo sapiens
aguuuucuaacucc

SEQ ID NO: 2174434 - RNA, 16 nt, Homo sapiens
cugauacauaacuaaa

SEQ ID NO: 2174435 - RNA, 17 nt, Homo sapiens
ucucuaggaaauauacu

SEQ ID NO: 2174436 - RNA, 13 nt, Homo sapiens
aaaaguugugauu

SEQ ID NO: 2174437 - RNA, 11 nt, Homo sapiens
uucuccacugg

SEQ ID NO: 2174438 - RNA, 21 nt, Homo sapiens
ucaagaagucagagaaaacac

SEQ ID NO: 2174439 - RNA, 15 nt, Homo sapiens
uagcuguguccucac

SEQ ID NO: 2174440 - RNA, 18 nt, Homo sapiens
uguuaaauggggagacaa

SEQ ID NO: 2174441 - RNA, 20 nt, Homo sapiens
guaaagccuuaaguggcaga

SEQ ID NO: 2174442 - RNA, 17 nt, Homo sapiens
cagccuagauaugaaga

SEQ ID NO: 2174443 - RNA, 15 nt, Homo sapiens
auauaaaaugcuuua

SEQ ID NO: 2174444 - RNA, 15 nt, Homo sapiens
uuaaaauaagcauuu

SEQ ID NO: 2174445 - RNA, 24 nt, Homo sapiens
gacuugaucacuuuugcacauucc

SEQ ID NO: 2174446 - RNA, 13 nt, Homo sapiens
uaaagauucucac

SEQ ID NO: 2174447 - RNA, 19 nt, Homo sapiens
gaucuaagccuuuccauaa

SEQ ID NO: 2174448 - RNA, 22 nt, Homo sapiens
gugcucucagcuggcagugcaa

SEQ ID NO: 2174449 - RNA, 21 nt, Homo sapiens
agaauacauugauacaaagua

SEQ ID NO: 2174450 - RNA, 19 nt, Homo sapiens
agucacuucaccaucaaca

SEQ ID NO: 2174451 - RNA, 15 nt, Homo sapiens
uagaagugcaagaaa

SEQ ID NO: 2174452 - RNA, 21 nt, Homo sapiens
gacaaagguuuuccucuucua

SEQ ID NO: 2174453 - RNA, 11 nt, Homo sapiens
caggggugacg

SEQ ID NO: 2174454 - RNA, 22 nt, Homo sapiens
uauuucauccagggaaaugccu

SEQ ID NO: 2174455 - RNA, 15 nt, Homo sapiens
uuaucauccuuucag

SEQ ID NO: 2174456 - RNA, 20 nt, Homo sapiens
uaaaagcacaaguacuuuug

SEQ ID NO: 2174457 - RNA, 23 nt, Homo sapiens
cauauauaaaaguuuaaagaaga

SEQ ID NO: 2174458 - RNA, 15 nt, Homo sapiens
aaagcaccuuagcug

SEQ ID NO: 2174459 - RNA, 17 nt, Homo sapiens
ugccucugccucugaca

SEQ ID NO: 2174460 - RNA, 15 nt, Homo sapiens
uucacagcaacacuc

SEQ ID NO: 2174461 - RNA, 20 nt, Homo sapiens
ucagaugauucuaugucuca

SEQ ID NO: 2174462 - RNA, 17 nt, Homo sapiens
ccuguagagucacugac

SEQ ID NO: 2174463 - RNA, 22 nt, Homo sapiens
cuggaagagcuaggcagggugu

SEQ ID NO: 2174464 - RNA, 21 nt, Homo sapiens
ugauauuucuauuuccuggaa

SEQ ID NO: 2174465 - RNA, 18 nt, Homo sapiens
aauacugccaaccagagc

SEQ ID NO: 2174466 - RNA, 19 nt, Homo sapiens
gccauagucuuaacugguc

SEQ ID NO: 2174467 - RNA, 16 nt, Homo sapiens
aacaaaaacagaauuu

SEQ ID NO: 2174468 - RNA, 13 nt, Homo sapiens
caccuggucuguu

SEQ ID NO: 2174469 - RNA, 18 nt, Homo sapiens
uuaaaaaaauaugccuuu

SEQ ID NO: 2174470 - RNA, 18 nt, Homo sapiens
aguucugguucaugcaga

SEQ ID NO: 2174471 - RNA, 16 nt, Homo sapiens
gucauuugacaggggc

SEQ ID NO: 2174472 - RNA, 23 nt, Homo sapiens
uguguaucaguguuuaugugcua

SEQ ID NO: 2174473 - RNA, 20 nt, Homo sapiens
caaugucacaaccucucuga

SEQ ID NO: 2174474 - RNA, 13 nt, Homo sapiens
ggaaauggcccau

SEQ ID NO: 2174475 - RNA, 16 nt, Homo sapiens
ucccauucucauaugu

SEQ ID NO: 2174476 - RNA, 12 nt, Homo sapiens
auuuugcauuag

SEQ ID NO: 2174477 - RNA, 18 nt, Homo sapiens
aagaucauuuaauaucuu

SEQ ID NO: 2174478 - RNA, 18 nt, Homo sapiens
aacauauguccauccaua

SEQ ID NO: 2174479 - RNA, 15 nt, Homo sapiens
uauguggaacuguac

SEQ ID NO: 2174480 - RNA, 14 nt, Homo sapiens
gauucuuagcaaaa

SEQ ID NO: 2174481 - RNA, 11 nt, Homo sapiens
guaagcuuuaa

SEQ ID NO: 2174482 - RNA, 18 nt, Homo sapiens
agcacauacuguguucca

SEQ ID NO: 2174483 - RNA, 16 nt, Homo sapiens
gucacagaaucuccau

SEQ ID NO: 2174484 - RNA, 17 nt, Homo sapiens
gcuugcugcucaucuga

SEQ ID NO: 2174485 - RNA, 18 nt, Homo sapiens
guaguuaacaauuuugca

SEQ ID NO: 2174486 - RNA, 15 nt, Homo sapiens
aaaagcccacugugg

SEQ ID NO: 2174487 - RNA, 15 nt, Homo sapiens
auugcuugugccaca

SEQ ID NO: 2174488 - RNA, 19 nt, Homo sapiens
caggaaggaaugcaaaacu

SEQ ID NO: 2174489 - RNA, 21 nt, Homo sapiens
ugccacaucuugaaaaugcca

SEQ ID NO: 2174490 - RNA, 14 nt, Homo sapiens
gaccagcacuucaa

SEQ ID NO: 2174491 - RNA, 17 nt, Homo sapiens
aauggggcuuuccugau

SEQ ID NO: 2174492 - RNA, 19 nt, Homo sapiens
auucacagccccuggccca

SEQ ID NO: 2174493 - RNA, 19 nt, Homo sapiens
ccaguacuauuuuaauuug

SEQ ID NO: 2174494 - RNA, 23 nt, Homo sapiens
gaaccacggugaaagugcugcuc

SEQ ID NO: 2174495 - RNA, 17 nt, Homo sapiens
ccaagcuggagugcagu

SEQ ID NO: 2174496 - RNA, 21 nt, Homo sapiens
gaggcucucccucucucucau

SEQ ID NO: 2174497 - RNA, 15 nt, Homo sapiens
ucugacucccaaaga

SEQ ID NO: 2174498 - RNA, 19 nt, Homo sapiens
uauuuauauaucauaguau

SEQ ID NO: 2174499 - RNA, 18 nt, Homo sapiens
ugugcucagagaccccuc

SEQ ID NO: 2174500 - RNA, 18 nt, Homo sapiens
gaguuucuuuccugccuu

SEQ ID NO: 2174501 - RNA, 16 nt, Homo sapiens
guaccuuguuuugcca

SEQ ID NO: 2174502 - RNA, 22 nt, Homo sapiens
gagcaucaggccuagaggccug

SEQ ID NO: 2174503 - RNA, 19 nt, Homo sapiens
uagugacauuuaaugccau

SEQ ID NO: 2174504 - RNA, 18 nt, Homo sapiens
caggaggagaugaccagu

SEQ ID NO: 2174505 - RNA, 19 nt, Homo sapiens
cauuguuccacacauuuaa

SEQ ID NO: 2174506 - RNA, 22 nt, Homo sapiens
guguacuaccccaggaugcaug

SEQ ID NO: 2174507 - RNA, 18 nt, Homo sapiens
gaauacccuuuucugacc

SEQ ID NO: 2174508 - RNA, 20 nt, Homo sapiens
agggcuccuaggcucagugg

SEQ ID NO: 2174509 - RNA, 13 nt, Homo sapiens
ucaaaccuguaga

SEQ ID NO: 2174510 - RNA, 22 nt, Homo sapiens
aagaaaaucaaagcugaggaca

SEQ ID NO: 2174511 - RNA, 18 nt, Homo sapiens
acaauaggcuuagugcuu

SEQ ID NO: 2174512 - RNA, 21 nt, Homo sapiens
uauuaccuuuacauauuauca

SEQ ID NO: 2174513 - RNA, 12 nt, Homo sapiens
agagagucucaa

SEQ ID NO: 2174514 - RNA, 14 nt, Homo sapiens
caaacauaaagaga

SEQ ID NO: 2174515 - RNA, 16 nt, Homo sapiens
cagcugguugcuccau

SEQ ID NO: 2174516 - RNA, 11 nt, Homo sapiens
guaacaauaug

SEQ ID NO: 2174517 - RNA, 14 nt, Homo sapiens
aauguuugccaaaa

SEQ ID NO: 2174518 - RNA, 22 nt, Homo sapiens
ccucccucucucuucugcucca

SEQ ID NO: 2174519 - RNA, 20 nt, Homo sapiens
aaaaccccaucuuuacuaaa

SEQ ID NO: 2174520 - RNA, 16 nt, Homo sapiens
gauuuaugcuccuuau

SEQ ID NO: 2174521 - RNA, 13 nt, Homo sapiens
uguccuccaacac

SEQ ID NO: 2174522 - RNA, 11 nt, Homo sapiens
aaaauggacau

SEQ ID NO: 2174523 - RNA, 17 nt, Homo sapiens
accgaaaaguugcugaa

SEQ ID NO: 2174524 - RNA, 18 nt, Homo sapiens
agccgggcaugauggugc

SEQ ID NO: 2174525 - RNA, 16 nt, Homo sapiens
augucugccuaugcac

SEQ ID NO: 2174526 - RNA, 16 nt, Homo sapiens
aagaaaucaaaaucca

SEQ ID NO: 2174527 - RNA, 22 nt, Homo sapiens
cuuacaguagaggguccagucu

SEQ ID NO: 2174528 - RNA, 16 nt, Homo sapiens
agaguacagauaugaa

SEQ ID NO: 2174529 - RNA, 19 nt, Homo sapiens
agauacacugcucucccca

SEQ ID NO: 2174530 - RNA, 14 nt, Homo sapiens
augagacuacuuca

SEQ ID NO: 2174531 - RNA, 13 nt, Homo sapiens
cuucgcccugugc

SEQ ID NO: 2174532 - RNA, 14 nt, Homo sapiens
cuggacauucucuu

SEQ ID NO: 2174533 - RNA, 18 nt, Homo sapiens
cugguauuuauauuucaa

SEQ ID NO: 2174534 - RNA, 17 nt, Homo sapiens
ucguugccugccacuga

SEQ ID NO: 2174535 - RNA, 15 nt, Homo sapiens
gagccagucccucag

SEQ ID NO: 2174536 - RNA, 19 nt, Homo sapiens
gucuucucccuacaccaag

SEQ ID NO: 2174537 - RNA, 14 nt, Homo sapiens
agugguggugaaca

SEQ ID NO: 2174538 - RNA, 16 nt, Homo sapiens
auauaaaggcagggaa

SEQ ID NO: 2174539 - RNA, 15 nt, Homo sapiens
agcuucaugccuuug

SEQ ID NO: 2174540 - RNA, 14 nt, Homo sapiens
gcacugagcagaag

SEQ ID NO: 2174541 - RNA, 17 nt, Homo sapiens
cccacccaacaagccau

SEQ ID NO: 2174542 - RNA, 19 nt, Homo sapiens
gagucugaaauggggcuac

SEQ ID NO: 2174543 - RNA, 17 nt, Homo sapiens
aaagagcgucauguccu

SEQ ID NO: 2174544 - RNA, 16 nt, Homo sapiens
acuaauaaaauacaua

SEQ ID NO: 2174545 - RNA, 16 nt, Homo sapiens
gcugggcagaccccuc

SEQ ID NO: 2174546 - RNA, 16 nt, Homo sapiens
augccaguuguggcag

SEQ ID NO: 2174547 - RNA, 12 nt, Homo sapiens
aucacaucauuu

SEQ ID NO: 2174548 - RNA, 18 nt, Homo sapiens
ucugucuagcaugccaac

SEQ ID NO: 2174549 - RNA, 22 nt, Homo sapiens
ugagcuuuggacacacacagcu

SEQ ID NO: 2174550 - RNA, 14 nt, Homo sapiens
aagaccucuggcau

SEQ ID NO: 2174551 - RNA, 23 nt, Homo sapiens
ucauucuguaaagucuagcacag

SEQ ID NO: 2174552 - RNA, 12 nt, Homo sapiens
agcuacauuccu

SEQ ID NO: 2174553 - RNA, 12 nt, Homo sapiens
agacacauucac

SEQ ID NO: 2174554 - RNA, 21 nt, Homo sapiens
uauaaagaaaaucaaugaagg

SEQ ID NO: 2174555 - RNA, 14 nt, Homo sapiens
uaaccccaccacac

SEQ ID NO: 2174556 - RNA, 20 nt, Homo sapiens
gcugugagaggaucaucugg

SEQ ID NO: 2174557 - RNA, 14 nt, Homo sapiens
uccacacacacaaa

SEQ ID NO: 2174558 - RNA, 19 nt, Homo sapiens
accuguuuagccuagucau

SEQ ID NO: 2174559 - RNA, 16 nt, Homo sapiens
agagaucauauccuca

SEQ ID NO: 2174560 - RNA, 22 nt, Homo sapiens
agccaggauugaccuuugcacg

SEQ ID NO: 2174561 - RNA, 14 nt, Homo sapiens
caaaagucagaccc

SEQ ID NO: 2174562 - RNA, 22 nt, Homo sapiens
ccucauuuaaguaaaagguuag

SEQ ID NO: 2174563 - RNA, 18 nt, Homo sapiens
ugaauucucugcucagug

SEQ ID NO: 2174564 - RNA, 17 nt, Homo sapiens
uguaagcauaacuuauu

SEQ ID NO: 2174565 - RNA, 13 nt, Homo sapiens
ugaacuaauuuca

SEQ ID NO: 2174566 - RNA, 21 nt, Homo sapiens
acgcucuccucgagcccuccc

SEQ ID NO: 2174567 - RNA, 14 nt, Homo sapiens
aaauagagugaauu

SEQ ID NO: 2174568 - RNA, 22 nt, Homo sapiens
ccccuuauccaggacucuguca

SEQ ID NO: 2174569 - RNA, 19 nt, Homo sapiens
gucuauuugagacuccuca

SEQ ID NO: 2174570 - RNA, 11 nt, Homo sapiens
uuuaccaaagc

SEQ ID NO: 2174571 - RNA, 22 nt, Homo sapiens
cugugcaaccucuuggccugau

SEQ ID NO: 2174572 - RNA, 23 nt, Homo sapiens
cugggacacuucccugggccuca

SEQ ID NO: 2174573 - RNA, 14 nt, Homo sapiens
gcauugccuggacu

SEQ ID NO: 2174574 - RNA, 21 nt, Homo sapiens
ugucugcuugucaaaagaaau

SEQ ID NO: 2174575 - RNA, 16 nt, Homo sapiens
uucaguaaaaggaccu

SEQ ID NO: 2174576 - RNA, 17 nt, Homo sapiens
cacgcauugucacagcu

SEQ ID NO: 2174577 - RNA, 23 nt, Homo sapiens
ccccagaaccuguccuugcacac

SEQ ID NO: 2174578 - RNA, 14 nt, Homo sapiens
aauugaauuugcac

SEQ ID NO: 2174579 - RNA, 17 nt, Homo sapiens
uggucagagugccacug

SEQ ID NO: 2174580 - RNA, 17 nt, Homo sapiens
aauucauccucuuacca

SEQ ID NO: 2174581 - RNA, 16 nt, Homo sapiens
ccuacccucuucucag

SEQ ID NO: 2174582 - RNA, 15 nt, Homo sapiens
gccuccccagcaccu

SEQ ID NO: 2174583 - RNA, 10 nt, Homo sapiens
uccacagcaa

SEQ ID NO: 2174584 - RNA, 16 nt, Homo sapiens
cacucuggagcauuuc

SEQ ID NO: 2174585 - RNA, 18 nt, Homo sapiens
aucucauuuuacacaaag

SEQ ID NO: 2174586 - RNA, 15 nt, Homo sapiens
gcaaaaagaacaaag

SEQ ID NO: 2174587 - RNA, 18 nt, Homo sapiens
ucaauucaugcuaccuga

SEQ ID NO: 2174588 - RNA, 18 nt, Homo sapiens
uggccugguucaauuucu

SEQ ID NO: 2174589 - RNA, 22 nt, Homo sapiens
aaaagacagagccuccacuuag

SEQ ID NO: 2174590 - RNA, 15 nt, Homo sapiens
agucucuauaccaau

SEQ ID NO: 2174591 - RNA, 19 nt, Homo sapiens
gugguacuuuauucuugcu

SEQ ID NO: 2174592 - RNA, 22 nt, Homo sapiens
aaaaguuuggccgggugcggug

SEQ ID NO: 2174593 - RNA, 18 nt, Homo sapiens
ucugugcagucacuggag

SEQ ID NO: 2174594 - RNA, 14 nt, Homo sapiens
uugucgcuauguga

SEQ ID NO: 2174595 - RNA, 14 nt, Homo sapiens
gugaaagacaauaa

SEQ ID NO: 2174596 - RNA, 16 nt, Homo sapiens
ugaaaauaauggaauu

SEQ ID NO: 2174597 - RNA, 16 nt, Homo sapiens
uuauguaucugguuaa

SEQ ID NO: 2174598 - RNA, 17 nt, Homo sapiens
ccgggcaauccagacag

SEQ ID NO: 2174599 - RNA, 14 nt, Homo sapiens
cagguuaaccugca

SEQ ID NO: 2174600 - RNA, 19 nt, Homo sapiens
caaugcccaacuuacuguc

SEQ ID NO: 2174601 - RNA, 19 nt, Homo sapiens
auugaccgagcacauacca

SEQ ID NO: 2174602 - RNA, 20 nt, Homo sapiens
agcaucaaagagauggugcu

SEQ ID NO: 2174603 - RNA, 18 nt, Homo sapiens
uacaccucgucaagagca

SEQ ID NO: 2174604 - RNA, 18 nt, Homo sapiens
gagaaugccuaggccagc

SEQ ID NO: 2174605 - RNA, 14 nt, Homo sapiens
caacgaugaugcuu

SEQ ID NO: 2174606 - RNA, 16 nt, Homo sapiens
cauaaacauuugccaa

SEQ ID NO: 2174607 - RNA, 20 nt, Homo sapiens
cacccagugggaagagugug

SEQ ID NO: 2174608 - RNA, 16 nt, Homo sapiens
ugacauuauguuuuau

SEQ ID NO: 2174609 - RNA, 21 nt, Homo sapiens
uccucuugacuccuugugaug

SEQ ID NO: 2174610 - RNA, 12 nt, Homo sapiens
cagcguggggga

SEQ ID NO: 2174611 - RNA, 21 nt, Homo sapiens
cagugggcguugggagccuag

SEQ ID NO: 2174612 - RNA, 12 nt, Homo sapiens
gugcucagagac

SEQ ID NO: 2174613 - RNA, 13 nt, Homo sapiens
gagggucauuuuc

SEQ ID NO: 2174614 - RNA, 17 nt, Homo sapiens
uucaucucuucaugaau

SEQ ID NO: 2174615 - RNA, 12 nt, Homo sapiens
uagaacuugccu

SEQ ID NO: 2174616 - RNA, 13 nt, Homo sapiens
accaugugcaaua

SEQ ID NO: 2174617 - RNA, 12 nt, Homo sapiens
cguauaucacau

SEQ ID NO: 2174618 - RNA, 12 nt, Homo sapiens
aaucauucaaua

SEQ ID NO: 2174619 - RNA, 16 nt, Homo sapiens
uaucuguuaaccaaau

SEQ ID NO: 2174620 - RNA, 16 nt, Homo sapiens
ugcuaauaaguuugaa

SEQ ID NO: 2174621 - RNA, 21 nt, Homo sapiens
uauucuaagaaauaucuguga

SEQ ID NO: 2174622 - RNA, 12 nt, Homo sapiens
aucccacuccac

SEQ ID NO: 2174623 - RNA, 16 nt, Homo sapiens
ggcaucuugcuggcua

SEQ ID NO: 2174624 - RNA, 20 nt, Homo sapiens
cccagugugcaagggcagug

SEQ ID NO: 2174625 - RNA, 22 nt, Homo sapiens
ugccuguagcaaacaccaccaa

SEQ ID NO: 2174626 - RNA, 14 nt, Homo sapiens
ucuuuuccaugaac

SEQ ID NO: 2174627 - RNA, 16 nt, Homo sapiens
caaauuguaacuacac

SEQ ID NO: 2174628 - RNA, 15 nt, Homo sapiens
uucaaagcaggguuc

SEQ ID NO: 2174629 - RNA, 21 nt, Homo sapiens
gcaggugucccugagaaccca

SEQ ID NO: 2174630 - RNA, 20 nt, Homo sapiens
gacacuguggaaagcuuuga

SEQ ID NO: 2174631 - RNA, 18 nt, Homo sapiens
aguuuucaacuucaguac

SEQ ID NO: 2174632 - RNA, 22 nt, Homo sapiens
cugcacuggugugagggccccu

SEQ ID NO: 2174633 - RNA, 22 nt, Homo sapiens
cauuacugccaucuuuaucaug

SEQ ID NO: 2174634 - RNA, 17 nt, Homo sapiens
cuaaguguaccagagaa

SEQ ID NO: 2174635 - RNA, 23 nt, Homo sapiens
ucaauaaaauaauuauuggcaaa

SEQ ID NO: 2174636 - RNA, 20 nt, Homo sapiens
aaauaucuccuccaaugucc

SEQ ID NO: 2174637 - RNA, 16 nt, Homo sapiens
aauuguuuucaaucua

SEQ ID NO: 2174638 - RNA, 17 nt, Homo sapiens
cuguggccuguguccca

SEQ ID NO: 2174639 - RNA, 21 nt, Homo sapiens
auuguauuaacgcaaauauua

SEQ ID NO: 2174640 - RNA, 22 nt, Homo sapiens
ccaggcagaauggcugcacgua

SEQ ID NO: 2174641 - RNA, 17 nt, Homo sapiens
ugagaauguucaucucu

SEQ ID NO: 2174642 - RNA, 13 nt, Homo sapiens
uaugacucaaaga

SEQ ID NO: 2174643 - RNA, 13 nt, Homo sapiens
agagacucuguga

SEQ ID NO: 2174644 - RNA, 17 nt, Homo sapiens
uuuuaaagacuugcaca

SEQ ID NO: 2174645 - RNA, 16 nt, Homo sapiens
gccucgcucagucagu

SEQ ID NO: 2174646 - RNA, 21 nt, Homo sapiens
gcuauggaaauaaaaggcauu

SEQ ID NO: 2174647 - RNA, 21 nt, Homo sapiens
ugaauauuuuuuuuuugccaa

SEQ ID NO: 2174648 - RNA, 15 nt, Homo sapiens
ucucccaggucccag

SEQ ID NO: 2174649 - RNA, 13 nt, Homo sapiens
gaauuauuugccu

SEQ ID NO: 2174650 - RNA, 16 nt, Homo sapiens
ggucccagcuaaagag

SEQ ID NO: 2174651 - RNA, 22 nt, Homo sapiens
cugcacuugauguuuguuugca

SEQ ID NO: 2174652 - RNA, 16 nt, Homo sapiens
cccaguaguguuugga

SEQ ID NO: 2174653 - RNA, 16 nt, Homo sapiens
gucagucuucuuccau

SEQ ID NO: 2174654 - RNA, 18 nt, Homo sapiens
auaauaaaggcauuucaa

SEQ ID NO: 2174655 - RNA, 14 nt, Homo sapiens
auaccugcacuguc

SEQ ID NO: 2174656 - RNA, 11 nt, Homo sapiens
cugcagccaac

SEQ ID NO: 2174657 - RNA, 20 nt, Homo sapiens
aaauacaugucccccuguga

SEQ ID NO: 2174658 - RNA, 21 nt, Homo sapiens
acaauauuccagaucuuucag

SEQ ID NO: 2174659 - RNA, 16 nt, Homo sapiens
acaaaccuuacuaugg

SEQ ID NO: 2174660 - RNA, 13 nt, Homo sapiens
gagcacucuuauc

SEQ ID NO: 2174661 - RNA, 17 nt, Homo sapiens
ugaagaauacacuguga

SEQ ID NO: 2174662 - RNA, 20 nt, Homo sapiens
guuacuuaauucaacuuaac

SEQ ID NO: 2174663 - RNA, 22 nt, Homo sapiens
gaagccaaaguuuucaaacugc

SEQ ID NO: 2174664 - RNA, 22 nt, Homo sapiens
aguuugaacaaaaucuccucuu

SEQ ID NO: 2174665 - RNA, 19 nt, Homo sapiens
cugaguuucuggcucuuga

SEQ ID NO: 2174666 - RNA, 15 nt, Homo sapiens
gauacacugcagcug

SEQ ID NO: 2174667 - RNA, 19 nt, Homo sapiens
uccauguguuuugcuuuua

SEQ ID NO: 2174668 - RNA, 21 nt, Homo sapiens
uaacucagaucacuacugcag

SEQ ID NO: 2174669 - RNA, 21 nt, Homo sapiens
ucucaaagauucacacaugcc

SEQ ID NO: 2174670 - RNA, 21 nt, Homo sapiens
gccaggcagaucccacuugca

SEQ ID NO: 2174671 - RNA, 16 nt, Homo sapiens
uggccuggcaucgcau

SEQ ID NO: 2174672 - RNA, 16 nt, Homo sapiens
guaugugucacugcau

SEQ ID NO: 2174673 - RNA, 16 nt, Homo sapiens
gcuaccugaauggaga

SEQ ID NO: 2174674 - RNA, 23 nt, Homo sapiens
aacgcuacggggaaaaugcauuu

SEQ ID NO: 2174675 - RNA, 21 nt, Homo sapiens
uuugguuggcagcauuccaug

SEQ ID NO: 2174676 - RNA, 23 nt, Homo sapiens
gaaauccaucuaaauaccugccc

SEQ ID NO: 2174677 - RNA, 17 nt, Homo sapiens
uccaccuaccacucaca

SEQ ID NO: 2174678 - RNA, 13 nt, Homo sapiens
auacucaaauggu

SEQ ID NO: 2174679 - RNA, 18 nt, Homo sapiens
agugccuugagcugccug

SEQ ID NO: 2174680 - RNA, 15 nt, Homo sapiens
aucucggcucagugc

SEQ ID NO: 2174681 - RNA, 22 nt, Homo sapiens
gaaagccauauuccagcaguga

SEQ ID NO: 2174682 - RNA, 14 nt, Homo sapiens
uaggcuacccccuc

SEQ ID NO: 2174683 - RNA, 16 nt, Homo sapiens
guaaaauuguuccuga

SEQ ID NO: 2174684 - RNA, 22 nt, Homo sapiens
auuaaaugcauguccucaaaac

SEQ ID NO: 2174685 - RNA, 20 nt, Homo sapiens
ucaggucagcugggagccag

SEQ ID NO: 2174686 - RNA, 18 nt, Homo sapiens
accggguaagagcucuga

SEQ ID NO: 2174687 - RNA, 17 nt, Homo sapiens
uaauauuuccaauguga

SEQ ID NO: 2174688 - RNA, 18 nt, Homo sapiens
aucuguuaaccaaauaaa

SEQ ID NO: 2174689 - RNA, 18 nt, Homo sapiens
aucauguuggauagucag

SEQ ID NO: 2174690 - RNA, 20 nt, Homo sapiens
gaguucauggauauguuaua

SEQ ID NO: 2174691 - RNA, 10 nt, Homo sapiens
cccuccaaaa

SEQ ID NO: 2174692 - RNA, 15 nt, Homo sapiens
ucuucccccaugugc

SEQ ID NO: 2174693 - RNA, 22 nt, Homo sapiens
cgugcauucacauugaccgcaa

SEQ ID NO: 2174694 - RNA, 19 nt, Homo sapiens
cucaccaguaaaagauaac

SEQ ID NO: 2174695 - RNA, 18 nt, Homo sapiens
cuugccccaccuccauca

SEQ ID NO: 2174696 - RNA, 18 nt, Homo sapiens
gggcaggaguagcugagc

SEQ ID NO: 2174697 - RNA, 17 nt, Homo sapiens
uaacuuuucaccaauga

SEQ ID NO: 2174698 - RNA, 22 nt, Homo sapiens
cuuuggguuccaucuugcuaau

SEQ ID NO: 2174699 - RNA, 16 nt, Homo sapiens
aaagguuagauuuugu

SEQ ID NO: 2174700 - RNA, 14 nt, Homo sapiens
gacacuacaaacau

SEQ ID NO: 2174701 - RNA, 12 nt, Homo sapiens
aaugccaugaaa

SEQ ID NO: 2174702 - RNA, 15 nt, Homo sapiens
gacuuuucaccuuaa

SEQ ID NO: 2174703 - RNA, 18 nt, Homo sapiens
gauuugguggaugugaug

SEQ ID NO: 2174704 - RNA, 18 nt, Homo sapiens
uacuucccuuaacuuuca

SEQ ID NO: 2174705 - RNA, 17 nt, Homo sapiens
ggugaggggcuggcacu

SEQ ID NO: 2174706 - RNA, 17 nt, Homo sapiens
gacaggaaagggcaaag

SEQ ID NO: 2174707 - RNA, 13 nt, Homo sapiens
ccaaaaauaccau

SEQ ID NO: 2174708 - RNA, 14 nt, Homo sapiens
auuuguuaucucaa

SEQ ID NO: 2174709 - RNA, 18 nt, Homo sapiens
agguugucugaagucacu

SEQ ID NO: 2174710 - RNA, 23 nt, Homo sapiens
gauggaaugaccagccuguccaa

SEQ ID NO: 2174711 - RNA, 15 nt, Homo sapiens
uaauauauugcugcu

SEQ ID NO: 2174712 - RNA, 19 nt, Homo sapiens
gaaaacuaggcaauguacu

SEQ ID NO: 2174713 - RNA, 20 nt, Homo sapiens
ugaaaaaaagggcacucuga

SEQ ID NO: 2174714 - RNA, 13 nt, Homo sapiens
uuggguucacuca

SEQ ID NO: 2174715 - RNA, 16 nt, Homo sapiens
ugaggggcuaccagga

SEQ ID NO: 2174716 - RNA, 21 nt, Homo sapiens
guuucuucuuuuccuuuaucc

SEQ ID NO: 2174717 - RNA, 14 nt, Homo sapiens
guaaagauauuuga

SEQ ID NO: 2174718 - RNA, 22 nt, Homo sapiens
ugguagcaaauuaacuuuacau

SEQ ID NO: 2174719 - RNA, 15 nt, Homo sapiens
caaguggagcugucu

SEQ ID NO: 2174720 - RNA, 21 nt, Homo sapiens
uagaaagcuggcaacaugaag

SEQ ID NO: 2174721 - RNA, 18 nt, Homo sapiens
aauaaguaaauacauuau

SEQ ID NO: 2174722 - RNA, 17 nt, Homo sapiens
ucucacagcaaaccucu

SEQ ID NO: 2174723 - RNA, 23 nt, Homo sapiens
cgccugguucuguacauguggaa

SEQ ID NO: 2174724 - RNA, 11 nt, Homo sapiens
ccacaaauagu

SEQ ID NO: 2174725 - RNA, 21 nt, Homo sapiens
gauuuguauaaggaaagccaa

SEQ ID NO: 2174726 - RNA, 23 nt, Homo sapiens
caccgcccuugccgaaccaggag

SEQ ID NO: 2174727 - RNA, 19 nt, Homo sapiens
ugggagaaaacgucuugcu

SEQ ID NO: 2174728 - RNA, 16 nt, Homo sapiens
gacagcauugccagua

SEQ ID NO: 2174729 - RNA, 21 nt, Homo sapiens
aguucuguucacguccauugc

SEQ ID NO: 2174730 - RNA, 21 nt, Homo sapiens
caugucuccuggacucagggu

SEQ ID NO: 2174731 - RNA, 17 nt, Homo sapiens
guucucuauugcugcuc

SEQ ID NO: 2174732 - RNA, 19 nt, Homo sapiens
agaagugcagccccucuca

SEQ ID NO: 2174733 - RNA, 15 nt, Homo sapiens
gaauccagugcuucc

SEQ ID NO: 2174734 - RNA, 19 nt, Homo sapiens
aaccaggauuuccuugacu

SEQ ID NO: 2174735 - RNA, 15 nt, Homo sapiens
gaacagcuucagguu

SEQ ID NO: 2174736 - RNA, 16 nt, Homo sapiens
gcaucugacaggugaa

SEQ ID NO: 2174737 - RNA, 14 nt, Homo sapiens
cucccaagcacuuc

SEQ ID NO: 2174738 - RNA, 11 nt, Homo sapiens
ugcauuuacuu

SEQ ID NO: 2174739 - RNA, 22 nt, Homo sapiens
acccagugaggaugcugcagug

SEQ ID NO: 2174740 - RNA, 17 nt, Homo sapiens
cuuuaaaagcuucugca

SEQ ID NO: 2174741 - RNA, 19 nt, Homo sapiens
augauauauauguauaauu

SEQ ID NO: 2174742 - RNA, 16 nt, Homo sapiens
caaagcaucauuguaa

SEQ ID NO: 2174743 - RNA, 23 nt, Homo sapiens
auuacaggugugagccacagcac

SEQ ID NO: 2174744 - RNA, 17 nt, Homo sapiens
gaguuuauuugaguauu

SEQ ID NO: 2174745 - RNA, 16 nt, Homo sapiens
auucuuaaccaagaaa

SEQ ID NO: 2174746 - RNA, 18 nt, Homo sapiens
gugacagcucugccuguu

SEQ ID NO: 2174747 - RNA, 19 nt, Homo sapiens
gcuagaugugucuuaccag

SEQ ID NO: 2174748 - RNA, 14 nt, Homo sapiens
ccaagggacagugg

SEQ ID NO: 2174749 - RNA, 21 nt, Homo sapiens
aagucuccccuucguguugcc

SEQ ID NO: 2174750 - RNA, 14 nt, Homo sapiens
uucuuacaugcauu

SEQ ID NO: 2174751 - RNA, 13 nt, Homo sapiens
ugucuguaccucg

SEQ ID NO: 2174752 - RNA, 22 nt, Homo sapiens
gagcuguguaccaaucgucuca

SEQ ID NO: 2174753 - RNA, 17 nt, Homo sapiens
uuguuucagugcacuaa

SEQ ID NO: 2174754 - RNA, 21 nt, Homo sapiens
uaaauaaguaaaagcuacuau

SEQ ID NO: 2174755 - RNA, 20 nt, Homo sapiens
uaauugguccaacccagccu

SEQ ID NO: 2174756 - RNA, 21 nt, Homo sapiens
uaaaauggcaacaaacugcac

SEQ ID NO: 2174757 - RNA, 14 nt, Homo sapiens
agacucccuugcuu

SEQ ID NO: 2174758 - RNA, 15 nt, Homo sapiens
uaaauaauucuuccu

SEQ ID NO: 2174759 - RNA, 21 nt, Homo sapiens
gaggauugcuugagcccagaa

SEQ ID NO: 2174760 - RNA, 22 nt, Homo sapiens
ugugcccgccucuccacgcacu

SEQ ID NO: 2174761 - RNA, 18 nt, Homo sapiens
gaagguuggcgugcccug

SEQ ID NO: 2174762 - RNA, 16 nt, Homo sapiens
aagaaagucaauguca

SEQ ID NO: 2174763 - RNA, 13 nt, Homo sapiens
gccccgacuccag

SEQ ID NO: 2174764 - RNA, 14 nt, Homo sapiens
ugaagucagccuug

SEQ ID NO: 2174765 - RNA, 16 nt, Homo sapiens
ugggacugaugucauc

SEQ ID NO: 2174766 - RNA, 20 nt, Homo sapiens
uagaauuugggggaaaauuu

SEQ ID NO: 2174767 - RNA, 12 nt, Homo sapiens
aggcugggagac

SEQ ID NO: 2174768 - RNA, 23 nt, Homo sapiens
uuccaagaaaauaucacuguaau

SEQ ID NO: 2174769 - RNA, 22 nt, Homo sapiens
uagguugaacuaugaacacugu

SEQ ID NO: 2174770 - RNA, 17 nt, Homo sapiens
aaacuuuuuccaccuuu

SEQ ID NO: 2174771 - RNA, 20 nt, Homo sapiens
auucauuuccugcccuuccu

SEQ ID NO: 2174772 - RNA, 21 nt, Homo sapiens
acugucuuucagauacauggu

SEQ ID NO: 2174773 - RNA, 17 nt, Homo sapiens
auucggaaccaggccca

SEQ ID NO: 2174774 - RNA, 22 nt, Homo sapiens
aggcuccacuuggucugugaga

SEQ ID NO: 2174775 - RNA, 16 nt, Homo sapiens
agccagugagggcagu

SEQ ID NO: 2174776 - RNA, 15 nt, Homo sapiens
aaccugaaauuccaa

SEQ ID NO: 2174777 - RNA, 14 nt, Homo sapiens
cucagcagccucag

SEQ ID NO: 2174778 - RNA, 20 nt, Homo sapiens
cagccuggccaacauggcaa

SEQ ID NO: 2174779 - RNA, 16 nt, Homo sapiens
aagccacacucugggc

SEQ ID NO: 2174780 - RNA, 19 nt, Homo sapiens
aaggucaagaacacaguga

SEQ ID NO: 2174781 - RNA, 19 nt, Homo sapiens
uuugccaagucucccaaua

SEQ ID NO: 2174782 - RNA, 14 nt, Homo sapiens
cgugagcaugcaca

SEQ ID NO: 2174783 - RNA, 20 nt, Homo sapiens
cuucauuucauguauaguuu

SEQ ID NO: 2174784 - RNA, 22 nt, Homo sapiens
ggcugccgugcacggggccagc

SEQ ID NO: 2174785 - RNA, 13 nt, Homo sapiens
ccuagagcacucu

SEQ ID NO: 2174786 - RNA, 20 nt, Homo sapiens
agcugaauuugauucuccag

SEQ ID NO: 2174787 - RNA, 15 nt, Homo sapiens
acuaauguacuguac

SEQ ID NO: 2174788 - RNA, 19 nt, Homo sapiens
aauuucaaucaaccaaagu

SEQ ID NO: 2174789 - RNA, 16 nt, Homo sapiens
gacuuuacaaaccuuu

SEQ ID NO: 2174790 - RNA, 22 nt, Homo sapiens
uuccaaugugguggcaauaaau

SEQ ID NO: 2174791 - RNA, 19 nt, Homo sapiens
cuucaagaucccauuugaa

SEQ ID NO: 2174792 - RNA, 13 nt, Homo sapiens
ggacauaucagug

SEQ ID NO: 2174793 - RNA, 17 nt, Homo sapiens
gagguccugagcacugc

SEQ ID NO: 2174794 - RNA, 18 nt, Homo sapiens
ucucuuaccugggaccuc

SEQ ID NO: 2174795 - RNA, 17 nt, Homo sapiens
gaaaauaaauacauaaa

SEQ ID NO: 2174796 - RNA, 15 nt, Homo sapiens
aguguaaugcaagaa

SEQ ID NO: 2174797 - RNA, 18 nt, Homo sapiens
cagugcaauacucaguaa

SEQ ID NO: 2174798 - RNA, 16 nt, Homo sapiens
uacauuaaaagcuuua

SEQ ID NO: 2174799 - RNA, 16 nt, Homo sapiens
uugauaccauggcacu

SEQ ID NO: 2174800 - RNA, 18 nt, Homo sapiens
acagcgauaagcuuucaa

SEQ ID NO: 2174801 - RNA, 11 nt, Homo sapiens
uuacuaauuaa

SEQ ID NO: 2174802 - RNA, 15 nt, Homo sapiens
aaauaaauaacuuug

SEQ ID NO: 2174803 - RNA, 15 nt, Homo sapiens
gaugggcaacuggcu

SEQ ID NO: 2174804 - RNA, 13 nt, Homo sapiens
uuaucaaagaagu

SEQ ID NO: 2174805 - RNA, 19 nt, Homo sapiens
uauaaaaaugagugcuuaa

SEQ ID NO: 2174806 - RNA, 15 nt, Homo sapiens
agacauuauauagca

SEQ ID NO: 2174807 - RNA, 22 nt, Homo sapiens
cugauuaccuccuguguggaag

SEQ ID NO: 2174808 - RNA, 15 nt, Homo sapiens
gcaucucagugcagg

SEQ ID NO: 2174809 - RNA, 21 nt, Homo sapiens
gcacuaagucucuagccucuu

SEQ ID NO: 2174810 - RNA, 16 nt, Homo sapiens
gcuauuuucugaccaa

SEQ ID NO: 2174811 - RNA, 17 nt, Homo sapiens
ugauccugcaucugggu

SEQ ID NO: 2174812 - RNA, 21 nt, Homo sapiens
cuucuggaguuccaaaugcaa

SEQ ID NO: 2174813 - RNA, 17 nt, Homo sapiens
ugaacauuuaucaauca

SEQ ID NO: 2174814 - RNA, 11 nt, Homo sapiens
cauagcacugc

SEQ ID NO: 2174815 - RNA, 16 nt, Homo sapiens
cuguacucagccuuuu

SEQ ID NO: 2174816 - RNA, 14 nt, Homo sapiens
gugauuacugcaau

SEQ ID NO: 2174817 - RNA, 21 nt, Homo sapiens
uucuaauuuuucagcuccuuc

SEQ ID NO: 2174818 - RNA, 12 nt, Homo sapiens
ccggcucuuucc

SEQ ID NO: 2174819 - RNA, 20 nt, Homo sapiens
ugcaguaggggcuacuguga

SEQ ID NO: 2174820 - RNA, 12 nt, Homo sapiens
caauaaaagagc

SEQ ID NO: 2174821 - RNA, 12 nt, Homo sapiens
agcaucucaggu

SEQ ID NO: 2174822 - RNA, 11 nt, Homo sapiens
auuuucuugcu

SEQ ID NO: 2174823 - RNA, 10 nt, Homo sapiens
aauugcucaa

SEQ ID NO: 2174824 - RNA, 17 nt, Homo sapiens
aagccuugaaacaguug

SEQ ID NO: 2174825 - RNA, 20 nt, Homo sapiens
aagucgccagucacugcugc

SEQ ID NO: 2174826 - RNA, 20 nt, Homo sapiens
ugccacagcaaggaaauguc

SEQ ID NO: 2174827 - RNA, 16 nt, Homo sapiens
gucuuuauacugcaaa

SEQ ID NO: 2174828 - RNA, 13 nt, Homo sapiens
cacuuuacuacuc

SEQ ID NO: 2174829 - RNA, 13 nt, Homo sapiens
uuuacuaccuuau

SEQ ID NO: 2174830 - RNA, 13 nt, Homo sapiens
cccuuuacuccuc

SEQ ID NO: 2174831 - RNA, 13 nt, Homo sapiens
aggucagacugaa

SEQ ID NO: 2174832 - RNA, 16 nt, Homo sapiens
auguguuuuuguauga

SEQ ID NO: 2174833 - RNA, 18 nt, Homo sapiens
aggcaucucccaccagcu

SEQ ID NO: 2174834 - RNA, 15 nt, Homo sapiens
cccagguguggcugu

SEQ ID NO: 2174835 - RNA, 17 nt, Homo sapiens
aaucaacaagauuucca

SEQ ID NO: 2174836 - RNA, 19 nt, Homo sapiens
agguaaauugacugagacu

SEQ ID NO: 2174837 - RNA, 17 nt, Homo sapiens
accuagaccuaaacggc

SEQ ID NO: 2174838 - RNA, 21 nt, Homo sapiens
gaucgucccauccccacaucc

SEQ ID NO: 2174839 - RNA, 16 nt, Homo sapiens
gaccagaccuggccaa

SEQ ID NO: 2174840 - RNA, 16 nt, Homo sapiens
ucuacuacaugugacu

SEQ ID NO: 2174841 - RNA, 21 nt, Homo sapiens
acuuauuucagauucaccucc

SEQ ID NO: 2174842 - RNA, 20 nt, Homo sapiens
ucuccucacucugucccugu

SEQ ID NO: 2174843 - RNA, 22 nt, Homo sapiens
uaagauccagaaauacuuaaca

SEQ ID NO: 2174844 - RNA, 20 nt, Homo sapiens
gaucuguaaggaacuggaac

SEQ ID NO: 2174845 - RNA, 22 nt, Homo sapiens
guauaucaugaaacacuucuca

SEQ ID NO: 2174846 - RNA, 13 nt, Homo sapiens
ccagcgggcacag

SEQ ID NO: 2174847 - RNA, 16 nt, Homo sapiens
caggaucccucccaga

SEQ ID NO: 2174848 - RNA, 15 nt, Homo sapiens
uaguauacauugucu

SEQ ID NO: 2174849 - RNA, 14 nt, Homo sapiens
acuguacccucgca

SEQ ID NO: 2174850 - RNA, 15 nt, Homo sapiens
acagcugaacuauuu

SEQ ID NO: 2174851 - RNA, 16 nt, Homo sapiens
aucugaucaaauguau

SEQ ID NO: 2174852 - RNA, 18 nt, Homo sapiens
uagggugauacuuuugcc

SEQ ID NO: 2174853 - RNA, 12 nt, Homo sapiens
acucgcuuuuau

SEQ ID NO: 2174854 - RNA, 14 nt, Homo sapiens
aaagcugcuugaau

SEQ ID NO: 2174855 - RNA, 22 nt, Homo sapiens
aggaaacuguuguguccaaucc

SEQ ID NO: 2174856 - RNA, 13 nt, Homo sapiens
cccuguugcuaca

SEQ ID NO: 2174857 - RNA, 22 nt, Homo sapiens
uagacaaaugaacaagcaauua

SEQ ID NO: 2174858 - RNA, 22 nt, Homo sapiens
cugugauguuuguguauguggg

SEQ ID NO: 2174859 - RNA, 16 nt, Homo sapiens
aaaguccacaagaaca

SEQ ID NO: 2174860 - RNA, 22 nt, Homo sapiens
aauaauuaaagcuuaaacugaa

SEQ ID NO: 2174861 - RNA, 14 nt, Homo sapiens
uauagucacaagag

SEQ ID NO: 2174862 - RNA, 13 nt, Homo sapiens
aaaaaacuacuuc

SEQ ID NO: 2174863 - RNA, 19 nt, Homo sapiens
uauaugucuaauucuaugu

SEQ ID NO: 2174864 - RNA, 18 nt, Homo sapiens
ucuggggaccagcuuggc

SEQ ID NO: 2174865 - RNA, 18 nt, Homo sapiens
caaaguguuguguuccug

SEQ ID NO: 2174866 - RNA, 17 nt, Homo sapiens
agggcucguuuccccac

SEQ ID NO: 2174867 - RNA, 19 nt, Homo sapiens
ccuaaaauuuuagauguag

SEQ ID NO: 2174868 - RNA, 19 nt, Homo sapiens
gucauuggccgacaucaca

SEQ ID NO: 2174869 - RNA, 22 nt, Homo sapiens
gggggcucaggccauccagcca

SEQ ID NO: 2174870 - RNA, 19 nt, Homo sapiens
ucccuaccauuucuagccu

SEQ ID NO: 2174871 - RNA, 15 nt, Homo sapiens
aagcagaccacugau

SEQ ID NO: 2174872 - RNA, 16 nt, Homo sapiens
uaccuaaguacuguaa

SEQ ID NO: 2174873 - RNA, 15 nt, Homo sapiens
ccugaauguguagaa

SEQ ID NO: 2174874 - RNA, 17 nt, Homo sapiens
uuguucauuccgaaaaa

SEQ ID NO: 2174875 - RNA, 17 nt, Homo sapiens
cuaagcacgggccauau

SEQ ID NO: 2174876 - RNA, 16 nt, Homo sapiens
cuuugauucaaagcac

SEQ ID NO: 2174877 - RNA, 20 nt, Homo sapiens
ugaaaugaggccuacucuaa

SEQ ID NO: 2174878 - RNA, 23 nt, Homo sapiens
aaccacgccucuugaccaggcug

SEQ ID NO: 2174879 - RNA, 15 nt, Homo sapiens
uuuccccagucccag

SEQ ID NO: 2174880 - RNA, 13 nt, Homo sapiens
uguguuaguaaua

SEQ ID NO: 2174881 - RNA, 23 nt, Homo sapiens
uuuauuaauuugaaaccaggaca

SEQ ID NO: 2174882 - RNA, 19 nt, Homo sapiens
uuggagaagcucaucagaa

SEQ ID NO: 2174883 - RNA, 14 nt, Homo sapiens
ggccccacauugca

SEQ ID NO: 2174884 - RNA, 20 nt, Homo sapiens
ucagucucugagggcuuccu

SEQ ID NO: 2174885 - RNA, 20 nt, Homo sapiens
uuaucuucuuccagauuucc

SEQ ID NO: 2174886 - RNA, 17 nt, Homo sapiens
gacucuuaaauauacuu

SEQ ID NO: 2174887 - RNA, 18 nt, Homo sapiens
caagccuacaugacacag

SEQ ID NO: 2174888 - RNA, 15 nt, Homo sapiens
auccaaugcucaaga

SEQ ID NO: 2174889 - RNA, 22 nt, Homo sapiens
gacuacacugaaucauuaacag

SEQ ID NO: 2174890 - RNA, 13 nt, Homo sapiens
cugcaagcccacc

SEQ ID NO: 2174891 - RNA, 23 nt, Homo sapiens
aaaaacucuuuaacuuguaauaa

SEQ ID NO: 2174892 - RNA, 15 nt, Homo sapiens
cuguauuagcagcaa

SEQ ID NO: 2174893 - RNA, 23 nt, Homo sapiens
ccacaggccgcccugcgggugaa

SEQ ID NO: 2174894 - RNA, 23 nt, Homo sapiens
aggacacuacccugagaucugca

SEQ ID NO: 2174895 - RNA, 19 nt, Homo sapiens
augaaacuuuccuuuguca

SEQ ID NO: 2174896 - RNA, 19 nt, Homo sapiens
aguggacgugucagguggu

SEQ ID NO: 2174897 - RNA, 17 nt, Homo sapiens
uuuaaaaauaaauucaa

SEQ ID NO: 2174898 - RNA, 13 nt, Homo sapiens
acguuuaagccaa

SEQ ID NO: 2174899 - RNA, 21 nt, Homo sapiens
ugacuaucacauacaauuugc

SEQ ID NO: 2174900 - RNA, 19 nt, Homo sapiens
cugaguagugacacacaga

SEQ ID NO: 2174901 - RNA, 14 nt, Homo sapiens
ugcuuggauuuuga

SEQ ID NO: 2174902 - RNA, 14 nt, Homo sapiens
cccucugugccuaa

SEQ ID NO: 2174903 - RNA, 19 nt, Homo sapiens
ggaauuguugaauguauuc

SEQ ID NO: 2174904 - RNA, 21 nt, Homo sapiens
cuacuguuaggaacagcagug

SEQ ID NO: 2174905 - RNA, 23 nt, Homo sapiens
caauugagaaaaauauauacuaa

SEQ ID NO: 2174906 - RNA, 11 nt, Homo sapiens
uucuucacuua

SEQ ID NO: 2174907 - RNA, 20 nt, Homo sapiens
uaucuggcacuguuaauaca

SEQ ID NO: 2174908 - RNA, 23 nt, Homo sapiens
gggaauggaggggcagagccagg

SEQ ID NO: 2174909 - RNA, 15 nt, Homo sapiens
aaccuggacccagau

SEQ ID NO: 2174910 - RNA, 18 nt, Homo sapiens
caugaccugcgcucucag

SEQ ID NO: 2174911 - RNA, 16 nt, Homo sapiens
gaagcaguaauaauca

SEQ ID NO: 2174912 - RNA, 18 nt, Homo sapiens
uaaccauauaaauucuga

SEQ ID NO: 2174913 - RNA, 14 nt, Homo sapiens
uaaaugaggauuca

SEQ ID NO: 2174914 - RNA, 22 nt, Homo sapiens
augugugugugcuuauguauga

SEQ ID NO: 2174915 - RNA, 21 nt, Homo sapiens
guugcuaaaaaaagugcauga

SEQ ID NO: 2174916 - RNA, 15 nt, Homo sapiens
acccauaaacaguaa

SEQ ID NO: 2174917 - RNA, 23 nt, Homo sapiens
ucucagucaugcacucacaaaga

SEQ ID NO: 2174918 - RNA, 18 nt, Homo sapiens
gggcuuggaccagaucua

SEQ ID NO: 2174919 - RNA, 22 nt, Homo sapiens
cuaaucucauaccucugaccaa

SEQ ID NO: 2174920 - RNA, 16 nt, Homo sapiens
agaugaaauuccauuu

SEQ ID NO: 2174921 - RNA, 19 nt, Homo sapiens
aagccaggacuauucccuu

SEQ ID NO: 2174922 - RNA, 16 nt, Homo sapiens
ccaguaauugguccga

SEQ ID NO: 2174923 - RNA, 16 nt, Homo sapiens
agaacuugucccucag

SEQ ID NO: 2174924 - RNA, 14 nt, Homo sapiens
cuuugcaccagaua

SEQ ID NO: 2174925 - RNA, 18 nt, Homo sapiens
ggcucuggagccagagag

SEQ ID NO: 2174926 - RNA, 16 nt, Homo sapiens
uauaaaagacugacca

SEQ ID NO: 2174927 - RNA, 21 nt, Homo sapiens
aauaugguaaugcacaauucc

SEQ ID NO: 2174928 - RNA, 21 nt, Homo sapiens
gguugcagauugaagcauuuc

SEQ ID NO: 2174929 - RNA, 18 nt, Homo sapiens
acagcagcucaggcacac

SEQ ID NO: 2174930 - RNA, 22 nt, Homo sapiens
uccuucaccgugacauuccagc

SEQ ID NO: 2174931 - RNA, 21 nt, Homo sapiens
uaaucaauaucccaacauucu

SEQ ID NO: 2174932 - RNA, 22 nt, Homo sapiens
cagauacuuugaagugcagcuc

SEQ ID NO: 2174933 - RNA, 21 nt, Homo sapiens
ccucacaucuuucacacuucc

SEQ ID NO: 2174934 - RNA, 20 nt, Homo sapiens
aacugaaugacuugacuuca

SEQ ID NO: 2174935 - RNA, 17 nt, Homo sapiens
ucauucuucaguucucu

SEQ ID NO: 2174936 - RNA, 12 nt, Homo sapiens
cccagcaaagag

SEQ ID NO: 2174937 - RNA, 14 nt, Homo sapiens
agcuugagcuauag

SEQ ID NO: 2174938 - RNA, 17 nt, Homo sapiens
ggaaggugugcucggug

SEQ ID NO: 2174939 - RNA, 13 nt, Homo sapiens
gaaggcgugcaag

SEQ ID NO: 2174940 - RNA, 21 nt, Homo sapiens
ggcagggagagaguagcugca

SEQ ID NO: 2174941 - RNA, 21 nt, Homo sapiens
auacuccaacugaaauguuaa

SEQ ID NO: 2174942 - RNA, 17 nt, Homo sapiens
auucauggcuuaugcuu

SEQ ID NO: 2174943 - RNA, 15 nt, Homo sapiens
uuuuggaagaauuca

SEQ ID NO: 2174944 - RNA, 12 nt, Homo sapiens
agcuaaguagaa

SEQ ID NO: 2174945 - RNA, 17 nt, Homo sapiens
aagaguaagcaguguua

SEQ ID NO: 2174946 - RNA, 13 nt, Homo sapiens
cagggagacaucu

SEQ ID NO: 2174947 - RNA, 15 nt, Homo sapiens
gucugggaugcugcg

SEQ ID NO: 2174948 - RNA, 21 nt, Homo sapiens
gaagacgccuuucuccuccaa

SEQ ID NO: 2174949 - RNA, 14 nt, Homo sapiens
aaguggacuguauu

SEQ ID NO: 2174950 - RNA, 18 nt, Homo sapiens
cucccaaagugcugagau

SEQ ID NO: 2174951 - RNA, 19 nt, Homo sapiens
uugugagcacucuacugca

SEQ ID NO: 2174952 - RNA, 22 nt, Homo sapiens
aaauaaacagauacauucacau

SEQ ID NO: 2174953 - RNA, 16 nt, Homo sapiens
ucucauucccaggcac

SEQ ID NO: 2174954 - RNA, 18 nt, Homo sapiens
ugaacuuggcuguaauca

SEQ ID NO: 2174955 - RNA, 21 nt, Homo sapiens
uacuaauuuguauaacccaua

SEQ ID NO: 2174956 - RNA, 19 nt, Homo sapiens
cauuaaaaaaauacaauau

SEQ ID NO: 2174957 - RNA, 15 nt, Homo sapiens
uagcagacccagcuu

SEQ ID NO: 2174958 - RNA, 13 nt, Homo sapiens
uauucucuccuca

SEQ ID NO: 2174959 - RNA, 21 nt, Homo sapiens
gcacauuuaaggcgccauugc

SEQ ID NO: 2174960 - RNA, 13 nt, Homo sapiens
aggcaaaaaccag

SEQ ID NO: 2174961 - RNA, 17 nt, Homo sapiens
guuccucuuugcaugga

SEQ ID NO: 2174962 - RNA, 20 nt, Homo sapiens
caaggaauuucagaguauuu

SEQ ID NO: 2174963 - RNA, 14 nt, Homo sapiens
cuguaaaagauuca

SEQ ID NO: 2174964 - RNA, 21 nt, Homo sapiens
auugcaaaagguuaagccaua

SEQ ID NO: 2174965 - RNA, 14 nt, Homo sapiens
gcuaugugcacuga

SEQ ID NO: 2174966 - RNA, 23 nt, Homo sapiens
ugcugcucauuccacacuguuga

SEQ ID NO: 2174967 - RNA, 19 nt, Homo sapiens
ugcugucuucaucaucuua

SEQ ID NO: 2174968 - RNA, 16 nt, Homo sapiens
caugcaauacauacca

SEQ ID NO: 2174969 - RNA, 14 nt, Homo sapiens
ucgaagcuguuaau

SEQ ID NO: 2174970 - RNA, 12 nt, Homo sapiens
uguuucuuuagc

SEQ ID NO: 2174971 - RNA, 21 nt, Homo sapiens
auccuaccccuuugcacuugu

SEQ ID NO: 2174972 - RNA, 13 nt, Homo sapiens
ccaggguggagug

SEQ ID NO: 2174973 - RNA, 12 nt, Homo sapiens
cuaguucagcug

SEQ ID NO: 2174974 - RNA, 14 nt, Homo sapiens
cacugcagccacag

SEQ ID NO: 2174975 - RNA, 20 nt, Homo sapiens
gcuucaggggacuguucuca

SEQ ID NO: 2174976 - RNA, 15 nt, Homo sapiens
aucuucaaacuuuca

SEQ ID NO: 2174977 - RNA, 21 nt, Homo sapiens
aaccgcugccuuuaucuugaa

SEQ ID NO: 2174978 - RNA, 18 nt, Homo sapiens
cugaauccuuccauuucu

SEQ ID NO: 2174979 - RNA, 14 nt, Homo sapiens
uugggcuugcuauu

SEQ ID NO: 2174980 - RNA, 19 nt, Homo sapiens
uuccugugccugugacucu

SEQ ID NO: 2174981 - RNA, 18 nt, Homo sapiens
ccacagccuuaccaaagc

SEQ ID NO: 2174982 - RNA, 17 nt, Homo sapiens
cauauucugguucuuga

SEQ ID NO: 2174983 - RNA, 19 nt, Homo sapiens
caaauaauuuuucacuuca

SEQ ID NO: 2174984 - RNA, 22 nt, Homo sapiens
cugucauucgcucccacauucu

SEQ ID NO: 2174985 - RNA, 15 nt, Homo sapiens
ugugucgcuuauguc

SEQ ID NO: 2174986 - RNA, 19 nt, Homo sapiens
gcacccaccacucucagga

SEQ ID NO: 2174987 - RNA, 19 nt, Homo sapiens
uguucacacacacaguuug

SEQ ID NO: 2174988 - RNA, 16 nt, Homo sapiens
acagauggauuugccu

SEQ ID NO: 2174989 - RNA, 16 nt, Homo sapiens
gagagcaggcuggcag

SEQ ID NO: 2174990 - RNA, 16 nt, Homo sapiens
ggauccucaguucuca

SEQ ID NO: 2174991 - RNA, 17 nt, Homo sapiens
uguaagauaauguugcu

SEQ ID NO: 2174992 - RNA, 20 nt, Homo sapiens
gccucuggcucucauggggu

SEQ ID NO: 2174993 - RNA, 20 nt, Homo sapiens
ucuuucuuuuguaauuugua

SEQ ID NO: 2174994 - RNA, 16 nt, Homo sapiens
cuaauacaacauguag

SEQ ID NO: 2174995 - RNA, 17 nt, Homo sapiens
uccuguuuucuaaaaaa

SEQ ID NO: 2174996 - RNA, 15 nt, Homo sapiens
ugccccuguaaauag

SEQ ID NO: 2174997 - RNA, 15 nt, Homo sapiens
ggaaaggggguccca

SEQ ID NO: 2174998 - RNA, 20 nt, Homo sapiens
gccaagagccugagugacag

SEQ ID NO: 2174999 - RNA, 18 nt, Homo sapiens
ggcagcauuuuugcacug

SEQ ID NO: 2175000 - RNA, 15 nt, Homo sapiens
guugguccacugugu

SEQ ID NO: 2175001 - RNA, 22 nt, Homo sapiens
acauguauguggauacagucau

SEQ ID NO: 2175002 - RNA, 19 nt, Homo sapiens
auguguuucuccugagcua

SEQ ID NO: 2175003 - RNA, 20 nt, Homo sapiens
uguauugugcugauugugga

SEQ ID NO: 2175004 - RNA, 19 nt, Homo sapiens
guuucuccucuuuccuccu

SEQ ID NO: 2175005 - RNA, 17 nt, Homo sapiens
ugacacuuugccagaaa

SEQ ID NO: 2175006 - RNA, 19 nt, Homo sapiens
aggaacucucaagugucuu

SEQ ID NO: 2175007 - RNA, 16 nt, Homo sapiens
agauuuuuaacuauuu

SEQ ID NO: 2175008 - RNA, 17 nt, Homo sapiens
gucugaaaaaguguuuu

SEQ ID NO: 2175009 - RNA, 14 nt, Homo sapiens
ucuaacgggcauuu

SEQ ID NO: 2175010 - RNA, 16 nt, Homo sapiens
cuggcccaaccagaac

SEQ ID NO: 2175011 - RNA, 14 nt, Homo sapiens
acuugacuuugcca

SEQ ID NO: 2175012 - RNA, 17 nt, Homo sapiens
caugugaagcuauuuga

SEQ ID NO: 2175013 - RNA, 23 nt, Homo sapiens
acuuauuuaugaauugucuaaag

SEQ ID NO: 2175014 - RNA, 15 nt, Homo sapiens
guuaaauaggcuuga

SEQ ID NO: 2175015 - RNA, 17 nt, Homo sapiens
acccaggcaaucuugcc

SEQ ID NO: 2175016 - RNA, 19 nt, Homo sapiens
uuccuuuauacacagugga

SEQ ID NO: 2175017 - RNA, 13 nt, Homo sapiens
agauaacauuuca

SEQ ID NO: 2175018 - RNA, 16 nt, Homo sapiens
aauucuuuacaauaaa

SEQ ID NO: 2175019 - RNA, 20 nt, Homo sapiens
auauuuucgcccaccuaaag

SEQ ID NO: 2175020 - RNA, 17 nt, Homo sapiens
cccaccuggugugacuu

SEQ ID NO: 2175021 - RNA, 14 nt, Homo sapiens
uugguuuaaaagac

SEQ ID NO: 2175022 - RNA, 21 nt, Homo sapiens
caagcaagcucccaagggaug

SEQ ID NO: 2175023 - RNA, 20 nt, Homo sapiens
cauaucuuuuaauuguguau

SEQ ID NO: 2175024 - RNA, 13 nt, Homo sapiens
uccucugugcucc

SEQ ID NO: 2175025 - RNA, 22 nt, Homo sapiens
gggccgugacagugacgccuuu

SEQ ID NO: 2175026 - RNA, 20 nt, Homo sapiens
auauauuuauauguacauac

SEQ ID NO: 2175027 - RNA, 20 nt, Homo sapiens
ccuguguuucauuacuugaa

SEQ ID NO: 2175028 - RNA, 20 nt, Homo sapiens
gcccuggaaggugccacucc

SEQ ID NO: 2175029 - RNA, 15 nt, Homo sapiens
aaugaagaugaugcu

SEQ ID NO: 2175030 - RNA, 18 nt, Homo sapiens
uccccacuucugugccac

SEQ ID NO: 2175031 - RNA, 16 nt, Homo sapiens
acugaagcugcacagu

SEQ ID NO: 2175032 - RNA, 20 nt, Homo sapiens
uacaggguuuuuaccuguca

SEQ ID NO: 2175033 - RNA, 22 nt, Homo sapiens
ccuuccaaggucccgaccccau

SEQ ID NO: 2175034 - RNA, 13 nt, Homo sapiens
uaaaggaaccagu

SEQ ID NO: 2175035 - RNA, 22 nt, Homo sapiens
gaauuuaggguguuaaacuuuu

SEQ ID NO: 2175036 - RNA, 12 nt, Homo sapiens
uauuucucugau

SEQ ID NO: 2175037 - RNA, 16 nt, Homo sapiens
cauugccgcuguauaa

SEQ ID NO: 2175038 - RNA, 19 nt, Homo sapiens
ggugauuaccggcauuuua

SEQ ID NO: 2175039 - RNA, 19 nt, Homo sapiens
auguguguguauguuugca

SEQ ID NO: 2175040 - RNA, 14 nt, Homo sapiens
ucccuuggcacacu

SEQ ID NO: 2175041 - RNA, 21 nt, Homo sapiens
agcauuugguacacacuugac

SEQ ID NO: 2175042 - RNA, 18 nt, Homo sapiens
uacacuaauaaaugccaa

SEQ ID NO: 2175043 - RNA, 16 nt, Homo sapiens
agugcaacagcacugg

SEQ ID NO: 2175044 - RNA, 13 nt, Homo sapiens
gaaagaaggaauc

SEQ ID NO: 2175045 - RNA, 13 nt, Homo sapiens
ugcucaagugcag

SEQ ID NO: 2175046 - RNA, 17 nt, Homo sapiens
cucaggggucuuaccuu

SEQ ID NO: 2175047 - RNA, 15 nt, Homo sapiens
gcccucucucugggc

SEQ ID NO: 2175048 - RNA, 18 nt, Homo sapiens
cagacaccgccacauggc

SEQ ID NO: 2175049 - RNA, 19 nt, Homo sapiens
ucaucaaaucaucauuaau

SEQ ID NO: 2175050 - RNA, 15 nt, Homo sapiens
cugcacccucgauga

SEQ ID NO: 2175051 - RNA, 20 nt, Homo sapiens
gcagugccaaaauauaauca

SEQ ID NO: 2175052 - RNA, 19 nt, Homo sapiens
acuguuaaauugcugugua

SEQ ID NO: 2175053 - RNA, 22 nt, Homo sapiens
uacgugaggccugcacagcuaa

SEQ ID NO: 2175054 - RNA, 14 nt, Homo sapiens
gauucuguugcaua

SEQ ID NO: 2175055 - RNA, 20 nt, Homo sapiens
gauuuuauggugaugucacu

SEQ ID NO: 2175056 - RNA, 21 nt, Homo sapiens
cuauuuaagugauacauaccu

SEQ ID NO: 2175057 - RNA, 21 nt, Homo sapiens
guucugcugaaucaaaucucu

SEQ ID NO: 2175058 - RNA, 22 nt, Homo sapiens
aaaguugguguagcagcaguug

SEQ ID NO: 2175059 - RNA, 15 nt, Homo sapiens
uguucaaugguucug

SEQ ID NO: 2175060 - RNA, 15 nt, Homo sapiens
ccucacaauaccuua

SEQ ID NO: 2175061 - RNA, 19 nt, Homo sapiens
cuaauuaaaaacugugauu

SEQ ID NO: 2175062 - RNA, 17 nt, Homo sapiens
cauugggcuacuguaga

SEQ ID NO: 2175063 - RNA, 14 nt, Homo sapiens
guuucaccaugaug

SEQ ID NO: 2175064 - RNA, 16 nt, Homo sapiens
aaucuuucacuugaaa

SEQ ID NO: 2175065 - RNA, 17 nt, Homo sapiens
auaccaaauggcacuuu

SEQ ID NO: 2175066 - RNA, 14 nt, Homo sapiens
acuguaaaauacau

SEQ ID NO: 2175067 - RNA, 14 nt, Homo sapiens
ucacuuaauuugaa

SEQ ID NO: 2175068 - RNA, 16 nt, Homo sapiens
cugaaaaaaacauauc

SEQ ID NO: 2175069 - RNA, 17 nt, Homo sapiens
auuggguucaaggaauc

SEQ ID NO: 2175070 - RNA, 22 nt, Homo sapiens
aaacauguuuaaauagccuaaa

SEQ ID NO: 2175071 - RNA, 20 nt, Homo sapiens
ugagaacucugcccaggugu

SEQ ID NO: 2175072 - RNA, 22 nt, Homo sapiens
ucggggaccagcccacagcaca

SEQ ID NO: 2175073 - RNA, 19 nt, Homo sapiens
guccaggguggaugaucuc

SEQ ID NO: 2175074 - RNA, 20 nt, Homo sapiens
cacccggcucguguauuuau

SEQ ID NO: 2175075 - RNA, 14 nt, Homo sapiens
uagcugcaucuaua

SEQ ID NO: 2175076 - RNA, 20 nt, Homo sapiens
uuggcaacagaagcaguuga

SEQ ID NO: 2175077 - RNA, 20 nt, Homo sapiens
uaaguuaccuuucuagguca

SEQ ID NO: 2175078 - RNA, 15 nt, Homo sapiens
ucacugcagccucaa

SEQ ID NO: 2175079 - RNA, 22 nt, Homo sapiens
aaacagaacucgaugcacugac

SEQ ID NO: 2175080 - RNA, 12 nt, Homo sapiens
gcccauccugcc

SEQ ID NO: 2175081 - RNA, 20 nt, Homo sapiens
uguauaauuggaguagauau

SEQ ID NO: 2175082 - RNA, 15 nt, Homo sapiens
acaccugcacacccc

SEQ ID NO: 2175083 - RNA, 20 nt, Homo sapiens
aggcccuguccuaagcacuu

SEQ ID NO: 2175084 - RNA, 23 nt, Homo sapiens
caguagagauuucccacauuccc

SEQ ID NO: 2175085 - RNA, 16 nt, Homo sapiens
aggaauuguguuuaua

SEQ ID NO: 2175086 - RNA, 17 nt, Homo sapiens
cuuaaaaaaagcacaug

SEQ ID NO: 2175087 - RNA, 18 nt, Homo sapiens
uaggauaugugugcuaua

SEQ ID NO: 2175088 - RNA, 14 nt, Homo sapiens
uacuuuuacagguu

SEQ ID NO: 2175089 - RNA, 13 nt, Homo sapiens
ccucuuccacuuu

SEQ ID NO: 2175090 - RNA, 13 nt, Homo sapiens
cauggcaugucuu

SEQ ID NO: 2175091 - RNA, 21 nt, Homo sapiens
uacucacuuuuuccaaaugau

SEQ ID NO: 2175092 - RNA, 15 nt, Homo sapiens
agaaauacuacugug

SEQ ID NO: 2175093 - RNA, 16 nt, Homo sapiens
aaucauaacucacuuu

SEQ ID NO: 2175094 - RNA, 22 nt, Homo sapiens
agagagcucgcucuugggaguc

SEQ ID NO: 2175095 - RNA, 22 nt, Homo sapiens
aauuucuagccugcacuuugau

SEQ ID NO: 2175096 - RNA, 22 nt, Homo sapiens
ucacuuguagguuucucugccu

SEQ ID NO: 2175097 - RNA, 19 nt, Homo sapiens
ugggaugauugaagaaaca

SEQ ID NO: 2175098 - RNA, 19 nt, Homo sapiens
uuucuagacaguauugcca

SEQ ID NO: 2175099 - RNA, 16 nt, Homo sapiens
ggggguuucaccuggg

SEQ ID NO: 2175100 - RNA, 21 nt, Homo sapiens
gagaguuacauguuaacugag

SEQ ID NO: 2175101 - RNA, 13 nt, Homo sapiens
aaugucuguauca

SEQ ID NO: 2175102 - RNA, 15 nt, Homo sapiens
gagagacacucccag

SEQ ID NO: 2175103 - RNA, 15 nt, Homo sapiens
gcaucacaugaugaa

SEQ ID NO: 2175104 - RNA, 14 nt, Homo sapiens
acuucaucaaucaa

SEQ ID NO: 2175105 - RNA, 13 nt, Homo sapiens
auguagcacuuac

SEQ ID NO: 2175106 - RNA, 15 nt, Homo sapiens
ccaaacaggagaccc

SEQ ID NO: 2175107 - RNA, 17 nt, Homo sapiens
ccucagcaccugggacc

SEQ ID NO: 2175108 - RNA, 12 nt, Homo sapiens
cucccauagcaa

SEQ ID NO: 2175109 - RNA, 17 nt, Homo sapiens
aagcacauaugugccaa

SEQ ID NO: 2175110 - RNA, 15 nt, Homo sapiens
uaccauacauuauca

SEQ ID NO: 2175111 - RNA, 20 nt, Homo sapiens
ccagaacccauuugaggggu

SEQ ID NO: 2175112 - RNA, 22 nt, Homo sapiens
uucuuguguugugugaucuuga

SEQ ID NO: 2175113 - RNA, 21 nt, Homo sapiens
ccugagauccggcaacaucaa

SEQ ID NO: 2175114 - RNA, 17 nt, Homo sapiens
aaaagaugguugccaag

SEQ ID NO: 2175115 - RNA, 23 nt, Homo sapiens
aguggcugcacaggcacugugca

SEQ ID NO: 2175116 - RNA, 12 nt, Homo sapiens
ugccacuuucca

SEQ ID NO: 2175117 - RNA, 12 nt, Homo sapiens
ucucacuuugua

SEQ ID NO: 2175118 - RNA, 15 nt, Homo sapiens
ugcuacaacauguga

SEQ ID NO: 2175119 - RNA, 15 nt, Homo sapiens
uuuccucuaacucau

SEQ ID NO: 2175120 - RNA, 20 nt, Homo sapiens
guguaugucuauuugcacaa

SEQ ID NO: 2175121 - RNA, 13 nt, Homo sapiens
guuccccucugcu

SEQ ID NO: 2175122 - RNA, 20 nt, Homo sapiens
guacugccaauacugccaac

SEQ ID NO: 2175123 - RNA, 17 nt, Homo sapiens
aggcaccucaagaagaa

SEQ ID NO: 2175124 - RNA, 19 nt, Homo sapiens
agcacugaaccacauucag

SEQ ID NO: 2175125 - RNA, 14 nt, Homo sapiens
guuacugucuucag

SEQ ID NO: 2175126 - RNA, 19 nt, Homo sapiens
gaaauccgggucaagugaa

SEQ ID NO: 2175127 - RNA, 12 nt, Homo sapiens
caguuauagaaa

SEQ ID NO: 2175128 - RNA, 12 nt, Homo sapiens
gagagggggcca

SEQ ID NO: 2175129 - RNA, 19 nt, Homo sapiens
ucuccacugggaccugacu

SEQ ID NO: 2175130 - RNA, 13 nt, Homo sapiens
augcuucuugccc

SEQ ID NO: 2175131 - RNA, 16 nt, Homo sapiens
ugaaguucaucuugca

SEQ ID NO: 2175132 - RNA, 21 nt, Homo sapiens
ugguagguucugucugugcca

SEQ ID NO: 2175133 - RNA, 23 nt, Homo sapiens
cucacuuuucccagggcaugcug

SEQ ID NO: 2175134 - RNA, 18 nt, Homo sapiens
uacaguucauaauucacc

SEQ ID NO: 2175135 - RNA, 15 nt, Homo sapiens
cacaaauaaaagcca

SEQ ID NO: 2175136 - RNA, 18 nt, Homo sapiens
agcccugugucugucaca

SEQ ID NO: 2175137 - RNA, 13 nt, Homo sapiens
uaaagcauuucag

SEQ ID NO: 2175138 - RNA, 13 nt, Homo sapiens
uaaaucauuucau

SEQ ID NO: 2175139 - RNA, 22 nt, Homo sapiens
uaacuuacugcgacuaaacuua

SEQ ID NO: 2175140 - RNA, 22 nt, Homo sapiens
uucaagcaaaucuccugccuca

SEQ ID NO: 2175141 - RNA, 16 nt, Homo sapiens
cuuuuccuuucugcca

SEQ ID NO: 2175142 - RNA, 18 nt, Homo sapiens
ccugucuuagacuuugaa

SEQ ID NO: 2175143 - RNA, 13 nt, Homo sapiens
caacccaaacugu

SEQ ID NO: 2175144 - RNA, 19 nt, Homo sapiens
cuuucuggaauugggcucc

SEQ ID NO: 2175145 - RNA, 18 nt, Homo sapiens
uaggcuguucuguagcuu

SEQ ID NO: 2175146 - RNA, 21 nt, Homo sapiens
uaauuuaucuugucucugggc

SEQ ID NO: 2175147 - RNA, 17 nt, Homo sapiens
gccuccuagagugcagg

SEQ ID NO: 2175148 - RNA, 13 nt, Homo sapiens
cuucccagaccag

SEQ ID NO: 2175149 - RNA, 14 nt, Homo sapiens
aacuucagacugaa

SEQ ID NO: 2175150 - RNA, 17 nt, Homo sapiens
uucaauugcaucuccca

SEQ ID NO: 2175151 - RNA, 14 nt, Homo sapiens
uaugagcaugccaa

SEQ ID NO: 2175152 - RNA, 16 nt, Homo sapiens
ugguugaugccaaaaa

SEQ ID NO: 2175153 - RNA, 18 nt, Homo sapiens
gcaagaucccaucucuuu

SEQ ID NO: 2175154 - RNA, 20 nt, Homo sapiens
gucuguguuuacagacagaa

SEQ ID NO: 2175155 - RNA, 19 nt, Homo sapiens
agccuccccgugccaaaaa

SEQ ID NO: 2175156 - RNA, 20 nt, Homo sapiens
gcagucugccugccucgggg

SEQ ID NO: 2175157 - RNA, 11 nt, Homo sapiens
cggcacccaca

SEQ ID NO: 2175158 - RNA, 16 nt, Homo sapiens
ugcugucaacuuccca

SEQ ID NO: 2175159 - RNA, 17 nt, Homo sapiens
cucuauaagauuccaaa

SEQ ID NO: 2175160 - RNA, 19 nt, Homo sapiens
uggguggcucugauugcuu

SEQ ID NO: 2175161 - RNA, 16 nt, Homo sapiens
gacaggagccacaggg

SEQ ID NO: 2175162 - RNA, 18 nt, Homo sapiens
auuggauuauuacuacaa

SEQ ID NO: 2175163 - RNA, 23 nt, Homo sapiens
uagugucuugaauguaagaacau

SEQ ID NO: 2175164 - RNA, 17 nt, Homo sapiens
aguuaucaacaugcaca

SEQ ID NO: 2175165 - RNA, 19 nt, Homo sapiens
cauucuuuuucuguugaaa

SEQ ID NO: 2175166 - RNA, 20 nt, Homo sapiens
agcacuugagaaccagucuc

SEQ ID NO: 2175167 - RNA, 20 nt, Homo sapiens
acuuggauugggagauuuca

SEQ ID NO: 2175168 - RNA, 16 nt, Homo sapiens
uuuggaauacauuucu

SEQ ID NO: 2175169 - RNA, 21 nt, Homo sapiens
uucccaagguacagcuguaua

SEQ ID NO: 2175170 - RNA, 16 nt, Homo sapiens
aagggggcugcugcuc

SEQ ID NO: 2175171 - RNA, 17 nt, Homo sapiens
gaguauacaugacugca

SEQ ID NO: 2175172 - RNA, 21 nt, Homo sapiens
cacagcaagucacuggccagu

SEQ ID NO: 2175173 - RNA, 16 nt, Homo sapiens
cuucagaugaccucaa

SEQ ID NO: 2175174 - RNA, 23 nt, Homo sapiens
guuacaaggguauccugugcuau

SEQ ID NO: 2175175 - RNA, 18 nt, Homo sapiens
agccagugagguucuuaa

SEQ ID NO: 2175176 - RNA, 18 nt, Homo sapiens
uacugcacucagauuuaa

SEQ ID NO: 2175177 - RNA, 18 nt, Homo sapiens
acgugucuccucacucua

SEQ ID NO: 2175178 - RNA, 14 nt, Homo sapiens
aaguaucugagauu

SEQ ID NO: 2175179 - RNA, 23 nt, Homo sapiens
cuucuagaaucucguuucuccuc

SEQ ID NO: 2175180 - RNA, 20 nt, Homo sapiens
cccaguaucucuucagucuc

SEQ ID NO: 2175181 - RNA, 14 nt, Homo sapiens
guagagaugugauu

SEQ ID NO: 2175182 - RNA, 17 nt, Homo sapiens
auaaaaauguuaggaua

SEQ ID NO: 2175183 - RNA, 16 nt, Homo sapiens
ucccacaggcccuucc

SEQ ID NO: 2175184 - RNA, 19 nt, Homo sapiens
cagugcaguccauuuccua

SEQ ID NO: 2175185 - RNA, 22 nt, Homo sapiens
cauauccaaguuugaauuccua

SEQ ID NO: 2175186 - RNA, 14 nt, Homo sapiens
gaguucuguucauc

SEQ ID NO: 2175187 - RNA, 19 nt, Homo sapiens
aaauacuuuauagcacaug

SEQ ID NO: 2175188 - RNA, 22 nt, Homo sapiens
gcagccugugggagaagggaca

SEQ ID NO: 2175189 - RNA, 22 nt, Homo sapiens
gugacuuugagcugagugcuga

SEQ ID NO: 2175190 - RNA, 13 nt, Homo sapiens
ucauagugccuuu

SEQ ID NO: 2175191 - RNA, 19 nt, Homo sapiens
ucccagggacccagggagg

SEQ ID NO: 2175192 - RNA, 18 nt, Homo sapiens
acuuucauucaauuugcg

SEQ ID NO: 2175193 - RNA, 20 nt, Homo sapiens
uaaacuaagagaaacugugu

SEQ ID NO: 2175194 - RNA, 18 nt, Homo sapiens
ccuuaagggguaucaugu

SEQ ID NO: 2175195 - RNA, 14 nt, Homo sapiens
gugagaugcagcug

SEQ ID NO: 2175196 - RNA, 14 nt, Homo sapiens
aaugcaauuuccaa

SEQ ID NO: 2175197 - RNA, 13 nt, Homo sapiens
ccguuuucugggc

SEQ ID NO: 2175198 - RNA, 18 nt, Homo sapiens
uuagauagcccugaauuc

SEQ ID NO: 2175199 - RNA, 17 nt, Homo sapiens
ucagcaaacccaaagau

SEQ ID NO: 2175200 - RNA, 12 nt, Homo sapiens
gugucacaaagc

SEQ ID NO: 2175201 - RNA, 12 nt, Homo sapiens
aucgaagcagau

SEQ ID NO: 2175202 - RNA, 18 nt, Homo sapiens
gagagcucuuugugaaug

SEQ ID NO: 2175203 - RNA, 18 nt, Homo sapiens
aguacugucccaggaaua

SEQ ID NO: 2175204 - RNA, 13 nt, Homo sapiens
augcaagacccca

SEQ ID NO: 2175205 - RNA, 20 nt, Homo sapiens
gcaaguuagaacuagccaaa

SEQ ID NO: 2175206 - RNA, 13 nt, Homo sapiens
auuuaauacuaau

SEQ ID NO: 2175207 - RNA, 20 nt, Homo sapiens
aauuuuuaaaacccauuuaa

SEQ ID NO: 2175208 - RNA, 15 nt, Homo sapiens
acauuuugcauuaga

SEQ ID NO: 2175209 - RNA, 16 nt, Homo sapiens
cucaggccagugccag

SEQ ID NO: 2175210 - RNA, 18 nt, Homo sapiens
uagugaaguugugcaacg

SEQ ID NO: 2175211 - RNA, 12 nt, Homo sapiens
uaaauguuauag

SEQ ID NO: 2175212 - RNA, 15 nt, Homo sapiens
ucugaaaaaugccug

SEQ ID NO: 2175213 - RNA, 21 nt, Homo sapiens
gaaagcaaggcagaaggccag

SEQ ID NO: 2175214 - RNA, 21 nt, Homo sapiens
aaguucuuaaaaaauuuauac

SEQ ID NO: 2175215 - RNA, 22 nt, Homo sapiens
acugguccaggccaggccucau

SEQ ID NO: 2175216 - RNA, 12 nt, Homo sapiens
gccugcaggacc

SEQ ID NO: 2175217 - RNA, 18 nt, Homo sapiens
cugucuggaagacauguc

SEQ ID NO: 2175218 - RNA, 19 nt, Homo sapiens
agguuucacuguucaugaa

SEQ ID NO: 2175219 - RNA, 22 nt, Homo sapiens
auguuaguauuuuaauccugua

SEQ ID NO: 2175220 - RNA, 12 nt, Homo sapiens
accacuggguac

SEQ ID NO: 2175221 - RNA, 16 nt, Homo sapiens
auuucuccuccauggg

SEQ ID NO: 2175222 - RNA, 13 nt, Homo sapiens
aaagcaucaucug

SEQ ID NO: 2175223 - RNA, 14 nt, Homo sapiens
augaggcuucucag

SEQ ID NO: 2175224 - RNA, 21 nt, Homo sapiens
ucuuauucuuucuaaacuaca

SEQ ID NO: 2175225 - RNA, 14 nt, Homo sapiens
aagcauuuuuccau

SEQ ID NO: 2175226 - RNA, 22 nt, Homo sapiens
ggucuuauuauauuguccaggc

SEQ ID NO: 2175227 - RNA, 16 nt, Homo sapiens
gcagacacagguguag

SEQ ID NO: 2175228 - RNA, 14 nt, Homo sapiens
cuaauguacuuuca

SEQ ID NO: 2175229 - RNA, 11 nt, Homo sapiens
cucaugccacu

SEQ ID NO: 2175230 - RNA, 18 nt, Homo sapiens
cagaaucacagcccucau

SEQ ID NO: 2175231 - RNA, 21 nt, Homo sapiens
ccuuccuuuaggucugguugu

SEQ ID NO: 2175232 - RNA, 15 nt, Homo sapiens
auuauaccgcuauca

SEQ ID NO: 2175233 - RNA, 14 nt, Homo sapiens
acagcaagagccac

SEQ ID NO: 2175234 - RNA, 21 nt, Homo sapiens
cuauggcccagccacugcagc

SEQ ID NO: 2175235 - RNA, 17 nt, Homo sapiens
auuaccauauaauguaa

SEQ ID NO: 2175236 - RNA, 22 nt, Homo sapiens
gccauuuuaaggaaaacuaccu

SEQ ID NO: 2175237 - RNA, 23 nt, Homo sapiens
cucuaauuuuggauaauauucau

SEQ ID NO: 2175238 - RNA, 13 nt, Homo sapiens
ggauucuaaggaa

SEQ ID NO: 2175239 - RNA, 13 nt, Homo sapiens
cuucuguaaaggu

SEQ ID NO: 2175240 - RNA, 17 nt, Homo sapiens
cacaauauuccuaugcu

SEQ ID NO: 2175241 - RNA, 13 nt, Homo sapiens
acagaaaauggaa

SEQ ID NO: 2175242 - RNA, 23 nt, Homo sapiens
gaggucaggaguucgaaaccagc

SEQ ID NO: 2175243 - RNA, 19 nt, Homo sapiens
cauugaucugcauccaagg

SEQ ID NO: 2175244 - RNA, 17 nt, Homo sapiens
cucacuauugaugcauu

SEQ ID NO: 2175245 - RNA, 21 nt, Homo sapiens
gaggcccucaccagaagcaga

SEQ ID NO: 2175246 - RNA, 20 nt, Homo sapiens
cugcaucaagaugugacaug

SEQ ID NO: 2175247 - RNA, 15 nt, Homo sapiens
cugacccaaaugaau

SEQ ID NO: 2175248 - RNA, 21 nt, Homo sapiens
guuuguaauaauaaaaccaaa

SEQ ID NO: 2175249 - RNA, 18 nt, Homo sapiens
cuguacacugacuugaga

SEQ ID NO: 2175250 - RNA, 20 nt, Homo sapiens
agguuuccucuuagguguua

SEQ ID NO: 2175251 - RNA, 19 nt, Homo sapiens
aaaaucaggagccugcuaa

SEQ ID NO: 2175252 - RNA, 19 nt, Homo sapiens
gaccccagaggauugcugc

SEQ ID NO: 2175253 - RNA, 14 nt, Homo sapiens
gugacagucuugca

SEQ ID NO: 2175254 - RNA, 23 nt, Homo sapiens
ugaauccaaaagaaaaacagcca

SEQ ID NO: 2175255 - RNA, 15 nt, Homo sapiens
gaacacaucucuuag

SEQ ID NO: 2175256 - RNA, 14 nt, Homo sapiens
gauaccacugcacu

SEQ ID NO: 2175257 - RNA, 13 nt, Homo sapiens
cuaaaaauacaaa

SEQ ID NO: 2175258 - RNA, 12 nt, Homo sapiens
ucauccuuccau

SEQ ID NO: 2175259 - RNA, 21 nt, Homo sapiens
gauuacugccauucacuucau

SEQ ID NO: 2175260 - RNA, 14 nt, Homo sapiens
augcccagacaaaa

SEQ ID NO: 2175261 - RNA, 20 nt, Homo sapiens
cugcauuggccuggccucca

SEQ ID NO: 2175262 - RNA, 17 nt, Homo sapiens
ugaggugccacccagua

SEQ ID NO: 2175263 - RNA, 16 nt, Homo sapiens
ccacacggucuucaca

SEQ ID NO: 2175264 - RNA, 20 nt, Homo sapiens
uuaaaugcuuuuaaaucugc

SEQ ID NO: 2175265 - RNA, 20 nt, Homo sapiens
uucuuagcugaugucuuugg

SEQ ID NO: 2175266 - RNA, 21 nt, Homo sapiens
uuaagguccuaaauucuuaac

SEQ ID NO: 2175267 - RNA, 18 nt, Homo sapiens
accugcuucagagcucaa

SEQ ID NO: 2175268 - RNA, 16 nt, Homo sapiens
acacauggaugcacgc

SEQ ID NO: 2175269 - RNA, 20 nt, Homo sapiens
aguuuuauuuugggccuguu

SEQ ID NO: 2175270 - RNA, 15 nt, Homo sapiens
aagaauguuuaugaa

SEQ ID NO: 2175271 - RNA, 21 nt, Homo sapiens
ccacaacuaauaggaccucaa

SEQ ID NO: 2175272 - RNA, 18 nt, Homo sapiens
cauaccuaaguacuguaa

SEQ ID NO: 2175273 - RNA, 17 nt, Homo sapiens
ugcaaacuaugcaucug

SEQ ID NO: 2175274 - RNA, 15 nt, Homo sapiens
ggcacaguccaggaa

SEQ ID NO: 2175275 - RNA, 22 nt, Homo sapiens
ucuuuuaaagaaauaaccacug

SEQ ID NO: 2175276 - RNA, 15 nt, Homo sapiens
aacagugagccaaau

SEQ ID NO: 2175277 - RNA, 13 nt, Homo sapiens
gauguuauauuaa

SEQ ID NO: 2175278 - RNA, 14 nt, Homo sapiens
ugcagccagcauua

SEQ ID NO: 2175279 - RNA, 22 nt, Homo sapiens
cagacgcguuggcacaguucau

SEQ ID NO: 2175280 - RNA, 14 nt, Homo sapiens
uguguguacaacac

SEQ ID NO: 2175281 - RNA, 23 nt, Homo sapiens
cucaauaaaguacaagagcuuaa

SEQ ID NO: 2175282 - RNA, 17 nt, Homo sapiens
ccuuauagagagcccaa

SEQ ID NO: 2175283 - RNA, 16 nt, Homo sapiens
ucccugaaguauuuaa

SEQ ID NO: 2175284 - RNA, 21 nt, Homo sapiens
uuugauguuuuguacuuacau

SEQ ID NO: 2175285 - RNA, 16 nt, Homo sapiens
cugaccauuuggucag

SEQ ID NO: 2175286 - RNA, 18 nt, Homo sapiens
acagcacagggaagcaaa

SEQ ID NO: 2175287 - RNA, 20 nt, Homo sapiens
agaucugugggcccagucau

SEQ ID NO: 2175288 - RNA, 16 nt, Homo sapiens
agacaauagcccaaag

SEQ ID NO: 2175289 - RNA, 12 nt, Homo sapiens
aagcaauguggu

SEQ ID NO: 2175290 - RNA, 22 nt, Homo sapiens
acauaguucuuacuacuugcca

SEQ ID NO: 2175291 - RNA, 19 nt, Homo sapiens
cuccuggugucaccccaga

SEQ ID NO: 2175292 - RNA, 16 nt, Homo sapiens
ggagauggacaacuca

SEQ ID NO: 2175293 - RNA, 20 nt, Homo sapiens
ccagcguagucaagggugga

SEQ ID NO: 2175294 - RNA, 22 nt, Homo sapiens
agggggcaagaaguagcagugu

SEQ ID NO: 2175295 - RNA, 14 nt, Homo sapiens
aauaguaggucucc

SEQ ID NO: 2175296 - RNA, 21 nt, Homo sapiens
ccgcucccgcgggaagccagc

SEQ ID NO: 2175297 - RNA, 13 nt, Homo sapiens
acauagcauccaa

SEQ ID NO: 2175298 - RNA, 23 nt, Homo sapiens
gcguggaacucgugucuggcaca

SEQ ID NO: 2175299 - RNA, 15 nt, Homo sapiens
uggaauuuguucaag

SEQ ID NO: 2175300 - RNA, 21 nt, Homo sapiens
acauguuuauauuuggcucuc

SEQ ID NO: 2175301 - RNA, 19 nt, Homo sapiens
uaacugcuucuuggagcuu

SEQ ID NO: 2175302 - RNA, 15 nt, Homo sapiens
cuccaccacgcuggg

SEQ ID NO: 2175303 - RNA, 18 nt, Homo sapiens
gcccucugaacuugccuu

SEQ ID NO: 2175304 - RNA, 14 nt, Homo sapiens
gacaggaggccaug

SEQ ID NO: 2175305 - RNA, 16 nt, Homo sapiens
gagaucguuguuuaca

SEQ ID NO: 2175306 - RNA, 14 nt, Homo sapiens
gcuuggagaacuca

SEQ ID NO: 2175307 - RNA, 21 nt, Homo sapiens
uacccacauguacagacauac

SEQ ID NO: 2175308 - RNA, 15 nt, Homo sapiens
uugguggggggucca

SEQ ID NO: 2175309 - RNA, 22 nt, Homo sapiens
acaugggugaacuuacuugcau

SEQ ID NO: 2175310 - RNA, 19 nt, Homo sapiens
augggguugguguucucau

SEQ ID NO: 2175311 - RNA, 22 nt, Homo sapiens
guucacaccagagaaccaggcu

SEQ ID NO: 2175312 - RNA, 22 nt, Homo sapiens
uccgcugccuggaacaccagca

SEQ ID NO: 2175313 - RNA, 23 nt, Homo sapiens
aaccuggagggcuagaaccugga

SEQ ID NO: 2175314 - RNA, 17 nt, Homo sapiens
agcccugccaugucaca

SEQ ID NO: 2175315 - RNA, 20 nt, Homo sapiens
cacuuuaugccggaugugcu

SEQ ID NO: 2175316 - RNA, 15 nt, Homo sapiens
accaagcuuguccaa

SEQ ID NO: 2175317 - RNA, 16 nt, Homo sapiens
ucaucacuaccuuuau

SEQ ID NO: 2175318 - RNA, 12 nt, Homo sapiens
guuauuugcucu

SEQ ID NO: 2175319 - RNA, 18 nt, Homo sapiens
uaaucauuuuaagugcau

SEQ ID NO: 2175320 - RNA, 17 nt, Homo sapiens
ucuugaaccugugcuca

SEQ ID NO: 2175321 - RNA, 18 nt, Homo sapiens
auuuugcuugcugaagga

SEQ ID NO: 2175322 - RNA, 15 nt, Homo sapiens
gaagcugcuagggga

SEQ ID NO: 2175323 - RNA, 18 nt, Homo sapiens
accucauggauugccaca

SEQ ID NO: 2175324 - RNA, 15 nt, Homo sapiens
auuucuagguaggaa

SEQ ID NO: 2175325 - RNA, 20 nt, Homo sapiens
ucuacaaaaugccaagggug

SEQ ID NO: 2175326 - RNA, 22 nt, Homo sapiens
ugggaugaaggcuugucagcac

SEQ ID NO: 2175327 - RNA, 18 nt, Homo sapiens
aaauuauucuagucaacu

SEQ ID NO: 2175328 - RNA, 13 nt, Homo sapiens
ccuauauuuagcc

SEQ ID NO: 2175329 - RNA, 14 nt, Homo sapiens
gcuucccagaggga

SEQ ID NO: 2175330 - RNA, 23 nt, Homo sapiens
cuuggcuggugugguacagagaa

SEQ ID NO: 2175331 - RNA, 14 nt, Homo sapiens
accagcucaugugu

SEQ ID NO: 2175332 - RNA, 19 nt, Homo sapiens
auuacgugcaauacuucaa

SEQ ID NO: 2175333 - RNA, 17 nt, Homo sapiens
agccauuuccauggcuc

SEQ ID NO: 2175334 - RNA, 16 nt, Homo sapiens
ucagucaugcacucac

SEQ ID NO: 2175335 - RNA, 17 nt, Homo sapiens
agugccaaggaccuccu

SEQ ID NO: 2175336 - RNA, 15 nt, Homo sapiens
auggaaaaugucaac

SEQ ID NO: 2175337 - RNA, 20 nt, Homo sapiens
agaccuggagcaauaaaaga

SEQ ID NO: 2175338 - RNA, 13 nt, Homo sapiens
aguuagauucacu

SEQ ID NO: 2175339 - RNA, 14 nt, Homo sapiens
aaguauuacaugau

SEQ ID NO: 2175340 - RNA, 21 nt, Homo sapiens
guagugcaccaucucacugca

SEQ ID NO: 2175341 - RNA, 20 nt, Homo sapiens
aggacuauggacuuggcugu

SEQ ID NO: 2175342 - RNA, 14 nt, Homo sapiens
acuuccauuugcuu

SEQ ID NO: 2175343 - RNA, 22 nt, Homo sapiens
cuccccauucacagagccuuuu

SEQ ID NO: 2175344 - RNA, 23 nt, Homo sapiens
uaguugaucuacaaaggccaugg

SEQ ID NO: 2175345 - RNA, 23 nt, Homo sapiens
uuucagaagccccauuugcacag

SEQ ID NO: 2175346 - RNA, 20 nt, Homo sapiens
augaaaugucuggucugucc

SEQ ID NO: 2175347 - RNA, 15 nt, Homo sapiens
ucuggcccaguuaau

SEQ ID NO: 2175348 - RNA, 17 nt, Homo sapiens
auucuaaguagaguaua

SEQ ID NO: 2175349 - RNA, 23 nt, Homo sapiens
agcaguuuacuuuagacuaaaga

SEQ ID NO: 2175350 - RNA, 18 nt, Homo sapiens
guuuucaaaagauggcuu

SEQ ID NO: 2175351 - RNA, 16 nt, Homo sapiens
uucugaagacugagaa

SEQ ID NO: 2175352 - RNA, 22 nt, Homo sapiens
auauuuuuguacugaaucucau

SEQ ID NO: 2175353 - RNA, 13 nt, Homo sapiens
aagaaugaucagc

SEQ ID NO: 2175354 - RNA, 23 nt, Homo sapiens
cuaggggcuugguccuagggugg

SEQ ID NO: 2175355 - RNA, 21 nt, Homo sapiens
agcaaaagugcaguaguguca

SEQ ID NO: 2175356 - RNA, 18 nt, Homo sapiens
gccaaaggaugugauaua

SEQ ID NO: 2175357 - RNA, 15 nt, Homo sapiens
cccuggcagcugccc

SEQ ID NO: 2175358 - RNA, 17 nt, Homo sapiens
cacagucucugggagac

SEQ ID NO: 2175359 - RNA, 20 nt, Homo sapiens
ggcuccugccacugaccuca

SEQ ID NO: 2175360 - RNA, 22 nt, Homo sapiens
uuuguaucauguuuuacuacau

SEQ ID NO: 2175361 - RNA, 15 nt, Homo sapiens
gacagagcgagacuu

SEQ ID NO: 2175362 - RNA, 16 nt, Homo sapiens
caugauaaaugauaga

SEQ ID NO: 2175363 - RNA, 11 nt, Homo sapiens
gaaagcacuua

SEQ ID NO: 2175364 - RNA, 11 nt, Homo sapiens
gugagcacuag

SEQ ID NO: 2175365 - RNA, 13 nt, Homo sapiens
gcuugagccuuug

SEQ ID NO: 2175366 - RNA, 13 nt, Homo sapiens
gccuuagccucuu

SEQ ID NO: 2175367 - RNA, 19 nt, Homo sapiens
uucccuaugcuacccuuaa

SEQ ID NO: 2175368 - RNA, 17 nt, Homo sapiens
gauuugggcucuuggaa

SEQ ID NO: 2175369 - RNA, 18 nt, Homo sapiens
auauucauuucaaaggga

SEQ ID NO: 2175370 - RNA, 18 nt, Homo sapiens
guaccaccaugcacugua

SEQ ID NO: 2175371 - RNA, 16 nt, Homo sapiens
ggacgggguccaggag

SEQ ID NO: 2175372 - RNA, 16 nt, Homo sapiens
agugugucacacugag

SEQ ID NO: 2175373 - RNA, 19 nt, Homo sapiens
gcucucggaggaugccuag

SEQ ID NO: 2175374 - RNA, 16 nt, Homo sapiens
uagugcuuucuuguca

SEQ ID NO: 2175375 - RNA, 13 nt, Homo sapiens
guauccugcagcg

SEQ ID NO: 2175376 - RNA, 15 nt, Homo sapiens
aguuggagucacucu

SEQ ID NO: 2175377 - RNA, 22 nt, Homo sapiens
cagccuccgccaagaucuacag

SEQ ID NO: 2175378 - RNA, 18 nt, Homo sapiens
cugcguccccacucccuu

SEQ ID NO: 2175379 - RNA, 23 nt, Homo sapiens
cacuauccuggcaacucaaggcu

SEQ ID NO: 2175380 - RNA, 18 nt, Homo sapiens
gggcguggagagcccggc

SEQ ID NO: 2175381 - RNA, 21 nt, Homo sapiens
gcguuguuacaggaagucccu

SEQ ID NO: 2175382 - RNA, 18 nt, Homo sapiens
gccugacugccaagccau

SEQ ID NO: 2175383 - RNA, 17 nt, Homo sapiens
cccugaggguggcugcc

SEQ ID NO: 2175384 - RNA, 18 nt, Homo sapiens
aaguuaucaacaugcaca

SEQ ID NO: 2175385 - RNA, 22 nt, Homo sapiens
cacaaggucauggccacacugu

SEQ ID NO: 2175386 - RNA, 13 nt, Homo sapiens
uuaaauccuaaaa

SEQ ID NO: 2175387 - RNA, 13 nt, Homo sapiens
auuuguccaauug

SEQ ID NO: 2175388 - RNA, 13 nt, Homo sapiens
aaaacuccauaac

SEQ ID NO: 2175389 - RNA, 13 nt, Homo sapiens
uugguguacugug

SEQ ID NO: 2175390 - RNA, 17 nt, Homo sapiens
gauccacaaaaacaacu

SEQ ID NO: 2175391 - RNA, 18 nt, Homo sapiens
augguggcaggaaaaugg

SEQ ID NO: 2175392 - RNA, 24 nt, Homo sapiens
gcaccauggacauguguacauuga

SEQ ID NO: 2175393 - RNA, 16 nt, Homo sapiens
uaacagacuuguuuaa

SEQ ID NO: 2175394 - RNA, 19 nt, Homo sapiens
aagcucuuuaugacuguuu

SEQ ID NO: 2175395 - RNA, 23 nt, Homo sapiens
ucaaacaugaaguguguuuccuu

SEQ ID NO: 2175396 - RNA, 16 nt, Homo sapiens
cuguucccaucccuga

SEQ ID NO: 2175397 - RNA, 20 nt, Homo sapiens
aggauacugaggcacacaga

SEQ ID NO: 2175398 - RNA, 12 nt, Homo sapiens
uauuguacauaa

SEQ ID NO: 2175399 - RNA, 16 nt, Homo sapiens
ucugaaacugcauaag

SEQ ID NO: 2175400 - RNA, 14 nt, Homo sapiens
cuugaaaccaaaga

SEQ ID NO: 2175401 - RNA, 20 nt, Homo sapiens
aauugacuuauacucuugag

SEQ ID NO: 2175402 - RNA, 16 nt, Homo sapiens
uguuugagaaagucag

SEQ ID NO: 2175403 - RNA, 17 nt, Homo sapiens
accauccauucuccuca

SEQ ID NO: 2175404 - RNA, 23 nt, Homo sapiens
ucaagagagcucguuccuaccug

SEQ ID NO: 2175405 - RNA, 22 nt, Homo sapiens
uucuuaaaguuuagaggcuaac

SEQ ID NO: 2175406 - RNA, 12 nt, Homo sapiens
agcaacauacca

SEQ ID NO: 2175407 - RNA, 13 nt, Homo sapiens
cuucaaguggcag

SEQ ID NO: 2175408 - RNA, 22 nt, Homo sapiens
gaagcuaauguaggacuguaua

SEQ ID NO: 2175409 - RNA, 22 nt, Homo sapiens
cccugcuugaacacugaagggc

SEQ ID NO: 2175410 - RNA, 17 nt, Homo sapiens
gucuuauaaacaaauga

SEQ ID NO: 2175411 - RNA, 23 nt, Homo sapiens
ucgguucugcgccacuuccuuug

SEQ ID NO: 2175412 - RNA, 14 nt, Homo sapiens
aaauugagugguuu

SEQ ID NO: 2175413 - RNA, 12 nt, Homo sapiens
aaguauuuccaa

SEQ ID NO: 2175414 - RNA, 16 nt, Homo sapiens
ggaaaaauccugucau

SEQ ID NO: 2175415 - RNA, 22 nt, Homo sapiens
augauccuaaugaaugcauaaa

SEQ ID NO: 2175416 - RNA, 13 nt, Homo sapiens
guagcagucuuca

SEQ ID NO: 2175417 - RNA, 23 nt, Homo sapiens
accaugaaacauuguagguauau

SEQ ID NO: 2175418 - RNA, 22 nt, Homo sapiens
guuucagaagcugcagcugguc

SEQ ID NO: 2175419 - RNA, 22 nt, Homo sapiens
cauuuuucacuuugcucucaau

SEQ ID NO: 2175420 - RNA, 13 nt, Homo sapiens
augaaaaugcagu

SEQ ID NO: 2175421 - RNA, 15 nt, Homo sapiens
uguacugugcugauu

SEQ ID NO: 2175422 - RNA, 12 nt, Homo sapiens
ucagcagcaucg

SEQ ID NO: 2175423 - RNA, 14 nt, Homo sapiens
ucccaaacucccag

SEQ ID NO: 2175424 - RNA, 21 nt, Homo sapiens
uguuuguaacuuuuuacauua

SEQ ID NO: 2175425 - RNA, 13 nt, Homo sapiens
cccuuuccacgaa

SEQ ID NO: 2175426 - RNA, 22 nt, Homo sapiens
cugaaaagugaagacagaacca

SEQ ID NO: 2175427 - RNA, 18 nt, Homo sapiens
gaugcacagaugccaugg

SEQ ID NO: 2175428 - RNA, 19 nt, Homo sapiens
caucuagggaaugggacug

SEQ ID NO: 2175429 - RNA, 22 nt, Homo sapiens
acuaaaaugugucuugcuguca

SEQ ID NO: 2175430 - RNA, 11 nt, Homo sapiens
uucugugagaa

SEQ ID NO: 2175431 - RNA, 21 nt, Homo sapiens
gcgucucccccagagugcugu

SEQ ID NO: 2175432 - RNA, 14 nt, Homo sapiens
ccuguacacaggcg

SEQ ID NO: 2175433 - RNA, 18 nt, Homo sapiens
aggggacccauguaaucc

SEQ ID NO: 2175434 - RNA, 12 nt, Homo sapiens
gaauuacuuuau

SEQ ID NO: 2175435 - RNA, 16 nt, Homo sapiens
cccuggugucaggcag

SEQ ID NO: 2175436 - RNA, 15 nt, Homo sapiens
cuaaauaaugcaaac

SEQ ID NO: 2175437 - RNA, 22 nt, Homo sapiens
ucccuagauagcuauuaagaua

SEQ ID NO: 2175438 - RNA, 15 nt, Homo sapiens
ucuuaacuuugaacc

SEQ ID NO: 2175439 - RNA, 19 nt, Homo sapiens
ugaaaucgcugcucaaaaa

SEQ ID NO: 2175440 - RNA, 19 nt, Homo sapiens
gggcaauuuuuguauccaa

SEQ ID NO: 2175441 - RNA, 20 nt, Homo sapiens
caagacauuugcugaacuca

SEQ ID NO: 2175442 - RNA, 20 nt, Homo sapiens
cagccugggcaacgagugaa

SEQ ID NO: 2175443 - RNA, 15 nt, Homo sapiens
ucaucgucaucauca

SEQ ID NO: 2175444 - RNA, 13 nt, Homo sapiens
cuaaacuucucac

SEQ ID NO: 2175445 - RNA, 23 nt, Homo sapiens
cuaaauuuauauucauaaaguua

SEQ ID NO: 2175446 - RNA, 19 nt, Homo sapiens
ccugcuccaucaugcuuga

SEQ ID NO: 2175447 - RNA, 20 nt, Homo sapiens
uggcauguggguugugauau

SEQ ID NO: 2175448 - RNA, 19 nt, Homo sapiens
caugagaccacuguuauca

SEQ ID NO: 2175449 - RNA, 23 nt, Homo sapiens
cacggcuccuccuuaugacucca

SEQ ID NO: 2175450 - RNA, 22 nt, Homo sapiens
ugagucagacacgauugagaac

SEQ ID NO: 2175451 - RNA, 14 nt, Homo sapiens
agagggaugcagug

SEQ ID NO: 2175452 - RNA, 16 nt, Homo sapiens
uuaaacagauguccau

SEQ ID NO: 2175453 - RNA, 14 nt, Homo sapiens
gcacuugucuuuga

SEQ ID NO: 2175454 - RNA, 22 nt, Homo sapiens
aggcuacuguucuugacaauca

SEQ ID NO: 2175455 - RNA, 21 nt, Homo sapiens
uccucugacagaagaacccca

SEQ ID NO: 2175456 - RNA, 18 nt, Homo sapiens
caugcuuauuccaugacu

SEQ ID NO: 2175457 - RNA, 16 nt, Homo sapiens
uacuguauuucauuau

SEQ ID NO: 2175458 - RNA, 15 nt, Homo sapiens
ucucauugccaguga

SEQ ID NO: 2175459 - RNA, 13 nt, Homo sapiens
uucuuaagacaug

SEQ ID NO: 2175460 - RNA, 15 nt, Homo sapiens
acucuagucaaugac

SEQ ID NO: 2175461 - RNA, 16 nt, Homo sapiens
cuucagagcucaagau

SEQ ID NO: 2175462 - RNA, 17 nt, Homo sapiens
ugcugguuucugccuuc

SEQ ID NO: 2175463 - RNA, 16 nt, Homo sapiens
aaaccaaaagaauuug

SEQ ID NO: 2175464 - RNA, 19 nt, Homo sapiens
gcacaagguaaauauucau

SEQ ID NO: 2175465 - RNA, 20 nt, Homo sapiens
uagaagccaguacagagaaa

SEQ ID NO: 2175466 - RNA, 18 nt, Homo sapiens
gucuugguuccucuacua

SEQ ID NO: 2175467 - RNA, 23 nt, Homo sapiens
uuccugagugcguggaucugggu

SEQ ID NO: 2175468 - RNA, 19 nt, Homo sapiens
uauuauugaagauuuacca

SEQ ID NO: 2175469 - RNA, 15 nt, Homo sapiens
acugagugcugaggu

SEQ ID NO: 2175470 - RNA, 20 nt, Homo sapiens
aauagugggaucaaagcuag

SEQ ID NO: 2175471 - RNA, 16 nt, Homo sapiens
ucaucacaaccuaaau

SEQ ID NO: 2175472 - RNA, 19 nt, Homo sapiens
cuagacgcccccaaauccu

SEQ ID NO: 2175473 - RNA, 18 nt, Homo sapiens
aauaccaaaauuauuuca

SEQ ID NO: 2175474 - RNA, 19 nt, Homo sapiens
cccccaugggcuguguccu

SEQ ID NO: 2175475 - RNA, 17 nt, Homo sapiens
gauaugacccacacugc

SEQ ID NO: 2175476 - RNA, 16 nt, Homo sapiens
gacuucagccagguga

SEQ ID NO: 2175477 - RNA, 17 nt, Homo sapiens
ugucuuuccuauuugca

SEQ ID NO: 2175478 - RNA, 19 nt, Homo sapiens
gaaaggagugacuuugcag

SEQ ID NO: 2175479 - RNA, 17 nt, Homo sapiens
uuugacaaauuacaaaa

SEQ ID NO: 2175480 - RNA, 19 nt, Homo sapiens
cauauauacccacauguac

SEQ ID NO: 2175481 - RNA, 15 nt, Homo sapiens
uaacuuguuuccaau

SEQ ID NO: 2175482 - RNA, 11 nt, Homo sapiens
caggaucucag

SEQ ID NO: 2175483 - RNA, 22 nt, Homo sapiens
gguccucccucccaaggagcca

SEQ ID NO: 2175484 - RNA, 13 nt, Homo sapiens
uuaaggcacagug

SEQ ID NO: 2175485 - RNA, 20 nt, Homo sapiens
aguguaguuaaggagccuaa

SEQ ID NO: 2175486 - RNA, 17 nt, Homo sapiens
acccaccuuucugcaca

SEQ ID NO: 2175487 - RNA, 21 nt, Homo sapiens
cauagugagacccugucucua

SEQ ID NO: 2175488 - RNA, 18 nt, Homo sapiens
uccugccacugaccucac

SEQ ID NO: 2175489 - RNA, 17 nt, Homo sapiens
aauaaacgucuugccac

SEQ ID NO: 2175490 - RNA, 19 nt, Homo sapiens
auccagucacagccauaca

SEQ ID NO: 2175491 - RNA, 17 nt, Homo sapiens
auccuccuaccucagcc

SEQ ID NO: 2175492 - RNA, 16 nt, Homo sapiens
ccugaccgguuugcua

SEQ ID NO: 2175493 - RNA, 15 nt, Homo sapiens
auguguuuggaagac

SEQ ID NO: 2175494 - RNA, 21 nt, Homo sapiens
uauccuuguagcaaagcacau

SEQ ID NO: 2175495 - RNA, 15 nt, Homo sapiens
cuucuauggggucua

SEQ ID NO: 2175496 - RNA, 13 nt, Homo sapiens
acaauuuucugua

SEQ ID NO: 2175497 - RNA, 10 nt, Homo sapiens
guagcucucc

SEQ ID NO: 2175498 - RNA, 12 nt, Homo sapiens
ccagcuacucag

SEQ ID NO: 2175499 - RNA, 13 nt, Homo sapiens
gcccugcucuuuc

SEQ ID NO: 2175500 - RNA, 22 nt, Homo sapiens
ggccucuuccuucguuccaggc

SEQ ID NO: 2175501 - RNA, 14 nt, Homo sapiens
ucgaguuuacuuca

SEQ ID NO: 2175502 - RNA, 19 nt, Homo sapiens
ugaaaaagucagcuacaaa

SEQ ID NO: 2175503 - RNA, 15 nt, Homo sapiens
cuccaaucaguguuu

SEQ ID NO: 2175504 - RNA, 23 nt, Homo sapiens
ccauaaugagaugugagccuugu

SEQ ID NO: 2175505 - RNA, 18 nt, Homo sapiens
uccggucccggcugacac

SEQ ID NO: 2175506 - RNA, 22 nt, Homo sapiens
auacacaaauuuccccucuaau

SEQ ID NO: 2175507 - RNA, 21 nt, Homo sapiens
cggggaggggaggaacaggga

SEQ ID NO: 2175508 - RNA, 15 nt, Homo sapiens
uguacagacauacau

SEQ ID NO: 2175509 - RNA, 14 nt, Homo sapiens
ccucaacaagaaga

SEQ ID NO: 2175510 - RNA, 17 nt, Homo sapiens
cauggaacagugcagga

SEQ ID NO: 2175511 - RNA, 12 nt, Homo sapiens
guacuacaguau

SEQ ID NO: 2175512 - RNA, 15 nt, Homo sapiens
uuucuuuagucuuua

SEQ ID NO: 2175513 - RNA, 17 nt, Homo sapiens
uaugaauuuuuucucaa

SEQ ID NO: 2175514 - RNA, 21 nt, Homo sapiens
aggcagugucuggaugaugcu

SEQ ID NO: 2175515 - RNA, 12 nt, Homo sapiens
ggggcagcacag

SEQ ID NO: 2175516 - RNA, 14 nt, Homo sapiens
aaccuaguacugcc

SEQ ID NO: 2175517 - RNA, 22 nt, Homo sapiens
uaaauuguuucucuuucugcau

SEQ ID NO: 2175518 - RNA, 16 nt, Homo sapiens
uauuuuaagcacucuu

SEQ ID NO: 2175519 - RNA, 14 nt, Homo sapiens
ccucuuauguauuu

SEQ ID NO: 2175520 - RNA, 18 nt, Homo sapiens
agcacuuucuucuuccca

SEQ ID NO: 2175521 - RNA, 20 nt, Homo sapiens
uuuuaucugguucuauauga

SEQ ID NO: 2175522 - RNA, 21 nt, Homo sapiens
aaaaagcccuuaaaaauaugu

SEQ ID NO: 2175523 - RNA, 13 nt, Homo sapiens
ccuuaaacugcca

SEQ ID NO: 2175524 - RNA, 21 nt, Homo sapiens
aagagaaacacuaauggccaa

SEQ ID NO: 2175525 - RNA, 16 nt, Homo sapiens
uaaugagagcucagac

SEQ ID NO: 2175526 - RNA, 20 nt, Homo sapiens
cagacuuuuaaagacuugca

SEQ ID NO: 2175527 - RNA, 20 nt, Homo sapiens
agaauguucuccuaaaagac

SEQ ID NO: 2175528 - RNA, 17 nt, Homo sapiens
auguauuuuccccucaa

SEQ ID NO: 2175529 - RNA, 20 nt, Homo sapiens
uuaagacgguuaaauacugu

SEQ ID NO: 2175530 - RNA, 14 nt, Homo sapiens
uuaaauaaauggaa

SEQ ID NO: 2175531 - RNA, 14 nt, Homo sapiens
cuuagccucuggau

SEQ ID NO: 2175532 - RNA, 16 nt, Homo sapiens
uccccuugaaaacugc

SEQ ID NO: 2175533 - RNA, 19 nt, Homo sapiens
gcucuacccugaguucaua

SEQ ID NO: 2175534 - RNA, 23 nt, Homo sapiens
uagcaaagcaaaaggcugagaag

SEQ ID NO: 2175535 - RNA, 13 nt, Homo sapiens
acugcgugccagg

SEQ ID NO: 2175536 - RNA, 14 nt, Homo sapiens
cucaugcugcucaa

SEQ ID NO: 2175537 - RNA, 21 nt, Homo sapiens
aaggccccucugcaacuggag

SEQ ID NO: 2175538 - RNA, 15 nt, Homo sapiens
ucacuugaguguaau

SEQ ID NO: 2175539 - RNA, 16 nt, Homo sapiens
ccucacugaaaacauc

SEQ ID NO: 2175540 - RNA, 18 nt, Homo sapiens
cuauaacaugucuuucag

SEQ ID NO: 2175541 - RNA, 21 nt, Homo sapiens
uuguguauguguauuuguaug

SEQ ID NO: 2175542 - RNA, 21 nt, Homo sapiens
ccccugcucaguaaagcacuu

SEQ ID NO: 2175543 - RNA, 15 nt, Homo sapiens
cugugcuugcuuaga

SEQ ID NO: 2175544 - RNA, 16 nt, Homo sapiens
auaggacccauauucc

SEQ ID NO: 2175545 - RNA, 11 nt, Homo sapiens
ugccagcagcc

SEQ ID NO: 2175546 - RNA, 12 nt, Homo sapiens
aauauccauuua

SEQ ID NO: 2175547 - RNA, 17 nt, Homo sapiens
ucuguuuucugugcacu

SEQ ID NO: 2175548 - RNA, 14 nt, Homo sapiens
cauaggucuguaug

SEQ ID NO: 2175549 - RNA, 18 nt, Homo sapiens
gcaacuccagaaguggag

SEQ ID NO: 2175550 - RNA, 16 nt, Homo sapiens
uuugguuaaacccaug

SEQ ID NO: 2175551 - RNA, 17 nt, Homo sapiens
accccagcucccuagga

SEQ ID NO: 2175552 - RNA, 17 nt, Homo sapiens
uccacagcugugugagc

SEQ ID NO: 2175553 - RNA, 17 nt, Homo sapiens
ugggcccgaggguccca

SEQ ID NO: 2175554 - RNA, 20 nt, Homo sapiens
uauuuguuuggugaauuugu

SEQ ID NO: 2175555 - RNA, 14 nt, Homo sapiens
caguaaauguacaa

SEQ ID NO: 2175556 - RNA, 18 nt, Homo sapiens
acucuugaaaaaugcaug

SEQ ID NO: 2175557 - RNA, 17 nt, Homo sapiens
acguguucgguacugag

SEQ ID NO: 2175558 - RNA, 17 nt, Homo sapiens
cgcccgagguggcugcc

SEQ ID NO: 2175559 - RNA, 11 nt, Homo sapiens
gucagggccau

SEQ ID NO: 2175560 - RNA, 11 nt, Homo sapiens
cccagcucucg

SEQ ID NO: 2175561 - RNA, 20 nt, Homo sapiens
ucuacacagauggaaucucu

SEQ ID NO: 2175562 - RNA, 14 nt, Homo sapiens
uuuaacggcacugu

SEQ ID NO: 2175563 - RNA, 15 nt, Homo sapiens
aauaaauuugaugaa

SEQ ID NO: 2175564 - RNA, 22 nt, Homo sapiens
cagcuuucuggguaauucacca

SEQ ID NO: 2175565 - RNA, 12 nt, Homo sapiens
gagaccuuccac

SEQ ID NO: 2175566 - RNA, 13 nt, Homo sapiens
cacucuagugcca

SEQ ID NO: 2175567 - RNA, 22 nt, Homo sapiens
caacauggugaaaaccccaucu

SEQ ID NO: 2175568 - RNA, 12 nt, Homo sapiens
ccuaucuuuaaa

SEQ ID NO: 2175569 - RNA, 12 nt, Homo sapiens
caugucuuucag

SEQ ID NO: 2175570 - RNA, 23 nt, Homo sapiens
uauuaaacguguaaauugcacag

SEQ ID NO: 2175571 - RNA, 19 nt, Homo sapiens
ggccacacagcacaugcac

SEQ ID NO: 2175572 - RNA, 21 nt, Homo sapiens
acugauaacaaccuuuuacau

SEQ ID NO: 2175573 - RNA, 20 nt, Homo sapiens
gucaucugggccaccagcuc

SEQ ID NO: 2175574 - RNA, 19 nt, Homo sapiens
ccugcucaggaaaccacaa

SEQ ID NO: 2175575 - RNA, 19 nt, Homo sapiens
ccacuuuaaacacccccau

SEQ ID NO: 2175576 - RNA, 21 nt, Homo sapiens
ucugagcuaacgugcugucag

SEQ ID NO: 2175577 - RNA, 13 nt, Homo sapiens
gcauuacauuugu

SEQ ID NO: 2175578 - RNA, 22 nt, Homo sapiens
aaguugaauacucucuucucaa

SEQ ID NO: 2175579 - RNA, 18 nt, Homo sapiens
gaacacgagacagcuugg

SEQ ID NO: 2175580 - RNA, 14 nt, Homo sapiens
uggcuucacuccug

SEQ ID NO: 2175581 - RNA, 14 nt, Homo sapiens
cuccaucauggcag

SEQ ID NO: 2175582 - RNA, 20 nt, Homo sapiens
gcgugagccaccaugccugg

SEQ ID NO: 2175583 - RNA, 18 nt, Homo sapiens
gaaauguucacugaauaa

SEQ ID NO: 2175584 - RNA, 15 nt, Homo sapiens
auaagauuuaauuca

SEQ ID NO: 2175585 - RNA, 23 nt, Homo sapiens
uuugcucucugucaggugugaua

SEQ ID NO: 2175586 - RNA, 21 nt, Homo sapiens
ucuuuuuuaaguugucaaaga

SEQ ID NO: 2175587 - RNA, 14 nt, Homo sapiens
acuccaucauucau

SEQ ID NO: 2175588 - RNA, 21 nt, Homo sapiens
gaggguuccgccacuccaguu

SEQ ID NO: 2175589 - RNA, 13 nt, Homo sapiens
ugcaauggcacca

SEQ ID NO: 2175590 - RNA, 21 nt, Homo sapiens
agcuggaagguacuaugccag

SEQ ID NO: 2175591 - RNA, 16 nt, Homo sapiens
gaauuugcugcuauuu

SEQ ID NO: 2175592 - RNA, 19 nt, Homo sapiens
aaucuguugacagugccaa

SEQ ID NO: 2175593 - RNA, 17 nt, Homo sapiens
gaagugggagugggaga

SEQ ID NO: 2175594 - RNA, 16 nt, Homo sapiens
ccaggcuggagugcaa

SEQ ID NO: 2175595 - RNA, 17 nt, Homo sapiens
auuccagaaugcuguac

SEQ ID NO: 2175596 - RNA, 16 nt, Homo sapiens
cauuccaaucagccaa

SEQ ID NO: 2175597 - RNA, 16 nt, Homo sapiens
uauggcacccaugcac

SEQ ID NO: 2175598 - RNA, 17 nt, Homo sapiens
aaugugcuaugaagcuu

SEQ ID NO: 2175599 - RNA, 18 nt, Homo sapiens
ucaauaguggcauaccaa

SEQ ID NO: 2175600 - RNA, 21 nt, Homo sapiens
ggggcuagaaaucuguugcua

SEQ ID NO: 2175601 - RNA, 17 nt, Homo sapiens
ggcagcugcuggcugug

SEQ ID NO: 2175602 - RNA, 16 nt, Homo sapiens
ugcuuaccacaucaca

SEQ ID NO: 2175603 - RNA, 20 nt, Homo sapiens
uggaguauguuaaguugaag

SEQ ID NO: 2175604 - RNA, 20 nt, Homo sapiens
cuccaagaaacguggaucuc

SEQ ID NO: 2175605 - RNA, 14 nt, Homo sapiens
ccuucuugacauuu

SEQ ID NO: 2175606 - RNA, 13 nt, Homo sapiens
cagcagaggcuuu

SEQ ID NO: 2175607 - RNA, 19 nt, Homo sapiens
agccucuaguguccgggga

SEQ ID NO: 2175608 - RNA, 22 nt, Homo sapiens
auauauuuauauguacauacau

SEQ ID NO: 2175609 - RNA, 23 nt, Homo sapiens
aagaauuaaugacuuacuuuaau

SEQ ID NO: 2175610 - RNA, 23 nt, Homo sapiens
cauuaaaauaauaaaauaaucau

SEQ ID NO: 2175611 - RNA, 17 nt, Homo sapiens
caccgagugaggccaua

SEQ ID NO: 2175612 - RNA, 17 nt, Homo sapiens
agaggaugucacaaaga

SEQ ID NO: 2175613 - RNA, 17 nt, Homo sapiens
ugcccacacacacuccu

SEQ ID NO: 2175614 - RNA, 12 nt, Homo sapiens
ugccagccucag

SEQ ID NO: 2175615 - RNA, 15 nt, Homo sapiens
ugucacuaaagcagg

SEQ ID NO: 2175616 - RNA, 19 nt, Homo sapiens
uucagcagacuaugaauau

SEQ ID NO: 2175617 - RNA, 15 nt, Homo sapiens
aauagucauauguga

SEQ ID NO: 2175618 - RNA, 18 nt, Homo sapiens
augguccgccugccucag

SEQ ID NO: 2175619 - RNA, 14 nt, Homo sapiens
cugccuugcugaca

SEQ ID NO: 2175620 - RNA, 14 nt, Homo sapiens
ggaaaaugggacau

SEQ ID NO: 2175621 - RNA, 23 nt, Homo sapiens
aagaaccacucauugucuuugag

SEQ ID NO: 2175622 - RNA, 20 nt, Homo sapiens
acaguuccuucagcuuccau

SEQ ID NO: 2175623 - RNA, 20 nt, Homo sapiens
aauaauuaaaaaccacugaa

SEQ ID NO: 2175624 - RNA, 15 nt, Homo sapiens
ugaaaugauaugacc

SEQ ID NO: 2175625 - RNA, 17 nt, Homo sapiens
ucgcggagguccugcua

SEQ ID NO: 2175626 - RNA, 23 nt, Homo sapiens
ccccaccuucccuccaccugcuu

SEQ ID NO: 2175627 - RNA, 19 nt, Homo sapiens
ugauaaacauucaucaccu

SEQ ID NO: 2175628 - RNA, 13 nt, Homo sapiens
ucccuauuuuccu

SEQ ID NO: 2175629 - RNA, 18 nt, Homo sapiens
acauguucuugucauaaa

SEQ ID NO: 2175630 - RNA, 12 nt, Homo sapiens
gaggaugacuaa

SEQ ID NO: 2175631 - RNA, 20 nt, Homo sapiens
ucuccaucacaaccagauuu

SEQ ID NO: 2175632 - RNA, 21 nt, Homo sapiens
cgcccaugugugagugugugc

SEQ ID NO: 2175633 - RNA, 19 nt, Homo sapiens
cagauacacuaaaguuaca

SEQ ID NO: 2175634 - RNA, 14 nt, Homo sapiens
caccaugaggauaa

SEQ ID NO: 2175635 - RNA, 16 nt, Homo sapiens
gccccgucugacccca

SEQ ID NO: 2175636 - RNA, 23 nt, Homo sapiens
cugucacugaugguggcucuggu

SEQ ID NO: 2175637 - RNA, 18 nt, Homo sapiens
ugcacaugcgcacucuca

SEQ ID NO: 2175638 - RNA, 17 nt, Homo sapiens
gccugaaaugacauuuc

SEQ ID NO: 2175639 - RNA, 23 nt, Homo sapiens
aucgggaccagaaaccugggaga

SEQ ID NO: 2175640 - RNA, 19 nt, Homo sapiens
uguaggaaccaauucuuga

SEQ ID NO: 2175641 - RNA, 13 nt, Homo sapiens
ucugaguguucuc

SEQ ID NO: 2175642 - RNA, 22 nt, Homo sapiens
cauuauuuuuguuagcaaagau

SEQ ID NO: 2175643 - RNA, 16 nt, Homo sapiens
acauagccgauucucu

SEQ ID NO: 2175644 - RNA, 19 nt, Homo sapiens
ucaguuucuuuuucacuug

SEQ ID NO: 2175645 - RNA, 16 nt, Homo sapiens
uguguggcagagccag

SEQ ID NO: 2175646 - RNA, 23 nt, Homo sapiens
acaacagugcuuuguaaauugug

SEQ ID NO: 2175647 - RNA, 16 nt, Homo sapiens
ccccugccccagagaa

SEQ ID NO: 2175648 - RNA, 21 nt, Homo sapiens
ucagggccaccauugucucaa

SEQ ID NO: 2175649 - RNA, 12 nt, Homo sapiens
cuuuuccuuuga

SEQ ID NO: 2175650 - RNA, 19 nt, Homo sapiens
uugauucucuccuacuguu

SEQ ID NO: 2175651 - RNA, 18 nt, Homo sapiens
accaacaaaaagaacaaa

SEQ ID NO: 2175652 - RNA, 15 nt, Homo sapiens
acucagccaagcaca

SEQ ID NO: 2175653 - RNA, 23 nt, Homo sapiens
aaaguucuaggcauacuuuucaa

SEQ ID NO: 2175654 - RNA, 13 nt, Homo sapiens
cugcugaaacugc

SEQ ID NO: 2175655 - RNA, 13 nt, Homo sapiens
ugcacuggaugug

SEQ ID NO: 2175656 - RNA, 15 nt, Homo sapiens
ugagcccgugucaca

SEQ ID NO: 2175657 - RNA, 21 nt, Homo sapiens
caggagaagggcuugggcccu

SEQ ID NO: 2175658 - RNA, 15 nt, Homo sapiens
ggagaaacacuugaa

SEQ ID NO: 2175659 - RNA, 19 nt, Homo sapiens
ggaaacaaccaugucauuu

SEQ ID NO: 2175660 - RNA, 21 nt, Homo sapiens
cuuuggggagguguucacuga

SEQ ID NO: 2175661 - RNA, 21 nt, Homo sapiens
accaucucugugauuaccucu

SEQ ID NO: 2175662 - RNA, 16 nt, Homo sapiens
uuaugcaaauacaauc

SEQ ID NO: 2175663 - RNA, 13 nt, Homo sapiens
uaaagcucaaggu

SEQ ID NO: 2175664 - RNA, 16 nt, Homo sapiens
ggcugcccacuggaga

SEQ ID NO: 2175665 - RNA, 12 nt, Homo sapiens
uucaaacacugc

SEQ ID NO: 2175666 - RNA, 18 nt, Homo sapiens
uaauucaagaaaugacag

SEQ ID NO: 2175667 - RNA, 21 nt, Homo sapiens
ucaauauuugguauuucaaua

SEQ ID NO: 2175668 - RNA, 13 nt, Homo sapiens
uuuaaaacugcuc

SEQ ID NO: 2175669 - RNA, 15 nt, Homo sapiens
cagagaagccagcuu

SEQ ID NO: 2175670 - RNA, 17 nt, Homo sapiens
guaaaaauccacuauuu

SEQ ID NO: 2175671 - RNA, 23 nt, Homo sapiens
cuucccuguggccuuaugagcuc

SEQ ID NO: 2175672 - RNA, 17 nt, Homo sapiens
ucccagauggcuggaag

SEQ ID NO: 2175673 - RNA, 14 nt, Homo sapiens
gagcccuuaugaca

SEQ ID NO: 2175674 - RNA, 13 nt, Homo sapiens
gagucacugccug

SEQ ID NO: 2175675 - RNA, 15 nt, Homo sapiens
gaggagaaaaaaacu

SEQ ID NO: 2175676 - RNA, 23 nt, Homo sapiens
auguugguguuccacguguuuua

SEQ ID NO: 2175677 - RNA, 16 nt, Homo sapiens
accaggggaccagagg

SEQ ID NO: 2175678 - RNA, 17 nt, Homo sapiens
caugagauaauaugcag

SEQ ID NO: 2175679 - RNA, 14 nt, Homo sapiens
cccggcggggugcc

SEQ ID NO: 2175680 - RNA, 14 nt, Homo sapiens
ugugauucugccuu

SEQ ID NO: 2175681 - RNA, 22 nt, Homo sapiens
uggaaugcacucagacuguaua

SEQ ID NO: 2175682 - RNA, 12 nt, Homo sapiens
aaaaagaacaaa

SEQ ID NO: 2175683 - RNA, 12 nt, Homo sapiens
auuuagaacuuu

SEQ ID NO: 2175684 - RNA, 19 nt, Homo sapiens
aacuacugcuggaaaaagc

SEQ ID NO: 2175685 - RNA, 18 nt, Homo sapiens
gauuguuuugccacuuag

SEQ ID NO: 2175686 - RNA, 15 nt, Homo sapiens
acucauaaucuauaa

SEQ ID NO: 2175687 - RNA, 20 nt, Homo sapiens
aacauuaccuugucuuucaa

SEQ ID NO: 2175688 - RNA, 16 nt, Homo sapiens
guaaguuuauaaugca

SEQ ID NO: 2175689 - RNA, 18 nt, Homo sapiens
cuauguguuuuagacuua

SEQ ID NO: 2175690 - RNA, 15 nt, Homo sapiens
cauacaaaacuguuc

SEQ ID NO: 2175691 - RNA, 23 nt, Homo sapiens
uaacaaaguuuucaugugcucag

SEQ ID NO: 2175692 - RNA, 14 nt, Homo sapiens
ugccucccaaagug

SEQ ID NO: 2175693 - RNA, 12 nt, Homo sapiens
aaagcuucacag

SEQ ID NO: 2175694 - RNA, 13 nt, Homo sapiens
cgcaccacugcca

SEQ ID NO: 2175695 - RNA, 20 nt, Homo sapiens
uaaagccgaacugguaccau

SEQ ID NO: 2175696 - RNA, 16 nt, Homo sapiens
auauauuuuagcauuu

SEQ ID NO: 2175697 - RNA, 20 nt, Homo sapiens
uccagaccagccugggcaac

SEQ ID NO: 2175698 - RNA, 16 nt, Homo sapiens
uaguaccucccagcag

SEQ ID NO: 2175699 - RNA, 15 nt, Homo sapiens
ggguuuguacauuuu

SEQ ID NO: 2175700 - RNA, 17 nt, Homo sapiens
agauuggccagcaaaaa

SEQ ID NO: 2175701 - RNA, 16 nt, Homo sapiens
agcuaucuauaccuua

SEQ ID NO: 2175702 - RNA, 15 nt, Homo sapiens
ugagggccugagguc

SEQ ID NO: 2175703 - RNA, 15 nt, Homo sapiens
uggcaggcaucgcca

SEQ ID NO: 2175704 - RNA, 17 nt, Homo sapiens
guggggaggugucacau

SEQ ID NO: 2175705 - RNA, 23 nt, Homo sapiens
uggaauguuuuaaucuccucuga

SEQ ID NO: 2175706 - RNA, 14 nt, Homo sapiens
aaagucaaucuuau

SEQ ID NO: 2175707 - RNA, 14 nt, Homo sapiens
ggcaaagaucucag

SEQ ID NO: 2175708 - RNA, 21 nt, Homo sapiens
ucucacuuauaccaaagggaa

SEQ ID NO: 2175709 - RNA, 23 nt, Homo sapiens
uauuccaauaaauugucaagacc

SEQ ID NO: 2175710 - RNA, 21 nt, Homo sapiens
gaacauggccaauagucauau

SEQ ID NO: 2175711 - RNA, 17 nt, Homo sapiens
aauuaauaaaugucauu

SEQ ID NO: 2175712 - RNA, 18 nt, Homo sapiens
gagauaauucuagcuuug

SEQ ID NO: 2175713 - RNA, 14 nt, Homo sapiens
gucaccuugcacuc

SEQ ID NO: 2175714 - RNA, 19 nt, Homo sapiens
ugaaaagcaggcaaaagac

SEQ ID NO: 2175715 - RNA, 20 nt, Homo sapiens
cccccacaggagcguguccu

SEQ ID NO: 2175716 - RNA, 14 nt, Homo sapiens
gacauguaauguug

SEQ ID NO: 2175717 - RNA, 18 nt, Homo sapiens
acaaagauugagaagcca

SEQ ID NO: 2175718 - RNA, 15 nt, Homo sapiens
aacuacuggcaauuu

SEQ ID NO: 2175719 - RNA, 13 nt, Homo sapiens
aucucaccugcug

SEQ ID NO: 2175720 - RNA, 18 nt, Homo sapiens
acuuauauguucuaauua

SEQ ID NO: 2175721 - RNA, 15 nt, Homo sapiens
aaggucuccacuuca

SEQ ID NO: 2175722 - RNA, 19 nt, Homo sapiens
cuggaauggaauuggacau

SEQ ID NO: 2175723 - RNA, 15 nt, Homo sapiens
aggucaggaugcaca

SEQ ID NO: 2175724 - RNA, 16 nt, Homo sapiens
caaccgugacugcaag

SEQ ID NO: 2175725 - RNA, 22 nt, Homo sapiens
ugaaaauguauguguaaguauu

SEQ ID NO: 2175726 - RNA, 18 nt, Homo sapiens
aacugggccuguagcuca

SEQ ID NO: 2175727 - RNA, 13 nt, Homo sapiens
uccgaggccaaag

SEQ ID NO: 2175728 - RNA, 18 nt, Homo sapiens
uccccagccagggagcuu

SEQ ID NO: 2175729 - RNA, 18 nt, Homo sapiens
agcaaccugccuugggac

SEQ ID NO: 2175730 - RNA, 19 nt, Homo sapiens
auaauguaaacgcaaacag

SEQ ID NO: 2175731 - RNA, 14 nt, Homo sapiens
uauccugugcuuga

SEQ ID NO: 2175732 - RNA, 14 nt, Homo sapiens
uaaugagugcaccu

SEQ ID NO: 2175733 - RNA, 19 nt, Homo sapiens
auaucuucauacaaugaca

SEQ ID NO: 2175734 - RNA, 19 nt, Homo sapiens
auuaaucuggaauaugcaa

SEQ ID NO: 2175735 - RNA, 20 nt, Homo sapiens
gcugggaaaaaaguuuugau

SEQ ID NO: 2175736 - RNA, 15 nt, Homo sapiens
ucuuaggugucaugu

SEQ ID NO: 2175737 - RNA, 23 nt, Homo sapiens
acaugugugcgugugcgugcaug

SEQ ID NO: 2175738 - RNA, 13 nt, Homo sapiens
cugcaccccaaga

SEQ ID NO: 2175739 - RNA, 20 nt, Homo sapiens
uuaaagcuuauuaaaacuca

SEQ ID NO: 2175740 - RNA, 16 nt, Homo sapiens
caccgauaaccacagg

SEQ ID NO: 2175741 - RNA, 22 nt, Homo sapiens
agacaagaaauccuaguggccu

SEQ ID NO: 2175742 - RNA, 13 nt, Homo sapiens
ucuggaaguccaa

SEQ ID NO: 2175743 - RNA, 19 nt, Homo sapiens
cuucuggggucaggugcca

SEQ ID NO: 2175744 - RNA, 18 nt, Homo sapiens
cagaaacacggaguuucc

SEQ ID NO: 2175745 - RNA, 22 nt, Homo sapiens
uaauuuaugaauuuuacuugca

SEQ ID NO: 2175746 - RNA, 14 nt, Homo sapiens
aauuccuggcauga

SEQ ID NO: 2175747 - RNA, 18 nt, Homo sapiens
uaggacuggguuccccac

SEQ ID NO: 2175748 - RNA, 13 nt, Homo sapiens
cugcuccaacccc

SEQ ID NO: 2175749 - RNA, 16 nt, Homo sapiens
ccucagugagaagcca

SEQ ID NO: 2175750 - RNA, 17 nt, Homo sapiens
cagugcucauucaucac

SEQ ID NO: 2175751 - RNA, 13 nt, Homo sapiens
gacuuacuaauaa

SEQ ID NO: 2175752 - RNA, 12 nt, Homo sapiens
aucugugccugg

SEQ ID NO: 2175753 - RNA, 23 nt, Homo sapiens
cagggguggggguggaggcuucc

SEQ ID NO: 2175754 - RNA, 23 nt, Homo sapiens
auucccccaagcagaagaccaga

SEQ ID NO: 2175755 - RNA, 15 nt, Homo sapiens
aaauaguacuaaagg

SEQ ID NO: 2175756 - RNA, 11 nt, Homo sapiens
augacacugac

SEQ ID NO: 2175757 - RNA, 15 nt, Homo sapiens
ugacauagcacuugc

SEQ ID NO: 2175758 - RNA, 21 nt, Homo sapiens
gaaaaauaugugaaggaccuu

SEQ ID NO: 2175759 - RNA, 18 nt, Homo sapiens
aaugaccaguaauuguga

SEQ ID NO: 2175760 - RNA, 14 nt, Homo sapiens
uacuuccugauuag

SEQ ID NO: 2175761 - RNA, 18 nt, Homo sapiens
gagguaggcacaaauaca

SEQ ID NO: 2175762 - RNA, 23 nt, Homo sapiens
auuuuucucuuuuaaucuaucua

SEQ ID NO: 2175763 - RNA, 16 nt, Homo sapiens
ccugcuggggaccuug

SEQ ID NO: 2175764 - RNA, 16 nt, Homo sapiens
ucaaucagugcaguga

SEQ ID NO: 2175765 - RNA, 16 nt, Homo sapiens
augacgcacugcucaa

SEQ ID NO: 2175766 - RNA, 14 nt, Homo sapiens
uuugauguuuacag

SEQ ID NO: 2175767 - RNA, 15 nt, Homo sapiens
ggauugucacuccaa

SEQ ID NO: 2175768 - RNA, 14 nt, Homo sapiens
aagcuuuaagcaaa

SEQ ID NO: 2175769 - RNA, 17 nt, Homo sapiens
ugggcuccaggccugua

SEQ ID NO: 2175770 - RNA, 14 nt, Homo sapiens
uguggcgcagcaua

SEQ ID NO: 2175771 - RNA, 14 nt, Homo sapiens
gaagagauccuucu

SEQ ID NO: 2175772 - RNA, 13 nt, Homo sapiens
uaaaauaaaccaa

SEQ ID NO: 2175773 - RNA, 16 nt, Homo sapiens
aggccuguggggagcc

SEQ ID NO: 2175774 - RNA, 14 nt, Homo sapiens
acgacacauuugcc

SEQ ID NO: 2175775 - RNA, 22 nt, Homo sapiens
gaaaucauaaaggaucagagau

SEQ ID NO: 2175776 - RNA, 14 nt, Homo sapiens
ucuucaugcuugac

SEQ ID NO: 2175777 - RNA, 13 nt, Homo sapiens
cuugcauacagag

SEQ ID NO: 2175778 - RNA, 24 nt, Homo sapiens
ccagaaaaaagaccaauaggugca

SEQ ID NO: 2175779 - RNA, 13 nt, Homo sapiens
guccgagcuuuga

SEQ ID NO: 2175780 - RNA, 16 nt, Homo sapiens
auuuucaucaaaacca

SEQ ID NO: 2175781 - RNA, 16 nt, Homo sapiens
ucacuuuguugcccag

SEQ ID NO: 2175782 - RNA, 23 nt, Homo sapiens
uugcccggcugugauugcugcca

SEQ ID NO: 2175783 - RNA, 18 nt, Homo sapiens
gugcaccacuucaaguga

SEQ ID NO: 2175784 - RNA, 15 nt, Homo sapiens
acuuccuccuagcaa

SEQ ID NO: 2175785 - RNA, 18 nt, Homo sapiens
caucaguuacugguuuca

SEQ ID NO: 2175786 - RNA, 19 nt, Homo sapiens
ugccucccuucaugcaugg

SEQ ID NO: 2175787 - RNA, 14 nt, Homo sapiens
aguguggucaagca

SEQ ID NO: 2175788 - RNA, 21 nt, Homo sapiens
gaaccccagcuucccuccagc

SEQ ID NO: 2175789 - RNA, 17 nt, Homo sapiens
uccuugagcuaagcaga

SEQ ID NO: 2175790 - RNA, 16 nt, Homo sapiens
ugaguuacaauuugga

SEQ ID NO: 2175791 - RNA, 22 nt, Homo sapiens
cucauccugauuuuuacuauca

SEQ ID NO: 2175792 - RNA, 16 nt, Homo sapiens
agaauaacacuggcuu

SEQ ID NO: 2175793 - RNA, 18 nt, Homo sapiens
gccucguaccagccagga

SEQ ID NO: 2175794 - RNA, 14 nt, Homo sapiens
augcuaacaaagac

SEQ ID NO: 2175795 - RNA, 19 nt, Homo sapiens
accugcuucccccacuuca

SEQ ID NO: 2175796 - RNA, 21 nt, Homo sapiens
accagcccuacaccauuccuu

SEQ ID NO: 2175797 - RNA, 15 nt, Homo sapiens
guauucucagcacuu

SEQ ID NO: 2175798 - RNA, 17 nt, Homo sapiens
gcaucugccacaaaaau

SEQ ID NO: 2175799 - RNA, 17 nt, Homo sapiens
caaaguguaugugacca

SEQ ID NO: 2175800 - RNA, 18 nt, Homo sapiens
auaggagccgauggaucu

SEQ ID NO: 2175801 - RNA, 22 nt, Homo sapiens
cugugucaccguaucucaggaa

SEQ ID NO: 2175802 - RNA, 17 nt, Homo sapiens
agauccccccacugagc

SEQ ID NO: 2175803 - RNA, 16 nt, Homo sapiens
ugaaagccacagacaa

SEQ ID NO: 2175804 - RNA, 22 nt, Homo sapiens
accaagggaugggaccugauga

SEQ ID NO: 2175805 - RNA, 16 nt, Homo sapiens
cuuuaauaaaggccac

SEQ ID NO: 2175806 - RNA, 22 nt, Homo sapiens
uaacaucuuuuaauuguuucca

SEQ ID NO: 2175807 - RNA, 19 nt, Homo sapiens
cagagucuuggacucaugg

SEQ ID NO: 2175808 - RNA, 18 nt, Homo sapiens
aaugaguuuaaugccaua

SEQ ID NO: 2175809 - RNA, 20 nt, Homo sapiens
uggagaacgagaccugugug

SEQ ID NO: 2175810 - RNA, 21 nt, Homo sapiens
aaugguguagcuguccucuca

SEQ ID NO: 2175811 - RNA, 21 nt, Homo sapiens
uguaaccugggaaagccauga

SEQ ID NO: 2175812 - RNA, 19 nt, Homo sapiens
aaggaguauaccaugagau

SEQ ID NO: 2175813 - RNA, 13 nt, Homo sapiens
aaagucacccaaa

SEQ ID NO: 2175814 - RNA, 21 nt, Homo sapiens
ggugccugugaccgggguccu

SEQ ID NO: 2175815 - RNA, 14 nt, Homo sapiens
ucaccucuugccuu

SEQ ID NO: 2175816 - RNA, 11 nt, Homo sapiens
aggccaaagau

SEQ ID NO: 2175817 - RNA, 13 nt, Homo sapiens
acaaacagauucu

SEQ ID NO: 2175818 - RNA, 18 nt, Homo sapiens
auuauuccaaaccaaauu

SEQ ID NO: 2175819 - RNA, 22 nt, Homo sapiens
gaagagugauguuucagucaag

SEQ ID NO: 2175820 - RNA, 17 nt, Homo sapiens
cuaguucccucugcuca

SEQ ID NO: 2175821 - RNA, 14 nt, Homo sapiens
aaauaaaaucacca

SEQ ID NO: 2175822 - RNA, 16 nt, Homo sapiens
uccagcauuuagcugg

SEQ ID NO: 2175823 - RNA, 16 nt, Homo sapiens
guuugcaauagucuua

SEQ ID NO: 2175824 - RNA, 16 nt, Homo sapiens
ucagugaaaacaaguc

SEQ ID NO: 2175825 - RNA, 16 nt, Homo sapiens
aauaguuccagauaaa

SEQ ID NO: 2175826 - RNA, 23 nt, Homo sapiens
uaccugaagucuuuguacagaca

SEQ ID NO: 2175827 - RNA, 15 nt, Homo sapiens
ggagucucacugucu

SEQ ID NO: 2175828 - RNA, 22 nt, Homo sapiens
uggugcucuuugcugcacuauu

SEQ ID NO: 2175829 - RNA, 16 nt, Homo sapiens
ccucccacccugcaaa

SEQ ID NO: 2175830 - RNA, 17 nt, Homo sapiens
cuguuucaugagcccaa

SEQ ID NO: 2175831 - RNA, 14 nt, Homo sapiens
gcagaaaacagcuc

SEQ ID NO: 2175832 - RNA, 13 nt, Homo sapiens
augaggacagagu

SEQ ID NO: 2175833 - RNA, 21 nt, Homo sapiens
ugacccuaugggucuaggaca

SEQ ID NO: 2175834 - RNA, 23 nt, Homo sapiens
cuaggcauuucugggaagcccca

SEQ ID NO: 2175835 - RNA, 23 nt, Homo sapiens
uuaauauguuaaccucaguguca

SEQ ID NO: 2175836 - RNA, 20 nt, Homo sapiens
uccagaaccaacugcauugg

SEQ ID NO: 2175837 - RNA, 21 nt, Homo sapiens
cuacuaaagugccuaccccag

SEQ ID NO: 2175838 - RNA, 19 nt, Homo sapiens
augaacagacacuuuucaa

SEQ ID NO: 2175839 - RNA, 12 nt, Homo sapiens
cucaaacucauu

SEQ ID NO: 2175840 - RNA, 15 nt, Homo sapiens
gaagcaaagacaaaa

SEQ ID NO: 2175841 - RNA, 20 nt, Homo sapiens
cuucaaacugugaagcauuu

SEQ ID NO: 2175842 - RNA, 16 nt, Homo sapiens
accuacaaggagauaa

SEQ ID NO: 2175843 - RNA, 20 nt, Homo sapiens
agugcaauggcgcgaucuca

SEQ ID NO: 2175844 - RNA, 15 nt, Homo sapiens
gaacucaaugugcaa

SEQ ID NO: 2175845 - RNA, 12 nt, Homo sapiens
agccccuagugc

SEQ ID NO: 2175846 - RNA, 17 nt, Homo sapiens
ggccugccuucucaggg

SEQ ID NO: 2175847 - RNA, 13 nt, Homo sapiens
uuacuaaacauuu

SEQ ID NO: 2175848 - RNA, 15 nt, Homo sapiens
aauuauaccaugaga

SEQ ID NO: 2175849 - RNA, 16 nt, Homo sapiens
ucaaaauauacauuca

SEQ ID NO: 2175850 - RNA, 14 nt, Homo sapiens
aaugaaccacugcc

SEQ ID NO: 2175851 - RNA, 17 nt, Homo sapiens
gccagagauaaacuaau

SEQ ID NO: 2175852 - RNA, 21 nt, Homo sapiens
guggugggggaggagccucug

SEQ ID NO: 2175853 - RNA, 22 nt, Homo sapiens
gccccaagcuucugagucuaga

SEQ ID NO: 2175854 - RNA, 17 nt, Homo sapiens
augguacccuguguuag

SEQ ID NO: 2175855 - RNA, 18 nt, Homo sapiens
cuucuugacaucaaggcu

SEQ ID NO: 2175856 - RNA, 14 nt, Homo sapiens
uuuuacacauuaga

SEQ ID NO: 2175857 - RNA, 11 nt, Homo sapiens
caaaaguagag

SEQ ID NO: 2175858 - RNA, 22 nt, Homo sapiens
uacaguuugugcucuacuguua

SEQ ID NO: 2175859 - RNA, 15 nt, Homo sapiens
ugcaugaccuaucag

SEQ ID NO: 2175860 - RNA, 18 nt, Homo sapiens
gcagaacagacacuuuaa

SEQ ID NO: 2175861 - RNA, 18 nt, Homo sapiens
guuucagguuccuacagg

SEQ ID NO: 2175862 - RNA, 19 nt, Homo sapiens
acccucccaaaacagggaa

SEQ ID NO: 2175863 - RNA, 21 nt, Homo sapiens
aaguaaaauugaagcaacuac

SEQ ID NO: 2175864 - RNA, 15 nt, Homo sapiens
agugccucaccuucc

SEQ ID NO: 2175865 - RNA, 14 nt, Homo sapiens
uguugauaaaugac

SEQ ID NO: 2175866 - RNA, 19 nt, Homo sapiens
aaacacucaucuccucugu

SEQ ID NO: 2175867 - RNA, 13 nt, Homo sapiens
uagcccaggucac

SEQ ID NO: 2175868 - RNA, 22 nt, Homo sapiens
ucagaccucuucauguuaaaag

SEQ ID NO: 2175869 - RNA, 12 nt, Homo sapiens
ggcuuuggcacu

SEQ ID NO: 2175870 - RNA, 22 nt, Homo sapiens
aauucuaccuccuuguguugca

SEQ ID NO: 2175871 - RNA, 22 nt, Homo sapiens
aacagcgggagaccugugcuag

SEQ ID NO: 2175872 - RNA, 17 nt, Homo sapiens
acccacuguggacucca

SEQ ID NO: 2175873 - RNA, 15 nt, Homo sapiens
acccucacuguguug

SEQ ID NO: 2175874 - RNA, 14 nt, Homo sapiens
uuaaaucauagcua

SEQ ID NO: 2175875 - RNA, 14 nt, Homo sapiens
gucagcgggugcac

SEQ ID NO: 2175876 - RNA, 13 nt, Homo sapiens
aacgggccagcuc

SEQ ID NO: 2175877 - RNA, 21 nt, Homo sapiens
cagggacaaaacacugugucc

SEQ ID NO: 2175878 - RNA, 14 nt, Homo sapiens
ugguccgagucuca

SEQ ID NO: 2175879 - RNA, 22 nt, Homo sapiens
caucaauaguguccuaugcaau

SEQ ID NO: 2175880 - RNA, 14 nt, Homo sapiens
cacuuccagagcca

SEQ ID NO: 2175881 - RNA, 15 nt, Homo sapiens
ccacucuguccugga

SEQ ID NO: 2175882 - RNA, 17 nt, Homo sapiens
auuaaguaaaccaaaaa

SEQ ID NO: 2175883 - RNA, 14 nt, Homo sapiens
auucuauaaauuca

SEQ ID NO: 2175884 - RNA, 19 nt, Homo sapiens
agccugugugcaguggagc

SEQ ID NO: 2175885 - RNA, 18 nt, Homo sapiens
aaccauuuuuaggaagcu

SEQ ID NO: 2175886 - RNA, 21 nt, Homo sapiens
uucauuuucucaaagggcaua

SEQ ID NO: 2175887 - RNA, 22 nt, Homo sapiens
ccccaccugccauuugcacccu

SEQ ID NO: 2175888 - RNA, 15 nt, Homo sapiens
ucuuaaagugcaguu

SEQ ID NO: 2175889 - RNA, 17 nt, Homo sapiens
cucuaagaauucucucu

SEQ ID NO: 2175890 - RNA, 13 nt, Homo sapiens
cggugaaauccag

SEQ ID NO: 2175891 - RNA, 22 nt, Homo sapiens
ccuccugugacgugaggcccau

SEQ ID NO: 2175892 - RNA, 18 nt, Homo sapiens
auggagcaagugagcacu

SEQ ID NO: 2175893 - RNA, 17 nt, Homo sapiens
gccucacgaaacuggaa

SEQ ID NO: 2175894 - RNA, 17 nt, Homo sapiens
acacuguugucaaaaag

SEQ ID NO: 2175895 - RNA, 16 nt, Homo sapiens
cauugaaauaauaaua

SEQ ID NO: 2175896 - RNA, 20 nt, Homo sapiens
acauagaaaaaugaugucuu

SEQ ID NO: 2175897 - RNA, 15 nt, Homo sapiens
ucaggagcugcucag

SEQ ID NO: 2175898 - RNA, 13 nt, Homo sapiens
ugcaaaccaggau

SEQ ID NO: 2175899 - RNA, 23 nt, Homo sapiens
gugguagaagccaguacagagaa

SEQ ID NO: 2175900 - RNA, 16 nt, Homo sapiens
cuccaucucagccauu

SEQ ID NO: 2175901 - RNA, 18 nt, Homo sapiens
ugugaccugucagaauaa

SEQ ID NO: 2175902 - RNA, 17 nt, Homo sapiens
cauuucagaaaugcugu

SEQ ID NO: 2175903 - RNA, 23 nt, Homo sapiens
ugcuugaaaugagaaacuuugau

SEQ ID NO: 2175904 - RNA, 22 nt, Homo sapiens
acaguuaaaggcaacccugagg

SEQ ID NO: 2175905 - RNA, 18 nt, Homo sapiens
agccauuauuaugauguu

SEQ ID NO: 2175906 - RNA, 23 nt, Homo sapiens
cauauggaggaggcucuggaguc

SEQ ID NO: 2175907 - RNA, 18 nt, Homo sapiens
cgucuacugcaagagcca

SEQ ID NO: 2175908 - RNA, 14 nt, Homo sapiens
uucagucugugaaa

SEQ ID NO: 2175909 - RNA, 24 nt, Homo sapiens
ugggacuaaagccaggaacaggga

SEQ ID NO: 2175910 - RNA, 18 nt, Homo sapiens
acaguugauucaacaaag

SEQ ID NO: 2175911 - RNA, 16 nt, Homo sapiens
uguccucccaccucag

SEQ ID NO: 2175912 - RNA, 18 nt, Homo sapiens
agaaagauguuccaguga

SEQ ID NO: 2175913 - RNA, 19 nt, Homo sapiens
acccuuuuuugaaccaaca

SEQ ID NO: 2175914 - RNA, 23 nt, Homo sapiens
auuuuuaaaggcauuagagucaa

SEQ ID NO: 2175915 - RNA, 20 nt, Homo sapiens
aagaccggcugguggagcug

SEQ ID NO: 2175916 - RNA, 13 nt, Homo sapiens
ggaugccuuagca

SEQ ID NO: 2175917 - RNA, 14 nt, Homo sapiens
aagggggaaaaagu

SEQ ID NO: 2175918 - RNA, 17 nt, Homo sapiens
ucaaauuggacuuucaa

SEQ ID NO: 2175919 - RNA, 20 nt, Homo sapiens
acccccaaauuuaauuaaag

SEQ ID NO: 2175920 - RNA, 14 nt, Homo sapiens
uguugcaaucuggu

SEQ ID NO: 2175921 - RNA, 23 nt, Homo sapiens
ccuggaacuagaaacagaggugg

SEQ ID NO: 2175922 - RNA, 19 nt, Homo sapiens
augccuccuucccaggacc

SEQ ID NO: 2175923 - RNA, 13 nt, Homo sapiens
agaaacacugggg

SEQ ID NO: 2175924 - RNA, 13 nt, Homo sapiens
gagugagcugguu

SEQ ID NO: 2175925 - RNA, 12 nt, Homo sapiens
uuuucugccacu

SEQ ID NO: 2175926 - RNA, 15 nt, Homo sapiens
aucccagcuacucga

SEQ ID NO: 2175927 - RNA, 18 nt, Homo sapiens
aaggaaguguguuugccu

SEQ ID NO: 2175928 - RNA, 22 nt, Homo sapiens
uauccauauuuuacugaucucu

SEQ ID NO: 2175929 - RNA, 21 nt, Homo sapiens
cugcuagauaucacuuacuca

SEQ ID NO: 2175930 - RNA, 22 nt, Homo sapiens
agaugcaaucucuugucucaca

SEQ ID NO: 2175931 - RNA, 23 nt, Homo sapiens
aaaguuauuaccuuuacauauua

SEQ ID NO: 2175932 - RNA, 19 nt, Homo sapiens
agauugauaaccauagcau

SEQ ID NO: 2175933 - RNA, 17 nt, Homo sapiens
agcacuacauaaacuga

SEQ ID NO: 2175934 - RNA, 15 nt, Homo sapiens
gucagcagcagugac

SEQ ID NO: 2175935 - RNA, 15 nt, Homo sapiens
gacugccgcugagaa

SEQ ID NO: 2175936 - RNA, 20 nt, Homo sapiens
uaaguucaggcagcacauca

SEQ ID NO: 2175937 - RNA, 14 nt, Homo sapiens
ucuaacucaggggu

SEQ ID NO: 2175938 - RNA, 23 nt, Homo sapiens
ucucacauguggcucccccugaa

SEQ ID NO: 2175939 - RNA, 17 nt, Homo sapiens
guacagugucugugcca

SEQ ID NO: 2175940 - RNA, 14 nt, Homo sapiens
ccuggccaggagcu

SEQ ID NO: 2175941 - RNA, 21 nt, Homo sapiens
guacuuuauuuguauuugcca

SEQ ID NO: 2175942 - RNA, 13 nt, Homo sapiens
cccuggaagcuga

SEQ ID NO: 2175943 - RNA, 23 nt, Homo sapiens
gaaacaccuucucuggagccaag

SEQ ID NO: 2175944 - RNA, 18 nt, Homo sapiens
ugucugagagccauaaau

SEQ ID NO: 2175945 - RNA, 21 nt, Homo sapiens
gacacaaacuuucaaguauua

SEQ ID NO: 2175946 - RNA, 15 nt, Homo sapiens
ucagcauuuaaucca

SEQ ID NO: 2175947 - RNA, 14 nt, Homo sapiens
agaggaaacugaag

SEQ ID NO: 2175948 - RNA, 19 nt, Homo sapiens
ucccuuccugggucuacca

SEQ ID NO: 2175949 - RNA, 13 nt, Homo sapiens
ucugcgugacaau

SEQ ID NO: 2175950 - RNA, 12 nt, Homo sapiens
auuuauuacaag

SEQ ID NO: 2175951 - RNA, 17 nt, Homo sapiens
gaucaaagaacugaaag

SEQ ID NO: 2175952 - RNA, 21 nt, Homo sapiens
ugcaauuucauuuaaacuucu

SEQ ID NO: 2175953 - RNA, 13 nt, Homo sapiens
cguugaggaugag

SEQ ID NO: 2175954 - RNA, 16 nt, Homo sapiens
cccucagggagcgauc

SEQ ID NO: 2175955 - RNA, 13 nt, Homo sapiens
ggacuccacugaa

SEQ ID NO: 2175956 - RNA, 17 nt, Homo sapiens
ccuaacuaucacugguu

SEQ ID NO: 2175957 - RNA, 14 nt, Homo sapiens
aaacuuuggcuuuc

SEQ ID NO: 2175958 - RNA, 21 nt, Homo sapiens
cacagacucauauuacuggua

SEQ ID NO: 2175959 - RNA, 22 nt, Homo sapiens
ugauaagagggcacacacugug

SEQ ID NO: 2175960 - RNA, 13 nt, Homo sapiens
cgcucgcugccau

SEQ ID NO: 2175961 - RNA, 16 nt, Homo sapiens
gugaauuucacaagcu

SEQ ID NO: 2175962 - RNA, 19 nt, Homo sapiens
ucccucucccaguccauuu

SEQ ID NO: 2175963 - RNA, 18 nt, Homo sapiens
auccuugcuaaguuuuca

SEQ ID NO: 2175964 - RNA, 17 nt, Homo sapiens
uuucuugaaccaauaau

SEQ ID NO: 2175965 - RNA, 13 nt, Homo sapiens
cuucucuagacau

SEQ ID NO: 2175966 - RNA, 17 nt, Homo sapiens
ccagaguggaaauucau

SEQ ID NO: 2175967 - RNA, 15 nt, Homo sapiens
cuguguguagggaga

SEQ ID NO: 2175968 - RNA, 16 nt, Homo sapiens
agcccuucucugcucc

SEQ ID NO: 2175969 - RNA, 18 nt, Homo sapiens
ccaaggaaauauugagag

SEQ ID NO: 2175970 - RNA, 12 nt, Homo sapiens
uuuuacauaguu

SEQ ID NO: 2175971 - RNA, 20 nt, Homo sapiens
gccuauaaucccagcacuuu

SEQ ID NO: 2175972 - RNA, 22 nt, Homo sapiens
gauuugccagcacaggggcccc

SEQ ID NO: 2175973 - RNA, 14 nt, Homo sapiens
gcagaugccaguga

SEQ ID NO: 2175974 - RNA, 14 nt, Homo sapiens
accugcugugauac

SEQ ID NO: 2175975 - RNA, 14 nt, Homo sapiens
ugcagaugacaaaa

SEQ ID NO: 2175976 - RNA, 17 nt, Homo sapiens
aucaggcauuuuuccaa

SEQ ID NO: 2175977 - RNA, 14 nt, Homo sapiens
agugcagagauuaa

SEQ ID NO: 2175978 - RNA, 22 nt, Homo sapiens
ugcuuguauuuuuuaaugcuaa

SEQ ID NO: 2175979 - RNA, 21 nt, Homo sapiens
aagauaugugagaacuuuuca

SEQ ID NO: 2175980 - RNA, 16 nt, Homo sapiens
ucugcccccugcagaa

SEQ ID NO: 2175981 - RNA, 23 nt, Homo sapiens
uaaucauaaauacugcuguauaa

SEQ ID NO: 2175982 - RNA, 18 nt, Homo sapiens
caaucucggcucacugaa

SEQ ID NO: 2175983 - RNA, 15 nt, Homo sapiens
uuuuuaacugauucu

SEQ ID NO: 2175984 - RNA, 21 nt, Homo sapiens
gcguuuguaaugagagcacuu

SEQ ID NO: 2175985 - RNA, 22 nt, Homo sapiens
cauuuauuuccucagcuguaca

SEQ ID NO: 2175986 - RNA, 21 nt, Homo sapiens
aaaaguuuauaaaagugaaua

SEQ ID NO: 2175987 - RNA, 14 nt, Homo sapiens
accaccuaauauca

SEQ ID NO: 2175988 - RNA, 20 nt, Homo sapiens
ucugcacccacgugcauuca

SEQ ID NO: 2175989 - RNA, 15 nt, Homo sapiens
ccaaccaaugcacac

SEQ ID NO: 2175990 - RNA, 15 nt, Homo sapiens
cuugcugacaauaaa

SEQ ID NO: 2175991 - RNA, 12 nt, Homo sapiens
uaggcagaucac

SEQ ID NO: 2175992 - RNA, 19 nt, Homo sapiens
aaauauagacauucucaca

SEQ ID NO: 2175993 - RNA, 13 nt, Homo sapiens
ggccagaauuuca

SEQ ID NO: 2175994 - RNA, 17 nt, Homo sapiens
gguuaaacaaaccagaa

SEQ ID NO: 2175995 - RNA, 22 nt, Homo sapiens
augcuggagaaaaauaucugua

SEQ ID NO: 2175996 - RNA, 18 nt, Homo sapiens
aaauucucucucuugcag

SEQ ID NO: 2175997 - RNA, 17 nt, Homo sapiens
agagucaagcucuguca

SEQ ID NO: 2175998 - RNA, 21 nt, Homo sapiens
gaagauuucauggacacugau

SEQ ID NO: 2175999 - RNA, 18 nt, Homo sapiens
acuauccaacuuaacaug

SEQ ID NO: 2176000 - RNA, 17 nt, Homo sapiens
ccuccugggaacacauc

SEQ ID NO: 2176001 - RNA, 13 nt, Homo sapiens
agggcaaccaaua

SEQ ID NO: 2176002 - RNA, 23 nt, Homo sapiens
gauacacugaaguuaacagagac

SEQ ID NO: 2176003 - RNA, 20 nt, Homo sapiens
cugcuaacaagucaccaaaa

SEQ ID NO: 2176004 - RNA, 19 nt, Homo sapiens
acuguuuauuugcacuaug

SEQ ID NO: 2176005 - RNA, 19 nt, Homo sapiens
gcacccaagaccucagggc

SEQ ID NO: 2176006 - RNA, 22 nt, Homo sapiens
uuaaaaaaauggcagugaugaa

SEQ ID NO: 2176007 - RNA, 10 nt, Homo sapiens
ccaacacuug

SEQ ID NO: 2176008 - RNA, 16 nt, Homo sapiens
aaaguaaagaaaugca

SEQ ID NO: 2176009 - RNA, 14 nt, Homo sapiens
aaauuuacugugag

SEQ ID NO: 2176010 - RNA, 17 nt, Homo sapiens
auuuauaaaacuucuca

SEQ ID NO: 2176011 - RNA, 23 nt, Homo sapiens
ugacugugcaugacagcggcaau

SEQ ID NO: 2176012 - RNA, 20 nt, Homo sapiens
cucagcccuggaggugccag

SEQ ID NO: 2176013 - RNA, 15 nt, Homo sapiens
aucugaaacuuccca

SEQ ID NO: 2176014 - RNA, 14 nt, Homo sapiens
gagggaccuuggag

SEQ ID NO: 2176015 - RNA, 14 nt, Homo sapiens
ugugugaagaaagc

SEQ ID NO: 2176016 - RNA, 20 nt, Homo sapiens
cuuaacacugaaauugccug

SEQ ID NO: 2176017 - RNA, 14 nt, Homo sapiens
gccagugccucuca

SEQ ID NO: 2176018 - RNA, 15 nt, Homo sapiens
aagaaaaacuagaca

SEQ ID NO: 2176019 - RNA, 14 nt, Homo sapiens
uucauuuaccucua

SEQ ID NO: 2176020 - RNA, 15 nt, Homo sapiens
ggaaagaacugucau

SEQ ID NO: 2176021 - RNA, 13 nt, Homo sapiens
aagaaggcauuug

SEQ ID NO: 2176022 - RNA, 16 nt, Homo sapiens
ccugccucuccgcccc

SEQ ID NO: 2176023 - RNA, 16 nt, Homo sapiens
cauauauauacauaca

SEQ ID NO: 2176024 - RNA, 16 nt, Homo sapiens
caucucuuuaccuccu

SEQ ID NO: 2176025 - RNA, 21 nt, Homo sapiens
uuccuaaaccauucaccaaga

SEQ ID NO: 2176026 - RNA, 17 nt, Homo sapiens
auuuacuggugcagaug

SEQ ID NO: 2176027 - RNA, 16 nt, Homo sapiens
aaauuccuccuucccc

SEQ ID NO: 2176028 - RNA, 16 nt, Homo sapiens
acucuugccaaccugu

SEQ ID NO: 2176029 - RNA, 17 nt, Homo sapiens
gagagggcaaagggaug

SEQ ID NO: 2176030 - RNA, 13 nt, Homo sapiens
ccuuuucucucac

SEQ ID NO: 2176031 - RNA, 21 nt, Homo sapiens
aaaugauggcaaaaacaaagg

SEQ ID NO: 2176032 - RNA, 15 nt, Homo sapiens
uauaaaggugugcug

SEQ ID NO: 2176033 - RNA, 16 nt, Homo sapiens
cagaggugcagcugga

SEQ ID NO: 2176034 - RNA, 16 nt, Homo sapiens
gcccuuuggccaguga

SEQ ID NO: 2176035 - RNA, 22 nt, Homo sapiens
uuucaugaaaagauuaugaucu

SEQ ID NO: 2176036 - RNA, 19 nt, Homo sapiens
guuuccucaaacugugauu

SEQ ID NO: 2176037 - RNA, 16 nt, Homo sapiens
ucucagcaaguguaca

SEQ ID NO: 2176038 - RNA, 16 nt, Homo sapiens
cuugaauagucucauc

SEQ ID NO: 2176039 - RNA, 17 nt, Homo sapiens
ucuaggcagcaccuuag

SEQ ID NO: 2176040 - RNA, 14 nt, Homo sapiens
uuaccagcaagaau

SEQ ID NO: 2176041 - RNA, 12 nt, Homo sapiens
uggaacagugca

SEQ ID NO: 2176042 - RNA, 12 nt, Homo sapiens
gcugagagccau

SEQ ID NO: 2176043 - RNA, 14 nt, Homo sapiens
uucuguguauuuaa

SEQ ID NO: 2176044 - RNA, 16 nt, Homo sapiens
ggauugccacuaagua

SEQ ID NO: 2176045 - RNA, 19 nt, Homo sapiens
ugaucccagcucacugcaa

SEQ ID NO: 2176046 - RNA, 14 nt, Homo sapiens
accaacaaauauag

SEQ ID NO: 2176047 - RNA, 20 nt, Homo sapiens
aucuuuaaagccgugcucuu

SEQ ID NO: 2176048 - RNA, 20 nt, Homo sapiens
cuuacguuuuucuggugcuu

SEQ ID NO: 2176049 - RNA, 20 nt, Homo sapiens
ggacagaaugugucucagga

SEQ ID NO: 2176050 - RNA, 18 nt, Homo sapiens
gauuucuccaaaucuggg

SEQ ID NO: 2176051 - RNA, 16 nt, Homo sapiens
aagggcugaacccuca

SEQ ID NO: 2176052 - RNA, 20 nt, Homo sapiens
auuauauaaggacagaccaa

SEQ ID NO: 2176053 - RNA, 20 nt, Homo sapiens
uagcccccgagggauguccu

SEQ ID NO: 2176054 - RNA, 15 nt, Homo sapiens
auucaaaaaaauccu

SEQ ID NO: 2176055 - RNA, 15 nt, Homo sapiens
agacauaucacucaa

SEQ ID NO: 2176056 - RNA, 13 nt, Homo sapiens
aaaagugucucaa

SEQ ID NO: 2176057 - RNA, 12 nt, Homo sapiens
gugguaccagcu

SEQ ID NO: 2176058 - RNA, 20 nt, Homo sapiens
guccagagcuggaucucuca

SEQ ID NO: 2176059 - RNA, 19 nt, Homo sapiens
guaaagucaacauaugcaa

SEQ ID NO: 2176060 - RNA, 19 nt, Homo sapiens
agaggagccaccaguucuc

SEQ ID NO: 2176061 - RNA, 12 nt, Homo sapiens
ugggcaugugau

SEQ ID NO: 2176062 - RNA, 23 nt, Homo sapiens
aggauguugccacuggcaaaugu

SEQ ID NO: 2176063 - RNA, 14 nt, Homo sapiens
aaggaaaaagcaga

SEQ ID NO: 2176064 - RNA, 19 nt, Homo sapiens
aagaccuucugaagaucuc

SEQ ID NO: 2176065 - RNA, 18 nt, Homo sapiens
acaguuuuugacauuuau

SEQ ID NO: 2176066 - RNA, 11 nt, Homo sapiens
aaaaugccaag

SEQ ID NO: 2176067 - RNA, 19 nt, Homo sapiens
agccccaagcuucugaguc

SEQ ID NO: 2176068 - RNA, 15 nt, Homo sapiens
aauuuucauuuuaca

SEQ ID NO: 2176069 - RNA, 19 nt, Homo sapiens
cuccucggucgccccgugu

SEQ ID NO: 2176070 - RNA, 21 nt, Homo sapiens
uuggaagaggaacagcacugg

SEQ ID NO: 2176071 - RNA, 13 nt, Homo sapiens
aguucacugcaac

SEQ ID NO: 2176072 - RNA, 21 nt, Homo sapiens
ugauguuauuuuguacguguu

SEQ ID NO: 2176073 - RNA, 17 nt, Homo sapiens
uccagaugcagggcagu

SEQ ID NO: 2176074 - RNA, 15 nt, Homo sapiens
ccagcgucccagucu

SEQ ID NO: 2176075 - RNA, 12 nt, Homo sapiens
aaagcugccccu

SEQ ID NO: 2176076 - RNA, 15 nt, Homo sapiens
uggguuuuuuaguug

SEQ ID NO: 2176077 - RNA, 14 nt, Homo sapiens
gauuagaaugccuc

SEQ ID NO: 2176078 - RNA, 17 nt, Homo sapiens
gauuuaaagaauucucu

SEQ ID NO: 2176079 - RNA, 21 nt, Homo sapiens
cuuuuaaaaucagugauuugg

SEQ ID NO: 2176080 - RNA, 13 nt, Homo sapiens
ugaguaauggcug

SEQ ID NO: 2176081 - RNA, 22 nt, Homo sapiens
cuuuauucugcaagcaaucaaa

SEQ ID NO: 2176082 - RNA, 19 nt, Homo sapiens
gaguuuauuggaggaucaa

SEQ ID NO: 2176083 - RNA, 13 nt, Homo sapiens
ugucugugccaug

SEQ ID NO: 2176084 - RNA, 14 nt, Homo sapiens
uaagaugucuugaa

SEQ ID NO: 2176085 - RNA, 22 nt, Homo sapiens
aaucauguuuuuucugcaauga

SEQ ID NO: 2176086 - RNA, 15 nt, Homo sapiens
aaaucuaggauuauu

SEQ ID NO: 2176087 - RNA, 15 nt, Homo sapiens
aacagaaaugcauga

SEQ ID NO: 2176088 - RNA, 14 nt, Homo sapiens
uguaacauccaugu

SEQ ID NO: 2176089 - RNA, 14 nt, Homo sapiens
aggucagcgugcuu

SEQ ID NO: 2176090 - RNA, 23 nt, Homo sapiens
caauggcccggccccuccugacu

SEQ ID NO: 2176091 - RNA, 15 nt, Homo sapiens
ugccagagauguacu

SEQ ID NO: 2176092 - RNA, 20 nt, Homo sapiens
cucuagcauucuaguuucau

SEQ ID NO: 2176093 - RNA, 14 nt, Homo sapiens
cccucucacuccag

SEQ ID NO: 2176094 - RNA, 19 nt, Homo sapiens
gcagggugaaguguacaga

SEQ ID NO: 2176095 - RNA, 18 nt, Homo sapiens
ucaggggaagauuuagaa

SEQ ID NO: 2176096 - RNA, 15 nt, Homo sapiens
uuaugucauaccuuu

SEQ ID NO: 2176097 - RNA, 15 nt, Homo sapiens
gaacacacaucccag

SEQ ID NO: 2176098 - RNA, 24 nt, Homo sapiens
uuuuuguggauggggacuugugaa

SEQ ID NO: 2176099 - RNA, 13 nt, Homo sapiens
acuaauucucaca

SEQ ID NO: 2176100 - RNA, 18 nt, Homo sapiens
ugaggguauaaagacauc

SEQ ID NO: 2176101 - RNA, 22 nt, Homo sapiens
uauaaauguacuacauuugcau

SEQ ID NO: 2176102 - RNA, 23 nt, Homo sapiens
aacucccugagagccacaggugc

SEQ ID NO: 2176103 - RNA, 18 nt, Homo sapiens
aaggaggcccuugcuugg

SEQ ID NO: 2176104 - RNA, 18 nt, Homo sapiens
cauuaggcuuacguacua

SEQ ID NO: 2176105 - RNA, 15 nt, Homo sapiens
ucgaccuacugaaaa

SEQ ID NO: 2176106 - RNA, 22 nt, Homo sapiens
ucauuauuccucagauugcuga

SEQ ID NO: 2176107 - RNA, 16 nt, Homo sapiens
aaaauuaaacuacaga

SEQ ID NO: 2176108 - RNA, 12 nt, Homo sapiens
aacguccacaaa

SEQ ID NO: 2176109 - RNA, 18 nt, Homo sapiens
ugcagaaaauugccuaaa

SEQ ID NO: 2176110 - RNA, 21 nt, Homo sapiens
ugguugaaaagauuccauuuu

SEQ ID NO: 2176111 - RNA, 19 nt, Homo sapiens
uauauaauaaagcuacuga

SEQ ID NO: 2176112 - RNA, 21 nt, Homo sapiens
gcaaagggccugcccagacaa

SEQ ID NO: 2176113 - RNA, 19 nt, Homo sapiens
ggauaucauacuuccaucu

SEQ ID NO: 2176114 - RNA, 12 nt, Homo sapiens
agugagccagca

SEQ ID NO: 2176115 - RNA, 12 nt, Homo sapiens
ugcgagccugua

SEQ ID NO: 2176116 - RNA, 22 nt, Homo sapiens
acccuaaagcgacaucccagua

SEQ ID NO: 2176117 - RNA, 20 nt, Homo sapiens
uuuucucggagcauauaugu

SEQ ID NO: 2176118 - RNA, 15 nt, Homo sapiens
auguucuagucugcu

SEQ ID NO: 2176119 - RNA, 20 nt, Homo sapiens
uugaaaacugacaucagauu

SEQ ID NO: 2176120 - RNA, 15 nt, Homo sapiens
auccacaacuuuuca

SEQ ID NO: 2176121 - RNA, 15 nt, Homo sapiens
ucuucucauucccau

SEQ ID NO: 2176122 - RNA, 18 nt, Homo sapiens
ucagaaggcaaaugacuu

SEQ ID NO: 2176123 - RNA, 20 nt, Homo sapiens
acuuaaaaaauguccaugau

SEQ ID NO: 2176124 - RNA, 23 nt, Homo sapiens
ugcacuaaaucagagacaaaaua

SEQ ID NO: 2176125 - RNA, 20 nt, Homo sapiens
gaagaagucuaagagugaag

SEQ ID NO: 2176126 - RNA, 19 nt, Homo sapiens
caggcagaucccacuugca

SEQ ID NO: 2176127 - RNA, 15 nt, Homo sapiens
agugcgaguccucca

SEQ ID NO: 2176128 - RNA, 12 nt, Homo sapiens
accagaggucag

SEQ ID NO: 2176129 - RNA, 16 nt, Homo sapiens
caaaaacaguaaaaau

SEQ ID NO: 2176130 - RNA, 12 nt, Homo sapiens
cuauuccugcug

SEQ ID NO: 2176131 - RNA, 20 nt, Homo sapiens
aaaucaucuuuguuggcuca

SEQ ID NO: 2176132 - RNA, 21 nt, Homo sapiens
agggugcagcccaaucugcca

SEQ ID NO: 2176133 - RNA, 17 nt, Homo sapiens
cucagaauccacagugu

SEQ ID NO: 2176134 - RNA, 22 nt, Homo sapiens
guauuauuacggagacuuucaa

SEQ ID NO: 2176135 - RNA, 17 nt, Homo sapiens
cggcccagaaguuuccc

SEQ ID NO: 2176136 - RNA, 16 nt, Homo sapiens
ugaaauaaugcacuga

SEQ ID NO: 2176137 - RNA, 20 nt, Homo sapiens
uugguuuucaucaugauuaa

SEQ ID NO: 2176138 - RNA, 21 nt, Homo sapiens
guuccccagcugaucauguca

SEQ ID NO: 2176139 - RNA, 13 nt, Homo sapiens
aggauaagccacu

SEQ ID NO: 2176140 - RNA, 20 nt, Homo sapiens
uggcacuuaguagguccuca

SEQ ID NO: 2176141 - RNA, 23 nt, Homo sapiens
gcugcacauugccuguucugcuu

SEQ ID NO: 2176142 - RNA, 20 nt, Homo sapiens
cacuuaauaaucaaccuggg

SEQ ID NO: 2176143 - RNA, 12 nt, Homo sapiens
uccucacacaga

SEQ ID NO: 2176144 - RNA, 13 nt, Homo sapiens
cuacaaagaccua

SEQ ID NO: 2176145 - RNA, 13 nt, Homo sapiens
cucuuaagacacu

SEQ ID NO: 2176146 - RNA, 10 nt, Homo sapiens
gacucuggaa

SEQ ID NO: 2176147 - RNA, 15 nt, Homo sapiens
uacacuaguccauaa

SEQ ID NO: 2176148 - RNA, 12 nt, Homo sapiens
cugauugcugag

SEQ ID NO: 2176149 - RNA, 16 nt, Homo sapiens
ccaacuccucuaguca

SEQ ID NO: 2176150 - RNA, 20 nt, Homo sapiens
ggcccagccacugcagcaca

SEQ ID NO: 2176151 - RNA, 14 nt, Homo sapiens
auaaagucuugccu

SEQ ID NO: 2176152 - RNA, 16 nt, Homo sapiens
cuguaauaauaccuca

SEQ ID NO: 2176153 - RNA, 18 nt, Homo sapiens
auaaaagucagagcucag

SEQ ID NO: 2176154 - RNA, 11 nt, Homo sapiens
acccacacugc

SEQ ID NO: 2176155 - RNA, 23 nt, Homo sapiens
aaaaauagaaaauuuucuagucc

SEQ ID NO: 2176156 - RNA, 15 nt, Homo sapiens
gcucaucauauucca

SEQ ID NO: 2176157 - RNA, 13 nt, Homo sapiens
gaacagagucuca

SEQ ID NO: 2176158 - RNA, 13 nt, Homo sapiens
cugguuugacuca

SEQ ID NO: 2176159 - RNA, 12 nt, Homo sapiens
uucauugcacuu

SEQ ID NO: 2176160 - RNA, 23 nt, Homo sapiens
gaagcagaaugagaugauuuaau

SEQ ID NO: 2176161 - RNA, 21 nt, Homo sapiens
uagaacuguuggauacaggag

SEQ ID NO: 2176162 - RNA, 18 nt, Homo sapiens
aauuacuuuuucauucuu

SEQ ID NO: 2176163 - RNA, 19 nt, Homo sapiens
cuuuucaaaauuggacuua

SEQ ID NO: 2176164 - RNA, 16 nt, Homo sapiens
cuucuuuauugcacua

SEQ ID NO: 2176165 - RNA, 17 nt, Homo sapiens
ccuguccuuucuugcag

SEQ ID NO: 2176166 - RNA, 15 nt, Homo sapiens
aacugggguggauuu

SEQ ID NO: 2176167 - RNA, 15 nt, Homo sapiens
uagacucauucuuca

SEQ ID NO: 2176168 - RNA, 23 nt, Homo sapiens
ggcggcacauuggcaguguguca

SEQ ID NO: 2176169 - RNA, 15 nt, Homo sapiens
gacuagagcucaggc

SEQ ID NO: 2176170 - RNA, 14 nt, Homo sapiens
aggccugugccuug

SEQ ID NO: 2176171 - RNA, 15 nt, Homo sapiens
ugagauugugcccag

SEQ ID NO: 2176172 - RNA, 20 nt, Homo sapiens
cuuuuugguuuuuacuuaac

SEQ ID NO: 2176173 - RNA, 16 nt, Homo sapiens
acugucagggucuuuc

SEQ ID NO: 2176174 - RNA, 14 nt, Homo sapiens
ucauggauuacuuc

SEQ ID NO: 2176175 - RNA, 21 nt, Homo sapiens
ggccaagccugccccggccac

SEQ ID NO: 2176176 - RNA, 21 nt, Homo sapiens
agcucucgggacuagcugccu

SEQ ID NO: 2176177 - RNA, 15 nt, Homo sapiens
auuucauaccaugga

SEQ ID NO: 2176178 - RNA, 19 nt, Homo sapiens
gccaaccuggaauggagac

SEQ ID NO: 2176179 - RNA, 15 nt, Homo sapiens
auugaacuuaugcaa

SEQ ID NO: 2176180 - RNA, 14 nt, Homo sapiens
accuuccacccagu

SEQ ID NO: 2176181 - RNA, 18 nt, Homo sapiens
caagcuuaaagcuugauu

SEQ ID NO: 2176182 - RNA, 17 nt, Homo sapiens
agccugugcuguggcau

SEQ ID NO: 2176183 - RNA, 23 nt, Homo sapiens
cuggaccauuccaggaaaacugg

SEQ ID NO: 2176184 - RNA, 21 nt, Homo sapiens
gagucuuugauucaccaaaca

SEQ ID NO: 2176185 - RNA, 15 nt, Homo sapiens
gcuucaauacccaaa

SEQ ID NO: 2176186 - RNA, 17 nt, Homo sapiens
uucugcaggcuguaugg

SEQ ID NO: 2176187 - RNA, 22 nt, Homo sapiens
acaaguugagcuaugacuuaac

SEQ ID NO: 2176188 - RNA, 19 nt, Homo sapiens
ucaauucucaauauauuca

SEQ ID NO: 2176189 - RNA, 23 nt, Homo sapiens
ccuagcugggccaacuccaguga

SEQ ID NO: 2176190 - RNA, 18 nt, Homo sapiens
acuuucaagaaucagaca

SEQ ID NO: 2176191 - RNA, 14 nt, Homo sapiens
aaaauaaugcaguu

SEQ ID NO: 2176192 - RNA, 16 nt, Homo sapiens
cuccccacuccagaag

SEQ ID NO: 2176193 - RNA, 21 nt, Homo sapiens
ggcagggcuuuggggggcacu

SEQ ID NO: 2176194 - RNA, 23 nt, Homo sapiens
auuagaagaaaauggaugacaaa

SEQ ID NO: 2176195 - RNA, 19 nt, Homo sapiens
gggcccugugcgucucagu

SEQ ID NO: 2176196 - RNA, 12 nt, Homo sapiens
auccuaccccac

SEQ ID NO: 2176197 - RNA, 14 nt, Homo sapiens
uucugggacugugc

SEQ ID NO: 2176198 - RNA, 15 nt, Homo sapiens
aaugcucacuggggu

SEQ ID NO: 2176199 - RNA, 20 nt, Homo sapiens
ggaggugggggccuccucag

SEQ ID NO: 2176200 - RNA, 12 nt, Homo sapiens
cauauccugccu

SEQ ID NO: 2176201 - RNA, 15 nt, Homo sapiens
cugagaaauguucag

SEQ ID NO: 2176202 - RNA, 18 nt, Homo sapiens
uccaagcaagacugaggg

SEQ ID NO: 2176203 - RNA, 16 nt, Homo sapiens
aucacaccucugggcu

SEQ ID NO: 2176204 - RNA, 21 nt, Homo sapiens
accauucuaccugaggccagg

SEQ ID NO: 2176205 - RNA, 23 nt, Homo sapiens
acccugggcuguccagccuuaau

SEQ ID NO: 2176206 - RNA, 19 nt, Homo sapiens
cagccuggucaauauagca

SEQ ID NO: 2176207 - RNA, 20 nt, Homo sapiens
caauaaagggagaauggugc

SEQ ID NO: 2176208 - RNA, 15 nt, Homo sapiens
agucccagcuacuug

SEQ ID NO: 2176209 - RNA, 15 nt, Homo sapiens
ucuuucuaucaaaua

SEQ ID NO: 2176210 - RNA, 15 nt, Homo sapiens
acaugcgugugucag

SEQ ID NO: 2176211 - RNA, 18 nt, Homo sapiens
gucuuggggccacuuuca

SEQ ID NO: 2176212 - RNA, 18 nt, Homo sapiens
caggcaugugucuggccc

SEQ ID NO: 2176213 - RNA, 23 nt, Homo sapiens
aacuugcacaaaaucacacagcc

SEQ ID NO: 2176214 - RNA, 16 nt, Homo sapiens
augguggcauauacuu

SEQ ID NO: 2176215 - RNA, 18 nt, Homo sapiens
agugcaugucacaugcca

SEQ ID NO: 2176216 - RNA, 17 nt, Homo sapiens
ugcaaccuuugccuccc

SEQ ID NO: 2176217 - RNA, 15 nt, Homo sapiens
aaguuuacacuucau

SEQ ID NO: 2176218 - RNA, 15 nt, Homo sapiens
gucaggaugcacauu

SEQ ID NO: 2176219 - RNA, 15 nt, Homo sapiens
accaguuuauacaga

SEQ ID NO: 2176220 - RNA, 19 nt, Homo sapiens
ccagagagaacaacaggca

SEQ ID NO: 2176221 - RNA, 17 nt, Homo sapiens
aauggacaaacugccag

SEQ ID NO: 2176222 - RNA, 13 nt, Homo sapiens
uaccuaaacugag

SEQ ID NO: 2176223 - RNA, 14 nt, Homo sapiens
aggaaggacugucc

SEQ ID NO: 2176224 - RNA, 13 nt, Homo sapiens
ucuucaugagcuu

SEQ ID NO: 2176225 - RNA, 23 nt, Homo sapiens
uuacucaaggaauuugcauuuag

SEQ ID NO: 2176226 - RNA, 22 nt, Homo sapiens
aauaagauugcgccugagauac

SEQ ID NO: 2176227 - RNA, 18 nt, Homo sapiens
agcuccugaguggaauca

SEQ ID NO: 2176228 - RNA, 13 nt, Homo sapiens
aaaccaagccaug

SEQ ID NO: 2176229 - RNA, 21 nt, Homo sapiens
ugcugacuacuacucugccaa

SEQ ID NO: 2176230 - RNA, 21 nt, Homo sapiens
agcacaccuacagagcaccug

SEQ ID NO: 2176231 - RNA, 21 nt, Homo sapiens
agcuguaagauaauguugcuu

SEQ ID NO: 2176232 - RNA, 15 nt, Homo sapiens
aucucugaggcaugg

SEQ ID NO: 2176233 - RNA, 19 nt, Homo sapiens
ucuugugaaggccaugaua

SEQ ID NO: 2176234 - RNA, 19 nt, Homo sapiens
agacucaagggggugacag

SEQ ID NO: 2176235 - RNA, 21 nt, Homo sapiens
gcucuucuaaccucagccaaa

SEQ ID NO: 2176236 - RNA, 16 nt, Homo sapiens
uggucuccucucagcu

SEQ ID NO: 2176237 - RNA, 19 nt, Homo sapiens
ucugccccagguacaccuc

SEQ ID NO: 2176238 - RNA, 14 nt, Homo sapiens
ugguaguggcaaag

SEQ ID NO: 2176239 - RNA, 15 nt, Homo sapiens
ucauuuuugcacuua

SEQ ID NO: 2176240 - RNA, 18 nt, Homo sapiens
gucaguggaagaagcaga

SEQ ID NO: 2176241 - RNA, 15 nt, Homo sapiens
ugagaugguggcauu

SEQ ID NO: 2176242 - RNA, 14 nt, Homo sapiens
ugaauccucucuuc

SEQ ID NO: 2176243 - RNA, 19 nt, Homo sapiens
gacuccacugcgccuggga

SEQ ID NO: 2176244 - RNA, 15 nt, Homo sapiens
aggucaaaaacaaac

SEQ ID NO: 2176245 - RNA, 16 nt, Homo sapiens
uggcgggcaccuguag

SEQ ID NO: 2176246 - RNA, 23 nt, Homo sapiens
ugacaguuuccagaugcuaucac

SEQ ID NO: 2176247 - RNA, 19 nt, Homo sapiens
ucgagcagaugaugccaac

SEQ ID NO: 2176248 - RNA, 22 nt, Homo sapiens
auccuggguggucugcaggcag

SEQ ID NO: 2176249 - RNA, 21 nt, Homo sapiens
aaacccaccaaucuacuuugu

SEQ ID NO: 2176250 - RNA, 18 nt, Homo sapiens
auggggugggagacuuuc

SEQ ID NO: 2176251 - RNA, 14 nt, Homo sapiens
acuggccagccaau

SEQ ID NO: 2176252 - RNA, 13 nt, Homo sapiens
uuugagacagagu

SEQ ID NO: 2176253 - RNA, 12 nt, Homo sapiens
ccaccugccauu

SEQ ID NO: 2176254 - RNA, 12 nt, Homo sapiens
ccuucugccaac

SEQ ID NO: 2176255 - RNA, 23 nt, Homo sapiens
uauauuucauuuuaaaauuugag

SEQ ID NO: 2176256 - RNA, 17 nt, Homo sapiens
caacacuuucugcacuu

SEQ ID NO: 2176257 - RNA, 21 nt, Homo sapiens
gcucauaaaauggaagcaauu

SEQ ID NO: 2176258 - RNA, 12 nt, Homo sapiens
uggccaaugggg

SEQ ID NO: 2176259 - RNA, 22 nt, Homo sapiens
aaugccacucuguaauugcaaa

SEQ ID NO: 2176260 - RNA, 14 nt, Homo sapiens
uaaagagugcuaca

SEQ ID NO: 2176261 - RNA, 15 nt, Homo sapiens
uaauuuaugugcuau

SEQ ID NO: 2176262 - RNA, 14 nt, Homo sapiens
auauguagccuuca

SEQ ID NO: 2176263 - RNA, 20 nt, Homo sapiens
accuacuuuucuuuccucag

SEQ ID NO: 2176264 - RNA, 19 nt, Homo sapiens
uccaacuuuaucauggaau

SEQ ID NO: 2176265 - RNA, 13 nt, Homo sapiens
agccuucugauga

SEQ ID NO: 2176266 - RNA, 21 nt, Homo sapiens
cucugcagcuuucaagcucau

SEQ ID NO: 2176267 - RNA, 16 nt, Homo sapiens
gcuccugggcagcuug

SEQ ID NO: 2176268 - RNA, 20 nt, Homo sapiens
cuauaagaugaaacaucauu

SEQ ID NO: 2176269 - RNA, 12 nt, Homo sapiens
augacaaaaagc

SEQ ID NO: 2176270 - RNA, 23 nt, Homo sapiens
uuuuuaaaauucuaaguagagua

SEQ ID NO: 2176271 - RNA, 16 nt, Homo sapiens
gauaugggacugagcc

SEQ ID NO: 2176272 - RNA, 22 nt, Homo sapiens
uuuucuucagguaacacuacag

SEQ ID NO: 2176273 - RNA, 19 nt, Homo sapiens
cuugccuggugaccuacua

SEQ ID NO: 2176274 - RNA, 22 nt, Homo sapiens
uuggucuucccaggcuggggcu

SEQ ID NO: 2176275 - RNA, 16 nt, Homo sapiens
ugguuguuguauugau

SEQ ID NO: 2176276 - RNA, 19 nt, Homo sapiens
gccgcccuccacaccucua

SEQ ID NO: 2176277 - RNA, 20 nt, Homo sapiens
uccuguggucucugaccagg

SEQ ID NO: 2176278 - RNA, 12 nt, Homo sapiens
gaagaacaucug

SEQ ID NO: 2176279 - RNA, 23 nt, Homo sapiens
ugaacuccugggcucaagugauc

SEQ ID NO: 2176280 - RNA, 18 nt, Homo sapiens
ucugccggucccccaugc

SEQ ID NO: 2176281 - RNA, 23 nt, Homo sapiens
ugugcacuugcacgcccaugugu

SEQ ID NO: 2176282 - RNA, 15 nt, Homo sapiens
uugcuucugugcaau

SEQ ID NO: 2176283 - RNA, 21 nt, Homo sapiens
agacaugagugcgugcucagu

SEQ ID NO: 2176284 - RNA, 20 nt, Homo sapiens
agcuuccuuaaguauaucau

SEQ ID NO: 2176285 - RNA, 11 nt, Homo sapiens
ccaucaguggu

SEQ ID NO: 2176286 - RNA, 17 nt, Homo sapiens
aggggagaagucagcua

SEQ ID NO: 2176287 - RNA, 22 nt, Homo sapiens
acgucuggacugcuauucuaga

SEQ ID NO: 2176288 - RNA, 18 nt, Homo sapiens
aggucucagaugagcuua

SEQ ID NO: 2176289 - RNA, 19 nt, Homo sapiens
auucuauuuauauguacau

SEQ ID NO: 2176290 - RNA, 16 nt, Homo sapiens
uugccugccacugagc

SEQ ID NO: 2176291 - RNA, 23 nt, Homo sapiens
gcuguuuuaucguuaagugcccc

SEQ ID NO: 2176292 - RNA, 12 nt, Homo sapiens
uuggaaagcagc

SEQ ID NO: 2176293 - RNA, 15 nt, Homo sapiens
guucuuccuaccaaa

SEQ ID NO: 2176294 - RNA, 18 nt, Homo sapiens
cccacuggaucuucagaa

SEQ ID NO: 2176295 - RNA, 21 nt, Homo sapiens
ccuaacugaaagaugaucauu

SEQ ID NO: 2176296 - RNA, 19 nt, Homo sapiens
cauuucaggacucucucca

SEQ ID NO: 2176297 - RNA, 23 nt, Homo sapiens
aauaacuaaaagguaugcaauca

SEQ ID NO: 2176298 - RNA, 13 nt, Homo sapiens
cauucuuccaaaa

SEQ ID NO: 2176299 - RNA, 22 nt, Homo sapiens
ccugacccagcccugaacaaag

SEQ ID NO: 2176300 - RNA, 21 nt, Homo sapiens
cuaucgucaggaaaccaaaua

SEQ ID NO: 2176301 - RNA, 17 nt, Homo sapiens
cuccccuucacucccac

SEQ ID NO: 2176302 - RNA, 19 nt, Homo sapiens
ucuuaugaaaugggcuuua

SEQ ID NO: 2176303 - RNA, 13 nt, Homo sapiens
gcuggagugcagu

SEQ ID NO: 2176304 - RNA, 13 nt, Homo sapiens
gcuagagugcaau

SEQ ID NO: 2176305 - RNA, 19 nt, Homo sapiens
acaguuuuuuacauauuaa

SEQ ID NO: 2176306 - RNA, 13 nt, Homo sapiens
gacacuuuaccuc

SEQ ID NO: 2176307 - RNA, 13 nt, Homo sapiens
aauuauuugcuaa

SEQ ID NO: 2176308 - RNA, 13 nt, Homo sapiens
cuuucaugcuccu

SEQ ID NO: 2176309 - RNA, 13 nt, Homo sapiens
cauccaugcacuu

SEQ ID NO: 2176310 - RNA, 22 nt, Homo sapiens
caaaaauugaagagagauauau

SEQ ID NO: 2176311 - RNA, 16 nt, Homo sapiens
uugagguccacacuga

SEQ ID NO: 2176312 - RNA, 18 nt, Homo sapiens
cucucggcuucaccaggg

SEQ ID NO: 2176313 - RNA, 22 nt, Homo sapiens
ugcagcccacagaggacagugc

SEQ ID NO: 2176314 - RNA, 22 nt, Homo sapiens
gggaucucaaugcuuuccacau

SEQ ID NO: 2176315 - RNA, 15 nt, Homo sapiens
aaccuucaacccagu

SEQ ID NO: 2176316 - RNA, 14 nt, Homo sapiens
cugguuugccugaa

SEQ ID NO: 2176317 - RNA, 12 nt, Homo sapiens
agccgcugugag

SEQ ID NO: 2176318 - RNA, 15 nt, Homo sapiens
cacagcaucagcuca

SEQ ID NO: 2176319 - RNA, 15 nt, Homo sapiens
ucuaugacacaugca

SEQ ID NO: 2176320 - RNA, 19 nt, Homo sapiens
uccauuuugugucugugaa

SEQ ID NO: 2176321 - RNA, 13 nt, Homo sapiens
cugaggaguggag

SEQ ID NO: 2176322 - RNA, 17 nt, Homo sapiens
guaccaaauuuaagcaa

SEQ ID NO: 2176323 - RNA, 15 nt, Homo sapiens
uaacaaacgcauuaa

SEQ ID NO: 2176324 - RNA, 14 nt, Homo sapiens
agacccugccaggg

SEQ ID NO: 2176325 - RNA, 14 nt, Homo sapiens
aggaguuaccuuaa

SEQ ID NO: 2176326 - RNA, 19 nt, Homo sapiens
aagcaagccagccaauaga

SEQ ID NO: 2176327 - RNA, 20 nt, Homo sapiens
uagaugccaaugacauaccu

SEQ ID NO: 2176328 - RNA, 21 nt, Homo sapiens
gauaaugcauaaauguuauau

SEQ ID NO: 2176329 - RNA, 16 nt, Homo sapiens
auguuauuugcucuaa

SEQ ID NO: 2176330 - RNA, 12 nt, Homo sapiens
uggcuccuugcc

SEQ ID NO: 2176331 - RNA, 16 nt, Homo sapiens
accucccagagaguga

SEQ ID NO: 2176332 - RNA, 20 nt, Homo sapiens
acaguuuaauaaauagcauc

SEQ ID NO: 2176333 - RNA, 13 nt, Homo sapiens
ugaguaucuccuc

SEQ ID NO: 2176334 - RNA, 15 nt, Homo sapiens
aguaaaugcuaccuc

SEQ ID NO: 2176335 - RNA, 16 nt, Homo sapiens
caaaauugaugaucca

SEQ ID NO: 2176336 - RNA, 23 nt, Homo sapiens
cauaaguuuacugaaucuucaag

SEQ ID NO: 2176337 - RNA, 23 nt, Homo sapiens
aaauaauuuauaugcaugcacag

SEQ ID NO: 2176338 - RNA, 13 nt, Homo sapiens
uggcagaagucaa

SEQ ID NO: 2176339 - RNA, 17 nt, Homo sapiens
ucagaacaagcaauugu

SEQ ID NO: 2176340 - RNA, 22 nt, Homo sapiens
uucccugcucuugcaguugcuc

SEQ ID NO: 2176341 - RNA, 22 nt, Homo sapiens
gccuagcccuccccccagcucc

SEQ ID NO: 2176342 - RNA, 16 nt, Homo sapiens
gccaaaauauugcuua

SEQ ID NO: 2176343 - RNA, 23 nt, Homo sapiens
ccuuggccucccaaagugcuagu

SEQ ID NO: 2176344 - RNA, 20 nt, Homo sapiens
uugcaauuggaauaaucacu

SEQ ID NO: 2176345 - RNA, 20 nt, Homo sapiens
cugagcugaacccauuuuga

SEQ ID NO: 2176346 - RNA, 19 nt, Homo sapiens
cgugcgcgcgcuucuggga

SEQ ID NO: 2176347 - RNA, 16 nt, Homo sapiens
uauggagaauugcuga

SEQ ID NO: 2176348 - RNA, 23 nt, Homo sapiens
uagggggagcaaaucgugccuug

SEQ ID NO: 2176349 - RNA, 19 nt, Homo sapiens
ucugcgccgagccucagaa

SEQ ID NO: 2176350 - RNA, 21 nt, Homo sapiens
acugucuccacccaccuugac

SEQ ID NO: 2176351 - RNA, 14 nt, Homo sapiens
aagcaauaacuuug

SEQ ID NO: 2176352 - RNA, 22 nt, Homo sapiens
aguccuuuacuaauccaaccca

SEQ ID NO: 2176353 - RNA, 17 nt, Homo sapiens
gcccaggcuggucuuga

SEQ ID NO: 2176354 - RNA, 16 nt, Homo sapiens
aaaaaguguauugcaa

SEQ ID NO: 2176355 - RNA, 19 nt, Homo sapiens
aggccccgcgcgccggugc

SEQ ID NO: 2176356 - RNA, 21 nt, Homo sapiens
ccucagguggccccaguucaa

SEQ ID NO: 2176357 - RNA, 18 nt, Homo sapiens
guuucagcagagcugaaa

SEQ ID NO: 2176358 - RNA, 13 nt, Homo sapiens
uucauuuccagca

SEQ ID NO: 2176359 - RNA, 18 nt, Homo sapiens
cacagccauggcuggaau

SEQ ID NO: 2176360 - RNA, 14 nt, Homo sapiens
aagauacgugcaug

SEQ ID NO: 2176361 - RNA, 18 nt, Homo sapiens
acccagugguccccagag

SEQ ID NO: 2176362 - RNA, 21 nt, Homo sapiens
aaacuuuagaguagcaugaga

SEQ ID NO: 2176363 - RNA, 19 nt, Homo sapiens
ccuugaugugccugugaau

SEQ ID NO: 2176364 - RNA, 23 nt, Homo sapiens
uaacgcagucuaauuacauuuca

SEQ ID NO: 2176365 - RNA, 13 nt, Homo sapiens
caggcgucugcca

SEQ ID NO: 2176366 - RNA, 20 nt, Homo sapiens
accccggggacccugugaca

SEQ ID NO: 2176367 - RNA, 13 nt, Homo sapiens
auuaacuuuacau

SEQ ID NO: 2176368 - RNA, 11 nt, Homo sapiens
guaaacuaaug

SEQ ID NO: 2176369 - RNA, 19 nt, Homo sapiens
aaucaugugcuucauagaa

SEQ ID NO: 2176370 - RNA, 15 nt, Homo sapiens
ucucacuaaaaugga

SEQ ID NO: 2176371 - RNA, 19 nt, Homo sapiens
cccaguuacuuuuuuacac

SEQ ID NO: 2176372 - RNA, 15 nt, Homo sapiens
agcuuggacuacaca

SEQ ID NO: 2176373 - RNA, 16 nt, Homo sapiens
gcuuccacaugugcca

SEQ ID NO: 2176374 - RNA, 18 nt, Homo sapiens
ggacaagagguacagggu

SEQ ID NO: 2176375 - RNA, 19 nt, Homo sapiens
acccagcuucagauaccau

SEQ ID NO: 2176376 - RNA, 17 nt, Homo sapiens
aaaauggaaugcuacuc

SEQ ID NO: 2176377 - RNA, 21 nt, Homo sapiens
gaaaccccaucucuacuaaaa

SEQ ID NO: 2176378 - RNA, 14 nt, Homo sapiens
ugcacaauauuucu

SEQ ID NO: 2176379 - RNA, 10 nt, Homo sapiens
cuagucaucg

SEQ ID NO: 2176380 - RNA, 21 nt, Homo sapiens
uccuuuccccucccucaggcc

SEQ ID NO: 2176381 - RNA, 13 nt, Homo sapiens
agucucauucugu

SEQ ID NO: 2176382 - RNA, 20 nt, Homo sapiens
cucagugggggcagagccac

SEQ ID NO: 2176383 - RNA, 17 nt, Homo sapiens
ucugucuagacuggccu

SEQ ID NO: 2176384 - RNA, 20 nt, Homo sapiens
ccaaaagcccauucauucca

SEQ ID NO: 2176385 - RNA, 9 nt, Homo sapiens
aauguaucu

SEQ ID NO: 2176386 - RNA, 17 nt, Homo sapiens
ugcuacauauaugcaau

SEQ ID NO: 2176387 - RNA, 13 nt, Homo sapiens
cccagcucgcugg

SEQ ID NO: 2176388 - RNA, 19 nt, Homo sapiens
cagagagucccacugccuc

SEQ ID NO: 2176389 - RNA, 17 nt, Homo sapiens
cuugagggaaucauggg

SEQ ID NO: 2176390 - RNA, 22 nt, Homo sapiens
uaaagaaaaaagcaccaaaggg

SEQ ID NO: 2176391 - RNA, 11 nt, Homo sapiens
cagcucugcaa

SEQ ID NO: 2176392 - RNA, 18 nt, Homo sapiens
aagagccaucugaagcca

SEQ ID NO: 2176393 - RNA, 18 nt, Homo sapiens
aaaugccaccauccaaua

SEQ ID NO: 2176394 - RNA, 17 nt, Homo sapiens
gagacuagauucucacc

SEQ ID NO: 2176395 - RNA, 16 nt, Homo sapiens
agaggcaacugcccag

SEQ ID NO: 2176396 - RNA, 22 nt, Homo sapiens
ucuuucuuugcaccaaagacau

SEQ ID NO: 2176397 - RNA, 19 nt, Homo sapiens
uauacuuaagaauacacag

SEQ ID NO: 2176398 - RNA, 13 nt, Homo sapiens
cauauauggaaga

SEQ ID NO: 2176399 - RNA, 15 nt, Homo sapiens
uugcagcagaagcca

SEQ ID NO: 2176400 - RNA, 20 nt, Homo sapiens
agcaacauucauagucuuug

SEQ ID NO: 2176401 - RNA, 14 nt, Homo sapiens
gagcuccagcuccu

SEQ ID NO: 2176402 - RNA, 21 nt, Homo sapiens
gaagauugaacccuggcugaa

SEQ ID NO: 2176403 - RNA, 17 nt, Homo sapiens
acuauccaaguguuaua

SEQ ID NO: 2176404 - RNA, 21 nt, Homo sapiens
cuuaccagggccucaguuuca

SEQ ID NO: 2176405 - RNA, 17 nt, Homo sapiens
uaaccugaauuauucca

SEQ ID NO: 2176406 - RNA, 17 nt, Homo sapiens
auaccugauauauucca

SEQ ID NO: 2176407 - RNA, 15 nt, Homo sapiens
caggccacaaaugug

SEQ ID NO: 2176408 - RNA, 19 nt, Homo sapiens
auuucaggaggaauacuga

SEQ ID NO: 2176409 - RNA, 18 nt, Homo sapiens
auuaaugaaaagcagauu

SEQ ID NO: 2176410 - RNA, 23 nt, Homo sapiens
agacuaaccugcccacccacucc

SEQ ID NO: 2176411 - RNA, 23 nt, Homo sapiens
gcccugggcuccucuuagcucag

SEQ ID NO: 2176412 - RNA, 18 nt, Homo sapiens
caugcugaagccaaagcc

SEQ ID NO: 2176413 - RNA, 23 nt, Homo sapiens
gcagcugcaccagcaggugccau

SEQ ID NO: 2176414 - RNA, 22 nt, Homo sapiens
cacaagaauugaguaucacuuu

SEQ ID NO: 2176415 - RNA, 23 nt, Homo sapiens
aucgcagauucucccuugcucug

SEQ ID NO: 2176416 - RNA, 20 nt, Homo sapiens
caucuguuguucugugguca

SEQ ID NO: 2176417 - RNA, 18 nt, Homo sapiens
aaaugggggugcauuuga

SEQ ID NO: 2176418 - RNA, 15 nt, Homo sapiens
ugcuucuacuuucau

SEQ ID NO: 2176419 - RNA, 19 nt, Homo sapiens
ugagucauuauguagcugu

SEQ ID NO: 2176420 - RNA, 22 nt, Homo sapiens
agcagagaccuuccaaggacau

SEQ ID NO: 2176421 - RNA, 18 nt, Homo sapiens
ccugaccccauuccugau

SEQ ID NO: 2176422 - RNA, 15 nt, Homo sapiens
agcuuuggaccuaau

SEQ ID NO: 2176423 - RNA, 15 nt, Homo sapiens
augugacuggcagua

SEQ ID NO: 2176424 - RNA, 16 nt, Homo sapiens
gaggcaggcggaucau

SEQ ID NO: 2176425 - RNA, 23 nt, Homo sapiens
aauuacaaccacagaaagcacuc

SEQ ID NO: 2176426 - RNA, 20 nt, Homo sapiens
acugacccauucacauuuua

SEQ ID NO: 2176427 - RNA, 22 nt, Homo sapiens
uccuguaagucaaaugugugcu

SEQ ID NO: 2176428 - RNA, 19 nt, Homo sapiens
ugugaccacauacguguua

SEQ ID NO: 2176429 - RNA, 18 nt, Homo sapiens
agggugggccuucaggga

SEQ ID NO: 2176430 - RNA, 23 nt, Homo sapiens
auucuaacaaaaagcaauuacua

SEQ ID NO: 2176431 - RNA, 21 nt, Homo sapiens
augcccccucccuucacaggg

SEQ ID NO: 2176432 - RNA, 17 nt, Homo sapiens
gccucaguagcaucuca

SEQ ID NO: 2176433 - RNA, 16 nt, Homo sapiens
gaccuacucgagggac

SEQ ID NO: 2176434 - RNA, 21 nt, Homo sapiens
uccguuuaccuucauggugcu

SEQ ID NO: 2176435 - RNA, 19 nt, Homo sapiens
gccacggagggaggcacca

SEQ ID NO: 2176436 - RNA, 17 nt, Homo sapiens
cucuuauaaaaucaaua

SEQ ID NO: 2176437 - RNA, 15 nt, Homo sapiens
gagaaagcuaaaaug

SEQ ID NO: 2176438 - RNA, 17 nt, Homo sapiens
cucaacaacaaaccaaa

SEQ ID NO: 2176439 - RNA, 20 nt, Homo sapiens
cuuucaaacccagaggguug

SEQ ID NO: 2176440 - RNA, 22 nt, Homo sapiens
agaaccuugucccagccaguga

SEQ ID NO: 2176441 - RNA, 13 nt, Homo sapiens
gaauuaacugcau

SEQ ID NO: 2176442 - RNA, 14 nt, Homo sapiens
gcugcuuuguucaa

SEQ ID NO: 2176443 - RNA, 12 nt, Homo sapiens
cauccccuguga

SEQ ID NO: 2176444 - RNA, 23 nt, Homo sapiens
uagugguaucugacauauacuca

SEQ ID NO: 2176445 - RNA, 22 nt, Homo sapiens
ugggcauuaagucaguggcuuu

SEQ ID NO: 2176446 - RNA, 19 nt, Homo sapiens
caaaaugugaggguggugg

SEQ ID NO: 2176447 - RNA, 13 nt, Homo sapiens
cagucagugcugg

SEQ ID NO: 2176448 - RNA, 16 nt, Homo sapiens
caaacucagaucucau

SEQ ID NO: 2176449 - RNA, 21 nt, Homo sapiens
ucugucuggacuuuccagaga

SEQ ID NO: 2176450 - RNA, 17 nt, Homo sapiens
ugcucucccaaagccau

SEQ ID NO: 2176451 - RNA, 17 nt, Homo sapiens
ucuugguuggucaggca

SEQ ID NO: 2176452 - RNA, 18 nt, Homo sapiens
uguggucagcagaugcca

SEQ ID NO: 2176453 - RNA, 17 nt, Homo sapiens
agcucccucugccugaa

SEQ ID NO: 2176454 - RNA, 11 nt, Homo sapiens
aacgucagggu

SEQ ID NO: 2176455 - RNA, 17 nt, Homo sapiens
cacagugccaccaagcu

SEQ ID NO: 2176456 - RNA, 18 nt, Homo sapiens
ucugauuaaaaugcuucc

SEQ ID NO: 2176457 - RNA, 22 nt, Homo sapiens
gcccugucauccagcucacuca

SEQ ID NO: 2176458 - RNA, 17 nt, Homo sapiens
cagcaucuguccucauc

SEQ ID NO: 2176459 - RNA, 21 nt, Homo sapiens
cacagcgcuggccccagcaug

SEQ ID NO: 2176460 - RNA, 17 nt, Homo sapiens
auuuuugugagccucuu

SEQ ID NO: 2176461 - RNA, 17 nt, Homo sapiens
cugucucugcucuugcc

SEQ ID NO: 2176462 - RNA, 12 nt, Homo sapiens
caccuauuucca

SEQ ID NO: 2176463 - RNA, 18 nt, Homo sapiens
gacauuuaguagaauucc

SEQ ID NO: 2176464 - RNA, 15 nt, Homo sapiens
cacauacgugcacag

SEQ ID NO: 2176465 - RNA, 14 nt, Homo sapiens
ccagagcaggagac

SEQ ID NO: 2176466 - RNA, 14 nt, Homo sapiens
cacacacuuuccau

SEQ ID NO: 2176467 - RNA, 19 nt, Homo sapiens
guagcugggauuacaggca

SEQ ID NO: 2176468 - RNA, 22 nt, Homo sapiens
guauuuuaggcagggauuugag

SEQ ID NO: 2176469 - RNA, 19 nt, Homo sapiens
acagcgucccuagcaguga

SEQ ID NO: 2176470 - RNA, 14 nt, Homo sapiens
gcagucacuuugac

SEQ ID NO: 2176471 - RNA, 15 nt, Homo sapiens
gacuuacagugccaa

SEQ ID NO: 2176472 - RNA, 22 nt, Homo sapiens
ggcaggaagggaagcguauaua

SEQ ID NO: 2176473 - RNA, 22 nt, Homo sapiens
acauuugaaaucuaugaaauau

SEQ ID NO: 2176474 - RNA, 12 nt, Homo sapiens
ugguugucacuc

SEQ ID NO: 2176475 - RNA, 23 nt, Homo sapiens
uaaaaauucaugucuguauuuca

SEQ ID NO: 2176476 - RNA, 14 nt, Homo sapiens
cucucucauccacu

SEQ ID NO: 2176477 - RNA, 20 nt, Homo sapiens
guuaaagggcagaaggggaa

SEQ ID NO: 2176478 - RNA, 23 nt, Homo sapiens
agagcaaaaaguguaauuccaca

SEQ ID NO: 2176479 - RNA, 16 nt, Homo sapiens
cacacaaacaccuccu

SEQ ID NO: 2176480 - RNA, 13 nt, Homo sapiens
auaagcaggacag

SEQ ID NO: 2176481 - RNA, 19 nt, Homo sapiens
ccaauaaaggcagcugccu

SEQ ID NO: 2176482 - RNA, 12 nt, Homo sapiens
uaaauuggcuaa

SEQ ID NO: 2176483 - RNA, 14 nt, Homo sapiens
caguuucugaaaug

SEQ ID NO: 2176484 - RNA, 17 nt, Homo sapiens
caccaguuuacaggaaa

SEQ ID NO: 2176485 - RNA, 12 nt, Homo sapiens
gaagccuguccu

SEQ ID NO: 2176486 - RNA, 18 nt, Homo sapiens
agcagggugaagagucca

SEQ ID NO: 2176487 - RNA, 18 nt, Homo sapiens
ugagguuaguucugugug

SEQ ID NO: 2176488 - RNA, 16 nt, Homo sapiens
ccacuccucugacuca

SEQ ID NO: 2176489 - RNA, 17 nt, Homo sapiens
ugaccuaaggaagacaa

SEQ ID NO: 2176490 - RNA, 19 nt, Homo sapiens
ugcagaccucacugucagg

SEQ ID NO: 2176491 - RNA, 21 nt, Homo sapiens
ggcugcagcagaggcacuggg

SEQ ID NO: 2176492 - RNA, 20 nt, Homo sapiens
ucucaacucuguuuauuuga

SEQ ID NO: 2176493 - RNA, 20 nt, Homo sapiens
agcuguaaaaagagagaaaa

SEQ ID NO: 2176494 - RNA, 13 nt, Homo sapiens
ccacccaaaauca

SEQ ID NO: 2176495 - RNA, 15 nt, Homo sapiens
cagacaggcucaggu

SEQ ID NO: 2176496 - RNA, 17 nt, Homo sapiens
cucaacuuuaagauaga

SEQ ID NO: 2176497 - RNA, 17 nt, Homo sapiens
uucaauaucaagacuga

SEQ ID NO: 2176498 - RNA, 17 nt, Homo sapiens
gggccaccaugcacuca

SEQ ID NO: 2176499 - RNA, 18 nt, Homo sapiens
aucugugguuuuccucua

SEQ ID NO: 2176500 - RNA, 18 nt, Homo sapiens
ccuggcaugucagagcca

SEQ ID NO: 2176501 - RNA, 20 nt, Homo sapiens
ggagggauugacauguuuca

SEQ ID NO: 2176502 - RNA, 12 nt, Homo sapiens
ugaacaucucuu

SEQ ID NO: 2176503 - RNA, 18 nt, Homo sapiens
aaaaugaacuaacugcca

SEQ ID NO: 2176504 - RNA, 21 nt, Homo sapiens
agaagagggaaugagcuucca

SEQ ID NO: 2176505 - RNA, 17 nt, Homo sapiens
guuuuguuuuggugcuc

SEQ ID NO: 2176506 - RNA, 11 nt, Homo sapiens
uaggcauuugu

SEQ ID NO: 2176507 - RNA, 21 nt, Homo sapiens
ucuggaaggccccucccagca

SEQ ID NO: 2176508 - RNA, 17 nt, Homo sapiens
aaagcuccaucaaugag

SEQ ID NO: 2176509 - RNA, 21 nt, Homo sapiens
acaauaaaagaaacugugguc

SEQ ID NO: 2176510 - RNA, 19 nt, Homo sapiens
aggugccaucucaggagaa

SEQ ID NO: 2176511 - RNA, 23 nt, Homo sapiens
caggcucuccgggccuuucucug

SEQ ID NO: 2176512 - RNA, 14 nt, Homo sapiens
agagaaggggccca

SEQ ID NO: 2176513 - RNA, 13 nt, Homo sapiens
auccuuccaucca

SEQ ID NO: 2176514 - RNA, 13 nt, Homo sapiens
auuuuuccauuua

SEQ ID NO: 2176515 - RNA, 22 nt, Homo sapiens
cuugcccaucagccauuugcca

SEQ ID NO: 2176516 - RNA, 20 nt, Homo sapiens
ugugucacgugacccugugc

SEQ ID NO: 2176517 - RNA, 15 nt, Homo sapiens
ucagaacuucaucug

SEQ ID NO: 2176518 - RNA, 19 nt, Homo sapiens
caucuauucucugccuuua

SEQ ID NO: 2176519 - RNA, 17 nt, Homo sapiens
acccaucccuguggucu

SEQ ID NO: 2176520 - RNA, 13 nt, Homo sapiens
aguuuaagcaauu

SEQ ID NO: 2176521 - RNA, 19 nt, Homo sapiens
aauguauaaaaauuaucaa

SEQ ID NO: 2176522 - RNA, 22 nt, Homo sapiens
uagaaauuaacaaaugugcugc

SEQ ID NO: 2176523 - RNA, 22 nt, Homo sapiens
gaguaacuuucaaccuugccag

SEQ ID NO: 2176524 - RNA, 21 nt, Homo sapiens
ucccuucugauaagacuggaa

SEQ ID NO: 2176525 - RNA, 20 nt, Homo sapiens
gaauuuagugcauuucaaaa

SEQ ID NO: 2176526 - RNA, 18 nt, Homo sapiens
ccuccugucccucaucca

SEQ ID NO: 2176527 - RNA, 17 nt, Homo sapiens
aacauaccccuuacaaa

SEQ ID NO: 2176528 - RNA, 13 nt, Homo sapiens
agggcucacacau

SEQ ID NO: 2176529 - RNA, 21 nt, Homo sapiens
uuaguaaaauuaucuguucua

SEQ ID NO: 2176530 - RNA, 22 nt, Homo sapiens
aauugccauuggacaguugucu

SEQ ID NO: 2176531 - RNA, 20 nt, Homo sapiens
uguggcugauuucaaaugca

SEQ ID NO: 2176532 - RNA, 18 nt, Homo sapiens
uucggauguaugaucucu

SEQ ID NO: 2176533 - RNA, 21 nt, Homo sapiens
cauccuguauaagcacugaaa

SEQ ID NO: 2176534 - RNA, 17 nt, Homo sapiens
uauaccaacccacuggc

SEQ ID NO: 2176535 - RNA, 23 nt, Homo sapiens
aggugggaggaggccugcacagg

SEQ ID NO: 2176536 - RNA, 16 nt, Homo sapiens
caguaaaagucacaug

SEQ ID NO: 2176537 - RNA, 18 nt, Homo sapiens
aaugugcagcucccauuu

SEQ ID NO: 2176538 - RNA, 19 nt, Homo sapiens
acucuaucggagaacauga

SEQ ID NO: 2176539 - RNA, 23 nt, Homo sapiens
ucccuaguguagagcaagccagu

SEQ ID NO: 2176540 - RNA, 15 nt, Homo sapiens
uuccuuccacaguua

SEQ ID NO: 2176541 - RNA, 18 nt, Homo sapiens
gcaaaaaaaaaaauauua

SEQ ID NO: 2176542 - RNA, 14 nt, Homo sapiens
gugcagagugcaga

SEQ ID NO: 2176543 - RNA, 22 nt, Homo sapiens
caaggaccuggagauugugcuc

SEQ ID NO: 2176544 - RNA, 11 nt, Homo sapiens
gccacugaccc

SEQ ID NO: 2176545 - RNA, 18 nt, Homo sapiens
uaauggucauuugggaaa

SEQ ID NO: 2176546 - RNA, 19 nt, Homo sapiens
caaaacccaugcauuucau

SEQ ID NO: 2176547 - RNA, 12 nt, Homo sapiens
ucaccuaagcaa

SEQ ID NO: 2176548 - RNA, 11 nt, Homo sapiens
gguugacacag

SEQ ID NO: 2176549 - RNA, 13 nt, Homo sapiens
uaacacacuggcc

SEQ ID NO: 2176550 - RNA, 15 nt, Homo sapiens
accugacacaauccc

SEQ ID NO: 2176551 - RNA, 14 nt, Homo sapiens
gaauauacauuguc

SEQ ID NO: 2176552 - RNA, 17 nt, Homo sapiens
auuaacaauaagccagu

SEQ ID NO: 2176553 - RNA, 12 nt, Homo sapiens
gaaucacuguuu

SEQ ID NO: 2176554 - RNA, 17 nt, Homo sapiens
uguuaucaggacuugag

SEQ ID NO: 2176555 - RNA, 15 nt, Homo sapiens
cugcguuuuccuagc

SEQ ID NO: 2176556 - RNA, 15 nt, Homo sapiens
ugaagucacauucca

SEQ ID NO: 2176557 - RNA, 20 nt, Homo sapiens
cugaaguuuuugaaauaccu

SEQ ID NO: 2176558 - RNA, 16 nt, Homo sapiens
cagcaaauaugggcug

SEQ ID NO: 2176559 - RNA, 14 nt, Homo sapiens
uugaggugagucag

SEQ ID NO: 2176560 - RNA, 17 nt, Homo sapiens
ugaggggaggcaccucc

SEQ ID NO: 2176561 - RNA, 15 nt, Homo sapiens
caauuuagcuuacau

SEQ ID NO: 2176562 - RNA, 23 nt, Homo sapiens
ugguacuuuuaacauaaagaaau

SEQ ID NO: 2176563 - RNA, 17 nt, Homo sapiens
acacuuuugaugacgau

SEQ ID NO: 2176564 - RNA, 21 nt, Homo sapiens
ugauaaugccccaaggacaag

SEQ ID NO: 2176565 - RNA, 22 nt, Homo sapiens
ccaggggcccuugggacagcca

SEQ ID NO: 2176566 - RNA, 21 nt, Homo sapiens
cauaauacugaaccacuugua

SEQ ID NO: 2176567 - RNA, 20 nt, Homo sapiens
uggggcucaagcaguucucc

SEQ ID NO: 2176568 - RNA, 22 nt, Homo sapiens
cuccacugucuuuaaaagucau

SEQ ID NO: 2176569 - RNA, 14 nt, Homo sapiens
uucuguuauacaca

SEQ ID NO: 2176570 - RNA, 22 nt, Homo sapiens
aacauggugaaaccucaucucu

SEQ ID NO: 2176571 - RNA, 19 nt, Homo sapiens
ucagcaaguguacaguauu

SEQ ID NO: 2176572 - RNA, 23 nt, Homo sapiens
agccuuugugcuuuuugucaugu

SEQ ID NO: 2176573 - RNA, 13 nt, Homo sapiens
gaggaaagacagg

SEQ ID NO: 2176574 - RNA, 16 nt, Homo sapiens
caagagcaugcacaug

SEQ ID NO: 2176575 - RNA, 14 nt, Homo sapiens
ugggcaugcucagc

SEQ ID NO: 2176576 - RNA, 21 nt, Homo sapiens
ccccaguuccucccaggaagc

SEQ ID NO: 2176577 - RNA, 19 nt, Homo sapiens
ccucagccuugccagagau

SEQ ID NO: 2176578 - RNA, 19 nt, Homo sapiens
acuccuuguaaagacugua

SEQ ID NO: 2176579 - RNA, 12 nt, Homo sapiens
cucaauucauau

SEQ ID NO: 2176580 - RNA, 12 nt, Homo sapiens
accuauucccaa

SEQ ID NO: 2176581 - RNA, 16 nt, Homo sapiens
ucuguguggugcauuc

SEQ ID NO: 2176582 - RNA, 14 nt, Homo sapiens
aacuacuguguuau

SEQ ID NO: 2176583 - RNA, 22 nt, Homo sapiens
cugugcugcccugaagaauggc

SEQ ID NO: 2176584 - RNA, 13 nt, Homo sapiens
gacccagcucuac

SEQ ID NO: 2176585 - RNA, 19 nt, Homo sapiens
gauuaacugcaagucuuca

SEQ ID NO: 2176586 - RNA, 14 nt, Homo sapiens
ccacguuaagucca

SEQ ID NO: 2176587 - RNA, 13 nt, Homo sapiens
uggaauguaauca

SEQ ID NO: 2176588 - RNA, 12 nt, Homo sapiens
aaauugcagaua

SEQ ID NO: 2176589 - RNA, 18 nt, Homo sapiens
uccacaugguugugaguc

SEQ ID NO: 2176590 - RNA, 20 nt, Homo sapiens
agucuguagaaucuagccac

SEQ ID NO: 2176591 - RNA, 13 nt, Homo sapiens
ccaaagugcugcg

SEQ ID NO: 2176592 - RNA, 17 nt, Homo sapiens
accaacgcacaacagga

SEQ ID NO: 2176593 - RNA, 22 nt, Homo sapiens
gaugauaaucccauacucucaa

SEQ ID NO: 2176594 - RNA, 22 nt, Homo sapiens
caagugcccaacugcagaccaa

SEQ ID NO: 2176595 - RNA, 15 nt, Homo sapiens
uauaugcuaugcugu

SEQ ID NO: 2176596 - RNA, 18 nt, Homo sapiens
cuucucgugacaccacca

SEQ ID NO: 2176597 - RNA, 21 nt, Homo sapiens
ugaguuuggaugucuguagca

SEQ ID NO: 2176598 - RNA, 18 nt, Homo sapiens
cuccuuuucuucuagcuu

SEQ ID NO: 2176599 - RNA, 16 nt, Homo sapiens
ugaagcaaaucagaaa

SEQ ID NO: 2176600 - RNA, 12 nt, Homo sapiens
guaaacaaugaa

SEQ ID NO: 2176601 - RNA, 17 nt, Homo sapiens
guuuuguguaacauauu

SEQ ID NO: 2176602 - RNA, 14 nt, Homo sapiens
aaguaugccuuccu

SEQ ID NO: 2176603 - RNA, 14 nt, Homo sapiens
cauucuagugcaga

SEQ ID NO: 2176604 - RNA, 22 nt, Homo sapiens
ucugagaacuccucauucccug

SEQ ID NO: 2176605 - RNA, 14 nt, Homo sapiens
agugagacugucuc

SEQ ID NO: 2176606 - RNA, 15 nt, Homo sapiens
ggagcaucugacuca

SEQ ID NO: 2176607 - RNA, 21 nt, Homo sapiens
caugaggugagagaaagccac

SEQ ID NO: 2176608 - RNA, 20 nt, Homo sapiens
gagcagaaaguaagcauuuc

SEQ ID NO: 2176609 - RNA, 23 nt, Homo sapiens
uacauucuugguuguuaauuuag

SEQ ID NO: 2176610 - RNA, 18 nt, Homo sapiens
cccaaggugcugauguca

SEQ ID NO: 2176611 - RNA, 15 nt, Homo sapiens
gccaauccacuccuu

SEQ ID NO: 2176612 - RNA, 22 nt, Homo sapiens
uaauuccccccacccccugcca

SEQ ID NO: 2176613 - RNA, 15 nt, Homo sapiens
augagacuguacuaa

SEQ ID NO: 2176614 - RNA, 15 nt, Homo sapiens
accaaagcaucaaua

SEQ ID NO: 2176615 - RNA, 15 nt, Homo sapiens
ucaggaccaugugau

SEQ ID NO: 2176616 - RNA, 14 nt, Homo sapiens
cugcccgccuaaga

SEQ ID NO: 2176617 - RNA, 20 nt, Homo sapiens
ugaaaugccagaaugacuuc

SEQ ID NO: 2176618 - RNA, 22 nt, Homo sapiens
agcauuuacagaaacgcaucca

SEQ ID NO: 2176619 - RNA, 15 nt, Homo sapiens
agcaccacucugggc

SEQ ID NO: 2176620 - RNA, 17 nt, Homo sapiens
ucaaaggagcuuucuca

SEQ ID NO: 2176621 - RNA, 17 nt, Homo sapiens
gugccaauauuucugau

SEQ ID NO: 2176622 - RNA, 19 nt, Homo sapiens
uuaaggaagagagaauucu

SEQ ID NO: 2176623 - RNA, 23 nt, Homo sapiens
ugcccagaggcuccaucguccau

SEQ ID NO: 2176624 - RNA, 20 nt, Homo sapiens
cacuagcuaaggaagggaaa

SEQ ID NO: 2176625 - RNA, 19 nt, Homo sapiens
auuuuaauccccugcacua

SEQ ID NO: 2176626 - RNA, 15 nt, Homo sapiens
cuaagagugucacug

SEQ ID NO: 2176627 - RNA, 10 nt, Homo sapiens
gaauuuugcc

SEQ ID NO: 2176628 - RNA, 16 nt, Homo sapiens
uuccuggagugccuuc

SEQ ID NO: 2176629 - RNA, 14 nt, Homo sapiens
ugaugucuucuuac

SEQ ID NO: 2176630 - RNA, 16 nt, Homo sapiens
agaauugacaguugaa

SEQ ID NO: 2176631 - RNA, 16 nt, Homo sapiens
guuuucagauuguaaa

SEQ ID NO: 2176632 - RNA, 19 nt, Homo sapiens
acaugccugggauugggaa

SEQ ID NO: 2176633 - RNA, 23 nt, Homo sapiens
cucaggaaaacagcuaguagaca

SEQ ID NO: 2176634 - RNA, 16 nt, Homo sapiens
cugauccuaacugaag

SEQ ID NO: 2176635 - RNA, 23 nt, Homo sapiens
uucuugaguugucuuuugccauu

SEQ ID NO: 2176636 - RNA, 19 nt, Homo sapiens
auaugaaauuccagcaaua

SEQ ID NO: 2176637 - RNA, 22 nt, Homo sapiens
ugacgaguggguauuugcugac

SEQ ID NO: 2176638 - RNA, 14 nt, Homo sapiens
cuccccauggugca

SEQ ID NO: 2176639 - RNA, 20 nt, Homo sapiens
agcacaucauggcaguggga

SEQ ID NO: 2176640 - RNA, 22 nt, Homo sapiens
uacauuugaugcaugucuuuua

SEQ ID NO: 2176641 - RNA, 18 nt, Homo sapiens
cauuuuaacaucugagaa

SEQ ID NO: 2176642 - RNA, 16 nt, Homo sapiens
gaaaugugcugcaaag

SEQ ID NO: 2176643 - RNA, 21 nt, Homo sapiens
aguuuuuccuggaauugccag

SEQ ID NO: 2176644 - RNA, 12 nt, Homo sapiens
gaucacugccaa

SEQ ID NO: 2176645 - RNA, 22 nt, Homo sapiens
caacacacaaaauaaugcaguu

SEQ ID NO: 2176646 - RNA, 15 nt, Homo sapiens
ugucuagaacacuca

SEQ ID NO: 2176647 - RNA, 13 nt, Homo sapiens
cauuuagcacaaa

SEQ ID NO: 2176648 - RNA, 13 nt, Homo sapiens
acugagagcugcc

SEQ ID NO: 2176649 - RNA, 15 nt, Homo sapiens
guaggacccucgaga

SEQ ID NO: 2176650 - RNA, 12 nt, Homo sapiens
ggccacauucag

SEQ ID NO: 2176651 - RNA, 14 nt, Homo sapiens
augugauccugccu

SEQ ID NO: 2176652 - RNA, 16 nt, Homo sapiens
gcaguguucugugaau

SEQ ID NO: 2176653 - RNA, 18 nt, Homo sapiens
aucauguuggccaggcug

SEQ ID NO: 2176654 - RNA, 19 nt, Homo sapiens
cuaaauacuguaacacugu

SEQ ID NO: 2176655 - RNA, 16 nt, Homo sapiens
cccaggcaugcaaugc

SEQ ID NO: 2176656 - RNA, 13 nt, Homo sapiens
cgcucccuuucag

SEQ ID NO: 2176657 - RNA, 23 nt, Homo sapiens
auugagaggugggggaugcugag

SEQ ID NO: 2176658 - RNA, 21 nt, Homo sapiens
gcucagaaugucugguccugg

SEQ ID NO: 2176659 - RNA, 15 nt, Homo sapiens
uaacagccaccugga

SEQ ID NO: 2176660 - RNA, 15 nt, Homo sapiens
aauuugauaaacuga

SEQ ID NO: 2176661 - RNA, 15 nt, Homo sapiens
aaauuuuuaaucuuu

SEQ ID NO: 2176662 - RNA, 15 nt, Homo sapiens
ccuuuccuccacucc

SEQ ID NO: 2176663 - RNA, 10 nt, Homo sapiens
ccccagacag

SEQ ID NO: 2176664 - RNA, 19 nt, Homo sapiens
aucaucauccuacaacuca

SEQ ID NO: 2176665 - RNA, 12 nt, Homo sapiens
ggaacagugcag

SEQ ID NO: 2176666 - RNA, 18 nt, Homo sapiens
agaaacuuugaguacaga

SEQ ID NO: 2176667 - RNA, 14 nt, Homo sapiens
ucugggccagguug

SEQ ID NO: 2176668 - RNA, 21 nt, Homo sapiens
cucccuaccuaccaagauaua

SEQ ID NO: 2176669 - RNA, 23 nt, Homo sapiens
ccagagccuuaauaaacguccac

SEQ ID NO: 2176670 - RNA, 23 nt, Homo sapiens
agagccaggggggugaggagcug

SEQ ID NO: 2176671 - RNA, 14 nt, Homo sapiens
aauguuucuagucu

SEQ ID NO: 2176672 - RNA, 16 nt, Homo sapiens
ucaggugcuggggccu

SEQ ID NO: 2176673 - RNA, 18 nt, Homo sapiens
ccauagcucuucacuucc

SEQ ID NO: 2176674 - RNA, 14 nt, Homo sapiens
uacacauguaucua

SEQ ID NO: 2176675 - RNA, 14 nt, Homo sapiens
cucacuugcuucuu

SEQ ID NO: 2176676 - RNA, 22 nt, Homo sapiens
aaguuauccagaggguugugau

SEQ ID NO: 2176677 - RNA, 22 nt, Homo sapiens
gaaaaaugggaacaaggcaaug

SEQ ID NO: 2176678 - RNA, 22 nt, Homo sapiens
ucaauuuucuucacacuaucaa

SEQ ID NO: 2176679 - RNA, 18 nt, Homo sapiens
guggcuaauucaauuuau

SEQ ID NO: 2176680 - RNA, 22 nt, Homo sapiens
gcccuggaggccgcugcugacc

SEQ ID NO: 2176681 - RNA, 20 nt, Homo sapiens
cuccucccaagcacuucaaa

SEQ ID NO: 2176682 - RNA, 18 nt, Homo sapiens
cagcuuucaaagcauuua

SEQ ID NO: 2176683 - RNA, 18 nt, Homo sapiens
ucuccaugcaagauuucu

SEQ ID NO: 2176684 - RNA, 19 nt, Homo sapiens
gccauccagaugugugcaa

SEQ ID NO: 2176685 - RNA, 15 nt, Homo sapiens
ggaugucacugccug

SEQ ID NO: 2176686 - RNA, 23 nt, Homo sapiens
gggagccaauacugagugccugc

SEQ ID NO: 2176687 - RNA, 19 nt, Homo sapiens
ccugcuuggucuuucauug

SEQ ID NO: 2176688 - RNA, 16 nt, Homo sapiens
ggggacacagcaucag

SEQ ID NO: 2176689 - RNA, 14 nt, Homo sapiens
gcuucgaaguauuc

SEQ ID NO: 2176690 - RNA, 22 nt, Homo sapiens
gaauaauaagcuacuugccuug

SEQ ID NO: 2176691 - RNA, 17 nt, Homo sapiens
uguuuaaauagccuaaa

SEQ ID NO: 2176692 - RNA, 17 nt, Homo sapiens
agugauuucauucugcc

SEQ ID NO: 2176693 - RNA, 13 nt, Homo sapiens
ccaagaauguuau

SEQ ID NO: 2176694 - RNA, 19 nt, Homo sapiens
gccagcccauuugggcaga

SEQ ID NO: 2176695 - RNA, 17 nt, Homo sapiens
caccuucaaaagcacug

SEQ ID NO: 2176696 - RNA, 19 nt, Homo sapiens
gcccagaauugcauucuga

SEQ ID NO: 2176697 - RNA, 22 nt, Homo sapiens
uaaaugucuucuguauucacuu

SEQ ID NO: 2176698 - RNA, 15 nt, Homo sapiens
gcaugucauuugcac

SEQ ID NO: 2176699 - RNA, 14 nt, Homo sapiens
ucaucaugcuccac

SEQ ID NO: 2176700 - RNA, 20 nt, Homo sapiens
acagacauccuagcauuugu

SEQ ID NO: 2176701 - RNA, 19 nt, Homo sapiens
agguccccuccacauccca

SEQ ID NO: 2176702 - RNA, 13 nt, Homo sapiens
aacuccuuucuca

SEQ ID NO: 2176703 - RNA, 15 nt, Homo sapiens
cugcucauauuguga

SEQ ID NO: 2176704 - RNA, 18 nt, Homo sapiens
uaaauacccaucuucauu

SEQ ID NO: 2176705 - RNA, 17 nt, Homo sapiens
gccugagccucugcuuc

SEQ ID NO: 2176706 - RNA, 22 nt, Homo sapiens
aacaaccaccaccacaaugaca

SEQ ID NO: 2176707 - RNA, 21 nt, Homo sapiens
aaaagagucaacaguaucugu

SEQ ID NO: 2176708 - RNA, 12 nt, Homo sapiens
ccauucuguucc

SEQ ID NO: 2176709 - RNA, 22 nt, Homo sapiens
uguagcauuucuugauguugcu

SEQ ID NO: 2176710 - RNA, 22 nt, Homo sapiens
agcccuuacccucccaccacuc

SEQ ID NO: 2176711 - RNA, 18 nt, Homo sapiens
uuguagccacuucacuuu

SEQ ID NO: 2176712 - RNA, 16 nt, Homo sapiens
uccucuggagcccuaa

SEQ ID NO: 2176713 - RNA, 14 nt, Homo sapiens
auguaaacaaucag

SEQ ID NO: 2176714 - RNA, 21 nt, Homo sapiens
cuuacccccccuaaguguaau

SEQ ID NO: 2176715 - RNA, 19 nt, Homo sapiens
gggugccuucuagcugugu

SEQ ID NO: 2176716 - RNA, 23 nt, Homo sapiens
agcacuacauaaacugacuuuau

SEQ ID NO: 2176717 - RNA, 11 nt, Homo sapiens
uauugcugcuc

SEQ ID NO: 2176718 - RNA, 19 nt, Homo sapiens
ugaauaaauaccucuuagc

SEQ ID NO: 2176719 - RNA, 13 nt, Homo sapiens
ugcaugccuaaug

SEQ ID NO: 2176720 - RNA, 13 nt, Homo sapiens
uggcaaccuuccu

SEQ ID NO: 2176721 - RNA, 14 nt, Homo sapiens
uagcucaucuuaga

SEQ ID NO: 2176722 - RNA, 23 nt, Homo sapiens
gcauucccccuaagaggcaguga

SEQ ID NO: 2176723 - RNA, 21 nt, Homo sapiens
ccuucaacuggcuacugaguc

SEQ ID NO: 2176724 - RNA, 23 nt, Homo sapiens
ugaauagagggaguagaaagcuu

SEQ ID NO: 2176725 - RNA, 14 nt, Homo sapiens
aucaagccaugugc

SEQ ID NO: 2176726 - RNA, 22 nt, Homo sapiens
cacucagauggaaccgcaggaa

SEQ ID NO: 2176727 - RNA, 19 nt, Homo sapiens
ccauauguggaacaagcag

SEQ ID NO: 2176728 - RNA, 19 nt, Homo sapiens
ugacuuaacagaacucaac

SEQ ID NO: 2176729 - RNA, 19 nt, Homo sapiens
acauuuuacccacacacag

SEQ ID NO: 2176730 - RNA, 20 nt, Homo sapiens
caaaucacuucaauccucaa

SEQ ID NO: 2176731 - RNA, 14 nt, Homo sapiens
acgugcagcaccug

SEQ ID NO: 2176732 - RNA, 15 nt, Homo sapiens
cauguuggcccagac

SEQ ID NO: 2176733 - RNA, 22 nt, Homo sapiens
aucuucagggaacugcauagau

SEQ ID NO: 2176734 - RNA, 16 nt, Homo sapiens
aaguguuagaagccua

SEQ ID NO: 2176735 - RNA, 15 nt, Homo sapiens
cacacauuucugcca

SEQ ID NO: 2176736 - RNA, 19 nt, Homo sapiens
acugaaggcauaugcuggc

SEQ ID NO: 2176737 - RNA, 22 nt, Homo sapiens
acaagcauucugucuugaaggg

SEQ ID NO: 2176738 - RNA, 18 nt, Homo sapiens
cgccucacugaaacaugg

SEQ ID NO: 2176739 - RNA, 12 nt, Homo sapiens
aauuauccuccu

SEQ ID NO: 2176740 - RNA, 14 nt, Homo sapiens
uacagauagucaaa

SEQ ID NO: 2176741 - RNA, 15 nt, Homo sapiens
guuccaggaaucuca

SEQ ID NO: 2176742 - RNA, 21 nt, Homo sapiens
uguacuuccaccuccaccaca

SEQ ID NO: 2176743 - RNA, 15 nt, Homo sapiens
uccucaacugucauc

SEQ ID NO: 2176744 - RNA, 14 nt, Homo sapiens
auguaaaguauguu

SEQ ID NO: 2176745 - RNA, 13 nt, Homo sapiens
augguaguggcaa

SEQ ID NO: 2176746 - RNA, 14 nt, Homo sapiens
aaaguaguauugca

SEQ ID NO: 2176747 - RNA, 23 nt, Homo sapiens
caguagucccugcacagugacuu

SEQ ID NO: 2176748 - RNA, 14 nt, Homo sapiens
cuccuuucacuuuc

SEQ ID NO: 2176749 - RNA, 14 nt, Homo sapiens
cuucacugcuccuc

SEQ ID NO: 2176750 - RNA, 14 nt, Homo sapiens
cauauuugcacaau

SEQ ID NO: 2176751 - RNA, 17 nt, Homo sapiens
cuuuaauacaaaaagca

SEQ ID NO: 2176752 - RNA, 14 nt, Homo sapiens
uauuaauguacuua

SEQ ID NO: 2176753 - RNA, 23 nt, Homo sapiens
gcucugcguggcgcaggugccau

SEQ ID NO: 2176754 - RNA, 17 nt, Homo sapiens
gaaaguuggacuugaga

SEQ ID NO: 2176755 - RNA, 17 nt, Homo sapiens
gagccaguuuauuuucu

SEQ ID NO: 2176756 - RNA, 20 nt, Homo sapiens
gucagcccaugugcaccugc

SEQ ID NO: 2176757 - RNA, 15 nt, Homo sapiens
acugugucucaugga

SEQ ID NO: 2176758 - RNA, 18 nt, Homo sapiens
caauacuuagagaaccua

SEQ ID NO: 2176759 - RNA, 16 nt, Homo sapiens
cagcuacuuuugccaa

SEQ ID NO: 2176760 - RNA, 22 nt, Homo sapiens
cuguugaguuggacacacugua

SEQ ID NO: 2176761 - RNA, 14 nt, Homo sapiens
ucaacaagauuucc

SEQ ID NO: 2176762 - RNA, 22 nt, Homo sapiens
auuccugccuuuaagccaaaga

SEQ ID NO: 2176763 - RNA, 17 nt, Homo sapiens
aucuuuugugaaauuau

SEQ ID NO: 2176764 - RNA, 13 nt, Homo sapiens
cauggcacaggcc

SEQ ID NO: 2176765 - RNA, 13 nt, Homo sapiens
accccacugggca

SEQ ID NO: 2176766 - RNA, 18 nt, Homo sapiens
acuugucaccaugagaua

SEQ ID NO: 2176767 - RNA, 12 nt, Homo sapiens
ucucaccugcuc

SEQ ID NO: 2176768 - RNA, 17 nt, Homo sapiens
aagacuuuucucuacuu

SEQ ID NO: 2176769 - RNA, 19 nt, Homo sapiens
auccauaguaacugacaug

SEQ ID NO: 2176770 - RNA, 15 nt, Homo sapiens
gcagugacagaacua

SEQ ID NO: 2176771 - RNA, 20 nt, Homo sapiens
caauccuccuaccucagccu

SEQ ID NO: 2176772 - RNA, 22 nt, Homo sapiens
ugaauguguaaugggaaugaga

SEQ ID NO: 2176773 - RNA, 13 nt, Homo sapiens
acuuucacaucuc

SEQ ID NO: 2176774 - RNA, 13 nt, Homo sapiens
uuucccacucccu

SEQ ID NO: 2176775 - RNA, 16 nt, Homo sapiens
cuguccugaaagccac

SEQ ID NO: 2176776 - RNA, 19 nt, Homo sapiens
cacucagcacucuggacuc

SEQ ID NO: 2176777 - RNA, 16 nt, Homo sapiens
cagaagucuugucuca

SEQ ID NO: 2176778 - RNA, 16 nt, Homo sapiens
augggccggucgggga

SEQ ID NO: 2176779 - RNA, 17 nt, Homo sapiens
cuaaaugauuaucuuga

SEQ ID NO: 2176780 - RNA, 15 nt, Homo sapiens
cucuucccaguucag

SEQ ID NO: 2176781 - RNA, 22 nt, Homo sapiens
aggcaggaccagaaggcaauca

SEQ ID NO: 2176782 - RNA, 14 nt, Homo sapiens
auuccucaucacca

SEQ ID NO: 2176783 - RNA, 13 nt, Homo sapiens
auccuugugacuu

SEQ ID NO: 2176784 - RNA, 11 nt, Homo sapiens
uagcacuuccc

SEQ ID NO: 2176785 - RNA, 16 nt, Homo sapiens
gccccuccagcacaca

SEQ ID NO: 2176786 - RNA, 15 nt, Homo sapiens
accucaucucuacua

SEQ ID NO: 2176787 - RNA, 21 nt, Homo sapiens
aaucauuucauguuagucuua

SEQ ID NO: 2176788 - RNA, 12 nt, Homo sapiens
auaaacauugag

SEQ ID NO: 2176789 - RNA, 22 nt, Homo sapiens
gcugaggugggccuuccauggg

SEQ ID NO: 2176790 - RNA, 19 nt, Homo sapiens
uucuacuauccuugcuaag

SEQ ID NO: 2176791 - RNA, 17 nt, Homo sapiens
aguguaugacugcacau

SEQ ID NO: 2176792 - RNA, 20 nt, Homo sapiens
uauagugaaaaaugucacua

SEQ ID NO: 2176793 - RNA, 16 nt, Homo sapiens
cuuaaaccuaccuccc

SEQ ID NO: 2176794 - RNA, 17 nt, Homo sapiens
guccggaaugccaccca

SEQ ID NO: 2176795 - RNA, 17 nt, Homo sapiens
agcacuccucaucauca

SEQ ID NO: 2176796 - RNA, 14 nt, Homo sapiens
cucugaccagagau

SEQ ID NO: 2176797 - RNA, 15 nt, Homo sapiens
aaggauggaugcaga

SEQ ID NO: 2176798 - RNA, 17 nt, Homo sapiens
gauccgugacagcacuu

SEQ ID NO: 2176799 - RNA, 18 nt, Homo sapiens
ugugagaguggcuuucua

SEQ ID NO: 2176800 - RNA, 22 nt, Homo sapiens
gcuugaccauguugcacuguuu

SEQ ID NO: 2176801 - RNA, 17 nt, Homo sapiens
cuuggggccacugccug

SEQ ID NO: 2176802 - RNA, 13 nt, Homo sapiens
ccaccucccaggu

SEQ ID NO: 2176803 - RNA, 22 nt, Homo sapiens
uguugccagcguggcaacaggc

SEQ ID NO: 2176804 - RNA, 19 nt, Homo sapiens
cuuggggccagacuggcug

SEQ ID NO: 2176805 - RNA, 10 nt, Homo sapiens
aauaccucac

SEQ ID NO: 2176806 - RNA, 18 nt, Homo sapiens
aggaagaagauagaucca

SEQ ID NO: 2176807 - RNA, 14 nt, Homo sapiens
gaugaggcccucau

SEQ ID NO: 2176808 - RNA, 17 nt, Homo sapiens
cuuuuucugaagcuacu

SEQ ID NO: 2176809 - RNA, 14 nt, Homo sapiens
ccaaugguggcaaa

SEQ ID NO: 2176810 - RNA, 15 nt, Homo sapiens
cauuugggcaccuua

SEQ ID NO: 2176811 - RNA, 19 nt, Homo sapiens
uugucuccuacuccugacu

SEQ ID NO: 2176812 - RNA, 13 nt, Homo sapiens
uugguauucaauu

SEQ ID NO: 2176813 - RNA, 13 nt, Homo sapiens
uaagaauucugua

SEQ ID NO: 2176814 - RNA, 14 nt, Homo sapiens
ucaauaaacauuga

SEQ ID NO: 2176815 - RNA, 20 nt, Homo sapiens
gccaaaacaagggauuauca

SEQ ID NO: 2176816 - RNA, 14 nt, Homo sapiens
gcccucaggccagu

SEQ ID NO: 2176817 - RNA, 15 nt, Homo sapiens
aaagaugcuauucuu

SEQ ID NO: 2176818 - RNA, 23 nt, Homo sapiens
auagcugccuuuuuuaacacuag

SEQ ID NO: 2176819 - RNA, 22 nt, Homo sapiens
cccagccacauguccuccauca

SEQ ID NO: 2176820 - RNA, 13 nt, Homo sapiens
uaaaaucugugaa

SEQ ID NO: 2176821 - RNA, 21 nt, Homo sapiens
ucccagagagacgcugugauu

SEQ ID NO: 2176822 - RNA, 17 nt, Homo sapiens
aggaccugagucugcua

SEQ ID NO: 2176823 - RNA, 23 nt, Homo sapiens
uuagacagucaaggaguggcuua

SEQ ID NO: 2176824 - RNA, 20 nt, Homo sapiens
caagcaucaguagcugagug

SEQ ID NO: 2176825 - RNA, 18 nt, Homo sapiens
guucccugggcugaaacu

SEQ ID NO: 2176826 - RNA, 15 nt, Homo sapiens
ucucuuaagcugccc

SEQ ID NO: 2176827 - RNA, 20 nt, Homo sapiens
guaaaagucuguaaauaugu

SEQ ID NO: 2176828 - RNA, 14 nt, Homo sapiens
acucuacuaaugcc

SEQ ID NO: 2176829 - RNA, 22 nt, Homo sapiens
ccguaccucuucccaugacugc

SEQ ID NO: 2176830 - RNA, 17 nt, Homo sapiens
caaccuaaccccuuucc

SEQ ID NO: 2176831 - RNA, 16 nt, Homo sapiens
aaauaccaacuguaca

SEQ ID NO: 2176832 - RNA, 19 nt, Homo sapiens
guccuccagaccaccagcc

SEQ ID NO: 2176833 - RNA, 20 nt, Homo sapiens
caugguucugccuccuggcc

SEQ ID NO: 2176834 - RNA, 12 nt, Homo sapiens
acuuguuuauuc

SEQ ID NO: 2176835 - RNA, 15 nt, Homo sapiens
acccagggccugcag

SEQ ID NO: 2176836 - RNA, 18 nt, Homo sapiens
auugagccaguggugcua

SEQ ID NO: 2176837 - RNA, 16 nt, Homo sapiens
uccguuuccaaauaca

SEQ ID NO: 2176838 - RNA, 17 nt, Homo sapiens
auuaauuggagugcagc

SEQ ID NO: 2176839 - RNA, 20 nt, Homo sapiens
uccucaauuuuugucucaga

SEQ ID NO: 2176840 - RNA, 21 nt, Homo sapiens
acucuuagauggauucuccac

SEQ ID NO: 2176841 - RNA, 22 nt, Homo sapiens
gcugagagaccaggagggcacu

SEQ ID NO: 2176842 - RNA, 21 nt, Homo sapiens
uauucucuuaugauacuugag

SEQ ID NO: 2176843 - RNA, 23 nt, Homo sapiens
aaucuugggucuuggggacuaac

SEQ ID NO: 2176844 - RNA, 19 nt, Homo sapiens
aauuuauuuauguucucaa

SEQ ID NO: 2176845 - RNA, 12 nt, Homo sapiens
agguaacuucuc

SEQ ID NO: 2176846 - RNA, 12 nt, Homo sapiens
uugagaaugagu

SEQ ID NO: 2176847 - RNA, 12 nt, Homo sapiens
gagugaauuuga

SEQ ID NO: 2176848 - RNA, 15 nt, Homo sapiens
auggaaucauauagu

SEQ ID NO: 2176849 - RNA, 22 nt, Homo sapiens
aaggugaccucacaguacuggu

SEQ ID NO: 2176850 - RNA, 17 nt, Homo sapiens
gcauaagcuaucaccua

SEQ ID NO: 2176851 - RNA, 17 nt, Homo sapiens
cuugcaaagauuucuca

SEQ ID NO: 2176852 - RNA, 21 nt, Homo sapiens
auuccuucuuucacaggcauc

SEQ ID NO: 2176853 - RNA, 13 nt, Homo sapiens
ucuucacaacaga

SEQ ID NO: 2176854 - RNA, 22 nt, Homo sapiens
ccaaguucuuucuccaucccuc

SEQ ID NO: 2176855 - RNA, 11 nt, Homo sapiens
cucuggaccag

SEQ ID NO: 2176856 - RNA, 19 nt, Homo sapiens
auucacccuucaacauaaa

SEQ ID NO: 2176857 - RNA, 14 nt, Homo sapiens
aaggcuuucagggc

SEQ ID NO: 2176858 - RNA, 19 nt, Homo sapiens
gccacugacugagauggag

SEQ ID NO: 2176859 - RNA, 16 nt, Homo sapiens
aaguuaaagagacaaa

SEQ ID NO: 2176860 - RNA, 17 nt, Homo sapiens
uggacaguucacacccu

SEQ ID NO: 2176861 - RNA, 16 nt, Homo sapiens
ucguucuccacccacc

SEQ ID NO: 2176862 - RNA, 20 nt, Homo sapiens
gagcucuggcuuugcaaggg

SEQ ID NO: 2176863 - RNA, 12 nt, Homo sapiens
ccuuugccuugg

SEQ ID NO: 2176864 - RNA, 19 nt, Homo sapiens
accucggcacacacugugc

SEQ ID NO: 2176865 - RNA, 20 nt, Homo sapiens
uacugcaucaucuguuugua

SEQ ID NO: 2176866 - RNA, 14 nt, Homo sapiens
ggauguccacagau

SEQ ID NO: 2176867 - RNA, 20 nt, Homo sapiens
uuaaccuaauaucacuuaaa

SEQ ID NO: 2176868 - RNA, 16 nt, Homo sapiens
cuuuuuguugccuuau

SEQ ID NO: 2176869 - RNA, 15 nt, Homo sapiens
auaaaaucuuuccau

SEQ ID NO: 2176870 - RNA, 12 nt, Homo sapiens
uaaguucaggga

SEQ ID NO: 2176871 - RNA, 20 nt, Homo sapiens
ucagaaggcucuaucugcug

SEQ ID NO: 2176872 - RNA, 22 nt, Homo sapiens
ccacaggcaguccaggccucuc

SEQ ID NO: 2176873 - RNA, 16 nt, Homo sapiens
gccuccagaagcacug

SEQ ID NO: 2176874 - RNA, 16 nt, Homo sapiens
cgugccacuuuccacc

SEQ ID NO: 2176875 - RNA, 18 nt, Homo sapiens
ugaagagcgauugugagg

SEQ ID NO: 2176876 - RNA, 13 nt, Homo sapiens
uucuaugagccca

SEQ ID NO: 2176877 - RNA, 16 nt, Homo sapiens
ugaaggauugugaacu

SEQ ID NO: 2176878 - RNA, 22 nt, Homo sapiens
gaacaguugcauuuagcuucuu

SEQ ID NO: 2176879 - RNA, 13 nt, Homo sapiens
aucauagcacugg

SEQ ID NO: 2176880 - RNA, 16 nt, Homo sapiens
ucuugauucagucaca

SEQ ID NO: 2176881 - RNA, 15 nt, Homo sapiens
gaaagcacaccucau

SEQ ID NO: 2176882 - RNA, 13 nt, Homo sapiens
gaggcucuucagu

SEQ ID NO: 2176883 - RNA, 15 nt, Homo sapiens
cauuauaagcuauga

SEQ ID NO: 2176884 - RNA, 18 nt, Homo sapiens
ccuguguucuuuccccag

SEQ ID NO: 2176885 - RNA, 15 nt, Homo sapiens
cucccauagcacugc

SEQ ID NO: 2176886 - RNA, 14 nt, Homo sapiens
cugucccaccccua

SEQ ID NO: 2176887 - RNA, 21 nt, Homo sapiens
cucuucauauucagcuugcac

SEQ ID NO: 2176888 - RNA, 15 nt, Homo sapiens
cugggaaaggugcuc

SEQ ID NO: 2176889 - RNA, 15 nt, Homo sapiens
agucuuguacuguga

SEQ ID NO: 2176890 - RNA, 21 nt, Homo sapiens
aagguagcuuaccugacacaa

SEQ ID NO: 2176891 - RNA, 21 nt, Homo sapiens
cacaccucccacccccuguau

SEQ ID NO: 2176892 - RNA, 13 nt, Homo sapiens
gugcuacaauuca

SEQ ID NO: 2176893 - RNA, 20 nt, Homo sapiens
uugaucccuguuacccagag

SEQ ID NO: 2176894 - RNA, 19 nt, Homo sapiens
gaagacuuuaaaccaccua

SEQ ID NO: 2176895 - RNA, 19 nt, Homo sapiens
caucuacaagcauuugccc

SEQ ID NO: 2176896 - RNA, 11 nt, Homo sapiens
ggcagugcacg

SEQ ID NO: 2176897 - RNA, 18 nt, Homo sapiens
ucuuaaaucugccuaguu

SEQ ID NO: 2176898 - RNA, 17 nt, Homo sapiens
aauaaauccaagacugu

SEQ ID NO: 2176899 - RNA, 20 nt, Homo sapiens
gcaguaccaucuacaucucc

SEQ ID NO: 2176900 - RNA, 18 nt, Homo sapiens
cgggccaccaaguucugg

SEQ ID NO: 2176901 - RNA, 12 nt, Homo sapiens
gccaaaauauca

SEQ ID NO: 2176902 - RNA, 17 nt, Homo sapiens
cugggauuucuaugcag

SEQ ID NO: 2176903 - RNA, 16 nt, Homo sapiens
uccuaaauuuuuacau

SEQ ID NO: 2176904 - RNA, 14 nt, Homo sapiens
auagcugagguaaa

SEQ ID NO: 2176905 - RNA, 18 nt, Homo sapiens
agggcuagggaaagggau

SEQ ID NO: 2176906 - RNA, 18 nt, Homo sapiens
guagagaggggacugggg

SEQ ID NO: 2176907 - RNA, 14 nt, Homo sapiens
aucguaacaagcaa

SEQ ID NO: 2176908 - RNA, 20 nt, Homo sapiens
gaccacccgcccuggcaguu

SEQ ID NO: 2176909 - RNA, 21 nt, Homo sapiens
uggaguuugggggaaggggaa

SEQ ID NO: 2176910 - RNA, 15 nt, Homo sapiens
uuaaagaacacugca

SEQ ID NO: 2176911 - RNA, 15 nt, Homo sapiens
gccacuuugcaaagg

SEQ ID NO: 2176912 - RNA, 20 nt, Homo sapiens
cuggccaaauaugcacuuuc

SEQ ID NO: 2176913 - RNA, 16 nt, Homo sapiens
gaucccaauaacccag

SEQ ID NO: 2176914 - RNA, 12 nt, Homo sapiens
ucauuguucacu

SEQ ID NO: 2176915 - RNA, 22 nt, Homo sapiens
ccucaaaugacccaaagaccaa

SEQ ID NO: 2176916 - RNA, 21 nt, Homo sapiens
aaccuggagccacuucuaucu

SEQ ID NO: 2176917 - RNA, 13 nt, Homo sapiens
agaaacucaccau

SEQ ID NO: 2176918 - RNA, 13 nt, Homo sapiens
ugauucucuccua

SEQ ID NO: 2176919 - RNA, 20 nt, Homo sapiens
aauuuugaguauuccaugag

SEQ ID NO: 2176920 - RNA, 14 nt, Homo sapiens
ccugauaaacagag

SEQ ID NO: 2176921 - RNA, 15 nt, Homo sapiens
gaccacuuccagggg

SEQ ID NO: 2176922 - RNA, 13 nt, Homo sapiens
ugccaccaaagga

SEQ ID NO: 2176923 - RNA, 16 nt, Homo sapiens
agcacaucaauuacaa

SEQ ID NO: 2176924 - RNA, 16 nt, Homo sapiens
aagcucagcucugcuu

SEQ ID NO: 2176925 - RNA, 13 nt, Homo sapiens
ggugcauagcaga

SEQ ID NO: 2176926 - RNA, 15 nt, Homo sapiens
augaggguccaccuu

SEQ ID NO: 2176927 - RNA, 22 nt, Homo sapiens
gagagugugugauuagaagcua

SEQ ID NO: 2176928 - RNA, 17 nt, Homo sapiens
gcacccagcuccagggg

SEQ ID NO: 2176929 - RNA, 18 nt, Homo sapiens
ccccaauaaaccagugug

SEQ ID NO: 2176930 - RNA, 21 nt, Homo sapiens
cuuccugcccuuuccuuccuu

SEQ ID NO: 2176931 - RNA, 17 nt, Homo sapiens
cucugcugccauuugaa

SEQ ID NO: 2176932 - RNA, 19 nt, Homo sapiens
uccccuugcccuugcccug

SEQ ID NO: 2176933 - RNA, 15 nt, Homo sapiens
caauguauguacaau

SEQ ID NO: 2176934 - RNA, 21 nt, Homo sapiens
guucagaaucacuucugagaa

SEQ ID NO: 2176935 - RNA, 20 nt, Homo sapiens
gcaaagcaacgacuacuuug

SEQ ID NO: 2176936 - RNA, 17 nt, Homo sapiens
cauuacccaaaagcaag

SEQ ID NO: 2176937 - RNA, 19 nt, Homo sapiens
ggacuccacgaugccuuug

SEQ ID NO: 2176938 - RNA, 21 nt, Homo sapiens
uugcccugaacauacacaugc

SEQ ID NO: 2176939 - RNA, 20 nt, Homo sapiens
ccaccuaauccuucuggcaa

SEQ ID NO: 2176940 - RNA, 19 nt, Homo sapiens
agggcugccaccaagguga

SEQ ID NO: 2176941 - RNA, 20 nt, Homo sapiens
gccaaaguuuucaaacugcu

SEQ ID NO: 2176942 - RNA, 22 nt, Homo sapiens
augaauagaggggcauucacaa

SEQ ID NO: 2176943 - RNA, 15 nt, Homo sapiens
gcaaaaaaugaaugu

SEQ ID NO: 2176944 - RNA, 16 nt, Homo sapiens
cucuguccacucugaa

SEQ ID NO: 2176945 - RNA, 22 nt, Homo sapiens
caauguuuguaauaauugcuca

SEQ ID NO: 2176946 - RNA, 12 nt, Homo sapiens
auugacacugaa

SEQ ID NO: 2176947 - RNA, 15 nt, Homo sapiens
gaugcauccauuuca

SEQ ID NO: 2176948 - RNA, 23 nt, Homo sapiens
aaaacuugguuuguggugcacag

SEQ ID NO: 2176949 - RNA, 19 nt, Homo sapiens
ugggacugcugcuucuuaa

SEQ ID NO: 2176950 - RNA, 14 nt, Homo sapiens
auguacugcauuau

SEQ ID NO: 2176951 - RNA, 15 nt, Homo sapiens
gcaucuucuggagaa

SEQ ID NO: 2176952 - RNA, 13 nt, Homo sapiens
ucauaauugucaa

SEQ ID NO: 2176953 - RNA, 15 nt, Homo sapiens
aguaucaaacuacug

SEQ ID NO: 2176954 - RNA, 21 nt, Homo sapiens
uggaaugcacucagacuguau

SEQ ID NO: 2176955 - RNA, 20 nt, Homo sapiens
gaaguauuuuauuugucuga

SEQ ID NO: 2176956 - RNA, 22 nt, Homo sapiens
aguauaugaauuacccuuucau

SEQ ID NO: 2176957 - RNA, 16 nt, Homo sapiens
ccccacccccugccaa

SEQ ID NO: 2176958 - RNA, 14 nt, Homo sapiens
caaggcugcaguga

SEQ ID NO: 2176959 - RNA, 15 nt, Homo sapiens
cagaauaaaugggua

SEQ ID NO: 2176960 - RNA, 21 nt, Homo sapiens
ucuccauucuguuccacugcu

SEQ ID NO: 2176961 - RNA, 21 nt, Homo sapiens
uguuacuauaccuaccauuua

SEQ ID NO: 2176962 - RNA, 20 nt, Homo sapiens
agaacuaaccaguaccucug

SEQ ID NO: 2176963 - RNA, 21 nt, Homo sapiens
cauauuuuuugcacagcuagc

SEQ ID NO: 2176964 - RNA, 22 nt, Homo sapiens
gaugauggggugggagacuuuc

SEQ ID NO: 2176965 - RNA, 17 nt, Homo sapiens
ugacuuugcuccucaca

SEQ ID NO: 2176966 - RNA, 17 nt, Homo sapiens
cuggaguccuguucuca

SEQ ID NO: 2176967 - RNA, 20 nt, Homo sapiens
auguauguccauucacuuuc

SEQ ID NO: 2176968 - RNA, 19 nt, Homo sapiens
ucccaugcucauaccucuu

SEQ ID NO: 2176969 - RNA, 19 nt, Homo sapiens
aaccuuguaaauuccccuu

SEQ ID NO: 2176970 - RNA, 14 nt, Homo sapiens
ucuucaagacucug

SEQ ID NO: 2176971 - RNA, 13 nt, Homo sapiens
cagagcugggaaa

SEQ ID NO: 2176972 - RNA, 22 nt, Homo sapiens
caaguauuccuaugccagagca

SEQ ID NO: 2176973 - RNA, 20 nt, Homo sapiens
cugcccacuguuucucuuga

SEQ ID NO: 2176974 - RNA, 17 nt, Homo sapiens
aucaaugaucaucucac

SEQ ID NO: 2176975 - RNA, 15 nt, Homo sapiens
uccucaguccacugc

SEQ ID NO: 2176976 - RNA, 20 nt, Homo sapiens
uggcuuaagugagcagaaca

SEQ ID NO: 2176977 - RNA, 17 nt, Homo sapiens
uaagcccacaguaggca

SEQ ID NO: 2176978 - RNA, 23 nt, Homo sapiens
cuacuuccccugggaugcugacc

SEQ ID NO: 2176979 - RNA, 16 nt, Homo sapiens
agcuaggugacauaua

SEQ ID NO: 2176980 - RNA, 14 nt, Homo sapiens
gagcuuucaaacac

SEQ ID NO: 2176981 - RNA, 17 nt, Homo sapiens
uaagguuggagauguca

SEQ ID NO: 2176982 - RNA, 12 nt, Homo sapiens
ucugcaucucau

SEQ ID NO: 2176983 - RNA, 13 nt, Homo sapiens
gcugggcacuucc

SEQ ID NO: 2176984 - RNA, 18 nt, Homo sapiens
cuucuuucuacaguauua

SEQ ID NO: 2176985 - RNA, 16 nt, Homo sapiens
aggcccagcugaggag

SEQ ID NO: 2176986 - RNA, 20 nt, Homo sapiens
auuacuguuuauuacuucca

SEQ ID NO: 2176987 - RNA, 17 nt, Homo sapiens
cuuuucccugcaccacu

SEQ ID NO: 2176988 - RNA, 23 nt, Homo sapiens
cgacagaggagcuuuucuggaau

SEQ ID NO: 2176989 - RNA, 14 nt, Homo sapiens
uccuuaaaaacugg

SEQ ID NO: 2176990 - RNA, 19 nt, Homo sapiens
uuugaugugagugccuuga

SEQ ID NO: 2176991 - RNA, 20 nt, Homo sapiens
aagaggaggcaaauggcacu

SEQ ID NO: 2176992 - RNA, 15 nt, Homo sapiens
guauguauauauaca

SEQ ID NO: 2176993 - RNA, 17 nt, Homo sapiens
aguauuucccagcacau

SEQ ID NO: 2176994 - RNA, 19 nt, Homo sapiens
cugcccuggggcaucaugg

SEQ ID NO: 2176995 - RNA, 15 nt, Homo sapiens
uauuacagcauuuga

SEQ ID NO: 2176996 - RNA, 13 nt, Homo sapiens
acuauucaugaga

SEQ ID NO: 2176997 - RNA, 18 nt, Homo sapiens
gauagcaaacacuggggg

SEQ ID NO: 2176998 - RNA, 23 nt, Homo sapiens
guggauuccugggcaagaaccua

SEQ ID NO: 2176999 - RNA, 15 nt, Homo sapiens
aucaaagcaccuuga

SEQ ID NO: 2177000 - RNA, 19 nt, Homo sapiens
aguuuggaaugaagaaauu

SEQ ID NO: 2177001 - RNA, 12 nt, Homo sapiens
auuuauucugau

SEQ ID NO: 2177002 - RNA, 18 nt, Homo sapiens
aucccaguguccuaggac

SEQ ID NO: 2177003 - RNA, 14 nt, Homo sapiens
gugagaacugugaa

SEQ ID NO: 2177004 - RNA, 19 nt, Homo sapiens
ggcaugagccacugcaccu

SEQ ID NO: 2177005 - RNA, 16 nt, Homo sapiens
cuguaaucucacuaca

SEQ ID NO: 2177006 - RNA, 17 nt, Homo sapiens
cucgcuccccucuggaa

SEQ ID NO: 2177007 - RNA, 15 nt, Homo sapiens
uuccacugaacaaaa

SEQ ID NO: 2177008 - RNA, 15 nt, Homo sapiens
uggggccucagacga

SEQ ID NO: 2177009 - RNA, 13 nt, Homo sapiens
agacaaugucugc

SEQ ID NO: 2177010 - RNA, 16 nt, Homo sapiens
augugguugcuuaauu

SEQ ID NO: 2177011 - RNA, 18 nt, Homo sapiens
aacuggccaagcugaggu

SEQ ID NO: 2177012 - RNA, 14 nt, Homo sapiens
aucauuugcaaugc

SEQ ID NO: 2177013 - RNA, 13 nt, Homo sapiens
aagauaguugaaa

SEQ ID NO: 2177014 - RNA, 15 nt, Homo sapiens
uaaguuaauauugga

SEQ ID NO: 2177015 - RNA, 13 nt, Homo sapiens
agaaaagccagag

SEQ ID NO: 2177016 - RNA, 20 nt, Homo sapiens
cucugccuacagaacuucag

SEQ ID NO: 2177017 - RNA, 20 nt, Homo sapiens
uaucuuugucuuaucuacca

SEQ ID NO: 2177018 - RNA, 12 nt, Homo sapiens
cugaagugucga

SEQ ID NO: 2177019 - RNA, 12 nt, Homo sapiens
uuacagugccac

SEQ ID NO: 2177020 - RNA, 12 nt, Homo sapiens
cuucgugccugu

SEQ ID NO: 2177021 - RNA, 14 nt, Homo sapiens
augccacuucccag

SEQ ID NO: 2177022 - RNA, 23 nt, Homo sapiens
gucucaguuuacauuuuguauau

SEQ ID NO: 2177023 - RNA, 22 nt, Homo sapiens
ggugaacugugaguacuacuua

SEQ ID NO: 2177024 - RNA, 18 nt, Homo sapiens
gaauauugccaaugcuac

SEQ ID NO: 2177025 - RNA, 16 nt, Homo sapiens
agaauucaacaguuac

SEQ ID NO: 2177026 - RNA, 20 nt, Homo sapiens
acuguggagguggcugguca

SEQ ID NO: 2177027 - RNA, 17 nt, Homo sapiens
cuuaaaacacguuuuaa

SEQ ID NO: 2177028 - RNA, 17 nt, Homo sapiens
ggacugucagcugagcu

SEQ ID NO: 2177029 - RNA, 13 nt, Homo sapiens
cauuccaagaaag

SEQ ID NO: 2177030 - RNA, 10 nt, Homo sapiens
uacauucaau

SEQ ID NO: 2177031 - RNA, 21 nt, Homo sapiens
guauauaaaucuucaaagcuu

SEQ ID NO: 2177032 - RNA, 16 nt, Homo sapiens
uuccguggcacugcau

SEQ ID NO: 2177033 - RNA, 18 nt, Homo sapiens
uguuaucuaucaacuaua

SEQ ID NO: 2177034 - RNA, 15 nt, Homo sapiens
ucuucaauccccaua

SEQ ID NO: 2177035 - RNA, 15 nt, Homo sapiens
cacacacacacgcac

SEQ ID NO: 2177036 - RNA, 15 nt, Homo sapiens
ugaguaaaugaauaa

SEQ ID NO: 2177037 - RNA, 15 nt, Homo sapiens
uguauauauguguau

SEQ ID NO: 2177038 - RNA, 15 nt, Homo sapiens
gauugccaaucugca

SEQ ID NO: 2177039 - RNA, 12 nt, Homo sapiens
gacuacaggugu

SEQ ID NO: 2177040 - RNA, 23 nt, Homo sapiens
uucaggcgauucuccugccucag

SEQ ID NO: 2177041 - RNA, 21 nt, Homo sapiens
cccuuccucagaacuuucuag

SEQ ID NO: 2177042 - RNA, 13 nt, Homo sapiens
ccucuauaaacuu

SEQ ID NO: 2177043 - RNA, 18 nt, Homo sapiens
cuuuaaaaaucauuguau

SEQ ID NO: 2177044 - RNA, 20 nt, Homo sapiens
accuauuuugcaaacaaacu

SEQ ID NO: 2177045 - RNA, 22 nt, Homo sapiens
ucccucccccccaugcacugug

SEQ ID NO: 2177046 - RNA, 18 nt, Homo sapiens
cagaauauugugccccau

SEQ ID NO: 2177047 - RNA, 19 nt, Homo sapiens
cuccgcgggagaccccuug

SEQ ID NO: 2177048 - RNA, 18 nt, Homo sapiens
cugcuccugucaccauga

SEQ ID NO: 2177049 - RNA, 11 nt, Homo sapiens
agccuguguca

SEQ ID NO: 2177050 - RNA, 14 nt, Homo sapiens
guaugguacucagu

SEQ ID NO: 2177051 - RNA, 21 nt, Homo sapiens
ugcaggcuuaacgugucugag

SEQ ID NO: 2177052 - RNA, 15 nt, Homo sapiens
agccuggguggcuca

SEQ ID NO: 2177053 - RNA, 16 nt, Homo sapiens
gcaugcacacugagaa

SEQ ID NO: 2177054 - RNA, 11 nt, Homo sapiens
cagaagugugu

SEQ ID NO: 2177055 - RNA, 11 nt, Homo sapiens
auuucugccag

SEQ ID NO: 2177056 - RNA, 20 nt, Homo sapiens
gucuauuucaucagaacagc

SEQ ID NO: 2177057 - RNA, 20 nt, Homo sapiens
acggagucucagucugucac

SEQ ID NO: 2177058 - RNA, 16 nt, Homo sapiens
ugggcuggacuggcca

SEQ ID NO: 2177059 - RNA, 17 nt, Homo sapiens
acuaggcauuuguaaau

SEQ ID NO: 2177060 - RNA, 14 nt, Homo sapiens
aggguguguguuca

SEQ ID NO: 2177061 - RNA, 22 nt, Homo sapiens
aguucaguagaauuaccauuaa

SEQ ID NO: 2177062 - RNA, 15 nt, Homo sapiens
auuugguguacaauu

SEQ ID NO: 2177063 - RNA, 13 nt, Homo sapiens
aaggugucuuccu

SEQ ID NO: 2177064 - RNA, 16 nt, Homo sapiens
uaauaaaugugacuca

SEQ ID NO: 2177065 - RNA, 13 nt, Homo sapiens
gccaaugugacaa

SEQ ID NO: 2177066 - RNA, 15 nt, Homo sapiens
caaaaauaguuaaaa

SEQ ID NO: 2177067 - RNA, 15 nt, Homo sapiens
auaaucuuucacagg

SEQ ID NO: 2177068 - RNA, 16 nt, Homo sapiens
auccugugacauguaa

SEQ ID NO: 2177069 - RNA, 22 nt, Homo sapiens
uaauuaccuggugaguaacuua

SEQ ID NO: 2177070 - RNA, 15 nt, Homo sapiens
ucuaccuagccccuu

SEQ ID NO: 2177071 - RNA, 21 nt, Homo sapiens
accaucuucacuggcuuccau

SEQ ID NO: 2177072 - RNA, 16 nt, Homo sapiens
ucuuaauucugaccaa

SEQ ID NO: 2177073 - RNA, 17 nt, Homo sapiens
aggugccuguccuugaa

SEQ ID NO: 2177074 - RNA, 15 nt, Homo sapiens
ugaguuguguuccac

SEQ ID NO: 2177075 - RNA, 15 nt, Homo sapiens
acccuaaauguggac

SEQ ID NO: 2177076 - RNA, 20 nt, Homo sapiens
gccaccaacauaaaacaaaa

SEQ ID NO: 2177077 - RNA, 21 nt, Homo sapiens
gaucugacauccccacucacg

SEQ ID NO: 2177078 - RNA, 21 nt, Homo sapiens
auacaauguuacaaauaugca

SEQ ID NO: 2177079 - RNA, 18 nt, Homo sapiens
aauaauuuuuagaaucuc

SEQ ID NO: 2177080 - RNA, 19 nt, Homo sapiens
uugcaaacugaaagaucug

SEQ ID NO: 2177081 - RNA, 20 nt, Homo sapiens
ugagggcaagagggggaccu

SEQ ID NO: 2177082 - RNA, 19 nt, Homo sapiens
ccagcccuuagcacagaga

SEQ ID NO: 2177083 - RNA, 15 nt, Homo sapiens
cacaaggggcuccac

SEQ ID NO: 2177084 - RNA, 22 nt, Homo sapiens
uucuguaccacacuagaauuca

SEQ ID NO: 2177085 - RNA, 13 nt, Homo sapiens
auaaagcauucuu

SEQ ID NO: 2177086 - RNA, 13 nt, Homo sapiens
aaaaagcauacuu

SEQ ID NO: 2177087 - RNA, 22 nt, Homo sapiens
uacagugaugcugugcuaugaa

SEQ ID NO: 2177088 - RNA, 14 nt, Homo sapiens
uccaaguauuucac

SEQ ID NO: 2177089 - RNA, 14 nt, Homo sapiens
aaagaguacacuca

SEQ ID NO: 2177090 - RNA, 17 nt, Homo sapiens
aaaucuguuagcauuau

SEQ ID NO: 2177091 - RNA, 13 nt, Homo sapiens
auaaaaugaacau

SEQ ID NO: 2177092 - RNA, 17 nt, Homo sapiens
gagccuggaacugcauc

SEQ ID NO: 2177093 - RNA, 14 nt, Homo sapiens
acuaaacugcugca

SEQ ID NO: 2177094 - RNA, 22 nt, Homo sapiens
agcuacugccauccuggcccag

SEQ ID NO: 2177095 - RNA, 20 nt, Homo sapiens
cagccucagaaaccagacuc

SEQ ID NO: 2177096 - RNA, 20 nt, Homo sapiens
aucuuaucauggucucaguc

SEQ ID NO: 2177097 - RNA, 22 nt, Homo sapiens
ugcaauggcacgaucucagcuc

SEQ ID NO: 2177098 - RNA, 15 nt, Homo sapiens
ccagcagcgccuuuc

SEQ ID NO: 2177099 - RNA, 14 nt, Homo sapiens
auuccaauuugcac

SEQ ID NO: 2177100 - RNA, 14 nt, Homo sapiens
uuuuacauauguca

SEQ ID NO: 2177101 - RNA, 14 nt, Homo sapiens
ucuaugaucuuggc

SEQ ID NO: 2177102 - RNA, 20 nt, Homo sapiens
ggcgccgcaaaccacacugg

SEQ ID NO: 2177103 - RNA, 13 nt, Homo sapiens
cccuaacucuugc

SEQ ID NO: 2177104 - RNA, 13 nt, Homo sapiens
cccucacucuuga

SEQ ID NO: 2177105 - RNA, 15 nt, Homo sapiens
ugacuuaucuaccau

SEQ ID NO: 2177106 - RNA, 19 nt, Homo sapiens
cacuguguuuuuuuguaua

SEQ ID NO: 2177107 - RNA, 14 nt, Homo sapiens
cuuuaauaacaaua

SEQ ID NO: 2177108 - RNA, 22 nt, Homo sapiens
ugcgccgcauucgcacuggggg

SEQ ID NO: 2177109 - RNA, 12 nt, Homo sapiens
guaaagacugua

SEQ ID NO: 2177110 - RNA, 19 nt, Homo sapiens
ucuuuggcaguugcauuag

SEQ ID NO: 2177111 - RNA, 22 nt, Homo sapiens
ccagaaugguacacaaugugau

SEQ ID NO: 2177112 - RNA, 19 nt, Homo sapiens
ugcaccagguagaacgcca

SEQ ID NO: 2177113 - RNA, 15 nt, Homo sapiens
guaggugcuaaccug

SEQ ID NO: 2177114 - RNA, 23 nt, Homo sapiens
ggagccucuccuugccuggugac

SEQ ID NO: 2177115 - RNA, 15 nt, Homo sapiens
ucaguguucaugcga

SEQ ID NO: 2177116 - RNA, 18 nt, Homo sapiens
gaagguccccuggcagug

SEQ ID NO: 2177117 - RNA, 11 nt, Homo sapiens
aaugucacaau

SEQ ID NO: 2177118 - RNA, 19 nt, Homo sapiens
cuuuuccugauaaagcaca

SEQ ID NO: 2177119 - RNA, 19 nt, Homo sapiens
auguacuacauuugcaugc

SEQ ID NO: 2177120 - RNA, 22 nt, Homo sapiens
gccccacccaguuucuggaaaa

SEQ ID NO: 2177121 - RNA, 16 nt, Homo sapiens
ucugccaaugccauga

SEQ ID NO: 2177122 - RNA, 18 nt, Homo sapiens
ugaauauaucccaugggu

SEQ ID NO: 2177123 - RNA, 18 nt, Homo sapiens
cuguggccuguuaacugg

SEQ ID NO: 2177124 - RNA, 22 nt, Homo sapiens
acauaucuaaagucaucaugaa

SEQ ID NO: 2177125 - RNA, 20 nt, Homo sapiens
uuguguaaaggaacaacuga

SEQ ID NO: 2177126 - RNA, 20 nt, Homo sapiens
uggcaagcugcaaaaggccu

SEQ ID NO: 2177127 - RNA, 17 nt, Homo sapiens
aguaugguaaucuuuac

SEQ ID NO: 2177128 - RNA, 19 nt, Homo sapiens
cuaaaccaguccuuagcaa

SEQ ID NO: 2177129 - RNA, 16 nt, Homo sapiens
aucgcuggaaaacagc

SEQ ID NO: 2177130 - RNA, 15 nt, Homo sapiens
aagagauggugcuaa

SEQ ID NO: 2177131 - RNA, 15 nt, Homo sapiens
agcacuguccaguau

SEQ ID NO: 2177132 - RNA, 18 nt, Homo sapiens
cagaacauacuguucuca

SEQ ID NO: 2177133 - RNA, 14 nt, Homo sapiens
gauugggauuucca

SEQ ID NO: 2177134 - RNA, 19 nt, Homo sapiens
cuguguccuacuccuugca

SEQ ID NO: 2177135 - RNA, 17 nt, Homo sapiens
auauaccuauaaugugu

SEQ ID NO: 2177136 - RNA, 14 nt, Homo sapiens
gagguccugcauuu

SEQ ID NO: 2177137 - RNA, 18 nt, Homo sapiens
auaaaaaguucagaguuc

SEQ ID NO: 2177138 - RNA, 12 nt, Homo sapiens
ccagccucagau

SEQ ID NO: 2177139 - RNA, 23 nt, Homo sapiens
ccacaccuggcauggugcaggga

SEQ ID NO: 2177140 - RNA, 16 nt, Homo sapiens
guucuaaccacuucag

SEQ ID NO: 2177141 - RNA, 16 nt, Homo sapiens
aauacaagaaccaagg

SEQ ID NO: 2177142 - RNA, 17 nt, Homo sapiens
acgcauggaaaaguuuc

SEQ ID NO: 2177143 - RNA, 15 nt, Homo sapiens
ucucaucccaaccuc

SEQ ID NO: 2177144 - RNA, 13 nt, Homo sapiens
uaaaaagugacac

SEQ ID NO: 2177145 - RNA, 14 nt, Homo sapiens
guuucaccucccaa

SEQ ID NO: 2177146 - RNA, 19 nt, Homo sapiens
accagaaagcuucauccac

SEQ ID NO: 2177147 - RNA, 13 nt, Homo sapiens
cauguuguaagca

SEQ ID NO: 2177148 - RNA, 19 nt, Homo sapiens
cuuggagggcccacuugua

SEQ ID NO: 2177149 - RNA, 17 nt, Homo sapiens
auauggacucugcacau

SEQ ID NO: 2177150 - RNA, 17 nt, Homo sapiens
augugugugcaagugug

SEQ ID NO: 2177151 - RNA, 15 nt, Homo sapiens
uaaauaugaaugaac

SEQ ID NO: 2177152 - RNA, 21 nt, Homo sapiens
aaauuuggcuucuguugucac

SEQ ID NO: 2177153 - RNA, 18 nt, Homo sapiens
uaugagcuaaaacaucca

SEQ ID NO: 2177154 - RNA, 13 nt, Homo sapiens
agaacucauuuga

SEQ ID NO: 2177155 - RNA, 19 nt, Homo sapiens
uauggcagugucuuuccac

SEQ ID NO: 2177156 - RNA, 15 nt, Homo sapiens
aaacucagcaucaaa

SEQ ID NO: 2177157 - RNA, 21 nt, Homo sapiens
aucugacagacaaugauccag

SEQ ID NO: 2177158 - RNA, 15 nt, Homo sapiens
caggucuagacuuuc

SEQ ID NO: 2177159 - RNA, 19 nt, Homo sapiens
cagacuggcugcacagccc

SEQ ID NO: 2177160 - RNA, 14 nt, Homo sapiens
agcccaggaucucu

SEQ ID NO: 2177161 - RNA, 21 nt, Homo sapiens
aauuguccuugaagcuuguau

SEQ ID NO: 2177162 - RNA, 21 nt, Homo sapiens
guaauaaccaaaugcaaugug

SEQ ID NO: 2177163 - RNA, 22 nt, Homo sapiens
guucaaaugaguucaacuuuga

SEQ ID NO: 2177164 - RNA, 23 nt, Homo sapiens
ucuucacuggguucccauucuga

SEQ ID NO: 2177165 - RNA, 17 nt, Homo sapiens
uuuaaccgcacaugcac

SEQ ID NO: 2177166 - RNA, 15 nt, Homo sapiens
ugaguaaucugagaa

SEQ ID NO: 2177167 - RNA, 17 nt, Homo sapiens
ucccaagcccugcauug

SEQ ID NO: 2177168 - RNA, 16 nt, Homo sapiens
uaugucccaagagcca

SEQ ID NO: 2177169 - RNA, 18 nt, Homo sapiens
acaaacuucccugacucu

SEQ ID NO: 2177170 - RNA, 18 nt, Homo sapiens
caggacacagauuaucaa

SEQ ID NO: 2177171 - RNA, 18 nt, Homo sapiens
gagcauggaugcauuuca

SEQ ID NO: 2177172 - RNA, 17 nt, Homo sapiens
uugggaauugcaugcca

SEQ ID NO: 2177173 - RNA, 21 nt, Homo sapiens
acacgcugcaccuaaagccua

SEQ ID NO: 2177174 - RNA, 21 nt, Homo sapiens
ccacacaagggaaggacagaa

SEQ ID NO: 2177175 - RNA, 13 nt, Homo sapiens
agaauggugggcu

SEQ ID NO: 2177176 - RNA, 17 nt, Homo sapiens
guucacugacacaguaa

SEQ ID NO: 2177177 - RNA, 10 nt, Homo sapiens
uaugugcaau

SEQ ID NO: 2177178 - RNA, 11 nt, Homo sapiens
uguacagugaa

SEQ ID NO: 2177179 - RNA, 16 nt, Homo sapiens
ugagugcacuaaacaa

SEQ ID NO: 2177180 - RNA, 16 nt, Homo sapiens
gauauuugauaaugaa

SEQ ID NO: 2177181 - RNA, 13 nt, Homo sapiens
auggagaacccag

SEQ ID NO: 2177182 - RNA, 20 nt, Homo sapiens
gacaucuuccgagaaacagg

SEQ ID NO: 2177183 - RNA, 15 nt, Homo sapiens
cuggcacuccccuga

SEQ ID NO: 2177184 - RNA, 17 nt, Homo sapiens
ggaccccaucugcugag

SEQ ID NO: 2177185 - RNA, 21 nt, Homo sapiens
cucauggauugccacagcuca

SEQ ID NO: 2177186 - RNA, 22 nt, Homo sapiens
aaaaccuacccucagugagcau

SEQ ID NO: 2177187 - RNA, 17 nt, Homo sapiens
gcucacaccugaccaau

SEQ ID NO: 2177188 - RNA, 19 nt, Homo sapiens
agccaaggcagcgacccca

SEQ ID NO: 2177189 - RNA, 19 nt, Homo sapiens
ccucugaccccugccugug

SEQ ID NO: 2177190 - RNA, 20 nt, Homo sapiens
guauuaaacuguaaaucaua

SEQ ID NO: 2177191 - RNA, 18 nt, Homo sapiens
agagaucuaugggcauuu

SEQ ID NO: 2177192 - RNA, 18 nt, Homo sapiens
uguuauggaaacuguugc

SEQ ID NO: 2177193 - RNA, 18 nt, Homo sapiens
gagugaaggggccaagga

SEQ ID NO: 2177194 - RNA, 17 nt, Homo sapiens
cugggaccaggcuccaa

SEQ ID NO: 2177195 - RNA, 19 nt, Homo sapiens
auucauccaggcaugggcu

SEQ ID NO: 2177196 - RNA, 20 nt, Homo sapiens
acaauugcuuuaacagucaa

SEQ ID NO: 2177197 - RNA, 16 nt, Homo sapiens
cacagagauaugcaca

SEQ ID NO: 2177198 - RNA, 17 nt, Homo sapiens
cauucgacauaccccac

SEQ ID NO: 2177199 - RNA, 15 nt, Homo sapiens
acuugggccauagcu

SEQ ID NO: 2177200 - RNA, 23 nt, Homo sapiens
ccccuaccagccacgggcacaag

SEQ ID NO: 2177201 - RNA, 16 nt, Homo sapiens
agcguuagggcugcuu

SEQ ID NO: 2177202 - RNA, 22 nt, Homo sapiens
cagggcucuaaugugucucuca

SEQ ID NO: 2177203 - RNA, 23 nt, Homo sapiens
ucugugcagagaugacuguccaa

SEQ ID NO: 2177204 - RNA, 15 nt, Homo sapiens
cuccugcccaggaga

SEQ ID NO: 2177205 - RNA, 17 nt, Homo sapiens
cauuucucaagggccau

SEQ ID NO: 2177206 - RNA, 19 nt, Homo sapiens
uggaaaugacccuauuuga

SEQ ID NO: 2177207 - RNA, 19 nt, Homo sapiens
ccccuagaauaaucucauc

SEQ ID NO: 2177208 - RNA, 16 nt, Homo sapiens
ucugccccagcccaga

SEQ ID NO: 2177209 - RNA, 11 nt, Homo sapiens
gaaauuaacac

SEQ ID NO: 2177210 - RNA, 19 nt, Homo sapiens
ugcuuagacauaacaaaac

SEQ ID NO: 2177211 - RNA, 14 nt, Homo sapiens
uaacuuacuuccaa

SEQ ID NO: 2177212 - RNA, 13 nt, Homo sapiens
ucugagaaacucu

SEQ ID NO: 2177213 - RNA, 15 nt, Homo sapiens
cuugugagucuucac

SEQ ID NO: 2177214 - RNA, 16 nt, Homo sapiens
agcagauaccuugcaa

SEQ ID NO: 2177215 - RNA, 18 nt, Homo sapiens
auuagagagcaucugcaa

SEQ ID NO: 2177216 - RNA, 21 nt, Homo sapiens
uauagcagaagcacauuuuca

SEQ ID NO: 2177217 - RNA, 20 nt, Homo sapiens
gcccuuuauuuauaauacau

SEQ ID NO: 2177218 - RNA, 16 nt, Homo sapiens
uuguccuucagccaaa

SEQ ID NO: 2177219 - RNA, 17 nt, Homo sapiens
ccucugggggguggcca

SEQ ID NO: 2177220 - RNA, 21 nt, Homo sapiens
ugacuaaugaggcauuacaaa

SEQ ID NO: 2177221 - RNA, 19 nt, Homo sapiens
ucaccauuauaaugaauuu

SEQ ID NO: 2177222 - RNA, 18 nt, Homo sapiens
cuaaucucagcacuuugg

SEQ ID NO: 2177223 - RNA, 16 nt, Homo sapiens
guaccaggaugugcua

SEQ ID NO: 2177224 - RNA, 16 nt, Homo sapiens
ugcaaaacacuaaaga

SEQ ID NO: 2177225 - RNA, 16 nt, Homo sapiens
auagcaaauggccuca

SEQ ID NO: 2177226 - RNA, 15 nt, Homo sapiens
ggaaagcagcucaaa

SEQ ID NO: 2177227 - RNA, 18 nt, Homo sapiens
cagaggagauguggucaa

SEQ ID NO: 2177228 - RNA, 21 nt, Homo sapiens
aucuuuaaauaaaugugagaa

SEQ ID NO: 2177229 - RNA, 18 nt, Homo sapiens
uguucuccuauauccucc

SEQ ID NO: 2177230 - RNA, 19 nt, Homo sapiens
uggagagcuagaaccugga

SEQ ID NO: 2177231 - RNA, 16 nt, Homo sapiens
uacauuagugccauag

SEQ ID NO: 2177232 - RNA, 13 nt, Homo sapiens
augucacuguuau

SEQ ID NO: 2177233 - RNA, 22 nt, Homo sapiens
caauaaagaauauuuacaauaa

SEQ ID NO: 2177234 - RNA, 12 nt, Homo sapiens
uauaaaacugcc

SEQ ID NO: 2177235 - RNA, 17 nt, Homo sapiens
aguucaagugcucuuca

SEQ ID NO: 2177236 - RNA, 23 nt, Homo sapiens
acuagaaaccccgggccauccca

SEQ ID NO: 2177237 - RNA, 16 nt, Homo sapiens
ugccaauucauuucuc

SEQ ID NO: 2177238 - RNA, 13 nt, Homo sapiens
agcaaagguuaca

SEQ ID NO: 2177239 - RNA, 12 nt, Homo sapiens
agcuacaguaga

SEQ ID NO: 2177240 - RNA, 22 nt, Homo sapiens
aaagaagguuggugaauuucac

SEQ ID NO: 2177241 - RNA, 19 nt, Homo sapiens
uuccuccuaaaacaauccu

SEQ ID NO: 2177242 - RNA, 21 nt, Homo sapiens
aucuccaaacuaaacccucac

SEQ ID NO: 2177243 - RNA, 22 nt, Homo sapiens
aggguuuuaaacacuaaucaca

SEQ ID NO: 2177244 - RNA, 19 nt, Homo sapiens
acccaccccacaauuccuc

SEQ ID NO: 2177245 - RNA, 18 nt, Homo sapiens
gaucauagguauuucaaa

SEQ ID NO: 2177246 - RNA, 19 nt, Homo sapiens
ucagagccaaauuacaagu

SEQ ID NO: 2177247 - RNA, 15 nt, Homo sapiens
ugauguuccacucca

SEQ ID NO: 2177248 - RNA, 20 nt, Homo sapiens
uggggaccaaaggucaggga

SEQ ID NO: 2177249 - RNA, 20 nt, Homo sapiens
guacuguacuuucccagguu

SEQ ID NO: 2177250 - RNA, 17 nt, Homo sapiens
ucccuggggcugugcau

SEQ ID NO: 2177251 - RNA, 13 nt, Homo sapiens
aaaucacuuugag

SEQ ID NO: 2177252 - RNA, 15 nt, Homo sapiens
uccuguuuugcaaau

SEQ ID NO: 2177253 - RNA, 15 nt, Homo sapiens
ggauauacugcagcu

SEQ ID NO: 2177254 - RNA, 20 nt, Homo sapiens
gcaaauauccuccacuuuca

SEQ ID NO: 2177255 - RNA, 13 nt, Homo sapiens
auaaaugacuguu

SEQ ID NO: 2177256 - RNA, 14 nt, Homo sapiens
auccaggcuuugua

SEQ ID NO: 2177257 - RNA, 13 nt, Homo sapiens
cagaaucucauua

SEQ ID NO: 2177258 - RNA, 12 nt, Homo sapiens
uaacauccagag

SEQ ID NO: 2177259 - RNA, 21 nt, Homo sapiens
cuguaaucccagcacuuuggg

SEQ ID NO: 2177260 - RNA, 13 nt, Homo sapiens
ugcaguccaguga

SEQ ID NO: 2177261 - RNA, 18 nt, Homo sapiens
gcaaaagguuaagccaua

SEQ ID NO: 2177262 - RNA, 19 nt, Homo sapiens
aaccgcuugccauauuccg

SEQ ID NO: 2177263 - RNA, 20 nt, Homo sapiens
cuugugcauugugugucaca

SEQ ID NO: 2177264 - RNA, 18 nt, Homo sapiens
ugguauuuucaaccauaa

SEQ ID NO: 2177265 - RNA, 23 nt, Homo sapiens
aagucugggauguagaacuucaa

SEQ ID NO: 2177266 - RNA, 20 nt, Homo sapiens
agacucuacagaggccaugg

SEQ ID NO: 2177267 - RNA, 19 nt, Homo sapiens
gcugcucauacuggucuca

SEQ ID NO: 2177268 - RNA, 19 nt, Homo sapiens
uccugcucuuuugugauga

SEQ ID NO: 2177269 - RNA, 14 nt, Homo sapiens
uaugcuaugauuaa

SEQ ID NO: 2177270 - RNA, 20 nt, Homo sapiens
aagggaagcccugacaacaa

SEQ ID NO: 2177271 - RNA, 20 nt, Homo sapiens
guucucaauacccacugcca

SEQ ID NO: 2177272 - RNA, 20 nt, Homo sapiens
cauauauauugaaaugcaaa

SEQ ID NO: 2177273 - RNA, 12 nt, Homo sapiens
cauucauccuga

SEQ ID NO: 2177274 - RNA, 17 nt, Homo sapiens
acuuggcgcugccauuu

SEQ ID NO: 2177275 - RNA, 22 nt, Homo sapiens
aacagggagaaguagcuaguag

SEQ ID NO: 2177276 - RNA, 22 nt, Homo sapiens
uuacauuuccaaaugaaugacc

SEQ ID NO: 2177277 - RNA, 13 nt, Homo sapiens
gucucaguguuaa

SEQ ID NO: 2177278 - RNA, 14 nt, Homo sapiens
cuuuuugacacuga

SEQ ID NO: 2177279 - RNA, 18 nt, Homo sapiens
ucacuggcaugggagacc

SEQ ID NO: 2177280 - RNA, 16 nt, Homo sapiens
ugcucucucugagggg

SEQ ID NO: 2177281 - RNA, 20 nt, Homo sapiens
uuauauagcaagugcuauuu

SEQ ID NO: 2177282 - RNA, 16 nt, Homo sapiens
ugggaaaagagucucu

SEQ ID NO: 2177283 - RNA, 15 nt, Homo sapiens
agucuuuugcauguc

SEQ ID NO: 2177284 - RNA, 11 nt, Homo sapiens
cccuugcacag

SEQ ID NO: 2177285 - RNA, 17 nt, Homo sapiens
auacauuguacuuauac

SEQ ID NO: 2177286 - RNA, 22 nt, Homo sapiens
augggacucugagaacuccuca

SEQ ID NO: 2177287 - RNA, 23 nt, Homo sapiens
ccugaacgcacaugacauagcac

SEQ ID NO: 2177288 - RNA, 21 nt, Homo sapiens
uucuuauggaacgaauacccu

SEQ ID NO: 2177289 - RNA, 15 nt, Homo sapiens
gaauuaugucugcug

SEQ ID NO: 2177290 - RNA, 15 nt, Homo sapiens
augugcaguacuuaa

SEQ ID NO: 2177291 - RNA, 23 nt, Homo sapiens
uuccuggacuggcccuugcccaa

SEQ ID NO: 2177292 - RNA, 15 nt, Homo sapiens
uuuacuagugccaaa

SEQ ID NO: 2177293 - RNA, 20 nt, Homo sapiens
uuaaagucccuuuauaaaga

SEQ ID NO: 2177294 - RNA, 14 nt, Homo sapiens
guccuggggugguu

SEQ ID NO: 2177295 - RNA, 18 nt, Homo sapiens
aauacauuaaagcaguca

SEQ ID NO: 2177296 - RNA, 14 nt, Homo sapiens
gaagaaucuguuuc

SEQ ID NO: 2177297 - RNA, 20 nt, Homo sapiens
ccagccugcucccuagccag

SEQ ID NO: 2177298 - RNA, 13 nt, Homo sapiens
uaauugaucagau

SEQ ID NO: 2177299 - RNA, 20 nt, Homo sapiens
aaguuuuggaaagaguucaa

SEQ ID NO: 2177300 - RNA, 23 nt, Homo sapiens
uuucuggaugaaugcccagugag

SEQ ID NO: 2177301 - RNA, 17 nt, Homo sapiens
ggguacagaugugcugu

SEQ ID NO: 2177302 - RNA, 15 nt, Homo sapiens
uggccccugggccug

SEQ ID NO: 2177303 - RNA, 18 nt, Homo sapiens
gucacucuaggacucugc

SEQ ID NO: 2177304 - RNA, 18 nt, Homo sapiens
cagagaaggaacauaccc

SEQ ID NO: 2177305 - RNA, 17 nt, Homo sapiens
ugaaggaauaauuaaga

SEQ ID NO: 2177306 - RNA, 15 nt, Homo sapiens
gagcucuugugucau

SEQ ID NO: 2177307 - RNA, 16 nt, Homo sapiens
ucacaaauccuucaaa

SEQ ID NO: 2177308 - RNA, 23 nt, Homo sapiens
aauaaaaugucuucucccaccag

SEQ ID NO: 2177309 - RNA, 18 nt, Homo sapiens
acagcuccuaggaaaaug

SEQ ID NO: 2177310 - RNA, 15 nt, Homo sapiens
aauucccucuacugu

SEQ ID NO: 2177311 - RNA, 21 nt, Homo sapiens
auacuguagaagaagcccaua

SEQ ID NO: 2177312 - RNA, 21 nt, Homo sapiens
cagcacagaugaggagcagcu

SEQ ID NO: 2177313 - RNA, 16 nt, Homo sapiens
uaaauggugagaauua

SEQ ID NO: 2177314 - RNA, 16 nt, Homo sapiens
ccauccccacccaguc

SEQ ID NO: 2177315 - RNA, 18 nt, Homo sapiens
cacuuacacuuuaugcac

SEQ ID NO: 2177316 - RNA, 22 nt, Homo sapiens
auauaccacucuuuaccuuuau

SEQ ID NO: 2177317 - RNA, 14 nt, Homo sapiens
cuugggaugcuuau

SEQ ID NO: 2177318 - RNA, 13 nt, Homo sapiens
uccugaaaguguu

SEQ ID NO: 2177319 - RNA, 13 nt, Homo sapiens
gccagaaauugau

SEQ ID NO: 2177320 - RNA, 14 nt, Homo sapiens
uaaaacuggaccug

SEQ ID NO: 2177321 - RNA, 19 nt, Homo sapiens
uaugaggagaugauaacug

SEQ ID NO: 2177322 - RNA, 15 nt, Homo sapiens
uuaugaauaguuucc

SEQ ID NO: 2177323 - RNA, 13 nt, Homo sapiens
aauauuacaauac

SEQ ID NO: 2177324 - RNA, 14 nt, Homo sapiens
ucgcaccuuuccaa

SEQ ID NO: 2177325 - RNA, 15 nt, Homo sapiens
gaucuuuggacagaa

SEQ ID NO: 2177326 - RNA, 20 nt, Homo sapiens
uucucauccugcaggcagcu

SEQ ID NO: 2177327 - RNA, 21 nt, Homo sapiens
ucucuauuuuuguuaaucauc

SEQ ID NO: 2177328 - RNA, 19 nt, Homo sapiens
ggccagagggagugacaga

SEQ ID NO: 2177329 - RNA, 13 nt, Homo sapiens
gagauggaguucu

SEQ ID NO: 2177330 - RNA, 15 nt, Homo sapiens
gcucaagacuggcau

SEQ ID NO: 2177331 - RNA, 20 nt, Homo sapiens
cugccucuggaauugcucaa

SEQ ID NO: 2177332 - RNA, 19 nt, Homo sapiens
caaggcuggagugcagugg

SEQ ID NO: 2177333 - RNA, 18 nt, Homo sapiens
uauuaugccugaaugacu

SEQ ID NO: 2177334 - RNA, 19 nt, Homo sapiens
acugccucgggaaccucac

SEQ ID NO: 2177335 - RNA, 23 nt, Homo sapiens
cacaacccuucagauuugccuua

SEQ ID NO: 2177336 - RNA, 20 nt, Homo sapiens
aggacucugcaagugucugg

SEQ ID NO: 2177337 - RNA, 12 nt, Homo sapiens
ggaauucagugc

SEQ ID NO: 2177338 - RNA, 16 nt, Homo sapiens
agugucugugccaugg

SEQ ID NO: 2177339 - RNA, 19 nt, Homo sapiens
uggacauuuuaaacacuua

SEQ ID NO: 2177340 - RNA, 15 nt, Homo sapiens
uuucuucagagacag

SEQ ID NO: 2177341 - RNA, 16 nt, Homo sapiens
gaaggcauugcuuccu

SEQ ID NO: 2177342 - RNA, 22 nt, Homo sapiens
ucuuugggaggugauguuccca

SEQ ID NO: 2177343 - RNA, 20 nt, Homo sapiens
ugaauuuuacuugcaccuua

SEQ ID NO: 2177344 - RNA, 16 nt, Homo sapiens
ccaccucgugaacaca

SEQ ID NO: 2177345 - RNA, 18 nt, Homo sapiens
uaguguuuggacagcuga

SEQ ID NO: 2177346 - RNA, 17 nt, Homo sapiens
uccccaaaggcauccau

SEQ ID NO: 2177347 - RNA, 12 nt, Homo sapiens
uaaccuaccugg

SEQ ID NO: 2177348 - RNA, 17 nt, Homo sapiens
gcuacaaucccaaagcg

SEQ ID NO: 2177349 - RNA, 17 nt, Homo sapiens
ccauuagaaugcuacaa

SEQ ID NO: 2177350 - RNA, 17 nt, Homo sapiens
uuuucuaacuucugcua

SEQ ID NO: 2177351 - RNA, 17 nt, Homo sapiens
aggcaagcaagcucucu

SEQ ID NO: 2177352 - RNA, 17 nt, Homo sapiens
ccuguacacacacagac

SEQ ID NO: 2177353 - RNA, 17 nt, Homo sapiens
gcuggcucacaguacag

SEQ ID NO: 2177354 - RNA, 21 nt, Homo sapiens
aggcgagccugacucuguuga

SEQ ID NO: 2177355 - RNA, 14 nt, Homo sapiens
ggaaaccaguguag

SEQ ID NO: 2177356 - RNA, 22 nt, Homo sapiens
gaauuugaaacacuuugcauaa

SEQ ID NO: 2177357 - RNA, 20 nt, Homo sapiens
aggcgggguuucaccaugcu

SEQ ID NO: 2177358 - RNA, 14 nt, Homo sapiens
ucuacauaugaucu

SEQ ID NO: 2177359 - RNA, 13 nt, Homo sapiens
uuacaggugugug

SEQ ID NO: 2177360 - RNA, 14 nt, Homo sapiens
caggucugacucca

SEQ ID NO: 2177361 - RNA, 18 nt, Homo sapiens
guaaucucagcuacucag

SEQ ID NO: 2177362 - RNA, 20 nt, Homo sapiens
auuuuguguucaguacaauu

SEQ ID NO: 2177363 - RNA, 20 nt, Homo sapiens
cccucaaagcuuccauucca

SEQ ID NO: 2177364 - RNA, 16 nt, Homo sapiens
cugucaauuacaggaa

SEQ ID NO: 2177365 - RNA, 21 nt, Homo sapiens
cuccuagggccacugaagaua

SEQ ID NO: 2177366 - RNA, 22 nt, Homo sapiens
aaagugugugauuucucuccca

SEQ ID NO: 2177367 - RNA, 14 nt, Homo sapiens
uugauaguauuuau

SEQ ID NO: 2177368 - RNA, 15 nt, Homo sapiens
aagcuccacugucac

SEQ ID NO: 2177369 - RNA, 23 nt, Homo sapiens
ugcagaaagaaauugagcgccau

SEQ ID NO: 2177370 - RNA, 18 nt, Homo sapiens
ccacauucaaaauagggu

SEQ ID NO: 2177371 - RNA, 13 nt, Homo sapiens
aaugaaacuuuaa

SEQ ID NO: 2177372 - RNA, 15 nt, Homo sapiens
aggcgcacaguguga

SEQ ID NO: 2177373 - RNA, 20 nt, Homo sapiens
acaaugaagugacacuuuga

SEQ ID NO: 2177374 - RNA, 18 nt, Homo sapiens
uugauuuucuuucuccuc

SEQ ID NO: 2177375 - RNA, 22 nt, Homo sapiens
ucuuagagagaagaucacugaa

SEQ ID NO: 2177376 - RNA, 13 nt, Homo sapiens
uucacacaaagug

SEQ ID NO: 2177377 - RNA, 20 nt, Homo sapiens
ugggacgcaggagaucaucu

SEQ ID NO: 2177378 - RNA, 17 nt, Homo sapiens
acuaaauaugugacuga

SEQ ID NO: 2177379 - RNA, 19 nt, Homo sapiens
uccacccaccuggcuucau

SEQ ID NO: 2177380 - RNA, 22 nt, Homo sapiens
acuuauuuaaugaaaucagaag

SEQ ID NO: 2177381 - RNA, 19 nt, Homo sapiens
cugagccauugauucuuca

SEQ ID NO: 2177382 - RNA, 16 nt, Homo sapiens
ugauauaauuacuuaa

SEQ ID NO: 2177383 - RNA, 22 nt, Homo sapiens
cugcuuuuggggcucuugauca

SEQ ID NO: 2177384 - RNA, 19 nt, Homo sapiens
gaaauaaaagccucuggug

SEQ ID NO: 2177385 - RNA, 12 nt, Homo sapiens
gguaauauaccu

SEQ ID NO: 2177386 - RNA, 19 nt, Homo sapiens
cgugguccccaacagcgac

SEQ ID NO: 2177387 - RNA, 19 nt, Homo sapiens
auuuuggcauuuuggcuca

SEQ ID NO: 2177388 - RNA, 19 nt, Homo sapiens
uguguguuuguguguuuca

SEQ ID NO: 2177389 - RNA, 17 nt, Homo sapiens
uuugcacacguccaugu

SEQ ID NO: 2177390 - RNA, 16 nt, Homo sapiens
uacauuuccaaauuca

SEQ ID NO: 2177391 - RNA, 16 nt, Homo sapiens
cuacucucuuccucca

SEQ ID NO: 2177392 - RNA, 21 nt, Homo sapiens
ccuggcuuuuauucauccuca

SEQ ID NO: 2177393 - RNA, 18 nt, Homo sapiens
auguaggaucugucaaag

SEQ ID NO: 2177394 - RNA, 16 nt, Homo sapiens
auuuuuugaaaguuaa

SEQ ID NO: 2177395 - RNA, 23 nt, Homo sapiens
acccuguuuguugugucuugcua

SEQ ID NO: 2177396 - RNA, 19 nt, Homo sapiens
agguccccguggauggucu

SEQ ID NO: 2177397 - RNA, 14 nt, Homo sapiens
ucacuaauacuuac

SEQ ID NO: 2177398 - RNA, 14 nt, Homo sapiens
uauuucauaaacaa

SEQ ID NO: 2177399 - RNA, 22 nt, Homo sapiens
ccaagagaaaggccugcacaca

SEQ ID NO: 2177400 - RNA, 17 nt, Homo sapiens
caucagugucuuuccac

SEQ ID NO: 2177401 - RNA, 20 nt, Homo sapiens
ugcaguggcgugaucucagc

SEQ ID NO: 2177402 - RNA, 18 nt, Homo sapiens
gcugggccucuucugccu

SEQ ID NO: 2177403 - RNA, 20 nt, Homo sapiens
gauggaacacggccacauca

SEQ ID NO: 2177404 - RNA, 17 nt, Homo sapiens
cagcugugguacaaaug

SEQ ID NO: 2177405 - RNA, 19 nt, Homo sapiens
cagcccccaggccagguga

SEQ ID NO: 2177406 - RNA, 16 nt, Homo sapiens
ccaauagcacuuucau

SEQ ID NO: 2177407 - RNA, 16 nt, Homo sapiens
ucucaaucuccugacu

SEQ ID NO: 2177408 - RNA, 18 nt, Homo sapiens
cuaucuucuuucacauau

SEQ ID NO: 2177409 - RNA, 17 nt, Homo sapiens
ucucaaaguaaggguuu

SEQ ID NO: 2177410 - RNA, 18 nt, Homo sapiens
auuagcucucaucuaguu

SEQ ID NO: 2177411 - RNA, 16 nt, Homo sapiens
cugggccugagccuaa

SEQ ID NO: 2177412 - RNA, 14 nt, Homo sapiens
uacaggcauaaaau

SEQ ID NO: 2177413 - RNA, 11 nt, Homo sapiens
ggccagcucac

SEQ ID NO: 2177414 - RNA, 14 nt, Homo sapiens
cugucccuucuccc

SEQ ID NO: 2177415 - RNA, 11 nt, Homo sapiens
ucaagccaugg

SEQ ID NO: 2177416 - RNA, 12 nt, Homo sapiens
cuuuugcugauc

SEQ ID NO: 2177417 - RNA, 18 nt, Homo sapiens
uacaauauuaaguccaaa

SEQ ID NO: 2177418 - RNA, 13 nt, Homo sapiens
ucaucaguuccuu

SEQ ID NO: 2177419 - RNA, 13 nt, Homo sapiens
gcaacagugccau

SEQ ID NO: 2177420 - RNA, 17 nt, Homo sapiens
ccagagcccagcuccaa

SEQ ID NO: 2177421 - RNA, 21 nt, Homo sapiens
acugugcuggagaauuccagu

SEQ ID NO: 2177422 - RNA, 20 nt, Homo sapiens
ugagauaaguuuuguuucaa

SEQ ID NO: 2177423 - RNA, 19 nt, Homo sapiens
agacaugugaggaggaaaa

SEQ ID NO: 2177424 - RNA, 13 nt, Homo sapiens
cacugacagccuu

SEQ ID NO: 2177425 - RNA, 21 nt, Homo sapiens
cauuguuaaauguucccuuag

SEQ ID NO: 2177426 - RNA, 22 nt, Homo sapiens
ggagggcuccagacacaugucc

SEQ ID NO: 2177427 - RNA, 22 nt, Homo sapiens
auaccagguuuuacacuugcau

SEQ ID NO: 2177428 - RNA, 17 nt, Homo sapiens
augcauacguacauucc

SEQ ID NO: 2177429 - RNA, 16 nt, Homo sapiens
uuacaaaaacauggcc

SEQ ID NO: 2177430 - RNA, 14 nt, Homo sapiens
guggggacagggau

SEQ ID NO: 2177431 - RNA, 22 nt, Homo sapiens
gaugggggaucagcagggcagu

SEQ ID NO: 2177432 - RNA, 20 nt, Homo sapiens
cucucaaugaauaauuguau

SEQ ID NO: 2177433 - RNA, 22 nt, Homo sapiens
gauucuguaauagugaacauau

SEQ ID NO: 2177434 - RNA, 14 nt, Homo sapiens
acagagauaugcac

SEQ ID NO: 2177435 - RNA, 16 nt, Homo sapiens
uuucaguauacugugu

SEQ ID NO: 2177436 - RNA, 13 nt, Homo sapiens
agccucaaccucc

SEQ ID NO: 2177437 - RNA, 12 nt, Homo sapiens
acaucuucucaa

SEQ ID NO: 2177438 - RNA, 20 nt, Homo sapiens
ccccucuucugagcacagau

SEQ ID NO: 2177439 - RNA, 22 nt, Homo sapiens
acggaccugcuuugagauuucc

SEQ ID NO: 2177440 - RNA, 18 nt, Homo sapiens
uucuuaaucaagaauauu

SEQ ID NO: 2177441 - RNA, 17 nt, Homo sapiens
cccauuccuauuucuua

SEQ ID NO: 2177442 - RNA, 16 nt, Homo sapiens
cugcaguuugggagac

SEQ ID NO: 2177443 - RNA, 21 nt, Homo sapiens
aauacacuauuaucuucuuaa

SEQ ID NO: 2177444 - RNA, 14 nt, Homo sapiens
uguguuuccuucag

SEQ ID NO: 2177445 - RNA, 21 nt, Homo sapiens
uggucuuccucgauaaaggga

SEQ ID NO: 2177446 - RNA, 19 nt, Homo sapiens
uugcaaaagaaguugcugg

SEQ ID NO: 2177447 - RNA, 14 nt, Homo sapiens
aauuucgcucugga

SEQ ID NO: 2177448 - RNA, 22 nt, Homo sapiens
ggcugccgagacagacccucug

SEQ ID NO: 2177449 - RNA, 21 nt, Homo sapiens
aguggcugaaauaaaagccuc

SEQ ID NO: 2177450 - RNA, 20 nt, Homo sapiens
agugauuugggggugcaaug

SEQ ID NO: 2177451 - RNA, 22 nt, Homo sapiens
ucauuuuauggaagauguguga

SEQ ID NO: 2177452 - RNA, 15 nt, Homo sapiens
caaaccaucuccucc

SEQ ID NO: 2177453 - RNA, 13 nt, Homo sapiens
auuuuccaaugca

SEQ ID NO: 2177454 - RNA, 22 nt, Homo sapiens
ugcagguuuagaggaccaguga

SEQ ID NO: 2177455 - RNA, 17 nt, Homo sapiens
gaccuggggaaacggcc

SEQ ID NO: 2177456 - RNA, 17 nt, Homo sapiens
uuauucuguuauauagu

SEQ ID NO: 2177457 - RNA, 21 nt, Homo sapiens
uauggcuauaggugcuacaaa

SEQ ID NO: 2177458 - RNA, 16 nt, Homo sapiens
auuuguuauacuucaa

SEQ ID NO: 2177459 - RNA, 21 nt, Homo sapiens
cauuauagauuuucauguucu

SEQ ID NO: 2177460 - RNA, 17 nt, Homo sapiens
uauucugguuacugugg

SEQ ID NO: 2177461 - RNA, 22 nt, Homo sapiens
gagguuuagccaucuuacuugg

SEQ ID NO: 2177462 - RNA, 22 nt, Homo sapiens
ccuuguucucuaaguuccacug

SEQ ID NO: 2177463 - RNA, 22 nt, Homo sapiens
auggaguuaaacuugaugccag

SEQ ID NO: 2177464 - RNA, 22 nt, Homo sapiens
ccuugcugauggugacauugca

SEQ ID NO: 2177465 - RNA, 14 nt, Homo sapiens
cuuuaaauaucauu

SEQ ID NO: 2177466 - RNA, 18 nt, Homo sapiens
gcacuaacacaugcacac

SEQ ID NO: 2177467 - RNA, 22 nt, Homo sapiens
accccuuacuuagcaugcacaa

SEQ ID NO: 2177468 - RNA, 13 nt, Homo sapiens
guuugaucuuccu

SEQ ID NO: 2177469 - RNA, 20 nt, Homo sapiens
gucacuaccuucaugcauag

SEQ ID NO: 2177470 - RNA, 16 nt, Homo sapiens
ucuugcugucaaggaa

SEQ ID NO: 2177471 - RNA, 18 nt, Homo sapiens
gcccugaaccucugaugc

SEQ ID NO: 2177472 - RNA, 18 nt, Homo sapiens
cucagacaccuagacucu

SEQ ID NO: 2177473 - RNA, 16 nt, Homo sapiens
gccccgugcagacugg

SEQ ID NO: 2177474 - RNA, 14 nt, Homo sapiens
aacugccugggcca

SEQ ID NO: 2177475 - RNA, 13 nt, Homo sapiens
acagaauauacuu

SEQ ID NO: 2177476 - RNA, 14 nt, Homo sapiens
acccaccaugucug

SEQ ID NO: 2177477 - RNA, 14 nt, Homo sapiens
ugguaaaguuacac

SEQ ID NO: 2177478 - RNA, 22 nt, Homo sapiens
caauuaacuccguuuccaaaua

SEQ ID NO: 2177479 - RNA, 23 nt, Homo sapiens
cucauucugguucccugcugcgc

SEQ ID NO: 2177480 - RNA, 13 nt, Homo sapiens
aggugauggccag

SEQ ID NO: 2177481 - RNA, 13 nt, Homo sapiens
caugcacugaccc

SEQ ID NO: 2177482 - RNA, 17 nt, Homo sapiens
ggaugaaggcuugucag

SEQ ID NO: 2177483 - RNA, 15 nt, Homo sapiens
cauucacagugcaag

SEQ ID NO: 2177484 - RNA, 14 nt, Homo sapiens
gaugacaacuggaa

SEQ ID NO: 2177485 - RNA, 18 nt, Homo sapiens
caggagaauggugugaac

SEQ ID NO: 2177486 - RNA, 23 nt, Homo sapiens
gggcauguccuuuccaucugucc

SEQ ID NO: 2177487 - RNA, 23 nt, Homo sapiens
ggccccagccccucucccugugc

SEQ ID NO: 2177488 - RNA, 16 nt, Homo sapiens
ugugaaauacucuucc

SEQ ID NO: 2177489 - RNA, 16 nt, Homo sapiens
aagguuugcaaauuaa

SEQ ID NO: 2177490 - RNA, 13 nt, Homo sapiens
aacaauauauguc

SEQ ID NO: 2177491 - RNA, 17 nt, Homo sapiens
acggcagggaaauguau

SEQ ID NO: 2177492 - RNA, 20 nt, Homo sapiens
uaaagaaguccaugugauaa

SEQ ID NO: 2177493 - RNA, 23 nt, Homo sapiens
aaaccgaauacggucagcaguca

SEQ ID NO: 2177494 - RNA, 16 nt, Homo sapiens
uaucugagucacuuga

SEQ ID NO: 2177495 - RNA, 17 nt, Homo sapiens
caggacauguacugaga

SEQ ID NO: 2177496 - RNA, 17 nt, Homo sapiens
ggcccuuucuugcacug

SEQ ID NO: 2177497 - RNA, 15 nt, Homo sapiens
accauggugaacucc

SEQ ID NO: 2177498 - RNA, 23 nt, Homo sapiens
gucauuagacaaaugucuugaag

SEQ ID NO: 2177499 - RNA, 15 nt, Homo sapiens
cucacuggaggagca

SEQ ID NO: 2177500 - RNA, 19 nt, Homo sapiens
gguggagccaaguggucca

SEQ ID NO: 2177501 - RNA, 15 nt, Homo sapiens
augcauguccucaaa

SEQ ID NO: 2177502 - RNA, 19 nt, Homo sapiens
ucugauacuuagaccaaaa

SEQ ID NO: 2177503 - RNA, 15 nt, Homo sapiens
aagccauucugccuc

SEQ ID NO: 2177504 - RNA, 13 nt, Homo sapiens
cuccugaaugcau

SEQ ID NO: 2177505 - RNA, 15 nt, Homo sapiens
cauacauuuaugcac

SEQ ID NO: 2177506 - RNA, 23 nt, Homo sapiens
aagaaauaucugagcucuuugca

SEQ ID NO: 2177507 - RNA, 15 nt, Homo sapiens
gaagucuugucucaa

SEQ ID NO: 2177508 - RNA, 23 nt, Homo sapiens
uuccucgcagagaggccaggugc

SEQ ID NO: 2177509 - RNA, 14 nt, Homo sapiens
caaccccacccagc

SEQ ID NO: 2177510 - RNA, 16 nt, Homo sapiens
auuauuuuguucauac

SEQ ID NO: 2177511 - RNA, 18 nt, Homo sapiens
cugccucucuuucacaca

SEQ ID NO: 2177512 - RNA, 20 nt, Homo sapiens
ucccuuucuaagcaaccaca

SEQ ID NO: 2177513 - RNA, 17 nt, Homo sapiens
cacccucaaaugucaga

SEQ ID NO: 2177514 - RNA, 12 nt, Homo sapiens
gauagacaucag

SEQ ID NO: 2177515 - RNA, 19 nt, Homo sapiens
gcauaguaaauguaguuca

SEQ ID NO: 2177516 - RNA, 15 nt, Homo sapiens
cuccccuucacaugc

SEQ ID NO: 2177517 - RNA, 21 nt, Homo sapiens
uccccgacuggggcagggugu

SEQ ID NO: 2177518 - RNA, 21 nt, Homo sapiens
ccuaggggaacagaccaguga

SEQ ID NO: 2177519 - RNA, 15 nt, Homo sapiens
ucuggcccagugaau

SEQ ID NO: 2177520 - RNA, 14 nt, Homo sapiens
cagugcuaccucuc

SEQ ID NO: 2177521 - RNA, 19 nt, Homo sapiens
gaaagccucugcugccaug

SEQ ID NO: 2177522 - RNA, 19 nt, Homo sapiens
ggacuauauuugggccugc

SEQ ID NO: 2177523 - RNA, 21 nt, Homo sapiens
ggacacgccgucuguccucac

SEQ ID NO: 2177524 - RNA, 16 nt, Homo sapiens
ugguuuaugucaucau

SEQ ID NO: 2177525 - RNA, 23 nt, Homo sapiens
augacauuuuuuuuaacuacuau

SEQ ID NO: 2177526 - RNA, 22 nt, Homo sapiens
aaccaagcuguacccuugagac

SEQ ID NO: 2177527 - RNA, 18 nt, Homo sapiens
uggagugaucucagcuca

SEQ ID NO: 2177528 - RNA, 17 nt, Homo sapiens
aaaauccuuacuuccag

SEQ ID NO: 2177529 - RNA, 19 nt, Homo sapiens
ccucuguuccuucccugug

SEQ ID NO: 2177530 - RNA, 12 nt, Homo sapiens
agagauacagua

SEQ ID NO: 2177531 - RNA, 15 nt, Homo sapiens
ugcuauaccuugacu

SEQ ID NO: 2177532 - RNA, 13 nt, Homo sapiens
uaggccaggugca

SEQ ID NO: 2177533 - RNA, 16 nt, Homo sapiens
cacugcgcccggccac

SEQ ID NO: 2177534 - RNA, 17 nt, Homo sapiens
uaaacgccuucccaaaa

SEQ ID NO: 2177535 - RNA, 21 nt, Homo sapiens
agugauuuuuuucauugucca

SEQ ID NO: 2177536 - RNA, 19 nt, Homo sapiens
acauuauuaaucauuccau

SEQ ID NO: 2177537 - RNA, 14 nt, Homo sapiens
uccgcgcaggugcc

SEQ ID NO: 2177538 - RNA, 15 nt, Homo sapiens
caugucuugugcaua

SEQ ID NO: 2177539 - RNA, 20 nt, Homo sapiens
uguccacaugaccuccauuu

SEQ ID NO: 2177540 - RNA, 13 nt, Homo sapiens
caaaccaagcaaa

SEQ ID NO: 2177541 - RNA, 22 nt, Homo sapiens
cuacauuuccgccacaucccuc

SEQ ID NO: 2177542 - RNA, 13 nt, Homo sapiens
auaguaugggaaa

SEQ ID NO: 2177543 - RNA, 20 nt, Homo sapiens
ccaaagugguuucagcaaua

SEQ ID NO: 2177544 - RNA, 16 nt, Homo sapiens
ucaacagaucaaugac

SEQ ID NO: 2177545 - RNA, 17 nt, Homo sapiens
auauauuccaccaggau

SEQ ID NO: 2177546 - RNA, 18 nt, Homo sapiens
gugucccugagcagcuua

SEQ ID NO: 2177547 - RNA, 18 nt, Homo sapiens
agaaugggccacuguagg

SEQ ID NO: 2177548 - RNA, 19 nt, Homo sapiens
ucuacagacuccaaaaggc

SEQ ID NO: 2177549 - RNA, 20 nt, Homo sapiens
cuccgaauaaacgugcuccc

SEQ ID NO: 2177550 - RNA, 14 nt, Homo sapiens
cgauaucagaauuu

SEQ ID NO: 2177551 - RNA, 17 nt, Homo sapiens
ugcaaaacucauuuaca

SEQ ID NO: 2177552 - RNA, 19 nt, Homo sapiens
acaaaggcaaaggguccag

SEQ ID NO: 2177553 - RNA, 16 nt, Homo sapiens
cugccuagcacucaca

SEQ ID NO: 2177554 - RNA, 11 nt, Homo sapiens
aguugccugau

SEQ ID NO: 2177555 - RNA, 17 nt, Homo sapiens
gccaagcugguccuggg

SEQ ID NO: 2177556 - RNA, 13 nt, Homo sapiens
uguuaagugcuuu

SEQ ID NO: 2177557 - RNA, 15 nt, Homo sapiens
uaaguaaacagucag

SEQ ID NO: 2177558 - RNA, 19 nt, Homo sapiens
aggcgcugcauacagggga

SEQ ID NO: 2177559 - RNA, 12 nt, Homo sapiens
cuuacacuguau

SEQ ID NO: 2177560 - RNA, 14 nt, Homo sapiens
gaugcugacccagg

SEQ ID NO: 2177561 - RNA, 19 nt, Homo sapiens
acaaaugauaaguacuaca

SEQ ID NO: 2177562 - RNA, 19 nt, Homo sapiens
acuaauguacuguacauaa

SEQ ID NO: 2177563 - RNA, 15 nt, Homo sapiens
uuuaauuacaaacaa

SEQ ID NO: 2177564 - RNA, 17 nt, Homo sapiens
uaaaacuucaucuuccc

SEQ ID NO: 2177565 - RNA, 16 nt, Homo sapiens
guccauuuaccuggaa

SEQ ID NO: 2177566 - RNA, 12 nt, Homo sapiens
aaagaacaggau

SEQ ID NO: 2177567 - RNA, 19 nt, Homo sapiens
cagugagcugagaucacac

SEQ ID NO: 2177568 - RNA, 13 nt, Homo sapiens
aaauaaaguacca

SEQ ID NO: 2177569 - RNA, 21 nt, Homo sapiens
cucaggugaaaauccaucuca

SEQ ID NO: 2177570 - RNA, 17 nt, Homo sapiens
acaacuuuauguugcag

SEQ ID NO: 2177571 - RNA, 21 nt, Homo sapiens
uaaacaagugcacuugaacau

SEQ ID NO: 2177572 - RNA, 24 nt, Homo sapiens
aucauuuggccgagucagcacgua

SEQ ID NO: 2177573 - RNA, 21 nt, Homo sapiens
gcgagccaggaccacagagcu

SEQ ID NO: 2177574 - RNA, 14 nt, Homo sapiens
agcugugugccaca

SEQ ID NO: 2177575 - RNA, 23 nt, Homo sapiens
cucccccaaaaacccaccaaaau

SEQ ID NO: 2177576 - RNA, 16 nt, Homo sapiens
accacugcacuccagc

SEQ ID NO: 2177577 - RNA, 22 nt, Homo sapiens
cacuguacaccauaguuuacaa

SEQ ID NO: 2177578 - RNA, 17 nt, Homo sapiens
accagcuccacuggccu

SEQ ID NO: 2177579 - RNA, 16 nt, Homo sapiens
ucuucaucccauucca

SEQ ID NO: 2177580 - RNA, 14 nt, Homo sapiens
aaauaugagugcca

SEQ ID NO: 2177581 - RNA, 15 nt, Homo sapiens
ccccaacuccaggaa

SEQ ID NO: 2177582 - RNA, 17 nt, Homo sapiens
gaauaccccuucucugu

SEQ ID NO: 2177583 - RNA, 14 nt, Homo sapiens
caaagcagauucag

SEQ ID NO: 2177584 - RNA, 19 nt, Homo sapiens
acagugggcagucacacaa

SEQ ID NO: 2177585 - RNA, 19 nt, Homo sapiens
cuuugcauguauuagcuca

SEQ ID NO: 2177586 - RNA, 22 nt, Homo sapiens
cugucuagaacuuaaguuugau

SEQ ID NO: 2177587 - RNA, 22 nt, Homo sapiens
acagcucccggcgggugcucug

SEQ ID NO: 2177588 - RNA, 14 nt, Homo sapiens
aauaauguacaucu

SEQ ID NO: 2177589 - RNA, 16 nt, Homo sapiens
cauuugccugcuucuu

SEQ ID NO: 2177590 - RNA, 18 nt, Homo sapiens
acaauauuuaaaauauua

SEQ ID NO: 2177591 - RNA, 18 nt, Homo sapiens
ucccagauguuggaccaa

SEQ ID NO: 2177592 - RNA, 19 nt, Homo sapiens
uagaggguccagucuucua

SEQ ID NO: 2177593 - RNA, 19 nt, Homo sapiens
ucauuccccgacacugcca

SEQ ID NO: 2177594 - RNA, 20 nt, Homo sapiens
accauuuagcacacugcuug

SEQ ID NO: 2177595 - RNA, 17 nt, Homo sapiens
ucgcuugcuagaaguag

SEQ ID NO: 2177596 - RNA, 19 nt, Homo sapiens
gagcuugacaccuggugcu

SEQ ID NO: 2177597 - RNA, 17 nt, Homo sapiens
acuaaugcucaaccuaa

SEQ ID NO: 2177598 - RNA, 17 nt, Homo sapiens
aaaaauuagccaggugu

SEQ ID NO: 2177599 - RNA, 16 nt, Homo sapiens
uaagagaaaugagcug

SEQ ID NO: 2177600 - RNA, 12 nt, Homo sapiens
cagcugcauggc

SEQ ID NO: 2177601 - RNA, 19 nt, Homo sapiens
gcaaaacuuaggcaugcac

SEQ ID NO: 2177602 - RNA, 14 nt, Homo sapiens
gggaaauccauucc

SEQ ID NO: 2177603 - RNA, 20 nt, Homo sapiens
cuuuuauuuucuacuuacuu

SEQ ID NO: 2177604 - RNA, 13 nt, Homo sapiens
uccacuucaucca

SEQ ID NO: 2177605 - RNA, 12 nt, Homo sapiens
ggaugucuuccu

SEQ ID NO: 2177606 - RNA, 19 nt, Homo sapiens
agcuacuauaaauauacau

SEQ ID NO: 2177607 - RNA, 21 nt, Homo sapiens
ggucuugcaggcaucugucuu

SEQ ID NO: 2177608 - RNA, 17 nt, Homo sapiens
cuuugaaaacaauucag

SEQ ID NO: 2177609 - RNA, 22 nt, Homo sapiens
aaguagauuagaaaacuagauu

SEQ ID NO: 2177610 - RNA, 15 nt, Homo sapiens
ugaaaugugcacuuu

SEQ ID NO: 2177611 - RNA, 17 nt, Homo sapiens
ucccuguuuuaauucaa

SEQ ID NO: 2177612 - RNA, 17 nt, Homo sapiens
uaaauacuacugcucua

SEQ ID NO: 2177613 - RNA, 18 nt, Homo sapiens
ccaaauccacaagccauu

SEQ ID NO: 2177614 - RNA, 23 nt, Homo sapiens
gaccuggcaaggacacagaugaa

SEQ ID NO: 2177615 - RNA, 22 nt, Homo sapiens
cuuucuucccucauguucucau

SEQ ID NO: 2177616 - RNA, 19 nt, Homo sapiens
uaucuacaguacuuccaga

SEQ ID NO: 2177617 - RNA, 14 nt, Homo sapiens
cuguugcucaggag

SEQ ID NO: 2177618 - RNA, 15 nt, Homo sapiens
ugaguggugccaaac

SEQ ID NO: 2177619 - RNA, 18 nt, Homo sapiens
ucuaucccuuaccugcuu

SEQ ID NO: 2177620 - RNA, 23 nt, Homo sapiens
agcauuugggcagacccugagca

SEQ ID NO: 2177621 - RNA, 21 nt, Homo sapiens
agcagacuggauuuuugcucu

SEQ ID NO: 2177622 - RNA, 13 nt, Homo sapiens
ucccugaucccau

SEQ ID NO: 2177623 - RNA, 12 nt, Homo sapiens
aguuccaaauaa

SEQ ID NO: 2177624 - RNA, 16 nt, Homo sapiens
cuagaaucuucuuaca

SEQ ID NO: 2177625 - RNA, 17 nt, Homo sapiens
gcgaaaggaaagccaaa

SEQ ID NO: 2177626 - RNA, 13 nt, Homo sapiens
uggaggcacuuua

SEQ ID NO: 2177627 - RNA, 14 nt, Homo sapiens
gcagugagcacuga

SEQ ID NO: 2177628 - RNA, 16 nt, Homo sapiens
cguaaugaaagccaca

SEQ ID NO: 2177629 - RNA, 19 nt, Homo sapiens
caggcaccucuuccuugau

SEQ ID NO: 2177630 - RNA, 21 nt, Homo sapiens
uggucaagauuuugaaugcuu

SEQ ID NO: 2177631 - RNA, 11 nt, Homo sapiens
cgcgacuucca

SEQ ID NO: 2177632 - RNA, 20 nt, Homo sapiens
acuaagaugaucaucuccag

SEQ ID NO: 2177633 - RNA, 17 nt, Homo sapiens
aaggaggaaucaagaag

SEQ ID NO: 2177634 - RNA, 20 nt, Homo sapiens
ccucucccgucagggcccaa

SEQ ID NO: 2177635 - RNA, 22 nt, Homo sapiens
caucuggguuuguuuacagcaa

SEQ ID NO: 2177636 - RNA, 16 nt, Homo sapiens
uuaccuaguuugcacu

SEQ ID NO: 2177637 - RNA, 14 nt, Homo sapiens
gcccccugguggga

SEQ ID NO: 2177638 - RNA, 18 nt, Homo sapiens
uacauagcauuuguguaa

SEQ ID NO: 2177639 - RNA, 16 nt, Homo sapiens
auugccuugugugauu

SEQ ID NO: 2177640 - RNA, 18 nt, Homo sapiens
gcauucugcaacauuuau

SEQ ID NO: 2177641 - RNA, 12 nt, Homo sapiens
gacaaagguaga

SEQ ID NO: 2177642 - RNA, 19 nt, Homo sapiens
uacauugcagcaagcaaua

SEQ ID NO: 2177643 - RNA, 21 nt, Homo sapiens
uauaaguguucaguguugaca

SEQ ID NO: 2177644 - RNA, 14 nt, Homo sapiens
cauuuacccaacuc

SEQ ID NO: 2177645 - RNA, 16 nt, Homo sapiens
aaucagcccagugcaa

SEQ ID NO: 2177646 - RNA, 15 nt, Homo sapiens
ccacugcugagcugg

SEQ ID NO: 2177647 - RNA, 14 nt, Homo sapiens
agcaggcacgggug

SEQ ID NO: 2177648 - RNA, 17 nt, Homo sapiens
cgugaaaccccaucucu

SEQ ID NO: 2177649 - RNA, 22 nt, Homo sapiens
ucaaugugucuuucuaagaaau

SEQ ID NO: 2177650 - RNA, 14 nt, Homo sapiens
agagccacuuucaa

SEQ ID NO: 2177651 - RNA, 18 nt, Homo sapiens
agcagaugccagcgccau

SEQ ID NO: 2177652 - RNA, 20 nt, Homo sapiens
aauauuuguauacacauaau

SEQ ID NO: 2177653 - RNA, 18 nt, Homo sapiens
cugauuuuuuuguuguug

SEQ ID NO: 2177654 - RNA, 21 nt, Homo sapiens
cucucagaggccugcugccag

SEQ ID NO: 2177655 - RNA, 23 nt, Homo sapiens
cugucaguucuaaccuccuaagc

SEQ ID NO: 2177656 - RNA, 15 nt, Homo sapiens
aacagccaacuagcc

SEQ ID NO: 2177657 - RNA, 16 nt, Homo sapiens
aaauguauuuuucaca

SEQ ID NO: 2177658 - RNA, 19 nt, Homo sapiens
ggauuacaggugugcacca

SEQ ID NO: 2177659 - RNA, 17 nt, Homo sapiens
aucuuagcuuuccacag

SEQ ID NO: 2177660 - RNA, 21 nt, Homo sapiens
ccccauggcuuguucucugga

SEQ ID NO: 2177661 - RNA, 23 nt, Homo sapiens
cacauaccuggcccugugccuug

SEQ ID NO: 2177662 - RNA, 14 nt, Homo sapiens
caugcauaccacaa

SEQ ID NO: 2177663 - RNA, 21 nt, Homo sapiens
guguuucuuuugacaccuuag

SEQ ID NO: 2177664 - RNA, 14 nt, Homo sapiens
uaacaccaugauua

SEQ ID NO: 2177665 - RNA, 23 nt, Homo sapiens
caaacugggaugaaacuaaagca

SEQ ID NO: 2177666 - RNA, 17 nt, Homo sapiens
aagaucaauuucuccca

SEQ ID NO: 2177667 - RNA, 14 nt, Homo sapiens
uacaggcugagaca

SEQ ID NO: 2177668 - RNA, 18 nt, Homo sapiens
gucugugugggacuguac

SEQ ID NO: 2177669 - RNA, 19 nt, Homo sapiens
acaaucauuggaauuccuu

SEQ ID NO: 2177670 - RNA, 13 nt, Homo sapiens
cuggaguugcuga

SEQ ID NO: 2177671 - RNA, 14 nt, Homo sapiens
cgagacaccacaag

SEQ ID NO: 2177672 - RNA, 13 nt, Homo sapiens
ccucuaguguccg

SEQ ID NO: 2177673 - RNA, 16 nt, Homo sapiens
caguguggcagugacc

SEQ ID NO: 2177674 - RNA, 11 nt, Homo sapiens
ucuuuuccacu

SEQ ID NO: 2177675 - RNA, 22 nt, Homo sapiens
guuagagagcuuuucacuguga

SEQ ID NO: 2177676 - RNA, 18 nt, Homo sapiens
uacaagguuauguagaga

SEQ ID NO: 2177677 - RNA, 22 nt, Homo sapiens
ugcccaauaugcaguucugcag

SEQ ID NO: 2177678 - RNA, 19 nt, Homo sapiens
auugugccacuucacucca

SEQ ID NO: 2177679 - RNA, 23 nt, Homo sapiens
cacugaaugccucaaugugacca

SEQ ID NO: 2177680 - RNA, 21 nt, Homo sapiens
ucauuccagguguguucagua

SEQ ID NO: 2177681 - RNA, 16 nt, Homo sapiens
ccucucucccuagugc

SEQ ID NO: 2177682 - RNA, 14 nt, Homo sapiens
ucuucccuaccuca

SEQ ID NO: 2177683 - RNA, 12 nt, Homo sapiens
ggggacaucuca

SEQ ID NO: 2177684 - RNA, 17 nt, Homo sapiens
uuugcuuaaaauuguga

SEQ ID NO: 2177685 - RNA, 18 nt, Homo sapiens
cauuucuugguaugauca

SEQ ID NO: 2177686 - RNA, 19 nt, Homo sapiens
ccuuucuugagggaguuca

SEQ ID NO: 2177687 - RNA, 21 nt, Homo sapiens
cugaacagcccucucucucac

SEQ ID NO: 2177688 - RNA, 14 nt, Homo sapiens
ggauccuuugcugc

SEQ ID NO: 2177689 - RNA, 17 nt, Homo sapiens
ugucgucuuagcaagaa

SEQ ID NO: 2177690 - RNA, 21 nt, Homo sapiens
uaaaagaucuugaauagucuc

SEQ ID NO: 2177691 - RNA, 11 nt, Homo sapiens
agucuauggcc

SEQ ID NO: 2177692 - RNA, 18 nt, Homo sapiens
uuuauauugucauuguca

SEQ ID NO: 2177693 - RNA, 15 nt, Homo sapiens
cucagcucucuggga

SEQ ID NO: 2177694 - RNA, 17 nt, Homo sapiens
ccgguuauuacuucugu

SEQ ID NO: 2177695 - RNA, 17 nt, Homo sapiens
uacuagagcaagcagga

SEQ ID NO: 2177696 - RNA, 19 nt, Homo sapiens
agaugagauucccucuccu

SEQ ID NO: 2177697 - RNA, 13 nt, Homo sapiens
gucaaagaagcuu

SEQ ID NO: 2177698 - RNA, 22 nt, Homo sapiens
gcguauguucguugcagcacug

SEQ ID NO: 2177699 - RNA, 18 nt, Homo sapiens
ccaacuagacauucuguc

SEQ ID NO: 2177700 - RNA, 19 nt, Homo sapiens
cuuuaaaacuuauccucca

SEQ ID NO: 2177701 - RNA, 15 nt, Homo sapiens
cagcaaaagugcagu

SEQ ID NO: 2177702 - RNA, 17 nt, Homo sapiens
uggcuaguugaaucuau

SEQ ID NO: 2177703 - RNA, 20 nt, Homo sapiens
ugagccaaaaugacuuugaa

SEQ ID NO: 2177704 - RNA, 20 nt, Homo sapiens
ucccaguguuccauuugaac

SEQ ID NO: 2177705 - RNA, 20 nt, Homo sapiens
gaauauuuauucagugacuu

SEQ ID NO: 2177706 - RNA, 17 nt, Homo sapiens
auuccaggcgaugugca

SEQ ID NO: 2177707 - RNA, 15 nt, Homo sapiens
gcagcagaagccaaa

SEQ ID NO: 2177708 - RNA, 16 nt, Homo sapiens
aacacccuucagcaau

SEQ ID NO: 2177709 - RNA, 19 nt, Homo sapiens
uuaacccuauuuuaccuag

SEQ ID NO: 2177710 - RNA, 20 nt, Homo sapiens
cagagcucuggguugugcac

SEQ ID NO: 2177711 - RNA, 15 nt, Homo sapiens
aauucagggaauaua

SEQ ID NO: 2177712 - RNA, 19 nt, Homo sapiens
uaaaauauuccugcauuug

SEQ ID NO: 2177713 - RNA, 15 nt, Homo sapiens
gaaucaaaagugccu

SEQ ID NO: 2177714 - RNA, 21 nt, Homo sapiens
cgugaucucggcucacugcaa

SEQ ID NO: 2177715 - RNA, 22 nt, Homo sapiens
gcaaaaccuugugacucagugu

SEQ ID NO: 2177716 - RNA, 19 nt, Homo sapiens
ucagcgugggccagaggca

SEQ ID NO: 2177717 - RNA, 13 nt, Homo sapiens
aggaauggugcuu

SEQ ID NO: 2177718 - RNA, 14 nt, Homo sapiens
ucuugaauagcuua

SEQ ID NO: 2177719 - RNA, 18 nt, Homo sapiens
uuccccaagaucugccag

SEQ ID NO: 2177720 - RNA, 21 nt, Homo sapiens
uagaagcaaaugacaaaaagc

SEQ ID NO: 2177721 - RNA, 18 nt, Homo sapiens
uuaguggaauuugcuuua

SEQ ID NO: 2177722 - RNA, 21 nt, Homo sapiens
cugcccccuugggugaccucu

SEQ ID NO: 2177723 - RNA, 18 nt, Homo sapiens
augucccuucucaugccu

SEQ ID NO: 2177724 - RNA, 13 nt, Homo sapiens
ugcacugaugucc

SEQ ID NO: 2177725 - RNA, 17 nt, Homo sapiens
auuccagaccugaagaa

SEQ ID NO: 2177726 - RNA, 16 nt, Homo sapiens
aucucggucacaggga

SEQ ID NO: 2177727 - RNA, 14 nt, Homo sapiens
aggggaccccacuc

SEQ ID NO: 2177728 - RNA, 13 nt, Homo sapiens
aucuaccuuccag

SEQ ID NO: 2177729 - RNA, 14 nt, Homo sapiens
auuugcaguauuca

SEQ ID NO: 2177730 - RNA, 20 nt, Homo sapiens
uuaaauuauggaacugcuaa

SEQ ID NO: 2177731 - RNA, 18 nt, Homo sapiens
ccaggaggggucugccuc

SEQ ID NO: 2177732 - RNA, 17 nt, Homo sapiens
ccauaguucacugacug

SEQ ID NO: 2177733 - RNA, 21 nt, Homo sapiens
agagaaacuugaaugcuccau

SEQ ID NO: 2177734 - RNA, 22 nt, Homo sapiens
aaaugcacuaagacaagaacau

SEQ ID NO: 2177735 - RNA, 16 nt, Homo sapiens
aaccccgucucuacua

SEQ ID NO: 2177736 - RNA, 23 nt, Homo sapiens
cacuucugggucaugcacugagg

SEQ ID NO: 2177737 - RNA, 16 nt, Homo sapiens
ccuuuuugguuuuuac

SEQ ID NO: 2177738 - RNA, 18 nt, Homo sapiens
uggauaauuccccaagag

SEQ ID NO: 2177739 - RNA, 23 nt, Homo sapiens
agucuacucuuucugcuuacaaa

SEQ ID NO: 2177740 - RNA, 19 nt, Homo sapiens
auccaugagggacuccucc

SEQ ID NO: 2177741 - RNA, 19 nt, Homo sapiens
uacagcaugacguaguauu

SEQ ID NO: 2177742 - RNA, 18 nt, Homo sapiens
guuuuauggagaccucuc

SEQ ID NO: 2177743 - RNA, 12 nt, Homo sapiens
aaaaauuuggca

SEQ ID NO: 2177744 - RNA, 19 nt, Homo sapiens
ugccaccaugacuggcuaa

SEQ ID NO: 2177745 - RNA, 21 nt, Homo sapiens
caauuuaaaaaugagugugaa

SEQ ID NO: 2177746 - RNA, 16 nt, Homo sapiens
uuuucaaagauuuaaa

SEQ ID NO: 2177747 - RNA, 21 nt, Homo sapiens
aauuagggagcucuugacaga

SEQ ID NO: 2177748 - RNA, 23 nt, Homo sapiens
ugcaucuaagcccaugggacaaa

SEQ ID NO: 2177749 - RNA, 14 nt, Homo sapiens
aguacuccaagaca

SEQ ID NO: 2177750 - RNA, 17 nt, Homo sapiens
uacaaagcaaauuucua

SEQ ID NO: 2177751 - RNA, 21 nt, Homo sapiens
agaagaaguuuaaaaaaccau

SEQ ID NO: 2177752 - RNA, 14 nt, Homo sapiens
cuggcaugcagcua

SEQ ID NO: 2177753 - RNA, 21 nt, Homo sapiens
ucagcucacgcuucacaguga

SEQ ID NO: 2177754 - RNA, 23 nt, Homo sapiens
agcuggcccaguuguccaugaca

SEQ ID NO: 2177755 - RNA, 18 nt, Homo sapiens
ucgggcacucccuaaguc

SEQ ID NO: 2177756 - RNA, 22 nt, Homo sapiens
aaagccaaucucaaucccucaa

SEQ ID NO: 2177757 - RNA, 20 nt, Homo sapiens
acauacauaagcagcauuuc

SEQ ID NO: 2177758 - RNA, 22 nt, Homo sapiens
caacuuggaagaucuaccugca

SEQ ID NO: 2177759 - RNA, 23 nt, Homo sapiens
aucccuacauuuuuuaauuaaag

SEQ ID NO: 2177760 - RNA, 17 nt, Homo sapiens
agccaugcaaugccaaa

SEQ ID NO: 2177761 - RNA, 18 nt, Homo sapiens
aaagccugccucuuccag

SEQ ID NO: 2177762 - RNA, 15 nt, Homo sapiens
uaauacuauucuuua

SEQ ID NO: 2177763 - RNA, 14 nt, Homo sapiens
uuugcuaagagcca

SEQ ID NO: 2177764 - RNA, 21 nt, Homo sapiens
ucuuuguaaugucaccaccuu

SEQ ID NO: 2177765 - RNA, 19 nt, Homo sapiens
uuaugucucuucugagcua

SEQ ID NO: 2177766 - RNA, 13 nt, Homo sapiens
ugccaaagcagcu

SEQ ID NO: 2177767 - RNA, 15 nt, Homo sapiens
ucuagugauaagaau

SEQ ID NO: 2177768 - RNA, 15 nt, Homo sapiens
guccacaagcuucug

SEQ ID NO: 2177769 - RNA, 19 nt, Homo sapiens
cagguuuaugaaugacagu

SEQ ID NO: 2177770 - RNA, 21 nt, Homo sapiens
ccuccuggugaagugugacuu

SEQ ID NO: 2177771 - RNA, 18 nt, Homo sapiens
auguaacuucagauguuu

SEQ ID NO: 2177772 - RNA, 22 nt, Homo sapiens
aagaacaguguugaaauuggaa

SEQ ID NO: 2177773 - RNA, 21 nt, Homo sapiens
aacaggauuacaguguagcua

SEQ ID NO: 2177774 - RNA, 22 nt, Homo sapiens
aaccugcaguacaacaguuuua

SEQ ID NO: 2177775 - RNA, 17 nt, Homo sapiens
caugacuuauuaugcau

SEQ ID NO: 2177776 - RNA, 22 nt, Homo sapiens
uaacuuucauaccacuugaauu

SEQ ID NO: 2177777 - RNA, 15 nt, Homo sapiens
ucaaauaucaaaagg

SEQ ID NO: 2177778 - RNA, 21 nt, Homo sapiens
auuuaaggccaggcauggugg

SEQ ID NO: 2177779 - RNA, 14 nt, Homo sapiens
uucucaugccucau

SEQ ID NO: 2177780 - RNA, 14 nt, Homo sapiens
gggcugcacgggau

SEQ ID NO: 2177781 - RNA, 20 nt, Homo sapiens
augucugugcuguguggaac

SEQ ID NO: 2177782 - RNA, 22 nt, Homo sapiens
ugcagucccagcuacucaggag

SEQ ID NO: 2177783 - RNA, 13 nt, Homo sapiens
ucuccagggacag

SEQ ID NO: 2177784 - RNA, 17 nt, Homo sapiens
cagcugugcugggugag

SEQ ID NO: 2177785 - RNA, 23 nt, Homo sapiens
uguaccgggcuggccugugccua

SEQ ID NO: 2177786 - RNA, 21 nt, Homo sapiens
caccgauguacacacacagau

SEQ ID NO: 2177787 - RNA, 14 nt, Homo sapiens
cagcguacucauca

SEQ ID NO: 2177788 - RNA, 19 nt, Homo sapiens
cagcacaagauacacguca

SEQ ID NO: 2177789 - RNA, 18 nt, Homo sapiens
agacagcaggaagccaua

SEQ ID NO: 2177790 - RNA, 19 nt, Homo sapiens
ucaagaagaggaaagggag

SEQ ID NO: 2177791 - RNA, 15 nt, Homo sapiens
gagugcaguggugcg

SEQ ID NO: 2177792 - RNA, 14 nt, Homo sapiens
ugcuaaauugucug

SEQ ID NO: 2177793 - RNA, 15 nt, Homo sapiens
cuuccagaaacuaca

SEQ ID NO: 2177794 - RNA, 19 nt, Homo sapiens
ugacacaguuggauuuauu

SEQ ID NO: 2177795 - RNA, 18 nt, Homo sapiens
cuugcuaccaaucuguga

SEQ ID NO: 2177796 - RNA, 23 nt, Homo sapiens
aucuguucauuucuaaauuuaua

SEQ ID NO: 2177797 - RNA, 17 nt, Homo sapiens
uacacaacuuugcaaau

SEQ ID NO: 2177798 - RNA, 14 nt, Homo sapiens
aaagguuuuccuua

SEQ ID NO: 2177799 - RNA, 17 nt, Homo sapiens
gcucugaacugcacaau

SEQ ID NO: 2177800 - RNA, 23 nt, Homo sapiens
guguuuuguaggagacuugccag

SEQ ID NO: 2177801 - RNA, 18 nt, Homo sapiens
guacuaagauugugcuca

SEQ ID NO: 2177802 - RNA, 19 nt, Homo sapiens
ucuaucuugucaaucccaa

SEQ ID NO: 2177803 - RNA, 16 nt, Homo sapiens
gaaugccuccuguggg

SEQ ID NO: 2177804 - RNA, 17 nt, Homo sapiens
cugcacccuguuuaaca

SEQ ID NO: 2177805 - RNA, 14 nt, Homo sapiens
agaaagacuauuca

SEQ ID NO: 2177806 - RNA, 22 nt, Homo sapiens
agagaaguaaaacaugcugaaa

SEQ ID NO: 2177807 - RNA, 22 nt, Homo sapiens
ugagcuuuauguaauaauguga

SEQ ID NO: 2177808 - RNA, 16 nt, Homo sapiens
uacuauuuaugugauc

SEQ ID NO: 2177809 - RNA, 16 nt, Homo sapiens
ugccuuugcucuuaua

SEQ ID NO: 2177810 - RNA, 20 nt, Homo sapiens
aauuuaauacagacaucuaa

SEQ ID NO: 2177811 - RNA, 16 nt, Homo sapiens
ucuguaaaucuacaca

SEQ ID NO: 2177812 - RNA, 15 nt, Homo sapiens
uggauacaggagaag

SEQ ID NO: 2177813 - RNA, 21 nt, Homo sapiens
gagcucuguuuucaugcuauu

SEQ ID NO: 2177814 - RNA, 18 nt, Homo sapiens
uguaugaaagauuguggg

SEQ ID NO: 2177815 - RNA, 18 nt, Homo sapiens
auccugucccaccaugca

SEQ ID NO: 2177816 - RNA, 18 nt, Homo sapiens
ugggguuucuggggucca

SEQ ID NO: 2177817 - RNA, 22 nt, Homo sapiens
ucugcuauggaaugccccaugg

SEQ ID NO: 2177818 - RNA, 16 nt, Homo sapiens
cuagguguggcuguga

SEQ ID NO: 2177819 - RNA, 22 nt, Homo sapiens
ucuuccagcccaucuccgggga

SEQ ID NO: 2177820 - RNA, 12 nt, Homo sapiens
caagauggucca

SEQ ID NO: 2177821 - RNA, 19 nt, Homo sapiens
uugaagauuucucugagau

SEQ ID NO: 2177822 - RNA, 22 nt, Homo sapiens
aggggugggauccacacugaga

SEQ ID NO: 2177823 - RNA, 22 nt, Homo sapiens
gcugaaugccuccuguggggaa

SEQ ID NO: 2177824 - RNA, 18 nt, Homo sapiens
accuuauuggauauuuga

SEQ ID NO: 2177825 - RNA, 12 nt, Homo sapiens
aauguccaccug

SEQ ID NO: 2177826 - RNA, 17 nt, Homo sapiens
ucuuacuguugcauaac

SEQ ID NO: 2177827 - RNA, 17 nt, Homo sapiens
augauuaaagacuguga

SEQ ID NO: 2177828 - RNA, 14 nt, Homo sapiens
gauucacaguguga

SEQ ID NO: 2177829 - RNA, 14 nt, Homo sapiens
aauaagucauugua

SEQ ID NO: 2177830 - RNA, 19 nt, Homo sapiens
acugcuuuuuugauucuga

SEQ ID NO: 2177831 - RNA, 10 nt, Homo sapiens
acaaugcaca

SEQ ID NO: 2177832 - RNA, 13 nt, Homo sapiens
gugucaacaugaa

SEQ ID NO: 2177833 - RNA, 13 nt, Homo sapiens
gcuaaaacacuuc

SEQ ID NO: 2177834 - RNA, 19 nt, Homo sapiens
aagagaacauuucuagaaa

SEQ ID NO: 2177835 - RNA, 17 nt, Homo sapiens
guucauauuaugaugcc

SEQ ID NO: 2177836 - RNA, 22 nt, Homo sapiens
ugaagugcaaauuugauacaua

SEQ ID NO: 2177837 - RNA, 18 nt, Homo sapiens
agggagggaaacccgggg

SEQ ID NO: 2177838 - RNA, 19 nt, Homo sapiens
caaaaauagagaaaauuca

SEQ ID NO: 2177839 - RNA, 20 nt, Homo sapiens
caacucagguuuuggcauua

SEQ ID NO: 2177840 - RNA, 16 nt, Homo sapiens
aaaaauauugaacuca

SEQ ID NO: 2177841 - RNA, 21 nt, Homo sapiens
acugaauaaagcacgugcaag

SEQ ID NO: 2177842 - RNA, 17 nt, Homo sapiens
aagaaugaugcuaugaa

SEQ ID NO: 2177843 - RNA, 21 nt, Homo sapiens
aacaucuuggucagauuugaa

SEQ ID NO: 2177844 - RNA, 18 nt, Homo sapiens
auccucccuuugguaccu

SEQ ID NO: 2177845 - RNA, 20 nt, Homo sapiens
gaggcggagguugcaaugag

SEQ ID NO: 2177846 - RNA, 22 nt, Homo sapiens
cauggaacaaaugggaucaauu

SEQ ID NO: 2177847 - RNA, 18 nt, Homo sapiens
cccgucgaggggcucuca

SEQ ID NO: 2177848 - RNA, 14 nt, Homo sapiens
cuugaugacugcug

SEQ ID NO: 2177849 - RNA, 23 nt, Homo sapiens
uuaggauuuucacauucuuggcu

SEQ ID NO: 2177850 - RNA, 16 nt, Homo sapiens
uucauaauuuuaguaa

SEQ ID NO: 2177851 - RNA, 16 nt, Homo sapiens
auuauuaaaucagaau

SEQ ID NO: 2177852 - RNA, 13 nt, Homo sapiens
cuguaagcuccuu

SEQ ID NO: 2177853 - RNA, 14 nt, Homo sapiens
cuuccagaaaacaa

SEQ ID NO: 2177854 - RNA, 16 nt, Homo sapiens
caucacaggaugccag

SEQ ID NO: 2177855 - RNA, 16 nt, Homo sapiens
ggaauaggaaauggau

SEQ ID NO: 2177856 - RNA, 11 nt, Homo sapiens
aguaccacugc

SEQ ID NO: 2177857 - RNA, 22 nt, Homo sapiens
cauggcuuuggcuuugcaaaau

SEQ ID NO: 2177858 - RNA, 16 nt, Homo sapiens
agagacauugccucca

SEQ ID NO: 2177859 - RNA, 14 nt, Homo sapiens
ucaucucuuuauuc

SEQ ID NO: 2177860 - RNA, 20 nt, Homo sapiens
guuagcacuaggcacccagc

SEQ ID NO: 2177861 - RNA, 17 nt, Homo sapiens
ccaugcaggauuugaau

SEQ ID NO: 2177862 - RNA, 14 nt, Homo sapiens
ggagaccagggacc

SEQ ID NO: 2177863 - RNA, 22 nt, Homo sapiens
caccuccuaagaaggcaccucu

SEQ ID NO: 2177864 - RNA, 15 nt, Homo sapiens
uccacugcucucagc

SEQ ID NO: 2177865 - RNA, 21 nt, Homo sapiens
gaggccuuacuuaaacccagc

SEQ ID NO: 2177866 - RNA, 15 nt, Homo sapiens
agauggaaaaacuga

SEQ ID NO: 2177867 - RNA, 15 nt, Homo sapiens
ugucucuauauugcu

SEQ ID NO: 2177868 - RNA, 14 nt, Homo sapiens
aaacaguagugaua

SEQ ID NO: 2177869 - RNA, 15 nt, Homo sapiens
uugaggccaggacuu

SEQ ID NO: 2177870 - RNA, 19 nt, Homo sapiens
uuugggauagagaauguuc

SEQ ID NO: 2177871 - RNA, 21 nt, Homo sapiens
agaaacaguauuuucuuccca

SEQ ID NO: 2177872 - RNA, 19 nt, Homo sapiens
uucaaugcuuucuacucau

SEQ ID NO: 2177873 - RNA, 18 nt, Homo sapiens
cauuuguuuuagucugaa

SEQ ID NO: 2177874 - RNA, 21 nt, Homo sapiens
uuagcccagucauauguucuc

SEQ ID NO: 2177875 - RNA, 17 nt, Homo sapiens
ugauuuagcucccucca

SEQ ID NO: 2177876 - RNA, 12 nt, Homo sapiens
cagaacuacuuc

SEQ ID NO: 2177877 - RNA, 16 nt, Homo sapiens
cucuaacaaugacauu

SEQ ID NO: 2177878 - RNA, 18 nt, Homo sapiens
ugcuguuaccaaaucuca

SEQ ID NO: 2177879 - RNA, 21 nt, Homo sapiens
ggugacagggccgugagcaug

SEQ ID NO: 2177880 - RNA, 16 nt, Homo sapiens
gaacuccauacagccu

SEQ ID NO: 2177881 - RNA, 17 nt, Homo sapiens
cgaguagcugagauuau

SEQ ID NO: 2177882 - RNA, 21 nt, Homo sapiens
agccaagaaaguccaguuuau

SEQ ID NO: 2177883 - RNA, 23 nt, Homo sapiens
aaccuaugauauuuucugugccu

SEQ ID NO: 2177884 - RNA, 17 nt, Homo sapiens
uccaacucccucuggga

SEQ ID NO: 2177885 - RNA, 16 nt, Homo sapiens
aagcacacuaaaccaa

SEQ ID NO: 2177886 - RNA, 14 nt, Homo sapiens
acaaugaguguuau

SEQ ID NO: 2177887 - RNA, 21 nt, Homo sapiens
gauacagauuuaagaauaccu

SEQ ID NO: 2177888 - RNA, 16 nt, Homo sapiens
gaaccuggaacuugga

SEQ ID NO: 2177889 - RNA, 19 nt, Homo sapiens
aucuuuucuagagacacau

SEQ ID NO: 2177890 - RNA, 14 nt, Homo sapiens
uagcuuaucugccc

SEQ ID NO: 2177891 - RNA, 14 nt, Homo sapiens
cuuuucauuauucu

SEQ ID NO: 2177892 - RNA, 18 nt, Homo sapiens
agcccacagcacaccaag

SEQ ID NO: 2177893 - RNA, 18 nt, Homo sapiens
aggcacacgccugccagg

SEQ ID NO: 2177894 - RNA, 22 nt, Homo sapiens
ugccaucaccgcugggugguuu

SEQ ID NO: 2177895 - RNA, 22 nt, Homo sapiens
gaggugcuguccccacugcccc

SEQ ID NO: 2177896 - RNA, 13 nt, Homo sapiens
uaaaacagcagca

SEQ ID NO: 2177897 - RNA, 17 nt, Homo sapiens
ucucagggaagcccagc

SEQ ID NO: 2177898 - RNA, 18 nt, Homo sapiens
ccauguuugguuguaaau

SEQ ID NO: 2177899 - RNA, 21 nt, Homo sapiens
uacaaaaccuacccucaguga

SEQ ID NO: 2177900 - RNA, 21 nt, Homo sapiens
cccauuuucaacugcuuugaa

SEQ ID NO: 2177901 - RNA, 23 nt, Homo sapiens
aauuucauuuccauuuaagcaau

SEQ ID NO: 2177902 - RNA, 16 nt, Homo sapiens
gugcgauaacuuaaca

SEQ ID NO: 2177903 - RNA, 18 nt, Homo sapiens
auggggugucuguguuau

SEQ ID NO: 2177904 - RNA, 21 nt, Homo sapiens
ugaagucugcuuaccaaaaca

SEQ ID NO: 2177905 - RNA, 21 nt, Homo sapiens
aggcugccccauugagaucuu

SEQ ID NO: 2177906 - RNA, 16 nt, Homo sapiens
acaaacucuuguguac

SEQ ID NO: 2177907 - RNA, 21 nt, Homo sapiens
caguucaggagucccaaggaa

SEQ ID NO: 2177908 - RNA, 13 nt, Homo sapiens
cuuuuucacuccc

SEQ ID NO: 2177909 - RNA, 17 nt, Homo sapiens
aucaggagaaaaagccu

SEQ ID NO: 2177910 - RNA, 13 nt, Homo sapiens
caacaauauccuu

SEQ ID NO: 2177911 - RNA, 14 nt, Homo sapiens
agagugugacucau

SEQ ID NO: 2177912 - RNA, 14 nt, Homo sapiens
uuuugaggagcugg

SEQ ID NO: 2177913 - RNA, 20 nt, Homo sapiens
gcauaauguuaagcuuuauu

SEQ ID NO: 2177914 - RNA, 16 nt, Homo sapiens
caguacuugugaaaca

SEQ ID NO: 2177915 - RNA, 17 nt, Homo sapiens
accacugacuacuggcu

SEQ ID NO: 2177916 - RNA, 19 nt, Homo sapiens
ggugucuggaaaagcacuu

SEQ ID NO: 2177917 - RNA, 18 nt, Homo sapiens
ucaucuuccuguguccug

SEQ ID NO: 2177918 - RNA, 22 nt, Homo sapiens
gcaggcuuuguuuauagcuugc

SEQ ID NO: 2177919 - RNA, 19 nt, Homo sapiens
aauguacuuuuuauugcau

SEQ ID NO: 2177920 - RNA, 21 nt, Homo sapiens
gcauuuuccugccugguuucu

SEQ ID NO: 2177921 - RNA, 22 nt, Homo sapiens
aucuccuccuccgcgcugugua

SEQ ID NO: 2177922 - RNA, 17 nt, Homo sapiens
cagccuugcucucuuca

SEQ ID NO: 2177923 - RNA, 22 nt, Homo sapiens
gucuucauaauuucuucacuca

SEQ ID NO: 2177924 - RNA, 14 nt, Homo sapiens
auugaaacugagua

SEQ ID NO: 2177925 - RNA, 15 nt, Homo sapiens
gcccacccccaggaa

SEQ ID NO: 2177926 - RNA, 17 nt, Homo sapiens
uguaacacugcaagaag

SEQ ID NO: 2177927 - RNA, 16 nt, Homo sapiens
ucacagcugcuuucug

SEQ ID NO: 2177928 - RNA, 19 nt, Homo sapiens
aguaggcauauaucacuaa

SEQ ID NO: 2177929 - RNA, 16 nt, Homo sapiens
ugugccgugacagggc

SEQ ID NO: 2177930 - RNA, 21 nt, Homo sapiens
uaauucuuaccucauuugcau

SEQ ID NO: 2177931 - RNA, 14 nt, Homo sapiens
aauuaguggcacuu

SEQ ID NO: 2177932 - RNA, 15 nt, Homo sapiens
agucuggaacacuuu

SEQ ID NO: 2177933 - RNA, 13 nt, Homo sapiens
uugaaugacaaag

SEQ ID NO: 2177934 - RNA, 12 nt, Homo sapiens
uggcuguuucau

SEQ ID NO: 2177935 - RNA, 14 nt, Homo sapiens
gcuguggaugcuuc

SEQ ID NO: 2177936 - RNA, 22 nt, Homo sapiens
aagauucucuauuggcucccuu

SEQ ID NO: 2177937 - RNA, 15 nt, Homo sapiens
ccuuaugacuuuuca

SEQ ID NO: 2177938 - RNA, 22 nt, Homo sapiens
uguguaauuuuuuuuccuugcc

SEQ ID NO: 2177939 - RNA, 19 nt, Homo sapiens
caaugccuuguuguauucc

SEQ ID NO: 2177940 - RNA, 22 nt, Homo sapiens
cagaagauaacuugagcaccgu

SEQ ID NO: 2177941 - RNA, 19 nt, Homo sapiens
ccugccccuuccuccuuca

SEQ ID NO: 2177942 - RNA, 18 nt, Homo sapiens
ccaagaggagacuuuaau

SEQ ID NO: 2177943 - RNA, 12 nt, Homo sapiens
acugcucuuuua

SEQ ID NO: 2177944 - RNA, 20 nt, Homo sapiens
ccggcugagcugugccagcu

SEQ ID NO: 2177945 - RNA, 13 nt, Homo sapiens
ccuccauccugag

SEQ ID NO: 2177946 - RNA, 21 nt, Homo sapiens
uguguagcucucacaugcaca

SEQ ID NO: 2177947 - RNA, 20 nt, Homo sapiens
acccagaucaggaaccaggg

SEQ ID NO: 2177948 - RNA, 19 nt, Homo sapiens
auagcuauugcagcuuaaa

SEQ ID NO: 2177949 - RNA, 14 nt, Homo sapiens
cuuaauaaacugug

SEQ ID NO: 2177950 - RNA, 18 nt, Homo sapiens
gaaucacuuaagccugga

SEQ ID NO: 2177951 - RNA, 20 nt, Homo sapiens
aacuacaacgaacacaagaa

SEQ ID NO: 2177952 - RNA, 20 nt, Homo sapiens
uuaccaaagcaucaauacaa

SEQ ID NO: 2177953 - RNA, 11 nt, Homo sapiens
gagauggacca

SEQ ID NO: 2177954 - RNA, 20 nt, Homo sapiens
cacucccuguuuuaauucaa

SEQ ID NO: 2177955 - RNA, 23 nt, Homo sapiens
agcaaauggaugcggugacaaau

SEQ ID NO: 2177956 - RNA, 19 nt, Homo sapiens
ugucauagaaauauugacu

SEQ ID NO: 2177957 - RNA, 14 nt, Homo sapiens
uccgcuuucacuuc

SEQ ID NO: 2177958 - RNA, 17 nt, Homo sapiens
cugacacaggaaaccaa

SEQ ID NO: 2177959 - RNA, 14 nt, Homo sapiens
gggggucaccaggu

SEQ ID NO: 2177960 - RNA, 18 nt, Homo sapiens
gaaaguuaacucuucaaa

SEQ ID NO: 2177961 - RNA, 14 nt, Homo sapiens
auuucuugcaauuu

SEQ ID NO: 2177962 - RNA, 18 nt, Homo sapiens
caaacaaugccaucacug

SEQ ID NO: 2177963 - RNA, 15 nt, Homo sapiens
uucugucaccaaauu

SEQ ID NO: 2177964 - RNA, 19 nt, Homo sapiens
caaggauccucuccacucc

SEQ ID NO: 2177965 - RNA, 13 nt, Homo sapiens
auucagccuucaa

SEQ ID NO: 2177966 - RNA, 13 nt, Homo sapiens
gucauuaacccau

SEQ ID NO: 2177967 - RNA, 15 nt, Homo sapiens
gucaggaaaccaaau

SEQ ID NO: 2177968 - RNA, 19 nt, Homo sapiens
ccuucuuuaccuucauuuc

SEQ ID NO: 2177969 - RNA, 23 nt, Homo sapiens
caaagucaauuaaaggcuuucag

SEQ ID NO: 2177970 - RNA, 18 nt, Homo sapiens
cccaccagagugaugugu

SEQ ID NO: 2177971 - RNA, 21 nt, Homo sapiens
ugcuggagucaugugccucug

SEQ ID NO: 2177972 - RNA, 22 nt, Homo sapiens
gauggggcaugugccauagugc

SEQ ID NO: 2177973 - RNA, 12 nt, Homo sapiens
caaucacacuca

SEQ ID NO: 2177974 - RNA, 21 nt, Homo sapiens
aauucccuucaucuggaacca

SEQ ID NO: 2177975 - RNA, 21 nt, Homo sapiens
aggaggcagaggguugcagug

SEQ ID NO: 2177976 - RNA, 22 nt, Homo sapiens
ucuuaauucaacuaguaccaca

SEQ ID NO: 2177977 - RNA, 18 nt, Homo sapiens
uucagcacaauaaauaua

SEQ ID NO: 2177978 - RNA, 14 nt, Homo sapiens
aacacuacagggga

SEQ ID NO: 2177979 - RNA, 19 nt, Homo sapiens
uguuuccuggaccagugac

SEQ ID NO: 2177980 - RNA, 12 nt, Homo sapiens
ucccaagcugcc

SEQ ID NO: 2177981 - RNA, 21 nt, Homo sapiens
gggggcaccaugugugccuuu

SEQ ID NO: 2177982 - RNA, 18 nt, Homo sapiens
aauguauucaaauaccaa

SEQ ID NO: 2177983 - RNA, 16 nt, Homo sapiens
ccagcuacaccuuucu

SEQ ID NO: 2177984 - RNA, 18 nt, Homo sapiens
ucguaguguuaaguuaua

SEQ ID NO: 2177985 - RNA, 22 nt, Homo sapiens
aaaacagaaauuaaucuuacaa

SEQ ID NO: 2177986 - RNA, 14 nt, Homo sapiens
ugaagucuaugaug

SEQ ID NO: 2177987 - RNA, 16 nt, Homo sapiens
cugccucaguguuuca

SEQ ID NO: 2177988 - RNA, 22 nt, Homo sapiens
uuaaagucuacacugccuuugu

SEQ ID NO: 2177989 - RNA, 23 nt, Homo sapiens
gguuuuuuuuuucuuuuuugcca

SEQ ID NO: 2177990 - RNA, 13 nt, Homo sapiens
auuugccauagca

SEQ ID NO: 2177991 - RNA, 11 nt, Homo sapiens
uggcauuucaa

SEQ ID NO: 2177992 - RNA, 18 nt, Homo sapiens
uaugagcaccccuaugcc

SEQ ID NO: 2177993 - RNA, 15 nt, Homo sapiens
acgcagccugagaau

SEQ ID NO: 2177994 - RNA, 19 nt, Homo sapiens
ccugggaguuuuguauuca

SEQ ID NO: 2177995 - RNA, 18 nt, Homo sapiens
ugacccagugugugcuca

SEQ ID NO: 2177996 - RNA, 16 nt, Homo sapiens
uggccggauguccuca

SEQ ID NO: 2177997 - RNA, 21 nt, Homo sapiens
cccaacuucgccagccuccaa

SEQ ID NO: 2177998 - RNA, 20 nt, Homo sapiens
gucugucaauguccuacuga

SEQ ID NO: 2177999 - RNA, 15 nt, Homo sapiens
aauaccuacugcuga

SEQ ID NO: 2178000 - RNA, 15 nt, Homo sapiens
ucuaaaggaaaucaa

SEQ ID NO: 2178001 - RNA, 17 nt, Homo sapiens
uuacaggugugagccac

SEQ ID NO: 2178002 - RNA, 20 nt, Homo sapiens
uaauguacagaagagcaaaa

SEQ ID NO: 2178003 - RNA, 16 nt, Homo sapiens
agggacagucucacca

SEQ ID NO: 2178004 - RNA, 15 nt, Homo sapiens
uguccccuccacugu

SEQ ID NO: 2178005 - RNA, 12 nt, Homo sapiens
gaucagcaucca

SEQ ID NO: 2178006 - RNA, 17 nt, Homo sapiens
uaaacucaaacaaaagu

SEQ ID NO: 2178007 - RNA, 19 nt, Homo sapiens
gugucaccuacgugccacu

SEQ ID NO: 2178008 - RNA, 18 nt, Homo sapiens
aauuuacuuuaagcauug

SEQ ID NO: 2178009 - RNA, 15 nt, Homo sapiens
ccuauaugcacuuau

SEQ ID NO: 2178010 - RNA, 20 nt, Homo sapiens
aacacaugugcagucacugg

SEQ ID NO: 2178011 - RNA, 16 nt, Homo sapiens
ccugguaugggagcca

SEQ ID NO: 2178012 - RNA, 13 nt, Homo sapiens
uauuggaagacuu

SEQ ID NO: 2178013 - RNA, 18 nt, Homo sapiens
gacucacaagaagaccag

SEQ ID NO: 2178014 - RNA, 18 nt, Homo sapiens
ugcuccccuaaagccagg

SEQ ID NO: 2178015 - RNA, 15 nt, Homo sapiens
aggcuugggauuugc

SEQ ID NO: 2178016 - RNA, 10 nt, Homo sapiens
aaccuaccuc

SEQ ID NO: 2178017 - RNA, 18 nt, Homo sapiens
augccuugugcuguuaau

SEQ ID NO: 2178018 - RNA, 18 nt, Homo sapiens
gacagcgauaagcuuuca

SEQ ID NO: 2178019 - RNA, 13 nt, Homo sapiens
uaccaagcuguga

SEQ ID NO: 2178020 - RNA, 16 nt, Homo sapiens
agaauuguaugucaug

SEQ ID NO: 2178021 - RNA, 22 nt, Homo sapiens
auugagcgugaccuugcaaugu

SEQ ID NO: 2178022 - RNA, 17 nt, Homo sapiens
cugcucacugcucacac

SEQ ID NO: 2178023 - RNA, 16 nt, Homo sapiens
ucucugggacucuccu

SEQ ID NO: 2178024 - RNA, 16 nt, Homo sapiens
gaaaacaucucaauaa

SEQ ID NO: 2178025 - RNA, 19 nt, Homo sapiens
gaucuucagggaacugcau

SEQ ID NO: 2178026 - RNA, 14 nt, Homo sapiens
gaggcuggggccaa

SEQ ID NO: 2178027 - RNA, 16 nt, Homo sapiens
uccagaaucccaagac

SEQ ID NO: 2178028 - RNA, 14 nt, Homo sapiens
uaauucaaauaaua

SEQ ID NO: 2178029 - RNA, 19 nt, Homo sapiens
uacucagggaaagcauuua

SEQ ID NO: 2178030 - RNA, 18 nt, Homo sapiens
auuaauauuaacuacaga

SEQ ID NO: 2178031 - RNA, 18 nt, Homo sapiens
ucccagaaaaacugagga

SEQ ID NO: 2178032 - RNA, 18 nt, Homo sapiens
cucccaaccccacacgcu

SEQ ID NO: 2178033 - RNA, 18 nt, Homo sapiens
ugagucugcaucuuaggg

SEQ ID NO: 2178034 - RNA, 19 nt, Homo sapiens
accaguugggagcacugga

SEQ ID NO: 2178035 - RNA, 17 nt, Homo sapiens
auaugaaaacuaaguuc

SEQ ID NO: 2178036 - RNA, 21 nt, Homo sapiens
gcaucucaaaauuauucugcc

SEQ ID NO: 2178037 - RNA, 20 nt, Homo sapiens
gaaauuugacucaugaacua

SEQ ID NO: 2178038 - RNA, 19 nt, Homo sapiens
cagacucagacuccauuug

SEQ ID NO: 2178039 - RNA, 20 nt, Homo sapiens
caggagguuuuuuugucaac

SEQ ID NO: 2178040 - RNA, 14 nt, Homo sapiens
auuuuacuuaacuc

SEQ ID NO: 2178041 - RNA, 19 nt, Homo sapiens
ccaggaacacaugcacaca

SEQ ID NO: 2178042 - RNA, 20 nt, Homo sapiens
gcgucaucucugacacggcc

SEQ ID NO: 2178043 - RNA, 18 nt, Homo sapiens
ugauauaauaauuacuua

SEQ ID NO: 2178044 - RNA, 12 nt, Homo sapiens
gaugucacucac

SEQ ID NO: 2178045 - RNA, 16 nt, Homo sapiens
gcuuggcaugaccuca

SEQ ID NO: 2178046 - RNA, 23 nt, Homo sapiens
ccaccgucucggcccugaaccac

SEQ ID NO: 2178047 - RNA, 20 nt, Homo sapiens
cuucagaauauggacaaaga

SEQ ID NO: 2178048 - RNA, 19 nt, Homo sapiens
gcaccuucccucucaccau

SEQ ID NO: 2178049 - RNA, 18 nt, Homo sapiens
cuguaauaaauaugagug

SEQ ID NO: 2178050 - RNA, 19 nt, Homo sapiens
caguucauccugcauggga

SEQ ID NO: 2178051 - RNA, 13 nt, Homo sapiens
uguuuccaaaaac

SEQ ID NO: 2178052 - RNA, 13 nt, Homo sapiens
gcagcuagacacc

SEQ ID NO: 2178053 - RNA, 17 nt, Homo sapiens
aaauucuucaugaacau

SEQ ID NO: 2178054 - RNA, 18 nt, Homo sapiens
uucuggauuugcagguga

SEQ ID NO: 2178055 - RNA, 20 nt, Homo sapiens
cugcagguacuuccucaguc

SEQ ID NO: 2178056 - RNA, 22 nt, Homo sapiens
ucuagugacaccucagucauau

SEQ ID NO: 2178057 - RNA, 23 nt, Homo sapiens
ggcugcagccucaggacugggag

SEQ ID NO: 2178058 - RNA, 21 nt, Homo sapiens
ccgugagugaaccaucauuau

SEQ ID NO: 2178059 - RNA, 17 nt, Homo sapiens
aggaaggggccucagga

SEQ ID NO: 2178060 - RNA, 16 nt, Homo sapiens
cacacaggguggcaga

SEQ ID NO: 2178061 - RNA, 16 nt, Homo sapiens
uccauuccccaggugg

SEQ ID NO: 2178062 - RNA, 13 nt, Homo sapiens
accaguaugacag

SEQ ID NO: 2178063 - RNA, 13 nt, Homo sapiens
aaucuuaugcucu

SEQ ID NO: 2178064 - RNA, 13 nt, Homo sapiens
auuuucuauucac

SEQ ID NO: 2178065 - RNA, 17 nt, Homo sapiens
ugugagaaacaucucaa

SEQ ID NO: 2178066 - RNA, 23 nt, Homo sapiens
aaggccucccugucuaaaauccc

SEQ ID NO: 2178067 - RNA, 14 nt, Homo sapiens
agacagaagcuuaa

SEQ ID NO: 2178068 - RNA, 19 nt, Homo sapiens
auggcagaaugaaaauuag

SEQ ID NO: 2178069 - RNA, 19 nt, Homo sapiens
ugagcccccugaccuucca

SEQ ID NO: 2178070 - RNA, 22 nt, Homo sapiens
cagcuaaagcaguccuccagcc

SEQ ID NO: 2178071 - RNA, 18 nt, Homo sapiens
acaguuuuaacuguggau

SEQ ID NO: 2178072 - RNA, 16 nt, Homo sapiens
aggaaaaaaccaaaag

SEQ ID NO: 2178073 - RNA, 17 nt, Homo sapiens
uauaaccuuguuccaaa

SEQ ID NO: 2178074 - RNA, 18 nt, Homo sapiens
aguuugaagccugugccu

SEQ ID NO: 2178075 - RNA, 21 nt, Homo sapiens
agaugggaaaaccaugguaau

SEQ ID NO: 2178076 - RNA, 22 nt, Homo sapiens
aagaugauggcucauuuacacu

SEQ ID NO: 2178077 - RNA, 14 nt, Homo sapiens
cuuaauaaugugua

SEQ ID NO: 2178078 - RNA, 16 nt, Homo sapiens
uggugauuucugagau

SEQ ID NO: 2178079 - RNA, 12 nt, Homo sapiens
auuccuuuauga

SEQ ID NO: 2178080 - RNA, 15 nt, Homo sapiens
ugcugcaaacacuua

SEQ ID NO: 2178081 - RNA, 21 nt, Homo sapiens
cccaucccugaaacauugcau

SEQ ID NO: 2178082 - RNA, 15 nt, Homo sapiens
uaccugaggccagga

SEQ ID NO: 2178083 - RNA, 17 nt, Homo sapiens
auuaaaaaugcauauac

SEQ ID NO: 2178084 - RNA, 13 nt, Homo sapiens
uuuuuuuauacug

SEQ ID NO: 2178085 - RNA, 23 nt, Homo sapiens
aacccuaggcaucacaugcucaa

SEQ ID NO: 2178086 - RNA, 13 nt, Homo sapiens
uuaucuguucuau

SEQ ID NO: 2178087 - RNA, 20 nt, Homo sapiens
ugaaaccccaucucuacuga

SEQ ID NO: 2178088 - RNA, 16 nt, Homo sapiens
uccugguuugacucag

SEQ ID NO: 2178089 - RNA, 15 nt, Homo sapiens
guggugcccuuccug

SEQ ID NO: 2178090 - RNA, 17 nt, Homo sapiens
agaaagaggcagugauu

SEQ ID NO: 2178091 - RNA, 21 nt, Homo sapiens
aauugacagaucaagcuguga

SEQ ID NO: 2178092 - RNA, 21 nt, Homo sapiens
gcaaaauugucuaaaauguca

SEQ ID NO: 2178093 - RNA, 18 nt, Homo sapiens
uccaggguuaaagaaagg

SEQ ID NO: 2178094 - RNA, 18 nt, Homo sapiens
auaaauguguggugcuaa

SEQ ID NO: 2178095 - RNA, 20 nt, Homo sapiens
acuuaauaauguguacauua

SEQ ID NO: 2178096 - RNA, 21 nt, Homo sapiens
aaaauaaugucuuguuaauau

SEQ ID NO: 2178097 - RNA, 15 nt, Homo sapiens
accugcauuauguac

SEQ ID NO: 2178098 - RNA, 21 nt, Homo sapiens
acguuugcuccuugacuccaa

SEQ ID NO: 2178099 - RNA, 22 nt, Homo sapiens
guauaaggacuauagugauuua

SEQ ID NO: 2178100 - RNA, 22 nt, Homo sapiens
cauuugauuuguucaugaauau

SEQ ID NO: 2178101 - RNA, 23 nt, Homo sapiens
cccagaaucucauuaaagcuuau

SEQ ID NO: 2178102 - RNA, 19 nt, Homo sapiens
uccugcauccucacugugg

SEQ ID NO: 2178103 - RNA, 22 nt, Homo sapiens
caaggugggcagggaggcacca

SEQ ID NO: 2178104 - RNA, 18 nt, Homo sapiens
cagcucaaugaccuggag

SEQ ID NO: 2178105 - RNA, 22 nt, Homo sapiens
caaugguuugcaaggaagccac

SEQ ID NO: 2178106 - RNA, 21 nt, Homo sapiens
gauuagcccuuccuugccagu

SEQ ID NO: 2178107 - RNA, 16 nt, Homo sapiens
uggugaccaaugcauu

SEQ ID NO: 2178108 - RNA, 22 nt, Homo sapiens
caggcccggcccagccuaggcc

SEQ ID NO: 2178109 - RNA, 19 nt, Homo sapiens
gacuuuguguucauuucau

SEQ ID NO: 2178110 - RNA, 14 nt, Homo sapiens
ccucagacugucag

SEQ ID NO: 2178111 - RNA, 12 nt, Homo sapiens
uaacauucccac

SEQ ID NO: 2178112 - RNA, 15 nt, Homo sapiens
cauuucucagcaucg

SEQ ID NO: 2178113 - RNA, 19 nt, Homo sapiens
uuggacuagccagaauucu

SEQ ID NO: 2178114 - RNA, 23 nt, Homo sapiens
cauaauaauaauuugcacuuaua

SEQ ID NO: 2178115 - RNA, 22 nt, Homo sapiens
ugccucccaagguccucucagu

SEQ ID NO: 2178116 - RNA, 23 nt, Homo sapiens
cuaccucuggugaugguuuccac

SEQ ID NO: 2178117 - RNA, 14 nt, Homo sapiens
caauugaaaguggg

SEQ ID NO: 2178118 - RNA, 22 nt, Homo sapiens
aguuuaugcugugcuaaauauc

SEQ ID NO: 2178119 - RNA, 23 nt, Homo sapiens
augguucucagaaccauuucacc

SEQ ID NO: 2178120 - RNA, 14 nt, Homo sapiens
acugucagcccuca

SEQ ID NO: 2178121 - RNA, 14 nt, Homo sapiens
acagggcauucaaa

SEQ ID NO: 2178122 - RNA, 19 nt, Homo sapiens
aacuaagcuaugugaaaua

SEQ ID NO: 2178123 - RNA, 15 nt, Homo sapiens
uucauauaugcaaaa

SEQ ID NO: 2178124 - RNA, 15 nt, Homo sapiens
cauuugccaagugag

SEQ ID NO: 2178125 - RNA, 14 nt, Homo sapiens
aucuuucuguuacu

SEQ ID NO: 2178126 - RNA, 18 nt, Homo sapiens
caggcugccugugugcau

SEQ ID NO: 2178127 - RNA, 22 nt, Homo sapiens
uuuaaauuaaacucuacuucaa

SEQ ID NO: 2178128 - RNA, 13 nt, Homo sapiens
aggccaacugccc

SEQ ID NO: 2178129 - RNA, 22 nt, Homo sapiens
agucacaggucuuuucuuggcg

SEQ ID NO: 2178130 - RNA, 16 nt, Homo sapiens
cuucagcccuggccaa

SEQ ID NO: 2178131 - RNA, 18 nt, Homo sapiens
ggugccgcucucucugag

SEQ ID NO: 2178132 - RNA, 13 nt, Homo sapiens
ugaccaguuuuga

SEQ ID NO: 2178133 - RNA, 23 nt, Homo sapiens
uugcccagagugccguaguccuu

SEQ ID NO: 2178134 - RNA, 13 nt, Homo sapiens
cagagggugaaag

SEQ ID NO: 2178135 - RNA, 17 nt, Homo sapiens
guccugacagcacuccu

SEQ ID NO: 2178136 - RNA, 16 nt, Homo sapiens
uuaacuaaaugcucau

SEQ ID NO: 2178137 - RNA, 13 nt, Homo sapiens
uaaaaauuagcug

SEQ ID NO: 2178138 - RNA, 15 nt, Homo sapiens
uccagcaucccaaga

SEQ ID NO: 2178139 - RNA, 18 nt, Homo sapiens
gauaugcaaguaagaaau

SEQ ID NO: 2178140 - RNA, 21 nt, Homo sapiens
gacuacuagagcuccauuucu

SEQ ID NO: 2178141 - RNA, 17 nt, Homo sapiens
agggacugaagccaaag

SEQ ID NO: 2178142 - RNA, 15 nt, Homo sapiens
aagucucauagcuuu

SEQ ID NO: 2178143 - RNA, 18 nt, Homo sapiens
uaaaaggcacugcacaua

SEQ ID NO: 2178144 - RNA, 14 nt, Homo sapiens
acaauuaauauuaa

SEQ ID NO: 2178145 - RNA, 23 nt, Homo sapiens
caaaagcgaaacacacaaaccag

SEQ ID NO: 2178146 - RNA, 22 nt, Homo sapiens
caucuacugaaugaccucucua

SEQ ID NO: 2178147 - RNA, 15 nt, Homo sapiens
ugauaauagcauuuu

SEQ ID NO: 2178148 - RNA, 16 nt, Homo sapiens
cuccaaggaggugaca

SEQ ID NO: 2178149 - RNA, 14 nt, Homo sapiens
cuacacacugucau

SEQ ID NO: 2178150 - RNA, 19 nt, Homo sapiens
caaaagccauaacuugaaa

SEQ ID NO: 2178151 - RNA, 19 nt, Homo sapiens
ugcccuugcuccagccuga

SEQ ID NO: 2178152 - RNA, 22 nt, Homo sapiens
aguggggcagccuccuugccug

SEQ ID NO: 2178153 - RNA, 21 nt, Homo sapiens
gcugaucgauuucuuuccucc

SEQ ID NO: 2178154 - RNA, 16 nt, Homo sapiens
uugauuaauguacuuu

SEQ ID NO: 2178155 - RNA, 14 nt, Homo sapiens
aaaaacguauugca

SEQ ID NO: 2178156 - RNA, 15 nt, Homo sapiens
cuaguuuugcugaaa

SEQ ID NO: 2178157 - RNA, 16 nt, Homo sapiens
acacagugagacuuca

SEQ ID NO: 2178158 - RNA, 21 nt, Homo sapiens
agauggauuugacacacucac

SEQ ID NO: 2178159 - RNA, 15 nt, Homo sapiens
aggcaggagguacaa

SEQ ID NO: 2178160 - RNA, 22 nt, Homo sapiens
uuuuuucucauucugugccauu

SEQ ID NO: 2178161 - RNA, 22 nt, Homo sapiens
acuuugcuaacugugcuccuca

SEQ ID NO: 2178162 - RNA, 13 nt, Homo sapiens
gcacuggggccac

SEQ ID NO: 2178163 - RNA, 11 nt, Homo sapiens
guacauuucac

SEQ ID NO: 2178164 - RNA, 18 nt, Homo sapiens
gguacuaaaaacacugga

SEQ ID NO: 2178165 - RNA, 22 nt, Homo sapiens
uguccucuugccuuuuacuuaa

SEQ ID NO: 2178166 - RNA, 18 nt, Homo sapiens
uuuugccucaccuaauag

SEQ ID NO: 2178167 - RNA, 23 nt, Homo sapiens
aggcacagugggagcugagcugg

SEQ ID NO: 2178168 - RNA, 16 nt, Homo sapiens
gagacugggcaucucu

SEQ ID NO: 2178169 - RNA, 15 nt, Homo sapiens
cuucugaaacuggag

SEQ ID NO: 2178170 - RNA, 22 nt, Homo sapiens
ucuaaaguuuuauugaugugaa

SEQ ID NO: 2178171 - RNA, 21 nt, Homo sapiens
ugcagagccaauggugcacau

SEQ ID NO: 2178172 - RNA, 14 nt, Homo sapiens
acaucuuguaagac

SEQ ID NO: 2178173 - RNA, 13 nt, Homo sapiens
accaaaucuugcu

SEQ ID NO: 2178174 - RNA, 15 nt, Homo sapiens
aaauagcugccuuuu

SEQ ID NO: 2178175 - RNA, 16 nt, Homo sapiens
gacugguaaguaacug

SEQ ID NO: 2178176 - RNA, 21 nt, Homo sapiens
uagaagccauccuaaggugcu

SEQ ID NO: 2178177 - RNA, 18 nt, Homo sapiens
ccuuucuugacaaaaccu

SEQ ID NO: 2178178 - RNA, 22 nt, Homo sapiens
gcagacaauaaacccucagagc

SEQ ID NO: 2178179 - RNA, 21 nt, Homo sapiens
ucauucagcaucuacucuaaa

SEQ ID NO: 2178180 - RNA, 17 nt, Homo sapiens
ugauugccaaucugcau

SEQ ID NO: 2178181 - RNA, 17 nt, Homo sapiens
aauuuuucagacuuuaa

SEQ ID NO: 2178182 - RNA, 18 nt, Homo sapiens
gucucuugacuggcucaa

SEQ ID NO: 2178183 - RNA, 17 nt, Homo sapiens
gcagugcaguacucagu

SEQ ID NO: 2178184 - RNA, 20 nt, Homo sapiens
augaaggcuugucagcacuu

SEQ ID NO: 2178185 - RNA, 15 nt, Homo sapiens
uaugaucuaauacaa

SEQ ID NO: 2178186 - RNA, 22 nt, Homo sapiens
cucacucuugccaaccuguaau

SEQ ID NO: 2178187 - RNA, 16 nt, Homo sapiens
ucuccugggccacccc

SEQ ID NO: 2178188 - RNA, 19 nt, Homo sapiens
auauuuacuaaaauggacu

SEQ ID NO: 2178189 - RNA, 17 nt, Homo sapiens
aagcuggagugcugcuu

SEQ ID NO: 2178190 - RNA, 21 nt, Homo sapiens
uaaaggcagcugccucugcuc

SEQ ID NO: 2178191 - RNA, 19 nt, Homo sapiens
ugcagucuuguacugugac

SEQ ID NO: 2178192 - RNA, 16 nt, Homo sapiens
guucugucucauauga

SEQ ID NO: 2178193 - RNA, 20 nt, Homo sapiens
aguuaaaugccgucuaucag

SEQ ID NO: 2178194 - RNA, 21 nt, Homo sapiens
guucuguucacccugcauuac

SEQ ID NO: 2178195 - RNA, 17 nt, Homo sapiens
ccaagcaguugggacua

SEQ ID NO: 2178196 - RNA, 23 nt, Homo sapiens
ucacaagaacacacacauauaca

SEQ ID NO: 2178197 - RNA, 12 nt, Homo sapiens
aagaccucuucc

SEQ ID NO: 2178198 - RNA, 22 nt, Homo sapiens
aacauuauucaucucuccuccc

SEQ ID NO: 2178199 - RNA, 14 nt, Homo sapiens
ugaccucugcugag

SEQ ID NO: 2178200 - RNA, 21 nt, Homo sapiens
ucuaugcauaaaaaaaugaug

SEQ ID NO: 2178201 - RNA, 14 nt, Homo sapiens
aagagauccaggga

SEQ ID NO: 2178202 - RNA, 21 nt, Homo sapiens
agggcuugugugcacauaucc

SEQ ID NO: 2178203 - RNA, 16 nt, Homo sapiens
cagagcagaacuuuca

SEQ ID NO: 2178204 - RNA, 16 nt, Homo sapiens
caaauaggagucuucu

SEQ ID NO: 2178205 - RNA, 21 nt, Homo sapiens
ccaggccgacaggaggccaug

SEQ ID NO: 2178206 - RNA, 12 nt, Homo sapiens
cuuuugaagucc

SEQ ID NO: 2178207 - RNA, 22 nt, Homo sapiens
acccaagcaaaaucauggaaug

SEQ ID NO: 2178208 - RNA, 14 nt, Homo sapiens
ggagaucuucacuc

SEQ ID NO: 2178209 - RNA, 17 nt, Homo sapiens
gcgcagcgcgugcacag

SEQ ID NO: 2178210 - RNA, 16 nt, Homo sapiens
uggaugcgaggaccac

SEQ ID NO: 2178211 - RNA, 17 nt, Homo sapiens
ucauuaucaguccaaag

SEQ ID NO: 2178212 - RNA, 18 nt, Homo sapiens
ugauaaucuuauuuuggc

SEQ ID NO: 2178213 - RNA, 22 nt, Homo sapiens
cagagcugacccccugcugcca

SEQ ID NO: 2178214 - RNA, 17 nt, Homo sapiens
caaaaacaaacaaaagc

SEQ ID NO: 2178215 - RNA, 16 nt, Homo sapiens
caaggccuggggagcc

SEQ ID NO: 2178216 - RNA, 20 nt, Homo sapiens
acaaucccuggggcugugca

SEQ ID NO: 2178217 - RNA, 15 nt, Homo sapiens
ugcuguccgugcuug

SEQ ID NO: 2178218 - RNA, 17 nt, Homo sapiens
aaaguguaacauaugca

SEQ ID NO: 2178219 - RNA, 15 nt, Homo sapiens
ugccuccugggacca

SEQ ID NO: 2178220 - RNA, 14 nt, Homo sapiens
aggugauccaccug

SEQ ID NO: 2178221 - RNA, 15 nt, Homo sapiens
gagcuuucuagccua

SEQ ID NO: 2178222 - RNA, 16 nt, Homo sapiens
gagugaucucagcuca

SEQ ID NO: 2178223 - RNA, 13 nt, Homo sapiens
accaggucaggga

SEQ ID NO: 2178224 - RNA, 19 nt, Homo sapiens
gcucagggaauaauccaga

SEQ ID NO: 2178225 - RNA, 18 nt, Homo sapiens
auagccacuuaccuucaa

SEQ ID NO: 2178226 - RNA, 18 nt, Homo sapiens
ugaaugcagcacugcugc

SEQ ID NO: 2178227 - RNA, 17 nt, Homo sapiens
gugcagacgaaacacaa

SEQ ID NO: 2178228 - RNA, 23 nt, Homo sapiens
ucgggcuaggaagaucucugcag

SEQ ID NO: 2178229 - RNA, 21 nt, Homo sapiens
ggcuuuuuuugccuaccauuu

SEQ ID NO: 2178230 - RNA, 19 nt, Homo sapiens
aggacuuaaaauagucuca

SEQ ID NO: 2178231 - RNA, 18 nt, Homo sapiens
ccaaaccaccgacucuca

SEQ ID NO: 2178232 - RNA, 20 nt, Homo sapiens
uacacauacugcaugcucag

SEQ ID NO: 2178233 - RNA, 17 nt, Homo sapiens
accuaacccucugucac

SEQ ID NO: 2178234 - RNA, 18 nt, Homo sapiens
cuucaucuucacugcaau

SEQ ID NO: 2178235 - RNA, 19 nt, Homo sapiens
acugcuguggcccccuguc

SEQ ID NO: 2178236 - RNA, 13 nt, Homo sapiens
uccuccucauccu

SEQ ID NO: 2178237 - RNA, 22 nt, Homo sapiens
ccagcuugccuguuucuucucu

SEQ ID NO: 2178238 - RNA, 13 nt, Homo sapiens
cagcagugccaua

SEQ ID NO: 2178239 - RNA, 16 nt, Homo sapiens
gccucccauccagggc

SEQ ID NO: 2178240 - RNA, 14 nt, Homo sapiens
uucaaaucucagca

SEQ ID NO: 2178241 - RNA, 21 nt, Homo sapiens
ccguguagccccgggcugacc

SEQ ID NO: 2178242 - RNA, 17 nt, Homo sapiens
caaauaauccauuccaa

SEQ ID NO: 2178243 - RNA, 15 nt, Homo sapiens
ccucagggguuucau

SEQ ID NO: 2178244 - RNA, 19 nt, Homo sapiens
ccccaccauccagguggag

SEQ ID NO: 2178245 - RNA, 11 nt, Homo sapiens
cuuaaucacac

SEQ ID NO: 2178246 - RNA, 16 nt, Homo sapiens
gagaccacuuccuuaa

SEQ ID NO: 2178247 - RNA, 22 nt, Homo sapiens
gaacugcauucuucugagcacu

SEQ ID NO: 2178248 - RNA, 17 nt, Homo sapiens
gagcucagcugggccag

SEQ ID NO: 2178249 - RNA, 19 nt, Homo sapiens
ucccaaaugagccaugaga

SEQ ID NO: 2178250 - RNA, 17 nt, Homo sapiens
uaaccccauucaugaga

SEQ ID NO: 2178251 - RNA, 16 nt, Homo sapiens
gcuugcaauguaguca

SEQ ID NO: 2178252 - RNA, 15 nt, Homo sapiens
caggaggcuccguga

SEQ ID NO: 2178253 - RNA, 18 nt, Homo sapiens
uccucgagcaacugcugu

SEQ ID NO: 2178254 - RNA, 20 nt, Homo sapiens
auuguuuuucccaccuuguc

SEQ ID NO: 2178255 - RNA, 11 nt, Homo sapiens
uacaugacugg

SEQ ID NO: 2178256 - RNA, 21 nt, Homo sapiens
uuggugacuucacagugaagu

SEQ ID NO: 2178257 - RNA, 20 nt, Homo sapiens
cuuuuauaaacuuuaccuuu

SEQ ID NO: 2178258 - RNA, 16 nt, Homo sapiens
agauuugauauuugca

SEQ ID NO: 2178259 - RNA, 17 nt, Homo sapiens
aggcugagacaggagaa

SEQ ID NO: 2178260 - RNA, 17 nt, Homo sapiens
uaggauaagcacuagau

SEQ ID NO: 2178261 - RNA, 17 nt, Homo sapiens
uguccauugacauguac

SEQ ID NO: 2178262 - RNA, 20 nt, Homo sapiens
aggaguggugggugcagucc

SEQ ID NO: 2178263 - RNA, 14 nt, Homo sapiens
ccagcugugcugug

SEQ ID NO: 2178264 - RNA, 16 nt, Homo sapiens
cacccccauaacaauu

SEQ ID NO: 2178265 - RNA, 13 nt, Homo sapiens
uguguaugcaagu

SEQ ID NO: 2178266 - RNA, 12 nt, Homo sapiens
ucuaaguauuua

SEQ ID NO: 2178267 - RNA, 12 nt, Homo sapiens
uacucugcaaac

SEQ ID NO: 2178268 - RNA, 13 nt, Homo sapiens
ugauccacccacc

SEQ ID NO: 2178269 - RNA, 12 nt, Homo sapiens
uucucacugccu

SEQ ID NO: 2178270 - RNA, 21 nt, Homo sapiens
caagaagcacugacaauguuu

SEQ ID NO: 2178271 - RNA, 14 nt, Homo sapiens
ugcuuuaggcucac

SEQ ID NO: 2178272 - RNA, 18 nt, Homo sapiens
cuauuuauugacuuugac

SEQ ID NO: 2178273 - RNA, 22 nt, Homo sapiens
ucugugaaaagggaucugcucc

SEQ ID NO: 2178274 - RNA, 22 nt, Homo sapiens
cuggaggaacugcuugugcacu

SEQ ID NO: 2178275 - RNA, 16 nt, Homo sapiens
ugccugggaaggccgu

SEQ ID NO: 2178276 - RNA, 19 nt, Homo sapiens
acacccaguggaaccaaaa

SEQ ID NO: 2178277 - RNA, 22 nt, Homo sapiens
ucuuucuuacacaagagcugga

SEQ ID NO: 2178278 - RNA, 13 nt, Homo sapiens
gucuugaccucuc

SEQ ID NO: 2178279 - RNA, 17 nt, Homo sapiens
guuaccugacuuaugaa

SEQ ID NO: 2178280 - RNA, 13 nt, Homo sapiens
gucuuacauugga

SEQ ID NO: 2178281 - RNA, 15 nt, Homo sapiens
ccaggggccaugaau

SEQ ID NO: 2178282 - RNA, 21 nt, Homo sapiens
ucaaagcacagaauuugucag

SEQ ID NO: 2178283 - RNA, 20 nt, Homo sapiens
caggaacauuggagccugca

SEQ ID NO: 2178284 - RNA, 16 nt, Homo sapiens
gaugucucacagcccu

SEQ ID NO: 2178285 - RNA, 16 nt, Homo sapiens
accccuccucuagcuc

SEQ ID NO: 2178286 - RNA, 13 nt, Homo sapiens
auguuacaagcua

SEQ ID NO: 2178287 - RNA, 16 nt, Homo sapiens
cacuacucaguuauua

SEQ ID NO: 2178288 - RNA, 17 nt, Homo sapiens
ccaaagggccccuuucu

SEQ ID NO: 2178289 - RNA, 22 nt, Homo sapiens
ugauacaaauugcagacugugu

SEQ ID NO: 2178290 - RNA, 23 nt, Homo sapiens
uaaaaaguuguucuuuguuucca

SEQ ID NO: 2178291 - RNA, 19 nt, Homo sapiens
gcagagggaucaagcaguu

SEQ ID NO: 2178292 - RNA, 18 nt, Homo sapiens
agauuucucugagaucau

SEQ ID NO: 2178293 - RNA, 19 nt, Homo sapiens
augugacccaccagugccu

SEQ ID NO: 2178294 - RNA, 17 nt, Homo sapiens
caggguagcacugggaa

SEQ ID NO: 2178295 - RNA, 17 nt, Homo sapiens
acccucaggaacccacc

SEQ ID NO: 2178296 - RNA, 23 nt, Homo sapiens
ucaguacugguguagugugucag

SEQ ID NO: 2178297 - RNA, 13 nt, Homo sapiens
augggcuuuucag

SEQ ID NO: 2178298 - RNA, 23 nt, Homo sapiens
ccaguuucugauuuuuauucuca

SEQ ID NO: 2178299 - RNA, 21 nt, Homo sapiens
acaguuaagagaaaugagcuu

SEQ ID NO: 2178300 - RNA, 15 nt, Homo sapiens
gagccaccaugccug

SEQ ID NO: 2178301 - RNA, 15 nt, Homo sapiens
cuuuaugaagugcua

SEQ ID NO: 2178302 - RNA, 15 nt, Homo sapiens
uuugcccuucacugu

SEQ ID NO: 2178303 - RNA, 14 nt, Homo sapiens
agccucuccaggaa

SEQ ID NO: 2178304 - RNA, 16 nt, Homo sapiens
cauggaggucauacau

SEQ ID NO: 2178305 - RNA, 15 nt, Homo sapiens
cccucucccacccaa

SEQ ID NO: 2178306 - RNA, 21 nt, Homo sapiens
acauguuaaacguuacuuuca

SEQ ID NO: 2178307 - RNA, 19 nt, Homo sapiens
agaagcggauuuccaggga

SEQ ID NO: 2178308 - RNA, 18 nt, Homo sapiens
agaagcuucuugcuccug

SEQ ID NO: 2178309 - RNA, 15 nt, Homo sapiens
uacaaguuuucauaa

SEQ ID NO: 2178310 - RNA, 15 nt, Homo sapiens
uauaaaccuuaugaa

SEQ ID NO: 2178311 - RNA, 15 nt, Homo sapiens
agagaaaagacauaa

SEQ ID NO: 2178312 - RNA, 20 nt, Homo sapiens
gccucaagagcacacagaga

SEQ ID NO: 2178313 - RNA, 16 nt, Homo sapiens
acauaaaaacaacuuu

SEQ ID NO: 2178314 - RNA, 18 nt, Homo sapiens
ugcacuguauugcuccuc

SEQ ID NO: 2178315 - RNA, 12 nt, Homo sapiens
aaugccuaccuu

SEQ ID NO: 2178316 - RNA, 20 nt, Homo sapiens
aaaaugcugcuuccacucag

SEQ ID NO: 2178317 - RNA, 16 nt, Homo sapiens
caccaggaugugugcc

SEQ ID NO: 2178318 - RNA, 14 nt, Homo sapiens
cauuucaaaaccca

SEQ ID NO: 2178319 - RNA, 15 nt, Homo sapiens
agaauugaccaaaua

SEQ ID NO: 2178320 - RNA, 17 nt, Homo sapiens
agccagcuuggugguua

SEQ ID NO: 2178321 - RNA, 20 nt, Homo sapiens
ucccgagauagccaccugga

SEQ ID NO: 2178322 - RNA, 22 nt, Homo sapiens
ccagugucacuugacucuugaa

SEQ ID NO: 2178323 - RNA, 18 nt, Homo sapiens
gccccagaaggcagggaa

SEQ ID NO: 2178324 - RNA, 16 nt, Homo sapiens
aucucuugucauucuc

SEQ ID NO: 2178325 - RNA, 22 nt, Homo sapiens
guggacacagaucccacuggaa

SEQ ID NO: 2178326 - RNA, 14 nt, Homo sapiens
cagccuccugagua

SEQ ID NO: 2178327 - RNA, 22 nt, Homo sapiens
aacauugugccaugucaaacaa

SEQ ID NO: 2178328 - RNA, 14 nt, Homo sapiens
uucaaaaugcaugu

SEQ ID NO: 2178329 - RNA, 13 nt, Homo sapiens
caaauaaaagcca

SEQ ID NO: 2178330 - RNA, 19 nt, Homo sapiens
guucccaccauucccugcc

SEQ ID NO: 2178331 - RNA, 12 nt, Homo sapiens
ccuacaacugaa

SEQ ID NO: 2178332 - RNA, 16 nt, Homo sapiens
ucuuauuuauaccuca

SEQ ID NO: 2178333 - RNA, 14 nt, Homo sapiens
cauuuauggcauga

SEQ ID NO: 2178334 - RNA, 15 nt, Homo sapiens
gcgggugauggccag

SEQ ID NO: 2178335 - RNA, 22 nt, Homo sapiens
cuugcuuaugacaucacuugua

SEQ ID NO: 2178336 - RNA, 21 nt, Homo sapiens
aucuucuuccaagaaaugcaa

SEQ ID NO: 2178337 - RNA, 15 nt, Homo sapiens
uggaauggaagaacc

SEQ ID NO: 2178338 - RNA, 15 nt, Homo sapiens
agccuggcacccacc

SEQ ID NO: 2178339 - RNA, 13 nt, Homo sapiens
agccacucuucca

SEQ ID NO: 2178340 - RNA, 16 nt, Homo sapiens
cacugaacaugcucau

SEQ ID NO: 2178341 - RNA, 16 nt, Homo sapiens
cagacgguucaccagc

SEQ ID NO: 2178342 - RNA, 17 nt, Homo sapiens
cuuucucucagccuuac

SEQ ID NO: 2178343 - RNA, 23 nt, Homo sapiens
aaugucucacuguucugcaaagg

SEQ ID NO: 2178344 - RNA, 19 nt, Homo sapiens
aaugaggaggaugcuaaaa

SEQ ID NO: 2178345 - RNA, 15 nt, Homo sapiens
gcagcuucaccagag

SEQ ID NO: 2178346 - RNA, 16 nt, Homo sapiens
cauuguuuugccagug

SEQ ID NO: 2178347 - RNA, 22 nt, Homo sapiens
uauauaagauggaagcuuccag

SEQ ID NO: 2178348 - RNA, 16 nt, Homo sapiens
guuaugugcaguacuu

SEQ ID NO: 2178349 - RNA, 14 nt, Homo sapiens
auggaucaaccaag

SEQ ID NO: 2178350 - RNA, 22 nt, Homo sapiens
cuggggguggggcuccuaccug

SEQ ID NO: 2178351 - RNA, 23 nt, Homo sapiens
aguuuauuuguugagagugugac

SEQ ID NO: 2178352 - RNA, 21 nt, Homo sapiens
aauaauuuuuaccuaaucucc

SEQ ID NO: 2178353 - RNA, 18 nt, Homo sapiens
accugaguacccauggga

SEQ ID NO: 2178354 - RNA, 23 nt, Homo sapiens
ugaaauaccagugaaccaaagag

SEQ ID NO: 2178355 - RNA, 21 nt, Homo sapiens
aauaaauauggaauacauuca

SEQ ID NO: 2178356 - RNA, 21 nt, Homo sapiens
gucaggcggggugcuguggug

SEQ ID NO: 2178357 - RNA, 16 nt, Homo sapiens
cugugagccauugucc

SEQ ID NO: 2178358 - RNA, 20 nt, Homo sapiens
cugcagaguaggcagcugcc

SEQ ID NO: 2178359 - RNA, 14 nt, Homo sapiens
uagcagcagaugua

SEQ ID NO: 2178360 - RNA, 18 nt, Homo sapiens
gguacauuuaucacugaa

SEQ ID NO: 2178361 - RNA, 21 nt, Homo sapiens
cugacacuaccuuaucaggca

SEQ ID NO: 2178362 - RNA, 19 nt, Homo sapiens
cggugucuggaaaagcacu

SEQ ID NO: 2178363 - RNA, 16 nt, Homo sapiens
ugucaucauacaugac

SEQ ID NO: 2178364 - RNA, 18 nt, Homo sapiens
auuucuuuaagaaucuau

SEQ ID NO: 2178365 - RNA, 16 nt, Homo sapiens
caacauuccacagcug

SEQ ID NO: 2178366 - RNA, 12 nt, Homo sapiens
aaagccagugac

SEQ ID NO: 2178367 - RNA, 18 nt, Homo sapiens
gagccccuacagcauugu

SEQ ID NO: 2178368 - RNA, 17 nt, Homo sapiens
uccaacauuaaaagcca

SEQ ID NO: 2178369 - RNA, 21 nt, Homo sapiens
auuauuucagucaucaucuca

SEQ ID NO: 2178370 - RNA, 15 nt, Homo sapiens
agccagcaucugggc

SEQ ID NO: 2178371 - RNA, 13 nt, Homo sapiens
auaaaauaauuau

SEQ ID NO: 2178372 - RNA, 19 nt, Homo sapiens
cuacuuauauaauugccaa

SEQ ID NO: 2178373 - RNA, 22 nt, Homo sapiens
ucuauggcgaacacagguguug

SEQ ID NO: 2178374 - RNA, 15 nt, Homo sapiens
cauucaccaaccaaa

SEQ ID NO: 2178375 - RNA, 12 nt, Homo sapiens
ugccauggauuu

SEQ ID NO: 2178376 - RNA, 11 nt, Homo sapiens
agcugcucacu

SEQ ID NO: 2178377 - RNA, 18 nt, Homo sapiens
uacuauuuuuauacuuua

SEQ ID NO: 2178378 - RNA, 18 nt, Homo sapiens
uuccacuuuaacauuuua

SEQ ID NO: 2178379 - RNA, 22 nt, Homo sapiens
aggaacucuucaugagcacuuu

SEQ ID NO: 2178380 - RNA, 15 nt, Homo sapiens
aacugagguuuacau

SEQ ID NO: 2178381 - RNA, 16 nt, Homo sapiens
auuaauauuugcacau

SEQ ID NO: 2178382 - RNA, 19 nt, Homo sapiens
cauucaaaguaauauauca

SEQ ID NO: 2178383 - RNA, 15 nt, Homo sapiens
gaaagaaucagucuu

SEQ ID NO: 2178384 - RNA, 21 nt, Homo sapiens
cauuuggaggaaucaccccau

SEQ ID NO: 2178385 - RNA, 19 nt, Homo sapiens
cuauuuuacuuuucugcca

SEQ ID NO: 2178386 - RNA, 17 nt, Homo sapiens
auuaaugaaaagcacaa

SEQ ID NO: 2178387 - RNA, 14 nt, Homo sapiens
cagacccugaaccc

SEQ ID NO: 2178388 - RNA, 15 nt, Homo sapiens
augaccacugcccug

SEQ ID NO: 2178389 - RNA, 17 nt, Homo sapiens
cguaguuugcauuccag

SEQ ID NO: 2178390 - RNA, 23 nt, Homo sapiens
ugucucuuuaagggcaugccuug

SEQ ID NO: 2178391 - RNA, 13 nt, Homo sapiens
uuacacagugaga

SEQ ID NO: 2178392 - RNA, 18 nt, Homo sapiens
cuuggaggaggaugccac

SEQ ID NO: 2178393 - RNA, 16 nt, Homo sapiens
cauaaagguuuacagu

SEQ ID NO: 2178394 - RNA, 18 nt, Homo sapiens
caggauuuguuguucuga

SEQ ID NO: 2178395 - RNA, 15 nt, Homo sapiens
uauucuccaucucaa

SEQ ID NO: 2178396 - RNA, 15 nt, Homo sapiens
aagaauucaguagca

SEQ ID NO: 2178397 - RNA, 22 nt, Homo sapiens
ugcgugauucaaugaaccacaa

SEQ ID NO: 2178398 - RNA, 21 nt, Homo sapiens
aagcucggcgaauucucagga

SEQ ID NO: 2178399 - RNA, 12 nt, Homo sapiens
augccucuggag

SEQ ID NO: 2178400 - RNA, 22 nt, Homo sapiens
ucagguauagcugacaucuccu

SEQ ID NO: 2178401 - RNA, 19 nt, Homo sapiens
acuugaaaguuuuccagua

SEQ ID NO: 2178402 - RNA, 18 nt, Homo sapiens
aaauaaacugaacauauu

SEQ ID NO: 2178403 - RNA, 23 nt, Homo sapiens
cagcuucuggggguagaucucaa

SEQ ID NO: 2178404 - RNA, 22 nt, Homo sapiens
gacaagacgcugcccacccgcg

SEQ ID NO: 2178405 - RNA, 14 nt, Homo sapiens
uugucagaugcugu

SEQ ID NO: 2178406 - RNA, 18 nt, Homo sapiens
ucuaccagauaacugagg

SEQ ID NO: 2178407 - RNA, 13 nt, Homo sapiens
ccauuuugaaaua

SEQ ID NO: 2178408 - RNA, 11 nt, Homo sapiens
uuaguuucaug

SEQ ID NO: 2178409 - RNA, 13 nt, Homo sapiens
ugaaagacacugu

SEQ ID NO: 2178410 - RNA, 16 nt, Homo sapiens
cuguaugaaugugauu

SEQ ID NO: 2178411 - RNA, 18 nt, Homo sapiens
guacaaggcaacauauag

SEQ ID NO: 2178412 - RNA, 21 nt, Homo sapiens
gccagcccugcaguaaucucc

SEQ ID NO: 2178413 - RNA, 20 nt, Homo sapiens
gugagaaucaaaacucuccu

SEQ ID NO: 2178414 - RNA, 20 nt, Homo sapiens
acuuuguauccucugaccua

SEQ ID NO: 2178415 - RNA, 23 nt, Homo sapiens
uuugugauucaaacuucugugua

SEQ ID NO: 2178416 - RNA, 12 nt, Homo sapiens
uuuccacacagc

SEQ ID NO: 2178417 - RNA, 15 nt, Homo sapiens
aacccacaguucucc

SEQ ID NO: 2178418 - RNA, 14 nt, Homo sapiens
ccuuaggagcaaaa

SEQ ID NO: 2178419 - RNA, 20 nt, Homo sapiens
gccuaaaagugggcuugauu

SEQ ID NO: 2178420 - RNA, 15 nt, Homo sapiens
gacucucacuaggcu

SEQ ID NO: 2178421 - RNA, 19 nt, Homo sapiens
uaagagccuaacuccaucc

SEQ ID NO: 2178422 - RNA, 16 nt, Homo sapiens
gaguacagugagccaa

SEQ ID NO: 2178423 - RNA, 14 nt, Homo sapiens
ggggcaguggccug

SEQ ID NO: 2178424 - RNA, 23 nt, Homo sapiens
ugaaaaagauuauuugugcauuu

SEQ ID NO: 2178425 - RNA, 18 nt, Homo sapiens
uggaacuugaacugauuc

SEQ ID NO: 2178426 - RNA, 13 nt, Homo sapiens
auuaauacuguag

SEQ ID NO: 2178427 - RNA, 21 nt, Homo sapiens
aaguuucacuccggagugaga

SEQ ID NO: 2178428 - RNA, 16 nt, Homo sapiens
ugcaaagaacggugau

SEQ ID NO: 2178429 - RNA, 15 nt, Homo sapiens
ucuguccaaggcaca

SEQ ID NO: 2178430 - RNA, 21 nt, Homo sapiens
cuuuaaaaauaaaagcuauua

SEQ ID NO: 2178431 - RNA, 16 nt, Homo sapiens
agggugcagugugagu

SEQ ID NO: 2178432 - RNA, 15 nt, Homo sapiens
uccauggaccuauga

SEQ ID NO: 2178433 - RNA, 15 nt, Homo sapiens
acuuacagugccaac

SEQ ID NO: 2178434 - RNA, 20 nt, Homo sapiens
uugauaauucgagcaaacaa

SEQ ID NO: 2178435 - RNA, 21 nt, Homo sapiens
cucagcacuuugggaggccaa

SEQ ID NO: 2178436 - RNA, 19 nt, Homo sapiens
agaugaaacaucauuucaa

SEQ ID NO: 2178437 - RNA, 22 nt, Homo sapiens
agccuggggugaccucuagagc

SEQ ID NO: 2178438 - RNA, 18 nt, Homo sapiens
caaccuguucaucuugaa

SEQ ID NO: 2178439 - RNA, 17 nt, Homo sapiens
uguuuauacacugugua

SEQ ID NO: 2178440 - RNA, 22 nt, Homo sapiens
acguggcccagagaagccaaaa

SEQ ID NO: 2178441 - RNA, 16 nt, Homo sapiens
cagugaauccagacca

SEQ ID NO: 2178442 - RNA, 16 nt, Homo sapiens
caaucuucuacuuuaa

SEQ ID NO: 2178443 - RNA, 17 nt, Homo sapiens
augggauucagugcuuc

SEQ ID NO: 2178444 - RNA, 17 nt, Homo sapiens
cugggcucaagugaucc

SEQ ID NO: 2178445 - RNA, 17 nt, Homo sapiens
ccuggggugaauacuua

SEQ ID NO: 2178446 - RNA, 14 nt, Homo sapiens
agcccagccauuac

SEQ ID NO: 2178447 - RNA, 22 nt, Homo sapiens
cugugcagguggggagacuggg

SEQ ID NO: 2178448 - RNA, 14 nt, Homo sapiens
acccucugcugaag

SEQ ID NO: 2178449 - RNA, 15 nt, Homo sapiens
cuuaucaacuaauga

SEQ ID NO: 2178450 - RNA, 23 nt, Homo sapiens
cacaucauggaccaaaugugcca

SEQ ID NO: 2178451 - RNA, 17 nt, Homo sapiens
ggaaaagaaauugcaug

SEQ ID NO: 2178452 - RNA, 20 nt, Homo sapiens
ccagucuugucauugccagc

SEQ ID NO: 2178453 - RNA, 17 nt, Homo sapiens
auucaagcuucauauau

SEQ ID NO: 2178454 - RNA, 19 nt, Homo sapiens
ucgaagcuccgugagugaa

SEQ ID NO: 2178455 - RNA, 18 nt, Homo sapiens
ccgcaugugucuguauuc

SEQ ID NO: 2178456 - RNA, 17 nt, Homo sapiens
cagauugacagcauaua

SEQ ID NO: 2178457 - RNA, 19 nt, Homo sapiens
acucaccagccucugcucu

SEQ ID NO: 2178458 - RNA, 20 nt, Homo sapiens
gauaaagucaaaugccaaac

SEQ ID NO: 2178459 - RNA, 15 nt, Homo sapiens
ggggagcaaugggcu

SEQ ID NO: 2178460 - RNA, 17 nt, Homo sapiens
auaaaaugaacaucucu

SEQ ID NO: 2178461 - RNA, 16 nt, Homo sapiens
caggaaaaaccaacag

SEQ ID NO: 2178462 - RNA, 16 nt, Homo sapiens
uaaaggaauuccccaa

SEQ ID NO: 2178463 - RNA, 18 nt, Homo sapiens
cagugacuggugccagug

SEQ ID NO: 2178464 - RNA, 17 nt, Homo sapiens
guguuauaacagggaac

SEQ ID NO: 2178465 - RNA, 14 nt, Homo sapiens
cugcugcgcugcuu

SEQ ID NO: 2178466 - RNA, 23 nt, Homo sapiens
guacagucuguaucaaacccacg

SEQ ID NO: 2178467 - RNA, 17 nt, Homo sapiens
aguucauauguaccaug

SEQ ID NO: 2178468 - RNA, 19 nt, Homo sapiens
ugaucuacuucauagcucc

SEQ ID NO: 2178469 - RNA, 17 nt, Homo sapiens
agugacugccaaaaagg

SEQ ID NO: 2178470 - RNA, 16 nt, Homo sapiens
uacugugugaucuuca

SEQ ID NO: 2178471 - RNA, 21 nt, Homo sapiens
acacuggaggagagaagaaug

SEQ ID NO: 2178472 - RNA, 17 nt, Homo sapiens
ccaccaugcucucucac

SEQ ID NO: 2178473 - RNA, 16 nt, Homo sapiens
guugcacagcaucuca

SEQ ID NO: 2178474 - RNA, 13 nt, Homo sapiens
auugaaguguucu

SEQ ID NO: 2178475 - RNA, 20 nt, Homo sapiens
uguaacuggguucaaaaaga

SEQ ID NO: 2178476 - RNA, 19 nt, Homo sapiens
ugagaaacauuauugucaa

SEQ ID NO: 2178477 - RNA, 20 nt, Homo sapiens
aucuuuguuuaaaugccaaa

SEQ ID NO: 2178478 - RNA, 15 nt, Homo sapiens
uucuacuuugccaca

SEQ ID NO: 2178479 - RNA, 20 nt, Homo sapiens
acagccgcuccugucugcca

SEQ ID NO: 2178480 - RNA, 19 nt, Homo sapiens
ugcacacgggaaagccuua

SEQ ID NO: 2178481 - RNA, 19 nt, Homo sapiens
ugacauuguggcacauucu

SEQ ID NO: 2178482 - RNA, 19 nt, Homo sapiens
aauggcaguguuuuuauga

SEQ ID NO: 2178483 - RNA, 22 nt, Homo sapiens
uugaauuaaaacagcugcgaca

SEQ ID NO: 2178484 - RNA, 21 nt, Homo sapiens
aaauccuguugaaaagccaug

SEQ ID NO: 2178485 - RNA, 16 nt, Homo sapiens
cuggucuuggugaaca

SEQ ID NO: 2178486 - RNA, 19 nt, Homo sapiens
gauggagauauuuacauga

SEQ ID NO: 2178487 - RNA, 18 nt, Homo sapiens
gggucaguggccaggugc

SEQ ID NO: 2178488 - RNA, 22 nt, Homo sapiens
ucuaaagguaccaaacaaggaa

SEQ ID NO: 2178489 - RNA, 23 nt, Homo sapiens
gcacacacaccacacauacacac

SEQ ID NO: 2178490 - RNA, 19 nt, Homo sapiens
cuacagauagucaaaccau

SEQ ID NO: 2178491 - RNA, 21 nt, Homo sapiens
gggaacaacugggccugggau

SEQ ID NO: 2178492 - RNA, 14 nt, Homo sapiens
acccagcaguucuc

SEQ ID NO: 2178493 - RNA, 23 nt, Homo sapiens
caggccucucggugcuccaucuc

SEQ ID NO: 2178494 - RNA, 13 nt, Homo sapiens
cuaacugcuguua

SEQ ID NO: 2178495 - RNA, 14 nt, Homo sapiens
gccauccaccuuca

SEQ ID NO: 2178496 - RNA, 15 nt, Homo sapiens
gcuggcuggguucca

SEQ ID NO: 2178497 - RNA, 18 nt, Homo sapiens
ugucuugcagauguagaa

SEQ ID NO: 2178498 - RNA, 16 nt, Homo sapiens
uugaccaaguaugaca

SEQ ID NO: 2178499 - RNA, 18 nt, Homo sapiens
ugcaaaugucaguuuccu

SEQ ID NO: 2178500 - RNA, 20 nt, Homo sapiens
cucuucucuugagcaguuag

SEQ ID NO: 2178501 - RNA, 22 nt, Homo sapiens
aggaucuccuguccaucagcca

SEQ ID NO: 2178502 - RNA, 18 nt, Homo sapiens
uaaacaggagacagguca

SEQ ID NO: 2178503 - RNA, 19 nt, Homo sapiens
cagauggaaacucuuuaac

SEQ ID NO: 2178504 - RNA, 11 nt, Homo sapiens
aauuguugacu

SEQ ID NO: 2178505 - RNA, 11 nt, Homo sapiens
ccguguugcag

SEQ ID NO: 2178506 - RNA, 14 nt, Homo sapiens
aaagaugugcaaag

SEQ ID NO: 2178507 - RNA, 16 nt, Homo sapiens
ucaugacacuauacag

SEQ ID NO: 2178508 - RNA, 20 nt, Homo sapiens
uuucuagauaccacuuaaca

SEQ ID NO: 2178509 - RNA, 22 nt, Homo sapiens
ugcccagcuucaauaauuacca

SEQ ID NO: 2178510 - RNA, 14 nt, Homo sapiens
cccucagacauccc

SEQ ID NO: 2178511 - RNA, 14 nt, Homo sapiens
uuguuuaccagaga

SEQ ID NO: 2178512 - RNA, 23 nt, Homo sapiens
gcuuuugcccacacacuuuccau

SEQ ID NO: 2178513 - RNA, 19 nt, Homo sapiens
gugcauuaaacugaaucac

SEQ ID NO: 2178514 - RNA, 16 nt, Homo sapiens
cucccugcuccucaug

SEQ ID NO: 2178515 - RNA, 17 nt, Homo sapiens
caguguuuccagugaca

SEQ ID NO: 2178516 - RNA, 15 nt, Homo sapiens
gaccaaaugugccau

SEQ ID NO: 2178517 - RNA, 23 nt, Homo sapiens
uagguuuggacaaaauggaauac

SEQ ID NO: 2178518 - RNA, 20 nt, Homo sapiens
ucuuucguugguuguuucuc

SEQ ID NO: 2178519 - RNA, 24 nt, Homo sapiens
ucugucuaaaaaccagacaaggaa

SEQ ID NO: 2178520 - RNA, 15 nt, Homo sapiens
gagcaaucugacccu

SEQ ID NO: 2178521 - RNA, 18 nt, Homo sapiens
acucagaagaaagcucag

SEQ ID NO: 2178522 - RNA, 22 nt, Homo sapiens
gcauuuauggucaacacuuaag

SEQ ID NO: 2178523 - RNA, 17 nt, Homo sapiens
cagaucaccaccugaac

SEQ ID NO: 2178524 - RNA, 14 nt, Homo sapiens
aggaacacaugcac

SEQ ID NO: 2178525 - RNA, 19 nt, Homo sapiens
ugccaggacugugacucau

SEQ ID NO: 2178526 - RNA, 21 nt, Homo sapiens
ucuucgacauccgucauugcu

SEQ ID NO: 2178527 - RNA, 16 nt, Homo sapiens
caaauaaagauaaccc

SEQ ID NO: 2178528 - RNA, 18 nt, Homo sapiens
auugaggauaaauugcca

SEQ ID NO: 2178529 - RNA, 19 nt, Homo sapiens
uucugauaguagucuuuaa

SEQ ID NO: 2178530 - RNA, 20 nt, Homo sapiens
aaugaugcucaaaaucuuuc

SEQ ID NO: 2178531 - RNA, 14 nt, Homo sapiens
caacaaaagggaaa

SEQ ID NO: 2178532 - RNA, 23 nt, Homo sapiens
ccuuuguuucggugcccuguguc

SEQ ID NO: 2178533 - RNA, 22 nt, Homo sapiens
aggucugcucggccgucuucac

SEQ ID NO: 2178534 - RNA, 18 nt, Homo sapiens
aauucuagaugacuuuaa

SEQ ID NO: 2178535 - RNA, 17 nt, Homo sapiens
uggaacacacauguccu

SEQ ID NO: 2178536 - RNA, 18 nt, Homo sapiens
acucaaacgaugugcaau

SEQ ID NO: 2178537 - RNA, 20 nt, Homo sapiens
aaauggcuacacucaucuga

SEQ ID NO: 2178538 - RNA, 15 nt, Homo sapiens
agacccagaucucau

SEQ ID NO: 2178539 - RNA, 15 nt, Homo sapiens
aacuagguuaccgcu

SEQ ID NO: 2178540 - RNA, 15 nt, Homo sapiens
aggcaugggugcaag

SEQ ID NO: 2178541 - RNA, 15 nt, Homo sapiens
uuauuaucuucuuaa

SEQ ID NO: 2178542 - RNA, 20 nt, Homo sapiens
uuuauuuuguuuauugcacu

SEQ ID NO: 2178543 - RNA, 16 nt, Homo sapiens
uuauagccauaaaaga

SEQ ID NO: 2178544 - RNA, 21 nt, Homo sapiens
ucuuugguagggagaggggcu

SEQ ID NO: 2178545 - RNA, 20 nt, Homo sapiens
acaucugcaauaugaauuca

SEQ ID NO: 2178546 - RNA, 18 nt, Homo sapiens
agccucagcccccugcuu

SEQ ID NO: 2178547 - RNA, 12 nt, Homo sapiens
aauugugcaaau

SEQ ID NO: 2178548 - RNA, 16 nt, Homo sapiens
auucagagaauaucaa

SEQ ID NO: 2178549 - RNA, 21 nt, Homo sapiens
ucagaggaaaagggcaaaaag

SEQ ID NO: 2178550 - RNA, 16 nt, Homo sapiens
gccaccccaacccaau

SEQ ID NO: 2178551 - RNA, 16 nt, Homo sapiens
ggcagcauuuuugcac

SEQ ID NO: 2178552 - RNA, 19 nt, Homo sapiens
uucagaucauauuucacaa

SEQ ID NO: 2178553 - RNA, 16 nt, Homo sapiens
accaggcuuccaagaa

SEQ ID NO: 2178554 - RNA, 22 nt, Homo sapiens
uggguggaaauccugcccugga

SEQ ID NO: 2178555 - RNA, 16 nt, Homo sapiens
gcggacaucucaggga

SEQ ID NO: 2178556 - RNA, 21 nt, Homo sapiens
acugacacaagaauggucuuu

SEQ ID NO: 2178557 - RNA, 14 nt, Homo sapiens
uggacucugugcuc

SEQ ID NO: 2178558 - RNA, 16 nt, Homo sapiens
agauacauucacauuc

SEQ ID NO: 2178559 - RNA, 15 nt, Homo sapiens
accgugccuggccac

SEQ ID NO: 2178560 - RNA, 17 nt, Homo sapiens
aaauaaaaagcauuauu

SEQ ID NO: 2178561 - RNA, 21 nt, Homo sapiens
accccugaaacuggaccugca

SEQ ID NO: 2178562 - RNA, 21 nt, Homo sapiens
gccugagguuugccagcauuu

SEQ ID NO: 2178563 - RNA, 16 nt, Homo sapiens
ccauaccuuugcuacu

SEQ ID NO: 2178564 - RNA, 22 nt, Homo sapiens
uucuucaggagaugaugugaug

SEQ ID NO: 2178565 - RNA, 18 nt, Homo sapiens
agccuggcuccccugggg

SEQ ID NO: 2178566 - RNA, 15 nt, Homo sapiens
cugucuugucuucaa

SEQ ID NO: 2178567 - RNA, 15 nt, Homo sapiens
auacggcagaccucu

SEQ ID NO: 2178568 - RNA, 14 nt, Homo sapiens
accacagcacuauu

SEQ ID NO: 2178569 - RNA, 20 nt, Homo sapiens
ggcgacagagcgagacuccg

SEQ ID NO: 2178570 - RNA, 20 nt, Homo sapiens
ggcgacagagcaagacucca

SEQ ID NO: 2178571 - RNA, 17 nt, Homo sapiens
aucuaucuguauuuuca

SEQ ID NO: 2178572 - RNA, 17 nt, Homo sapiens
gcuuuuaggaacuuuau

SEQ ID NO: 2178573 - RNA, 22 nt, Homo sapiens
guucuaaauaaaaagcauuauu

SEQ ID NO: 2178574 - RNA, 17 nt, Homo sapiens
accucuguucucaugaa

SEQ ID NO: 2178575 - RNA, 21 nt, Homo sapiens
gcuucaucaauuuuuauacau

SEQ ID NO: 2178576 - RNA, 18 nt, Homo sapiens
aaugauucauaagacacu

SEQ ID NO: 2178577 - RNA, 14 nt, Homo sapiens
ucgucaacuuuccu

SEQ ID NO: 2178578 - RNA, 16 nt, Homo sapiens
aaagacugcagcugcu

SEQ ID NO: 2178579 - RNA, 14 nt, Homo sapiens
ugguguggcugcuc

SEQ ID NO: 2178580 - RNA, 24 nt, Homo sapiens
ugauuccuuuccuaaaaguguaag

SEQ ID NO: 2178581 - RNA, 13 nt, Homo sapiens
ugggauaaacauc

SEQ ID NO: 2178582 - RNA, 18 nt, Homo sapiens
ccuaacugaaaugagaug

SEQ ID NO: 2178583 - RNA, 20 nt, Homo sapiens
agauuuucauguucuugcag

SEQ ID NO: 2178584 - RNA, 15 nt, Homo sapiens
aucuuugaaaacuca

SEQ ID NO: 2178585 - RNA, 22 nt, Homo sapiens
gggcugcugagggucugggauc

SEQ ID NO: 2178586 - RNA, 22 nt, Homo sapiens
ucucaggggaaggauuugcauu

SEQ ID NO: 2178587 - RNA, 22 nt, Homo sapiens
aaaaugggagacagccucuuac

SEQ ID NO: 2178588 - RNA, 22 nt, Homo sapiens
uucauuaacaaaauguaugucu

SEQ ID NO: 2178589 - RNA, 12 nt, Homo sapiens
acauuacugccu

SEQ ID NO: 2178590 - RNA, 13 nt, Homo sapiens
cuuagucauuacu

SEQ ID NO: 2178591 - RNA, 16 nt, Homo sapiens
uguauaacuaggcugu

SEQ ID NO: 2178592 - RNA, 20 nt, Homo sapiens
aauacuacugacguccuccc

SEQ ID NO: 2178593 - RNA, 23 nt, Homo sapiens
aaagccuacccuauucuauccau

SEQ ID NO: 2178594 - RNA, 18 nt, Homo sapiens
uuaauacaugcaacagaa

SEQ ID NO: 2178595 - RNA, 16 nt, Homo sapiens
caauaauuuguuuuca

SEQ ID NO: 2178596 - RNA, 13 nt, Homo sapiens
aaauacuugcaug

SEQ ID NO: 2178597 - RNA, 16 nt, Homo sapiens
cuucuugcugaucaga

SEQ ID NO: 2178598 - RNA, 16 nt, Homo sapiens
ugaccugacuuuuagc

SEQ ID NO: 2178599 - RNA, 18 nt, Homo sapiens
gggcuggaaugauuucag

SEQ ID NO: 2178600 - RNA, 18 nt, Homo sapiens
accacaaaaaccaaacau

SEQ ID NO: 2178601 - RNA, 23 nt, Homo sapiens
gugacaaccgaguggcugucauc

SEQ ID NO: 2178602 - RNA, 18 nt, Homo sapiens
gaguacaccccaacagca

SEQ ID NO: 2178603 - RNA, 20 nt, Homo sapiens
uguccccaacaccccacaga

SEQ ID NO: 2178604 - RNA, 15 nt, Homo sapiens
ccugcaagucagucc

SEQ ID NO: 2178605 - RNA, 20 nt, Homo sapiens
aggugauccacccaccucag

SEQ ID NO: 2178606 - RNA, 15 nt, Homo sapiens
ggaccugacuguggg

SEQ ID NO: 2178607 - RNA, 14 nt, Homo sapiens
cuguuucagaccag

SEQ ID NO: 2178608 - RNA, 12 nt, Homo sapiens
cuuucuuugugu

SEQ ID NO: 2178609 - RNA, 17 nt, Homo sapiens
ccugugggugaaacaga

SEQ ID NO: 2178610 - RNA, 15 nt, Homo sapiens
ggccucaucucagac

SEQ ID NO: 2178611 - RNA, 12 nt, Homo sapiens
uugggagcugcu

SEQ ID NO: 2178612 - RNA, 16 nt, Homo sapiens
cccaucccucauacca

SEQ ID NO: 2178613 - RNA, 15 nt, Homo sapiens
gucugucucagcuca

SEQ ID NO: 2178614 - RNA, 14 nt, Homo sapiens
auauacucaugucc

SEQ ID NO: 2178615 - RNA, 13 nt, Homo sapiens
gaugugcacugca

SEQ ID NO: 2178616 - RNA, 20 nt, Homo sapiens
aguuuauaagacuggaauau

SEQ ID NO: 2178617 - RNA, 19 nt, Homo sapiens
uuuccuucuacuuacacau

SEQ ID NO: 2178618 - RNA, 20 nt, Homo sapiens
aaccucauaaaaaucuagca

SEQ ID NO: 2178619 - RNA, 19 nt, Homo sapiens
ccugggaggcggagaguac

SEQ ID NO: 2178620 - RNA, 22 nt, Homo sapiens
agacauggaugcgaggaccacu

SEQ ID NO: 2178621 - RNA, 20 nt, Homo sapiens
ucccaccaugcgcugcucaa

SEQ ID NO: 2178622 - RNA, 18 nt, Homo sapiens
ccagugguacuaagcaca

SEQ ID NO: 2178623 - RNA, 19 nt, Homo sapiens
agcagguuaccacucuggc

SEQ ID NO: 2178624 - RNA, 23 nt, Homo sapiens
auauguacuuguuugcuaugacu

SEQ ID NO: 2178625 - RNA, 15 nt, Homo sapiens
ugaguaagauuuacc

SEQ ID NO: 2178626 - RNA, 12 nt, Homo sapiens
ccccuccacugg

SEQ ID NO: 2178627 - RNA, 19 nt, Homo sapiens
uaaucuuauuuauaccuca

SEQ ID NO: 2178628 - RNA, 22 nt, Homo sapiens
uggaauuuugugcccccaugua

SEQ ID NO: 2178629 - RNA, 16 nt, Homo sapiens
gaauacugccaaaaca

SEQ ID NO: 2178630 - RNA, 20 nt, Homo sapiens
guagguuauuaugauuagcu

SEQ ID NO: 2178631 - RNA, 17 nt, Homo sapiens
aaggagaaggagugcca

SEQ ID NO: 2178632 - RNA, 15 nt, Homo sapiens
auggaauacagucau

SEQ ID NO: 2178633 - RNA, 19 nt, Homo sapiens
agucagggacagcagccuc

SEQ ID NO: 2178634 - RNA, 19 nt, Homo sapiens
aggagagcaaacugcucag

SEQ ID NO: 2178635 - RNA, 18 nt, Homo sapiens
uuuuaacacuaaccaaac

SEQ ID NO: 2178636 - RNA, 19 nt, Homo sapiens
ccuaaauaauguuaucugu

SEQ ID NO: 2178637 - RNA, 18 nt, Homo sapiens
guaaucccagcuacucag

SEQ ID NO: 2178638 - RNA, 19 nt, Homo sapiens
agccuaucaagccuuaggc

SEQ ID NO: 2178639 - RNA, 20 nt, Homo sapiens
auggaggaagaacaacaaag

SEQ ID NO: 2178640 - RNA, 19 nt, Homo sapiens
uuuucagauacacugugau

SEQ ID NO: 2178641 - RNA, 19 nt, Homo sapiens
acucugcugcaaaaugaag

SEQ ID NO: 2178642 - RNA, 19 nt, Homo sapiens
acaaacuuuguuugucaca

SEQ ID NO: 2178643 - RNA, 17 nt, Homo sapiens
ccacaguucaguggcag

SEQ ID NO: 2178644 - RNA, 17 nt, Homo sapiens
cuuccuggcuucuuacu

SEQ ID NO: 2178645 - RNA, 19 nt, Homo sapiens
cacagaacacauaauucag

SEQ ID NO: 2178646 - RNA, 19 nt, Homo sapiens
accaaacaaggaagccaaa

SEQ ID NO: 2178647 - RNA, 15 nt, Homo sapiens
cagaggcuggaccac

SEQ ID NO: 2178648 - RNA, 14 nt, Homo sapiens
aaccaagaacauaa

SEQ ID NO: 2178649 - RNA, 13 nt, Homo sapiens
aaauaaacuguaa

SEQ ID NO: 2178650 - RNA, 17 nt, Homo sapiens
uuaggacuuuuugucaa

SEQ ID NO: 2178651 - RNA, 16 nt, Homo sapiens
auaaacuuguacuuac

SEQ ID NO: 2178652 - RNA, 22 nt, Homo sapiens
cuugaagauuagguacuaucug

SEQ ID NO: 2178653 - RNA, 18 nt, Homo sapiens
cucucccucccuugccac

SEQ ID NO: 2178654 - RNA, 14 nt, Homo sapiens
gcgaguugcgcugg

SEQ ID NO: 2178655 - RNA, 20 nt, Homo sapiens
gcagugggcccaagcaaggg

SEQ ID NO: 2178656 - RNA, 18 nt, Homo sapiens
agagaagcaaguaaaaag

SEQ ID NO: 2178657 - RNA, 18 nt, Homo sapiens
gucacacgauaaagggau

SEQ ID NO: 2178658 - RNA, 22 nt, Homo sapiens
ugcacugaggcagcgaccucaa

SEQ ID NO: 2178659 - RNA, 17 nt, Homo sapiens
gaaaucuuucucccuca

SEQ ID NO: 2178660 - RNA, 13 nt, Homo sapiens
ccuuacauuucac

SEQ ID NO: 2178661 - RNA, 11 nt, Homo sapiens
aaacacaaaac

SEQ ID NO: 2178662 - RNA, 18 nt, Homo sapiens
aggcauuuucaucuuucc

SEQ ID NO: 2178663 - RNA, 16 nt, Homo sapiens
agggacagaaaccaag

SEQ ID NO: 2178664 - RNA, 13 nt, Homo sapiens
agcucuacucugg

SEQ ID NO: 2178665 - RNA, 16 nt, Homo sapiens
cacaugucuguccuca

SEQ ID NO: 2178666 - RNA, 20 nt, Homo sapiens
cuuucagaaggaaaccgaaa

SEQ ID NO: 2178667 - RNA, 19 nt, Homo sapiens
cuugucauggaaaaugucc

SEQ ID NO: 2178668 - RNA, 19 nt, Homo sapiens
ccaaagacggcuccauuaa

SEQ ID NO: 2178669 - RNA, 20 nt, Homo sapiens
cagggcugaaccccaccucc

SEQ ID NO: 2178670 - RNA, 21 nt, Homo sapiens
uaugaaaaagaagaaucucau

SEQ ID NO: 2178671 - RNA, 18 nt, Homo sapiens
agaguagaauugcauuga

SEQ ID NO: 2178672 - RNA, 19 nt, Homo sapiens
gggagcaaaucgugccuug

SEQ ID NO: 2178673 - RNA, 23 nt, Homo sapiens
aaacuuugacgagucaccuucca

SEQ ID NO: 2178674 - RNA, 14 nt, Homo sapiens
ucagaaacagugag

SEQ ID NO: 2178675 - RNA, 15 nt, Homo sapiens
ccugggcgagacaca

SEQ ID NO: 2178676 - RNA, 15 nt, Homo sapiens
ccuauuuucauuccu

SEQ ID NO: 2178677 - RNA, 13 nt, Homo sapiens
uuaguuugcuuua

SEQ ID NO: 2178678 - RNA, 15 nt, Homo sapiens
aagguagacuacuuu

SEQ ID NO: 2178679 - RNA, 22 nt, Homo sapiens
ccauuucacucucaaacuucac

SEQ ID NO: 2178680 - RNA, 17 nt, Homo sapiens
acaaauggcuacaucuc

SEQ ID NO: 2178681 - RNA, 19 nt, Homo sapiens
cccagccccuccucccuca

SEQ ID NO: 2178682 - RNA, 16 nt, Homo sapiens
cagaaucugaauguaa

SEQ ID NO: 2178683 - RNA, 21 nt, Homo sapiens
cuaagacccacaaacugccug

SEQ ID NO: 2178684 - RNA, 20 nt, Homo sapiens
cuugucugagaacaaauaca

SEQ ID NO: 2178685 - RNA, 14 nt, Homo sapiens
guuuacuuugccaa

SEQ ID NO: 2178686 - RNA, 19 nt, Homo sapiens
caccucuggcuuugucucu

SEQ ID NO: 2178687 - RNA, 13 nt, Homo sapiens
gccuuuacaugaa

SEQ ID NO: 2178688 - RNA, 18 nt, Homo sapiens
uccgccacuggggcucag

SEQ ID NO: 2178689 - RNA, 17 nt, Homo sapiens
ccuuccuccucugcucu

SEQ ID NO: 2178690 - RNA, 13 nt, Homo sapiens
aagugaacuauga

SEQ ID NO: 2178691 - RNA, 20 nt, Homo sapiens
caugauuucccuuguagaaa

SEQ ID NO: 2178692 - RNA, 19 nt, Homo sapiens
cagcauugacucuguggcu

SEQ ID NO: 2178693 - RNA, 18 nt, Homo sapiens
aagggaagcccugacaac

SEQ ID NO: 2178694 - RNA, 11 nt, Homo sapiens
ucaaucacugu

SEQ ID NO: 2178695 - RNA, 17 nt, Homo sapiens
agcaacaaaauuuacac

SEQ ID NO: 2178696 - RNA, 16 nt, Homo sapiens
aaaauuugaaaauguc

SEQ ID NO: 2178697 - RNA, 16 nt, Homo sapiens
cauaugcagugauaua

SEQ ID NO: 2178698 - RNA, 19 nt, Homo sapiens
uucuucacuuaaacucagc

SEQ ID NO: 2178699 - RNA, 12 nt, Homo sapiens
uagcucuauggg

SEQ ID NO: 2178700 - RNA, 21 nt, Homo sapiens
aucucgugccagggcaggcua

SEQ ID NO: 2178701 - RNA, 17 nt, Homo sapiens
aaggagcacaagccaca

SEQ ID NO: 2178702 - RNA, 22 nt, Homo sapiens
gacagagggcucaccucuugcc

SEQ ID NO: 2178703 - RNA, 16 nt, Homo sapiens
agggagcccccagagg

SEQ ID NO: 2178704 - RNA, 16 nt, Homo sapiens
cuaaacccucugugaa

SEQ ID NO: 2178705 - RNA, 14 nt, Homo sapiens
ccacugcagcagaa

SEQ ID NO: 2178706 - RNA, 14 nt, Homo sapiens
cugcaacaguggug

SEQ ID NO: 2178707 - RNA, 20 nt, Homo sapiens
agagauuuaucuuuauacag

SEQ ID NO: 2178708 - RNA, 18 nt, Homo sapiens
augggaccuguggcuguc

SEQ ID NO: 2178709 - RNA, 16 nt, Homo sapiens
acacugaguugcacau

SEQ ID NO: 2178710 - RNA, 19 nt, Homo sapiens
ucugaccaucugugacuau

SEQ ID NO: 2178711 - RNA, 18 nt, Homo sapiens
cugcucguggccaaaagu

SEQ ID NO: 2178712 - RNA, 22 nt, Homo sapiens
agccacugugucuggccagaaa

SEQ ID NO: 2178713 - RNA, 17 nt, Homo sapiens
cagagaaauacuuucag

SEQ ID NO: 2178714 - RNA, 14 nt, Homo sapiens
cacacauguuuaca

SEQ ID NO: 2178715 - RNA, 19 nt, Homo sapiens
acuaguuuuuccugugcaa

SEQ ID NO: 2178716 - RNA, 14 nt, Homo sapiens
aacuggcucugauu

SEQ ID NO: 2178717 - RNA, 13 nt, Homo sapiens
cauuguguucacu

SEQ ID NO: 2178718 - RNA, 16 nt, Homo sapiens
uaaauccuugaugauu

SEQ ID NO: 2178719 - RNA, 20 nt, Homo sapiens
cccacuuuuuguuguucauu

SEQ ID NO: 2178720 - RNA, 14 nt, Homo sapiens
gagugaucucacca

SEQ ID NO: 2178721 - RNA, 17 nt, Homo sapiens
gccucgguggcccugac

SEQ ID NO: 2178722 - RNA, 14 nt, Homo sapiens
ggcccugggguccc

SEQ ID NO: 2178723 - RNA, 14 nt, Homo sapiens
cuggaaaaggagcu

SEQ ID NO: 2178724 - RNA, 17 nt, Homo sapiens
uugaaaagacuccaaag

SEQ ID NO: 2178725 - RNA, 23 nt, Homo sapiens
uaccagaaggaaagcacuaagaa

SEQ ID NO: 2178726 - RNA, 23 nt, Homo sapiens
acuagucauagaaauaccucauu

SEQ ID NO: 2178727 - RNA, 18 nt, Homo sapiens
gauuucucaccuguaaga

SEQ ID NO: 2178728 - RNA, 22 nt, Homo sapiens
uccauaauaaacuucuggugug

SEQ ID NO: 2178729 - RNA, 17 nt, Homo sapiens
gauauauaggacauuga

SEQ ID NO: 2178730 - RNA, 13 nt, Homo sapiens
gcuggcaaccacu

SEQ ID NO: 2178731 - RNA, 16 nt, Homo sapiens
uggcuaguacuguauu

SEQ ID NO: 2178732 - RNA, 21 nt, Homo sapiens
gcgacaggaauagaugugguc

SEQ ID NO: 2178733 - RNA, 16 nt, Homo sapiens
cuucuguauucacuua

SEQ ID NO: 2178734 - RNA, 18 nt, Homo sapiens
caagacaaaaaaaaugaa

SEQ ID NO: 2178735 - RNA, 21 nt, Homo sapiens
aguggugcgaucuggguucac

SEQ ID NO: 2178736 - RNA, 19 nt, Homo sapiens
acuccccccauccuaccua

SEQ ID NO: 2178737 - RNA, 19 nt, Homo sapiens
aucccugugccucuuccca

SEQ ID NO: 2178738 - RNA, 19 nt, Homo sapiens
uauguauaacuuuaacuuc

SEQ ID NO: 2178739 - RNA, 15 nt, Homo sapiens
uuucucuggcccuga

SEQ ID NO: 2178740 - RNA, 17 nt, Homo sapiens
ugugaaaugaauguaau

SEQ ID NO: 2178741 - RNA, 21 nt, Homo sapiens
cuguagucccagcuacuuggg

SEQ ID NO: 2178742 - RNA, 23 nt, Homo sapiens
aaaccaugcucuggcauguugaa

SEQ ID NO: 2178743 - RNA, 14 nt, Homo sapiens
cauguuuuuauaca

SEQ ID NO: 2178744 - RNA, 21 nt, Homo sapiens
ugacuguguucagugccuugg

SEQ ID NO: 2178745 - RNA, 21 nt, Homo sapiens
cauuuguuucccccacaguuu

SEQ ID NO: 2178746 - RNA, 19 nt, Homo sapiens
ugagggugacuauggagcu

SEQ ID NO: 2178747 - RNA, 18 nt, Homo sapiens
uaauucuuccauuuauuc

SEQ ID NO: 2178748 - RNA, 22 nt, Homo sapiens
aauucaggucuguaugucaugg

SEQ ID NO: 2178749 - RNA, 20 nt, Homo sapiens
ccacaaaauuaugcugcauu

SEQ ID NO: 2178750 - RNA, 13 nt, Homo sapiens
caccauguuggcc

SEQ ID NO: 2178751 - RNA, 13 nt, Homo sapiens
cagcauguugccc

SEQ ID NO: 2178752 - RNA, 20 nt, Homo sapiens
guugucagaauggaauccau

SEQ ID NO: 2178753 - RNA, 22 nt, Homo sapiens
acccucacauccccauccccuu

SEQ ID NO: 2178754 - RNA, 18 nt, Homo sapiens
guaacacaauuuucacuu

SEQ ID NO: 2178755 - RNA, 14 nt, Homo sapiens
uggcccuggggccu

SEQ ID NO: 2178756 - RNA, 11 nt, Homo sapiens
auggaucacaa

SEQ ID NO: 2178757 - RNA, 20 nt, Homo sapiens
auauaaggacagaccaaaaa

SEQ ID NO: 2178758 - RNA, 18 nt, Homo sapiens
cauaagcaaagacuauga

SEQ ID NO: 2178759 - RNA, 17 nt, Homo sapiens
gagagucucacuccccu

SEQ ID NO: 2178760 - RNA, 18 nt, Homo sapiens
cagaauucggugugcugc

SEQ ID NO: 2178761 - RNA, 16 nt, Homo sapiens
cccagcauuccagcuc

SEQ ID NO: 2178762 - RNA, 20 nt, Homo sapiens
aagggaaggcugcuguguag

SEQ ID NO: 2178763 - RNA, 14 nt, Homo sapiens
aguuugaagcccaa

SEQ ID NO: 2178764 - RNA, 19 nt, Homo sapiens
aauccacaaauaugcuaaa

SEQ ID NO: 2178765 - RNA, 22 nt, Homo sapiens
aaauccuggaaggacacaguga

SEQ ID NO: 2178766 - RNA, 20 nt, Homo sapiens
auauuuagaaaaacauccca

SEQ ID NO: 2178767 - RNA, 20 nt, Homo sapiens
cucugcuuucccuuuuccau

SEQ ID NO: 2178768 - RNA, 16 nt, Homo sapiens
uuaaacuccaaaugag

SEQ ID NO: 2178769 - RNA, 15 nt, Homo sapiens
ggccuggcaucgcau

SEQ ID NO: 2178770 - RNA, 17 nt, Homo sapiens
ugaaaagcugcauuuaa

SEQ ID NO: 2178771 - RNA, 13 nt, Homo sapiens
uuugauauagaua

SEQ ID NO: 2178772 - RNA, 15 nt, Homo sapiens
acuuuggcaacaucu

SEQ ID NO: 2178773 - RNA, 15 nt, Homo sapiens
cuuauaccaaaggga

SEQ ID NO: 2178774 - RNA, 17 nt, Homo sapiens
uuggcauuuuacuguac

SEQ ID NO: 2178775 - RNA, 22 nt, Homo sapiens
cagccccggccacucccugcca

SEQ ID NO: 2178776 - RNA, 17 nt, Homo sapiens
ccccagaguugggaugc

SEQ ID NO: 2178777 - RNA, 14 nt, Homo sapiens
uaaaaccucagcua

SEQ ID NO: 2178778 - RNA, 14 nt, Homo sapiens
aaauuuugcacuuu

SEQ ID NO: 2178779 - RNA, 14 nt, Homo sapiens
ggaaaagcccagug

SEQ ID NO: 2178780 - RNA, 20 nt, Homo sapiens
cugaugccaccuccucuguu

SEQ ID NO: 2178781 - RNA, 18 nt, Homo sapiens
cuucugcccccguuccag

SEQ ID NO: 2178782 - RNA, 13 nt, Homo sapiens
aaauuucuaucag

SEQ ID NO: 2178783 - RNA, 12 nt, Homo sapiens
ccaucacaugau

SEQ ID NO: 2178784 - RNA, 16 nt, Homo sapiens
ccuuuaaagagcaauc

SEQ ID NO: 2178785 - RNA, 21 nt, Homo sapiens
gccacagccccuggcacugca

SEQ ID NO: 2178786 - RNA, 14 nt, Homo sapiens
uccagccugaaugu

SEQ ID NO: 2178787 - RNA, 22 nt, Homo sapiens
gugugugcaugccuugggcaca

SEQ ID NO: 2178788 - RNA, 19 nt, Homo sapiens
ggcgaaagaaaacucuauu

SEQ ID NO: 2178789 - RNA, 22 nt, Homo sapiens
gaggcugcccugacccuuccac

SEQ ID NO: 2178790 - RNA, 19 nt, Homo sapiens
gccagaaggauaauauuga

SEQ ID NO: 2178791 - RNA, 19 nt, Homo sapiens
ccaccuaccuuacagugag

SEQ ID NO: 2178792 - RNA, 20 nt, Homo sapiens
gcaucucacagcuaugcaaa

SEQ ID NO: 2178793 - RNA, 13 nt, Homo sapiens
gccccacuugaag

SEQ ID NO: 2178794 - RNA, 15 nt, Homo sapiens
gcguggaaguguucc

SEQ ID NO: 2178795 - RNA, 13 nt, Homo sapiens
ccugcucuugcag

SEQ ID NO: 2178796 - RNA, 13 nt, Homo sapiens
uuuaugugcagcg

SEQ ID NO: 2178797 - RNA, 15 nt, Homo sapiens
uaucagugugcaaua

SEQ ID NO: 2178798 - RNA, 16 nt, Homo sapiens
uucauugagaaacugg

SEQ ID NO: 2178799 - RNA, 21 nt, Homo sapiens
guggagucccuuuugcaucau

SEQ ID NO: 2178800 - RNA, 20 nt, Homo sapiens
aaaugugauuugucuucccu

SEQ ID NO: 2178801 - RNA, 20 nt, Homo sapiens
ggcccuucuguccaccagac

SEQ ID NO: 2178802 - RNA, 16 nt, Homo sapiens
acuaggcucauacuca

SEQ ID NO: 2178803 - RNA, 16 nt, Homo sapiens
cauggaaucugaugaa

SEQ ID NO: 2178804 - RNA, 13 nt, Homo sapiens
gcuggggaaauca

SEQ ID NO: 2178805 - RNA, 16 nt, Homo sapiens
aauuguauuacuuccu

SEQ ID NO: 2178806 - RNA, 15 nt, Homo sapiens
cuauaugacuucaga

SEQ ID NO: 2178807 - RNA, 17 nt, Homo sapiens
caggagacugagaccau

SEQ ID NO: 2178808 - RNA, 14 nt, Homo sapiens
agagucuucccuac

SEQ ID NO: 2178809 - RNA, 15 nt, Homo sapiens
acugugacauuccac

SEQ ID NO: 2178810 - RNA, 19 nt, Homo sapiens
ggcaguuccuggcaucucu

SEQ ID NO: 2178811 - RNA, 17 nt, Homo sapiens
accucaggcaaucugcc

SEQ ID NO: 2178812 - RNA, 23 nt, Homo sapiens
cccugccaagacuccucaggcag

SEQ ID NO: 2178813 - RNA, 14 nt, Homo sapiens
uguccaucccagcg

SEQ ID NO: 2178814 - RNA, 14 nt, Homo sapiens
uccaacaugugcuc

SEQ ID NO: 2178815 - RNA, 14 nt, Homo sapiens
agugaaacauuugu

SEQ ID NO: 2178816 - RNA, 23 nt, Homo sapiens
gcaagacuucacugcagccuuuc

SEQ ID NO: 2178817 - RNA, 16 nt, Homo sapiens
ccaggugaacuggaau

SEQ ID NO: 2178818 - RNA, 19 nt, Homo sapiens
aaacuuagugacaaaauag

SEQ ID NO: 2178819 - RNA, 19 nt, Homo sapiens
aguugaaauguucugucaa

SEQ ID NO: 2178820 - RNA, 13 nt, Homo sapiens
aguuuaaguaauu

SEQ ID NO: 2178821 - RNA, 13 nt, Homo sapiens
agacacaggucac

SEQ ID NO: 2178822 - RNA, 15 nt, Homo sapiens
gagagggccuuuccu

SEQ ID NO: 2178823 - RNA, 16 nt, Homo sapiens
ucugggaaacaagaag

SEQ ID NO: 2178824 - RNA, 15 nt, Homo sapiens
gauggauaagcuugu

SEQ ID NO: 2178825 - RNA, 11 nt, Homo sapiens
caggugcagag

SEQ ID NO: 2178826 - RNA, 17 nt, Homo sapiens
cuguguauuuacaugaa

SEQ ID NO: 2178827 - RNA, 10 nt, Homo sapiens
uuuacauuca

SEQ ID NO: 2178828 - RNA, 22 nt, Homo sapiens
cccugucccucccaccucugug

SEQ ID NO: 2178829 - RNA, 17 nt, Homo sapiens
guaaaaauuuuuuugca

SEQ ID NO: 2178830 - RNA, 16 nt, Homo sapiens
acaggauuaggagcug

SEQ ID NO: 2178831 - RNA, 21 nt, Homo sapiens
uucaugaguuuuucccagcua

SEQ ID NO: 2178832 - RNA, 21 nt, Homo sapiens
cuugagagaggccacacuaca

SEQ ID NO: 2178833 - RNA, 15 nt, Homo sapiens
cugggaccugaaccu

SEQ ID NO: 2178834 - RNA, 17 nt, Homo sapiens
uauagacagcuuugacu

SEQ ID NO: 2178835 - RNA, 17 nt, Homo sapiens
uaccuucucccaggccu

SEQ ID NO: 2178836 - RNA, 14 nt, Homo sapiens
ccucauggacucca

SEQ ID NO: 2178837 - RNA, 19 nt, Homo sapiens
aacacuaauuguccacagc

SEQ ID NO: 2178838 - RNA, 23 nt, Homo sapiens
ugaccgagucuaggaaugcuuuu

SEQ ID NO: 2178839 - RNA, 22 nt, Homo sapiens
uagcccuggguuuaaugucaaa

SEQ ID NO: 2178840 - RNA, 22 nt, Homo sapiens
aagcugaauguucuugaauuau

SEQ ID NO: 2178841 - RNA, 16 nt, Homo sapiens
gcccuggcuggguuca

SEQ ID NO: 2178842 - RNA, 17 nt, Homo sapiens
gcacagcuccugccagg

SEQ ID NO: 2178843 - RNA, 13 nt, Homo sapiens
cucuggacuccac

SEQ ID NO: 2178844 - RNA, 15 nt, Homo sapiens
aaaacgcauccaaga

SEQ ID NO: 2178845 - RNA, 15 nt, Homo sapiens
caucuguacuugguc

SEQ ID NO: 2178846 - RNA, 19 nt, Homo sapiens
ugucucugcgccugaguaa

SEQ ID NO: 2178847 - RNA, 16 nt, Homo sapiens
agagaaguacuaucuu

SEQ ID NO: 2178848 - RNA, 12 nt, Homo sapiens
agcucucucuac

SEQ ID NO: 2178849 - RNA, 22 nt, Homo sapiens
ccaauuauagaucaaaugcccu

SEQ ID NO: 2178850 - RNA, 20 nt, Homo sapiens
cauccucagguggucaggcg

SEQ ID NO: 2178851 - RNA, 21 nt, Homo sapiens
ccaaucucgucaggcugccag

SEQ ID NO: 2178852 - RNA, 23 nt, Homo sapiens
agaccugacccauccaguucucu

SEQ ID NO: 2178853 - RNA, 12 nt, Homo sapiens
uagacugaggua

SEQ ID NO: 2178854 - RNA, 16 nt, Homo sapiens
acaguuaacuuucaga

SEQ ID NO: 2178855 - RNA, 15 nt, Homo sapiens
cuuuauacucaggca

SEQ ID NO: 2178856 - RNA, 16 nt, Homo sapiens
uaaauuuaaagucuaa

SEQ ID NO: 2178857 - RNA, 22 nt, Homo sapiens
augugcccacugucucuuccac

SEQ ID NO: 2178858 - RNA, 14 nt, Homo sapiens
gaacaugagccuuu

SEQ ID NO: 2178859 - RNA, 14 nt, Homo sapiens
caaguuucauacca

SEQ ID NO: 2178860 - RNA, 19 nt, Homo sapiens
gagaaauacaucauuugca

SEQ ID NO: 2178861 - RNA, 18 nt, Homo sapiens
aggcacaacaguucucuu

SEQ ID NO: 2178862 - RNA, 20 nt, Homo sapiens
cacauuagaauaaaagguag

SEQ ID NO: 2178863 - RNA, 20 nt, Homo sapiens
ccagcugucucccacgugug

SEQ ID NO: 2178864 - RNA, 15 nt, Homo sapiens
augugcagucacugg

SEQ ID NO: 2178865 - RNA, 19 nt, Homo sapiens
ucacagacuggcaacaaga

SEQ ID NO: 2178866 - RNA, 17 nt, Homo sapiens
cuguugcugccacucua

SEQ ID NO: 2178867 - RNA, 22 nt, Homo sapiens
ccaaaaugaaccuugcuaucaa

SEQ ID NO: 2178868 - RNA, 14 nt, Homo sapiens
guuagaaaauucag

SEQ ID NO: 2178869 - RNA, 18 nt, Homo sapiens
cuuaaaugacagugaauu

SEQ ID NO: 2178870 - RNA, 15 nt, Homo sapiens
ucccuugcuugccug

SEQ ID NO: 2178871 - RNA, 15 nt, Homo sapiens
accuccacauguuca

SEQ ID NO: 2178872 - RNA, 12 nt, Homo sapiens
cacuagcuugau

SEQ ID NO: 2178873 - RNA, 22 nt, Homo sapiens
accugucuuauuaagacuggcu

SEQ ID NO: 2178874 - RNA, 14 nt, Homo sapiens
uuuuauauugccuu

SEQ ID NO: 2178875 - RNA, 14 nt, Homo sapiens
ucccauguauuuau

SEQ ID NO: 2178876 - RNA, 22 nt, Homo sapiens
uagauuuacauagaauuaagag

SEQ ID NO: 2178877 - RNA, 16 nt, Homo sapiens
caauaaaccaaugaac

SEQ ID NO: 2178878 - RNA, 15 nt, Homo sapiens
cucuugucacaugga

SEQ ID NO: 2178879 - RNA, 19 nt, Homo sapiens
uuuccccuuugauugcuga

SEQ ID NO: 2178880 - RNA, 14 nt, Homo sapiens
uucccccuccccca

SEQ ID NO: 2178881 - RNA, 16 nt, Homo sapiens
cccagccaagugguga

SEQ ID NO: 2178882 - RNA, 12 nt, Homo sapiens
acauugcacuuu

SEQ ID NO: 2178883 - RNA, 12 nt, Homo sapiens
ccuaugcaauaa

SEQ ID NO: 2178884 - RNA, 23 nt, Homo sapiens
gauagagaguuguuguguacaga

SEQ ID NO: 2178885 - RNA, 22 nt, Homo sapiens
cuuagaagccaugggaccuccu

SEQ ID NO: 2178886 - RNA, 13 nt, Homo sapiens
cagaacuccuacc

SEQ ID NO: 2178887 - RNA, 15 nt, Homo sapiens
cauuuacaaagcaaa

SEQ ID NO: 2178888 - RNA, 19 nt, Homo sapiens
uccuuaccgugggcacuga

SEQ ID NO: 2178889 - RNA, 14 nt, Homo sapiens
guccugacaccagg

SEQ ID NO: 2178890 - RNA, 18 nt, Homo sapiens
cugcacuuauacccauga

SEQ ID NO: 2178891 - RNA, 18 nt, Homo sapiens
ucuguaggugucucuggg

SEQ ID NO: 2178892 - RNA, 15 nt, Homo sapiens
gcccaggccagagcc

SEQ ID NO: 2178893 - RNA, 16 nt, Homo sapiens
auugcuuuauuuuggc

SEQ ID NO: 2178894 - RNA, 18 nt, Homo sapiens
caaaucagacacaauuag

SEQ ID NO: 2178895 - RNA, 13 nt, Homo sapiens
ucuucacuugcac

SEQ ID NO: 2178896 - RNA, 20 nt, Homo sapiens
uaauuuaaagaaacacuaaa

SEQ ID NO: 2178897 - RNA, 18 nt, Homo sapiens
auggagccaugacaagaa

SEQ ID NO: 2178898 - RNA, 15 nt, Homo sapiens
agcauugccauuccu

SEQ ID NO: 2178899 - RNA, 20 nt, Homo sapiens
aaacuugaacucugguucuu

SEQ ID NO: 2178900 - RNA, 18 nt, Homo sapiens
gaguugcugccacaaaca

SEQ ID NO: 2178901 - RNA, 23 nt, Homo sapiens
uggaaguuaaagggcauuuccaa

SEQ ID NO: 2178902 - RNA, 12 nt, Homo sapiens
uauaaaauacug

SEQ ID NO: 2178903 - RNA, 23 nt, Homo sapiens
cgaaugcauuuggaaccaaaguc

SEQ ID NO: 2178904 - RNA, 13 nt, Homo sapiens
ccucgacuuauca

SEQ ID NO: 2178905 - RNA, 18 nt, Homo sapiens
ccaguguacugcuuucaa

SEQ ID NO: 2178906 - RNA, 23 nt, Homo sapiens
uucaaaaacaugcuuuuccaaac

SEQ ID NO: 2178907 - RNA, 20 nt, Homo sapiens
uaaaaaacaugaaugucauu

SEQ ID NO: 2178908 - RNA, 22 nt, Homo sapiens
aaaugaauggaggaacuuucca

SEQ ID NO: 2178909 - RNA, 16 nt, Homo sapiens
uagcaauugacuguca

SEQ ID NO: 2178910 - RNA, 20 nt, Homo sapiens
cugaacaugccugccaaaga

SEQ ID NO: 2178911 - RNA, 13 nt, Homo sapiens
aaauuccuaucuc

SEQ ID NO: 2178912 - RNA, 14 nt, Homo sapiens
acacuaguagcugu

SEQ ID NO: 2178913 - RNA, 15 nt, Homo sapiens
gacaagaagacuguc

SEQ ID NO: 2178914 - RNA, 18 nt, Homo sapiens
aggcaaaggaaauuguca

SEQ ID NO: 2178915 - RNA, 21 nt, Homo sapiens
uauccacaucuuuaaguauug

SEQ ID NO: 2178916 - RNA, 21 nt, Homo sapiens
ccagucuuccugacacuuuaa

SEQ ID NO: 2178917 - RNA, 12 nt, Homo sapiens
uguggcagugaa

SEQ ID NO: 2178918 - RNA, 13 nt, Homo sapiens
ugaacuauaucag

SEQ ID NO: 2178919 - RNA, 23 nt, Homo sapiens
agaacccauuugccaugcugcua

SEQ ID NO: 2178920 - RNA, 16 nt, Homo sapiens
cuccaaaaggccuuug

SEQ ID NO: 2178921 - RNA, 12 nt, Homo sapiens
acaaacauuucu

SEQ ID NO: 2178922 - RNA, 18 nt, Homo sapiens
aauaaaacuuaugcuagu

SEQ ID NO: 2178923 - RNA, 17 nt, Homo sapiens
guaaucccagugacuua

SEQ ID NO: 2178924 - RNA, 17 nt, Homo sapiens
ucauuauaucauuggaa

SEQ ID NO: 2178925 - RNA, 13 nt, Homo sapiens
cagccaacagcua

SEQ ID NO: 2178926 - RNA, 18 nt, Homo sapiens
acccagguucuguuuuaa

SEQ ID NO: 2178927 - RNA, 17 nt, Homo sapiens
ucaccuuggagccugaa

SEQ ID NO: 2178928 - RNA, 15 nt, Homo sapiens
auacaaaugcaucuu

SEQ ID NO: 2178929 - RNA, 13 nt, Homo sapiens
auaaauuugcacu

SEQ ID NO: 2178930 - RNA, 20 nt, Homo sapiens
ccaucuucagaccuuuggac

SEQ ID NO: 2178931 - RNA, 20 nt, Homo sapiens
ccacacacacacacaugcau

SEQ ID NO: 2178932 - RNA, 18 nt, Homo sapiens
ucagaaaugcugucauaa

SEQ ID NO: 2178933 - RNA, 22 nt, Homo sapiens
guguauccaugcaccuaccuua

SEQ ID NO: 2178934 - RNA, 12 nt, Homo sapiens
aauucacccucu

SEQ ID NO: 2178935 - RNA, 20 nt, Homo sapiens
cacaugugacacauaugcac

SEQ ID NO: 2178936 - RNA, 19 nt, Homo sapiens
uucaaagauaacauuguua

SEQ ID NO: 2178937 - RNA, 17 nt, Homo sapiens
cuaaagugucaaggugu

SEQ ID NO: 2178938 - RNA, 17 nt, Homo sapiens
cuggcccugugccuugg

SEQ ID NO: 2178939 - RNA, 18 nt, Homo sapiens
ucucuuguccuucacauc

SEQ ID NO: 2178940 - RNA, 20 nt, Homo sapiens
uauauugcaaggugugaugg

SEQ ID NO: 2178941 - RNA, 14 nt, Homo sapiens
aaacagcucugugu

SEQ ID NO: 2178942 - RNA, 20 nt, Homo sapiens
gacuucugggucuccaggga

SEQ ID NO: 2178943 - RNA, 15 nt, Homo sapiens
uaaauuuaauuuaca

SEQ ID NO: 2178944 - RNA, 22 nt, Homo sapiens
augcacuuggccugacucagga

SEQ ID NO: 2178945 - RNA, 19 nt, Homo sapiens
ccaggagcuacucaggaag

SEQ ID NO: 2178946 - RNA, 14 nt, Homo sapiens
uccugccuacccag

SEQ ID NO: 2178947 - RNA, 12 nt, Homo sapiens
aacauguauaaa

SEQ ID NO: 2178948 - RNA, 20 nt, Homo sapiens
cauguaccugaaacauuugg

SEQ ID NO: 2178949 - RNA, 20 nt, Homo sapiens
agcugcucugaaaucuccuu

SEQ ID NO: 2178950 - RNA, 16 nt, Homo sapiens
auuccauacagugaca

SEQ ID NO: 2178951 - RNA, 17 nt, Homo sapiens
ucugccuuagacaaagg

SEQ ID NO: 2178952 - RNA, 22 nt, Homo sapiens
gaggcagcaccaccacacaguc

SEQ ID NO: 2178953 - RNA, 15 nt, Homo sapiens
caaagcaccuugaau

SEQ ID NO: 2178954 - RNA, 16 nt, Homo sapiens
auccuuagcaacagcc

SEQ ID NO: 2178955 - RNA, 20 nt, Homo sapiens
cuugugacccuccaugccaa

SEQ ID NO: 2178956 - RNA, 19 nt, Homo sapiens
aagaucaacgccucacuga

SEQ ID NO: 2178957 - RNA, 18 nt, Homo sapiens
caguauuucuacauuaca

SEQ ID NO: 2178958 - RNA, 19 nt, Homo sapiens
acuuggauaucaacccucu

SEQ ID NO: 2178959 - RNA, 16 nt, Homo sapiens
caaggccuugguguuu

SEQ ID NO: 2178960 - RNA, 13 nt, Homo sapiens
uuaauauuccaau

SEQ ID NO: 2178961 - RNA, 16 nt, Homo sapiens
ugaguauaacucuaac

SEQ ID NO: 2178962 - RNA, 15 nt, Homo sapiens
cauaugcaaacagcc

SEQ ID NO: 2178963 - RNA, 21 nt, Homo sapiens
uccccgugccaaaaaucuuuu

SEQ ID NO: 2178964 - RNA, 17 nt, Homo sapiens
auucuggcagaccaagg

SEQ ID NO: 2178965 - RNA, 20 nt, Homo sapiens
ucaaucaugaguaccucaaa

SEQ ID NO: 2178966 - RNA, 23 nt, Homo sapiens
uaagacuguaauguguacugguc

SEQ ID NO: 2178967 - RNA, 23 nt, Homo sapiens
cuguggaauauaaauagcugaaa

SEQ ID NO: 2178968 - RNA, 16 nt, Homo sapiens
ucaccaugaacaaaga

SEQ ID NO: 2178969 - RNA, 23 nt, Homo sapiens
ucuucaaacaguuccauaccaag

SEQ ID NO: 2178970 - RNA, 11 nt, Homo sapiens
cugcacuuugc

SEQ ID NO: 2178971 - RNA, 22 nt, Homo sapiens
aacuguuaaaggucauaugcac

SEQ ID NO: 2178972 - RNA, 16 nt, Homo sapiens
cuucuauccugcaauu

SEQ ID NO: 2178973 - RNA, 16 nt, Homo sapiens
uguuacucugguucuu

SEQ ID NO: 2178974 - RNA, 13 nt, Homo sapiens
uggguuauccucc

SEQ ID NO: 2178975 - RNA, 14 nt, Homo sapiens
gcccagugaccuga

SEQ ID NO: 2178976 - RNA, 11 nt, Homo sapiens
caaacaugugc

SEQ ID NO: 2178977 - RNA, 20 nt, Homo sapiens
agaacuuucugauucacagu

SEQ ID NO: 2178978 - RNA, 19 nt, Homo sapiens
uaccucccccugccuucca

SEQ ID NO: 2178979 - RNA, 17 nt, Homo sapiens
gcugggccccugggcga

SEQ ID NO: 2178980 - RNA, 12 nt, Homo sapiens
aaguuccaagag

SEQ ID NO: 2178981 - RNA, 14 nt, Homo sapiens
aauuguagccaguu

SEQ ID NO: 2178982 - RNA, 22 nt, Homo sapiens
uaccaggcaggcacgugcacau

SEQ ID NO: 2178983 - RNA, 18 nt, Homo sapiens
auccuccauuugcuguac

SEQ ID NO: 2178984 - RNA, 21 nt, Homo sapiens
aacaaaacccucagcacuguu

SEQ ID NO: 2178985 - RNA, 12 nt, Homo sapiens
aggaacuguaca

SEQ ID NO: 2178986 - RNA, 18 nt, Homo sapiens
gccuuuuucauuuuccaa

SEQ ID NO: 2178987 - RNA, 14 nt, Homo sapiens
ccauuucccauuaa

SEQ ID NO: 2178988 - RNA, 21 nt, Homo sapiens
ugaaaagaaaaccacagcagg

SEQ ID NO: 2178989 - RNA, 19 nt, Homo sapiens
uggcaauuguccccaggga

SEQ ID NO: 2178990 - RNA, 10 nt, Homo sapiens
aaacauuauu

SEQ ID NO: 2178991 - RNA, 15 nt, Homo sapiens
ugcaacagacuugaa

SEQ ID NO: 2178992 - RNA, 22 nt, Homo sapiens
auguccacucaguaacaaguau

SEQ ID NO: 2178993 - RNA, 22 nt, Homo sapiens
uacaauuuggagcauaacugga

SEQ ID NO: 2178994 - RNA, 18 nt, Homo sapiens
ucuuggagaaaauaacaa

SEQ ID NO: 2178995 - RNA, 15 nt, Homo sapiens
auucaguggucuuau

SEQ ID NO: 2178996 - RNA, 15 nt, Homo sapiens
ugcacacacauauau

SEQ ID NO: 2178997 - RNA, 17 nt, Homo sapiens
ccuaugacauuacugua

SEQ ID NO: 2178998 - RNA, 16 nt, Homo sapiens
uggaaagcgccccuca

SEQ ID NO: 2178999 - RNA, 23 nt, Homo sapiens
acaccguggugagcauacagagu

SEQ ID NO: 2179000 - RNA, 20 nt, Homo sapiens
aauaugaguacaaaugccuu

SEQ ID NO: 2179001 - RNA, 15 nt, Homo sapiens
aagaguauguuguaa

SEQ ID NO: 2179002 - RNA, 19 nt, Homo sapiens
uuagcacaaagaugugcaa

SEQ ID NO: 2179003 - RNA, 16 nt, Homo sapiens
aaaaugccacucccua

SEQ ID NO: 2179004 - RNA, 14 nt, Homo sapiens
gagccugcagggaa

SEQ ID NO: 2179005 - RNA, 19 nt, Homo sapiens
uaaugguuaaaaaccaacu

SEQ ID NO: 2179006 - RNA, 17 nt, Homo sapiens
cugcacaaacaauaugu

SEQ ID NO: 2179007 - RNA, 15 nt, Homo sapiens
cgcuggacaccuaca

SEQ ID NO: 2179008 - RNA, 19 nt, Homo sapiens
aggcgcaguggcucaugcc

SEQ ID NO: 2179009 - RNA, 17 nt, Homo sapiens
agaccucaaaucacugc

SEQ ID NO: 2179010 - RNA, 14 nt, Homo sapiens
cagggcacugugcc

SEQ ID NO: 2179011 - RNA, 14 nt, Homo sapiens
aaagaaaugugauu

SEQ ID NO: 2179012 - RNA, 17 nt, Homo sapiens
uuauuggccaaaugccu

SEQ ID NO: 2179013 - RNA, 22 nt, Homo sapiens
caacccagcaguucucugccaa

SEQ ID NO: 2179014 - RNA, 21 nt, Homo sapiens
ugcuccuagagggaggggccu

SEQ ID NO: 2179015 - RNA, 21 nt, Homo sapiens
augugcucagggaauaaucca

SEQ ID NO: 2179016 - RNA, 13 nt, Homo sapiens
ccacaaccaaaaa

SEQ ID NO: 2179017 - RNA, 13 nt, Homo sapiens
uauaagagauuca

SEQ ID NO: 2179018 - RNA, 19 nt, Homo sapiens
cagucacaacagagugaaa

SEQ ID NO: 2179019 - RNA, 21 nt, Homo sapiens
gcgugcugguccccuccucag

SEQ ID NO: 2179020 - RNA, 17 nt, Homo sapiens
uaagggaguuacaucuu

SEQ ID NO: 2179021 - RNA, 14 nt, Homo sapiens
ucuaccucuuccag

SEQ ID NO: 2179022 - RNA, 13 nt, Homo sapiens
uccccuccacugu

SEQ ID NO: 2179023 - RNA, 21 nt, Homo sapiens
gcauccucucuaugggccaua

SEQ ID NO: 2179024 - RNA, 15 nt, Homo sapiens
guaucaaacccacga

SEQ ID NO: 2179025 - RNA, 17 nt, Homo sapiens
caaaaccugauguuaaa

SEQ ID NO: 2179026 - RNA, 14 nt, Homo sapiens
cagaugugcugaca

SEQ ID NO: 2179027 - RNA, 17 nt, Homo sapiens
aauguuggauaaggaau

SEQ ID NO: 2179028 - RNA, 21 nt, Homo sapiens
ugccaggauuuuguauugcca

SEQ ID NO: 2179029 - RNA, 11 nt, Homo sapiens
guugacugugu

SEQ ID NO: 2179030 - RNA, 13 nt, Homo sapiens
gaagugagcugag

SEQ ID NO: 2179031 - RNA, 19 nt, Homo sapiens
uaucauuuucugcauuuaa

SEQ ID NO: 2179032 - RNA, 21 nt, Homo sapiens
accuguugucugaaacauaga

SEQ ID NO: 2179033 - RNA, 14 nt, Homo sapiens
agcuauggccccag

SEQ ID NO: 2179034 - RNA, 22 nt, Homo sapiens
cucaguaauacaauacaguacu

SEQ ID NO: 2179035 - RNA, 22 nt, Homo sapiens
cuuguaaucgauuugucuguca

SEQ ID NO: 2179036 - RNA, 21 nt, Homo sapiens
ggcauucgcagugcccaguga

SEQ ID NO: 2179037 - RNA, 20 nt, Homo sapiens
uaaagaccgggaaaagggaa

SEQ ID NO: 2179038 - RNA, 16 nt, Homo sapiens
uuuaacuagacacaga

SEQ ID NO: 2179039 - RNA, 22 nt, Homo sapiens
ccauuagagaguggcaauagga

SEQ ID NO: 2179040 - RNA, 19 nt, Homo sapiens
cuuguugcccucugcaguu

SEQ ID NO: 2179041 - RNA, 19 nt, Homo sapiens
uaaauaaaccucaaaaugu

SEQ ID NO: 2179042 - RNA, 22 nt, Homo sapiens
ucccuaauccuccaagucuuca

SEQ ID NO: 2179043 - RNA, 23 nt, Homo sapiens
aggugagugugagggcagcacug

SEQ ID NO: 2179044 - RNA, 19 nt, Homo sapiens
ggaugagcaugcuguuuau

SEQ ID NO: 2179045 - RNA, 22 nt, Homo sapiens
cacuugcccugccacuuugcau

SEQ ID NO: 2179046 - RNA, 12 nt, Homo sapiens
ugcauauaguua

SEQ ID NO: 2179047 - RNA, 23 nt, Homo sapiens
aggacacagugaugaauguacua

SEQ ID NO: 2179048 - RNA, 21 nt, Homo sapiens
uuucucauaucaacuuaguca

SEQ ID NO: 2179049 - RNA, 19 nt, Homo sapiens
ugucguuccuuaagcagaa

SEQ ID NO: 2179050 - RNA, 15 nt, Homo sapiens
aauuuuacacucugu

SEQ ID NO: 2179051 - RNA, 15 nt, Homo sapiens
ccuuugagacaguuu

SEQ ID NO: 2179052 - RNA, 20 nt, Homo sapiens
ugucgcccaggcuggagugc

SEQ ID NO: 2179053 - RNA, 22 nt, Homo sapiens
ucuaagauacacugcacuuugu

SEQ ID NO: 2179054 - RNA, 19 nt, Homo sapiens
gcuggaucugguacaaagc

SEQ ID NO: 2179055 - RNA, 13 nt, Homo sapiens
cgauucuuaacaa

SEQ ID NO: 2179056 - RNA, 18 nt, Homo sapiens
cugggacccgaggauuuc

SEQ ID NO: 2179057 - RNA, 23 nt, Homo sapiens
uucacauuugaaauaaaguaauu

SEQ ID NO: 2179058 - RNA, 12 nt, Homo sapiens
ugagacuugaau

SEQ ID NO: 2179059 - RNA, 22 nt, Homo sapiens
augaugcgggccagugcuccag

SEQ ID NO: 2179060 - RNA, 13 nt, Homo sapiens
acuucacuaggca

SEQ ID NO: 2179061 - RNA, 14 nt, Homo sapiens
aaggaaacauauuu

SEQ ID NO: 2179062 - RNA, 19 nt, Homo sapiens
acacucaucuuagugccug

SEQ ID NO: 2179063 - RNA, 12 nt, Homo sapiens
guaucagaauug

SEQ ID NO: 2179064 - RNA, 21 nt, Homo sapiens
guacauuggcugguaacaguu

SEQ ID NO: 2179065 - RNA, 20 nt, Homo sapiens
cgacaucuuggcguggcagc

SEQ ID NO: 2179066 - RNA, 21 nt, Homo sapiens
gaccaauauuguacaguuuuu

SEQ ID NO: 2179067 - RNA, 17 nt, Homo sapiens
uuucaguuauaauuuca

SEQ ID NO: 2179068 - RNA, 17 nt, Homo sapiens
cugcucuugaucugugu

SEQ ID NO: 2179069 - RNA, 15 nt, Homo sapiens
acacugagagagugg

SEQ ID NO: 2179070 - RNA, 23 nt, Homo sapiens
caauagcgugagcuaacugagag

SEQ ID NO: 2179071 - RNA, 19 nt, Homo sapiens
auacuucucuauuaucuca

SEQ ID NO: 2179072 - RNA, 14 nt, Homo sapiens
guuuaaauucccau

SEQ ID NO: 2179073 - RNA, 15 nt, Homo sapiens
acaucuugaaaauau

SEQ ID NO: 2179074 - RNA, 15 nt, Homo sapiens
caugguauugacuca

SEQ ID NO: 2179075 - RNA, 16 nt, Homo sapiens
gcugucuugccccagu

SEQ ID NO: 2179076 - RNA, 19 nt, Homo sapiens
aggccucucggugcuccau

SEQ ID NO: 2179077 - RNA, 15 nt, Homo sapiens
ccccaccagcuuuau

SEQ ID NO: 2179078 - RNA, 15 nt, Homo sapiens
gucuuccacuucaau

SEQ ID NO: 2179079 - RNA, 16 nt, Homo sapiens
cagugccauugucuuu

SEQ ID NO: 2179080 - RNA, 19 nt, Homo sapiens
augcaccacgggcuuuuaa

SEQ ID NO: 2179081 - RNA, 18 nt, Homo sapiens
ugucaccuggcacauuca

SEQ ID NO: 2179082 - RNA, 15 nt, Homo sapiens
cuaaaacaaugaaua

SEQ ID NO: 2179083 - RNA, 20 nt, Homo sapiens
ugaaccauucacagugcaag

SEQ ID NO: 2179084 - RNA, 20 nt, Homo sapiens
gaaauauaacaaguggguga

SEQ ID NO: 2179085 - RNA, 14 nt, Homo sapiens
ccagggcaaaugga

SEQ ID NO: 2179086 - RNA, 14 nt, Homo sapiens
caucaacaacacag

SEQ ID NO: 2179087 - RNA, 15 nt, Homo sapiens
ccagcaguacaauaa

SEQ ID NO: 2179088 - RNA, 18 nt, Homo sapiens
acuaucaaacugaagcca

SEQ ID NO: 2179089 - RNA, 11 nt, Homo sapiens
gaaaauuccau

SEQ ID NO: 2179090 - RNA, 16 nt, Homo sapiens
uguaagcauacuuugu

SEQ ID NO: 2179091 - RNA, 19 nt, Homo sapiens
uaugcugguagcuagugau

SEQ ID NO: 2179092 - RNA, 17 nt, Homo sapiens
ccuuggcuucugugaug

SEQ ID NO: 2179093 - RNA, 22 nt, Homo sapiens
gcacaaaaugggacugcugaag

SEQ ID NO: 2179094 - RNA, 23 nt, Homo sapiens
auauguuagaaucaaauacucau

SEQ ID NO: 2179095 - RNA, 21 nt, Homo sapiens
ugccacauggccgcugcccac

SEQ ID NO: 2179096 - RNA, 23 nt, Homo sapiens
augcagaacaccaauauuaacac

SEQ ID NO: 2179097 - RNA, 14 nt, Homo sapiens
agacaagauggcua

SEQ ID NO: 2179098 - RNA, 13 nt, Homo sapiens
aacacagugcagu

SEQ ID NO: 2179099 - RNA, 21 nt, Homo sapiens
gagaggccuggagcccacaac

SEQ ID NO: 2179100 - RNA, 12 nt, Homo sapiens
auuuccuuccaa

SEQ ID NO: 2179101 - RNA, 13 nt, Homo sapiens
agaaaacauuguu

SEQ ID NO: 2179102 - RNA, 18 nt, Homo sapiens
uccuacaagacacaguga

SEQ ID NO: 2179103 - RNA, 14 nt, Homo sapiens
gaaaagaagacucu

SEQ ID NO: 2179104 - RNA, 15 nt, Homo sapiens
ugcccccagagccac

SEQ ID NO: 2179105 - RNA, 15 nt, Homo sapiens
aaagggugucuauca

SEQ ID NO: 2179106 - RNA, 21 nt, Homo sapiens
caagauuguccuuuucuccca

SEQ ID NO: 2179107 - RNA, 22 nt, Homo sapiens
ugggaugugccgauccuuguca

SEQ ID NO: 2179108 - RNA, 12 nt, Homo sapiens
ugcaagccauaa

SEQ ID NO: 2179109 - RNA, 14 nt, Homo sapiens
cuuguccccgcagc

SEQ ID NO: 2179110 - RNA, 19 nt, Homo sapiens
ugccccagauagguggugc

SEQ ID NO: 2179111 - RNA, 17 nt, Homo sapiens
guauuaagugugcuuau

SEQ ID NO: 2179112 - RNA, 21 nt, Homo sapiens
uucaguucagauaauuggcaa

SEQ ID NO: 2179113 - RNA, 19 nt, Homo sapiens
cauggggggagcacccuga

SEQ ID NO: 2179114 - RNA, 13 nt, Homo sapiens
caagaugcaaaug

SEQ ID NO: 2179115 - RNA, 19 nt, Homo sapiens
cauauaguuggugcucaau

SEQ ID NO: 2179116 - RNA, 16 nt, Homo sapiens
uuauugaagcagagug

SEQ ID NO: 2179117 - RNA, 17 nt, Homo sapiens
ccccugucucaggguga

SEQ ID NO: 2179118 - RNA, 20 nt, Homo sapiens
uuaaaauguauuuuucacaa

SEQ ID NO: 2179119 - RNA, 20 nt, Homo sapiens
acaccugaaaauuaugaguc

SEQ ID NO: 2179120 - RNA, 21 nt, Homo sapiens
agagggugccuggacucagca

SEQ ID NO: 2179121 - RNA, 21 nt, Homo sapiens
ucacacuauggcagccaucca

SEQ ID NO: 2179122 - RNA, 18 nt, Homo sapiens
uagagcugggaaucuuuu

SEQ ID NO: 2179123 - RNA, 17 nt, Homo sapiens
cagguggcucagugcca

SEQ ID NO: 2179124 - RNA, 17 nt, Homo sapiens
uuggaggggaaaugggg

SEQ ID NO: 2179125 - RNA, 22 nt, Homo sapiens
uuccaguugcaauucauaacua

SEQ ID NO: 2179126 - RNA, 19 nt, Homo sapiens
aggaucccugaucccauuu

SEQ ID NO: 2179127 - RNA, 18 nt, Homo sapiens
ucaauuuugucuguacuc

SEQ ID NO: 2179128 - RNA, 16 nt, Homo sapiens
cagagaugugccccca

SEQ ID NO: 2179129 - RNA, 13 nt, Homo sapiens
aucaacacugcgc

SEQ ID NO: 2179130 - RNA, 14 nt, Homo sapiens
ugcccugccugcau

SEQ ID NO: 2179131 - RNA, 13 nt, Homo sapiens
ucacaacagugaa

SEQ ID NO: 2179132 - RNA, 12 nt, Homo sapiens
uucacucccacc

SEQ ID NO: 2179133 - RNA, 15 nt, Homo sapiens
ugggacugcugcuuc

SEQ ID NO: 2179134 - RNA, 19 nt, Homo sapiens
augcaguacaggacauaua

SEQ ID NO: 2179135 - RNA, 13 nt, Homo sapiens
uugaaaaauugcc

SEQ ID NO: 2179136 - RNA, 13 nt, Homo sapiens
ugaacaaaugaca

SEQ ID NO: 2179137 - RNA, 22 nt, Homo sapiens
agugauuguaguuuaauacagg

SEQ ID NO: 2179138 - RNA, 14 nt, Homo sapiens
uucugagugaaugu

SEQ ID NO: 2179139 - RNA, 15 nt, Homo sapiens
aaauauugauuucau

SEQ ID NO: 2179140 - RNA, 21 nt, Homo sapiens
aaaaagcaggaaaaaaggaau

SEQ ID NO: 2179141 - RNA, 22 nt, Homo sapiens
agcaaaaguagccaucauuccu

SEQ ID NO: 2179142 - RNA, 14 nt, Homo sapiens
aaagcaagacccua

SEQ ID NO: 2179143 - RNA, 23 nt, Homo sapiens
agcagaucuucuuuauaacuauu

SEQ ID NO: 2179144 - RNA, 17 nt, Homo sapiens
ucugcuuaaucugagaa

SEQ ID NO: 2179145 - RNA, 14 nt, Homo sapiens
aucuggagucuucc

SEQ ID NO: 2179146 - RNA, 16 nt, Homo sapiens
cuguaaggcucuagau

SEQ ID NO: 2179147 - RNA, 22 nt, Homo sapiens
uaaagcuauuuaugggccccug

SEQ ID NO: 2179148 - RNA, 19 nt, Homo sapiens
acacauuaagccuuccaca

SEQ ID NO: 2179149 - RNA, 17 nt, Homo sapiens
agcccaauaucagcucu

SEQ ID NO: 2179150 - RNA, 14 nt, Homo sapiens
gaaaaccacuuuau

SEQ ID NO: 2179151 - RNA, 23 nt, Homo sapiens
ugauuugauaccauggcacugac

SEQ ID NO: 2179152 - RNA, 21 nt, Homo sapiens
acuaggaccucauaucuuccu

SEQ ID NO: 2179153 - RNA, 17 nt, Homo sapiens
gaggacacaguuucuau

SEQ ID NO: 2179154 - RNA, 17 nt, Homo sapiens
aguugaagccgucucau

SEQ ID NO: 2179155 - RNA, 14 nt, Homo sapiens
ugcaccauggagac

SEQ ID NO: 2179156 - RNA, 23 nt, Homo sapiens
aaugacaacaaaagggaaaaaag

SEQ ID NO: 2179157 - RNA, 18 nt, Homo sapiens
ccgguucaggaccacuuu

SEQ ID NO: 2179158 - RNA, 13 nt, Homo sapiens
caauaacuagcuu

SEQ ID NO: 2179159 - RNA, 13 nt, Homo sapiens
cacauacuagaaa

SEQ ID NO: 2179160 - RNA, 15 nt, Homo sapiens
ugaaaaugaaagugu

SEQ ID NO: 2179161 - RNA, 16 nt, Homo sapiens
gcugcuggcugugaca

SEQ ID NO: 2179162 - RNA, 22 nt, Homo sapiens
uauaagcuauaucauaaauaca

SEQ ID NO: 2179163 - RNA, 23 nt, Homo sapiens
gaaacauuuacuuuugcuuucua

SEQ ID NO: 2179164 - RNA, 22 nt, Homo sapiens
ugcuuaaacuaaugaacaaaua

SEQ ID NO: 2179165 - RNA, 22 nt, Homo sapiens
uggcuugccucuugcaauucaa

SEQ ID NO: 2179166 - RNA, 13 nt, Homo sapiens
aucuucucagcuc

SEQ ID NO: 2179167 - RNA, 17 nt, Homo sapiens
ucuuucucuacuuugag

SEQ ID NO: 2179168 - RNA, 16 nt, Homo sapiens
agccgggcacagcccu

SEQ ID NO: 2179169 - RNA, 18 nt, Homo sapiens
aagaaacuguuacugucc

SEQ ID NO: 2179170 - RNA, 21 nt, Homo sapiens
gugaccccuccuugucagggu

SEQ ID NO: 2179171 - RNA, 16 nt, Homo sapiens
aacagaaaaauaugua

SEQ ID NO: 2179172 - RNA, 16 nt, Homo sapiens
ugcuacugaugggaau

SEQ ID NO: 2179173 - RNA, 15 nt, Homo sapiens
ugagcagagaacuga

SEQ ID NO: 2179174 - RNA, 15 nt, Homo sapiens
ccaagguauugagac

SEQ ID NO: 2179175 - RNA, 13 nt, Homo sapiens
ucaaucacugucc

SEQ ID NO: 2179176 - RNA, 17 nt, Homo sapiens
ucagccuccuugaagcu

SEQ ID NO: 2179177 - RNA, 12 nt, Homo sapiens
uguagacugugu

SEQ ID NO: 2179178 - RNA, 17 nt, Homo sapiens
uauauguguguguauau

SEQ ID NO: 2179179 - RNA, 18 nt, Homo sapiens
gaagcggucacagaucac

SEQ ID NO: 2179180 - RNA, 14 nt, Homo sapiens
gcacuuuccacugg

SEQ ID NO: 2179181 - RNA, 22 nt, Homo sapiens
aaauagagcuuuuaaaaauguc

SEQ ID NO: 2179182 - RNA, 16 nt, Homo sapiens
uugccaaccuguaaua

SEQ ID NO: 2179183 - RNA, 16 nt, Homo sapiens
uaucccuacauuacac

SEQ ID NO: 2179184 - RNA, 15 nt, Homo sapiens
acaaucuugucauac

SEQ ID NO: 2179185 - RNA, 13 nt, Homo sapiens
caaagcagugcau

SEQ ID NO: 2179186 - RNA, 14 nt, Homo sapiens
aaguggcaaaaaua

SEQ ID NO: 2179187 - RNA, 19 nt, Homo sapiens
cauggccaccccgugccac

SEQ ID NO: 2179188 - RNA, 15 nt, Homo sapiens
aaaccaugagaauuu

SEQ ID NO: 2179189 - RNA, 16 nt, Homo sapiens
ggcuguggagaggguc

SEQ ID NO: 2179190 - RNA, 23 nt, Homo sapiens
agggaaagguaaauacaagugaa

SEQ ID NO: 2179191 - RNA, 13 nt, Homo sapiens
agaguuguucucu

SEQ ID NO: 2179192 - RNA, 20 nt, Homo sapiens
ggagcagggagagcucacca

SEQ ID NO: 2179193 - RNA, 16 nt, Homo sapiens
cugcagcuuccaggcu

SEQ ID NO: 2179194 - RNA, 18 nt, Homo sapiens
aagaacaggccucuccau

SEQ ID NO: 2179195 - RNA, 17 nt, Homo sapiens
gacucugucuggccagg

SEQ ID NO: 2179196 - RNA, 15 nt, Homo sapiens
auuccaaaguuuuga

SEQ ID NO: 2179197 - RNA, 15 nt, Homo sapiens
aguccguagguuuau

SEQ ID NO: 2179198 - RNA, 14 nt, Homo sapiens
aaauacauacuaua

SEQ ID NO: 2179199 - RNA, 18 nt, Homo sapiens
cuccacucucuaccagau

SEQ ID NO: 2179200 - RNA, 16 nt, Homo sapiens
gguacugagcagccac

SEQ ID NO: 2179201 - RNA, 17 nt, Homo sapiens
augaacauauuguugaa

SEQ ID NO: 2179202 - RNA, 23 nt, Homo sapiens
auccugccauccuugacuuugaa

SEQ ID NO: 2179203 - RNA, 17 nt, Homo sapiens
aguuaaacuuuaucuca

SEQ ID NO: 2179204 - RNA, 13 nt, Homo sapiens
ucccuuuccugag

SEQ ID NO: 2179205 - RNA, 20 nt, Homo sapiens
gaugcgggacugcuggcaug

SEQ ID NO: 2179206 - RNA, 16 nt, Homo sapiens
aaauuuaauuaccuua

SEQ ID NO: 2179207 - RNA, 20 nt, Homo sapiens
guguucauugacaccaaaua

SEQ ID NO: 2179208 - RNA, 20 nt, Homo sapiens
aggcgugguggugggugccu

SEQ ID NO: 2179209 - RNA, 14 nt, Homo sapiens
cugucucagagaua

SEQ ID NO: 2179210 - RNA, 22 nt, Homo sapiens
gacaggaggauucagcucagga

SEQ ID NO: 2179211 - RNA, 22 nt, Homo sapiens
gucugugauugccuucuuacaa

SEQ ID NO: 2179212 - RNA, 16 nt, Homo sapiens
cagacauuuaucuuuu

SEQ ID NO: 2179213 - RNA, 16 nt, Homo sapiens
ggcuauaagugcucaa

SEQ ID NO: 2179214 - RNA, 13 nt, Homo sapiens
guguuuugcucug

SEQ ID NO: 2179215 - RNA, 17 nt, Homo sapiens
cugggcagcugggcaga

SEQ ID NO: 2179216 - RNA, 17 nt, Homo sapiens
uacauacauacauacaa

SEQ ID NO: 2179217 - RNA, 17 nt, Homo sapiens
auagugcaauagugcaa

SEQ ID NO: 2179218 - RNA, 17 nt, Homo sapiens
aaacuucccaacuuccc

SEQ ID NO: 2179219 - RNA, 17 nt, Homo sapiens
auaaauguguaaaugug

SEQ ID NO: 2179220 - RNA, 17 nt, Homo sapiens
aaccaaccaaccaacca

SEQ ID NO: 2179221 - RNA, 18 nt, Homo sapiens
accaaagggaaggcuucc

SEQ ID NO: 2179222 - RNA, 20 nt, Homo sapiens
agcggcaaaauuaauggaca

SEQ ID NO: 2179223 - RNA, 13 nt, Homo sapiens
caagaugggcaca

SEQ ID NO: 2179224 - RNA, 13 nt, Homo sapiens
gcggcuggcagcc

SEQ ID NO: 2179225 - RNA, 22 nt, Homo sapiens
aauaaacuaguuuccaguggau

SEQ ID NO: 2179226 - RNA, 21 nt, Homo sapiens
cauauauauaguuaugcauac

SEQ ID NO: 2179227 - RNA, 17 nt, Homo sapiens
uguccuccaucaggggu

SEQ ID NO: 2179228 - RNA, 15 nt, Homo sapiens
agcaggaacugagcc

SEQ ID NO: 2179229 - RNA, 20 nt, Homo sapiens
gcaacaggaaggaaccagaa

SEQ ID NO: 2179230 - RNA, 20 nt, Homo sapiens
ccuuggccuccccugcugaa

SEQ ID NO: 2179231 - RNA, 14 nt, Homo sapiens
cagugccuguaauc

SEQ ID NO: 2179232 - RNA, 22 nt, Homo sapiens
ccagguugcugugggugcagcu

SEQ ID NO: 2179233 - RNA, 18 nt, Homo sapiens
gauauauuucauucucuu

SEQ ID NO: 2179234 - RNA, 18 nt, Homo sapiens
uuugcaauaccaaguaua

SEQ ID NO: 2179235 - RNA, 14 nt, Homo sapiens
ucacaccugaccaa

SEQ ID NO: 2179236 - RNA, 16 nt, Homo sapiens
cucuaguuauauugaa

SEQ ID NO: 2179237 - RNA, 19 nt, Homo sapiens
accccuguaaucaggcaag

SEQ ID NO: 2179238 - RNA, 22 nt, Homo sapiens
uagaagcaacuaggaaaaucac

SEQ ID NO: 2179239 - RNA, 23 nt, Homo sapiens
agacaugugcacaugaauccaua

SEQ ID NO: 2179240 - RNA, 13 nt, Homo sapiens
cuuugugcugcgc

SEQ ID NO: 2179241 - RNA, 18 nt, Homo sapiens
cuccaaacccaaccuuuc

SEQ ID NO: 2179242 - RNA, 19 nt, Homo sapiens
ugcucccugucuauguauu

SEQ ID NO: 2179243 - RNA, 18 nt, Homo sapiens
aggacagcuugcuucuuu

SEQ ID NO: 2179244 - RNA, 23 nt, Homo sapiens
uagaauguuacuuuggaaugacu

SEQ ID NO: 2179245 - RNA, 12 nt, Homo sapiens
cuuugccucaag

SEQ ID NO: 2179246 - RNA, 20 nt, Homo sapiens
ccccucccagcugacagucc

SEQ ID NO: 2179247 - RNA, 15 nt, Homo sapiens
uggucauauugccaa

SEQ ID NO: 2179248 - RNA, 14 nt, Homo sapiens
accuacugcacuga

SEQ ID NO: 2179249 - RNA, 23 nt, Homo sapiens
gcagagaccagcccaccccugug

SEQ ID NO: 2179250 - RNA, 21 nt, Homo sapiens
caauacuagucaccccaagua

SEQ ID NO: 2179251 - RNA, 22 nt, Homo sapiens
ugccgguguugaccuuccuuca

SEQ ID NO: 2179252 - RNA, 19 nt, Homo sapiens
agaagaaaaugaaugcugc

SEQ ID NO: 2179253 - RNA, 19 nt, Homo sapiens
cuguucuagacacagugua

SEQ ID NO: 2179254 - RNA, 22 nt, Homo sapiens
agggaggaccauuggcuugcca

SEQ ID NO: 2179255 - RNA, 16 nt, Homo sapiens
ccaaauuuguauuuaa

SEQ ID NO: 2179256 - RNA, 12 nt, Homo sapiens
cuugagcugucc

SEQ ID NO: 2179257 - RNA, 14 nt, Homo sapiens
cuuucugugcccua

SEQ ID NO: 2179258 - RNA, 18 nt, Homo sapiens
gccucagccauucacugc

SEQ ID NO: 2179259 - RNA, 18 nt, Homo sapiens
cugcaaugggcacuggga

SEQ ID NO: 2179260 - RNA, 19 nt, Homo sapiens
uacaucaaugguguguuaa

SEQ ID NO: 2179261 - RNA, 12 nt, Homo sapiens
aaaaagaacaac

SEQ ID NO: 2179262 - RNA, 17 nt, Homo sapiens
agccucaccaaggugac

SEQ ID NO: 2179263 - RNA, 19 nt, Homo sapiens
acagguguuuauacagcuc

SEQ ID NO: 2179264 - RNA, 17 nt, Homo sapiens
uggggcauggcaaauca

SEQ ID NO: 2179265 - RNA, 19 nt, Homo sapiens
uggcuccaacacugcugcu

SEQ ID NO: 2179266 - RNA, 12 nt, Homo sapiens
aauaacauguuu

SEQ ID NO: 2179267 - RNA, 12 nt, Homo sapiens
aucaacaugacu

SEQ ID NO: 2179268 - RNA, 22 nt, Homo sapiens
gggagacuuaggccagagguga

SEQ ID NO: 2179269 - RNA, 22 nt, Homo sapiens
gauguuuuguccccuccaaauc

SEQ ID NO: 2179270 - RNA, 14 nt, Homo sapiens
guuuugccagugau

SEQ ID NO: 2179271 - RNA, 11 nt, Homo sapiens
ugccuuaccuu

SEQ ID NO: 2179272 - RNA, 12 nt, Homo sapiens
uuccccaagauc

SEQ ID NO: 2179273 - RNA, 17 nt, Homo sapiens
ugaguucuauaauauaa

SEQ ID NO: 2179274 - RNA, 14 nt, Homo sapiens
caucuccugacccu

SEQ ID NO: 2179275 - RNA, 19 nt, Homo sapiens
uaagauugcgccugagaua

SEQ ID NO: 2179276 - RNA, 14 nt, Homo sapiens
guuaauauggugua

SEQ ID NO: 2179277 - RNA, 17 nt, Homo sapiens
accaggcuucuuccuac

SEQ ID NO: 2179278 - RNA, 15 nt, Homo sapiens
aguuguugacuguga

SEQ ID NO: 2179279 - RNA, 14 nt, Homo sapiens
agcccuuuacuuga

SEQ ID NO: 2179280 - RNA, 22 nt, Homo sapiens
cuucagcaguguucagagccaa

SEQ ID NO: 2179281 - RNA, 16 nt, Homo sapiens
agaugcaucacugggu

SEQ ID NO: 2179282 - RNA, 14 nt, Homo sapiens
aaaucuuuuaguca

SEQ ID NO: 2179283 - RNA, 17 nt, Homo sapiens
cagcagugaucucaggg

SEQ ID NO: 2179284 - RNA, 15 nt, Homo sapiens
auucauuguggucau

SEQ ID NO: 2179285 - RNA, 16 nt, Homo sapiens
gcuggagacaaggaua

SEQ ID NO: 2179286 - RNA, 17 nt, Homo sapiens
cccaaggcugaugcauu

SEQ ID NO: 2179287 - RNA, 14 nt, Homo sapiens
agcaggagaaucac

SEQ ID NO: 2179288 - RNA, 15 nt, Homo sapiens
uauuugauacauaua

SEQ ID NO: 2179289 - RNA, 14 nt, Homo sapiens
cugaagaaugaaga

SEQ ID NO: 2179290 - RNA, 20 nt, Homo sapiens
ucguaucccgagucugggac

SEQ ID NO: 2179291 - RNA, 16 nt, Homo sapiens
auuccaucagcacaaa

SEQ ID NO: 2179292 - RNA, 11 nt, Homo sapiens
cccagugaauu

SEQ ID NO: 2179293 - RNA, 15 nt, Homo sapiens
aguggugugcucugg

SEQ ID NO: 2179294 - RNA, 14 nt, Homo sapiens
caccgcgugccaug

SEQ ID NO: 2179295 - RNA, 12 nt, Homo sapiens
ucuucuggucug

SEQ ID NO: 2179296 - RNA, 19 nt, Homo sapiens
cuccggggcucagcccuga

SEQ ID NO: 2179297 - RNA, 20 nt, Homo sapiens
cugucuggacuuuccagaga

SEQ ID NO: 2179298 - RNA, 19 nt, Homo sapiens
aaacauugugccaugucaa

SEQ ID NO: 2179299 - RNA, 17 nt, Homo sapiens
uccccucagccaaugaa

SEQ ID NO: 2179300 - RNA, 20 nt, Homo sapiens
acggacagcguguggcagug

SEQ ID NO: 2179301 - RNA, 19 nt, Homo sapiens
uuggucacugcuacaccuu

SEQ ID NO: 2179302 - RNA, 11 nt, Homo sapiens
auuuaauuccu

SEQ ID NO: 2179303 - RNA, 18 nt, Homo sapiens
guccuauuaguguuauau

SEQ ID NO: 2179304 - RNA, 13 nt, Homo sapiens
ugcauugagcucu

SEQ ID NO: 2179305 - RNA, 17 nt, Homo sapiens
cucauucacagcuccuu

SEQ ID NO: 2179306 - RNA, 14 nt, Homo sapiens
gucccaccagggac

SEQ ID NO: 2179307 - RNA, 19 nt, Homo sapiens
auuuucucuggcagcauaa

SEQ ID NO: 2179308 - RNA, 19 nt, Homo sapiens
ucuuacaguggagugagau

SEQ ID NO: 2179309 - RNA, 23 nt, Homo sapiens
uaaaaagaaacagaaaugaccac

SEQ ID NO: 2179310 - RNA, 13 nt, Homo sapiens
uguaauaugggga

SEQ ID NO: 2179311 - RNA, 16 nt, Homo sapiens
auaauguaauuuagcu

SEQ ID NO: 2179312 - RNA, 20 nt, Homo sapiens
uguguuccaacaaccauuuu

SEQ ID NO: 2179313 - RNA, 19 nt, Homo sapiens
uuacaauuauggaaauaua

SEQ ID NO: 2179314 - RNA, 12 nt, Homo sapiens
accccuccaguu

SEQ ID NO: 2179315 - RNA, 14 nt, Homo sapiens
gcacuuucuucucu

SEQ ID NO: 2179316 - RNA, 19 nt, Homo sapiens
uccuguuucuugcucugag

SEQ ID NO: 2179317 - RNA, 14 nt, Homo sapiens
aagaggcugagaca

SEQ ID NO: 2179318 - RNA, 23 nt, Homo sapiens
uucugcuacuccccagaccucag

SEQ ID NO: 2179319 - RNA, 14 nt, Homo sapiens
auuuuauauacaau

SEQ ID NO: 2179320 - RNA, 18 nt, Homo sapiens
gcaauucauguaguuucu

SEQ ID NO: 2179321 - RNA, 20 nt, Homo sapiens
gcaagccuguuccggugaug

SEQ ID NO: 2179322 - RNA, 15 nt, Homo sapiens
cuaauuuuugcaaau

SEQ ID NO: 2179323 - RNA, 16 nt, Homo sapiens
agauccccaagccugg

SEQ ID NO: 2179324 - RNA, 18 nt, Homo sapiens
uauccagcagaucauuua

SEQ ID NO: 2179325 - RNA, 20 nt, Homo sapiens
guggcccuuaugacugccaa

SEQ ID NO: 2179326 - RNA, 12 nt, Homo sapiens
aaaaauauacag

SEQ ID NO: 2179327 - RNA, 13 nt, Homo sapiens
aagcuuuacucuu

SEQ ID NO: 2179328 - RNA, 15 nt, Homo sapiens
accugugcaauauga

SEQ ID NO: 2179329 - RNA, 15 nt, Homo sapiens
aguaaugcaaauuaa

SEQ ID NO: 2179330 - RNA, 14 nt, Homo sapiens
uuccaccucaccuc

SEQ ID NO: 2179331 - RNA, 17 nt, Homo sapiens
cacucauacacaugugc

SEQ ID NO: 2179332 - RNA, 23 nt, Homo sapiens
augaaggugucauacagauuugc

SEQ ID NO: 2179333 - RNA, 14 nt, Homo sapiens
ccauuuugcaaaau

SEQ ID NO: 2179334 - RNA, 13 nt, Homo sapiens
ugguaaccgagcc

SEQ ID NO: 2179335 - RNA, 18 nt, Homo sapiens
uuauuauaaauucuacua

SEQ ID NO: 2179336 - RNA, 13 nt, Homo sapiens
ugauguacucuaa

SEQ ID NO: 2179337 - RNA, 20 nt, Homo sapiens
cccugugcccugcacguaua

SEQ ID NO: 2179338 - RNA, 22 nt, Homo sapiens
gagccuacagaagggcagugac

SEQ ID NO: 2179339 - RNA, 19 nt, Homo sapiens
cuagcaauugguuguuuaa

SEQ ID NO: 2179340 - RNA, 13 nt, Homo sapiens
uucccacauucau

SEQ ID NO: 2179341 - RNA, 24 nt, Homo sapiens
uggccccuucacuucugaccacac

SEQ ID NO: 2179342 - RNA, 16 nt, Homo sapiens
gcucaacuguugccag

SEQ ID NO: 2179343 - RNA, 13 nt, Homo sapiens
accgauggccaug

SEQ ID NO: 2179344 - RNA, 21 nt, Homo sapiens
uaauggcccuguagcucugaa

SEQ ID NO: 2179345 - RNA, 13 nt, Homo sapiens
cuugucacacgag

SEQ ID NO: 2179346 - RNA, 13 nt, Homo sapiens
ugcucagccauaa

SEQ ID NO: 2179347 - RNA, 19 nt, Homo sapiens
ggucagguguucaagacca

SEQ ID NO: 2179348 - RNA, 23 nt, Homo sapiens
gucccagaaugccuccugcaggg

SEQ ID NO: 2179349 - RNA, 16 nt, Homo sapiens
acaaggcgaucccauc

SEQ ID NO: 2179350 - RNA, 16 nt, Homo sapiens
ccaccacccucaggug

SEQ ID NO: 2179351 - RNA, 18 nt, Homo sapiens
cucagcuuucccugccac

SEQ ID NO: 2179352 - RNA, 21 nt, Homo sapiens
aaguugugcaugcaaccagau

SEQ ID NO: 2179353 - RNA, 14 nt, Homo sapiens
cccugcugaccucc

SEQ ID NO: 2179354 - RNA, 17 nt, Homo sapiens
agaaagaagcacucugc

SEQ ID NO: 2179355 - RNA, 17 nt, Homo sapiens
aguccugguccccagaa

SEQ ID NO: 2179356 - RNA, 17 nt, Homo sapiens
cgaaacacacaaaccag

SEQ ID NO: 2179357 - RNA, 20 nt, Homo sapiens
augcuaguucaacagaaagg

SEQ ID NO: 2179358 - RNA, 15 nt, Homo sapiens
ccucucuuucucugg

SEQ ID NO: 2179359 - RNA, 15 nt, Homo sapiens
gugccgaaugugcag

SEQ ID NO: 2179360 - RNA, 12 nt, Homo sapiens
ccugggggacca

SEQ ID NO: 2179361 - RNA, 22 nt, Homo sapiens
aacaaauaaauaagaucagacu

SEQ ID NO: 2179362 - RNA, 22 nt, Homo sapiens
uauccacccagcccauucucuc

SEQ ID NO: 2179363 - RNA, 23 nt, Homo sapiens
aagccaggccuggcuggaggagc

SEQ ID NO: 2179364 - RNA, 16 nt, Homo sapiens
cuuauuaagaccaaag

SEQ ID NO: 2179365 - RNA, 13 nt, Homo sapiens
augagauuggcau

SEQ ID NO: 2179366 - RNA, 18 nt, Homo sapiens
augcugacccaugcaaua

SEQ ID NO: 2179367 - RNA, 13 nt, Homo sapiens
cagauucuucacu

SEQ ID NO: 2179368 - RNA, 23 nt, Homo sapiens
auucauuaccuguuuauucucug

SEQ ID NO: 2179369 - RNA, 21 nt, Homo sapiens
uaaagcccagaucucugcauc

SEQ ID NO: 2179370 - RNA, 12 nt, Homo sapiens
ucuaagccuuug

SEQ ID NO: 2179371 - RNA, 13 nt, Homo sapiens
gggaauccugcua

SEQ ID NO: 2179372 - RNA, 18 nt, Homo sapiens
gucaaauuuggauuuucc

SEQ ID NO: 2179373 - RNA, 17 nt, Homo sapiens
accucaucagcugccua

SEQ ID NO: 2179374 - RNA, 23 nt, Homo sapiens
ugcuguagaaaaaaaaauucaca

SEQ ID NO: 2179375 - RNA, 23 nt, Homo sapiens
cuuaugguuuaggccuugccagu

SEQ ID NO: 2179376 - RNA, 22 nt, Homo sapiens
gucuuugguuauuucugugcaa

SEQ ID NO: 2179377 - RNA, 22 nt, Homo sapiens
aacucuuuaaguugaaaaguaa

SEQ ID NO: 2179378 - RNA, 21 nt, Homo sapiens
uaucccuagauagcuauuaag

SEQ ID NO: 2179379 - RNA, 22 nt, Homo sapiens
uaacaaccagagaugacugaaa

SEQ ID NO: 2179380 - RNA, 16 nt, Homo sapiens
uaugaacaacuccaaa

SEQ ID NO: 2179381 - RNA, 21 nt, Homo sapiens
aacaaagggauguucacugua

SEQ ID NO: 2179382 - RNA, 19 nt, Homo sapiens
augaaaaaauacagguguc

SEQ ID NO: 2179383 - RNA, 19 nt, Homo sapiens
caaaagccuuaccuugaaa

SEQ ID NO: 2179384 - RNA, 20 nt, Homo sapiens
uucccugauuuaauaugcaa

SEQ ID NO: 2179385 - RNA, 20 nt, Homo sapiens
gaagacacgagcgaaugauu

SEQ ID NO: 2179386 - RNA, 21 nt, Homo sapiens
aucuugugacccuccaugcca

SEQ ID NO: 2179387 - RNA, 23 nt, Homo sapiens
cacauuugucaguauuuuugccg

SEQ ID NO: 2179388 - RNA, 14 nt, Homo sapiens
caccguguuagcca

SEQ ID NO: 2179389 - RNA, 16 nt, Homo sapiens
ucucaagaacugccau

SEQ ID NO: 2179390 - RNA, 19 nt, Homo sapiens
aaccagcucuuuggugcca

SEQ ID NO: 2179391 - RNA, 20 nt, Homo sapiens
uuugggugcuguuuugccag

SEQ ID NO: 2179392 - RNA, 13 nt, Homo sapiens
cccauucuugagu

SEQ ID NO: 2179393 - RNA, 14 nt, Homo sapiens
acugagagcgagau

SEQ ID NO: 2179394 - RNA, 12 nt, Homo sapiens
ucauugcacuuu

SEQ ID NO: 2179395 - RNA, 20 nt, Homo sapiens
gggcaggguggggagggagc

SEQ ID NO: 2179396 - RNA, 13 nt, Homo sapiens
uuuccaugauaca

SEQ ID NO: 2179397 - RNA, 15 nt, Homo sapiens
auucauugugauuua

SEQ ID NO: 2179398 - RNA, 21 nt, Homo sapiens
uugggaaaagcccacaggccu

SEQ ID NO: 2179399 - RNA, 20 nt, Homo sapiens
accuuggcccaggagcucug

SEQ ID NO: 2179400 - RNA, 21 nt, Homo sapiens
uuaagcagaggaauaacauca

SEQ ID NO: 2179401 - RNA, 13 nt, Homo sapiens
cagggaagccaaa

SEQ ID NO: 2179402 - RNA, 16 nt, Homo sapiens
ccauuucaaagacuca

SEQ ID NO: 2179403 - RNA, 23 nt, Homo sapiens
agaccuggcggaggcuuuuccca

SEQ ID NO: 2179404 - RNA, 14 nt, Homo sapiens
guucaccugaauca

SEQ ID NO: 2179405 - RNA, 18 nt, Homo sapiens
caggagcccacagugccu

SEQ ID NO: 2179406 - RNA, 9 nt, Homo sapiens
uacuuguca

SEQ ID NO: 2179407 - RNA, 20 nt, Homo sapiens
uugugaauugcuugguugua

SEQ ID NO: 2179408 - RNA, 20 nt, Homo sapiens
uuaaaaauaaagcuacugaa

SEQ ID NO: 2179409 - RNA, 22 nt, Homo sapiens
aucuacuuggcaaggucauaga

SEQ ID NO: 2179410 - RNA, 21 nt, Homo sapiens
auucauaguggauuaaugcau

SEQ ID NO: 2179411 - RNA, 20 nt, Homo sapiens
agaaaguguuuaacuuguca

SEQ ID NO: 2179412 - RNA, 10 nt, Homo sapiens
uuugguucua

SEQ ID NO: 2179413 - RNA, 17 nt, Homo sapiens
ccuagucucacaugucc

SEQ ID NO: 2179414 - RNA, 19 nt, Homo sapiens
acuauuaccaccaccugcu

SEQ ID NO: 2179415 - RNA, 22 nt, Homo sapiens
acaucccaguccaccugaggaa

SEQ ID NO: 2179416 - RNA, 15 nt, Homo sapiens
ugcaguaucaucuga

SEQ ID NO: 2179417 - RNA, 22 nt, Homo sapiens
acauaacuucagauacuuguga

SEQ ID NO: 2179418 - RNA, 16 nt, Homo sapiens
uguuuguuucauauau

SEQ ID NO: 2179419 - RNA, 16 nt, Homo sapiens
cacaaccuuccagcuc

SEQ ID NO: 2179420 - RNA, 18 nt, Homo sapiens
aguucuuggccuaugaua

SEQ ID NO: 2179421 - RNA, 21 nt, Homo sapiens
cuuuugguuaugaauacuuug

SEQ ID NO: 2179422 - RNA, 19 nt, Homo sapiens
agcuuucugcuaucaaaga

SEQ ID NO: 2179423 - RNA, 21 nt, Homo sapiens
uugaacuaagcaucuuuauau

SEQ ID NO: 2179424 - RNA, 14 nt, Homo sapiens
gagugcuggcacuu

SEQ ID NO: 2179425 - RNA, 16 nt, Homo sapiens
auuuuacaagucaaaa

SEQ ID NO: 2179426 - RNA, 12 nt, Homo sapiens
acuaaaugagac

SEQ ID NO: 2179427 - RNA, 22 nt, Homo sapiens
uccagggcagcaggccagagaa

SEQ ID NO: 2179428 - RNA, 21 nt, Homo sapiens
aauuuuacucacucacucuga

SEQ ID NO: 2179429 - RNA, 20 nt, Homo sapiens
aaacuaccucaaaacacuuu

SEQ ID NO: 2179430 - RNA, 17 nt, Homo sapiens
agaaaucauacugcaua

SEQ ID NO: 2179431 - RNA, 17 nt, Homo sapiens
uacagucaagauacaua

SEQ ID NO: 2179432 - RNA, 18 nt, Homo sapiens
gcauucuaagucacagga

SEQ ID NO: 2179433 - RNA, 12 nt, Homo sapiens
ggagugcaaugg

SEQ ID NO: 2179434 - RNA, 20 nt, Homo sapiens
ugaacugaaaacaagccaug

SEQ ID NO: 2179435 - RNA, 19 nt, Homo sapiens
gauccuguuccucaacaag

SEQ ID NO: 2179436 - RNA, 17 nt, Homo sapiens
aacauucuuuuccacuu

SEQ ID NO: 2179437 - RNA, 16 nt, Homo sapiens
cuaaaguauacaacug

SEQ ID NO: 2179438 - RNA, 22 nt, Homo sapiens
aacguggguauuuccugcuaca

SEQ ID NO: 2179439 - RNA, 16 nt, Homo sapiens
uucaaguuccacuucu

SEQ ID NO: 2179440 - RNA, 18 nt, Homo sapiens
guggaaagugaauuugaa

SEQ ID NO: 2179441 - RNA, 16 nt, Homo sapiens
uagcuauugcagcuua

SEQ ID NO: 2179442 - RNA, 19 nt, Homo sapiens
ccgcuagguagagucugag

SEQ ID NO: 2179443 - RNA, 16 nt, Homo sapiens
aucaaaagugaucagc

SEQ ID NO: 2179444 - RNA, 21 nt, Homo sapiens
gucugugaguaccuggucaua

SEQ ID NO: 2179445 - RNA, 21 nt, Homo sapiens
auuuaguuuguagcucauuaa

SEQ ID NO: 2179446 - RNA, 18 nt, Homo sapiens
ggcccauggcuguuggug

SEQ ID NO: 2179447 - RNA, 20 nt, Homo sapiens
augucauagguaagaaacac

SEQ ID NO: 2179448 - RNA, 20 nt, Homo sapiens
aacauuucaccccacucugu

SEQ ID NO: 2179449 - RNA, 12 nt, Homo sapiens
uaggcauguaaa

SEQ ID NO: 2179450 - RNA, 16 nt, Homo sapiens
ccuacagaagggcagu

SEQ ID NO: 2179451 - RNA, 21 nt, Homo sapiens
guacaaaagaagggcugguau

SEQ ID NO: 2179452 - RNA, 22 nt, Homo sapiens
ucuguauuccuagaaacugaca

SEQ ID NO: 2179453 - RNA, 21 nt, Homo sapiens
ucucccucuuucucaguuccu

SEQ ID NO: 2179454 - RNA, 20 nt, Homo sapiens
gaaagccucagccauucacu

SEQ ID NO: 2179455 - RNA, 15 nt, Homo sapiens
uaacaagccaaacau

SEQ ID NO: 2179456 - RNA, 21 nt, Homo sapiens
gagaccagcuucuagcagcua

SEQ ID NO: 2179457 - RNA, 12 nt, Homo sapiens
ggcuucuucaac

SEQ ID NO: 2179458 - RNA, 22 nt, Homo sapiens
ccccgucucuauaccaaccaaa

SEQ ID NO: 2179459 - RNA, 20 nt, Homo sapiens
gacaaccaaguaugaaucua

SEQ ID NO: 2179460 - RNA, 20 nt, Homo sapiens
agaaaccuggggugaauacu

SEQ ID NO: 2179461 - RNA, 14 nt, Homo sapiens
augcccuccaugug

SEQ ID NO: 2179462 - RNA, 21 nt, Homo sapiens
uugacuuccccacugcucucu

SEQ ID NO: 2179463 - RNA, 19 nt, Homo sapiens
uccuggaggugacacuuga

SEQ ID NO: 2179464 - RNA, 23 nt, Homo sapiens
gauguccaaacuuaacagaucac

SEQ ID NO: 2179465 - RNA, 22 nt, Homo sapiens
cauauucacugguuuauuugca

SEQ ID NO: 2179466 - RNA, 16 nt, Homo sapiens
cuaaucagugucucac

SEQ ID NO: 2179467 - RNA, 19 nt, Homo sapiens
aacaaccugaaugucccaa

SEQ ID NO: 2179468 - RNA, 21 nt, Homo sapiens
gaggccucaggugcuguccau

SEQ ID NO: 2179469 - RNA, 22 nt, Homo sapiens
aacagagcaagacccugucuca

SEQ ID NO: 2179470 - RNA, 17 nt, Homo sapiens
uauauauuuuguguaua

SEQ ID NO: 2179471 - RNA, 23 nt, Homo sapiens
auagagacggagauccuaagguc

SEQ ID NO: 2179472 - RNA, 19 nt, Homo sapiens
gcugucuaaaaugcagugg

SEQ ID NO: 2179473 - RNA, 20 nt, Homo sapiens
gaauauuuuaagaauuucac

SEQ ID NO: 2179474 - RNA, 21 nt, Homo sapiens
cugugagaccaaauugagcua

SEQ ID NO: 2179475 - RNA, 20 nt, Homo sapiens
cugugugggaaaauggcaga

SEQ ID NO: 2179476 - RNA, 15 nt, Homo sapiens
ccgaaacuaagccag

SEQ ID NO: 2179477 - RNA, 18 nt, Homo sapiens
auuuuuugucugugauaa

SEQ ID NO: 2179478 - RNA, 10 nt, Homo sapiens
ucuccaccuc

SEQ ID NO: 2179479 - RNA, 10 nt, Homo sapiens
uuuccaccuu

SEQ ID NO: 2179480 - RNA, 21 nt, Homo sapiens
uaacaaagacuucugucauaa

SEQ ID NO: 2179481 - RNA, 19 nt, Homo sapiens
guucaaagugugacauuca

SEQ ID NO: 2179482 - RNA, 22 nt, Homo sapiens
cccgaggacgcucccugcucca

SEQ ID NO: 2179483 - RNA, 15 nt, Homo sapiens
gcugggucacaucca

SEQ ID NO: 2179484 - RNA, 12 nt, Homo sapiens
aauuaugccaua

SEQ ID NO: 2179485 - RNA, 13 nt, Homo sapiens
cgcugucaaaagu

SEQ ID NO: 2179486 - RNA, 18 nt, Homo sapiens
uguggguguacauuuugu

SEQ ID NO: 2179487 - RNA, 13 nt, Homo sapiens
ggcuucuccugac

SEQ ID NO: 2179488 - RNA, 17 nt, Homo sapiens
gcucccacuucuuggga

SEQ ID NO: 2179489 - RNA, 17 nt, Homo sapiens
acuugaacucacucccu

SEQ ID NO: 2179490 - RNA, 22 nt, Homo sapiens
aagugacauugugucaguuuca

SEQ ID NO: 2179491 - RNA, 14 nt, Homo sapiens
gaaaagcaggcaaa

SEQ ID NO: 2179492 - RNA, 11 nt, Homo sapiens
agaagcuuugu

SEQ ID NO: 2179493 - RNA, 10 nt, Homo sapiens
gcaugugcag

SEQ ID NO: 2179494 - RNA, 15 nt, Homo sapiens
aacaaaaccaacuca

SEQ ID NO: 2179495 - RNA, 17 nt, Homo sapiens
gaacucugggcacuuuu

SEQ ID NO: 2179496 - RNA, 19 nt, Homo sapiens
caaacccauggcucuauuu

SEQ ID NO: 2179497 - RNA, 16 nt, Homo sapiens
aacacugugaagacaa

SEQ ID NO: 2179498 - RNA, 15 nt, Homo sapiens
auuuuccaggcuucu

SEQ ID NO: 2179499 - RNA, 16 nt, Homo sapiens
caaauaucuugaaagg

SEQ ID NO: 2179500 - RNA, 17 nt, Homo sapiens
ucccccagcccugucau

SEQ ID NO: 2179501 - RNA, 18 nt, Homo sapiens
accuuaacucagccagaa

SEQ ID NO: 2179502 - RNA, 23 nt, Homo sapiens
auuauucauuagggaaaugcaag

SEQ ID NO: 2179503 - RNA, 19 nt, Homo sapiens
uauuagaagcuaucaauca

SEQ ID NO: 2179504 - RNA, 15 nt, Homo sapiens
ccacagggucugcac

SEQ ID NO: 2179505 - RNA, 17 nt, Homo sapiens
aaagaacuaaauaugca

SEQ ID NO: 2179506 - RNA, 12 nt, Homo sapiens
caguuuuugccu

SEQ ID NO: 2179507 - RNA, 17 nt, Homo sapiens
ccacccuugucccucag

SEQ ID NO: 2179508 - RNA, 11 nt, Homo sapiens
uugcaccagcg

SEQ ID NO: 2179509 - RNA, 22 nt, Homo sapiens
gucucuuucucugacacugugu

SEQ ID NO: 2179510 - RNA, 21 nt, Homo sapiens
aucaagugugcuuuagcuuga

SEQ ID NO: 2179511 - RNA, 21 nt, Homo sapiens
gggcagagguccccugagguc

SEQ ID NO: 2179512 - RNA, 14 nt, Homo sapiens
guuuccacuggcuu

SEQ ID NO: 2179513 - RNA, 15 nt, Homo sapiens
uccucaccaagcuca

SEQ ID NO: 2179514 - RNA, 20 nt, Homo sapiens
uaaucuccacuuuuuucaua

SEQ ID NO: 2179515 - RNA, 18 nt, Homo sapiens
gcaggccucagcaucucc

SEQ ID NO: 2179516 - RNA, 17 nt, Homo sapiens
gaguaaucuguguacaa

SEQ ID NO: 2179517 - RNA, 22 nt, Homo sapiens
cuccccauccccgucugaccaa

SEQ ID NO: 2179518 - RNA, 15 nt, Homo sapiens
ugccauggggccauc

SEQ ID NO: 2179519 - RNA, 14 nt, Homo sapiens
caucacacucucca

SEQ ID NO: 2179520 - RNA, 18 nt, Homo sapiens
gccuucuaguuaccacau

SEQ ID NO: 2179521 - RNA, 15 nt, Homo sapiens
agugagccagcagug

SEQ ID NO: 2179522 - RNA, 20 nt, Homo sapiens
acaaaagcccgccuaacuca

SEQ ID NO: 2179523 - RNA, 22 nt, Homo sapiens
gcuucugcugcccugaugcguc

SEQ ID NO: 2179524 - RNA, 20 nt, Homo sapiens
ucgucugcgcagugguugcu

SEQ ID NO: 2179525 - RNA, 16 nt, Homo sapiens
ugacaccuuaguuccu

SEQ ID NO: 2179526 - RNA, 18 nt, Homo sapiens
cuaagaaagacaucacau

SEQ ID NO: 2179527 - RNA, 21 nt, Homo sapiens
cacaaggugcucagacaugaa

SEQ ID NO: 2179528 - RNA, 13 nt, Homo sapiens
ucucacagcaaca

SEQ ID NO: 2179529 - RNA, 14 nt, Homo sapiens
gacccaaccacaga

SEQ ID NO: 2179530 - RNA, 12 nt, Homo sapiens
ucuauacuuugu

SEQ ID NO: 2179531 - RNA, 13 nt, Homo sapiens
cuccucaugccuu

SEQ ID NO: 2179532 - RNA, 16 nt, Homo sapiens
augacgggaaaaccaa

SEQ ID NO: 2179533 - RNA, 16 nt, Homo sapiens
cuggcuggcugugucc

SEQ ID NO: 2179534 - RNA, 18 nt, Homo sapiens
ccuaaaacaaaagcucau

SEQ ID NO: 2179535 - RNA, 21 nt, Homo sapiens
uugagcccuccccaggaauuu

SEQ ID NO: 2179536 - RNA, 15 nt, Homo sapiens
uggagcugacuguuc

SEQ ID NO: 2179537 - RNA, 19 nt, Homo sapiens
gcucucuuuccuucuugcc

SEQ ID NO: 2179538 - RNA, 19 nt, Homo sapiens
aauuucccccuaaaccaac

SEQ ID NO: 2179539 - RNA, 15 nt, Homo sapiens
ccaacucacuuccag

SEQ ID NO: 2179540 - RNA, 12 nt, Homo sapiens
gagcaacaguaa

SEQ ID NO: 2179541 - RNA, 12 nt, Homo sapiens
guaaaacagagc

SEQ ID NO: 2179542 - RNA, 20 nt, Homo sapiens
gaagccaggugagaaaacca

SEQ ID NO: 2179543 - RNA, 23 nt, Homo sapiens
ugagauuaugaugaaaaccuaca

SEQ ID NO: 2179544 - RNA, 21 nt, Homo sapiens
gcccccaccgugggcagggag

SEQ ID NO: 2179545 - RNA, 17 nt, Homo sapiens
ugacuuacugacaaaag

SEQ ID NO: 2179546 - RNA, 20 nt, Homo sapiens
ucauaggaaaaguacauuua

SEQ ID NO: 2179547 - RNA, 21 nt, Homo sapiens
aagcgagucacgaaugauuaa

SEQ ID NO: 2179548 - RNA, 18 nt, Homo sapiens
ucuacuuguuuuucccau

SEQ ID NO: 2179549 - RNA, 19 nt, Homo sapiens
cuggccacugaaaagcuuu

SEQ ID NO: 2179550 - RNA, 16 nt, Homo sapiens
auuuuauaaagaggca

SEQ ID NO: 2179551 - RNA, 16 nt, Homo sapiens
cuuccagugaacauuc

SEQ ID NO: 2179552 - RNA, 19 nt, Homo sapiens
agaaagccuucauaagccu

SEQ ID NO: 2179553 - RNA, 13 nt, Homo sapiens
uccaugccuuuaa

SEQ ID NO: 2179554 - RNA, 18 nt, Homo sapiens
ccuccagggugauuuuau

SEQ ID NO: 2179555 - RNA, 16 nt, Homo sapiens
auugucuacucugaag

SEQ ID NO: 2179556 - RNA, 14 nt, Homo sapiens
uacauaugcuuuaa

SEQ ID NO: 2179557 - RNA, 14 nt, Homo sapiens
ugacaaagugccgu

SEQ ID NO: 2179558 - RNA, 16 nt, Homo sapiens
gaaaauaaacaucuga

SEQ ID NO: 2179559 - RNA, 17 nt, Homo sapiens
acugugagaacugugaa

SEQ ID NO: 2179560 - RNA, 15 nt, Homo sapiens
auuguguuaacuuau

SEQ ID NO: 2179561 - RNA, 15 nt, Homo sapiens
guauauacaauaaca

SEQ ID NO: 2179562 - RNA, 16 nt, Homo sapiens
agcccagagaccuuca

SEQ ID NO: 2179563 - RNA, 15 nt, Homo sapiens
gaaacuuauuucuca

SEQ ID NO: 2179564 - RNA, 18 nt, Homo sapiens
uccugccuguagcaguga

SEQ ID NO: 2179565 - RNA, 20 nt, Homo sapiens
cauacaccuaugucauuuca

SEQ ID NO: 2179566 - RNA, 15 nt, Homo sapiens
gaucacuaaauaagc

SEQ ID NO: 2179567 - RNA, 20 nt, Homo sapiens
auguuuaaaagcaaaacugc

SEQ ID NO: 2179568 - RNA, 16 nt, Homo sapiens
gggcugagcccuggca

SEQ ID NO: 2179569 - RNA, 17 nt, Homo sapiens
auaaacaaagacauuga

SEQ ID NO: 2179570 - RNA, 21 nt, Homo sapiens
aagagcgcuccucugccuugg

SEQ ID NO: 2179571 - RNA, 17 nt, Homo sapiens
ucaaucuucgacagcug

SEQ ID NO: 2179572 - RNA, 23 nt, Homo sapiens
auagagcuguucaacaucacuga

SEQ ID NO: 2179573 - RNA, 18 nt, Homo sapiens
cagcgccagugacaguca

SEQ ID NO: 2179574 - RNA, 22 nt, Homo sapiens
ugcaaccuaccuguugagcauc

SEQ ID NO: 2179575 - RNA, 20 nt, Homo sapiens
uauguggugguuucuauaca

SEQ ID NO: 2179576 - RNA, 23 nt, Homo sapiens
augcuacuuuuuuuuaguucaau

SEQ ID NO: 2179577 - RNA, 16 nt, Homo sapiens
uaaaccguacacugug

SEQ ID NO: 2179578 - RNA, 14 nt, Homo sapiens
guaguagugucuuc

SEQ ID NO: 2179579 - RNA, 16 nt, Homo sapiens
cccaggugaguccuag

SEQ ID NO: 2179580 - RNA, 16 nt, Homo sapiens
aaggaacucugggcag

SEQ ID NO: 2179581 - RNA, 16 nt, Homo sapiens
gguaggaggaugggcu

SEQ ID NO: 2179582 - RNA, 19 nt, Homo sapiens
cccacauaaauacaguauu

SEQ ID NO: 2179583 - RNA, 16 nt, Homo sapiens
uggccagugacguggu

SEQ ID NO: 2179584 - RNA, 19 nt, Homo sapiens
aaaagguuaaauauuguca

SEQ ID NO: 2179585 - RNA, 13 nt, Homo sapiens
auaauauagcuua

SEQ ID NO: 2179586 - RNA, 19 nt, Homo sapiens
aaggugugagacugggaag

SEQ ID NO: 2179587 - RNA, 19 nt, Homo sapiens
gcaggaaccagcaaugaga

SEQ ID NO: 2179588 - RNA, 17 nt, Homo sapiens
auuuacaguuccuucaa

SEQ ID NO: 2179589 - RNA, 22 nt, Homo sapiens
cugaggccacacucagcacaag

SEQ ID NO: 2179590 - RNA, 13 nt, Homo sapiens
acacacaugcaua

SEQ ID NO: 2179591 - RNA, 21 nt, Homo sapiens
ucuccuuucucuuaugcuuaa

SEQ ID NO: 2179592 - RNA, 17 nt, Homo sapiens
aggaugauguuauucac

SEQ ID NO: 2179593 - RNA, 18 nt, Homo sapiens
gaggacucucacgauaug

SEQ ID NO: 2179594 - RNA, 21 nt, Homo sapiens
guucuccugcugcucccucag

SEQ ID NO: 2179595 - RNA, 14 nt, Homo sapiens
uauucucuaagaua

SEQ ID NO: 2179596 - RNA, 12 nt, Homo sapiens
aaagacacaucu

SEQ ID NO: 2179597 - RNA, 19 nt, Homo sapiens
ucagaauaaagaacauucu

SEQ ID NO: 2179598 - RNA, 15 nt, Homo sapiens
ucucccgucucgccu

SEQ ID NO: 2179599 - RNA, 15 nt, Homo sapiens
guccccuccacuguc

SEQ ID NO: 2179600 - RNA, 17 nt, Homo sapiens
cagccuucguguggcuc

SEQ ID NO: 2179601 - RNA, 19 nt, Homo sapiens
cugucuuaugguccagaaa

SEQ ID NO: 2179602 - RNA, 19 nt, Homo sapiens
agaucugaggaaggccgua

SEQ ID NO: 2179603 - RNA, 16 nt, Homo sapiens
caaguuccacuucuug

SEQ ID NO: 2179604 - RNA, 17 nt, Homo sapiens
uuuuugcaaaugcuuua

SEQ ID NO: 2179605 - RNA, 17 nt, Homo sapiens
uggaguacccagccuau

SEQ ID NO: 2179606 - RNA, 23 nt, Homo sapiens
acaacuuagaaaccaaauuacaa

SEQ ID NO: 2179607 - RNA, 19 nt, Homo sapiens
ccuucuuuccauuucucuc

SEQ ID NO: 2179608 - RNA, 17 nt, Homo sapiens
uacuguaaacaguucug

SEQ ID NO: 2179609 - RNA, 20 nt, Homo sapiens
caggacaacuuuacaaaaca

SEQ ID NO: 2179610 - RNA, 15 nt, Homo sapiens
gugaucaucuuugcu

SEQ ID NO: 2179611 - RNA, 17 nt, Homo sapiens
uuguuuucacuuguauu

SEQ ID NO: 2179612 - RNA, 23 nt, Homo sapiens
guuucaaguuauucaaauuugua

SEQ ID NO: 2179613 - RNA, 14 nt, Homo sapiens
uaauguuacugauc

SEQ ID NO: 2179614 - RNA, 17 nt, Homo sapiens
ugagccauuaucaguca

SEQ ID NO: 2179615 - RNA, 22 nt, Homo sapiens
uggcucuauuggauuuguccaa

SEQ ID NO: 2179616 - RNA, 21 nt, Homo sapiens
gggagauaggccuugcuugcu

SEQ ID NO: 2179617 - RNA, 23 nt, Homo sapiens
uuucaagaaaggcaagagcucaa

SEQ ID NO: 2179618 - RNA, 17 nt, Homo sapiens
ugaacacaggcagcuuu

SEQ ID NO: 2179619 - RNA, 21 nt, Homo sapiens
ucacaaugccuagacugugua

SEQ ID NO: 2179620 - RNA, 19 nt, Homo sapiens
uucauuccuuccacuaacu

SEQ ID NO: 2179621 - RNA, 19 nt, Homo sapiens
aguuuucuguucagcuuuu

SEQ ID NO: 2179622 - RNA, 14 nt, Homo sapiens
aaaaugcugucaca

SEQ ID NO: 2179623 - RNA, 15 nt, Homo sapiens
aagggaaaacccuca

SEQ ID NO: 2179624 - RNA, 17 nt, Homo sapiens
ccugcuguugguccucu

SEQ ID NO: 2179625 - RNA, 14 nt, Homo sapiens
gaagagaaccucaa

SEQ ID NO: 2179626 - RNA, 17 nt, Homo sapiens
caauuaucaucuuuuga

SEQ ID NO: 2179627 - RNA, 17 nt, Homo sapiens
ucacucugucagccagc

SEQ ID NO: 2179628 - RNA, 21 nt, Homo sapiens
ucuggucauaaugaacacuca

SEQ ID NO: 2179629 - RNA, 12 nt, Homo sapiens
cacuucuuucag

SEQ ID NO: 2179630 - RNA, 19 nt, Homo sapiens
gucugagucaucaaaaaga

SEQ ID NO: 2179631 - RNA, 17 nt, Homo sapiens
cucaagauuguagaaac

SEQ ID NO: 2179632 - RNA, 16 nt, Homo sapiens
aagaagacacauuccu

SEQ ID NO: 2179633 - RNA, 21 nt, Homo sapiens
uaugaaggauuacucuccaua

SEQ ID NO: 2179634 - RNA, 15 nt, Homo sapiens
uuaauguuuuuaccc

SEQ ID NO: 2179635 - RNA, 14 nt, Homo sapiens
aaugucagcaucaa

SEQ ID NO: 2179636 - RNA, 22 nt, Homo sapiens
cacaagcgaaucucugccuuuc

SEQ ID NO: 2179637 - RNA, 20 nt, Homo sapiens
uuuacagaauggaaccaaaa

SEQ ID NO: 2179638 - RNA, 21 nt, Homo sapiens
agaagaaaaaguugcagucuc

SEQ ID NO: 2179639 - RNA, 22 nt, Homo sapiens
auagaagaaaauccauucauuc

SEQ ID NO: 2179640 - RNA, 14 nt, Homo sapiens
uguuaaucauuuca

SEQ ID NO: 2179641 - RNA, 16 nt, Homo sapiens
cauagcagcagugcau

SEQ ID NO: 2179642 - RNA, 13 nt, Homo sapiens
caucucaagcaag

SEQ ID NO: 2179643 - RNA, 22 nt, Homo sapiens
agauauuuuucagcuacagcaa

SEQ ID NO: 2179644 - RNA, 14 nt, Homo sapiens
uauaaaguauucaa

SEQ ID NO: 2179645 - RNA, 16 nt, Homo sapiens
auuuuuguuaguuuac

SEQ ID NO: 2179646 - RNA, 17 nt, Homo sapiens
cauuugucuuuguaaua

SEQ ID NO: 2179647 - RNA, 17 nt, Homo sapiens
cugaguguuauuugcac

SEQ ID NO: 2179648 - RNA, 22 nt, Homo sapiens
cuugggaauaaaucauagcaau

SEQ ID NO: 2179649 - RNA, 21 nt, Homo sapiens
gggacagggcugggagaagaa

SEQ ID NO: 2179650 - RNA, 15 nt, Homo sapiens
uuaggauccaugcag

SEQ ID NO: 2179651 - RNA, 19 nt, Homo sapiens
gagaaaucuauagaacuga

SEQ ID NO: 2179652 - RNA, 10 nt, Homo sapiens
uccagaucaa

SEQ ID NO: 2179653 - RNA, 20 nt, Homo sapiens
aauucagugggaccaaugaa

SEQ ID NO: 2179654 - RNA, 12 nt, Homo sapiens
aaggaaccuaau

SEQ ID NO: 2179655 - RNA, 19 nt, Homo sapiens
uuaucucacuuuguaaaua

SEQ ID NO: 2179656 - RNA, 18 nt, Homo sapiens
aguguggcgggaagggug

SEQ ID NO: 2179657 - RNA, 14 nt, Homo sapiens
cugucuacacuaag

SEQ ID NO: 2179658 - RNA, 22 nt, Homo sapiens
guucuguauucgaaaugagcuc

SEQ ID NO: 2179659 - RNA, 17 nt, Homo sapiens
ugcuuuuggagcugaga

SEQ ID NO: 2179660 - RNA, 22 nt, Homo sapiens
uaaaaaaaagaaucaccaaauc

SEQ ID NO: 2179661 - RNA, 22 nt, Homo sapiens
gucagauguacauagagaucua

SEQ ID NO: 2179662 - RNA, 18 nt, Homo sapiens
agugcgaguccauugugg

SEQ ID NO: 2179663 - RNA, 16 nt, Homo sapiens
uaacuuugaaccauaa

SEQ ID NO: 2179664 - RNA, 19 nt, Homo sapiens
uaaaggaacuaauccucac

SEQ ID NO: 2179665 - RNA, 14 nt, Homo sapiens
cuaauguaugcauu

SEQ ID NO: 2179666 - RNA, 15 nt, Homo sapiens
aggaaggagauucca

SEQ ID NO: 2179667 - RNA, 18 nt, Homo sapiens
cuucgcagccuagauaug

SEQ ID NO: 2179668 - RNA, 14 nt, Homo sapiens
ugaaucugucuauc

SEQ ID NO: 2179669 - RNA, 21 nt, Homo sapiens
cauugaaacuacuacaaugau

SEQ ID NO: 2179670 - RNA, 21 nt, Homo sapiens
cucagccauucucuacccauc

SEQ ID NO: 2179671 - RNA, 13 nt, Homo sapiens
uggaaauccaucc

SEQ ID NO: 2179672 - RNA, 22 nt, Homo sapiens
ccauaagccccucgcacucugg

SEQ ID NO: 2179673 - RNA, 21 nt, Homo sapiens
caggcugcccccaacacucca

SEQ ID NO: 2179674 - RNA, 17 nt, Homo sapiens
uuagugcacagcacaaa

SEQ ID NO: 2179675 - RNA, 20 nt, Homo sapiens
guccuaccuuugcugaugcc

SEQ ID NO: 2179676 - RNA, 22 nt, Homo sapiens
caauaaagggagaauggugcug

SEQ ID NO: 2179677 - RNA, 13 nt, Homo sapiens
aggugugccaaac

SEQ ID NO: 2179678 - RNA, 21 nt, Homo sapiens
ucccaucccacccccaaugca

SEQ ID NO: 2179679 - RNA, 15 nt, Homo sapiens
cagacgauuguucuu

SEQ ID NO: 2179680 - RNA, 20 nt, Homo sapiens
ugcuauucuagagcuuuuau

SEQ ID NO: 2179681 - RNA, 15 nt, Homo sapiens
gcccuucccacugga

SEQ ID NO: 2179682 - RNA, 18 nt, Homo sapiens
ucaaauacuuuaaaggaa

SEQ ID NO: 2179683 - RNA, 19 nt, Homo sapiens
guccucacagcagucacag

SEQ ID NO: 2179684 - RNA, 19 nt, Homo sapiens
uccugaaauacguggcauu

SEQ ID NO: 2179685 - RNA, 16 nt, Homo sapiens
guuuccagccugcuag

SEQ ID NO: 2179686 - RNA, 16 nt, Homo sapiens
cugauggucauaucca

SEQ ID NO: 2179687 - RNA, 20 nt, Homo sapiens
uauaccaaggacuuacagac

SEQ ID NO: 2179688 - RNA, 16 nt, Homo sapiens
cauuaucauguguaau

SEQ ID NO: 2179689 - RNA, 17 nt, Homo sapiens
ggcagcuguugcaguga

SEQ ID NO: 2179690 - RNA, 17 nt, Homo sapiens
aucgcaguguucaaggc

SEQ ID NO: 2179691 - RNA, 16 nt, Homo sapiens
cauggcccaaauccag

SEQ ID NO: 2179692 - RNA, 15 nt, Homo sapiens
aucagucaaugagga

SEQ ID NO: 2179693 - RNA, 16 nt, Homo sapiens
aaauuugcaggggaua

SEQ ID NO: 2179694 - RNA, 14 nt, Homo sapiens
gcuggggacccaga

SEQ ID NO: 2179695 - RNA, 20 nt, Homo sapiens
uuaccaggcaccaaaagaag

SEQ ID NO: 2179696 - RNA, 17 nt, Homo sapiens
uauaauuuauauuuugg

SEQ ID NO: 2179697 - RNA, 14 nt, Homo sapiens
aggacaacacagcu

SEQ ID NO: 2179698 - RNA, 16 nt, Homo sapiens
auugccaagucagcau

SEQ ID NO: 2179699 - RNA, 14 nt, Homo sapiens
aucaagcugugaga

SEQ ID NO: 2179700 - RNA, 24 nt, Homo sapiens
ccagccuauagcagaagcacauuu

SEQ ID NO: 2179701 - RNA, 14 nt, Homo sapiens
ggugucaaccagag

SEQ ID NO: 2179702 - RNA, 15 nt, Homo sapiens
cucgccaagcaggac

SEQ ID NO: 2179703 - RNA, 18 nt, Homo sapiens
ugcccuaucacccaacgc

SEQ ID NO: 2179704 - RNA, 14 nt, Homo sapiens
cucucuaccuccac

SEQ ID NO: 2179705 - RNA, 14 nt, Homo sapiens
cccuccacccccau

SEQ ID NO: 2179706 - RNA, 16 nt, Homo sapiens
cagggccagguccuca

SEQ ID NO: 2179707 - RNA, 20 nt, Homo sapiens
cugcaauacuaauugagaaa

SEQ ID NO: 2179708 - RNA, 19 nt, Homo sapiens
acuagcuuacugaugaugu

SEQ ID NO: 2179709 - RNA, 16 nt, Homo sapiens
cauguacauagcuuga

SEQ ID NO: 2179710 - RNA, 14 nt, Homo sapiens
auguguucugucac

SEQ ID NO: 2179711 - RNA, 14 nt, Homo sapiens
aggucauaaacacu

SEQ ID NO: 2179712 - RNA, 14 nt, Homo sapiens
aggaauuaaacuaa

SEQ ID NO: 2179713 - RNA, 14 nt, Homo sapiens
gaagaaaaccagcg

SEQ ID NO: 2179714 - RNA, 17 nt, Homo sapiens
ucaaaggcccucaguga

SEQ ID NO: 2179715 - RNA, 20 nt, Homo sapiens
gaacaaaauguaaagccagc

SEQ ID NO: 2179716 - RNA, 23 nt, Homo sapiens
gaaaugugugugaugugacauuu

SEQ ID NO: 2179717 - RNA, 12 nt, Homo sapiens
ccugugaucgug

SEQ ID NO: 2179718 - RNA, 14 nt, Homo sapiens
cugcgauggugcug

SEQ ID NO: 2179719 - RNA, 20 nt, Homo sapiens
aucaauccagcgguucucaa

SEQ ID NO: 2179720 - RNA, 16 nt, Homo sapiens
uaguaugugcauuuaa

SEQ ID NO: 2179721 - RNA, 17 nt, Homo sapiens
cuauaauuuugccuuua

SEQ ID NO: 2179722 - RNA, 14 nt, Homo sapiens
caacgagagcacuu

SEQ ID NO: 2179723 - RNA, 20 nt, Homo sapiens
aauuugccauagcagugcua

SEQ ID NO: 2179724 - RNA, 21 nt, Homo sapiens
ugacugugcuacugucuuugg

SEQ ID NO: 2179725 - RNA, 16 nt, Homo sapiens
aacaagaacacucgga

SEQ ID NO: 2179726 - RNA, 13 nt, Homo sapiens
ucagauuggacca

SEQ ID NO: 2179727 - RNA, 17 nt, Homo sapiens
cugcaaaccuugguaaa

SEQ ID NO: 2179728 - RNA, 19 nt, Homo sapiens
cccucaacugugucugaug

SEQ ID NO: 2179729 - RNA, 19 nt, Homo sapiens
caaggcuggcagugacaga

SEQ ID NO: 2179730 - RNA, 12 nt, Homo sapiens
gggaucauuuga

SEQ ID NO: 2179731 - RNA, 22 nt, Homo sapiens
ccgaggccugcauguccggcug

SEQ ID NO: 2179732 - RNA, 15 nt, Homo sapiens
cagucacagccauuu

SEQ ID NO: 2179733 - RNA, 23 nt, Homo sapiens
agaaaucccaguucauguugcuc

SEQ ID NO: 2179734 - RNA, 22 nt, Homo sapiens
cagcauccaccuuggcucugcc

SEQ ID NO: 2179735 - RNA, 14 nt, Homo sapiens
agaaaugagaucag

SEQ ID NO: 2179736 - RNA, 17 nt, Homo sapiens
agcaaaagucauuacac

SEQ ID NO: 2179737 - RNA, 20 nt, Homo sapiens
gaagcuagugaccaucuuca

SEQ ID NO: 2179738 - RNA, 22 nt, Homo sapiens
uggcaagucugcccuagaguca

SEQ ID NO: 2179739 - RNA, 15 nt, Homo sapiens
uggcuggacuguaga

SEQ ID NO: 2179740 - RNA, 13 nt, Homo sapiens
ucagugugcaaua

SEQ ID NO: 2179741 - RNA, 20 nt, Homo sapiens
uuuaaaacuaguuagauuca

SEQ ID NO: 2179742 - RNA, 19 nt, Homo sapiens
cauuuccucagacucuaag

SEQ ID NO: 2179743 - RNA, 18 nt, Homo sapiens
caccagggccagccucua

SEQ ID NO: 2179744 - RNA, 22 nt, Homo sapiens
ugggaagaugcuggccccaaaa

SEQ ID NO: 2179745 - RNA, 21 nt, Homo sapiens
cagcuaacucugaccugggag

SEQ ID NO: 2179746 - RNA, 21 nt, Homo sapiens
gagaauauguaacagccaaac

SEQ ID NO: 2179747 - RNA, 21 nt, Homo sapiens
acucucaccgacuuauucuga

SEQ ID NO: 2179748 - RNA, 13 nt, Homo sapiens
cuggagagcucac

SEQ ID NO: 2179749 - RNA, 13 nt, Homo sapiens
ggucaauuccuua

SEQ ID NO: 2179750 - RNA, 24 nt, Homo sapiens
ugcccuccaaauguccuuucucag

SEQ ID NO: 2179751 - RNA, 13 nt, Homo sapiens
gugcaaacagaag

SEQ ID NO: 2179752 - RNA, 12 nt, Homo sapiens
gaaaagugcuuu

SEQ ID NO: 2179753 - RNA, 15 nt, Homo sapiens
auuaaucaccuucuu

SEQ ID NO: 2179754 - RNA, 23 nt, Homo sapiens
caaaauguaaugucagacuuugc

SEQ ID NO: 2179755 - RNA, 14 nt, Homo sapiens
auggugacccagaa

SEQ ID NO: 2179756 - RNA, 18 nt, Homo sapiens
ugagucccuuccaggcca

SEQ ID NO: 2179757 - RNA, 11 nt, Homo sapiens
caucuauguau

SEQ ID NO: 2179758 - RNA, 15 nt, Homo sapiens
acaagaaccacuccu

SEQ ID NO: 2179759 - RNA, 19 nt, Homo sapiens
ccauauuuaucccuggugc

SEQ ID NO: 2179760 - RNA, 21 nt, Homo sapiens
gaagucuucuccuccaugaac

SEQ ID NO: 2179761 - RNA, 13 nt, Homo sapiens
uauuuucucucau

SEQ ID NO: 2179762 - RNA, 23 nt, Homo sapiens
gacacacgcgguuugguuugcag

SEQ ID NO: 2179763 - RNA, 14 nt, Homo sapiens
ugaauaugccacuu

SEQ ID NO: 2179764 - RNA, 21 nt, Homo sapiens
cauaaagacaaucacugccaa

SEQ ID NO: 2179765 - RNA, 15 nt, Homo sapiens
gagccucacagcagc

SEQ ID NO: 2179766 - RNA, 15 nt, Homo sapiens
aggaaaccacagcug

SEQ ID NO: 2179767 - RNA, 16 nt, Homo sapiens
auggcucacuaugaau

SEQ ID NO: 2179768 - RNA, 21 nt, Homo sapiens
cagguaggucggcacuuggac

SEQ ID NO: 2179769 - RNA, 17 nt, Homo sapiens
gacgcuguccugagaug

SEQ ID NO: 2179770 - RNA, 21 nt, Homo sapiens
agcacuguuggagcuacugca

SEQ ID NO: 2179771 - RNA, 18 nt, Homo sapiens
caaagagccaguuaucuu

SEQ ID NO: 2179772 - RNA, 20 nt, Homo sapiens
agugggagaaggcagugauu

SEQ ID NO: 2179773 - RNA, 16 nt, Homo sapiens
uaauugcuuacauuuu

SEQ ID NO: 2179774 - RNA, 12 nt, Homo sapiens
cauuauuaugca

SEQ ID NO: 2179775 - RNA, 22 nt, Homo sapiens
aggugggcugccugcuguguua

SEQ ID NO: 2179776 - RNA, 13 nt, Homo sapiens
ugcaggauuugaa

SEQ ID NO: 2179777 - RNA, 15 nt, Homo sapiens
acgugauuagugaaa

SEQ ID NO: 2179778 - RNA, 20 nt, Homo sapiens
uggggacccaggcuccgccc

SEQ ID NO: 2179779 - RNA, 16 nt, Homo sapiens
uccacaggaucaucau

SEQ ID NO: 2179780 - RNA, 20 nt, Homo sapiens
cagacaauggcccaggucuc

SEQ ID NO: 2179781 - RNA, 18 nt, Homo sapiens
ugagccgagaucaugcca

SEQ ID NO: 2179782 - RNA, 21 nt, Homo sapiens
acauggaguucccgugcaccu

SEQ ID NO: 2179783 - RNA, 19 nt, Homo sapiens
caguagccaaggcccgggg

SEQ ID NO: 2179784 - RNA, 20 nt, Homo sapiens
uacguuaggaggacaaaagg

SEQ ID NO: 2179785 - RNA, 20 nt, Homo sapiens
guuuuacagagcuaauuguc

SEQ ID NO: 2179786 - RNA, 20 nt, Homo sapiens
gaaacaccaagugaggccau

SEQ ID NO: 2179787 - RNA, 11 nt, Homo sapiens
uguuauccaua

SEQ ID NO: 2179788 - RNA, 13 nt, Homo sapiens
gccccuugacucu

SEQ ID NO: 2179789 - RNA, 17 nt, Homo sapiens
ucagucauuagacuccu

SEQ ID NO: 2179790 - RNA, 19 nt, Homo sapiens
uauguucaggaaaugaaag

SEQ ID NO: 2179791 - RNA, 21 nt, Homo sapiens
caucaguguccucuugcucaa

SEQ ID NO: 2179792 - RNA, 23 nt, Homo sapiens
cuucaugaagacuuaacuggccc

SEQ ID NO: 2179793 - RNA, 21 nt, Homo sapiens
acgucccccaaaacgugcaug

SEQ ID NO: 2179794 - RNA, 13 nt, Homo sapiens
uugccugccugug

SEQ ID NO: 2179795 - RNA, 23 nt, Homo sapiens
gcauuccuuacuugcacuguuac

SEQ ID NO: 2179796 - RNA, 10 nt, Homo sapiens
agccaaacag

SEQ ID NO: 2179797 - RNA, 22 nt, Homo sapiens
uuuucaagguuuuaaaacaguc

SEQ ID NO: 2179798 - RNA, 19 nt, Homo sapiens
acuaagguggaugccaacc

SEQ ID NO: 2179799 - RNA, 22 nt, Homo sapiens
accaggguccuuuugacacugc

SEQ ID NO: 2179800 - RNA, 20 nt, Homo sapiens
gccacuaaaauccacccagc

SEQ ID NO: 2179801 - RNA, 15 nt, Homo sapiens
cugauauacaauuag

SEQ ID NO: 2179802 - RNA, 20 nt, Homo sapiens
uuaucuacuuuuacucauaa

SEQ ID NO: 2179803 - RNA, 14 nt, Homo sapiens
aaaaaagccuacau

SEQ ID NO: 2179804 - RNA, 21 nt, Homo sapiens
cauguuaaugaacaguguacc

SEQ ID NO: 2179805 - RNA, 22 nt, Homo sapiens
uguuguauucuccuuugcacug

SEQ ID NO: 2179806 - RNA, 21 nt, Homo sapiens
ucaccuugggaugaugccuca

SEQ ID NO: 2179807 - RNA, 21 nt, Homo sapiens
uggaauugauguuuacauguc

SEQ ID NO: 2179808 - RNA, 15 nt, Homo sapiens
auucugcaagcaaua

SEQ ID NO: 2179809 - RNA, 14 nt, Homo sapiens
caguguacauggaa

SEQ ID NO: 2179810 - RNA, 23 nt, Homo sapiens
cuucacagaugugugauucacag

SEQ ID NO: 2179811 - RNA, 17 nt, Homo sapiens
ugauuucauauugaucu

SEQ ID NO: 2179812 - RNA, 18 nt, Homo sapiens
ucccagagaccuucugau

SEQ ID NO: 2179813 - RNA, 18 nt, Homo sapiens
auggguuaaaucaaagau

SEQ ID NO: 2179814 - RNA, 18 nt, Homo sapiens
cagaauuucccucugaua

SEQ ID NO: 2179815 - RNA, 18 nt, Homo sapiens
gccagacucuagguuaua

SEQ ID NO: 2179816 - RNA, 22 nt, Homo sapiens
auaccuugcuucuucaccaguu

SEQ ID NO: 2179817 - RNA, 18 nt, Homo sapiens
acucuugaauuccucuca

SEQ ID NO: 2179818 - RNA, 16 nt, Homo sapiens
ucacacugauacauaa

SEQ ID NO: 2179819 - RNA, 16 nt, Homo sapiens
cuauuugucucuuaca

SEQ ID NO: 2179820 - RNA, 23 nt, Homo sapiens
caaacugggaaccccuuucccac

SEQ ID NO: 2179821 - RNA, 13 nt, Homo sapiens
aaaguugagggaa

SEQ ID NO: 2179822 - RNA, 15 nt, Homo sapiens
ugacagucugcucaa

SEQ ID NO: 2179823 - RNA, 14 nt, Homo sapiens
auacaauuugcacu

SEQ ID NO: 2179824 - RNA, 12 nt, Homo sapiens
uccaaaagcaaa

SEQ ID NO: 2179825 - RNA, 14 nt, Homo sapiens
cccucccugccuaa

SEQ ID NO: 2179826 - RNA, 14 nt, Homo sapiens
uuuagccagugacu

SEQ ID NO: 2179827 - RNA, 20 nt, Homo sapiens
uguacauagugcuaacauga

SEQ ID NO: 2179828 - RNA, 19 nt, Homo sapiens
uacaggccauacuuuacaa

SEQ ID NO: 2179829 - RNA, 15 nt, Homo sapiens
aaccucugcacuacu

SEQ ID NO: 2179830 - RNA, 16 nt, Homo sapiens
gaaaacagaacacuua

SEQ ID NO: 2179831 - RNA, 15 nt, Homo sapiens
cuacccaguaaaaau

SEQ ID NO: 2179832 - RNA, 17 nt, Homo sapiens
ccaauaaaaaugucuca

SEQ ID NO: 2179833 - RNA, 17 nt, Homo sapiens
caaguaaaucuaucucu

SEQ ID NO: 2179834 - RNA, 13 nt, Homo sapiens
ugcuccaugcaca

SEQ ID NO: 2179835 - RNA, 17 nt, Homo sapiens
caaccaaagacacuguc

SEQ ID NO: 2179836 - RNA, 23 nt, Homo sapiens
gcccuccaguaccuucugccaga

SEQ ID NO: 2179837 - RNA, 14 nt, Homo sapiens
auugacuacauauu

SEQ ID NO: 2179838 - RNA, 19 nt, Homo sapiens
uccacuaggguccaccagg

SEQ ID NO: 2179839 - RNA, 18 nt, Homo sapiens
auuagcugggcauggugc

SEQ ID NO: 2179840 - RNA, 14 nt, Homo sapiens
ugguguuaaugagu

SEQ ID NO: 2179841 - RNA, 16 nt, Homo sapiens
augacuugaugcaguu

SEQ ID NO: 2179842 - RNA, 14 nt, Homo sapiens
cuaaaacagggugg

SEQ ID NO: 2179843 - RNA, 13 nt, Homo sapiens
uuacuaguaucac

SEQ ID NO: 2179844 - RNA, 21 nt, Homo sapiens
aguagugcuaucucaugacaa

SEQ ID NO: 2179845 - RNA, 12 nt, Homo sapiens
gauggucucuca

SEQ ID NO: 2179846 - RNA, 15 nt, Homo sapiens
agaagggggugacag

SEQ ID NO: 2179847 - RNA, 20 nt, Homo sapiens
ggcgcccgggauccagcuca

SEQ ID NO: 2179848 - RNA, 21 nt, Homo sapiens
caaaugaauucuaaaccaauc

SEQ ID NO: 2179849 - RNA, 19 nt, Homo sapiens
ccaggaagaccccagcaca

SEQ ID NO: 2179850 - RNA, 18 nt, Homo sapiens
ugcaagagugauugcagc

SEQ ID NO: 2179851 - RNA, 19 nt, Homo sapiens
aguuugcccugguuucacu

SEQ ID NO: 2179852 - RNA, 20 nt, Homo sapiens
cccagacguggugcuucuca

SEQ ID NO: 2179853 - RNA, 19 nt, Homo sapiens
cauggaaaacagaguauuu

SEQ ID NO: 2179854 - RNA, 18 nt, Homo sapiens
caccaucucuuuaccucc

SEQ ID NO: 2179855 - RNA, 20 nt, Homo sapiens
aggaaacccccaguguaaua

SEQ ID NO: 2179856 - RNA, 20 nt, Homo sapiens
uucuucaggucguagcauuu

SEQ ID NO: 2179857 - RNA, 14 nt, Homo sapiens
aguauguaaaacau

SEQ ID NO: 2179858 - RNA, 21 nt, Homo sapiens
cuccuguauuuaacaaaaagu

SEQ ID NO: 2179859 - RNA, 20 nt, Homo sapiens
uaaauaucauccugccuuca

SEQ ID NO: 2179860 - RNA, 12 nt, Homo sapiens
aaugacagcuag

SEQ ID NO: 2179861 - RNA, 12 nt, Homo sapiens
auuaccauucag

SEQ ID NO: 2179862 - RNA, 17 nt, Homo sapiens
uuggugacagggucuga

SEQ ID NO: 2179863 - RNA, 22 nt, Homo sapiens
cagggagcccugggguuuccac

SEQ ID NO: 2179864 - RNA, 14 nt, Homo sapiens
aagccacuguauga

SEQ ID NO: 2179865 - RNA, 19 nt, Homo sapiens
cuggcugaccccaaagagc

SEQ ID NO: 2179866 - RNA, 17 nt, Homo sapiens
uucuuaccucauuugca

SEQ ID NO: 2179867 - RNA, 17 nt, Homo sapiens
auuugaaacacaagaau

SEQ ID NO: 2179868 - RNA, 19 nt, Homo sapiens
ugaacaaguuaguuucuca

SEQ ID NO: 2179869 - RNA, 14 nt, Homo sapiens
acucagcugcucug

SEQ ID NO: 2179870 - RNA, 14 nt, Homo sapiens
uucauuuugcaacu

SEQ ID NO: 2179871 - RNA, 18 nt, Homo sapiens
accacaugugcacaugca

SEQ ID NO: 2179872 - RNA, 16 nt, Homo sapiens
caaucaauggugcaaa

SEQ ID NO: 2179873 - RNA, 16 nt, Homo sapiens
ggauaauuccuuggug

SEQ ID NO: 2179874 - RNA, 13 nt, Homo sapiens
cccuaaguuuuau

SEQ ID NO: 2179875 - RNA, 20 nt, Homo sapiens
ucagaugggucugauauuaa

SEQ ID NO: 2179876 - RNA, 12 nt, Homo sapiens
gacucaaaggga

SEQ ID NO: 2179877 - RNA, 12 nt, Homo sapiens
agcgaacaucuu

SEQ ID NO: 2179878 - RNA, 23 nt, Homo sapiens
gaacaaaaacaaaacaccaggga

SEQ ID NO: 2179879 - RNA, 18 nt, Homo sapiens
agggaaaaguccuuggcu

SEQ ID NO: 2179880 - RNA, 20 nt, Homo sapiens
auucuuacaaacaugugguu

SEQ ID NO: 2179881 - RNA, 20 nt, Homo sapiens
caauugcuucugugcaauaa

SEQ ID NO: 2179882 - RNA, 15 nt, Homo sapiens
aucgcuagacuaaga

SEQ ID NO: 2179883 - RNA, 13 nt, Homo sapiens
aaucccauuccug

SEQ ID NO: 2179884 - RNA, 12 nt, Homo sapiens
gaggaguucaau

SEQ ID NO: 2179885 - RNA, 19 nt, Homo sapiens
gccacgucuuccuucugcc

SEQ ID NO: 2179886 - RNA, 20 nt, Homo sapiens
gcaguagacuauaagcagaa

SEQ ID NO: 2179887 - RNA, 18 nt, Homo sapiens
ucaggggcugacacuuca

SEQ ID NO: 2179888 - RNA, 22 nt, Homo sapiens
caggugcugcucagcagaggau

SEQ ID NO: 2179889 - RNA, 21 nt, Homo sapiens
ucaauguuucuuuuaucacga

SEQ ID NO: 2179890 - RNA, 18 nt, Homo sapiens
gacggaacaguguggaag

SEQ ID NO: 2179891 - RNA, 22 nt, Homo sapiens
auguucuacuuuguucugcugu

SEQ ID NO: 2179892 - RNA, 19 nt, Homo sapiens
caucacagcuuguuuugga

SEQ ID NO: 2179893 - RNA, 16 nt, Homo sapiens
ucuuacaugcauuuga

SEQ ID NO: 2179894 - RNA, 16 nt, Homo sapiens
agauuauacaaucucu

SEQ ID NO: 2179895 - RNA, 22 nt, Homo sapiens
uugcacauaguagguacccaau

SEQ ID NO: 2179896 - RNA, 13 nt, Homo sapiens
aauuacauacuau

SEQ ID NO: 2179897 - RNA, 13 nt, Homo sapiens
aauuucauacuaa

SEQ ID NO: 2179898 - RNA, 17 nt, Homo sapiens
caggaaauaccaacuga

SEQ ID NO: 2179899 - RNA, 14 nt, Homo sapiens
aauauuguugacaa

SEQ ID NO: 2179900 - RNA, 18 nt, Homo sapiens
cauggguccuugaugcca

SEQ ID NO: 2179901 - RNA, 16 nt, Homo sapiens
gacauucggggugauc

SEQ ID NO: 2179902 - RNA, 13 nt, Homo sapiens
auuuuuaugcaga

SEQ ID NO: 2179903 - RNA, 12 nt, Homo sapiens
cuaaacugcagc

SEQ ID NO: 2179904 - RNA, 20 nt, Homo sapiens
cagcaggcuccuggcugugc

SEQ ID NO: 2179905 - RNA, 13 nt, Homo sapiens
gucucuacugugg

SEQ ID NO: 2179906 - RNA, 16 nt, Homo sapiens
cuaauucuugcauauu

SEQ ID NO: 2179907 - RNA, 16 nt, Homo sapiens
ccucccagagagugaa

SEQ ID NO: 2179908 - RNA, 14 nt, Homo sapiens
gaaaggucugagga

SEQ ID NO: 2179909 - RNA, 15 nt, Homo sapiens
uauuguauugcugcu

SEQ ID NO: 2179910 - RNA, 22 nt, Homo sapiens
ggauugucuuacuguugcauaa

SEQ ID NO: 2179911 - RNA, 21 nt, Homo sapiens
ucaacauccugccagccccac

SEQ ID NO: 2179912 - RNA, 18 nt, Homo sapiens
gccucugcuggcucagga

SEQ ID NO: 2179913 - RNA, 19 nt, Homo sapiens
ccauuugccaugcugcuau

SEQ ID NO: 2179914 - RNA, 21 nt, Homo sapiens
auagcuuaacacuaccaauuu

SEQ ID NO: 2179915 - RNA, 15 nt, Homo sapiens
gagggcgaaggccau

SEQ ID NO: 2179916 - RNA, 19 nt, Homo sapiens
ggccuuguccucagccagu

SEQ ID NO: 2179917 - RNA, 22 nt, Homo sapiens
caacaaaaucaauuuuuugcua

SEQ ID NO: 2179918 - RNA, 17 nt, Homo sapiens
ucacuccucugucauau

SEQ ID NO: 2179919 - RNA, 16 nt, Homo sapiens
ucccacuaaaguguca

SEQ ID NO: 2179920 - RNA, 14 nt, Homo sapiens
aaaauacgcaauuu

SEQ ID NO: 2179921 - RNA, 15 nt, Homo sapiens
acacagacuggcaau

SEQ ID NO: 2179922 - RNA, 18 nt, Homo sapiens
uuccccucucaaagggga

SEQ ID NO: 2179923 - RNA, 17 nt, Homo sapiens
agaauguugauggugcu

SEQ ID NO: 2179924 - RNA, 16 nt, Homo sapiens
ucucaacuuacauaug

SEQ ID NO: 2179925 - RNA, 15 nt, Homo sapiens
cccagcagacuugag

SEQ ID NO: 2179926 - RNA, 16 nt, Homo sapiens
auguugggaaaguauu

SEQ ID NO: 2179927 - RNA, 20 nt, Homo sapiens
augauuuauuaaauaaucuc

SEQ ID NO: 2179928 - RNA, 19 nt, Homo sapiens
cugauuccuucaacuggcu

SEQ ID NO: 2179929 - RNA, 15 nt, Homo sapiens
ccucgacagcucucu

SEQ ID NO: 2179930 - RNA, 11 nt, Homo sapiens
gcgcaucucaa

SEQ ID NO: 2179931 - RNA, 16 nt, Homo sapiens
uucagaaacaaagcau

SEQ ID NO: 2179932 - RNA, 16 nt, Homo sapiens
cacagaauuuaagcaa

SEQ ID NO: 2179933 - RNA, 19 nt, Homo sapiens
aagauggccaugcccucca

SEQ ID NO: 2179934 - RNA, 13 nt, Homo sapiens
cuguguccccgcg

SEQ ID NO: 2179935 - RNA, 18 nt, Homo sapiens
uccuuguuguucuuuaac

SEQ ID NO: 2179936 - RNA, 15 nt, Homo sapiens
aauccaaauuucuca

SEQ ID NO: 2179937 - RNA, 14 nt, Homo sapiens
uaauauuauauugu

SEQ ID NO: 2179938 - RNA, 17 nt, Homo sapiens
ccaagugagaaggagau

SEQ ID NO: 2179939 - RNA, 16 nt, Homo sapiens
uucauuuuucuccuca

SEQ ID NO: 2179940 - RNA, 17 nt, Homo sapiens
uccaggugaggcccaag

SEQ ID NO: 2179941 - RNA, 15 nt, Homo sapiens
cuggaugcaugaauu

SEQ ID NO: 2179942 - RNA, 11 nt, Homo sapiens
gugucuucuaa

SEQ ID NO: 2179943 - RNA, 14 nt, Homo sapiens
uguaaauuaccagu

SEQ ID NO: 2179944 - RNA, 12 nt, Homo sapiens
ugcuacauauau

SEQ ID NO: 2179945 - RNA, 21 nt, Homo sapiens
auggaagaggcaccuguccca

SEQ ID NO: 2179946 - RNA, 17 nt, Homo sapiens
cacuguggagaccacac

SEQ ID NO: 2179947 - RNA, 13 nt, Homo sapiens
aguuaauacuuaa

SEQ ID NO: 2179948 - RNA, 14 nt, Homo sapiens
ccauccgugcugca

SEQ ID NO: 2179949 - RNA, 22 nt, Homo sapiens
ugcagguuuucuucacugccag

SEQ ID NO: 2179950 - RNA, 15 nt, Homo sapiens
caagagucaugucaa

SEQ ID NO: 2179951 - RNA, 13 nt, Homo sapiens
aguuuuguuucaa

SEQ ID NO: 2179952 - RNA, 15 nt, Homo sapiens
agccugcaugcauuc

SEQ ID NO: 2179953 - RNA, 12 nt, Homo sapiens
uauauugccuua

SEQ ID NO: 2179954 - RNA, 19 nt, Homo sapiens
gagacugugugugcccucu

SEQ ID NO: 2179955 - RNA, 13 nt, Homo sapiens
cuuuuccauuuga

SEQ ID NO: 2179956 - RNA, 20 nt, Homo sapiens
ucaagaucacgccauugcac

SEQ ID NO: 2179957 - RNA, 17 nt, Homo sapiens
cagccacgugcucucug

SEQ ID NO: 2179958 - RNA, 23 nt, Homo sapiens
acucaauugaugguuauuagaca

SEQ ID NO: 2179959 - RNA, 17 nt, Homo sapiens
ucaaaaccugugccagg

SEQ ID NO: 2179960 - RNA, 15 nt, Homo sapiens
uaggaagacuuugga

SEQ ID NO: 2179961 - RNA, 19 nt, Homo sapiens
ucccagcuauuccuacucu

SEQ ID NO: 2179962 - RNA, 19 nt, Homo sapiens
cggaagaggcugcugagaa

SEQ ID NO: 2179963 - RNA, 12 nt, Homo sapiens
cugaccacagcc

SEQ ID NO: 2179964 - RNA, 15 nt, Homo sapiens
acaagcaaacccaga

SEQ ID NO: 2179965 - RNA, 21 nt, Homo sapiens
aagagccuuacuuucuuuaca

SEQ ID NO: 2179966 - RNA, 21 nt, Homo sapiens
ucucagcucacugcaaccucc

SEQ ID NO: 2179967 - RNA, 20 nt, Homo sapiens
agaguguggagucauucuca

SEQ ID NO: 2179968 - RNA, 19 nt, Homo sapiens
caaauggacauaggacuca

SEQ ID NO: 2179969 - RNA, 17 nt, Homo sapiens
aauauuuuguauauuau

SEQ ID NO: 2179970 - RNA, 17 nt, Homo sapiens
aauucaaguuaccaaug

SEQ ID NO: 2179971 - RNA, 16 nt, Homo sapiens
gagaggaaaagccagu

SEQ ID NO: 2179972 - RNA, 10 nt, Homo sapiens
caaucacaaa

SEQ ID NO: 2179973 - RNA, 17 nt, Homo sapiens
accccucccuuucuccc

SEQ ID NO: 2179974 - RNA, 21 nt, Homo sapiens
auggcacucuucccaccucag

SEQ ID NO: 2179975 - RNA, 13 nt, Homo sapiens
cccacaguccuca

SEQ ID NO: 2179976 - RNA, 15 nt, Homo sapiens
ccuuccucagcucag

SEQ ID NO: 2179977 - RNA, 21 nt, Homo sapiens
cucgccagagcugugguguca

SEQ ID NO: 2179978 - RNA, 21 nt, Homo sapiens
gagcuuccccaagcacggugu

SEQ ID NO: 2179979 - RNA, 21 nt, Homo sapiens
uugcuaaacgccacggagcuc

SEQ ID NO: 2179980 - RNA, 22 nt, Homo sapiens
ucgugggucccagagaccucau

SEQ ID NO: 2179981 - RNA, 23 nt, Homo sapiens
acacaaaaggaacaaaagcgaaa

SEQ ID NO: 2179982 - RNA, 16 nt, Homo sapiens
caagguuucccaguga

SEQ ID NO: 2179983 - RNA, 14 nt, Homo sapiens
ucuguuucaaggaa

SEQ ID NO: 2179984 - RNA, 13 nt, Homo sapiens
gcugggaaccuca

SEQ ID NO: 2179985 - RNA, 22 nt, Homo sapiens
ccaccccagcaucagcacagcu

SEQ ID NO: 2179986 - RNA, 13 nt, Homo sapiens
accauucucaccc

SEQ ID NO: 2179987 - RNA, 16 nt, Homo sapiens
aacaagcaagcuccca

SEQ ID NO: 2179988 - RNA, 21 nt, Homo sapiens
uaagguauuaucuugcaacuu

SEQ ID NO: 2179989 - RNA, 24 nt, Homo sapiens
uagacuccuuugcuaaugcuaugc

SEQ ID NO: 2179990 - RNA, 16 nt, Homo sapiens
auucuaaaugaacuca

SEQ ID NO: 2179991 - RNA, 18 nt, Homo sapiens
acguaaauuauuacauau

SEQ ID NO: 2179992 - RNA, 19 nt, Homo sapiens
cauauuuaauaaagcacaa

SEQ ID NO: 2179993 - RNA, 19 nt, Homo sapiens
aaagacugcagcugcugaa

SEQ ID NO: 2179994 - RNA, 11 nt, Homo sapiens
cuacaguauua

SEQ ID NO: 2179995 - RNA, 20 nt, Homo sapiens
gcguccuuugaaccugugca

SEQ ID NO: 2179996 - RNA, 13 nt, Homo sapiens
uacagagugagac

SEQ ID NO: 2179997 - RNA, 16 nt, Homo sapiens
auccgugacagcacuu

SEQ ID NO: 2179998 - RNA, 12 nt, Homo sapiens
uuacccauuucu

SEQ ID NO: 2179999 - RNA, 20 nt, Homo sapiens
cucaaaauaagccaugcugc

SEQ ID NO: 2180000 - RNA, 22 nt, Homo sapiens
uguggguauagcucaggguaag

SEQ ID NO: 2180001 - RNA, 21 nt, Homo sapiens
aucaauacccuuggcacugau

SEQ ID NO: 2180002 - RNA, 17 nt, Homo sapiens
guaugugaaacacacau

SEQ ID NO: 2180003 - RNA, 17 nt, Homo sapiens
auggcuucacacuguuu

SEQ ID NO: 2180004 - RNA, 19 nt, Homo sapiens
aguaugagucaaugugcag

SEQ ID NO: 2180005 - RNA, 13 nt, Homo sapiens
auaaaaacccugu

SEQ ID NO: 2180006 - RNA, 14 nt, Homo sapiens
aggcagcaccugau

SEQ ID NO: 2180007 - RNA, 18 nt, Homo sapiens
ccugaaaugacauuucac

SEQ ID NO: 2180008 - RNA, 18 nt, Homo sapiens
gcccuaggaggagaacuu

SEQ ID NO: 2180009 - RNA, 17 nt, Homo sapiens
ugguuaugucccaugac

SEQ ID NO: 2180010 - RNA, 19 nt, Homo sapiens
cauauuuuauuauagucac

SEQ ID NO: 2180011 - RNA, 18 nt, Homo sapiens
auucaaauuuguacagga

SEQ ID NO: 2180012 - RNA, 17 nt, Homo sapiens
gcccgaccccaucucau

SEQ ID NO: 2180013 - RNA, 22 nt, Homo sapiens
cuuccacagagggaaguuuaaa

SEQ ID NO: 2180014 - RNA, 21 nt, Homo sapiens
ugaaaauguacauguuccuuu

SEQ ID NO: 2180015 - RNA, 23 nt, Homo sapiens
caucagguuuuguuuuuuuucag

SEQ ID NO: 2180016 - RNA, 17 nt, Homo sapiens
aaacuugcacauuugaa

SEQ ID NO: 2180017 - RNA, 13 nt, Homo sapiens
uccagugucucac

SEQ ID NO: 2180018 - RNA, 18 nt, Homo sapiens
cucuaauucacagugcuc

SEQ ID NO: 2180019 - RNA, 18 nt, Homo sapiens
ccuaacuggcuuacuucc

SEQ ID NO: 2180020 - RNA, 18 nt, Homo sapiens
auccagaccaaccuucca

SEQ ID NO: 2180021 - RNA, 22 nt, Homo sapiens
uguuucuggaauugauauugaa

SEQ ID NO: 2180022 - RNA, 14 nt, Homo sapiens
ucugugaagcauuc

SEQ ID NO: 2180023 - RNA, 20 nt, Homo sapiens
uaaagaggaauggcccucau

SEQ ID NO: 2180024 - RNA, 13 nt, Homo sapiens
ccucugaagggaa

SEQ ID NO: 2180025 - RNA, 17 nt, Homo sapiens
gcacuucaaccuagucc

SEQ ID NO: 2180026 - RNA, 19 nt, Homo sapiens
aggucacuugaagccaaac

SEQ ID NO: 2180027 - RNA, 23 nt, Homo sapiens
acuguagaagaagugaacacuua

SEQ ID NO: 2180028 - RNA, 18 nt, Homo sapiens
uaacaaaauguaugucug

SEQ ID NO: 2180029 - RNA, 15 nt, Homo sapiens
cagagaccguccuca

SEQ ID NO: 2180030 - RNA, 22 nt, Homo sapiens
cuggggauaguccuuccuggca

SEQ ID NO: 2180031 - RNA, 13 nt, Homo sapiens
caagccugaauuu

SEQ ID NO: 2180032 - RNA, 13 nt, Homo sapiens
acuuucugccagc

SEQ ID NO: 2180033 - RNA, 23 nt, Homo sapiens
gcgggagugggggcugugccgug

SEQ ID NO: 2180034 - RNA, 12 nt, Homo sapiens
ggaacauuauua

SEQ ID NO: 2180035 - RNA, 19 nt, Homo sapiens
acccugcuucucccgggga

SEQ ID NO: 2180036 - RNA, 13 nt, Homo sapiens
uagcucgugugcu

SEQ ID NO: 2180037 - RNA, 15 nt, Homo sapiens
aggagggcuuugugu

SEQ ID NO: 2180038 - RNA, 21 nt, Homo sapiens
ugaguuccggcaccaguagca

SEQ ID NO: 2180039 - RNA, 11 nt, Homo sapiens
gucugucuucu

SEQ ID NO: 2180040 - RNA, 13 nt, Homo sapiens
aaaggucacuuuu

SEQ ID NO: 2180041 - RNA, 14 nt, Homo sapiens
cagucacacuguua

SEQ ID NO: 2180042 - RNA, 12 nt, Homo sapiens
agaaacugaagc

SEQ ID NO: 2180043 - RNA, 19 nt, Homo sapiens
cucccagagugcugggauu

SEQ ID NO: 2180044 - RNA, 21 nt, Homo sapiens
ugaagauuucauggacacuga

SEQ ID NO: 2180045 - RNA, 15 nt, Homo sapiens
aaggcugacuucucu

SEQ ID NO: 2180046 - RNA, 18 nt, Homo sapiens
aacaaaucaaauugcuua

SEQ ID NO: 2180047 - RNA, 23 nt, Homo sapiens
cugauacuuuuuugaaaucagua

SEQ ID NO: 2180048 - RNA, 15 nt, Homo sapiens
ccaauuagcucuaua

SEQ ID NO: 2180049 - RNA, 22 nt, Homo sapiens
agguccaaaaaaggcugcccug

SEQ ID NO: 2180050 - RNA, 15 nt, Homo sapiens
gagaccucagggaug

SEQ ID NO: 2180051 - RNA, 16 nt, Homo sapiens
uggagggcucagggca

SEQ ID NO: 2180052 - RNA, 23 nt, Homo sapiens
auauuuccuauuguucacuuuau

SEQ ID NO: 2180053 - RNA, 14 nt, Homo sapiens
uggaaaacacuuuc

SEQ ID NO: 2180054 - RNA, 19 nt, Homo sapiens
gcaaagggcugaaagccau

SEQ ID NO: 2180055 - RNA, 22 nt, Homo sapiens
acgcagguauuuagaagcagag

SEQ ID NO: 2180056 - RNA, 21 nt, Homo sapiens
uggggaagugugucaaaucaa

SEQ ID NO: 2180057 - RNA, 14 nt, Homo sapiens
gccccuccucgggc

SEQ ID NO: 2180058 - RNA, 14 nt, Homo sapiens
gaacagcauaugca

SEQ ID NO: 2180059 - RNA, 14 nt, Homo sapiens
accccauguccuca

SEQ ID NO: 2180060 - RNA, 12 nt, Homo sapiens
guacagaccucc

SEQ ID NO: 2180061 - RNA, 17 nt, Homo sapiens
agcuaaggacacagugg

SEQ ID NO: 2180062 - RNA, 21 nt, Homo sapiens
cuuucuguugaaaagcacaca

SEQ ID NO: 2180063 - RNA, 15 nt, Homo sapiens
gaaacaaaugaaaua

SEQ ID NO: 2180064 - RNA, 15 nt, Homo sapiens
ugaccuaagaacaaa

SEQ ID NO: 2180065 - RNA, 23 nt, Homo sapiens
cuuaguguccuuuuuuauauaca

SEQ ID NO: 2180066 - RNA, 17 nt, Homo sapiens
gucucugauuugcaaau

SEQ ID NO: 2180067 - RNA, 17 nt, Homo sapiens
acguguuuacuugguga

SEQ ID NO: 2180068 - RNA, 17 nt, Homo sapiens
aauuauuuuaguagugu

SEQ ID NO: 2180069 - RNA, 15 nt, Homo sapiens
ucacagaaucuccau

SEQ ID NO: 2180070 - RNA, 18 nt, Homo sapiens
ugguaagaugacucugag

SEQ ID NO: 2180071 - RNA, 17 nt, Homo sapiens
uaauaaauuuuggucag

SEQ ID NO: 2180072 - RNA, 20 nt, Homo sapiens
aaggugggaagaucauuuga

SEQ ID NO: 2180073 - RNA, 15 nt, Homo sapiens
auauguguaucucaa

SEQ ID NO: 2180074 - RNA, 19 nt, Homo sapiens
aaagaucuugaauagucuc

SEQ ID NO: 2180075 - RNA, 18 nt, Homo sapiens
aaagcuuuacuacugugg

SEQ ID NO: 2180076 - RNA, 19 nt, Homo sapiens
cuuagagcagauucuagca

SEQ ID NO: 2180077 - RNA, 22 nt, Homo sapiens
aucauaaccacccuagcuuuau

SEQ ID NO: 2180078 - RNA, 23 nt, Homo sapiens
uguuucucggcaccagugccuca

SEQ ID NO: 2180079 - RNA, 19 nt, Homo sapiens
aagccaaauuuccaguuua

SEQ ID NO: 2180080 - RNA, 15 nt, Homo sapiens
gcucaucugcaaaag

SEQ ID NO: 2180081 - RNA, 16 nt, Homo sapiens
uguguacaaaauaucc

SEQ ID NO: 2180082 - RNA, 18 nt, Homo sapiens
ucuaguuuuggcaagaag

SEQ ID NO: 2180083 - RNA, 23 nt, Homo sapiens
gcauugcucucccucgugcuccc

SEQ ID NO: 2180084 - RNA, 17 nt, Homo sapiens
uacagaaaucaauggua

SEQ ID NO: 2180085 - RNA, 18 nt, Homo sapiens
gcugagcacagggcuguu

SEQ ID NO: 2180086 - RNA, 22 nt, Homo sapiens
uccuaacaggauuagacaguca

SEQ ID NO: 2180087 - RNA, 14 nt, Homo sapiens
uggguugucaccaa

SEQ ID NO: 2180088 - RNA, 19 nt, Homo sapiens
gauuuuugacucuggcaaa

SEQ ID NO: 2180089 - RNA, 20 nt, Homo sapiens
acucagacuguugcacucua

SEQ ID NO: 2180090 - RNA, 20 nt, Homo sapiens
gcuccugcggaggaggugug

SEQ ID NO: 2180091 - RNA, 23 nt, Homo sapiens
cccugccccagcuggggaaauca

SEQ ID NO: 2180092 - RNA, 20 nt, Homo sapiens
uguguuauuauuuugcacug

SEQ ID NO: 2180093 - RNA, 23 nt, Homo sapiens
gauguauuuuugauguauauauc

SEQ ID NO: 2180094 - RNA, 20 nt, Homo sapiens
uauguaaauuauaaguaacu

SEQ ID NO: 2180095 - RNA, 21 nt, Homo sapiens
gcauacuguguauguuuuaua

SEQ ID NO: 2180096 - RNA, 20 nt, Homo sapiens
aagacccucaaugccaagaa

SEQ ID NO: 2180097 - RNA, 23 nt, Homo sapiens
aaccucauuggccagcucauaaa

SEQ ID NO: 2180098 - RNA, 16 nt, Homo sapiens
uccugaaucugugcaa

SEQ ID NO: 2180099 - RNA, 17 nt, Homo sapiens
ugcucauaacuguguca

SEQ ID NO: 2180100 - RNA, 14 nt, Homo sapiens
caaaagauucugua

SEQ ID NO: 2180101 - RNA, 16 nt, Homo sapiens
uccaggcccaaggagu

SEQ ID NO: 2180102 - RNA, 23 nt, Homo sapiens
uugauaaccauauaaauucugau

SEQ ID NO: 2180103 - RNA, 18 nt, Homo sapiens
cuaauucaauucauguaa

SEQ ID NO: 2180104 - RNA, 14 nt, Homo sapiens
ccuucuaacuaaac

SEQ ID NO: 2180105 - RNA, 15 nt, Homo sapiens
ugggaggccaaggca

SEQ ID NO: 2180106 - RNA, 15 nt, Homo sapiens
caggaggcugaggca

SEQ ID NO: 2180107 - RNA, 16 nt, Homo sapiens
aacaagaucauuaucu

SEQ ID NO: 2180108 - RNA, 16 nt, Homo sapiens
aacuuuaucauaugcu

SEQ ID NO: 2180109 - RNA, 21 nt, Homo sapiens
aacaucaauuccaguggaaca

SEQ ID NO: 2180110 - RNA, 22 nt, Homo sapiens
gccugggcugccgggaaccuca

SEQ ID NO: 2180111 - RNA, 17 nt, Homo sapiens
uggccagagaugccagc

SEQ ID NO: 2180112 - RNA, 14 nt, Homo sapiens
uuuguuacuuugaa

SEQ ID NO: 2180113 - RNA, 18 nt, Homo sapiens
uguccuaaaauacaaaca

SEQ ID NO: 2180114 - RNA, 22 nt, Homo sapiens
cuuauaaauucuguuagcugcu

SEQ ID NO: 2180115 - RNA, 15 nt, Homo sapiens
cucaagcagcaaaau

SEQ ID NO: 2180116 - RNA, 17 nt, Homo sapiens
gcaugucugccuaugca

SEQ ID NO: 2180117 - RNA, 18 nt, Homo sapiens
cuuacuuaaacccagcuc

SEQ ID NO: 2180118 - RNA, 18 nt, Homo sapiens
auaccucgaacaucaguu

SEQ ID NO: 2180119 - RNA, 15 nt, Homo sapiens
cugguuuaauuacau

SEQ ID NO: 2180120 - RNA, 17 nt, Homo sapiens
ucacuuuucuuuauugc

SEQ ID NO: 2180121 - RNA, 12 nt, Homo sapiens
aauugacuugca

SEQ ID NO: 2180122 - RNA, 19 nt, Homo sapiens
aggaauaacaucaccacug

SEQ ID NO: 2180123 - RNA, 13 nt, Homo sapiens
gaggcagggucuc

SEQ ID NO: 2180124 - RNA, 19 nt, Homo sapiens
gaggugggagaggccucau

SEQ ID NO: 2180125 - RNA, 18 nt, Homo sapiens
uugaauuuuuuaucugca

SEQ ID NO: 2180126 - RNA, 16 nt, Homo sapiens
gaucaugaggucagga

SEQ ID NO: 2180127 - RNA, 21 nt, Homo sapiens
acauucuuagcuguaacuuaa

SEQ ID NO: 2180128 - RNA, 22 nt, Homo sapiens
gcaacuuaagcugggauaauca

SEQ ID NO: 2180129 - RNA, 21 nt, Homo sapiens
ccuucgaguggccagcuucac

SEQ ID NO: 2180130 - RNA, 13 nt, Homo sapiens
gacguccaggugg

SEQ ID NO: 2180131 - RNA, 13 nt, Homo sapiens
uaggaaccuugca

SEQ ID NO: 2180132 - RNA, 12 nt, Homo sapiens
cagccauaugca

SEQ ID NO: 2180133 - RNA, 14 nt, Homo sapiens
gccuucccaaaaca

SEQ ID NO: 2180134 - RNA, 23 nt, Homo sapiens
gcaggcaugagucagucugauga

SEQ ID NO: 2180135 - RNA, 11 nt, Homo sapiens
uugcagugaag

SEQ ID NO: 2180136 - RNA, 22 nt, Homo sapiens
uaaugaaagacuguacaaagua

SEQ ID NO: 2180137 - RNA, 21 nt, Homo sapiens
acuugcacaaaaucacacagc

SEQ ID NO: 2180138 - RNA, 18 nt, Homo sapiens
aaacauaaucuucugccu

SEQ ID NO: 2180139 - RNA, 13 nt, Homo sapiens
uaguggagccagg

SEQ ID NO: 2180140 - RNA, 10 nt, Homo sapiens
uuugugacau

SEQ ID NO: 2180141 - RNA, 16 nt, Homo sapiens
agcugagccuucugau

SEQ ID NO: 2180142 - RNA, 15 nt, Homo sapiens
agcaucaguacuugu

SEQ ID NO: 2180143 - RNA, 16 nt, Homo sapiens
agccuguggccuuugc

SEQ ID NO: 2180144 - RNA, 12 nt, Homo sapiens
cucagaacauaa

SEQ ID NO: 2180145 - RNA, 23 nt, Homo sapiens
caauaaagugacccugcucucac

SEQ ID NO: 2180146 - RNA, 20 nt, Homo sapiens
cggggguggagugagacuga

SEQ ID NO: 2180147 - RNA, 17 nt, Homo sapiens
ggcuguguugggugguu

SEQ ID NO: 2180148 - RNA, 12 nt, Homo sapiens
aucuauugcuca

SEQ ID NO: 2180149 - RNA, 16 nt, Homo sapiens
aaaacuacaagccacg

SEQ ID NO: 2180150 - RNA, 17 nt, Homo sapiens
ggcagaacugcuugaac

SEQ ID NO: 2180151 - RNA, 19 nt, Homo sapiens
uguugagauccagugcagu

SEQ ID NO: 2180152 - RNA, 23 nt, Homo sapiens
aauauuuaaccccacacagcacu

SEQ ID NO: 2180153 - RNA, 17 nt, Homo sapiens
uccgcacuucagaauuc

SEQ ID NO: 2180154 - RNA, 16 nt, Homo sapiens
caaagucucaaugaaa

SEQ ID NO: 2180155 - RNA, 12 nt, Homo sapiens
aaauuggaagac

SEQ ID NO: 2180156 - RNA, 14 nt, Homo sapiens
aggggcagaugcca

SEQ ID NO: 2180157 - RNA, 22 nt, Homo sapiens
ugugaaaauuacacccaugcac

SEQ ID NO: 2180158 - RNA, 12 nt, Homo sapiens
caagcugccucc

SEQ ID NO: 2180159 - RNA, 15 nt, Homo sapiens
ccugagaacccaaac

SEQ ID NO: 2180160 - RNA, 19 nt, Homo sapiens
gagaaaacaggcucacaga

SEQ ID NO: 2180161 - RNA, 16 nt, Homo sapiens
ugaccccugaccucac

SEQ ID NO: 2180162 - RNA, 19 nt, Homo sapiens
uugcauagcagcugcuacu

SEQ ID NO: 2180163 - RNA, 22 nt, Homo sapiens
ugaauagauggguuauuucaac

SEQ ID NO: 2180164 - RNA, 16 nt, Homo sapiens
gcgcgugccuguaauc

SEQ ID NO: 2180165 - RNA, 14 nt, Homo sapiens
gaguauaauauuca

SEQ ID NO: 2180166 - RNA, 13 nt, Homo sapiens
aggauggcacugu

SEQ ID NO: 2180167 - RNA, 14 nt, Homo sapiens
cugagagucauuca

SEQ ID NO: 2180168 - RNA, 15 nt, Homo sapiens
aagucaucuugcuac

SEQ ID NO: 2180169 - RNA, 23 nt, Homo sapiens
agcuacauguguaagaaggcccu

SEQ ID NO: 2180170 - RNA, 13 nt, Homo sapiens
uucuguuccacau

SEQ ID NO: 2180171 - RNA, 18 nt, Homo sapiens
gugggcagagccuuccac

SEQ ID NO: 2180172 - RNA, 20 nt, Homo sapiens
cagcaauugucuacauucag

SEQ ID NO: 2180173 - RNA, 23 nt, Homo sapiens
ucccagcacauuuccucucuauc

SEQ ID NO: 2180174 - RNA, 14 nt, Homo sapiens
uggccgucuacugg

SEQ ID NO: 2180175 - RNA, 20 nt, Homo sapiens
uccuacaguguaucaacaaa

SEQ ID NO: 2180176 - RNA, 19 nt, Homo sapiens
ugacagugggaggggauaa

SEQ ID NO: 2180177 - RNA, 14 nt, Homo sapiens
cugggcagccuuuc

SEQ ID NO: 2180178 - RNA, 20 nt, Homo sapiens
aucugaacagagagauauaa

SEQ ID NO: 2180179 - RNA, 13 nt, Homo sapiens
uucauucugcaag

SEQ ID NO: 2180180 - RNA, 19 nt, Homo sapiens
uaaaauaauuuucauucau

SEQ ID NO: 2180181 - RNA, 17 nt, Homo sapiens
gaagauuucucugagau

SEQ ID NO: 2180182 - RNA, 22 nt, Homo sapiens
ugccauuaugcaaauggagaua

SEQ ID NO: 2180183 - RNA, 12 nt, Homo sapiens
cuccucuaguca

SEQ ID NO: 2180184 - RNA, 15 nt, Homo sapiens
uuucuuuugaauaau

SEQ ID NO: 2180185 - RNA, 23 nt, Homo sapiens
aggaguuaccuuaaacuguguaa

SEQ ID NO: 2180186 - RNA, 18 nt, Homo sapiens
ucugacuacuuguuguau

SEQ ID NO: 2180187 - RNA, 18 nt, Homo sapiens
auaaauuuuauuccaaaa

SEQ ID NO: 2180188 - RNA, 15 nt, Homo sapiens
gaaaaauaaacacua

SEQ ID NO: 2180189 - RNA, 15 nt, Homo sapiens
ggaacuaaagcaaau

SEQ ID NO: 2180190 - RNA, 13 nt, Homo sapiens
uuaguaucucauc

SEQ ID NO: 2180191 - RNA, 16 nt, Homo sapiens
cuuccagauaaugucc

SEQ ID NO: 2180192 - RNA, 19 nt, Homo sapiens
guguauuaaaccuuuccau

SEQ ID NO: 2180193 - RNA, 12 nt, Homo sapiens
acucugccauuc

SEQ ID NO: 2180194 - RNA, 12 nt, Homo sapiens
acuuugccauuu

SEQ ID NO: 2180195 - RNA, 20 nt, Homo sapiens
uucaugagaggaacuauacu

SEQ ID NO: 2180196 - RNA, 18 nt, Homo sapiens
uccaaugucaaugugaac

SEQ ID NO: 2180197 - RNA, 14 nt, Homo sapiens
accugaccucacag

SEQ ID NO: 2180198 - RNA, 20 nt, Homo sapiens
gugaaagucuccuguaucau

SEQ ID NO: 2180199 - RNA, 20 nt, Homo sapiens
gcuggaucuuuugguggagu

SEQ ID NO: 2180200 - RNA, 21 nt, Homo sapiens
auaugguaaauaaaacgugac

SEQ ID NO: 2180201 - RNA, 18 nt, Homo sapiens
augaagaaauacugcacu

SEQ ID NO: 2180202 - RNA, 12 nt, Homo sapiens
cuuuuaguauua

SEQ ID NO: 2180203 - RNA, 19 nt, Homo sapiens
aaaauguugagaaucccaa

SEQ ID NO: 2180204 - RNA, 17 nt, Homo sapiens
acccuucccagcccuca

SEQ ID NO: 2180205 - RNA, 21 nt, Homo sapiens
accgggcuggccugugccuau

SEQ ID NO: 2180206 - RNA, 23 nt, Homo sapiens
guguugauacuguugcacgugug

SEQ ID NO: 2180207 - RNA, 23 nt, Homo sapiens
gcaaaaccaaauauuccagagac

SEQ ID NO: 2180208 - RNA, 13 nt, Homo sapiens
aaccacuguacau

SEQ ID NO: 2180209 - RNA, 21 nt, Homo sapiens
agccccuuauuugcacuucac

SEQ ID NO: 2180210 - RNA, 19 nt, Homo sapiens
auaagauuaaugaccugaa

SEQ ID NO: 2180211 - RNA, 21 nt, Homo sapiens
ucauucacagggacauggaaa

SEQ ID NO: 2180212 - RNA, 12 nt, Homo sapiens
aauugauucaug

SEQ ID NO: 2180213 - RNA, 11 nt, Homo sapiens
caguucacagg

SEQ ID NO: 2180214 - RNA, 18 nt, Homo sapiens
uggaauacuuacucuugu

SEQ ID NO: 2180215 - RNA, 17 nt, Homo sapiens
gugcugggaagcccgga

SEQ ID NO: 2180216 - RNA, 19 nt, Homo sapiens
agucaagaacaauucacag

SEQ ID NO: 2180217 - RNA, 20 nt, Homo sapiens
uuuccagaguuugucauuau

SEQ ID NO: 2180218 - RNA, 15 nt, Homo sapiens
guaccugacuuccac

SEQ ID NO: 2180219 - RNA, 14 nt, Homo sapiens
gauuaucuacagaa

SEQ ID NO: 2180220 - RNA, 17 nt, Homo sapiens
ucuuuuuccuuuugcca

SEQ ID NO: 2180221 - RNA, 15 nt, Homo sapiens
uaaaaccauaaacug

SEQ ID NO: 2180222 - RNA, 16 nt, Homo sapiens
aaaugccucagcuaug

SEQ ID NO: 2180223 - RNA, 18 nt, Homo sapiens
ucaguucauccauucuau

SEQ ID NO: 2180224 - RNA, 23 nt, Homo sapiens
aaguagaccucuuuuucuuacca

SEQ ID NO: 2180225 - RNA, 20 nt, Homo sapiens
guaaccuugucgacaaagag

SEQ ID NO: 2180226 - RNA, 14 nt, Homo sapiens
uaagaauagugaaa

SEQ ID NO: 2180227 - RNA, 15 nt, Homo sapiens
cugcauguuuuccag

SEQ ID NO: 2180228 - RNA, 15 nt, Homo sapiens
ugccugcaugaaaca

SEQ ID NO: 2180229 - RNA, 14 nt, Homo sapiens
ugacaacugugaag

SEQ ID NO: 2180230 - RNA, 20 nt, Homo sapiens
uaacuggagccccaucagcu

SEQ ID NO: 2180231 - RNA, 15 nt, Homo sapiens
acuaucucaugccag

SEQ ID NO: 2180232 - RNA, 11 nt, Homo sapiens
aggagaaucuc

SEQ ID NO: 2180233 - RNA, 19 nt, Homo sapiens
uuuugaucuugugcuauga

SEQ ID NO: 2180234 - RNA, 15 nt, Homo sapiens
aguuaauucaccuau

SEQ ID NO: 2180235 - RNA, 16 nt, Homo sapiens
agaaauaaccaugaaa

SEQ ID NO: 2180236 - RNA, 17 nt, Homo sapiens
aaaaaauaacaucucuu

SEQ ID NO: 2180237 - RNA, 17 nt, Homo sapiens
accccuuuuugccuuac

SEQ ID NO: 2180238 - RNA, 17 nt, Homo sapiens
auuuucagacugcuuua

SEQ ID NO: 2180239 - RNA, 23 nt, Homo sapiens
uauuuauuacuuccucauaccac

SEQ ID NO: 2180240 - RNA, 20 nt, Homo sapiens
gaugacaaugggagccucau

SEQ ID NO: 2180241 - RNA, 20 nt, Homo sapiens
auacaaucagcccagugcaa

SEQ ID NO: 2180242 - RNA, 14 nt, Homo sapiens
uguagauuaccaaa

SEQ ID NO: 2180243 - RNA, 20 nt, Homo sapiens
ggaggcuccgugagcccuug

SEQ ID NO: 2180244 - RNA, 16 nt, Homo sapiens
aucaccuugcauuuca

SEQ ID NO: 2180245 - RNA, 16 nt, Homo sapiens
ccagcugugcacuuuc

SEQ ID NO: 2180246 - RNA, 13 nt, Homo sapiens
ggcuaaacucaag

SEQ ID NO: 2180247 - RNA, 15 nt, Homo sapiens
ugucuguuggcaaau

SEQ ID NO: 2180248 - RNA, 22 nt, Homo sapiens
cuaacccccacccccacugcca

SEQ ID NO: 2180249 - RNA, 13 nt, Homo sapiens
cacugagagugaa

SEQ ID NO: 2180250 - RNA, 20 nt, Homo sapiens
cauucuucacucuguuugaa

SEQ ID NO: 2180251 - RNA, 16 nt, Homo sapiens
guucuuacugcuuaau

SEQ ID NO: 2180252 - RNA, 18 nt, Homo sapiens
aauuuuuuugcauuuuca

SEQ ID NO: 2180253 - RNA, 18 nt, Homo sapiens
ugaggugugaaagcccag

SEQ ID NO: 2180254 - RNA, 13 nt, Homo sapiens
accacuucacuga

SEQ ID NO: 2180255 - RNA, 18 nt, Homo sapiens
ucuccugaagaggaacug

SEQ ID NO: 2180256 - RNA, 23 nt, Homo sapiens
uggauucauuacagcuuaaucaa

SEQ ID NO: 2180257 - RNA, 14 nt, Homo sapiens
ugauaaagagggau

SEQ ID NO: 2180258 - RNA, 13 nt, Homo sapiens
caggccucaggga

SEQ ID NO: 2180259 - RNA, 15 nt, Homo sapiens
ugaccauaaccacug

SEQ ID NO: 2180260 - RNA, 19 nt, Homo sapiens
uuuccuguagucccauuga

SEQ ID NO: 2180261 - RNA, 19 nt, Homo sapiens
aguccaucaaguaccucau

SEQ ID NO: 2180262 - RNA, 22 nt, Homo sapiens
gaugcuggucauccugggcaug

SEQ ID NO: 2180263 - RNA, 11 nt, Homo sapiens
acggcaaaaug

SEQ ID NO: 2180264 - RNA, 11 nt, Homo sapiens
uccagcaccuu

SEQ ID NO: 2180265 - RNA, 11 nt, Homo sapiens
cccagcacuuu

SEQ ID NO: 2180266 - RNA, 20 nt, Homo sapiens
cauugacugaacugcacguu

SEQ ID NO: 2180267 - RNA, 20 nt, Homo sapiens
ucaguagguugaacuaugaa

SEQ ID NO: 2180268 - RNA, 16 nt, Homo sapiens
ggacaugaaaaauugc

SEQ ID NO: 2180269 - RNA, 12 nt, Homo sapiens
gcuggcccugug

SEQ ID NO: 2180270 - RNA, 17 nt, Homo sapiens
ugacaguugcagcccuu

SEQ ID NO: 2180271 - RNA, 23 nt, Homo sapiens
caucucaaccccaucauccugcc

SEQ ID NO: 2180272 - RNA, 22 nt, Homo sapiens
aguucuguuauauccccugcua

SEQ ID NO: 2180273 - RNA, 22 nt, Homo sapiens
auucuuauaguaccucacugca

SEQ ID NO: 2180274 - RNA, 19 nt, Homo sapiens
caaauacauuaacaagcuc

SEQ ID NO: 2180275 - RNA, 15 nt, Homo sapiens
ugacgucaucuuguc

SEQ ID NO: 2180276 - RNA, 21 nt, Homo sapiens
caauucaaaacauugugccau

SEQ ID NO: 2180277 - RNA, 22 nt, Homo sapiens
gacaauuucuagaagacuacaa

SEQ ID NO: 2180278 - RNA, 14 nt, Homo sapiens
uucugucagcagua

SEQ ID NO: 2180279 - RNA, 15 nt, Homo sapiens
cacaguaagugugaa

SEQ ID NO: 2180280 - RNA, 13 nt, Homo sapiens
ucacuccuacccc

SEQ ID NO: 2180281 - RNA, 13 nt, Homo sapiens
gcagcaaacugcu

SEQ ID NO: 2180282 - RNA, 23 nt, Homo sapiens
aauuugagaaccuuggaccacuc

SEQ ID NO: 2180283 - RNA, 18 nt, Homo sapiens
aaauguuuggccaugcuu

SEQ ID NO: 2180284 - RNA, 19 nt, Homo sapiens
cacuggggcagaugucucc

SEQ ID NO: 2180285 - RNA, 19 nt, Homo sapiens
uccaagcugcucauuucac

SEQ ID NO: 2180286 - RNA, 12 nt, Homo sapiens
cccuggagcuga

SEQ ID NO: 2180287 - RNA, 13 nt, Homo sapiens
aauguaaagccau

SEQ ID NO: 2180288 - RNA, 19 nt, Homo sapiens
ggagcaugggccuggccac

SEQ ID NO: 2180289 - RNA, 15 nt, Homo sapiens
acugacaaauucugu

SEQ ID NO: 2180290 - RNA, 13 nt, Homo sapiens
auggagaaugcac

SEQ ID NO: 2180291 - RNA, 19 nt, Homo sapiens
aaguaauagggcuucugcc

SEQ ID NO: 2180292 - RNA, 21 nt, Homo sapiens
ucaguaauagcugaaccuguu

SEQ ID NO: 2180293 - RNA, 21 nt, Homo sapiens
ugauaaacauuaaacacugua

SEQ ID NO: 2180294 - RNA, 18 nt, Homo sapiens
aggauccccucucuuccu

SEQ ID NO: 2180295 - RNA, 12 nt, Homo sapiens
ccacaaacugau

SEQ ID NO: 2180296 - RNA, 17 nt, Homo sapiens
aaggaaaaaaaacacaa

SEQ ID NO: 2180297 - RNA, 21 nt, Homo sapiens
cacguccugggugcugucaug

SEQ ID NO: 2180298 - RNA, 20 nt, Homo sapiens
uuugaggccuuuuuugccag

SEQ ID NO: 2180299 - RNA, 15 nt, Homo sapiens
ugaauaacuaugcca

SEQ ID NO: 2180300 - RNA, 23 nt, Homo sapiens
ugacaacauugcauugugacuau

SEQ ID NO: 2180301 - RNA, 23 nt, Homo sapiens
cuuucugaggcccugagcauucu

SEQ ID NO: 2180302 - RNA, 22 nt, Homo sapiens
aagggcaacucacgggugcaug

SEQ ID NO: 2180303 - RNA, 20 nt, Homo sapiens
gguaaaggguggggcauuga

SEQ ID NO: 2180304 - RNA, 19 nt, Homo sapiens
ccauauuccagcagugaaa

SEQ ID NO: 2180305 - RNA, 23 nt, Homo sapiens
guuugcugccacacugucucauc

SEQ ID NO: 2180306 - RNA, 19 nt, Homo sapiens
uugaccaauaaccuaauug

SEQ ID NO: 2180307 - RNA, 19 nt, Homo sapiens
ccacuuaucaaaucauuca

SEQ ID NO: 2180308 - RNA, 20 nt, Homo sapiens
agcaacccuacaguauauaa

SEQ ID NO: 2180309 - RNA, 22 nt, Homo sapiens
uguucucauagaggaaauucaa

SEQ ID NO: 2180310 - RNA, 12 nt, Homo sapiens
ccccuccaggaa

SEQ ID NO: 2180311 - RNA, 17 nt, Homo sapiens
ugccacuuuacccaccu

SEQ ID NO: 2180312 - RNA, 16 nt, Homo sapiens
aaauaauuuucaagca

SEQ ID NO: 2180313 - RNA, 21 nt, Homo sapiens
cacauaugucuuacuacuuua

SEQ ID NO: 2180314 - RNA, 18 nt, Homo sapiens
cugccaugcccaccaucg

SEQ ID NO: 2180315 - RNA, 23 nt, Homo sapiens
cuccccuauguaaaacuuagcaa

SEQ ID NO: 2180316 - RNA, 21 nt, Homo sapiens
auucacuagguucgaauccag

SEQ ID NO: 2180317 - RNA, 19 nt, Homo sapiens
guuuguguguugucucuug

SEQ ID NO: 2180318 - RNA, 18 nt, Homo sapiens
ugaggaauguacuuuuaa

SEQ ID NO: 2180319 - RNA, 17 nt, Homo sapiens
cuaaggaagauaucuag

SEQ ID NO: 2180320 - RNA, 12 nt, Homo sapiens
ucacaagccaag

SEQ ID NO: 2180321 - RNA, 21 nt, Homo sapiens
uggggaccagcuuggcucagg

SEQ ID NO: 2180322 - RNA, 12 nt, Homo sapiens
caggaagcuuug

SEQ ID NO: 2180323 - RNA, 14 nt, Homo sapiens
cgugaucucagcuc

SEQ ID NO: 2180324 - RNA, 21 nt, Homo sapiens
cacucuuauuucacuaaagaa

SEQ ID NO: 2180325 - RNA, 18 nt, Homo sapiens
ugaugaaugaggaacaau

SEQ ID NO: 2180326 - RNA, 17 nt, Homo sapiens
auaaaagcacuuacuuc

SEQ ID NO: 2180327 - RNA, 19 nt, Homo sapiens
cucuuccagaagaugcccu

SEQ ID NO: 2180328 - RNA, 16 nt, Homo sapiens
aaggagcucacugugg

SEQ ID NO: 2180329 - RNA, 16 nt, Homo sapiens
gacuccgucucaaaaa

SEQ ID NO: 2180330 - RNA, 14 nt, Homo sapiens
aguuccuuucaucc

SEQ ID NO: 2180331 - RNA, 23 nt, Homo sapiens
uccauccacacacagcagcucca

SEQ ID NO: 2180332 - RNA, 20 nt, Homo sapiens
cacaaacauguguguacaug

SEQ ID NO: 2180333 - RNA, 12 nt, Homo sapiens
ucaccaaugagc

SEQ ID NO: 2180334 - RNA, 12 nt, Homo sapiens
gcacuguuuuca

SEQ ID NO: 2180335 - RNA, 20 nt, Homo sapiens
gagacaggaucguugucccu

SEQ ID NO: 2180336 - RNA, 15 nt, Homo sapiens
gcagggaugauggca

SEQ ID NO: 2180337 - RNA, 17 nt, Homo sapiens
ucuccaacggcaaggga

SEQ ID NO: 2180338 - RNA, 15 nt, Homo sapiens
gcauuugguacacac

SEQ ID NO: 2180339 - RNA, 14 nt, Homo sapiens
uagcagcuuuagcc

SEQ ID NO: 2180340 - RNA, 17 nt, Homo sapiens
auuccucagaaaccaaa

SEQ ID NO: 2180341 - RNA, 17 nt, Homo sapiens
cgugugugccaccucau

SEQ ID NO: 2180342 - RNA, 23 nt, Homo sapiens
uaaaauaggacauacuccccaau

SEQ ID NO: 2180343 - RNA, 22 nt, Homo sapiens
uaacauaauuuguacauaugua

SEQ ID NO: 2180344 - RNA, 22 nt, Homo sapiens
augugcaauaacucagcaguua

SEQ ID NO: 2180345 - RNA, 16 nt, Homo sapiens
auuccuguugauggga

SEQ ID NO: 2180346 - RNA, 17 nt, Homo sapiens
uuaggagugguucucau

SEQ ID NO: 2180347 - RNA, 14 nt, Homo sapiens
uaccagagauuuac

SEQ ID NO: 2180348 - RNA, 17 nt, Homo sapiens
uuuaauagguaaaccaa

SEQ ID NO: 2180349 - RNA, 19 nt, Homo sapiens
gauugggauuaacauaaaa

SEQ ID NO: 2180350 - RNA, 20 nt, Homo sapiens
caugacauagcuugagcuau

SEQ ID NO: 2180351 - RNA, 23 nt, Homo sapiens
acuccauggcuaagaccacagac

SEQ ID NO: 2180352 - RNA, 16 nt, Homo sapiens
aggcaguucuagaagc

SEQ ID NO: 2180353 - RNA, 18 nt, Homo sapiens
ccaggcccuacaaugcuc

SEQ ID NO: 2180354 - RNA, 15 nt, Homo sapiens
uuccagacuuugaaa

SEQ ID NO: 2180355 - RNA, 19 nt, Homo sapiens
cucccccuccuccagggaa

SEQ ID NO: 2180356 - RNA, 17 nt, Homo sapiens
ccucucggugaccuccg

SEQ ID NO: 2180357 - RNA, 16 nt, Homo sapiens
agaguuuugucauuca

SEQ ID NO: 2180358 - RNA, 13 nt, Homo sapiens
agacgucugccuu

SEQ ID NO: 2180359 - RNA, 18 nt, Homo sapiens
aaugacauauuuuaucuu

SEQ ID NO: 2180360 - RNA, 23 nt, Homo sapiens
ugggcuccccucuuccucuugac

SEQ ID NO: 2180361 - RNA, 17 nt, Homo sapiens
caaugcagugcagcaug

SEQ ID NO: 2180362 - RNA, 21 nt, Homo sapiens
cagauguacacccacccacau

SEQ ID NO: 2180363 - RNA, 21 nt, Homo sapiens
agcugcaaauugccugcaaaa

SEQ ID NO: 2180364 - RNA, 16 nt, Homo sapiens
cagguagcagcaaaua

SEQ ID NO: 2180365 - RNA, 21 nt, Homo sapiens
cuucuuccccaaggcacugag

SEQ ID NO: 2180366 - RNA, 20 nt, Homo sapiens
aaacuuugaggaacauucaa

SEQ ID NO: 2180367 - RNA, 17 nt, Homo sapiens
ugguuuauugaauguga

SEQ ID NO: 2180368 - RNA, 20 nt, Homo sapiens
aggggagcaagcuuacacaa

SEQ ID NO: 2180369 - RNA, 21 nt, Homo sapiens
acacugaaacagccagaucuc

SEQ ID NO: 2180370 - RNA, 14 nt, Homo sapiens
caacaagccauagu

SEQ ID NO: 2180371 - RNA, 19 nt, Homo sapiens
ugacagcucccgggucccc

SEQ ID NO: 2180372 - RNA, 23 nt, Homo sapiens
gcuuugugcuuguucuuccucuu

SEQ ID NO: 2180373 - RNA, 16 nt, Homo sapiens
ggagaccugcucuccg

SEQ ID NO: 2180374 - RNA, 17 nt, Homo sapiens
cagcugaccugguacug

SEQ ID NO: 2180375 - RNA, 20 nt, Homo sapiens
ggcuguauuugcuguugauu

SEQ ID NO: 2180376 - RNA, 18 nt, Homo sapiens
ugcccuuuuguaucuuaa

SEQ ID NO: 2180377 - RNA, 16 nt, Homo sapiens
uuggaauaaucacuug

SEQ ID NO: 2180378 - RNA, 14 nt, Homo sapiens
cuuggcuuuagcca

SEQ ID NO: 2180379 - RNA, 12 nt, Homo sapiens
cauuucaugucc

SEQ ID NO: 2180380 - RNA, 16 nt, Homo sapiens
cuccagaaacuuucca

SEQ ID NO: 2180381 - RNA, 15 nt, Homo sapiens
auagcuugaagccca

SEQ ID NO: 2180382 - RNA, 16 nt, Homo sapiens
ccccuuguugcacugc

SEQ ID NO: 2180383 - RNA, 22 nt, Homo sapiens
ccagcuaaaauuuucgacuuga

SEQ ID NO: 2180384 - RNA, 13 nt, Homo sapiens
cuggauauuucau

SEQ ID NO: 2180385 - RNA, 23 nt, Homo sapiens
ccaucagugcucuguaaaacaca

SEQ ID NO: 2180386 - RNA, 20 nt, Homo sapiens
cugccacaagcacaauugau

SEQ ID NO: 2180387 - RNA, 16 nt, Homo sapiens
acugcaccaacgagcu

SEQ ID NO: 2180388 - RNA, 18 nt, Homo sapiens
agccuggagccccugugu

SEQ ID NO: 2180389 - RNA, 20 nt, Homo sapiens
uuuuaaguuugugucguucc

SEQ ID NO: 2180390 - RNA, 16 nt, Homo sapiens
cggggugugguggccu

SEQ ID NO: 2180391 - RNA, 13 nt, Homo sapiens
gugccaugaucug

SEQ ID NO: 2180392 - RNA, 22 nt, Homo sapiens
accaagguuuugaaaucccauc

SEQ ID NO: 2180393 - RNA, 18 nt, Homo sapiens
cuuugaaugcggcccaac

SEQ ID NO: 2180394 - RNA, 15 nt, Homo sapiens
cuaaagcccauugcu

SEQ ID NO: 2180395 - RNA, 18 nt, Homo sapiens
ugccuguguacugccuua

SEQ ID NO: 2180396 - RNA, 17 nt, Homo sapiens
acaugcucaaugacucu

SEQ ID NO: 2180397 - RNA, 19 nt, Homo sapiens
gagcaaauaaagaccugag

SEQ ID NO: 2180398 - RNA, 14 nt, Homo sapiens
cacgaugcauuuaa

SEQ ID NO: 2180399 - RNA, 19 nt, Homo sapiens
cuggguccauccuggucag

SEQ ID NO: 2180400 - RNA, 16 nt, Homo sapiens
aggauuuucugaccuu

SEQ ID NO: 2180401 - RNA, 19 nt, Homo sapiens
augacugcuguacugcaau

SEQ ID NO: 2180402 - RNA, 19 nt, Homo sapiens
ugccuccucuccuccucag

SEQ ID NO: 2180403 - RNA, 20 nt, Homo sapiens
ccaagguugucagcuuugga

SEQ ID NO: 2180404 - RNA, 20 nt, Homo sapiens
agugcaauuuccccucugug

SEQ ID NO: 2180405 - RNA, 15 nt, Homo sapiens
uuaauuaaagcacac

SEQ ID NO: 2180406 - RNA, 22 nt, Homo sapiens
cagagcaaugacugugcucacc

SEQ ID NO: 2180407 - RNA, 14 nt, Homo sapiens
gaauuggaaucaca

SEQ ID NO: 2180408 - RNA, 18 nt, Homo sapiens
uggcaguguaugcucaua

SEQ ID NO: 2180409 - RNA, 19 nt, Homo sapiens
acaaauauugcuuggacua

SEQ ID NO: 2180410 - RNA, 22 nt, Homo sapiens
cugcucugucuucuuugcccac

SEQ ID NO: 2180411 - RNA, 13 nt, Homo sapiens
aguacuugucaua

SEQ ID NO: 2180412 - RNA, 17 nt, Homo sapiens
ucccgcuuagccugccu

SEQ ID NO: 2180413 - RNA, 19 nt, Homo sapiens
acaggcccggcuccaggcu

SEQ ID NO: 2180414 - RNA, 11 nt, Homo sapiens
cuucauauaac

SEQ ID NO: 2180415 - RNA, 11 nt, Homo sapiens
gcaagccagac

SEQ ID NO: 2180416 - RNA, 18 nt, Homo sapiens
uccaggcuggagugcaau

SEQ ID NO: 2180417 - RNA, 17 nt, Homo sapiens
uauaaauauccugcuca

SEQ ID NO: 2180418 - RNA, 19 nt, Homo sapiens
caguagaaauaauaugcau

SEQ ID NO: 2180419 - RNA, 16 nt, Homo sapiens
caacuguagucaucuu

SEQ ID NO: 2180420 - RNA, 15 nt, Homo sapiens
ugccugagaugcacg

SEQ ID NO: 2180421 - RNA, 23 nt, Homo sapiens
aggcuaauuuuuauauuuuuaga

SEQ ID NO: 2180422 - RNA, 21 nt, Homo sapiens
accugauuuaccucuuaccug

SEQ ID NO: 2180423 - RNA, 16 nt, Homo sapiens
acucacauuuacaagu

SEQ ID NO: 2180424 - RNA, 13 nt, Homo sapiens
agguggaagcaga

SEQ ID NO: 2180425 - RNA, 23 nt, Homo sapiens
uauuuugaaaaauuccuauugug

SEQ ID NO: 2180426 - RNA, 16 nt, Homo sapiens
auauuuucacaggugu

SEQ ID NO: 2180427 - RNA, 20 nt, Homo sapiens
aguauuuagaagccaacuau

SEQ ID NO: 2180428 - RNA, 19 nt, Homo sapiens
cuggcuucaccgcauucca

SEQ ID NO: 2180429 - RNA, 15 nt, Homo sapiens
ugacaagaauuguua

SEQ ID NO: 2180430 - RNA, 16 nt, Homo sapiens
gacggcugugggacca

SEQ ID NO: 2180431 - RNA, 13 nt, Homo sapiens
cagccagugccau

SEQ ID NO: 2180432 - RNA, 16 nt, Homo sapiens
gaagaaaauagucagu

SEQ ID NO: 2180433 - RNA, 14 nt, Homo sapiens
cuuaaugacaacac

SEQ ID NO: 2180434 - RNA, 15 nt, Homo sapiens
uggguuccagacaga

SEQ ID NO: 2180435 - RNA, 18 nt, Homo sapiens
acaaccugggcauuccuu

SEQ ID NO: 2180436 - RNA, 20 nt, Homo sapiens
acccaucgugguaugugaau

SEQ ID NO: 2180437 - RNA, 15 nt, Homo sapiens
acuuauugccaaaaa

SEQ ID NO: 2180438 - RNA, 14 nt, Homo sapiens
agagcagaugcaga

SEQ ID NO: 2180439 - RNA, 13 nt, Homo sapiens
cugaggcugugag

SEQ ID NO: 2180440 - RNA, 23 nt, Homo sapiens
ugucauauguauuuuguauuugc

SEQ ID NO: 2180441 - RNA, 12 nt, Homo sapiens
aaaacauguaug

SEQ ID NO: 2180442 - RNA, 22 nt, Homo sapiens
auucacuguuuguuacuaugua

SEQ ID NO: 2180443 - RNA, 16 nt, Homo sapiens
uugucucugucucuca

SEQ ID NO: 2180444 - RNA, 15 nt, Homo sapiens
cuuguugaugccagc

SEQ ID NO: 2180445 - RNA, 13 nt, Homo sapiens
cuuuuugaucugu

SEQ ID NO: 2180446 - RNA, 14 nt, Homo sapiens
ccccugcuuccacc

SEQ ID NO: 2180447 - RNA, 22 nt, Homo sapiens
ccccauucucaaaaacaaagag

SEQ ID NO: 2180448 - RNA, 21 nt, Homo sapiens
cucucaggcauggaugaauaa

SEQ ID NO: 2180449 - RNA, 18 nt, Homo sapiens
cuucaugugucuugcaau

SEQ ID NO: 2180450 - RNA, 14 nt, Homo sapiens
guauauuuaucaaa

SEQ ID NO: 2180451 - RNA, 24 nt, Homo sapiens
ugcccggcgcccucuguccugacu

SEQ ID NO: 2180452 - RNA, 18 nt, Homo sapiens
uucugugauauuguccaa

SEQ ID NO: 2180453 - RNA, 23 nt, Homo sapiens
guuacaaauuuuuuaauuuccaa

SEQ ID NO: 2180454 - RNA, 23 nt, Homo sapiens
gcagagcaccuuugcacaggaug

SEQ ID NO: 2180455 - RNA, 16 nt, Homo sapiens
cauuguagccuaauau

SEQ ID NO: 2180456 - RNA, 16 nt, Homo sapiens
aaauauugacaaguuu

SEQ ID NO: 2180457 - RNA, 22 nt, Homo sapiens
ugaagcuaauugugcacaucuu

SEQ ID NO: 2180458 - RNA, 14 nt, Homo sapiens
uuuaaacuauucag

SEQ ID NO: 2180459 - RNA, 12 nt, Homo sapiens
ggucacaggccc

SEQ ID NO: 2180460 - RNA, 14 nt, Homo sapiens
uucucauuucaccc

SEQ ID NO: 2180461 - RNA, 14 nt, Homo sapiens
cauaggcagcaucu

SEQ ID NO: 2180462 - RNA, 23 nt, Homo sapiens
aggcccuuccucuccacugccuu

SEQ ID NO: 2180463 - RNA, 21 nt, Homo sapiens
uacagggagccuccugcccag

SEQ ID NO: 2180464 - RNA, 21 nt, Homo sapiens
cuucaucuggcaacaucuuua

SEQ ID NO: 2180465 - RNA, 19 nt, Homo sapiens
ccugucuuggccucccaaa

SEQ ID NO: 2180466 - RNA, 16 nt, Homo sapiens
uaaauuauagaaucua

SEQ ID NO: 2180467 - RNA, 15 nt, Homo sapiens
aguuguuggucugua

SEQ ID NO: 2180468 - RNA, 17 nt, Homo sapiens
acccagugugugcucag

SEQ ID NO: 2180469 - RNA, 22 nt, Homo sapiens
uagagccauuagagcacagcuu

SEQ ID NO: 2180470 - RNA, 15 nt, Homo sapiens
aaaugcaccauguca

SEQ ID NO: 2180471 - RNA, 23 nt, Homo sapiens
gacuaagccuaccugcucuccaa

SEQ ID NO: 2180472 - RNA, 18 nt, Homo sapiens
gacuccuagauccaggga

SEQ ID NO: 2180473 - RNA, 19 nt, Homo sapiens
ucuccaugaucccaccucc

SEQ ID NO: 2180474 - RNA, 16 nt, Homo sapiens
uuaaucucuccaccuu

SEQ ID NO: 2180475 - RNA, 14 nt, Homo sapiens
guucaguaccacau

SEQ ID NO: 2180476 - RNA, 14 nt, Homo sapiens
accauccuguauuc

SEQ ID NO: 2180477 - RNA, 17 nt, Homo sapiens
gguuagugaugcaguua

SEQ ID NO: 2180478 - RNA, 12 nt, Homo sapiens
cugcaguucccu

SEQ ID NO: 2180479 - RNA, 16 nt, Homo sapiens
guuagauucucauuca

SEQ ID NO: 2180480 - RNA, 16 nt, Homo sapiens
agaccaaaauaugaaa

SEQ ID NO: 2180481 - RNA, 18 nt, Homo sapiens
guuuuuucuguacacaga

SEQ ID NO: 2180482 - RNA, 18 nt, Homo sapiens
uauauacccacacacaua

SEQ ID NO: 2180483 - RNA, 12 nt, Homo sapiens
gagcuucugggg

SEQ ID NO: 2180484 - RNA, 18 nt, Homo sapiens
aaucauggagcaagagaa

SEQ ID NO: 2180485 - RNA, 17 nt, Homo sapiens
auugucuuauuacagca

SEQ ID NO: 2180486 - RNA, 22 nt, Homo sapiens
gaaaggcaaaugcccaagggaa

SEQ ID NO: 2180487 - RNA, 18 nt, Homo sapiens
caugcuggcuuuugugcc

SEQ ID NO: 2180488 - RNA, 12 nt, Homo sapiens
cuauuguguuau

SEQ ID NO: 2180489 - RNA, 12 nt, Homo sapiens
uacuugugcacu

SEQ ID NO: 2180490 - RNA, 17 nt, Homo sapiens
cauuuggggaccacaga

SEQ ID NO: 2180491 - RNA, 19 nt, Homo sapiens
gccauaauuacuaugucau

SEQ ID NO: 2180492 - RNA, 17 nt, Homo sapiens
aggggguuugggggcuu

SEQ ID NO: 2180493 - RNA, 14 nt, Homo sapiens
uggcugauggagua

SEQ ID NO: 2180494 - RNA, 14 nt, Homo sapiens
ccagaggcucuaau

SEQ ID NO: 2180495 - RNA, 18 nt, Homo sapiens
gcaccauggacaugugua

SEQ ID NO: 2180496 - RNA, 16 nt, Homo sapiens
aaggaaauaugaucca

SEQ ID NO: 2180497 - RNA, 20 nt, Homo sapiens
guugagaauuaucaccauga

SEQ ID NO: 2180498 - RNA, 18 nt, Homo sapiens
augauuucauguacugca

SEQ ID NO: 2180499 - RNA, 18 nt, Homo sapiens
ucagauucuugcugugac

SEQ ID NO: 2180500 - RNA, 22 nt, Homo sapiens
cucacaucacuguccaccacca

SEQ ID NO: 2180501 - RNA, 20 nt, Homo sapiens
cauaugccaccccaugugcc

SEQ ID NO: 2180502 - RNA, 21 nt, Homo sapiens
ugcuccuugauaaaguauuau

SEQ ID NO: 2180503 - RNA, 15 nt, Homo sapiens
uccagcuuucugcca

SEQ ID NO: 2180504 - RNA, 15 nt, Homo sapiens
gcugcauuuuacaca

SEQ ID NO: 2180505 - RNA, 11 nt, Homo sapiens
aauugcucaag

SEQ ID NO: 2180506 - RNA, 11 nt, Homo sapiens
aguugcucagg

SEQ ID NO: 2180507 - RNA, 17 nt, Homo sapiens
uugacuugacagaacac

SEQ ID NO: 2180508 - RNA, 16 nt, Homo sapiens
cccuauucguagccau

SEQ ID NO: 2180509 - RNA, 18 nt, Homo sapiens
aagcuaaugucacaauua

SEQ ID NO: 2180510 - RNA, 14 nt, Homo sapiens
ucaacaaagucacc

SEQ ID NO: 2180511 - RNA, 21 nt, Homo sapiens
aacuucucugugaacuauuaa

SEQ ID NO: 2180512 - RNA, 22 nt, Homo sapiens
cucacacuguaagaguucacau

SEQ ID NO: 2180513 - RNA, 19 nt, Homo sapiens
cucucggcuggaagaacau

SEQ ID NO: 2180514 - RNA, 17 nt, Homo sapiens
acucacacaugccacaa

SEQ ID NO: 2180515 - RNA, 16 nt, Homo sapiens
cuuuugccauuagcca

SEQ ID NO: 2180516 - RNA, 18 nt, Homo sapiens
aguuuagaacgcaauguu

SEQ ID NO: 2180517 - RNA, 23 nt, Homo sapiens
uccccuccgucugugacauggag

SEQ ID NO: 2180518 - RNA, 16 nt, Homo sapiens
ccuugggcugcuccuc

SEQ ID NO: 2180519 - RNA, 21 nt, Homo sapiens
cuagaaccucucguaguccau

SEQ ID NO: 2180520 - RNA, 15 nt, Homo sapiens
uaaagccucaagguu

SEQ ID NO: 2180521 - RNA, 14 nt, Homo sapiens
uacguacuacuugu

SEQ ID NO: 2180522 - RNA, 16 nt, Homo sapiens
auuaagaaauacucau

SEQ ID NO: 2180523 - RNA, 18 nt, Homo sapiens
uuuaacauuuuacaguaa

SEQ ID NO: 2180524 - RNA, 16 nt, Homo sapiens
aaccugaaauuaacuc

SEQ ID NO: 2180525 - RNA, 17 nt, Homo sapiens
cuucacugcugugacuu

SEQ ID NO: 2180526 - RNA, 11 nt, Homo sapiens
ccuccuacccu

SEQ ID NO: 2180527 - RNA, 11 nt, Homo sapiens
ccaccuaccca

SEQ ID NO: 2180528 - RNA, 22 nt, Homo sapiens
uggaugggccuuugagccugau

SEQ ID NO: 2180529 - RNA, 16 nt, Homo sapiens
cccuuuguccacaagu

SEQ ID NO: 2180530 - RNA, 21 nt, Homo sapiens
gagaaggcaggaacacuggag

SEQ ID NO: 2180531 - RNA, 19 nt, Homo sapiens
gaacaggccgcacaucuca

SEQ ID NO: 2180532 - RNA, 18 nt, Homo sapiens
cccaaaacccugaagcca

SEQ ID NO: 2180533 - RNA, 17 nt, Homo sapiens
uccaaaaccuuccucuu

SEQ ID NO: 2180534 - RNA, 17 nt, Homo sapiens
cuuaagagaugccucau

SEQ ID NO: 2180535 - RNA, 13 nt, Homo sapiens
auucacaucucau

SEQ ID NO: 2180536 - RNA, 20 nt, Homo sapiens
ugaacaaaaaaaugcucaca

SEQ ID NO: 2180537 - RNA, 23 nt, Homo sapiens
accccugucccuccccugggcac

SEQ ID NO: 2180538 - RNA, 18 nt, Homo sapiens
ucccauuucuugcuagcu

SEQ ID NO: 2180539 - RNA, 22 nt, Homo sapiens
gucuaacuuaaauagcuuugag

SEQ ID NO: 2180540 - RNA, 15 nt, Homo sapiens
aaagucacccaaaca

SEQ ID NO: 2180541 - RNA, 17 nt, Homo sapiens
cugucuauaagagaauu

SEQ ID NO: 2180542 - RNA, 23 nt, Homo sapiens
agugugggcgcucucccuaccuu

SEQ ID NO: 2180543 - RNA, 16 nt, Homo sapiens
cagaaaucacugugaa

SEQ ID NO: 2180544 - RNA, 21 nt, Homo sapiens
aagcaggaaggucucaugccu

SEQ ID NO: 2180545 - RNA, 15 nt, Homo sapiens
uuccuaggccucagg

SEQ ID NO: 2180546 - RNA, 20 nt, Homo sapiens
augauuuuuaaaaguugcua

SEQ ID NO: 2180547 - RNA, 15 nt, Homo sapiens
aauggccauguuguc

SEQ ID NO: 2180548 - RNA, 19 nt, Homo sapiens
aaaaugugaaucucuuaau

SEQ ID NO: 2180549 - RNA, 20 nt, Homo sapiens
uauuuucuacaaauguuacu

SEQ ID NO: 2180550 - RNA, 20 nt, Homo sapiens
cggccaggcuggagugcagu

SEQ ID NO: 2180551 - RNA, 18 nt, Homo sapiens
uuuauccauuugauuuga

SEQ ID NO: 2180552 - RNA, 21 nt, Homo sapiens
uggccaaugagaucauuguga

SEQ ID NO: 2180553 - RNA, 16 nt, Homo sapiens
uacuguuuuugauaaa

SEQ ID NO: 2180554 - RNA, 14 nt, Homo sapiens
uaacuccugccauu

SEQ ID NO: 2180555 - RNA, 14 nt, Homo sapiens
guuguaaaaagccc

SEQ ID NO: 2180556 - RNA, 23 nt, Homo sapiens
cacauguguuucugucucuccau

SEQ ID NO: 2180557 - RNA, 19 nt, Homo sapiens
cucaaacuccugaccucaa

SEQ ID NO: 2180558 - RNA, 20 nt, Homo sapiens
agcccacugccuccugccug

SEQ ID NO: 2180559 - RNA, 18 nt, Homo sapiens
augguuucuaucugcaau

SEQ ID NO: 2180560 - RNA, 12 nt, Homo sapiens
agucuucacuaa

SEQ ID NO: 2180561 - RNA, 22 nt, Homo sapiens
cuaguuaauguuuauuguucaa

SEQ ID NO: 2180562 - RNA, 23 nt, Homo sapiens
ccgggcaccaacuccauguuugg

SEQ ID NO: 2180563 - RNA, 16 nt, Homo sapiens
ugcgucggcccugggg

SEQ ID NO: 2180564 - RNA, 15 nt, Homo sapiens
uuucaauuaauauua

SEQ ID NO: 2180565 - RNA, 19 nt, Homo sapiens
cauaggggaguaggggugg

SEQ ID NO: 2180566 - RNA, 15 nt, Homo sapiens
cuuaugaaaaucaua

SEQ ID NO: 2180567 - RNA, 16 nt, Homo sapiens
uuuucuauuauggaaa

SEQ ID NO: 2180568 - RNA, 10 nt, Homo sapiens
cccacuuccu

SEQ ID NO: 2180569 - RNA, 10 nt, Homo sapiens
accacuucau

SEQ ID NO: 2180570 - RNA, 12 nt, Homo sapiens
aaaagggcaaua

SEQ ID NO: 2180571 - RNA, 21 nt, Homo sapiens
acgucccagcggccucagggu

SEQ ID NO: 2180572 - RNA, 20 nt, Homo sapiens
auucuuccauuaaauugccu

SEQ ID NO: 2180573 - RNA, 17 nt, Homo sapiens
cuucaagaaauuacugg

SEQ ID NO: 2180574 - RNA, 16 nt, Homo sapiens
gccuucucacuagcug

SEQ ID NO: 2180575 - RNA, 13 nt, Homo sapiens
uagaggugcuuuu

SEQ ID NO: 2180576 - RNA, 11 nt, Homo sapiens
agggcacauua

SEQ ID NO: 2180577 - RNA, 18 nt, Homo sapiens
uuucucuuuuucauucau

SEQ ID NO: 2180578 - RNA, 22 nt, Homo sapiens
ugaaaauuacacccaugcacag

SEQ ID NO: 2180579 - RNA, 17 nt, Homo sapiens
cauucuccuccauacau

SEQ ID NO: 2180580 - RNA, 20 nt, Homo sapiens
caacacuuuuuauguuauau

SEQ ID NO: 2180581 - RNA, 22 nt, Homo sapiens
aggugcuacuuuauaauaagac

SEQ ID NO: 2180582 - RNA, 21 nt, Homo sapiens
ccccuuccuguguccauguga

SEQ ID NO: 2180583 - RNA, 21 nt, Homo sapiens
cucccuuaauaaacucacaac

SEQ ID NO: 2180584 - RNA, 14 nt, Homo sapiens
aaaaacaacagcca

SEQ ID NO: 2180585 - RNA, 18 nt, Homo sapiens
acaaagccgugccuuucu

SEQ ID NO: 2180586 - RNA, 15 nt, Homo sapiens
ccauguagaagcugc

SEQ ID NO: 2180587 - RNA, 20 nt, Homo sapiens
ugcacguugugcacauguac

SEQ ID NO: 2180588 - RNA, 16 nt, Homo sapiens
uucagccugaaagagg

SEQ ID NO: 2180589 - RNA, 16 nt, Homo sapiens
aaccccaagacagucu

SEQ ID NO: 2180590 - RNA, 12 nt, Homo sapiens
uaugguggcaua

SEQ ID NO: 2180591 - RNA, 19 nt, Homo sapiens
acucacccucauaccaucu

SEQ ID NO: 2180592 - RNA, 15 nt, Homo sapiens
aaggcacacugagca

SEQ ID NO: 2180593 - RNA, 23 nt, Homo sapiens
uccuguggaugcaaauagauuca

SEQ ID NO: 2180594 - RNA, 20 nt, Homo sapiens
ccacggaccguugcacaaaa

SEQ ID NO: 2180595 - RNA, 16 nt, Homo sapiens
guggagcugcuggugu

SEQ ID NO: 2180596 - RNA, 19 nt, Homo sapiens
ccgcacugcccaggucccu

SEQ ID NO: 2180597 - RNA, 17 nt, Homo sapiens
uaaccagcucaguguuu

SEQ ID NO: 2180598 - RNA, 17 nt, Homo sapiens
augcacauuugugcaua

SEQ ID NO: 2180599 - RNA, 21 nt, Homo sapiens
auacccaaguuauugggaugu

SEQ ID NO: 2180600 - RNA, 22 nt, Homo sapiens
ccucucucacacaucacauucc

SEQ ID NO: 2180601 - RNA, 18 nt, Homo sapiens
uacaauggcgugaucuca

SEQ ID NO: 2180602 - RNA, 21 nt, Homo sapiens
uuaaggagguagcucccagca

SEQ ID NO: 2180603 - RNA, 23 nt, Homo sapiens
aaauugauugucaaauacagcau

SEQ ID NO: 2180604 - RNA, 21 nt, Homo sapiens
acuaagaaaaaaagcacaaag

SEQ ID NO: 2180605 - RNA, 15 nt, Homo sapiens
cucaugucuuucuca

SEQ ID NO: 2180606 - RNA, 23 nt, Homo sapiens
gaggagccccuggacaugccugu

SEQ ID NO: 2180607 - RNA, 15 nt, Homo sapiens
gacagucaugcaguc

SEQ ID NO: 2180608 - RNA, 17 nt, Homo sapiens
gagcacaaacuucagaa

SEQ ID NO: 2180609 - RNA, 13 nt, Homo sapiens
ccaggagacaguu

SEQ ID NO: 2180610 - RNA, 15 nt, Homo sapiens
ugcauucacauaucu

SEQ ID NO: 2180611 - RNA, 18 nt, Homo sapiens
cgaaguagcugggauuac

SEQ ID NO: 2180612 - RNA, 19 nt, Homo sapiens
aaggaaaucuccucuuuug

SEQ ID NO: 2180613 - RNA, 16 nt, Homo sapiens
agccucuggcauuaga

SEQ ID NO: 2180614 - RNA, 22 nt, Homo sapiens
ccucaucauuucccaucuggac

SEQ ID NO: 2180615 - RNA, 14 nt, Homo sapiens
gaauugcaugccau

SEQ ID NO: 2180616 - RNA, 23 nt, Homo sapiens
cagaccucagagauggcuuccuu

SEQ ID NO: 2180617 - RNA, 23 nt, Homo sapiens
ccugcucuuucucugagaaccaa

SEQ ID NO: 2180618 - RNA, 22 nt, Homo sapiens
acuggugcaauuacagcaaaaa

SEQ ID NO: 2180619 - RNA, 12 nt, Homo sapiens
gcgaggggccca

SEQ ID NO: 2180620 - RNA, 15 nt, Homo sapiens
uaccacucagagaaa

SEQ ID NO: 2180621 - RNA, 17 nt, Homo sapiens
agacucccaagcuggac

SEQ ID NO: 2180622 - RNA, 16 nt, Homo sapiens
cuuauuguaacccugu

SEQ ID NO: 2180623 - RNA, 16 nt, Homo sapiens
augcaugaagauucga

SEQ ID NO: 2180624 - RNA, 11 nt, Homo sapiens
acagcacacag

SEQ ID NO: 2180625 - RNA, 22 nt, Homo sapiens
cacugcugaggcuucauaauca

SEQ ID NO: 2180626 - RNA, 21 nt, Homo sapiens
uaccagugaauuuuugcaaua

SEQ ID NO: 2180627 - RNA, 17 nt, Homo sapiens
uugcuguugcuguugcu

SEQ ID NO: 2180628 - RNA, 14 nt, Homo sapiens
cuauugaacugagc

SEQ ID NO: 2180629 - RNA, 13 nt, Homo sapiens
aaacgguuccugg

SEQ ID NO: 2180630 - RNA, 17 nt, Homo sapiens
gaagcuucuugcuccug

SEQ ID NO: 2180631 - RNA, 16 nt, Homo sapiens
ccucccaaucuugccc

SEQ ID NO: 2180632 - RNA, 15 nt, Homo sapiens
ggccaagcugaggug

SEQ ID NO: 2180633 - RNA, 20 nt, Homo sapiens
aaucccccaucguuacccau

SEQ ID NO: 2180634 - RNA, 14 nt, Homo sapiens
ccccaaccacagag

SEQ ID NO: 2180635 - RNA, 22 nt, Homo sapiens
cucucuuucuuuugugcauaug

SEQ ID NO: 2180636 - RNA, 17 nt, Homo sapiens
uggaaguuuagcucuga

SEQ ID NO: 2180637 - RNA, 20 nt, Homo sapiens
agaauuggagcuguacgagu

SEQ ID NO: 2180638 - RNA, 15 nt, Homo sapiens
gaggcuuuucccacc

SEQ ID NO: 2180639 - RNA, 15 nt, Homo sapiens
ccauuuacaauugca

SEQ ID NO: 2180640 - RNA, 17 nt, Homo sapiens
ccucacaucuuucacac

SEQ ID NO: 2180641 - RNA, 17 nt, Homo sapiens
aacaacagugugaucau

SEQ ID NO: 2180642 - RNA, 15 nt, Homo sapiens
agucaucucauucca

SEQ ID NO: 2180643 - RNA, 14 nt, Homo sapiens
ggaucacacgagcu

SEQ ID NO: 2180644 - RNA, 21 nt, Homo sapiens
gagcucacacuccaguggcag

SEQ ID NO: 2180645 - RNA, 17 nt, Homo sapiens
aaaaguaaggugcaguu

SEQ ID NO: 2180646 - RNA, 18 nt, Homo sapiens
gucaugaccuagaugacc

SEQ ID NO: 2180647 - RNA, 16 nt, Homo sapiens
uaaagcugaaaacugc

SEQ ID NO: 2180648 - RNA, 14 nt, Homo sapiens
ccuguucaucccau

SEQ ID NO: 2180649 - RNA, 15 nt, Homo sapiens
guaagaaaacaaaca

SEQ ID NO: 2180650 - RNA, 14 nt, Homo sapiens
gccucagcuaccca

SEQ ID NO: 2180651 - RNA, 22 nt, Homo sapiens
uaaagcugccggcacagaacuu

SEQ ID NO: 2180652 - RNA, 16 nt, Homo sapiens
ccaauuccuugcacau

SEQ ID NO: 2180653 - RNA, 22 nt, Homo sapiens
guuccauuccauggaaccaugg

SEQ ID NO: 2180654 - RNA, 13 nt, Homo sapiens
uggaacauuccag

SEQ ID NO: 2180655 - RNA, 20 nt, Homo sapiens
aguacuugacuaccuacugg

SEQ ID NO: 2180656 - RNA, 21 nt, Homo sapiens
cacaguggagagggcuacaaa

SEQ ID NO: 2180657 - RNA, 16 nt, Homo sapiens
caacuaucauaccugg

SEQ ID NO: 2180658 - RNA, 22 nt, Homo sapiens
augcugucugguugcgccauuu

SEQ ID NO: 2180659 - RNA, 20 nt, Homo sapiens
accacaaugcgcauguaguu

SEQ ID NO: 2180660 - RNA, 15 nt, Homo sapiens
caaaacacaaacugu

SEQ ID NO: 2180661 - RNA, 19 nt, Homo sapiens
gaaaugcucuuuugcacaa

SEQ ID NO: 2180662 - RNA, 18 nt, Homo sapiens
aacagcccuccucugcac

SEQ ID NO: 2180663 - RNA, 12 nt, Homo sapiens
uuuggauuuucc

SEQ ID NO: 2180664 - RNA, 19 nt, Homo sapiens
gaaaguucuugguggugga

SEQ ID NO: 2180665 - RNA, 18 nt, Homo sapiens
ugaggagugccagcucaa

SEQ ID NO: 2180666 - RNA, 16 nt, Homo sapiens
agagggccucaaucuc

SEQ ID NO: 2180667 - RNA, 12 nt, Homo sapiens
ccuugaccuucc

SEQ ID NO: 2180668 - RNA, 19 nt, Homo sapiens
auucucaucaguccauugc

SEQ ID NO: 2180669 - RNA, 22 nt, Homo sapiens
auaaauuauuuuugaggacugu

SEQ ID NO: 2180670 - RNA, 18 nt, Homo sapiens
cugggaccugagucaaug

SEQ ID NO: 2180671 - RNA, 16 nt, Homo sapiens
caagaaacaaugucug

SEQ ID NO: 2180672 - RNA, 17 nt, Homo sapiens
gaagauuucauggacau

SEQ ID NO: 2180673 - RNA, 16 nt, Homo sapiens
acuaaccacauuuuag

SEQ ID NO: 2180674 - RNA, 22 nt, Homo sapiens
cuucugaagcagagaccggaca

SEQ ID NO: 2180675 - RNA, 18 nt, Homo sapiens
uggcauguguacaaugaa

SEQ ID NO: 2180676 - RNA, 15 nt, Homo sapiens
caucucuacugaaaa

SEQ ID NO: 2180677 - RNA, 15 nt, Homo sapiens
aauauaccauuucaa

SEQ ID NO: 2180678 - RNA, 20 nt, Homo sapiens
gagugggggugggggguccc

SEQ ID NO: 2180679 - RNA, 17 nt, Homo sapiens
cuuuuuaaaugugauca

SEQ ID NO: 2180680 - RNA, 13 nt, Homo sapiens
cucucacugcauu

SEQ ID NO: 2180681 - RNA, 21 nt, Homo sapiens
ugcauaaaauagagugcauuu

SEQ ID NO: 2180682 - RNA, 19 nt, Homo sapiens
guguacaccugcggggcca

SEQ ID NO: 2180683 - RNA, 13 nt, Homo sapiens
gcacuucauguaa

SEQ ID NO: 2180684 - RNA, 13 nt, Homo sapiens
auuaaauguuuca

SEQ ID NO: 2180685 - RNA, 12 nt, Homo sapiens
cucacuggagau

SEQ ID NO: 2180686 - RNA, 23 nt, Homo sapiens
aauacucuuccaaaagccugcau

SEQ ID NO: 2180687 - RNA, 20 nt, Homo sapiens
ggacacagucagauuuccag

SEQ ID NO: 2180688 - RNA, 18 nt, Homo sapiens
guuacaauaaaacuaaau

SEQ ID NO: 2180689 - RNA, 18 nt, Homo sapiens
ugggagggugggaccaau

SEQ ID NO: 2180690 - RNA, 11 nt, Homo sapiens
cagauguuaaa

SEQ ID NO: 2180691 - RNA, 19 nt, Homo sapiens
acuacauauuugcacugaa

SEQ ID NO: 2180692 - RNA, 19 nt, Homo sapiens
ugacuaauuaggcaaggcu

SEQ ID NO: 2180693 - RNA, 19 nt, Homo sapiens
uuuugguauuacacuguau

SEQ ID NO: 2180694 - RNA, 13 nt, Homo sapiens
ccucuggcucuca

SEQ ID NO: 2180695 - RNA, 20 nt, Homo sapiens
ugaauguaaaaauuggucac

SEQ ID NO: 2180696 - RNA, 17 nt, Homo sapiens
uacuuuugauccugggg

SEQ ID NO: 2180697 - RNA, 17 nt, Homo sapiens
cuuagcugaugucuuug

SEQ ID NO: 2180698 - RNA, 20 nt, Homo sapiens
agagagccuuuuucuaggcc

SEQ ID NO: 2180699 - RNA, 16 nt, Homo sapiens
ugagguauaaagacaa

SEQ ID NO: 2180700 - RNA, 21 nt, Homo sapiens
ugccacacggaagcaagcaga

SEQ ID NO: 2180701 - RNA, 16 nt, Homo sapiens
uacauugaguagacac

SEQ ID NO: 2180702 - RNA, 15 nt, Homo sapiens
guauaacuuauucac

SEQ ID NO: 2180703 - RNA, 14 nt, Homo sapiens
cuagggagccauuu

SEQ ID NO: 2180704 - RNA, 15 nt, Homo sapiens
uucugguacagagaa

SEQ ID NO: 2180705 - RNA, 17 nt, Homo sapiens
uguguaaguccuaauaa

SEQ ID NO: 2180706 - RNA, 19 nt, Homo sapiens
ucaguccuggucugcucag

SEQ ID NO: 2180707 - RNA, 14 nt, Homo sapiens
aaagaauacuugaa

SEQ ID NO: 2180708 - RNA, 14 nt, Homo sapiens
auauaauacauuaa

SEQ ID NO: 2180709 - RNA, 23 nt, Homo sapiens
cugccccagcacucacacccuaa

SEQ ID NO: 2180710 - RNA, 18 nt, Homo sapiens
uauguauaacaagccaaa

SEQ ID NO: 2180711 - RNA, 19 nt, Homo sapiens
ggaggacgguuaacuugua

SEQ ID NO: 2180712 - RNA, 16 nt, Homo sapiens
ugugaccaucccaaca

SEQ ID NO: 2180713 - RNA, 22 nt, Homo sapiens
agcuuaaaguuauguuauuaua

SEQ ID NO: 2180714 - RNA, 22 nt, Homo sapiens
ccucaggaccuuuuggucuuca

SEQ ID NO: 2180715 - RNA, 19 nt, Homo sapiens
ucauucucuugaaggugcu

SEQ ID NO: 2180716 - RNA, 14 nt, Homo sapiens
cagagaaaguacuu

SEQ ID NO: 2180717 - RNA, 18 nt, Homo sapiens
ccauaagaggaguaggcc

SEQ ID NO: 2180718 - RNA, 18 nt, Homo sapiens
guacucuccaaaggcccu

SEQ ID NO: 2180719 - RNA, 21 nt, Homo sapiens
aacuaggaaaaucacuugcca

SEQ ID NO: 2180720 - RNA, 17 nt, Homo sapiens
uggaguccuguucucag

SEQ ID NO: 2180721 - RNA, 12 nt, Homo sapiens
gggaaauugcuu

SEQ ID NO: 2180722 - RNA, 14 nt, Homo sapiens
aggaagaugaaucc

SEQ ID NO: 2180723 - RNA, 18 nt, Homo sapiens
ugugaagcaccuacuaug

SEQ ID NO: 2180724 - RNA, 14 nt, Homo sapiens
uugcugcugugaau

SEQ ID NO: 2180725 - RNA, 18 nt, Homo sapiens
cuaugaaagacucaaaaa

SEQ ID NO: 2180726 - RNA, 17 nt, Homo sapiens
cuaagauaaaaauaaua

SEQ ID NO: 2180727 - RNA, 21 nt, Homo sapiens
cauuuuauaccaaaggugcua

SEQ ID NO: 2180728 - RNA, 19 nt, Homo sapiens
auaaauauuuagucugcau

SEQ ID NO: 2180729 - RNA, 18 nt, Homo sapiens
ucuauuuggggcuugaug

SEQ ID NO: 2180730 - RNA, 21 nt, Homo sapiens
cagugagccgagauugcacca

SEQ ID NO: 2180731 - RNA, 15 nt, Homo sapiens
ugcccugcucuucag

SEQ ID NO: 2180732 - RNA, 13 nt, Homo sapiens
cuccucuaucuua

SEQ ID NO: 2180733 - RNA, 24 nt, Homo sapiens
agcaacuucaaguauaacaacuuu

SEQ ID NO: 2180734 - RNA, 19 nt, Homo sapiens
cccccaucuuuacaaagaa

SEQ ID NO: 2180735 - RNA, 17 nt, Homo sapiens
gguauugucuuuugaca

SEQ ID NO: 2180736 - RNA, 15 nt, Homo sapiens
aggcagccacuccua

SEQ ID NO: 2180737 - RNA, 13 nt, Homo sapiens
gcccaaagugcuu

SEQ ID NO: 2180738 - RNA, 21 nt, Homo sapiens
gccaauugggaagagugacuu

SEQ ID NO: 2180739 - RNA, 21 nt, Homo sapiens
aucacgccauuguacuccagc

SEQ ID NO: 2180740 - RNA, 13 nt, Homo sapiens
ugaacagguguuu

SEQ ID NO: 2180741 - RNA, 21 nt, Homo sapiens
cuauuuauuuauuuauucauu

SEQ ID NO: 2180742 - RNA, 21 nt, Homo sapiens
aggaagugagguagugccaau

SEQ ID NO: 2180743 - RNA, 15 nt, Homo sapiens
aauaaaguguuuuca

SEQ ID NO: 2180744 - RNA, 21 nt, Homo sapiens
caggcgugauggcaggugccu

SEQ ID NO: 2180745 - RNA, 15 nt, Homo sapiens
cacuccccucaucca

SEQ ID NO: 2180746 - RNA, 21 nt, Homo sapiens
guggagacuaacuuauuuuga

SEQ ID NO: 2180747 - RNA, 21 nt, Homo sapiens
auuucccuuuagcuguguuau

SEQ ID NO: 2180748 - RNA, 19 nt, Homo sapiens
aauuggcaguuccuggcau

SEQ ID NO: 2180749 - RNA, 19 nt, Homo sapiens
caaacuaacaggaacaaaa

SEQ ID NO: 2180750 - RNA, 12 nt, Homo sapiens
acuguagcaaaa

SEQ ID NO: 2180751 - RNA, 18 nt, Homo sapiens
cauuuccacuacagugag

SEQ ID NO: 2180752 - RNA, 23 nt, Homo sapiens
gucgggauauuugggugcagagg

SEQ ID NO: 2180753 - RNA, 13 nt, Homo sapiens
gaaaguaacuguu

SEQ ID NO: 2180754 - RNA, 14 nt, Homo sapiens
cccagaguggccca

SEQ ID NO: 2180755 - RNA, 16 nt, Homo sapiens
cagacugacaaaugug

SEQ ID NO: 2180756 - RNA, 13 nt, Homo sapiens
gacagagcaagac

SEQ ID NO: 2180757 - RNA, 18 nt, Homo sapiens
aucucaggccaccugccc

SEQ ID NO: 2180758 - RNA, 22 nt, Homo sapiens
cccacguggacucugugcucac

SEQ ID NO: 2180759 - RNA, 15 nt, Homo sapiens
uuccuuguccccaca

SEQ ID NO: 2180760 - RNA, 14 nt, Homo sapiens
aguuucacauugca

SEQ ID NO: 2180761 - RNA, 15 nt, Homo sapiens
aaagacucaaaaagc

SEQ ID NO: 2180762 - RNA, 18 nt, Homo sapiens
cagaggcucuaauguaca

SEQ ID NO: 2180763 - RNA, 14 nt, Homo sapiens
ucuuaacuauccua

SEQ ID NO: 2180764 - RNA, 14 nt, Homo sapiens
ucucugcuaucuag

SEQ ID NO: 2180765 - RNA, 22 nt, Homo sapiens
gucagccaccugggaacacagu

SEQ ID NO: 2180766 - RNA, 18 nt, Homo sapiens
gccauaauuacuauguca

SEQ ID NO: 2180767 - RNA, 19 nt, Homo sapiens
uauuuguccucaugugaga

SEQ ID NO: 2180768 - RNA, 18 nt, Homo sapiens
cccaggcccaccaucacc

SEQ ID NO: 2180769 - RNA, 23 nt, Homo sapiens
auucauuuuucuuucugauguca

SEQ ID NO: 2180770 - RNA, 14 nt, Homo sapiens
gacagaacuaagau

SEQ ID NO: 2180771 - RNA, 19 nt, Homo sapiens
cauagacuuuaugcaauaa

SEQ ID NO: 2180772 - RNA, 19 nt, Homo sapiens
caucuuuuccucauuuuca

SEQ ID NO: 2180773 - RNA, 19 nt, Homo sapiens
ucacaacccaucuaccccu

SEQ ID NO: 2180774 - RNA, 23 nt, Homo sapiens
cuguugcacuuuugaauguccaa

SEQ ID NO: 2180775 - RNA, 15 nt, Homo sapiens
auucucaugccucag

SEQ ID NO: 2180776 - RNA, 22 nt, Homo sapiens
auuuucuuuuauuaucaguuaa

SEQ ID NO: 2180777 - RNA, 17 nt, Homo sapiens
aggacaguggaugcugc

SEQ ID NO: 2180778 - RNA, 20 nt, Homo sapiens
ugugaugacugguuguucaa

SEQ ID NO: 2180779 - RNA, 17 nt, Homo sapiens
aagguaugugucagcca

SEQ ID NO: 2180780 - RNA, 19 nt, Homo sapiens
ugggagaguaaaccuugaa

SEQ ID NO: 2180781 - RNA, 21 nt, Homo sapiens
aaacccagcucccuucuuccc

SEQ ID NO: 2180782 - RNA, 15 nt, Homo sapiens
guuugacaugugaag

SEQ ID NO: 2180783 - RNA, 17 nt, Homo sapiens
ucccgggggcacugccu

SEQ ID NO: 2180784 - RNA, 12 nt, Homo sapiens
aaaagugucuug

SEQ ID NO: 2180785 - RNA, 18 nt, Homo sapiens
gcagagagcacagugauc

SEQ ID NO: 2180786 - RNA, 19 nt, Homo sapiens
acucuuugcuaguaccaaa

SEQ ID NO: 2180787 - RNA, 14 nt, Homo sapiens
ugguaaguugagau

SEQ ID NO: 2180788 - RNA, 15 nt, Homo sapiens
cuccucaguucuugc

SEQ ID NO: 2180789 - RNA, 21 nt, Homo sapiens
ucugcuuucugauacaucugu

SEQ ID NO: 2180790 - RNA, 18 nt, Homo sapiens
cauugcgaccauuucuca

SEQ ID NO: 2180791 - RNA, 18 nt, Homo sapiens
aaugugauuugucuuccc

SEQ ID NO: 2180792 - RNA, 14 nt, Homo sapiens
aguaauuuuuuaca

SEQ ID NO: 2180793 - RNA, 21 nt, Homo sapiens
ugucauagaggaaaagcacag

SEQ ID NO: 2180794 - RNA, 13 nt, Homo sapiens
ccauaugagggaa

SEQ ID NO: 2180795 - RNA, 21 nt, Homo sapiens
ugaaagucaaauuuacuuuaa

SEQ ID NO: 2180796 - RNA, 15 nt, Homo sapiens
uucgugacaacaugc

SEQ ID NO: 2180797 - RNA, 15 nt, Homo sapiens
gguggagcagccaga

SEQ ID NO: 2180798 - RNA, 16 nt, Homo sapiens
uccuaauuguccacau

SEQ ID NO: 2180799 - RNA, 16 nt, Homo sapiens
uuucugucaagcauau

SEQ ID NO: 2180800 - RNA, 18 nt, Homo sapiens
uugugcauaaaaacaaga

SEQ ID NO: 2180801 - RNA, 18 nt, Homo sapiens
agggaaaaguucuccuau

SEQ ID NO: 2180802 - RNA, 22 nt, Homo sapiens
uuuaacacuuuguauuacuuag

SEQ ID NO: 2180803 - RNA, 16 nt, Homo sapiens
ucugaguucuggugag

SEQ ID NO: 2180804 - RNA, 19 nt, Homo sapiens
ugaaugguuucaacaaaga

SEQ ID NO: 2180805 - RNA, 21 nt, Homo sapiens
aagaggccaaaggaaugucca

SEQ ID NO: 2180806 - RNA, 20 nt, Homo sapiens
cuuccgcggugcaggugcag

SEQ ID NO: 2180807 - RNA, 22 nt, Homo sapiens
gugugaugcaccugcagggugu

SEQ ID NO: 2180808 - RNA, 12 nt, Homo sapiens
cuucccauuucu

SEQ ID NO: 2180809 - RNA, 15 nt, Homo sapiens
cagaaauacaugaaa

SEQ ID NO: 2180810 - RNA, 23 nt, Homo sapiens
cuagaugaagaaagagacugugg

SEQ ID NO: 2180811 - RNA, 14 nt, Homo sapiens
uaaccacagugaaa

SEQ ID NO: 2180812 - RNA, 21 nt, Homo sapiens
ugguggcaaagguuuauucca

SEQ ID NO: 2180813 - RNA, 23 nt, Homo sapiens
uugaauagacacuucaccaaaga

SEQ ID NO: 2180814 - RNA, 16 nt, Homo sapiens
acuuuguggauuugau

SEQ ID NO: 2180815 - RNA, 22 nt, Homo sapiens
gaaagcagaaaaucuaccaaga

SEQ ID NO: 2180816 - RNA, 17 nt, Homo sapiens
aauuacaauacaucuaa

SEQ ID NO: 2180817 - RNA, 17 nt, Homo sapiens
cuuuuucccucuuccca

SEQ ID NO: 2180818 - RNA, 14 nt, Homo sapiens
uuuauuuccacuaa

SEQ ID NO: 2180819 - RNA, 21 nt, Homo sapiens
cagagcacagccaaucuccag

SEQ ID NO: 2180820 - RNA, 12 nt, Homo sapiens
uuaacuacagac

SEQ ID NO: 2180821 - RNA, 12 nt, Homo sapiens
auaccuacugaa

SEQ ID NO: 2180822 - RNA, 22 nt, Homo sapiens
ucccuuuaccuucauaugugua

SEQ ID NO: 2180823 - RNA, 19 nt, Homo sapiens
accaggugucuagaggcaa

SEQ ID NO: 2180824 - RNA, 19 nt, Homo sapiens
gaugcuaggugucugggau

SEQ ID NO: 2180825 - RNA, 15 nt, Homo sapiens
acagauguaaaugcc

SEQ ID NO: 2180826 - RNA, 20 nt, Homo sapiens
cauuguagccuaauauucau

SEQ ID NO: 2180827 - RNA, 16 nt, Homo sapiens
cuguuuaaagugucac

SEQ ID NO: 2180828 - RNA, 15 nt, Homo sapiens
gcucaaggauucaau

SEQ ID NO: 2180829 - RNA, 15 nt, Homo sapiens
aggcucugugccuug

SEQ ID NO: 2180830 - RNA, 20 nt, Homo sapiens
agauuuaaaaaccaacuuau

SEQ ID NO: 2180831 - RNA, 22 nt, Homo sapiens
caguguggggaagugucccugu

SEQ ID NO: 2180832 - RNA, 16 nt, Homo sapiens
acuguacauagaugua

SEQ ID NO: 2180833 - RNA, 17 nt, Homo sapiens
gggucauagauguuucc

SEQ ID NO: 2180834 - RNA, 23 nt, Homo sapiens
ucucacgggcaugggcacucccu

SEQ ID NO: 2180835 - RNA, 21 nt, Homo sapiens
ucagggauuuuucuaccuuca

SEQ ID NO: 2180836 - RNA, 14 nt, Homo sapiens
auuccuguaggggg

SEQ ID NO: 2180837 - RNA, 14 nt, Homo sapiens
ucccugcacacggc

SEQ ID NO: 2180838 - RNA, 21 nt, Homo sapiens
auacaaggugagugugacuuc

SEQ ID NO: 2180839 - RNA, 20 nt, Homo sapiens
uucauacucuuaaguguaaa

SEQ ID NO: 2180840 - RNA, 14 nt, Homo sapiens
uaccagauauuuga

SEQ ID NO: 2180841 - RNA, 15 nt, Homo sapiens
aauaucagacaagca

SEQ ID NO: 2180842 - RNA, 13 nt, Homo sapiens
gagggaggcgcug

SEQ ID NO: 2180843 - RNA, 14 nt, Homo sapiens
cuaacaggaacaaa

SEQ ID NO: 2180844 - RNA, 17 nt, Homo sapiens
ggaaguaacauuugccu

SEQ ID NO: 2180845 - RNA, 15 nt, Homo sapiens
ccagauauuucacau

SEQ ID NO: 2180846 - RNA, 15 nt, Homo sapiens
gggcacaagcagggc

SEQ ID NO: 2180847 - RNA, 18 nt, Homo sapiens
uuaagaauuucacaagcu

SEQ ID NO: 2180848 - RNA, 16 nt, Homo sapiens
cugggccccaccaccu

SEQ ID NO: 2180849 - RNA, 23 nt, Homo sapiens
gaaaagcuuaaaaaaauuacugu

SEQ ID NO: 2180850 - RNA, 13 nt, Homo sapiens
aucagugcaguga

SEQ ID NO: 2180851 - RNA, 17 nt, Homo sapiens
ugcugguggcucuucag

SEQ ID NO: 2180852 - RNA, 13 nt, Homo sapiens
acuaaauacugua

SEQ ID NO: 2180853 - RNA, 16 nt, Homo sapiens
ucucuuauuacaaaga

SEQ ID NO: 2180854 - RNA, 13 nt, Homo sapiens
acaccgaccggag

SEQ ID NO: 2180855 - RNA, 17 nt, Homo sapiens
uuguagaguuuuuggaa

SEQ ID NO: 2180856 - RNA, 22 nt, Homo sapiens
cuggcuccugaagggugcucag

SEQ ID NO: 2180857 - RNA, 15 nt, Homo sapiens
ccuuuacauccagau

SEQ ID NO: 2180858 - RNA, 15 nt, Homo sapiens
cucucaguucucgau

SEQ ID NO: 2180859 - RNA, 19 nt, Homo sapiens
guacccaccugagcuuugg

SEQ ID NO: 2180860 - RNA, 18 nt, Homo sapiens
uguuagauguccucagaa

SEQ ID NO: 2180861 - RNA, 16 nt, Homo sapiens
ggagugcaguggcaca

SEQ ID NO: 2180862 - RNA, 16 nt, Homo sapiens
ggagucaugugccucu

SEQ ID NO: 2180863 - RNA, 23 nt, Homo sapiens
ugcuuaguauucuugagggacaa

SEQ ID NO: 2180864 - RNA, 23 nt, Homo sapiens
accucauagcuaauuuuugcaaa

SEQ ID NO: 2180865 - RNA, 12 nt, Homo sapiens
cauauuacugua

SEQ ID NO: 2180866 - RNA, 17 nt, Homo sapiens
cauacacccauuucucu

SEQ ID NO: 2180867 - RNA, 15 nt, Homo sapiens
caguccugugugagg

SEQ ID NO: 2180868 - RNA, 17 nt, Homo sapiens
cucaguaaaauguuuaa

SEQ ID NO: 2180869 - RNA, 18 nt, Homo sapiens
cuuaacuuaaaagaacau

SEQ ID NO: 2180870 - RNA, 13 nt, Homo sapiens
auguccuggacac

SEQ ID NO: 2180871 - RNA, 10 nt, Homo sapiens
cugucuuccu

SEQ ID NO: 2180872 - RNA, 15 nt, Homo sapiens
aagaagacacacagc

SEQ ID NO: 2180873 - RNA, 23 nt, Homo sapiens
cauuccccugaugggcccugacu

SEQ ID NO: 2180874 - RNA, 17 nt, Homo sapiens
gaucccagcuacucagg

SEQ ID NO: 2180875 - RNA, 12 nt, Homo sapiens
caacagcacuuu

SEQ ID NO: 2180876 - RNA, 14 nt, Homo sapiens
ccuuuaucucugag

SEQ ID NO: 2180877 - RNA, 20 nt, Homo sapiens
uccuauuuagacauguaauu

SEQ ID NO: 2180878 - RNA, 16 nt, Homo sapiens
gaccuggucaggguga

SEQ ID NO: 2180879 - RNA, 19 nt, Homo sapiens
aguuucuuccccaagagcu

SEQ ID NO: 2180880 - RNA, 14 nt, Homo sapiens
auccugaugcuguu

SEQ ID NO: 2180881 - RNA, 15 nt, Homo sapiens
uguguaaauuucuca

SEQ ID NO: 2180882 - RNA, 15 nt, Homo sapiens
uuucacaaugugaaa

SEQ ID NO: 2180883 - RNA, 21 nt, Homo sapiens
uaaucuaaacuguagcuguau

SEQ ID NO: 2180884 - RNA, 22 nt, Homo sapiens
uucacucccaggugagaauuca

SEQ ID NO: 2180885 - RNA, 13 nt, Homo sapiens
aaggacuaugaca

SEQ ID NO: 2180886 - RNA, 13 nt, Homo sapiens
auuaauacugaag

SEQ ID NO: 2180887 - RNA, 20 nt, Homo sapiens
uugaggccaagaauauugca

SEQ ID NO: 2180888 - RNA, 16 nt, Homo sapiens
ugcucauguaccucug

SEQ ID NO: 2180889 - RNA, 17 nt, Homo sapiens
uuauauggauaaucuga

SEQ ID NO: 2180890 - RNA, 22 nt, Homo sapiens
cacuuacugguccuuaccagag

SEQ ID NO: 2180891 - RNA, 23 nt, Homo sapiens
gggcgcucgcuuccgcauccuag

SEQ ID NO: 2180892 - RNA, 14 nt, Homo sapiens
aucagagcauugug

SEQ ID NO: 2180893 - RNA, 12 nt, Homo sapiens
uuuuaucaugau

SEQ ID NO: 2180894 - RNA, 23 nt, Homo sapiens
cacucaaugccaggcagugcagc

SEQ ID NO: 2180895 - RNA, 15 nt, Homo sapiens
ccaucuucuauucaa

SEQ ID NO: 2180896 - RNA, 18 nt, Homo sapiens
aaaauucccuaaagacua

SEQ ID NO: 2180897 - RNA, 19 nt, Homo sapiens
ucuuuaguguuaaaauaca

SEQ ID NO: 2180898 - RNA, 20 nt, Homo sapiens
gcacugaggcagcgaccuca

SEQ ID NO: 2180899 - RNA, 13 nt, Homo sapiens
caucucugcaauc

SEQ ID NO: 2180900 - RNA, 20 nt, Homo sapiens
guacaaugaacccccaugau

SEQ ID NO: 2180901 - RNA, 15 nt, Homo sapiens
uuaaaauauuugccu

SEQ ID NO: 2180902 - RNA, 20 nt, Homo sapiens
aguuggggcuguucauggca

SEQ ID NO: 2180903 - RNA, 20 nt, Homo sapiens
cuuccuugggaugaucuuga

SEQ ID NO: 2180904 - RNA, 23 nt, Homo sapiens
uuucucugcuuacccuucaccuu

SEQ ID NO: 2180905 - RNA, 21 nt, Homo sapiens
aaccggcuuuguggcacuggg

SEQ ID NO: 2180906 - RNA, 18 nt, Homo sapiens
uauaaauuuuuaccuguu

SEQ ID NO: 2180907 - RNA, 19 nt, Homo sapiens
caggaguauccucuugcca

SEQ ID NO: 2180908 - RNA, 18 nt, Homo sapiens
caccaggcacugcugcac

SEQ ID NO: 2180909 - RNA, 18 nt, Homo sapiens
gaaaguauucuaagccaa

SEQ ID NO: 2180910 - RNA, 16 nt, Homo sapiens
aaggucauccaaagaa

SEQ ID NO: 2180911 - RNA, 19 nt, Homo sapiens
uuagcaaaucuacugucaa

SEQ ID NO: 2180912 - RNA, 21 nt, Homo sapiens
ugagugacaugggugugccag

SEQ ID NO: 2180913 - RNA, 22 nt, Homo sapiens
cuuagccauuuuucaaagcaau

SEQ ID NO: 2180914 - RNA, 22 nt, Homo sapiens
ggcguuacugcuugaccaaaga

SEQ ID NO: 2180915 - RNA, 16 nt, Homo sapiens
uuaauaaaccuuugca

SEQ ID NO: 2180916 - RNA, 18 nt, Homo sapiens
uuacauaauacuugaaaa

SEQ ID NO: 2180917 - RNA, 21 nt, Homo sapiens
aaauuagcgaaaucaacccuu

SEQ ID NO: 2180918 - RNA, 22 nt, Homo sapiens
ucuuucagccaagaauucuuaa

SEQ ID NO: 2180919 - RNA, 18 nt, Homo sapiens
uuuguaggcauugcauga

SEQ ID NO: 2180920 - RNA, 21 nt, Homo sapiens
ugucauuuuuuuucuuugaau

SEQ ID NO: 2180921 - RNA, 14 nt, Homo sapiens
uccucuccuacucg

SEQ ID NO: 2180922 - RNA, 18 nt, Homo sapiens
ucauuuuuuauggcugca

SEQ ID NO: 2180923 - RNA, 21 nt, Homo sapiens
cauuucauaaaaaucccucuu

SEQ ID NO: 2180924 - RNA, 17 nt, Homo sapiens
uauaauaaaaagcuuca

SEQ ID NO: 2180925 - RNA, 19 nt, Homo sapiens
ggagguugcaguaagccaa

SEQ ID NO: 2180926 - RNA, 22 nt, Homo sapiens
ugugcuggucauggaauggcag

SEQ ID NO: 2180927 - RNA, 17 nt, Homo sapiens
agcagugucuuccauaa

SEQ ID NO: 2180928 - RNA, 18 nt, Homo sapiens
uugagcaccgucauggcu

SEQ ID NO: 2180929 - RNA, 20 nt, Homo sapiens
aggcuaagacccuguguccu

SEQ ID NO: 2180930 - RNA, 20 nt, Homo sapiens
gcaccgaguggccauggcau

SEQ ID NO: 2180931 - RNA, 21 nt, Homo sapiens
auugacuuuuuuugagcgaca

SEQ ID NO: 2180932 - RNA, 23 nt, Homo sapiens
cucauuuguuuuucucacuccuu

SEQ ID NO: 2180933 - RNA, 16 nt, Homo sapiens
cuccuugagacuggag

SEQ ID NO: 2180934 - RNA, 22 nt, Homo sapiens
aaguuucuguuucaaagcacaa

SEQ ID NO: 2180935 - RNA, 21 nt, Homo sapiens
ggccaccccuaggaacucagu

SEQ ID NO: 2180936 - RNA, 16 nt, Homo sapiens
ccugcccagacaagau

SEQ ID NO: 2180937 - RNA, 23 nt, Homo sapiens
caucaacaacacagcaaaaccau

SEQ ID NO: 2180938 - RNA, 17 nt, Homo sapiens
cgaaccuacaguuuuaa

SEQ ID NO: 2180939 - RNA, 21 nt, Homo sapiens
acucuagccugggccagagaa

SEQ ID NO: 2180940 - RNA, 13 nt, Homo sapiens
uacugcugugagc

SEQ ID NO: 2180941 - RNA, 15 nt, Homo sapiens
uuuacauucaucuca

SEQ ID NO: 2180942 - RNA, 17 nt, Homo sapiens
uaaacuaucuuggugaa

SEQ ID NO: 2180943 - RNA, 15 nt, Homo sapiens
aaauugccugacgaa

SEQ ID NO: 2180944 - RNA, 14 nt, Homo sapiens
ugcaguacucagua

SEQ ID NO: 2180945 - RNA, 13 nt, Homo sapiens
cacauuccaugac

SEQ ID NO: 2180946 - RNA, 14 nt, Homo sapiens
ucucuucaaucucu

SEQ ID NO: 2180947 - RNA, 17 nt, Homo sapiens
agaucacuuguccucuu

SEQ ID NO: 2180948 - RNA, 21 nt, Homo sapiens
gaacuccugaccucaagugau

SEQ ID NO: 2180949 - RNA, 20 nt, Homo sapiens
aagcuccagaagaacaaaga

SEQ ID NO: 2180950 - RNA, 18 nt, Homo sapiens
uucuagcuuaucuacuuc

SEQ ID NO: 2180951 - RNA, 17 nt, Homo sapiens
cugccgaaccaaaagaa

SEQ ID NO: 2180952 - RNA, 22 nt, Homo sapiens
cuguuauuaccauuagcauucu

SEQ ID NO: 2180953 - RNA, 23 nt, Homo sapiens
caccugaccaggggcccuaccug

SEQ ID NO: 2180954 - RNA, 16 nt, Homo sapiens
uccuucugauccacag

SEQ ID NO: 2180955 - RNA, 17 nt, Homo sapiens
ggccucagcaagccaug

SEQ ID NO: 2180956 - RNA, 16 nt, Homo sapiens
ugaagccauguagcca

SEQ ID NO: 2180957 - RNA, 16 nt, Homo sapiens
auuaucuuauaaucuu

SEQ ID NO: 2180958 - RNA, 16 nt, Homo sapiens
aguuucuaagauucua

SEQ ID NO: 2180959 - RNA, 19 nt, Homo sapiens
uagucagacugacacuacu

SEQ ID NO: 2180960 - RNA, 21 nt, Homo sapiens
ggaaauauuaacaauguuuau

SEQ ID NO: 2180961 - RNA, 21 nt, Homo sapiens
uaacucuuagaagugacauug

SEQ ID NO: 2180962 - RNA, 15 nt, Homo sapiens
agagcacugcuccag

SEQ ID NO: 2180963 - RNA, 18 nt, Homo sapiens
cccagccugcauacuugc

SEQ ID NO: 2180964 - RNA, 14 nt, Homo sapiens
ggcagaagcagcug

SEQ ID NO: 2180965 - RNA, 17 nt, Homo sapiens
uggcaaucccaccaaau

SEQ ID NO: 2180966 - RNA, 14 nt, Homo sapiens
ucuucccaccucag

SEQ ID NO: 2180967 - RNA, 15 nt, Homo sapiens
acucugaaugcauga

SEQ ID NO: 2180968 - RNA, 20 nt, Homo sapiens
gcucacuaccuccucaggga

SEQ ID NO: 2180969 - RNA, 16 nt, Homo sapiens
aaucuacaccaaugaa

SEQ ID NO: 2180970 - RNA, 18 nt, Homo sapiens
agcagauggaaugcugug

SEQ ID NO: 2180971 - RNA, 20 nt, Homo sapiens
gucauuggaaacacugccuu

SEQ ID NO: 2180972 - RNA, 21 nt, Homo sapiens
cuuaaugugaccuagcaauag

SEQ ID NO: 2180973 - RNA, 16 nt, Homo sapiens
augagguggagagugg

SEQ ID NO: 2180974 - RNA, 22 nt, Homo sapiens
agaacuuugcauagcagcugcu

SEQ ID NO: 2180975 - RNA, 19 nt, Homo sapiens
aguuuaagaggcaaguaaa

SEQ ID NO: 2180976 - RNA, 17 nt, Homo sapiens
cauugucagccugaaga

SEQ ID NO: 2180977 - RNA, 15 nt, Homo sapiens
augccuguccugaaa

SEQ ID NO: 2180978 - RNA, 13 nt, Homo sapiens
gcugcagggacag

SEQ ID NO: 2180979 - RNA, 17 nt, Homo sapiens
ugccacccacaucuucc

SEQ ID NO: 2180980 - RNA, 22 nt, Homo sapiens
uaaaauuggauuauuacuacaa

SEQ ID NO: 2180981 - RNA, 23 nt, Homo sapiens
caggcaaugugacuuugcaucag

SEQ ID NO: 2180982 - RNA, 10 nt, Homo sapiens
gucugcauug

SEQ ID NO: 2180983 - RNA, 22 nt, Homo sapiens
ugaagauguggaucccuuuaga

SEQ ID NO: 2180984 - RNA, 21 nt, Homo sapiens
gcaguguuucccucuguguua

SEQ ID NO: 2180985 - RNA, 13 nt, Homo sapiens
uaacuuucuugcu

SEQ ID NO: 2180986 - RNA, 14 nt, Homo sapiens
cacagaaaugcugc

SEQ ID NO: 2180987 - RNA, 21 nt, Homo sapiens
gaggaagcaaaagacucugua

SEQ ID NO: 2180988 - RNA, 21 nt, Homo sapiens
ugucucuuagaaauacuugug

SEQ ID NO: 2180989 - RNA, 22 nt, Homo sapiens
guuuguuggaaaguaacuguga

SEQ ID NO: 2180990 - RNA, 12 nt, Homo sapiens
ucuagcucuggu

SEQ ID NO: 2180991 - RNA, 20 nt, Homo sapiens
gagaccacaguuuaccucag

SEQ ID NO: 2180992 - RNA, 13 nt, Homo sapiens
caacauaugcaaa

SEQ ID NO: 2180993 - RNA, 20 nt, Homo sapiens
uuuaggcuuuuccaaaucaa

SEQ ID NO: 2180994 - RNA, 22 nt, Homo sapiens
auccugccagccccacacagcu

SEQ ID NO: 2180995 - RNA, 15 nt, Homo sapiens
uuuugcccuauauac

SEQ ID NO: 2180996 - RNA, 18 nt, Homo sapiens
uuggggugauuucucacc

SEQ ID NO: 2180997 - RNA, 13 nt, Homo sapiens
guuguuccuucac

SEQ ID NO: 2180998 - RNA, 19 nt, Homo sapiens
aagccugucccaggacuca

SEQ ID NO: 2180999 - RNA, 20 nt, Homo sapiens
gugagcagccuggagcccug

SEQ ID NO: 2181000 - RNA, 14 nt, Homo sapiens
augguuuuguggau

SEQ ID NO: 2181001 - RNA, 17 nt, Homo sapiens
cuguuuugcuaugcuau

SEQ ID NO: 2181002 - RNA, 20 nt, Homo sapiens
aauaaacaaucuuagacauu

SEQ ID NO: 2181003 - RNA, 14 nt, Homo sapiens
auccuuaaacugcc

SEQ ID NO: 2181004 - RNA, 15 nt, Homo sapiens
cauaaagucuugccu

SEQ ID NO: 2181005 - RNA, 21 nt, Homo sapiens
caugagacucgguccaagagu

SEQ ID NO: 2181006 - RNA, 13 nt, Homo sapiens
gaacucacugcga

SEQ ID NO: 2181007 - RNA, 13 nt, Homo sapiens
agaggaaagaccu

SEQ ID NO: 2181008 - RNA, 22 nt, Homo sapiens
ccaggcuggggccaggggaccu

SEQ ID NO: 2181009 - RNA, 17 nt, Homo sapiens
agccaccacauccagcc

SEQ ID NO: 2181010 - RNA, 16 nt, Homo sapiens
uaaauuugaaucugag

SEQ ID NO: 2181011 - RNA, 13 nt, Homo sapiens
acuaugacacuga

SEQ ID NO: 2181012 - RNA, 23 nt, Homo sapiens
ucauucaugccaaguaucuuucc

SEQ ID NO: 2181013 - RNA, 21 nt, Homo sapiens
gagggccagguuagcacagcg

SEQ ID NO: 2181014 - RNA, 13 nt, Homo sapiens
ugauuaugaauag

SEQ ID NO: 2181015 - RNA, 21 nt, Homo sapiens
cuuagcuucuauuauagccac

SEQ ID NO: 2181016 - RNA, 17 nt, Homo sapiens
aauugcuggaugcauuu

SEQ ID NO: 2181017 - RNA, 13 nt, Homo sapiens
gaacggugucauc

SEQ ID NO: 2181018 - RNA, 17 nt, Homo sapiens
ucagcuuauaugugaca

SEQ ID NO: 2181019 - RNA, 21 nt, Homo sapiens
agcccacccuccugucuuccc

SEQ ID NO: 2181020 - RNA, 18 nt, Homo sapiens
agcauuucuagcagugau

SEQ ID NO: 2181021 - RNA, 20 nt, Homo sapiens
aggggcaauggggugccuac

SEQ ID NO: 2181022 - RNA, 16 nt, Homo sapiens
ucacaucucccccaua

SEQ ID NO: 2181023 - RNA, 13 nt, Homo sapiens
uaaaaacuggccc

SEQ ID NO: 2181024 - RNA, 16 nt, Homo sapiens
cauaaaucaauucauu

SEQ ID NO: 2181025 - RNA, 22 nt, Homo sapiens
uuuucaaugugugugagguguu

SEQ ID NO: 2181026 - RNA, 10 nt, Homo sapiens
cccagcauuu

SEQ ID NO: 2181027 - RNA, 16 nt, Homo sapiens
gagcuuggcagcugaa

SEQ ID NO: 2181028 - RNA, 21 nt, Homo sapiens
gcuauauucugagacuuugaa

SEQ ID NO: 2181029 - RNA, 23 nt, Homo sapiens
cacccucugcuaugucugugaug

SEQ ID NO: 2181030 - RNA, 17 nt, Homo sapiens
cccugcccuuggcacca

SEQ ID NO: 2181031 - RNA, 15 nt, Homo sapiens
cccuucaacuaugca

SEQ ID NO: 2181032 - RNA, 14 nt, Homo sapiens
agaagcaccaauca

SEQ ID NO: 2181033 - RNA, 22 nt, Homo sapiens
acuugucuuuuuguuaugcaaa

SEQ ID NO: 2181034 - RNA, 22 nt, Homo sapiens
ggacugccggcucuaguaccuu

SEQ ID NO: 2181035 - RNA, 16 nt, Homo sapiens
caaauuuuaucuccag

SEQ ID NO: 2181036 - RNA, 20 nt, Homo sapiens
uaaaugauaucuauauucua

SEQ ID NO: 2181037 - RNA, 21 nt, Homo sapiens
uacauucuuuuuucuauucaa

SEQ ID NO: 2181038 - RNA, 17 nt, Homo sapiens
aaagcugaggacagggu

SEQ ID NO: 2181039 - RNA, 15 nt, Homo sapiens
auuuaacuagcacuu

SEQ ID NO: 2181040 - RNA, 19 nt, Homo sapiens
ccacuuggccaccaggacu

SEQ ID NO: 2181041 - RNA, 19 nt, Homo sapiens
acuauuuauuuacauauuu

SEQ ID NO: 2181042 - RNA, 14 nt, Homo sapiens
guuaguguuuagaa

SEQ ID NO: 2181043 - RNA, 15 nt, Homo sapiens
acuggaagacacuuc

SEQ ID NO: 2181044 - RNA, 18 nt, Homo sapiens
gaggacagagcuggcugu

SEQ ID NO: 2181045 - RNA, 16 nt, Homo sapiens
uaaacccucugugaaa

SEQ ID NO: 2181046 - RNA, 14 nt, Homo sapiens
cugaccccauuccu

SEQ ID NO: 2181047 - RNA, 15 nt, Homo sapiens
agacccucaaugcca

SEQ ID NO: 2181048 - RNA, 20 nt, Homo sapiens
gggaagcaucugucuuguca

SEQ ID NO: 2181049 - RNA, 17 nt, Homo sapiens
aacuauacuaccaaaag

SEQ ID NO: 2181050 - RNA, 14 nt, Homo sapiens
auugacgacuucac

SEQ ID NO: 2181051 - RNA, 14 nt, Homo sapiens
caacaagaaaagaa

SEQ ID NO: 2181052 - RNA, 21 nt, Homo sapiens
uggggccaaacccaccugcua

SEQ ID NO: 2181053 - RNA, 15 nt, Homo sapiens
uugugauguacugua

SEQ ID NO: 2181054 - RNA, 21 nt, Homo sapiens
uccaaacguuaagaauuguua

SEQ ID NO: 2181055 - RNA, 22 nt, Homo sapiens
cucuugcuaccugugagcaucc

SEQ ID NO: 2181056 - RNA, 20 nt, Homo sapiens
ucaaaauguuguccuuuccc

SEQ ID NO: 2181057 - RNA, 12 nt, Homo sapiens
ucauacacauga

SEQ ID NO: 2181058 - RNA, 15 nt, Homo sapiens
auuccagaaugaaga

SEQ ID NO: 2181059 - RNA, 15 nt, Homo sapiens
uuuaagaauugccag

SEQ ID NO: 2181060 - RNA, 16 nt, Homo sapiens
aguaacaguuugauau

SEQ ID NO: 2181061 - RNA, 15 nt, Homo sapiens
ucauuuucuuuccuu

SEQ ID NO: 2181062 - RNA, 22 nt, Homo sapiens
caccugggccaccaugcacuca

SEQ ID NO: 2181063 - RNA, 18 nt, Homo sapiens
ugaaauaauacauugcag

SEQ ID NO: 2181064 - RNA, 22 nt, Homo sapiens
ugggacuccuccuuuauuucag

SEQ ID NO: 2181065 - RNA, 19 nt, Homo sapiens
ucucuaaagcaucugcucu

SEQ ID NO: 2181066 - RNA, 21 nt, Homo sapiens
auuuagaccccccaccugugu

SEQ ID NO: 2181067 - RNA, 23 nt, Homo sapiens
cagggcaggaaggggaaacacag

SEQ ID NO: 2181068 - RNA, 22 nt, Homo sapiens
gccugccagcuucugccuucaa

SEQ ID NO: 2181069 - RNA, 16 nt, Homo sapiens
ccuggaaaacucauga

SEQ ID NO: 2181070 - RNA, 16 nt, Homo sapiens
uggucucacuacuuga

SEQ ID NO: 2181071 - RNA, 15 nt, Homo sapiens
uuacauacagugaua

SEQ ID NO: 2181072 - RNA, 15 nt, Homo sapiens
cccaggagcagcauc

SEQ ID NO: 2181073 - RNA, 18 nt, Homo sapiens
agguaagggggugcagca

SEQ ID NO: 2181074 - RNA, 18 nt, Homo sapiens
agauacagggaugaggca

SEQ ID NO: 2181075 - RNA, 22 nt, Homo sapiens
guguuugugauuguuugcucug

SEQ ID NO: 2181076 - RNA, 15 nt, Homo sapiens
uuggcaucuacuuag

SEQ ID NO: 2181077 - RNA, 14 nt, Homo sapiens
gauauaaacagcuu

SEQ ID NO: 2181078 - RNA, 13 nt, Homo sapiens
agcuggguggugu

SEQ ID NO: 2181079 - RNA, 14 nt, Homo sapiens
uaaauguaauaagu

SEQ ID NO: 2181080 - RNA, 16 nt, Homo sapiens
auuaucuauuaucuca

SEQ ID NO: 2181081 - RNA, 16 nt, Homo sapiens
uaagagauuaagaaua

SEQ ID NO: 2181082 - RNA, 23 nt, Homo sapiens
augaaaguaguauuuuguacuau

SEQ ID NO: 2181083 - RNA, 21 nt, Homo sapiens
aaggcuauguaaacaaaccac

SEQ ID NO: 2181084 - RNA, 22 nt, Homo sapiens
aauagugccuaaagugcugcag

SEQ ID NO: 2181085 - RNA, 17 nt, Homo sapiens
auacuuagacaguaugc

SEQ ID NO: 2181086 - RNA, 18 nt, Homo sapiens
gagggaagugucaugcaa

SEQ ID NO: 2181087 - RNA, 15 nt, Homo sapiens
guccauuuuucuucc

SEQ ID NO: 2181088 - RNA, 20 nt, Homo sapiens
ucuguauauauauauacuua

SEQ ID NO: 2181089 - RNA, 17 nt, Homo sapiens
uccauagcaccauuccu

SEQ ID NO: 2181090 - RNA, 19 nt, Homo sapiens
cgaauauuaugcccaguuu

SEQ ID NO: 2181091 - RNA, 15 nt, Homo sapiens
auacagucauuccaa

SEQ ID NO: 2181092 - RNA, 17 nt, Homo sapiens
uaccuggcucuccuguc

SEQ ID NO: 2181093 - RNA, 20 nt, Homo sapiens
gcagccccaggaccaagcuu

SEQ ID NO: 2181094 - RNA, 22 nt, Homo sapiens
cuuuaaccccaaauuuggcuaa

SEQ ID NO: 2181095 - RNA, 21 nt, Homo sapiens
aauacuaagagauuugcuuuu

SEQ ID NO: 2181096 - RNA, 20 nt, Homo sapiens
ggacacguggugcauuuugc

SEQ ID NO: 2181097 - RNA, 17 nt, Homo sapiens
auuuacucaaagacaua

SEQ ID NO: 2181098 - RNA, 21 nt, Homo sapiens
gagaucgcaucauugcacucu

SEQ ID NO: 2181099 - RNA, 18 nt, Homo sapiens
cuuucugaacugacugaa

SEQ ID NO: 2181100 - RNA, 15 nt, Homo sapiens
gcagagagagacugg

SEQ ID NO: 2181101 - RNA, 18 nt, Homo sapiens
caaacuuacuuaauauca

SEQ ID NO: 2181102 - RNA, 19 nt, Homo sapiens
agcagguuucuugcuucug

SEQ ID NO: 2181103 - RNA, 19 nt, Homo sapiens
gcaauguggagcagcagcc

SEQ ID NO: 2181104 - RNA, 20 nt, Homo sapiens
ucuguauccaaauaaugaau

SEQ ID NO: 2181105 - RNA, 16 nt, Homo sapiens
cgcgcaggccugcgug

SEQ ID NO: 2181106 - RNA, 22 nt, Homo sapiens
accugugacuaaacaacuaccu

SEQ ID NO: 2181107 - RNA, 18 nt, Homo sapiens
cuaucaaaacucuaucaa

SEQ ID NO: 2181108 - RNA, 17 nt, Homo sapiens
guauccugugacaugua

SEQ ID NO: 2181109 - RNA, 20 nt, Homo sapiens
auaauuuucuaauuucaagu

SEQ ID NO: 2181110 - RNA, 18 nt, Homo sapiens
gggcagacaccugugcac

SEQ ID NO: 2181111 - RNA, 21 nt, Homo sapiens
gaaaaccuagaucugcacuca

SEQ ID NO: 2181112 - RNA, 14 nt, Homo sapiens
agagcucaucauca

SEQ ID NO: 2181113 - RNA, 19 nt, Homo sapiens
cauauccuuucaagacaga

SEQ ID NO: 2181114 - RNA, 19 nt, Homo sapiens
uuugcugauuucuagugua

SEQ ID NO: 2181115 - RNA, 20 nt, Homo sapiens
ugcucggcuugaucacagcu

SEQ ID NO: 2181116 - RNA, 20 nt, Homo sapiens
agccuaaaguauacaacugc

SEQ ID NO: 2181117 - RNA, 13 nt, Homo sapiens
acccucugugaaa

SEQ ID NO: 2181118 - RNA, 13 nt, Homo sapiens
aacagaagccuga

SEQ ID NO: 2181119 - RNA, 17 nt, Homo sapiens
uguagacagccuuccag

SEQ ID NO: 2181120 - RNA, 16 nt, Homo sapiens
gagaagccucauggga

SEQ ID NO: 2181121 - RNA, 17 nt, Homo sapiens
ccugugccgcacuagcc

SEQ ID NO: 2181122 - RNA, 17 nt, Homo sapiens
aaaaaaaugauugucua

SEQ ID NO: 2181123 - RNA, 22 nt, Homo sapiens
aaucaguuucucaaacugagcu

SEQ ID NO: 2181124 - RNA, 22 nt, Homo sapiens
aacaguacaguauuuacaguau

SEQ ID NO: 2181125 - RNA, 23 nt, Homo sapiens
auauucuccagaccaaagcaauc

SEQ ID NO: 2181126 - RNA, 19 nt, Homo sapiens
accuccaucuucuuugcag

SEQ ID NO: 2181127 - RNA, 18 nt, Homo sapiens
ccagggccucugugcaga

SEQ ID NO: 2181128 - RNA, 18 nt, Homo sapiens
ugugaguuuccugcuaua

SEQ ID NO: 2181129 - RNA, 23 nt, Homo sapiens
ccagucccuguccggaaugccac

SEQ ID NO: 2181130 - RNA, 17 nt, Homo sapiens
accaaaacugugcagag

SEQ ID NO: 2181131 - RNA, 14 nt, Homo sapiens
gaguggugggugca

SEQ ID NO: 2181132 - RNA, 18 nt, Homo sapiens
aaugcugggacucagccu

SEQ ID NO: 2181133 - RNA, 14 nt, Homo sapiens
ucaugacagccaga

SEQ ID NO: 2181134 - RNA, 23 nt, Homo sapiens
cccacuaagcuuucuccuuugag

SEQ ID NO: 2181135 - RNA, 16 nt, Homo sapiens
acauuauucaucucuc

SEQ ID NO: 2181136 - RNA, 15 nt, Homo sapiens
caugaucacagcuca

SEQ ID NO: 2181137 - RNA, 18 nt, Homo sapiens
uguauuacagcuuucaca

SEQ ID NO: 2181138 - RNA, 19 nt, Homo sapiens
uguggacugagcgaggaaa

SEQ ID NO: 2181139 - RNA, 20 nt, Homo sapiens
guggguguucauaacugcua

SEQ ID NO: 2181140 - RNA, 21 nt, Homo sapiens
aauuaucacaauguacuauau

SEQ ID NO: 2181141 - RNA, 14 nt, Homo sapiens
cccugcacagugac

SEQ ID NO: 2181142 - RNA, 17 nt, Homo sapiens
acacaaaggaaguccaa

SEQ ID NO: 2181143 - RNA, 15 nt, Homo sapiens
caaaggaagcacaug

SEQ ID NO: 2181144 - RNA, 17 nt, Homo sapiens
ugcuacacauacaggau

SEQ ID NO: 2181145 - RNA, 23 nt, Homo sapiens
ccacacacagcugggcuguggua

SEQ ID NO: 2181146 - RNA, 14 nt, Homo sapiens
caagaacaauucaa

SEQ ID NO: 2181147 - RNA, 16 nt, Homo sapiens
acaauccuugccacag

SEQ ID NO: 2181148 - RNA, 22 nt, Homo sapiens
uaaauguauuuuagacuuccug

SEQ ID NO: 2181149 - RNA, 15 nt, Homo sapiens
ugcugaaaacuacac

SEQ ID NO: 2181150 - RNA, 16 nt, Homo sapiens
ccuugaggaggggcag

SEQ ID NO: 2181151 - RNA, 18 nt, Homo sapiens
ucacauccauucuucccu

SEQ ID NO: 2181152 - RNA, 15 nt, Homo sapiens
gaauuauagaacuaa

SEQ ID NO: 2181153 - RNA, 12 nt, Homo sapiens
auucugacccau

SEQ ID NO: 2181154 - RNA, 19 nt, Homo sapiens
agauuuucauguucuugca

SEQ ID NO: 2181155 - RNA, 17 nt, Homo sapiens
uuugaccuucagagcca

SEQ ID NO: 2181156 - RNA, 13 nt, Homo sapiens
gaauguuacagua

SEQ ID NO: 2181157 - RNA, 22 nt, Homo sapiens
uaauauaccagcuuguaugcaa

SEQ ID NO: 2181158 - RNA, 14 nt, Homo sapiens
gcauaaagccaaau

SEQ ID NO: 2181159 - RNA, 14 nt, Homo sapiens
caggaaaucaugag

SEQ ID NO: 2181160 - RNA, 13 nt, Homo sapiens
gaagagaagacau

SEQ ID NO: 2181161 - RNA, 17 nt, Homo sapiens
acuuggucagagccacu

SEQ ID NO: 2181162 - RNA, 18 nt, Homo sapiens
cguuugcuuaaacccuuu

SEQ ID NO: 2181163 - RNA, 17 nt, Homo sapiens
caaguaccucaucugca

SEQ ID NO: 2181164 - RNA, 17 nt, Homo sapiens
gaccugaggcugugguc

SEQ ID NO: 2181165 - RNA, 17 nt, Homo sapiens
cauaugucagggcacau

SEQ ID NO: 2181166 - RNA, 20 nt, Homo sapiens
cacaccccucaaaaaaagcc

SEQ ID NO: 2181167 - RNA, 16 nt, Homo sapiens
uuaaaucuauauacaa

SEQ ID NO: 2181168 - RNA, 18 nt, Homo sapiens
cccaggguagcccgccug

SEQ ID NO: 2181169 - RNA, 15 nt, Homo sapiens
gaauaaagcuucucu

SEQ ID NO: 2181170 - RNA, 20 nt, Homo sapiens
aacaauguuaaaugcaauug

SEQ ID NO: 2181171 - RNA, 19 nt, Homo sapiens
uaaaucauagcuaguauaa

SEQ ID NO: 2181172 - RNA, 18 nt, Homo sapiens
cugagugggggaucacag

SEQ ID NO: 2181173 - RNA, 17 nt, Homo sapiens
auagcucuucacuuccu

SEQ ID NO: 2181174 - RNA, 15 nt, Homo sapiens
ccccaauccaugcuu

SEQ ID NO: 2181175 - RNA, 11 nt, Homo sapiens
cuguugguguu

SEQ ID NO: 2181176 - RNA, 14 nt, Homo sapiens
gaucaggcacaggu

SEQ ID NO: 2181177 - RNA, 18 nt, Homo sapiens
ucagcuggaaaaggccug

SEQ ID NO: 2181178 - RNA, 16 nt, Homo sapiens
cuaggaugguucugug

SEQ ID NO: 2181179 - RNA, 11 nt, Homo sapiens
cacgcacacac

SEQ ID NO: 2181180 - RNA, 23 nt, Homo sapiens
acuccuuucucuaaaacugccuu

SEQ ID NO: 2181181 - RNA, 20 nt, Homo sapiens
aacauuucuaacucugaugu

SEQ ID NO: 2181182 - RNA, 21 nt, Homo sapiens
acccaucuugaaaaacacuau

SEQ ID NO: 2181183 - RNA, 21 nt, Homo sapiens
caaacuuaguuuuuaucuuug

SEQ ID NO: 2181184 - RNA, 15 nt, Homo sapiens
ugauagacuuguuag

SEQ ID NO: 2181185 - RNA, 15 nt, Homo sapiens
cugagccagucccag

SEQ ID NO: 2181186 - RNA, 14 nt, Homo sapiens
guccauacaccagc

SEQ ID NO: 2181187 - RNA, 19 nt, Homo sapiens
ccugaacuuucucccucau

SEQ ID NO: 2181188 - RNA, 21 nt, Homo sapiens
agaccgugaccagugcugcug

SEQ ID NO: 2181189 - RNA, 15 nt, Homo sapiens
ccucccucacuugug

SEQ ID NO: 2181190 - RNA, 17 nt, Homo sapiens
ggcauuuguuuccucau

SEQ ID NO: 2181191 - RNA, 20 nt, Homo sapiens
uguuaggccuggcacagugu

SEQ ID NO: 2181192 - RNA, 16 nt, Homo sapiens
auaacuguaacauaua

SEQ ID NO: 2181193 - RNA, 13 nt, Homo sapiens
cagaccucaugcc

SEQ ID NO: 2181194 - RNA, 17 nt, Homo sapiens
uucacgggcaacacuca

SEQ ID NO: 2181195 - RNA, 14 nt, Homo sapiens
uuauauuuggccca

SEQ ID NO: 2181196 - RNA, 21 nt, Homo sapiens
guauccgacucuaagcugugu

SEQ ID NO: 2181197 - RNA, 23 nt, Homo sapiens
ugagcuuggccagaagggggcca

SEQ ID NO: 2181198 - RNA, 20 nt, Homo sapiens
auugugaagauuucauggac

SEQ ID NO: 2181199 - RNA, 18 nt, Homo sapiens
ucucuuccacauguuacu

SEQ ID NO: 2181200 - RNA, 18 nt, Homo sapiens
aaaucugauuucauuaca

SEQ ID NO: 2181201 - RNA, 12 nt, Homo sapiens
cccuucaaaagc

SEQ ID NO: 2181202 - RNA, 15 nt, Homo sapiens
gcucuuuugugauga

SEQ ID NO: 2181203 - RNA, 16 nt, Homo sapiens
acucauguucauucag

SEQ ID NO: 2181204 - RNA, 15 nt, Homo sapiens
guuuggucagacuau

SEQ ID NO: 2181205 - RNA, 17 nt, Homo sapiens
uugcuuuugacuccagg

SEQ ID NO: 2181206 - RNA, 17 nt, Homo sapiens
cugccaagaguccaagc

SEQ ID NO: 2181207 - RNA, 14 nt, Homo sapiens
cagugcuugauaca

SEQ ID NO: 2181208 - RNA, 17 nt, Homo sapiens
gacgcccugcucuggau

SEQ ID NO: 2181209 - RNA, 16 nt, Homo sapiens
ugaggcugugcaccua

SEQ ID NO: 2181210 - RNA, 23 nt, Homo sapiens
uguuuccaugggucaaagccggu

SEQ ID NO: 2181211 - RNA, 16 nt, Homo sapiens
caccauaaccucuggg

SEQ ID NO: 2181212 - RNA, 14 nt, Homo sapiens
acugcauaaauaac

SEQ ID NO: 2181213 - RNA, 22 nt, Homo sapiens
ucagacugcggugaacauuucc

SEQ ID NO: 2181214 - RNA, 14 nt, Homo sapiens
gaucccucugggca

SEQ ID NO: 2181215 - RNA, 21 nt, Homo sapiens
aacaauuacauggcucuaaaa

SEQ ID NO: 2181216 - RNA, 21 nt, Homo sapiens
agucuugguuccucuacuacu

SEQ ID NO: 2181217 - RNA, 19 nt, Homo sapiens
ccuccccccaaucccucaa

SEQ ID NO: 2181218 - RNA, 21 nt, Homo sapiens
cagucauaacuaaauaaagcu

SEQ ID NO: 2181219 - RNA, 19 nt, Homo sapiens
ugauuuuauaugcuauuua

SEQ ID NO: 2181220 - RNA, 21 nt, Homo sapiens
uauccagauggaggcaccaaa

SEQ ID NO: 2181221 - RNA, 13 nt, Homo sapiens
acuucuaccugcc

SEQ ID NO: 2181222 - RNA, 22 nt, Homo sapiens
auuuugaaauaaacagguaaua

SEQ ID NO: 2181223 - RNA, 14 nt, Homo sapiens
ccucugugaccaac

SEQ ID NO: 2181224 - RNA, 16 nt, Homo sapiens
ucuuauacacaccuga

SEQ ID NO: 2181225 - RNA, 10 nt, Homo sapiens
uuuguacugg

SEQ ID NO: 2181226 - RNA, 15 nt, Homo sapiens
auuguggaaaaccag

SEQ ID NO: 2181227 - RNA, 12 nt, Homo sapiens
gaugagcauuua

SEQ ID NO: 2181228 - RNA, 23 nt, Homo sapiens
gcuuccaucccaaccagugccaa

SEQ ID NO: 2181229 - RNA, 22 nt, Homo sapiens
guggaaucucuuggaugcagcu

SEQ ID NO: 2181230 - RNA, 22 nt, Homo sapiens
uuauaaauauuauuagauuuau

SEQ ID NO: 2181231 - RNA, 11 nt, Homo sapiens
auugugcacau

SEQ ID NO: 2181232 - RNA, 20 nt, Homo sapiens
accuggaguggaucuauuua

SEQ ID NO: 2181233 - RNA, 20 nt, Homo sapiens
uauaaguaauacuucaguaa

SEQ ID NO: 2181234 - RNA, 18 nt, Homo sapiens
cuaaaagacaauuuuccu

SEQ ID NO: 2181235 - RNA, 17 nt, Homo sapiens
acugaaguuucacauga

SEQ ID NO: 2181236 - RNA, 16 nt, Homo sapiens
uaccucagucaguauu

SEQ ID NO: 2181237 - RNA, 23 nt, Homo sapiens
uggccucccaaagugcugggauu

SEQ ID NO: 2181238 - RNA, 19 nt, Homo sapiens
aauuauucugccuacguuc

SEQ ID NO: 2181239 - RNA, 20 nt, Homo sapiens
gcaggacgacuguuuuccca

SEQ ID NO: 2181240 - RNA, 15 nt, Homo sapiens
ccagcauauacugaa

SEQ ID NO: 2181241 - RNA, 22 nt, Homo sapiens
cggcuguuccccucacccaaaa

SEQ ID NO: 2181242 - RNA, 20 nt, Homo sapiens
augcugggccauugugauug

SEQ ID NO: 2181243 - RNA, 23 nt, Homo sapiens
aggcguccgcgcgccagcacaga

SEQ ID NO: 2181244 - RNA, 19 nt, Homo sapiens
cagaccacaugccccaucc

SEQ ID NO: 2181245 - RNA, 16 nt, Homo sapiens
cugggcucacuacaug

SEQ ID NO: 2181246 - RNA, 14 nt, Homo sapiens
cucaccuugagaua

SEQ ID NO: 2181247 - RNA, 15 nt, Homo sapiens
uuaguaauaaaaccc

SEQ ID NO: 2181248 - RNA, 14 nt, Homo sapiens
cuggacaccagggg

SEQ ID NO: 2181249 - RNA, 19 nt, Homo sapiens
auuuuaaguaacauaacua

SEQ ID NO: 2181250 - RNA, 23 nt, Homo sapiens
auauggcugcuucaaaggccaga

SEQ ID NO: 2181251 - RNA, 20 nt, Homo sapiens
aauaccuuggacuuuggaca

SEQ ID NO: 2181252 - RNA, 20 nt, Homo sapiens
cauugaaagagaaccaguuu

SEQ ID NO: 2181253 - RNA, 20 nt, Homo sapiens
agguugcuauauaguaucua

SEQ ID NO: 2181254 - RNA, 17 nt, Homo sapiens
aggcccaggaguccagg

SEQ ID NO: 2181255 - RNA, 22 nt, Homo sapiens
ccuggacucccguguaggaacc

SEQ ID NO: 2181256 - RNA, 20 nt, Homo sapiens
uucaagaccagccugaccaa

SEQ ID NO: 2181257 - RNA, 17 nt, Homo sapiens
ccugcgaggagaaauca

SEQ ID NO: 2181258 - RNA, 19 nt, Homo sapiens
gcuaggguggcccuugcag

SEQ ID NO: 2181259 - RNA, 19 nt, Homo sapiens
acaucaaauaaacugacuu

SEQ ID NO: 2181260 - RNA, 20 nt, Homo sapiens
auguuaagauuuaucugcaa

SEQ ID NO: 2181261 - RNA, 15 nt, Homo sapiens
gagaccaggagggag

SEQ ID NO: 2181262 - RNA, 17 nt, Homo sapiens
ccuggccccacaagcca

SEQ ID NO: 2181263 - RNA, 17 nt, Homo sapiens
ucuuccuugaccaaagc

SEQ ID NO: 2181264 - RNA, 16 nt, Homo sapiens
agaaugagccagaguu

SEQ ID NO: 2181265 - RNA, 20 nt, Homo sapiens
auuuuacagcuacuugcaau

SEQ ID NO: 2181266 - RNA, 17 nt, Homo sapiens
cagugaaacaaauuuac

SEQ ID NO: 2181267 - RNA, 21 nt, Homo sapiens
acccuucccaaucagcacuga

SEQ ID NO: 2181268 - RNA, 14 nt, Homo sapiens
uacccaauuuccca

SEQ ID NO: 2181269 - RNA, 14 nt, Homo sapiens
gagaugaugugaug

SEQ ID NO: 2181270 - RNA, 16 nt, Homo sapiens
aacugagcacuuugaa

SEQ ID NO: 2181271 - RNA, 14 nt, Homo sapiens
caagauggauuaaa

SEQ ID NO: 2181272 - RNA, 20 nt, Homo sapiens
ccugcagggacuccaugcug

SEQ ID NO: 2181273 - RNA, 13 nt, Homo sapiens
caacaccaccucu

SEQ ID NO: 2181274 - RNA, 13 nt, Homo sapiens
aaaauccaacuaa

SEQ ID NO: 2181275 - RNA, 20 nt, Homo sapiens
cucaaaugacccaaagacca

SEQ ID NO: 2181276 - RNA, 13 nt, Homo sapiens
auacuguguaugu

SEQ ID NO: 2181277 - RNA, 20 nt, Homo sapiens
aaagagaagcaucauuuccc

SEQ ID NO: 2181278 - RNA, 19 nt, Homo sapiens
uaguuuuagcuguagauca

SEQ ID NO: 2181279 - RNA, 15 nt, Homo sapiens
ccuauaacacuguga

SEQ ID NO: 2181280 - RNA, 18 nt, Homo sapiens
acuagagggauacacuga

SEQ ID NO: 2181281 - RNA, 14 nt, Homo sapiens
cauuccuugucacc

SEQ ID NO: 2181282 - RNA, 17 nt, Homo sapiens
caggucaguuuaugaaa

SEQ ID NO: 2181283 - RNA, 11 nt, Homo sapiens
aguucagggaa

SEQ ID NO: 2181284 - RNA, 16 nt, Homo sapiens
uuaccuggugcucuca

SEQ ID NO: 2181285 - RNA, 14 nt, Homo sapiens
caaacaauuuuaau

SEQ ID NO: 2181286 - RNA, 16 nt, Homo sapiens
uccuuuauacugugaa

SEQ ID NO: 2181287 - RNA, 20 nt, Homo sapiens
cagucucauuuugacagcau

SEQ ID NO: 2181288 - RNA, 12 nt, Homo sapiens
gcuucagaguuu

SEQ ID NO: 2181289 - RNA, 17 nt, Homo sapiens
aaauuauguuacuguau

SEQ ID NO: 2181290 - RNA, 16 nt, Homo sapiens
caggccuuugagcuca

SEQ ID NO: 2181291 - RNA, 14 nt, Homo sapiens
uuauucucaagaag

SEQ ID NO: 2181292 - RNA, 16 nt, Homo sapiens
caacaucccacagugg

SEQ ID NO: 2181293 - RNA, 13 nt, Homo sapiens
cuccucuaucaca

SEQ ID NO: 2181294 - RNA, 20 nt, Homo sapiens
auguagcaguucugcacuuu

SEQ ID NO: 2181295 - RNA, 18 nt, Homo sapiens
aagugcuaugccaagcca

SEQ ID NO: 2181296 - RNA, 16 nt, Homo sapiens
cugguagaaauaccca

SEQ ID NO: 2181297 - RNA, 18 nt, Homo sapiens
agcauagauuugcagcuc

SEQ ID NO: 2181298 - RNA, 11 nt, Homo sapiens
aagcuuuauga

SEQ ID NO: 2181299 - RNA, 18 nt, Homo sapiens
uauauugucuaguaauug

SEQ ID NO: 2181300 - RNA, 17 nt, Homo sapiens
agguugugggcauugau

SEQ ID NO: 2181301 - RNA, 18 nt, Homo sapiens
uucucuauaggucaugau

SEQ ID NO: 2181302 - RNA, 14 nt, Homo sapiens
ugggaaccaaacac

SEQ ID NO: 2181303 - RNA, 16 nt, Homo sapiens
uuguacacauauacau

SEQ ID NO: 2181304 - RNA, 21 nt, Homo sapiens
uacaaaacugcuuugugcaua

SEQ ID NO: 2181305 - RNA, 20 nt, Homo sapiens
gaugcacaguaucugcuguu

SEQ ID NO: 2181306 - RNA, 17 nt, Homo sapiens
ucagagacaacuuccca

SEQ ID NO: 2181307 - RNA, 19 nt, Homo sapiens
acaagcuuacuuccauugc

SEQ ID NO: 2181308 - RNA, 11 nt, Homo sapiens
cagucuacauu

SEQ ID NO: 2181309 - RNA, 22 nt, Homo sapiens
ucaauaaacagcuucaugccuu

SEQ ID NO: 2181310 - RNA, 21 nt, Homo sapiens
aguguguguuuguguguuuca

SEQ ID NO: 2181311 - RNA, 22 nt, Homo sapiens
aauaaaaaucaacucaucauuu

SEQ ID NO: 2181312 - RNA, 19 nt, Homo sapiens
gcagucucuuagaauuugu

SEQ ID NO: 2181313 - RNA, 14 nt, Homo sapiens
cagccaccaccacu

SEQ ID NO: 2181314 - RNA, 23 nt, Homo sapiens
aaccagaggaggaggaggacaga

SEQ ID NO: 2181315 - RNA, 20 nt, Homo sapiens
ccucaucuguaaaauggaga

SEQ ID NO: 2181316 - RNA, 16 nt, Homo sapiens
acuacaggcucaugcc

SEQ ID NO: 2181317 - RNA, 15 nt, Homo sapiens
cuggucccucugagg

SEQ ID NO: 2181318 - RNA, 17 nt, Homo sapiens
caacugauacuucacua

SEQ ID NO: 2181319 - RNA, 21 nt, Homo sapiens
cugaaagaguccuuucaggaa

SEQ ID NO: 2181320 - RNA, 22 nt, Homo sapiens
ugauucacaacuaggaccucau

SEQ ID NO: 2181321 - RNA, 16 nt, Homo sapiens
gaagacuauuugccau

SEQ ID NO: 2181322 - RNA, 18 nt, Homo sapiens
ggcgcugcuuugucaaaa

SEQ ID NO: 2181323 - RNA, 17 nt, Homo sapiens
uacugucucacugaaac

SEQ ID NO: 2181324 - RNA, 18 nt, Homo sapiens
gcagggaagaggggugca

SEQ ID NO: 2181325 - RNA, 20 nt, Homo sapiens
ucuuucccuaaagaacauac

SEQ ID NO: 2181326 - RNA, 22 nt, Homo sapiens
gacuucagcucagagagcacca

SEQ ID NO: 2181327 - RNA, 21 nt, Homo sapiens
ccacuucccgccuccaugacu

SEQ ID NO: 2181328 - RNA, 18 nt, Homo sapiens
uauaggauagacacugga

SEQ ID NO: 2181329 - RNA, 14 nt, Homo sapiens
cuuucuuaucccag

SEQ ID NO: 2181330 - RNA, 21 nt, Homo sapiens
auaaauuauuuaacuaauuaa

SEQ ID NO: 2181331 - RNA, 17 nt, Homo sapiens
cagagucaaaagaacuc

SEQ ID NO: 2181332 - RNA, 21 nt, Homo sapiens
uaaacagaagcagcaaaugaa

SEQ ID NO: 2181333 - RNA, 22 nt, Homo sapiens
aaccaggaacucuggaguucau

SEQ ID NO: 2181334 - RNA, 19 nt, Homo sapiens
auaaagcacagauuugcau

SEQ ID NO: 2181335 - RNA, 16 nt, Homo sapiens
ggcaagaccccaccuc

SEQ ID NO: 2181336 - RNA, 21 nt, Homo sapiens
guuauuucagcccccaucacc

SEQ ID NO: 2181337 - RNA, 22 nt, Homo sapiens
ugaguucuggaagggacuuuag

SEQ ID NO: 2181338 - RNA, 19 nt, Homo sapiens
ucagcuaaaguaacagagc

SEQ ID NO: 2181339 - RNA, 15 nt, Homo sapiens
acuucuggagucuau

SEQ ID NO: 2181340 - RNA, 19 nt, Homo sapiens
acgccuguaguccuagcca

SEQ ID NO: 2181341 - RNA, 22 nt, Homo sapiens
caguaaugugcgagaaagugaa

SEQ ID NO: 2181342 - RNA, 23 nt, Homo sapiens
agugccauggccaggaguggguu

SEQ ID NO: 2181343 - RNA, 13 nt, Homo sapiens
auaaaacuuuccu

SEQ ID NO: 2181344 - RNA, 20 nt, Homo sapiens
ggucucaaacuccugaccuc

SEQ ID NO: 2181345 - RNA, 15 nt, Homo sapiens
aacgcuugacacaaa

SEQ ID NO: 2181346 - RNA, 17 nt, Homo sapiens
ugugacucuucucucaa

SEQ ID NO: 2181347 - RNA, 13 nt, Homo sapiens
cuuggugagaugg

SEQ ID NO: 2181348 - RNA, 23 nt, Homo sapiens
cauugcucagcccgcuuggccac

SEQ ID NO: 2181349 - RNA, 20 nt, Homo sapiens
uucccaacucacugugcucc

SEQ ID NO: 2181350 - RNA, 17 nt, Homo sapiens
cacuaaagccagccuga

SEQ ID NO: 2181351 - RNA, 21 nt, Homo sapiens
cauuggcuaauaaauguugcc

SEQ ID NO: 2181352 - RNA, 15 nt, Homo sapiens
acuuaaaaacucuau

SEQ ID NO: 2181353 - RNA, 21 nt, Homo sapiens
uccgcauccuccuccugcuuc

SEQ ID NO: 2181354 - RNA, 15 nt, Homo sapiens
cagucuacgaagcca

SEQ ID NO: 2181355 - RNA, 23 nt, Homo sapiens
uccuguuuguugagugcacugac

SEQ ID NO: 2181356 - RNA, 14 nt, Homo sapiens
gggaccagggaugg

SEQ ID NO: 2181357 - RNA, 15 nt, Homo sapiens
acaagcugcauuuca

SEQ ID NO: 2181358 - RNA, 15 nt, Homo sapiens
gcaaaucaacacuuu

SEQ ID NO: 2181359 - RNA, 19 nt, Homo sapiens
uuugguucucuccaggaag

SEQ ID NO: 2181360 - RNA, 18 nt, Homo sapiens
cuuuauaugauauacuau

SEQ ID NO: 2181361 - RNA, 23 nt, Homo sapiens
agucucugaacuaggugaucuca

SEQ ID NO: 2181362 - RNA, 13 nt, Homo sapiens
ucuccuugcccug

SEQ ID NO: 2181363 - RNA, 22 nt, Homo sapiens
aaucuagaucuuugugccaaac

SEQ ID NO: 2181364 - RNA, 13 nt, Homo sapiens
ccaacagaacucc

SEQ ID NO: 2181365 - RNA, 20 nt, Homo sapiens
gcccggcugcugcuuggaug

SEQ ID NO: 2181366 - RNA, 15 nt, Homo sapiens
aauguaggacuguau

SEQ ID NO: 2181367 - RNA, 18 nt, Homo sapiens
gacagaggguggcuggag

SEQ ID NO: 2181368 - RNA, 18 nt, Homo sapiens
aaaucuguugauaaaucc

SEQ ID NO: 2181369 - RNA, 14 nt, Homo sapiens
uuguuuuauauucu

SEQ ID NO: 2181370 - RNA, 20 nt, Homo sapiens
ggcuggguuuucaggggcuu

SEQ ID NO: 2181371 - RNA, 23 nt, Homo sapiens
uaugaggaugcagagucagcaga

SEQ ID NO: 2181372 - RNA, 17 nt, Homo sapiens
uaaaauacuauucucau

SEQ ID NO: 2181373 - RNA, 18 nt, Homo sapiens
cagacuuuggaaaaugca

SEQ ID NO: 2181374 - RNA, 18 nt, Homo sapiens
uggauauuuuuuacuuua

SEQ ID NO: 2181375 - RNA, 14 nt, Homo sapiens
uguaaaaagagauu

SEQ ID NO: 2181376 - RNA, 15 nt, Homo sapiens
uucugucucugcuug

SEQ ID NO: 2181377 - RNA, 22 nt, Homo sapiens
cgaacgcucuuagcuuucucag

SEQ ID NO: 2181378 - RNA, 15 nt, Homo sapiens
cuguaggacuauaua

SEQ ID NO: 2181379 - RNA, 16 nt, Homo sapiens
ccagcagcugauucca

SEQ ID NO: 2181380 - RNA, 13 nt, Homo sapiens
accugaaucacaa

SEQ ID NO: 2181381 - RNA, 19 nt, Homo sapiens
aggacaaucuagcucucca

SEQ ID NO: 2181382 - RNA, 12 nt, Homo sapiens
guuacccaugaa

SEQ ID NO: 2181383 - RNA, 12 nt, Homo sapiens
ugaccccaguuc

SEQ ID NO: 2181384 - RNA, 17 nt, Homo sapiens
agaagauuuugccacau

SEQ ID NO: 2181385 - RNA, 21 nt, Homo sapiens
cugaggugccugcucaggugc

SEQ ID NO: 2181386 - RNA, 20 nt, Homo sapiens
ugaugcuguggagccuuagu

SEQ ID NO: 2181387 - RNA, 14 nt, Homo sapiens
auuuuaaaugcugu

SEQ ID NO: 2181388 - RNA, 18 nt, Homo sapiens
ccagaauguagcaucuga

SEQ ID NO: 2181389 - RNA, 22 nt, Homo sapiens
ccucuaguaaauuuaaguccac

SEQ ID NO: 2181390 - RNA, 14 nt, Homo sapiens
gacaugacauucuu

SEQ ID NO: 2181391 - RNA, 18 nt, Homo sapiens
uugaauuugguaucuuau

SEQ ID NO: 2181392 - RNA, 19 nt, Homo sapiens
gcagagaugacuguccaag

SEQ ID NO: 2181393 - RNA, 13 nt, Homo sapiens
uagccagugcuag

SEQ ID NO: 2181394 - RNA, 19 nt, Homo sapiens
agccaauaaaucaacucca

SEQ ID NO: 2181395 - RNA, 19 nt, Homo sapiens
cuagguuuaacucagauca

SEQ ID NO: 2181396 - RNA, 13 nt, Homo sapiens
aagaguccaagaa

SEQ ID NO: 2181397 - RNA, 14 nt, Homo sapiens
ugggaggauuugac

SEQ ID NO: 2181398 - RNA, 20 nt, Homo sapiens
ugaauuuacagaacaguuua

SEQ ID NO: 2181399 - RNA, 17 nt, Homo sapiens
gccaaagcuggcuuuuu

SEQ ID NO: 2181400 - RNA, 12 nt, Homo sapiens
ucuucaagagcu

SEQ ID NO: 2181401 - RNA, 22 nt, Homo sapiens
uaucuaauuuuacacucuguau

SEQ ID NO: 2181402 - RNA, 15 nt, Homo sapiens
cagcccucucucuca

SEQ ID NO: 2181403 - RNA, 16 nt, Homo sapiens
uuagauuuagaagugu

SEQ ID NO: 2181404 - RNA, 15 nt, Homo sapiens
uuucaaagacugcca

SEQ ID NO: 2181405 - RNA, 23 nt, Homo sapiens
uucuacugccuugaaaaaugaca

SEQ ID NO: 2181406 - RNA, 20 nt, Homo sapiens
ccuuucugacaauaaauaau

SEQ ID NO: 2181407 - RNA, 20 nt, Homo sapiens
aaacggguggugugucucag

SEQ ID NO: 2181408 - RNA, 16 nt, Homo sapiens
accugauuuccauuug

SEQ ID NO: 2181409 - RNA, 17 nt, Homo sapiens
uaugguucucucgcaag

SEQ ID NO: 2181410 - RNA, 19 nt, Homo sapiens
gcggaccccagcugugagc

SEQ ID NO: 2181411 - RNA, 23 nt, Homo sapiens
aagcgagcagaggcuccacaggc

SEQ ID NO: 2181412 - RNA, 23 nt, Homo sapiens
guaaugguucucauagugguaua

SEQ ID NO: 2181413 - RNA, 18 nt, Homo sapiens
ucaacaauuuuugaucaa

SEQ ID NO: 2181414 - RNA, 18 nt, Homo sapiens
aaaauaguuaagacauga

SEQ ID NO: 2181415 - RNA, 12 nt, Homo sapiens
gugaagugcaga

SEQ ID NO: 2181416 - RNA, 22 nt, Homo sapiens
aagacagcacaggcaacuucuc

SEQ ID NO: 2181417 - RNA, 21 nt, Homo sapiens
ccuuuguaaccacaacuuuca

SEQ ID NO: 2181418 - RNA, 22 nt, Homo sapiens
aaaugucuugcuguugacauau

SEQ ID NO: 2181419 - RNA, 16 nt, Homo sapiens
gagaagcugucaggga

SEQ ID NO: 2181420 - RNA, 22 nt, Homo sapiens
ccuuuuggaacccccacuuuua

SEQ ID NO: 2181421 - RNA, 15 nt, Homo sapiens
cuccuggugcccacu

SEQ ID NO: 2181422 - RNA, 17 nt, Homo sapiens
agauguucacuguggca

SEQ ID NO: 2181423 - RNA, 18 nt, Homo sapiens
cugccaggcuugaagaaa

SEQ ID NO: 2181424 - RNA, 17 nt, Homo sapiens
cuuucauuuacuguggc

SEQ ID NO: 2181425 - RNA, 16 nt, Homo sapiens
ccucucaugacuugca

SEQ ID NO: 2181426 - RNA, 15 nt, Homo sapiens
gcaggguauggccag

SEQ ID NO: 2181427 - RNA, 18 nt, Homo sapiens
uucuguccccucuuccua

SEQ ID NO: 2181428 - RNA, 14 nt, Homo sapiens
cugcaucaggugua

SEQ ID NO: 2181429 - RNA, 18 nt, Homo sapiens
uccccuccccaucugugu

SEQ ID NO: 2181430 - RNA, 19 nt, Homo sapiens
acaguagggcugcuaugcc

SEQ ID NO: 2181431 - RNA, 19 nt, Homo sapiens
ccuuuguguagaaagccaa

SEQ ID NO: 2181432 - RNA, 16 nt, Homo sapiens
agugccaacuguggcu

SEQ ID NO: 2181433 - RNA, 20 nt, Homo sapiens
augccucccugggccaccuc

SEQ ID NO: 2181434 - RNA, 19 nt, Homo sapiens
uggaaagcaucaccucagg

SEQ ID NO: 2181435 - RNA, 23 nt, Homo sapiens
ucacaguucuuugggccagacau

SEQ ID NO: 2181436 - RNA, 22 nt, Homo sapiens
cuugagcucugcucucagcaga

SEQ ID NO: 2181437 - RNA, 18 nt, Homo sapiens
acguucuggacugucuuc

SEQ ID NO: 2181438 - RNA, 22 nt, Homo sapiens
gcacauugaaagagaaccaguu

SEQ ID NO: 2181439 - RNA, 16 nt, Homo sapiens
gcagaauggcauuugc

SEQ ID NO: 2181440 - RNA, 15 nt, Homo sapiens
accucuggugauggu

SEQ ID NO: 2181441 - RNA, 15 nt, Homo sapiens
uuucuucaccucacu

SEQ ID NO: 2181442 - RNA, 21 nt, Homo sapiens
ugcguuuuagaguaugcaaga

SEQ ID NO: 2181443 - RNA, 18 nt, Homo sapiens
cagaaauguuuuuggcaa

SEQ ID NO: 2181444 - RNA, 17 nt, Homo sapiens
acugaaagguagacuuu

SEQ ID NO: 2181445 - RNA, 23 nt, Homo sapiens
cuuaguaguuuuuacaaaacugc

SEQ ID NO: 2181446 - RNA, 21 nt, Homo sapiens
ggcagcuguccugugauguca

SEQ ID NO: 2181447 - RNA, 23 nt, Homo sapiens
cagcugcauuucacaugccuugc

SEQ ID NO: 2181448 - RNA, 15 nt, Homo sapiens
acaaauaugucaguu

SEQ ID NO: 2181449 - RNA, 13 nt, Homo sapiens
uaaaaaaacacau

SEQ ID NO: 2181450 - RNA, 19 nt, Homo sapiens
ggcaccauggugacugcca

SEQ ID NO: 2181451 - RNA, 18 nt, Homo sapiens
acuguguguugccacagg

SEQ ID NO: 2181452 - RNA, 16 nt, Homo sapiens
ugguggguucagggga

SEQ ID NO: 2181453 - RNA, 13 nt, Homo sapiens
uauaagccaaaaa

SEQ ID NO: 2181454 - RNA, 17 nt, Homo sapiens
accaagagccaauggag

SEQ ID NO: 2181455 - RNA, 23 nt, Homo sapiens
agaugggaucccacuauauugca

SEQ ID NO: 2181456 - RNA, 15 nt, Homo sapiens
agcccccacugcacc

SEQ ID NO: 2181457 - RNA, 15 nt, Homo sapiens
aucgaugacgggcug

SEQ ID NO: 2181458 - RNA, 18 nt, Homo sapiens
cucguuguaaguacucua

SEQ ID NO: 2181459 - RNA, 15 nt, Homo sapiens
gguuaaggccugaau

SEQ ID NO: 2181460 - RNA, 16 nt, Homo sapiens
acacgaguuccagacc

SEQ ID NO: 2181461 - RNA, 19 nt, Homo sapiens
aagaccugggguugucagc

SEQ ID NO: 2181462 - RNA, 20 nt, Homo sapiens
cuugugccucggccucccua

SEQ ID NO: 2181463 - RNA, 12 nt, Homo sapiens
aauuacaaugga

SEQ ID NO: 2181464 - RNA, 20 nt, Homo sapiens
uaagggaaggaacucuggcu

SEQ ID NO: 2181465 - RNA, 23 nt, Homo sapiens
uaaacaaucagaccacauuugaa

SEQ ID NO: 2181466 - RNA, 14 nt, Homo sapiens
ugugccgcacucug

SEQ ID NO: 2181467 - RNA, 18 nt, Homo sapiens
ucaaauuaauugugugaa

SEQ ID NO: 2181468 - RNA, 20 nt, Homo sapiens
cccuccacaaagcaaaggca

SEQ ID NO: 2181469 - RNA, 17 nt, Homo sapiens
uccucaagauccugucu

SEQ ID NO: 2181470 - RNA, 14 nt, Homo sapiens
gaagguaaagggag

SEQ ID NO: 2181471 - RNA, 16 nt, Homo sapiens
uuuugaguguauacau

SEQ ID NO: 2181472 - RNA, 17 nt, Homo sapiens
acugugccucaggccag

SEQ ID NO: 2181473 - RNA, 15 nt, Homo sapiens
uuaguuuacuccuga

SEQ ID NO: 2181474 - RNA, 19 nt, Homo sapiens
gguuuguuauaucagggaa

SEQ ID NO: 2181475 - RNA, 17 nt, Homo sapiens
auucuuauguugaauau

SEQ ID NO: 2181476 - RNA, 13 nt, Homo sapiens
aaauaacuggaaa

SEQ ID NO: 2181477 - RNA, 13 nt, Homo sapiens
gagcccuugcaca

SEQ ID NO: 2181478 - RNA, 20 nt, Homo sapiens
cuacucuuucugcuuacaaa

SEQ ID NO: 2181479 - RNA, 21 nt, Homo sapiens
gucuuuugugucagugucuua

SEQ ID NO: 2181480 - RNA, 17 nt, Homo sapiens
cucaaauuuugaguuau

SEQ ID NO: 2181481 - RNA, 20 nt, Homo sapiens
ugggugccgggcugcacaga

SEQ ID NO: 2181482 - RNA, 23 nt, Homo sapiens
gccuugggacuuagaacaccgcc

SEQ ID NO: 2181483 - RNA, 14 nt, Homo sapiens
aucuucucccccac

SEQ ID NO: 2181484 - RNA, 14 nt, Homo sapiens
cuccugucaccuag

SEQ ID NO: 2181485 - RNA, 23 nt, Homo sapiens
ccagguuuuacacuugcaucucu

SEQ ID NO: 2181486 - RNA, 22 nt, Homo sapiens
aagagcaggacuccaggcccaa

SEQ ID NO: 2181487 - RNA, 15 nt, Homo sapiens
agaucuucaugguga

SEQ ID NO: 2181488 - RNA, 19 nt, Homo sapiens
aggugucuuaauacugucc

SEQ ID NO: 2181489 - RNA, 16 nt, Homo sapiens
aucugccgcuaccugg

SEQ ID NO: 2181490 - RNA, 13 nt, Homo sapiens
uaacagccaagaa

SEQ ID NO: 2181491 - RNA, 15 nt, Homo sapiens
ccaauuaaacccaga

SEQ ID NO: 2181492 - RNA, 18 nt, Homo sapiens
uuguuccuuaagucagaa

SEQ ID NO: 2181493 - RNA, 17 nt, Homo sapiens
ggguuccagcacaaagu

SEQ ID NO: 2181494 - RNA, 17 nt, Homo sapiens
gccccaaagacagcucc

SEQ ID NO: 2181495 - RNA, 14 nt, Homo sapiens
auguauuuucuuca

SEQ ID NO: 2181496 - RNA, 15 nt, Homo sapiens
gcucucugagagcaa

SEQ ID NO: 2181497 - RNA, 22 nt, Homo sapiens
uaaaauuuuuugugauuucaau

SEQ ID NO: 2181498 - RNA, 23 nt, Homo sapiens
aacuucuaaaacuguacuuugau

SEQ ID NO: 2181499 - RNA, 19 nt, Homo sapiens
cggagggucucccugggca

SEQ ID NO: 2181500 - RNA, 17 nt, Homo sapiens
agacucgagaacuuuca

SEQ ID NO: 2181501 - RNA, 19 nt, Homo sapiens
uacuggagaaaauggacgu

SEQ ID NO: 2181502 - RNA, 20 nt, Homo sapiens
gcuacugccgucagugcugu

SEQ ID NO: 2181503 - RNA, 14 nt, Homo sapiens
auggacacacuggu

SEQ ID NO: 2181504 - RNA, 16 nt, Homo sapiens
aaagaccuugcugaua

SEQ ID NO: 2181505 - RNA, 16 nt, Homo sapiens
uaggaggcugaggcag

SEQ ID NO: 2181506 - RNA, 18 nt, Homo sapiens
ugaacaugugaaguuaua

SEQ ID NO: 2181507 - RNA, 14 nt, Homo sapiens
aguaaacacugugu

SEQ ID NO: 2181508 - RNA, 22 nt, Homo sapiens
ccuuaagcaaauuuuguauuau

SEQ ID NO: 2181509 - RNA, 14 nt, Homo sapiens
uggcuucaagaaaa

SEQ ID NO: 2181510 - RNA, 19 nt, Homo sapiens
cuaagaguagcaggaacuc

SEQ ID NO: 2181511 - RNA, 12 nt, Homo sapiens
uuaauccagcug

SEQ ID NO: 2181512 - RNA, 15 nt, Homo sapiens
accuggaaugggucu

SEQ ID NO: 2181513 - RNA, 21 nt, Homo sapiens
ucuguaaauaaugugcacuga

SEQ ID NO: 2181514 - RNA, 21 nt, Homo sapiens
ugagaaaaggcuuucuuuauc

SEQ ID NO: 2181515 - RNA, 18 nt, Homo sapiens
uuucauguauuucuuuag

SEQ ID NO: 2181516 - RNA, 19 nt, Homo sapiens
guuuagaaauuacaaguuu

SEQ ID NO: 2181517 - RNA, 20 nt, Homo sapiens
cagagcugccuccccaaucc

SEQ ID NO: 2181518 - RNA, 20 nt, Homo sapiens
aggcaggagaacuacuugaa

SEQ ID NO: 2181519 - RNA, 19 nt, Homo sapiens
uggccagcccggcugguuu

SEQ ID NO: 2181520 - RNA, 18 nt, Homo sapiens
agcaggaaccccaggaga

SEQ ID NO: 2181521 - RNA, 22 nt, Homo sapiens
ugcaucgaaauguauucaccuu

SEQ ID NO: 2181522 - RNA, 16 nt, Homo sapiens
acacuggugugaccug

SEQ ID NO: 2181523 - RNA, 16 nt, Homo sapiens
uguaugaauagcugug

SEQ ID NO: 2181524 - RNA, 15 nt, Homo sapiens
ccaggcuccaggcug

SEQ ID NO: 2181525 - RNA, 23 nt, Homo sapiens
gauauccuuucacucugcauggu

SEQ ID NO: 2181526 - RNA, 20 nt, Homo sapiens
aauauaauccacuuugcucu

SEQ ID NO: 2181527 - RNA, 22 nt, Homo sapiens
acaauggcccgacauuucuuca

SEQ ID NO: 2181528 - RNA, 13 nt, Homo sapiens
cauaccauugaaa

SEQ ID NO: 2181529 - RNA, 16 nt, Homo sapiens
agccucagaaggcccc

SEQ ID NO: 2181530 - RNA, 14 nt, Homo sapiens
uaauaaauauucau

SEQ ID NO: 2181531 - RNA, 14 nt, Homo sapiens
aauccuauuuauca

SEQ ID NO: 2181532 - RNA, 15 nt, Homo sapiens
ccagaaaaggcauuu

SEQ ID NO: 2181533 - RNA, 15 nt, Homo sapiens
cuaggagaccaaggc

SEQ ID NO: 2181534 - RNA, 16 nt, Homo sapiens
acucucuuaugcauua

SEQ ID NO: 2181535 - RNA, 16 nt, Homo sapiens
gccaauucguucucug

SEQ ID NO: 2181536 - RNA, 18 nt, Homo sapiens
cugagaaggcaguaguuu

SEQ ID NO: 2181537 - RNA, 19 nt, Homo sapiens
cccuuuuguuuuugggaca

SEQ ID NO: 2181538 - RNA, 18 nt, Homo sapiens
acuuuuaaaaacauaaca

SEQ ID NO: 2181539 - RNA, 18 nt, Homo sapiens
cauuuuuguaacuugcca

SEQ ID NO: 2181540 - RNA, 20 nt, Homo sapiens
ggcacucagaagacacugau

SEQ ID NO: 2181541 - RNA, 20 nt, Homo sapiens
uuucaugcuauuucacucua

SEQ ID NO: 2181542 - RNA, 19 nt, Homo sapiens
agaagcucaucucagucau

SEQ ID NO: 2181543 - RNA, 23 nt, Homo sapiens
accaucugaaagugguacuugau

SEQ ID NO: 2181544 - RNA, 20 nt, Homo sapiens
ccauguguauggaagacaaa

SEQ ID NO: 2181545 - RNA, 11 nt, Homo sapiens
auccacccacc

SEQ ID NO: 2181546 - RNA, 11 nt, Homo sapiens
guccacccgcc

SEQ ID NO: 2181547 - RNA, 10 nt, Homo sapiens
uugucuccca

SEQ ID NO: 2181548 - RNA, 16 nt, Homo sapiens
ccaaacauguaucucu

SEQ ID NO: 2181549 - RNA, 22 nt, Homo sapiens
caaaaaaaaaaaaauacaacuc

SEQ ID NO: 2181550 - RNA, 14 nt, Homo sapiens
gaacaacuaccuga

SEQ ID NO: 2181551 - RNA, 11 nt, Homo sapiens
aaaacaaacuc

SEQ ID NO: 2181552 - RNA, 14 nt, Homo sapiens
gugcaaaaucuguu

SEQ ID NO: 2181553 - RNA, 15 nt, Homo sapiens
uaacuuccuguggau

SEQ ID NO: 2181554 - RNA, 15 nt, Homo sapiens
gaagaaaacaugacu

SEQ ID NO: 2181555 - RNA, 20 nt, Homo sapiens
cagccuuguuccucagcacc

SEQ ID NO: 2181556 - RNA, 18 nt, Homo sapiens
ucucccauuuuggaauuu

SEQ ID NO: 2181557 - RNA, 20 nt, Homo sapiens
ggcuuacacccacaguggaa

SEQ ID NO: 2181558 - RNA, 17 nt, Homo sapiens
gacugccccugccuuuu

SEQ ID NO: 2181559 - RNA, 14 nt, Homo sapiens
cauugugugucuuc

SEQ ID NO: 2181560 - RNA, 23 nt, Homo sapiens
agcaacucagaccugggcuuuuc

SEQ ID NO: 2181561 - RNA, 12 nt, Homo sapiens
gaugucauucuu

SEQ ID NO: 2181562 - RNA, 20 nt, Homo sapiens
gaaacggaggcagauggaga

SEQ ID NO: 2181563 - RNA, 15 nt, Homo sapiens
gcuugguacuguaau

SEQ ID NO: 2181564 - RNA, 13 nt, Homo sapiens
gaggcuacuguaa

SEQ ID NO: 2181565 - RNA, 23 nt, Homo sapiens
aauagaucaaaguccagcaggca

SEQ ID NO: 2181566 - RNA, 13 nt, Homo sapiens
cuuguggcugaga

SEQ ID NO: 2181567 - RNA, 16 nt, Homo sapiens
acaaauacuauccaaa

SEQ ID NO: 2181568 - RNA, 13 nt, Homo sapiens
ccaauacccagac

SEQ ID NO: 2181569 - RNA, 18 nt, Homo sapiens
aaaguacccugugcucaa

SEQ ID NO: 2181570 - RNA, 22 nt, Homo sapiens
accaucuaaucuaugcauguau

SEQ ID NO: 2181571 - RNA, 17 nt, Homo sapiens
auaugcucugauuuauc

SEQ ID NO: 2181572 - RNA, 14 nt, Homo sapiens
acagauuccuggca

SEQ ID NO: 2181573 - RNA, 22 nt, Homo sapiens
cauagagugaccuuuuaaucag

SEQ ID NO: 2181574 - RNA, 21 nt, Homo sapiens
uugaaugcauacucugugcaa

SEQ ID NO: 2181575 - RNA, 15 nt, Homo sapiens
cugaagacucaggca

SEQ ID NO: 2181576 - RNA, 20 nt, Homo sapiens
cugggccgggguguggaauc

SEQ ID NO: 2181577 - RNA, 18 nt, Homo sapiens
cccagaacuccauaccau

SEQ ID NO: 2181578 - RNA, 15 nt, Homo sapiens
agaaaaccauuuuag

SEQ ID NO: 2181579 - RNA, 17 nt, Homo sapiens
acagguggggacugggc

SEQ ID NO: 2181580 - RNA, 16 nt, Homo sapiens
gaagugucugccagcu

SEQ ID NO: 2181581 - RNA, 22 nt, Homo sapiens
cugcacuccagauaugugccaa

SEQ ID NO: 2181582 - RNA, 13 nt, Homo sapiens
auuguuguuacuu

SEQ ID NO: 2181583 - RNA, 15 nt, Homo sapiens
ccaaacacaccacau

SEQ ID NO: 2181584 - RNA, 15 nt, Homo sapiens
cuccuuuucugugaa

SEQ ID NO: 2181585 - RNA, 22 nt, Homo sapiens
cuuggaagggggagacaggaag

SEQ ID NO: 2181586 - RNA, 15 nt, Homo sapiens
aaagaaagaauaugu

SEQ ID NO: 2181587 - RNA, 12 nt, Homo sapiens
uauuugaacccc

SEQ ID NO: 2181588 - RNA, 19 nt, Homo sapiens
ccuacuucucugagucagc

SEQ ID NO: 2181589 - RNA, 20 nt, Homo sapiens
cccaggccuccccagcaccu

SEQ ID NO: 2181590 - RNA, 22 nt, Homo sapiens
guauuuaucauucaagaaauca

SEQ ID NO: 2181591 - RNA, 19 nt, Homo sapiens
ccaauucuucugcugccau

SEQ ID NO: 2181592 - RNA, 19 nt, Homo sapiens
auccggaaaucagcaaacu

SEQ ID NO: 2181593 - RNA, 21 nt, Homo sapiens
cauagauuucgaagccacaga

SEQ ID NO: 2181594 - RNA, 22 nt, Homo sapiens
ugaucaugccacugcacuccag

SEQ ID NO: 2181595 - RNA, 23 nt, Homo sapiens
ccgggaggcagagguugcagugu

SEQ ID NO: 2181596 - RNA, 13 nt, Homo sapiens
aacugaaacuggg

SEQ ID NO: 2181597 - RNA, 20 nt, Homo sapiens
cuaugaagcccacccagaaa

SEQ ID NO: 2181598 - RNA, 22 nt, Homo sapiens
gcacuuugcaucacagucacau

SEQ ID NO: 2181599 - RNA, 13 nt, Homo sapiens
uccugaagcugcu

SEQ ID NO: 2181600 - RNA, 16 nt, Homo sapiens
ggcuaagaguguccua

SEQ ID NO: 2181601 - RNA, 16 nt, Homo sapiens
uccacagacaucuuuc

SEQ ID NO: 2181602 - RNA, 18 nt, Homo sapiens
caaagggagggugacaug

SEQ ID NO: 2181603 - RNA, 15 nt, Homo sapiens
uuauaauaaccuggu

SEQ ID NO: 2181604 - RNA, 20 nt, Homo sapiens
gaauccaaagaucacauauu

SEQ ID NO: 2181605 - RNA, 22 nt, Homo sapiens
uaaacuggcuggcccagaguuu

SEQ ID NO: 2181606 - RNA, 22 nt, Homo sapiens
cccagcgagcaucccgggcaag

SEQ ID NO: 2181607 - RNA, 13 nt, Homo sapiens
aauagaugauggu

SEQ ID NO: 2181608 - RNA, 21 nt, Homo sapiens
aguuacauuuaugugcuguua

SEQ ID NO: 2181609 - RNA, 12 nt, Homo sapiens
caacagugugaa

SEQ ID NO: 2181610 - RNA, 21 nt, Homo sapiens
uuuaauaggugcagucuuuga

SEQ ID NO: 2181611 - RNA, 16 nt, Homo sapiens
cacaguuggauuuauu

SEQ ID NO: 2181612 - RNA, 23 nt, Homo sapiens
uugccuaaggugcguaguccaac

SEQ ID NO: 2181613 - RNA, 22 nt, Homo sapiens
gcucccacauucugaugagcaa

SEQ ID NO: 2181614 - RNA, 17 nt, Homo sapiens
auucugaaucaagguga

SEQ ID NO: 2181615 - RNA, 12 nt, Homo sapiens
cggaguccaaag

SEQ ID NO: 2181616 - RNA, 20 nt, Homo sapiens
guauccagucugaagauguu

SEQ ID NO: 2181617 - RNA, 19 nt, Homo sapiens
gcugauucaagaaacagaa

SEQ ID NO: 2181618 - RNA, 18 nt, Homo sapiens
ucagccucgcucuugucu

SEQ ID NO: 2181619 - RNA, 21 nt, Homo sapiens
ggaucaaguucagccaccgaa

SEQ ID NO: 2181620 - RNA, 14 nt, Homo sapiens
aagucuugcauuga

SEQ ID NO: 2181621 - RNA, 17 nt, Homo sapiens
uuccccaaaggcaucca

SEQ ID NO: 2181622 - RNA, 16 nt, Homo sapiens
uguccggagaugagau

SEQ ID NO: 2181623 - RNA, 17 nt, Homo sapiens
acaggggcaucucuggg

SEQ ID NO: 2181624 - RNA, 20 nt, Homo sapiens
gaaaagccuaaucacaguuu

SEQ ID NO: 2181625 - RNA, 20 nt, Homo sapiens
aaauuuacucacagcacuug

SEQ ID NO: 2181626 - RNA, 21 nt, Homo sapiens
cagcccagaaccacagaugug

SEQ ID NO: 2181627 - RNA, 13 nt, Homo sapiens
ggcagggugcagu

SEQ ID NO: 2181628 - RNA, 15 nt, Homo sapiens
ugcuucucccgggga

SEQ ID NO: 2181629 - RNA, 15 nt, Homo sapiens
uggugcugcucugug

SEQ ID NO: 2181630 - RNA, 15 nt, Homo sapiens
aaccguacacugugu

SEQ ID NO: 2181631 - RNA, 21 nt, Homo sapiens
cauguaauguuaauguuauau

SEQ ID NO: 2181632 - RNA, 18 nt, Homo sapiens
gaaagaccgugugugaaa

SEQ ID NO: 2181633 - RNA, 15 nt, Homo sapiens
uaaacccucugugaa

SEQ ID NO: 2181634 - RNA, 11 nt, Homo sapiens
ucagagcugcc

SEQ ID NO: 2181635 - RNA, 17 nt, Homo sapiens
ccaguggggaagugcgu

SEQ ID NO: 2181636 - RNA, 15 nt, Homo sapiens
ugccuaguccaacau

SEQ ID NO: 2181637 - RNA, 13 nt, Homo sapiens
auaauacuugcaa

SEQ ID NO: 2181638 - RNA, 15 nt, Homo sapiens
ccaccacaucuggcu

SEQ ID NO: 2181639 - RNA, 14 nt, Homo sapiens
uacuaccuguguau

SEQ ID NO: 2181640 - RNA, 17 nt, Homo sapiens
caggcuucggacagugc

SEQ ID NO: 2181641 - RNA, 12 nt, Homo sapiens
augccuacugcu

SEQ ID NO: 2181642 - RNA, 13 nt, Homo sapiens
cacaagaaucacu

SEQ ID NO: 2181643 - RNA, 18 nt, Homo sapiens
auccuucuaguuucccac

SEQ ID NO: 2181644 - RNA, 22 nt, Homo sapiens
uaaguuuuccuuuuguuuucca

SEQ ID NO: 2181645 - RNA, 14 nt, Homo sapiens
cuggcuuccuagaa

SEQ ID NO: 2181646 - RNA, 17 nt, Homo sapiens
cagcuggggcugaguga

SEQ ID NO: 2181647 - RNA, 11 nt, Homo sapiens
guuaugaucua

SEQ ID NO: 2181648 - RNA, 12 nt, Homo sapiens
augaaagcaauc

SEQ ID NO: 2181649 - RNA, 15 nt, Homo sapiens
ggaagcgauuacuuu

SEQ ID NO: 2181650 - RNA, 18 nt, Homo sapiens
gggaggcugcagccaggc

SEQ ID NO: 2181651 - RNA, 18 nt, Homo sapiens
aaguauucccuucuuucc

SEQ ID NO: 2181652 - RNA, 22 nt, Homo sapiens
cuacuccuagaagaaccaaaua

SEQ ID NO: 2181653 - RNA, 21 nt, Homo sapiens
aaaucaugaagauauuuuucc

SEQ ID NO: 2181654 - RNA, 14 nt, Homo sapiens
aaggacuuuggcaa

SEQ ID NO: 2181655 - RNA, 19 nt, Homo sapiens
aacugucucguacuagaau

SEQ ID NO: 2181656 - RNA, 17 nt, Homo sapiens
caagagcugaaaaacuu

SEQ ID NO: 2181657 - RNA, 21 nt, Homo sapiens
acagaaaauuugcaacauaua

SEQ ID NO: 2181658 - RNA, 20 nt, Homo sapiens
uuaggugguguuugcuuguu

SEQ ID NO: 2181659 - RNA, 15 nt, Homo sapiens
agccucagggacgac

SEQ ID NO: 2181660 - RNA, 18 nt, Homo sapiens
agcacauguauugacaac

SEQ ID NO: 2181661 - RNA, 17 nt, Homo sapiens
uaaaacuuacuauggua

SEQ ID NO: 2181662 - RNA, 21 nt, Homo sapiens
auggucacgagguccagaccc

SEQ ID NO: 2181663 - RNA, 20 nt, Homo sapiens
agacaagaaggccacuggua

SEQ ID NO: 2181664 - RNA, 15 nt, Homo sapiens
cuucuaauguucccc

SEQ ID NO: 2181665 - RNA, 12 nt, Homo sapiens
caccgcauucca

SEQ ID NO: 2181666 - RNA, 18 nt, Homo sapiens
uaugaugguggucaucca

SEQ ID NO: 2181667 - RNA, 12 nt, Homo sapiens
uaauacauucac

SEQ ID NO: 2181668 - RNA, 12 nt, Homo sapiens
uucucccugugu

SEQ ID NO: 2181669 - RNA, 18 nt, Homo sapiens
ugcuuguggccaaugcau

SEQ ID NO: 2181670 - RNA, 18 nt, Homo sapiens
ccccuuugauugcugaga

SEQ ID NO: 2181671 - RNA, 19 nt, Homo sapiens
ugccucagccuccaaagua

SEQ ID NO: 2181672 - RNA, 22 nt, Homo sapiens
ccuagagucggccaccacagau

SEQ ID NO: 2181673 - RNA, 12 nt, Homo sapiens
guuucuguguca

SEQ ID NO: 2181674 - RNA, 13 nt, Homo sapiens
augucucauguca

SEQ ID NO: 2181675 - RNA, 13 nt, Homo sapiens
aggcaucauuuuc

SEQ ID NO: 2181676 - RNA, 14 nt, Homo sapiens
cacuggaguccaca

SEQ ID NO: 2181677 - RNA, 19 nt, Homo sapiens
ccuaaggagccugggauga

SEQ ID NO: 2181678 - RNA, 14 nt, Homo sapiens
gucauaauugcauu

SEQ ID NO: 2181679 - RNA, 13 nt, Homo sapiens
uuacacaucugcc

SEQ ID NO: 2181680 - RNA, 18 nt, Homo sapiens
uugaaaaauauugcuaaa

SEQ ID NO: 2181681 - RNA, 22 nt, Homo sapiens
ccuugguuccuaacuggaauca

SEQ ID NO: 2181682 - RNA, 16 nt, Homo sapiens
ccuguauauaauacua

SEQ ID NO: 2181683 - RNA, 21 nt, Homo sapiens
augucucccagggccuuaaaa

SEQ ID NO: 2181684 - RNA, 13 nt, Homo sapiens
ugcucucuucaau

SEQ ID NO: 2181685 - RNA, 12 nt, Homo sapiens
uacuggacucag

SEQ ID NO: 2181686 - RNA, 14 nt, Homo sapiens
aguagugucuuccu

SEQ ID NO: 2181687 - RNA, 18 nt, Homo sapiens
auggacaugaucuucuuu

SEQ ID NO: 2181688 - RNA, 21 nt, Homo sapiens
ccugacagguucccagcagcu

SEQ ID NO: 2181689 - RNA, 20 nt, Homo sapiens
gcagccacacucacccagcc

SEQ ID NO: 2181690 - RNA, 16 nt, Homo sapiens
uuacuguguaaacuca

SEQ ID NO: 2181691 - RNA, 15 nt, Homo sapiens
agggcccgaccuggg

SEQ ID NO: 2181692 - RNA, 20 nt, Homo sapiens
aguaacucauugcucuguua

SEQ ID NO: 2181693 - RNA, 19 nt, Homo sapiens
guguggcaagcaagagcuc

SEQ ID NO: 2181694 - RNA, 17 nt, Homo sapiens
aaggagaacugugcucu

SEQ ID NO: 2181695 - RNA, 12 nt, Homo sapiens
accucuaguaaa

SEQ ID NO: 2181696 - RNA, 14 nt, Homo sapiens
ugagagacccaagg

SEQ ID NO: 2181697 - RNA, 13 nt, Homo sapiens
uugggaugggcag

SEQ ID NO: 2181698 - RNA, 21 nt, Homo sapiens
agagagucuggauaacuucca

SEQ ID NO: 2181699 - RNA, 23 nt, Homo sapiens
ggcugccccucgcacacagggcu

SEQ ID NO: 2181700 - RNA, 22 nt, Homo sapiens
uuccgugcuugucccuguggaa

SEQ ID NO: 2181701 - RNA, 17 nt, Homo sapiens
ugauuacuaauuaucaa

SEQ ID NO: 2181702 - RNA, 12 nt, Homo sapiens
aggggagacaga

SEQ ID NO: 2181703 - RNA, 12 nt, Homo sapiens
auaauuguguag

SEQ ID NO: 2181704 - RNA, 18 nt, Homo sapiens
uuccucuuggugucauau

SEQ ID NO: 2181705 - RNA, 18 nt, Homo sapiens
aggacagggaggugaccc

SEQ ID NO: 2181706 - RNA, 18 nt, Homo sapiens
uacguaugagauccuuua

SEQ ID NO: 2181707 - RNA, 16 nt, Homo sapiens
caccccugacuuuuau

SEQ ID NO: 2181708 - RNA, 19 nt, Homo sapiens
agaaggaaccagccaugag

SEQ ID NO: 2181709 - RNA, 17 nt, Homo sapiens
gggcagcagcaucucag

SEQ ID NO: 2181710 - RNA, 23 nt, Homo sapiens
aaauauuaugcaaauucccagau

SEQ ID NO: 2181711 - RNA, 12 nt, Homo sapiens
gagccuguccaa

SEQ ID NO: 2181712 - RNA, 21 nt, Homo sapiens
ugaaacucccagccacagcau

SEQ ID NO: 2181713 - RNA, 12 nt, Homo sapiens
ccaaaucugccu

SEQ ID NO: 2181714 - RNA, 22 nt, Homo sapiens
cauaacauaaaagugcuacuug

SEQ ID NO: 2181715 - RNA, 15 nt, Homo sapiens
ucuuuugcugaucuu

SEQ ID NO: 2181716 - RNA, 13 nt, Homo sapiens
cuagccucagggg

SEQ ID NO: 2181717 - RNA, 22 nt, Homo sapiens
ccugggcugccgggaaccucau

SEQ ID NO: 2181718 - RNA, 21 nt, Homo sapiens
uucuugaggcagggucucacu

SEQ ID NO: 2181719 - RNA, 15 nt, Homo sapiens
auaaaaaugagugcu

SEQ ID NO: 2181720 - RNA, 15 nt, Homo sapiens
augaaaaugaaugcu

SEQ ID NO: 2181721 - RNA, 21 nt, Homo sapiens
aggaguucgagaccaaccuag

SEQ ID NO: 2181722 - RNA, 14 nt, Homo sapiens
gggcucugagccaa

SEQ ID NO: 2181723 - RNA, 21 nt, Homo sapiens
guguucgcuuggcuccaugcu

SEQ ID NO: 2181724 - RNA, 16 nt, Homo sapiens
uugggaccugcuucau

SEQ ID NO: 2181725 - RNA, 17 nt, Homo sapiens
uacugacugaaaucagu

SEQ ID NO: 2181726 - RNA, 14 nt, Homo sapiens
aaagcaugugagac

SEQ ID NO: 2181727 - RNA, 21 nt, Homo sapiens
ucaaucucguuuagugccaau

SEQ ID NO: 2181728 - RNA, 18 nt, Homo sapiens
uauugcaagcagauuccc

SEQ ID NO: 2181729 - RNA, 16 nt, Homo sapiens
cccccaucccugccac

SEQ ID NO: 2181730 - RNA, 20 nt, Homo sapiens
ggcauccauggggucucuca

SEQ ID NO: 2181731 - RNA, 20 nt, Homo sapiens
aucuccaguagaaagcauaa

SEQ ID NO: 2181732 - RNA, 16 nt, Homo sapiens
agccaccucacccagc

SEQ ID NO: 2181733 - RNA, 19 nt, Homo sapiens
agcauuaaaauaacuauca

SEQ ID NO: 2181734 - RNA, 14 nt, Homo sapiens
ccaccccaccucuu

SEQ ID NO: 2181735 - RNA, 12 nt, Homo sapiens
uguuaacaaugc

SEQ ID NO: 2181736 - RNA, 21 nt, Homo sapiens
augccugcagugccacuaaaa

SEQ ID NO: 2181737 - RNA, 23 nt, Homo sapiens
cucacgcuccuuucugaucuuca

SEQ ID NO: 2181738 - RNA, 13 nt, Homo sapiens
aaaaggucauaua

SEQ ID NO: 2181739 - RNA, 19 nt, Homo sapiens
ucucauuuauauugcagau

SEQ ID NO: 2181740 - RNA, 16 nt, Homo sapiens
gcugcaccccaagucc

SEQ ID NO: 2181741 - RNA, 20 nt, Homo sapiens
aaggacuuccuguccagcuc

SEQ ID NO: 2181742 - RNA, 18 nt, Homo sapiens
ggaugaccauaugcacaa

SEQ ID NO: 2181743 - RNA, 22 nt, Homo sapiens
aaauuauuguuaaagaauacac

SEQ ID NO: 2181744 - RNA, 17 nt, Homo sapiens
agcuacaugguggagca

SEQ ID NO: 2181745 - RNA, 14 nt, Homo sapiens
uaaugugcuuuauu

SEQ ID NO: 2181746 - RNA, 14 nt, Homo sapiens
acuaugauguggag

SEQ ID NO: 2181747 - RNA, 19 nt, Homo sapiens
agucuggaaagugauguca

SEQ ID NO: 2181748 - RNA, 16 nt, Homo sapiens
aggaaguucuccagcu

SEQ ID NO: 2181749 - RNA, 21 nt, Homo sapiens
auacagucuuccacaaagaaa

SEQ ID NO: 2181750 - RNA, 20 nt, Homo sapiens
uuccaacuaacguacauuca

SEQ ID NO: 2181751 - RNA, 18 nt, Homo sapiens
aaacugcccacucugcaa

SEQ ID NO: 2181752 - RNA, 14 nt, Homo sapiens
caacacugcucaca

SEQ ID NO: 2181753 - RNA, 21 nt, Homo sapiens
gaaugagcuugugugcccuga

SEQ ID NO: 2181754 - RNA, 22 nt, Homo sapiens
cuuguccacccaccuaugugcc

SEQ ID NO: 2181755 - RNA, 20 nt, Homo sapiens
ucuucaauuuauuacugaaa

SEQ ID NO: 2181756 - RNA, 15 nt, Homo sapiens
caggaucacagcuca

SEQ ID NO: 2181757 - RNA, 13 nt, Homo sapiens
aacucuucacucu

SEQ ID NO: 2181758 - RNA, 14 nt, Homo sapiens
cugcaugcaaacaa

SEQ ID NO: 2181759 - RNA, 19 nt, Homo sapiens
ccacugcugcccccagaaa

SEQ ID NO: 2181760 - RNA, 19 nt, Homo sapiens
gcugccaugcccaccaucg

SEQ ID NO: 2181761 - RNA, 20 nt, Homo sapiens
acuuacuauuggucaugcaa

SEQ ID NO: 2181762 - RNA, 16 nt, Homo sapiens
aacuuagagauugcau

SEQ ID NO: 2181763 - RNA, 15 nt, Homo sapiens
guucugcucauucua

SEQ ID NO: 2181764 - RNA, 18 nt, Homo sapiens
uuuucuaaugugcauuaa

SEQ ID NO: 2181765 - RNA, 12 nt, Homo sapiens
gguucgcauuau

SEQ ID NO: 2181766 - RNA, 21 nt, Homo sapiens
acuuauucucuguaggccaaa

SEQ ID NO: 2181767 - RNA, 14 nt, Homo sapiens
gccaaaccaagcaa

SEQ ID NO: 2181768 - RNA, 22 nt, Homo sapiens
aacaccuucuauagcaucacuu

SEQ ID NO: 2181769 - RNA, 23 nt, Homo sapiens
cacccaguugccaaaguuuugcu

SEQ ID NO: 2181770 - RNA, 21 nt, Homo sapiens
caucaacaaagaaauauuauu

SEQ ID NO: 2181771 - RNA, 24 nt, Homo sapiens
aagaaggcaauuuuaguguauuaa

SEQ ID NO: 2181772 - RNA, 21 nt, Homo sapiens
cagugaaugauucaguguuaa

SEQ ID NO: 2181773 - RNA, 20 nt, Homo sapiens
caaguuguuucaaacagcau

SEQ ID NO: 2181774 - RNA, 17 nt, Homo sapiens
agcaucucccaguucau

SEQ ID NO: 2181775 - RNA, 11 nt, Homo sapiens
aucgacaagaa

SEQ ID NO: 2181776 - RNA, 17 nt, Homo sapiens
uugaccuccuugacuca

SEQ ID NO: 2181777 - RNA, 14 nt, Homo sapiens
uuguguacugauaa

SEQ ID NO: 2181778 - RNA, 18 nt, Homo sapiens
gagugaaaacaucugcac

SEQ ID NO: 2181779 - RNA, 22 nt, Homo sapiens
uaucaggggugcauucuggcca

SEQ ID NO: 2181780 - RNA, 23 nt, Homo sapiens
gcagacacuguagucagaccuca

SEQ ID NO: 2181781 - RNA, 23 nt, Homo sapiens
ucccugcacuaaagccagccuga

SEQ ID NO: 2181782 - RNA, 17 nt, Homo sapiens
aaugguuaugugcauua

SEQ ID NO: 2181783 - RNA, 11 nt, Homo sapiens
gaaaacauuca

SEQ ID NO: 2181784 - RNA, 16 nt, Homo sapiens
agugcccccaacagca

SEQ ID NO: 2181785 - RNA, 18 nt, Homo sapiens
agaauagggagacaaucu

SEQ ID NO: 2181786 - RNA, 13 nt, Homo sapiens
uauucaguucuua

SEQ ID NO: 2181787 - RNA, 17 nt, Homo sapiens
caaaucacgaccacuga

SEQ ID NO: 2181788 - RNA, 18 nt, Homo sapiens
aauacagcuucauuaucu

SEQ ID NO: 2181789 - RNA, 14 nt, Homo sapiens
aaucucauucccag

SEQ ID NO: 2181790 - RNA, 21 nt, Homo sapiens
ugaguuguaucguguggugua

SEQ ID NO: 2181791 - RNA, 19 nt, Homo sapiens
acucuaccaaauaauuuca

SEQ ID NO: 2181792 - RNA, 16 nt, Homo sapiens
ugcccucaggggacuu

SEQ ID NO: 2181793 - RNA, 21 nt, Homo sapiens
ugucaaaugugucucacaucu

SEQ ID NO: 2181794 - RNA, 18 nt, Homo sapiens
uggaaguucauaccuaag

SEQ ID NO: 2181795 - RNA, 12 nt, Homo sapiens
ugccucugccac

SEQ ID NO: 2181796 - RNA, 17 nt, Homo sapiens
ucuugucccuuucccua

SEQ ID NO: 2181797 - RNA, 16 nt, Homo sapiens
uaagacgaaugauuua

SEQ ID NO: 2181798 - RNA, 17 nt, Homo sapiens
gccuuccugccuagucu

SEQ ID NO: 2181799 - RNA, 23 nt, Homo sapiens
acuggcgcagacuucacaauuca

SEQ ID NO: 2181800 - RNA, 12 nt, Homo sapiens
acaugagcacac

SEQ ID NO: 2181801 - RNA, 12 nt, Homo sapiens
ugcugagcugcc

SEQ ID NO: 2181802 - RNA, 12 nt, Homo sapiens
accuucuuucac

SEQ ID NO: 2181803 - RNA, 19 nt, Homo sapiens
gauauuuuuuauacaguga

SEQ ID NO: 2181804 - RNA, 18 nt, Homo sapiens
caggagcguguccuaucc

SEQ ID NO: 2181805 - RNA, 23 nt, Homo sapiens
gcaacaauaaugauuuucuugcc

SEQ ID NO: 2181806 - RNA, 18 nt, Homo sapiens
gaagucucuuuuucuucc

SEQ ID NO: 2181807 - RNA, 13 nt, Homo sapiens
auuuaaacuucua

SEQ ID NO: 2181808 - RNA, 20 nt, Homo sapiens
agugcaguggugccaucacc

SEQ ID NO: 2181809 - RNA, 16 nt, Homo sapiens
uaauguaaaauucaua

SEQ ID NO: 2181810 - RNA, 16 nt, Homo sapiens
cccccaucucuacaaa

SEQ ID NO: 2181811 - RNA, 17 nt, Homo sapiens
caaaggcaaugcucaaa

SEQ ID NO: 2181812 - RNA, 21 nt, Homo sapiens
cuucucccgccauuggccuua

SEQ ID NO: 2181813 - RNA, 17 nt, Homo sapiens
acaagggcaggucuuca

SEQ ID NO: 2181814 - RNA, 17 nt, Homo sapiens
auacgauccugcagggu

SEQ ID NO: 2181815 - RNA, 16 nt, Homo sapiens
gguuuaacucagauca

SEQ ID NO: 2181816 - RNA, 19 nt, Homo sapiens
ucaacauaaagagcaauaa

SEQ ID NO: 2181817 - RNA, 13 nt, Homo sapiens
aaccuuccaccca

SEQ ID NO: 2181818 - RNA, 13 nt, Homo sapiens
ccuguucccauga

SEQ ID NO: 2181819 - RNA, 19 nt, Homo sapiens
auguaagaguucagacuca

SEQ ID NO: 2181820 - RNA, 17 nt, Homo sapiens
caggcagccacgucuca

SEQ ID NO: 2181821 - RNA, 13 nt, Homo sapiens
cacccucugccua

SEQ ID NO: 2181822 - RNA, 13 nt, Homo sapiens
ucuagaaccacua

SEQ ID NO: 2181823 - RNA, 13 nt, Homo sapiens
guaaagaugucaa

SEQ ID NO: 2181824 - RNA, 19 nt, Homo sapiens
uaugcauuuuuuaccacaa

SEQ ID NO: 2181825 - RNA, 24 nt, Homo sapiens
ugaccguacucucacauguggcaa

SEQ ID NO: 2181826 - RNA, 18 nt, Homo sapiens
uaacaucaacaacacagc

SEQ ID NO: 2181827 - RNA, 15 nt, Homo sapiens
aacaaaugugcugcu

SEQ ID NO: 2181828 - RNA, 19 nt, Homo sapiens
ucagcaguccacaaagcau

SEQ ID NO: 2181829 - RNA, 20 nt, Homo sapiens
uucugaagucugagcccauu

SEQ ID NO: 2181830 - RNA, 19 nt, Homo sapiens
cccucuccuccguggcaca

SEQ ID NO: 2181831 - RNA, 20 nt, Homo sapiens
cauaugaucugucuguggca

SEQ ID NO: 2181832 - RNA, 16 nt, Homo sapiens
auaaacaacauugucu

SEQ ID NO: 2181833 - RNA, 21 nt, Homo sapiens
uugaccaauuugcaccaguuu

SEQ ID NO: 2181834 - RNA, 17 nt, Homo sapiens
auuuaauaccaccaaca

SEQ ID NO: 2181835 - RNA, 23 nt, Homo sapiens
auugagccuuuuauuaacauaua

SEQ ID NO: 2181836 - RNA, 21 nt, Homo sapiens
ucugaagaguaaggaguagua

SEQ ID NO: 2181837 - RNA, 17 nt, Homo sapiens
auuaaaauaaauguugu

SEQ ID NO: 2181838 - RNA, 12 nt, Homo sapiens
ucaccaccacca

SEQ ID NO: 2181839 - RNA, 16 nt, Homo sapiens
ggcuucagugagccau

SEQ ID NO: 2181840 - RNA, 22 nt, Homo sapiens
ucauaaaauguaucuuccaugc

SEQ ID NO: 2181841 - RNA, 16 nt, Homo sapiens
cuauuuauuaucgcau

SEQ ID NO: 2181842 - RNA, 12 nt, Homo sapiens
uagcauggggcu

SEQ ID NO: 2181843 - RNA, 14 nt, Homo sapiens
ugcacauaggcagu

SEQ ID NO: 2181844 - RNA, 17 nt, Homo sapiens
caauuaacauacaucau

SEQ ID NO: 2181845 - RNA, 12 nt, Homo sapiens
cuucugguccuu

SEQ ID NO: 2181846 - RNA, 20 nt, Homo sapiens
uuaaagugcaguucuuagcc

SEQ ID NO: 2181847 - RNA, 21 nt, Homo sapiens
uuuugguagaugcaugacuug

SEQ ID NO: 2181848 - RNA, 23 nt, Homo sapiens
cucauguuguugaggcugucaca

SEQ ID NO: 2181849 - RNA, 20 nt, Homo sapiens
aucccaccaaccuccagugu

SEQ ID NO: 2181850 - RNA, 18 nt, Homo sapiens
ugacaacuguggacucca

SEQ ID NO: 2181851 - RNA, 14 nt, Homo sapiens
cugagaacuggaca

SEQ ID NO: 2181852 - RNA, 14 nt, Homo sapiens
caggccagucccac

SEQ ID NO: 2181853 - RNA, 23 nt, Homo sapiens
cagcaaacaaauaaaaugaaaua

SEQ ID NO: 2181854 - RNA, 22 nt, Homo sapiens
aggaugaucuaggaagacuuug

SEQ ID NO: 2181855 - RNA, 20 nt, Homo sapiens
aaugcaauaguaggacugcu

SEQ ID NO: 2181856 - RNA, 19 nt, Homo sapiens
guggccugcgcuagcuucu

SEQ ID NO: 2181857 - RNA, 17 nt, Homo sapiens
gcaagugggaccaggau

SEQ ID NO: 2181858 - RNA, 15 nt, Homo sapiens
aaccauuccaacuuc

SEQ ID NO: 2181859 - RNA, 15 nt, Homo sapiens
gaauggccugagaca

SEQ ID NO: 2181860 - RNA, 15 nt, Homo sapiens
cagaauaaagcaauu

SEQ ID NO: 2181861 - RNA, 14 nt, Homo sapiens
cuauuccaaaaagg

SEQ ID NO: 2181862 - RNA, 17 nt, Homo sapiens
gaacuauguaaaugacu

SEQ ID NO: 2181863 - RNA, 15 nt, Homo sapiens
aucucugaaagcaca

SEQ ID NO: 2181864 - RNA, 14 nt, Homo sapiens
auauuguguugcaa

SEQ ID NO: 2181865 - RNA, 13 nt, Homo sapiens
cggcaagaaggaa

SEQ ID NO: 2181866 - RNA, 16 nt, Homo sapiens
gaaaacugauucucua

SEQ ID NO: 2181867 - RNA, 23 nt, Homo sapiens
cuuacagauaggccuucuuguga

SEQ ID NO: 2181868 - RNA, 20 nt, Homo sapiens
aagagggagggagggcucca

SEQ ID NO: 2181869 - RNA, 23 nt, Homo sapiens
guuuuguuugguaguuuugccaa

SEQ ID NO: 2181870 - RNA, 17 nt, Homo sapiens
aauccaggcuguucuca

SEQ ID NO: 2181871 - RNA, 18 nt, Homo sapiens
auuggcuauaacaugucu

SEQ ID NO: 2181872 - RNA, 19 nt, Homo sapiens
gcaaccucuucaugagcuu

SEQ ID NO: 2181873 - RNA, 17 nt, Homo sapiens
aaggacgguucuuacac

SEQ ID NO: 2181874 - RNA, 24 nt, Homo sapiens
uccaaaaggccuuuggaaagacuu

SEQ ID NO: 2181875 - RNA, 23 nt, Homo sapiens
ccuccuggguuuacuccuugagu

SEQ ID NO: 2181876 - RNA, 22 nt, Homo sapiens
cacuuguaagaaaaugagacaa

SEQ ID NO: 2181877 - RNA, 21 nt, Homo sapiens
agaaaggacccucaagacaaa

SEQ ID NO: 2181878 - RNA, 17 nt, Homo sapiens
cuaugcagaacagugag

SEQ ID NO: 2181879 - RNA, 16 nt, Homo sapiens
cuggccaggccccgcg

SEQ ID NO: 2181880 - RNA, 16 nt, Homo sapiens
ucuggacaccagggga

SEQ ID NO: 2181881 - RNA, 22 nt, Homo sapiens
accaaccaaagggggacaguga

SEQ ID NO: 2181882 - RNA, 12 nt, Homo sapiens
aaagaugcagug

SEQ ID NO: 2181883 - RNA, 17 nt, Homo sapiens
augccaccuccuggaag

SEQ ID NO: 2181884 - RNA, 12 nt, Homo sapiens
uuuucuguucca

SEQ ID NO: 2181885 - RNA, 23 nt, Homo sapiens
cuguccccgccgggcagugucac

SEQ ID NO: 2181886 - RNA, 9 nt, Homo sapiens
uuugccaaa

SEQ ID NO: 2181887 - RNA, 22 nt, Homo sapiens
uccugcugcggaggagcugccu

SEQ ID NO: 2181888 - RNA, 16 nt, Homo sapiens
uugaauuuauggaauc

SEQ ID NO: 2181889 - RNA, 16 nt, Homo sapiens
uuaaaugcucaucugg

SEQ ID NO: 2181890 - RNA, 20 nt, Homo sapiens
uugccagacuggagugcagu

SEQ ID NO: 2181891 - RNA, 14 nt, Homo sapiens
agauauucuuuaca

SEQ ID NO: 2181892 - RNA, 21 nt, Homo sapiens
ugggauugggggcuggugcca

SEQ ID NO: 2181893 - RNA, 18 nt, Homo sapiens
aucucucagagcccucaa

SEQ ID NO: 2181894 - RNA, 16 nt, Homo sapiens
aaguuacuacuuacag

SEQ ID NO: 2181895 - RNA, 14 nt, Homo sapiens
caucuucucagugu

SEQ ID NO: 2181896 - RNA, 23 nt, Homo sapiens
aaaucucuucuuugcugcaguca

SEQ ID NO: 2181897 - RNA, 19 nt, Homo sapiens
ugcuuccuauacaguucua

SEQ ID NO: 2181898 - RNA, 15 nt, Homo sapiens
ggugggagaugugga

SEQ ID NO: 2181899 - RNA, 18 nt, Homo sapiens
aaaucauacuuucucuuc

SEQ ID NO: 2181900 - RNA, 22 nt, Homo sapiens
gaacugaauaaacaggaaaaug

SEQ ID NO: 2181901 - RNA, 21 nt, Homo sapiens
ccacggcaggccccugcagga

SEQ ID NO: 2181902 - RNA, 18 nt, Homo sapiens
cagaacacacuccaucag

SEQ ID NO: 2181903 - RNA, 19 nt, Homo sapiens
ugggcauuucacgaacugu

SEQ ID NO: 2181904 - RNA, 16 nt, Homo sapiens
caagggcugcuuccag

SEQ ID NO: 2181905 - RNA, 17 nt, Homo sapiens
ccuuaccuuuaccccau

SEQ ID NO: 2181906 - RNA, 17 nt, Homo sapiens
cuggagcagucugagga

SEQ ID NO: 2181907 - RNA, 18 nt, Homo sapiens
uuuguaaaucugccacaa

SEQ ID NO: 2181908 - RNA, 23 nt, Homo sapiens
uacaauccuuugaguuauaguuu

SEQ ID NO: 2181909 - RNA, 15 nt, Homo sapiens
caucacguaccccac

SEQ ID NO: 2181910 - RNA, 13 nt, Homo sapiens
auuucaaccagca

SEQ ID NO: 2181911 - RNA, 18 nt, Homo sapiens
uucgaggacuacaaccaa

SEQ ID NO: 2181912 - RNA, 16 nt, Homo sapiens
accagaaaagcaauac

SEQ ID NO: 2181913 - RNA, 15 nt, Homo sapiens
uggagucacuguagu

SEQ ID NO: 2181914 - RNA, 18 nt, Homo sapiens
gucucugcuccaccuuuc

SEQ ID NO: 2181915 - RNA, 19 nt, Homo sapiens
uccuuuccuccucugacuu

SEQ ID NO: 2181916 - RNA, 14 nt, Homo sapiens
ccaucuaccugcuu

SEQ ID NO: 2181917 - RNA, 15 nt, Homo sapiens
aggagaauaugauaa

SEQ ID NO: 2181918 - RNA, 23 nt, Homo sapiens
gaaagcuuacauuuuccugagac

SEQ ID NO: 2181919 - RNA, 12 nt, Homo sapiens
auuguggcugca

SEQ ID NO: 2181920 - RNA, 18 nt, Homo sapiens
ucaccgcugggugguuuu

SEQ ID NO: 2181921 - RNA, 12 nt, Homo sapiens
uaccaugcugaa

SEQ ID NO: 2181922 - RNA, 20 nt, Homo sapiens
ucauuauuuauguccaggug

SEQ ID NO: 2181923 - RNA, 19 nt, Homo sapiens
uggcuaucugcauuuauaa

SEQ ID NO: 2181924 - RNA, 15 nt, Homo sapiens
ugucaggguccagga

SEQ ID NO: 2181925 - RNA, 16 nt, Homo sapiens
cacugaaagacaguuu

SEQ ID NO: 2181926 - RNA, 18 nt, Homo sapiens
gauuuauaacgcacaacu

SEQ ID NO: 2181927 - RNA, 19 nt, Homo sapiens
gcauuuauuaccuugguau

SEQ ID NO: 2181928 - RNA, 15 nt, Homo sapiens
ugagcugagugcuga

SEQ ID NO: 2181929 - RNA, 19 nt, Homo sapiens
uaaauauuucucaacugag

SEQ ID NO: 2181930 - RNA, 15 nt, Homo sapiens
uuuguuuagucuuua

SEQ ID NO: 2181931 - RNA, 13 nt, Homo sapiens
uguuaaaacuacu

SEQ ID NO: 2181932 - RNA, 23 nt, Homo sapiens
gaauauauggucugugugucuga

SEQ ID NO: 2181933 - RNA, 19 nt, Homo sapiens
guucuggguguugaccacu

SEQ ID NO: 2181934 - RNA, 19 nt, Homo sapiens
acauagguaaaaacuggaa

SEQ ID NO: 2181935 - RNA, 16 nt, Homo sapiens
acagcuugcugcuaaa

SEQ ID NO: 2181936 - RNA, 16 nt, Homo sapiens
uucucaucccaaccuc

SEQ ID NO: 2181937 - RNA, 13 nt, Homo sapiens
uguuugagcucug

SEQ ID NO: 2181938 - RNA, 17 nt, Homo sapiens
ugcugaauguggacuca

SEQ ID NO: 2181939 - RNA, 15 nt, Homo sapiens
cgccuggccaaaaug

SEQ ID NO: 2181940 - RNA, 18 nt, Homo sapiens
ccaaaauaaaaccagcuc

SEQ ID NO: 2181941 - RNA, 16 nt, Homo sapiens
uuccuuugucauuauu

SEQ ID NO: 2181942 - RNA, 18 nt, Homo sapiens
ugccccaggacucuggca

SEQ ID NO: 2181943 - RNA, 14 nt, Homo sapiens
agucuguugauuaa

SEQ ID NO: 2181944 - RNA, 15 nt, Homo sapiens
ccuccccacccugac

SEQ ID NO: 2181945 - RNA, 18 nt, Homo sapiens
gcaccaagaccccaaagg

SEQ ID NO: 2181946 - RNA, 15 nt, Homo sapiens
ccuuggaaggugaca

SEQ ID NO: 2181947 - RNA, 15 nt, Homo sapiens
ggauggggacaaaga

SEQ ID NO: 2181948 - RNA, 20 nt, Homo sapiens
cccuuuggcccugaaccagg

SEQ ID NO: 2181949 - RNA, 18 nt, Homo sapiens
agucaagaucaacauucc

SEQ ID NO: 2181950 - RNA, 16 nt, Homo sapiens
aucuaucuacaaagaa

SEQ ID NO: 2181951 - RNA, 13 nt, Homo sapiens
cuggacuugaaug

SEQ ID NO: 2181952 - RNA, 16 nt, Homo sapiens
ugccuaggaggccuuc

SEQ ID NO: 2181953 - RNA, 19 nt, Homo sapiens
aaaugggcucgugacccaa

SEQ ID NO: 2181954 - RNA, 13 nt, Homo sapiens
guuagaccacuuu

SEQ ID NO: 2181955 - RNA, 13 nt, Homo sapiens
ugaguaauugagg

SEQ ID NO: 2181956 - RNA, 13 nt, Homo sapiens
cccauaaucccag

SEQ ID NO: 2181957 - RNA, 12 nt, Homo sapiens
gccacuuccuuu

SEQ ID NO: 2181958 - RNA, 19 nt, Homo sapiens
auauuagucgcacauguau

SEQ ID NO: 2181959 - RNA, 21 nt, Homo sapiens
aaugcugguuuuucaguuuuc

SEQ ID NO: 2181960 - RNA, 21 nt, Homo sapiens
cuaucggagcaguucaauaac

SEQ ID NO: 2181961 - RNA, 13 nt, Homo sapiens
aauacaugcacag

SEQ ID NO: 2181962 - RNA, 22 nt, Homo sapiens
cuguaauucaguguauuucagu

SEQ ID NO: 2181963 - RNA, 14 nt, Homo sapiens
aacaaucacuguuc

SEQ ID NO: 2181964 - RNA, 16 nt, Homo sapiens
gaaauuccaaagucuc

SEQ ID NO: 2181965 - RNA, 16 nt, Homo sapiens
acccugggauucagga

SEQ ID NO: 2181966 - RNA, 15 nt, Homo sapiens
cuugguaaaaacugc

SEQ ID NO: 2181967 - RNA, 15 nt, Homo sapiens
agccgguaacugucc

SEQ ID NO: 2181968 - RNA, 17 nt, Homo sapiens
caaauaaagcagucaug

SEQ ID NO: 2181969 - RNA, 17 nt, Homo sapiens
cuauuucuacacagugg

SEQ ID NO: 2181970 - RNA, 15 nt, Homo sapiens
gcaaaacgacacugc

SEQ ID NO: 2181971 - RNA, 17 nt, Homo sapiens
aguuuggaacucuaccc

SEQ ID NO: 2181972 - RNA, 22 nt, Homo sapiens
cagggagaaguagcuaguagca

SEQ ID NO: 2181973 - RNA, 16 nt, Homo sapiens
uuuuaagcuaucagca

SEQ ID NO: 2181974 - RNA, 22 nt, Homo sapiens
caaugugauuuauaacgcacaa

SEQ ID NO: 2181975 - RNA, 15 nt, Homo sapiens
gagaaugcuggcaaa

SEQ ID NO: 2181976 - RNA, 16 nt, Homo sapiens
ugccagugccucucac

SEQ ID NO: 2181977 - RNA, 14 nt, Homo sapiens
uccuuaucuuuauu

SEQ ID NO: 2181978 - RNA, 20 nt, Homo sapiens
aauuucuaccagaugugcuu

SEQ ID NO: 2181979 - RNA, 15 nt, Homo sapiens
uauuucuuggcaugc

SEQ ID NO: 2181980 - RNA, 16 nt, Homo sapiens
caggccugccuucuca

SEQ ID NO: 2181981 - RNA, 19 nt, Homo sapiens
cuccuggcccuucuauuua

SEQ ID NO: 2181982 - RNA, 18 nt, Homo sapiens
uacacuucuuaccccagc

SEQ ID NO: 2181983 - RNA, 14 nt, Homo sapiens
aguuucacugacuu

SEQ ID NO: 2181984 - RNA, 17 nt, Homo sapiens
uucauuugugugcucau

SEQ ID NO: 2181985 - RNA, 16 nt, Homo sapiens
acacuggagccaucuc

SEQ ID NO: 2181986 - RNA, 16 nt, Homo sapiens
cauuucccugugcuga

SEQ ID NO: 2181987 - RNA, 14 nt, Homo sapiens
guagcugggaccac

SEQ ID NO: 2181988 - RNA, 19 nt, Homo sapiens
ccaaggugggcagaucacu

SEQ ID NO: 2181989 - RNA, 14 nt, Homo sapiens
ccugggcagggcag

SEQ ID NO: 2181990 - RNA, 13 nt, Homo sapiens
acuggccaaaaau

SEQ ID NO: 2181991 - RNA, 21 nt, Homo sapiens
augucuguuaccuuguuaaua

SEQ ID NO: 2181992 - RNA, 20 nt, Homo sapiens
cuaaaguagggaaguuuuau

SEQ ID NO: 2181993 - RNA, 19 nt, Homo sapiens
aacaucucugcuuucacuc

SEQ ID NO: 2181994 - RNA, 14 nt, Homo sapiens
gggccuggaccugc

SEQ ID NO: 2181995 - RNA, 12 nt, Homo sapiens
cagccaaccugg

SEQ ID NO: 2181996 - RNA, 13 nt, Homo sapiens
ccuaaaggacucu

SEQ ID NO: 2181997 - RNA, 19 nt, Homo sapiens
auagugcuggaacacugcu

SEQ ID NO: 2181998 - RNA, 15 nt, Homo sapiens
cuuugcaccaaagac

SEQ ID NO: 2181999 - RNA, 16 nt, Homo sapiens
ggaaauggcuguggag

SEQ ID NO: 2182000 - RNA, 19 nt, Homo sapiens
acaaguguaacuaugcugu

SEQ ID NO: 2182001 - RNA, 14 nt, Homo sapiens
uuaaaaaugucuua

SEQ ID NO: 2182002 - RNA, 16 nt, Homo sapiens
uauuugauaacaguua

SEQ ID NO: 2182003 - RNA, 18 nt, Homo sapiens
cuacacagaucacagcuu

SEQ ID NO: 2182004 - RNA, 17 nt, Homo sapiens
ucaagaggcugagacag

SEQ ID NO: 2182005 - RNA, 17 nt, Homo sapiens
gaaacccccaguguaau

SEQ ID NO: 2182006 - RNA, 19 nt, Homo sapiens
ucgaugaauguaaacucgg

SEQ ID NO: 2182007 - RNA, 13 nt, Homo sapiens
aaagcuagcuuuc

SEQ ID NO: 2182008 - RNA, 21 nt, Homo sapiens
ccaggagauggaaguugcagu

SEQ ID NO: 2182009 - RNA, 16 nt, Homo sapiens
augugacgcacuguau

SEQ ID NO: 2182010 - RNA, 22 nt, Homo sapiens
auucaggggcugggggugcugg

SEQ ID NO: 2182011 - RNA, 21 nt, Homo sapiens
uuacccaccugucacccccuc

SEQ ID NO: 2182012 - RNA, 14 nt, Homo sapiens
cugggccuucucac

SEQ ID NO: 2182013 - RNA, 13 nt, Homo sapiens
uucuuaaccaaga

SEQ ID NO: 2182014 - RNA, 23 nt, Homo sapiens
uccagcagguguuuuccuucaca

SEQ ID NO: 2182015 - RNA, 13 nt, Homo sapiens
ucuccaguggauu

SEQ ID NO: 2182016 - RNA, 19 nt, Homo sapiens
aggcuacuguaaugcugcc

SEQ ID NO: 2182017 - RNA, 17 nt, Homo sapiens
cacacgccuggcuucca

SEQ ID NO: 2182018 - RNA, 17 nt, Homo sapiens
aacacaagccacgccug

SEQ ID NO: 2182019 - RNA, 16 nt, Homo sapiens
agaccagggaacggaa

SEQ ID NO: 2182020 - RNA, 18 nt, Homo sapiens
ucaacccaauaauucugu

SEQ ID NO: 2182021 - RNA, 13 nt, Homo sapiens
ugugcugaccaaa

SEQ ID NO: 2182022 - RNA, 14 nt, Homo sapiens
uuaguuuuugauca

SEQ ID NO: 2182023 - RNA, 22 nt, Homo sapiens
aaucuccucucucuuuccucca

SEQ ID NO: 2182024 - RNA, 21 nt, Homo sapiens
gaaaccagaaugauuuugaca

SEQ ID NO: 2182025 - RNA, 20 nt, Homo sapiens
aaggaauccuggauuuugcc

SEQ ID NO: 2182026 - RNA, 14 nt, Homo sapiens
ugcgaacagcaaac

SEQ ID NO: 2182027 - RNA, 21 nt, Homo sapiens
ucuucauuaagcccucuucca

SEQ ID NO: 2182028 - RNA, 17 nt, Homo sapiens
ucuuaauugucuguaga

SEQ ID NO: 2182029 - RNA, 19 nt, Homo sapiens
uccugcuagaacagucucu

SEQ ID NO: 2182030 - RNA, 16 nt, Homo sapiens
ucccaguuaccugcac

SEQ ID NO: 2182031 - RNA, 14 nt, Homo sapiens
aauaaugugaauga

SEQ ID NO: 2182032 - RNA, 16 nt, Homo sapiens
aauaagaguucuugcc

SEQ ID NO: 2182033 - RNA, 16 nt, Homo sapiens
uaggaucuucacuguc

SEQ ID NO: 2182034 - RNA, 22 nt, Homo sapiens
agcucugacccacagccuccaa

SEQ ID NO: 2182035 - RNA, 19 nt, Homo sapiens
acagcucagaaaaucaaag

SEQ ID NO: 2182036 - RNA, 18 nt, Homo sapiens
aucugguuaaugacauac

SEQ ID NO: 2182037 - RNA, 22 nt, Homo sapiens
aaaaucucagcaaugauuacuc

SEQ ID NO: 2182038 - RNA, 23 nt, Homo sapiens
guaaucugacuucucacuuccua

SEQ ID NO: 2182039 - RNA, 19 nt, Homo sapiens
ccuccuuggcuuuaugcaa

SEQ ID NO: 2182040 - RNA, 17 nt, Homo sapiens
ugaagcacaacucccuu

SEQ ID NO: 2182041 - RNA, 14 nt, Homo sapiens
ggccagcccagcca

SEQ ID NO: 2182042 - RNA, 14 nt, Homo sapiens
gaccagcccggcca

SEQ ID NO: 2182043 - RNA, 16 nt, Homo sapiens
uuugcggaaugcauug

SEQ ID NO: 2182044 - RNA, 17 nt, Homo sapiens
agugcccaggcacuccu

SEQ ID NO: 2182045 - RNA, 19 nt, Homo sapiens
ggcccaccaaggacagcua

SEQ ID NO: 2182046 - RNA, 21 nt, Homo sapiens
uaaugauacauguuuccaauu

SEQ ID NO: 2182047 - RNA, 19 nt, Homo sapiens
acucuugccaaccuguaau

SEQ ID NO: 2182048 - RNA, 23 nt, Homo sapiens
gaagcauugccuggacugaccac

SEQ ID NO: 2182049 - RNA, 14 nt, Homo sapiens
agguuacuuuggac

SEQ ID NO: 2182050 - RNA, 13 nt, Homo sapiens
agugcaucuugcu

SEQ ID NO: 2182051 - RNA, 13 nt, Homo sapiens
auccaacuauuaa

SEQ ID NO: 2182052 - RNA, 15 nt, Homo sapiens
cucccuggggaccag

SEQ ID NO: 2182053 - RNA, 21 nt, Homo sapiens
auuuaauuuuuuaacugcugc

SEQ ID NO: 2182054 - RNA, 12 nt, Homo sapiens
uguucuguguac

SEQ ID NO: 2182055 - RNA, 23 nt, Homo sapiens
ggauguggcuuaugagauacuuu

SEQ ID NO: 2182056 - RNA, 20 nt, Homo sapiens
acacagacccaaaccauacc

SEQ ID NO: 2182057 - RNA, 11 nt, Homo sapiens
caucuuccaag

SEQ ID NO: 2182058 - RNA, 14 nt, Homo sapiens
ugcuaaucuugucc

SEQ ID NO: 2182059 - RNA, 15 nt, Homo sapiens
caagugaaaccagcu

SEQ ID NO: 2182060 - RNA, 21 nt, Homo sapiens
ucuaaggccuaggauucuaaa

SEQ ID NO: 2182061 - RNA, 14 nt, Homo sapiens
guagaaacauuuag

SEQ ID NO: 2182062 - RNA, 16 nt, Homo sapiens
gcccagcagcggccca

SEQ ID NO: 2182063 - RNA, 22 nt, Homo sapiens
ugcguucccuucaguacugcag

SEQ ID NO: 2182064 - RNA, 21 nt, Homo sapiens
ucuccagcaguuaggcaccuu

SEQ ID NO: 2182065 - RNA, 14 nt, Homo sapiens
uaacauuuuccaaa

SEQ ID NO: 2182066 - RNA, 15 nt, Homo sapiens
cuuugacuuugccca

SEQ ID NO: 2182067 - RNA, 17 nt, Homo sapiens
cacaugaaaccuacaca

SEQ ID NO: 2182068 - RNA, 10 nt, Homo sapiens
cauacugcug

SEQ ID NO: 2182069 - RNA, 15 nt, Homo sapiens
cagguaugcaaauau

SEQ ID NO: 2182070 - RNA, 14 nt, Homo sapiens
uucauuuaucuaua

SEQ ID NO: 2182071 - RNA, 14 nt, Homo sapiens
cacccuuucuggca

SEQ ID NO: 2182072 - RNA, 23 nt, Homo sapiens
cuacagcagcacuguucuguccu

SEQ ID NO: 2182073 - RNA, 22 nt, Homo sapiens
agaagggugguaaauauuuuca

SEQ ID NO: 2182074 - RNA, 23 nt, Homo sapiens
caggaucugaguuauuuugcuaa

SEQ ID NO: 2182075 - RNA, 20 nt, Homo sapiens
uagcauagcuuauuauugaa

SEQ ID NO: 2182076 - RNA, 23 nt, Homo sapiens
caaacuguuuugacaaaugagca

SEQ ID NO: 2182077 - RNA, 20 nt, Homo sapiens
augcaagagcaccuggccaa

SEQ ID NO: 2182078 - RNA, 20 nt, Homo sapiens
ugccaaaauccaaggcaauu

SEQ ID NO: 2182079 - RNA, 17 nt, Homo sapiens
acuuuccaaugccacag

SEQ ID NO: 2182080 - RNA, 17 nt, Homo sapiens
uagaagaaagggcaaga

SEQ ID NO: 2182081 - RNA, 18 nt, Homo sapiens
ugucaguaguuuuacuga

SEQ ID NO: 2182082 - RNA, 13 nt, Homo sapiens
guuagacugccag

SEQ ID NO: 2182083 - RNA, 13 nt, Homo sapiens
cucgaacuccuga

SEQ ID NO: 2182084 - RNA, 14 nt, Homo sapiens
gcagaccacugaua

SEQ ID NO: 2182085 - RNA, 16 nt, Homo sapiens
cuuaaagaaguucccc

SEQ ID NO: 2182086 - RNA, 16 nt, Homo sapiens
caguucaguuccucuu

SEQ ID NO: 2182087 - RNA, 14 nt, Homo sapiens
ucuuuggacccuga

SEQ ID NO: 2182088 - RNA, 23 nt, Homo sapiens
cccgccaaggaaaggcauguaca

SEQ ID NO: 2182089 - RNA, 14 nt, Homo sapiens
aagaugacaaagaa

SEQ ID NO: 2182090 - RNA, 22 nt, Homo sapiens
ucaaguuggcuucuaaucaaag

SEQ ID NO: 2182091 - RNA, 18 nt, Homo sapiens
cauugaccucaucauuaa

SEQ ID NO: 2182092 - RNA, 13 nt, Homo sapiens
gaaaggggugcuu

SEQ ID NO: 2182093 - RNA, 21 nt, Homo sapiens
cauucauuugcauccaugggc

SEQ ID NO: 2182094 - RNA, 12 nt, Homo sapiens
cacuguccagca

SEQ ID NO: 2182095 - RNA, 18 nt, Homo sapiens
accuguaguguaccauuc

SEQ ID NO: 2182096 - RNA, 21 nt, Homo sapiens
aaaaacgugaggacucaggaa

SEQ ID NO: 2182097 - RNA, 17 nt, Homo sapiens
ugaucauugguuucuua

SEQ ID NO: 2182098 - RNA, 19 nt, Homo sapiens
cucaagguuuuagguucua

SEQ ID NO: 2182099 - RNA, 22 nt, Homo sapiens
uacagaaaccuaggguuuucua

SEQ ID NO: 2182100 - RNA, 21 nt, Homo sapiens
ugcaggcugcagucccuggaa

SEQ ID NO: 2182101 - RNA, 18 nt, Homo sapiens
ccugcuuccugcuugcca

SEQ ID NO: 2182102 - RNA, 23 nt, Homo sapiens
uauauagcucuacacaacaugua

SEQ ID NO: 2182103 - RNA, 13 nt, Homo sapiens
aaggauagccuca

SEQ ID NO: 2182104 - RNA, 19 nt, Homo sapiens
agguuccuuaucugucaca

SEQ ID NO: 2182105 - RNA, 22 nt, Homo sapiens
cauagcaauuccccuacaucaa

SEQ ID NO: 2182106 - RNA, 16 nt, Homo sapiens
ugagcaacucuugauu

SEQ ID NO: 2182107 - RNA, 23 nt, Homo sapiens
aagcaucauuuccccaacagggc

SEQ ID NO: 2182108 - RNA, 23 nt, Homo sapiens
auuucagaugauucaaauaucaa

SEQ ID NO: 2182109 - RNA, 17 nt, Homo sapiens
agaugcaauugcuccca

SEQ ID NO: 2182110 - RNA, 22 nt, Homo sapiens
aggccacaccggccuugcauug

SEQ ID NO: 2182111 - RNA, 18 nt, Homo sapiens
uggauagaaccaccauag

SEQ ID NO: 2182112 - RNA, 22 nt, Homo sapiens
uugcagagaagcauccuccaca

SEQ ID NO: 2182113 - RNA, 17 nt, Homo sapiens
auaguuugugaauccuu

SEQ ID NO: 2182114 - RNA, 19 nt, Homo sapiens
auuagaaacaacauagcaa

SEQ ID NO: 2182115 - RNA, 19 nt, Homo sapiens
aaugucagaaaccaguuau

SEQ ID NO: 2182116 - RNA, 16 nt, Homo sapiens
gugaaccaacacagac

SEQ ID NO: 2182117 - RNA, 16 nt, Homo sapiens
uauucccuuuugcugc

SEQ ID NO: 2182118 - RNA, 14 nt, Homo sapiens
uaacaaacucugag

SEQ ID NO: 2182119 - RNA, 20 nt, Homo sapiens
ccaauguuuaaaaaaguuua

SEQ ID NO: 2182120 - RNA, 15 nt, Homo sapiens
gcagcgcgcuccuga

SEQ ID NO: 2182121 - RNA, 12 nt, Homo sapiens
gaagcaccauca

SEQ ID NO: 2182122 - RNA, 14 nt, Homo sapiens
uccaagcauaccaa

SEQ ID NO: 2182123 - RNA, 18 nt, Homo sapiens
auguauguggccuugccu

SEQ ID NO: 2182124 - RNA, 19 nt, Homo sapiens
agaauaaacacugguugua

SEQ ID NO: 2182125 - RNA, 14 nt, Homo sapiens
caaagaaaaugccu

SEQ ID NO: 2182126 - RNA, 16 nt, Homo sapiens
acaucuuucacacuuc

SEQ ID NO: 2182127 - RNA, 17 nt, Homo sapiens
gccacccggcacuggcg

SEQ ID NO: 2182128 - RNA, 14 nt, Homo sapiens
acgugccuccagca

SEQ ID NO: 2182129 - RNA, 13 nt, Homo sapiens
aaaagauugcaaa

SEQ ID NO: 2182130 - RNA, 15 nt, Homo sapiens
cugcuguugaacuuu

SEQ ID NO: 2182131 - RNA, 14 nt, Homo sapiens
ggaccacaguaaca

SEQ ID NO: 2182132 - RNA, 15 nt, Homo sapiens
cucuucucauuucac

SEQ ID NO: 2182133 - RNA, 20 nt, Homo sapiens
cuuuccugggggaugugcac

SEQ ID NO: 2182134 - RNA, 12 nt, Homo sapiens
ucaggugacaug

SEQ ID NO: 2182135 - RNA, 19 nt, Homo sapiens
ucaugaguaccucaaagga

SEQ ID NO: 2182136 - RNA, 13 nt, Homo sapiens
ugagagacuccau

SEQ ID NO: 2182137 - RNA, 22 nt, Homo sapiens
uuuucuuguaaacauugccuga

SEQ ID NO: 2182138 - RNA, 20 nt, Homo sapiens
auucauuuaaaaugauuaga

SEQ ID NO: 2182139 - RNA, 23 nt, Homo sapiens
gaaccccgucgaggggcucucag

SEQ ID NO: 2182140 - RNA, 17 nt, Homo sapiens
uuuccccaccagugaau

SEQ ID NO: 2182141 - RNA, 13 nt, Homo sapiens
uugaaaaccuggc

SEQ ID NO: 2182142 - RNA, 13 nt, Homo sapiens
uaugcaaccauaa

SEQ ID NO: 2182143 - RNA, 23 nt, Homo sapiens
gaucauacguaccccaaaccuca

SEQ ID NO: 2182144 - RNA, 22 nt, Homo sapiens
guuugaaauucugaauuugcaa

SEQ ID NO: 2182145 - RNA, 17 nt, Homo sapiens
cccuuauaauuggugca

SEQ ID NO: 2182146 - RNA, 12 nt, Homo sapiens
uacauguaaaau

SEQ ID NO: 2182147 - RNA, 21 nt, Homo sapiens
aaugaagggacggcuguggga

SEQ ID NO: 2182148 - RNA, 13 nt, Homo sapiens
accuccucuccac

SEQ ID NO: 2182149 - RNA, 13 nt, Homo sapiens
ugcaucugauaaa

SEQ ID NO: 2182150 - RNA, 20 nt, Homo sapiens
gauaagacacccccucaaac

SEQ ID NO: 2182151 - RNA, 14 nt, Homo sapiens
uagaaucucuucau

SEQ ID NO: 2182152 - RNA, 15 nt, Homo sapiens
ucaacugguuguaua

SEQ ID NO: 2182153 - RNA, 15 nt, Homo sapiens
aauagaacacugccu

SEQ ID NO: 2182154 - RNA, 12 nt, Homo sapiens
uauuaaucucau

SEQ ID NO: 2182155 - RNA, 12 nt, Homo sapiens
acucucuacugg

SEQ ID NO: 2182156 - RNA, 16 nt, Homo sapiens
acacaaaucuauuuaa

SEQ ID NO: 2182157 - RNA, 22 nt, Homo sapiens
aucuuaugcuauuauucuguaa

SEQ ID NO: 2182158 - RNA, 14 nt, Homo sapiens
accagcaaagcaau

SEQ ID NO: 2182159 - RNA, 14 nt, Homo sapiens
ggaaguaagcaaac

SEQ ID NO: 2182160 - RNA, 15 nt, Homo sapiens
agagcuggaucucuc

SEQ ID NO: 2182161 - RNA, 17 nt, Homo sapiens
uuaccguucaccaguug

SEQ ID NO: 2182162 - RNA, 16 nt, Homo sapiens
cacacgccuccuguag

SEQ ID NO: 2182163 - RNA, 13 nt, Homo sapiens
ugauauaaacagc

SEQ ID NO: 2182164 - RNA, 14 nt, Homo sapiens
auaaaggauaaaga

SEQ ID NO: 2182165 - RNA, 15 nt, Homo sapiens
ggaacaugcguguga

SEQ ID NO: 2182166 - RNA, 16 nt, Homo sapiens
uuccuccaaacccaac

SEQ ID NO: 2182167 - RNA, 22 nt, Homo sapiens
gcuuuuuauuaggcucagugac

SEQ ID NO: 2182168 - RNA, 14 nt, Homo sapiens
caggcguguucaua

SEQ ID NO: 2182169 - RNA, 13 nt, Homo sapiens
aauaaagcauucu

SEQ ID NO: 2182170 - RNA, 18 nt, Homo sapiens
uguucaaacccagucuug

SEQ ID NO: 2182171 - RNA, 23 nt, Homo sapiens
uacaaacuuuguaauucuaauaa

SEQ ID NO: 2182172 - RNA, 16 nt, Homo sapiens
uaaauuaccuugccaa

SEQ ID NO: 2182173 - RNA, 15 nt, Homo sapiens
auaaauauacucaag

SEQ ID NO: 2182174 - RNA, 21 nt, Homo sapiens
uagagcaaccagucaaaacca

SEQ ID NO: 2182175 - RNA, 19 nt, Homo sapiens
aagcaccugccucagcaau

SEQ ID NO: 2182176 - RNA, 19 nt, Homo sapiens
auuuacuugaaauguaaaa

SEQ ID NO: 2182177 - RNA, 18 nt, Homo sapiens
uuugugauaacuacuccc

SEQ ID NO: 2182178 - RNA, 19 nt, Homo sapiens
caaaagacaaacaugcaag

SEQ ID NO: 2182179 - RNA, 19 nt, Homo sapiens
auuaaccacuucugcgaua

SEQ ID NO: 2182180 - RNA, 17 nt, Homo sapiens
ccuaugcuauugacaau

SEQ ID NO: 2182181 - RNA, 20 nt, Homo sapiens
agacacaauuucauuuccag

SEQ ID NO: 2182182 - RNA, 14 nt, Homo sapiens
auuugauauacaga

SEQ ID NO: 2182183 - RNA, 16 nt, Homo sapiens
uuaaagccuguuccau

SEQ ID NO: 2182184 - RNA, 12 nt, Homo sapiens
cacgucacuuga

SEQ ID NO: 2182185 - RNA, 14 nt, Homo sapiens
ccacagcaggugcu

SEQ ID NO: 2182186 - RNA, 10 nt, Homo sapiens
acucuucccu

SEQ ID NO: 2182187 - RNA, 16 nt, Homo sapiens
uuccuaaagcauggga

SEQ ID NO: 2182188 - RNA, 13 nt, Homo sapiens
uuccaaugcauug

SEQ ID NO: 2182189 - RNA, 23 nt, Homo sapiens
uuaauggguuuuguguacuguaa

SEQ ID NO: 2182190 - RNA, 14 nt, Homo sapiens
uucucugagaucau

SEQ ID NO: 2182191 - RNA, 20 nt, Homo sapiens
aucucaugagaagucacuca

SEQ ID NO: 2182192 - RNA, 16 nt, Homo sapiens
accccugaaaucugag

SEQ ID NO: 2182193 - RNA, 16 nt, Homo sapiens
cauugaauacucugaa

SEQ ID NO: 2182194 - RNA, 16 nt, Homo sapiens
auagcuuuucccuguc

SEQ ID NO: 2182195 - RNA, 22 nt, Homo sapiens
gacauuugggagacaugugaca

SEQ ID NO: 2182196 - RNA, 19 nt, Homo sapiens
uacugugaaacuggcacug

SEQ ID NO: 2182197 - RNA, 16 nt, Homo sapiens
aaguggggucuggccu

SEQ ID NO: 2182198 - RNA, 13 nt, Homo sapiens
gcugaguguacua

SEQ ID NO: 2182199 - RNA, 15 nt, Homo sapiens
cugauacguguauga

SEQ ID NO: 2182200 - RNA, 18 nt, Homo sapiens
cuaguaauaauguaauac

SEQ ID NO: 2182201 - RNA, 20 nt, Homo sapiens
uuaucaaugacaauggugcc

SEQ ID NO: 2182202 - RNA, 16 nt, Homo sapiens
acagucuggcucauga

SEQ ID NO: 2182203 - RNA, 21 nt, Homo sapiens
aagcugggagaaccaaaaaga

SEQ ID NO: 2182204 - RNA, 15 nt, Homo sapiens
caaauuauaugcuaa

SEQ ID NO: 2182205 - RNA, 23 nt, Homo sapiens
ugccagguaaagaaaccauggca

SEQ ID NO: 2182206 - RNA, 16 nt, Homo sapiens
gaucacacacaugcac

SEQ ID NO: 2182207 - RNA, 22 nt, Homo sapiens
agcucuccccucagagugcaag

SEQ ID NO: 2182208 - RNA, 18 nt, Homo sapiens
aguauacuuuuccccugu

SEQ ID NO: 2182209 - RNA, 15 nt, Homo sapiens
ucaugagcuugaaca

SEQ ID NO: 2182210 - RNA, 23 nt, Homo sapiens
acuucaguuuuauuuuugccaag

SEQ ID NO: 2182211 - RNA, 17 nt, Homo sapiens
ugaugggggccaggaca

SEQ ID NO: 2182212 - RNA, 16 nt, Homo sapiens
aucuugccacauuucu

SEQ ID NO: 2182213 - RNA, 13 nt, Homo sapiens
agaacuacugaua

SEQ ID NO: 2182214 - RNA, 22 nt, Homo sapiens
caccccaucccuggcugaccug

SEQ ID NO: 2182215 - RNA, 17 nt, Homo sapiens
cacaccccagacuccag

SEQ ID NO: 2182216 - RNA, 15 nt, Homo sapiens
agacaagcagcccuu

SEQ ID NO: 2182217 - RNA, 15 nt, Homo sapiens
ugaacaggaugcuga

SEQ ID NO: 2182218 - RNA, 14 nt, Homo sapiens
caccacugagcucu

SEQ ID NO: 2182219 - RNA, 19 nt, Homo sapiens
ccaucucucagcaguuauu

SEQ ID NO: 2182220 - RNA, 15 nt, Homo sapiens
gcacagucacuggcc

SEQ ID NO: 2182221 - RNA, 19 nt, Homo sapiens
uuacauuugaaaucuauga

SEQ ID NO: 2182222 - RNA, 21 nt, Homo sapiens
gcaaaguacuguaagaauaau

SEQ ID NO: 2182223 - RNA, 17 nt, Homo sapiens
gaaacaaaaaauauuca

SEQ ID NO: 2182224 - RNA, 17 nt, Homo sapiens
gugcuugcguugaugac

SEQ ID NO: 2182225 - RNA, 20 nt, Homo sapiens
ccuugcuuucaucacuaccu

SEQ ID NO: 2182226 - RNA, 18 nt, Homo sapiens
aguugauucauauugcau

SEQ ID NO: 2182227 - RNA, 20 nt, Homo sapiens
ucuccuguuuuuugaugcuu

SEQ ID NO: 2182228 - RNA, 17 nt, Homo sapiens
ucagacuccugugcaac

SEQ ID NO: 2182229 - RNA, 18 nt, Homo sapiens
cuagagcuagaugugucu

SEQ ID NO: 2182230 - RNA, 21 nt, Homo sapiens
aauauaggauagacacuggac

SEQ ID NO: 2182231 - RNA, 17 nt, Homo sapiens
gguggucaccaugccaa

SEQ ID NO: 2182232 - RNA, 21 nt, Homo sapiens
ugcugcauuuuucugucagaa

SEQ ID NO: 2182233 - RNA, 16 nt, Homo sapiens
uggaaaaaacucugaa

SEQ ID NO: 2182234 - RNA, 13 nt, Homo sapiens
uugacaacuggca

SEQ ID NO: 2182235 - RNA, 13 nt, Homo sapiens
aggaugacacugc

SEQ ID NO: 2182236 - RNA, 12 nt, Homo sapiens
uacuaacaaagc

SEQ ID NO: 2182237 - RNA, 12 nt, Homo sapiens
auguaacauucc

SEQ ID NO: 2182238 - RNA, 15 nt, Homo sapiens
agcuccuuaaggcuc

SEQ ID NO: 2182239 - RNA, 19 nt, Homo sapiens
uggacaggggcgugggauu

SEQ ID NO: 2182240 - RNA, 21 nt, Homo sapiens
uagcaaguugguaaauucaca

SEQ ID NO: 2182241 - RNA, 15 nt, Homo sapiens
uugaaauauuaguua

SEQ ID NO: 2182242 - RNA, 23 nt, Homo sapiens
uggaauaauccuaaacauaugaa

SEQ ID NO: 2182243 - RNA, 21 nt, Homo sapiens
uccgaacuguucaaguguccc

SEQ ID NO: 2182244 - RNA, 14 nt, Homo sapiens
ugggagagugcagu

SEQ ID NO: 2182245 - RNA, 13 nt, Homo sapiens
acuuuucaccaau

SEQ ID NO: 2182246 - RNA, 17 nt, Homo sapiens
agucccuuucagcugcu

SEQ ID NO: 2182247 - RNA, 13 nt, Homo sapiens
cugcaagaacugu

SEQ ID NO: 2182248 - RNA, 13 nt, Homo sapiens
cugucacccaggc

SEQ ID NO: 2182249 - RNA, 18 nt, Homo sapiens
gcaggacugaagauuuca

SEQ ID NO: 2182250 - RNA, 17 nt, Homo sapiens
cuggacuaaaacuacau

SEQ ID NO: 2182251 - RNA, 14 nt, Homo sapiens
gagccuagccaccu

SEQ ID NO: 2182252 - RNA, 12 nt, Homo sapiens
gcaaagacuuaa

SEQ ID NO: 2182253 - RNA, 22 nt, Homo sapiens
auacaaaggaagaacaucugga

SEQ ID NO: 2182254 - RNA, 20 nt, Homo sapiens
gugggagagagacguguaca

SEQ ID NO: 2182255 - RNA, 14 nt, Homo sapiens
aagucuacaacaua

SEQ ID NO: 2182256 - RNA, 15 nt, Homo sapiens
accucuugccucaga

SEQ ID NO: 2182257 - RNA, 17 nt, Homo sapiens
uggaggccugugccuug

SEQ ID NO: 2182258 - RNA, 19 nt, Homo sapiens
cacagauuuuugggcucca

SEQ ID NO: 2182259 - RNA, 21 nt, Homo sapiens
gugggguauagaaaaaggaau

SEQ ID NO: 2182260 - RNA, 20 nt, Homo sapiens
cuucuagcagagacccuggu

SEQ ID NO: 2182261 - RNA, 17 nt, Homo sapiens
ucugauuuugagcucaa

SEQ ID NO: 2182262 - RNA, 15 nt, Homo sapiens
uauccuagucuucac

SEQ ID NO: 2182263 - RNA, 18 nt, Homo sapiens
cucuuucuacaugacugg

SEQ ID NO: 2182264 - RNA, 13 nt, Homo sapiens
uuaguugcaugac

SEQ ID NO: 2182265 - RNA, 17 nt, Homo sapiens
auguucaucuucaaaaa

SEQ ID NO: 2182266 - RNA, 18 nt, Homo sapiens
uugacguggcacuuaccc

SEQ ID NO: 2182267 - RNA, 18 nt, Homo sapiens
gaaacacucaacaauaaa

SEQ ID NO: 2182268 - RNA, 17 nt, Homo sapiens
ugacagaggaggaugua

SEQ ID NO: 2182269 - RNA, 19 nt, Homo sapiens
aaagucauucaguuaucac

SEQ ID NO: 2182270 - RNA, 16 nt, Homo sapiens
agucugcaacuuuaag

SEQ ID NO: 2182271 - RNA, 15 nt, Homo sapiens
agacacugugcuaua

SEQ ID NO: 2182272 - RNA, 20 nt, Homo sapiens
ccaaaggaacacugacauca

SEQ ID NO: 2182273 - RNA, 17 nt, Homo sapiens
uauuggaggaccaaaaa

SEQ ID NO: 2182274 - RNA, 16 nt, Homo sapiens
auacuauugccucaua

SEQ ID NO: 2182275 - RNA, 16 nt, Homo sapiens
agugacuuccugguga

SEQ ID NO: 2182276 - RNA, 18 nt, Homo sapiens
gaguaggaguuugcuaag

SEQ ID NO: 2182277 - RNA, 13 nt, Homo sapiens
agaaccacagggc

SEQ ID NO: 2182278 - RNA, 13 nt, Homo sapiens
uaauccagcaaua

SEQ ID NO: 2182279 - RNA, 19 nt, Homo sapiens
cucaagucccccaagaccu

SEQ ID NO: 2182280 - RNA, 13 nt, Homo sapiens
ggacugaugucau

SEQ ID NO: 2182281 - RNA, 13 nt, Homo sapiens
ugcaugauuuacu

SEQ ID NO: 2182282 - RNA, 22 nt, Homo sapiens
gagagaugggagcuccucuccu

SEQ ID NO: 2182283 - RNA, 20 nt, Homo sapiens
uaugccacagaauuugcuaa

SEQ ID NO: 2182284 - RNA, 15 nt, Homo sapiens
ucuuggucacauaca

SEQ ID NO: 2182285 - RNA, 15 nt, Homo sapiens
uuuuccucaccaguc

SEQ ID NO: 2182286 - RNA, 17 nt, Homo sapiens
gcuucuguugaucucag

SEQ ID NO: 2182287 - RNA, 19 nt, Homo sapiens
caauaauauaauaauaguu

SEQ ID NO: 2182288 - RNA, 18 nt, Homo sapiens
gcaguuguggugugccau

SEQ ID NO: 2182289 - RNA, 16 nt, Homo sapiens
gagcuugcaagaagca

SEQ ID NO: 2182290 - RNA, 23 nt, Homo sapiens
gacugcacguggcuucugaugaa

SEQ ID NO: 2182291 - RNA, 19 nt, Homo sapiens
agauaacuuccuucacauc

SEQ ID NO: 2182292 - RNA, 18 nt, Homo sapiens
gagcugggagacaaagga

SEQ ID NO: 2182293 - RNA, 20 nt, Homo sapiens
ugcccacugaacaugcucau

SEQ ID NO: 2182294 - RNA, 18 nt, Homo sapiens
acuagggagccauuugag

SEQ ID NO: 2182295 - RNA, 20 nt, Homo sapiens
gagaguccugguccucaggg

SEQ ID NO: 2182296 - RNA, 15 nt, Homo sapiens
uccaaucuccaucac

SEQ ID NO: 2182297 - RNA, 23 nt, Homo sapiens
acccaaaacacgcacacccugcc

SEQ ID NO: 2182298 - RNA, 20 nt, Homo sapiens
aagagguuuuguugcuugua

SEQ ID NO: 2182299 - RNA, 22 nt, Homo sapiens
ucaacuggcgaagccugagcag

SEQ ID NO: 2182300 - RNA, 19 nt, Homo sapiens
aaacuacaaacacaagcaa

SEQ ID NO: 2182301 - RNA, 21 nt, Homo sapiens
aaaaguagacugauuacacug

SEQ ID NO: 2182302 - RNA, 16 nt, Homo sapiens
cuaaaguaucuguauu

SEQ ID NO: 2182303 - RNA, 10 nt, Homo sapiens
acaugcaguu

SEQ ID NO: 2182304 - RNA, 19 nt, Homo sapiens
ucucuuugagucaagucaa

SEQ ID NO: 2182305 - RNA, 17 nt, Homo sapiens
ucuccuuacagucacua

SEQ ID NO: 2182306 - RNA, 14 nt, Homo sapiens
ucugcucaucauuc

SEQ ID NO: 2182307 - RNA, 21 nt, Homo sapiens
cccuauugcugcuugaggcaa

SEQ ID NO: 2182308 - RNA, 22 nt, Homo sapiens
auggccugagaugcaggugaug

SEQ ID NO: 2182309 - RNA, 23 nt, Homo sapiens
accaccgcccuccucgcugugcc

SEQ ID NO: 2182310 - RNA, 23 nt, Homo sapiens
ucaaaaauuaucuauagcuaagu

SEQ ID NO: 2182311 - RNA, 15 nt, Homo sapiens
agacaacuagauuug

SEQ ID NO: 2182312 - RNA, 16 nt, Homo sapiens
uuuacuacuauucugu

SEQ ID NO: 2182313 - RNA, 19 nt, Homo sapiens
cauaccacccaaugcugau

SEQ ID NO: 2182314 - RNA, 14 nt, Homo sapiens
cuaguugagagcac

SEQ ID NO: 2182315 - RNA, 14 nt, Homo sapiens
caaugcugccaugc

SEQ ID NO: 2182316 - RNA, 11 nt, Homo sapiens
ugcuguuccac

SEQ ID NO: 2182317 - RNA, 19 nt, Homo sapiens
agcaaauauuuaugaccuc

SEQ ID NO: 2182318 - RNA, 14 nt, Homo sapiens
ucaggaacuauuaa

SEQ ID NO: 2182319 - RNA, 14 nt, Homo sapiens
ugcaaacgcugccu

SEQ ID NO: 2182320 - RNA, 20 nt, Homo sapiens
caaaggcauaagucauucca

SEQ ID NO: 2182321 - RNA, 20 nt, Homo sapiens
uaucuugaauguaguauuca

SEQ ID NO: 2182322 - RNA, 17 nt, Homo sapiens
uugccugggacggcuga

SEQ ID NO: 2182323 - RNA, 23 nt, Homo sapiens
guucucaauacccacugccagac

SEQ ID NO: 2182324 - RNA, 16 nt, Homo sapiens
gcuucaaggccugggg

SEQ ID NO: 2182325 - RNA, 16 nt, Homo sapiens
agcaggaaaguacaga

SEQ ID NO: 2182326 - RNA, 16 nt, Homo sapiens
uauguacuugauacug

SEQ ID NO: 2182327 - RNA, 20 nt, Homo sapiens
aagaauguugguuuacuuuc

SEQ ID NO: 2182328 - RNA, 16 nt, Homo sapiens
aggacagccagcagca

SEQ ID NO: 2182329 - RNA, 18 nt, Homo sapiens
ucccuggcgcugugcuag

SEQ ID NO: 2182330 - RNA, 15 nt, Homo sapiens
acacugaaauauaca

SEQ ID NO: 2182331 - RNA, 21 nt, Homo sapiens
uaaagguuaugaaacauauca

SEQ ID NO: 2182332 - RNA, 16 nt, Homo sapiens
agcucacgucacacuu

SEQ ID NO: 2182333 - RNA, 16 nt, Homo sapiens
cuaauuauaaugcaaa

SEQ ID NO: 2182334 - RNA, 16 nt, Homo sapiens
gauuucccugaagcua

SEQ ID NO: 2182335 - RNA, 15 nt, Homo sapiens
ugaauccaucuugcu

SEQ ID NO: 2182336 - RNA, 15 nt, Homo sapiens
agaauacaacuugau

SEQ ID NO: 2182337 - RNA, 15 nt, Homo sapiens
ucaugacagccagag

SEQ ID NO: 2182338 - RNA, 16 nt, Homo sapiens
cagacucccgcgugaa

SEQ ID NO: 2182339 - RNA, 14 nt, Homo sapiens
ugggcacaguggac

SEQ ID NO: 2182340 - RNA, 19 nt, Homo sapiens
gagucauuuaugagcagaa

SEQ ID NO: 2182341 - RNA, 22 nt, Homo sapiens
caaccagaggaggaggaggaca

SEQ ID NO: 2182342 - RNA, 15 nt, Homo sapiens
ugggcucacaggccu

SEQ ID NO: 2182343 - RNA, 14 nt, Homo sapiens
ccuggcugugauga

SEQ ID NO: 2182344 - RNA, 15 nt, Homo sapiens
auuuacagaaaucaa

SEQ ID NO: 2182345 - RNA, 17 nt, Homo sapiens
cgugcugggaccaacuc

SEQ ID NO: 2182346 - RNA, 23 nt, Homo sapiens
uagucacauggccuaugcacaua

SEQ ID NO: 2182347 - RNA, 19 nt, Homo sapiens
agaggaauaagaauggagc

SEQ ID NO: 2182348 - RNA, 13 nt, Homo sapiens
acacaacuaggaa

SEQ ID NO: 2182349 - RNA, 13 nt, Homo sapiens
acaauaaaagcuu

SEQ ID NO: 2182350 - RNA, 13 nt, Homo sapiens
ggaauaaagccuu

SEQ ID NO: 2182351 - RNA, 16 nt, Homo sapiens
gcugcccacaccaccg

SEQ ID NO: 2182352 - RNA, 13 nt, Homo sapiens
guccugcacauga

SEQ ID NO: 2182353 - RNA, 16 nt, Homo sapiens
cagguagacuuuugua

SEQ ID NO: 2182354 - RNA, 15 nt, Homo sapiens
agaacccugcuguuu

SEQ ID NO: 2182355 - RNA, 20 nt, Homo sapiens
auaaagcuaccauuuaucaa

SEQ ID NO: 2182356 - RNA, 16 nt, Homo sapiens
cuggagcaagugcuca

SEQ ID NO: 2182357 - RNA, 14 nt, Homo sapiens
ggacuauacugcug

SEQ ID NO: 2182358 - RNA, 19 nt, Homo sapiens
accagucugucuucuguag

SEQ ID NO: 2182359 - RNA, 15 nt, Homo sapiens
aaguuuucagcuuua

SEQ ID NO: 2182360 - RNA, 15 nt, Homo sapiens
uaaaauaacuaucag

SEQ ID NO: 2182361 - RNA, 16 nt, Homo sapiens
aauauuauacugcuau

SEQ ID NO: 2182362 - RNA, 12 nt, Homo sapiens
cccuuugcuaaa

SEQ ID NO: 2182363 - RNA, 19 nt, Homo sapiens
caaacagcaaaccaagaga

SEQ ID NO: 2182364 - RNA, 19 nt, Homo sapiens
ugaagaagcccuguucucg

SEQ ID NO: 2182365 - RNA, 15 nt, Homo sapiens
auugcuugagccugg

SEQ ID NO: 2182366 - RNA, 18 nt, Homo sapiens
cagcagugccuugugcaa

SEQ ID NO: 2182367 - RNA, 15 nt, Homo sapiens
agagagcaucuuucc

SEQ ID NO: 2182368 - RNA, 15 nt, Homo sapiens
ugauacaaacuguga

SEQ ID NO: 2182369 - RNA, 15 nt, Homo sapiens
cugucuuuuuccuca

SEQ ID NO: 2182370 - RNA, 23 nt, Homo sapiens
ugccaaaguuuugcugucucuua

SEQ ID NO: 2182371 - RNA, 16 nt, Homo sapiens
cuggacaaggucucuu

SEQ ID NO: 2182372 - RNA, 18 nt, Homo sapiens
uaguacaccauaaacugg

SEQ ID NO: 2182373 - RNA, 16 nt, Homo sapiens
cuacccauuguucccu

SEQ ID NO: 2182374 - RNA, 17 nt, Homo sapiens
ccagggauggcaguggc

SEQ ID NO: 2182375 - RNA, 14 nt, Homo sapiens
acacccucuuccca

SEQ ID NO: 2182376 - RNA, 14 nt, Homo sapiens
aaccugcugaaggg

SEQ ID NO: 2182377 - RNA, 23 nt, Homo sapiens
uucucccaggccaggcuccuucc

SEQ ID NO: 2182378 - RNA, 17 nt, Homo sapiens
acaugccaacacuuaau

SEQ ID NO: 2182379 - RNA, 19 nt, Homo sapiens
aagccagccaacucuuucu

SEQ ID NO: 2182380 - RNA, 18 nt, Homo sapiens
uggcccacauuuuccuua

SEQ ID NO: 2182381 - RNA, 13 nt, Homo sapiens
gcugucugaucuu

SEQ ID NO: 2182382 - RNA, 16 nt, Homo sapiens
uuaaccagaaauccag

SEQ ID NO: 2182383 - RNA, 23 nt, Homo sapiens
ucaugcugcuccccuaaagccag

SEQ ID NO: 2182384 - RNA, 15 nt, Homo sapiens
ccaggucagccacug

SEQ ID NO: 2182385 - RNA, 20 nt, Homo sapiens
cucucugaugucccagugcu

SEQ ID NO: 2182386 - RNA, 16 nt, Homo sapiens
acucuugccuuuccac

SEQ ID NO: 2182387 - RNA, 15 nt, Homo sapiens
auuguaguguucaaa

SEQ ID NO: 2182388 - RNA, 23 nt, Homo sapiens
cagcagcccuaaggaucucucag

SEQ ID NO: 2182389 - RNA, 21 nt, Homo sapiens
caugccaacacuuaaucauuu

SEQ ID NO: 2182390 - RNA, 17 nt, Homo sapiens
cucugguuagaaaaagg

SEQ ID NO: 2182391 - RNA, 15 nt, Homo sapiens
cagggacaagauaca

SEQ ID NO: 2182392 - RNA, 21 nt, Homo sapiens
gcugcaacuuuuuuaugucuc

SEQ ID NO: 2182393 - RNA, 16 nt, Homo sapiens
aucauaguuacugugu

SEQ ID NO: 2182394 - RNA, 19 nt, Homo sapiens
agcuacuugaaggacacaa

SEQ ID NO: 2182395 - RNA, 19 nt, Homo sapiens
gggaagugucaugcaagug

SEQ ID NO: 2182396 - RNA, 19 nt, Homo sapiens
cacacacagaugucuuaaa

SEQ ID NO: 2182397 - RNA, 23 nt, Homo sapiens
cuccucaggacccucccaggaga

SEQ ID NO: 2182398 - RNA, 21 nt, Homo sapiens
agaaaacacuacagugguuua

SEQ ID NO: 2182399 - RNA, 16 nt, Homo sapiens
acccuuuagugcuuug

SEQ ID NO: 2182400 - RNA, 13 nt, Homo sapiens
ccauggugcagug

SEQ ID NO: 2182401 - RNA, 12 nt, Homo sapiens
ucaauccagcua

SEQ ID NO: 2182402 - RNA, 12 nt, Homo sapiens
guauuccauuuu

SEQ ID NO: 2182403 - RNA, 12 nt, Homo sapiens
gcauuccaucuu

SEQ ID NO: 2182404 - RNA, 20 nt, Homo sapiens
aggcagcagugucuguaccu

SEQ ID NO: 2182405 - RNA, 13 nt, Homo sapiens
gaaauuuggcaaa

SEQ ID NO: 2182406 - RNA, 11 nt, Homo sapiens
cagcacccucc

SEQ ID NO: 2182407 - RNA, 15 nt, Homo sapiens
cagaugaaaugcauc

SEQ ID NO: 2182408 - RNA, 23 nt, Homo sapiens
acucggaauucccugaagcaaca

SEQ ID NO: 2182409 - RNA, 22 nt, Homo sapiens
cuugaggccaaaugaguucccu

SEQ ID NO: 2182410 - RNA, 18 nt, Homo sapiens
auuauaggccaaacuggc

SEQ ID NO: 2182411 - RNA, 15 nt, Homo sapiens
gcuauccaaauaacu

SEQ ID NO: 2182412 - RNA, 17 nt, Homo sapiens
uacuuuucuuuccucag

SEQ ID NO: 2182413 - RNA, 22 nt, Homo sapiens
cacagcuuguauuuugugaaga

SEQ ID NO: 2182414 - RNA, 18 nt, Homo sapiens
ugaaggagagagucuuuu

SEQ ID NO: 2182415 - RNA, 20 nt, Homo sapiens
ggccggcugugcucagagac

SEQ ID NO: 2182416 - RNA, 22 nt, Homo sapiens
auuuacacagugcuuuccagcc

SEQ ID NO: 2182417 - RNA, 13 nt, Homo sapiens
caguggcacucug

SEQ ID NO: 2182418 - RNA, 23 nt, Homo sapiens
agaagugucacagccauagucaa

SEQ ID NO: 2182419 - RNA, 14 nt, Homo sapiens
aaauaaacacugug

SEQ ID NO: 2182420 - RNA, 18 nt, Homo sapiens
cuacaugaucuggagcaa

SEQ ID NO: 2182421 - RNA, 21 nt, Homo sapiens
agggacaugcccuguguggcu

SEQ ID NO: 2182422 - RNA, 16 nt, Homo sapiens
agagcaggcaggggca

SEQ ID NO: 2182423 - RNA, 20 nt, Homo sapiens
uacuuaugaaaucucacaga

SEQ ID NO: 2182424 - RNA, 13 nt, Homo sapiens
guguuucuugccu

SEQ ID NO: 2182425 - RNA, 22 nt, Homo sapiens
ucuuagacuuugcaagcagaga

SEQ ID NO: 2182426 - RNA, 15 nt, Homo sapiens
uaugagaauguauua

SEQ ID NO: 2182427 - RNA, 15 nt, Homo sapiens
uaagagaaugaauua

SEQ ID NO: 2182428 - RNA, 15 nt, Homo sapiens
ucgaguuuacuucau

SEQ ID NO: 2182429 - RNA, 15 nt, Homo sapiens
ccagaacccauuuga

SEQ ID NO: 2182430 - RNA, 20 nt, Homo sapiens
agcagacccauaccuuucca

SEQ ID NO: 2182431 - RNA, 20 nt, Homo sapiens
gcugggccucccuuugccag

SEQ ID NO: 2182432 - RNA, 19 nt, Homo sapiens
augcauuuuuaauaugaca

SEQ ID NO: 2182433 - RNA, 19 nt, Homo sapiens
uguaguuggggcaccauac

SEQ ID NO: 2182434 - RNA, 19 nt, Homo sapiens
cgacgcagguguaccuccc

SEQ ID NO: 2182435 - RNA, 21 nt, Homo sapiens
guucacggcgauucuccccau

SEQ ID NO: 2182436 - RNA, 13 nt, Homo sapiens
uuuaaagcaaaca

SEQ ID NO: 2182437 - RNA, 14 nt, Homo sapiens
ggcuuggggaccag

SEQ ID NO: 2182438 - RNA, 20 nt, Homo sapiens
gagacuguaaguuacaugaa

SEQ ID NO: 2182439 - RNA, 20 nt, Homo sapiens
uuggggcuaauuuaacaaga

SEQ ID NO: 2182440 - RNA, 16 nt, Homo sapiens
gaaaagauuacugaaa

SEQ ID NO: 2182441 - RNA, 16 nt, Homo sapiens
cacggaagcaagcaga

SEQ ID NO: 2182442 - RNA, 13 nt, Homo sapiens
ccuuucacuuacc

SEQ ID NO: 2182443 - RNA, 14 nt, Homo sapiens
gcugcaucgcuguu

SEQ ID NO: 2182444 - RNA, 21 nt, Homo sapiens
auggucuuauauuuacaacac

SEQ ID NO: 2182445 - RNA, 17 nt, Homo sapiens
caucaagcgaugaaacu

SEQ ID NO: 2182446 - RNA, 22 nt, Homo sapiens
gggagaaccucguugacaugca

SEQ ID NO: 2182447 - RNA, 23 nt, Homo sapiens
gacuugaugaauaaacacuuuuu

SEQ ID NO: 2182448 - RNA, 14 nt, Homo sapiens
cccuagggccuuca

SEQ ID NO: 2182449 - RNA, 19 nt, Homo sapiens
ggaccuuccugccaccagu

SEQ ID NO: 2182450 - RNA, 20 nt, Homo sapiens
cuuuuaugagacccauuccu

SEQ ID NO: 2182451 - RNA, 23 nt, Homo sapiens
aauacauuaaaauaacuaagcaa

SEQ ID NO: 2182452 - RNA, 22 nt, Homo sapiens
aauggcccccaaaaucugucac

SEQ ID NO: 2182453 - RNA, 15 nt, Homo sapiens
cauuccauuuuguga

SEQ ID NO: 2182454 - RNA, 15 nt, Homo sapiens
ucaaugucaaugaac

SEQ ID NO: 2182455 - RNA, 14 nt, Homo sapiens
aagugaucuuucaa

SEQ ID NO: 2182456 - RNA, 16 nt, Homo sapiens
gacauaaacccuugcc

SEQ ID NO: 2182457 - RNA, 21 nt, Homo sapiens
ucauaccugugaauauagaua

SEQ ID NO: 2182458 - RNA, 13 nt, Homo sapiens
cuuccucuuugaa

SEQ ID NO: 2182459 - RNA, 21 nt, Homo sapiens
uuaaacaaaauuucacaguuc

SEQ ID NO: 2182460 - RNA, 15 nt, Homo sapiens
cgugguggcacacac

SEQ ID NO: 2182461 - RNA, 21 nt, Homo sapiens
uuacacagccuaaagcuaaaa

SEQ ID NO: 2182462 - RNA, 20 nt, Homo sapiens
uauuagugaaguaugcacua

SEQ ID NO: 2182463 - RNA, 15 nt, Homo sapiens
uuagccugcaaacaa

SEQ ID NO: 2182464 - RNA, 11 nt, Homo sapiens
ucaaccaaagu

SEQ ID NO: 2182465 - RNA, 16 nt, Homo sapiens
uagcuaaugaaauuga

SEQ ID NO: 2182466 - RNA, 20 nt, Homo sapiens
gggaggcagaguuugccuuc

SEQ ID NO: 2182467 - RNA, 16 nt, Homo sapiens
aaggccacauaccucu

SEQ ID NO: 2182468 - RNA, 16 nt, Homo sapiens
ggucugggcagcaccu

SEQ ID NO: 2182469 - RNA, 22 nt, Homo sapiens
ucaagcaauucuccugccucag

SEQ ID NO: 2182470 - RNA, 23 nt, Homo sapiens
uucuaccuagaaauacauggaca

SEQ ID NO: 2182471 - RNA, 17 nt, Homo sapiens
cuuccacuucaggguuc

SEQ ID NO: 2182472 - RNA, 12 nt, Homo sapiens
agggcacugagg

SEQ ID NO: 2182473 - RNA, 11 nt, Homo sapiens
auccacuuugc

SEQ ID NO: 2182474 - RNA, 17 nt, Homo sapiens
uaaacuguacaaaugaa

SEQ ID NO: 2182475 - RNA, 17 nt, Homo sapiens
uccucccagacuaccug

SEQ ID NO: 2182476 - RNA, 23 nt, Homo sapiens
acacacgccacccagccucuugu

SEQ ID NO: 2182477 - RNA, 23 nt, Homo sapiens
gcuaugcggaggaaagcaagugu

SEQ ID NO: 2182478 - RNA, 20 nt, Homo sapiens
cuaaaucuuaagaacuuuaa

SEQ ID NO: 2182479 - RNA, 15 nt, Homo sapiens
cacuugaugugccau

SEQ ID NO: 2182480 - RNA, 20 nt, Homo sapiens
ucuccaccagcccuacuccu

SEQ ID NO: 2182481 - RNA, 14 nt, Homo sapiens
agcuggcacugugg

SEQ ID NO: 2182482 - RNA, 14 nt, Homo sapiens
cugucccaagcucc

SEQ ID NO: 2182483 - RNA, 17 nt, Homo sapiens
ugggauggcucaaagga

SEQ ID NO: 2182484 - RNA, 22 nt, Homo sapiens
agcaugccaaggcucuguggga

SEQ ID NO: 2182485 - RNA, 20 nt, Homo sapiens
agcaugggacugugccuuug

SEQ ID NO: 2182486 - RNA, 13 nt, Homo sapiens
auucaucuaaugu

SEQ ID NO: 2182487 - RNA, 20 nt, Homo sapiens
uaaugccaaugaacaucuca

SEQ ID NO: 2182488 - RNA, 19 nt, Homo sapiens
uguggaaggcaagccaggc

SEQ ID NO: 2182489 - RNA, 18 nt, Homo sapiens
auaccauucuauucucca

SEQ ID NO: 2182490 - RNA, 14 nt, Homo sapiens
aaguuaacacucua

SEQ ID NO: 2182491 - RNA, 19 nt, Homo sapiens
uggcacucagggagcauuu

SEQ ID NO: 2182492 - RNA, 19 nt, Homo sapiens
gcaaaaagcaaaaucauuu

SEQ ID NO: 2182493 - RNA, 15 nt, Homo sapiens
cuuuuccuuucugcc

SEQ ID NO: 2182494 - RNA, 15 nt, Homo sapiens
acauucaccaaccaa

SEQ ID NO: 2182495 - RNA, 14 nt, Homo sapiens
aguaaauauuuacu

SEQ ID NO: 2182496 - RNA, 19 nt, Homo sapiens
accuucaugucacugcucu

SEQ ID NO: 2182497 - RNA, 22 nt, Homo sapiens
cagugaccugcccuacauaucu

SEQ ID NO: 2182498 - RNA, 20 nt, Homo sapiens
uuaaaggaacagagugagag

SEQ ID NO: 2182499 - RNA, 18 nt, Homo sapiens
ucaucaaggcacugccug

SEQ ID NO: 2182500 - RNA, 19 nt, Homo sapiens
uccccugaugcccagguca

SEQ ID NO: 2182501 - RNA, 19 nt, Homo sapiens
ugcaauugcacaaauacaa

SEQ ID NO: 2182502 - RNA, 21 nt, Homo sapiens
uggggcaauggggagaggcaa

SEQ ID NO: 2182503 - RNA, 16 nt, Homo sapiens
ucaaaguaauauauca

SEQ ID NO: 2182504 - RNA, 17 nt, Homo sapiens
guuaucuuagcuggaua

SEQ ID NO: 2182505 - RNA, 17 nt, Homo sapiens
aguagaauugauuuccc

SEQ ID NO: 2182506 - RNA, 19 nt, Homo sapiens
gcaaggucauagacaauuc

SEQ ID NO: 2182507 - RNA, 21 nt, Homo sapiens
aaggcugacauucacugagug

SEQ ID NO: 2182508 - RNA, 16 nt, Homo sapiens
aucuguaaaacuaaga

SEQ ID NO: 2182509 - RNA, 17 nt, Homo sapiens
auuuguaaaaugacaau

SEQ ID NO: 2182510 - RNA, 15 nt, Homo sapiens
augucaaaccacugg

SEQ ID NO: 2182511 - RNA, 15 nt, Homo sapiens
uugaccucugugacc

SEQ ID NO: 2182512 - RNA, 23 nt, Homo sapiens
gcaguauauaggugcuggaugua

SEQ ID NO: 2182513 - RNA, 18 nt, Homo sapiens
cuuccuuccucucugcaa

SEQ ID NO: 2182514 - RNA, 23 nt, Homo sapiens
aucuacugaauuggcuuccagau

SEQ ID NO: 2182515 - RNA, 12 nt, Homo sapiens
ucuuaauugcau

SEQ ID NO: 2182516 - RNA, 15 nt, Homo sapiens
aaccaaaaguuauua

SEQ ID NO: 2182517 - RNA, 16 nt, Homo sapiens
acacaguucaauucuc

SEQ ID NO: 2182518 - RNA, 15 nt, Homo sapiens
augccaacuggucac

SEQ ID NO: 2182519 - RNA, 15 nt, Homo sapiens
uggucaccaugccaa

SEQ ID NO: 2182520 - RNA, 14 nt, Homo sapiens
aaaaugaauaucua

SEQ ID NO: 2182521 - RNA, 14 nt, Homo sapiens
gcugaauuaagcag

SEQ ID NO: 2182522 - RNA, 15 nt, Homo sapiens
auugagauuuaauuc

SEQ ID NO: 2182523 - RNA, 14 nt, Homo sapiens
acauguugugccug

SEQ ID NO: 2182524 - RNA, 21 nt, Homo sapiens
caugcgugccgccugcuccuc

SEQ ID NO: 2182525 - RNA, 16 nt, Homo sapiens
acaauaguaauucuca

SEQ ID NO: 2182526 - RNA, 15 nt, Homo sapiens
acuuuccuucccucu

SEQ ID NO: 2182527 - RNA, 16 nt, Homo sapiens
cuucuuuauacaugcu

SEQ ID NO: 2182528 - RNA, 18 nt, Homo sapiens
uacacuaaauccccucac

SEQ ID NO: 2182529 - RNA, 18 nt, Homo sapiens
agcugcgggcacccaucc

SEQ ID NO: 2182530 - RNA, 20 nt, Homo sapiens
ucggcuuccuacagccagca

SEQ ID NO: 2182531 - RNA, 14 nt, Homo sapiens
uacuauugcaaaag

SEQ ID NO: 2182532 - RNA, 14 nt, Homo sapiens
uagaggagaggaaa

SEQ ID NO: 2182533 - RNA, 19 nt, Homo sapiens
uguguuuauucauccagca

SEQ ID NO: 2182534 - RNA, 13 nt, Homo sapiens
caaaacucaggca

SEQ ID NO: 2182535 - RNA, 23 nt, Homo sapiens
cugauuucucuucagcuuugaaa

SEQ ID NO: 2182536 - RNA, 20 nt, Homo sapiens
uacuguugguuaaaugacaa

SEQ ID NO: 2182537 - RNA, 21 nt, Homo sapiens
uauguacuauucaaucuuuac

SEQ ID NO: 2182538 - RNA, 21 nt, Homo sapiens
cuuacuggggccuggggcucu

SEQ ID NO: 2182539 - RNA, 19 nt, Homo sapiens
aacaugacuauauauacau

SEQ ID NO: 2182540 - RNA, 17 nt, Homo sapiens
cuccagccccugacccc

SEQ ID NO: 2182541 - RNA, 13 nt, Homo sapiens
cuaguuucauuca

SEQ ID NO: 2182542 - RNA, 17 nt, Homo sapiens
uauuuuuuuuuugccaa

SEQ ID NO: 2182543 - RNA, 23 nt, Homo sapiens
uccacgcggccaccucacccucu

SEQ ID NO: 2182544 - RNA, 20 nt, Homo sapiens
augucugaucuaaaugugga

SEQ ID NO: 2182545 - RNA, 17 nt, Homo sapiens
auccacuuugcucugaa

SEQ ID NO: 2182546 - RNA, 18 nt, Homo sapiens
guaaaugaccuaauugau

SEQ ID NO: 2182547 - RNA, 17 nt, Homo sapiens
cuuuggaacaagacagc

SEQ ID NO: 2182548 - RNA, 15 nt, Homo sapiens
cacaacacaguucuc

SEQ ID NO: 2182549 - RNA, 20 nt, Homo sapiens
uccaauugcucuuucacagg

SEQ ID NO: 2182550 - RNA, 19 nt, Homo sapiens
cccagcaucgcacucuggc

SEQ ID NO: 2182551 - RNA, 19 nt, Homo sapiens
uaaaauaacagauuucuca

SEQ ID NO: 2182552 - RNA, 18 nt, Homo sapiens
agccuggggauuccagcu

SEQ ID NO: 2182553 - RNA, 22 nt, Homo sapiens
gucacuuccuucagcaucucac

SEQ ID NO: 2182554 - RNA, 21 nt, Homo sapiens
caacauaaggagaauguaucu

SEQ ID NO: 2182555 - RNA, 18 nt, Homo sapiens
uuugucauauggaauuua

SEQ ID NO: 2182556 - RNA, 14 nt, Homo sapiens
gucugcaucauccu

SEQ ID NO: 2182557 - RNA, 17 nt, Homo sapiens
agauugacagcauauag

SEQ ID NO: 2182558 - RNA, 15 nt, Homo sapiens
cuguuccccagagaa

SEQ ID NO: 2182559 - RNA, 14 nt, Homo sapiens
aauugugugucuuc

SEQ ID NO: 2182560 - RNA, 16 nt, Homo sapiens
ugggcuugggcaauaa

SEQ ID NO: 2182561 - RNA, 14 nt, Homo sapiens
gguaauuguugcua

SEQ ID NO: 2182562 - RNA, 13 nt, Homo sapiens
cucauuagacugg

SEQ ID NO: 2182563 - RNA, 14 nt, Homo sapiens
uuguuucugauuaa

SEQ ID NO: 2182564 - RNA, 14 nt, Homo sapiens
uauuuucuguguaa

SEQ ID NO: 2182565 - RNA, 14 nt, Homo sapiens
aaaaauauagaugu

SEQ ID NO: 2182566 - RNA, 14 nt, Homo sapiens
uccucuugugauuu

SEQ ID NO: 2182567 - RNA, 20 nt, Homo sapiens
uucuuucuagcuaauggaaa

SEQ ID NO: 2182568 - RNA, 17 nt, Homo sapiens
agcuuggcacucaggug

SEQ ID NO: 2182569 - RNA, 18 nt, Homo sapiens
aaucacuuagacuccccu

SEQ ID NO: 2182570 - RNA, 22 nt, Homo sapiens
uccugcuacacaaaagccaaaa

SEQ ID NO: 2182571 - RNA, 17 nt, Homo sapiens
augccucgagccauaga

SEQ ID NO: 2182572 - RNA, 13 nt, Homo sapiens
uaacucacuggaa

SEQ ID NO: 2182573 - RNA, 19 nt, Homo sapiens
ccugaugacagaacacaga

SEQ ID NO: 2182574 - RNA, 21 nt, Homo sapiens
cauggaaauguauuuuaguua

SEQ ID NO: 2182575 - RNA, 17 nt, Homo sapiens
aaugacaggacauuuga

SEQ ID NO: 2182576 - RNA, 24 nt, Homo sapiens
cucaaaaaaaaaaaaaugcacaua

SEQ ID NO: 2182577 - RNA, 20 nt, Homo sapiens
acucucugaguacauugugc

SEQ ID NO: 2182578 - RNA, 15 nt, Homo sapiens
aguuuugaagcuuua

SEQ ID NO: 2182579 - RNA, 22 nt, Homo sapiens
caucaggauggaauucauaucc

SEQ ID NO: 2182580 - RNA, 18 nt, Homo sapiens
ugucuagagaacacugug

SEQ ID NO: 2182581 - RNA, 20 nt, Homo sapiens
auuuuggagaguuuccugaa

SEQ ID NO: 2182582 - RNA, 19 nt, Homo sapiens
aguuuaauauuccaauacc

SEQ ID NO: 2182583 - RNA, 19 nt, Homo sapiens
agaucgcaccacugcacuc

SEQ ID NO: 2182584 - RNA, 13 nt, Homo sapiens
uauaauacuguau

SEQ ID NO: 2182585 - RNA, 17 nt, Homo sapiens
agauagcuuagugucuc

SEQ ID NO: 2182586 - RNA, 17 nt, Homo sapiens
cugugugugugugugca

SEQ ID NO: 2182587 - RNA, 20 nt, Homo sapiens
ccguuccgugggaugccaua

SEQ ID NO: 2182588 - RNA, 16 nt, Homo sapiens
uguguuuuauuguggu

SEQ ID NO: 2182589 - RNA, 19 nt, Homo sapiens
uuguagaguggugcugcuu

SEQ ID NO: 2182590 - RNA, 12 nt, Homo sapiens
agcuuccuccag

SEQ ID NO: 2182591 - RNA, 19 nt, Homo sapiens
auuucuagaacaauuacau

SEQ ID NO: 2182592 - RNA, 14 nt, Homo sapiens
cagugagcacugaa

SEQ ID NO: 2182593 - RNA, 20 nt, Homo sapiens
gaucacaccacuacacucca

SEQ ID NO: 2182594 - RNA, 20 nt, Homo sapiens
gaucgcaccacugcacucca

SEQ ID NO: 2182595 - RNA, 13 nt, Homo sapiens
gcccuucugggac

SEQ ID NO: 2182596 - RNA, 19 nt, Homo sapiens
uuggugugugugacaauuc

SEQ ID NO: 2182597 - RNA, 21 nt, Homo sapiens
uauaguuaugcauacauacac

SEQ ID NO: 2182598 - RNA, 19 nt, Homo sapiens
auuuugauauaaucuuuca

SEQ ID NO: 2182599 - RNA, 21 nt, Homo sapiens
agcaccaauuguacauucccu

SEQ ID NO: 2182600 - RNA, 13 nt, Homo sapiens
cuucacuuuacaa

SEQ ID NO: 2182601 - RNA, 12 nt, Homo sapiens
aagcauuuacaa

SEQ ID NO: 2182602 - RNA, 20 nt, Homo sapiens
aucgcgccaguacauuccaa

SEQ ID NO: 2182603 - RNA, 17 nt, Homo sapiens
aaauggccaaagcacau

SEQ ID NO: 2182604 - RNA, 13 nt, Homo sapiens
ugcuuucuguucc

SEQ ID NO: 2182605 - RNA, 16 nt, Homo sapiens
cuuccuagauaugaua

SEQ ID NO: 2182606 - RNA, 15 nt, Homo sapiens
auccucacacuucag

SEQ ID NO: 2182607 - RNA, 18 nt, Homo sapiens
ucccuuugaaaugaauau

SEQ ID NO: 2182608 - RNA, 17 nt, Homo sapiens
uacucuuacauguauaa

SEQ ID NO: 2182609 - RNA, 13 nt, Homo sapiens
cccuugaagcaau

SEQ ID NO: 2182610 - RNA, 18 nt, Homo sapiens
auacuugccuucugauag

SEQ ID NO: 2182611 - RNA, 12 nt, Homo sapiens
auuauacagaua

SEQ ID NO: 2182612 - RNA, 20 nt, Homo sapiens
acucuuugcuaguaccaaaa

SEQ ID NO: 2182613 - RNA, 23 nt, Homo sapiens
aacaaccuuuccagcuacuuuug

SEQ ID NO: 2182614 - RNA, 14 nt, Homo sapiens
agaucaacaauacc

SEQ ID NO: 2182615 - RNA, 23 nt, Homo sapiens
ugcacuggaaccauugcuuuacu

SEQ ID NO: 2182616 - RNA, 15 nt, Homo sapiens
acagucucuggaaaa

SEQ ID NO: 2182617 - RNA, 17 nt, Homo sapiens
ugcagcagcuucccuug

SEQ ID NO: 2182618 - RNA, 17 nt, Homo sapiens
augacucguuaccugcc

SEQ ID NO: 2182619 - RNA, 15 nt, Homo sapiens
ccagauccagacugu

SEQ ID NO: 2182620 - RNA, 22 nt, Homo sapiens
aacuuccagguuccauccacca

SEQ ID NO: 2182621 - RNA, 22 nt, Homo sapiens
gcaggguauggugagaaaccaa

SEQ ID NO: 2182622 - RNA, 15 nt, Homo sapiens
gagccccuguuucuc

SEQ ID NO: 2182623 - RNA, 21 nt, Homo sapiens
gugaaguccacuuauguagac

SEQ ID NO: 2182624 - RNA, 16 nt, Homo sapiens
uccacaucaccagaaa

SEQ ID NO: 2182625 - RNA, 15 nt, Homo sapiens
gaaguauuacaugau

SEQ ID NO: 2182626 - RNA, 19 nt, Homo sapiens
gacguccucccugauccca

SEQ ID NO: 2182627 - RNA, 15 nt, Homo sapiens
gaaucagguugcaaa

SEQ ID NO: 2182628 - RNA, 15 nt, Homo sapiens
cagagccacucuuca

SEQ ID NO: 2182629 - RNA, 19 nt, Homo sapiens
aaaaugcaacucuaacucu

SEQ ID NO: 2182630 - RNA, 18 nt, Homo sapiens
cauuccuguucccaugag

SEQ ID NO: 2182631 - RNA, 21 nt, Homo sapiens
caauauuccuuauuaauacaa

SEQ ID NO: 2182632 - RNA, 14 nt, Homo sapiens
guguuuauugcaau

SEQ ID NO: 2182633 - RNA, 16 nt, Homo sapiens
ggggcauguggccaag

SEQ ID NO: 2182634 - RNA, 17 nt, Homo sapiens
cuagaugggcauggggu

SEQ ID NO: 2182635 - RNA, 17 nt, Homo sapiens
cccucagauuccaccua

SEQ ID NO: 2182636 - RNA, 20 nt, Homo sapiens
cacugcaccugcccagcucc

SEQ ID NO: 2182637 - RNA, 21 nt, Homo sapiens
agugaugcugugauaccuuag

SEQ ID NO: 2182638 - RNA, 18 nt, Homo sapiens
agcuucucugaugugaua

SEQ ID NO: 2182639 - RNA, 11 nt, Homo sapiens
cuuaguaccag

SEQ ID NO: 2182640 - RNA, 22 nt, Homo sapiens
cuuuugaccuguggugcaaaag

SEQ ID NO: 2182641 - RNA, 14 nt, Homo sapiens
ucuuucucucugug

SEQ ID NO: 2182642 - RNA, 13 nt, Homo sapiens
uaauucaauguga

SEQ ID NO: 2182643 - RNA, 15 nt, Homo sapiens
cuaauaagcaguaug

SEQ ID NO: 2182644 - RNA, 17 nt, Homo sapiens
ugaguuaauuuuaccaa

SEQ ID NO: 2182645 - RNA, 15 nt, Homo sapiens
auuacagacaaccua

SEQ ID NO: 2182646 - RNA, 21 nt, Homo sapiens
cuguuugccaagcugaagcua

SEQ ID NO: 2182647 - RNA, 17 nt, Homo sapiens
ugacaggccuuccuccu

SEQ ID NO: 2182648 - RNA, 23 nt, Homo sapiens
ucuaccgggaggacagcugccug

SEQ ID NO: 2182649 - RNA, 14 nt, Homo sapiens
cgucaagucuaaac

SEQ ID NO: 2182650 - RNA, 20 nt, Homo sapiens
cacaugugcugauguuuaca

SEQ ID NO: 2182651 - RNA, 11 nt, Homo sapiens
ugaaccaaauu

SEQ ID NO: 2182652 - RNA, 19 nt, Homo sapiens
acugcccgcacacccucac

SEQ ID NO: 2182653 - RNA, 13 nt, Homo sapiens
aucauacaaauac

SEQ ID NO: 2182654 - RNA, 22 nt, Homo sapiens
gugaagcccuguugugccacag

SEQ ID NO: 2182655 - RNA, 19 nt, Homo sapiens
cacauuuggaauugacgga

SEQ ID NO: 2182656 - RNA, 19 nt, Homo sapiens
uccugcauuucucuucuca

SEQ ID NO: 2182657 - RNA, 22 nt, Homo sapiens
gcacugcccaggucccuccuca

SEQ ID NO: 2182658 - RNA, 23 nt, Homo sapiens
agcccauaaagucugagaaauag

SEQ ID NO: 2182659 - RNA, 22 nt, Homo sapiens
cuuaauucuuaccucauuugca

SEQ ID NO: 2182660 - RNA, 13 nt, Homo sapiens
uauuuccacuugc

SEQ ID NO: 2182661 - RNA, 16 nt, Homo sapiens
uagaugugugccacua

SEQ ID NO: 2182662 - RNA, 13 nt, Homo sapiens
cucagcaaaagau

SEQ ID NO: 2182663 - RNA, 18 nt, Homo sapiens
cuacaaccaauuuacacu

SEQ ID NO: 2182664 - RNA, 22 nt, Homo sapiens
uuaaugaucagcuauauacuau

SEQ ID NO: 2182665 - RNA, 20 nt, Homo sapiens
uacaauuucacuuagucugu

SEQ ID NO: 2182666 - RNA, 16 nt, Homo sapiens
augaucaaacuuccau

SEQ ID NO: 2182667 - RNA, 22 nt, Homo sapiens
aggggcaggcccugcacugucc

SEQ ID NO: 2182668 - RNA, 19 nt, Homo sapiens
uccuccgucaccucagaga

SEQ ID NO: 2182669 - RNA, 12 nt, Homo sapiens
aaggcacacaga

SEQ ID NO: 2182670 - RNA, 19 nt, Homo sapiens
uauacuaaaccaacucuaa

SEQ ID NO: 2182671 - RNA, 15 nt, Homo sapiens
uuuaaagcacaugcc

SEQ ID NO: 2182672 - RNA, 19 nt, Homo sapiens
ccuggucugugcauugugg

SEQ ID NO: 2182673 - RNA, 23 nt, Homo sapiens
acagauccaaugggaguccaugg

SEQ ID NO: 2182674 - RNA, 17 nt, Homo sapiens
ccgcccuccacaccucu

SEQ ID NO: 2182675 - RNA, 13 nt, Homo sapiens
cagaaguuugcau

SEQ ID NO: 2182676 - RNA, 21 nt, Homo sapiens
guuuugucaucaauccaggau

SEQ ID NO: 2182677 - RNA, 13 nt, Homo sapiens
cauagaggcuucu

SEQ ID NO: 2182678 - RNA, 12 nt, Homo sapiens
uacuaaugaagu

SEQ ID NO: 2182679 - RNA, 12 nt, Homo sapiens
uucaaaugauga

SEQ ID NO: 2182680 - RNA, 12 nt, Homo sapiens
uagaaaugaaca

SEQ ID NO: 2182681 - RNA, 12 nt, Homo sapiens
aucuaauguugu

SEQ ID NO: 2182682 - RNA, 11 nt, Homo sapiens
ucccagugugu

SEQ ID NO: 2182683 - RNA, 17 nt, Homo sapiens
auuggcuuuucugaucc

SEQ ID NO: 2182684 - RNA, 23 nt, Homo sapiens
aucucagcagccagcuccuggua

SEQ ID NO: 2182685 - RNA, 16 nt, Homo sapiens
gaguauaaauuuacuu

SEQ ID NO: 2182686 - RNA, 16 nt, Homo sapiens
cuuuagcaaaacugga

SEQ ID NO: 2182687 - RNA, 16 nt, Homo sapiens
ucacuugaaccgggga

SEQ ID NO: 2182688 - RNA, 14 nt, Homo sapiens
ucagaacuuucuag

SEQ ID NO: 2182689 - RNA, 14 nt, Homo sapiens
aagaagauaugcaa

SEQ ID NO: 2182690 - RNA, 14 nt, Homo sapiens
uuccagauuacaaa

SEQ ID NO: 2182691 - RNA, 21 nt, Homo sapiens
aaugcuagcacaauauuccua

SEQ ID NO: 2182692 - RNA, 20 nt, Homo sapiens
ucaaagcacuguuucucuca

SEQ ID NO: 2182693 - RNA, 15 nt, Homo sapiens
uggcaguuuugacau

SEQ ID NO: 2182694 - RNA, 23 nt, Homo sapiens
auacucaaagaggccaguacuuu

SEQ ID NO: 2182695 - RNA, 17 nt, Homo sapiens
ugagucagugcucucag

SEQ ID NO: 2182696 - RNA, 13 nt, Homo sapiens
caaaacugcaaau

SEQ ID NO: 2182697 - RNA, 13 nt, Homo sapiens
cuccucugcucca

SEQ ID NO: 2182698 - RNA, 13 nt, Homo sapiens
augcucugaugca

SEQ ID NO: 2182699 - RNA, 16 nt, Homo sapiens
aagagaaccauaucaa

SEQ ID NO: 2182700 - RNA, 19 nt, Homo sapiens
uauaauugccacugagaga

SEQ ID NO: 2182701 - RNA, 19 nt, Homo sapiens
aggaggauuugucugagac

SEQ ID NO: 2182702 - RNA, 13 nt, Homo sapiens
augauuagugcaa

SEQ ID NO: 2182703 - RNA, 17 nt, Homo sapiens
cgguggcugccccggcc

SEQ ID NO: 2182704 - RNA, 14 nt, Homo sapiens
ucugacucuugccu

SEQ ID NO: 2182705 - RNA, 15 nt, Homo sapiens
cugggaccuccuuag

SEQ ID NO: 2182706 - RNA, 21 nt, Homo sapiens
cucauauuuaaagacagggaa

SEQ ID NO: 2182707 - RNA, 16 nt, Homo sapiens
cucauuuuacacaaag

SEQ ID NO: 2182708 - RNA, 13 nt, Homo sapiens
ucucagaugcagu

SEQ ID NO: 2182709 - RNA, 22 nt, Homo sapiens
acaauuuccuggguuccaccaa

SEQ ID NO: 2182710 - RNA, 19 nt, Homo sapiens
agccuuaaagauacuugaa

SEQ ID NO: 2182711 - RNA, 22 nt, Homo sapiens
cacuuauguuauacaauacaga

SEQ ID NO: 2182712 - RNA, 13 nt, Homo sapiens
gcccaugguacuc

SEQ ID NO: 2182713 - RNA, 13 nt, Homo sapiens
augauaaacauuc

SEQ ID NO: 2182714 - RNA, 16 nt, Homo sapiens
uauagccucaacaaca

SEQ ID NO: 2182715 - RNA, 15 nt, Homo sapiens
cauuucuggugugua

SEQ ID NO: 2182716 - RNA, 17 nt, Homo sapiens
caaagaaucuaucacua

SEQ ID NO: 2182717 - RNA, 19 nt, Homo sapiens
cacaugagggggugcccuc

SEQ ID NO: 2182718 - RNA, 20 nt, Homo sapiens
gaucauaccacggcacucca

SEQ ID NO: 2182719 - RNA, 19 nt, Homo sapiens
ugaauaccacuuaccucaa

SEQ ID NO: 2182720 - RNA, 20 nt, Homo sapiens
ugcagcucuucaacaugaca

SEQ ID NO: 2182721 - RNA, 14 nt, Homo sapiens
gaacaaugaaugcu

SEQ ID NO: 2182722 - RNA, 20 nt, Homo sapiens
ucugacucuuggcacagcau

SEQ ID NO: 2182723 - RNA, 14 nt, Homo sapiens
uuuaagaacuguau

SEQ ID NO: 2182724 - RNA, 17 nt, Homo sapiens
caucuaaaacucauaca

SEQ ID NO: 2182725 - RNA, 21 nt, Homo sapiens
gcucccggcgggugcucugag

SEQ ID NO: 2182726 - RNA, 19 nt, Homo sapiens
ucuuacuuuguuuacuuau

SEQ ID NO: 2182727 - RNA, 16 nt, Homo sapiens
ucugcuguagagccau

SEQ ID NO: 2182728 - RNA, 21 nt, Homo sapiens
acugcaguggacaguccccac

SEQ ID NO: 2182729 - RNA, 15 nt, Homo sapiens
ugauaaaagcacuua

SEQ ID NO: 2182730 - RNA, 22 nt, Homo sapiens
cacuuugcacugauauaucaug

SEQ ID NO: 2182731 - RNA, 20 nt, Homo sapiens
cuacagcuucuauucauuau

SEQ ID NO: 2182732 - RNA, 22 nt, Homo sapiens
gaugaaccugagcgggugccga

SEQ ID NO: 2182733 - RNA, 22 nt, Homo sapiens
ggacagggcuggagucaaaaca

SEQ ID NO: 2182734 - RNA, 14 nt, Homo sapiens
cugcguaugagucc

SEQ ID NO: 2182735 - RNA, 21 nt, Homo sapiens
ucuuucagaacacgacagaaa

SEQ ID NO: 2182736 - RNA, 17 nt, Homo sapiens
ugaccucaggugaucca

SEQ ID NO: 2182737 - RNA, 16 nt, Homo sapiens
auuuuuacacauguau

SEQ ID NO: 2182738 - RNA, 15 nt, Homo sapiens
aauguauacuugaaa

SEQ ID NO: 2182739 - RNA, 18 nt, Homo sapiens
ccuggaaggggcaaagaa

SEQ ID NO: 2182740 - RNA, 21 nt, Homo sapiens
augucuccccaguuccacagc

SEQ ID NO: 2182741 - RNA, 13 nt, Homo sapiens
agauaugugaaga

SEQ ID NO: 2182742 - RNA, 13 nt, Homo sapiens
ggcagaaagggaa

SEQ ID NO: 2182743 - RNA, 19 nt, Homo sapiens
ugauuccugcugccuguau

SEQ ID NO: 2182744 - RNA, 17 nt, Homo sapiens
cacacccaccucugcca

SEQ ID NO: 2182745 - RNA, 20 nt, Homo sapiens
cagaaaguagaauagugguu

SEQ ID NO: 2182746 - RNA, 23 nt, Homo sapiens
uaauuagaaauuuauaugucaga

SEQ ID NO: 2182747 - RNA, 17 nt, Homo sapiens
ucuacaccugucauuga

SEQ ID NO: 2182748 - RNA, 17 nt, Homo sapiens
uagauaaucuugugcaa

SEQ ID NO: 2182749 - RNA, 19 nt, Homo sapiens
agacaucuggacacugggc

SEQ ID NO: 2182750 - RNA, 17 nt, Homo sapiens
ugugcuuugccacugaa

SEQ ID NO: 2182751 - RNA, 23 nt, Homo sapiens
cuauuaaugauaaaaauaaugca

SEQ ID NO: 2182752 - RNA, 15 nt, Homo sapiens
caguuuuucugccuu

SEQ ID NO: 2182753 - RNA, 21 nt, Homo sapiens
agagacauccuucauuugaca

SEQ ID NO: 2182754 - RNA, 15 nt, Homo sapiens
cccagaucacaaaca

SEQ ID NO: 2182755 - RNA, 20 nt, Homo sapiens
gucaaacuuucaccucagau

SEQ ID NO: 2182756 - RNA, 19 nt, Homo sapiens
accucaaaggcucucacua

SEQ ID NO: 2182757 - RNA, 18 nt, Homo sapiens
aaggaaaaauagcagaga

SEQ ID NO: 2182758 - RNA, 12 nt, Homo sapiens
uugaaaugauua

SEQ ID NO: 2182759 - RNA, 16 nt, Homo sapiens
aggaagaaaugucaga

SEQ ID NO: 2182760 - RNA, 13 nt, Homo sapiens
uaagugcugcuau

SEQ ID NO: 2182761 - RNA, 13 nt, Homo sapiens
guucaaucauuga

SEQ ID NO: 2182762 - RNA, 19 nt, Homo sapiens
cugugugugucuagguaga

SEQ ID NO: 2182763 - RNA, 22 nt, Homo sapiens
aucaaaucucuuccacaugggu

SEQ ID NO: 2182764 - RNA, 23 nt, Homo sapiens
aaagcaaaauaaaaacuauucga

SEQ ID NO: 2182765 - RNA, 13 nt, Homo sapiens
cauccuccagcuu

SEQ ID NO: 2182766 - RNA, 15 nt, Homo sapiens
ugagaugaugauuag

SEQ ID NO: 2182767 - RNA, 16 nt, Homo sapiens
aaagaaaaaaaaagca

SEQ ID NO: 2182768 - RNA, 18 nt, Homo sapiens
aaucugcccauucaucuu

SEQ ID NO: 2182769 - RNA, 15 nt, Homo sapiens
cuguaucuccagcca

SEQ ID NO: 2182770 - RNA, 21 nt, Homo sapiens
uuauguaugaaaaguaacuga

SEQ ID NO: 2182771 - RNA, 13 nt, Homo sapiens
ucaaaacuuggaa

SEQ ID NO: 2182772 - RNA, 13 nt, Homo sapiens
agggcacugugau

SEQ ID NO: 2182773 - RNA, 21 nt, Homo sapiens
augcuccaaauauaagacauu

SEQ ID NO: 2182774 - RNA, 15 nt, Homo sapiens
acucaucugccaagc

SEQ ID NO: 2182775 - RNA, 17 nt, Homo sapiens
caaaauuagugcuuuuu

SEQ ID NO: 2182776 - RNA, 24 nt, Homo sapiens
guccuuuuucuucccuuaggcaau

SEQ ID NO: 2182777 - RNA, 17 nt, Homo sapiens
uuuaaaugucugcaugc

SEQ ID NO: 2182778 - RNA, 14 nt, Homo sapiens
caggccaccaggau

SEQ ID NO: 2182779 - RNA, 22 nt, Homo sapiens
caucacucaaccauaacacuug

SEQ ID NO: 2182780 - RNA, 15 nt, Homo sapiens
aaauuguauuaucaa

SEQ ID NO: 2182781 - RNA, 15 nt, Homo sapiens
uauucaaaauuuugu

SEQ ID NO: 2182782 - RNA, 21 nt, Homo sapiens
ggauuacaggugugugccacc

SEQ ID NO: 2182783 - RNA, 13 nt, Homo sapiens
ucccuuuguugcu

SEQ ID NO: 2182784 - RNA, 15 nt, Homo sapiens
cuguuuucucucggc

SEQ ID NO: 2182785 - RNA, 16 nt, Homo sapiens
uauuuuauagcuacua

SEQ ID NO: 2182786 - RNA, 23 nt, Homo sapiens
ggucugagucuauguucaaagac

SEQ ID NO: 2182787 - RNA, 20 nt, Homo sapiens
cugggccccagaaagccuca

SEQ ID NO: 2182788 - RNA, 15 nt, Homo sapiens
cuacacagucacaca

SEQ ID NO: 2182789 - RNA, 17 nt, Homo sapiens
aaagaagacaucugugg

SEQ ID NO: 2182790 - RNA, 23 nt, Homo sapiens
cuccaaggagcaugucacuccag

SEQ ID NO: 2182791 - RNA, 18 nt, Homo sapiens
cagaaggacauauuuccu

SEQ ID NO: 2182792 - RNA, 14 nt, Homo sapiens
aacuguguauuuau

SEQ ID NO: 2182793 - RNA, 16 nt, Homo sapiens
auucagguauaaggca

SEQ ID NO: 2182794 - RNA, 15 nt, Homo sapiens
cuguucugcacugaa

SEQ ID NO: 2182795 - RNA, 16 nt, Homo sapiens
auucugagccauucac

SEQ ID NO: 2182796 - RNA, 13 nt, Homo sapiens
cugcuucauguaa

SEQ ID NO: 2182797 - RNA, 21 nt, Homo sapiens
ccaccaucaaccccccaaguc

SEQ ID NO: 2182798 - RNA, 17 nt, Homo sapiens
ugauacuuuaguacaau

SEQ ID NO: 2182799 - RNA, 17 nt, Homo sapiens
ugguucauuaauucuau

SEQ ID NO: 2182800 - RNA, 13 nt, Homo sapiens
gaagagaccacag

SEQ ID NO: 2182801 - RNA, 23 nt, Homo sapiens
auuucuaggccugauauccaaca

SEQ ID NO: 2182802 - RNA, 15 nt, Homo sapiens
acuaugauuuaccua

SEQ ID NO: 2182803 - RNA, 21 nt, Homo sapiens
ugucuaauaaaauauaaucua

SEQ ID NO: 2182804 - RNA, 17 nt, Homo sapiens
acugauggaaaauacca

SEQ ID NO: 2182805 - RNA, 23 nt, Homo sapiens
ucacagacggauacuggggagua

SEQ ID NO: 2182806 - RNA, 14 nt, Homo sapiens
agaugugcaacacu

SEQ ID NO: 2182807 - RNA, 17 nt, Homo sapiens
agagggggucugugaau

SEQ ID NO: 2182808 - RNA, 16 nt, Homo sapiens
uauaggccaucuguaa

SEQ ID NO: 2182809 - RNA, 22 nt, Homo sapiens
cccuccacaaagcaaaggcagu

SEQ ID NO: 2182810 - RNA, 14 nt, Homo sapiens
aaaggaagucagua

SEQ ID NO: 2182811 - RNA, 16 nt, Homo sapiens
aucaugcugucuuuac

SEQ ID NO: 2182812 - RNA, 20 nt, Homo sapiens
agccugcagacucacugugg

SEQ ID NO: 2182813 - RNA, 15 nt, Homo sapiens
cagcuauuugaauga

SEQ ID NO: 2182814 - RNA, 15 nt, Homo sapiens
agcccuacucugugu

SEQ ID NO: 2182815 - RNA, 16 nt, Homo sapiens
agagugcuuuaccaau

SEQ ID NO: 2182816 - RNA, 17 nt, Homo sapiens
uaauucacucaagcacu

SEQ ID NO: 2182817 - RNA, 22 nt, Homo sapiens
agccuauaccccuuacuuagca

SEQ ID NO: 2182818 - RNA, 20 nt, Homo sapiens
ccugaagggugacaucccag

SEQ ID NO: 2182819 - RNA, 21 nt, Homo sapiens
gaagugcuacagaaagcacaa

SEQ ID NO: 2182820 - RNA, 17 nt, Homo sapiens
cucaaaaaaagggcaau

SEQ ID NO: 2182821 - RNA, 12 nt, Homo sapiens
agucucaucucc

SEQ ID NO: 2182822 - RNA, 23 nt, Homo sapiens
aaagugacucacuuaucccaaga

SEQ ID NO: 2182823 - RNA, 14 nt, Homo sapiens
aauuaucaagcuuu

SEQ ID NO: 2182824 - RNA, 15 nt, Homo sapiens
ugcaccuggauguac

SEQ ID NO: 2182825 - RNA, 23 nt, Homo sapiens
caccacuaacaugcccuguucag

SEQ ID NO: 2182826 - RNA, 21 nt, Homo sapiens
uguagcccuggauggccucug

SEQ ID NO: 2182827 - RNA, 12 nt, Homo sapiens
ggacucaaugca

SEQ ID NO: 2182828 - RNA, 20 nt, Homo sapiens
ccguccacguccuccaagcu

SEQ ID NO: 2182829 - RNA, 16 nt, Homo sapiens
cggaaagcccugugcu

SEQ ID NO: 2182830 - RNA, 17 nt, Homo sapiens
uaugaugagcauacaca

SEQ ID NO: 2182831 - RNA, 14 nt, Homo sapiens
acccaggaguggau

SEQ ID NO: 2182832 - RNA, 23 nt, Homo sapiens
caaaacagcccucagacugucag

SEQ ID NO: 2182833 - RNA, 17 nt, Homo sapiens
cuacauacguguuccua

SEQ ID NO: 2182834 - RNA, 16 nt, Homo sapiens
agacaagcugcauuuc

SEQ ID NO: 2182835 - RNA, 23 nt, Homo sapiens
caucuugaauccuuccauuccac

SEQ ID NO: 2182836 - RNA, 19 nt, Homo sapiens
aggaccaauguugugauua

SEQ ID NO: 2182837 - RNA, 13 nt, Homo sapiens
gaauguacauuac

SEQ ID NO: 2182838 - RNA, 19 nt, Homo sapiens
augcacacaaacaccuccu

SEQ ID NO: 2182839 - RNA, 16 nt, Homo sapiens
ugacauauucaaguga

SEQ ID NO: 2182840 - RNA, 13 nt, Homo sapiens
cuaagcaagccag

SEQ ID NO: 2182841 - RNA, 14 nt, Homo sapiens
uguccauccauaua

SEQ ID NO: 2182842 - RNA, 21 nt, Homo sapiens
aacauuuguguguuauaccuu

SEQ ID NO: 2182843 - RNA, 14 nt, Homo sapiens
aauacugcucugaa

SEQ ID NO: 2182844 - RNA, 23 nt, Homo sapiens
uaagaucacaccacuacacucca

SEQ ID NO: 2182845 - RNA, 19 nt, Homo sapiens
ucuguuucuucagcacauu

SEQ ID NO: 2182846 - RNA, 14 nt, Homo sapiens
ccugcuuaccugac

SEQ ID NO: 2182847 - RNA, 22 nt, Homo sapiens
uucaacucagaaugcacuugau

SEQ ID NO: 2182848 - RNA, 22 nt, Homo sapiens
aguuauucuugacaugagaaaa

SEQ ID NO: 2182849 - RNA, 22 nt, Homo sapiens
accucuccaugaucccaccucc

SEQ ID NO: 2182850 - RNA, 16 nt, Homo sapiens
cagaggacagcuuccc

SEQ ID NO: 2182851 - RNA, 14 nt, Homo sapiens
ccaccugugcugcu

SEQ ID NO: 2182852 - RNA, 17 nt, Homo sapiens
ucacuugaauccauuga

SEQ ID NO: 2182853 - RNA, 22 nt, Homo sapiens
acucuuucauaaaaacacucaa

SEQ ID NO: 2182854 - RNA, 12 nt, Homo sapiens
ucuauuacauuu

SEQ ID NO: 2182855 - RNA, 14 nt, Homo sapiens
accccugcuccuga

SEQ ID NO: 2182856 - RNA, 13 nt, Homo sapiens
auuugugugcauc

SEQ ID NO: 2182857 - RNA, 15 nt, Homo sapiens
uuucauacuauuuag

SEQ ID NO: 2182858 - RNA, 12 nt, Homo sapiens
agcguacuugaa

SEQ ID NO: 2182859 - RNA, 17 nt, Homo sapiens
cuuccuucuagggagca

SEQ ID NO: 2182860 - RNA, 19 nt, Homo sapiens
ucccacgcuucucuuugga

SEQ ID NO: 2182861 - RNA, 17 nt, Homo sapiens
gaguuuuggcagccaga

SEQ ID NO: 2182862 - RNA, 23 nt, Homo sapiens
agauaucuucaguuuaaugcaag

SEQ ID NO: 2182863 - RNA, 16 nt, Homo sapiens
auuacuugugcacuua

SEQ ID NO: 2182864 - RNA, 18 nt, Homo sapiens
gugacugcuuuuuugccu

SEQ ID NO: 2182865 - RNA, 21 nt, Homo sapiens
aacagggauuuugaauaugcc

SEQ ID NO: 2182866 - RNA, 13 nt, Homo sapiens
ugcugaccucugg

SEQ ID NO: 2182867 - RNA, 21 nt, Homo sapiens
gggaauauuugaaucuugucu

SEQ ID NO: 2182868 - RNA, 15 nt, Homo sapiens
uucccuuaguauuaa

SEQ ID NO: 2182869 - RNA, 14 nt, Homo sapiens
uuucacauugcaaa

SEQ ID NO: 2182870 - RNA, 16 nt, Homo sapiens
caagccaaaugugcag

SEQ ID NO: 2182871 - RNA, 19 nt, Homo sapiens
augguaauaaaacaaguua

SEQ ID NO: 2182872 - RNA, 14 nt, Homo sapiens
cagggcccagugac

SEQ ID NO: 2182873 - RNA, 18 nt, Homo sapiens
cuuuggaagauggcauaa

SEQ ID NO: 2182874 - RNA, 16 nt, Homo sapiens
caaugauucauaacaa

SEQ ID NO: 2182875 - RNA, 16 nt, Homo sapiens
acguuucauuucucau

SEQ ID NO: 2182876 - RNA, 20 nt, Homo sapiens
uaucugcacucuaaacugca

SEQ ID NO: 2182877 - RNA, 14 nt, Homo sapiens
ggauuaauuugcau

SEQ ID NO: 2182878 - RNA, 17 nt, Homo sapiens
cagggacugugaacauu

SEQ ID NO: 2182879 - RNA, 20 nt, Homo sapiens
uaugcuguauccacaaauca

SEQ ID NO: 2182880 - RNA, 21 nt, Homo sapiens
agcaaaaacauguaugugcau

SEQ ID NO: 2182881 - RNA, 21 nt, Homo sapiens
aauucuauuacgugcaauacu

SEQ ID NO: 2182882 - RNA, 17 nt, Homo sapiens
ucauagcaauacuugga

SEQ ID NO: 2182883 - RNA, 16 nt, Homo sapiens
gacuggacgugcucag

SEQ ID NO: 2182884 - RNA, 20 nt, Homo sapiens
uuuguccuuggggacaucuc

SEQ ID NO: 2182885 - RNA, 19 nt, Homo sapiens
ccuaggaacgucugguccu

SEQ ID NO: 2182886 - RNA, 14 nt, Homo sapiens
ugaauuggcuaugc

SEQ ID NO: 2182887 - RNA, 23 nt, Homo sapiens
gucagaaacaaugacauccagaa

SEQ ID NO: 2182888 - RNA, 14 nt, Homo sapiens
uacaguucauaaau

SEQ ID NO: 2182889 - RNA, 20 nt, Homo sapiens
guaaacugaggcccaaagca

SEQ ID NO: 2182890 - RNA, 11 nt, Homo sapiens
augcuuuacaa

SEQ ID NO: 2182891 - RNA, 23 nt, Homo sapiens
acaaaaauauuagcaaacugaau

SEQ ID NO: 2182892 - RNA, 13 nt, Homo sapiens
augguuuuaucaa

SEQ ID NO: 2182893 - RNA, 14 nt, Homo sapiens
ugccaaaccacaag

SEQ ID NO: 2182894 - RNA, 19 nt, Homo sapiens
cauuuaauauuucugugga

SEQ ID NO: 2182895 - RNA, 18 nt, Homo sapiens
uauuuuuggaagcauaca

SEQ ID NO: 2182896 - RNA, 12 nt, Homo sapiens
gagcaucuggcu

SEQ ID NO: 2182897 - RNA, 21 nt, Homo sapiens
uugggaacggacugguaugua

SEQ ID NO: 2182898 - RNA, 22 nt, Homo sapiens
acccuucccugcacuaaagcca

SEQ ID NO: 2182899 - RNA, 17 nt, Homo sapiens
aggcucuuacagccaca

SEQ ID NO: 2182900 - RNA, 11 nt, Homo sapiens
aaguacuuuac

SEQ ID NO: 2182901 - RNA, 15 nt, Homo sapiens
cucaugcuguuucac

SEQ ID NO: 2182902 - RNA, 15 nt, Homo sapiens
cacuugaugauacaa

SEQ ID NO: 2182903 - RNA, 17 nt, Homo sapiens
gauagcuguguguguua

SEQ ID NO: 2182904 - RNA, 10 nt, Homo sapiens
cuccaaaggc

SEQ ID NO: 2182905 - RNA, 23 nt, Homo sapiens
cgaaagaggcacccuuccaucug

SEQ ID NO: 2182906 - RNA, 18 nt, Homo sapiens
aaucauccucaugccuuu

SEQ ID NO: 2182907 - RNA, 17 nt, Homo sapiens
gcuggauaaaaugaggu

SEQ ID NO: 2182908 - RNA, 18 nt, Homo sapiens
ucagugcacuguauauag

SEQ ID NO: 2182909 - RNA, 18 nt, Homo sapiens
caggaaacuccugugacc

SEQ ID NO: 2182910 - RNA, 20 nt, Homo sapiens
uguguccacaguugagaggu

SEQ ID NO: 2182911 - RNA, 18 nt, Homo sapiens
cggugucuggaaaagcac

SEQ ID NO: 2182912 - RNA, 17 nt, Homo sapiens
auuugguaccauggugu

SEQ ID NO: 2182913 - RNA, 21 nt, Homo sapiens
caacuucuuucuguugagaga

SEQ ID NO: 2182914 - RNA, 19 nt, Homo sapiens
uggacagauggaccaaaag

SEQ ID NO: 2182915 - RNA, 16 nt, Homo sapiens
guauauaaaguuacac

SEQ ID NO: 2182916 - RNA, 16 nt, Homo sapiens
cagacuucgcuauucc

SEQ ID NO: 2182917 - RNA, 20 nt, Homo sapiens
ucacagcaagucacuggcca

SEQ ID NO: 2182918 - RNA, 22 nt, Homo sapiens
gacaucagggaguaagugacac

SEQ ID NO: 2182919 - RNA, 21 nt, Homo sapiens
acaauccaucaaagugaugau

SEQ ID NO: 2182920 - RNA, 19 nt, Homo sapiens
augaucagcaucugugaug

SEQ ID NO: 2182921 - RNA, 14 nt, Homo sapiens
ucaagcauugcuaa

SEQ ID NO: 2182922 - RNA, 21 nt, Homo sapiens
auaaaagugcuuugcauugaa

SEQ ID NO: 2182923 - RNA, 10 nt, Homo sapiens
aaauccaaag

SEQ ID NO: 2182924 - RNA, 12 nt, Homo sapiens
caccaccaggag

SEQ ID NO: 2182925 - RNA, 18 nt, Homo sapiens
gcacaucaaaauaugccc

SEQ ID NO: 2182926 - RNA, 22 nt, Homo sapiens
acagagggcaggaacuugcaca

SEQ ID NO: 2182927 - RNA, 23 nt, Homo sapiens
cgugggcagcaaaacgacacugc

SEQ ID NO: 2182928 - RNA, 16 nt, Homo sapiens
agaacucacagaaaua

SEQ ID NO: 2182929 - RNA, 21 nt, Homo sapiens
gcaacagauaaguuugcaguu

SEQ ID NO: 2182930 - RNA, 22 nt, Homo sapiens
uguggacuuauucauuccucac

SEQ ID NO: 2182931 - RNA, 14 nt, Homo sapiens
auccuuuacauuca

SEQ ID NO: 2182932 - RNA, 15 nt, Homo sapiens
cuuucccagucccau

SEQ ID NO: 2182933 - RNA, 15 nt, Homo sapiens
acuuauauuuugauu

SEQ ID NO: 2182934 - RNA, 19 nt, Homo sapiens
uuaucagaauaucaaggaa

SEQ ID NO: 2182935 - RNA, 21 nt, Homo sapiens
uccuaagcuucaaaucagaag

SEQ ID NO: 2182936 - RNA, 18 nt, Homo sapiens
gcaaaauacaugacauuu

SEQ ID NO: 2182937 - RNA, 14 nt, Homo sapiens
uggaugcauguucu

SEQ ID NO: 2182938 - RNA, 19 nt, Homo sapiens
ccccaacuauuaaagugcc

SEQ ID NO: 2182939 - RNA, 20 nt, Homo sapiens
aaucugucuccccagaagac

SEQ ID NO: 2182940 - RNA, 20 nt, Homo sapiens
uucuuuuuaaaauggugcuu

SEQ ID NO: 2182941 - RNA, 11 nt, Homo sapiens
gcuuugcuccu

SEQ ID NO: 2182942 - RNA, 18 nt, Homo sapiens
caccuguacucuuccgaa

SEQ ID NO: 2182943 - RNA, 20 nt, Homo sapiens
ggaaauaucauaauguaaug

SEQ ID NO: 2182944 - RNA, 17 nt, Homo sapiens
uuucaacagaauucacu

SEQ ID NO: 2182945 - RNA, 16 nt, Homo sapiens
uggcaugucauuugca

SEQ ID NO: 2182946 - RNA, 22 nt, Homo sapiens
gucuaccugcuggacagccucc

SEQ ID NO: 2182947 - RNA, 16 nt, Homo sapiens
acuauacaagaauuaa

SEQ ID NO: 2182948 - RNA, 20 nt, Homo sapiens
aauacaauggucauuuccag

SEQ ID NO: 2182949 - RNA, 18 nt, Homo sapiens
acuuaacuauuaaggccu

SEQ ID NO: 2182950 - RNA, 19 nt, Homo sapiens
accccuccucccucagacu

SEQ ID NO: 2182951 - RNA, 19 nt, Homo sapiens
uaaaggaaggagauacuca

SEQ ID NO: 2182952 - RNA, 16 nt, Homo sapiens
gaaauauuuucuagga

SEQ ID NO: 2182953 - RNA, 16 nt, Homo sapiens
uaaucccagcuauuca

SEQ ID NO: 2182954 - RNA, 15 nt, Homo sapiens
ucacccauuccgggu

SEQ ID NO: 2182955 - RNA, 21 nt, Homo sapiens
cucauagugaacacagcagac

SEQ ID NO: 2182956 - RNA, 21 nt, Homo sapiens
uguuaauaugguguacauucu

SEQ ID NO: 2182957 - RNA, 15 nt, Homo sapiens
guagcaacaugagaa

SEQ ID NO: 2182958 - RNA, 16 nt, Homo sapiens
uaaauuguguauuuaa

SEQ ID NO: 2182959 - RNA, 14 nt, Homo sapiens
auggggccaucucc

SEQ ID NO: 2182960 - RNA, 16 nt, Homo sapiens
cuccuagacugacccu

SEQ ID NO: 2182961 - RNA, 21 nt, Homo sapiens
ucaacuuucuguuggauucca

SEQ ID NO: 2182962 - RNA, 14 nt, Homo sapiens
ucaaauuuaagaau

SEQ ID NO: 2182963 - RNA, 21 nt, Homo sapiens
guguaacuugugcuuuugcaa

SEQ ID NO: 2182964 - RNA, 13 nt, Homo sapiens
uauaaaacagugu

SEQ ID NO: 2182965 - RNA, 17 nt, Homo sapiens
aauggcgcagugccucu

SEQ ID NO: 2182966 - RNA, 16 nt, Homo sapiens
aauugcuucugugcaa

SEQ ID NO: 2182967 - RNA, 22 nt, Homo sapiens
uugccuggauugggagccauuu

SEQ ID NO: 2182968 - RNA, 13 nt, Homo sapiens
aggcaugcacauc

SEQ ID NO: 2182969 - RNA, 17 nt, Homo sapiens
cucauuuuuauauucau

SEQ ID NO: 2182970 - RNA, 14 nt, Homo sapiens
agacucugucucag

SEQ ID NO: 2182971 - RNA, 14 nt, Homo sapiens
ucuguacuuccaau

SEQ ID NO: 2182972 - RNA, 15 nt, Homo sapiens
uaugaggaccuuuau

SEQ ID NO: 2182973 - RNA, 17 nt, Homo sapiens
ucaugucaggccaucaa

SEQ ID NO: 2182974 - RNA, 15 nt, Homo sapiens
cugaaggacugugac

SEQ ID NO: 2182975 - RNA, 15 nt, Homo sapiens
uaauaaguaaucuaa

SEQ ID NO: 2182976 - RNA, 17 nt, Homo sapiens
accccagucgugaugug

SEQ ID NO: 2182977 - RNA, 14 nt, Homo sapiens
ucacgccacugcac

SEQ ID NO: 2182978 - RNA, 21 nt, Homo sapiens
ugguuuugcucacaaaagucu

SEQ ID NO: 2182979 - RNA, 14 nt, Homo sapiens
auaucugaaccaag

SEQ ID NO: 2182980 - RNA, 18 nt, Homo sapiens
ugaguaagcccucaggag

SEQ ID NO: 2182981 - RNA, 14 nt, Homo sapiens
acagccacuuggga

SEQ ID NO: 2182982 - RNA, 22 nt, Homo sapiens
agacacugaaaaaucuaaguga

SEQ ID NO: 2182983 - RNA, 20 nt, Homo sapiens
ggaaugaccagccuguccaa

SEQ ID NO: 2182984 - RNA, 18 nt, Homo sapiens
caauugugaaaaugaaua

SEQ ID NO: 2182985 - RNA, 13 nt, Homo sapiens
ucuuacucugaaa

SEQ ID NO: 2182986 - RNA, 23 nt, Homo sapiens
ccuucuugguuuccaaaggcauu

SEQ ID NO: 2182987 - RNA, 23 nt, Homo sapiens
ugagaagggcucagagaggacaa

SEQ ID NO: 2182988 - RNA, 21 nt, Homo sapiens
uggaagaaagcccugugcuuu

SEQ ID NO: 2182989 - RNA, 12 nt, Homo sapiens
aaaccaugugac

SEQ ID NO: 2182990 - RNA, 13 nt, Homo sapiens
guugcccuaauaa

SEQ ID NO: 2182991 - RNA, 19 nt, Homo sapiens
gagcaaaaucgaugcagug

SEQ ID NO: 2182992 - RNA, 13 nt, Homo sapiens
cacucuguuccug

SEQ ID NO: 2182993 - RNA, 19 nt, Homo sapiens
uccuaaggaauuaccaaga

SEQ ID NO: 2182994 - RNA, 17 nt, Homo sapiens
cuuaaaccugugcuuuc

SEQ ID NO: 2182995 - RNA, 16 nt, Homo sapiens
auaacuggauugcaga

SEQ ID NO: 2182996 - RNA, 20 nt, Homo sapiens
caguuguguaaauaaaauca

SEQ ID NO: 2182997 - RNA, 21 nt, Homo sapiens
uguagucccagcuacuuggga

SEQ ID NO: 2182998 - RNA, 23 nt, Homo sapiens
uugcuaaauauaaaaacauaaau

SEQ ID NO: 2182999 - RNA, 24 nt, Homo sapiens
uucccacucccucucuugccgaca

SEQ ID NO: 2183000 - RNA, 13 nt, Homo sapiens
gauucaauuuaaa

SEQ ID NO: 2183001 - RNA, 19 nt, Homo sapiens
uuggacugagggcugggua

SEQ ID NO: 2183002 - RNA, 18 nt, Homo sapiens
ugagauucccucaccugu

SEQ ID NO: 2183003 - RNA, 23 nt, Homo sapiens
auuuauuugcaaauauacuuuac

SEQ ID NO: 2183004 - RNA, 24 nt, Homo sapiens
acugaaucuggaccccaucuguga

SEQ ID NO: 2183005 - RNA, 20 nt, Homo sapiens
cacagacuggcaauaaacuc

SEQ ID NO: 2183006 - RNA, 18 nt, Homo sapiens
ugcauugucuaaugacag

SEQ ID NO: 2183007 - RNA, 15 nt, Homo sapiens
ggcugggaguggcau

SEQ ID NO: 2183008 - RNA, 15 nt, Homo sapiens
cacuguauuccuguc

SEQ ID NO: 2183009 - RNA, 15 nt, Homo sapiens
ccugcccaccaagaa

SEQ ID NO: 2183010 - RNA, 21 nt, Homo sapiens
aauuuaugggagaauugcaca

SEQ ID NO: 2183011 - RNA, 18 nt, Homo sapiens
uaaaggagcaucuaucag

SEQ ID NO: 2183012 - RNA, 17 nt, Homo sapiens
auaauuaucagucauga

SEQ ID NO: 2183013 - RNA, 21 nt, Homo sapiens
gcuaaggggaucggacaugaa

SEQ ID NO: 2183014 - RNA, 14 nt, Homo sapiens
cuggcccaaccaga

SEQ ID NO: 2183015 - RNA, 17 nt, Homo sapiens
agccucaucauuuccca

SEQ ID NO: 2183016 - RNA, 21 nt, Homo sapiens
cagcuugaaaccuucacuuag

SEQ ID NO: 2183017 - RNA, 19 nt, Homo sapiens
agcaaaauuguggcauuuu

SEQ ID NO: 2183018 - RNA, 15 nt, Homo sapiens
cuucauuuugagggg

SEQ ID NO: 2183019 - RNA, 12 nt, Homo sapiens
uaauuuccauga

SEQ ID NO: 2183020 - RNA, 13 nt, Homo sapiens
auucuacuggaaa

SEQ ID NO: 2183021 - RNA, 20 nt, Homo sapiens
ucacuauccaugcaccaaac

SEQ ID NO: 2183022 - RNA, 20 nt, Homo sapiens
ugcaggagcuaguucucagc

SEQ ID NO: 2183023 - RNA, 24 nt, Homo sapiens
aagcaucucagccuaccaugagaa

SEQ ID NO: 2183024 - RNA, 16 nt, Homo sapiens
ugugauauccuaggag

SEQ ID NO: 2183025 - RNA, 15 nt, Homo sapiens
uccuugcacacaccc

SEQ ID NO: 2183026 - RNA, 20 nt, Homo sapiens
uugucucuugccugccacug

SEQ ID NO: 2183027 - RNA, 18 nt, Homo sapiens
cagaguuuguauugugau

SEQ ID NO: 2183028 - RNA, 23 nt, Homo sapiens
uaauuuagagauaagccaugcau

SEQ ID NO: 2183029 - RNA, 22 nt, Homo sapiens
uguggaaaaaguaagaggacua

SEQ ID NO: 2183030 - RNA, 21 nt, Homo sapiens
uagauuauugaauucuucaca

SEQ ID NO: 2183031 - RNA, 18 nt, Homo sapiens
agucugagguccugagca

SEQ ID NO: 2183032 - RNA, 19 nt, Homo sapiens
gaaugcuguccuagugguc

SEQ ID NO: 2183033 - RNA, 12 nt, Homo sapiens
ugugccauagaa

SEQ ID NO: 2183034 - RNA, 20 nt, Homo sapiens
uccauacccccacaugccaa

SEQ ID NO: 2183035 - RNA, 18 nt, Homo sapiens
uagcugggacuagaggca

SEQ ID NO: 2183036 - RNA, 15 nt, Homo sapiens
auuacuuacaaacug

SEQ ID NO: 2183037 - RNA, 20 nt, Homo sapiens
cuaaaaugaaguaacacaau

SEQ ID NO: 2183038 - RNA, 18 nt, Homo sapiens
aaaggaagaacuggauaa

SEQ ID NO: 2183039 - RNA, 18 nt, Homo sapiens
ccagugcagaaaugaaau

SEQ ID NO: 2183040 - RNA, 21 nt, Homo sapiens
ugggaaugacucugacuuuga

SEQ ID NO: 2183041 - RNA, 18 nt, Homo sapiens
cuggcucccccacaccuc

SEQ ID NO: 2183042 - RNA, 13 nt, Homo sapiens
augcaugagcacc

SEQ ID NO: 2183043 - RNA, 22 nt, Homo sapiens
uagcuggagagagaguucucac

SEQ ID NO: 2183044 - RNA, 21 nt, Homo sapiens
ugguggcucacaccuguaauc

SEQ ID NO: 2183045 - RNA, 19 nt, Homo sapiens
aggagccaccaguucucau

SEQ ID NO: 2183046 - RNA, 19 nt, Homo sapiens
cuagacucuucacuguuag

SEQ ID NO: 2183047 - RNA, 19 nt, Homo sapiens
uuagacaagucuaguggaa

SEQ ID NO: 2183048 - RNA, 15 nt, Homo sapiens
uagggaaguaacauu

SEQ ID NO: 2183049 - RNA, 16 nt, Homo sapiens
cugccagcugcacuga

SEQ ID NO: 2183050 - RNA, 13 nt, Homo sapiens
guuggcuuucccu

SEQ ID NO: 2183051 - RNA, 14 nt, Homo sapiens
uuaguggagccagg

SEQ ID NO: 2183052 - RNA, 13 nt, Homo sapiens
augaugugcuuaa

SEQ ID NO: 2183053 - RNA, 19 nt, Homo sapiens
ugcacgaccgccccaguuc

SEQ ID NO: 2183054 - RNA, 15 nt, Homo sapiens
aaacauuugccaagu

SEQ ID NO: 2183055 - RNA, 14 nt, Homo sapiens
uaauugaagcuuuu

SEQ ID NO: 2183056 - RNA, 16 nt, Homo sapiens
aaaguuggugucaaug

SEQ ID NO: 2183057 - RNA, 17 nt, Homo sapiens
gaauacugcauuuacag

SEQ ID NO: 2183058 - RNA, 13 nt, Homo sapiens
gucauugaccucu

SEQ ID NO: 2183059 - RNA, 15 nt, Homo sapiens
caggcuugcauuaaa

SEQ ID NO: 2183060 - RNA, 22 nt, Homo sapiens
gacaugcugaaauuauuucucu

SEQ ID NO: 2183061 - RNA, 22 nt, Homo sapiens
uagauacagauccgcauguguc

SEQ ID NO: 2183062 - RNA, 21 nt, Homo sapiens
uccagacucagagggcuggau

SEQ ID NO: 2183063 - RNA, 18 nt, Homo sapiens
ggauaacuggcacccaga

SEQ ID NO: 2183064 - RNA, 23 nt, Homo sapiens
ucaucaggaacguuuagcugaca

SEQ ID NO: 2183065 - RNA, 15 nt, Homo sapiens
gaagcuccacuguca

SEQ ID NO: 2183066 - RNA, 15 nt, Homo sapiens
uguuuaaagugaauu

SEQ ID NO: 2183067 - RNA, 17 nt, Homo sapiens
acauaggcaaagcaauc

SEQ ID NO: 2183068 - RNA, 18 nt, Homo sapiens
uccugauccugacacauu

SEQ ID NO: 2183069 - RNA, 22 nt, Homo sapiens
uccucugagccaagacugaggu

SEQ ID NO: 2183070 - RNA, 16 nt, Homo sapiens
guauucuacagcagau

SEQ ID NO: 2183071 - RNA, 23 nt, Homo sapiens
aaacuuggaugucacugccugac

SEQ ID NO: 2183072 - RNA, 22 nt, Homo sapiens
aagagaggaguucaaugaucua

SEQ ID NO: 2183073 - RNA, 16 nt, Homo sapiens
auguguguguauauau

SEQ ID NO: 2183074 - RNA, 16 nt, Homo sapiens
acacgcgcgcgcacac

SEQ ID NO: 2183075 - RNA, 16 nt, Homo sapiens
acgcgcgcgcacacac

SEQ ID NO: 2183076 - RNA, 18 nt, Homo sapiens
auauggaagcaaccagca

SEQ ID NO: 2183077 - RNA, 20 nt, Homo sapiens
aaaauccgacaagccuucag

SEQ ID NO: 2183078 - RNA, 21 nt, Homo sapiens
gccuccaccccccagaaccug

SEQ ID NO: 2183079 - RNA, 17 nt, Homo sapiens
uuuaccuaguuugcacu

SEQ ID NO: 2183080 - RNA, 15 nt, Homo sapiens
aagaucaggcacaga

SEQ ID NO: 2183081 - RNA, 15 nt, Homo sapiens
guuacaaauaugcag

SEQ ID NO: 2183082 - RNA, 20 nt, Homo sapiens
gaauucucagcagagcucaa

SEQ ID NO: 2183083 - RNA, 13 nt, Homo sapiens
aaacaaauaugca

SEQ ID NO: 2183084 - RNA, 13 nt, Homo sapiens
uaacuaauuugcu

SEQ ID NO: 2183085 - RNA, 19 nt, Homo sapiens
uuggaaaggaccuuaccug

SEQ ID NO: 2183086 - RNA, 20 nt, Homo sapiens
ugaaacaggagagaaagggg

SEQ ID NO: 2183087 - RNA, 17 nt, Homo sapiens
cacuagaaaacauucca

SEQ ID NO: 2183088 - RNA, 24 nt, Homo sapiens
gcuggucuugaacuccuagacuca

SEQ ID NO: 2183089 - RNA, 21 nt, Homo sapiens
cuucccagagaguaucugaga

SEQ ID NO: 2183090 - RNA, 13 nt, Homo sapiens
uacaagauauuau

SEQ ID NO: 2183091 - RNA, 18 nt, Homo sapiens
uaggcuuuaaaaaagcau

SEQ ID NO: 2183092 - RNA, 22 nt, Homo sapiens
aggacccagaaaaaaagcccaa

SEQ ID NO: 2183093 - RNA, 14 nt, Homo sapiens
aaaacuucuuguca

SEQ ID NO: 2183094 - RNA, 15 nt, Homo sapiens
caguggcccuuucaa

SEQ ID NO: 2183095 - RNA, 14 nt, Homo sapiens
uacucugcagugau

SEQ ID NO: 2183096 - RNA, 14 nt, Homo sapiens
aaugcacaucucau

SEQ ID NO: 2183097 - RNA, 22 nt, Homo sapiens
cuacacauucaauaagcaucaa

SEQ ID NO: 2183098 - RNA, 21 nt, Homo sapiens
caucuagcuccauaauugcaa

SEQ ID NO: 2183099 - RNA, 14 nt, Homo sapiens
ggugcaaaucaaug

SEQ ID NO: 2183100 - RNA, 16 nt, Homo sapiens
uccaagucuagcuuuc

SEQ ID NO: 2183101 - RNA, 20 nt, Homo sapiens
cgaauguaauuggaaucuuc

SEQ ID NO: 2183102 - RNA, 12 nt, Homo sapiens
gaucuuugcccc

SEQ ID NO: 2183103 - RNA, 15 nt, Homo sapiens
uccccagagcuacag

SEQ ID NO: 2183104 - RNA, 23 nt, Homo sapiens
augccauagcaagauugcuuaaa

SEQ ID NO: 2183105 - RNA, 18 nt, Homo sapiens
gaagcugaauuauuagua

SEQ ID NO: 2183106 - RNA, 12 nt, Homo sapiens
guuuaaggccac

SEQ ID NO: 2183107 - RNA, 12 nt, Homo sapiens
ccacgcucaaga

SEQ ID NO: 2183108 - RNA, 17 nt, Homo sapiens
uggaccaguggugccuu

SEQ ID NO: 2183109 - RNA, 12 nt, Homo sapiens
uggugcaaaaaa

SEQ ID NO: 2183110 - RNA, 21 nt, Homo sapiens
uuuggaccuuacgaucaggca

SEQ ID NO: 2183111 - RNA, 19 nt, Homo sapiens
ucgauguuuagugugauag

SEQ ID NO: 2183112 - RNA, 15 nt, Homo sapiens
ugagaagucacucac

SEQ ID NO: 2183113 - RNA, 18 nt, Homo sapiens
aacuucaaauagcaauaa

SEQ ID NO: 2183114 - RNA, 23 nt, Homo sapiens
aucucauccaucaaguugcacac

SEQ ID NO: 2183115 - RNA, 21 nt, Homo sapiens
gaacauuccuaucaauccaaa

SEQ ID NO: 2183116 - RNA, 20 nt, Homo sapiens
gucugauaaugauuugcucu

SEQ ID NO: 2183117 - RNA, 14 nt, Homo sapiens
aauggugcaaaaaa

SEQ ID NO: 2183118 - RNA, 22 nt, Homo sapiens
augaucaucacaaucaucauca

SEQ ID NO: 2183119 - RNA, 11 nt, Homo sapiens
uugcaucucac

SEQ ID NO: 2183120 - RNA, 20 nt, Homo sapiens
uuuccccauugacccucacc

SEQ ID NO: 2183121 - RNA, 13 nt, Homo sapiens
uauauaaguuuac

SEQ ID NO: 2183122 - RNA, 23 nt, Homo sapiens
aguaaaacaauugugacagcagu

SEQ ID NO: 2183123 - RNA, 17 nt, Homo sapiens
aaugaaauguaugugcu

SEQ ID NO: 2183124 - RNA, 17 nt, Homo sapiens
cuacccuuggcagugug

SEQ ID NO: 2183125 - RNA, 21 nt, Homo sapiens
agauauuuuuaacuuaauggc

SEQ ID NO: 2183126 - RNA, 21 nt, Homo sapiens
gcagcucuggcucugccucag

SEQ ID NO: 2183127 - RNA, 17 nt, Homo sapiens
caagaugaucacaugga

SEQ ID NO: 2183128 - RNA, 22 nt, Homo sapiens
ucuuucuuaaccacuuucagcc

SEQ ID NO: 2183129 - RNA, 17 nt, Homo sapiens
uccauccggcuccuguc

SEQ ID NO: 2183130 - RNA, 16 nt, Homo sapiens
aaucuaaccacaucaa

SEQ ID NO: 2183131 - RNA, 18 nt, Homo sapiens
guuguagacguuguguaa

SEQ ID NO: 2183132 - RNA, 13 nt, Homo sapiens
augugcaccaaua

SEQ ID NO: 2183133 - RNA, 24 nt, Homo sapiens
gguguacuuauauccacacugcac

SEQ ID NO: 2183134 - RNA, 14 nt, Homo sapiens
ucagacagauguca

SEQ ID NO: 2183135 - RNA, 22 nt, Homo sapiens
aaaguucucagaacuguuggcu

SEQ ID NO: 2183136 - RNA, 17 nt, Homo sapiens
gaucugcuuguugcauu

SEQ ID NO: 2183137 - RNA, 12 nt, Homo sapiens
cuucaccaccuc

SEQ ID NO: 2183138 - RNA, 12 nt, Homo sapiens
uuuauugagaua

SEQ ID NO: 2183139 - RNA, 20 nt, Homo sapiens
aagugcugggauuacaggca

SEQ ID NO: 2183140 - RNA, 21 nt, Homo sapiens
ggcuucauugagaaacuggga

SEQ ID NO: 2183141 - RNA, 21 nt, Homo sapiens
ugccuucuuauugcuuuuaug

SEQ ID NO: 2183142 - RNA, 14 nt, Homo sapiens
agggcaaugccauc

SEQ ID NO: 2183143 - RNA, 16 nt, Homo sapiens
acacuuccagcauuua

SEQ ID NO: 2183144 - RNA, 19 nt, Homo sapiens
gagaugaaguuaaagguau

SEQ ID NO: 2183145 - RNA, 19 nt, Homo sapiens
agacgugauuuugcuguag

SEQ ID NO: 2183146 - RNA, 23 nt, Homo sapiens
aauauaucacuuuugauacaaua

SEQ ID NO: 2183147 - RNA, 13 nt, Homo sapiens
auauauuccacca

SEQ ID NO: 2183148 - RNA, 22 nt, Homo sapiens
cauaggaucugaggacaaggaa

SEQ ID NO: 2183149 - RNA, 22 nt, Homo sapiens
ucccuuucugugugaagaucac

SEQ ID NO: 2183150 - RNA, 11 nt, Homo sapiens
cagauccugca

SEQ ID NO: 2183151 - RNA, 20 nt, Homo sapiens
aaauucagaaagucauagau

SEQ ID NO: 2183152 - RNA, 23 nt, Homo sapiens
auuaauaccugaccucacagagu

SEQ ID NO: 2183153 - RNA, 16 nt, Homo sapiens
aaaugauuuucauuga

SEQ ID NO: 2183154 - RNA, 13 nt, Homo sapiens
ccaucauuccuuu

SEQ ID NO: 2183155 - RNA, 16 nt, Homo sapiens
aauaguucaguauaaa

SEQ ID NO: 2183156 - RNA, 19 nt, Homo sapiens
gggcuccccaggaagccca

SEQ ID NO: 2183157 - RNA, 15 nt, Homo sapiens
cuugcacacaggugu

SEQ ID NO: 2183158 - RNA, 22 nt, Homo sapiens
gcuucaggaaggacauggacaa

SEQ ID NO: 2183159 - RNA, 19 nt, Homo sapiens
uguuaaugucauugcuaaa

SEQ ID NO: 2183160 - RNA, 11 nt, Homo sapiens
gugcaucucau

SEQ ID NO: 2183161 - RNA, 13 nt, Homo sapiens
ucauucauauuac

SEQ ID NO: 2183162 - RNA, 21 nt, Homo sapiens
uguucauaauaucaugugcac

SEQ ID NO: 2183163 - RNA, 16 nt, Homo sapiens
uagccacgauggucuc

SEQ ID NO: 2183164 - RNA, 22 nt, Homo sapiens
gcauggcacucccuccagcaca

SEQ ID NO: 2183165 - RNA, 19 nt, Homo sapiens
ugguuuggaguuuauuuga

SEQ ID NO: 2183166 - RNA, 23 nt, Homo sapiens
caggagggcugggcuccacuuca

SEQ ID NO: 2183167 - RNA, 19 nt, Homo sapiens
agguucucagguguugcca

SEQ ID NO: 2183168 - RNA, 15 nt, Homo sapiens
ugaucacacucuggg

SEQ ID NO: 2183169 - RNA, 20 nt, Homo sapiens
ucaucuccaucauaugccug

SEQ ID NO: 2183170 - RNA, 16 nt, Homo sapiens
cuuccagagucaucua

SEQ ID NO: 2183171 - RNA, 19 nt, Homo sapiens
uucccaaaagcccauucau

SEQ ID NO: 2183172 - RNA, 23 nt, Homo sapiens
uuuauacaauuuccauauagucu

SEQ ID NO: 2183173 - RNA, 12 nt, Homo sapiens
agcugcaucauc

SEQ ID NO: 2183174 - RNA, 23 nt, Homo sapiens
uuuguccaccucugauuacaugu

SEQ ID NO: 2183175 - RNA, 17 nt, Homo sapiens
cucagucagacauggcc

SEQ ID NO: 2183176 - RNA, 16 nt, Homo sapiens
cucuggucugggugcc

SEQ ID NO: 2183177 - RNA, 13 nt, Homo sapiens
uuuugccagagaa

SEQ ID NO: 2183178 - RNA, 14 nt, Homo sapiens
cauuuuugcaaauc

SEQ ID NO: 2183179 - RNA, 18 nt, Homo sapiens
ucauuagauacaguagug

SEQ ID NO: 2183180 - RNA, 18 nt, Homo sapiens
cauuuucuguuccagguu

SEQ ID NO: 2183181 - RNA, 12 nt, Homo sapiens
agauguccucag

SEQ ID NO: 2183182 - RNA, 12 nt, Homo sapiens
agagguccucau

SEQ ID NO: 2183183 - RNA, 19 nt, Homo sapiens
agauuggccagcaaaaacu

SEQ ID NO: 2183184 - RNA, 16 nt, Homo sapiens
guagccucaauucucc

SEQ ID NO: 2183185 - RNA, 20 nt, Homo sapiens
cuaagaaauaaaacuguuaa

SEQ ID NO: 2183186 - RNA, 14 nt, Homo sapiens
aauaugaguacaaa

SEQ ID NO: 2183187 - RNA, 18 nt, Homo sapiens
cugagcccucucacucca

SEQ ID NO: 2183188 - RNA, 16 nt, Homo sapiens
ggaagugaggcccaag

SEQ ID NO: 2183189 - RNA, 19 nt, Homo sapiens
uauuucuaauucaguucug

SEQ ID NO: 2183190 - RNA, 12 nt, Homo sapiens
aguccuugcaaa

SEQ ID NO: 2183191 - RNA, 17 nt, Homo sapiens
uauugcuaacaucucau

SEQ ID NO: 2183192 - RNA, 22 nt, Homo sapiens
cauauuggaauguacaugucaa

SEQ ID NO: 2183193 - RNA, 16 nt, Homo sapiens
aggccuccaagccagg

SEQ ID NO: 2183194 - RNA, 20 nt, Homo sapiens
cagagaccugaagugugcac

SEQ ID NO: 2183195 - RNA, 17 nt, Homo sapiens
aaugcuucuagaguuuu

SEQ ID NO: 2183196 - RNA, 15 nt, Homo sapiens
uuuacucuguguaaa

SEQ ID NO: 2183197 - RNA, 14 nt, Homo sapiens
uccaaucacauuca

SEQ ID NO: 2183198 - RNA, 16 nt, Homo sapiens
gaacacuggaacauuc

SEQ ID NO: 2183199 - RNA, 15 nt, Homo sapiens
caagcucuucacuga

SEQ ID NO: 2183200 - RNA, 19 nt, Homo sapiens
cagccgcccagaucaugcc

SEQ ID NO: 2183201 - RNA, 21 nt, Homo sapiens
guuacuaagaugaaauugcca

SEQ ID NO: 2183202 - RNA, 17 nt, Homo sapiens
gauaauucuggaccaga

SEQ ID NO: 2183203 - RNA, 16 nt, Homo sapiens
gaucagaucuuacaag

SEQ ID NO: 2183204 - RNA, 20 nt, Homo sapiens
aaugaguuuuucuguuauca

SEQ ID NO: 2183205 - RNA, 13 nt, Homo sapiens
gaagagcuugugu

SEQ ID NO: 2183206 - RNA, 15 nt, Homo sapiens
ugacuuugugccauc

SEQ ID NO: 2183207 - RNA, 16 nt, Homo sapiens
uccauccauggccagc

SEQ ID NO: 2183208 - RNA, 14 nt, Homo sapiens
gcauagacaagugu

SEQ ID NO: 2183209 - RNA, 21 nt, Homo sapiens
auguggggcugguuucugccc

SEQ ID NO: 2183210 - RNA, 16 nt, Homo sapiens
aaacuuuguaauucua

SEQ ID NO: 2183211 - RNA, 21 nt, Homo sapiens
cauuuaagaauuuaccagaaa

SEQ ID NO: 2183212 - RNA, 20 nt, Homo sapiens
gaugcaaucucuugucucac

SEQ ID NO: 2183213 - RNA, 22 nt, Homo sapiens
uuccaacguaaauuauuacaua

SEQ ID NO: 2183214 - RNA, 14 nt, Homo sapiens
guaaaacugugaca

SEQ ID NO: 2183215 - RNA, 12 nt, Homo sapiens
ccaaagaagcag

SEQ ID NO: 2183216 - RNA, 16 nt, Homo sapiens
ucacuugacuuugcca

SEQ ID NO: 2183217 - RNA, 17 nt, Homo sapiens
aguccaaaccacuccac

SEQ ID NO: 2183218 - RNA, 19 nt, Homo sapiens
uuguagagauggggucuca

SEQ ID NO: 2183219 - RNA, 23 nt, Homo sapiens
acauucugaaucaagcacacugu

SEQ ID NO: 2183220 - RNA, 15 nt, Homo sapiens
uucucuacagacucc

SEQ ID NO: 2183221 - RNA, 18 nt, Homo sapiens
ucacuuuucuccaugagu

SEQ ID NO: 2183222 - RNA, 24 nt, Homo sapiens
uccauauauuuagccccauuacac

SEQ ID NO: 2183223 - RNA, 20 nt, Homo sapiens
ccaagguggugaaaucccau

SEQ ID NO: 2183224 - RNA, 14 nt, Homo sapiens
uaaaagucuaccug

SEQ ID NO: 2183225 - RNA, 20 nt, Homo sapiens
acagaucugaauucugcccu

SEQ ID NO: 2183226 - RNA, 19 nt, Homo sapiens
gaccgcgcuguuccggcuu

SEQ ID NO: 2183227 - RNA, 14 nt, Homo sapiens
agaggcuccugucc

SEQ ID NO: 2183228 - RNA, 12 nt, Homo sapiens
gcuacuaccugg

SEQ ID NO: 2183229 - RNA, 15 nt, Homo sapiens
ucagcuggaucucca

SEQ ID NO: 2183230 - RNA, 18 nt, Homo sapiens
agcuucagaaaggggcau

SEQ ID NO: 2183231 - RNA, 13 nt, Homo sapiens
uaaagaauucuuu

SEQ ID NO: 2183232 - RNA, 11 nt, Homo sapiens
uuuuacuucca

SEQ ID NO: 2183233 - RNA, 20 nt, Homo sapiens
ugcccacucuccauccuccc

SEQ ID NO: 2183234 - RNA, 21 nt, Homo sapiens
uagcuuuccuggucccucacc

SEQ ID NO: 2183235 - RNA, 17 nt, Homo sapiens
uagcaagagugugaaau

SEQ ID NO: 2183236 - RNA, 16 nt, Homo sapiens
ggagacuuggggccag

SEQ ID NO: 2183237 - RNA, 13 nt, Homo sapiens
cugugguggagaa

SEQ ID NO: 2183238 - RNA, 18 nt, Homo sapiens
caaugccaugacugcuca

SEQ ID NO: 2183239 - RNA, 17 nt, Homo sapiens
aaaugcugcaggauuaa

SEQ ID NO: 2183240 - RNA, 18 nt, Homo sapiens
gcagucucuauaccaaua

SEQ ID NO: 2183241 - RNA, 18 nt, Homo sapiens
aguuuugaguguacugug

SEQ ID NO: 2183242 - RNA, 19 nt, Homo sapiens
gaccagccccaccaugcaa

SEQ ID NO: 2183243 - RNA, 13 nt, Homo sapiens
ugugaucuaagca

SEQ ID NO: 2183244 - RNA, 16 nt, Homo sapiens
uguuuuuaaacuaaua

SEQ ID NO: 2183245 - RNA, 22 nt, Homo sapiens
aacauuguuuuuguugucuuua

SEQ ID NO: 2183246 - RNA, 14 nt, Homo sapiens
ccucaggcaggugg

SEQ ID NO: 2183247 - RNA, 22 nt, Homo sapiens
aacaaagggauguucacuguau

SEQ ID NO: 2183248 - RNA, 20 nt, Homo sapiens
acuccuuucucaucuugucc

SEQ ID NO: 2183249 - RNA, 15 nt, Homo sapiens
ugucucccccaacac

SEQ ID NO: 2183250 - RNA, 15 nt, Homo sapiens
uauguauuauuugca

SEQ ID NO: 2183251 - RNA, 20 nt, Homo sapiens
caugccuuuccagugcugcu

SEQ ID NO: 2183252 - RNA, 17 nt, Homo sapiens
gaccagcccaccccugu

SEQ ID NO: 2183253 - RNA, 13 nt, Homo sapiens
uuggcacuguaag

SEQ ID NO: 2183254 - RNA, 13 nt, Homo sapiens
ugaacacuggggg

SEQ ID NO: 2183255 - RNA, 14 nt, Homo sapiens
uggccaaaagcuag

SEQ ID NO: 2183256 - RNA, 15 nt, Homo sapiens
acaucaacaggacuu

SEQ ID NO: 2183257 - RNA, 19 nt, Homo sapiens
cacucccaugugcugacuc

SEQ ID NO: 2183258 - RNA, 20 nt, Homo sapiens
aaagguugaguaugugaaga

SEQ ID NO: 2183259 - RNA, 22 nt, Homo sapiens
ccgauuuuuuuuuuuuccucuu

SEQ ID NO: 2183260 - RNA, 23 nt, Homo sapiens
uuucaccccagaggacacaggca

SEQ ID NO: 2183261 - RNA, 15 nt, Homo sapiens
gaguggaaauacacu

SEQ ID NO: 2183262 - RNA, 17 nt, Homo sapiens
ccuauaucuucaucugu

SEQ ID NO: 2183263 - RNA, 16 nt, Homo sapiens
acuaguaaacaugugg

SEQ ID NO: 2183264 - RNA, 15 nt, Homo sapiens
gugcaugcuaguguu

SEQ ID NO: 2183265 - RNA, 22 nt, Homo sapiens
augcuggaugaugaaauggauu

SEQ ID NO: 2183266 - RNA, 22 nt, Homo sapiens
uaaaagauaaguguguuugcaa

SEQ ID NO: 2183267 - RNA, 11 nt, Homo sapiens
uugacuugcca

SEQ ID NO: 2183268 - RNA, 20 nt, Homo sapiens
gcacacaaugcuauugaaau

SEQ ID NO: 2183269 - RNA, 19 nt, Homo sapiens
ccuagccagcacuuguaua

SEQ ID NO: 2183270 - RNA, 22 nt, Homo sapiens
uuacccgaaagcaucacugccu

SEQ ID NO: 2183271 - RNA, 14 nt, Homo sapiens
aggaacacuggagc

SEQ ID NO: 2183272 - RNA, 14 nt, Homo sapiens
uugugcacauguac

SEQ ID NO: 2183273 - RNA, 16 nt, Homo sapiens
ugaagcagucuugcuc

SEQ ID NO: 2183274 - RNA, 23 nt, Homo sapiens
ugugugaagaaagccucagugaa

SEQ ID NO: 2183275 - RNA, 12 nt, Homo sapiens
ugcauucagggg

SEQ ID NO: 2183276 - RNA, 23 nt, Homo sapiens
agucacuuaaacucaucuaucca

SEQ ID NO: 2183277 - RNA, 14 nt, Homo sapiens
gacucagcuggaag

SEQ ID NO: 2183278 - RNA, 13 nt, Homo sapiens
gauggagccugaa

SEQ ID NO: 2183279 - RNA, 11 nt, Homo sapiens
uguccccaaaa

SEQ ID NO: 2183280 - RNA, 19 nt, Homo sapiens
agauguuucaacugugcuc

SEQ ID NO: 2183281 - RNA, 22 nt, Homo sapiens
acaauuuggucuuagcuuuaca

SEQ ID NO: 2183282 - RNA, 22 nt, Homo sapiens
caguaaauaacaggcauuuguu

SEQ ID NO: 2183283 - RNA, 23 nt, Homo sapiens
aauuuaauucuuguucuuugcac

SEQ ID NO: 2183284 - RNA, 13 nt, Homo sapiens
uacagacaagguu

SEQ ID NO: 2183285 - RNA, 21 nt, Homo sapiens
aguaauuauuagcauugaucu

SEQ ID NO: 2183286 - RNA, 19 nt, Homo sapiens
ugaaauauuuucuacuuua

SEQ ID NO: 2183287 - RNA, 14 nt, Homo sapiens
gcucaggacucaga

SEQ ID NO: 2183288 - RNA, 15 nt, Homo sapiens
cuauuuguucagaga

SEQ ID NO: 2183289 - RNA, 18 nt, Homo sapiens
ccacacuuaaauucucua

SEQ ID NO: 2183290 - RNA, 15 nt, Homo sapiens
ugaaaugacauuuca

SEQ ID NO: 2183291 - RNA, 18 nt, Homo sapiens
augacugcaaucaugugc

SEQ ID NO: 2183292 - RNA, 22 nt, Homo sapiens
aaucugaguagagcagccacaa

SEQ ID NO: 2183293 - RNA, 22 nt, Homo sapiens
uaaugaguaacaucuacuuagu

SEQ ID NO: 2183294 - RNA, 22 nt, Homo sapiens
aguucuuuucaugcaaguauaa

SEQ ID NO: 2183295 - RNA, 14 nt, Homo sapiens
uaaucaguaugcaa

SEQ ID NO: 2183296 - RNA, 14 nt, Homo sapiens
guggccucauucag

SEQ ID NO: 2183297 - RNA, 21 nt, Homo sapiens
guagauacaaucagcugcuuu

SEQ ID NO: 2183298 - RNA, 18 nt, Homo sapiens
uagucuguuggcaauuga

SEQ ID NO: 2183299 - RNA, 20 nt, Homo sapiens
cucuguaaaaugcaccaauc

SEQ ID NO: 2183300 - RNA, 19 nt, Homo sapiens
caggcacaguaagcaugcu

SEQ ID NO: 2183301 - RNA, 11 nt, Homo sapiens
aaucuacaggc

SEQ ID NO: 2183302 - RNA, 23 nt, Homo sapiens
cuauaacaugucuuucagcauua

SEQ ID NO: 2183303 - RNA, 15 nt, Homo sapiens
aucccuuccuggaaa

SEQ ID NO: 2183304 - RNA, 20 nt, Homo sapiens
aggugccuccaauuggugcu

SEQ ID NO: 2183305 - RNA, 18 nt, Homo sapiens
agccucugggaucugcca

SEQ ID NO: 2183306 - RNA, 19 nt, Homo sapiens
uucuaauuucaaaaauaua

SEQ ID NO: 2183307 - RNA, 12 nt, Homo sapiens
gucaacauuucu

SEQ ID NO: 2183308 - RNA, 13 nt, Homo sapiens
aguugaagaucuu

SEQ ID NO: 2183309 - RNA, 19 nt, Homo sapiens
gaauaaugggcauugagau

SEQ ID NO: 2183310 - RNA, 12 nt, Homo sapiens
cagauucuucag

SEQ ID NO: 2183311 - RNA, 18 nt, Homo sapiens
acagaacagucucuggaa

SEQ ID NO: 2183312 - RNA, 22 nt, Homo sapiens
gaugggaucccaggccagggaa

SEQ ID NO: 2183313 - RNA, 19 nt, Homo sapiens
agccaagggaaaggggugc

SEQ ID NO: 2183314 - RNA, 14 nt, Homo sapiens
agugggacccauag

SEQ ID NO: 2183315 - RNA, 14 nt, Homo sapiens
aguugaacccagaa

SEQ ID NO: 2183316 - RNA, 19 nt, Homo sapiens
ugugagaauaaagcauuuc

SEQ ID NO: 2183317 - RNA, 18 nt, Homo sapiens
cacaccugacaaauggaa

SEQ ID NO: 2183318 - RNA, 20 nt, Homo sapiens
aaucagacugacaguuuaca

SEQ ID NO: 2183319 - RNA, 17 nt, Homo sapiens
aggucaagaacaugcaa

SEQ ID NO: 2183320 - RNA, 22 nt, Homo sapiens
uucucuaauauggcaaccauua

SEQ ID NO: 2183321 - RNA, 13 nt, Homo sapiens
gaaauuacugugu

SEQ ID NO: 2183322 - RNA, 17 nt, Homo sapiens
agccugauauugauaug

SEQ ID NO: 2183323 - RNA, 14 nt, Homo sapiens
agggugauagucaa

SEQ ID NO: 2183324 - RNA, 18 nt, Homo sapiens
ggucagaggcccaaaaca

SEQ ID NO: 2183325 - RNA, 19 nt, Homo sapiens
ccacugugguuuugacuua

SEQ ID NO: 2183326 - RNA, 15 nt, Homo sapiens
uccauuaugcugcag

SEQ ID NO: 2183327 - RNA, 20 nt, Homo sapiens
gccccuguaacccuacucuc

SEQ ID NO: 2183328 - RNA, 23 nt, Homo sapiens
acagacuggcaauaaacuccuac

SEQ ID NO: 2183329 - RNA, 13 nt, Homo sapiens
auaccacaugauu

SEQ ID NO: 2183330 - RNA, 19 nt, Homo sapiens
ucaucccccaucagaugau

SEQ ID NO: 2183331 - RNA, 20 nt, Homo sapiens
acaaugaugcuauuugcaau

SEQ ID NO: 2183332 - RNA, 13 nt, Homo sapiens
accucuacugucu

SEQ ID NO: 2183333 - RNA, 23 nt, Homo sapiens
caucuccaucggaacagaaaacu

SEQ ID NO: 2183334 - RNA, 20 nt, Homo sapiens
cuccuaagcuggagugcagu

SEQ ID NO: 2183335 - RNA, 18 nt, Homo sapiens
uaacugacuucuguccac

SEQ ID NO: 2183336 - RNA, 18 nt, Homo sapiens
gaggacuacucagcacug

SEQ ID NO: 2183337 - RNA, 17 nt, Homo sapiens
uuaaggugaaccaaaga

SEQ ID NO: 2183338 - RNA, 17 nt, Homo sapiens
cagacugucucaaauaa

SEQ ID NO: 2183339 - RNA, 10 nt, Homo sapiens
gagauuuauu

SEQ ID NO: 2183340 - RNA, 15 nt, Homo sapiens
ggcugaacucucccc

SEQ ID NO: 2183341 - RNA, 14 nt, Homo sapiens
acauuuagucuucc

SEQ ID NO: 2183342 - RNA, 14 nt, Homo sapiens
ucuccuagacacuc

SEQ ID NO: 2183343 - RNA, 15 nt, Homo sapiens
caugaaggaugccaa

SEQ ID NO: 2183344 - RNA, 18 nt, Homo sapiens
augaguugcuggaaaauc

SEQ ID NO: 2183345 - RNA, 16 nt, Homo sapiens
aacacuucgagcacug

SEQ ID NO: 2183346 - RNA, 22 nt, Homo sapiens
uuuggggcaggggguucuggga

SEQ ID NO: 2183347 - RNA, 20 nt, Homo sapiens
agggagaacucuaucugugg

SEQ ID NO: 2183348 - RNA, 13 nt, Homo sapiens
acacuuuaccucu

SEQ ID NO: 2183349 - RNA, 14 nt, Homo sapiens
uccgugugucucau

SEQ ID NO: 2183350 - RNA, 17 nt, Homo sapiens
aucuuccuuucuugucu

SEQ ID NO: 2183351 - RNA, 19 nt, Homo sapiens
gcacucacacccuaacuca

SEQ ID NO: 2183352 - RNA, 13 nt, Homo sapiens
accaaguuuauuc

SEQ ID NO: 2183353 - RNA, 15 nt, Homo sapiens
agggguuugccaaac

SEQ ID NO: 2183354 - RNA, 21 nt, Homo sapiens
uauccuaaacccuuaaccuaa

SEQ ID NO: 2183355 - RNA, 16 nt, Homo sapiens
ccccaguaggacaaac

SEQ ID NO: 2183356 - RNA, 21 nt, Homo sapiens
accuguaguguaccauucuca

SEQ ID NO: 2183357 - RNA, 20 nt, Homo sapiens
aauaucugugaaauaucauc

SEQ ID NO: 2183358 - RNA, 17 nt, Homo sapiens
uguuagugguuacccag

SEQ ID NO: 2183359 - RNA, 15 nt, Homo sapiens
acaucauugcauaac

SEQ ID NO: 2183360 - RNA, 14 nt, Homo sapiens
ccugguugugugca

SEQ ID NO: 2183361 - RNA, 15 nt, Homo sapiens
acuucugggcccuag

SEQ ID NO: 2183362 - RNA, 22 nt, Homo sapiens
ugugugcuuugccacugaagua

SEQ ID NO: 2183363 - RNA, 16 nt, Homo sapiens
cauuuguaaugaauuu

SEQ ID NO: 2183364 - RNA, 19 nt, Homo sapiens
cucuaguccuuggcuggac

SEQ ID NO: 2183365 - RNA, 17 nt, Homo sapiens
aauauagaaccaugaau

SEQ ID NO: 2183366 - RNA, 18 nt, Homo sapiens
accugaaaaaaugccaag

SEQ ID NO: 2183367 - RNA, 14 nt, Homo sapiens
uuaagguguuugaa

SEQ ID NO: 2183368 - RNA, 13 nt, Homo sapiens
uuuaaaugccaua

SEQ ID NO: 2183369 - RNA, 15 nt, Homo sapiens
ccugacaagugaagu

SEQ ID NO: 2183370 - RNA, 19 nt, Homo sapiens
uaguauuccucauucugca

SEQ ID NO: 2183371 - RNA, 14 nt, Homo sapiens
acauuucuuugcau

SEQ ID NO: 2183372 - RNA, 21 nt, Homo sapiens
acagggcugggcuacuaagcu

SEQ ID NO: 2183373 - RNA, 23 nt, Homo sapiens
acccugggccuggcagcucagcu

SEQ ID NO: 2183374 - RNA, 18 nt, Homo sapiens
acagcaguuucaccaucu

SEQ ID NO: 2183375 - RNA, 14 nt, Homo sapiens
cuccugaccaaaga

SEQ ID NO: 2183376 - RNA, 17 nt, Homo sapiens
ugaucugccugccuugg

SEQ ID NO: 2183377 - RNA, 16 nt, Homo sapiens
aaccaaagagacugga

SEQ ID NO: 2183378 - RNA, 20 nt, Homo sapiens
cucuaccagacuguguauuc

SEQ ID NO: 2183379 - RNA, 18 nt, Homo sapiens
gcagcuacaagugcagcu

SEQ ID NO: 2183380 - RNA, 16 nt, Homo sapiens
uggggaccucaccugc

SEQ ID NO: 2183381 - RNA, 14 nt, Homo sapiens
aggcagagccagug

SEQ ID NO: 2183382 - RNA, 16 nt, Homo sapiens
gacguggagcugcuca

SEQ ID NO: 2183383 - RNA, 20 nt, Homo sapiens
auacagucuuccacaaagaa

SEQ ID NO: 2183384 - RNA, 15 nt, Homo sapiens
aauugacgccaccau

SEQ ID NO: 2183385 - RNA, 16 nt, Homo sapiens
cugggcucaagugauc

SEQ ID NO: 2183386 - RNA, 14 nt, Homo sapiens
cagccaagugcaga

SEQ ID NO: 2183387 - RNA, 13 nt, Homo sapiens
uguuguaugggga

SEQ ID NO: 2183388 - RNA, 15 nt, Homo sapiens
ugggggaugugcacg

SEQ ID NO: 2183389 - RNA, 23 nt, Homo sapiens
gcuuugcaccccuuuccucccca

SEQ ID NO: 2183390 - RNA, 23 nt, Homo sapiens
guccauuucuuauuuaauuagaa

SEQ ID NO: 2183391 - RNA, 21 nt, Homo sapiens
aaccaaucaaccaaacaaaga

SEQ ID NO: 2183392 - RNA, 14 nt, Homo sapiens
guccuaccuauuau

SEQ ID NO: 2183393 - RNA, 14 nt, Homo sapiens
auucucaccugaau

SEQ ID NO: 2183394 - RNA, 13 nt, Homo sapiens
caaauauauaaug

SEQ ID NO: 2183395 - RNA, 17 nt, Homo sapiens
uagagaucuaugggcau

SEQ ID NO: 2183396 - RNA, 17 nt, Homo sapiens
caggccuuuuugagcca

SEQ ID NO: 2183397 - RNA, 14 nt, Homo sapiens
gagucacaccagaa

SEQ ID NO: 2183398 - RNA, 13 nt, Homo sapiens
auguaaaugguau

SEQ ID NO: 2183399 - RNA, 10 nt, Homo sapiens
gugcauucaa

SEQ ID NO: 2183400 - RNA, 13 nt, Homo sapiens
cagaaacagugag

SEQ ID NO: 2183401 - RNA, 14 nt, Homo sapiens
cacacucggccacu

SEQ ID NO: 2183402 - RNA, 17 nt, Homo sapiens
ugccucaaugugaccag

SEQ ID NO: 2183403 - RNA, 18 nt, Homo sapiens
acguaggugugacacuuu

SEQ ID NO: 2183404 - RNA, 23 nt, Homo sapiens
cugacaggccuuccuccucucaa

SEQ ID NO: 2183405 - RNA, 14 nt, Homo sapiens
ucccaggagaguac

SEQ ID NO: 2183406 - RNA, 19 nt, Homo sapiens
guuucccuggugcccuucc

SEQ ID NO: 2183407 - RNA, 14 nt, Homo sapiens
uggagacaccacca

SEQ ID NO: 2183408 - RNA, 18 nt, Homo sapiens
ugccuggacagaggacaa

SEQ ID NO: 2183409 - RNA, 16 nt, Homo sapiens
gcuuaaaccaacaaua

SEQ ID NO: 2183410 - RNA, 17 nt, Homo sapiens
uucugccccagcuuuau

SEQ ID NO: 2183411 - RNA, 20 nt, Homo sapiens
uugcuguuccacaaagcagu

SEQ ID NO: 2183412 - RNA, 20 nt, Homo sapiens
guuuuguugaguuaaaguau

SEQ ID NO: 2183413 - RNA, 18 nt, Homo sapiens
ugcacuuuaaauggaaua

SEQ ID NO: 2183414 - RNA, 15 nt, Homo sapiens
aauuuccacuuuauu

SEQ ID NO: 2183415 - RNA, 16 nt, Homo sapiens
auuaccauauaaugua

SEQ ID NO: 2183416 - RNA, 19 nt, Homo sapiens
acucccuccucacacucca

SEQ ID NO: 2183417 - RNA, 23 nt, Homo sapiens
gcugggcuuuggggcugguggga

SEQ ID NO: 2183418 - RNA, 14 nt, Homo sapiens
cuaaguuauuguua

SEQ ID NO: 2183419 - RNA, 19 nt, Homo sapiens
aacccggugcaucuggcac

SEQ ID NO: 2183420 - RNA, 15 nt, Homo sapiens
uucaugccaaguauc

SEQ ID NO: 2183421 - RNA, 19 nt, Homo sapiens
gucuccuaaaguacuggga

SEQ ID NO: 2183422 - RNA, 18 nt, Homo sapiens
gccacugcgcccggccca

SEQ ID NO: 2183423 - RNA, 19 nt, Homo sapiens
aaugguuuguaaaauccac

SEQ ID NO: 2183424 - RNA, 14 nt, Homo sapiens
agaucaaauacuuu

SEQ ID NO: 2183425 - RNA, 20 nt, Homo sapiens
auuccuuggagccacuggga

SEQ ID NO: 2183426 - RNA, 21 nt, Homo sapiens
cuccccagccuuugaucaggu

SEQ ID NO: 2183427 - RNA, 21 nt, Homo sapiens
guuuugcccuauauaccucac

SEQ ID NO: 2183428 - RNA, 12 nt, Homo sapiens
ggaccagugagu

SEQ ID NO: 2183429 - RNA, 16 nt, Homo sapiens
augaauaaacaguuau

SEQ ID NO: 2183430 - RNA, 12 nt, Homo sapiens
auaugacucaga

SEQ ID NO: 2183431 - RNA, 20 nt, Homo sapiens
uuugaacaacucgaaucacu

SEQ ID NO: 2183432 - RNA, 17 nt, Homo sapiens
ugcaagacuucacugca

SEQ ID NO: 2183433 - RNA, 15 nt, Homo sapiens
ccauccccaccagcu

SEQ ID NO: 2183434 - RNA, 19 nt, Homo sapiens
uucauauuaagaaugaucu

SEQ ID NO: 2183435 - RNA, 12 nt, Homo sapiens
ccuauuugccau

SEQ ID NO: 2183436 - RNA, 16 nt, Homo sapiens
gcaggcagagaacugu

SEQ ID NO: 2183437 - RNA, 12 nt, Homo sapiens
ccagcaaaaucc

SEQ ID NO: 2183438 - RNA, 14 nt, Homo sapiens
agaagugcccuuaa

SEQ ID NO: 2183439 - RNA, 21 nt, Homo sapiens
acuggccauucuuauguucca

SEQ ID NO: 2183440 - RNA, 14 nt, Homo sapiens
ccauuaaucuugau

SEQ ID NO: 2183441 - RNA, 16 nt, Homo sapiens
aguggauugcauuucu

SEQ ID NO: 2183442 - RNA, 14 nt, Homo sapiens
acccuucacaucac

SEQ ID NO: 2183443 - RNA, 15 nt, Homo sapiens
ugcugaccccaggaa

SEQ ID NO: 2183444 - RNA, 21 nt, Homo sapiens
uuggcuucuuaaaaacugugu

SEQ ID NO: 2183445 - RNA, 19 nt, Homo sapiens
uaagggcagauuacaguca

SEQ ID NO: 2183446 - RNA, 23 nt, Homo sapiens
agggcagccaggggcugcucauc

SEQ ID NO: 2183447 - RNA, 19 nt, Homo sapiens
uccagaacugucuuaguca

SEQ ID NO: 2183448 - RNA, 21 nt, Homo sapiens
auauuaaggaagacaauguga

SEQ ID NO: 2183449 - RNA, 13 nt, Homo sapiens
agagaauaaucau

SEQ ID NO: 2183450 - RNA, 16 nt, Homo sapiens
cugauauuaaucaaaa

SEQ ID NO: 2183451 - RNA, 18 nt, Homo sapiens
caguguuuccacacuuaa

SEQ ID NO: 2183452 - RNA, 23 nt, Homo sapiens
uauuuaugcaacucaucuucaca

SEQ ID NO: 2183453 - RNA, 18 nt, Homo sapiens
aacagauugccauggaca

SEQ ID NO: 2183454 - RNA, 14 nt, Homo sapiens
gcacuacaguuuua

SEQ ID NO: 2183455 - RNA, 23 nt, Homo sapiens
ccccaguaaaaucaaaugugcau

SEQ ID NO: 2183456 - RNA, 13 nt, Homo sapiens
gaacaagguuuca

SEQ ID NO: 2183457 - RNA, 22 nt, Homo sapiens
auguuacucaguguuaacacau

SEQ ID NO: 2183458 - RNA, 14 nt, Homo sapiens
aauguuaauguuau

SEQ ID NO: 2183459 - RNA, 13 nt, Homo sapiens
uaaauaagaucag

SEQ ID NO: 2183460 - RNA, 18 nt, Homo sapiens
aauaaacaagcuguggua

SEQ ID NO: 2183461 - RNA, 16 nt, Homo sapiens
ugaauggcugaccuga

SEQ ID NO: 2183462 - RNA, 17 nt, Homo sapiens
auuguaaauacauguac

SEQ ID NO: 2183463 - RNA, 18 nt, Homo sapiens
caucccugugagcaaaaa

SEQ ID NO: 2183464 - RNA, 15 nt, Homo sapiens
aggcaggcauuccug

SEQ ID NO: 2183465 - RNA, 15 nt, Homo sapiens
cuuuacguaucugcu

SEQ ID NO: 2183466 - RNA, 20 nt, Homo sapiens
auuccucccaccccaagcaa

SEQ ID NO: 2183467 - RNA, 13 nt, Homo sapiens
auggugggcucca

SEQ ID NO: 2183468 - RNA, 22 nt, Homo sapiens
ugauucuuccagauaauguccu

SEQ ID NO: 2183469 - RNA, 15 nt, Homo sapiens
aauacagugcuuuau

SEQ ID NO: 2183470 - RNA, 17 nt, Homo sapiens
uggggcccagacaccag

SEQ ID NO: 2183471 - RNA, 22 nt, Homo sapiens
cuagucuucuguguaugugaug

SEQ ID NO: 2183472 - RNA, 16 nt, Homo sapiens
gucccucugcucucag

SEQ ID NO: 2183473 - RNA, 16 nt, Homo sapiens
cugugauuacugcaau

SEQ ID NO: 2183474 - RNA, 23 nt, Homo sapiens
caagucccauugaaaaugaaugc

SEQ ID NO: 2183475 - RNA, 20 nt, Homo sapiens
cuuuaaaauuacaacuaagu

SEQ ID NO: 2183476 - RNA, 21 nt, Homo sapiens
cacucagaugcccaguaucau

SEQ ID NO: 2183477 - RNA, 22 nt, Homo sapiens
aggacaaagugccaaagaaagu

SEQ ID NO: 2183478 - RNA, 14 nt, Homo sapiens
guuguuuucugacu

SEQ ID NO: 2183479 - RNA, 14 nt, Homo sapiens
caugccuugagauc

SEQ ID NO: 2183480 - RNA, 18 nt, Homo sapiens
cuaguuaucagauccuuu

SEQ ID NO: 2183481 - RNA, 16 nt, Homo sapiens
uacaugagccagugau

SEQ ID NO: 2183482 - RNA, 12 nt, Homo sapiens
gaaucagaguau

SEQ ID NO: 2183483 - RNA, 16 nt, Homo sapiens
cauccaagcaaacuga

SEQ ID NO: 2183484 - RNA, 22 nt, Homo sapiens
aaccagaguuggagacucagca

SEQ ID NO: 2183485 - RNA, 15 nt, Homo sapiens
uuggugaacauugca

SEQ ID NO: 2183486 - RNA, 14 nt, Homo sapiens
ggaggucgacccca

SEQ ID NO: 2183487 - RNA, 18 nt, Homo sapiens
aucacagagacauuccuc

SEQ ID NO: 2183488 - RNA, 16 nt, Homo sapiens
uuagaaaaauuccuaa

SEQ ID NO: 2183489 - RNA, 13 nt, Homo sapiens
cacacacugaguu

SEQ ID NO: 2183490 - RNA, 17 nt, Homo sapiens
gcaguguuuucaccuca

SEQ ID NO: 2183491 - RNA, 18 nt, Homo sapiens
aagggcuucugcacccuc

SEQ ID NO: 2183492 - RNA, 19 nt, Homo sapiens
cuuccccuugcccuugccc

SEQ ID NO: 2183493 - RNA, 22 nt, Homo sapiens
ccgaauaaauguuuuauuucua

SEQ ID NO: 2183494 - RNA, 22 nt, Homo sapiens
agcacucccuaauuuaugugcu

SEQ ID NO: 2183495 - RNA, 14 nt, Homo sapiens
uacaggugugaguc

SEQ ID NO: 2183496 - RNA, 23 nt, Homo sapiens
gggccggguuggggguugcuaga

SEQ ID NO: 2183497 - RNA, 20 nt, Homo sapiens
ugaaaaccacagucagugga

SEQ ID NO: 2183498 - RNA, 21 nt, Homo sapiens
auggaccacagugacuuauuu

SEQ ID NO: 2183499 - RNA, 17 nt, Homo sapiens
gcuguauccauccaugg

SEQ ID NO: 2183500 - RNA, 17 nt, Homo sapiens
uucuccagauagcugaa

SEQ ID NO: 2183501 - RNA, 13 nt, Homo sapiens
uguauccaaagga

SEQ ID NO: 2183502 - RNA, 18 nt, Homo sapiens
gaagauccacauccucua

SEQ ID NO: 2183503 - RNA, 19 nt, Homo sapiens
cucucaugggguccaaguu

SEQ ID NO: 2183504 - RNA, 16 nt, Homo sapiens
cucaaaacugcacugu

SEQ ID NO: 2183505 - RNA, 13 nt, Homo sapiens
ccaggggugcaca

SEQ ID NO: 2183506 - RNA, 20 nt, Homo sapiens
aguuccuguaacaggugugg

SEQ ID NO: 2183507 - RNA, 21 nt, Homo sapiens
auccauagauuucgaagccac

SEQ ID NO: 2183508 - RNA, 17 nt, Homo sapiens
cugaggagggcccugag

SEQ ID NO: 2183509 - RNA, 20 nt, Homo sapiens
gaaguaggugugacuugaac

SEQ ID NO: 2183510 - RNA, 14 nt, Homo sapiens
gcagcuacuccccu

SEQ ID NO: 2183511 - RNA, 22 nt, Homo sapiens
uaaauacuguaaaugcauugga

SEQ ID NO: 2183512 - RNA, 19 nt, Homo sapiens
gucagaccaguacugggaa

SEQ ID NO: 2183513 - RNA, 20 nt, Homo sapiens
gcacugcucccuaccccagg

SEQ ID NO: 2183514 - RNA, 22 nt, Homo sapiens
ugaugcugccaggccugggacc

SEQ ID NO: 2183515 - RNA, 16 nt, Homo sapiens
gcaugaccacauagaa

SEQ ID NO: 2183516 - RNA, 14 nt, Homo sapiens
caaguaugccuuaa

SEQ ID NO: 2183517 - RNA, 10 nt, Homo sapiens
cuucacugac

SEQ ID NO: 2183518 - RNA, 19 nt, Homo sapiens
aauaaauggguaacacuga

SEQ ID NO: 2183519 - RNA, 24 nt, Homo sapiens
uauccacuuaccuagauucuacau

SEQ ID NO: 2183520 - RNA, 21 nt, Homo sapiens
ggacagccuccuucagcccuu

SEQ ID NO: 2183521 - RNA, 20 nt, Homo sapiens
aagccucuggucacauggcu

SEQ ID NO: 2183522 - RNA, 18 nt, Homo sapiens
cucaccaggguuuaguuu

SEQ ID NO: 2183523 - RNA, 21 nt, Homo sapiens
ugacacagcugagcuggccua

SEQ ID NO: 2183524 - RNA, 22 nt, Homo sapiens
guacccucgcaugacuguuaca

SEQ ID NO: 2183525 - RNA, 14 nt, Homo sapiens
aacccggcuuccug

SEQ ID NO: 2183526 - RNA, 19 nt, Homo sapiens
cauuugcauucaauuuaca

SEQ ID NO: 2183527 - RNA, 12 nt, Homo sapiens
gaaaaauuacuu

SEQ ID NO: 2183528 - RNA, 19 nt, Homo sapiens
caaauguuuugacaugaaa

SEQ ID NO: 2183529 - RNA, 19 nt, Homo sapiens
gacaucgucucugccacuc

SEQ ID NO: 2183530 - RNA, 15 nt, Homo sapiens
acauagaauugcaau

SEQ ID NO: 2183531 - RNA, 21 nt, Homo sapiens
gaacaaagugcuagacuuucu

SEQ ID NO: 2183532 - RNA, 18 nt, Homo sapiens
aagcauugagcaaagggg

SEQ ID NO: 2183533 - RNA, 15 nt, Homo sapiens
acuccuaugaucuga

SEQ ID NO: 2183534 - RNA, 12 nt, Homo sapiens
ccauuucuucag

SEQ ID NO: 2183535 - RNA, 22 nt, Homo sapiens
cacagaauuguuccaguacuau

SEQ ID NO: 2183536 - RNA, 23 nt, Homo sapiens
gcagcaaaauaauaaaauacuuc

SEQ ID NO: 2183537 - RNA, 15 nt, Homo sapiens
gcagcccucuugccc

SEQ ID NO: 2183538 - RNA, 16 nt, Homo sapiens
ugcaauggcaccaucu

SEQ ID NO: 2183539 - RNA, 16 nt, Homo sapiens
acguuguguauggccu

SEQ ID NO: 2183540 - RNA, 23 nt, Homo sapiens
uucucagcucccauuucuacucu

SEQ ID NO: 2183541 - RNA, 17 nt, Homo sapiens
uaccgggcuggccugug

SEQ ID NO: 2183542 - RNA, 21 nt, Homo sapiens
cuucaaagucucaaugaaaua

SEQ ID NO: 2183543 - RNA, 21 nt, Homo sapiens
ucacagcuggacccugcuuca

SEQ ID NO: 2183544 - RNA, 12 nt, Homo sapiens
gugaacacaaaa

SEQ ID NO: 2183545 - RNA, 12 nt, Homo sapiens
aaauacacgugu

SEQ ID NO: 2183546 - RNA, 18 nt, Homo sapiens
auuuaggaccaauaccuc

SEQ ID NO: 2183547 - RNA, 16 nt, Homo sapiens
aagccugucccaggac

SEQ ID NO: 2183548 - RNA, 18 nt, Homo sapiens
gugauuuucaaaaccagc

SEQ ID NO: 2183549 - RNA, 23 nt, Homo sapiens
cucuacuacuuuuacuacaguga

SEQ ID NO: 2183550 - RNA, 23 nt, Homo sapiens
ucuacacagcaguaugaaugaug

SEQ ID NO: 2183551 - RNA, 22 nt, Homo sapiens
ccuucuccacuggccggaguca

SEQ ID NO: 2183552 - RNA, 19 nt, Homo sapiens
ucuacugaccuuuguccuu

SEQ ID NO: 2183553 - RNA, 13 nt, Homo sapiens
cauuggaagccau

SEQ ID NO: 2183554 - RNA, 17 nt, Homo sapiens
cugcccgaaaagcauuu

SEQ ID NO: 2183555 - RNA, 22 nt, Homo sapiens
ucaugacagucagcaacaugau

SEQ ID NO: 2183556 - RNA, 16 nt, Homo sapiens
uccucucacucuucag

SEQ ID NO: 2183557 - RNA, 17 nt, Homo sapiens
uguugacauccaagcuu

SEQ ID NO: 2183558 - RNA, 15 nt, Homo sapiens
caggugcugccaucc

SEQ ID NO: 2183559 - RNA, 17 nt, Homo sapiens
cuuguagccagccgggg

SEQ ID NO: 2183560 - RNA, 15 nt, Homo sapiens
auauguucagauuau

SEQ ID NO: 2183561 - RNA, 23 nt, Homo sapiens
cuccaaccuggggggcaguggug

SEQ ID NO: 2183562 - RNA, 19 nt, Homo sapiens
ugcuuaccuacauacgugu

SEQ ID NO: 2183563 - RNA, 14 nt, Homo sapiens
augcugauaugauc

SEQ ID NO: 2183564 - RNA, 14 nt, Homo sapiens
ucaaagauucacac

SEQ ID NO: 2183565 - RNA, 14 nt, Homo sapiens
ugagcaccuacuua

SEQ ID NO: 2183566 - RNA, 12 nt, Homo sapiens
ucucauuugcca

SEQ ID NO: 2183567 - RNA, 18 nt, Homo sapiens
cugaggcagaaggauuac

SEQ ID NO: 2183568 - RNA, 14 nt, Homo sapiens
ccccaagacagucu

SEQ ID NO: 2183569 - RNA, 17 nt, Homo sapiens
agcgccagcucuaccag

SEQ ID NO: 2183570 - RNA, 19 nt, Homo sapiens
uucacauucagaaguaauu

SEQ ID NO: 2183571 - RNA, 19 nt, Homo sapiens
ggcagaguggccugugagc

SEQ ID NO: 2183572 - RNA, 22 nt, Homo sapiens
aagguugcugaggcucugaccc

SEQ ID NO: 2183573 - RNA, 21 nt, Homo sapiens
agucaaccugccugacauuug

SEQ ID NO: 2183574 - RNA, 13 nt, Homo sapiens
acuuauuuuacac

SEQ ID NO: 2183575 - RNA, 18 nt, Homo sapiens
uaccucagaaagauuuga

SEQ ID NO: 2183576 - RNA, 16 nt, Homo sapiens
uccuuaucagugccau

SEQ ID NO: 2183577 - RNA, 20 nt, Homo sapiens
auuggguccugggucuuuca

SEQ ID NO: 2183578 - RNA, 20 nt, Homo sapiens
aaaauccacuuuaucuugaa

SEQ ID NO: 2183579 - RNA, 15 nt, Homo sapiens
gccaguuauggcuau

SEQ ID NO: 2183580 - RNA, 13 nt, Homo sapiens
guaucugccaguc

SEQ ID NO: 2183581 - RNA, 21 nt, Homo sapiens
guguccauugaugucauucag

SEQ ID NO: 2183582 - RNA, 18 nt, Homo sapiens
ucagcaaacuccacaaag

SEQ ID NO: 2183583 - RNA, 13 nt, Homo sapiens
aaacuguuuauau

SEQ ID NO: 2183584 - RNA, 15 nt, Homo sapiens
gaacagggcaguuua

SEQ ID NO: 2183585 - RNA, 14 nt, Homo sapiens
agacagccaaaggc

SEQ ID NO: 2183586 - RNA, 14 nt, Homo sapiens
ccaaagugguauag

SEQ ID NO: 2183587 - RNA, 17 nt, Homo sapiens
auccaagacaaacuaaa

SEQ ID NO: 2183588 - RNA, 15 nt, Homo sapiens
uccagguuuuccacc

SEQ ID NO: 2183589 - RNA, 16 nt, Homo sapiens
aguuugguuucuagca

SEQ ID NO: 2183590 - RNA, 15 nt, Homo sapiens
ccuuuuaguucuuag

SEQ ID NO: 2183591 - RNA, 16 nt, Homo sapiens
ucagggugugggaucu

SEQ ID NO: 2183592 - RNA, 21 nt, Homo sapiens
uaaauuggaauuuucuuaccc

SEQ ID NO: 2183593 - RNA, 14 nt, Homo sapiens
ccuggagaugauga

SEQ ID NO: 2183594 - RNA, 15 nt, Homo sapiens
cuacaaaaugacuag

SEQ ID NO: 2183595 - RNA, 16 nt, Homo sapiens
agaacacacugaguga

SEQ ID NO: 2183596 - RNA, 14 nt, Homo sapiens
caccuaguucuccc

SEQ ID NO: 2183597 - RNA, 21 nt, Homo sapiens
cucuacuaaaaauaccaaaaa

SEQ ID NO: 2183598 - RNA, 13 nt, Homo sapiens
cagcgcgugcaca

SEQ ID NO: 2183599 - RNA, 16 nt, Homo sapiens
ccuacgacuaucugga

SEQ ID NO: 2183600 - RNA, 18 nt, Homo sapiens
aaaugcagggcacaugau

SEQ ID NO: 2183601 - RNA, 19 nt, Homo sapiens
acucuguaaaacgcaccaa

SEQ ID NO: 2183602 - RNA, 20 nt, Homo sapiens
cuuauaauuuaaaauaugcu

SEQ ID NO: 2183603 - RNA, 16 nt, Homo sapiens
cuugcgaacuagagau

SEQ ID NO: 2183604 - RNA, 14 nt, Homo sapiens
aaggcaaugcucaa

SEQ ID NO: 2183605 - RNA, 22 nt, Homo sapiens
uguuagccacggaaacauagaa

SEQ ID NO: 2183606 - RNA, 21 nt, Homo sapiens
acaccauaguuuacaauauua

SEQ ID NO: 2183607 - RNA, 19 nt, Homo sapiens
cugaggaaggaagauuuga

SEQ ID NO: 2183608 - RNA, 20 nt, Homo sapiens
cagggcuggucuuuuaggac

SEQ ID NO: 2183609 - RNA, 22 nt, Homo sapiens
gaugaagcccagccacauuuca

SEQ ID NO: 2183610 - RNA, 20 nt, Homo sapiens
ccauuuuccuucaccgugac

SEQ ID NO: 2183611 - RNA, 18 nt, Homo sapiens
gcaccugggcagcuccuc

SEQ ID NO: 2183612 - RNA, 15 nt, Homo sapiens
auuacugaugugaua

SEQ ID NO: 2183613 - RNA, 15 nt, Homo sapiens
uggacaaaauggaag

SEQ ID NO: 2183614 - RNA, 15 nt, Homo sapiens
uagcauggcugccaa

SEQ ID NO: 2183615 - RNA, 15 nt, Homo sapiens
uagacuggcugaaaa

SEQ ID NO: 2183616 - RNA, 21 nt, Homo sapiens
caccucaggaccaugugauaa

SEQ ID NO: 2183617 - RNA, 18 nt, Homo sapiens
aguaaauauauaugucaa

SEQ ID NO: 2183618 - RNA, 17 nt, Homo sapiens
guuuugcaugucugcau

SEQ ID NO: 2183619 - RNA, 13 nt, Homo sapiens
caucaaguucucc

SEQ ID NO: 2183620 - RNA, 17 nt, Homo sapiens
uucuuccuaccaaauau

SEQ ID NO: 2183621 - RNA, 17 nt, Homo sapiens
ccaacauuaaaacucau

SEQ ID NO: 2183622 - RNA, 16 nt, Homo sapiens
ugguuuuguacuggau

SEQ ID NO: 2183623 - RNA, 16 nt, Homo sapiens
ggccuggccagaugca

SEQ ID NO: 2183624 - RNA, 19 nt, Homo sapiens
cacccgugugaagaugaag

SEQ ID NO: 2183625 - RNA, 11 nt, Homo sapiens
acuacaguguu

SEQ ID NO: 2183626 - RNA, 12 nt, Homo sapiens
caauacauguau

SEQ ID NO: 2183627 - RNA, 18 nt, Homo sapiens
uucuuuccuucccaauag

SEQ ID NO: 2183628 - RNA, 20 nt, Homo sapiens
aagcauguuugguuuuccaa

SEQ ID NO: 2183629 - RNA, 14 nt, Homo sapiens
gaaugaacaaccuc

SEQ ID NO: 2183630 - RNA, 23 nt, Homo sapiens
gaaaggggagaaauaaacauaag

SEQ ID NO: 2183631 - RNA, 15 nt, Homo sapiens
acccagcaccuugca

SEQ ID NO: 2183632 - RNA, 16 nt, Homo sapiens
cucaguuucuaggcac

SEQ ID NO: 2183633 - RNA, 24 nt, Homo sapiens
aaacuuccauagcuucauccacug

SEQ ID NO: 2183634 - RNA, 13 nt, Homo sapiens
ggcuccucaccac

SEQ ID NO: 2183635 - RNA, 16 nt, Homo sapiens
ggguuacaaacugcaa

SEQ ID NO: 2183636 - RNA, 19 nt, Homo sapiens
uucaguguguugacuucua

SEQ ID NO: 2183637 - RNA, 15 nt, Homo sapiens
ucacuaggaggucau

SEQ ID NO: 2183638 - RNA, 13 nt, Homo sapiens
cugggcucacuca

SEQ ID NO: 2183639 - RNA, 15 nt, Homo sapiens
ccccugauguuugaa

SEQ ID NO: 2183640 - RNA, 21 nt, Homo sapiens
auaccuguugagacugauuca

SEQ ID NO: 2183641 - RNA, 18 nt, Homo sapiens
ggauaccagcaaauggau

SEQ ID NO: 2183642 - RNA, 17 nt, Homo sapiens
ucccauguugcaugccu

SEQ ID NO: 2183643 - RNA, 18 nt, Homo sapiens
agaaugagcuuacaaagu

SEQ ID NO: 2183644 - RNA, 13 nt, Homo sapiens
cccagcggcacca

SEQ ID NO: 2183645 - RNA, 13 nt, Homo sapiens
cuaggucagucuu

SEQ ID NO: 2183646 - RNA, 13 nt, Homo sapiens
ucauucacauuca

SEQ ID NO: 2183647 - RNA, 13 nt, Homo sapiens
uuuaauggcagca

SEQ ID NO: 2183648 - RNA, 12 nt, Homo sapiens
accaugcugcug

SEQ ID NO: 2183649 - RNA, 17 nt, Homo sapiens
cuuagcagcuuccagau

SEQ ID NO: 2183650 - RNA, 16 nt, Homo sapiens
gcccgggccccuggca

SEQ ID NO: 2183651 - RNA, 16 nt, Homo sapiens
caccuucagacuuugc

SEQ ID NO: 2183652 - RNA, 20 nt, Homo sapiens
ugcuccaaccgggaugggag

SEQ ID NO: 2183653 - RNA, 23 nt, Homo sapiens
accuuggagcgagucugccccag

SEQ ID NO: 2183654 - RNA, 16 nt, Homo sapiens
aaacuacaaagcugaa

SEQ ID NO: 2183655 - RNA, 23 nt, Homo sapiens
aaggacgugggccuccagaguug

SEQ ID NO: 2183656 - RNA, 19 nt, Homo sapiens
ccucuuagaagaaauauga

SEQ ID NO: 2183657 - RNA, 22 nt, Homo sapiens
aggaaaaaugaggaauccaaaa

SEQ ID NO: 2183658 - RNA, 14 nt, Homo sapiens
aaggucaaaacuga

SEQ ID NO: 2183659 - RNA, 21 nt, Homo sapiens
uuugacacaagguguaacuag

SEQ ID NO: 2183660 - RNA, 18 nt, Homo sapiens
cauauguggaacaagcag

SEQ ID NO: 2183661 - RNA, 17 nt, Homo sapiens
gagaaauaaaauaugga

SEQ ID NO: 2183662 - RNA, 21 nt, Homo sapiens
cagccagaggguagggcacaa

SEQ ID NO: 2183663 - RNA, 20 nt, Homo sapiens
gccauuguugagaauuagau

SEQ ID NO: 2183664 - RNA, 16 nt, Homo sapiens
ggccagcaccaucucu

SEQ ID NO: 2183665 - RNA, 14 nt, Homo sapiens
uacuacaugcacuu

SEQ ID NO: 2183666 - RNA, 14 nt, Homo sapiens
aacaaauacugaac

SEQ ID NO: 2183667 - RNA, 17 nt, Homo sapiens
gacccuuuucucaggac

SEQ ID NO: 2183668 - RNA, 18 nt, Homo sapiens
agugcuauggugggagag

SEQ ID NO: 2183669 - RNA, 14 nt, Homo sapiens
cccacaugggaccu

SEQ ID NO: 2183670 - RNA, 19 nt, Homo sapiens
uuaauccuuaacacauuca

SEQ ID NO: 2183671 - RNA, 14 nt, Homo sapiens
ccauuuuaaggaaa

SEQ ID NO: 2183672 - RNA, 19 nt, Homo sapiens
gagcagaagcuggaggcac

SEQ ID NO: 2183673 - RNA, 14 nt, Homo sapiens
aaaaauucaacuca

SEQ ID NO: 2183674 - RNA, 15 nt, Homo sapiens
cucguccccaaguga

SEQ ID NO: 2183675 - RNA, 21 nt, Homo sapiens
ugcuguugauaauaucucuca

SEQ ID NO: 2183676 - RNA, 17 nt, Homo sapiens
ccugaacuguugguauu

SEQ ID NO: 2183677 - RNA, 17 nt, Homo sapiens
acuugcaugcagcagcu

SEQ ID NO: 2183678 - RNA, 20 nt, Homo sapiens
uuaucaccuauccugaagau

SEQ ID NO: 2183679 - RNA, 15 nt, Homo sapiens
ucaggccaucaagga

SEQ ID NO: 2183680 - RNA, 14 nt, Homo sapiens
ugguccuugaacaa

SEQ ID NO: 2183681 - RNA, 14 nt, Homo sapiens
cagggccguugccc

SEQ ID NO: 2183682 - RNA, 16 nt, Homo sapiens
ggaggguaacagaaga

SEQ ID NO: 2183683 - RNA, 19 nt, Homo sapiens
gagcgccccucccuaguga

SEQ ID NO: 2183684 - RNA, 13 nt, Homo sapiens
caauuugaaauca

SEQ ID NO: 2183685 - RNA, 15 nt, Homo sapiens
aacuugggcuguaaa

SEQ ID NO: 2183686 - RNA, 14 nt, Homo sapiens
auauacacauugcu

SEQ ID NO: 2183687 - RNA, 21 nt, Homo sapiens
gcucaggccacauaauuggac

SEQ ID NO: 2183688 - RNA, 17 nt, Homo sapiens
acuuuuaaguugcugau

SEQ ID NO: 2183689 - RNA, 12 nt, Homo sapiens
augcucuugucc

SEQ ID NO: 2183690 - RNA, 23 nt, Homo sapiens
uaauaaauguaccuucacaccaa

SEQ ID NO: 2183691 - RNA, 20 nt, Homo sapiens
cuuuucuuuggucaaaguuu

SEQ ID NO: 2183692 - RNA, 21 nt, Homo sapiens
gacucacaccacuagccucag

SEQ ID NO: 2183693 - RNA, 23 nt, Homo sapiens
auuuuuguuuuuguaaugcacug

SEQ ID NO: 2183694 - RNA, 21 nt, Homo sapiens
guuuuguuuuuuauuuugccu

SEQ ID NO: 2183695 - RNA, 16 nt, Homo sapiens
gcccucccgcaccuuc

SEQ ID NO: 2183696 - RNA, 22 nt, Homo sapiens
uucaaaaacgcacugcaagaag

SEQ ID NO: 2183697 - RNA, 20 nt, Homo sapiens
cugucuuuaaaagucauuca

SEQ ID NO: 2183698 - RNA, 13 nt, Homo sapiens
aaaacuuaguuug

SEQ ID NO: 2183699 - RNA, 18 nt, Homo sapiens
cuccgggcaaauggcuga

SEQ ID NO: 2183700 - RNA, 18 nt, Homo sapiens
uccaugcaaguguuuuaa

SEQ ID NO: 2183701 - RNA, 20 nt, Homo sapiens
cuccagccugggcaacagag

SEQ ID NO: 2183702 - RNA, 12 nt, Homo sapiens
uccaugucaucc

SEQ ID NO: 2183703 - RNA, 23 nt, Homo sapiens
augcacgcacacaucagugcaca

SEQ ID NO: 2183704 - RNA, 14 nt, Homo sapiens
accuucugugcuca

SEQ ID NO: 2183705 - RNA, 22 nt, Homo sapiens
ugacugaagacaggcacaaaau

SEQ ID NO: 2183706 - RNA, 23 nt, Homo sapiens
ucccaacuccucaugucuucuca

SEQ ID NO: 2183707 - RNA, 21 nt, Homo sapiens
guuucguaacacagcauugua

SEQ ID NO: 2183708 - RNA, 23 nt, Homo sapiens
cauuaaaccugucuccacugugc

SEQ ID NO: 2183709 - RNA, 23 nt, Homo sapiens
cugggguacaaggggcccagugc

SEQ ID NO: 2183710 - RNA, 19 nt, Homo sapiens
cagcugaccugguacugag

SEQ ID NO: 2183711 - RNA, 18 nt, Homo sapiens
cuucuaggucacuucuca

SEQ ID NO: 2183712 - RNA, 20 nt, Homo sapiens
gucaacaauaaaaaccaaau

SEQ ID NO: 2183713 - RNA, 13 nt, Homo sapiens
gcagugagccaaa

SEQ ID NO: 2183714 - RNA, 12 nt, Homo sapiens
agucacuuccac

SEQ ID NO: 2183715 - RNA, 20 nt, Homo sapiens
gugccagagcuccaugcaug

SEQ ID NO: 2183716 - RNA, 15 nt, Homo sapiens
uuuauacaguugaaa

SEQ ID NO: 2183717 - RNA, 21 nt, Homo sapiens
cugccaggauugucacuccaa

SEQ ID NO: 2183718 - RNA, 17 nt, Homo sapiens
cugaugagaaucaugca

SEQ ID NO: 2183719 - RNA, 18 nt, Homo sapiens
ccucgggacaucaaaaac

SEQ ID NO: 2183720 - RNA, 18 nt, Homo sapiens
cuaaaagaaaaaggaacu

SEQ ID NO: 2183721 - RNA, 14 nt, Homo sapiens
aguggcucuguaag

SEQ ID NO: 2183722 - RNA, 16 nt, Homo sapiens
aacuauuuauuucacc

SEQ ID NO: 2183723 - RNA, 15 nt, Homo sapiens
aaaggcagugcaaua

SEQ ID NO: 2183724 - RNA, 15 nt, Homo sapiens
ucccuucuccaucuc

SEQ ID NO: 2183725 - RNA, 15 nt, Homo sapiens
aauagugguugccaa

SEQ ID NO: 2183726 - RNA, 18 nt, Homo sapiens
acucacuggcaucuuugc

SEQ ID NO: 2183727 - RNA, 19 nt, Homo sapiens
cuucuuaucacacuugcaa

SEQ ID NO: 2183728 - RNA, 12 nt, Homo sapiens
aaaaagcacaaa

SEQ ID NO: 2183729 - RNA, 18 nt, Homo sapiens
gaucagauaauuaugcuu

SEQ ID NO: 2183730 - RNA, 23 nt, Homo sapiens
aacauacuucuaaaauucccauu

SEQ ID NO: 2183731 - RNA, 13 nt, Homo sapiens
acucucaaaucca

SEQ ID NO: 2183732 - RNA, 13 nt, Homo sapiens
cuccacaaccucu

SEQ ID NO: 2183733 - RNA, 23 nt, Homo sapiens
ccuuacauuauuacuccuugcca

SEQ ID NO: 2183734 - RNA, 21 nt, Homo sapiens
agauguugauuuuuacugugu

SEQ ID NO: 2183735 - RNA, 14 nt, Homo sapiens
ucuucuuguugacc

SEQ ID NO: 2183736 - RNA, 18 nt, Homo sapiens
gugcccaucaagugcagu

SEQ ID NO: 2183737 - RNA, 14 nt, Homo sapiens
ccugagcacacugc

SEQ ID NO: 2183738 - RNA, 20 nt, Homo sapiens
ccauuguggaagacagugug

SEQ ID NO: 2183739 - RNA, 14 nt, Homo sapiens
aaaaguuaaacuac

SEQ ID NO: 2183740 - RNA, 14 nt, Homo sapiens
cucccuuugaugau

SEQ ID NO: 2183741 - RNA, 17 nt, Homo sapiens
cuccuucuccuagcucu

SEQ ID NO: 2183742 - RNA, 17 nt, Homo sapiens
uaaucggaguaucugaa

SEQ ID NO: 2183743 - RNA, 21 nt, Homo sapiens
aaccaccuuuccagccauaga

SEQ ID NO: 2183744 - RNA, 15 nt, Homo sapiens
aggaaggcucuucuc

SEQ ID NO: 2183745 - RNA, 14 nt, Homo sapiens
uaagaauaucuaau

SEQ ID NO: 2183746 - RNA, 21 nt, Homo sapiens
uagguaaguuggcucacauca

SEQ ID NO: 2183747 - RNA, 20 nt, Homo sapiens
aaaaguuagucaauccuguc

SEQ ID NO: 2183748 - RNA, 21 nt, Homo sapiens
agacuauggugcugccuugcu

SEQ ID NO: 2183749 - RNA, 14 nt, Homo sapiens
accucuacaggguu

SEQ ID NO: 2183750 - RNA, 16 nt, Homo sapiens
cuagauuuaugaauac

SEQ ID NO: 2183751 - RNA, 15 nt, Homo sapiens
acuugcaaguuuuca

SEQ ID NO: 2183752 - RNA, 19 nt, Homo sapiens
uacaaaauccaacucucug

SEQ ID NO: 2183753 - RNA, 19 nt, Homo sapiens
guucccuugcagggguccc

SEQ ID NO: 2183754 - RNA, 21 nt, Homo sapiens
cuccccuaaagccaggcucag

SEQ ID NO: 2183755 - RNA, 16 nt, Homo sapiens
uggucgcuuugccauc

SEQ ID NO: 2183756 - RNA, 17 nt, Homo sapiens
uucacucacaacacuua

SEQ ID NO: 2183757 - RNA, 20 nt, Homo sapiens
uuaacuccguuuccaaauac

SEQ ID NO: 2183758 - RNA, 20 nt, Homo sapiens
agcuacaaaacaauucaauu

SEQ ID NO: 2183759 - RNA, 20 nt, Homo sapiens
acaaagaaaaaaaaucuuau

SEQ ID NO: 2183760 - RNA, 22 nt, Homo sapiens
gcaguggcgugaucucggcuca

SEQ ID NO: 2183761 - RNA, 15 nt, Homo sapiens
cauguuucacagugg

SEQ ID NO: 2183762 - RNA, 17 nt, Homo sapiens
acacaggaguccuuucu

SEQ ID NO: 2183763 - RNA, 20 nt, Homo sapiens
ucaggcauuuuuccaaagga

SEQ ID NO: 2183764 - RNA, 17 nt, Homo sapiens
uggccacacugggcuca

SEQ ID NO: 2183765 - RNA, 18 nt, Homo sapiens
acucuggaccauauacca

SEQ ID NO: 2183766 - RNA, 13 nt, Homo sapiens
gcaugucucaggc

SEQ ID NO: 2183767 - RNA, 16 nt, Homo sapiens
cagccugucuugucag

SEQ ID NO: 2183768 - RNA, 21 nt, Homo sapiens
gcagaugcguccgaagggaaa

SEQ ID NO: 2183769 - RNA, 19 nt, Homo sapiens
agauuagucucuucugugu

SEQ ID NO: 2183770 - RNA, 14 nt, Homo sapiens
cauccuagugagaa

SEQ ID NO: 2183771 - RNA, 23 nt, Homo sapiens
acuggacaggcaaagacugcagu

SEQ ID NO: 2183772 - RNA, 18 nt, Homo sapiens
uucaaggccuggggagcc

SEQ ID NO: 2183773 - RNA, 14 nt, Homo sapiens
uucauugcauuuau

SEQ ID NO: 2183774 - RNA, 18 nt, Homo sapiens
aggacacaguggagccca

SEQ ID NO: 2183775 - RNA, 17 nt, Homo sapiens
cauggcucccccuccac

SEQ ID NO: 2183776 - RNA, 18 nt, Homo sapiens
agccgcugcugagcugcg

SEQ ID NO: 2183777 - RNA, 13 nt, Homo sapiens
caugagaaaucau

SEQ ID NO: 2183778 - RNA, 21 nt, Homo sapiens
ccacaaucacuaaauaucuag

SEQ ID NO: 2183779 - RNA, 21 nt, Homo sapiens
aagaggacuuuuuugauuaag

SEQ ID NO: 2183780 - RNA, 18 nt, Homo sapiens
acuagggcacaucuggau

SEQ ID NO: 2183781 - RNA, 15 nt, Homo sapiens
ucugccuucucagga

SEQ ID NO: 2183782 - RNA, 19 nt, Homo sapiens
uauuagaaaggacuguaaa

SEQ ID NO: 2183783 - RNA, 11 nt, Homo sapiens
uaaaccuggag

SEQ ID NO: 2183784 - RNA, 13 nt, Homo sapiens
agugaaaccauga

SEQ ID NO: 2183785 - RNA, 16 nt, Homo sapiens
agaaauuaaacauauu

SEQ ID NO: 2183786 - RNA, 17 nt, Homo sapiens
cuccguggaacauucug

SEQ ID NO: 2183787 - RNA, 17 nt, Homo sapiens
ucgcugucccccaacac

SEQ ID NO: 2183788 - RNA, 20 nt, Homo sapiens
uaggaaaauuagaagcaagc

SEQ ID NO: 2183789 - RNA, 19 nt, Homo sapiens
ccucaacaagcaagaucug

SEQ ID NO: 2183790 - RNA, 19 nt, Homo sapiens
uaaaagcccaggagcccau

SEQ ID NO: 2183791 - RNA, 21 nt, Homo sapiens
auuuguauauauuuuauaugu

SEQ ID NO: 2183792 - RNA, 23 nt, Homo sapiens
augagccauuuuuugagucuccu

SEQ ID NO: 2183793 - RNA, 21 nt, Homo sapiens
gcguuauaguaacucccauca

SEQ ID NO: 2183794 - RNA, 12 nt, Homo sapiens
gaugcauuuaau

SEQ ID NO: 2183795 - RNA, 13 nt, Homo sapiens
uguguaugugcgu

SEQ ID NO: 2183796 - RNA, 13 nt, Homo sapiens
aauugaugaacug

SEQ ID NO: 2183797 - RNA, 19 nt, Homo sapiens
gacaguuuacuuugccaac

SEQ ID NO: 2183798 - RNA, 13 nt, Homo sapiens
aagccucucucuc

SEQ ID NO: 2183799 - RNA, 10 nt, Homo sapiens
ccacagccuc

SEQ ID NO: 2183800 - RNA, 19 nt, Homo sapiens
auugagauaauaucuguga

SEQ ID NO: 2183801 - RNA, 22 nt, Homo sapiens
agucacuuuuuccccugcaaug

SEQ ID NO: 2183802 - RNA, 16 nt, Homo sapiens
aaaguuuugaguguua

SEQ ID NO: 2183803 - RNA, 21 nt, Homo sapiens
cuuuaaaacugcucauuucau

SEQ ID NO: 2183804 - RNA, 21 nt, Homo sapiens
gugccaggcuguaagcauucu

SEQ ID NO: 2183805 - RNA, 18 nt, Homo sapiens
uacugccucggaucucuc

SEQ ID NO: 2183806 - RNA, 22 nt, Homo sapiens
ucuguaccacacuagaauucau

SEQ ID NO: 2183807 - RNA, 23 nt, Homo sapiens
ggggaaaagaagcacccagaccc

SEQ ID NO: 2183808 - RNA, 14 nt, Homo sapiens
cuggugcuccaguu

SEQ ID NO: 2183809 - RNA, 23 nt, Homo sapiens
acagaagacagcagcaagugugc

SEQ ID NO: 2183810 - RNA, 13 nt, Homo sapiens
ucagccaaaggga

SEQ ID NO: 2183811 - RNA, 14 nt, Homo sapiens
uccaagacagccac

SEQ ID NO: 2183812 - RNA, 22 nt, Homo sapiens
agaccuggucgucgucuugacu

SEQ ID NO: 2183813 - RNA, 15 nt, Homo sapiens
agggacaagcauguu

SEQ ID NO: 2183814 - RNA, 21 nt, Homo sapiens
uuaguagagacggguuucacc

SEQ ID NO: 2183815 - RNA, 23 nt, Homo sapiens
cauggagaaugcaccauacucau

SEQ ID NO: 2183816 - RNA, 23 nt, Homo sapiens
agcagguuucaaggaaguagaaa

SEQ ID NO: 2183817 - RNA, 12 nt, Homo sapiens
uuaaaaagaagu

SEQ ID NO: 2183818 - RNA, 23 nt, Homo sapiens
cagcacacacuuccauaugucau

SEQ ID NO: 2183819 - RNA, 13 nt, Homo sapiens
auauauacauggg

SEQ ID NO: 2183820 - RNA, 19 nt, Homo sapiens
uaauggaagcaucuagcau

SEQ ID NO: 2183821 - RNA, 15 nt, Homo sapiens
uauucuaggucugua

SEQ ID NO: 2183822 - RNA, 20 nt, Homo sapiens
cagugagccgagaucaugcc

SEQ ID NO: 2183823 - RNA, 18 nt, Homo sapiens
ccaccucugcaggggaga

SEQ ID NO: 2183824 - RNA, 21 nt, Homo sapiens
ugcuaaaugcuacauacucca

SEQ ID NO: 2183825 - RNA, 19 nt, Homo sapiens
ccauauucccacagcacua

SEQ ID NO: 2183826 - RNA, 17 nt, Homo sapiens
ugacccccugcugccau

SEQ ID NO: 2183827 - RNA, 14 nt, Homo sapiens
uuucuaagaauuua

SEQ ID NO: 2183828 - RNA, 12 nt, Homo sapiens
cugcucugcaag

SEQ ID NO: 2183829 - RNA, 20 nt, Homo sapiens
acugugucagggaacauauu

SEQ ID NO: 2183830 - RNA, 12 nt, Homo sapiens
acugcugugaaa

SEQ ID NO: 2183831 - RNA, 12 nt, Homo sapiens
acacucaugcug

SEQ ID NO: 2183832 - RNA, 17 nt, Homo sapiens
acagaaagacugagcuc

SEQ ID NO: 2183833 - RNA, 19 nt, Homo sapiens
cuuccuggaguacaaacac

SEQ ID NO: 2183834 - RNA, 16 nt, Homo sapiens
cucuuccuggacagug

SEQ ID NO: 2183835 - RNA, 15 nt, Homo sapiens
ccgaagugcaaugau

SEQ ID NO: 2183836 - RNA, 22 nt, Homo sapiens
uuucauccggggcuuugccaga

SEQ ID NO: 2183837 - RNA, 21 nt, Homo sapiens
auuuguuuaugaaauguuaca

SEQ ID NO: 2183838 - RNA, 22 nt, Homo sapiens
uuuguauacccugaagaacucu

SEQ ID NO: 2183839 - RNA, 15 nt, Homo sapiens
ugaauugccugccau

SEQ ID NO: 2183840 - RNA, 22 nt, Homo sapiens
uugagcaucuauuuuaccauau

SEQ ID NO: 2183841 - RNA, 18 nt, Homo sapiens
ugcuuuuccucaagcaau

SEQ ID NO: 2183842 - RNA, 21 nt, Homo sapiens
auugucuuaaauaaaucaaga

SEQ ID NO: 2183843 - RNA, 19 nt, Homo sapiens
cgagacccuggauggggcu

SEQ ID NO: 2183844 - RNA, 12 nt, Homo sapiens
cgcuguggcucc

SEQ ID NO: 2183845 - RNA, 14 nt, Homo sapiens
ugacugucagggag

SEQ ID NO: 2183846 - RNA, 11 nt, Homo sapiens
uguccaaagac

SEQ ID NO: 2183847 - RNA, 22 nt, Homo sapiens
cagcuuuugccuugguucuucc

SEQ ID NO: 2183848 - RNA, 22 nt, Homo sapiens
cuaagauuacaggcgugagcca

SEQ ID NO: 2183849 - RNA, 22 nt, Homo sapiens
aguuuuucaauuaguaacauuc

SEQ ID NO: 2183850 - RNA, 16 nt, Homo sapiens
gaagcuguucucagga

SEQ ID NO: 2183851 - RNA, 14 nt, Homo sapiens
cuuuuccagaguau

SEQ ID NO: 2183852 - RNA, 13 nt, Homo sapiens
cauagcacuugcc

SEQ ID NO: 2183853 - RNA, 19 nt, Homo sapiens
ucuccaacuuggucuuuca

SEQ ID NO: 2183854 - RNA, 15 nt, Homo sapiens
ugucuuauuguccca

SEQ ID NO: 2183855 - RNA, 16 nt, Homo sapiens
gaaaccaguucaugca

SEQ ID NO: 2183856 - RNA, 14 nt, Homo sapiens
agcuauuuccauuc

SEQ ID NO: 2183857 - RNA, 15 nt, Homo sapiens
cuagcccuugcugcc

SEQ ID NO: 2183858 - RNA, 24 nt, Homo sapiens
gcacauugucaccccaagccauag

SEQ ID NO: 2183859 - RNA, 21 nt, Homo sapiens
aguaaggaacggcccuuuuag

SEQ ID NO: 2183860 - RNA, 19 nt, Homo sapiens
aagaagcacugggugacca

SEQ ID NO: 2183861 - RNA, 18 nt, Homo sapiens
cggcaaaugcgcacgacc

SEQ ID NO: 2183862 - RNA, 18 nt, Homo sapiens
caauauuuuuauaucaug

SEQ ID NO: 2183863 - RNA, 23 nt, Homo sapiens
agcacuccugauuuuuaucuaga

SEQ ID NO: 2183864 - RNA, 16 nt, Homo sapiens
agacagcuuacugcag

SEQ ID NO: 2183865 - RNA, 23 nt, Homo sapiens
acccuauuccucaaucuuuuacc

SEQ ID NO: 2183866 - RNA, 20 nt, Homo sapiens
agccaagagugcacuacugu

SEQ ID NO: 2183867 - RNA, 15 nt, Homo sapiens
acuggaggugggcau

SEQ ID NO: 2183868 - RNA, 16 nt, Homo sapiens
gcacaaaagccucuca

SEQ ID NO: 2183869 - RNA, 18 nt, Homo sapiens
augaggaccuccuacccc

SEQ ID NO: 2183870 - RNA, 17 nt, Homo sapiens
aacgccgagugcacugc

SEQ ID NO: 2183871 - RNA, 19 nt, Homo sapiens
uggcuuuggguagugccau

SEQ ID NO: 2183872 - RNA, 17 nt, Homo sapiens
gcccccacuccagucca

SEQ ID NO: 2183873 - RNA, 21 nt, Homo sapiens
cagcccucuucugacacuaaa

SEQ ID NO: 2183874 - RNA, 22 nt, Homo sapiens
aaaugggaaaccaguucaugca

SEQ ID NO: 2183875 - RNA, 15 nt, Homo sapiens
cuugcagaacuguag

SEQ ID NO: 2183876 - RNA, 17 nt, Homo sapiens
uccgcgcaggugccaac

SEQ ID NO: 2183877 - RNA, 15 nt, Homo sapiens
uggucaaagcaacug

SEQ ID NO: 2183878 - RNA, 20 nt, Homo sapiens
auuuauuuuguguuguucau

SEQ ID NO: 2183879 - RNA, 19 nt, Homo sapiens
uugacuuuccccaccagau

SEQ ID NO: 2183880 - RNA, 17 nt, Homo sapiens
acucagcacucagagac

SEQ ID NO: 2183881 - RNA, 20 nt, Homo sapiens
cucucaugguacuuccucug

SEQ ID NO: 2183882 - RNA, 22 nt, Homo sapiens
uuuccuaucauguuaaccucug

SEQ ID NO: 2183883 - RNA, 20 nt, Homo sapiens
caaaugcaguccagugagaa

SEQ ID NO: 2183884 - RNA, 17 nt, Homo sapiens
cagagugagugagacuc

SEQ ID NO: 2183885 - RNA, 19 nt, Homo sapiens
augccacgagaucaacaca

SEQ ID NO: 2183886 - RNA, 13 nt, Homo sapiens
augacuccuacuu

SEQ ID NO: 2183887 - RNA, 14 nt, Homo sapiens
ugccaucaccgcug

SEQ ID NO: 2183888 - RNA, 21 nt, Homo sapiens
agauucucuuguauaagaucc

SEQ ID NO: 2183889 - RNA, 23 nt, Homo sapiens
aauaguccaccucccauuacuuu

SEQ ID NO: 2183890 - RNA, 15 nt, Homo sapiens
ucaucauugauuguu

SEQ ID NO: 2183891 - RNA, 20 nt, Homo sapiens
cuguauuuuacaagucaaaa

SEQ ID NO: 2183892 - RNA, 14 nt, Homo sapiens
uaauuaacauauca

SEQ ID NO: 2183893 - RNA, 23 nt, Homo sapiens
ccaacauuacuccauuacuaaag

SEQ ID NO: 2183894 - RNA, 13 nt, Homo sapiens
auccugauuccuc

SEQ ID NO: 2183895 - RNA, 15 nt, Homo sapiens
cagccaggaggggcu

SEQ ID NO: 2183896 - RNA, 10 nt, Homo sapiens
uuuguaaaac

SEQ ID NO: 2183897 - RNA, 18 nt, Homo sapiens
aaggaaaaaaccauccag

SEQ ID NO: 2183898 - RNA, 21 nt, Homo sapiens
gccagcauauauacuugcaag

SEQ ID NO: 2183899 - RNA, 16 nt, Homo sapiens
agauccuaggugcugg

SEQ ID NO: 2183900 - RNA, 22 nt, Homo sapiens
cagggcaacauaauaagacuuu

SEQ ID NO: 2183901 - RNA, 21 nt, Homo sapiens
ggggcccuuggccccagagga

SEQ ID NO: 2183902 - RNA, 19 nt, Homo sapiens
aacauugcaauaaauggcu

SEQ ID NO: 2183903 - RNA, 13 nt, Homo sapiens
aacacagaggcag

SEQ ID NO: 2183904 - RNA, 12 nt, Homo sapiens
uuuaacauuucc

SEQ ID NO: 2183905 - RNA, 20 nt, Homo sapiens
agcacuuugggagacugaag

SEQ ID NO: 2183906 - RNA, 19 nt, Homo sapiens
gaaguugugcuaaaccaag

SEQ ID NO: 2183907 - RNA, 16 nt, Homo sapiens
ucccucucucccugcc

SEQ ID NO: 2183908 - RNA, 20 nt, Homo sapiens
ucuuucaauccacaguauug

SEQ ID NO: 2183909 - RNA, 22 nt, Homo sapiens
auauguagcccucaugauaauc

SEQ ID NO: 2183910 - RNA, 14 nt, Homo sapiens
accuuguuuugcca

SEQ ID NO: 2183911 - RNA, 15 nt, Homo sapiens
acucucaaauccaaa

SEQ ID NO: 2183912 - RNA, 19 nt, Homo sapiens
uauuucaaccagcacauuc

SEQ ID NO: 2183913 - RNA, 14 nt, Homo sapiens
gaaaauugcaugaa

SEQ ID NO: 2183914 - RNA, 15 nt, Homo sapiens
aagcaccuguuaaua

SEQ ID NO: 2183915 - RNA, 19 nt, Homo sapiens
aguaagauuaaguuaggca

SEQ ID NO: 2183916 - RNA, 16 nt, Homo sapiens
ugccugugauuuccua

SEQ ID NO: 2183917 - RNA, 23 nt, Homo sapiens
acagcccuccacuccagcucuga

SEQ ID NO: 2183918 - RNA, 22 nt, Homo sapiens
ggcuuuaugcaaauacaaucag

SEQ ID NO: 2183919 - RNA, 19 nt, Homo sapiens
gacugugauucuuagcaaa

SEQ ID NO: 2183920 - RNA, 13 nt, Homo sapiens
cuggacagcacuc

SEQ ID NO: 2183921 - RNA, 16 nt, Homo sapiens
aauuagguagcacagc

SEQ ID NO: 2183922 - RNA, 17 nt, Homo sapiens
auaaaguaccauuaguu

SEQ ID NO: 2183923 - RNA, 17 nt, Homo sapiens
ucuagaaaggaguguga

SEQ ID NO: 2183924 - RNA, 19 nt, Homo sapiens
uucuccucaugcuuagaaa

SEQ ID NO: 2183925 - RNA, 16 nt, Homo sapiens
uggacuguaacugacu

SEQ ID NO: 2183926 - RNA, 22 nt, Homo sapiens
agcagaccuaccugcaguggga

SEQ ID NO: 2183927 - RNA, 16 nt, Homo sapiens
aagacauccucaaaag

SEQ ID NO: 2183928 - RNA, 17 nt, Homo sapiens
cuuugaagaccaguccu

SEQ ID NO: 2183929 - RNA, 17 nt, Homo sapiens
cauccucacugcuguca

SEQ ID NO: 2183930 - RNA, 15 nt, Homo sapiens
ggcauucuucuuauu

SEQ ID NO: 2183931 - RNA, 15 nt, Homo sapiens
ugcaaacugcuuuau

SEQ ID NO: 2183932 - RNA, 19 nt, Homo sapiens
agaagccagcuuguuuaca

SEQ ID NO: 2183933 - RNA, 17 nt, Homo sapiens
caccaaggagcuacacu

SEQ ID NO: 2183934 - RNA, 23 nt, Homo sapiens
agcaugaauaacauuuaaauucc

SEQ ID NO: 2183935 - RNA, 22 nt, Homo sapiens
uggaacaucaucaaggcacugc

SEQ ID NO: 2183936 - RNA, 18 nt, Homo sapiens
agccuguccaacauggug

SEQ ID NO: 2183937 - RNA, 17 nt, Homo sapiens
acagggugguggcacau

SEQ ID NO: 2183938 - RNA, 21 nt, Homo sapiens
caccucacugcaguagugcac

SEQ ID NO: 2183939 - RNA, 22 nt, Homo sapiens
uacagcuuuuggauuggacaaa

SEQ ID NO: 2183940 - RNA, 14 nt, Homo sapiens
ugagcuugcucauu

SEQ ID NO: 2183941 - RNA, 17 nt, Homo sapiens
ucaagauucccacuccc

SEQ ID NO: 2183942 - RNA, 16 nt, Homo sapiens
agcccccuuuucuuga

SEQ ID NO: 2183943 - RNA, 22 nt, Homo sapiens
cuaugcagaacagugagccaaa

SEQ ID NO: 2183944 - RNA, 21 nt, Homo sapiens
uugaaguuuuagcggucaauu

SEQ ID NO: 2183945 - RNA, 23 nt, Homo sapiens
ggaggcccaucccccaccugcca

SEQ ID NO: 2183946 - RNA, 17 nt, Homo sapiens
agcccaccugcacccag

SEQ ID NO: 2183947 - RNA, 20 nt, Homo sapiens
cucauuuugcucaacauggu

SEQ ID NO: 2183948 - RNA, 22 nt, Homo sapiens
ggaaccagggccucccuguuca

SEQ ID NO: 2183949 - RNA, 21 nt, Homo sapiens
agacccagccaugcugugaua

SEQ ID NO: 2183950 - RNA, 23 nt, Homo sapiens
cugugaagcccuuugccuguaga

SEQ ID NO: 2183951 - RNA, 22 nt, Homo sapiens
ccccucagagaggcaugugaug

SEQ ID NO: 2183952 - RNA, 19 nt, Homo sapiens
ugucuguuuggaagaccag

SEQ ID NO: 2183953 - RNA, 17 nt, Homo sapiens
uucaacaugcuccaaau

SEQ ID NO: 2183954 - RNA, 16 nt, Homo sapiens
cugagggaaagugcau

SEQ ID NO: 2183955 - RNA, 16 nt, Homo sapiens
agcuguccacacugaa

SEQ ID NO: 2183956 - RNA, 13 nt, Homo sapiens
agccgugaacugu

SEQ ID NO: 2183957 - RNA, 17 nt, Homo sapiens
cuauaccaauaaaguga

SEQ ID NO: 2183958 - RNA, 21 nt, Homo sapiens
uaaaauaacuaacaaacagau

SEQ ID NO: 2183959 - RNA, 13 nt, Homo sapiens
uuugaugaacugu

SEQ ID NO: 2183960 - RNA, 13 nt, Homo sapiens
uccuucacauuua

SEQ ID NO: 2183961 - RNA, 12 nt, Homo sapiens
gacagugcagug

SEQ ID NO: 2183962 - RNA, 21 nt, Homo sapiens
aucucugggggcugaggagca

SEQ ID NO: 2183963 - RNA, 18 nt, Homo sapiens
gaaaaugaauuuuuucca

SEQ ID NO: 2183964 - RNA, 19 nt, Homo sapiens
guuuacucuagacuaaaga

SEQ ID NO: 2183965 - RNA, 20 nt, Homo sapiens
auauucucuauuuuacuuuu

SEQ ID NO: 2183966 - RNA, 17 nt, Homo sapiens
aucacuguaaugaguca

SEQ ID NO: 2183967 - RNA, 19 nt, Homo sapiens
cacccacccuguggcucac

SEQ ID NO: 2183968 - RNA, 13 nt, Homo sapiens
cagccccacccuu

SEQ ID NO: 2183969 - RNA, 23 nt, Homo sapiens
cucaagcccgcggggacauuggg

SEQ ID NO: 2183970 - RNA, 12 nt, Homo sapiens
uaguugccaauc

SEQ ID NO: 2183971 - RNA, 24 nt, Homo sapiens
ggauaugcugcuuuaaacuuggaa

SEQ ID NO: 2183972 - RNA, 14 nt, Homo sapiens
aaaccuacacagcu

SEQ ID NO: 2183973 - RNA, 14 nt, Homo sapiens
caauaagugccauu

SEQ ID NO: 2183974 - RNA, 11 nt, Homo sapiens
ucucuacuguc

SEQ ID NO: 2183975 - RNA, 18 nt, Homo sapiens
agcuggaucgcugcacau

SEQ ID NO: 2183976 - RNA, 15 nt, Homo sapiens
gcuuuaaaagucauu

SEQ ID NO: 2183977 - RNA, 16 nt, Homo sapiens
uaaaucuuucucucac

SEQ ID NO: 2183978 - RNA, 21 nt, Homo sapiens
cuucuaagguagcugcagaua

SEQ ID NO: 2183979 - RNA, 19 nt, Homo sapiens
gucacagccucaagucacu

SEQ ID NO: 2183980 - RNA, 10 nt, Homo sapiens
uuuaagguga

SEQ ID NO: 2183981 - RNA, 19 nt, Homo sapiens
cccuuauucuaaagcugcc

SEQ ID NO: 2183982 - RNA, 20 nt, Homo sapiens
caguaacugugcuguacuga

SEQ ID NO: 2183983 - RNA, 17 nt, Homo sapiens
agugucgaguccagucc

SEQ ID NO: 2183984 - RNA, 19 nt, Homo sapiens
gguuaaauaccuguguuca

SEQ ID NO: 2183985 - RNA, 21 nt, Homo sapiens
uuaacagauggaaaaacugag

SEQ ID NO: 2183986 - RNA, 21 nt, Homo sapiens
ucuauauaguuccuugccuua

SEQ ID NO: 2183987 - RNA, 16 nt, Homo sapiens
gagaugaccccaucaa

SEQ ID NO: 2183988 - RNA, 13 nt, Homo sapiens
auuuaacuucuga

SEQ ID NO: 2183989 - RNA, 14 nt, Homo sapiens
gauggcagcuuuua

SEQ ID NO: 2183990 - RNA, 18 nt, Homo sapiens
ugccugaagccaggccau

SEQ ID NO: 2183991 - RNA, 13 nt, Homo sapiens
ugaauggucucag

SEQ ID NO: 2183992 - RNA, 16 nt, Homo sapiens
ucguccugcaguguga

SEQ ID NO: 2183993 - RNA, 17 nt, Homo sapiens
auuuugauuauauacuu

SEQ ID NO: 2183994 - RNA, 19 nt, Homo sapiens
aggcgcagagacagugugu

SEQ ID NO: 2183995 - RNA, 15 nt, Homo sapiens
cccauuauagcacaa

SEQ ID NO: 2183996 - RNA, 19 nt, Homo sapiens
cuucuuuacuaacacuggc

SEQ ID NO: 2183997 - RNA, 19 nt, Homo sapiens
uacccuugguuugcacaua

SEQ ID NO: 2183998 - RNA, 18 nt, Homo sapiens
ugacuuuugaagaacaaa

SEQ ID NO: 2183999 - RNA, 21 nt, Homo sapiens
auuuccuuuuguccacuugua

SEQ ID NO: 2184000 - RNA, 15 nt, Homo sapiens
cacugugaaaccacu

SEQ ID NO: 2184001 - RNA, 18 nt, Homo sapiens
ccaaggauggaccacaca

SEQ ID NO: 2184002 - RNA, 16 nt, Homo sapiens
ugaauaggaauauuca

SEQ ID NO: 2184003 - RNA, 17 nt, Homo sapiens
gguggaggcugcaguga

SEQ ID NO: 2184004 - RNA, 20 nt, Homo sapiens
uagcaaaucuacugucaauu

SEQ ID NO: 2184005 - RNA, 19 nt, Homo sapiens
uguaaauguugugcuguua

SEQ ID NO: 2184006 - RNA, 13 nt, Homo sapiens
acucuaaacugca

SEQ ID NO: 2184007 - RNA, 17 nt, Homo sapiens
gaagagccugacugugu

SEQ ID NO: 2184008 - RNA, 18 nt, Homo sapiens
caaaugaaacacuuucag

SEQ ID NO: 2184009 - RNA, 14 nt, Homo sapiens
augaccgacugcac

SEQ ID NO: 2184010 - RNA, 20 nt, Homo sapiens
uuauaaauuggagaugcaaa

SEQ ID NO: 2184011 - RNA, 15 nt, Homo sapiens
agcuagacugaacca

SEQ ID NO: 2184012 - RNA, 16 nt, Homo sapiens
cuucccauuggcuuuc

SEQ ID NO: 2184013 - RNA, 17 nt, Homo sapiens
ugcuggcuccaaacuuc

SEQ ID NO: 2184014 - RNA, 12 nt, Homo sapiens
uucaagcccagg

SEQ ID NO: 2184015 - RNA, 10 nt, Homo sapiens
uguugccagc

SEQ ID NO: 2184016 - RNA, 20 nt, Homo sapiens
ucacuguugcuuaauuguga

SEQ ID NO: 2184017 - RNA, 12 nt, Homo sapiens
ugucacaucucu

SEQ ID NO: 2184018 - RNA, 18 nt, Homo sapiens
aucuguaaggaacuggaa

SEQ ID NO: 2184019 - RNA, 20 nt, Homo sapiens
gcuuuggucucuucuuucau

SEQ ID NO: 2184020 - RNA, 20 nt, Homo sapiens
acgucaggagaggccagcug

SEQ ID NO: 2184021 - RNA, 23 nt, Homo sapiens
uguuccuguugaaucuugcacau

SEQ ID NO: 2184022 - RNA, 15 nt, Homo sapiens
ucaguccuuugauca

SEQ ID NO: 2184023 - RNA, 16 nt, Homo sapiens
acacgaugcauuuaau

SEQ ID NO: 2184024 - RNA, 14 nt, Homo sapiens
aauagcaguuucac

SEQ ID NO: 2184025 - RNA, 14 nt, Homo sapiens
uacagcagauccac

SEQ ID NO: 2184026 - RNA, 23 nt, Homo sapiens
caaaacucucugguuuacuucaa

SEQ ID NO: 2184027 - RNA, 21 nt, Homo sapiens
gaccagaggagcagaccagca

SEQ ID NO: 2184028 - RNA, 14 nt, Homo sapiens
cagcauacuucaaa

SEQ ID NO: 2184029 - RNA, 22 nt, Homo sapiens
ucucugaacuaggugaucucag

SEQ ID NO: 2184030 - RNA, 18 nt, Homo sapiens
cauguuuuguugcucagu

SEQ ID NO: 2184031 - RNA, 21 nt, Homo sapiens
auaaaacauucagucugacaa

SEQ ID NO: 2184032 - RNA, 18 nt, Homo sapiens
ggggacaauaugugccaa

SEQ ID NO: 2184033 - RNA, 18 nt, Homo sapiens
ccuuuuggcauguuccca

SEQ ID NO: 2184034 - RNA, 15 nt, Homo sapiens
agcacuuuaaccaau

SEQ ID NO: 2184035 - RNA, 15 nt, Homo sapiens
uacccuguugcaaag

SEQ ID NO: 2184036 - RNA, 21 nt, Homo sapiens
acgaauggcagcauacacaga

SEQ ID NO: 2184037 - RNA, 21 nt, Homo sapiens
cuguguuucagccacacugaa

SEQ ID NO: 2184038 - RNA, 22 nt, Homo sapiens
accagaaaaaauaaauguucau

SEQ ID NO: 2184039 - RNA, 18 nt, Homo sapiens
gauaaccuugugccuugg

SEQ ID NO: 2184040 - RNA, 15 nt, Homo sapiens
gagcuauacauaugu

SEQ ID NO: 2184041 - RNA, 18 nt, Homo sapiens
uuauguaccuccaugagc

SEQ ID NO: 2184042 - RNA, 10 nt, Homo sapiens
aauggugcuu

SEQ ID NO: 2184043 - RNA, 17 nt, Homo sapiens
gaacuuagauguuaaau

SEQ ID NO: 2184044 - RNA, 22 nt, Homo sapiens
acccauuucucuuugcuucaca

SEQ ID NO: 2184045 - RNA, 20 nt, Homo sapiens
uuugacucuggggugcagcu

SEQ ID NO: 2184046 - RNA, 19 nt, Homo sapiens
aaguuuauaucuugauuau

SEQ ID NO: 2184047 - RNA, 20 nt, Homo sapiens
aguacuauggagugcucaca

SEQ ID NO: 2184048 - RNA, 13 nt, Homo sapiens
ccuuuccauuuau

SEQ ID NO: 2184049 - RNA, 19 nt, Homo sapiens
gccccaugaccuccagcuu

SEQ ID NO: 2184050 - RNA, 19 nt, Homo sapiens
aagacauaguugugcaugc

SEQ ID NO: 2184051 - RNA, 22 nt, Homo sapiens
uagugcaccaucucacugcagu

SEQ ID NO: 2184052 - RNA, 18 nt, Homo sapiens
ugagacauugacaccaga

SEQ ID NO: 2184053 - RNA, 22 nt, Homo sapiens
uguugccuccucccauccagcg

SEQ ID NO: 2184054 - RNA, 20 nt, Homo sapiens
cucagagaccugaagugugc

SEQ ID NO: 2184055 - RNA, 21 nt, Homo sapiens
ucuugcaccaaauuaucuuga

SEQ ID NO: 2184056 - RNA, 19 nt, Homo sapiens
ugggaccgugcgagcugcc

SEQ ID NO: 2184057 - RNA, 19 nt, Homo sapiens
gaucucagccucugaucag

SEQ ID NO: 2184058 - RNA, 20 nt, Homo sapiens
ucggggcccccgcagcagca

SEQ ID NO: 2184059 - RNA, 23 nt, Homo sapiens
uugacacacaguuguugaaugac

SEQ ID NO: 2184060 - RNA, 19 nt, Homo sapiens
aagauucuucccauucucc

SEQ ID NO: 2184061 - RNA, 22 nt, Homo sapiens
aaauauugcucuauguuaguau

SEQ ID NO: 2184062 - RNA, 14 nt, Homo sapiens
acagccauuuucca

SEQ ID NO: 2184063 - RNA, 20 nt, Homo sapiens
cuaaugugaaaauguauucu

SEQ ID NO: 2184064 - RNA, 19 nt, Homo sapiens
gauauauauucaacagaaa

SEQ ID NO: 2184065 - RNA, 21 nt, Homo sapiens
ugaccucagggcuauguggau

SEQ ID NO: 2184066 - RNA, 13 nt, Homo sapiens
uugguguucucau

SEQ ID NO: 2184067 - RNA, 22 nt, Homo sapiens
uacuguacaugcuaugcugaag

SEQ ID NO: 2184068 - RNA, 23 nt, Homo sapiens
aaacugauucucuaugacaugaa

SEQ ID NO: 2184069 - RNA, 12 nt, Homo sapiens
ugacagaucucu

SEQ ID NO: 2184070 - RNA, 20 nt, Homo sapiens
aaaugcugucccuauacacu

SEQ ID NO: 2184071 - RNA, 15 nt, Homo sapiens
ucacaguuucaggcu

SEQ ID NO: 2184072 - RNA, 23 nt, Homo sapiens
agcugucccuugcuugccugcag

SEQ ID NO: 2184073 - RNA, 19 nt, Homo sapiens
cuucacugaaagacaccau

SEQ ID NO: 2184074 - RNA, 13 nt, Homo sapiens
ccuuccaacugcu

SEQ ID NO: 2184075 - RNA, 20 nt, Homo sapiens
aagucaccauucugcauuua

SEQ ID NO: 2184076 - RNA, 13 nt, Homo sapiens
aaguagcugcuac

SEQ ID NO: 2184077 - RNA, 13 nt, Homo sapiens
aagaagcugcuuc

SEQ ID NO: 2184078 - RNA, 19 nt, Homo sapiens
gaacagugauaaguauacu

SEQ ID NO: 2184079 - RNA, 16 nt, Homo sapiens
uaaagccaaacauaua

SEQ ID NO: 2184080 - RNA, 20 nt, Homo sapiens
cuuuuggcauuuuacuguac

SEQ ID NO: 2184081 - RNA, 19 nt, Homo sapiens
uugcuuauaacaagcauau

SEQ ID NO: 2184082 - RNA, 22 nt, Homo sapiens
uaaagcuaaggaccuuaagaca

SEQ ID NO: 2184083 - RNA, 17 nt, Homo sapiens
cugagucaugucuuucc

SEQ ID NO: 2184084 - RNA, 15 nt, Homo sapiens
uaggguccaccagga

SEQ ID NO: 2184085 - RNA, 16 nt, Homo sapiens
cuggcuucaaauugua

SEQ ID NO: 2184086 - RNA, 16 nt, Homo sapiens
cgucuguuuuugcaac

SEQ ID NO: 2184087 - RNA, 18 nt, Homo sapiens
cagauguuagaucagggg

SEQ ID NO: 2184088 - RNA, 10 nt, Homo sapiens
uaaagcacau

SEQ ID NO: 2184089 - RNA, 13 nt, Homo sapiens
uagugcuuuccag

SEQ ID NO: 2184090 - RNA, 20 nt, Homo sapiens
ugccacccugccccuugcca

SEQ ID NO: 2184091 - RNA, 11 nt, Homo sapiens
aagaaggguua

SEQ ID NO: 2184092 - RNA, 19 nt, Homo sapiens
guggcacuauauucuggcc

SEQ ID NO: 2184093 - RNA, 20 nt, Homo sapiens
uagcagaguuaaaucucaaa

SEQ ID NO: 2184094 - RNA, 21 nt, Homo sapiens
cacacuaguuuaugcuaccua

SEQ ID NO: 2184095 - RNA, 16 nt, Homo sapiens
gggugaacugcagcga

SEQ ID NO: 2184096 - RNA, 13 nt, Homo sapiens
cacauuuuacucu

SEQ ID NO: 2184097 - RNA, 15 nt, Homo sapiens
acuugauugucuccu

SEQ ID NO: 2184098 - RNA, 18 nt, Homo sapiens
ucccuuagaacaccugag

SEQ ID NO: 2184099 - RNA, 15 nt, Homo sapiens
ugaccucgugaucca

SEQ ID NO: 2184100 - RNA, 14 nt, Homo sapiens
ugauucacuauuag

SEQ ID NO: 2184101 - RNA, 19 nt, Homo sapiens
cgaccaggcuggacacccu

SEQ ID NO: 2184102 - RNA, 23 nt, Homo sapiens
guugcagucucagaaagccuucc

SEQ ID NO: 2184103 - RNA, 13 nt, Homo sapiens
cuuuuaaugaugc

SEQ ID NO: 2184104 - RNA, 14 nt, Homo sapiens
ggacagcucuuccc

SEQ ID NO: 2184105 - RNA, 22 nt, Homo sapiens
caucccaggggagaacuacauu

SEQ ID NO: 2184106 - RNA, 23 nt, Homo sapiens
uuuuuaaauuugcaaaucucagg

SEQ ID NO: 2184107 - RNA, 23 nt, Homo sapiens
uaagagcaaaucaauucuaguca

SEQ ID NO: 2184108 - RNA, 15 nt, Homo sapiens
uuccuccacauucau

SEQ ID NO: 2184109 - RNA, 16 nt, Homo sapiens
ccauugucagcucaau

SEQ ID NO: 2184110 - RNA, 13 nt, Homo sapiens
cacaggaggaacc

SEQ ID NO: 2184111 - RNA, 23 nt, Homo sapiens
ccugaaugugucugcgucccugu

SEQ ID NO: 2184112 - RNA, 17 nt, Homo sapiens
ucguaacuuuauggagu

SEQ ID NO: 2184113 - RNA, 16 nt, Homo sapiens
agaaaaaucaaucauu

SEQ ID NO: 2184114 - RNA, 13 nt, Homo sapiens
uucauuuagccaa

SEQ ID NO: 2184115 - RNA, 22 nt, Homo sapiens
caaagcaucccucuuagucuag

SEQ ID NO: 2184116 - RNA, 21 nt, Homo sapiens
ugaaggaaaugaaccacauag

SEQ ID NO: 2184117 - RNA, 18 nt, Homo sapiens
uaaaauuaaaaguuugaa

SEQ ID NO: 2184118 - RNA, 12 nt, Homo sapiens
gaccagggccac

SEQ ID NO: 2184119 - RNA, 22 nt, Homo sapiens
cacuaguuuuuccugugcaaaa

SEQ ID NO: 2184120 - RNA, 23 nt, Homo sapiens
cuccagacacaccugaacacauc

SEQ ID NO: 2184121 - RNA, 21 nt, Homo sapiens
guaauuaaaaugauaguugau

SEQ ID NO: 2184122 - RNA, 12 nt, Homo sapiens
agcauuuuggaa

SEQ ID NO: 2184123 - RNA, 23 nt, Homo sapiens
ugcauggcagggggcugcugcug

SEQ ID NO: 2184124 - RNA, 13 nt, Homo sapiens
guaucgcugagac

SEQ ID NO: 2184125 - RNA, 13 nt, Homo sapiens
gaaaagcugugua

SEQ ID NO: 2184126 - RNA, 19 nt, Homo sapiens
ugucacauagagugaucuu

SEQ ID NO: 2184127 - RNA, 23 nt, Homo sapiens
uuucaaacugaguaaauuggaaa

SEQ ID NO: 2184128 - RNA, 15 nt, Homo sapiens
auacagaaguuccau

SEQ ID NO: 2184129 - RNA, 19 nt, Homo sapiens
aaaaguuacauguuugcac

SEQ ID NO: 2184130 - RNA, 13 nt, Homo sapiens
auuccuugauuca

SEQ ID NO: 2184131 - RNA, 22 nt, Homo sapiens
aaauagacccacaagaggcagu

SEQ ID NO: 2184132 - RNA, 15 nt, Homo sapiens
gaaaauaguauuuca

SEQ ID NO: 2184133 - RNA, 22 nt, Homo sapiens
ugaauguauuuugguugcugau

SEQ ID NO: 2184134 - RNA, 20 nt, Homo sapiens
gaucggagccuccucucuca

SEQ ID NO: 2184135 - RNA, 21 nt, Homo sapiens
gcucccugccagcuuccuguc

SEQ ID NO: 2184136 - RNA, 16 nt, Homo sapiens
ucguguuucacagugg

SEQ ID NO: 2184137 - RNA, 18 nt, Homo sapiens
gguggugaguucugacua

SEQ ID NO: 2184138 - RNA, 16 nt, Homo sapiens
aagucaacauaugcaa

SEQ ID NO: 2184139 - RNA, 19 nt, Homo sapiens
acaucuguauaucagcucu

SEQ ID NO: 2184140 - RNA, 19 nt, Homo sapiens
cuaaaaucuaaaauuucau

SEQ ID NO: 2184141 - RNA, 22 nt, Homo sapiens
uuaaauugccuuuguaauauga

SEQ ID NO: 2184142 - RNA, 14 nt, Homo sapiens
caagauuaugugac

SEQ ID NO: 2184143 - RNA, 13 nt, Homo sapiens
aacugacuuccaa

SEQ ID NO: 2184144 - RNA, 15 nt, Homo sapiens
uaaaaaauacuguug

SEQ ID NO: 2184145 - RNA, 17 nt, Homo sapiens
ucaccuccucugugauu

SEQ ID NO: 2184146 - RNA, 23 nt, Homo sapiens
cuagcacugccccacaugcaugu

SEQ ID NO: 2184147 - RNA, 17 nt, Homo sapiens
augugcuucaucugugg

SEQ ID NO: 2184148 - RNA, 16 nt, Homo sapiens
ggacucugcaucccag

SEQ ID NO: 2184149 - RNA, 14 nt, Homo sapiens
aguggugccugcau

SEQ ID NO: 2184150 - RNA, 16 nt, Homo sapiens
gccaucugcuuaccac

SEQ ID NO: 2184151 - RNA, 23 nt, Homo sapiens
gagauuuucuuggcaguauucca

SEQ ID NO: 2184152 - RNA, 15 nt, Homo sapiens
aggagcugggggcag

SEQ ID NO: 2184153 - RNA, 14 nt, Homo sapiens
gggguuagaccacu

SEQ ID NO: 2184154 - RNA, 20 nt, Homo sapiens
uggccaagaaaauugccuuu

SEQ ID NO: 2184155 - RNA, 17 nt, Homo sapiens
gucuugaugacugcuga

SEQ ID NO: 2184156 - RNA, 11 nt, Homo sapiens
ucaccaaaauu

SEQ ID NO: 2184157 - RNA, 23 nt, Homo sapiens
acauauuugcacaaguacaguaa

SEQ ID NO: 2184158 - RNA, 16 nt, Homo sapiens
uauuaccaucucucca

SEQ ID NO: 2184159 - RNA, 23 nt, Homo sapiens
gaauauggugggcacagaaguag

SEQ ID NO: 2184160 - RNA, 17 nt, Homo sapiens
gucaguacgagcugcuc

SEQ ID NO: 2184161 - RNA, 16 nt, Homo sapiens
cagccccacaccaggg

SEQ ID NO: 2184162 - RNA, 20 nt, Homo sapiens
gguuuuuugcuaagagccag

SEQ ID NO: 2184163 - RNA, 19 nt, Homo sapiens
gcucuucuaccauuugaau

SEQ ID NO: 2184164 - RNA, 21 nt, Homo sapiens
uugaaauaaaugacaauguaa

SEQ ID NO: 2184165 - RNA, 16 nt, Homo sapiens
uggacuuucuugcaug

SEQ ID NO: 2184166 - RNA, 20 nt, Homo sapiens
ccaugggggcuccagacauu

SEQ ID NO: 2184167 - RNA, 13 nt, Homo sapiens
cauagugucacag

SEQ ID NO: 2184168 - RNA, 19 nt, Homo sapiens
agguugucuccaggccaug

SEQ ID NO: 2184169 - RNA, 14 nt, Homo sapiens
uauuuacauuuucc

SEQ ID NO: 2184170 - RNA, 16 nt, Homo sapiens
gccacuugccucaccu

SEQ ID NO: 2184171 - RNA, 20 nt, Homo sapiens
cugccagcaguuacugugaa

SEQ ID NO: 2184172 - RNA, 15 nt, Homo sapiens
aagcuacugccaucc

SEQ ID NO: 2184173 - RNA, 15 nt, Homo sapiens
ucaugcacacagaua

SEQ ID NO: 2184174 - RNA, 14 nt, Homo sapiens
cugaaccacuuugc

SEQ ID NO: 2184175 - RNA, 19 nt, Homo sapiens
caaaacacacuacuaccuc

SEQ ID NO: 2184176 - RNA, 15 nt, Homo sapiens
uccccacacuccacu

SEQ ID NO: 2184177 - RNA, 16 nt, Homo sapiens
ucagaacccacaguga

SEQ ID NO: 2184178 - RNA, 15 nt, Homo sapiens
auaacaacacuaaua

SEQ ID NO: 2184179 - RNA, 23 nt, Homo sapiens
uggaagcauagugaacacacuga

SEQ ID NO: 2184180 - RNA, 15 nt, Homo sapiens
ucaggagaaacucgg

SEQ ID NO: 2184181 - RNA, 20 nt, Homo sapiens
uaaagucaacaaccaugcca

SEQ ID NO: 2184182 - RNA, 22 nt, Homo sapiens
gaccaguccuguuugcagggaa

SEQ ID NO: 2184183 - RNA, 13 nt, Homo sapiens
cuggaacauuuau

SEQ ID NO: 2184184 - RNA, 13 nt, Homo sapiens
auauagccaauau

SEQ ID NO: 2184185 - RNA, 16 nt, Homo sapiens
cagagagcacagugau

SEQ ID NO: 2184186 - RNA, 22 nt, Homo sapiens
uaguuuauuuuguuacacuaaa

SEQ ID NO: 2184187 - RNA, 19 nt, Homo sapiens
uguguucauccccuuccug

SEQ ID NO: 2184188 - RNA, 19 nt, Homo sapiens
uggguuuguuccuggggcu

SEQ ID NO: 2184189 - RNA, 20 nt, Homo sapiens
ccaugauggccuuacacuga

SEQ ID NO: 2184190 - RNA, 21 nt, Homo sapiens
acccccaucaccuacuccagc

SEQ ID NO: 2184191 - RNA, 17 nt, Homo sapiens
caaguguuaaaacugaa

SEQ ID NO: 2184192 - RNA, 15 nt, Homo sapiens
uccucacucucgcca

SEQ ID NO: 2184193 - RNA, 9 nt, Homo sapiens
cacuucuua

SEQ ID NO: 2184194 - RNA, 15 nt, Homo sapiens
uaucucaucuugaug

SEQ ID NO: 2184195 - RNA, 19 nt, Homo sapiens
augucauaccuuuggauac

SEQ ID NO: 2184196 - RNA, 23 nt, Homo sapiens
ggacaagagcagccuggggccaa

SEQ ID NO: 2184197 - RNA, 19 nt, Homo sapiens
acuguggacuccaugccuc

SEQ ID NO: 2184198 - RNA, 12 nt, Homo sapiens
guggagggguca

SEQ ID NO: 2184199 - RNA, 12 nt, Homo sapiens
agggagggagca

SEQ ID NO: 2184200 - RNA, 21 nt, Homo sapiens
uccugagguggauuuacugag

SEQ ID NO: 2184201 - RNA, 16 nt, Homo sapiens
guugcagaauguggag

SEQ ID NO: 2184202 - RNA, 21 nt, Homo sapiens
guuucugaaccauuacuguaa

SEQ ID NO: 2184203 - RNA, 14 nt, Homo sapiens
auauauauuacaag

SEQ ID NO: 2184204 - RNA, 20 nt, Homo sapiens
agaacaagcaacauaaaaca

SEQ ID NO: 2184205 - RNA, 16 nt, Homo sapiens
aucaccugaaacacug

SEQ ID NO: 2184206 - RNA, 15 nt, Homo sapiens
cagacagaaguguag

SEQ ID NO: 2184207 - RNA, 15 nt, Homo sapiens
uauaccucaaugucc

SEQ ID NO: 2184208 - RNA, 12 nt, Homo sapiens
aaaagaacauaa

SEQ ID NO: 2184209 - RNA, 12 nt, Homo sapiens
aaaugaacauau

SEQ ID NO: 2184210 - RNA, 16 nt, Homo sapiens
aacaccaaaauauuca

SEQ ID NO: 2184211 - RNA, 19 nt, Homo sapiens
augccucauuaccuugugc

SEQ ID NO: 2184212 - RNA, 17 nt, Homo sapiens
ucuauguagugguuuua

SEQ ID NO: 2184213 - RNA, 16 nt, Homo sapiens
accuuaaaugcuacug

SEQ ID NO: 2184214 - RNA, 17 nt, Homo sapiens
cccuuugaguccagugu

SEQ ID NO: 2184215 - RNA, 16 nt, Homo sapiens
auguguugcuuuggau

SEQ ID NO: 2184216 - RNA, 17 nt, Homo sapiens
cuggcacuauaauguaa

SEQ ID NO: 2184217 - RNA, 20 nt, Homo sapiens
cuuguccacgucuuuucuca

SEQ ID NO: 2184218 - RNA, 16 nt, Homo sapiens
caaagagaaaagccac

SEQ ID NO: 2184219 - RNA, 15 nt, Homo sapiens
ccuccagaggaugac

SEQ ID NO: 2184220 - RNA, 21 nt, Homo sapiens
ugaggcccagugcauaugcaa

SEQ ID NO: 2184221 - RNA, 12 nt, Homo sapiens
agaaaguacaaa

SEQ ID NO: 2184222 - RNA, 13 nt, Homo sapiens
aaauauucucucu

SEQ ID NO: 2184223 - RNA, 20 nt, Homo sapiens
cauuuaccaagagagcacau

SEQ ID NO: 2184224 - RNA, 20 nt, Homo sapiens
uggccuggcggagaugcuuc

SEQ ID NO: 2184225 - RNA, 18 nt, Homo sapiens
uaucauguaaauguauug

SEQ ID NO: 2184226 - RNA, 18 nt, Homo sapiens
ccuaagaaugcuuugcca

SEQ ID NO: 2184227 - RNA, 17 nt, Homo sapiens
auuucaauaaccuuuca

SEQ ID NO: 2184228 - RNA, 18 nt, Homo sapiens
ugugaccccaccuugacg

SEQ ID NO: 2184229 - RNA, 22 nt, Homo sapiens
ggcauugaaugacaagcaucag

SEQ ID NO: 2184230 - RNA, 11 nt, Homo sapiens
gaaaaugcaaa

SEQ ID NO: 2184231 - RNA, 18 nt, Homo sapiens
uucuccuuuuacuucacu

SEQ ID NO: 2184232 - RNA, 15 nt, Homo sapiens
agauacacugugaua

SEQ ID NO: 2184233 - RNA, 22 nt, Homo sapiens
acuguuggcugauuggaaaaua

SEQ ID NO: 2184234 - RNA, 18 nt, Homo sapiens
cuaaagcgaagagacaag

SEQ ID NO: 2184235 - RNA, 22 nt, Homo sapiens
cuuuuuuuugagaauacacuau

SEQ ID NO: 2184236 - RNA, 15 nt, Homo sapiens
acuggaacauuccag

SEQ ID NO: 2184237 - RNA, 19 nt, Homo sapiens
gugccagauccucuucuca

SEQ ID NO: 2184238 - RNA, 23 nt, Homo sapiens
aaauuuuuaaugucuuugagugg

SEQ ID NO: 2184239 - RNA, 19 nt, Homo sapiens
agccuaagaaaaucaucuu

SEQ ID NO: 2184240 - RNA, 23 nt, Homo sapiens
cagauguaauguuuucuuugcaa

SEQ ID NO: 2184241 - RNA, 13 nt, Homo sapiens
ugugugcaagugu

SEQ ID NO: 2184242 - RNA, 13 nt, Homo sapiens
auugagcauuuga

SEQ ID NO: 2184243 - RNA, 13 nt, Homo sapiens
uaaaugcaaaaau

SEQ ID NO: 2184244 - RNA, 21 nt, Homo sapiens
caggggagacgaggccaagcu

SEQ ID NO: 2184245 - RNA, 18 nt, Homo sapiens
aauguucaugaagguccu

SEQ ID NO: 2184246 - RNA, 17 nt, Homo sapiens
guauuuaggcagauuga

SEQ ID NO: 2184247 - RNA, 19 nt, Homo sapiens
cuuuaaaauguauuuuuca

SEQ ID NO: 2184248 - RNA, 18 nt, Homo sapiens
ccucuaagcacauuccaa

SEQ ID NO: 2184249 - RNA, 22 nt, Homo sapiens
uuugcuucuuaugguauaauaa

SEQ ID NO: 2184250 - RNA, 11 nt, Homo sapiens
ucaaggacuug

SEQ ID NO: 2184251 - RNA, 15 nt, Homo sapiens
uagguugcacauuca

SEQ ID NO: 2184252 - RNA, 22 nt, Homo sapiens
gugacacacagcagcacugcag

SEQ ID NO: 2184253 - RNA, 15 nt, Homo sapiens
gaaugaagaacugca

SEQ ID NO: 2184254 - RNA, 19 nt, Homo sapiens
cauggcacucuauguucua

SEQ ID NO: 2184255 - RNA, 22 nt, Homo sapiens
cuuauguugcacaaugagaaaa

SEQ ID NO: 2184256 - RNA, 17 nt, Homo sapiens
ugugagaauaaagcauu

SEQ ID NO: 2184257 - RNA, 18 nt, Homo sapiens
aagaagggccaauucccu

SEQ ID NO: 2184258 - RNA, 14 nt, Homo sapiens
caauacccaccucu

SEQ ID NO: 2184259 - RNA, 15 nt, Homo sapiens
cauuggacugagggc

SEQ ID NO: 2184260 - RNA, 15 nt, Homo sapiens
gcccauggagauuga

SEQ ID NO: 2184261 - RNA, 20 nt, Homo sapiens
auuuaauuuagauauuuucc

SEQ ID NO: 2184262 - RNA, 12 nt, Homo sapiens
guaaucucugau

SEQ ID NO: 2184263 - RNA, 12 nt, Homo sapiens
guuuucucugua

SEQ ID NO: 2184264 - RNA, 13 nt, Homo sapiens
gaauaaucacuug

SEQ ID NO: 2184265 - RNA, 15 nt, Homo sapiens
cagccugccugggag

SEQ ID NO: 2184266 - RNA, 22 nt, Homo sapiens
ggcaaaggagggcaaccugaca

SEQ ID NO: 2184267 - RNA, 23 nt, Homo sapiens
uggggcugccauagggucugcag

SEQ ID NO: 2184268 - RNA, 18 nt, Homo sapiens
caucccguaucacagugu

SEQ ID NO: 2184269 - RNA, 13 nt, Homo sapiens
ccauugucucaau

SEQ ID NO: 2184270 - RNA, 20 nt, Homo sapiens
aaccaacaccaucacagcuu

SEQ ID NO: 2184271 - RNA, 16 nt, Homo sapiens
aggucacugucacugc

SEQ ID NO: 2184272 - RNA, 21 nt, Homo sapiens
uuuuucuaaaacauuccccuc

SEQ ID NO: 2184273 - RNA, 14 nt, Homo sapiens
agugauugcagcuu

SEQ ID NO: 2184274 - RNA, 13 nt, Homo sapiens
cuuuuuaugcauu

SEQ ID NO: 2184275 - RNA, 16 nt, Homo sapiens
ugcugugauaccuuag

SEQ ID NO: 2184276 - RNA, 14 nt, Homo sapiens
gaauuauuacaauu

SEQ ID NO: 2184277 - RNA, 14 nt, Homo sapiens
aauacuuugcuuca

SEQ ID NO: 2184278 - RNA, 17 nt, Homo sapiens
gcaucccggccaggugg

SEQ ID NO: 2184279 - RNA, 23 nt, Homo sapiens
uagccucccaaagugcugggauu

SEQ ID NO: 2184280 - RNA, 22 nt, Homo sapiens
agccaucuaaaguaaaaaggga

SEQ ID NO: 2184281 - RNA, 23 nt, Homo sapiens
cacagcccuggggacaccugccc

SEQ ID NO: 2184282 - RNA, 17 nt, Homo sapiens
uccuuuaccuaccaccu

SEQ ID NO: 2184283 - RNA, 22 nt, Homo sapiens
uuauuguguuuaagaaaguagc

SEQ ID NO: 2184284 - RNA, 16 nt, Homo sapiens
cacaugaauuucugcc

SEQ ID NO: 2184285 - RNA, 15 nt, Homo sapiens
uuucuagaaugucau

SEQ ID NO: 2184286 - RNA, 17 nt, Homo sapiens
ucucacuguguugccca

SEQ ID NO: 2184287 - RNA, 14 nt, Homo sapiens
uggccucucuagca

SEQ ID NO: 2184288 - RNA, 17 nt, Homo sapiens
aagauggauuugaaaau

SEQ ID NO: 2184289 - RNA, 16 nt, Homo sapiens
ucaggccugugcccac

SEQ ID NO: 2184290 - RNA, 15 nt, Homo sapiens
acagcagcaaugcaa

SEQ ID NO: 2184291 - RNA, 19 nt, Homo sapiens
guacuccacaaacaugggu

SEQ ID NO: 2184292 - RNA, 13 nt, Homo sapiens
cuccaucucuuaa

SEQ ID NO: 2184293 - RNA, 16 nt, Homo sapiens
cggagcuugcagugag

SEQ ID NO: 2184294 - RNA, 14 nt, Homo sapiens
agcccuugcacucc

SEQ ID NO: 2184295 - RNA, 20 nt, Homo sapiens
cacauacgugagggggagcu

SEQ ID NO: 2184296 - RNA, 14 nt, Homo sapiens
ggagacaacuggac

SEQ ID NO: 2184297 - RNA, 18 nt, Homo sapiens
aguuaugcaagggacugu

SEQ ID NO: 2184298 - RNA, 17 nt, Homo sapiens
uuacuuaccuaaacaga

SEQ ID NO: 2184299 - RNA, 18 nt, Homo sapiens
ugguuccaugcagccuug

SEQ ID NO: 2184300 - RNA, 21 nt, Homo sapiens
caaacuagauuuauaaaugca

SEQ ID NO: 2184301 - RNA, 21 nt, Homo sapiens
cacccuugcccggcugugauu

SEQ ID NO: 2184302 - RNA, 23 nt, Homo sapiens
cacuacagaucucccaguaauuu

SEQ ID NO: 2184303 - RNA, 23 nt, Homo sapiens
aguucuuuucaaccuacuuucau

SEQ ID NO: 2184304 - RNA, 23 nt, Homo sapiens
aaucaacccugcaaucacuuuuu

SEQ ID NO: 2184305 - RNA, 22 nt, Homo sapiens
uucccucucccucucucuggga

SEQ ID NO: 2184306 - RNA, 15 nt, Homo sapiens
gcucucaagaccaga

SEQ ID NO: 2184307 - RNA, 15 nt, Homo sapiens
ccucauccagccuca

SEQ ID NO: 2184308 - RNA, 23 nt, Homo sapiens
agauucaaugccccugaauuuaa

SEQ ID NO: 2184309 - RNA, 22 nt, Homo sapiens
aacagaaaaauaagacccugug

SEQ ID NO: 2184310 - RNA, 21 nt, Homo sapiens
ugcaucauaagcugauuugau

SEQ ID NO: 2184311 - RNA, 17 nt, Homo sapiens
acuguugaaaaagauaa

SEQ ID NO: 2184312 - RNA, 20 nt, Homo sapiens
accaauaaagugacccuguu

SEQ ID NO: 2184313 - RNA, 19 nt, Homo sapiens
aaagcuugagcugcucugc

SEQ ID NO: 2184314 - RNA, 19 nt, Homo sapiens
cagauugcagaaauacagu

SEQ ID NO: 2184315 - RNA, 11 nt, Homo sapiens
aaacaaaaaug

SEQ ID NO: 2184316 - RNA, 17 nt, Homo sapiens
ugcucccggguccugcu

SEQ ID NO: 2184317 - RNA, 20 nt, Homo sapiens
agguguaagccaucacaccu

SEQ ID NO: 2184318 - RNA, 11 nt, Homo sapiens
cccagcauuuu

SEQ ID NO: 2184319 - RNA, 17 nt, Homo sapiens
ucaaugaacaagcauuc

SEQ ID NO: 2184320 - RNA, 21 nt, Homo sapiens
uaaagaagauaaacacaaaau

SEQ ID NO: 2184321 - RNA, 23 nt, Homo sapiens
gccuacuggaugcuuacagugac

SEQ ID NO: 2184322 - RNA, 21 nt, Homo sapiens
ugguggaugggcccugcaaga

SEQ ID NO: 2184323 - RNA, 16 nt, Homo sapiens
gcaagcaaagaaccca

SEQ ID NO: 2184324 - RNA, 13 nt, Homo sapiens
auaacaguuauaa

SEQ ID NO: 2184325 - RNA, 20 nt, Homo sapiens
caugaaguguguuuccuuca

SEQ ID NO: 2184326 - RNA, 15 nt, Homo sapiens
ugcaacuaaggacaa

SEQ ID NO: 2184327 - RNA, 18 nt, Homo sapiens
cccaugggggcacuugag

SEQ ID NO: 2184328 - RNA, 15 nt, Homo sapiens
gucugggcaccaccu

SEQ ID NO: 2184329 - RNA, 16 nt, Homo sapiens
gcuggccugggguccc

SEQ ID NO: 2184330 - RNA, 23 nt, Homo sapiens
gccacaccacauugccucaacaa

SEQ ID NO: 2184331 - RNA, 15 nt, Homo sapiens
aacagcaguggagua

SEQ ID NO: 2184332 - RNA, 21 nt, Homo sapiens
aguguccuucacggcacugga

SEQ ID NO: 2184333 - RNA, 15 nt, Homo sapiens
accguguggcccaag

SEQ ID NO: 2184334 - RNA, 15 nt, Homo sapiens
aggcagaaugguggg

SEQ ID NO: 2184335 - RNA, 14 nt, Homo sapiens
cuguaacugucuca

SEQ ID NO: 2184336 - RNA, 16 nt, Homo sapiens
gcccugcgggugaaca

SEQ ID NO: 2184337 - RNA, 17 nt, Homo sapiens
uucucccgugagccagg

SEQ ID NO: 2184338 - RNA, 22 nt, Homo sapiens
acuccagcccuguccccugaaa

SEQ ID NO: 2184339 - RNA, 20 nt, Homo sapiens
ugauugaggagcugcacuga

SEQ ID NO: 2184340 - RNA, 17 nt, Homo sapiens
cccagccucgcaugcca

SEQ ID NO: 2184341 - RNA, 21 nt, Homo sapiens
gaguggcugaaauaaaagccu

SEQ ID NO: 2184342 - RNA, 18 nt, Homo sapiens
ucacaaaaaaauguucau

SEQ ID NO: 2184343 - RNA, 14 nt, Homo sapiens
aacaggccauugug

SEQ ID NO: 2184344 - RNA, 22 nt, Homo sapiens
auacuguaggcacacuuugcac

SEQ ID NO: 2184345 - RNA, 15 nt, Homo sapiens
cauuuuagugacugu

SEQ ID NO: 2184346 - RNA, 21 nt, Homo sapiens
ccugcuggggaagaacagccc

SEQ ID NO: 2184347 - RNA, 16 nt, Homo sapiens
ucuggcccuugcuuac

SEQ ID NO: 2184348 - RNA, 16 nt, Homo sapiens
cuuuggaggauuucac

SEQ ID NO: 2184349 - RNA, 16 nt, Homo sapiens
aauacuuuuccuuacc

SEQ ID NO: 2184350 - RNA, 19 nt, Homo sapiens
cacacauccugucaguguc

SEQ ID NO: 2184351 - RNA, 11 nt, Homo sapiens
agagcugccac

SEQ ID NO: 2184352 - RNA, 17 nt, Homo sapiens
ccgguugcuucugggaa

SEQ ID NO: 2184353 - RNA, 22 nt, Homo sapiens
ucgagagcuggccaaagagccu

SEQ ID NO: 2184354 - RNA, 20 nt, Homo sapiens
ccuuuugguuccucacauau

SEQ ID NO: 2184355 - RNA, 15 nt, Homo sapiens
uggacugaccaaaga

SEQ ID NO: 2184356 - RNA, 15 nt, Homo sapiens
ugaaauugaugccag

SEQ ID NO: 2184357 - RNA, 21 nt, Homo sapiens
agguauguuacuguaguaauu

SEQ ID NO: 2184358 - RNA, 21 nt, Homo sapiens
cacaugguuacauaucaaaac

SEQ ID NO: 2184359 - RNA, 20 nt, Homo sapiens
ggaagcucccaccccacuca

SEQ ID NO: 2184360 - RNA, 17 nt, Homo sapiens
cugcccugcucugggga

SEQ ID NO: 2184361 - RNA, 18 nt, Homo sapiens
guauugaaugauaauuca

SEQ ID NO: 2184362 - RNA, 17 nt, Homo sapiens
aaccuacacacauaccu

SEQ ID NO: 2184363 - RNA, 20 nt, Homo sapiens
ucaaggacagccaccaagaa

SEQ ID NO: 2184364 - RNA, 20 nt, Homo sapiens
cugagacuuacgcccuguuc

SEQ ID NO: 2184365 - RNA, 19 nt, Homo sapiens
ugaagaagaguuucuccuu

SEQ ID NO: 2184366 - RNA, 13 nt, Homo sapiens
ccucaaugugaug

SEQ ID NO: 2184367 - RNA, 12 nt, Homo sapiens
gaugccucuugc

SEQ ID NO: 2184368 - RNA, 16 nt, Homo sapiens
cuccugugcuggugac

SEQ ID NO: 2184369 - RNA, 18 nt, Homo sapiens
cuaaaauucacuuagggu

SEQ ID NO: 2184370 - RNA, 17 nt, Homo sapiens
gaacaagucaaaauauu

SEQ ID NO: 2184371 - RNA, 21 nt, Homo sapiens
ccuggugagauuauacaggag

SEQ ID NO: 2184372 - RNA, 14 nt, Homo sapiens
uacagccacauccc

SEQ ID NO: 2184373 - RNA, 19 nt, Homo sapiens
cuuccauccucucuggugu

SEQ ID NO: 2184374 - RNA, 13 nt, Homo sapiens
aaauuagcuggau

SEQ ID NO: 2184375 - RNA, 20 nt, Homo sapiens
cuuuuugggaccaucacuga

SEQ ID NO: 2184376 - RNA, 15 nt, Homo sapiens
acauuaaaucacuug

SEQ ID NO: 2184377 - RNA, 17 nt, Homo sapiens
cagagaguccucuggau

SEQ ID NO: 2184378 - RNA, 20 nt, Homo sapiens
uggcucuguggcgagccauu

SEQ ID NO: 2184379 - RNA, 22 nt, Homo sapiens
auauuugcugugaagggagaaa

SEQ ID NO: 2184380 - RNA, 14 nt, Homo sapiens
cauaaaucuuccaa

SEQ ID NO: 2184381 - RNA, 22 nt, Homo sapiens
ccaguugucuauucauugacug

SEQ ID NO: 2184382 - RNA, 21 nt, Homo sapiens
gaaauaaguauccaguacuuu

SEQ ID NO: 2184383 - RNA, 18 nt, Homo sapiens
cagggcuuccucuuccgg

SEQ ID NO: 2184384 - RNA, 16 nt, Homo sapiens
caccgcauuccagggg

SEQ ID NO: 2184385 - RNA, 22 nt, Homo sapiens
uugccaaaaucaauacaauccu

SEQ ID NO: 2184386 - RNA, 22 nt, Homo sapiens
cccucugcagucucuauaccaa

SEQ ID NO: 2184387 - RNA, 20 nt, Homo sapiens
auaaguccacaucuucucag

SEQ ID NO: 2184388 - RNA, 21 nt, Homo sapiens
uaguuaccacauuacucugcc

SEQ ID NO: 2184389 - RNA, 18 nt, Homo sapiens
gagaggcccggccucuca

SEQ ID NO: 2184390 - RNA, 17 nt, Homo sapiens
agagacgggguuugcca

SEQ ID NO: 2184391 - RNA, 21 nt, Homo sapiens
gcauccuccacauccuguguc

SEQ ID NO: 2184392 - RNA, 12 nt, Homo sapiens
gaccacuccugu

SEQ ID NO: 2184393 - RNA, 19 nt, Homo sapiens
caauaucugggucaaucca

SEQ ID NO: 2184394 - RNA, 13 nt, Homo sapiens
uuuauugccauga

SEQ ID NO: 2184395 - RNA, 19 nt, Homo sapiens
uuauuugaaaaacauacau

SEQ ID NO: 2184396 - RNA, 16 nt, Homo sapiens
gaaacuacuaaucuca

SEQ ID NO: 2184397 - RNA, 23 nt, Homo sapiens
uccugagaggugcugcaggcaaa

SEQ ID NO: 2184398 - RNA, 14 nt, Homo sapiens
aauauaaagcuuaa

SEQ ID NO: 2184399 - RNA, 17 nt, Homo sapiens
agcaguuggucuauuca

SEQ ID NO: 2184400 - RNA, 17 nt, Homo sapiens
cagccaagaucuugcca

SEQ ID NO: 2184401 - RNA, 21 nt, Homo sapiens
agcaccugcgggagcugcacu

SEQ ID NO: 2184402 - RNA, 15 nt, Homo sapiens
agcucauaagaguaa

SEQ ID NO: 2184403 - RNA, 19 nt, Homo sapiens
ccaaaauauuaacauucuu

SEQ ID NO: 2184404 - RNA, 19 nt, Homo sapiens
uuugcauuucagaauauua

SEQ ID NO: 2184405 - RNA, 17 nt, Homo sapiens
gaaacuguccaccaaga

SEQ ID NO: 2184406 - RNA, 15 nt, Homo sapiens
cuacacccuggccca

SEQ ID NO: 2184407 - RNA, 16 nt, Homo sapiens
ccacuuccccaaagaa

SEQ ID NO: 2184408 - RNA, 19 nt, Homo sapiens
caaagagaauaaagacuuc

SEQ ID NO: 2184409 - RNA, 22 nt, Homo sapiens
ccccugagaugguaugcacaau

SEQ ID NO: 2184410 - RNA, 16 nt, Homo sapiens
aacccaagcucugggg

SEQ ID NO: 2184411 - RNA, 21 nt, Homo sapiens
gcccucccccaaacagacucg

SEQ ID NO: 2184412 - RNA, 13 nt, Homo sapiens
gggcuaccaggaa

SEQ ID NO: 2184413 - RNA, 21 nt, Homo sapiens
cugaaauccgggucaagugaa

SEQ ID NO: 2184414 - RNA, 24 nt, Homo sapiens
uacccucaucaaaaacacucucac

SEQ ID NO: 2184415 - RNA, 15 nt, Homo sapiens
ccuaccauacaauau

SEQ ID NO: 2184416 - RNA, 14 nt, Homo sapiens
auggagcagucucc

SEQ ID NO: 2184417 - RNA, 15 nt, Homo sapiens
cccauaucugugaaa

SEQ ID NO: 2184418 - RNA, 15 nt, Homo sapiens
aauaagaauaaacuu

SEQ ID NO: 2184419 - RNA, 20 nt, Homo sapiens
ucauuuuuuuuauauugccu

SEQ ID NO: 2184420 - RNA, 22 nt, Homo sapiens
gaacuugagcgugaaucuguau

SEQ ID NO: 2184421 - RNA, 16 nt, Homo sapiens
uggcugagcccauuuu

SEQ ID NO: 2184422 - RNA, 19 nt, Homo sapiens
ucagaagaaaggcauugca

SEQ ID NO: 2184423 - RNA, 18 nt, Homo sapiens
auuauauuuuaaauaccc

SEQ ID NO: 2184424 - RNA, 16 nt, Homo sapiens
aucacaucacacaaaa

SEQ ID NO: 2184425 - RNA, 19 nt, Homo sapiens
agauccgggagacugacac

SEQ ID NO: 2184426 - RNA, 18 nt, Homo sapiens
acucauuucuuauaucau

SEQ ID NO: 2184427 - RNA, 17 nt, Homo sapiens
uguguaagacaaaaagc

SEQ ID NO: 2184428 - RNA, 21 nt, Homo sapiens
aaagaucgccuggcucaguca

SEQ ID NO: 2184429 - RNA, 21 nt, Homo sapiens
agcuaagcuaccuugucauau

SEQ ID NO: 2184430 - RNA, 17 nt, Homo sapiens
uuauaaguaaagacagc

SEQ ID NO: 2184431 - RNA, 21 nt, Homo sapiens
acauaggaaaaugccaugaaa

SEQ ID NO: 2184432 - RNA, 12 nt, Homo sapiens
cguuaagugccc

SEQ ID NO: 2184433 - RNA, 11 nt, Homo sapiens
aggcagccacc

SEQ ID NO: 2184434 - RNA, 18 nt, Homo sapiens
cacuggagaaaaggcagu

SEQ ID NO: 2184435 - RNA, 21 nt, Homo sapiens
cacaugagaugguauauccuu

SEQ ID NO: 2184436 - RNA, 22 nt, Homo sapiens
uccuauccccggacgcaugcag

SEQ ID NO: 2184437 - RNA, 22 nt, Homo sapiens
uacuaccccaggaugcaugcag

SEQ ID NO: 2184438 - RNA, 23 nt, Homo sapiens
cucaggauuguuucucggcacca

SEQ ID NO: 2184439 - RNA, 16 nt, Homo sapiens
agggaagggugccugg

SEQ ID NO: 2184440 - RNA, 13 nt, Homo sapiens
caaagggggacag

SEQ ID NO: 2184441 - RNA, 10 nt, Homo sapiens
cauaugcaug

SEQ ID NO: 2184442 - RNA, 23 nt, Homo sapiens
ucuuuauguaagaagaaacugcu

SEQ ID NO: 2184443 - RNA, 14 nt, Homo sapiens
agcugaaccacaga

SEQ ID NO: 2184444 - RNA, 20 nt, Homo sapiens
acaggcacugaacaggcugg

SEQ ID NO: 2184445 - RNA, 20 nt, Homo sapiens
aaaugucaggccuuccccac

SEQ ID NO: 2184446 - RNA, 15 nt, Homo sapiens
cauaggaauugcaca

SEQ ID NO: 2184447 - RNA, 16 nt, Homo sapiens
gccauaaaccaauaaa

SEQ ID NO: 2184448 - RNA, 22 nt, Homo sapiens
acuauccuuccucucugugaug

SEQ ID NO: 2184449 - RNA, 17 nt, Homo sapiens
acuaaugaggcauuaca

SEQ ID NO: 2184450 - RNA, 22 nt, Homo sapiens
uauuuuugcugaaacccaauga

SEQ ID NO: 2184451 - RNA, 16 nt, Homo sapiens
caguaaaucucacaaa

SEQ ID NO: 2184452 - RNA, 12 nt, Homo sapiens
aauaaucacuug

SEQ ID NO: 2184453 - RNA, 23 nt, Homo sapiens
auagccagauaguagaaccagug

SEQ ID NO: 2184454 - RNA, 13 nt, Homo sapiens
gacuuggaaucag

SEQ ID NO: 2184455 - RNA, 21 nt, Homo sapiens
uacaguaaaguauagaaauau

SEQ ID NO: 2184456 - RNA, 13 nt, Homo sapiens
ucacuauggugcc

SEQ ID NO: 2184457 - RNA, 19 nt, Homo sapiens
ugugacaacaugcaagaag

SEQ ID NO: 2184458 - RNA, 15 nt, Homo sapiens
aaaugccacaaagaa

SEQ ID NO: 2184459 - RNA, 15 nt, Homo sapiens
aaaagccacaaugaa

SEQ ID NO: 2184460 - RNA, 21 nt, Homo sapiens
guaaugcacauccucauucac

SEQ ID NO: 2184461 - RNA, 17 nt, Homo sapiens
ucccuguggccuuauga

SEQ ID NO: 2184462 - RNA, 17 nt, Homo sapiens
caggauuuuaaauuaca

SEQ ID NO: 2184463 - RNA, 17 nt, Homo sapiens
uuaaacucuccuuugau

SEQ ID NO: 2184464 - RNA, 13 nt, Homo sapiens
agcaguucagagc

SEQ ID NO: 2184465 - RNA, 16 nt, Homo sapiens
guccaaccagacuuug

SEQ ID NO: 2184466 - RNA, 21 nt, Homo sapiens
cuucagaggauaaauaucaau

SEQ ID NO: 2184467 - RNA, 16 nt, Homo sapiens
uauauguauaugcaau

SEQ ID NO: 2184468 - RNA, 16 nt, Homo sapiens
aauauguuaaugcaaa

SEQ ID NO: 2184469 - RNA, 11 nt, Homo sapiens
ccuuucucuga

SEQ ID NO: 2184470 - RNA, 20 nt, Homo sapiens
caacaaggaucaggcugcug

SEQ ID NO: 2184471 - RNA, 16 nt, Homo sapiens
ggaggcaugccucuga

SEQ ID NO: 2184472 - RNA, 14 nt, Homo sapiens
gaaaauaugcauaa

SEQ ID NO: 2184473 - RNA, 14 nt, Homo sapiens
caucugugccagag

SEQ ID NO: 2184474 - RNA, 18 nt, Homo sapiens
gcuuucuucuuaaccuau

SEQ ID NO: 2184475 - RNA, 23 nt, Homo sapiens
agacccgcccuuagaccaggcag

SEQ ID NO: 2184476 - RNA, 15 nt, Homo sapiens
acacugaaaaggaaa

SEQ ID NO: 2184477 - RNA, 15 nt, Homo sapiens
uaaugcucugauaug

SEQ ID NO: 2184478 - RNA, 22 nt, Homo sapiens
auacauucuaaaucacuuuaau

SEQ ID NO: 2184479 - RNA, 17 nt, Homo sapiens
ccccacuggacugaccu

SEQ ID NO: 2184480 - RNA, 18 nt, Homo sapiens
agauacuuuuguaaauaa

SEQ ID NO: 2184481 - RNA, 21 nt, Homo sapiens
ccugcaccccugcaguuugag

SEQ ID NO: 2184482 - RNA, 18 nt, Homo sapiens
cccacuguaaagccaguu

SEQ ID NO: 2184483 - RNA, 15 nt, Homo sapiens
ugaauuaaucaucua

SEQ ID NO: 2184484 - RNA, 16 nt, Homo sapiens
uuauauacaguacaca

SEQ ID NO: 2184485 - RNA, 21 nt, Homo sapiens
uguuucugagaccacaguuua

SEQ ID NO: 2184486 - RNA, 23 nt, Homo sapiens
cacuugauuuuuuucauuuugcc

SEQ ID NO: 2184487 - RNA, 14 nt, Homo sapiens
uuucauucauccca

SEQ ID NO: 2184488 - RNA, 15 nt, Homo sapiens
ugggccagaacacac

SEQ ID NO: 2184489 - RNA, 23 nt, Homo sapiens
gacuguccaagugccacaugccu

SEQ ID NO: 2184490 - RNA, 22 nt, Homo sapiens
cuuauauuugacauucuucacu

SEQ ID NO: 2184491 - RNA, 20 nt, Homo sapiens
auuccagucaaaucugggcu

SEQ ID NO: 2184492 - RNA, 21 nt, Homo sapiens
gaaugaaagcuccucgagggc

SEQ ID NO: 2184493 - RNA, 17 nt, Homo sapiens
aggaaggccuccugagg

SEQ ID NO: 2184494 - RNA, 17 nt, Homo sapiens
guccaaugcucaggugc

SEQ ID NO: 2184495 - RNA, 21 nt, Homo sapiens
ccaagugccaucccacauucg

SEQ ID NO: 2184496 - RNA, 19 nt, Homo sapiens
ugcccugaggagggcccug

SEQ ID NO: 2184497 - RNA, 16 nt, Homo sapiens
acagccucuuugccca

SEQ ID NO: 2184498 - RNA, 18 nt, Homo sapiens
cuauuuaugaaaaccaua

SEQ ID NO: 2184499 - RNA, 13 nt, Homo sapiens
ccagcccacugga

SEQ ID NO: 2184500 - RNA, 15 nt, Homo sapiens
ugagcucggggucca

SEQ ID NO: 2184501 - RNA, 16 nt, Homo sapiens
auuuauuuaagacacu

SEQ ID NO: 2184502 - RNA, 13 nt, Homo sapiens
ccuuguaaugcca

SEQ ID NO: 2184503 - RNA, 21 nt, Homo sapiens
auuguuaggaccacugaggaa

SEQ ID NO: 2184504 - RNA, 21 nt, Homo sapiens
cacagcccugagugucccaag

SEQ ID NO: 2184505 - RNA, 14 nt, Homo sapiens
cccauccgcaucuc

SEQ ID NO: 2184506 - RNA, 18 nt, Homo sapiens
ugcuggggaagacagugg

SEQ ID NO: 2184507 - RNA, 20 nt, Homo sapiens
uucaccuguaaaacuuuauu

SEQ ID NO: 2184508 - RNA, 19 nt, Homo sapiens
ugaaggaaggacuaugaca

SEQ ID NO: 2184509 - RNA, 16 nt, Homo sapiens
aucaccagccaugugc

SEQ ID NO: 2184510 - RNA, 19 nt, Homo sapiens
ccaaaaagagacugaucau

SEQ ID NO: 2184511 - RNA, 20 nt, Homo sapiens
uuccucuuccccuuuaccaa

SEQ ID NO: 2184512 - RNA, 13 nt, Homo sapiens
ucauguccaguga

SEQ ID NO: 2184513 - RNA, 19 nt, Homo sapiens
agagaagggacacauucaa

SEQ ID NO: 2184514 - RNA, 17 nt, Homo sapiens
guaauuaauaaacgaag

SEQ ID NO: 2184515 - RNA, 14 nt, Homo sapiens
ccaugcagacauga

SEQ ID NO: 2184516 - RNA, 13 nt, Homo sapiens
gaccuacuguucu

SEQ ID NO: 2184517 - RNA, 20 nt, Homo sapiens
agacugcaguggacaguccc

SEQ ID NO: 2184518 - RNA, 22 nt, Homo sapiens
agcuauucuccauguacuggca

SEQ ID NO: 2184519 - RNA, 16 nt, Homo sapiens
gagaaagaccaugcau

SEQ ID NO: 2184520 - RNA, 12 nt, Homo sapiens
gugcagcauuaa

SEQ ID NO: 2184521 - RNA, 14 nt, Homo sapiens
gauggugaccuggg

SEQ ID NO: 2184522 - RNA, 19 nt, Homo sapiens
aauaugaggggacugcaug

SEQ ID NO: 2184523 - RNA, 19 nt, Homo sapiens
cucucuggaaggagacuga

SEQ ID NO: 2184524 - RNA, 14 nt, Homo sapiens
cuagagcucaggcc

SEQ ID NO: 2184525 - RNA, 20 nt, Homo sapiens
auucagaacauaaaugcaca

SEQ ID NO: 2184526 - RNA, 22 nt, Homo sapiens
ccugugacaacacucaucacac

SEQ ID NO: 2184527 - RNA, 12 nt, Homo sapiens
ggucaguccaug

SEQ ID NO: 2184528 - RNA, 15 nt, Homo sapiens
guauuuucacuggag

SEQ ID NO: 2184529 - RNA, 16 nt, Homo sapiens
uuuuguaaauguaucu

SEQ ID NO: 2184530 - RNA, 17 nt, Homo sapiens
caccuguagcugaagca

SEQ ID NO: 2184531 - RNA, 17 nt, Homo sapiens
aagaucgugaugcuaug

SEQ ID NO: 2184532 - RNA, 21 nt, Homo sapiens
ucggcugccaggggcucugug

SEQ ID NO: 2184533 - RNA, 21 nt, Homo sapiens
gccugcugccauagcagcacc

SEQ ID NO: 2184534 - RNA, 14 nt, Homo sapiens
cagaauagcacaaa

SEQ ID NO: 2184535 - RNA, 14 nt, Homo sapiens
aauguaaagacaaa

SEQ ID NO: 2184536 - RNA, 14 nt, Homo sapiens
aaugagaagacaug

SEQ ID NO: 2184537 - RNA, 22 nt, Homo sapiens
uuauggcaagugauaucaccuc

SEQ ID NO: 2184538 - RNA, 16 nt, Homo sapiens
gugaccaaaccaacau

SEQ ID NO: 2184539 - RNA, 22 nt, Homo sapiens
accuggagggcuagaaccuaga

SEQ ID NO: 2184540 - RNA, 15 nt, Homo sapiens
ucuauaguuaagaau

SEQ ID NO: 2184541 - RNA, 15 nt, Homo sapiens
ucucuuccuacccuu

SEQ ID NO: 2184542 - RNA, 19 nt, Homo sapiens
acaagagcugcuguccuuu

SEQ ID NO: 2184543 - RNA, 22 nt, Homo sapiens
ucugcaaauggcuuagcuacuu

SEQ ID NO: 2184544 - RNA, 20 nt, Homo sapiens
uaggaaauaaaauuaaugaa

SEQ ID NO: 2184545 - RNA, 12 nt, Homo sapiens
aaaccaugacug

SEQ ID NO: 2184546 - RNA, 15 nt, Homo sapiens
guagaaaaauuauua

SEQ ID NO: 2184547 - RNA, 15 nt, Homo sapiens
gcaaauuaacuguau

SEQ ID NO: 2184548 - RNA, 15 nt, Homo sapiens
gcaaauaaacuguaa

SEQ ID NO: 2184549 - RNA, 16 nt, Homo sapiens
cacacaucuguggaga

SEQ ID NO: 2184550 - RNA, 17 nt, Homo sapiens
aagaauuucaauaucaa

SEQ ID NO: 2184551 - RNA, 22 nt, Homo sapiens
gcaucuuucauaugguaggaac

SEQ ID NO: 2184552 - RNA, 14 nt, Homo sapiens
uagagacucaaaga

SEQ ID NO: 2184553 - RNA, 15 nt, Homo sapiens
ggccuuucugugucc

SEQ ID NO: 2184554 - RNA, 18 nt, Homo sapiens
ucaggccaaccccaaaga

SEQ ID NO: 2184555 - RNA, 15 nt, Homo sapiens
aggauggcaagcacg

SEQ ID NO: 2184556 - RNA, 12 nt, Homo sapiens
uaaacauucucu

SEQ ID NO: 2184557 - RNA, 17 nt, Homo sapiens
cuugucccugcccagaa

SEQ ID NO: 2184558 - RNA, 14 nt, Homo sapiens
auaagcuagcauua

SEQ ID NO: 2184559 - RNA, 24 nt, Homo sapiens
aauuugugguccacugagcuauaa

SEQ ID NO: 2184560 - RNA, 18 nt, Homo sapiens
cgguaaacacgccugcaa

SEQ ID NO: 2184561 - RNA, 20 nt, Homo sapiens
ccucugcagcuuccaggcug

SEQ ID NO: 2184562 - RNA, 17 nt, Homo sapiens
uaaauuuguguucucaa

SEQ ID NO: 2184563 - RNA, 14 nt, Homo sapiens
uuaaaauugcucau

SEQ ID NO: 2184564 - RNA, 12 nt, Homo sapiens
agugggcuguga

SEQ ID NO: 2184565 - RNA, 23 nt, Homo sapiens
cuucuuaaaaucaaauguaaauc

SEQ ID NO: 2184566 - RNA, 12 nt, Homo sapiens
acauauuuagcg

SEQ ID NO: 2184567 - RNA, 17 nt, Homo sapiens
caagugaaaaacaucca

SEQ ID NO: 2184568 - RNA, 20 nt, Homo sapiens
gccccuggggcuguauuuau

SEQ ID NO: 2184569 - RNA, 18 nt, Homo sapiens
ccaugaccuaguuuucca

SEQ ID NO: 2184570 - RNA, 20 nt, Homo sapiens
gaggggacagaguucaggga

SEQ ID NO: 2184571 - RNA, 23 nt, Homo sapiens
ucagcuagacaaugauuuggcca

SEQ ID NO: 2184572 - RNA, 21 nt, Homo sapiens
uagcaacuuguguuacaaaaa

SEQ ID NO: 2184573 - RNA, 22 nt, Homo sapiens
aaucugaggccuccucucucag

SEQ ID NO: 2184574 - RNA, 14 nt, Homo sapiens
aggcggucacugcc

SEQ ID NO: 2184575 - RNA, 16 nt, Homo sapiens
aaaagcuucauucuca

SEQ ID NO: 2184576 - RNA, 21 nt, Homo sapiens
agucugguugaauaaagcuua

SEQ ID NO: 2184577 - RNA, 20 nt, Homo sapiens
gcaaaauuaaauacauaaau

SEQ ID NO: 2184578 - RNA, 23 nt, Homo sapiens
ugcaucacaauuuguugaaucuc

SEQ ID NO: 2184579 - RNA, 22 nt, Homo sapiens
cuucaaaugucuaagguaguaa

SEQ ID NO: 2184580 - RNA, 21 nt, Homo sapiens
cuucagcugggucacauccau

SEQ ID NO: 2184581 - RNA, 17 nt, Homo sapiens
ugggguggccaccagua

SEQ ID NO: 2184582 - RNA, 22 nt, Homo sapiens
ugagcuggggaugucucucaug

SEQ ID NO: 2184583 - RNA, 15 nt, Homo sapiens
gccuuacugaccuca

SEQ ID NO: 2184584 - RNA, 21 nt, Homo sapiens
accugugagcauccuucccag

SEQ ID NO: 2184585 - RNA, 20 nt, Homo sapiens
auaaacacccaugaaucaaa

SEQ ID NO: 2184586 - RNA, 12 nt, Homo sapiens
uccuggugcugg

SEQ ID NO: 2184587 - RNA, 14 nt, Homo sapiens
aagccucagugaaa

SEQ ID NO: 2184588 - RNA, 12 nt, Homo sapiens
auagguuuccac

SEQ ID NO: 2184589 - RNA, 16 nt, Homo sapiens
cacucaugcacacaga

SEQ ID NO: 2184590 - RNA, 16 nt, Homo sapiens
ugcucaauacaucuca

SEQ ID NO: 2184591 - RNA, 14 nt, Homo sapiens
aguggaacaugcaa

SEQ ID NO: 2184592 - RNA, 17 nt, Homo sapiens
uaucucacacaguuuaa

SEQ ID NO: 2184593 - RNA, 12 nt, Homo sapiens
cugaaacacugg

SEQ ID NO: 2184594 - RNA, 15 nt, Homo sapiens
gagcacuucacacag

SEQ ID NO: 2184595 - RNA, 16 nt, Homo sapiens
acauuucuaacucuau

SEQ ID NO: 2184596 - RNA, 21 nt, Homo sapiens
cccuggaugacauuaaagaag

SEQ ID NO: 2184597 - RNA, 19 nt, Homo sapiens
cuaaugauuagcacuuaau

SEQ ID NO: 2184598 - RNA, 17 nt, Homo sapiens
cuuugcaggaugaccuc

SEQ ID NO: 2184599 - RNA, 12 nt, Homo sapiens
ccugggcacaaa

SEQ ID NO: 2184600 - RNA, 19 nt, Homo sapiens
uauuuguguucaguuccag

SEQ ID NO: 2184601 - RNA, 16 nt, Homo sapiens
aguucaggcucugaga

SEQ ID NO: 2184602 - RNA, 22 nt, Homo sapiens
aaaagguacuggugagggcaag

SEQ ID NO: 2184603 - RNA, 14 nt, Homo sapiens
aaaaguuuuugcuu

SEQ ID NO: 2184604 - RNA, 15 nt, Homo sapiens
gcuugcacacuuccc

SEQ ID NO: 2184605 - RNA, 20 nt, Homo sapiens
gcccaggcuggaguacagug

SEQ ID NO: 2184606 - RNA, 22 nt, Homo sapiens
uacuauaaucaaaugauuucau

SEQ ID NO: 2184607 - RNA, 21 nt, Homo sapiens
aaaacucaaagaauguguaug

SEQ ID NO: 2184608 - RNA, 19 nt, Homo sapiens
cauccaaugcucaagaaac

SEQ ID NO: 2184609 - RNA, 15 nt, Homo sapiens
ugagugagggagaca

SEQ ID NO: 2184610 - RNA, 14 nt, Homo sapiens
gcaaggcugugcuc

SEQ ID NO: 2184611 - RNA, 23 nt, Homo sapiens
gcuuagaaaauuguccuccuugu

SEQ ID NO: 2184612 - RNA, 22 nt, Homo sapiens
uuuugcacagacaucuccucac

SEQ ID NO: 2184613 - RNA, 14 nt, Homo sapiens
guagacuacuuugg

SEQ ID NO: 2184614 - RNA, 20 nt, Homo sapiens
cuccccaacaccccacugag

SEQ ID NO: 2184615 - RNA, 16 nt, Homo sapiens
cauauuucauccagga

SEQ ID NO: 2184616 - RNA, 14 nt, Homo sapiens
cagaagacacugca

SEQ ID NO: 2184617 - RNA, 16 nt, Homo sapiens
uucuccugugacccca

SEQ ID NO: 2184618 - RNA, 17 nt, Homo sapiens
aaagcagggacugugaa

SEQ ID NO: 2184619 - RNA, 23 nt, Homo sapiens
guccuuggagugcugcagcuuug

SEQ ID NO: 2184620 - RNA, 18 nt, Homo sapiens
gccugggaguguguggug

SEQ ID NO: 2184621 - RNA, 12 nt, Homo sapiens
acuugacagugg

SEQ ID NO: 2184622 - RNA, 16 nt, Homo sapiens
ccuuccuugaccagca

SEQ ID NO: 2184623 - RNA, 23 nt, Homo sapiens
guucuuguguccugguaauuccu

SEQ ID NO: 2184624 - RNA, 22 nt, Homo sapiens
uuuagauuuauuuuuucaucuc

SEQ ID NO: 2184625 - RNA, 18 nt, Homo sapiens
gccaugccuccucaggag

SEQ ID NO: 2184626 - RNA, 17 nt, Homo sapiens
gaguccaagaagccagc

SEQ ID NO: 2184627 - RNA, 13 nt, Homo sapiens
gccuggcccuccu

SEQ ID NO: 2184628 - RNA, 22 nt, Homo sapiens
ggcacaagugucccugggccua

SEQ ID NO: 2184629 - RNA, 15 nt, Homo sapiens
aaaacuguacuuuga

SEQ ID NO: 2184630 - RNA, 23 nt, Homo sapiens
gagaccaggggaccagagggaug

SEQ ID NO: 2184631 - RNA, 21 nt, Homo sapiens
ugcauccauuugaacacauua

SEQ ID NO: 2184632 - RNA, 22 nt, Homo sapiens
auguauaaagugauugacuuga

SEQ ID NO: 2184633 - RNA, 20 nt, Homo sapiens
acagccuccaaaaauggcag

SEQ ID NO: 2184634 - RNA, 16 nt, Homo sapiens
aaccucgaguacugug

SEQ ID NO: 2184635 - RNA, 12 nt, Homo sapiens
aagugaacuuuu

SEQ ID NO: 2184636 - RNA, 22 nt, Homo sapiens
auuuucauugauucguaugcca

SEQ ID NO: 2184637 - RNA, 15 nt, Homo sapiens
agagagaaauucugu

SEQ ID NO: 2184638 - RNA, 18 nt, Homo sapiens
uccccaguuggcccuucu

SEQ ID NO: 2184639 - RNA, 16 nt, Homo sapiens
uauguuguugcuugua

SEQ ID NO: 2184640 - RNA, 20 nt, Homo sapiens
auggugaaacuccaucucua

SEQ ID NO: 2184641 - RNA, 21 nt, Homo sapiens
gguugaaacuguuaucacuua

SEQ ID NO: 2184642 - RNA, 15 nt, Homo sapiens
gaaacauuuaacuca

SEQ ID NO: 2184643 - RNA, 23 nt, Homo sapiens
ccagucucugucguggagccauu

SEQ ID NO: 2184644 - RNA, 13 nt, Homo sapiens
aagucaacaugua

SEQ ID NO: 2184645 - RNA, 20 nt, Homo sapiens
gccuucaacgacccuggaca

SEQ ID NO: 2184646 - RNA, 13 nt, Homo sapiens
aaucugauuuaca

SEQ ID NO: 2184647 - RNA, 18 nt, Homo sapiens
cgacuggggaguccucau

SEQ ID NO: 2184648 - RNA, 14 nt, Homo sapiens
cuagccucaggggu

SEQ ID NO: 2184649 - RNA, 16 nt, Homo sapiens
ugagaggcauuucccc

SEQ ID NO: 2184650 - RNA, 21 nt, Homo sapiens
gaccaucugaugugaugugaa

SEQ ID NO: 2184651 - RNA, 16 nt, Homo sapiens
uuuacuaucuuuucau

SEQ ID NO: 2184652 - RNA, 19 nt, Homo sapiens
uuaaacuagcacaguaaaa

SEQ ID NO: 2184653 - RNA, 16 nt, Homo sapiens
gucuucggcugcucag

SEQ ID NO: 2184654 - RNA, 21 nt, Homo sapiens
ccuuauuaaagguaugcauuu

SEQ ID NO: 2184655 - RNA, 21 nt, Homo sapiens
ucucugauaaaacugguuuua

SEQ ID NO: 2184656 - RNA, 16 nt, Homo sapiens
uguaauauguacacaa

SEQ ID NO: 2184657 - RNA, 12 nt, Homo sapiens
auguugcaaugc

SEQ ID NO: 2184658 - RNA, 16 nt, Homo sapiens
uuuccagguuccugag

SEQ ID NO: 2184659 - RNA, 16 nt, Homo sapiens
gacacguggugcauuu

SEQ ID NO: 2184660 - RNA, 17 nt, Homo sapiens
aauggaggccauugugu

SEQ ID NO: 2184661 - RNA, 21 nt, Homo sapiens
gauauagcuaggugacauaua

SEQ ID NO: 2184662 - RNA, 17 nt, Homo sapiens
uaaugaguauguaaaac

SEQ ID NO: 2184663 - RNA, 19 nt, Homo sapiens
gccucaccguccucaccca

SEQ ID NO: 2184664 - RNA, 22 nt, Homo sapiens
ugagaccuugucuccacaaaaa

SEQ ID NO: 2184665 - RNA, 16 nt, Homo sapiens
caugucuugacuguua

SEQ ID NO: 2184666 - RNA, 14 nt, Homo sapiens
ccgaccacaccaga

SEQ ID NO: 2184667 - RNA, 21 nt, Homo sapiens
acuuggccaguuuucuguuca

SEQ ID NO: 2184668 - RNA, 18 nt, Homo sapiens
aaggguaucccaaaaaua

SEQ ID NO: 2184669 - RNA, 20 nt, Homo sapiens
agcauugcagucacuuugac

SEQ ID NO: 2184670 - RNA, 19 nt, Homo sapiens
caccauguuagccaggcug

SEQ ID NO: 2184671 - RNA, 19 nt, Homo sapiens
ccauauugcucucauuuca

SEQ ID NO: 2184672 - RNA, 23 nt, Homo sapiens
gaggaagggcaaaaccacuagaa

SEQ ID NO: 2184673 - RNA, 13 nt, Homo sapiens
guacacacacaga

SEQ ID NO: 2184674 - RNA, 17 nt, Homo sapiens
cugaccuuggguccuga

SEQ ID NO: 2184675 - RNA, 18 nt, Homo sapiens
gaaucagacuucacacug

SEQ ID NO: 2184676 - RNA, 22 nt, Homo sapiens
augcaucaaguuauugacaaac

SEQ ID NO: 2184677 - RNA, 22 nt, Homo sapiens
agcacuuacagcucuggccaca

SEQ ID NO: 2184678 - RNA, 18 nt, Homo sapiens
ugguugccucucuugccc

SEQ ID NO: 2184679 - RNA, 18 nt, Homo sapiens
guguuaagcguucaguga

SEQ ID NO: 2184680 - RNA, 20 nt, Homo sapiens
caucuaccuuuucuggcaaa

SEQ ID NO: 2184681 - RNA, 16 nt, Homo sapiens
cugacccugugcccca

SEQ ID NO: 2184682 - RNA, 23 nt, Homo sapiens
aguaauaaaacaucuuuccaguc

SEQ ID NO: 2184683 - RNA, 13 nt, Homo sapiens
ucuaacagcacca

SEQ ID NO: 2184684 - RNA, 13 nt, Homo sapiens
uccaacagcauca

SEQ ID NO: 2184685 - RNA, 17 nt, Homo sapiens
uugaggcugcagauuuc

SEQ ID NO: 2184686 - RNA, 15 nt, Homo sapiens
guuucuccugagcua

SEQ ID NO: 2184687 - RNA, 21 nt, Homo sapiens
cugacucucugugaccugccc

SEQ ID NO: 2184688 - RNA, 21 nt, Homo sapiens
uaacguuucccguuagucucu

SEQ ID NO: 2184689 - RNA, 12 nt, Homo sapiens
auuaaacuacuu

SEQ ID NO: 2184690 - RNA, 18 nt, Homo sapiens
cacacugcccucugccac

SEQ ID NO: 2184691 - RNA, 22 nt, Homo sapiens
aaaugugccauuuuuuucacuc

SEQ ID NO: 2184692 - RNA, 15 nt, Homo sapiens
uuccaguauugaaaa

SEQ ID NO: 2184693 - RNA, 14 nt, Homo sapiens
gguccgacaugccu

SEQ ID NO: 2184694 - RNA, 21 nt, Homo sapiens
gaauauauugaauaggcauua

SEQ ID NO: 2184695 - RNA, 22 nt, Homo sapiens
uucuuuccguuucucuauugua

SEQ ID NO: 2184696 - RNA, 19 nt, Homo sapiens
ccucccacuugaccugaga

SEQ ID NO: 2184697 - RNA, 15 nt, Homo sapiens
aagacuccucugggc

SEQ ID NO: 2184698 - RNA, 18 nt, Homo sapiens
uccuggaauggagcugua

SEQ ID NO: 2184699 - RNA, 23 nt, Homo sapiens
guuauuuuuuaaaugaggauuca

SEQ ID NO: 2184700 - RNA, 22 nt, Homo sapiens
caucucugcauuuauccuauau

SEQ ID NO: 2184701 - RNA, 12 nt, Homo sapiens
aacuaacuugau

SEQ ID NO: 2184702 - RNA, 15 nt, Homo sapiens
uguuucuguuauuaa

SEQ ID NO: 2184703 - RNA, 15 nt, Homo sapiens
uuaaacuguguaaaa

SEQ ID NO: 2184704 - RNA, 22 nt, Homo sapiens
auacacagcuuuaugauaucaa

SEQ ID NO: 2184705 - RNA, 20 nt, Homo sapiens
aaugcaaauuaaaacauauu

SEQ ID NO: 2184706 - RNA, 12 nt, Homo sapiens
ucuuuccuccaa

SEQ ID NO: 2184707 - RNA, 22 nt, Homo sapiens
uggcagagcacacaugugcaca

SEQ ID NO: 2184708 - RNA, 19 nt, Homo sapiens
acaucugucuuucaucucc

SEQ ID NO: 2184709 - RNA, 18 nt, Homo sapiens
cuguggugagguccuguc

SEQ ID NO: 2184710 - RNA, 14 nt, Homo sapiens
cugacaguuuacag

SEQ ID NO: 2184711 - RNA, 16 nt, Homo sapiens
gcgcagggcucuuuga

SEQ ID NO: 2184712 - RNA, 21 nt, Homo sapiens
aggaguucacuucaucuucuc

SEQ ID NO: 2184713 - RNA, 20 nt, Homo sapiens
cuccuaaagugcugggauua

SEQ ID NO: 2184714 - RNA, 16 nt, Homo sapiens
ccucucccauccagug

SEQ ID NO: 2184715 - RNA, 17 nt, Homo sapiens
ggccaacguggaccugc

SEQ ID NO: 2184716 - RNA, 20 nt, Homo sapiens
auguuguuagccgccuguga

SEQ ID NO: 2184717 - RNA, 16 nt, Homo sapiens
ccuucucucacugugu

SEQ ID NO: 2184718 - RNA, 13 nt, Homo sapiens
gccucucuugcca

SEQ ID NO: 2184719 - RNA, 21 nt, Homo sapiens
uuggaaauagaaagaagccau

SEQ ID NO: 2184720 - RNA, 21 nt, Homo sapiens
cacaugauuuuacucauaugu

SEQ ID NO: 2184721 - RNA, 17 nt, Homo sapiens
uaccucaaagggcaguu

SEQ ID NO: 2184722 - RNA, 16 nt, Homo sapiens
uccggcgggauguuga

SEQ ID NO: 2184723 - RNA, 17 nt, Homo sapiens
guaacaauacaaaugga

SEQ ID NO: 2184724 - RNA, 17 nt, Homo sapiens
ccaagcccuaagccugu

SEQ ID NO: 2184725 - RNA, 15 nt, Homo sapiens
cacaaggcugaccaa

SEQ ID NO: 2184726 - RNA, 17 nt, Homo sapiens
aucacuuaauaccguau

SEQ ID NO: 2184727 - RNA, 14 nt, Homo sapiens
gccaggauggcgca

SEQ ID NO: 2184728 - RNA, 14 nt, Homo sapiens
aaaccaacauggag

SEQ ID NO: 2184729 - RNA, 22 nt, Homo sapiens
cuuuuaaaaauucaaaugauuu

SEQ ID NO: 2184730 - RNA, 19 nt, Homo sapiens
uacuuguuugguuugguau

SEQ ID NO: 2184731 - RNA, 17 nt, Homo sapiens
aacuguuucaagcccuc

SEQ ID NO: 2184732 - RNA, 16 nt, Homo sapiens
uccaugugcccaguua

SEQ ID NO: 2184733 - RNA, 17 nt, Homo sapiens
agauguuacaaguuuau

SEQ ID NO: 2184734 - RNA, 20 nt, Homo sapiens
aacagauuuuguuggcauag

SEQ ID NO: 2184735 - RNA, 21 nt, Homo sapiens
auaaauuuaaaugaccucaga

SEQ ID NO: 2184736 - RNA, 22 nt, Homo sapiens
aaaaugcaucauuaauaccuaa

SEQ ID NO: 2184737 - RNA, 17 nt, Homo sapiens
gcauucaagaaacugau

SEQ ID NO: 2184738 - RNA, 20 nt, Homo sapiens
aauuuuauaacagaauuaaa

SEQ ID NO: 2184739 - RNA, 18 nt, Homo sapiens
ucuuucccagaugcccca

SEQ ID NO: 2184740 - RNA, 14 nt, Homo sapiens
ugauacaacaggau

SEQ ID NO: 2184741 - RNA, 15 nt, Homo sapiens
ucugcugcauuucac

SEQ ID NO: 2184742 - RNA, 13 nt, Homo sapiens
uacucugccagag

SEQ ID NO: 2184743 - RNA, 18 nt, Homo sapiens
augucaagaacaggacau

SEQ ID NO: 2184744 - RNA, 20 nt, Homo sapiens
ugggauugcuaaaacagcuu

SEQ ID NO: 2184745 - RNA, 18 nt, Homo sapiens
cagccaauuauguuaaac

SEQ ID NO: 2184746 - RNA, 17 nt, Homo sapiens
gcucuuccucaucucau

SEQ ID NO: 2184747 - RNA, 17 nt, Homo sapiens
acaacaaccuggucaca

SEQ ID NO: 2184748 - RNA, 14 nt, Homo sapiens
cuguaucuugaugu

SEQ ID NO: 2184749 - RNA, 15 nt, Homo sapiens
agugaagauguguaa

SEQ ID NO: 2184750 - RNA, 16 nt, Homo sapiens
uaaaggugguccuucc

SEQ ID NO: 2184751 - RNA, 23 nt, Homo sapiens
gacuuucuugcaagcaacaagcu

SEQ ID NO: 2184752 - RNA, 14 nt, Homo sapiens
ccucuaagcacauu

SEQ ID NO: 2184753 - RNA, 20 nt, Homo sapiens
gccuggauuuaucauugggu

SEQ ID NO: 2184754 - RNA, 20 nt, Homo sapiens
auauucuguaugaacuuuau

SEQ ID NO: 2184755 - RNA, 18 nt, Homo sapiens
auuauguccacuguguau

SEQ ID NO: 2184756 - RNA, 16 nt, Homo sapiens
uuagcuauguugacau

SEQ ID NO: 2184757 - RNA, 15 nt, Homo sapiens
aucaccauauuguaa

SEQ ID NO: 2184758 - RNA, 20 nt, Homo sapiens
agaaucucauuacugcuuca

SEQ ID NO: 2184759 - RNA, 20 nt, Homo sapiens
gacaauuucuuuuuccaaaa

SEQ ID NO: 2184760 - RNA, 18 nt, Homo sapiens
gguguguguuacauacac

SEQ ID NO: 2184761 - RNA, 15 nt, Homo sapiens
uggguugcaaucugg

SEQ ID NO: 2184762 - RNA, 17 nt, Homo sapiens
ucggacaccaucuuggg

SEQ ID NO: 2184763 - RNA, 21 nt, Homo sapiens
gggccugggacuuccaugccu

SEQ ID NO: 2184764 - RNA, 23 nt, Homo sapiens
guaauaguucuauccuuuugccu

SEQ ID NO: 2184765 - RNA, 19 nt, Homo sapiens
cccacaccccaacacuucc

SEQ ID NO: 2184766 - RNA, 16 nt, Homo sapiens
uaccuggcccaucagg

SEQ ID NO: 2184767 - RNA, 15 nt, Homo sapiens
aaugguuuugaauag

SEQ ID NO: 2184768 - RNA, 22 nt, Homo sapiens
gugccagguggcucagugccac

SEQ ID NO: 2184769 - RNA, 16 nt, Homo sapiens
aggaagcaaggccagc

SEQ ID NO: 2184770 - RNA, 14 nt, Homo sapiens
uucggcagccuuaa

SEQ ID NO: 2184771 - RNA, 19 nt, Homo sapiens
cugcugucugguugagagc

SEQ ID NO: 2184772 - RNA, 19 nt, Homo sapiens
ccaggccaccucagucuca

SEQ ID NO: 2184773 - RNA, 13 nt, Homo sapiens
gccucuuaggacu

SEQ ID NO: 2184774 - RNA, 15 nt, Homo sapiens
auauucucauuuuaa

SEQ ID NO: 2184775 - RNA, 14 nt, Homo sapiens
acccaggucuucca

SEQ ID NO: 2184776 - RNA, 22 nt, Homo sapiens
ccuucagugccaaaaacaacaa

SEQ ID NO: 2184777 - RNA, 16 nt, Homo sapiens
cccaucucuacuaaaa

SEQ ID NO: 2184778 - RNA, 19 nt, Homo sapiens
auauauguguauacauaca

SEQ ID NO: 2184779 - RNA, 13 nt, Homo sapiens
ucuggcccagaaa

SEQ ID NO: 2184780 - RNA, 13 nt, Homo sapiens
aaguauugaauua

SEQ ID NO: 2184781 - RNA, 13 nt, Homo sapiens
uuuuauuguugua

SEQ ID NO: 2184782 - RNA, 17 nt, Homo sapiens
gagacugggcaucucug

SEQ ID NO: 2184783 - RNA, 20 nt, Homo sapiens
accucauaaaaaucuagcac

SEQ ID NO: 2184784 - RNA, 17 nt, Homo sapiens
cacugccaccagcaaug

SEQ ID NO: 2184785 - RNA, 15 nt, Homo sapiens
aucaggucccaucaa

SEQ ID NO: 2184786 - RNA, 23 nt, Homo sapiens
cugacuucagugggacucgguga

SEQ ID NO: 2184787 - RNA, 15 nt, Homo sapiens
guaaacauagguaua

SEQ ID NO: 2184788 - RNA, 21 nt, Homo sapiens
guuaaacucgcucacugcuaa

SEQ ID NO: 2184789 - RNA, 16 nt, Homo sapiens
gcccugguagggcagu

SEQ ID NO: 2184790 - RNA, 15 nt, Homo sapiens
gucacaaagcuaaau

SEQ ID NO: 2184791 - RNA, 12 nt, Homo sapiens
gaccucuagccc

SEQ ID NO: 2184792 - RNA, 18 nt, Homo sapiens
cauuaggaacagaguaua

SEQ ID NO: 2184793 - RNA, 17 nt, Homo sapiens
auuuuaacaucugagaa

SEQ ID NO: 2184794 - RNA, 14 nt, Homo sapiens
ucccuguggucuac

SEQ ID NO: 2184795 - RNA, 23 nt, Homo sapiens
cauaacuucagauacuugugaac

SEQ ID NO: 2184796 - RNA, 18 nt, Homo sapiens
gauaaauuugacuguuau

SEQ ID NO: 2184797 - RNA, 17 nt, Homo sapiens
gcagaagcaacccaaau

SEQ ID NO: 2184798 - RNA, 15 nt, Homo sapiens
uacacaacuuugcaa

SEQ ID NO: 2184799 - RNA, 23 nt, Homo sapiens
cugggauuauaggcaugagccac

SEQ ID NO: 2184800 - RNA, 15 nt, Homo sapiens
aaauucaugcacuuu

SEQ ID NO: 2184801 - RNA, 18 nt, Homo sapiens
acugaugaugacagguca

SEQ ID NO: 2184802 - RNA, 16 nt, Homo sapiens
acagugaaacuccauc

SEQ ID NO: 2184803 - RNA, 22 nt, Homo sapiens
ccccaugcaccucagggccaag

SEQ ID NO: 2184804 - RNA, 14 nt, Homo sapiens
gccgcaucauggga

SEQ ID NO: 2184805 - RNA, 21 nt, Homo sapiens
gacacuauuuaucugugcaaa

SEQ ID NO: 2184806 - RNA, 16 nt, Homo sapiens
cuggaaggacaaauaa

SEQ ID NO: 2184807 - RNA, 23 nt, Homo sapiens
aggaugacgguauuaugcuucuu

SEQ ID NO: 2184808 - RNA, 23 nt, Homo sapiens
gcaauuuuuuuauacuaccaagu

SEQ ID NO: 2184809 - RNA, 21 nt, Homo sapiens
cuuguuucaccuuccauguca

SEQ ID NO: 2184810 - RNA, 18 nt, Homo sapiens
aggccugcuagucacugg

SEQ ID NO: 2184811 - RNA, 19 nt, Homo sapiens
uguuguaaaugaccaagaa

SEQ ID NO: 2184812 - RNA, 23 nt, Homo sapiens
gcagaggauguucuggaccuccc

SEQ ID NO: 2184813 - RNA, 22 nt, Homo sapiens
ggaacugguucaagagacacug

SEQ ID NO: 2184814 - RNA, 20 nt, Homo sapiens
accaguguaaauucagucuu

SEQ ID NO: 2184815 - RNA, 17 nt, Homo sapiens
cuguggcaaaugccagg

SEQ ID NO: 2184816 - RNA, 17 nt, Homo sapiens
gcacacccgugugcaca

SEQ ID NO: 2184817 - RNA, 18 nt, Homo sapiens
cgugaaacacaauaucau

SEQ ID NO: 2184818 - RNA, 22 nt, Homo sapiens
guaagaucguucucugccucac

SEQ ID NO: 2184819 - RNA, 14 nt, Homo sapiens
ucuaauugcaaaga

SEQ ID NO: 2184820 - RNA, 15 nt, Homo sapiens
caaacccagccucua

SEQ ID NO: 2184821 - RNA, 13 nt, Homo sapiens
ugcagcugucaca

SEQ ID NO: 2184822 - RNA, 20 nt, Homo sapiens
aaggggcucuucaucugccu

SEQ ID NO: 2184823 - RNA, 14 nt, Homo sapiens
aaccagagugcuga

SEQ ID NO: 2184824 - RNA, 19 nt, Homo sapiens
uuuguagcuaacagugaag

SEQ ID NO: 2184825 - RNA, 16 nt, Homo sapiens
ccuugccaguuuuccg

SEQ ID NO: 2184826 - RNA, 19 nt, Homo sapiens
cuaccauaagugacaccaa

SEQ ID NO: 2184827 - RNA, 12 nt, Homo sapiens
uguuuucugaca

SEQ ID NO: 2184828 - RNA, 12 nt, Homo sapiens
cuaagcaccugu

SEQ ID NO: 2184829 - RNA, 23 nt, Homo sapiens
cuccugagacacaugggugcuau

SEQ ID NO: 2184830 - RNA, 21 nt, Homo sapiens
ccuggaguacuuugaagaugu

SEQ ID NO: 2184831 - RNA, 21 nt, Homo sapiens
gagccuuugaucuucaggaug

SEQ ID NO: 2184832 - RNA, 23 nt, Homo sapiens
aaugcaacaaaugaauuuuccac

SEQ ID NO: 2184833 - RNA, 20 nt, Homo sapiens
uuugccucccugcacuucau

SEQ ID NO: 2184834 - RNA, 18 nt, Homo sapiens
agaauuuuaauauugcca

SEQ ID NO: 2184835 - RNA, 15 nt, Homo sapiens
cuuugaaauaccuca

SEQ ID NO: 2184836 - RNA, 18 nt, Homo sapiens
uaugugugugugugaacc

SEQ ID NO: 2184837 - RNA, 23 nt, Homo sapiens
uacuguggcuucuuaaucuuuuc

SEQ ID NO: 2184838 - RNA, 23 nt, Homo sapiens
uguaauuggaaucuucaccucag

SEQ ID NO: 2184839 - RNA, 15 nt, Homo sapiens
gauauuaugauuuga

SEQ ID NO: 2184840 - RNA, 16 nt, Homo sapiens
auucucucuccuguac

SEQ ID NO: 2184841 - RNA, 18 nt, Homo sapiens
aacacuuucugcacuuau

SEQ ID NO: 2184842 - RNA, 17 nt, Homo sapiens
cccaggaagaucuggcc

SEQ ID NO: 2184843 - RNA, 22 nt, Homo sapiens
uuugcauuaugacuccuguaaa

SEQ ID NO: 2184844 - RNA, 17 nt, Homo sapiens
cauguuacucaguguua

SEQ ID NO: 2184845 - RNA, 18 nt, Homo sapiens
uauaccugggcauacuaa

SEQ ID NO: 2184846 - RNA, 19 nt, Homo sapiens
uccugauggagugugcaga

SEQ ID NO: 2184847 - RNA, 20 nt, Homo sapiens
cauauaaauagaugauuuca

SEQ ID NO: 2184848 - RNA, 22 nt, Homo sapiens
uugcaaacccugguugcuguau

SEQ ID NO: 2184849 - RNA, 17 nt, Homo sapiens
cccaggccgagaagcca

SEQ ID NO: 2184850 - RNA, 20 nt, Homo sapiens
agaucaaaaugcuaaaacau

SEQ ID NO: 2184851 - RNA, 22 nt, Homo sapiens
gacgugcacugagagugaagug

SEQ ID NO: 2184852 - RNA, 15 nt, Homo sapiens
uuucaaaagucagac

SEQ ID NO: 2184853 - RNA, 17 nt, Homo sapiens
aacugcugaauucaccu

SEQ ID NO: 2184854 - RNA, 16 nt, Homo sapiens
ugcugaccucaccugg

SEQ ID NO: 2184855 - RNA, 22 nt, Homo sapiens
cuuaagaaagcuauauaugaau

SEQ ID NO: 2184856 - RNA, 15 nt, Homo sapiens
augauaacaacccaa

SEQ ID NO: 2184857 - RNA, 19 nt, Homo sapiens
agaggcugcagaaggccaa

SEQ ID NO: 2184858 - RNA, 20 nt, Homo sapiens
acugagugagcaucauggag

SEQ ID NO: 2184859 - RNA, 18 nt, Homo sapiens
gcuuacuaugaccuucca

SEQ ID NO: 2184860 - RNA, 15 nt, Homo sapiens
ggagucacaucagug

SEQ ID NO: 2184861 - RNA, 17 nt, Homo sapiens
ucagucacaaaccagcc

SEQ ID NO: 2184862 - RNA, 19 nt, Homo sapiens
uuuacccuuuauagaacau

SEQ ID NO: 2184863 - RNA, 16 nt, Homo sapiens
aacauucuguguucac

SEQ ID NO: 2184864 - RNA, 23 nt, Homo sapiens
acauauuacuguugcauuuacuu

SEQ ID NO: 2184865 - RNA, 18 nt, Homo sapiens
cuaaauacaacacugaua

SEQ ID NO: 2184866 - RNA, 18 nt, Homo sapiens
ugcagcuguacugaggau

SEQ ID NO: 2184867 - RNA, 19 nt, Homo sapiens
ccucacguccaucacuggc

SEQ ID NO: 2184868 - RNA, 19 nt, Homo sapiens
auaaagguuuuugaauuca

SEQ ID NO: 2184869 - RNA, 15 nt, Homo sapiens
aggauugaaagggag

SEQ ID NO: 2184870 - RNA, 14 nt, Homo sapiens
uauauaauuuccuc

SEQ ID NO: 2184871 - RNA, 17 nt, Homo sapiens
uugugaaagacauguaa

SEQ ID NO: 2184872 - RNA, 21 nt, Homo sapiens
aaugaauugccuuugauaauu

SEQ ID NO: 2184873 - RNA, 12 nt, Homo sapiens
gagcuuccucag

SEQ ID NO: 2184874 - RNA, 20 nt, Homo sapiens
uaacuucaaggcccauaucu

SEQ ID NO: 2184875 - RNA, 20 nt, Homo sapiens
ugaccuaucacuuccacugc

SEQ ID NO: 2184876 - RNA, 18 nt, Homo sapiens
caggcucucgcacaccuc

SEQ ID NO: 2184877 - RNA, 21 nt, Homo sapiens
caaauguggcuguauccacuu

SEQ ID NO: 2184878 - RNA, 22 nt, Homo sapiens
auugugguuuauugaaugugau

SEQ ID NO: 2184879 - RNA, 16 nt, Homo sapiens
ggauaauauacuucca

SEQ ID NO: 2184880 - RNA, 14 nt, Homo sapiens
aauuuuaaauguuc

SEQ ID NO: 2184881 - RNA, 14 nt, Homo sapiens
cuguuuaacauuuc

SEQ ID NO: 2184882 - RNA, 15 nt, Homo sapiens
gcccaaguggcucuu

SEQ ID NO: 2184883 - RNA, 11 nt, Homo sapiens
accuuccccag

SEQ ID NO: 2184884 - RNA, 19 nt, Homo sapiens
gugcaguggcacgaucuca

SEQ ID NO: 2184885 - RNA, 23 nt, Homo sapiens
aaauaucaaggaggucagaagaa

SEQ ID NO: 2184886 - RNA, 16 nt, Homo sapiens
ucuguguuguguccug

SEQ ID NO: 2184887 - RNA, 17 nt, Homo sapiens
acuuuugauauggccaa

SEQ ID NO: 2184888 - RNA, 13 nt, Homo sapiens
cacacugaccaca

SEQ ID NO: 2184889 - RNA, 15 nt, Homo sapiens
uccaccccagugugc

SEQ ID NO: 2184890 - RNA, 13 nt, Homo sapiens
aaagauaguuuau

SEQ ID NO: 2184891 - RNA, 15 nt, Homo sapiens
cacaggggcccugua

SEQ ID NO: 2184892 - RNA, 22 nt, Homo sapiens
gcccaauccauccugcucagga

SEQ ID NO: 2184893 - RNA, 21 nt, Homo sapiens
uucuugugcacuggcaccaag

SEQ ID NO: 2184894 - RNA, 19 nt, Homo sapiens
acagggucuugcucugucc

SEQ ID NO: 2184895 - RNA, 22 nt, Homo sapiens
uccuuuaccuaccaccuucccu

SEQ ID NO: 2184896 - RNA, 17 nt, Homo sapiens
cugaccucgugauccac

SEQ ID NO: 2184897 - RNA, 14 nt, Homo sapiens
ugcagccagccaca

SEQ ID NO: 2184898 - RNA, 21 nt, Homo sapiens
aagguucuuuagcugucacuu

SEQ ID NO: 2184899 - RNA, 15 nt, Homo sapiens
cagggcuguguguac

SEQ ID NO: 2184900 - RNA, 17 nt, Homo sapiens
uggaagauuucuugacu

SEQ ID NO: 2184901 - RNA, 16 nt, Homo sapiens
cagagucgaugcucaa

SEQ ID NO: 2184902 - RNA, 22 nt, Homo sapiens
gcagcacaugcgggcucgccca

SEQ ID NO: 2184903 - RNA, 13 nt, Homo sapiens
aaggacuucuucc

SEQ ID NO: 2184904 - RNA, 14 nt, Homo sapiens
cuuuagcuaccuca

SEQ ID NO: 2184905 - RNA, 20 nt, Homo sapiens
auuuugaacagaacugcuau

SEQ ID NO: 2184906 - RNA, 13 nt, Homo sapiens
cucuagaagccaa

SEQ ID NO: 2184907 - RNA, 21 nt, Homo sapiens
uuaaauuugguacaaaaccac

SEQ ID NO: 2184908 - RNA, 17 nt, Homo sapiens
cauucuguccccaaaau

SEQ ID NO: 2184909 - RNA, 12 nt, Homo sapiens
guagacauacuu

SEQ ID NO: 2184910 - RNA, 15 nt, Homo sapiens
aaaauucuuggaaua

SEQ ID NO: 2184911 - RNA, 15 nt, Homo sapiens
ggggaucgaugugcu

SEQ ID NO: 2184912 - RNA, 13 nt, Homo sapiens
auuucagccaaaa

SEQ ID NO: 2184913 - RNA, 12 nt, Homo sapiens
uccagggcuccc

SEQ ID NO: 2184914 - RNA, 14 nt, Homo sapiens
ggaaaaugacucug

SEQ ID NO: 2184915 - RNA, 23 nt, Homo sapiens
guccccgggguuccccacacagg

SEQ ID NO: 2184916 - RNA, 22 nt, Homo sapiens
aguggaauaugucuucuguaua

SEQ ID NO: 2184917 - RNA, 15 nt, Homo sapiens
uaucaggaugccuua

SEQ ID NO: 2184918 - RNA, 18 nt, Homo sapiens
acauauccuuucaagaca

SEQ ID NO: 2184919 - RNA, 14 nt, Homo sapiens
agagccuccuccag

SEQ ID NO: 2184920 - RNA, 16 nt, Homo sapiens
gaccucccacugcccc

SEQ ID NO: 2184921 - RNA, 13 nt, Homo sapiens
ccuggaaauggac

SEQ ID NO: 2184922 - RNA, 22 nt, Homo sapiens
uguguggagaacucagugccac

SEQ ID NO: 2184923 - RNA, 18 nt, Homo sapiens
cauucccuuuuccauaua

SEQ ID NO: 2184924 - RNA, 19 nt, Homo sapiens
aguuuacauuuuguauauu

SEQ ID NO: 2184925 - RNA, 15 nt, Homo sapiens
gaggaacacagagaa

SEQ ID NO: 2184926 - RNA, 21 nt, Homo sapiens
cucacccccaccucaagguca

SEQ ID NO: 2184927 - RNA, 15 nt, Homo sapiens
augacuaaagacaua

SEQ ID NO: 2184928 - RNA, 22 nt, Homo sapiens
ugcuugggacguguacagcaca

SEQ ID NO: 2184929 - RNA, 19 nt, Homo sapiens
gcccacccuccugucuucc

SEQ ID NO: 2184930 - RNA, 21 nt, Homo sapiens
cauuucugggcuccuggggcu

SEQ ID NO: 2184931 - RNA, 13 nt, Homo sapiens
aacacaguauuuu

SEQ ID NO: 2184932 - RNA, 9 nt, Homo sapiens
auccagggc

SEQ ID NO: 2184933 - RNA, 13 nt, Homo sapiens
gagaaguauacau

SEQ ID NO: 2184934 - RNA, 14 nt, Homo sapiens
cgccuccaugacuc

SEQ ID NO: 2184935 - RNA, 14 nt, Homo sapiens
aaauggacuuucag

SEQ ID NO: 2184936 - RNA, 18 nt, Homo sapiens
gcauuggcaagaucacag

SEQ ID NO: 2184937 - RNA, 16 nt, Homo sapiens
aagacuuuuauuaaua

SEQ ID NO: 2184938 - RNA, 21 nt, Homo sapiens
caccaauguacccaccgggcc

SEQ ID NO: 2184939 - RNA, 17 nt, Homo sapiens
uuuguuuuaaacuguga

SEQ ID NO: 2184940 - RNA, 20 nt, Homo sapiens
agucccuugagacuccccaa

SEQ ID NO: 2184941 - RNA, 15 nt, Homo sapiens
cauuuucuaaacaga

SEQ ID NO: 2184942 - RNA, 21 nt, Homo sapiens
cugagcaggaaagacuggccc

SEQ ID NO: 2184943 - RNA, 18 nt, Homo sapiens
acccgacugaaacuggaa

SEQ ID NO: 2184944 - RNA, 14 nt, Homo sapiens
acuguaaaugcauu

SEQ ID NO: 2184945 - RNA, 17 nt, Homo sapiens
cgggcugugcccgggga

SEQ ID NO: 2184946 - RNA, 16 nt, Homo sapiens
gaaaucuuaagucaua

SEQ ID NO: 2184947 - RNA, 20 nt, Homo sapiens
uuuuacacucuagugccaua

SEQ ID NO: 2184948 - RNA, 16 nt, Homo sapiens
auacaauucauuguga

SEQ ID NO: 2184949 - RNA, 14 nt, Homo sapiens
ucugccugagauuc

SEQ ID NO: 2184950 - RNA, 14 nt, Homo sapiens
agcuucuccaggaa

SEQ ID NO: 2184951 - RNA, 15 nt, Homo sapiens
gcacaaaaugugaca

SEQ ID NO: 2184952 - RNA, 23 nt, Homo sapiens
aggucuugaauagauuuucucug

SEQ ID NO: 2184953 - RNA, 14 nt, Homo sapiens
agccuccacuuccc

SEQ ID NO: 2184954 - RNA, 20 nt, Homo sapiens
gcaucaucaucacaaccuaa

SEQ ID NO: 2184955 - RNA, 14 nt, Homo sapiens
cugggccaccagcu

SEQ ID NO: 2184956 - RNA, 22 nt, Homo sapiens
gagcgagaaccaggcugcugca

SEQ ID NO: 2184957 - RNA, 22 nt, Homo sapiens
uaauugcauuuuaaauuggccc

SEQ ID NO: 2184958 - RNA, 15 nt, Homo sapiens
ugaaguuucacauga

SEQ ID NO: 2184959 - RNA, 21 nt, Homo sapiens
guaccucccccugccuuccaa

SEQ ID NO: 2184960 - RNA, 19 nt, Homo sapiens
aagucugcauuucauauua

SEQ ID NO: 2184961 - RNA, 15 nt, Homo sapiens
guaaagaggcuucca

SEQ ID NO: 2184962 - RNA, 15 nt, Homo sapiens
gccagagcugagugg

SEQ ID NO: 2184963 - RNA, 12 nt, Homo sapiens
aaugugguuauu

SEQ ID NO: 2184964 - RNA, 18 nt, Homo sapiens
uucauugcucaacaagaa

SEQ ID NO: 2184965 - RNA, 21 nt, Homo sapiens
gggaaugccacagugaaggga

SEQ ID NO: 2184966 - RNA, 21 nt, Homo sapiens
uaaagcuuuaucuuuguguaa

SEQ ID NO: 2184967 - RNA, 20 nt, Homo sapiens
ggaggagccuuggaguguaa

SEQ ID NO: 2184968 - RNA, 19 nt, Homo sapiens
agaaucauaugauucugcu

SEQ ID NO: 2184969 - RNA, 14 nt, Homo sapiens
aguugcacauuaau

SEQ ID NO: 2184970 - RNA, 22 nt, Homo sapiens
acaguaacugugacugaugacu

SEQ ID NO: 2184971 - RNA, 20 nt, Homo sapiens
ucuuaauaagcccacauaua

SEQ ID NO: 2184972 - RNA, 14 nt, Homo sapiens
gaaauacacaggga

SEQ ID NO: 2184973 - RNA, 16 nt, Homo sapiens
cagcaguuacugugaa

SEQ ID NO: 2184974 - RNA, 19 nt, Homo sapiens
acaauccucgucugaauca

SEQ ID NO: 2184975 - RNA, 21 nt, Homo sapiens
uauauuuuccugauagcauau

SEQ ID NO: 2184976 - RNA, 17 nt, Homo sapiens
ucccaaaagucaccacu

SEQ ID NO: 2184977 - RNA, 21 nt, Homo sapiens
uuaucaacauaccuuggccag

SEQ ID NO: 2184978 - RNA, 15 nt, Homo sapiens
augugcugagcauuu

SEQ ID NO: 2184979 - RNA, 19 nt, Homo sapiens
guuuccucaucugucacau

SEQ ID NO: 2184980 - RNA, 13 nt, Homo sapiens
agugggcccucau

SEQ ID NO: 2184981 - RNA, 14 nt, Homo sapiens
ucaggcccuggaac

SEQ ID NO: 2184982 - RNA, 21 nt, Homo sapiens
guucccacucccucucuugcc

SEQ ID NO: 2184983 - RNA, 22 nt, Homo sapiens
ccucgauguccuccucugugaa

SEQ ID NO: 2184984 - RNA, 12 nt, Homo sapiens
uucuugaucucu

SEQ ID NO: 2184985 - RNA, 20 nt, Homo sapiens
cuaacaggagaaugcacagu

SEQ ID NO: 2184986 - RNA, 17 nt, Homo sapiens
cagcaccggccucggga

SEQ ID NO: 2184987 - RNA, 19 nt, Homo sapiens
cucagcccccaccucaggu

SEQ ID NO: 2184988 - RNA, 16 nt, Homo sapiens
augguuuuacagugaa

SEQ ID NO: 2184989 - RNA, 20 nt, Homo sapiens
aagaaacaaagaaggacaga

SEQ ID NO: 2184990 - RNA, 18 nt, Homo sapiens
ggauaaaaugacuacuua

SEQ ID NO: 2184991 - RNA, 20 nt, Homo sapiens
cuccagccugggugacagaa

SEQ ID NO: 2184992 - RNA, 20 nt, Homo sapiens
gaccaccauuggaacaacca

SEQ ID NO: 2184993 - RNA, 14 nt, Homo sapiens
auucuuucaaguca

SEQ ID NO: 2184994 - RNA, 22 nt, Homo sapiens
aauauguaauuucaaaauacau

SEQ ID NO: 2184995 - RNA, 20 nt, Homo sapiens
caguguagcccacacuugag

SEQ ID NO: 2184996 - RNA, 21 nt, Homo sapiens
gucauucuuuauucuuuacua

SEQ ID NO: 2184997 - RNA, 13 nt, Homo sapiens
ucuggcuggaaag

SEQ ID NO: 2184998 - RNA, 19 nt, Homo sapiens
cagagggggccuucacagu

SEQ ID NO: 2184999 - RNA, 18 nt, Homo sapiens
gaaaauuuuuacauucau

SEQ ID NO: 2185000 - RNA, 14 nt, Homo sapiens
aggggcaacgaaga

SEQ ID NO: 2185001 - RNA, 13 nt, Homo sapiens
cagaaucuuuuca

SEQ ID NO: 2185002 - RNA, 15 nt, Homo sapiens
ucagcugaaugccuc

SEQ ID NO: 2185003 - RNA, 18 nt, Homo sapiens
cucaaaucugagggagcu

SEQ ID NO: 2185004 - RNA, 19 nt, Homo sapiens
ucuucuggacugguuuuca

SEQ ID NO: 2185005 - RNA, 17 nt, Homo sapiens
cuucucuccuuucuccc

SEQ ID NO: 2185006 - RNA, 15 nt, Homo sapiens
agaguuaaaaguuag

SEQ ID NO: 2185007 - RNA, 15 nt, Homo sapiens
aaauguuaacuacau

SEQ ID NO: 2185008 - RNA, 20 nt, Homo sapiens
aaaauuaaaccggaccaucu

SEQ ID NO: 2185009 - RNA, 21 nt, Homo sapiens
uguaaccagcagucacagguc

SEQ ID NO: 2185010 - RNA, 23 nt, Homo sapiens
aacucuaaaucuuguauaugcau

SEQ ID NO: 2185011 - RNA, 13 nt, Homo sapiens
ccucauucacugu

SEQ ID NO: 2185012 - RNA, 20 nt, Homo sapiens
agaaauuuggcuauaaucuu

SEQ ID NO: 2185013 - RNA, 15 nt, Homo sapiens
agcaccagguguuaa

SEQ ID NO: 2185014 - RNA, 22 nt, Homo sapiens
uucucaugcaugucuaaccuga

SEQ ID NO: 2185015 - RNA, 17 nt, Homo sapiens
caggagggacagucuca

SEQ ID NO: 2185016 - RNA, 18 nt, Homo sapiens
cacccgccgccuccugca

SEQ ID NO: 2185017 - RNA, 20 nt, Homo sapiens
uaguuuguuaugugucugga

SEQ ID NO: 2185018 - RNA, 17 nt, Homo sapiens
guaguuguuggucugua

SEQ ID NO: 2185019 - RNA, 17 nt, Homo sapiens
gccuggccagaugcaug

SEQ ID NO: 2185020 - RNA, 16 nt, Homo sapiens
gcuacagaaagcacaa

SEQ ID NO: 2185021 - RNA, 22 nt, Homo sapiens
cauaccaaugaaaaaauguaua

SEQ ID NO: 2185022 - RNA, 16 nt, Homo sapiens
ucuagguaauuugcca

SEQ ID NO: 2185023 - RNA, 19 nt, Homo sapiens
aguacugggacaaccucau

SEQ ID NO: 2185024 - RNA, 15 nt, Homo sapiens
uagaauauacugucu

SEQ ID NO: 2185025 - RNA, 12 nt, Homo sapiens
uugaacuugagu

SEQ ID NO: 2185026 - RNA, 13 nt, Homo sapiens
gcacaaacuuuaa

SEQ ID NO: 2185027 - RNA, 13 nt, Homo sapiens
aagugauucucau

SEQ ID NO: 2185028 - RNA, 17 nt, Homo sapiens
auuuuuaauauuacugu

SEQ ID NO: 2185029 - RNA, 20 nt, Homo sapiens
ugcaccuaucucagccauag

SEQ ID NO: 2185030 - RNA, 19 nt, Homo sapiens
ccuccuguucaucugugca

SEQ ID NO: 2185031 - RNA, 20 nt, Homo sapiens
ucauuguguaagacuuauua

SEQ ID NO: 2185032 - RNA, 22 nt, Homo sapiens
ugugacauuauaugcacuagca

SEQ ID NO: 2185033 - RNA, 13 nt, Homo sapiens
auguucugacagc

SEQ ID NO: 2185034 - RNA, 19 nt, Homo sapiens
aaguauauaauccugugaa

SEQ ID NO: 2185035 - RNA, 22 nt, Homo sapiens
ucacaggcuucugagcacagcu

SEQ ID NO: 2185036 - RNA, 20 nt, Homo sapiens
uauuugcacaaguacaguaa

SEQ ID NO: 2185037 - RNA, 14 nt, Homo sapiens
gacagcuugggagg

SEQ ID NO: 2185038 - RNA, 18 nt, Homo sapiens
cucacuucaucaaucaaa

SEQ ID NO: 2185039 - RNA, 17 nt, Homo sapiens
uggucuugaucuccuga

SEQ ID NO: 2185040 - RNA, 19 nt, Homo sapiens
ccccuccuucccuggucca

SEQ ID NO: 2185041 - RNA, 19 nt, Homo sapiens
uguccagcuuauagucuuc

SEQ ID NO: 2185042 - RNA, 15 nt, Homo sapiens
caggagaaugugcag

SEQ ID NO: 2185043 - RNA, 21 nt, Homo sapiens
acuucugacagccucagugac

SEQ ID NO: 2185044 - RNA, 20 nt, Homo sapiens
gaccuaaggauaugcauuaa

SEQ ID NO: 2185045 - RNA, 20 nt, Homo sapiens
uuuuaccuuucaugugccug

SEQ ID NO: 2185046 - RNA, 16 nt, Homo sapiens
agacugaagauggaaa

SEQ ID NO: 2185047 - RNA, 21 nt, Homo sapiens
agccuacagaagggcagugac

SEQ ID NO: 2185048 - RNA, 19 nt, Homo sapiens
auuuucugugguuugggcu

SEQ ID NO: 2185049 - RNA, 15 nt, Homo sapiens
ugauuucugugccau

SEQ ID NO: 2185050 - RNA, 21 nt, Homo sapiens
aauuuggguacugggugcugu

SEQ ID NO: 2185051 - RNA, 14 nt, Homo sapiens
ugagcaaaggugau

SEQ ID NO: 2185052 - RNA, 22 nt, Homo sapiens
guauaaagaauugugguuuaua

SEQ ID NO: 2185053 - RNA, 22 nt, Homo sapiens
cacgguguggggggugccccac

SEQ ID NO: 2185054 - RNA, 18 nt, Homo sapiens
caucuggauucugccuaa

SEQ ID NO: 2185055 - RNA, 20 nt, Homo sapiens
agcacugggcucugauggcu

SEQ ID NO: 2185056 - RNA, 17 nt, Homo sapiens
ccaagaguuaagauauc

SEQ ID NO: 2185057 - RNA, 14 nt, Homo sapiens
auguuagccuuaga

SEQ ID NO: 2185058 - RNA, 18 nt, Homo sapiens
aauaaugccuaguggcuu

SEQ ID NO: 2185059 - RNA, 15 nt, Homo sapiens
auaauuggugcuauu

SEQ ID NO: 2185060 - RNA, 13 nt, Homo sapiens
uugccccaagaua

SEQ ID NO: 2185061 - RNA, 14 nt, Homo sapiens
cuggcgccucugca

SEQ ID NO: 2185062 - RNA, 22 nt, Homo sapiens
cccaggucccuccucagaccuc

SEQ ID NO: 2185063 - RNA, 18 nt, Homo sapiens
auggcuuuuagcauuuau

SEQ ID NO: 2185064 - RNA, 14 nt, Homo sapiens
auagacagugcugc

SEQ ID NO: 2185065 - RNA, 16 nt, Homo sapiens
aagugcaaauuugaua

SEQ ID NO: 2185066 - RNA, 21 nt, Homo sapiens
agucccucccaucucuacccc

SEQ ID NO: 2185067 - RNA, 19 nt, Homo sapiens
auuucuucaaaucucagca

SEQ ID NO: 2185068 - RNA, 19 nt, Homo sapiens
aaagugcaguagugucacu

SEQ ID NO: 2185069 - RNA, 15 nt, Homo sapiens
ccuagcauugcacuu

SEQ ID NO: 2185070 - RNA, 17 nt, Homo sapiens
cuauuccccacacucuc

SEQ ID NO: 2185071 - RNA, 21 nt, Homo sapiens
guccuuuaauuaagacugaaa

SEQ ID NO: 2185072 - RNA, 17 nt, Homo sapiens
gcccaggaaacaagggg

SEQ ID NO: 2185073 - RNA, 17 nt, Homo sapiens
acaaagaaaaacagaga

SEQ ID NO: 2185074 - RNA, 23 nt, Homo sapiens
uucuauccugaguaguaaucuca

SEQ ID NO: 2185075 - RNA, 13 nt, Homo sapiens
cauccaauguaug

SEQ ID NO: 2185076 - RNA, 16 nt, Homo sapiens
cuccucagcacggugc

SEQ ID NO: 2185077 - RNA, 13 nt, Homo sapiens
augugauacaaau

SEQ ID NO: 2185078 - RNA, 15 nt, Homo sapiens
gcauagcuugcacaa

SEQ ID NO: 2185079 - RNA, 14 nt, Homo sapiens
uguuaguucccaac

SEQ ID NO: 2185080 - RNA, 13 nt, Homo sapiens
gaucuguccgaca

SEQ ID NO: 2185081 - RNA, 16 nt, Homo sapiens
ccucuagagucacuga

SEQ ID NO: 2185082 - RNA, 18 nt, Homo sapiens
cuguucuauacgagugac

SEQ ID NO: 2185083 - RNA, 23 nt, Homo sapiens
caggcugcaggugggguuuucac

SEQ ID NO: 2185084 - RNA, 23 nt, Homo sapiens
uaauacauggcuaucaucaaaag

SEQ ID NO: 2185085 - RNA, 22 nt, Homo sapiens
caagaaaagaggaaaaaaagcc

SEQ ID NO: 2185086 - RNA, 17 nt, Homo sapiens
uaaggaacggcccuuuu

SEQ ID NO: 2185087 - RNA, 15 nt, Homo sapiens
cagcuggugcugcaa

SEQ ID NO: 2185088 - RNA, 21 nt, Homo sapiens
ccaauacuagccccccagugg

SEQ ID NO: 2185089 - RNA, 19 nt, Homo sapiens
caucccugaaacauugcau

SEQ ID NO: 2185090 - RNA, 15 nt, Homo sapiens
agccaaguuaagaau

SEQ ID NO: 2185091 - RNA, 15 nt, Homo sapiens
aaacaaacucauuca

SEQ ID NO: 2185092 - RNA, 16 nt, Homo sapiens
augugaaaucauucau

SEQ ID NO: 2185093 - RNA, 18 nt, Homo sapiens
agaguuauagugagggaa

SEQ ID NO: 2185094 - RNA, 22 nt, Homo sapiens
uucucagacuuuggaaaaugca

SEQ ID NO: 2185095 - RNA, 17 nt, Homo sapiens
cucggccacgucccugc

SEQ ID NO: 2185096 - RNA, 17 nt, Homo sapiens
accuuaagacacuguga

SEQ ID NO: 2185097 - RNA, 21 nt, Homo sapiens
cuugcauuugugguaaucuac

SEQ ID NO: 2185098 - RNA, 22 nt, Homo sapiens
cuggcccuggcggguggcugca

SEQ ID NO: 2185099 - RNA, 18 nt, Homo sapiens
acacucaacaauaaagac

SEQ ID NO: 2185100 - RNA, 20 nt, Homo sapiens
cuggugacaggcagacacau

SEQ ID NO: 2185101 - RNA, 22 nt, Homo sapiens
uaaucagcaauauugccugugc

SEQ ID NO: 2185102 - RNA, 20 nt, Homo sapiens
auuaacaacaauaacacugu

SEQ ID NO: 2185103 - RNA, 17 nt, Homo sapiens
accauauuuuuuguaaa

SEQ ID NO: 2185104 - RNA, 14 nt, Homo sapiens
caaccuuucccuca

SEQ ID NO: 2185105 - RNA, 22 nt, Homo sapiens
ugcaguuuccaaucccauagau

SEQ ID NO: 2185106 - RNA, 13 nt, Homo sapiens
cagaguugugcac

SEQ ID NO: 2185107 - RNA, 23 nt, Homo sapiens
cacuaaaaugugggugaagguga

SEQ ID NO: 2185108 - RNA, 20 nt, Homo sapiens
cuaagugaugggauuuucaa

SEQ ID NO: 2185109 - RNA, 19 nt, Homo sapiens
aaggaugggccaucugggg

SEQ ID NO: 2185110 - RNA, 12 nt, Homo sapiens
uuaaggagccua

SEQ ID NO: 2185111 - RNA, 18 nt, Homo sapiens
acaugugacacauaugca

SEQ ID NO: 2185112 - RNA, 22 nt, Homo sapiens
auaacauuauacacaaagaaua

SEQ ID NO: 2185113 - RNA, 18 nt, Homo sapiens
cccgggucucucacuguu

SEQ ID NO: 2185114 - RNA, 15 nt, Homo sapiens
aaccuguccuugcac

SEQ ID NO: 2185115 - RNA, 22 nt, Homo sapiens
aacgugggaguucagcugcuuc

SEQ ID NO: 2185116 - RNA, 16 nt, Homo sapiens
gagauaggguggcaca

SEQ ID NO: 2185117 - RNA, 18 nt, Homo sapiens
ugaaaugcuggcauuugc

SEQ ID NO: 2185118 - RNA, 23 nt, Homo sapiens
ccuucagauccuuuuauucucca

SEQ ID NO: 2185119 - RNA, 16 nt, Homo sapiens
ugacggggggugggaa

SEQ ID NO: 2185120 - RNA, 14 nt, Homo sapiens
gcauguuucuccca

SEQ ID NO: 2185121 - RNA, 15 nt, Homo sapiens
aauaucaugcuccau

SEQ ID NO: 2185122 - RNA, 22 nt, Homo sapiens
aaaguagaaaagcccagcuuuu

SEQ ID NO: 2185123 - RNA, 17 nt, Homo sapiens
ccugggaccuccccuga

SEQ ID NO: 2185124 - RNA, 17 nt, Homo sapiens
ccugcaggacuugccac

SEQ ID NO: 2185125 - RNA, 23 nt, Homo sapiens
cccaugggaucuugagggaccaa

SEQ ID NO: 2185126 - RNA, 19 nt, Homo sapiens
gaacagaauugcuccugca

SEQ ID NO: 2185127 - RNA, 16 nt, Homo sapiens
aguaauggagguccca

SEQ ID NO: 2185128 - RNA, 23 nt, Homo sapiens
ccacuuuguauagacaucugccc

SEQ ID NO: 2185129 - RNA, 22 nt, Homo sapiens
augaccuacuaguuuuccuuga

SEQ ID NO: 2185130 - RNA, 20 nt, Homo sapiens
ugcuguccuguuucugucaa

SEQ ID NO: 2185131 - RNA, 22 nt, Homo sapiens
aaggcaacccaaaugguggcca

SEQ ID NO: 2185132 - RNA, 15 nt, Homo sapiens
aaguuguugcauucc

SEQ ID NO: 2185133 - RNA, 16 nt, Homo sapiens
cuuuccuauuugcaca

SEQ ID NO: 2185134 - RNA, 16 nt, Homo sapiens
uaauggcacugagaaa

SEQ ID NO: 2185135 - RNA, 18 nt, Homo sapiens
ucuaagugguauauacau

SEQ ID NO: 2185136 - RNA, 16 nt, Homo sapiens
cuuuucugucuuacaa

SEQ ID NO: 2185137 - RNA, 22 nt, Homo sapiens
ccaacagaagcagacuuuucag

SEQ ID NO: 2185138 - RNA, 15 nt, Homo sapiens
ggugaaggcaagaga

SEQ ID NO: 2185139 - RNA, 19 nt, Homo sapiens
aguuacuuuccauugcuau

SEQ ID NO: 2185140 - RNA, 14 nt, Homo sapiens
aaaagucaccugcc

SEQ ID NO: 2185141 - RNA, 16 nt, Homo sapiens
guacacuaacauuucc

SEQ ID NO: 2185142 - RNA, 17 nt, Homo sapiens
auacuagcaacaaacaa

SEQ ID NO: 2185143 - RNA, 13 nt, Homo sapiens
auuucacauuaau

SEQ ID NO: 2185144 - RNA, 19 nt, Homo sapiens
ccaagggacaguggucuaa

SEQ ID NO: 2185145 - RNA, 15 nt, Homo sapiens
gcaagauuucuuugu

SEQ ID NO: 2185146 - RNA, 17 nt, Homo sapiens
aauggacuaaaacauuu

SEQ ID NO: 2185147 - RNA, 19 nt, Homo sapiens
auuuuaaguaugugaagaa

SEQ ID NO: 2185148 - RNA, 23 nt, Homo sapiens
agccacauuucagaccugcugag

SEQ ID NO: 2185149 - RNA, 18 nt, Homo sapiens
cagaggcuucuccaaagg

SEQ ID NO: 2185150 - RNA, 23 nt, Homo sapiens
uuaagaguccaacucacuuccag

SEQ ID NO: 2185151 - RNA, 15 nt, Homo sapiens
ggaagucuccaugaa

SEQ ID NO: 2185152 - RNA, 23 nt, Homo sapiens
aauauuguccauuguccaauccu

SEQ ID NO: 2185153 - RNA, 14 nt, Homo sapiens
auaguuauuaucca

SEQ ID NO: 2185154 - RNA, 19 nt, Homo sapiens
uggaaaaaucagaagcaca

SEQ ID NO: 2185155 - RNA, 18 nt, Homo sapiens
agcucccaagagcuucca

SEQ ID NO: 2185156 - RNA, 22 nt, Homo sapiens
ucccagaaaaacuggcucugau

SEQ ID NO: 2185157 - RNA, 21 nt, Homo sapiens
ccucugucacguucuggaaca

SEQ ID NO: 2185158 - RNA, 14 nt, Homo sapiens
cugagaauauguaa

SEQ ID NO: 2185159 - RNA, 14 nt, Homo sapiens
guccuuuaccaaag

SEQ ID NO: 2185160 - RNA, 18 nt, Homo sapiens
guuaaauguauucuuggc

SEQ ID NO: 2185161 - RNA, 14 nt, Homo sapiens
aaaugauguuuuca

SEQ ID NO: 2185162 - RNA, 14 nt, Homo sapiens
uaauguugauuucu

SEQ ID NO: 2185163 - RNA, 16 nt, Homo sapiens
acucaagaguucagug

SEQ ID NO: 2185164 - RNA, 22 nt, Homo sapiens
uauuuuaacuacuuuacuaaau

SEQ ID NO: 2185165 - RNA, 14 nt, Homo sapiens
uguguggcccugga

SEQ ID NO: 2185166 - RNA, 16 nt, Homo sapiens
aaagggucuuaugaaa

SEQ ID NO: 2185167 - RNA, 14 nt, Homo sapiens
uaucacacauauca

SEQ ID NO: 2185168 - RNA, 21 nt, Homo sapiens
uuaaacuaagaucuguuaaaa

SEQ ID NO: 2185169 - RNA, 15 nt, Homo sapiens
uucauauccauagau

SEQ ID NO: 2185170 - RNA, 15 nt, Homo sapiens
uguaaauaguauaaa

SEQ ID NO: 2185171 - RNA, 23 nt, Homo sapiens
ggguguguuucaggacagcugcu

SEQ ID NO: 2185172 - RNA, 13 nt, Homo sapiens
uccacuccuccca

SEQ ID NO: 2185173 - RNA, 17 nt, Homo sapiens
aaaaaauaaaguaccac

SEQ ID NO: 2185174 - RNA, 19 nt, Homo sapiens
aagacuguaagcuccauga

SEQ ID NO: 2185175 - RNA, 20 nt, Homo sapiens
agauuuuuuuuuuaaucucc

SEQ ID NO: 2185176 - RNA, 13 nt, Homo sapiens
ccacaaaacugac

SEQ ID NO: 2185177 - RNA, 20 nt, Homo sapiens
caucagcugcugaaacaaca

SEQ ID NO: 2185178 - RNA, 16 nt, Homo sapiens
acagacacacacuggc

SEQ ID NO: 2185179 - RNA, 23 nt, Homo sapiens
acuuuagggcuaaccaguucucu

SEQ ID NO: 2185180 - RNA, 15 nt, Homo sapiens
gaaagccucuggaaa

SEQ ID NO: 2185181 - RNA, 19 nt, Homo sapiens
ugccuggagggaauccaua

SEQ ID NO: 2185182 - RNA, 15 nt, Homo sapiens
ugagaguuauaguga

SEQ ID NO: 2185183 - RNA, 16 nt, Homo sapiens
gaugcaucuaagcagg

SEQ ID NO: 2185184 - RNA, 23 nt, Homo sapiens
cuaugcaauuuuucaagagcucc

SEQ ID NO: 2185185 - RNA, 15 nt, Homo sapiens
agucagugucuggcu

SEQ ID NO: 2185186 - RNA, 17 nt, Homo sapiens
uauuccccccuacuuga

SEQ ID NO: 2185187 - RNA, 22 nt, Homo sapiens
aacacuuugggaggcugaggca

SEQ ID NO: 2185188 - RNA, 20 nt, Homo sapiens
acacccuucucccacucucc

SEQ ID NO: 2185189 - RNA, 17 nt, Homo sapiens
gccucuggaaagcaaag

SEQ ID NO: 2185190 - RNA, 19 nt, Homo sapiens
acuccgugcuuaaccaaag

SEQ ID NO: 2185191 - RNA, 19 nt, Homo sapiens
aauuacaguuaaagaagca

SEQ ID NO: 2185192 - RNA, 15 nt, Homo sapiens
acuuuauaucuguaa

SEQ ID NO: 2185193 - RNA, 21 nt, Homo sapiens
auuugggguugggacagggag

SEQ ID NO: 2185194 - RNA, 16 nt, Homo sapiens
agcuagaugccacugc

SEQ ID NO: 2185195 - RNA, 11 nt, Homo sapiens
ggucauuugcu

SEQ ID NO: 2185196 - RNA, 18 nt, Homo sapiens
cagucacacugcugggaa

SEQ ID NO: 2185197 - RNA, 21 nt, Homo sapiens
accaaccuccccgcagagcuc

SEQ ID NO: 2185198 - RNA, 23 nt, Homo sapiens
agcuuuccugagcugaagugccu

SEQ ID NO: 2185199 - RNA, 18 nt, Homo sapiens
guaacgaugcacuuugga

SEQ ID NO: 2185200 - RNA, 18 nt, Homo sapiens
agccauuccuguucccau

SEQ ID NO: 2185201 - RNA, 16 nt, Homo sapiens
auucuuuaagaaccuu

SEQ ID NO: 2185202 - RNA, 19 nt, Homo sapiens
cuuugcccugaauggucuc

SEQ ID NO: 2185203 - RNA, 17 nt, Homo sapiens
uuccuguuuuaagcagc

SEQ ID NO: 2185204 - RNA, 18 nt, Homo sapiens
uaaaacccaagugccuua

SEQ ID NO: 2185205 - RNA, 17 nt, Homo sapiens
ugugagccggagcucau

SEQ ID NO: 2185206 - RNA, 15 nt, Homo sapiens
aggcagggcaagaac

SEQ ID NO: 2185207 - RNA, 16 nt, Homo sapiens
uaacccuuucuucaau

SEQ ID NO: 2185208 - RNA, 22 nt, Homo sapiens
ucccaacccauucacuacaggu

SEQ ID NO: 2185209 - RNA, 19 nt, Homo sapiens
gaucaaauguauagacuug

SEQ ID NO: 2185210 - RNA, 15 nt, Homo sapiens
gaucaucgucauuug

SEQ ID NO: 2185211 - RNA, 22 nt, Homo sapiens
gcuauuugaaauacuaaaagca

SEQ ID NO: 2185212 - RNA, 16 nt, Homo sapiens
cuuuguaauauuuucc

SEQ ID NO: 2185213 - RNA, 21 nt, Homo sapiens
ucccuacgaggaguguuccca

SEQ ID NO: 2185214 - RNA, 14 nt, Homo sapiens
caaguauuggcaaa

SEQ ID NO: 2185215 - RNA, 19 nt, Homo sapiens
uccucucuccccucugcaa

SEQ ID NO: 2185216 - RNA, 14 nt, Homo sapiens
accugggacccugc

SEQ ID NO: 2185217 - RNA, 14 nt, Homo sapiens
aauauggacauauc

SEQ ID NO: 2185218 - RNA, 15 nt, Homo sapiens
caucaaacauuugcc

SEQ ID NO: 2185219 - RNA, 19 nt, Homo sapiens
gcuaauuggcagcacccac

SEQ ID NO: 2185220 - RNA, 14 nt, Homo sapiens
uaagagaugugacu

SEQ ID NO: 2185221 - RNA, 18 nt, Homo sapiens
ccugguaaauauauuuca

SEQ ID NO: 2185222 - RNA, 15 nt, Homo sapiens
agaggccaugucucc

SEQ ID NO: 2185223 - RNA, 18 nt, Homo sapiens
gcccauaagcacagauuu

SEQ ID NO: 2185224 - RNA, 21 nt, Homo sapiens
gcuuugcaauauuuauuacac

SEQ ID NO: 2185225 - RNA, 22 nt, Homo sapiens
gccagaaaaggcagccagaucc

SEQ ID NO: 2185226 - RNA, 19 nt, Homo sapiens
acugaggagcaaagcagca

SEQ ID NO: 2185227 - RNA, 14 nt, Homo sapiens
gaggcccucaccag

SEQ ID NO: 2185228 - RNA, 21 nt, Homo sapiens
ucuucaccccuacacugugaa

SEQ ID NO: 2185229 - RNA, 19 nt, Homo sapiens
gcaaagacaguuucuugca

SEQ ID NO: 2185230 - RNA, 11 nt, Homo sapiens
ugaaacuggag

SEQ ID NO: 2185231 - RNA, 18 nt, Homo sapiens
cacaggggugucuugucu

SEQ ID NO: 2185232 - RNA, 12 nt, Homo sapiens
cauuugugucaa

SEQ ID NO: 2185233 - RNA, 18 nt, Homo sapiens
augaauaccuuagugcag

SEQ ID NO: 2185234 - RNA, 18 nt, Homo sapiens
agaagagaguauggugcu

SEQ ID NO: 2185235 - RNA, 17 nt, Homo sapiens
ugcacuuauucucaaga

SEQ ID NO: 2185236 - RNA, 20 nt, Homo sapiens
gauacaaaaccuuguguaag

SEQ ID NO: 2185237 - RNA, 16 nt, Homo sapiens
cucccagggcuacuca

SEQ ID NO: 2185238 - RNA, 15 nt, Homo sapiens
ucuuccagaaggcaa

SEQ ID NO: 2185239 - RNA, 20 nt, Homo sapiens
gcgauuuguuaaagggccaa

SEQ ID NO: 2185240 - RNA, 14 nt, Homo sapiens
ccagcggaugcugc

SEQ ID NO: 2185241 - RNA, 16 nt, Homo sapiens
cagaucaaaugugaaa

SEQ ID NO: 2185242 - RNA, 18 nt, Homo sapiens
gcacuuugaaauaccuca

SEQ ID NO: 2185243 - RNA, 20 nt, Homo sapiens
uugguuucuucaacaggaga

SEQ ID NO: 2185244 - RNA, 22 nt, Homo sapiens
uaauaaauauuuagucugcauu

SEQ ID NO: 2185245 - RNA, 19 nt, Homo sapiens
ccuguuccuuuaaccccaa

SEQ ID NO: 2185246 - RNA, 13 nt, Homo sapiens
cucucccuugugg

SEQ ID NO: 2185247 - RNA, 19 nt, Homo sapiens
ggccacggugccuccagau

SEQ ID NO: 2185248 - RNA, 21 nt, Homo sapiens
cuccagaauuuggaaauccua

SEQ ID NO: 2185249 - RNA, 20 nt, Homo sapiens
agaaucacuugacuuugcca

SEQ ID NO: 2185250 - RNA, 20 nt, Homo sapiens
ucuuuguaaugaaaaccaca

SEQ ID NO: 2185251 - RNA, 18 nt, Homo sapiens
agcugcuccccucugcac

SEQ ID NO: 2185252 - RNA, 20 nt, Homo sapiens
uaaaauauuuuuugcuauau

SEQ ID NO: 2185253 - RNA, 15 nt, Homo sapiens
ucuacauuugagggc

SEQ ID NO: 2185254 - RNA, 19 nt, Homo sapiens
gacaccuguacauucuucc

SEQ ID NO: 2185255 - RNA, 16 nt, Homo sapiens
caugaucauagcucac

SEQ ID NO: 2185256 - RNA, 18 nt, Homo sapiens
uuaaaaauaucugaauau

SEQ ID NO: 2185257 - RNA, 22 nt, Homo sapiens
augugucaggugacccugauga

SEQ ID NO: 2185258 - RNA, 18 nt, Homo sapiens
gcuuaccugggcacaaac

SEQ ID NO: 2185259 - RNA, 14 nt, Homo sapiens
cacaagccugagaa

SEQ ID NO: 2185260 - RNA, 14 nt, Homo sapiens
ccuauggaaagggu

SEQ ID NO: 2185261 - RNA, 21 nt, Homo sapiens
cccgcauguacaaaaacacaa

SEQ ID NO: 2185262 - RNA, 14 nt, Homo sapiens
ugacacugucugcu

SEQ ID NO: 2185263 - RNA, 15 nt, Homo sapiens
cucuuucuacauucu

SEQ ID NO: 2185264 - RNA, 15 nt, Homo sapiens
ugaaucaugaaguaa

SEQ ID NO: 2185265 - RNA, 15 nt, Homo sapiens
caaaugaaaacccca

SEQ ID NO: 2185266 - RNA, 13 nt, Homo sapiens
guuucagcauucc

SEQ ID NO: 2185267 - RNA, 12 nt, Homo sapiens
gggaaacuggcu

SEQ ID NO: 2185268 - RNA, 16 nt, Homo sapiens
gaugccagggcuggaa

SEQ ID NO: 2185269 - RNA, 12 nt, Homo sapiens
aaaguucccuga

SEQ ID NO: 2185270 - RNA, 21 nt, Homo sapiens
gggaagaggcgagagggcugu

SEQ ID NO: 2185271 - RNA, 18 nt, Homo sapiens
cuaauaauguuaaccaag

SEQ ID NO: 2185272 - RNA, 20 nt, Homo sapiens
augauaaauuaagcaugaaa

SEQ ID NO: 2185273 - RNA, 13 nt, Homo sapiens
cccaggugcauuu

SEQ ID NO: 2185274 - RNA, 15 nt, Homo sapiens
cucuaccuaaguucc

SEQ ID NO: 2185275 - RNA, 23 nt, Homo sapiens
gccuccacuugccuugugauauu

SEQ ID NO: 2185276 - RNA, 21 nt, Homo sapiens
cugaugagagagugcugagaa

SEQ ID NO: 2185277 - RNA, 22 nt, Homo sapiens
gcguucacuccaaugucugcug

SEQ ID NO: 2185278 - RNA, 19 nt, Homo sapiens
uccaaugcauuggccucug

SEQ ID NO: 2185279 - RNA, 16 nt, Homo sapiens
guuugguuuacauuua

SEQ ID NO: 2185280 - RNA, 14 nt, Homo sapiens
uaaucacuacugua

SEQ ID NO: 2185281 - RNA, 21 nt, Homo sapiens
acuguccggccccgagucacu

SEQ ID NO: 2185282 - RNA, 16 nt, Homo sapiens
guuugcuaauguuucc

SEQ ID NO: 2185283 - RNA, 17 nt, Homo sapiens
caugggggugaccccac

SEQ ID NO: 2185284 - RNA, 20 nt, Homo sapiens
aacaucauaagauaguuaca

SEQ ID NO: 2185285 - RNA, 18 nt, Homo sapiens
auuaccacuucccugcuu

SEQ ID NO: 2185286 - RNA, 19 nt, Homo sapiens
uguggaggcuccuguggua

SEQ ID NO: 2185287 - RNA, 14 nt, Homo sapiens
agggggugucagaa

SEQ ID NO: 2185288 - RNA, 13 nt, Homo sapiens
aauuuaaggcaaa

SEQ ID NO: 2185289 - RNA, 13 nt, Homo sapiens
uuaauaaagaagu

SEQ ID NO: 2185290 - RNA, 13 nt, Homo sapiens
aauaaaaggcauu

SEQ ID NO: 2185291 - RNA, 13 nt, Homo sapiens
cugggcugugcua

SEQ ID NO: 2185292 - RNA, 22 nt, Homo sapiens
caccgcgcccggccucagugcc

SEQ ID NO: 2185293 - RNA, 14 nt, Homo sapiens
auaaguagcauuca

SEQ ID NO: 2185294 - RNA, 22 nt, Homo sapiens
gauggccuuguuucaaaauucu

SEQ ID NO: 2185295 - RNA, 16 nt, Homo sapiens
ucucucaguucuacac

SEQ ID NO: 2185296 - RNA, 15 nt, Homo sapiens
auguucauugcacau

SEQ ID NO: 2185297 - RNA, 11 nt, Homo sapiens
cucuuccauau

SEQ ID NO: 2185298 - RNA, 22 nt, Homo sapiens
aagguuagguuugucaacacaa

SEQ ID NO: 2185299 - RNA, 16 nt, Homo sapiens
gcuccagaugcagggc

SEQ ID NO: 2185300 - RNA, 15 nt, Homo sapiens
agcggggagccagga

SEQ ID NO: 2185301 - RNA, 21 nt, Homo sapiens
uugaucccuaaagaaaacaaa

SEQ ID NO: 2185302 - RNA, 22 nt, Homo sapiens
acaacauccucagaaccauuca

SEQ ID NO: 2185303 - RNA, 22 nt, Homo sapiens
acacucuccaaacagucaccau

SEQ ID NO: 2185304 - RNA, 14 nt, Homo sapiens
uaaagaugcugugu

SEQ ID NO: 2185305 - RNA, 14 nt, Homo sapiens
gauccacuucucuc

SEQ ID NO: 2185306 - RNA, 15 nt, Homo sapiens
ugaaagaaauuugau

SEQ ID NO: 2185307 - RNA, 19 nt, Homo sapiens
ugcacaaugcauugaaccg

SEQ ID NO: 2185308 - RNA, 13 nt, Homo sapiens
ucacacugugcuc

SEQ ID NO: 2185309 - RNA, 23 nt, Homo sapiens
uccucagcccucucuugccaaaa

SEQ ID NO: 2185310 - RNA, 16 nt, Homo sapiens
caaaaaauucagugau

SEQ ID NO: 2185311 - RNA, 14 nt, Homo sapiens
auucauuaugcaac

SEQ ID NO: 2185312 - RNA, 19 nt, Homo sapiens
guuccugaaaauugcaaua

SEQ ID NO: 2185313 - RNA, 22 nt, Homo sapiens
ugccuaguaagggaacuaugga

SEQ ID NO: 2185314 - RNA, 19 nt, Homo sapiens
ccaaaacccugaagccauu

SEQ ID NO: 2185315 - RNA, 16 nt, Homo sapiens
gccacgaggugcaaca

SEQ ID NO: 2185316 - RNA, 13 nt, Homo sapiens
ugccagcaucugc

SEQ ID NO: 2185317 - RNA, 15 nt, Homo sapiens
aggcagcaaacagau

SEQ ID NO: 2185318 - RNA, 10 nt, Homo sapiens
auugcacaau

SEQ ID NO: 2185319 - RNA, 18 nt, Homo sapiens
augaagagcaacugggac

SEQ ID NO: 2185320 - RNA, 15 nt, Homo sapiens
cacuuuuucauuugc

SEQ ID NO: 2185321 - RNA, 18 nt, Homo sapiens
cggcauccugaaagccag

SEQ ID NO: 2185322 - RNA, 16 nt, Homo sapiens
ccagcccuguccccua

SEQ ID NO: 2185323 - RNA, 15 nt, Homo sapiens
auuuaaguuuuuccc

SEQ ID NO: 2185324 - RNA, 18 nt, Homo sapiens
auagcaagaccucaucuc

SEQ ID NO: 2185325 - RNA, 23 nt, Homo sapiens
ugauucaguucccuccuucuuac

SEQ ID NO: 2185326 - RNA, 19 nt, Homo sapiens
gaggugaaugcacagugaa

SEQ ID NO: 2185327 - RNA, 12 nt, Homo sapiens
gaacaugaauca

SEQ ID NO: 2185328 - RNA, 19 nt, Homo sapiens
aguauuggcaaagaugugg

SEQ ID NO: 2185329 - RNA, 14 nt, Homo sapiens
caggucucccugga

SEQ ID NO: 2185330 - RNA, 20 nt, Homo sapiens
cagacgggaaugccuagguc

SEQ ID NO: 2185331 - RNA, 15 nt, Homo sapiens
gaaaccuuugacacu

SEQ ID NO: 2185332 - RNA, 18 nt, Homo sapiens
aggacauuuuacugcagu

SEQ ID NO: 2185333 - RNA, 18 nt, Homo sapiens
cugggaagaauguauucg

SEQ ID NO: 2185334 - RNA, 17 nt, Homo sapiens
ccagcaugguugcagau

SEQ ID NO: 2185335 - RNA, 18 nt, Homo sapiens
ucugaauggaagaguguu

SEQ ID NO: 2185336 - RNA, 19 nt, Homo sapiens
cugcgcauguuuucuucau

SEQ ID NO: 2185337 - RNA, 13 nt, Homo sapiens
agcugguccaggg

SEQ ID NO: 2185338 - RNA, 18 nt, Homo sapiens
uaugcauguaauggacua

SEQ ID NO: 2185339 - RNA, 12 nt, Homo sapiens
agucuucuuuca

SEQ ID NO: 2185340 - RNA, 21 nt, Homo sapiens
ugccuuaauuuagaaacugaa

SEQ ID NO: 2185341 - RNA, 23 nt, Homo sapiens
ggcuggagauggcugcugcucac

SEQ ID NO: 2185342 - RNA, 18 nt, Homo sapiens
uaguuacuaaacauguau

SEQ ID NO: 2185343 - RNA, 16 nt, Homo sapiens
uuuuuaugugcaauaa

SEQ ID NO: 2185344 - RNA, 19 nt, Homo sapiens
auuuuuugcugcagacuca

SEQ ID NO: 2185345 - RNA, 20 nt, Homo sapiens
gugcucucucagcacuggga

SEQ ID NO: 2185346 - RNA, 18 nt, Homo sapiens
aaugugaauugcaugacu

SEQ ID NO: 2185347 - RNA, 15 nt, Homo sapiens
ucuuguucacugcag

SEQ ID NO: 2185348 - RNA, 14 nt, Homo sapiens
ucauugacuaucaa

SEQ ID NO: 2185349 - RNA, 21 nt, Homo sapiens
aagccaaaaaaugggagacaa

SEQ ID NO: 2185350 - RNA, 23 nt, Homo sapiens
ugcugcugagugcaccacuucaa

SEQ ID NO: 2185351 - RNA, 22 nt, Homo sapiens
ucugccgcccuccacaccucua

SEQ ID NO: 2185352 - RNA, 20 nt, Homo sapiens
aaacacugcuguucuuuaaa

SEQ ID NO: 2185353 - RNA, 16 nt, Homo sapiens
aaaauuccauuuacuu

SEQ ID NO: 2185354 - RNA, 23 nt, Homo sapiens
aucacgaaggaaaacugccauaa

SEQ ID NO: 2185355 - RNA, 14 nt, Homo sapiens
cagaccagagcucu

SEQ ID NO: 2185356 - RNA, 13 nt, Homo sapiens
augcuuaggugaa

SEQ ID NO: 2185357 - RNA, 19 nt, Homo sapiens
cucuuugagucaagucaaa

SEQ ID NO: 2185358 - RNA, 22 nt, Homo sapiens
cuucgggcugugcccggggaaa

SEQ ID NO: 2185359 - RNA, 23 nt, Homo sapiens
auuccccuacaucaaaugcucaa

SEQ ID NO: 2185360 - RNA, 16 nt, Homo sapiens
auucucaaagcaggaa

SEQ ID NO: 2185361 - RNA, 20 nt, Homo sapiens
uugaaucuacaaaaaacaac

SEQ ID NO: 2185362 - RNA, 23 nt, Homo sapiens
guuuauauuuucaugugguacua

SEQ ID NO: 2185363 - RNA, 14 nt, Homo sapiens
aacuuuugcaaucu

SEQ ID NO: 2185364 - RNA, 14 nt, Homo sapiens
aaauuugagacaaa

SEQ ID NO: 2185365 - RNA, 14 nt, Homo sapiens
gcuuuucacaucca

SEQ ID NO: 2185366 - RNA, 22 nt, Homo sapiens
agccuauuccaucaacugugaa

SEQ ID NO: 2185367 - RNA, 12 nt, Homo sapiens
uucaagugcuaa

SEQ ID NO: 2185368 - RNA, 18 nt, Homo sapiens
uuuccugcccuuccucag

SEQ ID NO: 2185369 - RNA, 14 nt, Homo sapiens
agcugauccagaug

SEQ ID NO: 2185370 - RNA, 20 nt, Homo sapiens
ucaguucuuagauucagggg

SEQ ID NO: 2185371 - RNA, 13 nt, Homo sapiens
auuugaaaacaua

SEQ ID NO: 2185372 - RNA, 20 nt, Homo sapiens
gcugugggguggagcacugg

SEQ ID NO: 2185373 - RNA, 22 nt, Homo sapiens
uugcagguguccgggggucuag

SEQ ID NO: 2185374 - RNA, 17 nt, Homo sapiens
cugcacagagucaggau

SEQ ID NO: 2185375 - RNA, 16 nt, Homo sapiens
ucacucugcuuugcau

SEQ ID NO: 2185376 - RNA, 21 nt, Homo sapiens
cuuucauuauuaguacugcuc

SEQ ID NO: 2185377 - RNA, 14 nt, Homo sapiens
cuaaaaaaauuuau

SEQ ID NO: 2185378 - RNA, 14 nt, Homo sapiens
cuuacuaaauauca

SEQ ID NO: 2185379 - RNA, 14 nt, Homo sapiens
aaauuaaacauauu

SEQ ID NO: 2185380 - RNA, 15 nt, Homo sapiens
uccuggucacuggag

SEQ ID NO: 2185381 - RNA, 19 nt, Homo sapiens
ugaagccaauucagacagg

SEQ ID NO: 2185382 - RNA, 13 nt, Homo sapiens
ggugcaugccuuc

SEQ ID NO: 2185383 - RNA, 24 nt, Homo sapiens
agcgugcauaaguuaacuuccaau

SEQ ID NO: 2185384 - RNA, 16 nt, Homo sapiens
caggcaaauagcuuua

SEQ ID NO: 2185385 - RNA, 12 nt, Homo sapiens
gagagcucuuag

SEQ ID NO: 2185386 - RNA, 14 nt, Homo sapiens
auacaaaucaucca

SEQ ID NO: 2185387 - RNA, 19 nt, Homo sapiens
aggaauacauaaaguaugu

SEQ ID NO: 2185388 - RNA, 19 nt, Homo sapiens
uccugccugugcugugacu

SEQ ID NO: 2185389 - RNA, 13 nt, Homo sapiens
acuucucuugaau

SEQ ID NO: 2185390 - RNA, 12 nt, Homo sapiens
aauaagugccag

SEQ ID NO: 2185391 - RNA, 17 nt, Homo sapiens
cacccgacuccucaaaa

SEQ ID NO: 2185392 - RNA, 22 nt, Homo sapiens
caaggagacacaacaacuccua

SEQ ID NO: 2185393 - RNA, 15 nt, Homo sapiens
cccauccagccacgg

SEQ ID NO: 2185394 - RNA, 14 nt, Homo sapiens
gauuggcucaccca

SEQ ID NO: 2185395 - RNA, 14 nt, Homo sapiens
auccccagccagaa

SEQ ID NO: 2185396 - RNA, 19 nt, Homo sapiens
augugaccagacugcacag

SEQ ID NO: 2185397 - RNA, 14 nt, Homo sapiens
uccuaauacuguca

SEQ ID NO: 2185398 - RNA, 12 nt, Homo sapiens
ucuacuuuuuga

SEQ ID NO: 2185399 - RNA, 16 nt, Homo sapiens
aacacaccacacuggc

SEQ ID NO: 2185400 - RNA, 13 nt, Homo sapiens
cgggaaaggagcu

SEQ ID NO: 2185401 - RNA, 18 nt, Homo sapiens
uguuuuuguaaagugugg

SEQ ID NO: 2185402 - RNA, 14 nt, Homo sapiens
ugagaagaacacau

SEQ ID NO: 2185403 - RNA, 23 nt, Homo sapiens
ucugagccaaagagaaugccauu

SEQ ID NO: 2185404 - RNA, 20 nt, Homo sapiens
gacuuccucugccacucccu

SEQ ID NO: 2185405 - RNA, 19 nt, Homo sapiens
gcuuugaaugcggcccaac

SEQ ID NO: 2185406 - RNA, 15 nt, Homo sapiens
auauauuaauaugca

SEQ ID NO: 2185407 - RNA, 21 nt, Homo sapiens
ccaagauaucagcccaaaagu

SEQ ID NO: 2185408 - RNA, 17 nt, Homo sapiens
ccagauuucauucucag

SEQ ID NO: 2185409 - RNA, 20 nt, Homo sapiens
gcggcccacgccagcuggcc

SEQ ID NO: 2185410 - RNA, 22 nt, Homo sapiens
cuccagcuagcaaaauuacuac

SEQ ID NO: 2185411 - RNA, 14 nt, Homo sapiens
gccaacugcaaaaa

SEQ ID NO: 2185412 - RNA, 19 nt, Homo sapiens
gguccccgguugcugguca

SEQ ID NO: 2185413 - RNA, 17 nt, Homo sapiens
uucccacccuccaucua

SEQ ID NO: 2185414 - RNA, 12 nt, Homo sapiens
acuccaccucaa

SEQ ID NO: 2185415 - RNA, 14 nt, Homo sapiens
gacauguugcucuu

SEQ ID NO: 2185416 - RNA, 22 nt, Homo sapiens
acaagaaacuuuggaagcacuu

SEQ ID NO: 2185417 - RNA, 16 nt, Homo sapiens
caaaaagaaaugaugu

SEQ ID NO: 2185418 - RNA, 13 nt, Homo sapiens
gacuuugccaaaa

SEQ ID NO: 2185419 - RNA, 11 nt, Homo sapiens
augugcaauaa

SEQ ID NO: 2185420 - RNA, 19 nt, Homo sapiens
ugguuccacagaagcuuug

SEQ ID NO: 2185421 - RNA, 20 nt, Homo sapiens
aaucuccuauuccuucacac

SEQ ID NO: 2185422 - RNA, 16 nt, Homo sapiens
ugggcggaucacuuga

SEQ ID NO: 2185423 - RNA, 16 nt, Homo sapiens
ccaugugcccacuguc

SEQ ID NO: 2185424 - RNA, 19 nt, Homo sapiens
acaggaaacuacuucacag

SEQ ID NO: 2185425 - RNA, 17 nt, Homo sapiens
aaacaucaccuauuuaa

SEQ ID NO: 2185426 - RNA, 20 nt, Homo sapiens
cuuuacaaauagaauuugag

SEQ ID NO: 2185427 - RNA, 23 nt, Homo sapiens
acugcuggggagacaaaucucag

SEQ ID NO: 2185428 - RNA, 12 nt, Homo sapiens
uuggagacagag

SEQ ID NO: 2185429 - RNA, 11 nt, Homo sapiens
cuuaaacacau

SEQ ID NO: 2185430 - RNA, 22 nt, Homo sapiens
ccuauuauaauugucaugacuu

SEQ ID NO: 2185431 - RNA, 21 nt, Homo sapiens
cuuuauauauguacuagcauu

SEQ ID NO: 2185432 - RNA, 14 nt, Homo sapiens
aucccaacagccca

SEQ ID NO: 2185433 - RNA, 15 nt, Homo sapiens
cucugaaauuuccca

SEQ ID NO: 2185434 - RNA, 23 nt, Homo sapiens
cuucagauccuuuuauucuccag

SEQ ID NO: 2185435 - RNA, 18 nt, Homo sapiens
aaugaaaugcauuuugcu

SEQ ID NO: 2185436 - RNA, 12 nt, Homo sapiens
ccaccuugccaa

SEQ ID NO: 2185437 - RNA, 15 nt, Homo sapiens
gaagcgagucauuuc

SEQ ID NO: 2185438 - RNA, 16 nt, Homo sapiens
gaaaugggcuuuucag

SEQ ID NO: 2185439 - RNA, 11 nt, Homo sapiens
cgauccuuaau

SEQ ID NO: 2185440 - RNA, 16 nt, Homo sapiens
ggagaagccguggccu

SEQ ID NO: 2185441 - RNA, 13 nt, Homo sapiens
guauaacugaaaa

SEQ ID NO: 2185442 - RNA, 14 nt, Homo sapiens
augauaguuuucau

SEQ ID NO: 2185443 - RNA, 16 nt, Homo sapiens
ccaagagcagcugcca

SEQ ID NO: 2185444 - RNA, 16 nt, Homo sapiens
ucugcucauucuaaug

SEQ ID NO: 2185445 - RNA, 16 nt, Homo sapiens
aggacgcacugagcaa

SEQ ID NO: 2185446 - RNA, 17 nt, Homo sapiens
uaccuugagccaguaau

SEQ ID NO: 2185447 - RNA, 18 nt, Homo sapiens
caaagucucauagcuuug

SEQ ID NO: 2185448 - RNA, 23 nt, Homo sapiens
caagaaccagaucguacuugaaa

SEQ ID NO: 2185449 - RNA, 22 nt, Homo sapiens
caagugauaauacagauuugua

SEQ ID NO: 2185450 - RNA, 19 nt, Homo sapiens
uuacaagagaagaaaguga

SEQ ID NO: 2185451 - RNA, 20 nt, Homo sapiens
caaacccauuuccagcuccu

SEQ ID NO: 2185452 - RNA, 15 nt, Homo sapiens
cuccaccuccugggu

SEQ ID NO: 2185453 - RNA, 18 nt, Homo sapiens
cuuuucauugcuaccucu

SEQ ID NO: 2185454 - RNA, 17 nt, Homo sapiens
ugccuuaugggcugaag

SEQ ID NO: 2185455 - RNA, 14 nt, Homo sapiens
aagcaggugcuaca

SEQ ID NO: 2185456 - RNA, 22 nt, Homo sapiens
gcugaggccuuaucauucauuc

SEQ ID NO: 2185457 - RNA, 19 nt, Homo sapiens
uacccugaaauucaggaug

SEQ ID NO: 2185458 - RNA, 15 nt, Homo sapiens
acaguggcucuccaa

SEQ ID NO: 2185459 - RNA, 15 nt, Homo sapiens
aacauucgaccucca

SEQ ID NO: 2185460 - RNA, 16 nt, Homo sapiens
uacaaaaaucccaaau

SEQ ID NO: 2185461 - RNA, 21 nt, Homo sapiens
ucggagcuggcccagggggcc

SEQ ID NO: 2185462 - RNA, 23 nt, Homo sapiens
uuggccguuugcuuaaugccaga

SEQ ID NO: 2185463 - RNA, 16 nt, Homo sapiens
aaggcauauauguacu

SEQ ID NO: 2185464 - RNA, 15 nt, Homo sapiens
uggagucauucucau

SEQ ID NO: 2185465 - RNA, 23 nt, Homo sapiens
ugugagggugacguuagcauuac

SEQ ID NO: 2185466 - RNA, 20 nt, Homo sapiens
gccaccacccucaggugccu

SEQ ID NO: 2185467 - RNA, 20 nt, Homo sapiens
augugcuaugaagcuuucuu

SEQ ID NO: 2185468 - RNA, 12 nt, Homo sapiens
ccuaugauccca

SEQ ID NO: 2185469 - RNA, 16 nt, Homo sapiens
agcucacacucaucca

SEQ ID NO: 2185470 - RNA, 13 nt, Homo sapiens
aauccaacaucca

SEQ ID NO: 2185471 - RNA, 14 nt, Homo sapiens
ggaggccuuucauc

SEQ ID NO: 2185472 - RNA, 20 nt, Homo sapiens
uccagaugauccuugcacag

SEQ ID NO: 2185473 - RNA, 20 nt, Homo sapiens
ccugcuaguguagcuucuga

SEQ ID NO: 2185474 - RNA, 20 nt, Homo sapiens
gaaucuccauuucugcucag

SEQ ID NO: 2185475 - RNA, 22 nt, Homo sapiens
gaagguuaaaggaaaagcacaa

SEQ ID NO: 2185476 - RNA, 11 nt, Homo sapiens
uaacuauucaa

SEQ ID NO: 2185477 - RNA, 22 nt, Homo sapiens
cuucagcucuucuugacaucaa

SEQ ID NO: 2185478 - RNA, 13 nt, Homo sapiens
cuaugacaugcaa

SEQ ID NO: 2185479 - RNA, 15 nt, Homo sapiens
acagcucuggcuuug

SEQ ID NO: 2185480 - RNA, 18 nt, Homo sapiens
ugaacauuguuuuaauca

SEQ ID NO: 2185481 - RNA, 23 nt, Homo sapiens
cagcuuuauccccguuucuugca

SEQ ID NO: 2185482 - RNA, 14 nt, Homo sapiens
uaaggauucaggga

SEQ ID NO: 2185483 - RNA, 13 nt, Homo sapiens
aaaguauuauuca

SEQ ID NO: 2185484 - RNA, 13 nt, Homo sapiens
caugauguuacau

SEQ ID NO: 2185485 - RNA, 13 nt, Homo sapiens
uugaaaacauaca

SEQ ID NO: 2185486 - RNA, 22 nt, Homo sapiens
agucauggagaaucugcugcau

SEQ ID NO: 2185487 - RNA, 14 nt, Homo sapiens
cuugucauucucau

SEQ ID NO: 2185488 - RNA, 21 nt, Homo sapiens
agaugaccuacagugcugugu

SEQ ID NO: 2185489 - RNA, 23 nt, Homo sapiens
cuccacucaugugacucuuucca

SEQ ID NO: 2185490 - RNA, 21 nt, Homo sapiens
uggccaccaguaugacaguau

SEQ ID NO: 2185491 - RNA, 23 nt, Homo sapiens
gacagaugaggcuuuccauggga

SEQ ID NO: 2185492 - RNA, 19 nt, Homo sapiens
gcccauaugcuaccaccag

SEQ ID NO: 2185493 - RNA, 16 nt, Homo sapiens
aggauaugacaacucu

SEQ ID NO: 2185494 - RNA, 22 nt, Homo sapiens
ugcuaucucucaagagugcuga

SEQ ID NO: 2185495 - RNA, 17 nt, Homo sapiens
ccuaaaagcacacucau

SEQ ID NO: 2185496 - RNA, 13 nt, Homo sapiens
caacaggcauucc

SEQ ID NO: 2185497 - RNA, 21 nt, Homo sapiens
acagacgccugcuuuugcaaa

SEQ ID NO: 2185498 - RNA, 17 nt, Homo sapiens
uaacaagaccucagugc

SEQ ID NO: 2185499 - RNA, 16 nt, Homo sapiens
cucccagcugcacuuu

SEQ ID NO: 2185500 - RNA, 14 nt, Homo sapiens
uguuuagugauauu

SEQ ID NO: 2185501 - RNA, 17 nt, Homo sapiens
ccugcuaaaugacuuau

SEQ ID NO: 2185502 - RNA, 19 nt, Homo sapiens
gaagcuggaggcuccagga

SEQ ID NO: 2185503 - RNA, 16 nt, Homo sapiens
gacacugaaccuuguu

SEQ ID NO: 2185504 - RNA, 22 nt, Homo sapiens
uaugugaaaaaaaugagacuua

SEQ ID NO: 2185505 - RNA, 16 nt, Homo sapiens
ugucacaguauaguca

SEQ ID NO: 2185506 - RNA, 13 nt, Homo sapiens
auaaaacggugcu

SEQ ID NO: 2185507 - RNA, 18 nt, Homo sapiens
ugugccuucccuuucuaa

SEQ ID NO: 2185508 - RNA, 14 nt, Homo sapiens
ccacagacucuuac

SEQ ID NO: 2185509 - RNA, 15 nt, Homo sapiens
ggucagugguccaca

SEQ ID NO: 2185510 - RNA, 21 nt, Homo sapiens
uggcugauuuagaccaaaaga

SEQ ID NO: 2185511 - RNA, 17 nt, Homo sapiens
agacucaguuugucaga

SEQ ID NO: 2185512 - RNA, 22 nt, Homo sapiens
auagcuaagcaucuccuuacag

SEQ ID NO: 2185513 - RNA, 17 nt, Homo sapiens
augagaauuguauguca

SEQ ID NO: 2185514 - RNA, 14 nt, Homo sapiens
uuucacucucugca

SEQ ID NO: 2185515 - RNA, 22 nt, Homo sapiens
gacacuacacguuucaaccucu

SEQ ID NO: 2185516 - RNA, 19 nt, Homo sapiens
uauuugcacacugcacugu

SEQ ID NO: 2185517 - RNA, 14 nt, Homo sapiens
gcucgggugcugcc

SEQ ID NO: 2185518 - RNA, 22 nt, Homo sapiens
gucccugguucauugauggaug

SEQ ID NO: 2185519 - RNA, 12 nt, Homo sapiens
gcacuagcauuu

SEQ ID NO: 2185520 - RNA, 22 nt, Homo sapiens
cccaccuucuucagccaccucu

SEQ ID NO: 2185521 - RNA, 19 nt, Homo sapiens
ggcgcuccucccagcugua

SEQ ID NO: 2185522 - RNA, 19 nt, Homo sapiens
auccugggggccuggguug

SEQ ID NO: 2185523 - RNA, 22 nt, Homo sapiens
aaaucugacauauuaugccuga

SEQ ID NO: 2185524 - RNA, 15 nt, Homo sapiens
ugguaugagacagau

SEQ ID NO: 2185525 - RNA, 16 nt, Homo sapiens
aaaauuaacugaaaag

SEQ ID NO: 2185526 - RNA, 13 nt, Homo sapiens
cucucugccaugg

SEQ ID NO: 2185527 - RNA, 16 nt, Homo sapiens
uucugauagccgguga

SEQ ID NO: 2185528 - RNA, 22 nt, Homo sapiens
cacugagaagucaaacauuuca

SEQ ID NO: 2185529 - RNA, 21 nt, Homo sapiens
ccuucucgcuuuugccauuag

SEQ ID NO: 2185530 - RNA, 13 nt, Homo sapiens
gccuucuggagcu

SEQ ID NO: 2185531 - RNA, 23 nt, Homo sapiens
ugaauaugggguugguguucuca

SEQ ID NO: 2185532 - RNA, 16 nt, Homo sapiens
accagcggcugcucaa

SEQ ID NO: 2185533 - RNA, 17 nt, Homo sapiens
aagggguuggggugaca

SEQ ID NO: 2185534 - RNA, 21 nt, Homo sapiens
gaacucaucccuguuccucaa

SEQ ID NO: 2185535 - RNA, 18 nt, Homo sapiens
gaaacacugccugcccuc

SEQ ID NO: 2185536 - RNA, 11 nt, Homo sapiens
uccuguucuca

SEQ ID NO: 2185537 - RNA, 16 nt, Homo sapiens
guuacuguugcacuga

SEQ ID NO: 2185538 - RNA, 11 nt, Homo sapiens
acgcacugcuc

SEQ ID NO: 2185539 - RNA, 18 nt, Homo sapiens
ugcauucaugguuaugaa

SEQ ID NO: 2185540 - RNA, 18 nt, Homo sapiens
ucaguaaauguuugugga

SEQ ID NO: 2185541 - RNA, 19 nt, Homo sapiens
accaagcauuuagugcaca

SEQ ID NO: 2185542 - RNA, 16 nt, Homo sapiens
caaagcugcaugugua

SEQ ID NO: 2185543 - RNA, 12 nt, Homo sapiens
acccguccuccc

SEQ ID NO: 2185544 - RNA, 16 nt, Homo sapiens
acuccccagugcuccu

SEQ ID NO: 2185545 - RNA, 19 nt, Homo sapiens
acccugaagaggcauuuca

SEQ ID NO: 2185546 - RNA, 20 nt, Homo sapiens
ugagaaggacaccuccuucc

SEQ ID NO: 2185547 - RNA, 19 nt, Homo sapiens
gaauugucuuuggugcuuu

SEQ ID NO: 2185548 - RNA, 14 nt, Homo sapiens
agauagcagggcau

SEQ ID NO: 2185549 - RNA, 20 nt, Homo sapiens
ugcugugcauaucacuugau

SEQ ID NO: 2185550 - RNA, 16 nt, Homo sapiens
ucuuggaacuugccug

SEQ ID NO: 2185551 - RNA, 17 nt, Homo sapiens
gcugugcaucaguggga

SEQ ID NO: 2185552 - RNA, 22 nt, Homo sapiens
cauguaguuggggcaccauaca

SEQ ID NO: 2185553 - RNA, 22 nt, Homo sapiens
caguuucccuaucugcaaaaug

SEQ ID NO: 2185554 - RNA, 19 nt, Homo sapiens
caaugacgugccuaccucu

SEQ ID NO: 2185555 - RNA, 21 nt, Homo sapiens
ccccaggugcagugugacauu

SEQ ID NO: 2185556 - RNA, 15 nt, Homo sapiens
cacacugccaaauaa

SEQ ID NO: 2185557 - RNA, 14 nt, Homo sapiens
gcucucaggccagc

SEQ ID NO: 2185558 - RNA, 19 nt, Homo sapiens
uccaaucggagacaaaagc

SEQ ID NO: 2185559 - RNA, 18 nt, Homo sapiens
ggugaaaaccccaucucu

SEQ ID NO: 2185560 - RNA, 22 nt, Homo sapiens
ccaagcuucaacccucagccuu

SEQ ID NO: 2185561 - RNA, 16 nt, Homo sapiens
gaacuggguacuugug

SEQ ID NO: 2185562 - RNA, 17 nt, Homo sapiens
aaggacuuaaggacagc

SEQ ID NO: 2185563 - RNA, 21 nt, Homo sapiens
caaguaguagugucuuccuag

SEQ ID NO: 2185564 - RNA, 22 nt, Homo sapiens
guuuccauccccaggauccacu

SEQ ID NO: 2185565 - RNA, 23 nt, Homo sapiens
auccuauuuugaaccccucucca

SEQ ID NO: 2185566 - RNA, 15 nt, Homo sapiens
ucauccaggccucag

SEQ ID NO: 2185567 - RNA, 21 nt, Homo sapiens
aauguaucauuuuugugcaca

SEQ ID NO: 2185568 - RNA, 21 nt, Homo sapiens
ugcaaccucggggagugccac

SEQ ID NO: 2185569 - RNA, 19 nt, Homo sapiens
guaugugugccagcugugu

SEQ ID NO: 2185570 - RNA, 19 nt, Homo sapiens
ucuuuaaaugcguuccuca

SEQ ID NO: 2185571 - RNA, 16 nt, Homo sapiens
ugagcugagugcugaa

SEQ ID NO: 2185572 - RNA, 14 nt, Homo sapiens
uucacaaaacauua

SEQ ID NO: 2185573 - RNA, 17 nt, Homo sapiens
auugugaaccaugguga

SEQ ID NO: 2185574 - RNA, 17 nt, Homo sapiens
agugauagauguagucu

SEQ ID NO: 2185575 - RNA, 14 nt, Homo sapiens
auuguguuugacuu

SEQ ID NO: 2185576 - RNA, 14 nt, Homo sapiens
cuggggcaacugag

SEQ ID NO: 2185577 - RNA, 16 nt, Homo sapiens
auugacuccuuuccaa

SEQ ID NO: 2185578 - RNA, 15 nt, Homo sapiens
uggaaggcagacagc

SEQ ID NO: 2185579 - RNA, 21 nt, Homo sapiens
cuggcaguccaaauugaaaga

SEQ ID NO: 2185580 - RNA, 13 nt, Homo sapiens
ucaagaacaggac

SEQ ID NO: 2185581 - RNA, 17 nt, Homo sapiens
ugaaaguugcuuuuauu

SEQ ID NO: 2185582 - RNA, 18 nt, Homo sapiens
ugcuuaguguacuuggag

SEQ ID NO: 2185583 - RNA, 14 nt, Homo sapiens
agauuccuuuccug

SEQ ID NO: 2185584 - RNA, 20 nt, Homo sapiens
ccaaguacgauaauuccuca

SEQ ID NO: 2185585 - RNA, 15 nt, Homo sapiens
agaaaaaaaaacugg

SEQ ID NO: 2185586 - RNA, 12 nt, Homo sapiens
ucagacauacag

SEQ ID NO: 2185587 - RNA, 12 nt, Homo sapiens
auaaacauuuaa

SEQ ID NO: 2185588 - RNA, 15 nt, Homo sapiens
uuacaaaaguauuau

SEQ ID NO: 2185589 - RNA, 22 nt, Homo sapiens
cugacagccuuccccagcucca

SEQ ID NO: 2185590 - RNA, 16 nt, Homo sapiens
auaaucagucaugugu

SEQ ID NO: 2185591 - RNA, 18 nt, Homo sapiens
uaaagacugaucucaggg

SEQ ID NO: 2185592 - RNA, 18 nt, Homo sapiens
uucuugcuuucucucuca

SEQ ID NO: 2185593 - RNA, 23 nt, Homo sapiens
ccauuuagccaccaucuuugcag

SEQ ID NO: 2185594 - RNA, 17 nt, Homo sapiens
uuaagacagagucucac

SEQ ID NO: 2185595 - RNA, 20 nt, Homo sapiens
uuaaauacuucaugagcauu

SEQ ID NO: 2185596 - RNA, 13 nt, Homo sapiens
aguuuuuauacau

SEQ ID NO: 2185597 - RNA, 15 nt, Homo sapiens
aaauuuaaaauucaa

SEQ ID NO: 2185598 - RNA, 15 nt, Homo sapiens
auuauuuaauaacau

SEQ ID NO: 2185599 - RNA, 23 nt, Homo sapiens
aauuaggaagugcagaagcacau

SEQ ID NO: 2185600 - RNA, 15 nt, Homo sapiens
ucuuugcugcaguca

SEQ ID NO: 2185601 - RNA, 22 nt, Homo sapiens
ccaguaaaaucaaaugugcauc

SEQ ID NO: 2185602 - RNA, 20 nt, Homo sapiens
gaaaucaaaaucuggagaaa

SEQ ID NO: 2185603 - RNA, 20 nt, Homo sapiens
ugcaauacggaacacuguca

SEQ ID NO: 2185604 - RNA, 23 nt, Homo sapiens
agcucugcuugccgaaacuggaa

SEQ ID NO: 2185605 - RNA, 20 nt, Homo sapiens
aagaacaggacauagcacga

SEQ ID NO: 2185606 - RNA, 15 nt, Homo sapiens
caaucuuucaugucu

SEQ ID NO: 2185607 - RNA, 13 nt, Homo sapiens
acaacugcuccau

SEQ ID NO: 2185608 - RNA, 19 nt, Homo sapiens
uuucuuggccucaaguuca

SEQ ID NO: 2185609 - RNA, 18 nt, Homo sapiens
cuaaaagaggccuguuca

SEQ ID NO: 2185610 - RNA, 14 nt, Homo sapiens
acgauggaauguaa

SEQ ID NO: 2185611 - RNA, 22 nt, Homo sapiens
cuguagggggcgauauacuaaa

SEQ ID NO: 2185612 - RNA, 18 nt, Homo sapiens
aucacaguuuugguugcu

SEQ ID NO: 2185613 - RNA, 15 nt, Homo sapiens
ugccucuguccgugc

SEQ ID NO: 2185614 - RNA, 18 nt, Homo sapiens
aucucauccuuuccucua

SEQ ID NO: 2185615 - RNA, 21 nt, Homo sapiens
aacuggguuaaauauuuugcu

SEQ ID NO: 2185616 - RNA, 17 nt, Homo sapiens
ugcucuggcaagagacu

SEQ ID NO: 2185617 - RNA, 16 nt, Homo sapiens
uuuccuggccucagag

SEQ ID NO: 2185618 - RNA, 17 nt, Homo sapiens
augaaaaugucaauacu

SEQ ID NO: 2185619 - RNA, 18 nt, Homo sapiens
uucccuugccaucacacu

SEQ ID NO: 2185620 - RNA, 12 nt, Homo sapiens
cugucacuguag

SEQ ID NO: 2185621 - RNA, 15 nt, Homo sapiens
ucccgggaagccacc

SEQ ID NO: 2185622 - RNA, 13 nt, Homo sapiens
aaaugcauacugu

SEQ ID NO: 2185623 - RNA, 23 nt, Homo sapiens
ucuggagggguguggcuccuucc

SEQ ID NO: 2185624 - RNA, 12 nt, Homo sapiens
cucccagcauag

SEQ ID NO: 2185625 - RNA, 15 nt, Homo sapiens
uggcugggcccagaa

SEQ ID NO: 2185626 - RNA, 17 nt, Homo sapiens
ucuuagaagaaauauga

SEQ ID NO: 2185627 - RNA, 20 nt, Homo sapiens
cugacccagcccugaacaaa

SEQ ID NO: 2185628 - RNA, 12 nt, Homo sapiens
aaguaaaaccac

SEQ ID NO: 2185629 - RNA, 14 nt, Homo sapiens
gucgcuuugccauc

SEQ ID NO: 2185630 - RNA, 19 nt, Homo sapiens
cauguguuuuaauuccaau

SEQ ID NO: 2185631 - RNA, 15 nt, Homo sapiens
gugccgugacagggc

SEQ ID NO: 2185632 - RNA, 14 nt, Homo sapiens
uucuuacucugaaa

SEQ ID NO: 2185633 - RNA, 23 nt, Homo sapiens
ugguucuuuuaccccacgaagac

SEQ ID NO: 2185634 - RNA, 21 nt, Homo sapiens
gucuuaggaugugucuugggg

SEQ ID NO: 2185635 - RNA, 22 nt, Homo sapiens
caccucuggauucuggauucac

SEQ ID NO: 2185636 - RNA, 14 nt, Homo sapiens
aggaggcugccaca

SEQ ID NO: 2185637 - RNA, 16 nt, Homo sapiens
caccagggcaccgcag

SEQ ID NO: 2185638 - RNA, 15 nt, Homo sapiens
acuugacccaugccc

SEQ ID NO: 2185639 - RNA, 22 nt, Homo sapiens
ugcucaaugaaaccuuccucuu

SEQ ID NO: 2185640 - RNA, 15 nt, Homo sapiens
cacucuccagcaguu

SEQ ID NO: 2185641 - RNA, 14 nt, Homo sapiens
auaaagcagaguuu

SEQ ID NO: 2185642 - RNA, 16 nt, Homo sapiens
agaaucggcuuugcag

SEQ ID NO: 2185643 - RNA, 11 nt, Homo sapiens
aagaguggcuu

SEQ ID NO: 2185644 - RNA, 17 nt, Homo sapiens
ugacaaugacugugcua

SEQ ID NO: 2185645 - RNA, 14 nt, Homo sapiens
gaauuuucuuccaa

SEQ ID NO: 2185646 - RNA, 18 nt, Homo sapiens
cagaauuuggguugacuc

SEQ ID NO: 2185647 - RNA, 16 nt, Homo sapiens
auugauucaugucuca

SEQ ID NO: 2185648 - RNA, 15 nt, Homo sapiens
ugaagugguuucuaa

SEQ ID NO: 2185649 - RNA, 14 nt, Homo sapiens
ugguaaaugucaca

SEQ ID NO: 2185650 - RNA, 16 nt, Homo sapiens
gccuauggagagcccu

SEQ ID NO: 2185651 - RNA, 17 nt, Homo sapiens
uuacaggaagccucuca

SEQ ID NO: 2185652 - RNA, 15 nt, Homo sapiens
guuauuugcacacug

SEQ ID NO: 2185653 - RNA, 17 nt, Homo sapiens
auccagaagagaauuag

SEQ ID NO: 2185654 - RNA, 13 nt, Homo sapiens
uucucuuccuccc

SEQ ID NO: 2185655 - RNA, 22 nt, Homo sapiens
accugaagguccccuggcagug

SEQ ID NO: 2185656 - RNA, 17 nt, Homo sapiens
ccugauucauacuccuu

SEQ ID NO: 2185657 - RNA, 22 nt, Homo sapiens
ucccccagaaaagaaagcuaca

SEQ ID NO: 2185658 - RNA, 19 nt, Homo sapiens
gcccugagcuuuguccuga

SEQ ID NO: 2185659 - RNA, 15 nt, Homo sapiens
agggaagagggcuca

SEQ ID NO: 2185660 - RNA, 16 nt, Homo sapiens
uagauuaaagcuuauu

SEQ ID NO: 2185661 - RNA, 12 nt, Homo sapiens
uacggacacugu

SEQ ID NO: 2185662 - RNA, 21 nt, Homo sapiens
aaaguagcaaaaaaguacaaa

SEQ ID NO: 2185663 - RNA, 19 nt, Homo sapiens
gcuggugggacagugguga

SEQ ID NO: 2185664 - RNA, 18 nt, Homo sapiens
ucaauuuuucccaguauu

SEQ ID NO: 2185665 - RNA, 17 nt, Homo sapiens
accaaacagugcuguuu

SEQ ID NO: 2185666 - RNA, 22 nt, Homo sapiens
uguguucuuccucucucagggg

SEQ ID NO: 2185667 - RNA, 16 nt, Homo sapiens
aaggacgugucucagg

SEQ ID NO: 2185668 - RNA, 13 nt, Homo sapiens
aagaauacacaau

SEQ ID NO: 2185669 - RNA, 19 nt, Homo sapiens
uuggauggccuccauccag

SEQ ID NO: 2185670 - RNA, 18 nt, Homo sapiens
cacauauggaauuuugca

SEQ ID NO: 2185671 - RNA, 18 nt, Homo sapiens
ucucagcuaccuaagaaa

SEQ ID NO: 2185672 - RNA, 14 nt, Homo sapiens
cgcgaugggaaccg

SEQ ID NO: 2185673 - RNA, 14 nt, Homo sapiens
gggagcccucaggc

SEQ ID NO: 2185674 - RNA, 22 nt, Homo sapiens
acagaucaagaaaaaaagggag

SEQ ID NO: 2185675 - RNA, 19 nt, Homo sapiens
agcuccuuuauuauaauca

SEQ ID NO: 2185676 - RNA, 19 nt, Homo sapiens
aguccuuggcuguauccau

SEQ ID NO: 2185677 - RNA, 19 nt, Homo sapiens
caaguucaacaacaaaaca

SEQ ID NO: 2185678 - RNA, 15 nt, Homo sapiens
gggacucguggcugu

SEQ ID NO: 2185679 - RNA, 17 nt, Homo sapiens
ggcauuuuuccaaagga

SEQ ID NO: 2185680 - RNA, 15 nt, Homo sapiens
aggugcucauccuca

SEQ ID NO: 2185681 - RNA, 19 nt, Homo sapiens
uacaaucagcccagugcaa

SEQ ID NO: 2185682 - RNA, 13 nt, Homo sapiens
cuccuuuaggcag

SEQ ID NO: 2185683 - RNA, 23 nt, Homo sapiens
uugccccuaggaaggugaaucug

SEQ ID NO: 2185684 - RNA, 21 nt, Homo sapiens
uuacaagugcgcacuaccaca

SEQ ID NO: 2185685 - RNA, 11 nt, Homo sapiens
gagcagugggg

SEQ ID NO: 2185686 - RNA, 17 nt, Homo sapiens
uagaaaauauaaguaaa

SEQ ID NO: 2185687 - RNA, 16 nt, Homo sapiens
gccccauccuguguua

SEQ ID NO: 2185688 - RNA, 18 nt, Homo sapiens
ugccagacauugcucuca

SEQ ID NO: 2185689 - RNA, 20 nt, Homo sapiens
ucaaaugaucaauaagcuuu

SEQ ID NO: 2185690 - RNA, 20 nt, Homo sapiens
ucaagccccacgaugacugc

SEQ ID NO: 2185691 - RNA, 15 nt, Homo sapiens
auaguucuuacuacu

SEQ ID NO: 2185692 - RNA, 20 nt, Homo sapiens
auauucaaggaucucaaaga

SEQ ID NO: 2185693 - RNA, 17 nt, Homo sapiens
gcuauaacuuacuucug

SEQ ID NO: 2185694 - RNA, 16 nt, Homo sapiens
agguuggaggcccuag

SEQ ID NO: 2185695 - RNA, 17 nt, Homo sapiens
aggaaucccggcuccag

SEQ ID NO: 2185696 - RNA, 12 nt, Homo sapiens
auguauacuuca

SEQ ID NO: 2185697 - RNA, 19 nt, Homo sapiens
aagcacagccucagaauaa

SEQ ID NO: 2185698 - RNA, 18 nt, Homo sapiens
gacagcuuuccucaaaaa

SEQ ID NO: 2185699 - RNA, 21 nt, Homo sapiens
uaaaaacauaaaauauacaaa

SEQ ID NO: 2185700 - RNA, 16 nt, Homo sapiens
auuguguauagcauua

SEQ ID NO: 2185701 - RNA, 14 nt, Homo sapiens
ucgcugccaucacc

SEQ ID NO: 2185702 - RNA, 14 nt, Homo sapiens
aucagcaguggcag

SEQ ID NO: 2185703 - RNA, 11 nt, Homo sapiens
aacacuggcau

SEQ ID NO: 2185704 - RNA, 12 nt, Homo sapiens
acuguugcacug

SEQ ID NO: 2185705 - RNA, 20 nt, Homo sapiens
ucauuggacccugacuguau

SEQ ID NO: 2185706 - RNA, 14 nt, Homo sapiens
agaucuggcugugg

SEQ ID NO: 2185707 - RNA, 14 nt, Homo sapiens
ccugcugaagcugc

SEQ ID NO: 2185708 - RNA, 15 nt, Homo sapiens
gcaacaaaaagucau

SEQ ID NO: 2185709 - RNA, 22 nt, Homo sapiens
guaguggcacaaucucagcuca

SEQ ID NO: 2185710 - RNA, 13 nt, Homo sapiens
uaguacugugaau

SEQ ID NO: 2185711 - RNA, 20 nt, Homo sapiens
aaggcugucaauuacaggaa

SEQ ID NO: 2185712 - RNA, 21 nt, Homo sapiens
gaaccguuugugauugccauu

SEQ ID NO: 2185713 - RNA, 24 nt, Homo sapiens
ucucuaguaguuaaaacagcuauu

SEQ ID NO: 2185714 - RNA, 14 nt, Homo sapiens
gcaggaaaauggac

SEQ ID NO: 2185715 - RNA, 22 nt, Homo sapiens
aauaaauacguuuugucuuucc

SEQ ID NO: 2185716 - RNA, 20 nt, Homo sapiens
acguguucacaggcugcuaa

SEQ ID NO: 2185717 - RNA, 19 nt, Homo sapiens
cucagauugaggagcucaa

SEQ ID NO: 2185718 - RNA, 19 nt, Homo sapiens
auuuugauaaauuacuaau

SEQ ID NO: 2185719 - RNA, 14 nt, Homo sapiens
uaaaauuggcacca

SEQ ID NO: 2185720 - RNA, 22 nt, Homo sapiens
uaacagauuugcauaugucuau

SEQ ID NO: 2185721 - RNA, 17 nt, Homo sapiens
ccugugccagaccucaa

SEQ ID NO: 2185722 - RNA, 15 nt, Homo sapiens
gcauuuuuuaccaca

SEQ ID NO: 2185723 - RNA, 13 nt, Homo sapiens
uaauucauguugc

SEQ ID NO: 2185724 - RNA, 15 nt, Homo sapiens
caggaagguagaaau

SEQ ID NO: 2185725 - RNA, 20 nt, Homo sapiens
auuaauaaagauggcacuuu

SEQ ID NO: 2185726 - RNA, 21 nt, Homo sapiens
uaguuuguuuuagaaccagcc

SEQ ID NO: 2185727 - RNA, 21 nt, Homo sapiens
ggcagaaggaagcagguguga

SEQ ID NO: 2185728 - RNA, 13 nt, Homo sapiens
auuaacuuccucu

SEQ ID NO: 2185729 - RNA, 15 nt, Homo sapiens
auaaacuaacuacug

SEQ ID NO: 2185730 - RNA, 12 nt, Homo sapiens
auucaaaccaau

SEQ ID NO: 2185731 - RNA, 21 nt, Homo sapiens
gagucuggcucugucacccag

SEQ ID NO: 2185732 - RNA, 14 nt, Homo sapiens
agcuaugaauauag

SEQ ID NO: 2185733 - RNA, 11 nt, Homo sapiens
cauuuugacaa

SEQ ID NO: 2185734 - RNA, 21 nt, Homo sapiens
uauguguucuaacuauuauca

SEQ ID NO: 2185735 - RNA, 14 nt, Homo sapiens
gcaacccuuuugaa

SEQ ID NO: 2185736 - RNA, 21 nt, Homo sapiens
uaaacauauucaaggagcaag

SEQ ID NO: 2185737 - RNA, 22 nt, Homo sapiens
uuuuccuccccuuugacccuau

SEQ ID NO: 2185738 - RNA, 17 nt, Homo sapiens
uuccaauuacuacuuug

SEQ ID NO: 2185739 - RNA, 20 nt, Homo sapiens
aaaccccaucuuuacuaaaa

SEQ ID NO: 2185740 - RNA, 15 nt, Homo sapiens
uuauuucuacuauga

SEQ ID NO: 2185741 - RNA, 18 nt, Homo sapiens
acucgcguucccaaagau

SEQ ID NO: 2185742 - RNA, 20 nt, Homo sapiens
gagaauuuaucccuuuacaa

SEQ ID NO: 2185743 - RNA, 18 nt, Homo sapiens
acuuugugagccaaagcu

SEQ ID NO: 2185744 - RNA, 18 nt, Homo sapiens
aaaccuccgccaaugcac

SEQ ID NO: 2185745 - RNA, 16 nt, Homo sapiens
ugggaagggguuucua

SEQ ID NO: 2185746 - RNA, 17 nt, Homo sapiens
cauucagugacaugucc

SEQ ID NO: 2185747 - RNA, 22 nt, Homo sapiens
guuauaaaaauuacauaauuca

SEQ ID NO: 2185748 - RNA, 17 nt, Homo sapiens
uccaggaacacaugcac

SEQ ID NO: 2185749 - RNA, 12 nt, Homo sapiens
aauaucaccuag

SEQ ID NO: 2185750 - RNA, 13 nt, Homo sapiens
ucuacccaggugc

SEQ ID NO: 2185751 - RNA, 18 nt, Homo sapiens
aacugcccagagccacag

SEQ ID NO: 2185752 - RNA, 19 nt, Homo sapiens
ccucccagucucaucuccu

SEQ ID NO: 2185753 - RNA, 11 nt, Homo sapiens
aguuuccccac

SEQ ID NO: 2185754 - RNA, 22 nt, Homo sapiens
agugacuaugaacuucucucag

SEQ ID NO: 2185755 - RNA, 23 nt, Homo sapiens
agccaccgcgccuggccaggcug

SEQ ID NO: 2185756 - RNA, 21 nt, Homo sapiens
cagcagauuucagguguaacc

SEQ ID NO: 2185757 - RNA, 15 nt, Homo sapiens
agcgagacuccgucu

SEQ ID NO: 2185758 - RNA, 19 nt, Homo sapiens
cucccucugcuguguuccc

SEQ ID NO: 2185759 - RNA, 13 nt, Homo sapiens
cuacuguguuccu

SEQ ID NO: 2185760 - RNA, 20 nt, Homo sapiens
uuuacuaagacauagucucu

SEQ ID NO: 2185761 - RNA, 11 nt, Homo sapiens
cuaacacuagu

SEQ ID NO: 2185762 - RNA, 15 nt, Homo sapiens
acuuccuugcuuaag

SEQ ID NO: 2185763 - RNA, 14 nt, Homo sapiens
cuuuuaauccuggc

SEQ ID NO: 2185764 - RNA, 14 nt, Homo sapiens
aagcaaacacacuc

SEQ ID NO: 2185765 - RNA, 12 nt, Homo sapiens
gguggcaucaca

SEQ ID NO: 2185766 - RNA, 19 nt, Homo sapiens
guguccugaagcugcugga

SEQ ID NO: 2185767 - RNA, 16 nt, Homo sapiens
uaaacuccacagggac

SEQ ID NO: 2185768 - RNA, 19 nt, Homo sapiens
gcucucagaagguauuccu

SEQ ID NO: 2185769 - RNA, 20 nt, Homo sapiens
ugcaggacuugagaagaccu

SEQ ID NO: 2185770 - RNA, 15 nt, Homo sapiens
uaaauuuaugugaug

SEQ ID NO: 2185771 - RNA, 21 nt, Homo sapiens
ccaagggaugggaccugauga

SEQ ID NO: 2185772 - RNA, 13 nt, Homo sapiens
aacauuuacacau

SEQ ID NO: 2185773 - RNA, 13 nt, Homo sapiens
cccuauuaaccua

SEQ ID NO: 2185774 - RNA, 21 nt, Homo sapiens
acuagagaucugguuuugcua

SEQ ID NO: 2185775 - RNA, 19 nt, Homo sapiens
uaugacuacuacauuccaa

SEQ ID NO: 2185776 - RNA, 17 nt, Homo sapiens
cugguggccaccguguc

SEQ ID NO: 2185777 - RNA, 19 nt, Homo sapiens
guacauagcucucauguau

SEQ ID NO: 2185778 - RNA, 13 nt, Homo sapiens
uggauaacaaaga

SEQ ID NO: 2185779 - RNA, 13 nt, Homo sapiens
acuucaagcuuuu

SEQ ID NO: 2185780 - RNA, 16 nt, Homo sapiens
cauggcacugacaaug

SEQ ID NO: 2185781 - RNA, 19 nt, Homo sapiens
ggcaccaugugugccuuug

SEQ ID NO: 2185782 - RNA, 19 nt, Homo sapiens
ggagaccauuugauuuucu

SEQ ID NO: 2185783 - RNA, 19 nt, Homo sapiens
cucuuggugugauugcaca

SEQ ID NO: 2185784 - RNA, 23 nt, Homo sapiens
gucucacugucccccguuugccu

SEQ ID NO: 2185785 - RNA, 18 nt, Homo sapiens
ugugacauucaguguuag

SEQ ID NO: 2185786 - RNA, 21 nt, Homo sapiens
acuggacgcuguccugagaug

SEQ ID NO: 2185787 - RNA, 13 nt, Homo sapiens
aagauuugcccau

SEQ ID NO: 2185788 - RNA, 12 nt, Homo sapiens
cagggacuugaa

SEQ ID NO: 2185789 - RNA, 18 nt, Homo sapiens
uuacagggagcugggaca

SEQ ID NO: 2185790 - RNA, 21 nt, Homo sapiens
agccucuggaugcauuuccau

SEQ ID NO: 2185791 - RNA, 14 nt, Homo sapiens
caagcuggcacaaa

SEQ ID NO: 2185792 - RNA, 16 nt, Homo sapiens
uaacccucaaugugau

SEQ ID NO: 2185793 - RNA, 15 nt, Homo sapiens
aguguagugcucagu

SEQ ID NO: 2185794 - RNA, 15 nt, Homo sapiens
aauccuccugaguga

SEQ ID NO: 2185795 - RNA, 15 nt, Homo sapiens
gccugagacuggaaa

SEQ ID NO: 2185796 - RNA, 24 nt, Homo sapiens
gaaugaggauauaguagccaugac

SEQ ID NO: 2185797 - RNA, 15 nt, Homo sapiens
cagcugguguagcua

SEQ ID NO: 2185798 - RNA, 13 nt, Homo sapiens
accugaaggugcu

SEQ ID NO: 2185799 - RNA, 17 nt, Homo sapiens
gaggaucuccuguccau

SEQ ID NO: 2185800 - RNA, 20 nt, Homo sapiens
acaagaaaaaaagcuuuuau

SEQ ID NO: 2185801 - RNA, 15 nt, Homo sapiens
ugauuugauaccaug

SEQ ID NO: 2185802 - RNA, 17 nt, Homo sapiens
aucauggggaguaauag

SEQ ID NO: 2185803 - RNA, 13 nt, Homo sapiens
uguacauuaccau

SEQ ID NO: 2185804 - RNA, 13 nt, Homo sapiens
acuacauuugcau

SEQ ID NO: 2185805 - RNA, 14 nt, Homo sapiens
uguagaacugcaau

SEQ ID NO: 2185806 - RNA, 16 nt, Homo sapiens
gaaacagccucagugg

SEQ ID NO: 2185807 - RNA, 20 nt, Homo sapiens
ucaagacggagaugcauggc

SEQ ID NO: 2185808 - RNA, 21 nt, Homo sapiens
acuaaauguacuacugagcuu

SEQ ID NO: 2185809 - RNA, 20 nt, Homo sapiens
uguauauuugagaaaacagg

SEQ ID NO: 2185810 - RNA, 20 nt, Homo sapiens
gaagcucuugugaacugucu

SEQ ID NO: 2185811 - RNA, 17 nt, Homo sapiens
aagaaagcuuccuucaa

SEQ ID NO: 2185812 - RNA, 17 nt, Homo sapiens
augucguuugaaucaca

SEQ ID NO: 2185813 - RNA, 15 nt, Homo sapiens
guuugaaggggagag

SEQ ID NO: 2185814 - RNA, 21 nt, Homo sapiens
cagcagacugaccaucuccca

SEQ ID NO: 2185815 - RNA, 15 nt, Homo sapiens
ugcaugugugugaug

SEQ ID NO: 2185816 - RNA, 16 nt, Homo sapiens
cuuccaugugccuuuc

SEQ ID NO: 2185817 - RNA, 23 nt, Homo sapiens
aauguaacacacacacacauaca

SEQ ID NO: 2185818 - RNA, 21 nt, Homo sapiens
cacuaucauggacuacaccag

SEQ ID NO: 2185819 - RNA, 14 nt, Homo sapiens
ugcccgccaccaca

SEQ ID NO: 2185820 - RNA, 17 nt, Homo sapiens
agaugaacuuugucauu

SEQ ID NO: 2185821 - RNA, 22 nt, Homo sapiens
ugcuccauagagcagugcacau

SEQ ID NO: 2185822 - RNA, 11 nt, Homo sapiens
acacugucaau

SEQ ID NO: 2185823 - RNA, 22 nt, Homo sapiens
agaauggggguggggaggcaag

SEQ ID NO: 2185824 - RNA, 13 nt, Homo sapiens
uauuuuccugcca

SEQ ID NO: 2185825 - RNA, 22 nt, Homo sapiens
uaccauuaauaaguuaucuugu

SEQ ID NO: 2185826 - RNA, 12 nt, Homo sapiens
cucacgccugua

SEQ ID NO: 2185827 - RNA, 15 nt, Homo sapiens
uucuaaaaguugcau

SEQ ID NO: 2185828 - RNA, 18 nt, Homo sapiens
ccauuaauuaaaagugug

SEQ ID NO: 2185829 - RNA, 14 nt, Homo sapiens
uaccuuuuuugaua

SEQ ID NO: 2185830 - RNA, 21 nt, Homo sapiens
guagcgugcaucaguacuuca

SEQ ID NO: 2185831 - RNA, 22 nt, Homo sapiens
auaauguuaucuguguagcaag

SEQ ID NO: 2185832 - RNA, 23 nt, Homo sapiens
augguaugccaacuuaaguauuu

SEQ ID NO: 2185833 - RNA, 21 nt, Homo sapiens
ucaguuauucauucugugauc

SEQ ID NO: 2185834 - RNA, 18 nt, Homo sapiens
ugcaccuguaaagugccu

SEQ ID NO: 2185835 - RNA, 15 nt, Homo sapiens
uaguagcaaacuggg

SEQ ID NO: 2185836 - RNA, 20 nt, Homo sapiens
acuagugugguguguuugcu

SEQ ID NO: 2185837 - RNA, 19 nt, Homo sapiens
cuccucccucugacucuaa

SEQ ID NO: 2185838 - RNA, 17 nt, Homo sapiens
ugugaaauucucuuucc

SEQ ID NO: 2185839 - RNA, 19 nt, Homo sapiens
aagcccccacuacaaguga

SEQ ID NO: 2185840 - RNA, 15 nt, Homo sapiens
gagcuucuauugcca

SEQ ID NO: 2185841 - RNA, 16 nt, Homo sapiens
gagcuccgaugcccgc

SEQ ID NO: 2185842 - RNA, 22 nt, Homo sapiens
acacaaucugaaacagcuucau

SEQ ID NO: 2185843 - RNA, 15 nt, Homo sapiens
uguucauguuacuca

SEQ ID NO: 2185844 - RNA, 19 nt, Homo sapiens
uccugaaggaaauucuuau

SEQ ID NO: 2185845 - RNA, 13 nt, Homo sapiens
uuacaaaauauuc

SEQ ID NO: 2185846 - RNA, 13 nt, Homo sapiens
aggccacauggga

SEQ ID NO: 2185847 - RNA, 13 nt, Homo sapiens
aaauaaaaauucc

SEQ ID NO: 2185848 - RNA, 21 nt, Homo sapiens
uauaaauacagcauacuucaa

SEQ ID NO: 2185849 - RNA, 20 nt, Homo sapiens
gagaaggacagcucuucccc

SEQ ID NO: 2185850 - RNA, 22 nt, Homo sapiens
gucaauuggaaagacuauccaa

SEQ ID NO: 2185851 - RNA, 20 nt, Homo sapiens
auauugaaaaugucacuguu

SEQ ID NO: 2185852 - RNA, 15 nt, Homo sapiens
ucccagcugcacuuu

SEQ ID NO: 2185853 - RNA, 16 nt, Homo sapiens
agagccccucaugcca

SEQ ID NO: 2185854 - RNA, 16 nt, Homo sapiens
uuggaaaccacaguca

SEQ ID NO: 2185855 - RNA, 18 nt, Homo sapiens
uacaaucagcagucuagu

SEQ ID NO: 2185856 - RNA, 11 nt, Homo sapiens
uacaguaugcu

SEQ ID NO: 2185857 - RNA, 23 nt, Homo sapiens
gaaggguaccuugaacacugggg

SEQ ID NO: 2185858 - RNA, 22 nt, Homo sapiens
augaugggauaucugaggccau

SEQ ID NO: 2185859 - RNA, 13 nt, Homo sapiens
gguacagcagggu

SEQ ID NO: 2185860 - RNA, 14 nt, Homo sapiens
acacacacgaugca

SEQ ID NO: 2185861 - RNA, 15 nt, Homo sapiens
cucaagaccaacaga

SEQ ID NO: 2185862 - RNA, 21 nt, Homo sapiens
cuuauuuauguaacaaaguuu

SEQ ID NO: 2185863 - RNA, 19 nt, Homo sapiens
uuauuguuuucuacugcua

SEQ ID NO: 2185864 - RNA, 21 nt, Homo sapiens
cugaggccaggggagacauca

SEQ ID NO: 2185865 - RNA, 22 nt, Homo sapiens
cgugucaguuacuuuuuuagua

SEQ ID NO: 2185866 - RNA, 17 nt, Homo sapiens
cacagggacucuccaua

SEQ ID NO: 2185867 - RNA, 15 nt, Homo sapiens
augaaacaccuucuc

SEQ ID NO: 2185868 - RNA, 16 nt, Homo sapiens
ggcaggagccggcugc

SEQ ID NO: 2185869 - RNA, 18 nt, Homo sapiens
agggaauaauauucaaua

SEQ ID NO: 2185870 - RNA, 21 nt, Homo sapiens
ugggacccuucagccacuaca

SEQ ID NO: 2185871 - RNA, 23 nt, Homo sapiens
uggcauagagaauacacauauaa

SEQ ID NO: 2185872 - RNA, 14 nt, Homo sapiens
cucacacccuaaua

SEQ ID NO: 2185873 - RNA, 16 nt, Homo sapiens
uccuucuauacauguu

SEQ ID NO: 2185874 - RNA, 16 nt, Homo sapiens
aauuacguacuaagga

SEQ ID NO: 2185875 - RNA, 23 nt, Homo sapiens
aauuaaaccagauuggagcaauu

SEQ ID NO: 2185876 - RNA, 18 nt, Homo sapiens
auagaguaaauacaggua

SEQ ID NO: 2185877 - RNA, 13 nt, Homo sapiens
acuguaaagccag

SEQ ID NO: 2185878 - RNA, 16 nt, Homo sapiens
acacagcccugaauca

SEQ ID NO: 2185879 - RNA, 14 nt, Homo sapiens
ccugcugccagaag

SEQ ID NO: 2185880 - RNA, 20 nt, Homo sapiens
guucucuaggccuucaggac

SEQ ID NO: 2185881 - RNA, 12 nt, Homo sapiens
auccacaaggac

SEQ ID NO: 2185882 - RNA, 13 nt, Homo sapiens
guggaaaauggaa

SEQ ID NO: 2185883 - RNA, 18 nt, Homo sapiens
acuguguacauaacugaa

SEQ ID NO: 2185884 - RNA, 21 nt, Homo sapiens
ggagccugaacaugacauuuc

SEQ ID NO: 2185885 - RNA, 12 nt, Homo sapiens
accuaccaaaau

SEQ ID NO: 2185886 - RNA, 21 nt, Homo sapiens
uaaaacagguuauaacagugu

SEQ ID NO: 2185887 - RNA, 14 nt, Homo sapiens
gacuguguuugcau

SEQ ID NO: 2185888 - RNA, 12 nt, Homo sapiens
uuguuauuucag

SEQ ID NO: 2185889 - RNA, 17 nt, Homo sapiens
uagcuggaugugguggu

SEQ ID NO: 2185890 - RNA, 19 nt, Homo sapiens
uuugguaaaaaugcugcuc

SEQ ID NO: 2185891 - RNA, 13 nt, Homo sapiens
ugaugaaggugaa

SEQ ID NO: 2185892 - RNA, 22 nt, Homo sapiens
guguguuuucccaaagcacuuu

SEQ ID NO: 2185893 - RNA, 20 nt, Homo sapiens
aauugucuguuuguuuucuc

SEQ ID NO: 2185894 - RNA, 18 nt, Homo sapiens
cauucaggguuauacaca

SEQ ID NO: 2185895 - RNA, 16 nt, Homo sapiens
auggauuugaugcugu

SEQ ID NO: 2185896 - RNA, 19 nt, Homo sapiens
gucaaugaacuuuccacau

SEQ ID NO: 2185897 - RNA, 19 nt, Homo sapiens
ugcuucuaccaacuggaag

SEQ ID NO: 2185898 - RNA, 18 nt, Homo sapiens
uauuugagaaguucucag

SEQ ID NO: 2185899 - RNA, 21 nt, Homo sapiens
uaaucugagaggccacagugc

SEQ ID NO: 2185900 - RNA, 13 nt, Homo sapiens
caauaaauuggaa

SEQ ID NO: 2185901 - RNA, 13 nt, Homo sapiens
aucagccagacau

SEQ ID NO: 2185902 - RNA, 20 nt, Homo sapiens
cuuaaacucuggacacucua

SEQ ID NO: 2185903 - RNA, 15 nt, Homo sapiens
cugagagaaccucac

SEQ ID NO: 2185904 - RNA, 23 nt, Homo sapiens
aacgagauugcuggaaaccaagu

SEQ ID NO: 2185905 - RNA, 21 nt, Homo sapiens
acaaaauagcacauccaccaa

SEQ ID NO: 2185906 - RNA, 19 nt, Homo sapiens
ccuuaucuuucuaaaacug

SEQ ID NO: 2185907 - RNA, 19 nt, Homo sapiens
agcugcucccuuuccugca

SEQ ID NO: 2185908 - RNA, 23 nt, Homo sapiens
ugggcuauugcugcugccccuua

SEQ ID NO: 2185909 - RNA, 17 nt, Homo sapiens
cgaaaaggauaugcagu

SEQ ID NO: 2185910 - RNA, 20 nt, Homo sapiens
uugaaggugcugacggccag

SEQ ID NO: 2185911 - RNA, 14 nt, Homo sapiens
aacaacaacuuaau

SEQ ID NO: 2185912 - RNA, 20 nt, Homo sapiens
uuuucucucuuacugcuuca

SEQ ID NO: 2185913 - RNA, 18 nt, Homo sapiens
uggggcucgaugguuacc

SEQ ID NO: 2185914 - RNA, 14 nt, Homo sapiens
uaaucuucauuucu

SEQ ID NO: 2185915 - RNA, 15 nt, Homo sapiens
cgucccagccugcac

SEQ ID NO: 2185916 - RNA, 17 nt, Homo sapiens
gugccugcucagcagcc

SEQ ID NO: 2185917 - RNA, 14 nt, Homo sapiens
ggcucagaacaccc

SEQ ID NO: 2185918 - RNA, 18 nt, Homo sapiens
ggagaaauaaacauaaga

SEQ ID NO: 2185919 - RNA, 24 nt, Homo sapiens
agagccuugucuucuuagcuguca

SEQ ID NO: 2185920 - RNA, 16 nt, Homo sapiens
ucuacuaccacaagga

SEQ ID NO: 2185921 - RNA, 12 nt, Homo sapiens
gugaacacugga

SEQ ID NO: 2185922 - RNA, 20 nt, Homo sapiens
aggagacaggucaguaguca

SEQ ID NO: 2185923 - RNA, 17 nt, Homo sapiens
uacuauucaaucuuuac

SEQ ID NO: 2185924 - RNA, 15 nt, Homo sapiens
agugugaaugaucaa

SEQ ID NO: 2185925 - RNA, 15 nt, Homo sapiens
aaacuguauuuacuu

SEQ ID NO: 2185926 - RNA, 15 nt, Homo sapiens
auuucaggugugaga

SEQ ID NO: 2185927 - RNA, 23 nt, Homo sapiens
cauagacagauguggacaugcac

SEQ ID NO: 2185928 - RNA, 19 nt, Homo sapiens
ucuaaauuacagugcaguu

SEQ ID NO: 2185929 - RNA, 13 nt, Homo sapiens
aagacaacauaac

SEQ ID NO: 2185930 - RNA, 23 nt, Homo sapiens
uuuccuguuucugaaaagaaaua

SEQ ID NO: 2185931 - RNA, 22 nt, Homo sapiens
cuuugagcccauucuucugggu

SEQ ID NO: 2185932 - RNA, 22 nt, Homo sapiens
accaaacuggacuugucuuccu

SEQ ID NO: 2185933 - RNA, 17 nt, Homo sapiens
cccuuuccccauucagu

SEQ ID NO: 2185934 - RNA, 9 nt, Homo sapiens
uacacugcc

SEQ ID NO: 2185935 - RNA, 15 nt, Homo sapiens
caccgccagcaauaa

SEQ ID NO: 2185936 - RNA, 14 nt, Homo sapiens
aaaauucuccuuga

SEQ ID NO: 2185937 - RNA, 18 nt, Homo sapiens
uaaaaugguuaugugcau

SEQ ID NO: 2185938 - RNA, 19 nt, Homo sapiens
accucccaccccacuccag

SEQ ID NO: 2185939 - RNA, 16 nt, Homo sapiens
cguguggcccaagacc

SEQ ID NO: 2185940 - RNA, 18 nt, Homo sapiens
guacauguaacauuaaag

SEQ ID NO: 2185941 - RNA, 19 nt, Homo sapiens
cuuagaccgaaggggaaaa

SEQ ID NO: 2185942 - RNA, 12 nt, Homo sapiens
auaugugucagu

SEQ ID NO: 2185943 - RNA, 15 nt, Homo sapiens
aggaaaaacaaacua

SEQ ID NO: 2185944 - RNA, 22 nt, Homo sapiens
ugagaaacauuauuagcacuuc

SEQ ID NO: 2185945 - RNA, 22 nt, Homo sapiens
gacuccugguccuaggcuggaa

SEQ ID NO: 2185946 - RNA, 21 nt, Homo sapiens
acucccuuuccaaccucacuu

SEQ ID NO: 2185947 - RNA, 12 nt, Homo sapiens
cuuuuacugugg

SEQ ID NO: 2185948 - RNA, 20 nt, Homo sapiens
ucuguugaaucacaguauca

SEQ ID NO: 2185949 - RNA, 17 nt, Homo sapiens
uuuccuaaggccacugu

SEQ ID NO: 2185950 - RNA, 16 nt, Homo sapiens
gagccacaggugccug

SEQ ID NO: 2185951 - RNA, 15 nt, Homo sapiens
gcucuauguuuacaa

SEQ ID NO: 2185952 - RNA, 18 nt, Homo sapiens
uuguuuuuauuguaaaac

SEQ ID NO: 2185953 - RNA, 13 nt, Homo sapiens
accccaacccugg

SEQ ID NO: 2185954 - RNA, 13 nt, Homo sapiens
ucauccaaaaagu

SEQ ID NO: 2185955 - RNA, 16 nt, Homo sapiens
uauuaauauucauugu

SEQ ID NO: 2185956 - RNA, 21 nt, Homo sapiens
caaauucuacugaacacuuca

SEQ ID NO: 2185957 - RNA, 19 nt, Homo sapiens
cagugauagaaagaaacaa

SEQ ID NO: 2185958 - RNA, 23 nt, Homo sapiens
agugauuuuauuagaaguuucau

SEQ ID NO: 2185959 - RNA, 22 nt, Homo sapiens
uugguuguuugguuagugacug

SEQ ID NO: 2185960 - RNA, 21 nt, Homo sapiens
ggccugaagucccagcauuga

SEQ ID NO: 2185961 - RNA, 22 nt, Homo sapiens
uucccagagaguaugugagaac

SEQ ID NO: 2185962 - RNA, 12 nt, Homo sapiens
uccaauacucag

SEQ ID NO: 2185963 - RNA, 16 nt, Homo sapiens
ugcacugcucauaaac

SEQ ID NO: 2185964 - RNA, 18 nt, Homo sapiens
cucguuucaaaaacacag

SEQ ID NO: 2185965 - RNA, 20 nt, Homo sapiens
augucacaguaaugcaagca

SEQ ID NO: 2185966 - RNA, 13 nt, Homo sapiens
agacauuugcuga

SEQ ID NO: 2185967 - RNA, 21 nt, Homo sapiens
ucaccuccacccccuccuguc

SEQ ID NO: 2185968 - RNA, 17 nt, Homo sapiens
uuuaugcucaccugaca

SEQ ID NO: 2185969 - RNA, 18 nt, Homo sapiens
accccuagccaccagugu

SEQ ID NO: 2185970 - RNA, 19 nt, Homo sapiens
agaaaaccagcgcaaggaa

SEQ ID NO: 2185971 - RNA, 19 nt, Homo sapiens
ggagcccugggguuuccac

SEQ ID NO: 2185972 - RNA, 17 nt, Homo sapiens
guuagauauugcuacua

SEQ ID NO: 2185973 - RNA, 15 nt, Homo sapiens
uguuaugacagugaa

SEQ ID NO: 2185974 - RNA, 13 nt, Homo sapiens
cucaaacuaacag

SEQ ID NO: 2185975 - RNA, 17 nt, Homo sapiens
aaaauggaauuacucca

SEQ ID NO: 2185976 - RNA, 17 nt, Homo sapiens
ccugugccucuucccau

SEQ ID NO: 2185977 - RNA, 16 nt, Homo sapiens
uuauuuuuaaaauaau

SEQ ID NO: 2185978 - RNA, 15 nt, Homo sapiens
caaaucaaaccucag

SEQ ID NO: 2185979 - RNA, 19 nt, Homo sapiens
cuucucagccacaaacccu

SEQ ID NO: 2185980 - RNA, 18 nt, Homo sapiens
guaaccuuauauuuacaa

SEQ ID NO: 2185981 - RNA, 13 nt, Homo sapiens
uaagucucaaggu

SEQ ID NO: 2185982 - RNA, 13 nt, Homo sapiens
agagccucugggc

SEQ ID NO: 2185983 - RNA, 22 nt, Homo sapiens
aaaucuaaaguugcuccauaca

SEQ ID NO: 2185984 - RNA, 21 nt, Homo sapiens
aguagacuucauuuuuccuaa

SEQ ID NO: 2185985 - RNA, 18 nt, Homo sapiens
gccugacuguguucagug

SEQ ID NO: 2185986 - RNA, 18 nt, Homo sapiens
aaacaugugcaacucuug

SEQ ID NO: 2185987 - RNA, 17 nt, Homo sapiens
uauaauguugcccagug

SEQ ID NO: 2185988 - RNA, 15 nt, Homo sapiens
ccuccugauggccaa

SEQ ID NO: 2185989 - RNA, 19 nt, Homo sapiens
ccauuguccuccuuuucac

SEQ ID NO: 2185990 - RNA, 20 nt, Homo sapiens
aguguccccuccacugucac

SEQ ID NO: 2185991 - RNA, 19 nt, Homo sapiens
gacaugaagggaugcugca

SEQ ID NO: 2185992 - RNA, 21 nt, Homo sapiens
gguuuccugcuggacaggggc

SEQ ID NO: 2185993 - RNA, 20 nt, Homo sapiens
cuaaucacaugugcugcaaa

SEQ ID NO: 2185994 - RNA, 17 nt, Homo sapiens
cugcccaggcaaagugc

SEQ ID NO: 2185995 - RNA, 21 nt, Homo sapiens
gggaaggguccaucucagaga

SEQ ID NO: 2185996 - RNA, 21 nt, Homo sapiens
uucuuacaauugcacugcugu

SEQ ID NO: 2185997 - RNA, 21 nt, Homo sapiens
cuguacaaugaacccccauga

SEQ ID NO: 2185998 - RNA, 16 nt, Homo sapiens
agucaauguguucuua

SEQ ID NO: 2185999 - RNA, 22 nt, Homo sapiens
ugcuccuuggcuuaccugaccu

SEQ ID NO: 2186000 - RNA, 20 nt, Homo sapiens
cuuggaauucucucaccucu

SEQ ID NO: 2186001 - RNA, 20 nt, Homo sapiens
ucacuguuuguuacuaugua

SEQ ID NO: 2186002 - RNA, 15 nt, Homo sapiens
ucuccccugauuaca

SEQ ID NO: 2186003 - RNA, 13 nt, Homo sapiens
aaauaaacuagua

SEQ ID NO: 2186004 - RNA, 13 nt, Homo sapiens
uggguaacagagu

SEQ ID NO: 2186005 - RNA, 23 nt, Homo sapiens
ugagcccucuaugguguggcaaa

SEQ ID NO: 2186006 - RNA, 17 nt, Homo sapiens
ugggauagccauuucca

SEQ ID NO: 2186007 - RNA, 14 nt, Homo sapiens
uuugaacaaccaaa

SEQ ID NO: 2186008 - RNA, 16 nt, Homo sapiens
ugcucuuggcugaccc

SEQ ID NO: 2186009 - RNA, 18 nt, Homo sapiens
ugcaauauaaaaauguga

SEQ ID NO: 2186010 - RNA, 13 nt, Homo sapiens
ccacagcccugcu

SEQ ID NO: 2186011 - RNA, 13 nt, Homo sapiens
cauguaugcaagu

SEQ ID NO: 2186012 - RNA, 14 nt, Homo sapiens
uagaucgaagccaa

SEQ ID NO: 2186013 - RNA, 14 nt, Homo sapiens
aaagagagcacuga

SEQ ID NO: 2186014 - RNA, 20 nt, Homo sapiens
uaaauaagauuuaauucaca

SEQ ID NO: 2186015 - RNA, 18 nt, Homo sapiens
guaauaaacgucuugcca

SEQ ID NO: 2186016 - RNA, 17 nt, Homo sapiens
ucucugcucagugaucu

SEQ ID NO: 2186017 - RNA, 13 nt, Homo sapiens
cugagcagugggg

SEQ ID NO: 2186018 - RNA, 21 nt, Homo sapiens
cgaggcugagaaucagacuga

SEQ ID NO: 2186019 - RNA, 17 nt, Homo sapiens
aauuuacccauuucuau

SEQ ID NO: 2186020 - RNA, 23 nt, Homo sapiens
cugaaaccccaucuccacuaaaa

SEQ ID NO: 2186021 - RNA, 13 nt, Homo sapiens
ucuugggaaaaua

SEQ ID NO: 2186022 - RNA, 13 nt, Homo sapiens
aagccaaccuuca

SEQ ID NO: 2186023 - RNA, 17 nt, Homo sapiens
gucauggaaaauguccu

SEQ ID NO: 2186024 - RNA, 11 nt, Homo sapiens
ucaugaugucu

SEQ ID NO: 2186025 - RNA, 14 nt, Homo sapiens
aggcguucuucgag

SEQ ID NO: 2186026 - RNA, 18 nt, Homo sapiens
guaccugaaagcacugua

SEQ ID NO: 2186027 - RNA, 17 nt, Homo sapiens
acaggggcuggugggca

SEQ ID NO: 2186028 - RNA, 21 nt, Homo sapiens
gaccaagauggaugcgaccca

SEQ ID NO: 2186029 - RNA, 17 nt, Homo sapiens
ugcaaagcugaagacca

SEQ ID NO: 2186030 - RNA, 15 nt, Homo sapiens
aucauguugaaguca

SEQ ID NO: 2186031 - RNA, 16 nt, Homo sapiens
ggccuggugucuccuc

SEQ ID NO: 2186032 - RNA, 12 nt, Homo sapiens
caccuagcuuua

SEQ ID NO: 2186033 - RNA, 17 nt, Homo sapiens
aggcccaacuaacaguc

SEQ ID NO: 2186034 - RNA, 13 nt, Homo sapiens
aggaugugcaagc

SEQ ID NO: 2186035 - RNA, 14 nt, Homo sapiens
auaucaaacugaaa

SEQ ID NO: 2186036 - RNA, 17 nt, Homo sapiens
gcugggagagccuucca

SEQ ID NO: 2186037 - RNA, 15 nt, Homo sapiens
gaaauaaaaauaccu

SEQ ID NO: 2186038 - RNA, 19 nt, Homo sapiens
acguucagaggugcagcug

SEQ ID NO: 2186039 - RNA, 21 nt, Homo sapiens
ugaguuauaguuugcuuugcu

SEQ ID NO: 2186040 - RNA, 18 nt, Homo sapiens
gaaggcaccugcucccac

SEQ ID NO: 2186041 - RNA, 14 nt, Homo sapiens
ugcuaggucucgga

SEQ ID NO: 2186042 - RNA, 14 nt, Homo sapiens
uggggaagacugug

SEQ ID NO: 2186043 - RNA, 18 nt, Homo sapiens
ccagagauggucacauga

SEQ ID NO: 2186044 - RNA, 13 nt, Homo sapiens
gcaguuaggcacc

SEQ ID NO: 2186045 - RNA, 23 nt, Homo sapiens
gauuuacuaacaguaacugccau

SEQ ID NO: 2186046 - RNA, 12 nt, Homo sapiens
cuaagagaucug

SEQ ID NO: 2186047 - RNA, 23 nt, Homo sapiens
aaccaaccuaagggcccaaaggc

SEQ ID NO: 2186048 - RNA, 17 nt, Homo sapiens
cuacagaguacgugaaa

SEQ ID NO: 2186049 - RNA, 23 nt, Homo sapiens
gauuuuggccaucaggacucuga

SEQ ID NO: 2186050 - RNA, 15 nt, Homo sapiens
ccucgaacacuagua

SEQ ID NO: 2186051 - RNA, 23 nt, Homo sapiens
acucauuuuuguuuucauuaucu

SEQ ID NO: 2186052 - RNA, 17 nt, Homo sapiens
ugacauucuucacuguc

SEQ ID NO: 2186053 - RNA, 20 nt, Homo sapiens
uuuuaaggcuaaaacuuaac

SEQ ID NO: 2186054 - RNA, 20 nt, Homo sapiens
guuuacuuuuuaacuggcuu

SEQ ID NO: 2186055 - RNA, 14 nt, Homo sapiens
gauucaaaucuaug

SEQ ID NO: 2186056 - RNA, 20 nt, Homo sapiens
gcacaaaaucuguacauguc

SEQ ID NO: 2186057 - RNA, 10 nt, Homo sapiens
augcugcuau

SEQ ID NO: 2186058 - RNA, 15 nt, Homo sapiens
accacacggaucuga

SEQ ID NO: 2186059 - RNA, 22 nt, Homo sapiens
auuaaaaggcaguugcugugga

SEQ ID NO: 2186060 - RNA, 19 nt, Homo sapiens
agaccugacaccuuucaua

SEQ ID NO: 2186061 - RNA, 22 nt, Homo sapiens
gcugcuuccuggcugggaacaa

SEQ ID NO: 2186062 - RNA, 15 nt, Homo sapiens
acagcugacccagug

SEQ ID NO: 2186063 - RNA, 15 nt, Homo sapiens
uugggauaguguucu

SEQ ID NO: 2186064 - RNA, 18 nt, Homo sapiens
ucuguuaaaugaacuuga

SEQ ID NO: 2186065 - RNA, 20 nt, Homo sapiens
agucauccugcccugcagca

SEQ ID NO: 2186066 - RNA, 12 nt, Homo sapiens
uuaauugcugca

SEQ ID NO: 2186067 - RNA, 15 nt, Homo sapiens
uuccucgcaggucuc

SEQ ID NO: 2186068 - RNA, 18 nt, Homo sapiens
agaagugagcaaggugcu

SEQ ID NO: 2186069 - RNA, 19 nt, Homo sapiens
cagcccucagcaaugugcc

SEQ ID NO: 2186070 - RNA, 21 nt, Homo sapiens
uuauuguuugaaaugucgauc

SEQ ID NO: 2186071 - RNA, 18 nt, Homo sapiens
cuccucuuugugaaaucc

SEQ ID NO: 2186072 - RNA, 19 nt, Homo sapiens
gagaacuucucuucccaua

SEQ ID NO: 2186073 - RNA, 19 nt, Homo sapiens
cucucuuuccuccacccau

SEQ ID NO: 2186074 - RNA, 17 nt, Homo sapiens
acgccacaaaucuggug

SEQ ID NO: 2186075 - RNA, 23 nt, Homo sapiens
gggucacaccugacaaauggaag

SEQ ID NO: 2186076 - RNA, 16 nt, Homo sapiens
ccaacagcgcccaaag

SEQ ID NO: 2186077 - RNA, 22 nt, Homo sapiens
caaauuugccaugacauuucau

SEQ ID NO: 2186078 - RNA, 17 nt, Homo sapiens
uuaaacaaauaauuuag

SEQ ID NO: 2186079 - RNA, 14 nt, Homo sapiens
aaauacucuaauuc

SEQ ID NO: 2186080 - RNA, 14 nt, Homo sapiens
agaguaucugagaa

SEQ ID NO: 2186081 - RNA, 13 nt, Homo sapiens
gugcaccaucuca

SEQ ID NO: 2186082 - RNA, 19 nt, Homo sapiens
gcaaugaagggaagugcau

SEQ ID NO: 2186083 - RNA, 14 nt, Homo sapiens
gaaccagaguuucu

SEQ ID NO: 2186084 - RNA, 19 nt, Homo sapiens
ucacaguguguuugugauu

SEQ ID NO: 2186085 - RNA, 17 nt, Homo sapiens
cuguggcugucuuguca

SEQ ID NO: 2186086 - RNA, 19 nt, Homo sapiens
caugauuucccacugcacu

SEQ ID NO: 2186087 - RNA, 22 nt, Homo sapiens
cucuugaguuguuuuuguauau

SEQ ID NO: 2186088 - RNA, 16 nt, Homo sapiens
uuuggaggaagauaca

SEQ ID NO: 2186089 - RNA, 18 nt, Homo sapiens
ggaaucaucuccuuugca

SEQ ID NO: 2186090 - RNA, 13 nt, Homo sapiens
aguacagaugcag

SEQ ID NO: 2186091 - RNA, 13 nt, Homo sapiens
uucagagaauuac

SEQ ID NO: 2186092 - RNA, 18 nt, Homo sapiens
ucgcaccacugcacucca

SEQ ID NO: 2186093 - RNA, 17 nt, Homo sapiens
accaacugaaggcuaaa

SEQ ID NO: 2186094 - RNA, 14 nt, Homo sapiens
uggucccuugucac

SEQ ID NO: 2186095 - RNA, 14 nt, Homo sapiens
guuucacugugcaa

SEQ ID NO: 2186096 - RNA, 23 nt, Homo sapiens
uccccugaaaaacugaucaaaaa

SEQ ID NO: 2186097 - RNA, 14 nt, Homo sapiens
uaaauucagucuuu

SEQ ID NO: 2186098 - RNA, 23 nt, Homo sapiens
gaacauuucuguaaauaccauug

SEQ ID NO: 2186099 - RNA, 18 nt, Homo sapiens
uaggaaagcagugcagua

SEQ ID NO: 2186100 - RNA, 18 nt, Homo sapiens
uaaaauagagugcauuug

SEQ ID NO: 2186101 - RNA, 21 nt, Homo sapiens
ugucauccucaaagaaagugu

SEQ ID NO: 2186102 - RNA, 14 nt, Homo sapiens
auucagguaauaca

SEQ ID NO: 2186103 - RNA, 17 nt, Homo sapiens
cauuuguucuuugccag

SEQ ID NO: 2186104 - RNA, 17 nt, Homo sapiens
cauggaggguuuagugc

SEQ ID NO: 2186105 - RNA, 19 nt, Homo sapiens
uuuggagacacaacuauuu

SEQ ID NO: 2186106 - RNA, 14 nt, Homo sapiens
gugcucagacauga

SEQ ID NO: 2186107 - RNA, 14 nt, Homo sapiens
auuaaauauaugau

SEQ ID NO: 2186108 - RNA, 23 nt, Homo sapiens
gggagcagagcuuccacaagaca

SEQ ID NO: 2186109 - RNA, 15 nt, Homo sapiens
gugagccugggccag

SEQ ID NO: 2186110 - RNA, 19 nt, Homo sapiens
auguguacagucuuugcag

SEQ ID NO: 2186111 - RNA, 15 nt, Homo sapiens
aggugauaauauguu

SEQ ID NO: 2186112 - RNA, 17 nt, Homo sapiens
ccauuauuauguaaaua

SEQ ID NO: 2186113 - RNA, 13 nt, Homo sapiens
cucccuguugcug

SEQ ID NO: 2186114 - RNA, 18 nt, Homo sapiens
cuugcuuuaauaaaucac

SEQ ID NO: 2186115 - RNA, 20 nt, Homo sapiens
cacguuaaaaguugaccaau

SEQ ID NO: 2186116 - RNA, 21 nt, Homo sapiens
uuccuguuuccauccaguucc

SEQ ID NO: 2186117 - RNA, 14 nt, Homo sapiens
gauggcagcuguuu

SEQ ID NO: 2186118 - RNA, 20 nt, Homo sapiens
auuuauccaaagcauugcag

SEQ ID NO: 2186119 - RNA, 12 nt, Homo sapiens
caucuuggcuca

SEQ ID NO: 2186120 - RNA, 20 nt, Homo sapiens
ugaaaguuaauccacuguga

SEQ ID NO: 2186121 - RNA, 19 nt, Homo sapiens
agcacggucccccaggagg

SEQ ID NO: 2186122 - RNA, 13 nt, Homo sapiens
gcccccuugccca

SEQ ID NO: 2186123 - RNA, 16 nt, Homo sapiens
gccguucagcugugac

SEQ ID NO: 2186124 - RNA, 12 nt, Homo sapiens
auccuggcccau

SEQ ID NO: 2186125 - RNA, 20 nt, Homo sapiens
uacaaaauccagcuaugaau

SEQ ID NO: 2186126 - RNA, 23 nt, Homo sapiens
acccauaauaagagaauguuccu

SEQ ID NO: 2186127 - RNA, 20 nt, Homo sapiens
gcuggaguacaguggugcca

SEQ ID NO: 2186128 - RNA, 13 nt, Homo sapiens
ccuacugcacuga

SEQ ID NO: 2186129 - RNA, 18 nt, Homo sapiens
cacaaacccugcugaaca

SEQ ID NO: 2186130 - RNA, 20 nt, Homo sapiens
cugccaucauuuacuuuuaa

SEQ ID NO: 2186131 - RNA, 20 nt, Homo sapiens
augcaaaccaaaccauuauu

SEQ ID NO: 2186132 - RNA, 13 nt, Homo sapiens
gacccugcucuca

SEQ ID NO: 2186133 - RNA, 23 nt, Homo sapiens
uccccaauaucuugcuugaacuu

SEQ ID NO: 2186134 - RNA, 17 nt, Homo sapiens
gaaaaugaaucuucaca

SEQ ID NO: 2186135 - RNA, 23 nt, Homo sapiens
ugguucuucugacacuuguggua

SEQ ID NO: 2186136 - RNA, 16 nt, Homo sapiens
cacuuaaaauacauga

SEQ ID NO: 2186137 - RNA, 15 nt, Homo sapiens
guagggugaggcgug

SEQ ID NO: 2186138 - RNA, 12 nt, Homo sapiens
ugagauggaguu

SEQ ID NO: 2186139 - RNA, 15 nt, Homo sapiens
auuuugcccaaccua

SEQ ID NO: 2186140 - RNA, 17 nt, Homo sapiens
uugugauauagaacaaa

SEQ ID NO: 2186141 - RNA, 14 nt, Homo sapiens
cagagacacugagc

SEQ ID NO: 2186142 - RNA, 14 nt, Homo sapiens
aaccaccaauccaa

SEQ ID NO: 2186143 - RNA, 15 nt, Homo sapiens
agaaauaaacuuugg

SEQ ID NO: 2186144 - RNA, 14 nt, Homo sapiens
auugcaugguguga

SEQ ID NO: 2186145 - RNA, 14 nt, Homo sapiens
gagagugaaaccau

SEQ ID NO: 2186146 - RNA, 14 nt, Homo sapiens
gagucucucuucca

SEQ ID NO: 2186147 - RNA, 19 nt, Homo sapiens
cccaggccaaaggggaccu

SEQ ID NO: 2186148 - RNA, 18 nt, Homo sapiens
ucucaagugccauauucu

SEQ ID NO: 2186149 - RNA, 20 nt, Homo sapiens
ugaggcauuuccagacuuga

SEQ ID NO: 2186150 - RNA, 13 nt, Homo sapiens
aacaaucacaaag

SEQ ID NO: 2186151 - RNA, 22 nt, Homo sapiens
caggcuguuuggagauccucau

SEQ ID NO: 2186152 - RNA, 21 nt, Homo sapiens
cucucagcuuucccugccaca

SEQ ID NO: 2186153 - RNA, 16 nt, Homo sapiens
aauuuugggacauuug

SEQ ID NO: 2186154 - RNA, 22 nt, Homo sapiens
aaaucuauuuuguaacuuucuc

SEQ ID NO: 2186155 - RNA, 20 nt, Homo sapiens
gcccccggcuuuccuccgga

SEQ ID NO: 2186156 - RNA, 18 nt, Homo sapiens
uggucacagccuccucug

SEQ ID NO: 2186157 - RNA, 15 nt, Homo sapiens
cagcccauggcuuua

SEQ ID NO: 2186158 - RNA, 18 nt, Homo sapiens
uagucugcuuugguacua

SEQ ID NO: 2186159 - RNA, 16 nt, Homo sapiens
auaauagagauaaguc

SEQ ID NO: 2186160 - RNA, 16 nt, Homo sapiens
uggaugcugagcugug

SEQ ID NO: 2186161 - RNA, 16 nt, Homo sapiens
gcuguuccaccaaaua

SEQ ID NO: 2186162 - RNA, 23 nt, Homo sapiens
uccaagccucucuggcacuuuga

SEQ ID NO: 2186163 - RNA, 14 nt, Homo sapiens
ggaaaaaacccagc

SEQ ID NO: 2186164 - RNA, 14 nt, Homo sapiens
cagaguucuguggc

SEQ ID NO: 2186165 - RNA, 17 nt, Homo sapiens
gcaucguggugugucaa

SEQ ID NO: 2186166 - RNA, 15 nt, Homo sapiens
cugccuaaccauggg

SEQ ID NO: 2186167 - RNA, 14 nt, Homo sapiens
gaauaaauguaucu

SEQ ID NO: 2186168 - RNA, 14 nt, Homo sapiens
uuuucuauuauuaa

SEQ ID NO: 2186169 - RNA, 15 nt, Homo sapiens
gccauuuuugugcuu

SEQ ID NO: 2186170 - RNA, 20 nt, Homo sapiens
aaaaagucaauucaguucua

SEQ ID NO: 2186171 - RNA, 20 nt, Homo sapiens
uacaugacucagcauaccug

SEQ ID NO: 2186172 - RNA, 21 nt, Homo sapiens
uaauuauauaguaaugcacuc

SEQ ID NO: 2186173 - RNA, 20 nt, Homo sapiens
aguauguuggugggaaucaa

SEQ ID NO: 2186174 - RNA, 17 nt, Homo sapiens
cagaagaccagauccaa

SEQ ID NO: 2186175 - RNA, 23 nt, Homo sapiens
cagaaagaugguagggagcauuu

SEQ ID NO: 2186176 - RNA, 17 nt, Homo sapiens
cucuaccccugcuccca

SEQ ID NO: 2186177 - RNA, 21 nt, Homo sapiens
uaaaagcaagaucuacuacau

SEQ ID NO: 2186178 - RNA, 12 nt, Homo sapiens
aguuucaccagg

SEQ ID NO: 2186179 - RNA, 17 nt, Homo sapiens
auucucuggcacucuga

SEQ ID NO: 2186180 - RNA, 15 nt, Homo sapiens
acucugcccaggugu

SEQ ID NO: 2186181 - RNA, 22 nt, Homo sapiens
acagauguucacccaaccacau

SEQ ID NO: 2186182 - RNA, 15 nt, Homo sapiens
ucuucucagaaggaa

SEQ ID NO: 2186183 - RNA, 15 nt, Homo sapiens
uuguaaaucacuugu

SEQ ID NO: 2186184 - RNA, 20 nt, Homo sapiens
ccugaccuuccaaaccucaa

SEQ ID NO: 2186185 - RNA, 18 nt, Homo sapiens
aucaugcccugugcaacc

SEQ ID NO: 2186186 - RNA, 22 nt, Homo sapiens
gucucacugugggaaggccagc

SEQ ID NO: 2186187 - RNA, 16 nt, Homo sapiens
cuuugccaaaauacca

SEQ ID NO: 2186188 - RNA, 18 nt, Homo sapiens
uaucuugcuucauucuga

SEQ ID NO: 2186189 - RNA, 20 nt, Homo sapiens
augacauagccaauggacaa

SEQ ID NO: 2186190 - RNA, 15 nt, Homo sapiens
uggacugugccaucu

SEQ ID NO: 2186191 - RNA, 22 nt, Homo sapiens
ucuggaaauaccgggaagccca

SEQ ID NO: 2186192 - RNA, 20 nt, Homo sapiens
gacucuaagcucagugcucu

SEQ ID NO: 2186193 - RNA, 17 nt, Homo sapiens
augaagcuuugguucuc

SEQ ID NO: 2186194 - RNA, 23 nt, Homo sapiens
cgugagugugugagcgcuucugc

SEQ ID NO: 2186195 - RNA, 18 nt, Homo sapiens
cuaaggacaagacacuga

SEQ ID NO: 2186196 - RNA, 18 nt, Homo sapiens
gacugugauuuauuugga

SEQ ID NO: 2186197 - RNA, 14 nt, Homo sapiens
uugacuucugacaa

SEQ ID NO: 2186198 - RNA, 18 nt, Homo sapiens
cugacgaggcugggccaa

SEQ ID NO: 2186199 - RNA, 13 nt, Homo sapiens
auugaagcuuugu

SEQ ID NO: 2186200 - RNA, 13 nt, Homo sapiens
ucuuaagcacuuu

SEQ ID NO: 2186201 - RNA, 16 nt, Homo sapiens
uucccucccaguuuuc

SEQ ID NO: 2186202 - RNA, 20 nt, Homo sapiens
agcugcucggagcucagugc

SEQ ID NO: 2186203 - RNA, 20 nt, Homo sapiens
acccugcccaggguuggcau

SEQ ID NO: 2186204 - RNA, 15 nt, Homo sapiens
aagccuaagaaucuu

SEQ ID NO: 2186205 - RNA, 18 nt, Homo sapiens
cuugaaacaagcaacaga

SEQ ID NO: 2186206 - RNA, 13 nt, Homo sapiens
uaauuuuuccaua

SEQ ID NO: 2186207 - RNA, 14 nt, Homo sapiens
cagauccucaagca

SEQ ID NO: 2186208 - RNA, 19 nt, Homo sapiens
cauagaauuaagaguugaa

SEQ ID NO: 2186209 - RNA, 18 nt, Homo sapiens
ggaguuaggcuauucaca

SEQ ID NO: 2186210 - RNA, 14 nt, Homo sapiens
uucaaacugcugga

SEQ ID NO: 2186211 - RNA, 13 nt, Homo sapiens
ucacaagcacuuu

SEQ ID NO: 2186212 - RNA, 21 nt, Homo sapiens
ucccagcgacauuucuccaag

SEQ ID NO: 2186213 - RNA, 19 nt, Homo sapiens
ugguaauaaguacugugua

SEQ ID NO: 2186214 - RNA, 20 nt, Homo sapiens
accaggcugggcucagcuca

SEQ ID NO: 2186215 - RNA, 18 nt, Homo sapiens
ggcacucaacaugaguca

SEQ ID NO: 2186216 - RNA, 20 nt, Homo sapiens
ggguggagugcaguggugcg

SEQ ID NO: 2186217 - RNA, 21 nt, Homo sapiens
aaaaguuuuauguacuuugau

SEQ ID NO: 2186218 - RNA, 15 nt, Homo sapiens
caagaagugguccau

SEQ ID NO: 2186219 - RNA, 22 nt, Homo sapiens
uggcaagucaccugcagcccau

SEQ ID NO: 2186220 - RNA, 12 nt, Homo sapiens
auuuuaaaguaa

SEQ ID NO: 2186221 - RNA, 16 nt, Homo sapiens
uugacuggccaaaaau

SEQ ID NO: 2186222 - RNA, 23 nt, Homo sapiens
cuucagagacuucguaauuaaag

SEQ ID NO: 2186223 - RNA, 23 nt, Homo sapiens
ccuuuuguauuuaaaaccuugau

SEQ ID NO: 2186224 - RNA, 20 nt, Homo sapiens
auccuguuaacacuguaaua

SEQ ID NO: 2186225 - RNA, 22 nt, Homo sapiens
augugauggauggcacaaugaa

SEQ ID NO: 2186226 - RNA, 20 nt, Homo sapiens
guuaguguguugucugugca

SEQ ID NO: 2186227 - RNA, 16 nt, Homo sapiens
aacccugcccugcccc

SEQ ID NO: 2186228 - RNA, 22 nt, Homo sapiens
auauuaaauaaaugugcaugcu

SEQ ID NO: 2186229 - RNA, 20 nt, Homo sapiens
acauucuuuuuucuauucaa

SEQ ID NO: 2186230 - RNA, 19 nt, Homo sapiens
auaacaaccccggacaaau

SEQ ID NO: 2186231 - RNA, 22 nt, Homo sapiens
ucuuucggggugcuccuguggg

SEQ ID NO: 2186232 - RNA, 22 nt, Homo sapiens
aaaagcuucgugccaacagaga

SEQ ID NO: 2186233 - RNA, 13 nt, Homo sapiens
uaggagauuuauu

SEQ ID NO: 2186234 - RNA, 14 nt, Homo sapiens
uccuaccagcaaag

SEQ ID NO: 2186235 - RNA, 21 nt, Homo sapiens
aaaguucaacuuauuucauaa

SEQ ID NO: 2186236 - RNA, 12 nt, Homo sapiens
caugcaagucau

SEQ ID NO: 2186237 - RNA, 18 nt, Homo sapiens
cacacuccccugcacugg

SEQ ID NO: 2186238 - RNA, 20 nt, Homo sapiens
aagaaaagccucagcucaua

SEQ ID NO: 2186239 - RNA, 20 nt, Homo sapiens
caccaagaggguggaucaca

SEQ ID NO: 2186240 - RNA, 16 nt, Homo sapiens
auucaacccagcaauc

SEQ ID NO: 2186241 - RNA, 21 nt, Homo sapiens
aagaauuuuguuuuacuuuuu

SEQ ID NO: 2186242 - RNA, 19 nt, Homo sapiens
aggugaguuugagcugccu

SEQ ID NO: 2186243 - RNA, 11 nt, Homo sapiens
uaaaugaaggc

SEQ ID NO: 2186244 - RNA, 19 nt, Homo sapiens
ucauuuugucucucucaca

SEQ ID NO: 2186245 - RNA, 16 nt, Homo sapiens
ggaacaguguuuacuu

SEQ ID NO: 2186246 - RNA, 18 nt, Homo sapiens
cagagauauuucuucagg

SEQ ID NO: 2186247 - RNA, 17 nt, Homo sapiens
aaggugagcaaagggcu

SEQ ID NO: 2186248 - RNA, 13 nt, Homo sapiens
caggguucaucug

SEQ ID NO: 2186249 - RNA, 17 nt, Homo sapiens
uaggaacugggccuugu

SEQ ID NO: 2186250 - RNA, 14 nt, Homo sapiens
agcugagccugcag

SEQ ID NO: 2186251 - RNA, 13 nt, Homo sapiens
cagcaaaugagau

SEQ ID NO: 2186252 - RNA, 13 nt, Homo sapiens
ccacuaaugcaaa

SEQ ID NO: 2186253 - RNA, 20 nt, Homo sapiens
guggggaccgggcucugaca

SEQ ID NO: 2186254 - RNA, 14 nt, Homo sapiens
gaggggauucucua

SEQ ID NO: 2186255 - RNA, 15 nt, Homo sapiens
agcuaagacugaugu

SEQ ID NO: 2186256 - RNA, 13 nt, Homo sapiens
gagugauucuguc

SEQ ID NO: 2186257 - RNA, 17 nt, Homo sapiens
ccuuacucugagcucau

SEQ ID NO: 2186258 - RNA, 17 nt, Homo sapiens
cucuucccugaccuccc

SEQ ID NO: 2186259 - RNA, 17 nt, Homo sapiens
gucuucuucaugucauc

SEQ ID NO: 2186260 - RNA, 15 nt, Homo sapiens
ugauucacaguguga

SEQ ID NO: 2186261 - RNA, 16 nt, Homo sapiens
cugucucaacuacuca

SEQ ID NO: 2186262 - RNA, 22 nt, Homo sapiens
agcuccucggacaccaagcaga

SEQ ID NO: 2186263 - RNA, 13 nt, Homo sapiens
ccuuguaccucaa

SEQ ID NO: 2186264 - RNA, 20 nt, Homo sapiens
aaaaggaguagggaguucau

SEQ ID NO: 2186265 - RNA, 12 nt, Homo sapiens
uuagaacuauua

SEQ ID NO: 2186266 - RNA, 21 nt, Homo sapiens
ugggccgggcaauccagacag

SEQ ID NO: 2186267 - RNA, 17 nt, Homo sapiens
caguuuauauuguggaa

SEQ ID NO: 2186268 - RNA, 18 nt, Homo sapiens
uugccuccuuauuuauca

SEQ ID NO: 2186269 - RNA, 15 nt, Homo sapiens
aggcuaaacucaaga

SEQ ID NO: 2186270 - RNA, 16 nt, Homo sapiens
cugucccccagcaucg

SEQ ID NO: 2186271 - RNA, 13 nt, Homo sapiens
agcacacuuuucc

SEQ ID NO: 2186272 - RNA, 19 nt, Homo sapiens
uuguuuaaaucaagagcuu

SEQ ID NO: 2186273 - RNA, 22 nt, Homo sapiens
aagaccccacuggagucucucu

SEQ ID NO: 2186274 - RNA, 12 nt, Homo sapiens
acuucagggauc

SEQ ID NO: 2186275 - RNA, 22 nt, Homo sapiens
ucccuauuuuuuuucuguuaua

SEQ ID NO: 2186276 - RNA, 20 nt, Homo sapiens
ucuguguuuucagacugccu

SEQ ID NO: 2186277 - RNA, 23 nt, Homo sapiens
ucaucaguguccucuugcucaaa

SEQ ID NO: 2186278 - RNA, 22 nt, Homo sapiens
cuuaccuguggagaagccuauu

SEQ ID NO: 2186279 - RNA, 21 nt, Homo sapiens
guaggagcugccuuggcucag

SEQ ID NO: 2186280 - RNA, 19 nt, Homo sapiens
auuguauuaauaccaaagu

SEQ ID NO: 2186281 - RNA, 15 nt, Homo sapiens
uucccaugaguguga

SEQ ID NO: 2186282 - RNA, 18 nt, Homo sapiens
aauaaauuggaacaccuc

SEQ ID NO: 2186283 - RNA, 16 nt, Homo sapiens
cauuaaaguucuaggc

SEQ ID NO: 2186284 - RNA, 16 nt, Homo sapiens
uccuggaggugggaga

SEQ ID NO: 2186285 - RNA, 15 nt, Homo sapiens
uaggagacacaggga

SEQ ID NO: 2186286 - RNA, 19 nt, Homo sapiens
cuggggaauaaacuccagc

SEQ ID NO: 2186287 - RNA, 21 nt, Homo sapiens
ccaauauuuaccagaccacaa

SEQ ID NO: 2186288 - RNA, 15 nt, Homo sapiens
caugaaucaaagaca

SEQ ID NO: 2186289 - RNA, 21 nt, Homo sapiens
cuacauauucuuuaaauuuca

SEQ ID NO: 2186290 - RNA, 21 nt, Homo sapiens
caucuuuuuaaccugcaaaau

SEQ ID NO: 2186291 - RNA, 18 nt, Homo sapiens
ucauacaaggcccaggag

SEQ ID NO: 2186292 - RNA, 18 nt, Homo sapiens
uuguuucaaccaguuuga

SEQ ID NO: 2186293 - RNA, 21 nt, Homo sapiens
ugagccagucuuugaacugca

SEQ ID NO: 2186294 - RNA, 19 nt, Homo sapiens
aggauguagagaaacuggu

SEQ ID NO: 2186295 - RNA, 14 nt, Homo sapiens
aaacaugauauauc

SEQ ID NO: 2186296 - RNA, 14 nt, Homo sapiens
agucaugaugaauc

SEQ ID NO: 2186297 - RNA, 23 nt, Homo sapiens
agaaaucgagagugugcucuccc

SEQ ID NO: 2186298 - RNA, 13 nt, Homo sapiens
gccgacucaggga

SEQ ID NO: 2186299 - RNA, 16 nt, Homo sapiens
ucauaauuaaaucaua

SEQ ID NO: 2186300 - RNA, 13 nt, Homo sapiens
cuaauaaacaauu

SEQ ID NO: 2186301 - RNA, 22 nt, Homo sapiens
uggacaauaugaaucuuuucca

SEQ ID NO: 2186302 - RNA, 14 nt, Homo sapiens
ucaaguguauuuga

SEQ ID NO: 2186303 - RNA, 18 nt, Homo sapiens
uacuguagacucuggaag

SEQ ID NO: 2186304 - RNA, 16 nt, Homo sapiens
caaguuuccccagcuu

SEQ ID NO: 2186305 - RNA, 11 nt, Homo sapiens
auccugugaag

SEQ ID NO: 2186306 - RNA, 15 nt, Homo sapiens
agggaaucaugggca

SEQ ID NO: 2186307 - RNA, 14 nt, Homo sapiens
agaaccuaaugcac

SEQ ID NO: 2186308 - RNA, 17 nt, Homo sapiens
cuggcauuacaauugca

SEQ ID NO: 2186309 - RNA, 21 nt, Homo sapiens
ccuggccagaccaggugaccu

SEQ ID NO: 2186310 - RNA, 18 nt, Homo sapiens
agaaucccucuacaugga

SEQ ID NO: 2186311 - RNA, 21 nt, Homo sapiens
aaggugggaaggaugguccag

SEQ ID NO: 2186312 - RNA, 11 nt, Homo sapiens
auaaccauagc

SEQ ID NO: 2186313 - RNA, 22 nt, Homo sapiens
uguuaagcaaaggaaaccaaag

SEQ ID NO: 2186314 - RNA, 19 nt, Homo sapiens
cuucacucgacauuuggug

SEQ ID NO: 2186315 - RNA, 22 nt, Homo sapiens
aaacugagacacauuggcuuug

SEQ ID NO: 2186316 - RNA, 20 nt, Homo sapiens
aacuagacauuaccaaagug

SEQ ID NO: 2186317 - RNA, 21 nt, Homo sapiens
ccaccuuggacccuggugacc

SEQ ID NO: 2186318 - RNA, 17 nt, Homo sapiens
gggcugaggccagggga

SEQ ID NO: 2186319 - RNA, 19 nt, Homo sapiens
ucgccucaggaaugggcug

SEQ ID NO: 2186320 - RNA, 15 nt, Homo sapiens
cuccuuuacaaaaga

SEQ ID NO: 2186321 - RNA, 12 nt, Homo sapiens
uuaugguuuugg

SEQ ID NO: 2186322 - RNA, 15 nt, Homo sapiens
acccagggugcgcug

SEQ ID NO: 2186323 - RNA, 17 nt, Homo sapiens
gauacugucucuuucau

SEQ ID NO: 2186324 - RNA, 14 nt, Homo sapiens
ugcaagugcuguca

SEQ ID NO: 2186325 - RNA, 15 nt, Homo sapiens
gccuaacacacucca

SEQ ID NO: 2186326 - RNA, 22 nt, Homo sapiens
uguuuucugacuaggcugauca

SEQ ID NO: 2186327 - RNA, 16 nt, Homo sapiens
agaauggaauaagcag

SEQ ID NO: 2186328 - RNA, 23 nt, Homo sapiens
ccuuaagaagucuauaaugcaau

SEQ ID NO: 2186329 - RNA, 14 nt, Homo sapiens
uguuuuugccaaag

SEQ ID NO: 2186330 - RNA, 23 nt, Homo sapiens
cguuccuguuagcauaaugugag

SEQ ID NO: 2186331 - RNA, 16 nt, Homo sapiens
gauggugaaaccaaac

SEQ ID NO: 2186332 - RNA, 12 nt, Homo sapiens
acucacaggcua

SEQ ID NO: 2186333 - RNA, 12 nt, Homo sapiens
agacacagggaa

SEQ ID NO: 2186334 - RNA, 16 nt, Homo sapiens
cggagguugcagugag

SEQ ID NO: 2186335 - RNA, 19 nt, Homo sapiens
agagcagcugccauugcag

SEQ ID NO: 2186336 - RNA, 17 nt, Homo sapiens
caccgugaaauagguga

SEQ ID NO: 2186337 - RNA, 14 nt, Homo sapiens
agcucagugccaaa

SEQ ID NO: 2186338 - RNA, 15 nt, Homo sapiens
ccagcugagucugaa

SEQ ID NO: 2186339 - RNA, 22 nt, Homo sapiens
gcagguuuguuuucagcacuga

SEQ ID NO: 2186340 - RNA, 23 nt, Homo sapiens
acauguguguguguuguguuaau

SEQ ID NO: 2186341 - RNA, 17 nt, Homo sapiens
auggcccugggucccag

SEQ ID NO: 2186342 - RNA, 14 nt, Homo sapiens
cuucauuuccguga

SEQ ID NO: 2186343 - RNA, 12 nt, Homo sapiens
cuugacuaucac

SEQ ID NO: 2186344 - RNA, 18 nt, Homo sapiens
auucuauuauacuacaau

SEQ ID NO: 2186345 - RNA, 22 nt, Homo sapiens
auccccaaguggugaaugacac

SEQ ID NO: 2186346 - RNA, 15 nt, Homo sapiens
auugaccuuuaggua

SEQ ID NO: 2186347 - RNA, 19 nt, Homo sapiens
cuaucauggaaugagacug

SEQ ID NO: 2186348 - RNA, 16 nt, Homo sapiens
guccuuacauacucaa

SEQ ID NO: 2186349 - RNA, 21 nt, Homo sapiens
ggacacugugcccagcccgga

SEQ ID NO: 2186350 - RNA, 20 nt, Homo sapiens
gccaaguugugacagucacu

SEQ ID NO: 2186351 - RNA, 15 nt, Homo sapiens
ccugguuugacucag

SEQ ID NO: 2186352 - RNA, 22 nt, Homo sapiens
aauaucuaagcaagugaacuca

SEQ ID NO: 2186353 - RNA, 15 nt, Homo sapiens
agagcacacuguagc

SEQ ID NO: 2186354 - RNA, 15 nt, Homo sapiens
uugcuuggugcuggu

SEQ ID NO: 2186355 - RNA, 20 nt, Homo sapiens
acauggccagugugauccca

SEQ ID NO: 2186356 - RNA, 22 nt, Homo sapiens
uaacuaggcucagagaugugca

SEQ ID NO: 2186357 - RNA, 20 nt, Homo sapiens
uauuuaaauuguuuuggacg

SEQ ID NO: 2186358 - RNA, 22 nt, Homo sapiens
gugaucagaccauaauguuaca

SEQ ID NO: 2186359 - RNA, 15 nt, Homo sapiens
aauagcaauauucuu

SEQ ID NO: 2186360 - RNA, 16 nt, Homo sapiens
uugcuuccaaacuccu

SEQ ID NO: 2186361 - RNA, 21 nt, Homo sapiens
ccuuuucuuguaaacauugcc

SEQ ID NO: 2186362 - RNA, 17 nt, Homo sapiens
auuuagacaaaguucaa

SEQ ID NO: 2186363 - RNA, 17 nt, Homo sapiens
gauggucucgaucucuu

SEQ ID NO: 2186364 - RNA, 23 nt, Homo sapiens
aaaaauugcucuuggcugugaaa

SEQ ID NO: 2186365 - RNA, 17 nt, Homo sapiens
uaauaccuaaacuguau

SEQ ID NO: 2186366 - RNA, 13 nt, Homo sapiens
acaauaagccacu

SEQ ID NO: 2186367 - RNA, 20 nt, Homo sapiens
agagaagcccagacuuccuu

SEQ ID NO: 2186368 - RNA, 17 nt, Homo sapiens
caguaaagaaacugaug

SEQ ID NO: 2186369 - RNA, 16 nt, Homo sapiens
gaggaauauugcugcu

SEQ ID NO: 2186370 - RNA, 13 nt, Homo sapiens
ucacugcauucau

SEQ ID NO: 2186371 - RNA, 13 nt, Homo sapiens
uauagcacuuuga

SEQ ID NO: 2186372 - RNA, 22 nt, Homo sapiens
caccucuugauuaucuaaacua

SEQ ID NO: 2186373 - RNA, 9 nt, Homo sapiens
cauucaguc

SEQ ID NO: 2186374 - RNA, 15 nt, Homo sapiens
ucccucugaguuuga

SEQ ID NO: 2186375 - RNA, 16 nt, Homo sapiens
uccuuggggagcacuu

SEQ ID NO: 2186376 - RNA, 19 nt, Homo sapiens
aggaaauggcuuugugauu

SEQ ID NO: 2186377 - RNA, 23 nt, Homo sapiens
auugugccgagaaaagcauuuua

SEQ ID NO: 2186378 - RNA, 15 nt, Homo sapiens
guggaagaacuguga

SEQ ID NO: 2186379 - RNA, 14 nt, Homo sapiens
acuugucucaggac

SEQ ID NO: 2186380 - RNA, 22 nt, Homo sapiens
agggauaaccccaggcacuguu

SEQ ID NO: 2186381 - RNA, 18 nt, Homo sapiens
accuguguuaaugcuuug

SEQ ID NO: 2186382 - RNA, 12 nt, Homo sapiens
gaaacauucacu

SEQ ID NO: 2186383 - RNA, 14 nt, Homo sapiens
ugagugacuagacg

SEQ ID NO: 2186384 - RNA, 22 nt, Homo sapiens
uuaaacaugaauuuaaugucua

SEQ ID NO: 2186385 - RNA, 12 nt, Homo sapiens
guagaguggugc

SEQ ID NO: 2186386 - RNA, 15 nt, Homo sapiens
ugcagagcaugaccu

SEQ ID NO: 2186387 - RNA, 17 nt, Homo sapiens
guccagccaacauuuaa

SEQ ID NO: 2186388 - RNA, 21 nt, Homo sapiens
guuaaaccaguuugcauuccc

SEQ ID NO: 2186389 - RNA, 21 nt, Homo sapiens
gcaguuggggcccucuugcca

SEQ ID NO: 2186390 - RNA, 15 nt, Homo sapiens
ccgcucucucaugug

SEQ ID NO: 2186391 - RNA, 15 nt, Homo sapiens
cuggcuuuccagcuu

SEQ ID NO: 2186392 - RNA, 12 nt, Homo sapiens
augauuuuuaca

SEQ ID NO: 2186393 - RNA, 20 nt, Homo sapiens
aaagguauuuugaauaccau

SEQ ID NO: 2186394 - RNA, 15 nt, Homo sapiens
gaugucagcuuccca

SEQ ID NO: 2186395 - RNA, 14 nt, Homo sapiens
guggcugugccacc

SEQ ID NO: 2186396 - RNA, 20 nt, Homo sapiens
agugcugcuggaaguagaau

SEQ ID NO: 2186397 - RNA, 18 nt, Homo sapiens
agaaagauuuuaugugcu

SEQ ID NO: 2186398 - RNA, 16 nt, Homo sapiens
aggaaacuucaguuga

SEQ ID NO: 2186399 - RNA, 20 nt, Homo sapiens
aauugucuuuugucaugugg

SEQ ID NO: 2186400 - RNA, 21 nt, Homo sapiens
uacagacuccaaaaggcccuu

SEQ ID NO: 2186401 - RNA, 14 nt, Homo sapiens
aucgaagccaaagc

SEQ ID NO: 2186402 - RNA, 20 nt, Homo sapiens
auugaauuugccuuccucau

SEQ ID NO: 2186403 - RNA, 20 nt, Homo sapiens
gauaaccucggcuguuuaca

SEQ ID NO: 2186404 - RNA, 14 nt, Homo sapiens
caagccggugccca

SEQ ID NO: 2186405 - RNA, 14 nt, Homo sapiens
gggcccccacugua

SEQ ID NO: 2186406 - RNA, 23 nt, Homo sapiens
cggaauucaaguuaccaauguaa

SEQ ID NO: 2186407 - RNA, 21 nt, Homo sapiens
agcgugcgucugugugugccu

SEQ ID NO: 2186408 - RNA, 16 nt, Homo sapiens
agaccugugugaacua

SEQ ID NO: 2186409 - RNA, 15 nt, Homo sapiens
cauaaaaguaauuaa

SEQ ID NO: 2186410 - RNA, 15 nt, Homo sapiens
ccagaucugcaguca

SEQ ID NO: 2186411 - RNA, 22 nt, Homo sapiens
augaaggaaggacuaugacaaa

SEQ ID NO: 2186412 - RNA, 14 nt, Homo sapiens
uuguugcaguucag

SEQ ID NO: 2186413 - RNA, 17 nt, Homo sapiens
uuuaugcccucaggaaa

SEQ ID NO: 2186414 - RNA, 22 nt, Homo sapiens
uuaaauagcuuuuuucucugau

SEQ ID NO: 2186415 - RNA, 21 nt, Homo sapiens
aauuuuccucauuuugaauua

SEQ ID NO: 2186416 - RNA, 19 nt, Homo sapiens
aauugugaucagaccauaa

SEQ ID NO: 2186417 - RNA, 16 nt, Homo sapiens
uuacucauauguggaa

SEQ ID NO: 2186418 - RNA, 21 nt, Homo sapiens
aauauaucuguaacacuauua

SEQ ID NO: 2186419 - RNA, 13 nt, Homo sapiens
uacucauccagac

SEQ ID NO: 2186420 - RNA, 15 nt, Homo sapiens
ucaaaguucaaaaau

SEQ ID NO: 2186421 - RNA, 16 nt, Homo sapiens
gaaugcccuguucaug

SEQ ID NO: 2186422 - RNA, 13 nt, Homo sapiens
uaggggcaaaaau

SEQ ID NO: 2186423 - RNA, 14 nt, Homo sapiens
agcccaugucuucu

SEQ ID NO: 2186424 - RNA, 21 nt, Homo sapiens
auuauauucuguuuauuauga

SEQ ID NO: 2186425 - RNA, 16 nt, Homo sapiens
cuaccugagcaacaag

SEQ ID NO: 2186426 - RNA, 13 nt, Homo sapiens
acugucauguggc

SEQ ID NO: 2186427 - RNA, 16 nt, Homo sapiens
uuggaaagguuucaag

SEQ ID NO: 2186428 - RNA, 20 nt, Homo sapiens
aagggacaagacaaaaccaa

SEQ ID NO: 2186429 - RNA, 17 nt, Homo sapiens
auaagcauacaacugga

SEQ ID NO: 2186430 - RNA, 20 nt, Homo sapiens
ugucuguccugauuucuaca

SEQ ID NO: 2186431 - RNA, 12 nt, Homo sapiens
ucuccccagaau

SEQ ID NO: 2186432 - RNA, 20 nt, Homo sapiens
cuugaauagauuuucucugg

SEQ ID NO: 2186433 - RNA, 16 nt, Homo sapiens
uugcccagagcucucu

SEQ ID NO: 2186434 - RNA, 21 nt, Homo sapiens
acaccugcggcccaauccaag

SEQ ID NO: 2186435 - RNA, 17 nt, Homo sapiens
cugaaauuuauucacau

SEQ ID NO: 2186436 - RNA, 15 nt, Homo sapiens
uugcgugauucaaug

SEQ ID NO: 2186437 - RNA, 23 nt, Homo sapiens
caaugcucaguaacacagugcag

SEQ ID NO: 2186438 - RNA, 16 nt, Homo sapiens
uuaugaaacauuacag

SEQ ID NO: 2186439 - RNA, 21 nt, Homo sapiens
uuucugucagaugagaacaaa

SEQ ID NO: 2186440 - RNA, 16 nt, Homo sapiens
aaugggcucaaacuuc

SEQ ID NO: 2186441 - RNA, 20 nt, Homo sapiens
accagugaguugggaguuau

SEQ ID NO: 2186442 - RNA, 18 nt, Homo sapiens
aaccgaguaucuggccuu

SEQ ID NO: 2186443 - RNA, 15 nt, Homo sapiens
ucuccuaauauucca

SEQ ID NO: 2186444 - RNA, 15 nt, Homo sapiens
gcacuucagaauucc

SEQ ID NO: 2186445 - RNA, 12 nt, Homo sapiens
gugcaugcucuc

SEQ ID NO: 2186446 - RNA, 19 nt, Homo sapiens
ucucacaaauaaguaauau

SEQ ID NO: 2186447 - RNA, 15 nt, Homo sapiens
cucucaaauccaaaa

SEQ ID NO: 2186448 - RNA, 17 nt, Homo sapiens
acucugaauaccaagug

SEQ ID NO: 2186449 - RNA, 19 nt, Homo sapiens
aagaggcugagacaggaga

SEQ ID NO: 2186450 - RNA, 18 nt, Homo sapiens
aaucaacaaaauggucau

SEQ ID NO: 2186451 - RNA, 20 nt, Homo sapiens
cuuugaccucaaccugugau

SEQ ID NO: 2186452 - RNA, 21 nt, Homo sapiens
uggaacuacaagugugagcca

SEQ ID NO: 2186453 - RNA, 19 nt, Homo sapiens
cacuaggaauucuuugcau

SEQ ID NO: 2186454 - RNA, 14 nt, Homo sapiens
uucauacuugaacg

SEQ ID NO: 2186455 - RNA, 17 nt, Homo sapiens
gcaacaaaauguagaau

SEQ ID NO: 2186456 - RNA, 16 nt, Homo sapiens
agcuauuucauuugcu

SEQ ID NO: 2186457 - RNA, 18 nt, Homo sapiens
auuuagauauaacacuau

SEQ ID NO: 2186458 - RNA, 14 nt, Homo sapiens
cacugccugaggcu

SEQ ID NO: 2186459 - RNA, 20 nt, Homo sapiens
cucagaauaaggcaggcauu

SEQ ID NO: 2186460 - RNA, 14 nt, Homo sapiens
uuaauacucaugca

SEQ ID NO: 2186461 - RNA, 12 nt, Homo sapiens
cuauaagccaau

SEQ ID NO: 2186462 - RNA, 12 nt, Homo sapiens
cuagaagccaag

SEQ ID NO: 2186463 - RNA, 12 nt, Homo sapiens
aauuaagcauuu

SEQ ID NO: 2186464 - RNA, 12 nt, Homo sapiens
caugaagccuug

SEQ ID NO: 2186465 - RNA, 19 nt, Homo sapiens
ccucaagaaaaauucacag

SEQ ID NO: 2186466 - RNA, 16 nt, Homo sapiens
agucccucugcucuca

SEQ ID NO: 2186467 - RNA, 15 nt, Homo sapiens
ggucccccugcagcu

SEQ ID NO: 2186468 - RNA, 20 nt, Homo sapiens
ccacuccaaccagaagugaa

SEQ ID NO: 2186469 - RNA, 19 nt, Homo sapiens
ucuuucauaaaaacacuca

SEQ ID NO: 2186470 - RNA, 17 nt, Homo sapiens
aucaugccauugcacuc

SEQ ID NO: 2186471 - RNA, 10 nt, Homo sapiens
aaccaaacac

SEQ ID NO: 2186472 - RNA, 15 nt, Homo sapiens
uuccuguucaguaau

SEQ ID NO: 2186473 - RNA, 13 nt, Homo sapiens
acagacacugcac

SEQ ID NO: 2186474 - RNA, 18 nt, Homo sapiens
ggaaggugggaacagagg

SEQ ID NO: 2186475 - RNA, 13 nt, Homo sapiens
ugauuaugaauua

SEQ ID NO: 2186476 - RNA, 15 nt, Homo sapiens
ugaauugggggaguc

SEQ ID NO: 2186477 - RNA, 14 nt, Homo sapiens
cucuugccaaaaag

SEQ ID NO: 2186478 - RNA, 20 nt, Homo sapiens
aggccugaaaugacauuuca

SEQ ID NO: 2186479 - RNA, 16 nt, Homo sapiens
cacugccugccaugua

SEQ ID NO: 2186480 - RNA, 20 nt, Homo sapiens
cauuucuggacaguaccuga

SEQ ID NO: 2186481 - RNA, 21 nt, Homo sapiens
acuuuuacagaaugcauuaaa

SEQ ID NO: 2186482 - RNA, 22 nt, Homo sapiens
uuaaccaguucugucuucagcu

SEQ ID NO: 2186483 - RNA, 13 nt, Homo sapiens
uaauaaaaccaaa

SEQ ID NO: 2186484 - RNA, 13 nt, Homo sapiens
caaaaaaaucaua

SEQ ID NO: 2186485 - RNA, 13 nt, Homo sapiens
uaaagaaaccaug

SEQ ID NO: 2186486 - RNA, 21 nt, Homo sapiens
aggaaucauuccagugcuaga

SEQ ID NO: 2186487 - RNA, 20 nt, Homo sapiens
aguggcacgaucucagcuca

SEQ ID NO: 2186488 - RNA, 20 nt, Homo sapiens
aguggugcgaucuuggcuca

SEQ ID NO: 2186489 - RNA, 20 nt, Homo sapiens
aguggcgcgaucucggcuca

SEQ ID NO: 2186490 - RNA, 21 nt, Homo sapiens
uugaguuugucgcucaugugu

SEQ ID NO: 2186491 - RNA, 14 nt, Homo sapiens
uucuagugcugcug

SEQ ID NO: 2186492 - RNA, 20 nt, Homo sapiens
gcuaguauaaacaaacaaau

SEQ ID NO: 2186493 - RNA, 14 nt, Homo sapiens
acugagccuagcua

SEQ ID NO: 2186494 - RNA, 12 nt, Homo sapiens
cagaccacugau

SEQ ID NO: 2186495 - RNA, 14 nt, Homo sapiens
ucuaauuagaauuc

SEQ ID NO: 2186496 - RNA, 13 nt, Homo sapiens
uuuuagacagagu

SEQ ID NO: 2186497 - RNA, 10 nt, Homo sapiens
uuacuguaac

SEQ ID NO: 2186498 - RNA, 21 nt, Homo sapiens
gucuuaauucugaccaauaaa

SEQ ID NO: 2186499 - RNA, 13 nt, Homo sapiens
auuucaaugauug

SEQ ID NO: 2186500 - RNA, 20 nt, Homo sapiens
uguaaaaauccuuuugaaug

SEQ ID NO: 2186501 - RNA, 11 nt, Homo sapiens
cuaugcaagag

SEQ ID NO: 2186502 - RNA, 20 nt, Homo sapiens
aagccugggcuugagcugca

SEQ ID NO: 2186503 - RNA, 16 nt, Homo sapiens
ugucuuuacuccauga

SEQ ID NO: 2186504 - RNA, 20 nt, Homo sapiens
gggcaguuguugcuucuuaa

SEQ ID NO: 2186505 - RNA, 22 nt, Homo sapiens
ccuuaaagaaaauugcaugaaa

SEQ ID NO: 2186506 - RNA, 20 nt, Homo sapiens
uggaggcugcuguggggacc

SEQ ID NO: 2186507 - RNA, 16 nt, Homo sapiens
auuuugaguauuccau

SEQ ID NO: 2186508 - RNA, 14 nt, Homo sapiens
ugaguuggggccau

SEQ ID NO: 2186509 - RNA, 23 nt, Homo sapiens
cuucaugucaucaaaaucugcac

SEQ ID NO: 2186510 - RNA, 21 nt, Homo sapiens
aguaaucugucaguuauuaaa

SEQ ID NO: 2186511 - RNA, 13 nt, Homo sapiens
cagcagugccuug

SEQ ID NO: 2186512 - RNA, 22 nt, Homo sapiens
uguaccugcuggaagaauucua

SEQ ID NO: 2186513 - RNA, 18 nt, Homo sapiens
aaagcuuuggcugagacc

SEQ ID NO: 2186514 - RNA, 16 nt, Homo sapiens
ugaaaggugacaaaag

SEQ ID NO: 2186515 - RNA, 14 nt, Homo sapiens
gccaaaagcugcuc

SEQ ID NO: 2186516 - RNA, 14 nt, Homo sapiens
cugcugggugugac

SEQ ID NO: 2186517 - RNA, 18 nt, Homo sapiens
aggaggaacagauuugag

SEQ ID NO: 2186518 - RNA, 16 nt, Homo sapiens
agagcuccacagaaga

SEQ ID NO: 2186519 - RNA, 22 nt, Homo sapiens
aagaucuuuuuccagguuccug

SEQ ID NO: 2186520 - RNA, 17 nt, Homo sapiens
ccagcccagccugcaua

SEQ ID NO: 2186521 - RNA, 13 nt, Homo sapiens
augacaucacuug

SEQ ID NO: 2186522 - RNA, 15 nt, Homo sapiens
uguucauuucugucu

SEQ ID NO: 2186523 - RNA, 13 nt, Homo sapiens
uaagccugaugau

SEQ ID NO: 2186524 - RNA, 14 nt, Homo sapiens
uaaugucagugaca

SEQ ID NO: 2186525 - RNA, 20 nt, Homo sapiens
ucuuuacaaaaaaauacaaa

SEQ ID NO: 2186526 - RNA, 21 nt, Homo sapiens
ucucgaaaaaagagacaacuc

SEQ ID NO: 2186527 - RNA, 14 nt, Homo sapiens
aggcucauuuacuu

SEQ ID NO: 2186528 - RNA, 13 nt, Homo sapiens
ucaccacuucccu

SEQ ID NO: 2186529 - RNA, 14 nt, Homo sapiens
gaaacaacagggga

SEQ ID NO: 2186530 - RNA, 14 nt, Homo sapiens
gaagccacaggagc

SEQ ID NO: 2186531 - RNA, 22 nt, Homo sapiens
uaacauuucauuaaccaaagaa

SEQ ID NO: 2186532 - RNA, 13 nt, Homo sapiens
uccaagauaugga

SEQ ID NO: 2186533 - RNA, 15 nt, Homo sapiens
uuccucaacaagcaa

SEQ ID NO: 2186534 - RNA, 14 nt, Homo sapiens
auggaacaauaaaa

SEQ ID NO: 2186535 - RNA, 18 nt, Homo sapiens
cccuggaccauuccagga

SEQ ID NO: 2186536 - RNA, 21 nt, Homo sapiens
uggaaaugagaacaaucucaa

SEQ ID NO: 2186537 - RNA, 21 nt, Homo sapiens
ucacaccuguccuucucaggc

SEQ ID NO: 2186538 - RNA, 21 nt, Homo sapiens
cgugcaauacggaacacuguc

SEQ ID NO: 2186539 - RNA, 13 nt, Homo sapiens
cugcagccaaaga

SEQ ID NO: 2186540 - RNA, 17 nt, Homo sapiens
cagugugcuaaccucac

SEQ ID NO: 2186541 - RNA, 21 nt, Homo sapiens
gccuacagucaucugccacca

SEQ ID NO: 2186542 - RNA, 19 nt, Homo sapiens
acauuccugauacugggua

SEQ ID NO: 2186543 - RNA, 22 nt, Homo sapiens
ggcuaagcacgggccauaugaa

SEQ ID NO: 2186544 - RNA, 18 nt, Homo sapiens
cucaugagaagucacuca

SEQ ID NO: 2186545 - RNA, 18 nt, Homo sapiens
cucuacuccuaccucagc

SEQ ID NO: 2186546 - RNA, 18 nt, Homo sapiens
gagaugaccagugccuug

SEQ ID NO: 2186547 - RNA, 22 nt, Homo sapiens
uggacagacccaggucuuccag

SEQ ID NO: 2186548 - RNA, 12 nt, Homo sapiens
aaccaccaaucc

SEQ ID NO: 2186549 - RNA, 12 nt, Homo sapiens
cacaaccacuca

SEQ ID NO: 2186550 - RNA, 12 nt, Homo sapiens
cuaaaccacaaa

SEQ ID NO: 2186551 - RNA, 20 nt, Homo sapiens
ugggcagcuauccagugacu

SEQ ID NO: 2186552 - RNA, 18 nt, Homo sapiens
uccuuucacccgcuccua

SEQ ID NO: 2186553 - RNA, 17 nt, Homo sapiens
ugcucauguauauuuag

SEQ ID NO: 2186554 - RNA, 20 nt, Homo sapiens
aguuuucuggagugagcacu

SEQ ID NO: 2186555 - RNA, 12 nt, Homo sapiens
aacagaguaaau

SEQ ID NO: 2186556 - RNA, 16 nt, Homo sapiens
cagccucuuuguucca

SEQ ID NO: 2186557 - RNA, 15 nt, Homo sapiens
agaugaugcuuugag

SEQ ID NO: 2186558 - RNA, 22 nt, Homo sapiens
acaguguuguucccucccucaa

SEQ ID NO: 2186559 - RNA, 12 nt, Homo sapiens
uuggauuugaca

SEQ ID NO: 2186560 - RNA, 14 nt, Homo sapiens
agugcaccaaagag

SEQ ID NO: 2186561 - RNA, 17 nt, Homo sapiens
uggccuuguaucuugca

SEQ ID NO: 2186562 - RNA, 24 nt, Homo sapiens
uccuguugcaaugacacauaggaa

SEQ ID NO: 2186563 - RNA, 23 nt, Homo sapiens
gccacgcacugggccacggagga

SEQ ID NO: 2186564 - RNA, 14 nt, Homo sapiens
ugaaagacuaccuc

SEQ ID NO: 2186565 - RNA, 18 nt, Homo sapiens
ucgugggguaacaucugu

SEQ ID NO: 2186566 - RNA, 17 nt, Homo sapiens
uaaaaaggaaaacagac

SEQ ID NO: 2186567 - RNA, 15 nt, Homo sapiens
ugaucacagcucccu

SEQ ID NO: 2186568 - RNA, 18 nt, Homo sapiens
gugccuggcacacaguaa

SEQ ID NO: 2186569 - RNA, 20 nt, Homo sapiens
cagcccucucucucacuccc

SEQ ID NO: 2186570 - RNA, 14 nt, Homo sapiens
agcuuauacagagc

SEQ ID NO: 2186571 - RNA, 17 nt, Homo sapiens
ucucuugacguuuacau

SEQ ID NO: 2186572 - RNA, 19 nt, Homo sapiens
cugucauggaaaagcccag

SEQ ID NO: 2186573 - RNA, 15 nt, Homo sapiens
uuguucuaguuuuca

SEQ ID NO: 2186574 - RNA, 19 nt, Homo sapiens
gucagucucuuucuguaca

SEQ ID NO: 2186575 - RNA, 14 nt, Homo sapiens
uguuugcauaaagu

SEQ ID NO: 2186576 - RNA, 14 nt, Homo sapiens
cugcccuccaucuc

SEQ ID NO: 2186577 - RNA, 20 nt, Homo sapiens
cuguaaucccaacacuuugg

SEQ ID NO: 2186578 - RNA, 18 nt, Homo sapiens
guaucuuauagucacuca

SEQ ID NO: 2186579 - RNA, 18 nt, Homo sapiens
aggccaccaagcugcucu

SEQ ID NO: 2186580 - RNA, 22 nt, Homo sapiens
gauuuccuacagaaauacugcu

SEQ ID NO: 2186581 - RNA, 14 nt, Homo sapiens
cuuuaguguuaaaa

SEQ ID NO: 2186582 - RNA, 21 nt, Homo sapiens
aauuuuuucccagacuacuau

SEQ ID NO: 2186583 - RNA, 18 nt, Homo sapiens
aacggcuccaggauuuua

SEQ ID NO: 2186584 - RNA, 12 nt, Homo sapiens
cccaaagcacuu

SEQ ID NO: 2186585 - RNA, 12 nt, Homo sapiens
uuuguugcucag

SEQ ID NO: 2186586 - RNA, 12 nt, Homo sapiens
uuaauugcucua

SEQ ID NO: 2186587 - RNA, 20 nt, Homo sapiens
aggccuuaucugaaaggcca

SEQ ID NO: 2186588 - RNA, 13 nt, Homo sapiens
aggagcagcuuca

SEQ ID NO: 2186589 - RNA, 18 nt, Homo sapiens
ucuauuacucugacauaa

SEQ ID NO: 2186590 - RNA, 13 nt, Homo sapiens
ucagucacuugaa

SEQ ID NO: 2186591 - RNA, 15 nt, Homo sapiens
uuccaauaguuagau

SEQ ID NO: 2186592 - RNA, 20 nt, Homo sapiens
guaucccaccuccagcccac

SEQ ID NO: 2186593 - RNA, 19 nt, Homo sapiens
accaggcccaccuggaauc

SEQ ID NO: 2186594 - RNA, 21 nt, Homo sapiens
cacuugacuauaaaaacugcc

SEQ ID NO: 2186595 - RNA, 14 nt, Homo sapiens
aauaauauccaugc

SEQ ID NO: 2186596 - RNA, 20 nt, Homo sapiens
ccaggcacccccagaaugac

SEQ ID NO: 2186597 - RNA, 23 nt, Homo sapiens
gccaacuuuuagugggugagaaa

SEQ ID NO: 2186598 - RNA, 17 nt, Homo sapiens
gaaugaucccacucacc

SEQ ID NO: 2186599 - RNA, 21 nt, Homo sapiens
ugcuucucuaugauaauuaca

SEQ ID NO: 2186600 - RNA, 22 nt, Homo sapiens
cuuaauacaucuacaaccauug

SEQ ID NO: 2186601 - RNA, 17 nt, Homo sapiens
uguucuuaaaaccaauu

SEQ ID NO: 2186602 - RNA, 18 nt, Homo sapiens
uaccaaaguaacugaauu

SEQ ID NO: 2186603 - RNA, 17 nt, Homo sapiens
aggaaggucucauucuu

SEQ ID NO: 2186604 - RNA, 20 nt, Homo sapiens
aauacagauagauauaugcu

SEQ ID NO: 2186605 - RNA, 16 nt, Homo sapiens
uaaauuaauuugacca

SEQ ID NO: 2186606 - RNA, 14 nt, Homo sapiens
uaguucaugucugc

SEQ ID NO: 2186607 - RNA, 13 nt, Homo sapiens
uuauccauguacu

SEQ ID NO: 2186608 - RNA, 14 nt, Homo sapiens
uccuagacauaguu

SEQ ID NO: 2186609 - RNA, 19 nt, Homo sapiens
cauagauguuaugcaaaaa

SEQ ID NO: 2186610 - RNA, 15 nt, Homo sapiens
uaaguuucucagcuc

SEQ ID NO: 2186611 - RNA, 23 nt, Homo sapiens
uucagcccacugcccaaugccug

SEQ ID NO: 2186612 - RNA, 23 nt, Homo sapiens
aaauccgcauugauggccucaau

SEQ ID NO: 2186613 - RNA, 17 nt, Homo sapiens
ucaugcuugacauaccu

SEQ ID NO: 2186614 - RNA, 18 nt, Homo sapiens
acuucccaauugccacau

SEQ ID NO: 2186615 - RNA, 16 nt, Homo sapiens
agaagccagagggugg

SEQ ID NO: 2186616 - RNA, 17 nt, Homo sapiens
uaaugacaaugaaguga

SEQ ID NO: 2186617 - RNA, 15 nt, Homo sapiens
uaauuuucacaaaau

SEQ ID NO: 2186618 - RNA, 22 nt, Homo sapiens
aauugcacauaguucugcccaa

SEQ ID NO: 2186619 - RNA, 18 nt, Homo sapiens
cagagaagcggauuucca

SEQ ID NO: 2186620 - RNA, 14 nt, Homo sapiens
ugaggcuccacuug

SEQ ID NO: 2186621 - RNA, 15 nt, Homo sapiens
ggugucccuuucaca

SEQ ID NO: 2186622 - RNA, 13 nt, Homo sapiens
acucaaugcacaa

SEQ ID NO: 2186623 - RNA, 18 nt, Homo sapiens
gagaaugguguuccauug

SEQ ID NO: 2186624 - RNA, 19 nt, Homo sapiens
uauuuacagcugugcucca

SEQ ID NO: 2186625 - RNA, 12 nt, Homo sapiens
cagcagcugaac

SEQ ID NO: 2186626 - RNA, 16 nt, Homo sapiens
gacagcagccugugag

SEQ ID NO: 2186627 - RNA, 22 nt, Homo sapiens
acaaagcugggauuucagucua

SEQ ID NO: 2186628 - RNA, 16 nt, Homo sapiens
cacaacuaaaacugga

SEQ ID NO: 2186629 - RNA, 23 nt, Homo sapiens
uggggucagagacugcuguguuu

SEQ ID NO: 2186630 - RNA, 21 nt, Homo sapiens
cucucgcacacacagugauuc

SEQ ID NO: 2186631 - RNA, 12 nt, Homo sapiens
uggcaagccaca

SEQ ID NO: 2186632 - RNA, 12 nt, Homo sapiens
ugccaagccaga

SEQ ID NO: 2186633 - RNA, 15 nt, Homo sapiens
guccagaucuugccu

SEQ ID NO: 2186634 - RNA, 14 nt, Homo sapiens
ugcuccucugccug

SEQ ID NO: 2186635 - RNA, 20 nt, Homo sapiens
uccugguuguuccucucaaa

SEQ ID NO: 2186636 - RNA, 22 nt, Homo sapiens
cagaaugacuuuuauugagcuc

SEQ ID NO: 2186637 - RNA, 21 nt, Homo sapiens
agucagacugacacuacuaaa

SEQ ID NO: 2186638 - RNA, 14 nt, Homo sapiens
uuguauccaaagga

SEQ ID NO: 2186639 - RNA, 16 nt, Homo sapiens
gaugaaaaaugguccc

SEQ ID NO: 2186640 - RNA, 23 nt, Homo sapiens
uagugccaauguuguguguugca

SEQ ID NO: 2186641 - RNA, 18 nt, Homo sapiens
uguaaguuuaugucuaaa

SEQ ID NO: 2186642 - RNA, 12 nt, Homo sapiens
acuucuguguac

SEQ ID NO: 2186643 - RNA, 23 nt, Homo sapiens
caucagcucccugaggaccaccu

SEQ ID NO: 2186644 - RNA, 20 nt, Homo sapiens
gaaagaugacaaaagaaaau

SEQ ID NO: 2186645 - RNA, 20 nt, Homo sapiens
guucagcuccuuccaccaca

SEQ ID NO: 2186646 - RNA, 20 nt, Homo sapiens
aauugagggcuaaaucccaa

SEQ ID NO: 2186647 - RNA, 14 nt, Homo sapiens
agacagcugcucag

SEQ ID NO: 2186648 - RNA, 19 nt, Homo sapiens
accucagccuggccagaca

SEQ ID NO: 2186649 - RNA, 15 nt, Homo sapiens
ccuuucuaaacaaga

SEQ ID NO: 2186650 - RNA, 12 nt, Homo sapiens
uagaaggcugug

SEQ ID NO: 2186651 - RNA, 15 nt, Homo sapiens
agugggggaucacag

SEQ ID NO: 2186652 - RNA, 22 nt, Homo sapiens
gaacauguggugggacuuucau

SEQ ID NO: 2186653 - RNA, 19 nt, Homo sapiens
auccuuugcuucauuccaa

SEQ ID NO: 2186654 - RNA, 23 nt, Homo sapiens
uugaauauuccuggacuuacaaa

SEQ ID NO: 2186655 - RNA, 19 nt, Homo sapiens
aauuuucuuugcucugucu

SEQ ID NO: 2186656 - RNA, 13 nt, Homo sapiens
uugagcccaggag

SEQ ID NO: 2186657 - RNA, 19 nt, Homo sapiens
aggaccugagacucacacu

SEQ ID NO: 2186658 - RNA, 20 nt, Homo sapiens
ucucauccugcaggcagcuu

SEQ ID NO: 2186659 - RNA, 17 nt, Homo sapiens
augcaagagaacauuuu

SEQ ID NO: 2186660 - RNA, 13 nt, Homo sapiens
aaagacacugcag

SEQ ID NO: 2186661 - RNA, 16 nt, Homo sapiens
ggacugggaagcauua

SEQ ID NO: 2186662 - RNA, 19 nt, Homo sapiens
gccauuugcugcuuaacag

SEQ ID NO: 2186663 - RNA, 13 nt, Homo sapiens
ccauauagucuau

SEQ ID NO: 2186664 - RNA, 22 nt, Homo sapiens
cacuucugguauaauuguguag

SEQ ID NO: 2186665 - RNA, 18 nt, Homo sapiens
cccugcagagaugcggug

SEQ ID NO: 2186666 - RNA, 16 nt, Homo sapiens
uaacaucaacaacaca

SEQ ID NO: 2186667 - RNA, 12 nt, Homo sapiens
uccaauguagcu

SEQ ID NO: 2186668 - RNA, 21 nt, Homo sapiens
acuaccuauccuuacauuuca

SEQ ID NO: 2186669 - RNA, 15 nt, Homo sapiens
gaacuguagggccag

SEQ ID NO: 2186670 - RNA, 19 nt, Homo sapiens
uguaugagcuucuaacuca

SEQ ID NO: 2186671 - RNA, 19 nt, Homo sapiens
caagaugacaugguccaug

SEQ ID NO: 2186672 - RNA, 20 nt, Homo sapiens
cgggagcucuguauggucag

SEQ ID NO: 2186673 - RNA, 13 nt, Homo sapiens
uaaccuauuucca

SEQ ID NO: 2186674 - RNA, 15 nt, Homo sapiens
uucuauuuauuuacu

SEQ ID NO: 2186675 - RNA, 14 nt, Homo sapiens
cuguuauugacagc

SEQ ID NO: 2186676 - RNA, 19 nt, Homo sapiens
accuuuuccucaccagucc

SEQ ID NO: 2186677 - RNA, 21 nt, Homo sapiens
uucaccuccauuaaccaagaa

SEQ ID NO: 2186678 - RNA, 20 nt, Homo sapiens
cacauuuagaaaagugaauu

SEQ ID NO: 2186679 - RNA, 22 nt, Homo sapiens
cccaucauuacugguaaagccu

SEQ ID NO: 2186680 - RNA, 21 nt, Homo sapiens
agauugauuaaugaacuauug

SEQ ID NO: 2186681 - RNA, 14 nt, Homo sapiens
aguaaaauuucagg

SEQ ID NO: 2186682 - RNA, 16 nt, Homo sapiens
gauguuagcagaccca

SEQ ID NO: 2186683 - RNA, 13 nt, Homo sapiens
augugccaaagcu

SEQ ID NO: 2186684 - RNA, 18 nt, Homo sapiens
uuuuaucuguuaaccaaa

SEQ ID NO: 2186685 - RNA, 21 nt, Homo sapiens
ugcuaugauguuaguuuuccu

SEQ ID NO: 2186686 - RNA, 20 nt, Homo sapiens
agccuccugacccugugaug

SEQ ID NO: 2186687 - RNA, 23 nt, Homo sapiens
ugucaccaaauuuguaccucuaa

SEQ ID NO: 2186688 - RNA, 19 nt, Homo sapiens
cuggugggaaaaugcacac

SEQ ID NO: 2186689 - RNA, 20 nt, Homo sapiens
ugccuuccucucucuaccag

SEQ ID NO: 2186690 - RNA, 19 nt, Homo sapiens
agugcuauaaaugccagag

SEQ ID NO: 2186691 - RNA, 16 nt, Homo sapiens
aacgccuuuuauucua

SEQ ID NO: 2186692 - RNA, 15 nt, Homo sapiens
caggaaacugggaau

SEQ ID NO: 2186693 - RNA, 21 nt, Homo sapiens
guaagacauuaguaacauaau

SEQ ID NO: 2186694 - RNA, 16 nt, Homo sapiens
auguaauaaagugaac

SEQ ID NO: 2186695 - RNA, 16 nt, Homo sapiens
aaauauuaauauguac

SEQ ID NO: 2186696 - RNA, 15 nt, Homo sapiens
caaaauaguucugca

SEQ ID NO: 2186697 - RNA, 19 nt, Homo sapiens
aucaauguauuaauaucuc

SEQ ID NO: 2186698 - RNA, 21 nt, Homo sapiens
guauauuucuaguauggcaca

SEQ ID NO: 2186699 - RNA, 11 nt, Homo sapiens
cccaagacagc

SEQ ID NO: 2186700 - RNA, 14 nt, Homo sapiens
ugaaaacaacauug

SEQ ID NO: 2186701 - RNA, 16 nt, Homo sapiens
aacauagagaucuaug

SEQ ID NO: 2186702 - RNA, 15 nt, Homo sapiens
cuuguuaucagcuuu

SEQ ID NO: 2186703 - RNA, 23 nt, Homo sapiens
aagugauagaaaaguguggcuug

SEQ ID NO: 2186704 - RNA, 23 nt, Homo sapiens
uucggcuccgggcaaauggcuga

SEQ ID NO: 2186705 - RNA, 17 nt, Homo sapiens
aguauuuuuuaaggcaa

SEQ ID NO: 2186706 - RNA, 19 nt, Homo sapiens
gagagcccacugcaguuag

SEQ ID NO: 2186707 - RNA, 12 nt, Homo sapiens
cccaaaucugca

SEQ ID NO: 2186708 - RNA, 16 nt, Homo sapiens
agcugcugaggacaau

SEQ ID NO: 2186709 - RNA, 16 nt, Homo sapiens
uuacauuuuggucucu

SEQ ID NO: 2186710 - RNA, 21 nt, Homo sapiens
agugacaaaguuauauauuua

SEQ ID NO: 2186711 - RNA, 12 nt, Homo sapiens
auacucauuccu

SEQ ID NO: 2186712 - RNA, 22 nt, Homo sapiens
uacaggagaagaaacagcagcu

SEQ ID NO: 2186713 - RNA, 17 nt, Homo sapiens
ugcagaaauacaguaug

SEQ ID NO: 2186714 - RNA, 16 nt, Homo sapiens
acuggaugucaaacag

SEQ ID NO: 2186715 - RNA, 19 nt, Homo sapiens
cauucuugcuugugugucu

SEQ ID NO: 2186716 - RNA, 11 nt, Homo sapiens
guguguuacaa

SEQ ID NO: 2186717 - RNA, 16 nt, Homo sapiens
gagccagggcuguccu

SEQ ID NO: 2186718 - RNA, 19 nt, Homo sapiens
guagacaagcguugagcca

SEQ ID NO: 2186719 - RNA, 13 nt, Homo sapiens
ugucagaguagaa

SEQ ID NO: 2186720 - RNA, 18 nt, Homo sapiens
ugcucauacuacauugag

SEQ ID NO: 2186721 - RNA, 18 nt, Homo sapiens
gagaggggagugcauuua

SEQ ID NO: 2186722 - RNA, 14 nt, Homo sapiens
aacucacugugauc

SEQ ID NO: 2186723 - RNA, 15 nt, Homo sapiens
cuggaaccauuggca

SEQ ID NO: 2186724 - RNA, 18 nt, Homo sapiens
guggaaaaaacauuuuaa

SEQ ID NO: 2186725 - RNA, 15 nt, Homo sapiens
gcccuccacaccucc

SEQ ID NO: 2186726 - RNA, 13 nt, Homo sapiens
gaaaucuaugaaa

SEQ ID NO: 2186727 - RNA, 14 nt, Homo sapiens
caaguuucagugaa

SEQ ID NO: 2186728 - RNA, 19 nt, Homo sapiens
aauagaaccaagaauucua

SEQ ID NO: 2186729 - RNA, 19 nt, Homo sapiens
ucuguuucaaacugaauuu

SEQ ID NO: 2186730 - RNA, 15 nt, Homo sapiens
acaaaggagccugug

SEQ ID NO: 2186731 - RNA, 17 nt, Homo sapiens
cugcucccaccaggaga

SEQ ID NO: 2186732 - RNA, 14 nt, Homo sapiens
cguuuuccaaagag

SEQ ID NO: 2186733 - RNA, 22 nt, Homo sapiens
accuccuuucaucacacugggu

SEQ ID NO: 2186734 - RNA, 15 nt, Homo sapiens
cuaggaagaaucagu

SEQ ID NO: 2186735 - RNA, 16 nt, Homo sapiens
cguguaaauugcacag

SEQ ID NO: 2186736 - RNA, 14 nt, Homo sapiens
ccacacuucugggc

SEQ ID NO: 2186737 - RNA, 17 nt, Homo sapiens
cccauguugcaugccua

SEQ ID NO: 2186738 - RNA, 20 nt, Homo sapiens
uuuauaccccuuuggcacac

SEQ ID NO: 2186739 - RNA, 20 nt, Homo sapiens
caagaguccugaagaucaag

SEQ ID NO: 2186740 - RNA, 18 nt, Homo sapiens
guucuuuucuccuuuacc

SEQ ID NO: 2186741 - RNA, 16 nt, Homo sapiens
guuuagcaacuuugau

SEQ ID NO: 2186742 - RNA, 21 nt, Homo sapiens
ugaaacacaauaccuacaaua

SEQ ID NO: 2186743 - RNA, 17 nt, Homo sapiens
uuguuguauugaucaau

SEQ ID NO: 2186744 - RNA, 20 nt, Homo sapiens
uacauauaauaaacuuuuca

SEQ ID NO: 2186745 - RNA, 14 nt, Homo sapiens
uaaaaagcuuccau

SEQ ID NO: 2186746 - RNA, 15 nt, Homo sapiens
ugguaaucaguugga

SEQ ID NO: 2186747 - RNA, 16 nt, Homo sapiens
gaggccaagccacuca

SEQ ID NO: 2186748 - RNA, 13 nt, Homo sapiens
cggugacuggccc

SEQ ID NO: 2186749 - RNA, 16 nt, Homo sapiens
gccuggaacucacuca

SEQ ID NO: 2186750 - RNA, 23 nt, Homo sapiens
ggggagccuucugugcugugagu

SEQ ID NO: 2186751 - RNA, 14 nt, Homo sapiens
cagauucagucuug

SEQ ID NO: 2186752 - RNA, 15 nt, Homo sapiens
ucuuaaaauguuaac

SEQ ID NO: 2186753 - RNA, 19 nt, Homo sapiens
agcugcuccuagagggagg

SEQ ID NO: 2186754 - RNA, 21 nt, Homo sapiens
uggcuaugagaagccugauga

SEQ ID NO: 2186755 - RNA, 16 nt, Homo sapiens
ccucaaguuccaugcu

SEQ ID NO: 2186756 - RNA, 16 nt, Homo sapiens
aggagaaucacugcag

SEQ ID NO: 2186757 - RNA, 20 nt, Homo sapiens
uguaaugugugguggccuca

SEQ ID NO: 2186758 - RNA, 19 nt, Homo sapiens
uuagaaaaaccaccaccau

SEQ ID NO: 2186759 - RNA, 17 nt, Homo sapiens
gaagagguuuuguugcu

SEQ ID NO: 2186760 - RNA, 18 nt, Homo sapiens
uuacuauauguugaccau

SEQ ID NO: 2186761 - RNA, 14 nt, Homo sapiens
guaaauacauaaaa

SEQ ID NO: 2186762 - RNA, 19 nt, Homo sapiens
uauuucaucagaacagcug

SEQ ID NO: 2186763 - RNA, 18 nt, Homo sapiens
auaggaggacagaaccaa

SEQ ID NO: 2186764 - RNA, 14 nt, Homo sapiens
ucagcacuguuuca

SEQ ID NO: 2186765 - RNA, 18 nt, Homo sapiens
aagagacauauacuaaga

SEQ ID NO: 2186766 - RNA, 14 nt, Homo sapiens
acuaugaucucagg

SEQ ID NO: 2186767 - RNA, 16 nt, Homo sapiens
cugguuggcagcaucu

SEQ ID NO: 2186768 - RNA, 20 nt, Homo sapiens
accccagugggaacugugca

SEQ ID NO: 2186769 - RNA, 23 nt, Homo sapiens
caaugcuauaacuauguugauaa

SEQ ID NO: 2186770 - RNA, 22 nt, Homo sapiens
ccugccuuuuaacguagauaua

SEQ ID NO: 2186771 - RNA, 23 nt, Homo sapiens
agcacuugauucuucccgagaua

SEQ ID NO: 2186772 - RNA, 20 nt, Homo sapiens
cccacacugaaaccaaaaca

SEQ ID NO: 2186773 - RNA, 17 nt, Homo sapiens
cugcagucucuauacca

SEQ ID NO: 2186774 - RNA, 22 nt, Homo sapiens
aagcacauaacuggauuuugaa

SEQ ID NO: 2186775 - RNA, 13 nt, Homo sapiens
auuucagaccagu

SEQ ID NO: 2186776 - RNA, 15 nt, Homo sapiens
cuuguagcuguaaaa

SEQ ID NO: 2186777 - RNA, 14 nt, Homo sapiens
uaccuccucucagu

SEQ ID NO: 2186778 - RNA, 23 nt, Homo sapiens
aaagucuuugaagugacuucaca

SEQ ID NO: 2186779 - RNA, 17 nt, Homo sapiens
uacccaguuacuuauga

SEQ ID NO: 2186780 - RNA, 21 nt, Homo sapiens
auuucuaauuauguagcucuu

SEQ ID NO: 2186781 - RNA, 13 nt, Homo sapiens
ccaccgcacucca

SEQ ID NO: 2186782 - RNA, 21 nt, Homo sapiens
aguagcaacccugugauacua

SEQ ID NO: 2186783 - RNA, 14 nt, Homo sapiens
cuucuuuauugcac

SEQ ID NO: 2186784 - RNA, 14 nt, Homo sapiens
uaguucuacauuau

SEQ ID NO: 2186785 - RNA, 10 nt, Homo sapiens
auguucaagc

SEQ ID NO: 2186786 - RNA, 14 nt, Homo sapiens
uggccagcaaaaac

SEQ ID NO: 2186787 - RNA, 19 nt, Homo sapiens
ugcccagugagacuguguu

SEQ ID NO: 2186788 - RNA, 15 nt, Homo sapiens
ugagacucacaggaa

SEQ ID NO: 2186789 - RNA, 23 nt, Homo sapiens
ccccucguuagccuuccucugau

SEQ ID NO: 2186790 - RNA, 17 nt, Homo sapiens
aaggccuuaauggacau

SEQ ID NO: 2186791 - RNA, 17 nt, Homo sapiens
aagcuuuauauaccucu

SEQ ID NO: 2186792 - RNA, 23 nt, Homo sapiens
gaccucauaaaaggacucucagc

SEQ ID NO: 2186793 - RNA, 10 nt, Homo sapiens
accucuggaa

SEQ ID NO: 2186794 - RNA, 23 nt, Homo sapiens
cagcuccgccucugccagguguc

SEQ ID NO: 2186795 - RNA, 22 nt, Homo sapiens
augagcgaaauugucuuuacua

SEQ ID NO: 2186796 - RNA, 11 nt, Homo sapiens
uucuuuccacc

SEQ ID NO: 2186797 - RNA, 11 nt, Homo sapiens
uuauuuccaca

SEQ ID NO: 2186798 - RNA, 19 nt, Homo sapiens
aaaauaaaagaucuugaau

SEQ ID NO: 2186799 - RNA, 22 nt, Homo sapiens
accguccucaccccuguccuca

SEQ ID NO: 2186800 - RNA, 10 nt, Homo sapiens
agguggcacu

SEQ ID NO: 2186801 - RNA, 22 nt, Homo sapiens
agauucaccuccauuaaccaag

SEQ ID NO: 2186802 - RNA, 23 nt, Homo sapiens
cugcaaaaaugaaauccagugag

SEQ ID NO: 2186803 - RNA, 16 nt, Homo sapiens
auggaauaaagcccuu

SEQ ID NO: 2186804 - RNA, 22 nt, Homo sapiens
ggaaauucggagcuauacauau

SEQ ID NO: 2186805 - RNA, 17 nt, Homo sapiens
guauaguuagcuuuauu

SEQ ID NO: 2186806 - RNA, 22 nt, Homo sapiens
cccuagcaguuugccucugcac

SEQ ID NO: 2186807 - RNA, 21 nt, Homo sapiens
aggaccccagcuuuucuugcc

SEQ ID NO: 2186808 - RNA, 20 nt, Homo sapiens
aauucugcaacuagccaagg

SEQ ID NO: 2186809 - RNA, 17 nt, Homo sapiens
gaggugaaagcuauauc

SEQ ID NO: 2186810 - RNA, 13 nt, Homo sapiens
ucucuuugcccag

SEQ ID NO: 2186811 - RNA, 23 nt, Homo sapiens
caaagcucuuuugagcauuuaga

SEQ ID NO: 2186812 - RNA, 14 nt, Homo sapiens
cagguacuccugcc

SEQ ID NO: 2186813 - RNA, 16 nt, Homo sapiens
aucacugccaucacau

SEQ ID NO: 2186814 - RNA, 20 nt, Homo sapiens
cuuguucuauuuuucaauca

SEQ ID NO: 2186815 - RNA, 16 nt, Homo sapiens
ugaaccgucaauguga

SEQ ID NO: 2186816 - RNA, 22 nt, Homo sapiens
uuguauauuuguaaacuacaaa

SEQ ID NO: 2186817 - RNA, 14 nt, Homo sapiens
uuuccucuacccua

SEQ ID NO: 2186818 - RNA, 19 nt, Homo sapiens
uaaacuggcaucugcucua

SEQ ID NO: 2186819 - RNA, 15 nt, Homo sapiens
agccacaggcauuuc

SEQ ID NO: 2186820 - RNA, 17 nt, Homo sapiens
ucuagcacacucuucuc

SEQ ID NO: 2186821 - RNA, 21 nt, Homo sapiens
uuaaauuuuaauucuucagaa

SEQ ID NO: 2186822 - RNA, 18 nt, Homo sapiens
gcagagccugcaggguga

SEQ ID NO: 2186823 - RNA, 13 nt, Homo sapiens
auaaagacuucau

SEQ ID NO: 2186824 - RNA, 15 nt, Homo sapiens
ggccaggccagggga

SEQ ID NO: 2186825 - RNA, 15 nt, Homo sapiens
caggugccagucuuc

SEQ ID NO: 2186826 - RNA, 18 nt, Homo sapiens
auuggcuugauaaacaua

SEQ ID NO: 2186827 - RNA, 21 nt, Homo sapiens
uggcaaaaguaggcaucuaaa

SEQ ID NO: 2186828 - RNA, 17 nt, Homo sapiens
cacgagagagucuucca

SEQ ID NO: 2186829 - RNA, 13 nt, Homo sapiens
ucaagccauucca

SEQ ID NO: 2186830 - RNA, 19 nt, Homo sapiens
cccagcaguucucugccaa

SEQ ID NO: 2186831 - RNA, 19 nt, Homo sapiens
cugcacuccagccuggcaa

SEQ ID NO: 2186832 - RNA, 16 nt, Homo sapiens
ugcccuuccucagggc

SEQ ID NO: 2186833 - RNA, 11 nt, Homo sapiens
ggcuacuugag

SEQ ID NO: 2186834 - RNA, 22 nt, Homo sapiens
agcacaagcaggugaacuggga

SEQ ID NO: 2186835 - RNA, 19 nt, Homo sapiens
ggagguugagaaugcagug

SEQ ID NO: 2186836 - RNA, 21 nt, Homo sapiens
uauuaaaaucacugucaauau

SEQ ID NO: 2186837 - RNA, 17 nt, Homo sapiens
aucugcuggauauuuag

SEQ ID NO: 2186838 - RNA, 17 nt, Homo sapiens
guauagauguugcuaac

SEQ ID NO: 2186839 - RNA, 16 nt, Homo sapiens
ucccccugcaaaaaga

SEQ ID NO: 2186840 - RNA, 15 nt, Homo sapiens
uggauaaaaucugau

SEQ ID NO: 2186841 - RNA, 14 nt, Homo sapiens
gcaauaaauaccag

SEQ ID NO: 2186842 - RNA, 17 nt, Homo sapiens
acauggagcugucauca

SEQ ID NO: 2186843 - RNA, 14 nt, Homo sapiens
caaaggguuaggac

SEQ ID NO: 2186844 - RNA, 16 nt, Homo sapiens
aaggcuuccaaugugg

SEQ ID NO: 2186845 - RNA, 15 nt, Homo sapiens
gucauaccauccauc

SEQ ID NO: 2186846 - RNA, 15 nt, Homo sapiens
cucuucuacccuuuu

SEQ ID NO: 2186847 - RNA, 15 nt, Homo sapiens
auuuuuuaacuuucu

SEQ ID NO: 2186848 - RNA, 17 nt, Homo sapiens
gacugagagaugcagaa

SEQ ID NO: 2186849 - RNA, 18 nt, Homo sapiens
gaugacgacgacaacgau

SEQ ID NO: 2186850 - RNA, 15 nt, Homo sapiens
caguaucaugcgaug

SEQ ID NO: 2186851 - RNA, 12 nt, Homo sapiens
uguggcuucuag

SEQ ID NO: 2186852 - RNA, 16 nt, Homo sapiens
ucaauauaccaugaca

SEQ ID NO: 2186853 - RNA, 16 nt, Homo sapiens
caaaagccuuguguau

SEQ ID NO: 2186854 - RNA, 18 nt, Homo sapiens
uauugccuggagugugaa

SEQ ID NO: 2186855 - RNA, 14 nt, Homo sapiens
ugacauuacuguau

SEQ ID NO: 2186856 - RNA, 19 nt, Homo sapiens
aucuuacagucagcacaga

SEQ ID NO: 2186857 - RNA, 15 nt, Homo sapiens
uggaguggagcauug

SEQ ID NO: 2186858 - RNA, 20 nt, Homo sapiens
uuuuaucuucuuagcucauc

SEQ ID NO: 2186859 - RNA, 14 nt, Homo sapiens
caugagaagucacu

SEQ ID NO: 2186860 - RNA, 14 nt, Homo sapiens
cuucuaaauggcau

SEQ ID NO: 2186861 - RNA, 21 nt, Homo sapiens
accaucuggaaggacaucuac

SEQ ID NO: 2186862 - RNA, 23 nt, Homo sapiens
uacccuccaagucuguaccucaa

SEQ ID NO: 2186863 - RNA, 14 nt, Homo sapiens
aacauaauuaagcu

SEQ ID NO: 2186864 - RNA, 14 nt, Homo sapiens
uaagcuauaacaua

SEQ ID NO: 2186865 - RNA, 18 nt, Homo sapiens
auagauaccauuuugaaa

SEQ ID NO: 2186866 - RNA, 22 nt, Homo sapiens
ugucacugcuguaaagcaaaau

SEQ ID NO: 2186867 - RNA, 15 nt, Homo sapiens
cuuaagagaauccac

SEQ ID NO: 2186868 - RNA, 19 nt, Homo sapiens
caguuuuauaaaaagugga

SEQ ID NO: 2186869 - RNA, 17 nt, Homo sapiens
ggagacaaaacuagaga

SEQ ID NO: 2186870 - RNA, 23 nt, Homo sapiens
ucuuauaguguuuggacagcuga

SEQ ID NO: 2186871 - RNA, 16 nt, Homo sapiens
uugaaaugaaagggaa

SEQ ID NO: 2186872 - RNA, 14 nt, Homo sapiens
ggagcugcucagaa

SEQ ID NO: 2186873 - RNA, 19 nt, Homo sapiens
aaaccuaccacauucacua

SEQ ID NO: 2186874 - RNA, 14 nt, Homo sapiens
aauaaauaaucauc

SEQ ID NO: 2186875 - RNA, 12 nt, Homo sapiens
gugggcacuggu

SEQ ID NO: 2186876 - RNA, 22 nt, Homo sapiens
ucucaucccaacaaacuuuaau

SEQ ID NO: 2186877 - RNA, 15 nt, Homo sapiens
ugagaggaucaucug

SEQ ID NO: 2186878 - RNA, 21 nt, Homo sapiens
auaaaucauuaagacaacuga

SEQ ID NO: 2186879 - RNA, 18 nt, Homo sapiens
cuuccguucauugcucuc

SEQ ID NO: 2186880 - RNA, 19 nt, Homo sapiens
auuagcuuugggugccuuu

SEQ ID NO: 2186881 - RNA, 18 nt, Homo sapiens
ggauaaacauuccagaga

SEQ ID NO: 2186882 - RNA, 15 nt, Homo sapiens
uucaaauaaacugaa

SEQ ID NO: 2186883 - RNA, 13 nt, Homo sapiens
gaaaguccagcua

SEQ ID NO: 2186884 - RNA, 13 nt, Homo sapiens
cuucuuugcccac

SEQ ID NO: 2186885 - RNA, 14 nt, Homo sapiens
ucuuuucacauucu

SEQ ID NO: 2186886 - RNA, 15 nt, Homo sapiens
aguuggugacuggga

SEQ ID NO: 2186887 - RNA, 14 nt, Homo sapiens
uucuacccaggugc

SEQ ID NO: 2186888 - RNA, 21 nt, Homo sapiens
ccggacgggggagcuuuccca

SEQ ID NO: 2186889 - RNA, 21 nt, Homo sapiens
ccgcgcuguguaaaugcucca

SEQ ID NO: 2186890 - RNA, 19 nt, Homo sapiens
cacagacuucuggccuagg

SEQ ID NO: 2186891 - RNA, 22 nt, Homo sapiens
uuuggcauuccccacuugagaa

SEQ ID NO: 2186892 - RNA, 16 nt, Homo sapiens
gcugugcaucaguggg

SEQ ID NO: 2186893 - RNA, 17 nt, Homo sapiens
ugcugcauggcacugac

SEQ ID NO: 2186894 - RNA, 13 nt, Homo sapiens
uagccauuugccc

SEQ ID NO: 2186895 - RNA, 14 nt, Homo sapiens
accucauuugcauc

SEQ ID NO: 2186896 - RNA, 13 nt, Homo sapiens
aaucauaaaggau

SEQ ID NO: 2186897 - RNA, 15 nt, Homo sapiens
uuguggacuugucug

SEQ ID NO: 2186898 - RNA, 21 nt, Homo sapiens
ugcggacacuuuugaggacaa

SEQ ID NO: 2186899 - RNA, 14 nt, Homo sapiens
ccagcucauucuca

SEQ ID NO: 2186900 - RNA, 12 nt, Homo sapiens
gcggccacagca

SEQ ID NO: 2186901 - RNA, 15 nt, Homo sapiens
cacugaggaacucac

SEQ ID NO: 2186902 - RNA, 18 nt, Homo sapiens
cagcuauuuucugaccaa

SEQ ID NO: 2186903 - RNA, 22 nt, Homo sapiens
gaaaggcagagggugacugugu

SEQ ID NO: 2186904 - RNA, 16 nt, Homo sapiens
caaugaaaugauguca

SEQ ID NO: 2186905 - RNA, 16 nt, Homo sapiens
caaaugcuauugucag

SEQ ID NO: 2186906 - RNA, 13 nt, Homo sapiens
aggugacagagug

SEQ ID NO: 2186907 - RNA, 13 nt, Homo sapiens
agguuacagaguu

SEQ ID NO: 2186908 - RNA, 23 nt, Homo sapiens
uaugaaccuauuuucauuuguac

SEQ ID NO: 2186909 - RNA, 12 nt, Homo sapiens
cuccacuuguau

SEQ ID NO: 2186910 - RNA, 23 nt, Homo sapiens
cuuuggggagcaggaggccaaua

SEQ ID NO: 2186911 - RNA, 16 nt, Homo sapiens
auuuguauaugacugc

SEQ ID NO: 2186912 - RNA, 14 nt, Homo sapiens
agcucauaaagaau

SEQ ID NO: 2186913 - RNA, 23 nt, Homo sapiens
uaugcugucuuaauucuuuucac

SEQ ID NO: 2186914 - RNA, 21 nt, Homo sapiens
auaguaguuaggauaacuaaa

SEQ ID NO: 2186915 - RNA, 18 nt, Homo sapiens
accagcggaaacaggugu

SEQ ID NO: 2186916 - RNA, 20 nt, Homo sapiens
cuguugauuucuuuccagag

SEQ ID NO: 2186917 - RNA, 16 nt, Homo sapiens
cucucuaaacccaaau

SEQ ID NO: 2186918 - RNA, 16 nt, Homo sapiens
aaauguauaccuguaa

SEQ ID NO: 2186919 - RNA, 22 nt, Homo sapiens
ggccggaguaggagcacugggg

SEQ ID NO: 2186920 - RNA, 16 nt, Homo sapiens
cugaguuuugaugcug

SEQ ID NO: 2186921 - RNA, 13 nt, Homo sapiens
uugacaggccauc

SEQ ID NO: 2186922 - RNA, 14 nt, Homo sapiens
caagaucugccaga

SEQ ID NO: 2186923 - RNA, 16 nt, Homo sapiens
acgagggguggugcua

SEQ ID NO: 2186924 - RNA, 20 nt, Homo sapiens
uuauguuuucaacucaggaa

SEQ ID NO: 2186925 - RNA, 15 nt, Homo sapiens
guccuccucugugaa

SEQ ID NO: 2186926 - RNA, 15 nt, Homo sapiens
cagacucugucucaa

SEQ ID NO: 2186927 - RNA, 23 nt, Homo sapiens
ugcuucuuauccuuacacucccc

SEQ ID NO: 2186928 - RNA, 17 nt, Homo sapiens
cuaaaagugaugugauu

SEQ ID NO: 2186929 - RNA, 13 nt, Homo sapiens
aauagaugcaggc

SEQ ID NO: 2186930 - RNA, 16 nt, Homo sapiens
ugcugggccaguggca

SEQ ID NO: 2186931 - RNA, 21 nt, Homo sapiens
uggggugcugccugaauccau

SEQ ID NO: 2186932 - RNA, 18 nt, Homo sapiens
ugccuugcuaaaagauua

SEQ ID NO: 2186933 - RNA, 16 nt, Homo sapiens
gcucugcugacagaca

SEQ ID NO: 2186934 - RNA, 12 nt, Homo sapiens
aggcagcuccaa

SEQ ID NO: 2186935 - RNA, 23 nt, Homo sapiens
agagaacacagugcuauuugcau

SEQ ID NO: 2186936 - RNA, 15 nt, Homo sapiens
ggucacuggaacuca

SEQ ID NO: 2186937 - RNA, 15 nt, Homo sapiens
aaagagagagugugu

SEQ ID NO: 2186938 - RNA, 14 nt, Homo sapiens
cuauuuuugaggaa

SEQ ID NO: 2186939 - RNA, 16 nt, Homo sapiens
agcaguggcagaggua

SEQ ID NO: 2186940 - RNA, 19 nt, Homo sapiens
ccccuccuugccgcuggga

SEQ ID NO: 2186941 - RNA, 19 nt, Homo sapiens
uaggccagggcauguguau

SEQ ID NO: 2186942 - RNA, 14 nt, Homo sapiens
guaccgucuucucc

SEQ ID NO: 2186943 - RNA, 23 nt, Homo sapiens
acagcauuacacgccacaacucc

SEQ ID NO: 2186944 - RNA, 24 nt, Homo sapiens
cuggaugauacgaaugaugucaga

SEQ ID NO: 2186945 - RNA, 18 nt, Homo sapiens
uccuuggggagcacuugu

SEQ ID NO: 2186946 - RNA, 23 nt, Homo sapiens
gcaauuucacgacacacuuugau

SEQ ID NO: 2186947 - RNA, 19 nt, Homo sapiens
guucugcugagacugagca

SEQ ID NO: 2186948 - RNA, 23 nt, Homo sapiens
acuggaagguggggacagggaug

SEQ ID NO: 2186949 - RNA, 21 nt, Homo sapiens
uagcuguauuuuuuguaugcu

SEQ ID NO: 2186950 - RNA, 13 nt, Homo sapiens
ugagaaaggugag

SEQ ID NO: 2186951 - RNA, 14 nt, Homo sapiens
agcauuauugccaa

SEQ ID NO: 2186952 - RNA, 17 nt, Homo sapiens
augcucccagcugugcu

SEQ ID NO: 2186953 - RNA, 19 nt, Homo sapiens
uauaaucaaaaucaaugca

SEQ ID NO: 2186954 - RNA, 14 nt, Homo sapiens
uggagucaccaaaa

SEQ ID NO: 2186955 - RNA, 18 nt, Homo sapiens
caagugaauuugccugua

SEQ ID NO: 2186956 - RNA, 18 nt, Homo sapiens
ucagcuccgcaagcauca

SEQ ID NO: 2186957 - RNA, 13 nt, Homo sapiens
aaaagauguagau

SEQ ID NO: 2186958 - RNA, 13 nt, Homo sapiens
uaaggaugaaggu

SEQ ID NO: 2186959 - RNA, 21 nt, Homo sapiens
cagcaugauucuuccaaggaa

SEQ ID NO: 2186960 - RNA, 16 nt, Homo sapiens
cuccaacugcaggaaa

SEQ ID NO: 2186961 - RNA, 11 nt, Homo sapiens
accacugcacu

SEQ ID NO: 2186962 - RNA, 11 nt, Homo sapiens
ugcacugcugu

SEQ ID NO: 2186963 - RNA, 22 nt, Homo sapiens
aaacuuuccugacuuacaauac

SEQ ID NO: 2186964 - RNA, 19 nt, Homo sapiens
gaggaggggagugcucuga

SEQ ID NO: 2186965 - RNA, 16 nt, Homo sapiens
auauucccacucagca

SEQ ID NO: 2186966 - RNA, 21 nt, Homo sapiens
ugagcccagccuacuuuucag

SEQ ID NO: 2186967 - RNA, 16 nt, Homo sapiens
caucagccugcuucuu

SEQ ID NO: 2186968 - RNA, 21 nt, Homo sapiens
ucuugaaaaaugcauguugcc

SEQ ID NO: 2186969 - RNA, 20 nt, Homo sapiens
aagccagcacucacaccacu

SEQ ID NO: 2186970 - RNA, 14 nt, Homo sapiens
cucuaacauccuug

SEQ ID NO: 2186971 - RNA, 17 nt, Homo sapiens
caacuuagaaaccaaau

SEQ ID NO: 2186972 - RNA, 19 nt, Homo sapiens
agcaggggggcugugccaa

SEQ ID NO: 2186973 - RNA, 22 nt, Homo sapiens
cuguuuuaauaauuaugugcca

SEQ ID NO: 2186974 - RNA, 14 nt, Homo sapiens
cauuuaaauuccac

SEQ ID NO: 2186975 - RNA, 13 nt, Homo sapiens
guuaccacuacuu

SEQ ID NO: 2186976 - RNA, 14 nt, Homo sapiens
uuaauuagauuucu

SEQ ID NO: 2186977 - RNA, 15 nt, Homo sapiens
cccuucuugccauua

SEQ ID NO: 2186978 - RNA, 17 nt, Homo sapiens
ugcuuggcuggagucac

SEQ ID NO: 2186979 - RNA, 18 nt, Homo sapiens
uugugcuugcugguacua

SEQ ID NO: 2186980 - RNA, 20 nt, Homo sapiens
ucuaccuucaacaugugcuc

SEQ ID NO: 2186981 - RNA, 15 nt, Homo sapiens
ugugcuggacuuuaa

SEQ ID NO: 2186982 - RNA, 11 nt, Homo sapiens
ccauucuugga

SEQ ID NO: 2186983 - RNA, 15 nt, Homo sapiens
ccgacaaaauuccag

SEQ ID NO: 2186984 - RNA, 14 nt, Homo sapiens
gagauugcacugcu

SEQ ID NO: 2186985 - RNA, 17 nt, Homo sapiens
gaaagccaggguccuga

SEQ ID NO: 2186986 - RNA, 15 nt, Homo sapiens
ugcaugugacucuga

SEQ ID NO: 2186987 - RNA, 16 nt, Homo sapiens
augauccuugcacaga

SEQ ID NO: 2186988 - RNA, 19 nt, Homo sapiens
uacacacccauagugcaca

SEQ ID NO: 2186989 - RNA, 20 nt, Homo sapiens
uuaguuauuucugccuauaa

SEQ ID NO: 2186990 - RNA, 14 nt, Homo sapiens
ucuccuuacucauu

SEQ ID NO: 2186991 - RNA, 18 nt, Homo sapiens
gaagucuucuaacucugu

SEQ ID NO: 2186992 - RNA, 20 nt, Homo sapiens
cccacuggaggcaugugaug

SEQ ID NO: 2186993 - RNA, 14 nt, Homo sapiens
cugacuuccugaac

SEQ ID NO: 2186994 - RNA, 14 nt, Homo sapiens
ugagcuucugagac

SEQ ID NO: 2186995 - RNA, 20 nt, Homo sapiens
uaaagcccaaccuccugacc

SEQ ID NO: 2186996 - RNA, 19 nt, Homo sapiens
auaaccacccuagcuuuau

SEQ ID NO: 2186997 - RNA, 17 nt, Homo sapiens
agggcuggucauucaca

SEQ ID NO: 2186998 - RNA, 17 nt, Homo sapiens
gccccuucauggaagaa

SEQ ID NO: 2186999 - RNA, 19 nt, Homo sapiens
ggauuccaaaccaggacac

SEQ ID NO: 2187000 - RNA, 21 nt, Homo sapiens
gcugcuuuguccaggugagaa

SEQ ID NO: 2187001 - RNA, 14 nt, Homo sapiens
gaaggugcugccac

SEQ ID NO: 2187002 - RNA, 22 nt, Homo sapiens
uuacugguauuaauaaacacau

SEQ ID NO: 2187003 - RNA, 16 nt, Homo sapiens
cuuucccaucuuccaa

SEQ ID NO: 2187004 - RNA, 14 nt, Homo sapiens
cgccguacaguucu

SEQ ID NO: 2187005 - RNA, 21 nt, Homo sapiens
uucugcugaaggacagaacau

SEQ ID NO: 2187006 - RNA, 14 nt, Homo sapiens
gggccauacuggcc

SEQ ID NO: 2187007 - RNA, 12 nt, Homo sapiens
agcggugucucu

SEQ ID NO: 2187008 - RNA, 18 nt, Homo sapiens
cuuccuucaggacucugc

SEQ ID NO: 2187009 - RNA, 15 nt, Homo sapiens
gacagccacagccac

SEQ ID NO: 2187010 - RNA, 20 nt, Homo sapiens
gcuucuccuucuccuuccca

SEQ ID NO: 2187011 - RNA, 18 nt, Homo sapiens
agaaaugacagucaaaag

SEQ ID NO: 2187012 - RNA, 19 nt, Homo sapiens
aaauauguuuggaauauuc

SEQ ID NO: 2187013 - RNA, 19 nt, Homo sapiens
gaaacaagucagucauuca

SEQ ID NO: 2187014 - RNA, 13 nt, Homo sapiens
gaugguggcacag

SEQ ID NO: 2187015 - RNA, 19 nt, Homo sapiens
ugaaucacuuaaaugucac

SEQ ID NO: 2187016 - RNA, 21 nt, Homo sapiens
agacucugauucuacagugau

SEQ ID NO: 2187017 - RNA, 18 nt, Homo sapiens
uuccucucucucuuccuc

SEQ ID NO: 2187018 - RNA, 20 nt, Homo sapiens
uuaaacuacaaacacaagca

SEQ ID NO: 2187019 - RNA, 11 nt, Homo sapiens
caguucaugca

SEQ ID NO: 2187020 - RNA, 22 nt, Homo sapiens
aaugagucugcauaaacuucau

SEQ ID NO: 2187021 - RNA, 14 nt, Homo sapiens
caaguauuuugcca

SEQ ID NO: 2187022 - RNA, 18 nt, Homo sapiens
cuugcagugaaguguucu

SEQ ID NO: 2187023 - RNA, 21 nt, Homo sapiens
uccugggcauggguccagggc

SEQ ID NO: 2187024 - RNA, 21 nt, Homo sapiens
caagaaccugcuaaggcugcc

SEQ ID NO: 2187025 - RNA, 17 nt, Homo sapiens
auuugugggcaagcaga

SEQ ID NO: 2187026 - RNA, 17 nt, Homo sapiens
aagacagaaguuugcac

SEQ ID NO: 2187027 - RNA, 17 nt, Homo sapiens
uugcuuucagaugcagu

SEQ ID NO: 2187028 - RNA, 19 nt, Homo sapiens
caaacuacaauuaaaacua

SEQ ID NO: 2187029 - RNA, 18 nt, Homo sapiens
caucaagaucgugcuggc

SEQ ID NO: 2187030 - RNA, 23 nt, Homo sapiens
gagaaauuccuuagucauggugu

SEQ ID NO: 2187031 - RNA, 14 nt, Homo sapiens
gauaacagccucuu

SEQ ID NO: 2187032 - RNA, 17 nt, Homo sapiens
uguagauauugugaagu

SEQ ID NO: 2187033 - RNA, 18 nt, Homo sapiens
ucguucaaaacauuccaa

SEQ ID NO: 2187034 - RNA, 15 nt, Homo sapiens
ccagagaguggcucc

SEQ ID NO: 2187035 - RNA, 22 nt, Homo sapiens
ccuuuugcacauaacaugcuuu

SEQ ID NO: 2187036 - RNA, 16 nt, Homo sapiens
agccacaaacuccauc

SEQ ID NO: 2187037 - RNA, 17 nt, Homo sapiens
uucuaaaggcuugauau

SEQ ID NO: 2187038 - RNA, 16 nt, Homo sapiens
ugcuuuuuuucaggga

SEQ ID NO: 2187039 - RNA, 14 nt, Homo sapiens
aagagggaccucca

SEQ ID NO: 2187040 - RNA, 21 nt, Homo sapiens
cauaaguuuacugaaucuuca

SEQ ID NO: 2187041 - RNA, 13 nt, Homo sapiens
cagcaucccuuga

SEQ ID NO: 2187042 - RNA, 20 nt, Homo sapiens
aaauauuuugucacugcugu

SEQ ID NO: 2187043 - RNA, 14 nt, Homo sapiens
agucgagaccucac

SEQ ID NO: 2187044 - RNA, 21 nt, Homo sapiens
guaguuuuuacagcuguguua

SEQ ID NO: 2187045 - RNA, 16 nt, Homo sapiens
agccuggccaacaugg

SEQ ID NO: 2187046 - RNA, 18 nt, Homo sapiens
aucauggcaucauugcau

SEQ ID NO: 2187047 - RNA, 14 nt, Homo sapiens
acaauuucaauaaa

SEQ ID NO: 2187048 - RNA, 18 nt, Homo sapiens
accccgagggcugaggag

SEQ ID NO: 2187049 - RNA, 17 nt, Homo sapiens
aguuggcuaggggagca

SEQ ID NO: 2187050 - RNA, 13 nt, Homo sapiens
cagcugcauggca

SEQ ID NO: 2187051 - RNA, 13 nt, Homo sapiens
cugaaaaucacua

SEQ ID NO: 2187052 - RNA, 16 nt, Homo sapiens
uggcaauuuagcaaac

SEQ ID NO: 2187053 - RNA, 18 nt, Homo sapiens
uuuucacuucuaccuaca

SEQ ID NO: 2187054 - RNA, 15 nt, Homo sapiens
ccuccccagauauca

SEQ ID NO: 2187055 - RNA, 19 nt, Homo sapiens
cuuaacacuaccaauuucc

SEQ ID NO: 2187056 - RNA, 14 nt, Homo sapiens
cugcccagugcaaa

SEQ ID NO: 2187057 - RNA, 13 nt, Homo sapiens
ucaggaugagaug

SEQ ID NO: 2187058 - RNA, 18 nt, Homo sapiens
cuuauucuuugaguaaug

SEQ ID NO: 2187059 - RNA, 11 nt, Homo sapiens
ccuucucucuc

SEQ ID NO: 2187060 - RNA, 21 nt, Homo sapiens
cagacccaacucgccugugga

SEQ ID NO: 2187061 - RNA, 20 nt, Homo sapiens
gacucuuagccccagacucu

SEQ ID NO: 2187062 - RNA, 20 nt, Homo sapiens
uucccaaucagcacugaaaa

SEQ ID NO: 2187063 - RNA, 16 nt, Homo sapiens
gccugauccagccucu

SEQ ID NO: 2187064 - RNA, 16 nt, Homo sapiens
gauaaaccugcuccaa

SEQ ID NO: 2187065 - RNA, 14 nt, Homo sapiens
uccucuaugugguu

SEQ ID NO: 2187066 - RNA, 15 nt, Homo sapiens
ugacuaccgugccag

SEQ ID NO: 2187067 - RNA, 21 nt, Homo sapiens
aaauuuugaguucuacauaag

SEQ ID NO: 2187068 - RNA, 14 nt, Homo sapiens
ucccuuguccuuga

SEQ ID NO: 2187069 - RNA, 18 nt, Homo sapiens
auucacugcuuaugcagu

SEQ ID NO: 2187070 - RNA, 13 nt, Homo sapiens
uuacguacuguaa

SEQ ID NO: 2187071 - RNA, 22 nt, Homo sapiens
uuucuuuaauaguuuugauccu

SEQ ID NO: 2187072 - RNA, 15 nt, Homo sapiens
acugauucucucuug

SEQ ID NO: 2187073 - RNA, 21 nt, Homo sapiens
caaauccccaagaacacaaga

SEQ ID NO: 2187074 - RNA, 23 nt, Homo sapiens
uauaauuucaaaccacacauuag

SEQ ID NO: 2187075 - RNA, 10 nt, Homo sapiens
uucucaaaaa

SEQ ID NO: 2187076 - RNA, 12 nt, Homo sapiens
cauggacagugu

SEQ ID NO: 2187077 - RNA, 17 nt, Homo sapiens
acucuguccaggccacu

SEQ ID NO: 2187078 - RNA, 15 nt, Homo sapiens
gacugucacuugcug

SEQ ID NO: 2187079 - RNA, 16 nt, Homo sapiens
uugggaggccauuugu

SEQ ID NO: 2187080 - RNA, 18 nt, Homo sapiens
gcauucuagauuacuuuu

SEQ ID NO: 2187081 - RNA, 17 nt, Homo sapiens
cauacauaggauggcug

SEQ ID NO: 2187082 - RNA, 21 nt, Homo sapiens
gcuauuacagugccacugcaa

SEQ ID NO: 2187083 - RNA, 20 nt, Homo sapiens
aauauuuuacauacacugua

SEQ ID NO: 2187084 - RNA, 20 nt, Homo sapiens
aguggaagaagaaaacacua

SEQ ID NO: 2187085 - RNA, 13 nt, Homo sapiens
aauaaaggaugau

SEQ ID NO: 2187086 - RNA, 13 nt, Homo sapiens
aaucaaggaugcu

SEQ ID NO: 2187087 - RNA, 11 nt, Homo sapiens
ggcuaacggga

SEQ ID NO: 2187088 - RNA, 15 nt, Homo sapiens
gauucagaaccaaga

SEQ ID NO: 2187089 - RNA, 21 nt, Homo sapiens
uuugcaauagucuuauuaaaa

SEQ ID NO: 2187090 - RNA, 16 nt, Homo sapiens
uaccacugcacccagc

SEQ ID NO: 2187091 - RNA, 12 nt, Homo sapiens
aggccugagauu

SEQ ID NO: 2187092 - RNA, 21 nt, Homo sapiens
ucccucugcagucucuauacc

SEQ ID NO: 2187093 - RNA, 13 nt, Homo sapiens
cacagcauggccu

SEQ ID NO: 2187094 - RNA, 17 nt, Homo sapiens
cccagaacaugaagaag

SEQ ID NO: 2187095 - RNA, 23 nt, Homo sapiens
ugcacaugugagcaugucacuuc

SEQ ID NO: 2187096 - RNA, 13 nt, Homo sapiens
ucacuucucuuaa

SEQ ID NO: 2187097 - RNA, 17 nt, Homo sapiens
gggauagaggggcugca

SEQ ID NO: 2187098 - RNA, 15 nt, Homo sapiens
cuuuguucugugauu

SEQ ID NO: 2187099 - RNA, 15 nt, Homo sapiens
cuuuggccugugagc

SEQ ID NO: 2187100 - RNA, 18 nt, Homo sapiens
cucuaugauaauuacaau

SEQ ID NO: 2187101 - RNA, 16 nt, Homo sapiens
auccaggcacccaaac

SEQ ID NO: 2187102 - RNA, 21 nt, Homo sapiens
guuuuaguaugugucaaacau

SEQ ID NO: 2187103 - RNA, 20 nt, Homo sapiens
gcagcgcccuuccucuccac

SEQ ID NO: 2187104 - RNA, 14 nt, Homo sapiens
cagagcacuguagc

SEQ ID NO: 2187105 - RNA, 13 nt, Homo sapiens
ggcugacuacuca

SEQ ID NO: 2187106 - RNA, 20 nt, Homo sapiens
ucucaaaaaaaaaaauacaa

SEQ ID NO: 2187107 - RNA, 18 nt, Homo sapiens
aaaaauuaaauuguaccu

SEQ ID NO: 2187108 - RNA, 23 nt, Homo sapiens
gucuucugagcgagugcucucac

SEQ ID NO: 2187109 - RNA, 14 nt, Homo sapiens
ugccgaaacuggaa

SEQ ID NO: 2187110 - RNA, 16 nt, Homo sapiens
augacagagagagacc

SEQ ID NO: 2187111 - RNA, 23 nt, Homo sapiens
aaagcaacgacuacuuugcuacg

SEQ ID NO: 2187112 - RNA, 19 nt, Homo sapiens
aguuuauuugaaccaauaa

SEQ ID NO: 2187113 - RNA, 17 nt, Homo sapiens
gcaauuacggggugacc

SEQ ID NO: 2187114 - RNA, 15 nt, Homo sapiens
aauucagucucugaa

SEQ ID NO: 2187115 - RNA, 20 nt, Homo sapiens
aggugcucaaagauguacug

SEQ ID NO: 2187116 - RNA, 14 nt, Homo sapiens
guguauuaaucucu

SEQ ID NO: 2187117 - RNA, 12 nt, Homo sapiens
acccccaugaug

SEQ ID NO: 2187118 - RNA, 14 nt, Homo sapiens
uggacucugcacau

SEQ ID NO: 2187119 - RNA, 22 nt, Homo sapiens
cugaguggaugacaaaaagagg

SEQ ID NO: 2187120 - RNA, 14 nt, Homo sapiens
ugggcagaaagugg

SEQ ID NO: 2187121 - RNA, 12 nt, Homo sapiens
gccuuuugcccg

SEQ ID NO: 2187122 - RNA, 21 nt, Homo sapiens
aauuaccauuaauuacauaca

SEQ ID NO: 2187123 - RNA, 17 nt, Homo sapiens
auauauaacaaugcugu

SEQ ID NO: 2187124 - RNA, 16 nt, Homo sapiens
uuucaugauuugcaac

SEQ ID NO: 2187125 - RNA, 20 nt, Homo sapiens
guggaccacaggcaucuaca

SEQ ID NO: 2187126 - RNA, 20 nt, Homo sapiens
ugaaucuugcuguuuucaau

SEQ ID NO: 2187127 - RNA, 22 nt, Homo sapiens
aucagccugggcaacaugguga

SEQ ID NO: 2187128 - RNA, 21 nt, Homo sapiens
ccuucaucuuccuguguccug

SEQ ID NO: 2187129 - RNA, 18 nt, Homo sapiens
uccagaacuucaccucca

SEQ ID NO: 2187130 - RNA, 20 nt, Homo sapiens
cacugaugaguuucacugua

SEQ ID NO: 2187131 - RNA, 14 nt, Homo sapiens
aguuagccaaacaa

SEQ ID NO: 2187132 - RNA, 14 nt, Homo sapiens
auuauaagcauaca

SEQ ID NO: 2187133 - RNA, 14 nt, Homo sapiens
auuguaagcaugca

SEQ ID NO: 2187134 - RNA, 14 nt, Homo sapiens
cuacccuaaccaag

SEQ ID NO: 2187135 - RNA, 15 nt, Homo sapiens
uaggucucaugccca

SEQ ID NO: 2187136 - RNA, 19 nt, Homo sapiens
cugggacucaguucuuggc

SEQ ID NO: 2187137 - RNA, 20 nt, Homo sapiens
gucaacggagggaguggcac

SEQ ID NO: 2187138 - RNA, 18 nt, Homo sapiens
uccuggccuaauccuuua

SEQ ID NO: 2187139 - RNA, 15 nt, Homo sapiens
aaaguaguccuguga

SEQ ID NO: 2187140 - RNA, 19 nt, Homo sapiens
uaccucauccaugcacuuu

SEQ ID NO: 2187141 - RNA, 14 nt, Homo sapiens
aauagaauaaucua

SEQ ID NO: 2187142 - RNA, 18 nt, Homo sapiens
aacuacuguguuaugcaa

SEQ ID NO: 2187143 - RNA, 23 nt, Homo sapiens
caggguuggccaggcacgguggu

SEQ ID NO: 2187144 - RNA, 20 nt, Homo sapiens
acauaacuccaucuacaccu

SEQ ID NO: 2187145 - RNA, 17 nt, Homo sapiens
uguuuacaaggugacaa

SEQ ID NO: 2187146 - RNA, 23 nt, Homo sapiens
uuccuuuaaagaugaacucugaa

SEQ ID NO: 2187147 - RNA, 19 nt, Homo sapiens
ugugauuuuggacuagcca

SEQ ID NO: 2187148 - RNA, 18 nt, Homo sapiens
auagauauuacuggaaac

SEQ ID NO: 2187149 - RNA, 17 nt, Homo sapiens
uguggcaguuuggcaaa

SEQ ID NO: 2187150 - RNA, 21 nt, Homo sapiens
ucuccccaggaaguggcucag

SEQ ID NO: 2187151 - RNA, 13 nt, Homo sapiens
auaucaucagcau

SEQ ID NO: 2187152 - RNA, 22 nt, Homo sapiens
cgggaggauguucugggacaca

SEQ ID NO: 2187153 - RNA, 23 nt, Homo sapiens
aaagaucguuuaaaaacaaagga

SEQ ID NO: 2187154 - RNA, 22 nt, Homo sapiens
gcuccuguauuugagacuagga

SEQ ID NO: 2187155 - RNA, 23 nt, Homo sapiens
ucuucauuccuugcugcucacau

SEQ ID NO: 2187156 - RNA, 17 nt, Homo sapiens
cguaccuucaugugauu

SEQ ID NO: 2187157 - RNA, 22 nt, Homo sapiens
aaagcuugcucacaucuuggca

SEQ ID NO: 2187158 - RNA, 16 nt, Homo sapiens
aaaaguaccacauucc

SEQ ID NO: 2187159 - RNA, 19 nt, Homo sapiens
ugugcagaauucuaggcag

SEQ ID NO: 2187160 - RNA, 14 nt, Homo sapiens
cuguggucucaggc

SEQ ID NO: 2187161 - RNA, 15 nt, Homo sapiens
augcaaaauuuagaa

SEQ ID NO: 2187162 - RNA, 21 nt, Homo sapiens
aaguuguaaaguauguauuau

SEQ ID NO: 2187163 - RNA, 21 nt, Homo sapiens
aaggacggccuucaacugaaa

SEQ ID NO: 2187164 - RNA, 11 nt, Homo sapiens
aaaaacuacuu

SEQ ID NO: 2187165 - RNA, 15 nt, Homo sapiens
ugguuugcagaugau

SEQ ID NO: 2187166 - RNA, 14 nt, Homo sapiens
cuacccacuaugca

SEQ ID NO: 2187167 - RNA, 13 nt, Homo sapiens
agaaugauggacu

SEQ ID NO: 2187168 - RNA, 16 nt, Homo sapiens
aaaaucuuggaaguac

SEQ ID NO: 2187169 - RNA, 18 nt, Homo sapiens
uuggauguagccaugacc

SEQ ID NO: 2187170 - RNA, 14 nt, Homo sapiens
acagcaaaacucca

SEQ ID NO: 2187171 - RNA, 14 nt, Homo sapiens
aaugggaaaaacgg

SEQ ID NO: 2187172 - RNA, 16 nt, Homo sapiens
aaguguccauugacau

SEQ ID NO: 2187173 - RNA, 15 nt, Homo sapiens
acauuuuuugggcag

SEQ ID NO: 2187174 - RNA, 19 nt, Homo sapiens
cugaugcuuauuguaacuu

SEQ ID NO: 2187175 - RNA, 22 nt, Homo sapiens
aacauggugaaaccccgucucu

SEQ ID NO: 2187176 - RNA, 22 nt, Homo sapiens
aacaugguaaaaccccaucucu

SEQ ID NO: 2187177 - RNA, 21 nt, Homo sapiens
aguauuguuuccugagcauaa

SEQ ID NO: 2187178 - RNA, 24 nt, Homo sapiens
auaauauccagccucccacaagaa

SEQ ID NO: 2187179 - RNA, 20 nt, Homo sapiens
auccugcauuuaugguguag

SEQ ID NO: 2187180 - RNA, 13 nt, Homo sapiens
cuuguuggguaaa

SEQ ID NO: 2187181 - RNA, 21 nt, Homo sapiens
ugugcccggugccaucuucca

SEQ ID NO: 2187182 - RNA, 18 nt, Homo sapiens
gagagggcugcugaccau

SEQ ID NO: 2187183 - RNA, 22 nt, Homo sapiens
guuuaagccugcggcgccagcc

SEQ ID NO: 2187184 - RNA, 18 nt, Homo sapiens
uuuuggaauugguguaua

SEQ ID NO: 2187185 - RNA, 17 nt, Homo sapiens
ugccccggaccuaccuc

SEQ ID NO: 2187186 - RNA, 17 nt, Homo sapiens
ccaaauaaaguaccauu

SEQ ID NO: 2187187 - RNA, 12 nt, Homo sapiens
cuacagggccaa

SEQ ID NO: 2187188 - RNA, 20 nt, Homo sapiens
uugggccuaggcugcauuga

SEQ ID NO: 2187189 - RNA, 15 nt, Homo sapiens
caucacacauguuca

SEQ ID NO: 2187190 - RNA, 15 nt, Homo sapiens
agcaaacacauuaag

SEQ ID NO: 2187191 - RNA, 17 nt, Homo sapiens
ucagaccuuuuaacucc

SEQ ID NO: 2187192 - RNA, 20 nt, Homo sapiens
acaaauugaagcauguacaa

SEQ ID NO: 2187193 - RNA, 14 nt, Homo sapiens
gagugugugcaugu

SEQ ID NO: 2187194 - RNA, 14 nt, Homo sapiens
uagaaaguucaaaa

SEQ ID NO: 2187195 - RNA, 16 nt, Homo sapiens
uuaauuguaauugcau

SEQ ID NO: 2187196 - RNA, 22 nt, Homo sapiens
cuucuugaacacucaugcugaa

SEQ ID NO: 2187197 - RNA, 19 nt, Homo sapiens
cugccucugacuccaagag

SEQ ID NO: 2187198 - RNA, 20 nt, Homo sapiens
ccaagugcuaugacagaggu

SEQ ID NO: 2187199 - RNA, 21 nt, Homo sapiens
aaagagucuugguuccucuac

SEQ ID NO: 2187200 - RNA, 20 nt, Homo sapiens
uaauaaugugcaaaucugac

SEQ ID NO: 2187201 - RNA, 15 nt, Homo sapiens
caaaagcacauauau

SEQ ID NO: 2187202 - RNA, 21 nt, Homo sapiens
acugcugcgucauuacagggc

SEQ ID NO: 2187203 - RNA, 16 nt, Homo sapiens
cucauaauuuugcaaa

SEQ ID NO: 2187204 - RNA, 20 nt, Homo sapiens
cauuuuuuuuuaacacuguc

SEQ ID NO: 2187205 - RNA, 23 nt, Homo sapiens
cuaugaaauacuuuauagcacau

SEQ ID NO: 2187206 - RNA, 19 nt, Homo sapiens
gagaggcugggaauggagg

SEQ ID NO: 2187207 - RNA, 18 nt, Homo sapiens
ucagccuagccgaccuca

SEQ ID NO: 2187208 - RNA, 15 nt, Homo sapiens
uacuguuucacgugu

SEQ ID NO: 2187209 - RNA, 15 nt, Homo sapiens
ucuuuuauccuggga

SEQ ID NO: 2187210 - RNA, 12 nt, Homo sapiens
aaagccuagaca

SEQ ID NO: 2187211 - RNA, 13 nt, Homo sapiens
aagaggcagugau

SEQ ID NO: 2187212 - RNA, 22 nt, Homo sapiens
auuuccucuuauaacuucugaa

SEQ ID NO: 2187213 - RNA, 20 nt, Homo sapiens
uaggcuacuguaaugcugcc

SEQ ID NO: 2187214 - RNA, 18 nt, Homo sapiens
cugaacaugccugccaaa

SEQ ID NO: 2187215 - RNA, 19 nt, Homo sapiens
aaagaaaauaaauuacaau

SEQ ID NO: 2187216 - RNA, 21 nt, Homo sapiens
aauguacaccagagccucagu

SEQ ID NO: 2187217 - RNA, 15 nt, Homo sapiens
aaacccaugaucacc

SEQ ID NO: 2187218 - RNA, 13 nt, Homo sapiens
ggagcacuggguu

SEQ ID NO: 2187219 - RNA, 17 nt, Homo sapiens
aauaauuaguaagcuag

SEQ ID NO: 2187220 - RNA, 21 nt, Homo sapiens
cugauccaacaguugcuaaac

SEQ ID NO: 2187221 - RNA, 17 nt, Homo sapiens
agggcaguucugagugu

SEQ ID NO: 2187222 - RNA, 16 nt, Homo sapiens
guuuuuugccauguua

SEQ ID NO: 2187223 - RNA, 12 nt, Homo sapiens
gacuauggagcc

SEQ ID NO: 2187224 - RNA, 17 nt, Homo sapiens
uaaaaagaaaaguguaa

SEQ ID NO: 2187225 - RNA, 22 nt, Homo sapiens
accacacacacaaggugcucag

SEQ ID NO: 2187226 - RNA, 14 nt, Homo sapiens
auuguuucuuucaa

SEQ ID NO: 2187227 - RNA, 20 nt, Homo sapiens
cuaggcucagagaugugcac

SEQ ID NO: 2187228 - RNA, 20 nt, Homo sapiens
acagaaucuccugauaguaa

SEQ ID NO: 2187229 - RNA, 17 nt, Homo sapiens
ugauucuaugccuguau

SEQ ID NO: 2187230 - RNA, 13 nt, Homo sapiens
cccuaaagcccuc

SEQ ID NO: 2187231 - RNA, 13 nt, Homo sapiens
uauucaaguauua

SEQ ID NO: 2187232 - RNA, 13 nt, Homo sapiens
aguuaaaaguaaa

SEQ ID NO: 2187233 - RNA, 12 nt, Homo sapiens
gguugacuuucu

SEQ ID NO: 2187234 - RNA, 12 nt, Homo sapiens
gacagcacuccu

SEQ ID NO: 2187235 - RNA, 16 nt, Homo sapiens
ugaccccagcccagac

SEQ ID NO: 2187236 - RNA, 12 nt, Homo sapiens
caggacacuggu

SEQ ID NO: 2187237 - RNA, 12 nt, Homo sapiens
gauaucacuuca

SEQ ID NO: 2187238 - RNA, 16 nt, Homo sapiens
cuuccucucccauuca

SEQ ID NO: 2187239 - RNA, 16 nt, Homo sapiens
aaugacuuuauugcau

SEQ ID NO: 2187240 - RNA, 16 nt, Homo sapiens
ugcgccaaucccgcca

SEQ ID NO: 2187241 - RNA, 13 nt, Homo sapiens
gcuuuucugcaau

SEQ ID NO: 2187242 - RNA, 21 nt, Homo sapiens
cauccuuguuuugaaaaccua

SEQ ID NO: 2187243 - RNA, 19 nt, Homo sapiens
aguucccuauuugugaauu

SEQ ID NO: 2187244 - RNA, 23 nt, Homo sapiens
cugugagguuucccaaugguguu

SEQ ID NO: 2187245 - RNA, 23 nt, Homo sapiens
aagucuaaauaaaugaaguauuu

SEQ ID NO: 2187246 - RNA, 14 nt, Homo sapiens
uccagcuacuuagc

SEQ ID NO: 2187247 - RNA, 14 nt, Homo sapiens
caggugcaguccca

SEQ ID NO: 2187248 - RNA, 14 nt, Homo sapiens
gacagaaguauuua

SEQ ID NO: 2187249 - RNA, 21 nt, Homo sapiens
guaaaucaauuacagauuaaa

SEQ ID NO: 2187250 - RNA, 18 nt, Homo sapiens
auacgacacccaguauuu

SEQ ID NO: 2187251 - RNA, 20 nt, Homo sapiens
uugagaagucuaauucacag

SEQ ID NO: 2187252 - RNA, 14 nt, Homo sapiens
gugugugcugccag

SEQ ID NO: 2187253 - RNA, 21 nt, Homo sapiens
caauucuuuguauaugcauuc

SEQ ID NO: 2187254 - RNA, 12 nt, Homo sapiens
uaucucaucucu

SEQ ID NO: 2187255 - RNA, 17 nt, Homo sapiens
auggacagcugagcacu

SEQ ID NO: 2187256 - RNA, 13 nt, Homo sapiens
aacaaccugggca

SEQ ID NO: 2187257 - RNA, 15 nt, Homo sapiens
accuaugccuguggu

SEQ ID NO: 2187258 - RNA, 15 nt, Homo sapiens
agaugaguuuugcca

SEQ ID NO: 2187259 - RNA, 14 nt, Homo sapiens
gagcaugcacaugc

SEQ ID NO: 2187260 - RNA, 18 nt, Homo sapiens
aggcuaaaaggcuuccag

SEQ ID NO: 2187261 - RNA, 19 nt, Homo sapiens
agcuaucaggaugucccug

SEQ ID NO: 2187262 - RNA, 14 nt, Homo sapiens
auugccugcagauu

SEQ ID NO: 2187263 - RNA, 19 nt, Homo sapiens
uaaagucuagugaccuuaa

SEQ ID NO: 2187264 - RNA, 11 nt, Homo sapiens
acuaaccauag

SEQ ID NO: 2187265 - RNA, 13 nt, Homo sapiens
cagaccuccuagc

SEQ ID NO: 2187266 - RNA, 15 nt, Homo sapiens
caaauucaugugccg

SEQ ID NO: 2187267 - RNA, 19 nt, Homo sapiens
aagauuccaaaaagcacau

SEQ ID NO: 2187268 - RNA, 18 nt, Homo sapiens
aagagcaaagggaaauca

SEQ ID NO: 2187269 - RNA, 12 nt, Homo sapiens
aguuuugcacuu

SEQ ID NO: 2187270 - RNA, 22 nt, Homo sapiens
aaacucaaaagaaggccacugu

SEQ ID NO: 2187271 - RNA, 16 nt, Homo sapiens
aauagguaaagcuaua

SEQ ID NO: 2187272 - RNA, 14 nt, Homo sapiens
cagcucagacauau

SEQ ID NO: 2187273 - RNA, 15 nt, Homo sapiens
auggcugcugcucac

SEQ ID NO: 2187274 - RNA, 22 nt, Homo sapiens
ggcaucaugcaugucaaacaug

SEQ ID NO: 2187275 - RNA, 17 nt, Homo sapiens
guacaauaaagcaaugu

SEQ ID NO: 2187276 - RNA, 20 nt, Homo sapiens
ucuggcccuugcuuaccucu

SEQ ID NO: 2187277 - RNA, 22 nt, Homo sapiens
cgaaaguaauggggaagauuag

SEQ ID NO: 2187278 - RNA, 20 nt, Homo sapiens
agaaaaagaagugccuuuaa

SEQ ID NO: 2187279 - RNA, 13 nt, Homo sapiens
auagaauagcaca

SEQ ID NO: 2187280 - RNA, 18 nt, Homo sapiens
gccauugcacuccagccu

SEQ ID NO: 2187281 - RNA, 14 nt, Homo sapiens
uccucaacugggaa

SEQ ID NO: 2187282 - RNA, 14 nt, Homo sapiens
cuugccacaaucac

SEQ ID NO: 2187283 - RNA, 20 nt, Homo sapiens
aaguuaucagacacucuggc

SEQ ID NO: 2187284 - RNA, 17 nt, Homo sapiens
gacauguuuuuauaugu

SEQ ID NO: 2187285 - RNA, 21 nt, Homo sapiens
cauggauuacuucucuauaaa

SEQ ID NO: 2187286 - RNA, 16 nt, Homo sapiens
acugcaugaaugaaac

SEQ ID NO: 2187287 - RNA, 12 nt, Homo sapiens
uccaauaugaug

SEQ ID NO: 2187288 - RNA, 17 nt, Homo sapiens
gacugaaauuacuuuaa

SEQ ID NO: 2187289 - RNA, 19 nt, Homo sapiens
aagauauauuucacuuuug

SEQ ID NO: 2187290 - RNA, 14 nt, Homo sapiens
cugaggaugggcaa

SEQ ID NO: 2187291 - RNA, 17 nt, Homo sapiens
ugguuugggagcaauac

SEQ ID NO: 2187292 - RNA, 12 nt, Homo sapiens
guucaaagccag

SEQ ID NO: 2187293 - RNA, 15 nt, Homo sapiens
uucugacauccacau

SEQ ID NO: 2187294 - RNA, 19 nt, Homo sapiens
aaccuggaauggagacuuu

SEQ ID NO: 2187295 - RNA, 12 nt, Homo sapiens
uacugcagugac

SEQ ID NO: 2187296 - RNA, 18 nt, Homo sapiens
aagcagccaagcuccuug

SEQ ID NO: 2187297 - RNA, 16 nt, Homo sapiens
aagccacguugcagaa

SEQ ID NO: 2187298 - RNA, 18 nt, Homo sapiens
aauccucauguuacucag

SEQ ID NO: 2187299 - RNA, 14 nt, Homo sapiens
ugagaacuuuccau

SEQ ID NO: 2187300 - RNA, 21 nt, Homo sapiens
ucuauguucaaagacugugaa

SEQ ID NO: 2187301 - RNA, 22 nt, Homo sapiens
uuaaaaggaaauguaaaagcac

SEQ ID NO: 2187302 - RNA, 13 nt, Homo sapiens
ggcguuacugcuu

SEQ ID NO: 2187303 - RNA, 17 nt, Homo sapiens
cgcuggccucuuccucc

SEQ ID NO: 2187304 - RNA, 17 nt, Homo sapiens
accuaagggcccaaagg

SEQ ID NO: 2187305 - RNA, 11 nt, Homo sapiens
auuguuuacag

SEQ ID NO: 2187306 - RNA, 16 nt, Homo sapiens
cagcugcaucugauaa

SEQ ID NO: 2187307 - RNA, 18 nt, Homo sapiens
cacucuagucaaugacau

SEQ ID NO: 2187308 - RNA, 17 nt, Homo sapiens
caagucaacaugcauau

SEQ ID NO: 2187309 - RNA, 21 nt, Homo sapiens
agcacacacuucacaaagcca

SEQ ID NO: 2187310 - RNA, 15 nt, Homo sapiens
cucccccaacacaaa

SEQ ID NO: 2187311 - RNA, 18 nt, Homo sapiens
cuuuuggauuggacaaaa

SEQ ID NO: 2187312 - RNA, 15 nt, Homo sapiens
ugaguugcuuuucag

SEQ ID NO: 2187313 - RNA, 21 nt, Homo sapiens
uucuccccugggggccugaga

SEQ ID NO: 2187314 - RNA, 14 nt, Homo sapiens
uguaguuuguauua

SEQ ID NO: 2187315 - RNA, 15 nt, Homo sapiens
ccaucuuacagagac

SEQ ID NO: 2187316 - RNA, 15 nt, Homo sapiens
guuaaauguuuacaa

SEQ ID NO: 2187317 - RNA, 19 nt, Homo sapiens
aguuuugucuuugcuguaa

SEQ ID NO: 2187318 - RNA, 15 nt, Homo sapiens
uaccucgaguuuuaa

SEQ ID NO: 2187319 - RNA, 14 nt, Homo sapiens
uaugucccaugacc

SEQ ID NO: 2187320 - RNA, 12 nt, Homo sapiens
aggcugagcacc

SEQ ID NO: 2187321 - RNA, 16 nt, Homo sapiens
augucaucaccuccag

SEQ ID NO: 2187322 - RNA, 18 nt, Homo sapiens
aguacguugugcauuugg

SEQ ID NO: 2187323 - RNA, 21 nt, Homo sapiens
agcauuuuccacgcugauguu

SEQ ID NO: 2187324 - RNA, 20 nt, Homo sapiens
acacucugccuuccugaguc

SEQ ID NO: 2187325 - RNA, 12 nt, Homo sapiens
ucagaguggcuc

SEQ ID NO: 2187326 - RNA, 14 nt, Homo sapiens
uggagcugggcuaa

SEQ ID NO: 2187327 - RNA, 21 nt, Homo sapiens
ggucuggaauggacugggugc

SEQ ID NO: 2187328 - RNA, 22 nt, Homo sapiens
aguacugaagagugacggacuu

SEQ ID NO: 2187329 - RNA, 23 nt, Homo sapiens
aaaggugagcccucauagggaga

SEQ ID NO: 2187330 - RNA, 14 nt, Homo sapiens
aguguguguauacu

SEQ ID NO: 2187331 - RNA, 21 nt, Homo sapiens
aaagugacucacuuaucccaa

SEQ ID NO: 2187332 - RNA, 19 nt, Homo sapiens
aaagaaucaacagugaaca

SEQ ID NO: 2187333 - RNA, 17 nt, Homo sapiens
cuuucuaaauugcauga

SEQ ID NO: 2187334 - RNA, 21 nt, Homo sapiens
acaccauucaucucuaacaua

SEQ ID NO: 2187335 - RNA, 22 nt, Homo sapiens
guacuuuuucuaccuguacaca

SEQ ID NO: 2187336 - RNA, 17 nt, Homo sapiens
guccccuccacugucac

SEQ ID NO: 2187337 - RNA, 16 nt, Homo sapiens
uguguguauguauaca

SEQ ID NO: 2187338 - RNA, 16 nt, Homo sapiens
aaaacuucacugugcu

SEQ ID NO: 2187339 - RNA, 11 nt, Homo sapiens
guauacuauag

SEQ ID NO: 2187340 - RNA, 17 nt, Homo sapiens
ccuucuuuccuuccuuu

SEQ ID NO: 2187341 - RNA, 16 nt, Homo sapiens
auagcgccuguauaag

SEQ ID NO: 2187342 - RNA, 18 nt, Homo sapiens
ucuaagaaaucaugugca

SEQ ID NO: 2187343 - RNA, 18 nt, Homo sapiens
auaaaagacaagcacuuu

SEQ ID NO: 2187344 - RNA, 13 nt, Homo sapiens
cgauccccaugga

SEQ ID NO: 2187345 - RNA, 16 nt, Homo sapiens
uaaaguugugccaaac

SEQ ID NO: 2187346 - RNA, 22 nt, Homo sapiens
aaugaauuuuguuuggacuucu

SEQ ID NO: 2187347 - RNA, 16 nt, Homo sapiens
cacuagccugugcacg

SEQ ID NO: 2187348 - RNA, 18 nt, Homo sapiens
gcuuccagggagcccuuu

SEQ ID NO: 2187349 - RNA, 20 nt, Homo sapiens
ccuggcugugcacauucucc

SEQ ID NO: 2187350 - RNA, 14 nt, Homo sapiens
agcuucuaacucau

SEQ ID NO: 2187351 - RNA, 18 nt, Homo sapiens
aaaaugaagcugcccuaa

SEQ ID NO: 2187352 - RNA, 21 nt, Homo sapiens
caucugagccgucagagcagu

SEQ ID NO: 2187353 - RNA, 24 nt, Homo sapiens
gggccuuucuccuccccaccugua

SEQ ID NO: 2187354 - RNA, 23 nt, Homo sapiens
aagauuaagacagagaaacagac

SEQ ID NO: 2187355 - RNA, 16 nt, Homo sapiens
aaacucuugagaucuu

SEQ ID NO: 2187356 - RNA, 20 nt, Homo sapiens
cuugacaauuucuuuuucca

SEQ ID NO: 2187357 - RNA, 15 nt, Homo sapiens
cuauaacauucaauu

SEQ ID NO: 2187358 - RNA, 15 nt, Homo sapiens
cuauuauauucauuc

SEQ ID NO: 2187359 - RNA, 21 nt, Homo sapiens
ucccacugccccugcaccugc

SEQ ID NO: 2187360 - RNA, 18 nt, Homo sapiens
agaaaacaagagauauac

SEQ ID NO: 2187361 - RNA, 22 nt, Homo sapiens
ugaacauauuuaaaguguacua

SEQ ID NO: 2187362 - RNA, 20 nt, Homo sapiens
uagaaauaccucauucgccu

SEQ ID NO: 2187363 - RNA, 21 nt, Homo sapiens
uugccuuaaccagucucucaa

SEQ ID NO: 2187364 - RNA, 18 nt, Homo sapiens
guuccucccccaguuccu

SEQ ID NO: 2187365 - RNA, 13 nt, Homo sapiens
uacgccaggggaa

SEQ ID NO: 2187366 - RNA, 18 nt, Homo sapiens
aguuccuugaucuguaua

SEQ ID NO: 2187367 - RNA, 13 nt, Homo sapiens
uggccugagacaa

SEQ ID NO: 2187368 - RNA, 23 nt, Homo sapiens
gugcccuuccugcagaagagaca

SEQ ID NO: 2187369 - RNA, 15 nt, Homo sapiens
cagagagcaacucug

SEQ ID NO: 2187370 - RNA, 12 nt, Homo sapiens
ugauugucaaau

SEQ ID NO: 2187371 - RNA, 21 nt, Homo sapiens
ccagaaaucuucaugcaauga

SEQ ID NO: 2187372 - RNA, 19 nt, Homo sapiens
ugcacgcgcgcgugcacac

SEQ ID NO: 2187373 - RNA, 16 nt, Homo sapiens
cuccccuuucacaggu

SEQ ID NO: 2187374 - RNA, 19 nt, Homo sapiens
ugccagccccacacagcua

SEQ ID NO: 2187375 - RNA, 18 nt, Homo sapiens
ugugauuagaagcuaaau

SEQ ID NO: 2187376 - RNA, 14 nt, Homo sapiens
uagccccccagugg

SEQ ID NO: 2187377 - RNA, 16 nt, Homo sapiens
uuuuaguugacucaca

SEQ ID NO: 2187378 - RNA, 19 nt, Homo sapiens
aaauauggacugcucagga

SEQ ID NO: 2187379 - RNA, 21 nt, Homo sapiens
accuaggccucagcugcacug

SEQ ID NO: 2187380 - RNA, 16 nt, Homo sapiens
gacccccgugccaaau

SEQ ID NO: 2187381 - RNA, 19 nt, Homo sapiens
aaagauaaaaaaacagcuu

SEQ ID NO: 2187382 - RNA, 15 nt, Homo sapiens
uaguuccagcuaacu

SEQ ID NO: 2187383 - RNA, 22 nt, Homo sapiens
cccaugugagggaauaaaccug

SEQ ID NO: 2187384 - RNA, 16 nt, Homo sapiens
agcuauuuaaugacac

SEQ ID NO: 2187385 - RNA, 22 nt, Homo sapiens
cugggauuacagacaugagcca

SEQ ID NO: 2187386 - RNA, 20 nt, Homo sapiens
accaaaucaaaaucucucca

SEQ ID NO: 2187387 - RNA, 14 nt, Homo sapiens
uuuuauuaaacuca

SEQ ID NO: 2187388 - RNA, 14 nt, Homo sapiens
uauuauuaaucuca

SEQ ID NO: 2187389 - RNA, 17 nt, Homo sapiens
uaagguucuaaggccua

SEQ ID NO: 2187390 - RNA, 16 nt, Homo sapiens
gaauuguuuucuuaca

SEQ ID NO: 2187391 - RNA, 22 nt, Homo sapiens
cacuuaauaccguaucuucuaa

SEQ ID NO: 2187392 - RNA, 18 nt, Homo sapiens
gcaucugcaacaaaaagu

SEQ ID NO: 2187393 - RNA, 19 nt, Homo sapiens
aguuauuccccaucuucca

SEQ ID NO: 2187394 - RNA, 22 nt, Homo sapiens
caggcuucugagcacagcugca

SEQ ID NO: 2187395 - RNA, 16 nt, Homo sapiens
aaaagugaaccaucuc

SEQ ID NO: 2187396 - RNA, 17 nt, Homo sapiens
cuccguguggacugugc

SEQ ID NO: 2187397 - RNA, 21 nt, Homo sapiens
aaggagagcucuuugugaaug

SEQ ID NO: 2187398 - RNA, 20 nt, Homo sapiens
aacagacucgcuagcacuca

SEQ ID NO: 2187399 - RNA, 20 nt, Homo sapiens
ucuguuuauaaacauuguau

SEQ ID NO: 2187400 - RNA, 15 nt, Homo sapiens
cauguggaugacaca

SEQ ID NO: 2187401 - RNA, 12 nt, Homo sapiens
agucaccaaaua

SEQ ID NO: 2187402 - RNA, 16 nt, Homo sapiens
ccucccaggcucaagc

SEQ ID NO: 2187403 - RNA, 21 nt, Homo sapiens
agcuuccugucaacacuucuc

SEQ ID NO: 2187404 - RNA, 14 nt, Homo sapiens
uuuaaagaagggaa

SEQ ID NO: 2187405 - RNA, 16 nt, Homo sapiens
uuagguuuuguacaau

SEQ ID NO: 2187406 - RNA, 23 nt, Homo sapiens
aagauaccuaaaagagauuucaa

SEQ ID NO: 2187407 - RNA, 15 nt, Homo sapiens
cugauugcacacccc

SEQ ID NO: 2187408 - RNA, 17 nt, Homo sapiens
uaaauuuuuaagagaaa

SEQ ID NO: 2187409 - RNA, 18 nt, Homo sapiens
aaucucggcucacugcaa

SEQ ID NO: 2187410 - RNA, 17 nt, Homo sapiens
ccuggagacaaggugcu

SEQ ID NO: 2187411 - RNA, 22 nt, Homo sapiens
ucaccccagagccacacauggg

SEQ ID NO: 2187412 - RNA, 18 nt, Homo sapiens
gagaauaccuuggucuca

SEQ ID NO: 2187413 - RNA, 21 nt, Homo sapiens
ugugaccccuccccagugccu

SEQ ID NO: 2187414 - RNA, 19 nt, Homo sapiens
uccuugcugccaccugcuu

SEQ ID NO: 2187415 - RNA, 19 nt, Homo sapiens
cauagggucacuuugccau

SEQ ID NO: 2187416 - RNA, 15 nt, Homo sapiens
cauaugaacuuguca

SEQ ID NO: 2187417 - RNA, 15 nt, Homo sapiens
uuagacaauguggaa

SEQ ID NO: 2187418 - RNA, 15 nt, Homo sapiens
gugcauccccacgac

SEQ ID NO: 2187419 - RNA, 17 nt, Homo sapiens
ugugggagccugcaaac

SEQ ID NO: 2187420 - RNA, 13 nt, Homo sapiens
cuccugcacuuug

SEQ ID NO: 2187421 - RNA, 21 nt, Homo sapiens
cacaguauugcucacccagug

SEQ ID NO: 2187422 - RNA, 13 nt, Homo sapiens
uccucucucucag

SEQ ID NO: 2187423 - RNA, 22 nt, Homo sapiens
cccaguccccagcccuucacau

SEQ ID NO: 2187424 - RNA, 18 nt, Homo sapiens
aucuccaagaccagagau

SEQ ID NO: 2187425 - RNA, 20 nt, Homo sapiens
ugcauccauuugaacacauu

SEQ ID NO: 2187426 - RNA, 19 nt, Homo sapiens
gauaauauugucugucucu

SEQ ID NO: 2187427 - RNA, 18 nt, Homo sapiens
cgcuguguccccgcgggc

SEQ ID NO: 2187428 - RNA, 15 nt, Homo sapiens
ugaccccaugucucc

SEQ ID NO: 2187429 - RNA, 19 nt, Homo sapiens
auugugcaauacaguuuca

SEQ ID NO: 2187430 - RNA, 20 nt, Homo sapiens
auagggucggaggugcuguc

SEQ ID NO: 2187431 - RNA, 17 nt, Homo sapiens
ucacguuuccuuuucau

SEQ ID NO: 2187432 - RNA, 14 nt, Homo sapiens
gccacacuagcuuc

SEQ ID NO: 2187433 - RNA, 15 nt, Homo sapiens
gagcucacagcugga

SEQ ID NO: 2187434 - RNA, 23 nt, Homo sapiens
uuugggggguguuuuguggggcu

SEQ ID NO: 2187435 - RNA, 19 nt, Homo sapiens
gggugguccgggaagugag

SEQ ID NO: 2187436 - RNA, 23 nt, Homo sapiens
auagcagcaaacagagugaaaug

SEQ ID NO: 2187437 - RNA, 16 nt, Homo sapiens
auugccuuuccagggu

SEQ ID NO: 2187438 - RNA, 15 nt, Homo sapiens
agagccagcucucuc

SEQ ID NO: 2187439 - RNA, 20 nt, Homo sapiens
gaaugugacuggcgugcuga

SEQ ID NO: 2187440 - RNA, 21 nt, Homo sapiens
uuuccuucggaauccagugcu

SEQ ID NO: 2187441 - RNA, 16 nt, Homo sapiens
ggauuuggugcuggaa

SEQ ID NO: 2187442 - RNA, 13 nt, Homo sapiens
ggauggcgcagga

SEQ ID NO: 2187443 - RNA, 14 nt, Homo sapiens
augcucuuuugcac

SEQ ID NO: 2187444 - RNA, 19 nt, Homo sapiens
accagaauggggacaucuu

SEQ ID NO: 2187445 - RNA, 17 nt, Homo sapiens
caggaaggacuucuucc

SEQ ID NO: 2187446 - RNA, 17 nt, Homo sapiens
auccaggccucagccuc

SEQ ID NO: 2187447 - RNA, 13 nt, Homo sapiens
aagaaaauguucu

SEQ ID NO: 2187448 - RNA, 19 nt, Homo sapiens
gucauggaauggcaggugu

SEQ ID NO: 2187449 - RNA, 18 nt, Homo sapiens
aaaauagagccugaggga

SEQ ID NO: 2187450 - RNA, 22 nt, Homo sapiens
aguuuaaaaaaauaacaucuga

SEQ ID NO: 2187451 - RNA, 18 nt, Homo sapiens
acacaaaauccauuccag

SEQ ID NO: 2187452 - RNA, 19 nt, Homo sapiens
guugguguucggagcucuu

SEQ ID NO: 2187453 - RNA, 16 nt, Homo sapiens
cauauuuaaagucuug

SEQ ID NO: 2187454 - RNA, 13 nt, Homo sapiens
uacuguuuugcca

SEQ ID NO: 2187455 - RNA, 22 nt, Homo sapiens
ccaaaauauccaauucauuucu

SEQ ID NO: 2187456 - RNA, 19 nt, Homo sapiens
aacaccacuuaaucuucuc

SEQ ID NO: 2187457 - RNA, 23 nt, Homo sapiens
acgcacccacacccuacagcaga

SEQ ID NO: 2187458 - RNA, 17 nt, Homo sapiens
uuuaaaauaaggauaau

SEQ ID NO: 2187459 - RNA, 22 nt, Homo sapiens
agggccacagagcuacauggug

SEQ ID NO: 2187460 - RNA, 18 nt, Homo sapiens
agcaucuuagugccuuua

SEQ ID NO: 2187461 - RNA, 19 nt, Homo sapiens
acacagauguguugcaaag

SEQ ID NO: 2187462 - RNA, 17 nt, Homo sapiens
aggaggauccccugagg

SEQ ID NO: 2187463 - RNA, 19 nt, Homo sapiens
ggacacuguccaugaagca

SEQ ID NO: 2187464 - RNA, 19 nt, Homo sapiens
cccugggggauaccagcug

SEQ ID NO: 2187465 - RNA, 23 nt, Homo sapiens
agcucuggggcagaggaagccca

SEQ ID NO: 2187466 - RNA, 23 nt, Homo sapiens
uaagaguugagauuuugcaaucu

SEQ ID NO: 2187467 - RNA, 22 nt, Homo sapiens
uaacuaacaaccaaagacuaca

SEQ ID NO: 2187468 - RNA, 21 nt, Homo sapiens
gagcuccccagaucucccacu

SEQ ID NO: 2187469 - RNA, 16 nt, Homo sapiens
gggccugaccaaacag

SEQ ID NO: 2187470 - RNA, 16 nt, Homo sapiens
uguaaaucuugccuuu

SEQ ID NO: 2187471 - RNA, 17 nt, Homo sapiens
aguccaccucccauuac

SEQ ID NO: 2187472 - RNA, 12 nt, Homo sapiens
aaccaguccugc

SEQ ID NO: 2187473 - RNA, 21 nt, Homo sapiens
uaccacaugggugaacacuca

SEQ ID NO: 2187474 - RNA, 14 nt, Homo sapiens
acccaggaaucuca

SEQ ID NO: 2187475 - RNA, 19 nt, Homo sapiens
caggugugaaccaccacac

SEQ ID NO: 2187476 - RNA, 19 nt, Homo sapiens
uaagcauuuuuaaucugug

SEQ ID NO: 2187477 - RNA, 20 nt, Homo sapiens
gaguuucauguuaugccugu

SEQ ID NO: 2187478 - RNA, 20 nt, Homo sapiens
agagguuugucaacacaaag

SEQ ID NO: 2187479 - RNA, 21 nt, Homo sapiens
cuggaagcugcagaucuuugc

SEQ ID NO: 2187480 - RNA, 22 nt, Homo sapiens
auacuuugcagcacagcugaga

SEQ ID NO: 2187481 - RNA, 17 nt, Homo sapiens
ucuguuaacucuugaag

SEQ ID NO: 2187482 - RNA, 15 nt, Homo sapiens
auuuuucuaguauau

SEQ ID NO: 2187483 - RNA, 19 nt, Homo sapiens
gauaagguaccuuucacau

SEQ ID NO: 2187484 - RNA, 24 nt, Homo sapiens
uuggaacagcaugcugcugcucaa

SEQ ID NO: 2187485 - RNA, 19 nt, Homo sapiens
acuacagggaccagggaug

SEQ ID NO: 2187486 - RNA, 15 nt, Homo sapiens
uguuaaccauuugca

SEQ ID NO: 2187487 - RNA, 22 nt, Homo sapiens
uucaagcgacucuccugccuca

SEQ ID NO: 2187488 - RNA, 21 nt, Homo sapiens
auaggcuucucacggcgacca

SEQ ID NO: 2187489 - RNA, 19 nt, Homo sapiens
auccugaguaguaaucuca

SEQ ID NO: 2187490 - RNA, 17 nt, Homo sapiens
augcucugcauguuaca

SEQ ID NO: 2187491 - RNA, 21 nt, Homo sapiens
uaugcagggagcacuguucac

SEQ ID NO: 2187492 - RNA, 20 nt, Homo sapiens
aguggaagccccaacgggaa

SEQ ID NO: 2187493 - RNA, 12 nt, Homo sapiens
aaaaaaugcaca

SEQ ID NO: 2187494 - RNA, 18 nt, Homo sapiens
uauucacuugugugugua

SEQ ID NO: 2187495 - RNA, 24 nt, Homo sapiens
aaauuuggauuuacgacugaagaa

SEQ ID NO: 2187496 - RNA, 22 nt, Homo sapiens
cagccccacugcccuccagggc

SEQ ID NO: 2187497 - RNA, 21 nt, Homo sapiens
ugcacuuuauccucauuccau

SEQ ID NO: 2187498 - RNA, 15 nt, Homo sapiens
cagcuacuaaccugg

SEQ ID NO: 2187499 - RNA, 14 nt, Homo sapiens
augaugcagucucc

SEQ ID NO: 2187500 - RNA, 16 nt, Homo sapiens
uuaugaaccuuuacau

SEQ ID NO: 2187501 - RNA, 14 nt, Homo sapiens
aggagucugugcag

SEQ ID NO: 2187502 - RNA, 18 nt, Homo sapiens
ucuuuugaacaaaugaca

SEQ ID NO: 2187503 - RNA, 15 nt, Homo sapiens
gcuucaguugcauau

SEQ ID NO: 2187504 - RNA, 23 nt, Homo sapiens
guggcucugccuucaaagggaaa

SEQ ID NO: 2187505 - RNA, 18 nt, Homo sapiens
acuuuggccaaaaccuuu

SEQ ID NO: 2187506 - RNA, 21 nt, Homo sapiens
gaccaugaggccuccugccau

SEQ ID NO: 2187507 - RNA, 15 nt, Homo sapiens
ugcaguagugccaaa

SEQ ID NO: 2187508 - RNA, 17 nt, Homo sapiens
gagacuguagauugcuu

SEQ ID NO: 2187509 - RNA, 17 nt, Homo sapiens
ucucggcucagugcaac

SEQ ID NO: 2187510 - RNA, 15 nt, Homo sapiens
aauguauguacaaua

SEQ ID NO: 2187511 - RNA, 19 nt, Homo sapiens
uaauugaccuacuuuggua

SEQ ID NO: 2187512 - RNA, 17 nt, Homo sapiens
aacaugaaucaagcaau

SEQ ID NO: 2187513 - RNA, 17 nt, Homo sapiens
uggauuugccugugcca

SEQ ID NO: 2187514 - RNA, 14 nt, Homo sapiens
agcaacacaucuac

SEQ ID NO: 2187515 - RNA, 18 nt, Homo sapiens
uuuggccaaaaccuuuca

SEQ ID NO: 2187516 - RNA, 12 nt, Homo sapiens
ucuuuccacuuu

SEQ ID NO: 2187517 - RNA, 12 nt, Homo sapiens
ucuguccacuug

SEQ ID NO: 2187518 - RNA, 12 nt, Homo sapiens
cuucuccaucuc

SEQ ID NO: 2187519 - RNA, 17 nt, Homo sapiens
gcugcagagagcaccug

SEQ ID NO: 2187520 - RNA, 14 nt, Homo sapiens
gcaaucuuugccuu

SEQ ID NO: 2187521 - RNA, 18 nt, Homo sapiens
auguaccccucucagucu

SEQ ID NO: 2187522 - RNA, 18 nt, Homo sapiens
gaaaugguggugcuuuaa

SEQ ID NO: 2187523 - RNA, 17 nt, Homo sapiens
agcuucccaaguagcug

SEQ ID NO: 2187524 - RNA, 19 nt, Homo sapiens
gcauuuacuuuguguucac

SEQ ID NO: 2187525 - RNA, 18 nt, Homo sapiens
caagcugugguaugauga

SEQ ID NO: 2187526 - RNA, 23 nt, Homo sapiens
uaaaaugugaggaagaacuacag

SEQ ID NO: 2187527 - RNA, 22 nt, Homo sapiens
gaagccugcccuugucugagau

SEQ ID NO: 2187528 - RNA, 18 nt, Homo sapiens
ccccacccaucaguggag

SEQ ID NO: 2187529 - RNA, 17 nt, Homo sapiens
cguguaauauucucuga

SEQ ID NO: 2187530 - RNA, 20 nt, Homo sapiens
uuccuuggggcaggcaguga

SEQ ID NO: 2187531 - RNA, 18 nt, Homo sapiens
gaagugugaguagagcau

SEQ ID NO: 2187532 - RNA, 21 nt, Homo sapiens
aggguaaauaggaaucauuca

SEQ ID NO: 2187533 - RNA, 21 nt, Homo sapiens
caaauaugcaaagcacugacu

SEQ ID NO: 2187534 - RNA, 15 nt, Homo sapiens
uuguuauuuguacag

SEQ ID NO: 2187535 - RNA, 13 nt, Homo sapiens
caguuuucuuggu

SEQ ID NO: 2187536 - RNA, 19 nt, Homo sapiens
ugccagaagcagcauccuc

SEQ ID NO: 2187537 - RNA, 18 nt, Homo sapiens
auagaaucaauauuugua

SEQ ID NO: 2187538 - RNA, 16 nt, Homo sapiens
ugcaagaaugaaauga

SEQ ID NO: 2187539 - RNA, 23 nt, Homo sapiens
caggguccagugggaacugaaga

SEQ ID NO: 2187540 - RNA, 15 nt, Homo sapiens
gaauuagaagccauc

SEQ ID NO: 2187541 - RNA, 19 nt, Homo sapiens
uuucuaccuccuccuuugu

SEQ ID NO: 2187542 - RNA, 16 nt, Homo sapiens
gcuuguugugcuuuua

SEQ ID NO: 2187543 - RNA, 15 nt, Homo sapiens
ggagcauaacuggag

SEQ ID NO: 2187544 - RNA, 13 nt, Homo sapiens
ugugccaccucau

SEQ ID NO: 2187545 - RNA, 19 nt, Homo sapiens
ccugcuucucucagccagc

SEQ ID NO: 2187546 - RNA, 22 nt, Homo sapiens
gagaacaaagaccaaugugaag

SEQ ID NO: 2187547 - RNA, 18 nt, Homo sapiens
cugagauugcagauguga

SEQ ID NO: 2187548 - RNA, 18 nt, Homo sapiens
acaauuaucaaccacgug

SEQ ID NO: 2187549 - RNA, 22 nt, Homo sapiens
gauuugguuaagcucacacagc

SEQ ID NO: 2187550 - RNA, 17 nt, Homo sapiens
cacacauucugccuugg

SEQ ID NO: 2187551 - RNA, 15 nt, Homo sapiens
uauucuaaagcuuuc

SEQ ID NO: 2187552 - RNA, 22 nt, Homo sapiens
caccucugauuacaauucugau

SEQ ID NO: 2187553 - RNA, 24 nt, Homo sapiens
uuaagaaaaaaagacaaggcugau

SEQ ID NO: 2187554 - RNA, 22 nt, Homo sapiens
caagcugcucugagccacagug

SEQ ID NO: 2187555 - RNA, 22 nt, Homo sapiens
uggaacuuuagugaaacauaau

SEQ ID NO: 2187556 - RNA, 19 nt, Homo sapiens
gaaagggauugcugaggca

SEQ ID NO: 2187557 - RNA, 19 nt, Homo sapiens
ugcugugugagaccagggg

SEQ ID NO: 2187558 - RNA, 16 nt, Homo sapiens
ggguggaucaccugag

SEQ ID NO: 2187559 - RNA, 14 nt, Homo sapiens
aggacuacuuucca

SEQ ID NO: 2187560 - RNA, 14 nt, Homo sapiens
agagacucauuuca

SEQ ID NO: 2187561 - RNA, 19 nt, Homo sapiens
aaaccuuauggaaaagggg

SEQ ID NO: 2187562 - RNA, 21 nt, Homo sapiens
cugcuucucccacuuggccaa

SEQ ID NO: 2187563 - RNA, 14 nt, Homo sapiens
uuugugacauugua

SEQ ID NO: 2187564 - RNA, 12 nt, Homo sapiens
uggagcauuuau

SEQ ID NO: 2187565 - RNA, 14 nt, Homo sapiens
acccaagugccaag

SEQ ID NO: 2187566 - RNA, 13 nt, Homo sapiens
acagcauguguau

SEQ ID NO: 2187567 - RNA, 18 nt, Homo sapiens
aguaucagaauacuugca

SEQ ID NO: 2187568 - RNA, 19 nt, Homo sapiens
gcccagacuuuagugcccu

SEQ ID NO: 2187569 - RNA, 18 nt, Homo sapiens
ucuccacucaugugacuc

SEQ ID NO: 2187570 - RNA, 23 nt, Homo sapiens
uaaggggguguaaugaaaaugau

SEQ ID NO: 2187571 - RNA, 21 nt, Homo sapiens
acccagaaugagacauccagc

SEQ ID NO: 2187572 - RNA, 18 nt, Homo sapiens
uccacggaaacagaacuc

SEQ ID NO: 2187573 - RNA, 17 nt, Homo sapiens
agcugacccaacacuua

SEQ ID NO: 2187574 - RNA, 22 nt, Homo sapiens
caugagauuuuuuagaucuucc

SEQ ID NO: 2187575 - RNA, 16 nt, Homo sapiens
cagaaacacacaguca

SEQ ID NO: 2187576 - RNA, 23 nt, Homo sapiens
ucuaacucccuccucacacucca

SEQ ID NO: 2187577 - RNA, 22 nt, Homo sapiens
augcugcuccccuaaagccagg

SEQ ID NO: 2187578 - RNA, 20 nt, Homo sapiens
auacacaugguaacauugac

SEQ ID NO: 2187579 - RNA, 16 nt, Homo sapiens
acaagcaacaaaccuc

SEQ ID NO: 2187580 - RNA, 20 nt, Homo sapiens
ggaaaaugugcacacauaua

SEQ ID NO: 2187581 - RNA, 16 nt, Homo sapiens
cucccacaggggccau

SEQ ID NO: 2187582 - RNA, 11 nt, Homo sapiens
ugguugagggg

SEQ ID NO: 2187583 - RNA, 20 nt, Homo sapiens
auccauacaaaacuaucggu

SEQ ID NO: 2187584 - RNA, 16 nt, Homo sapiens
uggcacugacugggca

SEQ ID NO: 2187585 - RNA, 20 nt, Homo sapiens
ucaugguccgccugccucag

SEQ ID NO: 2187586 - RNA, 17 nt, Homo sapiens
caacuccacugucuuua

SEQ ID NO: 2187587 - RNA, 22 nt, Homo sapiens
uucuaagauaagaguugagauu

SEQ ID NO: 2187588 - RNA, 18 nt, Homo sapiens
agcucuacacaacaugua

SEQ ID NO: 2187589 - RNA, 21 nt, Homo sapiens
cagacuauggauguguucucu

SEQ ID NO: 2187590 - RNA, 15 nt, Homo sapiens
caaucccucaaaccu

SEQ ID NO: 2187591 - RNA, 23 nt, Homo sapiens
ucaugucagcuuauaugugacac

SEQ ID NO: 2187592 - RNA, 23 nt, Homo sapiens
cuaauucggauuugccauagccu

SEQ ID NO: 2187593 - RNA, 18 nt, Homo sapiens
uggaauauuugcuuuaua

SEQ ID NO: 2187594 - RNA, 13 nt, Homo sapiens
ccucugaagcauu

SEQ ID NO: 2187595 - RNA, 17 nt, Homo sapiens
gggcugaaguugcucug

SEQ ID NO: 2187596 - RNA, 15 nt, Homo sapiens
auucuagauuaccau

SEQ ID NO: 2187597 - RNA, 16 nt, Homo sapiens
ucauacuuggacaguu

SEQ ID NO: 2187598 - RNA, 13 nt, Homo sapiens
uuauauguucaca

SEQ ID NO: 2187599 - RNA, 21 nt, Homo sapiens
uucaacauuaaggcaguauga

SEQ ID NO: 2187600 - RNA, 19 nt, Homo sapiens
cuggucgccaauccaugcu

SEQ ID NO: 2187601 - RNA, 21 nt, Homo sapiens
auuccaacauuucucacugaa

SEQ ID NO: 2187602 - RNA, 20 nt, Homo sapiens
cauaaacgguuccuggugac

SEQ ID NO: 2187603 - RNA, 19 nt, Homo sapiens
ugauggcaugcugccuuaa

SEQ ID NO: 2187604 - RNA, 12 nt, Homo sapiens
cauccucaaaag

SEQ ID NO: 2187605 - RNA, 13 nt, Homo sapiens
augauacaguauu

SEQ ID NO: 2187606 - RNA, 14 nt, Homo sapiens
aaagugguuuuagg

SEQ ID NO: 2187607 - RNA, 12 nt, Homo sapiens
ugugggggccaa

SEQ ID NO: 2187608 - RNA, 17 nt, Homo sapiens
auccccacccagucuca

SEQ ID NO: 2187609 - RNA, 18 nt, Homo sapiens
agucuaaugaagagaaaa

SEQ ID NO: 2187610 - RNA, 22 nt, Homo sapiens
ugaugucauaucauuucacugu

SEQ ID NO: 2187611 - RNA, 17 nt, Homo sapiens
auguugcccacaccuaa

SEQ ID NO: 2187612 - RNA, 16 nt, Homo sapiens
gaaucugaaagagcau

SEQ ID NO: 2187613 - RNA, 19 nt, Homo sapiens
ucaacugggaaccuucaua

SEQ ID NO: 2187614 - RNA, 16 nt, Homo sapiens
cuccuaaggggccccu

SEQ ID NO: 2187615 - RNA, 21 nt, Homo sapiens
uacuuuguuauuguaccuaag

SEQ ID NO: 2187616 - RNA, 16 nt, Homo sapiens
guuugcccauucucuu

SEQ ID NO: 2187617 - RNA, 17 nt, Homo sapiens
ugaacacaggcaaagag

SEQ ID NO: 2187618 - RNA, 19 nt, Homo sapiens
ucccuuuuucaaugaauuu

SEQ ID NO: 2187619 - RNA, 14 nt, Homo sapiens
cauuaaaucuauga

SEQ ID NO: 2187620 - RNA, 14 nt, Homo sapiens
acaugugaaaagcu

SEQ ID NO: 2187621 - RNA, 16 nt, Homo sapiens
uaaagcaggugcccag

SEQ ID NO: 2187622 - RNA, 18 nt, Homo sapiens
gaugacuuaccuguucag

SEQ ID NO: 2187623 - RNA, 20 nt, Homo sapiens
auuuacagaaacgcauccag

SEQ ID NO: 2187624 - RNA, 22 nt, Homo sapiens
auauauuauuuagucaacauau

SEQ ID NO: 2187625 - RNA, 16 nt, Homo sapiens
guaacaguucauguuu

SEQ ID NO: 2187626 - RNA, 16 nt, Homo sapiens
cagggauuacuggugu

SEQ ID NO: 2187627 - RNA, 16 nt, Homo sapiens
caaaggcuucuuggcu

SEQ ID NO: 2187628 - RNA, 22 nt, Homo sapiens
gcauuuucuacacagcgagaaa

SEQ ID NO: 2187629 - RNA, 21 nt, Homo sapiens
agaaagccccucaccucagga

SEQ ID NO: 2187630 - RNA, 22 nt, Homo sapiens
cuuugagcugagugcugaaaua

SEQ ID NO: 2187631 - RNA, 15 nt, Homo sapiens
uucacauaguuugau

SEQ ID NO: 2187632 - RNA, 16 nt, Homo sapiens
gagagauucugugauc

SEQ ID NO: 2187633 - RNA, 16 nt, Homo sapiens
uaauaaugagguccuu

SEQ ID NO: 2187634 - RNA, 15 nt, Homo sapiens
auuccugugcggaca

SEQ ID NO: 2187635 - RNA, 16 nt, Homo sapiens
agcuaauaagugcuuu

SEQ ID NO: 2187636 - RNA, 19 nt, Homo sapiens
aauuucaaaagggccccau

SEQ ID NO: 2187637 - RNA, 24 nt, Homo sapiens
aaguguauaugauucucuugagau

SEQ ID NO: 2187638 - RNA, 18 nt, Homo sapiens
cuguagcucaaucugcaa

SEQ ID NO: 2187639 - RNA, 16 nt, Homo sapiens
gucucuuggaaacagc

SEQ ID NO: 2187640 - RNA, 15 nt, Homo sapiens
uggagugcucacaaa

SEQ ID NO: 2187641 - RNA, 23 nt, Homo sapiens
cuccaccaaccccgcggcccaga

SEQ ID NO: 2187642 - RNA, 17 nt, Homo sapiens
cuuuuuucaaaagaaag

SEQ ID NO: 2187643 - RNA, 18 nt, Homo sapiens
ucuguccuuuaugauccc

SEQ ID NO: 2187644 - RNA, 22 nt, Homo sapiens
cgucuucacuuccccacaggcu

SEQ ID NO: 2187645 - RNA, 18 nt, Homo sapiens
auuuuaaguaauuucaga

SEQ ID NO: 2187646 - RNA, 20 nt, Homo sapiens
ccagucacugugagcuccca

SEQ ID NO: 2187647 - RNA, 19 nt, Homo sapiens
ggcaggagaaucaauaaaa

SEQ ID NO: 2187648 - RNA, 15 nt, Homo sapiens
guucaguaguuccag

SEQ ID NO: 2187649 - RNA, 19 nt, Homo sapiens
acacugaaccuuguugaug

SEQ ID NO: 2187650 - RNA, 10 nt, Homo sapiens
aacacugggg

SEQ ID NO: 2187651 - RNA, 15 nt, Homo sapiens
ugaagaaguucuuaa

SEQ ID NO: 2187652 - RNA, 18 nt, Homo sapiens
cuaugaggggguuuggca

SEQ ID NO: 2187653 - RNA, 15 nt, Homo sapiens
acucuggacuuucuc

SEQ ID NO: 2187654 - RNA, 20 nt, Homo sapiens
gauauaauuuuauuacauau

SEQ ID NO: 2187655 - RNA, 17 nt, Homo sapiens
ccuguuuuaugcccuuc

SEQ ID NO: 2187656 - RNA, 22 nt, Homo sapiens
uuuucuugcuaaaacucuaugu

SEQ ID NO: 2187657 - RNA, 17 nt, Homo sapiens
augugcuggaaggacaa

SEQ ID NO: 2187658 - RNA, 18 nt, Homo sapiens
uuccacaccuagcaucuc

SEQ ID NO: 2187659 - RNA, 19 nt, Homo sapiens
uauugccuugugaauuugc

SEQ ID NO: 2187660 - RNA, 18 nt, Homo sapiens
ugcagggccuccauuccu

SEQ ID NO: 2187661 - RNA, 23 nt, Homo sapiens
guguaucggaugcuuuuguucag

SEQ ID NO: 2187662 - RNA, 15 nt, Homo sapiens
aguguggaagcagaa

SEQ ID NO: 2187663 - RNA, 13 nt, Homo sapiens
uguguaauaugca

SEQ ID NO: 2187664 - RNA, 19 nt, Homo sapiens
aacuccauacuccacucca

SEQ ID NO: 2187665 - RNA, 14 nt, Homo sapiens
ggaaaggggugcuu

SEQ ID NO: 2187666 - RNA, 17 nt, Homo sapiens
cccaaauccuguuccaa

SEQ ID NO: 2187667 - RNA, 17 nt, Homo sapiens
aagaggguacuaggggc

SEQ ID NO: 2187668 - RNA, 21 nt, Homo sapiens
cugcagggccuauaugccagc

SEQ ID NO: 2187669 - RNA, 16 nt, Homo sapiens
ugcagaugacuggaaa

SEQ ID NO: 2187670 - RNA, 23 nt, Homo sapiens
uugucuacauuaaaucacuugaa

SEQ ID NO: 2187671 - RNA, 23 nt, Homo sapiens
gccuggacuagagggaccucucc

SEQ ID NO: 2187672 - RNA, 14 nt, Homo sapiens
ugcugaaacugugg

SEQ ID NO: 2187673 - RNA, 12 nt, Homo sapiens
cauuuugccaaa

SEQ ID NO: 2187674 - RNA, 18 nt, Homo sapiens
gauaaucccauacucuca

SEQ ID NO: 2187675 - RNA, 22 nt, Homo sapiens
guuuucgaugaugaugaugauc

SEQ ID NO: 2187676 - RNA, 16 nt, Homo sapiens
ucagugcucuguaaaa

SEQ ID NO: 2187677 - RNA, 12 nt, Homo sapiens
caccgagaccaa

SEQ ID NO: 2187678 - RNA, 21 nt, Homo sapiens
cggcaucgggccaucucagau

SEQ ID NO: 2187679 - RNA, 15 nt, Homo sapiens
ggaauggcucaggga

SEQ ID NO: 2187680 - RNA, 16 nt, Homo sapiens
auaacuauugcugcuu

SEQ ID NO: 2187681 - RNA, 15 nt, Homo sapiens
aguucuuuguuccug

SEQ ID NO: 2187682 - RNA, 16 nt, Homo sapiens
cuuauucaaccugucc

SEQ ID NO: 2187683 - RNA, 18 nt, Homo sapiens
agaucuacacagucacac

SEQ ID NO: 2187684 - RNA, 23 nt, Homo sapiens
auugaggccaagaauauugcaaa

SEQ ID NO: 2187685 - RNA, 16 nt, Homo sapiens
uauuuauuuuuugcca

SEQ ID NO: 2187686 - RNA, 20 nt, Homo sapiens
uguccggaaugccacccaca

SEQ ID NO: 2187687 - RNA, 12 nt, Homo sapiens
gggcucuucccc

SEQ ID NO: 2187688 - RNA, 21 nt, Homo sapiens
gcccagaaaaccuccaguagu

SEQ ID NO: 2187689 - RNA, 12 nt, Homo sapiens
cauuacuacugu

SEQ ID NO: 2187690 - RNA, 12 nt, Homo sapiens
cgaugacuguga

SEQ ID NO: 2187691 - RNA, 12 nt, Homo sapiens
gccagacacuga

SEQ ID NO: 2187692 - RNA, 15 nt, Homo sapiens
uugauuuacauauau

SEQ ID NO: 2187693 - RNA, 22 nt, Homo sapiens
auaugaggcuguugucuuuucc

SEQ ID NO: 2187694 - RNA, 19 nt, Homo sapiens
ggccauuugugauacuucc

SEQ ID NO: 2187695 - RNA, 14 nt, Homo sapiens
cauuucgaagucau

SEQ ID NO: 2187696 - RNA, 18 nt, Homo sapiens
cuuguaucaaauucaaua

SEQ ID NO: 2187697 - RNA, 23 nt, Homo sapiens
uuuacuccuguaagcaagagcca

SEQ ID NO: 2187698 - RNA, 21 nt, Homo sapiens
uuaauaaaacugcacagugcu

SEQ ID NO: 2187699 - RNA, 17 nt, Homo sapiens
cuugcuuucuucuuucc

SEQ ID NO: 2187700 - RNA, 21 nt, Homo sapiens
gauuugaaaauuguauaccaa

SEQ ID NO: 2187701 - RNA, 13 nt, Homo sapiens
acucauagcacuu

SEQ ID NO: 2187702 - RNA, 16 nt, Homo sapiens
aguaaaaauacaagca

SEQ ID NO: 2187703 - RNA, 21 nt, Homo sapiens
ccaccgagccacgcagugccu

SEQ ID NO: 2187704 - RNA, 13 nt, Homo sapiens
cagcccagugcaa

SEQ ID NO: 2187705 - RNA, 16 nt, Homo sapiens
ccaccagggcacuguc

SEQ ID NO: 2187706 - RNA, 14 nt, Homo sapiens
ggacaacugcggug

SEQ ID NO: 2187707 - RNA, 14 nt, Homo sapiens
ucaauggugcaaaa

SEQ ID NO: 2187708 - RNA, 14 nt, Homo sapiens
uuugauggugccag

SEQ ID NO: 2187709 - RNA, 12 nt, Homo sapiens
acacacacuccc

SEQ ID NO: 2187710 - RNA, 14 nt, Homo sapiens
ugcaucugucuguc

SEQ ID NO: 2187711 - RNA, 21 nt, Homo sapiens
guuugcuauugacaagucauu

SEQ ID NO: 2187712 - RNA, 20 nt, Homo sapiens
agauguucacccaaccacau

SEQ ID NO: 2187713 - RNA, 12 nt, Homo sapiens
uacauucuucca

SEQ ID NO: 2187714 - RNA, 20 nt, Homo sapiens
caacaucacaccauugcacu

SEQ ID NO: 2187715 - RNA, 15 nt, Homo sapiens
guuggcagcauucca

SEQ ID NO: 2187716 - RNA, 14 nt, Homo sapiens
guccuucaccucac

SEQ ID NO: 2187717 - RNA, 21 nt, Homo sapiens
ugauuaacucuuagaaguguu

SEQ ID NO: 2187718 - RNA, 18 nt, Homo sapiens
auccccaccacugauauc

SEQ ID NO: 2187719 - RNA, 23 nt, Homo sapiens
uauguaacagucaaauaucauuu

SEQ ID NO: 2187720 - RNA, 14 nt, Homo sapiens
uaucuacauuauac

SEQ ID NO: 2187721 - RNA, 21 nt, Homo sapiens
auuuaagccaucaucagcuua

SEQ ID NO: 2187722 - RNA, 18 nt, Homo sapiens
cauacaagagacauauaa

SEQ ID NO: 2187723 - RNA, 18 nt, Homo sapiens
agagggaggucacuggaa

SEQ ID NO: 2187724 - RNA, 20 nt, Homo sapiens
guuaauaaaccuuugcaaac

SEQ ID NO: 2187725 - RNA, 17 nt, Homo sapiens
aaaugacagauguugaa

SEQ ID NO: 2187726 - RNA, 17 nt, Homo sapiens
agucaagaucaacauuc

SEQ ID NO: 2187727 - RNA, 15 nt, Homo sapiens
ugaaugccuucuuaa

SEQ ID NO: 2187728 - RNA, 21 nt, Homo sapiens
gaagaugauuucaguucauca

SEQ ID NO: 2187729 - RNA, 21 nt, Homo sapiens
cgcacagugcaguugaggucu

SEQ ID NO: 2187730 - RNA, 22 nt, Homo sapiens
agguaaaucuaguuuacuuccu

SEQ ID NO: 2187731 - RNA, 16 nt, Homo sapiens
auccugcgagcuccuu

SEQ ID NO: 2187732 - RNA, 14 nt, Homo sapiens
uauuaaagaugugu

SEQ ID NO: 2187733 - RNA, 15 nt, Homo sapiens
uaacuauccuuccag

SEQ ID NO: 2187734 - RNA, 15 nt, Homo sapiens
ucuauuccaguauuu

SEQ ID NO: 2187735 - RNA, 15 nt, Homo sapiens
ucucuaccagucuau

SEQ ID NO: 2187736 - RNA, 14 nt, Homo sapiens
auaggcauuucaca

SEQ ID NO: 2187737 - RNA, 20 nt, Homo sapiens
caaaaucaagagauggcuua

SEQ ID NO: 2187738 - RNA, 18 nt, Homo sapiens
auuuuccugcuucaucuu

SEQ ID NO: 2187739 - RNA, 17 nt, Homo sapiens
ucaaaagccagauguga

SEQ ID NO: 2187740 - RNA, 22 nt, Homo sapiens
gaaaccagagucaaauuugaaa

SEQ ID NO: 2187741 - RNA, 22 nt, Homo sapiens
gagcaagacucugucucaaaaa

SEQ ID NO: 2187742 - RNA, 18 nt, Homo sapiens
ugaaaauuaugagucucu

SEQ ID NO: 2187743 - RNA, 14 nt, Homo sapiens
aaaaggcagccaga

SEQ ID NO: 2187744 - RNA, 23 nt, Homo sapiens
ggcaguucgaccagccagggaaa

SEQ ID NO: 2187745 - RNA, 11 nt, Homo sapiens
caaacaaaagc

SEQ ID NO: 2187746 - RNA, 13 nt, Homo sapiens
ucaauaaggcagu

SEQ ID NO: 2187747 - RNA, 13 nt, Homo sapiens
uggggaaggggag

SEQ ID NO: 2187748 - RNA, 18 nt, Homo sapiens
agaaaaccucaccaacug

SEQ ID NO: 2187749 - RNA, 11 nt, Homo sapiens
ucuaaugaaga

SEQ ID NO: 2187750 - RNA, 17 nt, Homo sapiens
uucacuacguguucaca

SEQ ID NO: 2187751 - RNA, 21 nt, Homo sapiens
uauugucuuuugacauccagc

SEQ ID NO: 2187752 - RNA, 14 nt, Homo sapiens
uucuagcaguaugu

SEQ ID NO: 2187753 - RNA, 20 nt, Homo sapiens
aauuaccauuaauuacauac

SEQ ID NO: 2187754 - RNA, 18 nt, Homo sapiens
gagauaguuuucauuuua

SEQ ID NO: 2187755 - RNA, 13 nt, Homo sapiens
ugaaccuggaaau

SEQ ID NO: 2187756 - RNA, 19 nt, Homo sapiens
uagacaucuucagauuuaa

SEQ ID NO: 2187757 - RNA, 18 nt, Homo sapiens
uuuugauucuacucuuau

SEQ ID NO: 2187758 - RNA, 18 nt, Homo sapiens
ugggcaacaagagcaaaa

SEQ ID NO: 2187759 - RNA, 13 nt, Homo sapiens
guucuuuugcaau

SEQ ID NO: 2187760 - RNA, 15 nt, Homo sapiens
uuccuugguucccuc

SEQ ID NO: 2187761 - RNA, 18 nt, Homo sapiens
guccuccagaaagcacca

SEQ ID NO: 2187762 - RNA, 20 nt, Homo sapiens
aaagaagauucuuaccaaga

SEQ ID NO: 2187763 - RNA, 23 nt, Homo sapiens
agcuggagcccgugcccuaccac

SEQ ID NO: 2187764 - RNA, 16 nt, Homo sapiens
gacauuuguauucuca

SEQ ID NO: 2187765 - RNA, 19 nt, Homo sapiens
aucucuucaugcuugacau

SEQ ID NO: 2187766 - RNA, 16 nt, Homo sapiens
caggauaugaguacau

SEQ ID NO: 2187767 - RNA, 19 nt, Homo sapiens
cuuugucugucaaucacag

SEQ ID NO: 2187768 - RNA, 13 nt, Homo sapiens
ucauuguguuugu

SEQ ID NO: 2187769 - RNA, 22 nt, Homo sapiens
uuuuccacaagauucccagaga

SEQ ID NO: 2187770 - RNA, 22 nt, Homo sapiens
aggcugggggcgggggagccaa

SEQ ID NO: 2187771 - RNA, 22 nt, Homo sapiens
uaucacauuacaucauccuccu

SEQ ID NO: 2187772 - RNA, 18 nt, Homo sapiens
cuggacuggcccuugccc

SEQ ID NO: 2187773 - RNA, 16 nt, Homo sapiens
uaacuuguaaaccaca

SEQ ID NO: 2187774 - RNA, 19 nt, Homo sapiens
uauuaagagcaaacuuuag

SEQ ID NO: 2187775 - RNA, 23 nt, Homo sapiens
acccccagggcauuguguucacu

SEQ ID NO: 2187776 - RNA, 18 nt, Homo sapiens
gauuccuucaacuggcua

SEQ ID NO: 2187777 - RNA, 23 nt, Homo sapiens
guccucgccccccgcccggccuc

SEQ ID NO: 2187778 - RNA, 12 nt, Homo sapiens
gaggcaccucca

SEQ ID NO: 2187779 - RNA, 16 nt, Homo sapiens
cuagauccuaugugaa

SEQ ID NO: 2187780 - RNA, 18 nt, Homo sapiens
aguucaagugaucuuuca

SEQ ID NO: 2187781 - RNA, 23 nt, Homo sapiens
gauucucuuguauaagauccuag

SEQ ID NO: 2187782 - RNA, 11 nt, Homo sapiens
aauugccugua

SEQ ID NO: 2187783 - RNA, 22 nt, Homo sapiens
caaaugccaaacacuagcucug

SEQ ID NO: 2187784 - RNA, 14 nt, Homo sapiens
aaggcggaaaccca

SEQ ID NO: 2187785 - RNA, 21 nt, Homo sapiens
agacagacgccugcuuuugca

SEQ ID NO: 2187786 - RNA, 20 nt, Homo sapiens
cagggggcccagggugccug

SEQ ID NO: 2187787 - RNA, 16 nt, Homo sapiens
uuauaguuugcuguug

SEQ ID NO: 2187788 - RNA, 19 nt, Homo sapiens
cuacaccaauuaauguagc

SEQ ID NO: 2187789 - RNA, 18 nt, Homo sapiens
ggacaaucuuauguuucc

SEQ ID NO: 2187790 - RNA, 15 nt, Homo sapiens
cugggaaugcuccca

SEQ ID NO: 2187791 - RNA, 20 nt, Homo sapiens
gcgcaauugcucaugcauag

SEQ ID NO: 2187792 - RNA, 22 nt, Homo sapiens
acgacauuuuggaacagcaugc

SEQ ID NO: 2187793 - RNA, 15 nt, Homo sapiens
caagugugugugcgu

SEQ ID NO: 2187794 - RNA, 18 nt, Homo sapiens
aaucagcaaacacaauaa

SEQ ID NO: 2187795 - RNA, 17 nt, Homo sapiens
aucaucuuaccugugcu

SEQ ID NO: 2187796 - RNA, 19 nt, Homo sapiens
auccuagaucaccacugga

SEQ ID NO: 2187797 - RNA, 17 nt, Homo sapiens
accuucagauccuaccc

SEQ ID NO: 2187798 - RNA, 16 nt, Homo sapiens
aaaauaagaaaauaac

SEQ ID NO: 2187799 - RNA, 22 nt, Homo sapiens
ggacaagauuuccuacuuucuc

SEQ ID NO: 2187800 - RNA, 16 nt, Homo sapiens
uguuaccaaaucucag

SEQ ID NO: 2187801 - RNA, 18 nt, Homo sapiens
aaugaaccuugcuaucaa

SEQ ID NO: 2187802 - RNA, 18 nt, Homo sapiens
gaaaccacagucagugga

SEQ ID NO: 2187803 - RNA, 16 nt, Homo sapiens
aaaaacacucaacaaa

SEQ ID NO: 2187804 - RNA, 14 nt, Homo sapiens
uccaucccuagcca

SEQ ID NO: 2187805 - RNA, 14 nt, Homo sapiens
cugaaauuaguguu

SEQ ID NO: 2187806 - RNA, 12 nt, Homo sapiens
ccuuucacuuua

SEQ ID NO: 2187807 - RNA, 13 nt, Homo sapiens
auuguacuguuga

SEQ ID NO: 2187808 - RNA, 15 nt, Homo sapiens
gaagcugcaggcuuu

SEQ ID NO: 2187809 - RNA, 17 nt, Homo sapiens
ggccccaguccaugcuu

SEQ ID NO: 2187810 - RNA, 15 nt, Homo sapiens
ucucagccucugauc

SEQ ID NO: 2187811 - RNA, 19 nt, Homo sapiens
auguauuccuaugacaaaa

SEQ ID NO: 2187812 - RNA, 23 nt, Homo sapiens
gcuaggagauacucuucugccuc

SEQ ID NO: 2187813 - RNA, 18 nt, Homo sapiens
aaugccaauucaucucag

SEQ ID NO: 2187814 - RNA, 17 nt, Homo sapiens
ucuuugaagagauuuca

SEQ ID NO: 2187815 - RNA, 17 nt, Homo sapiens
gcucuaauguacaauaa

SEQ ID NO: 2187816 - RNA, 18 nt, Homo sapiens
caauggaaaaauagguaa

SEQ ID NO: 2187817 - RNA, 16 nt, Homo sapiens
gcugagacuacaggug

SEQ ID NO: 2187818 - RNA, 20 nt, Homo sapiens
cccuggaaucagaagcacua

SEQ ID NO: 2187819 - RNA, 18 nt, Homo sapiens
cuuuuccccaauucaugu

SEQ ID NO: 2187820 - RNA, 14 nt, Homo sapiens
caccauacccagcu

SEQ ID NO: 2187821 - RNA, 14 nt, Homo sapiens
ggagagagccaaga

SEQ ID NO: 2187822 - RNA, 15 nt, Homo sapiens
cgagaagacaaacuc

SEQ ID NO: 2187823 - RNA, 18 nt, Homo sapiens
ucaagaguaguuauauaa

SEQ ID NO: 2187824 - RNA, 19 nt, Homo sapiens
agcacacuuuacacaagaa

SEQ ID NO: 2187825 - RNA, 14 nt, Homo sapiens
acauugaaguauua

SEQ ID NO: 2187826 - RNA, 19 nt, Homo sapiens
auuuacuuuuaccacuauu

SEQ ID NO: 2187827 - RNA, 14 nt, Homo sapiens
accugaucauuaca

SEQ ID NO: 2187828 - RNA, 11 nt, Homo sapiens
cuaaacaugug

SEQ ID NO: 2187829 - RNA, 17 nt, Homo sapiens
uguuuaugugaacauuc

SEQ ID NO: 2187830 - RNA, 16 nt, Homo sapiens
aaccaaucaaaugucu

SEQ ID NO: 2187831 - RNA, 16 nt, Homo sapiens
ugcuaucccacuguau

SEQ ID NO: 2187832 - RNA, 15 nt, Homo sapiens
aaaauagacauguag

SEQ ID NO: 2187833 - RNA, 14 nt, Homo sapiens
cuuuucacaaauca

SEQ ID NO: 2187834 - RNA, 16 nt, Homo sapiens
ccaacuacuacuggug

SEQ ID NO: 2187835 - RNA, 17 nt, Homo sapiens
aauuuuguucucuggga

SEQ ID NO: 2187836 - RNA, 16 nt, Homo sapiens
aaacaagcaacagaug

SEQ ID NO: 2187837 - RNA, 20 nt, Homo sapiens
ugggagagguucugugcaaa

SEQ ID NO: 2187838 - RNA, 23 nt, Homo sapiens
cagaccauucaggacacagggaa

SEQ ID NO: 2187839 - RNA, 18 nt, Homo sapiens
aucuuggagggaccaagg

SEQ ID NO: 2187840 - RNA, 13 nt, Homo sapiens
ugacucagcacug

SEQ ID NO: 2187841 - RNA, 15 nt, Homo sapiens
gcuugcaagauucca

SEQ ID NO: 2187842 - RNA, 18 nt, Homo sapiens
agcacuguugauguaucu

SEQ ID NO: 2187843 - RNA, 14 nt, Homo sapiens
acuuugacaguguu

SEQ ID NO: 2187844 - RNA, 18 nt, Homo sapiens
auuuaaguuaucaacuuu

SEQ ID NO: 2187845 - RNA, 15 nt, Homo sapiens
cuccaaccuggaggc

SEQ ID NO: 2187846 - RNA, 14 nt, Homo sapiens
ccagagacugggac

SEQ ID NO: 2187847 - RNA, 22 nt, Homo sapiens
auaguggaggguugagauguag

SEQ ID NO: 2187848 - RNA, 20 nt, Homo sapiens
agucuuccaaaccaccuucc

SEQ ID NO: 2187849 - RNA, 21 nt, Homo sapiens
acaguacaggcagcacagaga

SEQ ID NO: 2187850 - RNA, 15 nt, Homo sapiens
aagcucagaauccaa

SEQ ID NO: 2187851 - RNA, 15 nt, Homo sapiens
agagggcccagccca

SEQ ID NO: 2187852 - RNA, 23 nt, Homo sapiens
cugacacaggccagccuuggcac

SEQ ID NO: 2187853 - RNA, 20 nt, Homo sapiens
cuuccugaguggccagggaa

SEQ ID NO: 2187854 - RNA, 15 nt, Homo sapiens
ugccccgaauuuagu

SEQ ID NO: 2187855 - RNA, 13 nt, Homo sapiens
cuuugagccucuu

SEQ ID NO: 2187856 - RNA, 17 nt, Homo sapiens
aauuuauauucauaaag

SEQ ID NO: 2187857 - RNA, 17 nt, Homo sapiens
uguuuaauuguacucaa

SEQ ID NO: 2187858 - RNA, 19 nt, Homo sapiens
auccuuaacacauucaaua

SEQ ID NO: 2187859 - RNA, 16 nt, Homo sapiens
uugucuuuacuccaug

SEQ ID NO: 2187860 - RNA, 21 nt, Homo sapiens
cgacuccugccugaguuucca

SEQ ID NO: 2187861 - RNA, 14 nt, Homo sapiens
guaacugaaggugu

SEQ ID NO: 2187862 - RNA, 12 nt, Homo sapiens
uagguugcugac

SEQ ID NO: 2187863 - RNA, 14 nt, Homo sapiens
agcauggaacacuu

SEQ ID NO: 2187864 - RNA, 14 nt, Homo sapiens
agacaugaaccaag

SEQ ID NO: 2187865 - RNA, 17 nt, Homo sapiens
guaacauagaugccugg

SEQ ID NO: 2187866 - RNA, 16 nt, Homo sapiens
caccugcuggagugaa

SEQ ID NO: 2187867 - RNA, 20 nt, Homo sapiens
aggaagcucagacugguuga

SEQ ID NO: 2187868 - RNA, 11 nt, Homo sapiens
aaguaccacac

SEQ ID NO: 2187869 - RNA, 21 nt, Homo sapiens
ccugugaucuccacaccaaag

SEQ ID NO: 2187870 - RNA, 20 nt, Homo sapiens
cgcugcaucccugcagcuca

SEQ ID NO: 2187871 - RNA, 14 nt, Homo sapiens
acagaagggcucuu

SEQ ID NO: 2187872 - RNA, 14 nt, Homo sapiens
gcuagccacuggaa

SEQ ID NO: 2187873 - RNA, 22 nt, Homo sapiens
augucuaaaauccugcuuaaaa

SEQ ID NO: 2187874 - RNA, 23 nt, Homo sapiens
cugccgggagacugccaguggag

SEQ ID NO: 2187875 - RNA, 16 nt, Homo sapiens
aauugcaguuuugccu

SEQ ID NO: 2187876 - RNA, 18 nt, Homo sapiens
gaauggagggcaacauuc

SEQ ID NO: 2187877 - RNA, 14 nt, Homo sapiens
caaugguugaauga

SEQ ID NO: 2187878 - RNA, 19 nt, Homo sapiens
guguuugggaugaccagga

SEQ ID NO: 2187879 - RNA, 13 nt, Homo sapiens
gugugugugauau

SEQ ID NO: 2187880 - RNA, 22 nt, Homo sapiens
cccuguuuacgguacuugguaa

SEQ ID NO: 2187881 - RNA, 21 nt, Homo sapiens
acucauuuaaauuaaauaagu

SEQ ID NO: 2187882 - RNA, 17 nt, Homo sapiens
uacgcucugcucaauga

SEQ ID NO: 2187883 - RNA, 18 nt, Homo sapiens
ggaggccuuccagcugcu

SEQ ID NO: 2187884 - RNA, 17 nt, Homo sapiens
gccgccaggacuguguu

SEQ ID NO: 2187885 - RNA, 13 nt, Homo sapiens
ugggugacaggau

SEQ ID NO: 2187886 - RNA, 16 nt, Homo sapiens
caaauauugcuauugu

SEQ ID NO: 2187887 - RNA, 23 nt, Homo sapiens
agaaggcaggagugcugcccucu

SEQ ID NO: 2187888 - RNA, 20 nt, Homo sapiens
caguguacucugaguccuca

SEQ ID NO: 2187889 - RNA, 19 nt, Homo sapiens
uggaccacuguuucuugcu

SEQ ID NO: 2187890 - RNA, 17 nt, Homo sapiens
gcaaucucuugcauuuc

SEQ ID NO: 2187891 - RNA, 13 nt, Homo sapiens
guggcacaggagu

SEQ ID NO: 2187892 - RNA, 21 nt, Homo sapiens
cuuuuagggaauaauauucaa

SEQ ID NO: 2187893 - RNA, 20 nt, Homo sapiens
uaagucaagaucaacauucc

SEQ ID NO: 2187894 - RNA, 20 nt, Homo sapiens
aaaaauaguguguccaugca

SEQ ID NO: 2187895 - RNA, 19 nt, Homo sapiens
caagaaagccucagccauu

SEQ ID NO: 2187896 - RNA, 14 nt, Homo sapiens
auggauugauucag

SEQ ID NO: 2187897 - RNA, 20 nt, Homo sapiens
cugggugcccaagcucagaa

SEQ ID NO: 2187898 - RNA, 17 nt, Homo sapiens
guacccagccaucugcc

SEQ ID NO: 2187899 - RNA, 16 nt, Homo sapiens
ccaacagcgacauagc

SEQ ID NO: 2187900 - RNA, 17 nt, Homo sapiens
aaaccuuccucuuccag

SEQ ID NO: 2187901 - RNA, 20 nt, Homo sapiens
caacaaacacauugugaaua

SEQ ID NO: 2187902 - RNA, 11 nt, Homo sapiens
uauaugaauga

SEQ ID NO: 2187903 - RNA, 15 nt, Homo sapiens
guaaacggucucuca

SEQ ID NO: 2187904 - RNA, 21 nt, Homo sapiens
uacaacugaguccuuaaacag

SEQ ID NO: 2187905 - RNA, 18 nt, Homo sapiens
guugucaacaaaccaagc

SEQ ID NO: 2187906 - RNA, 18 nt, Homo sapiens
cuggcugagguuccucug

SEQ ID NO: 2187907 - RNA, 18 nt, Homo sapiens
acuuucuuucuguaggug

SEQ ID NO: 2187908 - RNA, 23 nt, Homo sapiens
auuugugggcuuggggacagaaa

SEQ ID NO: 2187909 - RNA, 19 nt, Homo sapiens
ugacuucccuggucaccaa

SEQ ID NO: 2187910 - RNA, 20 nt, Homo sapiens
gcaggccgugugucugucag

SEQ ID NO: 2187911 - RNA, 16 nt, Homo sapiens
ugugugaugcugacac

SEQ ID NO: 2187912 - RNA, 19 nt, Homo sapiens
ccugcaucuuuagugcuuu

SEQ ID NO: 2187913 - RNA, 20 nt, Homo sapiens
cacaucagagugacauccag

SEQ ID NO: 2187914 - RNA, 20 nt, Homo sapiens
gaguuaaacuugaugccagu

SEQ ID NO: 2187915 - RNA, 15 nt, Homo sapiens
ggcaggaugggcacu

SEQ ID NO: 2187916 - RNA, 16 nt, Homo sapiens
ggcuaugacaugagca

SEQ ID NO: 2187917 - RNA, 15 nt, Homo sapiens
acaaccuaaauggag

SEQ ID NO: 2187918 - RNA, 15 nt, Homo sapiens
ugcacuauugcacau

SEQ ID NO: 2187919 - RNA, 15 nt, Homo sapiens
uugcaauuuugcaua

SEQ ID NO: 2187920 - RNA, 19 nt, Homo sapiens
cacgaagcacgaucagucc

SEQ ID NO: 2187921 - RNA, 14 nt, Homo sapiens
cuucuuuaaucaca

SEQ ID NO: 2187922 - RNA, 14 nt, Homo sapiens
aagcagaugcucug

SEQ ID NO: 2187923 - RNA, 13 nt, Homo sapiens
ucccuguucuggu

SEQ ID NO: 2187924 - RNA, 15 nt, Homo sapiens
auuuuuagaauuaaa

SEQ ID NO: 2187925 - RNA, 16 nt, Homo sapiens
cuguguaccucaugga

SEQ ID NO: 2187926 - RNA, 23 nt, Homo sapiens
agaaguugcugcuugugaucuca

SEQ ID NO: 2187927 - RNA, 12 nt, Homo sapiens
acauuagaauaa

SEQ ID NO: 2187928 - RNA, 13 nt, Homo sapiens
aaaacaguauuua

SEQ ID NO: 2187929 - RNA, 14 nt, Homo sapiens
acauuugcuggaga

SEQ ID NO: 2187930 - RNA, 17 nt, Homo sapiens
uaacaaccccggacaaa

SEQ ID NO: 2187931 - RNA, 23 nt, Homo sapiens
gaaagagcucuccagaagccaau

SEQ ID NO: 2187932 - RNA, 18 nt, Homo sapiens
uuagaggaagaaaaccag

SEQ ID NO: 2187933 - RNA, 12 nt, Homo sapiens
uucguaugcacu

SEQ ID NO: 2187934 - RNA, 19 nt, Homo sapiens
aacauaaguaagacuugau

SEQ ID NO: 2187935 - RNA, 15 nt, Homo sapiens
auuucugauucugau

SEQ ID NO: 2187936 - RNA, 19 nt, Homo sapiens
aagucauucaagagucuca

SEQ ID NO: 2187937 - RNA, 15 nt, Homo sapiens
aggacagugacccca

SEQ ID NO: 2187938 - RNA, 19 nt, Homo sapiens
uugaagagacaauagcauu

SEQ ID NO: 2187939 - RNA, 11 nt, Homo sapiens
aacaauaucaa

SEQ ID NO: 2187940 - RNA, 14 nt, Homo sapiens
ccuucacagugacc

SEQ ID NO: 2187941 - RNA, 17 nt, Homo sapiens
agaggaacuucugaacu

SEQ ID NO: 2187942 - RNA, 17 nt, Homo sapiens
ccagaucgcaccacugc

SEQ ID NO: 2187943 - RNA, 19 nt, Homo sapiens
ccauauccgggugcucaau

SEQ ID NO: 2187944 - RNA, 12 nt, Homo sapiens
auuaaugaugau

SEQ ID NO: 2187945 - RNA, 14 nt, Homo sapiens
uguucuccaacucc

SEQ ID NO: 2187946 - RNA, 18 nt, Homo sapiens
aaaauguuauuaugucaa

SEQ ID NO: 2187947 - RNA, 15 nt, Homo sapiens
uccauccugcagaua

SEQ ID NO: 2187948 - RNA, 15 nt, Homo sapiens
auguaaaaauacacu

SEQ ID NO: 2187949 - RNA, 22 nt, Homo sapiens
ccacccuuggaggcugucuucu

SEQ ID NO: 2187950 - RNA, 14 nt, Homo sapiens
aaaaucaacuguau

SEQ ID NO: 2187951 - RNA, 12 nt, Homo sapiens
gcuuagaugacg

SEQ ID NO: 2187952 - RNA, 16 nt, Homo sapiens
ugugccuguggcauga

SEQ ID NO: 2187953 - RNA, 14 nt, Homo sapiens
uauaguugcuaauu

SEQ ID NO: 2187954 - RNA, 17 nt, Homo sapiens
ccuuggucuuccauggg

SEQ ID NO: 2187955 - RNA, 13 nt, Homo sapiens
auugucagaaaag

SEQ ID NO: 2187956 - RNA, 18 nt, Homo sapiens
ugacauccaagcuuccuu

SEQ ID NO: 2187957 - RNA, 21 nt, Homo sapiens
agcaggaugugccuguggcau

SEQ ID NO: 2187958 - RNA, 13 nt, Homo sapiens
ccgcaagcagcug

SEQ ID NO: 2187959 - RNA, 15 nt, Homo sapiens
acuuuucugcugaua

SEQ ID NO: 2187960 - RNA, 13 nt, Homo sapiens
aacauauguccau

SEQ ID NO: 2187961 - RNA, 13 nt, Homo sapiens
gucuauacaauga

SEQ ID NO: 2187962 - RNA, 11 nt, Homo sapiens
agcauccaugu

SEQ ID NO: 2187963 - RNA, 15 nt, Homo sapiens
cugagggagcuccaa

SEQ ID NO: 2187964 - RNA, 14 nt, Homo sapiens
gaauaacuaugcca

SEQ ID NO: 2187965 - RNA, 13 nt, Homo sapiens
gugucuggcugca

SEQ ID NO: 2187966 - RNA, 15 nt, Homo sapiens
aucuacucauugucu

SEQ ID NO: 2187967 - RNA, 15 nt, Homo sapiens
accuacacacuguca

SEQ ID NO: 2187968 - RNA, 13 nt, Homo sapiens
caagguaacugua

SEQ ID NO: 2187969 - RNA, 13 nt, Homo sapiens
gcaucaaacauga

SEQ ID NO: 2187970 - RNA, 15 nt, Homo sapiens
uuggagaaaguauuu

SEQ ID NO: 2187971 - RNA, 23 nt, Homo sapiens
uagaaaaggguuucuugacaaug

SEQ ID NO: 2187972 - RNA, 16 nt, Homo sapiens
uacaaagauuaguuuc

SEQ ID NO: 2187973 - RNA, 22 nt, Homo sapiens
uuggaaaucaguugugaauaca

SEQ ID NO: 2187974 - RNA, 20 nt, Homo sapiens
gugcuaucgcaccacugugu

SEQ ID NO: 2187975 - RNA, 19 nt, Homo sapiens
agauguaucuaauucuccu

SEQ ID NO: 2187976 - RNA, 18 nt, Homo sapiens
ccugacacggacugugca

SEQ ID NO: 2187977 - RNA, 17 nt, Homo sapiens
gaacacaagcauuucac

SEQ ID NO: 2187978 - RNA, 14 nt, Homo sapiens
uaaugcucucaggg

SEQ ID NO: 2187979 - RNA, 14 nt, Homo sapiens
ugccagaagcuacu

SEQ ID NO: 2187980 - RNA, 12 nt, Homo sapiens
uggagagcugcu

SEQ ID NO: 2187981 - RNA, 14 nt, Homo sapiens
aaauuucaccacug

SEQ ID NO: 2187982 - RNA, 19 nt, Homo sapiens
agucccagaaugaccccau

SEQ ID NO: 2187983 - RNA, 16 nt, Homo sapiens
ugccaguuucccaaaa

SEQ ID NO: 2187984 - RNA, 11 nt, Homo sapiens
auauugcuaaa

SEQ ID NO: 2187985 - RNA, 11 nt, Homo sapiens
cucuugcucac

SEQ ID NO: 2187986 - RNA, 19 nt, Homo sapiens
cucugcgucgguccuggug

SEQ ID NO: 2187987 - RNA, 19 nt, Homo sapiens
gacaggaggaaucauguca

SEQ ID NO: 2187988 - RNA, 13 nt, Homo sapiens
auagaaaaaccaa

SEQ ID NO: 2187989 - RNA, 19 nt, Homo sapiens
ccggcaacaucucugggaa

SEQ ID NO: 2187990 - RNA, 19 nt, Homo sapiens
aaaagugccuuagcaugug

SEQ ID NO: 2187991 - RNA, 14 nt, Homo sapiens
gguguccauuuuau

SEQ ID NO: 2187992 - RNA, 17 nt, Homo sapiens
auagccacaaaugccuu

SEQ ID NO: 2187993 - RNA, 13 nt, Homo sapiens
gauagcaauguuc

SEQ ID NO: 2187994 - RNA, 19 nt, Homo sapiens
uuguaauaugucugccaca

SEQ ID NO: 2187995 - RNA, 18 nt, Homo sapiens
augcucaggcuacuauag

SEQ ID NO: 2187996 - RNA, 17 nt, Homo sapiens
caggagcacccaggcau

SEQ ID NO: 2187997 - RNA, 23 nt, Homo sapiens
gacaaaguguguaauuauguaaa

SEQ ID NO: 2187998 - RNA, 12 nt, Homo sapiens
auucauuccuca

SEQ ID NO: 2187999 - RNA, 14 nt, Homo sapiens
auuaaccuggugcu

SEQ ID NO: 2188000 - RNA, 16 nt, Homo sapiens
ggauauccuuucacuc

SEQ ID NO: 2188001 - RNA, 21 nt, Homo sapiens
cucaggccaagcccaauacag

SEQ ID NO: 2188002 - RNA, 14 nt, Homo sapiens
ggaccagguauaga

SEQ ID NO: 2188003 - RNA, 22 nt, Homo sapiens
augcugaaacaucauuacagau

SEQ ID NO: 2188004 - RNA, 21 nt, Homo sapiens
acaccugccuucaaagccacu

SEQ ID NO: 2188005 - RNA, 14 nt, Homo sapiens
agucacgccugaaa

SEQ ID NO: 2188006 - RNA, 13 nt, Homo sapiens
cagaauacauaca

SEQ ID NO: 2188007 - RNA, 21 nt, Homo sapiens
cagaauguauauuaaggugug

SEQ ID NO: 2188008 - RNA, 20 nt, Homo sapiens
ucugaggaguaaguguacaa

SEQ ID NO: 2188009 - RNA, 15 nt, Homo sapiens
ccugaccuccgcccc

SEQ ID NO: 2188010 - RNA, 18 nt, Homo sapiens
cugggccuguggugccug

SEQ ID NO: 2188011 - RNA, 15 nt, Homo sapiens
aggacaucaccauuu

SEQ ID NO: 2188012 - RNA, 14 nt, Homo sapiens
cgaggacccaugaa

SEQ ID NO: 2188013 - RNA, 15 nt, Homo sapiens
guaugcaugggaugu

SEQ ID NO: 2188014 - RNA, 17 nt, Homo sapiens
aauuuaagugacacaga

SEQ ID NO: 2188015 - RNA, 19 nt, Homo sapiens
agugcugagaaggacaccu

SEQ ID NO: 2188016 - RNA, 18 nt, Homo sapiens
ugaaagcuacgcagacaa

SEQ ID NO: 2188017 - RNA, 17 nt, Homo sapiens
cugcaaguuaugaaaua

SEQ ID NO: 2188018 - RNA, 13 nt, Homo sapiens
cuuaugauucaga

SEQ ID NO: 2188019 - RNA, 23 nt, Homo sapiens
aaacccaguggauggcugaaggu

SEQ ID NO: 2188020 - RNA, 22 nt, Homo sapiens
ccaauuucucucagauuuccac

SEQ ID NO: 2188021 - RNA, 18 nt, Homo sapiens
gaccaggggcaccggcug

SEQ ID NO: 2188022 - RNA, 15 nt, Homo sapiens
ccuagacccaggugg

SEQ ID NO: 2188023 - RNA, 21 nt, Homo sapiens
gcuggagauaacagccucuug

SEQ ID NO: 2188024 - RNA, 15 nt, Homo sapiens
uaguacccaccugag

SEQ ID NO: 2188025 - RNA, 16 nt, Homo sapiens
uggcuccuugcccuca

SEQ ID NO: 2188026 - RNA, 16 nt, Homo sapiens
cucagcuguccagcug

SEQ ID NO: 2188027 - RNA, 13 nt, Homo sapiens
acccaugccauag

SEQ ID NO: 2188028 - RNA, 13 nt, Homo sapiens
uagaaaccaccug

SEQ ID NO: 2188029 - RNA, 18 nt, Homo sapiens
gaacaagacccugucuca

SEQ ID NO: 2188030 - RNA, 14 nt, Homo sapiens
aucaugauaauuca

SEQ ID NO: 2188031 - RNA, 23 nt, Homo sapiens
uuccaggaguucugaagcugaca

SEQ ID NO: 2188032 - RNA, 19 nt, Homo sapiens
cuauaaucccagcacuuug

SEQ ID NO: 2188033 - RNA, 15 nt, Homo sapiens
auucagucucugugu

SEQ ID NO: 2188034 - RNA, 18 nt, Homo sapiens
cguuaccauuuacauguu

SEQ ID NO: 2188035 - RNA, 13 nt, Homo sapiens
uaccucagguugc

SEQ ID NO: 2188036 - RNA, 17 nt, Homo sapiens
aacagauuugugaacuc

SEQ ID NO: 2188037 - RNA, 21 nt, Homo sapiens
aggcucccuccccauggggca

SEQ ID NO: 2188038 - RNA, 18 nt, Homo sapiens
aacaguuaccugagagau

SEQ ID NO: 2188039 - RNA, 19 nt, Homo sapiens
ugcucccgaugcugcuaug

SEQ ID NO: 2188040 - RNA, 17 nt, Homo sapiens
uggacagucuggccacu

SEQ ID NO: 2188041 - RNA, 17 nt, Homo sapiens
cacuaguugugaauuua

SEQ ID NO: 2188042 - RNA, 15 nt, Homo sapiens
cuggaggcagggaac

SEQ ID NO: 2188043 - RNA, 21 nt, Homo sapiens
aacauccuuauucagccuuau

SEQ ID NO: 2188044 - RNA, 18 nt, Homo sapiens
cugccagauauugcccag

SEQ ID NO: 2188045 - RNA, 23 nt, Homo sapiens
gcuuggccuacagucaucugcca

SEQ ID NO: 2188046 - RNA, 16 nt, Homo sapiens
ccucuaaaacaguccu

SEQ ID NO: 2188047 - RNA, 22 nt, Homo sapiens
uuccuuugccaauucauuucuc

SEQ ID NO: 2188048 - RNA, 15 nt, Homo sapiens
aauacuguauugaau

SEQ ID NO: 2188049 - RNA, 21 nt, Homo sapiens
uacuguaugccggcuccuuca

SEQ ID NO: 2188050 - RNA, 20 nt, Homo sapiens
caagucaggaaugauugcug

SEQ ID NO: 2188051 - RNA, 13 nt, Homo sapiens
auuaaagucuaca

SEQ ID NO: 2188052 - RNA, 11 nt, Homo sapiens
auugcacuucu

SEQ ID NO: 2188053 - RNA, 19 nt, Homo sapiens
cagucacguguaaacagga

SEQ ID NO: 2188054 - RNA, 22 nt, Homo sapiens
ucauuucuaaauuuauauucau

SEQ ID NO: 2188055 - RNA, 23 nt, Homo sapiens
aguggcuuccaucucagcacucu

SEQ ID NO: 2188056 - RNA, 20 nt, Homo sapiens
ugugaaguaaaagagggacc

SEQ ID NO: 2188057 - RNA, 23 nt, Homo sapiens
ggagcccugaggaccucucagca

SEQ ID NO: 2188058 - RNA, 15 nt, Homo sapiens
ugagaaucaugcacu

SEQ ID NO: 2188059 - RNA, 18 nt, Homo sapiens
agauuagccuguagcuua

SEQ ID NO: 2188060 - RNA, 17 nt, Homo sapiens
uccccacgcccccaugc

SEQ ID NO: 2188061 - RNA, 17 nt, Homo sapiens
uacauacauacauauau

SEQ ID NO: 2188062 - RNA, 19 nt, Homo sapiens
ggcuggaggcugagcugca

SEQ ID NO: 2188063 - RNA, 20 nt, Homo sapiens
gcccccgagcugggggccau

SEQ ID NO: 2188064 - RNA, 19 nt, Homo sapiens
uccaggcuacaaucuucau

SEQ ID NO: 2188065 - RNA, 14 nt, Homo sapiens
aagcauuuacuuug

SEQ ID NO: 2188066 - RNA, 16 nt, Homo sapiens
agcugauuccagaaca

SEQ ID NO: 2188067 - RNA, 19 nt, Homo sapiens
acgcuuuuuuggaucagcu

SEQ ID NO: 2188068 - RNA, 23 nt, Homo sapiens
ucugcacuuauaagaaagaucaa

SEQ ID NO: 2188069 - RNA, 11 nt, Homo sapiens
gccaguauuuu

SEQ ID NO: 2188070 - RNA, 14 nt, Homo sapiens
acagguagugggcu

SEQ ID NO: 2188071 - RNA, 23 nt, Homo sapiens
auuacaggugugacccacugcgc

SEQ ID NO: 2188072 - RNA, 17 nt, Homo sapiens
cuugagauauaaaggaa

SEQ ID NO: 2188073 - RNA, 17 nt, Homo sapiens
aaaacaaacaugcagua

SEQ ID NO: 2188074 - RNA, 12 nt, Homo sapiens
uauggugcucag

SEQ ID NO: 2188075 - RNA, 14 nt, Homo sapiens
aggauguaugugua

SEQ ID NO: 2188076 - RNA, 11 nt, Homo sapiens
ccgugaacugg

SEQ ID NO: 2188077 - RNA, 19 nt, Homo sapiens
caagcacuuuauauuuucc

SEQ ID NO: 2188078 - RNA, 18 nt, Homo sapiens
gccuggagcuaauggcga

SEQ ID NO: 2188079 - RNA, 16 nt, Homo sapiens
uagcgcucucuuccag

SEQ ID NO: 2188080 - RNA, 18 nt, Homo sapiens
uuuauuauuaacaaaaca

SEQ ID NO: 2188081 - RNA, 21 nt, Homo sapiens
cuggcugcggggcgggcacac

SEQ ID NO: 2188082 - RNA, 22 nt, Homo sapiens
gauucagggccccugaagugac

SEQ ID NO: 2188083 - RNA, 16 nt, Homo sapiens
cgaacuccugaccuca

SEQ ID NO: 2188084 - RNA, 20 nt, Homo sapiens
gaaaauguaaggauucugga

SEQ ID NO: 2188085 - RNA, 17 nt, Homo sapiens
ucgcucgaugacuguga

SEQ ID NO: 2188086 - RNA, 13 nt, Homo sapiens
uauagcuucagga

SEQ ID NO: 2188087 - RNA, 22 nt, Homo sapiens
cugguaauauugacuuguauau

SEQ ID NO: 2188088 - RNA, 21 nt, Homo sapiens
cacucaggccaacaagccaac

SEQ ID NO: 2188089 - RNA, 14 nt, Homo sapiens
acacagaugaaggu

SEQ ID NO: 2188090 - RNA, 16 nt, Homo sapiens
agcuuggggccaggga

SEQ ID NO: 2188091 - RNA, 20 nt, Homo sapiens
caguuccaauacuucauuaa

SEQ ID NO: 2188092 - RNA, 16 nt, Homo sapiens
cugaacuacacugcau

SEQ ID NO: 2188093 - RNA, 22 nt, Homo sapiens
gaagagguuuuaaagcuuccau

SEQ ID NO: 2188094 - RNA, 18 nt, Homo sapiens
caauuucccauuuuggaa

SEQ ID NO: 2188095 - RNA, 14 nt, Homo sapiens
cugauggugucauc

SEQ ID NO: 2188096 - RNA, 23 nt, Homo sapiens
uuuaaauuuuuuaagcaacugga

SEQ ID NO: 2188097 - RNA, 16 nt, Homo sapiens
cagugcauguugccau

SEQ ID NO: 2188098 - RNA, 17 nt, Homo sapiens
acucaaccucuacaggg

SEQ ID NO: 2188099 - RNA, 18 nt, Homo sapiens
auucaggugcagaggaag

SEQ ID NO: 2188100 - RNA, 16 nt, Homo sapiens
cccauguuacuucucu

SEQ ID NO: 2188101 - RNA, 20 nt, Homo sapiens
agaaaccaagagaaguuuug

SEQ ID NO: 2188102 - RNA, 18 nt, Homo sapiens
aauauugacucaaaccau

SEQ ID NO: 2188103 - RNA, 22 nt, Homo sapiens
uaaauuccacacuaccacauua

SEQ ID NO: 2188104 - RNA, 16 nt, Homo sapiens
agccugcagucacugg

SEQ ID NO: 2188105 - RNA, 20 nt, Homo sapiens
ccauaaccucuauaucuuua

SEQ ID NO: 2188106 - RNA, 23 nt, Homo sapiens
auugggaaaggacagcuuugaua

SEQ ID NO: 2188107 - RNA, 18 nt, Homo sapiens
ucaccuagggaagcacuu

SEQ ID NO: 2188108 - RNA, 14 nt, Homo sapiens
uggcucucagagga

SEQ ID NO: 2188109 - RNA, 18 nt, Homo sapiens
caaacuccugaccucagg

SEQ ID NO: 2188110 - RNA, 16 nt, Homo sapiens
acugggaagaugcugg

SEQ ID NO: 2188111 - RNA, 16 nt, Homo sapiens
uggcaggcuacucugc

SEQ ID NO: 2188112 - RNA, 13 nt, Homo sapiens
ugccucaugccug

SEQ ID NO: 2188113 - RNA, 13 nt, Homo sapiens
cccccucccugga

SEQ ID NO: 2188114 - RNA, 16 nt, Homo sapiens
auuccuugggacucag

SEQ ID NO: 2188115 - RNA, 16 nt, Homo sapiens
gcagccgugcaggacu

SEQ ID NO: 2188116 - RNA, 21 nt, Homo sapiens
ucuucacuucuaaaugcauau

SEQ ID NO: 2188117 - RNA, 21 nt, Homo sapiens
gagcuguguccugcaguuccc

SEQ ID NO: 2188118 - RNA, 19 nt, Homo sapiens
agaugaggugcucaauuaa

SEQ ID NO: 2188119 - RNA, 18 nt, Homo sapiens
cugaaggcugaguguccg

SEQ ID NO: 2188120 - RNA, 17 nt, Homo sapiens
uggaaaaguguuaggga

SEQ ID NO: 2188121 - RNA, 16 nt, Homo sapiens
gaccaccacauugaga

SEQ ID NO: 2188122 - RNA, 18 nt, Homo sapiens
ccacuggcuucacauucu

SEQ ID NO: 2188123 - RNA, 19 nt, Homo sapiens
cauauucuuuaaauuucau

SEQ ID NO: 2188124 - RNA, 21 nt, Homo sapiens
cccaaaggucuaucuacuaaa

SEQ ID NO: 2188125 - RNA, 21 nt, Homo sapiens
ugacagccuccgucagacucc

SEQ ID NO: 2188126 - RNA, 15 nt, Homo sapiens
uugcugcugugaauc

SEQ ID NO: 2188127 - RNA, 14 nt, Homo sapiens
cacacauaguuucu

SEQ ID NO: 2188128 - RNA, 20 nt, Homo sapiens
gagaucgugcuacugcacuc

SEQ ID NO: 2188129 - RNA, 14 nt, Homo sapiens
ucuccacauuccaa

SEQ ID NO: 2188130 - RNA, 22 nt, Homo sapiens
cagggaaagucuuagcugagaa

SEQ ID NO: 2188131 - RNA, 20 nt, Homo sapiens
cucugcagacucguucucgu

SEQ ID NO: 2188132 - RNA, 14 nt, Homo sapiens
acuccauacauaac

SEQ ID NO: 2188133 - RNA, 19 nt, Homo sapiens
agcauuuacuaugccacag

SEQ ID NO: 2188134 - RNA, 16 nt, Homo sapiens
agaguuccaugaacac

SEQ ID NO: 2188135 - RNA, 17 nt, Homo sapiens
agaagaagcuaccucag

SEQ ID NO: 2188136 - RNA, 20 nt, Homo sapiens
ccugagcgugcuuuccaaaa

SEQ ID NO: 2188137 - RNA, 17 nt, Homo sapiens
cauguuuuucuucuccc

SEQ ID NO: 2188138 - RNA, 14 nt, Homo sapiens
aauaaagucuuucc

SEQ ID NO: 2188139 - RNA, 15 nt, Homo sapiens
auaacgcaggccuuu

SEQ ID NO: 2188140 - RNA, 17 nt, Homo sapiens
caucuguauaaacacaa

SEQ ID NO: 2188141 - RNA, 13 nt, Homo sapiens
augagaaugugac

SEQ ID NO: 2188142 - RNA, 14 nt, Homo sapiens
uacugaaaacaauu

SEQ ID NO: 2188143 - RNA, 14 nt, Homo sapiens
caguggaggugcug

SEQ ID NO: 2188144 - RNA, 16 nt, Homo sapiens
cccggggugaguccau

SEQ ID NO: 2188145 - RNA, 19 nt, Homo sapiens
uaaaauuugcacacaaaac

SEQ ID NO: 2188146 - RNA, 21 nt, Homo sapiens
gacagugcacaugaacugucu

SEQ ID NO: 2188147 - RNA, 17 nt, Homo sapiens
aaggccguguuucagcc

SEQ ID NO: 2188148 - RNA, 22 nt, Homo sapiens
uaggacagcauauaaauguaau

SEQ ID NO: 2188149 - RNA, 21 nt, Homo sapiens
cuacacgguucaaaccuguga

SEQ ID NO: 2188150 - RNA, 14 nt, Homo sapiens
cacuauuuccauug

SEQ ID NO: 2188151 - RNA, 23 nt, Homo sapiens
uccagaaaaaugaaaagcaauac

SEQ ID NO: 2188152 - RNA, 20 nt, Homo sapiens
gaaucccacccacaugugac

SEQ ID NO: 2188153 - RNA, 18 nt, Homo sapiens
gcugacuagaagggccag

SEQ ID NO: 2188154 - RNA, 17 nt, Homo sapiens
uuaucaccaggauuuau

SEQ ID NO: 2188155 - RNA, 21 nt, Homo sapiens
aauaguugguuucaaauccuu

SEQ ID NO: 2188156 - RNA, 19 nt, Homo sapiens
cuucuguuaacugaagccu

SEQ ID NO: 2188157 - RNA, 21 nt, Homo sapiens
acagacuggcaauaaacuccu

SEQ ID NO: 2188158 - RNA, 15 nt, Homo sapiens
ggaaaacuaccugua

SEQ ID NO: 2188159 - RNA, 20 nt, Homo sapiens
guacuugugaaacacagcug

SEQ ID NO: 2188160 - RNA, 21 nt, Homo sapiens
uaaaacagguagaauuaucua

SEQ ID NO: 2188161 - RNA, 22 nt, Homo sapiens
ggcaaguagcaggacuaggcau

SEQ ID NO: 2188162 - RNA, 15 nt, Homo sapiens
guucucacauaacag

SEQ ID NO: 2188163 - RNA, 17 nt, Homo sapiens
uucauaccuacauguau

SEQ ID NO: 2188164 - RNA, 22 nt, Homo sapiens
cuggaguugcauugauucagua

SEQ ID NO: 2188165 - RNA, 22 nt, Homo sapiens
caaggaauccauccugcaaagg

SEQ ID NO: 2188166 - RNA, 17 nt, Homo sapiens
cauucugcaacccgguu

SEQ ID NO: 2188167 - RNA, 15 nt, Homo sapiens
ggacguuagacuguu

SEQ ID NO: 2188168 - RNA, 15 nt, Homo sapiens
cuguucacuuuucaa

SEQ ID NO: 2188169 - RNA, 19 nt, Homo sapiens
acugcugugggcugcucac

SEQ ID NO: 2188170 - RNA, 21 nt, Homo sapiens
aaauuaucuugauacauucaa

SEQ ID NO: 2188171 - RNA, 20 nt, Homo sapiens
cacuaauaauaguacuauua

SEQ ID NO: 2188172 - RNA, 21 nt, Homo sapiens
uagauguagucuugacgaaua

SEQ ID NO: 2188173 - RNA, 22 nt, Homo sapiens
acuaucgaaaugacgguguuaa

SEQ ID NO: 2188174 - RNA, 20 nt, Homo sapiens
gccuaggugggagccaccac

SEQ ID NO: 2188175 - RNA, 12 nt, Homo sapiens
aacuacuaaagu

SEQ ID NO: 2188176 - RNA, 15 nt, Homo sapiens
uugcuuaaugccaga

SEQ ID NO: 2188177 - RNA, 13 nt, Homo sapiens
uaagaaguaagca

SEQ ID NO: 2188178 - RNA, 23 nt, Homo sapiens
acaguuaucauuaucaucaucau

SEQ ID NO: 2188179 - RNA, 15 nt, Homo sapiens
caaauacaugcacag

SEQ ID NO: 2188180 - RNA, 14 nt, Homo sapiens
aaaugagugcuuaa

SEQ ID NO: 2188181 - RNA, 16 nt, Homo sapiens
aaaaugagugcuuaaa

SEQ ID NO: 2188182 - RNA, 11 nt, Homo sapiens
guacuguuacu

SEQ ID NO: 2188183 - RNA, 18 nt, Homo sapiens
caccagcccugaccccag

SEQ ID NO: 2188184 - RNA, 13 nt, Homo sapiens
aauuguaaugcau

SEQ ID NO: 2188185 - RNA, 16 nt, Homo sapiens
caguugccuccagggc

SEQ ID NO: 2188186 - RNA, 14 nt, Homo sapiens
cugauuguuuucau

SEQ ID NO: 2188187 - RNA, 16 nt, Homo sapiens
accuucaucagaccac

SEQ ID NO: 2188188 - RNA, 16 nt, Homo sapiens
accuccuucagaucuc

SEQ ID NO: 2188189 - RNA, 22 nt, Homo sapiens
uucuuucaucucccuccuccag

SEQ ID NO: 2188190 - RNA, 20 nt, Homo sapiens
cuguaacuuccaaauaaaua

SEQ ID NO: 2188191 - RNA, 15 nt, Homo sapiens
agcaucucacugcaa

SEQ ID NO: 2188192 - RNA, 22 nt, Homo sapiens
aauugaaaacacacucaaaaga

SEQ ID NO: 2188193 - RNA, 12 nt, Homo sapiens
acaaaugggaau

SEQ ID NO: 2188194 - RNA, 18 nt, Homo sapiens
gacgagcaugagcuggau

SEQ ID NO: 2188195 - RNA, 12 nt, Homo sapiens
ucuauucuagcc

SEQ ID NO: 2188196 - RNA, 12 nt, Homo sapiens
acucuucuugca

SEQ ID NO: 2188197 - RNA, 19 nt, Homo sapiens
ggaaaggugacuuccucug

SEQ ID NO: 2188198 - RNA, 16 nt, Homo sapiens
uauaauguaagcucua

SEQ ID NO: 2188199 - RNA, 19 nt, Homo sapiens
gacggagagauauaaaggu

SEQ ID NO: 2188200 - RNA, 16 nt, Homo sapiens
uauucaaguaacacuu

SEQ ID NO: 2188201 - RNA, 19 nt, Homo sapiens
guuauagguaaaaucucug

SEQ ID NO: 2188202 - RNA, 14 nt, Homo sapiens
uacuaucuuuucau

SEQ ID NO: 2188203 - RNA, 13 nt, Homo sapiens
aaggcauuucaua

SEQ ID NO: 2188204 - RNA, 21 nt, Homo sapiens
ugaaguagacucauucuucac

SEQ ID NO: 2188205 - RNA, 14 nt, Homo sapiens
caaauacuauccaa

SEQ ID NO: 2188206 - RNA, 21 nt, Homo sapiens
auuuauuucuuucuauucuug

SEQ ID NO: 2188207 - RNA, 23 nt, Homo sapiens
gguuuuuauguaaaacauuuuua

SEQ ID NO: 2188208 - RNA, 20 nt, Homo sapiens
auaagccacuuccccacaaa

SEQ ID NO: 2188209 - RNA, 12 nt, Homo sapiens
agcuguucucug

SEQ ID NO: 2188210 - RNA, 24 nt, Homo sapiens
cauauauaauuuuauugcuggaau

SEQ ID NO: 2188211 - RNA, 12 nt, Homo sapiens
guauuuuugcca

SEQ ID NO: 2188212 - RNA, 17 nt, Homo sapiens
cccggcugucaaggggu

SEQ ID NO: 2188213 - RNA, 13 nt, Homo sapiens
uuagccugugcug

SEQ ID NO: 2188214 - RNA, 19 nt, Homo sapiens
ccgauucuuucagauugcu

SEQ ID NO: 2188215 - RNA, 22 nt, Homo sapiens
guguacacggaggucucuguaa

SEQ ID NO: 2188216 - RNA, 21 nt, Homo sapiens
gaacuaaaaauuaaaaccucu

SEQ ID NO: 2188217 - RNA, 22 nt, Homo sapiens
gcccuaacuccuauaaagugcc

SEQ ID NO: 2188218 - RNA, 13 nt, Homo sapiens
accagcaagaaua

SEQ ID NO: 2188219 - RNA, 16 nt, Homo sapiens
caacuaaaaacaaacc

SEQ ID NO: 2188220 - RNA, 16 nt, Homo sapiens
cuaauuccauccauaa

SEQ ID NO: 2188221 - RNA, 18 nt, Homo sapiens
gggcgaucgcggcggagc

SEQ ID NO: 2188222 - RNA, 20 nt, Homo sapiens
gcuugugugcaaaagcagug

SEQ ID NO: 2188223 - RNA, 22 nt, Homo sapiens
cccagccccucucccugugcug

SEQ ID NO: 2188224 - RNA, 21 nt, Homo sapiens
uuucugggagacagaaaacau

SEQ ID NO: 2188225 - RNA, 16 nt, Homo sapiens
ugcaacuucuaccucc

SEQ ID NO: 2188226 - RNA, 13 nt, Homo sapiens
acucccugccaac

SEQ ID NO: 2188227 - RNA, 13 nt, Homo sapiens
acucacugccaaa

SEQ ID NO: 2188228 - RNA, 15 nt, Homo sapiens
uaugaaaagcuaucu

SEQ ID NO: 2188229 - RNA, 19 nt, Homo sapiens
aggauaaggaggcacugcu

SEQ ID NO: 2188230 - RNA, 20 nt, Homo sapiens
agguguaccaggaaaggauu

SEQ ID NO: 2188231 - RNA, 23 nt, Homo sapiens
caacaccuaggucgccagugaaa

SEQ ID NO: 2188232 - RNA, 14 nt, Homo sapiens
aucaguuggaguuu

SEQ ID NO: 2188233 - RNA, 20 nt, Homo sapiens
ccaggcugcagugcaauggc

SEQ ID NO: 2188234 - RNA, 15 nt, Homo sapiens
aagcguuugcacaga

SEQ ID NO: 2188235 - RNA, 16 nt, Homo sapiens
cagcccccacugaccu

SEQ ID NO: 2188236 - RNA, 18 nt, Homo sapiens
cugcauuuuguagccucu

SEQ ID NO: 2188237 - RNA, 16 nt, Homo sapiens
acguauaauauguaca

SEQ ID NO: 2188238 - RNA, 18 nt, Homo sapiens
ucagaacacucaaagguu

SEQ ID NO: 2188239 - RNA, 13 nt, Homo sapiens
uccacucugccau

SEQ ID NO: 2188240 - RNA, 13 nt, Homo sapiens
uucacucugucau

SEQ ID NO: 2188241 - RNA, 18 nt, Homo sapiens
uguucgcaauuaugcuuu

SEQ ID NO: 2188242 - RNA, 19 nt, Homo sapiens
ccagaccuguucugaccuc

SEQ ID NO: 2188243 - RNA, 20 nt, Homo sapiens
auaaaaauuacauaauucaa

SEQ ID NO: 2188244 - RNA, 21 nt, Homo sapiens
ugucauccucaugcugcucaa

SEQ ID NO: 2188245 - RNA, 17 nt, Homo sapiens
cuaaugauacuuacaag

SEQ ID NO: 2188246 - RNA, 22 nt, Homo sapiens
aaguccuacuuuuaaagaauuu

SEQ ID NO: 2188247 - RNA, 15 nt, Homo sapiens
caaguguacaugugu

SEQ ID NO: 2188248 - RNA, 11 nt, Homo sapiens
aacaugcacaa

SEQ ID NO: 2188249 - RNA, 11 nt, Homo sapiens
aaaaugcacac

SEQ ID NO: 2188250 - RNA, 16 nt, Homo sapiens
ugccuuuugcaaccag

SEQ ID NO: 2188251 - RNA, 22 nt, Homo sapiens
aguagcugggaccacaggcaug

SEQ ID NO: 2188252 - RNA, 15 nt, Homo sapiens
aggcucgagcaugcc

SEQ ID NO: 2188253 - RNA, 22 nt, Homo sapiens
ggaaccacgucugcuaacuugg

SEQ ID NO: 2188254 - RNA, 17 nt, Homo sapiens
acaggagcguguacuac

SEQ ID NO: 2188255 - RNA, 20 nt, Homo sapiens
aacuauaaauauguacaauu

SEQ ID NO: 2188256 - RNA, 16 nt, Homo sapiens
ugaaauucucagaauu

SEQ ID NO: 2188257 - RNA, 16 nt, Homo sapiens
ggaaagagacugucau

SEQ ID NO: 2188258 - RNA, 19 nt, Homo sapiens
gugaugcuuuaugcaacua

SEQ ID NO: 2188259 - RNA, 22 nt, Homo sapiens
guuuaaaaaucaguuuguuguu

SEQ ID NO: 2188260 - RNA, 19 nt, Homo sapiens
cuccucuggggaagggaac

SEQ ID NO: 2188261 - RNA, 15 nt, Homo sapiens
uuuaaaaggcuccca

SEQ ID NO: 2188262 - RNA, 19 nt, Homo sapiens
caggaguacaccccaacag

SEQ ID NO: 2188263 - RNA, 16 nt, Homo sapiens
auccuaacaagccuug

SEQ ID NO: 2188264 - RNA, 17 nt, Homo sapiens
aagcacccacugugcac

SEQ ID NO: 2188265 - RNA, 20 nt, Homo sapiens
uaucuuuugaauucuugaua

SEQ ID NO: 2188266 - RNA, 16 nt, Homo sapiens
aaggcaggaggaucac

SEQ ID NO: 2188267 - RNA, 21 nt, Homo sapiens
gaaccauguggauaacuuuac

SEQ ID NO: 2188268 - RNA, 19 nt, Homo sapiens
gcaaaccucuccuuccuca

SEQ ID NO: 2188269 - RNA, 18 nt, Homo sapiens
uauguuuacuauugcucu

SEQ ID NO: 2188270 - RNA, 17 nt, Homo sapiens
uucucucuuaguaacau

SEQ ID NO: 2188271 - RNA, 12 nt, Homo sapiens
auaaagcacaga

SEQ ID NO: 2188272 - RNA, 14 nt, Homo sapiens
cucagcagccagcu

SEQ ID NO: 2188273 - RNA, 15 nt, Homo sapiens
uccaaaccucaauaa

SEQ ID NO: 2188274 - RNA, 17 nt, Homo sapiens
ucaccauguacauagcu

SEQ ID NO: 2188275 - RNA, 17 nt, Homo sapiens
uuuccaucucugguaaa

SEQ ID NO: 2188276 - RNA, 13 nt, Homo sapiens
gucucugaacugc

SEQ ID NO: 2188277 - RNA, 19 nt, Homo sapiens
cuguuuuugucuacacucu

SEQ ID NO: 2188278 - RNA, 18 nt, Homo sapiens
agacaguauuuugacaaa

SEQ ID NO: 2188279 - RNA, 16 nt, Homo sapiens
caggugccaucaucuc

SEQ ID NO: 2188280 - RNA, 19 nt, Homo sapiens
ucuuaacaaucaaaucugg

SEQ ID NO: 2188281 - RNA, 18 nt, Homo sapiens
acauuucuaacuaaggac

SEQ ID NO: 2188282 - RNA, 23 nt, Homo sapiens
gcuauaccugggcauacuaauaa

SEQ ID NO: 2188283 - RNA, 13 nt, Homo sapiens
ucuugcauugcaa

SEQ ID NO: 2188284 - RNA, 13 nt, Homo sapiens
uguccccaacagg

SEQ ID NO: 2188285 - RNA, 23 nt, Homo sapiens
aagaacuucaugggccuuccaua

SEQ ID NO: 2188286 - RNA, 20 nt, Homo sapiens
aguagccgcugggguguuaa

SEQ ID NO: 2188287 - RNA, 16 nt, Homo sapiens
acacuaguagagcaaa

SEQ ID NO: 2188288 - RNA, 19 nt, Homo sapiens
cuggcacugaauuaaucau

SEQ ID NO: 2188289 - RNA, 16 nt, Homo sapiens
cauuuauguguagaau

SEQ ID NO: 2188290 - RNA, 13 nt, Homo sapiens
ggcaggauccaag

SEQ ID NO: 2188291 - RNA, 18 nt, Homo sapiens
cguccuugugccagguca

SEQ ID NO: 2188292 - RNA, 15 nt, Homo sapiens
caauaagaaacaguu

SEQ ID NO: 2188293 - RNA, 20 nt, Homo sapiens
cuaccccaaaguuugcucaa

SEQ ID NO: 2188294 - RNA, 15 nt, Homo sapiens
cagauggugcugcua

SEQ ID NO: 2188295 - RNA, 16 nt, Homo sapiens
uauauuuuuuugcaag

SEQ ID NO: 2188296 - RNA, 23 nt, Homo sapiens
ccagcuucccgaguaccagugac

SEQ ID NO: 2188297 - RNA, 15 nt, Homo sapiens
auacacacuuuccaa

SEQ ID NO: 2188298 - RNA, 17 nt, Homo sapiens
gguagagucauguuugc

SEQ ID NO: 2188299 - RNA, 21 nt, Homo sapiens
caucuuccaacccacuggccc

SEQ ID NO: 2188300 - RNA, 19 nt, Homo sapiens
uuuucaaaugucagcuuaa

SEQ ID NO: 2188301 - RNA, 21 nt, Homo sapiens
caguauuguagaaagcuaaua

SEQ ID NO: 2188302 - RNA, 15 nt, Homo sapiens
ggugcgcucagagac

SEQ ID NO: 2188303 - RNA, 22 nt, Homo sapiens
acaauugacaacaguuacauaa

SEQ ID NO: 2188304 - RNA, 14 nt, Homo sapiens
guccuagcacagau

SEQ ID NO: 2188305 - RNA, 17 nt, Homo sapiens
agcaugaagacccugga

SEQ ID NO: 2188306 - RNA, 15 nt, Homo sapiens
gcuguggccagggug

SEQ ID NO: 2188307 - RNA, 19 nt, Homo sapiens
ugagaaaccuauauuucaa

SEQ ID NO: 2188308 - RNA, 16 nt, Homo sapiens
auguccucagcauuuc

SEQ ID NO: 2188309 - RNA, 22 nt, Homo sapiens
gccucugcggggcagggccuuc

SEQ ID NO: 2188310 - RNA, 17 nt, Homo sapiens
ccucucauuugcaguca

SEQ ID NO: 2188311 - RNA, 22 nt, Homo sapiens
ugucaaugcuauggacugcaca

SEQ ID NO: 2188312 - RNA, 13 nt, Homo sapiens
gcaagaggaugaa

SEQ ID NO: 2188313 - RNA, 23 nt, Homo sapiens
gucuucuaaauuugaaauauaau

SEQ ID NO: 2188314 - RNA, 22 nt, Homo sapiens
gauccaguuuccggaaacaaaa

SEQ ID NO: 2188315 - RNA, 23 nt, Homo sapiens
ucaagagacaugguauugacuca

SEQ ID NO: 2188316 - RNA, 15 nt, Homo sapiens
uuuugacacugguau

SEQ ID NO: 2188317 - RNA, 20 nt, Homo sapiens
cagacacuauguagucuguu

SEQ ID NO: 2188318 - RNA, 14 nt, Homo sapiens
gcucuucagcacca

SEQ ID NO: 2188319 - RNA, 20 nt, Homo sapiens
caauaacuuuucaccaauga

SEQ ID NO: 2188320 - RNA, 23 nt, Homo sapiens
uuuagggaaaaaaaacaggagga

SEQ ID NO: 2188321 - RNA, 19 nt, Homo sapiens
uggcucccaaauuccauca

SEQ ID NO: 2188322 - RNA, 21 nt, Homo sapiens
augucuucauuggcuauauaa

SEQ ID NO: 2188323 - RNA, 23 nt, Homo sapiens
ucugcaauaugaauucaagaaag

SEQ ID NO: 2188324 - RNA, 21 nt, Homo sapiens
gucuuccugaguggugccaaa

SEQ ID NO: 2188325 - RNA, 14 nt, Homo sapiens
guaaaugcuccauu

SEQ ID NO: 2188326 - RNA, 18 nt, Homo sapiens
uauuaaugaacugugaca

SEQ ID NO: 2188327 - RNA, 15 nt, Homo sapiens
aaagugacaugcauu

SEQ ID NO: 2188328 - RNA, 19 nt, Homo sapiens
ccaguacucccugcuaaag

SEQ ID NO: 2188329 - RNA, 15 nt, Homo sapiens
ggaaucuugcuccaa

SEQ ID NO: 2188330 - RNA, 21 nt, Homo sapiens
acaaacacugccauauugugu

SEQ ID NO: 2188331 - RNA, 20 nt, Homo sapiens
agccuagauaugaagaaucu

SEQ ID NO: 2188332 - RNA, 23 nt, Homo sapiens
uaugauaaauauaacaucuauga

SEQ ID NO: 2188333 - RNA, 13 nt, Homo sapiens
gcggcagggccag

SEQ ID NO: 2188334 - RNA, 21 nt, Homo sapiens
uucuguuggaugacuuugaga

SEQ ID NO: 2188335 - RNA, 17 nt, Homo sapiens
augcugugauaccuuag

SEQ ID NO: 2188336 - RNA, 13 nt, Homo sapiens
guguuugugcuga

SEQ ID NO: 2188337 - RNA, 19 nt, Homo sapiens
guuuaaaguacugagcagu

SEQ ID NO: 2188338 - RNA, 22 nt, Homo sapiens
ggcagauaucuauggcagcaca

SEQ ID NO: 2188339 - RNA, 13 nt, Homo sapiens
ccugcaccuccca

SEQ ID NO: 2188340 - RNA, 16 nt, Homo sapiens
guucauauuaugucau

SEQ ID NO: 2188341 - RNA, 22 nt, Homo sapiens
gacaagagaugggaaugaggug

SEQ ID NO: 2188342 - RNA, 23 nt, Homo sapiens
uucagagagcagcuuuaaacuca

SEQ ID NO: 2188343 - RNA, 23 nt, Homo sapiens
cccacagagucuguguguagcca

SEQ ID NO: 2188344 - RNA, 19 nt, Homo sapiens
guaacugugccaguucuuu

SEQ ID NO: 2188345 - RNA, 13 nt, Homo sapiens
uggaccagccugu

SEQ ID NO: 2188346 - RNA, 17 nt, Homo sapiens
gcauacugccuuguuua

SEQ ID NO: 2188347 - RNA, 17 nt, Homo sapiens
agccucacaaucccaca

SEQ ID NO: 2188348 - RNA, 16 nt, Homo sapiens
uccacaguguucauuu

SEQ ID NO: 2188349 - RNA, 15 nt, Homo sapiens
gucacccaaacacuu

SEQ ID NO: 2188350 - RNA, 17 nt, Homo sapiens
gcacugagaaagccaau

SEQ ID NO: 2188351 - RNA, 17 nt, Homo sapiens
uacuguauggaaacacu

SEQ ID NO: 2188352 - RNA, 18 nt, Homo sapiens
ugcagaauccaaaguaaa

SEQ ID NO: 2188353 - RNA, 15 nt, Homo sapiens
aguugucaguauuau

SEQ ID NO: 2188354 - RNA, 19 nt, Homo sapiens
uuuaguccacccaauggcu

SEQ ID NO: 2188355 - RNA, 13 nt, Homo sapiens
cuucacaguguuu

SEQ ID NO: 2188356 - RNA, 17 nt, Homo sapiens
gaugcacuucaaauuca

SEQ ID NO: 2188357 - RNA, 16 nt, Homo sapiens
cugcuauaacuaugac

SEQ ID NO: 2188358 - RNA, 17 nt, Homo sapiens
ugcccaguaucauacgu

SEQ ID NO: 2188359 - RNA, 15 nt, Homo sapiens
uucacagucacugau

SEQ ID NO: 2188360 - RNA, 19 nt, Homo sapiens
uguagucccagcacuuugg

SEQ ID NO: 2188361 - RNA, 22 nt, Homo sapiens
uccugcaaagucuccagaagaa

SEQ ID NO: 2188362 - RNA, 20 nt, Homo sapiens
ccaguuuugucaaugcaguu

SEQ ID NO: 2188363 - RNA, 19 nt, Homo sapiens
aaacauaauaucuugaaga

SEQ ID NO: 2188364 - RNA, 13 nt, Homo sapiens
cagaccuccaggu

SEQ ID NO: 2188365 - RNA, 13 nt, Homo sapiens
gcccauucuugag

SEQ ID NO: 2188366 - RNA, 13 nt, Homo sapiens
gcccguucuugaa

SEQ ID NO: 2188367 - RNA, 23 nt, Homo sapiens
uucuaaaauuuggggggucuugc

SEQ ID NO: 2188368 - RNA, 16 nt, Homo sapiens
ucacucagaagacaca

SEQ ID NO: 2188369 - RNA, 18 nt, Homo sapiens
ccaacaugugcucaggga

SEQ ID NO: 2188370 - RNA, 14 nt, Homo sapiens
ugaaaacuucaaag

SEQ ID NO: 2188371 - RNA, 19 nt, Homo sapiens
aaacuuuggguacuuauac

SEQ ID NO: 2188372 - RNA, 18 nt, Homo sapiens
aaagcaucacacaguggc

SEQ ID NO: 2188373 - RNA, 16 nt, Homo sapiens
ugugaaagcaccauca

SEQ ID NO: 2188374 - RNA, 14 nt, Homo sapiens
uucuaacuguaaau

SEQ ID NO: 2188375 - RNA, 23 nt, Homo sapiens
cuacagggcgagacucugucuca

SEQ ID NO: 2188376 - RNA, 17 nt, Homo sapiens
aguucagcuccuuccac

SEQ ID NO: 2188377 - RNA, 14 nt, Homo sapiens
aggcacaccuugca

SEQ ID NO: 2188378 - RNA, 13 nt, Homo sapiens
cuggaacccagga

SEQ ID NO: 2188379 - RNA, 13 nt, Homo sapiens
cagccacccugcc

SEQ ID NO: 2188380 - RNA, 22 nt, Homo sapiens
aaccacuaugaagcuaccucaa

SEQ ID NO: 2188381 - RNA, 14 nt, Homo sapiens
ggccacacuggcau

SEQ ID NO: 2188382 - RNA, 18 nt, Homo sapiens
ugcuacccuggcuggcag

SEQ ID NO: 2188383 - RNA, 20 nt, Homo sapiens
gcuccauguuuccaccaaau

SEQ ID NO: 2188384 - RNA, 11 nt, Homo sapiens
aggccagguga

SEQ ID NO: 2188385 - RNA, 22 nt, Homo sapiens
aagaccugcugagggaccagcc

SEQ ID NO: 2188386 - RNA, 19 nt, Homo sapiens
uggcacacaccuguagucc

SEQ ID NO: 2188387 - RNA, 15 nt, Homo sapiens
caggcuucgucucag

SEQ ID NO: 2188388 - RNA, 17 nt, Homo sapiens
gcaggaggauugcuuga

SEQ ID NO: 2188389 - RNA, 17 nt, Homo sapiens
ucaccaggggugcucac

SEQ ID NO: 2188390 - RNA, 21 nt, Homo sapiens
agaugggaggaucacuugagg

SEQ ID NO: 2188391 - RNA, 20 nt, Homo sapiens
guuuuuauauuaauguacuu

SEQ ID NO: 2188392 - RNA, 12 nt, Homo sapiens
uucuuacacugu

SEQ ID NO: 2188393 - RNA, 16 nt, Homo sapiens
uagaccagaggacaua

SEQ ID NO: 2188394 - RNA, 13 nt, Homo sapiens
augucucucauga

SEQ ID NO: 2188395 - RNA, 16 nt, Homo sapiens
cacauuuuacaggcaa

SEQ ID NO: 2188396 - RNA, 16 nt, Homo sapiens
cuauaguuauacauca

SEQ ID NO: 2188397 - RNA, 20 nt, Homo sapiens
cagaagcaugcacaaagaga

SEQ ID NO: 2188398 - RNA, 21 nt, Homo sapiens
uaaauuuguacuauuuaacug

SEQ ID NO: 2188399 - RNA, 13 nt, Homo sapiens
cuucuccuuagaa

SEQ ID NO: 2188400 - RNA, 13 nt, Homo sapiens
uuucaccucagau

SEQ ID NO: 2188401 - RNA, 12 nt, Homo sapiens
augucauuacaa

SEQ ID NO: 2188402 - RNA, 20 nt, Homo sapiens
guccaaaacugccucaggag

SEQ ID NO: 2188403 - RNA, 17 nt, Homo sapiens
auuuuauagacuaccaa

SEQ ID NO: 2188404 - RNA, 16 nt, Homo sapiens
agcauuccaugagcug

SEQ ID NO: 2188405 - RNA, 23 nt, Homo sapiens
cucagcacuuuggacauggcuca

SEQ ID NO: 2188406 - RNA, 16 nt, Homo sapiens
aggaaaauauugacaa

SEQ ID NO: 2188407 - RNA, 19 nt, Homo sapiens
aaccucuguggucacccau

SEQ ID NO: 2188408 - RNA, 14 nt, Homo sapiens
aggcaaaaggcagu

SEQ ID NO: 2188409 - RNA, 12 nt, Homo sapiens
ugguggggccag

SEQ ID NO: 2188410 - RNA, 13 nt, Homo sapiens
ccuaccucuagua

SEQ ID NO: 2188411 - RNA, 19 nt, Homo sapiens
accauauugcccagggugg

SEQ ID NO: 2188412 - RNA, 22 nt, Homo sapiens
uaauuucgcacaaugcaugccc

SEQ ID NO: 2188413 - RNA, 17 nt, Homo sapiens
cuaaucuaacaauggaa

SEQ ID NO: 2188414 - RNA, 13 nt, Homo sapiens
aauccaccugcag

SEQ ID NO: 2188415 - RNA, 15 nt, Homo sapiens
agguggugucacugu

SEQ ID NO: 2188416 - RNA, 22 nt, Homo sapiens
ggaugucuccgucucugucuca

SEQ ID NO: 2188417 - RNA, 15 nt, Homo sapiens
ggccuauuguugaau

SEQ ID NO: 2188418 - RNA, 17 nt, Homo sapiens
gaagacccacgugcuag

SEQ ID NO: 2188419 - RNA, 18 nt, Homo sapiens
uaaucagcauuaacaugg

SEQ ID NO: 2188420 - RNA, 16 nt, Homo sapiens
guuucuauguccaaac

SEQ ID NO: 2188421 - RNA, 14 nt, Homo sapiens
auuccaaaguucaa

SEQ ID NO: 2188422 - RNA, 14 nt, Homo sapiens
gaacaaaaaaacca

SEQ ID NO: 2188423 - RNA, 21 nt, Homo sapiens
ugguagaagaugaaucaguau

SEQ ID NO: 2188424 - RNA, 18 nt, Homo sapiens
agggccagagcaagcgcu

SEQ ID NO: 2188425 - RNA, 21 nt, Homo sapiens
gcuuaccauuaaaguucucaa

SEQ ID NO: 2188426 - RNA, 20 nt, Homo sapiens
ucugcuccccuaaagccuca

SEQ ID NO: 2188427 - RNA, 20 nt, Homo sapiens
uacuauuauauuauguaguc

SEQ ID NO: 2188428 - RNA, 19 nt, Homo sapiens
guccuccaucuuccaggau

SEQ ID NO: 2188429 - RNA, 22 nt, Homo sapiens
gagaccaggcaaagcaagugau

SEQ ID NO: 2188430 - RNA, 20 nt, Homo sapiens
auacauuuuuagaaaucaca

SEQ ID NO: 2188431 - RNA, 21 nt, Homo sapiens
uacaucugggacugacuuucc

SEQ ID NO: 2188432 - RNA, 16 nt, Homo sapiens
aauuugagauacaaac

SEQ ID NO: 2188433 - RNA, 22 nt, Homo sapiens
cauggguggauuuagccaagga

SEQ ID NO: 2188434 - RNA, 16 nt, Homo sapiens
ugagcucuguaacuua

SEQ ID NO: 2188435 - RNA, 22 nt, Homo sapiens
aaaggaaaauugcacuauugca

SEQ ID NO: 2188436 - RNA, 14 nt, Homo sapiens
aggaugcucaguga

SEQ ID NO: 2188437 - RNA, 16 nt, Homo sapiens
ugucauccuuggucuu

SEQ ID NO: 2188438 - RNA, 13 nt, Homo sapiens
ugaucccagucac

SEQ ID NO: 2188439 - RNA, 17 nt, Homo sapiens
cauauaggccagaguug

SEQ ID NO: 2188440 - RNA, 18 nt, Homo sapiens
cccagucccacacugugg

SEQ ID NO: 2188441 - RNA, 16 nt, Homo sapiens
agcacagcgaacccaa

SEQ ID NO: 2188442 - RNA, 17 nt, Homo sapiens
ugaccugguacugaggu

SEQ ID NO: 2188443 - RNA, 16 nt, Homo sapiens
aguagaucaugcauag

SEQ ID NO: 2188444 - RNA, 18 nt, Homo sapiens
guauucauugaagucaga

SEQ ID NO: 2188445 - RNA, 13 nt, Homo sapiens
acagaaucucagu

SEQ ID NO: 2188446 - RNA, 22 nt, Homo sapiens
uguuuuuugccacagcuuuugc

SEQ ID NO: 2188447 - RNA, 18 nt, Homo sapiens
cuuugcuggaguccuguu

SEQ ID NO: 2188448 - RNA, 18 nt, Homo sapiens
accuaggcaacaugguga

SEQ ID NO: 2188449 - RNA, 16 nt, Homo sapiens
agagcuccuguaagag

SEQ ID NO: 2188450 - RNA, 18 nt, Homo sapiens
ugcccacacacacccacu

SEQ ID NO: 2188451 - RNA, 19 nt, Homo sapiens
acuggucaccuugcacucc

SEQ ID NO: 2188452 - RNA, 14 nt, Homo sapiens
ugaugacuauggaa

SEQ ID NO: 2188453 - RNA, 16 nt, Homo sapiens
gaugauuuuaacaguu

SEQ ID NO: 2188454 - RNA, 22 nt, Homo sapiens
ucauacacaagucuaacaguua

SEQ ID NO: 2188455 - RNA, 17 nt, Homo sapiens
ugcccacguguccugag

SEQ ID NO: 2188456 - RNA, 18 nt, Homo sapiens
ggaccugcgguacaggag

SEQ ID NO: 2188457 - RNA, 21 nt, Homo sapiens
ccaccucuggccaaauaugca

SEQ ID NO: 2188458 - RNA, 15 nt, Homo sapiens
ugagucauaucuuaa

SEQ ID NO: 2188459 - RNA, 20 nt, Homo sapiens
auuuuccagugacuugcaau

SEQ ID NO: 2188460 - RNA, 12 nt, Homo sapiens
ugcagccuucau

SEQ ID NO: 2188461 - RNA, 16 nt, Homo sapiens
aagcugcccacuguuu

SEQ ID NO: 2188462 - RNA, 18 nt, Homo sapiens
caugugcuggacacuguc

SEQ ID NO: 2188463 - RNA, 24 nt, Homo sapiens
gcacugaaaucacuuuaccugcag

SEQ ID NO: 2188464 - RNA, 17 nt, Homo sapiens
cugcguuaugaagagcu

SEQ ID NO: 2188465 - RNA, 22 nt, Homo sapiens
augcugggucuccacguggugu

SEQ ID NO: 2188466 - RNA, 14 nt, Homo sapiens
auguuuguacacaa

SEQ ID NO: 2188467 - RNA, 17 nt, Homo sapiens
ggauagguggggaaauc

SEQ ID NO: 2188468 - RNA, 23 nt, Homo sapiens
uuucaaaagcaagaacaccaucc

SEQ ID NO: 2188469 - RNA, 18 nt, Homo sapiens
accaaagauacauguaaa

SEQ ID NO: 2188470 - RNA, 22 nt, Homo sapiens
aaacuuacauuuaaaagacaga

SEQ ID NO: 2188471 - RNA, 15 nt, Homo sapiens
ccugugcuccauggc

SEQ ID NO: 2188472 - RNA, 17 nt, Homo sapiens
agaaacaguuccauuca

SEQ ID NO: 2188473 - RNA, 20 nt, Homo sapiens
gucugugugaugaacuuucu

SEQ ID NO: 2188474 - RNA, 20 nt, Homo sapiens
aagaucgcgccacugcacuc

SEQ ID NO: 2188475 - RNA, 19 nt, Homo sapiens
uacauuuccaaauucacaa

SEQ ID NO: 2188476 - RNA, 20 nt, Homo sapiens
ucuugguuccagccugccac

SEQ ID NO: 2188477 - RNA, 21 nt, Homo sapiens
cccuuuuucauuuaacuuuau

SEQ ID NO: 2188478 - RNA, 19 nt, Homo sapiens
cccucgggccccauccuca

SEQ ID NO: 2188479 - RNA, 20 nt, Homo sapiens
agcuaggugcacauauacau

SEQ ID NO: 2188480 - RNA, 23 nt, Homo sapiens
uuggcagaaaggauguuuugucc

SEQ ID NO: 2188481 - RNA, 22 nt, Homo sapiens
cuucagugcaaauuguaucuua

SEQ ID NO: 2188482 - RNA, 14 nt, Homo sapiens
uaauucugucacuc

SEQ ID NO: 2188483 - RNA, 14 nt, Homo sapiens
aaaggagcucugaa

SEQ ID NO: 2188484 - RNA, 17 nt, Homo sapiens
ccauucucuccagugug

SEQ ID NO: 2188485 - RNA, 18 nt, Homo sapiens
ccuauagccaccccaaga

SEQ ID NO: 2188486 - RNA, 19 nt, Homo sapiens
cugauaugaccccaguuca

SEQ ID NO: 2188487 - RNA, 16 nt, Homo sapiens
aguugcuucucaugga

SEQ ID NO: 2188488 - RNA, 12 nt, Homo sapiens
cccuacugggag

SEQ ID NO: 2188489 - RNA, 14 nt, Homo sapiens
uucaguuuugcuua

SEQ ID NO: 2188490 - RNA, 22 nt, Homo sapiens
acuugacaacuguggacuccag

SEQ ID NO: 2188491 - RNA, 23 nt, Homo sapiens
uuauggagcucacacuccagugg

SEQ ID NO: 2188492 - RNA, 20 nt, Homo sapiens
gccucaggggccucagggga

SEQ ID NO: 2188493 - RNA, 23 nt, Homo sapiens
aguaacugguuaaaaaacaaaug

SEQ ID NO: 2188494 - RNA, 21 nt, Homo sapiens
aaagccugcguucucauccca

SEQ ID NO: 2188495 - RNA, 13 nt, Homo sapiens
uuagcauuuucaa

SEQ ID NO: 2188496 - RNA, 18 nt, Homo sapiens
cuuuauuugaacaaugaa

SEQ ID NO: 2188497 - RNA, 18 nt, Homo sapiens
gagcaaaaucaacaugac

SEQ ID NO: 2188498 - RNA, 16 nt, Homo sapiens
auggcuaucaucaaaa

SEQ ID NO: 2188499 - RNA, 16 nt, Homo sapiens
guaaaagcuuacacag

SEQ ID NO: 2188500 - RNA, 17 nt, Homo sapiens
accuugacuucauuuau

SEQ ID NO: 2188501 - RNA, 16 nt, Homo sapiens
guccugaccaucgcac

SEQ ID NO: 2188502 - RNA, 11 nt, Homo sapiens
ucuuuccagag

SEQ ID NO: 2188503 - RNA, 17 nt, Homo sapiens
guaacuucagauguuuc

SEQ ID NO: 2188504 - RNA, 19 nt, Homo sapiens
gcaguucucgcagauguua

SEQ ID NO: 2188505 - RNA, 23 nt, Homo sapiens
aaagaacucaaaaggagaacugu

SEQ ID NO: 2188506 - RNA, 15 nt, Homo sapiens
acuccagaagaugag

SEQ ID NO: 2188507 - RNA, 21 nt, Homo sapiens
agcugggcuagaggcugagca

SEQ ID NO: 2188508 - RNA, 22 nt, Homo sapiens
accucggcucacugcagccucc

SEQ ID NO: 2188509 - RNA, 22 nt, Homo sapiens
gcuucugcaguucucaugacuc

SEQ ID NO: 2188510 - RNA, 16 nt, Homo sapiens
ucccacaugaggccau

SEQ ID NO: 2188511 - RNA, 20 nt, Homo sapiens
cucaaucaugaguaccucaa

SEQ ID NO: 2188512 - RNA, 16 nt, Homo sapiens
uucuggaaaaacagga

SEQ ID NO: 2188513 - RNA, 17 nt, Homo sapiens
ucauccccucucaggag

SEQ ID NO: 2188514 - RNA, 20 nt, Homo sapiens
gaaacuaucucaugccagug

SEQ ID NO: 2188515 - RNA, 19 nt, Homo sapiens
ugcuauagagccuaccugu

SEQ ID NO: 2188516 - RNA, 21 nt, Homo sapiens
gucacaauccuaacacauuau

SEQ ID NO: 2188517 - RNA, 22 nt, Homo sapiens
aggcccugcacugccagcaucu

SEQ ID NO: 2188518 - RNA, 19 nt, Homo sapiens
augugccaggccuacugua

SEQ ID NO: 2188519 - RNA, 22 nt, Homo sapiens
gccauggcagacaguagacaga

SEQ ID NO: 2188520 - RNA, 16 nt, Homo sapiens
ugcugaccaugcagcc

SEQ ID NO: 2188521 - RNA, 23 nt, Homo sapiens
gaggaaguagcugucagauguca

SEQ ID NO: 2188522 - RNA, 16 nt, Homo sapiens
ucugccccagcuuuau

SEQ ID NO: 2188523 - RNA, 20 nt, Homo sapiens
ccaugguuuuucacauugca

SEQ ID NO: 2188524 - RNA, 16 nt, Homo sapiens
cucuuucgcuuggcag

SEQ ID NO: 2188525 - RNA, 15 nt, Homo sapiens
cauagggccuccuua

SEQ ID NO: 2188526 - RNA, 16 nt, Homo sapiens
uuccuugauucacaau

SEQ ID NO: 2188527 - RNA, 19 nt, Homo sapiens
ccccuacccccaguaaaau

SEQ ID NO: 2188528 - RNA, 15 nt, Homo sapiens
ugauagucaucauca

SEQ ID NO: 2188529 - RNA, 20 nt, Homo sapiens
aaggagcucugaaucugaua

SEQ ID NO: 2188530 - RNA, 22 nt, Homo sapiens
gaccgugcuaacuguguguaca

SEQ ID NO: 2188531 - RNA, 14 nt, Homo sapiens
gaggccacccagag

SEQ ID NO: 2188532 - RNA, 22 nt, Homo sapiens
aguaaauaugguucuugccaaa

SEQ ID NO: 2188533 - RNA, 23 nt, Homo sapiens
cuauauaguuuauugacaauaau

SEQ ID NO: 2188534 - RNA, 12 nt, Homo sapiens
ugcacaauuuga

SEQ ID NO: 2188535 - RNA, 17 nt, Homo sapiens
augggcccacaggguac

SEQ ID NO: 2188536 - RNA, 17 nt, Homo sapiens
cuuaaccucaaaacugu

SEQ ID NO: 2188537 - RNA, 16 nt, Homo sapiens
ccuuugcuucauucca

SEQ ID NO: 2188538 - RNA, 23 nt, Homo sapiens
aggaucacuugaggccaggacuu

SEQ ID NO: 2188539 - RNA, 16 nt, Homo sapiens
cucaggcagugcagua

SEQ ID NO: 2188540 - RNA, 17 nt, Homo sapiens
cccaaucugccagacuu

SEQ ID NO: 2188541 - RNA, 14 nt, Homo sapiens
guacauguauuaaa

SEQ ID NO: 2188542 - RNA, 17 nt, Homo sapiens
guuuaaaacaguauuua

SEQ ID NO: 2188543 - RNA, 19 nt, Homo sapiens
agaacuucauggaucagau

SEQ ID NO: 2188544 - RNA, 14 nt, Homo sapiens
gcaccucaagaaga

SEQ ID NO: 2188545 - RNA, 18 nt, Homo sapiens
auuuuccaggacuguuuc

SEQ ID NO: 2188546 - RNA, 22 nt, Homo sapiens
auguuaacaacuugaauuacaa

SEQ ID NO: 2188547 - RNA, 19 nt, Homo sapiens
agcuguccucccaccucag

SEQ ID NO: 2188548 - RNA, 18 nt, Homo sapiens
gccggucgggggggaccc

SEQ ID NO: 2188549 - RNA, 16 nt, Homo sapiens
uaggaaagcagugcag

SEQ ID NO: 2188550 - RNA, 13 nt, Homo sapiens
agauaaucacaau

SEQ ID NO: 2188551 - RNA, 19 nt, Homo sapiens
cucaaaucaggguccagug

SEQ ID NO: 2188552 - RNA, 18 nt, Homo sapiens
aaauaccccuaacauacu

SEQ ID NO: 2188553 - RNA, 14 nt, Homo sapiens
ugccgccagcugcc

SEQ ID NO: 2188554 - RNA, 15 nt, Homo sapiens
cagcuuuacuguggc

SEQ ID NO: 2188555 - RNA, 19 nt, Homo sapiens
uuuuaauaagaacauuaau

SEQ ID NO: 2188556 - RNA, 11 nt, Homo sapiens
uaaugauacug

SEQ ID NO: 2188557 - RNA, 13 nt, Homo sapiens
uaauuagugucca

SEQ ID NO: 2188558 - RNA, 13 nt, Homo sapiens
gaauuaagcagaa

SEQ ID NO: 2188559 - RNA, 17 nt, Homo sapiens
caguucugaacuggaac

SEQ ID NO: 2188560 - RNA, 20 nt, Homo sapiens
aucaggaaaacaaaucacug

SEQ ID NO: 2188561 - RNA, 19 nt, Homo sapiens
uuuggcaaaggucccugag

SEQ ID NO: 2188562 - RNA, 13 nt, Homo sapiens
auuaagcacugug

SEQ ID NO: 2188563 - RNA, 13 nt, Homo sapiens
gccauuccuggaa

SEQ ID NO: 2188564 - RNA, 14 nt, Homo sapiens
gugacagucucccc

SEQ ID NO: 2188565 - RNA, 20 nt, Homo sapiens
uugaccuccgaaggauccuc

SEQ ID NO: 2188566 - RNA, 19 nt, Homo sapiens
uucccucuugcucaguggg

SEQ ID NO: 2188567 - RNA, 20 nt, Homo sapiens
cauagcucacugcacccuca

SEQ ID NO: 2188568 - RNA, 14 nt, Homo sapiens
augacaaguggggu

SEQ ID NO: 2188569 - RNA, 20 nt, Homo sapiens
uuugaaacaaaaugagcucu

SEQ ID NO: 2188570 - RNA, 16 nt, Homo sapiens
ccccagcccuccuuau

SEQ ID NO: 2188571 - RNA, 23 nt, Homo sapiens
agagaaagaaagggaaacuggcu

SEQ ID NO: 2188572 - RNA, 16 nt, Homo sapiens
aacuuaaauuccaaac

SEQ ID NO: 2188573 - RNA, 23 nt, Homo sapiens
gaauccuuuggugccaacuggug

SEQ ID NO: 2188574 - RNA, 22 nt, Homo sapiens
uaccaaaaauaucccuuuuuca

SEQ ID NO: 2188575 - RNA, 17 nt, Homo sapiens
uaaagugccaguuugcu

SEQ ID NO: 2188576 - RNA, 19 nt, Homo sapiens
uccugcccaaaaugugaag

SEQ ID NO: 2188577 - RNA, 20 nt, Homo sapiens
auaaaggggagggacucauc

SEQ ID NO: 2188578 - RNA, 14 nt, Homo sapiens
ucagaccaguucuu

SEQ ID NO: 2188579 - RNA, 16 nt, Homo sapiens
cugauuuugagcucaa

SEQ ID NO: 2188580 - RNA, 22 nt, Homo sapiens
cuauagaaauagaacacugccu

SEQ ID NO: 2188581 - RNA, 20 nt, Homo sapiens
ccaaaucugcauccuuuuca

SEQ ID NO: 2188582 - RNA, 17 nt, Homo sapiens
cccagaaauguauggca

SEQ ID NO: 2188583 - RNA, 18 nt, Homo sapiens
agcucuucccuugcucau

SEQ ID NO: 2188584 - RNA, 23 nt, Homo sapiens
gcuuugcccaccccucacucccc

SEQ ID NO: 2188585 - RNA, 12 nt, Homo sapiens
acaaucugggac

SEQ ID NO: 2188586 - RNA, 23 nt, Homo sapiens
gacagugaaacaaauuuacauca

SEQ ID NO: 2188587 - RNA, 21 nt, Homo sapiens
guggcaucccaguggccucaa

SEQ ID NO: 2188588 - RNA, 19 nt, Homo sapiens
acuuuuccuggacacuuua

SEQ ID NO: 2188589 - RNA, 17 nt, Homo sapiens
auugugcaguacuuugu

SEQ ID NO: 2188590 - RNA, 19 nt, Homo sapiens
ucucuagucauuuguuaau

SEQ ID NO: 2188591 - RNA, 18 nt, Homo sapiens
agucauggauaacuacau

SEQ ID NO: 2188592 - RNA, 19 nt, Homo sapiens
ucaccagauuuaaauaacu

SEQ ID NO: 2188593 - RNA, 19 nt, Homo sapiens
cuuuccucagugacugugu

SEQ ID NO: 2188594 - RNA, 13 nt, Homo sapiens
gugcagugauaca

SEQ ID NO: 2188595 - RNA, 15 nt, Homo sapiens
gaucagagauuuguc

SEQ ID NO: 2188596 - RNA, 15 nt, Homo sapiens
augccucucucaggc

SEQ ID NO: 2188597 - RNA, 15 nt, Homo sapiens
ggaacaugaagccag

SEQ ID NO: 2188598 - RNA, 18 nt, Homo sapiens
uuacaaauuuugcacuuu

SEQ ID NO: 2188599 - RNA, 18 nt, Homo sapiens
uuucaaaaaaagcacaaa

SEQ ID NO: 2188600 - RNA, 18 nt, Homo sapiens
cuacacaaaagccaaaag

SEQ ID NO: 2188601 - RNA, 16 nt, Homo sapiens
caagcuggaagcacau

SEQ ID NO: 2188602 - RNA, 15 nt, Homo sapiens
agauuuaaagcacau

SEQ ID NO: 2188603 - RNA, 20 nt, Homo sapiens
gccaucgccgggacuccaga

SEQ ID NO: 2188604 - RNA, 18 nt, Homo sapiens
agcccaucugcacagugg

SEQ ID NO: 2188605 - RNA, 14 nt, Homo sapiens
uuucuagccuuaga

SEQ ID NO: 2188606 - RNA, 22 nt, Homo sapiens
gucauuugaaugagaccuggaa

SEQ ID NO: 2188607 - RNA, 14 nt, Homo sapiens
cggcucauugaacc

SEQ ID NO: 2188608 - RNA, 14 nt, Homo sapiens
cuaauaauuugcca

SEQ ID NO: 2188609 - RNA, 20 nt, Homo sapiens
uguuccuuuguaauugacac

SEQ ID NO: 2188610 - RNA, 19 nt, Homo sapiens
ccugcaggcuggagacugg

SEQ ID NO: 2188611 - RNA, 12 nt, Homo sapiens
ccagcacuuugg

SEQ ID NO: 2188612 - RNA, 18 nt, Homo sapiens
uaguagacaugaauuuua

SEQ ID NO: 2188613 - RNA, 15 nt, Homo sapiens
cugaacacugaaguc

SEQ ID NO: 2188614 - RNA, 17 nt, Homo sapiens
uguuaaaauacauaacu

SEQ ID NO: 2188615 - RNA, 10 nt, Homo sapiens
aggcugcaaa

SEQ ID NO: 2188616 - RNA, 20 nt, Homo sapiens
agaacugauuuuacaaauua

SEQ ID NO: 2188617 - RNA, 12 nt, Homo sapiens
cacauagcacag

SEQ ID NO: 2188618 - RNA, 18 nt, Homo sapiens
uacuucagucuugaugca

SEQ ID NO: 2188619 - RNA, 21 nt, Homo sapiens
uauuccugguauuauuuacaa

SEQ ID NO: 2188620 - RNA, 23 nt, Homo sapiens
cacuccaggcauauguuucccca

SEQ ID NO: 2188621 - RNA, 20 nt, Homo sapiens
auacaauucacagcacagua

SEQ ID NO: 2188622 - RNA, 17 nt, Homo sapiens
aacuauaacaccugcca

SEQ ID NO: 2188623 - RNA, 22 nt, Homo sapiens
cucacaccuccuuuucuucuag

SEQ ID NO: 2188624 - RNA, 17 nt, Homo sapiens
aaaggauuguuaauguu

SEQ ID NO: 2188625 - RNA, 16 nt, Homo sapiens
cucuggugacaccagc

SEQ ID NO: 2188626 - RNA, 19 nt, Homo sapiens
ggacagucaaggugauaua

SEQ ID NO: 2188627 - RNA, 15 nt, Homo sapiens
gaagacuuacagcaa

SEQ ID NO: 2188628 - RNA, 22 nt, Homo sapiens
ugcauuucauaaacuaauagaa

SEQ ID NO: 2188629 - RNA, 16 nt, Homo sapiens
uaggaacacuccuuca

SEQ ID NO: 2188630 - RNA, 11 nt, Homo sapiens
ccauugugaug

SEQ ID NO: 2188631 - RNA, 16 nt, Homo sapiens
gaggcugauuccucuc

SEQ ID NO: 2188632 - RNA, 16 nt, Homo sapiens
ugcagagugcccagaa

SEQ ID NO: 2188633 - RNA, 23 nt, Homo sapiens
guggcuuuggcagaccaucucca

SEQ ID NO: 2188634 - RNA, 13 nt, Homo sapiens
cacuaacauauau

SEQ ID NO: 2188635 - RNA, 23 nt, Homo sapiens
ccugugucuuauagguuuccacu

SEQ ID NO: 2188636 - RNA, 13 nt, Homo sapiens
uccucccugucuc

SEQ ID NO: 2188637 - RNA, 14 nt, Homo sapiens
aaauauucucucca

SEQ ID NO: 2188638 - RNA, 12 nt, Homo sapiens
auucauucucau

SEQ ID NO: 2188639 - RNA, 19 nt, Homo sapiens
cuccuggccucaagcaauc

SEQ ID NO: 2188640 - RNA, 19 nt, Homo sapiens
ccgaaaaggauaugcagua

SEQ ID NO: 2188641 - RNA, 22 nt, Homo sapiens
gcugagggaacauagacucacu

SEQ ID NO: 2188642 - RNA, 23 nt, Homo sapiens
uuccuguugauguucagaaugga

SEQ ID NO: 2188643 - RNA, 22 nt, Homo sapiens
acaccaucaggccgcauccuga

SEQ ID NO: 2188644 - RNA, 23 nt, Homo sapiens
cucucaccucugugccucugucu

SEQ ID NO: 2188645 - RNA, 14 nt, Homo sapiens
gucuuuaaucccag

SEQ ID NO: 2188646 - RNA, 18 nt, Homo sapiens
ucaauaauauauuuucug

SEQ ID NO: 2188647 - RNA, 14 nt, Homo sapiens
cuggcucucuccag

SEQ ID NO: 2188648 - RNA, 13 nt, Homo sapiens
aucuguaccucug

SEQ ID NO: 2188649 - RNA, 19 nt, Homo sapiens
uuuccauccuagugagaag

SEQ ID NO: 2188650 - RNA, 23 nt, Homo sapiens
gcagcaggacuguccccuugaag

SEQ ID NO: 2188651 - RNA, 19 nt, Homo sapiens
aguaguuuucaaaacacau

SEQ ID NO: 2188652 - RNA, 17 nt, Homo sapiens
gcccucaggccauuccc

SEQ ID NO: 2188653 - RNA, 15 nt, Homo sapiens
aaauaaaugugagaa

SEQ ID NO: 2188654 - RNA, 16 nt, Homo sapiens
uaauagcuauacauua

SEQ ID NO: 2188655 - RNA, 17 nt, Homo sapiens
gcauaaucagacaagcu

SEQ ID NO: 2188656 - RNA, 17 nt, Homo sapiens
cauugaaacuacacuaa

SEQ ID NO: 2188657 - RNA, 19 nt, Homo sapiens
auguauuuuccuaauguga

SEQ ID NO: 2188658 - RNA, 18 nt, Homo sapiens
ucacuauggucaaaaagu

SEQ ID NO: 2188659 - RNA, 16 nt, Homo sapiens
gucaucacccagccuc

SEQ ID NO: 2188660 - RNA, 20 nt, Homo sapiens
caugacccaccccugugcuc

SEQ ID NO: 2188661 - RNA, 14 nt, Homo sapiens
cuagcacuugucuc

SEQ ID NO: 2188662 - RNA, 16 nt, Homo sapiens
cccucauucugcauua

SEQ ID NO: 2188663 - RNA, 15 nt, Homo sapiens
guuauucuuugcacu

SEQ ID NO: 2188664 - RNA, 20 nt, Homo sapiens
ucuuauggaagaaaugggag

SEQ ID NO: 2188665 - RNA, 18 nt, Homo sapiens
caguaguguacauuacca

SEQ ID NO: 2188666 - RNA, 19 nt, Homo sapiens
uugauaggauguggauuaa

SEQ ID NO: 2188667 - RNA, 16 nt, Homo sapiens
aaagcagucuguucug

SEQ ID NO: 2188668 - RNA, 16 nt, Homo sapiens
acaucucuuucaucua

SEQ ID NO: 2188669 - RNA, 14 nt, Homo sapiens
uuguuuucagugaa

SEQ ID NO: 2188670 - RNA, 22 nt, Homo sapiens
ucuggggguguaucacagucag

SEQ ID NO: 2188671 - RNA, 11 nt, Homo sapiens
aagcacacuca

SEQ ID NO: 2188672 - RNA, 22 nt, Homo sapiens
aaaggugugucaaagauuuuac

SEQ ID NO: 2188673 - RNA, 18 nt, Homo sapiens
acucagaugaugccagcu

SEQ ID NO: 2188674 - RNA, 22 nt, Homo sapiens
acugccagaacauggauuccac

SEQ ID NO: 2188675 - RNA, 21 nt, Homo sapiens
aauauuccuaugcugcaauac

SEQ ID NO: 2188676 - RNA, 13 nt, Homo sapiens
auuuuccuguccu

SEQ ID NO: 2188677 - RNA, 14 nt, Homo sapiens
accuucaugucacu

SEQ ID NO: 2188678 - RNA, 17 nt, Homo sapiens
ugcuuauuaagaccaaa

SEQ ID NO: 2188679 - RNA, 18 nt, Homo sapiens
auagcccgagcagggucu

SEQ ID NO: 2188680 - RNA, 13 nt, Homo sapiens
gcucaauuccuuc

SEQ ID NO: 2188681 - RNA, 18 nt, Homo sapiens
guaaccuggccacugucc

SEQ ID NO: 2188682 - RNA, 14 nt, Homo sapiens
augugcccaaagcu

SEQ ID NO: 2188683 - RNA, 12 nt, Homo sapiens
agaacugaugac

SEQ ID NO: 2188684 - RNA, 20 nt, Homo sapiens
aaccuguugaauaauuugau

SEQ ID NO: 2188685 - RNA, 18 nt, Homo sapiens
auaucuuguagcuuuauc

SEQ ID NO: 2188686 - RNA, 17 nt, Homo sapiens
acuuauguguuuugcua

SEQ ID NO: 2188687 - RNA, 23 nt, Homo sapiens
cagccucccaaagugcugggauu

SEQ ID NO: 2188688 - RNA, 14 nt, Homo sapiens
agucugacagccag

SEQ ID NO: 2188689 - RNA, 14 nt, Homo sapiens
acucugacaguauu

SEQ ID NO: 2188690 - RNA, 13 nt, Homo sapiens
ccuuccacuguag

SEQ ID NO: 2188691 - RNA, 22 nt, Homo sapiens
ucauagauaauaguacauguca

SEQ ID NO: 2188692 - RNA, 17 nt, Homo sapiens
aaggcaauccuaagcaa

SEQ ID NO: 2188693 - RNA, 16 nt, Homo sapiens
agaucuugaauagucu

SEQ ID NO: 2188694 - RNA, 14 nt, Homo sapiens
cacacacgcagaca

SEQ ID NO: 2188695 - RNA, 17 nt, Homo sapiens
auuaaguacaagcacau

SEQ ID NO: 2188696 - RNA, 18 nt, Homo sapiens
ccccaccuccaccuguga

SEQ ID NO: 2188697 - RNA, 14 nt, Homo sapiens
cagcucugggccau

SEQ ID NO: 2188698 - RNA, 12 nt, Homo sapiens
gauaucaccucu

SEQ ID NO: 2188699 - RNA, 19 nt, Homo sapiens
gaacaauggagauaucagu

SEQ ID NO: 2188700 - RNA, 21 nt, Homo sapiens
uuacaauaaucauucuggaua

SEQ ID NO: 2188701 - RNA, 19 nt, Homo sapiens
gccauaugacaauuucaaa

SEQ ID NO: 2188702 - RNA, 17 nt, Homo sapiens
aucugaaaugugauaag

SEQ ID NO: 2188703 - RNA, 17 nt, Homo sapiens
uccacuuguucauucug

SEQ ID NO: 2188704 - RNA, 13 nt, Homo sapiens
uuccaaacaucca

SEQ ID NO: 2188705 - RNA, 21 nt, Homo sapiens
cagagcucuggguugugcaca

SEQ ID NO: 2188706 - RNA, 18 nt, Homo sapiens
auacagcauugacucaga

SEQ ID NO: 2188707 - RNA, 22 nt, Homo sapiens
acaaauuguugacugcugaauu

SEQ ID NO: 2188708 - RNA, 12 nt, Homo sapiens
gaugcuugauau

SEQ ID NO: 2188709 - RNA, 14 nt, Homo sapiens
aaaccccacuuccc

SEQ ID NO: 2188710 - RNA, 22 nt, Homo sapiens
uguucuaaaaauaaaaguauug

SEQ ID NO: 2188711 - RNA, 17 nt, Homo sapiens
caaagagcaauauucca

SEQ ID NO: 2188712 - RNA, 22 nt, Homo sapiens
uacauaacuaaauuugauacuu

SEQ ID NO: 2188713 - RNA, 19 nt, Homo sapiens
gaggcagagguuacagguu

SEQ ID NO: 2188714 - RNA, 18 nt, Homo sapiens
gaacuguggaaucaucac

SEQ ID NO: 2188715 - RNA, 15 nt, Homo sapiens
ugcuucuguccagga

SEQ ID NO: 2188716 - RNA, 19 nt, Homo sapiens
cagcugaucacagacacca

SEQ ID NO: 2188717 - RNA, 14 nt, Homo sapiens
uauaaaugagcaaa

SEQ ID NO: 2188718 - RNA, 19 nt, Homo sapiens
ugaagaagagaaugugaca

SEQ ID NO: 2188719 - RNA, 12 nt, Homo sapiens
acauugugccuu

SEQ ID NO: 2188720 - RNA, 16 nt, Homo sapiens
acugacccuaacugca

SEQ ID NO: 2188721 - RNA, 21 nt, Homo sapiens
aguacacuuccugugccaugu

SEQ ID NO: 2188722 - RNA, 19 nt, Homo sapiens
caguccuccgcuacgcaca

SEQ ID NO: 2188723 - RNA, 21 nt, Homo sapiens
ggaagaaagcuaaucuguuua

SEQ ID NO: 2188724 - RNA, 22 nt, Homo sapiens
cucucccagugacaaccaaaag

SEQ ID NO: 2188725 - RNA, 20 nt, Homo sapiens
ccuuccccagccucuucuag

SEQ ID NO: 2188726 - RNA, 10 nt, Homo sapiens
gacagugaau

SEQ ID NO: 2188727 - RNA, 17 nt, Homo sapiens
ccaaagcugcugcacag

SEQ ID NO: 2188728 - RNA, 23 nt, Homo sapiens
uaguuaaguauuuacagauguua

SEQ ID NO: 2188729 - RNA, 21 nt, Homo sapiens
auaacaugucuuucagcauua

SEQ ID NO: 2188730 - RNA, 19 nt, Homo sapiens
cuuccugaacucccaguca

SEQ ID NO: 2188731 - RNA, 11 nt, Homo sapiens
accaucaugua

SEQ ID NO: 2188732 - RNA, 13 nt, Homo sapiens
ucaucugugcacu

SEQ ID NO: 2188733 - RNA, 17 nt, Homo sapiens
gcugggaggaagccaga

SEQ ID NO: 2188734 - RNA, 17 nt, Homo sapiens
ucaauccaagaacuuau

SEQ ID NO: 2188735 - RNA, 14 nt, Homo sapiens
ugcacccaccuguu

SEQ ID NO: 2188736 - RNA, 19 nt, Homo sapiens
uuaaauaauagacauacag

SEQ ID NO: 2188737 - RNA, 13 nt, Homo sapiens
cagaccuucacag

SEQ ID NO: 2188738 - RNA, 17 nt, Homo sapiens
ugcuacuuugccauuaa

SEQ ID NO: 2188739 - RNA, 16 nt, Homo sapiens
aagauaauucacugua

SEQ ID NO: 2188740 - RNA, 20 nt, Homo sapiens
gagggaccugcaucuaagca

SEQ ID NO: 2188741 - RNA, 23 nt, Homo sapiens
uaccggcgugcaccaccaugcca

SEQ ID NO: 2188742 - RNA, 17 nt, Homo sapiens
caucacugcuccuguca

SEQ ID NO: 2188743 - RNA, 22 nt, Homo sapiens
uccuggccccagcccccaccuc

SEQ ID NO: 2188744 - RNA, 20 nt, Homo sapiens
cugucgucccccuccagugc

SEQ ID NO: 2188745 - RNA, 15 nt, Homo sapiens
ccucaaccaaugcca

SEQ ID NO: 2188746 - RNA, 15 nt, Homo sapiens
agaguugaagacaga

SEQ ID NO: 2188747 - RNA, 16 nt, Homo sapiens
uaauguauaauuugag

SEQ ID NO: 2188748 - RNA, 20 nt, Homo sapiens
auucugauuugccacugaua

SEQ ID NO: 2188749 - RNA, 20 nt, Homo sapiens
aacauacuggccuggacugu

SEQ ID NO: 2188750 - RNA, 18 nt, Homo sapiens
uaguccggacccaccuca

SEQ ID NO: 2188751 - RNA, 13 nt, Homo sapiens
ugcagagcaauaa

SEQ ID NO: 2188752 - RNA, 14 nt, Homo sapiens
guuaagcaaaggaa

SEQ ID NO: 2188753 - RNA, 16 nt, Homo sapiens
ggggagaauguaauca

SEQ ID NO: 2188754 - RNA, 17 nt, Homo sapiens
acuuuacugccugaaua

SEQ ID NO: 2188755 - RNA, 12 nt, Homo sapiens
ccucuuugccuc

SEQ ID NO: 2188756 - RNA, 19 nt, Homo sapiens
ggaggacaggcaggccaga

SEQ ID NO: 2188757 - RNA, 19 nt, Homo sapiens
auucuuauuaggauuccac

SEQ ID NO: 2188758 - RNA, 14 nt, Homo sapiens
aucucuaauauauc

SEQ ID NO: 2188759 - RNA, 17 nt, Homo sapiens
ucuucagucucuauacc

SEQ ID NO: 2188760 - RNA, 16 nt, Homo sapiens
cccuauggaagucuca

SEQ ID NO: 2188761 - RNA, 12 nt, Homo sapiens
ucacagcugcuu

SEQ ID NO: 2188762 - RNA, 13 nt, Homo sapiens
ugcccaccagauc

SEQ ID NO: 2188763 - RNA, 15 nt, Homo sapiens
aagcguuuuucucaa

SEQ ID NO: 2188764 - RNA, 21 nt, Homo sapiens
aggaagagaaaccaggcccug

SEQ ID NO: 2188765 - RNA, 15 nt, Homo sapiens
agauauacacaugga

SEQ ID NO: 2188766 - RNA, 18 nt, Homo sapiens
cuguaaucucagcacuuu

SEQ ID NO: 2188767 - RNA, 21 nt, Homo sapiens
uuaaaagaaaucuugcuucag

SEQ ID NO: 2188768 - RNA, 14 nt, Homo sapiens
ucuugguaugggcu

SEQ ID NO: 2188769 - RNA, 15 nt, Homo sapiens
cucauguuguuccca

SEQ ID NO: 2188770 - RNA, 13 nt, Homo sapiens
auggucaaugcag

SEQ ID NO: 2188771 - RNA, 13 nt, Homo sapiens
uaaauauuacaaa

SEQ ID NO: 2188772 - RNA, 11 nt, Homo sapiens
gugccaaaaau

SEQ ID NO: 2188773 - RNA, 15 nt, Homo sapiens
gaaacucacacuccc

SEQ ID NO: 2188774 - RNA, 18 nt, Homo sapiens
uguauguacguuuguaug

SEQ ID NO: 2188775 - RNA, 18 nt, Homo sapiens
ucuacguaucugcuacuu

SEQ ID NO: 2188776 - RNA, 15 nt, Homo sapiens
gccaggacaugaaga

SEQ ID NO: 2188777 - RNA, 16 nt, Homo sapiens
auagaaaaugcuaaag

SEQ ID NO: 2188778 - RNA, 19 nt, Homo sapiens
cuucuuaaucuuuucacaa

SEQ ID NO: 2188779 - RNA, 21 nt, Homo sapiens
ggugcccaaacaccagucacc

SEQ ID NO: 2188780 - RNA, 13 nt, Homo sapiens
aagauauggacac

SEQ ID NO: 2188781 - RNA, 21 nt, Homo sapiens
uuuguuuggguuacaguaugc

SEQ ID NO: 2188782 - RNA, 12 nt, Homo sapiens
ccguacauucaa

SEQ ID NO: 2188783 - RNA, 20 nt, Homo sapiens
acacccacccaauuggccca

SEQ ID NO: 2188784 - RNA, 13 nt, Homo sapiens
agggcaugagcau

SEQ ID NO: 2188785 - RNA, 18 nt, Homo sapiens
uuuugugaaguuaccucu

SEQ ID NO: 2188786 - RNA, 22 nt, Homo sapiens
gcgggaaaauaaaccacugguc

SEQ ID NO: 2188787 - RNA, 23 nt, Homo sapiens
accucagguugcugguugcugug

SEQ ID NO: 2188788 - RNA, 19 nt, Homo sapiens
guuugccuuuguaccauau

SEQ ID NO: 2188789 - RNA, 18 nt, Homo sapiens
auagcacccugcccucau

SEQ ID NO: 2188790 - RNA, 18 nt, Homo sapiens
cuuuugugcuaucaauga

SEQ ID NO: 2188791 - RNA, 21 nt, Homo sapiens
caaguggggucuuucagaaca

SEQ ID NO: 2188792 - RNA, 14 nt, Homo sapiens
uaagugccugagac

SEQ ID NO: 2188793 - RNA, 15 nt, Homo sapiens
auccagcccaugccg

SEQ ID NO: 2188794 - RNA, 11 nt, Homo sapiens
cacagugcagu

SEQ ID NO: 2188795 - RNA, 17 nt, Homo sapiens
gagcucuccaggccagg

SEQ ID NO: 2188796 - RNA, 14 nt, Homo sapiens
ucauagugcucaga

SEQ ID NO: 2188797 - RNA, 19 nt, Homo sapiens
uacuuccuguguacucuuu

SEQ ID NO: 2188798 - RNA, 14 nt, Homo sapiens
ggaugaagugauau

SEQ ID NO: 2188799 - RNA, 20 nt, Homo sapiens
aacccaccuuugagcuuuag

SEQ ID NO: 2188800 - RNA, 13 nt, Homo sapiens
cagggcugcuccc

SEQ ID NO: 2188801 - RNA, 14 nt, Homo sapiens
gaaagcucacucug

SEQ ID NO: 2188802 - RNA, 20 nt, Homo sapiens
ucuuucccuuuaucaguuug

SEQ ID NO: 2188803 - RNA, 16 nt, Homo sapiens
gcucucacuccaggac

SEQ ID NO: 2188804 - RNA, 11 nt, Homo sapiens
ucccuguucuc

SEQ ID NO: 2188805 - RNA, 13 nt, Homo sapiens
ugccauguucaaa

SEQ ID NO: 2188806 - RNA, 23 nt, Homo sapiens
aaucugucccugagagugucucu

SEQ ID NO: 2188807 - RNA, 16 nt, Homo sapiens
cuggagaucagcaugc

SEQ ID NO: 2188808 - RNA, 18 nt, Homo sapiens
uggaagaagugagcagug

SEQ ID NO: 2188809 - RNA, 15 nt, Homo sapiens
uauaucccauugaaa

SEQ ID NO: 2188810 - RNA, 14 nt, Homo sapiens
uucauucaucauga

SEQ ID NO: 2188811 - RNA, 13 nt, Homo sapiens
guuucaguaauag

SEQ ID NO: 2188812 - RNA, 13 nt, Homo sapiens
aacacagugucug

SEQ ID NO: 2188813 - RNA, 14 nt, Homo sapiens
uguuuguacaagau

SEQ ID NO: 2188814 - RNA, 18 nt, Homo sapiens
accugaccccagugaaug

SEQ ID NO: 2188815 - RNA, 19 nt, Homo sapiens
uguuuucccaaagcacuuu

SEQ ID NO: 2188816 - RNA, 14 nt, Homo sapiens
auuuccauggugcc

SEQ ID NO: 2188817 - RNA, 19 nt, Homo sapiens
caggcaugagccaccaugc

SEQ ID NO: 2188818 - RNA, 19 nt, Homo sapiens
uaggaaaauuagaagcaag

SEQ ID NO: 2188819 - RNA, 19 nt, Homo sapiens
ucaauaaaauuauagcucu

SEQ ID NO: 2188820 - RNA, 14 nt, Homo sapiens
ccuggggaugugaa

SEQ ID NO: 2188821 - RNA, 11 nt, Homo sapiens
cuacaugccuc

SEQ ID NO: 2188822 - RNA, 13 nt, Homo sapiens
cauccagaggcaa

SEQ ID NO: 2188823 - RNA, 17 nt, Homo sapiens
ugcccguaaacacgccu

SEQ ID NO: 2188824 - RNA, 13 nt, Homo sapiens
uaauaaaucugag

SEQ ID NO: 2188825 - RNA, 12 nt, Homo sapiens
ugcaagacauag

SEQ ID NO: 2188826 - RNA, 20 nt, Homo sapiens
cucuuuccuccuuccaugga

SEQ ID NO: 2188827 - RNA, 20 nt, Homo sapiens
gcaccugagacccuacugaa

SEQ ID NO: 2188828 - RNA, 15 nt, Homo sapiens
gugugcuucugcuca

SEQ ID NO: 2188829 - RNA, 15 nt, Homo sapiens
cugcuaaugugugau

SEQ ID NO: 2188830 - RNA, 20 nt, Homo sapiens
ucugaaggaagagaagacau

SEQ ID NO: 2188831 - RNA, 20 nt, Homo sapiens
uuccuguugucuacaccaau

SEQ ID NO: 2188832 - RNA, 20 nt, Homo sapiens
gccaaaauaucauguucaau

SEQ ID NO: 2188833 - RNA, 16 nt, Homo sapiens
accucuaauaguauaa

SEQ ID NO: 2188834 - RNA, 16 nt, Homo sapiens
uccccaggcaccucac

SEQ ID NO: 2188835 - RNA, 17 nt, Homo sapiens
uguccagugagcagugu

SEQ ID NO: 2188836 - RNA, 15 nt, Homo sapiens
uuggcuggacccagc

SEQ ID NO: 2188837 - RNA, 21 nt, Homo sapiens
ugaaaagcugcauuuaaauca

SEQ ID NO: 2188838 - RNA, 17 nt, Homo sapiens
uugaagaggccaaagga

SEQ ID NO: 2188839 - RNA, 19 nt, Homo sapiens
cagggagccuucugccacc

SEQ ID NO: 2188840 - RNA, 18 nt, Homo sapiens
augaaaacucaugaucaa

SEQ ID NO: 2188841 - RNA, 15 nt, Homo sapiens
ggaaccuccccucau

SEQ ID NO: 2188842 - RNA, 20 nt, Homo sapiens
cagaaggaaaccgaaacuga

SEQ ID NO: 2188843 - RNA, 16 nt, Homo sapiens
uguaauugacacuaua

SEQ ID NO: 2188844 - RNA, 16 nt, Homo sapiens
ggugggcggacaaaag

SEQ ID NO: 2188845 - RNA, 16 nt, Homo sapiens
ugaucaccugccaaau

SEQ ID NO: 2188846 - RNA, 14 nt, Homo sapiens
ucaaggcacucuag

SEQ ID NO: 2188847 - RNA, 16 nt, Homo sapiens
ggcaacaaggugcaca

SEQ ID NO: 2188848 - RNA, 18 nt, Homo sapiens
gggucugggccagugcac

SEQ ID NO: 2188849 - RNA, 21 nt, Homo sapiens
cucugucugcucaaugccauu

SEQ ID NO: 2188850 - RNA, 17 nt, Homo sapiens
cacaaguagggagcuca

SEQ ID NO: 2188851 - RNA, 14 nt, Homo sapiens
acgaauucugucuc

SEQ ID NO: 2188852 - RNA, 21 nt, Homo sapiens
ccaaaagguauuuuaaucacc

SEQ ID NO: 2188853 - RNA, 23 nt, Homo sapiens
ugccccaccugccuggugcauug

SEQ ID NO: 2188854 - RNA, 19 nt, Homo sapiens
acacccuuuuaacauuuau

SEQ ID NO: 2188855 - RNA, 13 nt, Homo sapiens
uguaaugauacug

SEQ ID NO: 2188856 - RNA, 23 nt, Homo sapiens
gcauaugcuacacauaugugcuu

SEQ ID NO: 2188857 - RNA, 18 nt, Homo sapiens
cuggucccggucaccgcg

SEQ ID NO: 2188858 - RNA, 22 nt, Homo sapiens
ggacacuguccaugaagcacug

SEQ ID NO: 2188859 - RNA, 12 nt, Homo sapiens
gaaggccagcuu

SEQ ID NO: 2188860 - RNA, 16 nt, Homo sapiens
gaacuuguagccagaa

SEQ ID NO: 2188861 - RNA, 22 nt, Homo sapiens
cagcauaguacuggcacaaaaa

SEQ ID NO: 2188862 - RNA, 15 nt, Homo sapiens
caaccugcccagcug

SEQ ID NO: 2188863 - RNA, 14 nt, Homo sapiens
uccucaugcugcuc

SEQ ID NO: 2188864 - RNA, 21 nt, Homo sapiens
gcuggccugcgccugcaccug

SEQ ID NO: 2188865 - RNA, 21 nt, Homo sapiens
gucuaacucaaagacuuccuc

SEQ ID NO: 2188866 - RNA, 16 nt, Homo sapiens
uauauuucuguguaca

SEQ ID NO: 2188867 - RNA, 15 nt, Homo sapiens
ugcagaaacuacuga

SEQ ID NO: 2188868 - RNA, 20 nt, Homo sapiens
agccagaggaggccggugaa

SEQ ID NO: 2188869 - RNA, 14 nt, Homo sapiens
gcuucugauaugca

SEQ ID NO: 2188870 - RNA, 21 nt, Homo sapiens
uugucuguuaaaugaacuuga

SEQ ID NO: 2188871 - RNA, 14 nt, Homo sapiens
uagcacuaggcacc

SEQ ID NO: 2188872 - RNA, 20 nt, Homo sapiens
aaugcacuguauugcuccuc

SEQ ID NO: 2188873 - RNA, 16 nt, Homo sapiens
caagagagcuuaacag

SEQ ID NO: 2188874 - RNA, 22 nt, Homo sapiens
cccagacacagacuggcaauaa

SEQ ID NO: 2188875 - RNA, 22 nt, Homo sapiens
gugggccgaggugacugcagac

SEQ ID NO: 2188876 - RNA, 15 nt, Homo sapiens
gaaugauuaaucaua

SEQ ID NO: 2188877 - RNA, 20 nt, Homo sapiens
ggcugcuuugccuauggagu

SEQ ID NO: 2188878 - RNA, 21 nt, Homo sapiens
aauauaucacuuuugauacaa

SEQ ID NO: 2188879 - RNA, 21 nt, Homo sapiens
uuuguccaccauuccuuuaaa

SEQ ID NO: 2188880 - RNA, 15 nt, Homo sapiens
ugcuaggucugacca

SEQ ID NO: 2188881 - RNA, 20 nt, Homo sapiens
uggcagcaccgccucuuccc

SEQ ID NO: 2188882 - RNA, 13 nt, Homo sapiens
cuaccucagguug

SEQ ID NO: 2188883 - RNA, 22 nt, Homo sapiens
ggaggugaaaucccugccucag

SEQ ID NO: 2188884 - RNA, 15 nt, Homo sapiens
cuagcgcaagaccag

SEQ ID NO: 2188885 - RNA, 16 nt, Homo sapiens
uggguacaucaagucc

SEQ ID NO: 2188886 - RNA, 17 nt, Homo sapiens
cugcuaucccacuguau

SEQ ID NO: 2188887 - RNA, 17 nt, Homo sapiens
gacgcuggccugggaug

SEQ ID NO: 2188888 - RNA, 17 nt, Homo sapiens
agaugucucuggggcag

SEQ ID NO: 2188889 - RNA, 15 nt, Homo sapiens
accacacacacaagg

SEQ ID NO: 2188890 - RNA, 21 nt, Homo sapiens
aagaaggaguucugacauuca

SEQ ID NO: 2188891 - RNA, 14 nt, Homo sapiens
agaucaagcauuac

SEQ ID NO: 2188892 - RNA, 12 nt, Homo sapiens
uaauacuugcaa

SEQ ID NO: 2188893 - RNA, 16 nt, Homo sapiens
caugauauuguaugua

SEQ ID NO: 2188894 - RNA, 14 nt, Homo sapiens
gccgacucagcaac

SEQ ID NO: 2188895 - RNA, 13 nt, Homo sapiens
ucauuaaccaucu

SEQ ID NO: 2188896 - RNA, 17 nt, Homo sapiens
uuaaacaguugcacagc

SEQ ID NO: 2188897 - RNA, 16 nt, Homo sapiens
ugaacaauaugaaauc

SEQ ID NO: 2188898 - RNA, 23 nt, Homo sapiens
gcccaugcccuccguccuggcag

SEQ ID NO: 2188899 - RNA, 22 nt, Homo sapiens
augaucgcuuucuacacuguau

SEQ ID NO: 2188900 - RNA, 14 nt, Homo sapiens
ccuaagaggcagug

SEQ ID NO: 2188901 - RNA, 22 nt, Homo sapiens
cuuggaccgaguagaggcauuu

SEQ ID NO: 2188902 - RNA, 14 nt, Homo sapiens
gacuggacagccag

SEQ ID NO: 2188903 - RNA, 23 nt, Homo sapiens
ugagauuacaggugugagccacu

SEQ ID NO: 2188904 - RNA, 17 nt, Homo sapiens
uugcuuuauccaaaagu

SEQ ID NO: 2188905 - RNA, 19 nt, Homo sapiens
ugucacacgauaaagggau

SEQ ID NO: 2188906 - RNA, 19 nt, Homo sapiens
uagcaagauauugaucaaa

SEQ ID NO: 2188907 - RNA, 13 nt, Homo sapiens
auggggaggacaa

SEQ ID NO: 2188908 - RNA, 13 nt, Homo sapiens
auggagaggacag

SEQ ID NO: 2188909 - RNA, 22 nt, Homo sapiens
acagagcaagcgaaagagcaaa

SEQ ID NO: 2188910 - RNA, 16 nt, Homo sapiens
aggguuugcacuccac

SEQ ID NO: 2188911 - RNA, 13 nt, Homo sapiens
ccuccagccacuu

SEQ ID NO: 2188912 - RNA, 14 nt, Homo sapiens
gcacagccucagaa

SEQ ID NO: 2188913 - RNA, 12 nt, Homo sapiens
gacuauguuugg

SEQ ID NO: 2188914 - RNA, 22 nt, Homo sapiens
gaaaauaaauaucacaguauua

SEQ ID NO: 2188915 - RNA, 20 nt, Homo sapiens
acauauguaauucuuuccau

SEQ ID NO: 2188916 - RNA, 22 nt, Homo sapiens
cucaaagagggagugcauuuau

SEQ ID NO: 2188917 - RNA, 19 nt, Homo sapiens
uuagugguuacccaguuag

SEQ ID NO: 2188918 - RNA, 21 nt, Homo sapiens
cuuuauucucaguaacuuuua

SEQ ID NO: 2188919 - RNA, 17 nt, Homo sapiens
gcuuaggagacagauca

SEQ ID NO: 2188920 - RNA, 15 nt, Homo sapiens
ugauccauccaucuc

SEQ ID NO: 2188921 - RNA, 23 nt, Homo sapiens
ucacuaccuuuauagcucucauc

SEQ ID NO: 2188922 - RNA, 14 nt, Homo sapiens
ggggcuuuugccac

SEQ ID NO: 2188923 - RNA, 17 nt, Homo sapiens
cucuuguauaugaugau

SEQ ID NO: 2188924 - RNA, 21 nt, Homo sapiens
caacucaagucccaggcccca

SEQ ID NO: 2188925 - RNA, 14 nt, Homo sapiens
cagccuccaacaca

SEQ ID NO: 2188926 - RNA, 22 nt, Homo sapiens
gaagaguggguuucacaaguga

SEQ ID NO: 2188927 - RNA, 15 nt, Homo sapiens
cacagccugggacca

SEQ ID NO: 2188928 - RNA, 20 nt, Homo sapiens
ggccucaucucugccugaca

SEQ ID NO: 2188929 - RNA, 18 nt, Homo sapiens
caauucuggacagacaga

SEQ ID NO: 2188930 - RNA, 15 nt, Homo sapiens
cuccuauucaacaca

SEQ ID NO: 2188931 - RNA, 16 nt, Homo sapiens
caucuccuuugcagaa

SEQ ID NO: 2188932 - RNA, 20 nt, Homo sapiens
cauccagaguucugugacac

SEQ ID NO: 2188933 - RNA, 22 nt, Homo sapiens
cugaacugcgccaucaacucca

SEQ ID NO: 2188934 - RNA, 20 nt, Homo sapiens
aauagaauacccuaaaguau

SEQ ID NO: 2188935 - RNA, 14 nt, Homo sapiens
agguggaagcagag

SEQ ID NO: 2188936 - RNA, 23 nt, Homo sapiens
acuucuuuaaaaaaacacauaau

SEQ ID NO: 2188937 - RNA, 21 nt, Homo sapiens
cucaaggggcuggaaucucau

SEQ ID NO: 2188938 - RNA, 22 nt, Homo sapiens
aagaguauuaagagcaauucaa

SEQ ID NO: 2188939 - RNA, 23 nt, Homo sapiens
gucacaugcuagcagcugugaug

SEQ ID NO: 2188940 - RNA, 17 nt, Homo sapiens
gacccuggggcaggggu

SEQ ID NO: 2188941 - RNA, 14 nt, Homo sapiens
augcagggacaaau

SEQ ID NO: 2188942 - RNA, 20 nt, Homo sapiens
ugagacaggaggauugccug

SEQ ID NO: 2188943 - RNA, 21 nt, Homo sapiens
uucauucaagucuaugaugcu

SEQ ID NO: 2188944 - RNA, 15 nt, Homo sapiens
ccuuugcuaaugcua

SEQ ID NO: 2188945 - RNA, 21 nt, Homo sapiens
auuaacugaggcauccacuuc

SEQ ID NO: 2188946 - RNA, 21 nt, Homo sapiens
ucacgauugucaucaggagaa

SEQ ID NO: 2188947 - RNA, 18 nt, Homo sapiens
gacagauggaccaaaaga

SEQ ID NO: 2188948 - RNA, 23 nt, Homo sapiens
ucccuguguugucccaucugccc

SEQ ID NO: 2188949 - RNA, 18 nt, Homo sapiens
aggccauaccaggugcua

SEQ ID NO: 2188950 - RNA, 11 nt, Homo sapiens
aucagugccau

SEQ ID NO: 2188951 - RNA, 16 nt, Homo sapiens
uaagugagauguuugg

SEQ ID NO: 2188952 - RNA, 16 nt, Homo sapiens
caggauuucauugacu

SEQ ID NO: 2188953 - RNA, 13 nt, Homo sapiens
agacagaugucag

SEQ ID NO: 2188954 - RNA, 18 nt, Homo sapiens
aacauugaacucauaucu

SEQ ID NO: 2188955 - RNA, 22 nt, Homo sapiens
gcccauacuuguaaucccagcu

SEQ ID NO: 2188956 - RNA, 19 nt, Homo sapiens
uacaauaauucuaugagau

SEQ ID NO: 2188957 - RNA, 13 nt, Homo sapiens
gccuuccccauca

SEQ ID NO: 2188958 - RNA, 20 nt, Homo sapiens
ccccuguauucucagcacuu

SEQ ID NO: 2188959 - RNA, 18 nt, Homo sapiens
gccauccuaaaagccacc

SEQ ID NO: 2188960 - RNA, 16 nt, Homo sapiens
ucuacaaaauauagcu

SEQ ID NO: 2188961 - RNA, 21 nt, Homo sapiens
caugcucauggggagggagca

SEQ ID NO: 2188962 - RNA, 18 nt, Homo sapiens
accccugccuacuuccuu

SEQ ID NO: 2188963 - RNA, 12 nt, Homo sapiens
ugguccaugccu

SEQ ID NO: 2188964 - RNA, 22 nt, Homo sapiens
guaauaauaaaucguccuccca

SEQ ID NO: 2188965 - RNA, 17 nt, Homo sapiens
cacuguuuauugaagaa

SEQ ID NO: 2188966 - RNA, 24 nt, Homo sapiens
caacacagugaaacuccaucucaa

SEQ ID NO: 2188967 - RNA, 16 nt, Homo sapiens
cugugugagugcucug

SEQ ID NO: 2188968 - RNA, 20 nt, Homo sapiens
ugagauugagcgccacgaca

SEQ ID NO: 2188969 - RNA, 17 nt, Homo sapiens
aagagagucgcaucuca

SEQ ID NO: 2188970 - RNA, 16 nt, Homo sapiens
agcacugcuccagugg

SEQ ID NO: 2188971 - RNA, 14 nt, Homo sapiens
auggucccaaauga

SEQ ID NO: 2188972 - RNA, 23 nt, Homo sapiens
ccuccucccaccugccaccaggc

SEQ ID NO: 2188973 - RNA, 23 nt, Homo sapiens
aaaagcccucaucuucucuuucu

SEQ ID NO: 2188974 - RNA, 17 nt, Homo sapiens
agagagauauaucugaa

SEQ ID NO: 2188975 - RNA, 23 nt, Homo sapiens
uauuucaaaguguguuggauuaa

SEQ ID NO: 2188976 - RNA, 20 nt, Homo sapiens
augagccacagaaauugcau

SEQ ID NO: 2188977 - RNA, 13 nt, Homo sapiens
cacugugucucau

SEQ ID NO: 2188978 - RNA, 18 nt, Homo sapiens
uuacagaauggaucaugu

SEQ ID NO: 2188979 - RNA, 23 nt, Homo sapiens
acaccucaguucccuuggccuca

SEQ ID NO: 2188980 - RNA, 14 nt, Homo sapiens
uugccacacugugg

SEQ ID NO: 2188981 - RNA, 19 nt, Homo sapiens
agaucgaggcuacagugag

SEQ ID NO: 2188982 - RNA, 18 nt, Homo sapiens
ugaauccaaaucuguccu

SEQ ID NO: 2188983 - RNA, 13 nt, Homo sapiens
cuauaaaaucaaa

SEQ ID NO: 2188984 - RNA, 19 nt, Homo sapiens
cuaaugugcugugugacau

SEQ ID NO: 2188985 - RNA, 16 nt, Homo sapiens
gacaacugacaauaug

SEQ ID NO: 2188986 - RNA, 21 nt, Homo sapiens
auaauaaaacuaaacuuucau

SEQ ID NO: 2188987 - RNA, 14 nt, Homo sapiens
uaguauucuuuauu

SEQ ID NO: 2188988 - RNA, 17 nt, Homo sapiens
gucucuuccaguuugcu

SEQ ID NO: 2188989 - RNA, 12 nt, Homo sapiens
caccaaagggaa

SEQ ID NO: 2188990 - RNA, 20 nt, Homo sapiens
guauaaccccaccuugccaa

SEQ ID NO: 2188991 - RNA, 13 nt, Homo sapiens
ggugccucaggac

SEQ ID NO: 2188992 - RNA, 22 nt, Homo sapiens
cauguguaggagucugggcaca

SEQ ID NO: 2188993 - RNA, 16 nt, Homo sapiens
augcuagcagcuguga

SEQ ID NO: 2188994 - RNA, 19 nt, Homo sapiens
uggaagagcuccuugauau

SEQ ID NO: 2188995 - RNA, 13 nt, Homo sapiens
auuccugauaaua

SEQ ID NO: 2188996 - RNA, 14 nt, Homo sapiens
cauaaaucacuuca

SEQ ID NO: 2188997 - RNA, 19 nt, Homo sapiens
uuuuaguucugacuuugaa

SEQ ID NO: 2188998 - RNA, 18 nt, Homo sapiens
uccauuaaacuucuacug

SEQ ID NO: 2188999 - RNA, 23 nt, Homo sapiens
agguuaucugccuggccuggcuc

SEQ ID NO: 2189000 - RNA, 12 nt, Homo sapiens
uuaaucugugua

SEQ ID NO: 2189001 - RNA, 13 nt, Homo sapiens
uaguuugcacuuc

SEQ ID NO: 2189002 - RNA, 14 nt, Homo sapiens
aacugacuaaccau

SEQ ID NO: 2189003 - RNA, 12 nt, Homo sapiens
ccagcuaucugc

SEQ ID NO: 2189004 - RNA, 13 nt, Homo sapiens
uucuauuucauau

SEQ ID NO: 2189005 - RNA, 14 nt, Homo sapiens
auuucacuggagca

SEQ ID NO: 2189006 - RNA, 21 nt, Homo sapiens
uacauuucauaaggccugccc

SEQ ID NO: 2189007 - RNA, 11 nt, Homo sapiens
ccauugcacaa

SEQ ID NO: 2189008 - RNA, 15 nt, Homo sapiens
uguaucaugugcuag

SEQ ID NO: 2189009 - RNA, 21 nt, Homo sapiens
gaaaguagaucauguucacug

SEQ ID NO: 2189010 - RNA, 13 nt, Homo sapiens
auguuuuguaaga

SEQ ID NO: 2189011 - RNA, 20 nt, Homo sapiens
cugcccuucccccugcaaaa

SEQ ID NO: 2189012 - RNA, 22 nt, Homo sapiens
uacaguaaaacaauugugacag

SEQ ID NO: 2189013 - RNA, 14 nt, Homo sapiens
uaugucguaaguca

SEQ ID NO: 2189014 - RNA, 17 nt, Homo sapiens
uuccugacuuaaaacaa

SEQ ID NO: 2189015 - RNA, 20 nt, Homo sapiens
gcagccucuucaaaaugagc

SEQ ID NO: 2189016 - RNA, 21 nt, Homo sapiens
gcacugccggcccagugacac

SEQ ID NO: 2189017 - RNA, 16 nt, Homo sapiens
gccaggggcaguuuua

SEQ ID NO: 2189018 - RNA, 19 nt, Homo sapiens
ugaaugccucaaugugacc

SEQ ID NO: 2189019 - RNA, 13 nt, Homo sapiens
agaaaucccugag

SEQ ID NO: 2189020 - RNA, 21 nt, Homo sapiens
gcuggagucaaaacacuugua

SEQ ID NO: 2189021 - RNA, 19 nt, Homo sapiens
guuuccuagcugugugaau

SEQ ID NO: 2189022 - RNA, 14 nt, Homo sapiens
caugguagacugug

SEQ ID NO: 2189023 - RNA, 21 nt, Homo sapiens
uucaaugcuucuuuuagucag

SEQ ID NO: 2189024 - RNA, 21 nt, Homo sapiens
caaaaagaggcuaugugagca

SEQ ID NO: 2189025 - RNA, 13 nt, Homo sapiens
uacaucuaacuca

SEQ ID NO: 2189026 - RNA, 11 nt, Homo sapiens
gaaacauuuag

SEQ ID NO: 2189027 - RNA, 14 nt, Homo sapiens
ccacuuucccacac

SEQ ID NO: 2189028 - RNA, 12 nt, Homo sapiens
cuucugcuaaaa

SEQ ID NO: 2189029 - RNA, 19 nt, Homo sapiens
acacccugccccuggugcc

SEQ ID NO: 2189030 - RNA, 16 nt, Homo sapiens
ucugguuauaucauuc

SEQ ID NO: 2189031 - RNA, 16 nt, Homo sapiens
cacacagugacaaaag

SEQ ID NO: 2189032 - RNA, 19 nt, Homo sapiens
aagguauuuuaaucaccaa

SEQ ID NO: 2189033 - RNA, 19 nt, Homo sapiens
gagguuguuuuaaagucag

SEQ ID NO: 2189034 - RNA, 15 nt, Homo sapiens
gcagggccacuggaa

SEQ ID NO: 2189035 - RNA, 15 nt, Homo sapiens
aguccucugcuaaaa

SEQ ID NO: 2189036 - RNA, 21 nt, Homo sapiens
gcgcaacaacaaggacccugu

SEQ ID NO: 2189037 - RNA, 23 nt, Homo sapiens
cauuccaagaauagcaucuguac

SEQ ID NO: 2189038 - RNA, 21 nt, Homo sapiens
cuuuuugaauucuauguuggc

SEQ ID NO: 2189039 - RNA, 23 nt, Homo sapiens
aaaaacucuuuggugcacaagua

SEQ ID NO: 2189040 - RNA, 19 nt, Homo sapiens
gaaggauuuugcaguucuu

SEQ ID NO: 2189041 - RNA, 14 nt, Homo sapiens
aguuuuugcugaag

SEQ ID NO: 2189042 - RNA, 18 nt, Homo sapiens
cugaaugcauucagggga

SEQ ID NO: 2189043 - RNA, 17 nt, Homo sapiens
auuaaacuuaugaaugu

SEQ ID NO: 2189044 - RNA, 12 nt, Homo sapiens
aaaggagccugu

SEQ ID NO: 2189045 - RNA, 18 nt, Homo sapiens
ggucugugugaauguggg

SEQ ID NO: 2189046 - RNA, 13 nt, Homo sapiens
ccucaauucacau

SEQ ID NO: 2189047 - RNA, 13 nt, Homo sapiens
gcaccguggucag

SEQ ID NO: 2189048 - RNA, 20 nt, Homo sapiens
uggaggaacugcuugugcac

SEQ ID NO: 2189049 - RNA, 15 nt, Homo sapiens
acgauuucacugaca

SEQ ID NO: 2189050 - RNA, 13 nt, Homo sapiens
auagcuucaggag

SEQ ID NO: 2189051 - RNA, 15 nt, Homo sapiens
ggacaauaugugcca

SEQ ID NO: 2189052 - RNA, 21 nt, Homo sapiens
agcuuucuccucauccauuuc

SEQ ID NO: 2189053 - RNA, 22 nt, Homo sapiens
cugcuaagauuccuuuugucaa

SEQ ID NO: 2189054 - RNA, 17 nt, Homo sapiens
cuuaaauauugcucuau

SEQ ID NO: 2189055 - RNA, 12 nt, Homo sapiens
acucaaacaauc

SEQ ID NO: 2189056 - RNA, 23 nt, Homo sapiens
cccugccuguuaaggaaacuuua

SEQ ID NO: 2189057 - RNA, 22 nt, Homo sapiens
uucaugaaauaaagacucuugg

SEQ ID NO: 2189058 - RNA, 16 nt, Homo sapiens
ggugggcccccaauga

SEQ ID NO: 2189059 - RNA, 20 nt, Homo sapiens
uaaacuuaauuuuguaaaac

SEQ ID NO: 2189060 - RNA, 13 nt, Homo sapiens
cuccuauacucua

SEQ ID NO: 2189061 - RNA, 13 nt, Homo sapiens
uauuuauauauca

SEQ ID NO: 2189062 - RNA, 22 nt, Homo sapiens
cuugcaaaaaguagacuuggug

SEQ ID NO: 2189063 - RNA, 22 nt, Homo sapiens
guucuuggugaugcuggcagcc

SEQ ID NO: 2189064 - RNA, 21 nt, Homo sapiens
ucuacauuaaaucacuugaau

SEQ ID NO: 2189065 - RNA, 18 nt, Homo sapiens
gaucuucgugauacugua

SEQ ID NO: 2189066 - RNA, 17 nt, Homo sapiens
aaauuaauacugaagga

SEQ ID NO: 2189067 - RNA, 12 nt, Homo sapiens
uauacuguguau

SEQ ID NO: 2189068 - RNA, 14 nt, Homo sapiens
acacugugacuuaa

SEQ ID NO: 2189069 - RNA, 17 nt, Homo sapiens
aaagcaaaacagacugu

SEQ ID NO: 2189070 - RNA, 16 nt, Homo sapiens
uaucugguuauaucau

SEQ ID NO: 2189071 - RNA, 21 nt, Homo sapiens
cgauaguuuacugagaaugau

SEQ ID NO: 2189072 - RNA, 13 nt, Homo sapiens
cauccacuuucca

SEQ ID NO: 2189073 - RNA, 18 nt, Homo sapiens
ugguuggcaacaggccaa

SEQ ID NO: 2189074 - RNA, 16 nt, Homo sapiens
agcccccgccccagag

SEQ ID NO: 2189075 - RNA, 14 nt, Homo sapiens
gggucugaaagggg

SEQ ID NO: 2189076 - RNA, 13 nt, Homo sapiens
ucuguucauuuca

SEQ ID NO: 2189077 - RNA, 12 nt, Homo sapiens
aaggcauccacu

SEQ ID NO: 2189078 - RNA, 22 nt, Homo sapiens
caaaccacuucuccaugcugca

SEQ ID NO: 2189079 - RNA, 22 nt, Homo sapiens
cagaguauauuuaagaagccaa

SEQ ID NO: 2189080 - RNA, 23 nt, Homo sapiens
ucugauggcacauuagaugaagu

SEQ ID NO: 2189081 - RNA, 21 nt, Homo sapiens
ugagauuuccuccuggccuuu

SEQ ID NO: 2189082 - RNA, 11 nt, Homo sapiens
auaucuuggcc

SEQ ID NO: 2189083 - RNA, 18 nt, Homo sapiens
uccauauacauauauugu

SEQ ID NO: 2189084 - RNA, 16 nt, Homo sapiens
aacuggaauuucgcuc

SEQ ID NO: 2189085 - RNA, 23 nt, Homo sapiens
gaccuuaaaauguguacagugaa

SEQ ID NO: 2189086 - RNA, 22 nt, Homo sapiens
uuuuguuaacugauuugcaaua

SEQ ID NO: 2189087 - RNA, 17 nt, Homo sapiens
agacaaaguucauucaa

SEQ ID NO: 2189088 - RNA, 23 nt, Homo sapiens
cuuuugcuagagcugacagcuuu

SEQ ID NO: 2189089 - RNA, 12 nt, Homo sapiens
cuuccuccucag

SEQ ID NO: 2189090 - RNA, 20 nt, Homo sapiens
gcugcauccaggacugugcc

SEQ ID NO: 2189091 - RNA, 20 nt, Homo sapiens
gacuuguauaucccacuggg

SEQ ID NO: 2189092 - RNA, 20 nt, Homo sapiens
uuagcuaggcuaaaacaccu

SEQ ID NO: 2189093 - RNA, 14 nt, Homo sapiens
aauccacucuccau

SEQ ID NO: 2189094 - RNA, 13 nt, Homo sapiens
agcugcucgcaca

SEQ ID NO: 2189095 - RNA, 23 nt, Homo sapiens
cacagcugcuuucuguugucauu

SEQ ID NO: 2189096 - RNA, 19 nt, Homo sapiens
agcugcacugaugcugccc

SEQ ID NO: 2189097 - RNA, 15 nt, Homo sapiens
acagauuuuaauugu

SEQ ID NO: 2189098 - RNA, 20 nt, Homo sapiens
uggggaggaagaaguguaac

SEQ ID NO: 2189099 - RNA, 18 nt, Homo sapiens
uggaaaguagaaaagccc

SEQ ID NO: 2189100 - RNA, 14 nt, Homo sapiens
uucaguggcagcug

SEQ ID NO: 2189101 - RNA, 20 nt, Homo sapiens
agagcuuggacuacacaaua

SEQ ID NO: 2189102 - RNA, 20 nt, Homo sapiens
aauguauuccugaaaagcug

SEQ ID NO: 2189103 - RNA, 14 nt, Homo sapiens
ucaacaaaccacaa

SEQ ID NO: 2189104 - RNA, 23 nt, Homo sapiens
ugcaauaccaaguauagccuaug

SEQ ID NO: 2189105 - RNA, 14 nt, Homo sapiens
cacaaauggcuaca

SEQ ID NO: 2189106 - RNA, 18 nt, Homo sapiens
aggacaaauaaagcaaug

SEQ ID NO: 2189107 - RNA, 22 nt, Homo sapiens
gcuucauagagcaaccagucaa

SEQ ID NO: 2189108 - RNA, 23 nt, Homo sapiens
ucccaggguggacuucagugugu

SEQ ID NO: 2189109 - RNA, 16 nt, Homo sapiens
cagaaaagcaccugcc

SEQ ID NO: 2189110 - RNA, 16 nt, Homo sapiens
uauuuagaacugccaa

SEQ ID NO: 2189111 - RNA, 12 nt, Homo sapiens
ccaggcuguagg

SEQ ID NO: 2189112 - RNA, 15 nt, Homo sapiens
aggaggaaacuacac

SEQ ID NO: 2189113 - RNA, 16 nt, Homo sapiens
auuaaguacaugguca

SEQ ID NO: 2189114 - RNA, 16 nt, Homo sapiens
aagccaagacaguggc

SEQ ID NO: 2189115 - RNA, 21 nt, Homo sapiens
uuauuucugcugcuuggcaca

SEQ ID NO: 2189116 - RNA, 18 nt, Homo sapiens
ugaguucugcacauacag

SEQ ID NO: 2189117 - RNA, 13 nt, Homo sapiens
caguuucuuccau

SEQ ID NO: 2189118 - RNA, 23 nt, Homo sapiens
agccucaucaucagagccuuucc

SEQ ID NO: 2189119 - RNA, 23 nt, Homo sapiens
aggccugagauuucaucugcucu

SEQ ID NO: 2189120 - RNA, 23 nt, Homo sapiens
agggcuauggccucccuaugcuu

SEQ ID NO: 2189121 - RNA, 23 nt, Homo sapiens
uaugaaagagaaaaugcuuucuc

SEQ ID NO: 2189122 - RNA, 14 nt, Homo sapiens
gaaccaccccggcc

SEQ ID NO: 2189123 - RNA, 14 nt, Homo sapiens
agucgggacuugaa

SEQ ID NO: 2189124 - RNA, 22 nt, Homo sapiens
gagaaauccuuccuaaacccaa

SEQ ID NO: 2189125 - RNA, 19 nt, Homo sapiens
auacuguaaucgugcuauu

SEQ ID NO: 2189126 - RNA, 19 nt, Homo sapiens
agcuaauuuauagcaagau

SEQ ID NO: 2189127 - RNA, 21 nt, Homo sapiens
gccacagaggacucacuugcc

SEQ ID NO: 2189128 - RNA, 20 nt, Homo sapiens
gccuacccgauuauagcaga

SEQ ID NO: 2189129 - RNA, 19 nt, Homo sapiens
ccuggguauccccugccuc

SEQ ID NO: 2189130 - RNA, 17 nt, Homo sapiens
uuaaacugggaaaugag

SEQ ID NO: 2189131 - RNA, 13 nt, Homo sapiens
auaaaugcacugu

SEQ ID NO: 2189132 - RNA, 22 nt, Homo sapiens
gcccuuccucacagaguuaaau

SEQ ID NO: 2189133 - RNA, 22 nt, Homo sapiens
cauacuccuaugcuuuagcuua

SEQ ID NO: 2189134 - RNA, 17 nt, Homo sapiens
gcacuugugauccuaaa

SEQ ID NO: 2189135 - RNA, 23 nt, Homo sapiens
aauuacuuugugaauagaacucu

SEQ ID NO: 2189136 - RNA, 23 nt, Homo sapiens
accugccuucucacuagcugucu

SEQ ID NO: 2189137 - RNA, 16 nt, Homo sapiens
ugcacuuggugcugcg

SEQ ID NO: 2189138 - RNA, 20 nt, Homo sapiens
uaccacuuauaucaacuuau

SEQ ID NO: 2189139 - RNA, 20 nt, Homo sapiens
acagcacccaggcuccaugg

SEQ ID NO: 2189140 - RNA, 22 nt, Homo sapiens
cacaguucuccauuucacuuga

SEQ ID NO: 2189141 - RNA, 16 nt, Homo sapiens
auauaggagcaauacu

SEQ ID NO: 2189142 - RNA, 23 nt, Homo sapiens
ggaugccgagguaaaaguucuuu

SEQ ID NO: 2189143 - RNA, 15 nt, Homo sapiens
aaauaccagccagca

SEQ ID NO: 2189144 - RNA, 16 nt, Homo sapiens
cccacgccuccugcca

SEQ ID NO: 2189145 - RNA, 19 nt, Homo sapiens
aauagacaguaugacauau

SEQ ID NO: 2189146 - RNA, 23 nt, Homo sapiens
aagacugaaucuaccugcccuaa

SEQ ID NO: 2189147 - RNA, 15 nt, Homo sapiens
gccuaugagaugaaa

SEQ ID NO: 2189148 - RNA, 19 nt, Homo sapiens
cugaaucagcuggacauac

SEQ ID NO: 2189149 - RNA, 20 nt, Homo sapiens
guuacagacaaagcguggug

SEQ ID NO: 2189150 - RNA, 18 nt, Homo sapiens
aagaucuagucuguuaca

SEQ ID NO: 2189151 - RNA, 16 nt, Homo sapiens
gcuuuauacaguugaa

SEQ ID NO: 2189152 - RNA, 19 nt, Homo sapiens
gucuccauaggacaggaag

SEQ ID NO: 2189153 - RNA, 14 nt, Homo sapiens
uaaaguacagacuu

SEQ ID NO: 2189154 - RNA, 13 nt, Homo sapiens
aaucugacuuuag

SEQ ID NO: 2189155 - RNA, 14 nt, Homo sapiens
uagcaccauugcac

SEQ ID NO: 2189156 - RNA, 14 nt, Homo sapiens
cucaaacacacaaa

SEQ ID NO: 2189157 - RNA, 15 nt, Homo sapiens
cagccugguggccca

SEQ ID NO: 2189158 - RNA, 18 nt, Homo sapiens
augacaauuuucuaccac

SEQ ID NO: 2189159 - RNA, 22 nt, Homo sapiens
ugggacacuccgucugcuccaa

SEQ ID NO: 2189160 - RNA, 16 nt, Homo sapiens
ucagacgccaggcacc

SEQ ID NO: 2189161 - RNA, 15 nt, Homo sapiens
gcugcaaaccaggcc

SEQ ID NO: 2189162 - RNA, 17 nt, Homo sapiens
gccucagagacaucagc

SEQ ID NO: 2189163 - RNA, 23 nt, Homo sapiens
gggaauacugugcauaagccauu

SEQ ID NO: 2189164 - RNA, 18 nt, Homo sapiens
uuguccccacuuacagau

SEQ ID NO: 2189165 - RNA, 20 nt, Homo sapiens
gccucucccaaguccagugu

SEQ ID NO: 2189166 - RNA, 20 nt, Homo sapiens
ucuugggcccaggacuguug

SEQ ID NO: 2189167 - RNA, 14 nt, Homo sapiens
ccacccuucuucag

SEQ ID NO: 2189168 - RNA, 12 nt, Homo sapiens
accaaaauugag

SEQ ID NO: 2189169 - RNA, 19 nt, Homo sapiens
cagguuuguuuucagcacu

SEQ ID NO: 2189170 - RNA, 22 nt, Homo sapiens
gcuccaaccugcaaagaucugu

SEQ ID NO: 2189171 - RNA, 15 nt, Homo sapiens
guacucuugcugaug

SEQ ID NO: 2189172 - RNA, 13 nt, Homo sapiens
auaguuacuguaa

SEQ ID NO: 2189173 - RNA, 16 nt, Homo sapiens
uauacaguguacaugu

SEQ ID NO: 2189174 - RNA, 14 nt, Homo sapiens
uuuucugugccuga

SEQ ID NO: 2189175 - RNA, 23 nt, Homo sapiens
gaauuaagacgguuaaauacugu

SEQ ID NO: 2189176 - RNA, 14 nt, Homo sapiens
caaugugauucuuc

SEQ ID NO: 2189177 - RNA, 12 nt, Homo sapiens
agauuacaggug

SEQ ID NO: 2189178 - RNA, 18 nt, Homo sapiens
cuaccuuauagagcacaa

SEQ ID NO: 2189179 - RNA, 14 nt, Homo sapiens
cacagaagcuuugu

SEQ ID NO: 2189180 - RNA, 15 nt, Homo sapiens
ccugguauauccaaa

SEQ ID NO: 2189181 - RNA, 19 nt, Homo sapiens
ucuuaacauuuuguauaaa

SEQ ID NO: 2189182 - RNA, 22 nt, Homo sapiens
guugcaaaucacucugcaaugg

SEQ ID NO: 2189183 - RNA, 23 nt, Homo sapiens
ucuuugguguacaaaauggaauu

SEQ ID NO: 2189184 - RNA, 16 nt, Homo sapiens
accauuuuacauuucu

SEQ ID NO: 2189185 - RNA, 16 nt, Homo sapiens
ugaaguuaugcuguca

SEQ ID NO: 2189186 - RNA, 16 nt, Homo sapiens
cacuaagaggaggcag

SEQ ID NO: 2189187 - RNA, 15 nt, Homo sapiens
uauaaaugaauuugc

SEQ ID NO: 2189188 - RNA, 18 nt, Homo sapiens
uggagauuaaucuaccau

SEQ ID NO: 2189189 - RNA, 13 nt, Homo sapiens
gcaguaccauuca

SEQ ID NO: 2189190 - RNA, 20 nt, Homo sapiens
gcaauaaguugaaugauaau

SEQ ID NO: 2189191 - RNA, 19 nt, Homo sapiens
ugcugacaacuuagcucag

SEQ ID NO: 2189192 - RNA, 13 nt, Homo sapiens
cagcucuggagaa

SEQ ID NO: 2189193 - RNA, 16 nt, Homo sapiens
ggcaucuccugugcau

SEQ ID NO: 2189194 - RNA, 14 nt, Homo sapiens
caucuuccauugcc

SEQ ID NO: 2189195 - RNA, 13 nt, Homo sapiens
uaaggacuacaga

SEQ ID NO: 2189196 - RNA, 20 nt, Homo sapiens
agagccuucacugguucugc

SEQ ID NO: 2189197 - RNA, 24 nt, Homo sapiens
agaugaccuacagugcuguguacc

SEQ ID NO: 2189198 - RNA, 14 nt, Homo sapiens
augagaacuaaaua

SEQ ID NO: 2189199 - RNA, 22 nt, Homo sapiens
cgcccugggcucgucuuugcag

SEQ ID NO: 2189200 - RNA, 21 nt, Homo sapiens
uuuggcucuucuaaucagagc

SEQ ID NO: 2189201 - RNA, 22 nt, Homo sapiens
cccugccacauacaggugcuca

SEQ ID NO: 2189202 - RNA, 22 nt, Homo sapiens
cacaggcagcauuuagcacaua

SEQ ID NO: 2189203 - RNA, 16 nt, Homo sapiens
caaaaugagcaguaaa

SEQ ID NO: 2189204 - RNA, 20 nt, Homo sapiens
ucaacaucuuuuacauucug

SEQ ID NO: 2189205 - RNA, 19 nt, Homo sapiens
gguguggacugaaugggau

SEQ ID NO: 2189206 - RNA, 21 nt, Homo sapiens
gucucuguuccaugucuccuu

SEQ ID NO: 2189207 - RNA, 20 nt, Homo sapiens
acucccaccagcaccgugac

SEQ ID NO: 2189208 - RNA, 19 nt, Homo sapiens
gccuggcccucugugguca

SEQ ID NO: 2189209 - RNA, 20 nt, Homo sapiens
auuugaaauaacagccuuaa

SEQ ID NO: 2189210 - RNA, 15 nt, Homo sapiens
gggauguuuugacau

SEQ ID NO: 2189211 - RNA, 17 nt, Homo sapiens
cauuucaagugauuugg

SEQ ID NO: 2189212 - RNA, 13 nt, Homo sapiens
uaaacuuccaaac

SEQ ID NO: 2189213 - RNA, 18 nt, Homo sapiens
guuuaucgcaauuacuug

SEQ ID NO: 2189214 - RNA, 23 nt, Homo sapiens
guauucugcuuccacaugugcca

SEQ ID NO: 2189215 - RNA, 23 nt, Homo sapiens
cugcaauucaggccgcaagcagc

SEQ ID NO: 2189216 - RNA, 16 nt, Homo sapiens
ucaauacuuugaacac

SEQ ID NO: 2189217 - RNA, 13 nt, Homo sapiens
aaucuaggugugg

SEQ ID NO: 2189218 - RNA, 18 nt, Homo sapiens
accucaggcacuagccuu

SEQ ID NO: 2189219 - RNA, 13 nt, Homo sapiens
ugcuccuccgggu

SEQ ID NO: 2189220 - RNA, 21 nt, Homo sapiens
aaagguuugagauuccuguaa

SEQ ID NO: 2189221 - RNA, 16 nt, Homo sapiens
ucgauguccagcugcu

SEQ ID NO: 2189222 - RNA, 15 nt, Homo sapiens
aacuuuaguuugccu

SEQ ID NO: 2189223 - RNA, 14 nt, Homo sapiens
ugucuuaccaguga

SEQ ID NO: 2189224 - RNA, 14 nt, Homo sapiens
aauauuacagugaa

SEQ ID NO: 2189225 - RNA, 22 nt, Homo sapiens
gccaggauugaccuuugcacga

SEQ ID NO: 2189226 - RNA, 16 nt, Homo sapiens
uucuuugcaccaaaga

SEQ ID NO: 2189227 - RNA, 20 nt, Homo sapiens
ucaagugauccaccugccuu

SEQ ID NO: 2189228 - RNA, 22 nt, Homo sapiens
ccaaaagggccauguuucaaga

SEQ ID NO: 2189229 - RNA, 17 nt, Homo sapiens
ucacaguugagugcauc

SEQ ID NO: 2189230 - RNA, 17 nt, Homo sapiens
ucaagcuaugugagcuc

SEQ ID NO: 2189231 - RNA, 13 nt, Homo sapiens
accuucaauacuu

SEQ ID NO: 2189232 - RNA, 13 nt, Homo sapiens
accagcaauacag

SEQ ID NO: 2189233 - RNA, 14 nt, Homo sapiens
uucuggcauaacua

SEQ ID NO: 2189234 - RNA, 15 nt, Homo sapiens
agaccgggggccaga

SEQ ID NO: 2189235 - RNA, 15 nt, Homo sapiens
accucagggcauaaa

SEQ ID NO: 2189236 - RNA, 16 nt, Homo sapiens
agcuuuccuacuugca

SEQ ID NO: 2189237 - RNA, 15 nt, Homo sapiens
cauauaccuauaaug

SEQ ID NO: 2189238 - RNA, 20 nt, Homo sapiens
gcucagccccagaccugccg

SEQ ID NO: 2189239 - RNA, 21 nt, Homo sapiens
gaaagaguaaaggaaaugauu

SEQ ID NO: 2189240 - RNA, 20 nt, Homo sapiens
ucacgucacguuggucuuga

SEQ ID NO: 2189241 - RNA, 12 nt, Homo sapiens
aauucagucuca

SEQ ID NO: 2189242 - RNA, 16 nt, Homo sapiens
cccucccugugugaaa

SEQ ID NO: 2189243 - RNA, 18 nt, Homo sapiens
gccaagaaguugcucuga

SEQ ID NO: 2189244 - RNA, 17 nt, Homo sapiens
gacaaaaauucaacuca

SEQ ID NO: 2189245 - RNA, 16 nt, Homo sapiens
ucagauggcacauuag

SEQ ID NO: 2189246 - RNA, 18 nt, Homo sapiens
uuuaagaauaucuguaau

SEQ ID NO: 2189247 - RNA, 20 nt, Homo sapiens
cccggagggaaacugugaau

SEQ ID NO: 2189248 - RNA, 20 nt, Homo sapiens
aaaugcaucaaaagacuuaa

SEQ ID NO: 2189249 - RNA, 16 nt, Homo sapiens
uauaucugaagagcua

SEQ ID NO: 2189250 - RNA, 23 nt, Homo sapiens
agugacaagggcacaagcucagg

SEQ ID NO: 2189251 - RNA, 22 nt, Homo sapiens
augaaauaaaagcacacugcuu

SEQ ID NO: 2189252 - RNA, 13 nt, Homo sapiens
cuuagauugccuc

SEQ ID NO: 2189253 - RNA, 20 nt, Homo sapiens
cccacacagcuacagcuuuc

SEQ ID NO: 2189254 - RNA, 13 nt, Homo sapiens
gagaaggaugggu

SEQ ID NO: 2189255 - RNA, 13 nt, Homo sapiens
auuuaacacugag

SEQ ID NO: 2189256 - RNA, 17 nt, Homo sapiens
augcauuacuaucagug

SEQ ID NO: 2189257 - RNA, 19 nt, Homo sapiens
gcugccccuacugcaaaug

SEQ ID NO: 2189258 - RNA, 21 nt, Homo sapiens
cauuaacagcaggugugaccc

SEQ ID NO: 2189259 - RNA, 16 nt, Homo sapiens
ccaccugaaagccugu

SEQ ID NO: 2189260 - RNA, 19 nt, Homo sapiens
ugagauccugauagccugu

SEQ ID NO: 2189261 - RNA, 20 nt, Homo sapiens
auuccauguggauaucaguu

SEQ ID NO: 2189262 - RNA, 15 nt, Homo sapiens
cuuuacaaauauguc

SEQ ID NO: 2189263 - RNA, 14 nt, Homo sapiens
caaucuugguugcu

SEQ ID NO: 2189264 - RNA, 19 nt, Homo sapiens
ggguacaaggggcccagug

SEQ ID NO: 2189265 - RNA, 15 nt, Homo sapiens
ugcaucuguacucac

SEQ ID NO: 2189266 - RNA, 15 nt, Homo sapiens
uuuucugguggggcu

SEQ ID NO: 2189267 - RNA, 17 nt, Homo sapiens
gaaagauccccuaauaa

SEQ ID NO: 2189268 - RNA, 20 nt, Homo sapiens
cccagguuugauguccuucc

SEQ ID NO: 2189269 - RNA, 14 nt, Homo sapiens
uuauuauaaauucu

SEQ ID NO: 2189270 - RNA, 18 nt, Homo sapiens
ugcaucaagaugugacau

SEQ ID NO: 2189271 - RNA, 19 nt, Homo sapiens
ugacauacauauuaucuca

SEQ ID NO: 2189272 - RNA, 17 nt, Homo sapiens
uagguugaaacauaucu

SEQ ID NO: 2189273 - RNA, 21 nt, Homo sapiens
cuucucccuggggacggggcu

SEQ ID NO: 2189274 - RNA, 22 nt, Homo sapiens
gagccuucuuguguaauguaaa

SEQ ID NO: 2189275 - RNA, 19 nt, Homo sapiens
uaggggagccugugguggc

SEQ ID NO: 2189276 - RNA, 16 nt, Homo sapiens
ggaaaggcuccaggag

SEQ ID NO: 2189277 - RNA, 17 nt, Homo sapiens
gguacaaacccaaaaaa

SEQ ID NO: 2189278 - RNA, 18 nt, Homo sapiens
gaauuuagugcauuucaa

SEQ ID NO: 2189279 - RNA, 16 nt, Homo sapiens
ugacacgucucgccaa

SEQ ID NO: 2189280 - RNA, 17 nt, Homo sapiens
uauuauugaagauguga

SEQ ID NO: 2189281 - RNA, 15 nt, Homo sapiens
ggcaugguggcucau

SEQ ID NO: 2189282 - RNA, 15 nt, Homo sapiens
acaaugugcacugaa

SEQ ID NO: 2189283 - RNA, 17 nt, Homo sapiens
uucuaggaagcuccagu

SEQ ID NO: 2189284 - RNA, 13 nt, Homo sapiens
uggcuuugcuuag

SEQ ID NO: 2189285 - RNA, 17 nt, Homo sapiens
cuagugaaacugcauua

SEQ ID NO: 2189286 - RNA, 17 nt, Homo sapiens
cauuuugugaauuguga

SEQ ID NO: 2189287 - RNA, 17 nt, Homo sapiens
ccuggugugcaggguga

SEQ ID NO: 2189288 - RNA, 20 nt, Homo sapiens
gauccuucgggugcuggaag

SEQ ID NO: 2189289 - RNA, 19 nt, Homo sapiens
cauuuugaaugugaucauc

SEQ ID NO: 2189290 - RNA, 13 nt, Homo sapiens
gaccuacuuccuc

SEQ ID NO: 2189291 - RNA, 21 nt, Homo sapiens
uggagccuccaauugcagugg

SEQ ID NO: 2189292 - RNA, 18 nt, Homo sapiens
acacaguguuuuuguaaa

SEQ ID NO: 2189293 - RNA, 16 nt, Homo sapiens
ugucccucuguauacu

SEQ ID NO: 2189294 - RNA, 14 nt, Homo sapiens
auuuaaauuccaca

SEQ ID NO: 2189295 - RNA, 14 nt, Homo sapiens
gugaacacaucagc

SEQ ID NO: 2189296 - RNA, 16 nt, Homo sapiens
gaagggugacauccca

SEQ ID NO: 2189297 - RNA, 15 nt, Homo sapiens
cucuugaagagaaaa

SEQ ID NO: 2189298 - RNA, 16 nt, Homo sapiens
gcagccuagauaugaa

SEQ ID NO: 2189299 - RNA, 17 nt, Homo sapiens
uaaacucaauaaguuua

SEQ ID NO: 2189300 - RNA, 16 nt, Homo sapiens
caagccaggaccugcu

SEQ ID NO: 2189301 - RNA, 23 nt, Homo sapiens
cacaaaggguugggagcugauga

SEQ ID NO: 2189302 - RNA, 23 nt, Homo sapiens
gugaggaaagauuuuuguuguua

SEQ ID NO: 2189303 - RNA, 14 nt, Homo sapiens
ccugaagugccagc

SEQ ID NO: 2189304 - RNA, 17 nt, Homo sapiens
acgacuguuuucccaac

SEQ ID NO: 2189305 - RNA, 22 nt, Homo sapiens
ugaugucccuauggaagcauau

SEQ ID NO: 2189306 - RNA, 22 nt, Homo sapiens
uggcaacaaauauuuauacaua

SEQ ID NO: 2189307 - RNA, 14 nt, Homo sapiens
uuaugacuugcuac

SEQ ID NO: 2189308 - RNA, 18 nt, Homo sapiens
cccagguggcugacccag

SEQ ID NO: 2189309 - RNA, 15 nt, Homo sapiens
cagacuggagugcag

SEQ ID NO: 2189310 - RNA, 18 nt, Homo sapiens
aucggaguugacagugaa

SEQ ID NO: 2189311 - RNA, 21 nt, Homo sapiens
ucugguggggcuguccugcug

SEQ ID NO: 2189312 - RNA, 14 nt, Homo sapiens
auucaguacaaccc

SEQ ID NO: 2189313 - RNA, 20 nt, Homo sapiens
caggaaagagaacuuccaga

SEQ ID NO: 2189314 - RNA, 14 nt, Homo sapiens
ucugcggguccaaa

SEQ ID NO: 2189315 - RNA, 18 nt, Homo sapiens
cuauaagaugaaacauca

SEQ ID NO: 2189316 - RNA, 15 nt, Homo sapiens
ucucacagauaccca

SEQ ID NO: 2189317 - RNA, 22 nt, Homo sapiens
aagacuguggcugcuagcacuu

SEQ ID NO: 2189318 - RNA, 19 nt, Homo sapiens
uccucagguaguacuggga

SEQ ID NO: 2189319 - RNA, 16 nt, Homo sapiens
cccauucuucacucuu

SEQ ID NO: 2189320 - RNA, 22 nt, Homo sapiens
ugaauccaucaggacuugggaa

SEQ ID NO: 2189321 - RNA, 22 nt, Homo sapiens
uucaucaauaucccucuuguaa

SEQ ID NO: 2189322 - RNA, 14 nt, Homo sapiens
aguaggagcaagag

SEQ ID NO: 2189323 - RNA, 14 nt, Homo sapiens
gcuguggacugucc

SEQ ID NO: 2189324 - RNA, 17 nt, Homo sapiens
uucguauuacaagagaa

SEQ ID NO: 2189325 - RNA, 14 nt, Homo sapiens
gccuggccuaccca

SEQ ID NO: 2189326 - RNA, 18 nt, Homo sapiens
cuaaaacaagaggacaca

SEQ ID NO: 2189327 - RNA, 16 nt, Homo sapiens
auauuuaguguucaua

SEQ ID NO: 2189328 - RNA, 13 nt, Homo sapiens
ugugucauauagu

SEQ ID NO: 2189329 - RNA, 19 nt, Homo sapiens
ucccucccacccaaccaac

SEQ ID NO: 2189330 - RNA, 14 nt, Homo sapiens
cuucagaacugccc

SEQ ID NO: 2189331 - RNA, 13 nt, Homo sapiens
ccagaaaugucua

SEQ ID NO: 2189332 - RNA, 11 nt, Homo sapiens
ucaacuccugg

SEQ ID NO: 2189333 - RNA, 16 nt, Homo sapiens
ccagucacugcugcaa

SEQ ID NO: 2189334 - RNA, 16 nt, Homo sapiens
ggcaccuucauucucc

SEQ ID NO: 2189335 - RNA, 22 nt, Homo sapiens
aaugaccucagcaaauccucuu

SEQ ID NO: 2189336 - RNA, 22 nt, Homo sapiens
ggaugagcaugcuguuuaugaa

SEQ ID NO: 2189337 - RNA, 22 nt, Homo sapiens
ccaauauaguuuucuaacuccu

SEQ ID NO: 2189338 - RNA, 14 nt, Homo sapiens
cagaucacuacugc

SEQ ID NO: 2189339 - RNA, 14 nt, Homo sapiens
caggucaccaagca

SEQ ID NO: 2189340 - RNA, 17 nt, Homo sapiens
aucacucucaccuucca

SEQ ID NO: 2189341 - RNA, 17 nt, Homo sapiens
agauccaagaggcccug

SEQ ID NO: 2189342 - RNA, 17 nt, Homo sapiens
uaauguuacaacaacua

SEQ ID NO: 2189343 - RNA, 20 nt, Homo sapiens
aaaaauuuuagcucuuccca

SEQ ID NO: 2189344 - RNA, 19 nt, Homo sapiens
cuguuucugcagccacuau

SEQ ID NO: 2189345 - RNA, 15 nt, Homo sapiens
acccuaaacauccau

SEQ ID NO: 2189346 - RNA, 22 nt, Homo sapiens
agcucauuugugacaacauuuc

SEQ ID NO: 2189347 - RNA, 18 nt, Homo sapiens
ugcuccauggaugcaugc

SEQ ID NO: 2189348 - RNA, 18 nt, Homo sapiens
cccugauuuuaucauucu

SEQ ID NO: 2189349 - RNA, 19 nt, Homo sapiens
ugauuguaaaguagcugua

SEQ ID NO: 2189350 - RNA, 22 nt, Homo sapiens
uauuauaaaaauaucaaaaagg

SEQ ID NO: 2189351 - RNA, 20 nt, Homo sapiens
cggccacucuguuugcucac

SEQ ID NO: 2189352 - RNA, 19 nt, Homo sapiens
uaauuuucccaaugaucuu

SEQ ID NO: 2189353 - RNA, 19 nt, Homo sapiens
ucuuucuaagagaccugaa

SEQ ID NO: 2189354 - RNA, 21 nt, Homo sapiens
cacaauccuugccacagugug

SEQ ID NO: 2189355 - RNA, 21 nt, Homo sapiens
gaagauuagagguuugucaac

SEQ ID NO: 2189356 - RNA, 15 nt, Homo sapiens
auaguacaguuacaa

SEQ ID NO: 2189357 - RNA, 15 nt, Homo sapiens
gaaacaaaaauguac

SEQ ID NO: 2189358 - RNA, 18 nt, Homo sapiens
caagugucugugugcaag

SEQ ID NO: 2189359 - RNA, 13 nt, Homo sapiens
cauuguccagagc

SEQ ID NO: 2189360 - RNA, 16 nt, Homo sapiens
agggacuuugcugauu

SEQ ID NO: 2189361 - RNA, 13 nt, Homo sapiens
ugaaauauaccuu

SEQ ID NO: 2189362 - RNA, 15 nt, Homo sapiens
ugagccaccaugccc

SEQ ID NO: 2189363 - RNA, 23 nt, Homo sapiens
ggcugaugaugucuucugguguc

SEQ ID NO: 2189364 - RNA, 15 nt, Homo sapiens
caaaggacugaccug

SEQ ID NO: 2189365 - RNA, 15 nt, Homo sapiens
auacaaacaaugcaa

SEQ ID NO: 2189366 - RNA, 14 nt, Homo sapiens
uuuauuggcaauac

SEQ ID NO: 2189367 - RNA, 22 nt, Homo sapiens
aggccccaaucuugcccacugg

SEQ ID NO: 2189368 - RNA, 14 nt, Homo sapiens
uaguauaccauaca

SEQ ID NO: 2189369 - RNA, 19 nt, Homo sapiens
acaaucucuguuuguaugu

SEQ ID NO: 2189370 - RNA, 17 nt, Homo sapiens
cggagcuauacauaugu

SEQ ID NO: 2189371 - RNA, 17 nt, Homo sapiens
aagucagccacacuggg

SEQ ID NO: 2189372 - RNA, 13 nt, Homo sapiens
ucuuacaaugaaa

SEQ ID NO: 2189373 - RNA, 11 nt, Homo sapiens
uugaugccaag

SEQ ID NO: 2189374 - RNA, 18 nt, Homo sapiens
cgccaguugccucuugaa

SEQ ID NO: 2189375 - RNA, 15 nt, Homo sapiens
auucauaaccaaaga

SEQ ID NO: 2189376 - RNA, 14 nt, Homo sapiens
gugucuagagucau

SEQ ID NO: 2189377 - RNA, 21 nt, Homo sapiens
gcagagagggauggguuccug

SEQ ID NO: 2189378 - RNA, 19 nt, Homo sapiens
agacuugacaacaucccac

SEQ ID NO: 2189379 - RNA, 13 nt, Homo sapiens
caaccccuagcug

SEQ ID NO: 2189380 - RNA, 21 nt, Homo sapiens
gcauguuuuaugugcacucau

SEQ ID NO: 2189381 - RNA, 14 nt, Homo sapiens
auucaaagcagggu

SEQ ID NO: 2189382 - RNA, 22 nt, Homo sapiens
uuggaguaucuaaagccagugg

SEQ ID NO: 2189383 - RNA, 14 nt, Homo sapiens
ccucacccauccua

SEQ ID NO: 2189384 - RNA, 19 nt, Homo sapiens
ucaaacucccuagucucca

SEQ ID NO: 2189385 - RNA, 21 nt, Homo sapiens
cugcucucaggaccagagaag

SEQ ID NO: 2189386 - RNA, 18 nt, Homo sapiens
caagguggugugaucuua

SEQ ID NO: 2189387 - RNA, 20 nt, Homo sapiens
cuuuugcuggucacugccau

SEQ ID NO: 2189388 - RNA, 14 nt, Homo sapiens
cccuguuaagcaau

SEQ ID NO: 2189389 - RNA, 14 nt, Homo sapiens
cccugauaagcaaa

SEQ ID NO: 2189390 - RNA, 19 nt, Homo sapiens
aaauauccauauuaaguaa

SEQ ID NO: 2189391 - RNA, 12 nt, Homo sapiens
cugcgugccauc

SEQ ID NO: 2189392 - RNA, 12 nt, Homo sapiens
cugugugccauu

SEQ ID NO: 2189393 - RNA, 18 nt, Homo sapiens
ucaaccccccaagucaua

SEQ ID NO: 2189394 - RNA, 17 nt, Homo sapiens
cagaggcuuaaucacac

SEQ ID NO: 2189395 - RNA, 23 nt, Homo sapiens
uguuuuaaagaauaugacuuuuu

SEQ ID NO: 2189396 - RNA, 12 nt, Homo sapiens
uuucaaccagca

SEQ ID NO: 2189397 - RNA, 13 nt, Homo sapiens
ucucugucucaaa

SEQ ID NO: 2189398 - RNA, 13 nt, Homo sapiens
ccagggcacugag

SEQ ID NO: 2189399 - RNA, 21 nt, Homo sapiens
auauaaagguggugggcaaaa

SEQ ID NO: 2189400 - RNA, 24 nt, Homo sapiens
guuauucacaaccucaccaaacua

SEQ ID NO: 2189401 - RNA, 14 nt, Homo sapiens
acaaauacauuccu

SEQ ID NO: 2189402 - RNA, 18 nt, Homo sapiens
aaugccucuucuuuaugu

SEQ ID NO: 2189403 - RNA, 20 nt, Homo sapiens
aggagcguguacuaccccag

SEQ ID NO: 2189404 - RNA, 14 nt, Homo sapiens
uuaauuaguaucga

SEQ ID NO: 2189405 - RNA, 22 nt, Homo sapiens
cgaguguuuaaaugcuguguac

SEQ ID NO: 2189406 - RNA, 15 nt, Homo sapiens
aaccaagugcuuaua

SEQ ID NO: 2189407 - RNA, 14 nt, Homo sapiens
uccuaauggucuca

SEQ ID NO: 2189408 - RNA, 13 nt, Homo sapiens
cuugaacugagac

SEQ ID NO: 2189409 - RNA, 23 nt, Homo sapiens
aauaaacacugguuguagucagu

SEQ ID NO: 2189410 - RNA, 14 nt, Homo sapiens
ucauauaccagcaa

SEQ ID NO: 2189411 - RNA, 17 nt, Homo sapiens
uagcuguaaacugaaua

SEQ ID NO: 2189412 - RNA, 21 nt, Homo sapiens
cuucucccuugcccucccuuu

SEQ ID NO: 2189413 - RNA, 10 nt, Homo sapiens
cugcacuuuu

SEQ ID NO: 2189414 - RNA, 18 nt, Homo sapiens
cagcugcaagccagggau

SEQ ID NO: 2189415 - RNA, 13 nt, Homo sapiens
auuuaaugcugcc

SEQ ID NO: 2189416 - RNA, 16 nt, Homo sapiens
ucccacugagucacau

SEQ ID NO: 2189417 - RNA, 21 nt, Homo sapiens
cauauuuacauucuaguucag

SEQ ID NO: 2189418 - RNA, 19 nt, Homo sapiens
uagacuagguuuauuuauc

SEQ ID NO: 2189419 - RNA, 13 nt, Homo sapiens
gucccaugaccca

SEQ ID NO: 2189420 - RNA, 20 nt, Homo sapiens
cacagcgggagaacgcagua

SEQ ID NO: 2189421 - RNA, 20 nt, Homo sapiens
gagaauguuagccaugacuu

SEQ ID NO: 2189422 - RNA, 19 nt, Homo sapiens
uacuugaaauaccagugaa

SEQ ID NO: 2189423 - RNA, 11 nt, Homo sapiens
gccauaugccu

SEQ ID NO: 2189424 - RNA, 16 nt, Homo sapiens
cucuggaggaaguucu

SEQ ID NO: 2189425 - RNA, 18 nt, Homo sapiens
gccaagacaguggcagca

SEQ ID NO: 2189426 - RNA, 22 nt, Homo sapiens
cauggcccugggacacccacag

SEQ ID NO: 2189427 - RNA, 19 nt, Homo sapiens
aguagcaaguucuagagaa

SEQ ID NO: 2189428 - RNA, 14 nt, Homo sapiens
uucuuaaacacaaa

SEQ ID NO: 2189429 - RNA, 22 nt, Homo sapiens
ccuggggugaggggaggcaucu

SEQ ID NO: 2189430 - RNA, 22 nt, Homo sapiens
ucuuuuccccucauugcauuua

SEQ ID NO: 2189431 - RNA, 23 nt, Homo sapiens
ugcaucuccccucagauuccacc

SEQ ID NO: 2189432 - RNA, 18 nt, Homo sapiens
cagcuggaguucaugucg

SEQ ID NO: 2189433 - RNA, 22 nt, Homo sapiens
ccugggcauuguugagguuaag

SEQ ID NO: 2189434 - RNA, 16 nt, Homo sapiens
gacagcucugccuguu

SEQ ID NO: 2189435 - RNA, 18 nt, Homo sapiens
uucauuuggaggaaucac

SEQ ID NO: 2189436 - RNA, 15 nt, Homo sapiens
acuugcuacuuauca

SEQ ID NO: 2189437 - RNA, 23 nt, Homo sapiens
uaugagcuggggaugucucucau

SEQ ID NO: 2189438 - RNA, 16 nt, Homo sapiens
agauggggaccagcag

SEQ ID NO: 2189439 - RNA, 20 nt, Homo sapiens
uuguaaugauauagccagaa

SEQ ID NO: 2189440 - RNA, 15 nt, Homo sapiens
uuuagaucucugaag

SEQ ID NO: 2189441 - RNA, 23 nt, Homo sapiens
auguauguguaaaacaaucuguu

SEQ ID NO: 2189442 - RNA, 17 nt, Homo sapiens
ugcuaccugugagcauc

SEQ ID NO: 2189443 - RNA, 21 nt, Homo sapiens
acuacaccacacacaacagcc

SEQ ID NO: 2189444 - RNA, 15 nt, Homo sapiens
ccagccuccugcuaa

SEQ ID NO: 2189445 - RNA, 14 nt, Homo sapiens
auauuuugaucuuc

SEQ ID NO: 2189446 - RNA, 14 nt, Homo sapiens
uuauccuguucucu

SEQ ID NO: 2189447 - RNA, 17 nt, Homo sapiens
auaaaaguaaaccacaa

SEQ ID NO: 2189448 - RNA, 22 nt, Homo sapiens
cagauccucugcugacuccaua

SEQ ID NO: 2189449 - RNA, 18 nt, Homo sapiens
uguucccuuacuguuuca

SEQ ID NO: 2189450 - RNA, 18 nt, Homo sapiens
ggacccaguggcagggca

SEQ ID NO: 2189451 - RNA, 20 nt, Homo sapiens
ucucuccaccgugacacaau

SEQ ID NO: 2189452 - RNA, 20 nt, Homo sapiens
guuaaacaaguuuucaaaaa

SEQ ID NO: 2189453 - RNA, 22 nt, Homo sapiens
cagcgcaugugugcaugugcug

SEQ ID NO: 2189454 - RNA, 22 nt, Homo sapiens
gcacucaggagcacagccauag

SEQ ID NO: 2189455 - RNA, 23 nt, Homo sapiens
cucagggcauaaagcauguuuca

SEQ ID NO: 2189456 - RNA, 12 nt, Homo sapiens
auaaacugagag

SEQ ID NO: 2189457 - RNA, 19 nt, Homo sapiens
gguggggagacauaaccac

SEQ ID NO: 2189458 - RNA, 21 nt, Homo sapiens
acucuggcuucaaaaagccac

SEQ ID NO: 2189459 - RNA, 16 nt, Homo sapiens
caggcagcuauuucag

SEQ ID NO: 2189460 - RNA, 19 nt, Homo sapiens
cuuauguagcugaauguga

SEQ ID NO: 2189461 - RNA, 18 nt, Homo sapiens
cuuuaugaaaaaaauaua

SEQ ID NO: 2189462 - RNA, 23 nt, Homo sapiens
uuaauaaucagcaagaauuugau

SEQ ID NO: 2189463 - RNA, 16 nt, Homo sapiens
ucaaaaagcauuugau

SEQ ID NO: 2189464 - RNA, 21 nt, Homo sapiens
uggucauuggccgacaucaca

SEQ ID NO: 2189465 - RNA, 20 nt, Homo sapiens
gccuggccaauacggcaaaa

SEQ ID NO: 2189466 - RNA, 18 nt, Homo sapiens
gccacaguccuucuuuga

SEQ ID NO: 2189467 - RNA, 16 nt, Homo sapiens
ggaaguuuuaaucucu

SEQ ID NO: 2189468 - RNA, 12 nt, Homo sapiens
acagauaugcac

SEQ ID NO: 2189469 - RNA, 18 nt, Homo sapiens
gccuuggccuuaaggaaa

SEQ ID NO: 2189470 - RNA, 13 nt, Homo sapiens
agacauacuugaa

SEQ ID NO: 2189471 - RNA, 19 nt, Homo sapiens
accccauuucucuccucac

SEQ ID NO: 2189472 - RNA, 20 nt, Homo sapiens
accucugugaggaaagcaca

SEQ ID NO: 2189473 - RNA, 21 nt, Homo sapiens
accaugguuuuggcucuccca

SEQ ID NO: 2189474 - RNA, 16 nt, Homo sapiens
auguaugucaccucag

SEQ ID NO: 2189475 - RNA, 20 nt, Homo sapiens
ucuauuuaacugagucacac

SEQ ID NO: 2189476 - RNA, 13 nt, Homo sapiens
guuauucuugccc

SEQ ID NO: 2189477 - RNA, 22 nt, Homo sapiens
gaauguagcucaacuugugaua

SEQ ID NO: 2189478 - RNA, 16 nt, Homo sapiens
auuaacagcugauaca

SEQ ID NO: 2189479 - RNA, 23 nt, Homo sapiens
gauucccaggccaggcucccgac

SEQ ID NO: 2189480 - RNA, 17 nt, Homo sapiens
agcaggguccacagcug

SEQ ID NO: 2189481 - RNA, 18 nt, Homo sapiens
ucacaucauuugggauac

SEQ ID NO: 2189482 - RNA, 13 nt, Homo sapiens
ccauuacuuugau

SEQ ID NO: 2189483 - RNA, 15 nt, Homo sapiens
ugacauuauaugcac

SEQ ID NO: 2189484 - RNA, 17 nt, Homo sapiens
acguuagaccacaaaua

SEQ ID NO: 2189485 - RNA, 20 nt, Homo sapiens
aggauggcagcaauggcgcu

SEQ ID NO: 2189486 - RNA, 12 nt, Homo sapiens
uauauauugaau

SEQ ID NO: 2189487 - RNA, 14 nt, Homo sapiens
accauggcacuaca

SEQ ID NO: 2189488 - RNA, 15 nt, Homo sapiens
uuucagcuacauaua

SEQ ID NO: 2189489 - RNA, 22 nt, Homo sapiens
ggaacuccagagaugagugucu

SEQ ID NO: 2189490 - RNA, 23 nt, Homo sapiens
aagcuuuuguucacacacacucu

SEQ ID NO: 2189491 - RNA, 14 nt, Homo sapiens
augugucccaguga

SEQ ID NO: 2189492 - RNA, 14 nt, Homo sapiens
cuaauaccaaaauu

SEQ ID NO: 2189493 - RNA, 14 nt, Homo sapiens
acccccagugcagg

SEQ ID NO: 2189494 - RNA, 13 nt, Homo sapiens
cuccccucagagc

SEQ ID NO: 2189495 - RNA, 20 nt, Homo sapiens
aaucugaauuggaaugcacu

SEQ ID NO: 2189496 - RNA, 13 nt, Homo sapiens
gcccuugcccuug

SEQ ID NO: 2189497 - RNA, 12 nt, Homo sapiens
guuguuuuaaca

SEQ ID NO: 2189498 - RNA, 22 nt, Homo sapiens
aacagugugaugcaauuacugc

SEQ ID NO: 2189499 - RNA, 15 nt, Homo sapiens
ucauuaaaauuguga

SEQ ID NO: 2189500 - RNA, 19 nt, Homo sapiens
uugaaggggcuucuaauga

SEQ ID NO: 2189501 - RNA, 21 nt, Homo sapiens
agaacagggucauguuugcag

SEQ ID NO: 2189502 - RNA, 23 nt, Homo sapiens
acccacccccaugcacucaaaga

SEQ ID NO: 2189503 - RNA, 22 nt, Homo sapiens
uugaaucuucucccuuguccug

SEQ ID NO: 2189504 - RNA, 17 nt, Homo sapiens
ccugcgucuccugccca

SEQ ID NO: 2189505 - RNA, 17 nt, Homo sapiens
acccaauaaaacugaug

SEQ ID NO: 2189506 - RNA, 19 nt, Homo sapiens
gucuacagggaggggcccu

SEQ ID NO: 2189507 - RNA, 13 nt, Homo sapiens
gcaauaccaaugu

SEQ ID NO: 2189508 - RNA, 16 nt, Homo sapiens
acccugacuguauaca

SEQ ID NO: 2189509 - RNA, 16 nt, Homo sapiens
aggcucucaggccagc

SEQ ID NO: 2189510 - RNA, 13 nt, Homo sapiens
aagcacagguccu

SEQ ID NO: 2189511 - RNA, 17 nt, Homo sapiens
uccagcgacaauuugaa

SEQ ID NO: 2189512 - RNA, 22 nt, Homo sapiens
aggccacacagcacaugcacac

SEQ ID NO: 2189513 - RNA, 17 nt, Homo sapiens
ugcaaauggaagacaaa

SEQ ID NO: 2189514 - RNA, 19 nt, Homo sapiens
agucgcaucucagugcagg

SEQ ID NO: 2189515 - RNA, 19 nt, Homo sapiens
uuguuaugcaucauuucag

SEQ ID NO: 2189516 - RNA, 19 nt, Homo sapiens
ugcuugugccacacccucc

SEQ ID NO: 2189517 - RNA, 14 nt, Homo sapiens
agaucuccaaagcu

SEQ ID NO: 2189518 - RNA, 16 nt, Homo sapiens
acagaggcccugccac

SEQ ID NO: 2189519 - RNA, 23 nt, Homo sapiens
guacuguaauggguaauucugac

SEQ ID NO: 2189520 - RNA, 18 nt, Homo sapiens
guaggucacucuccagca

SEQ ID NO: 2189521 - RNA, 11 nt, Homo sapiens
ucuccuacuuu

SEQ ID NO: 2189522 - RNA, 13 nt, Homo sapiens
acauauacauacu

SEQ ID NO: 2189523 - RNA, 13 nt, Homo sapiens
caauacaaauaca

SEQ ID NO: 2189524 - RNA, 14 nt, Homo sapiens
aaugaugcucaaaa

SEQ ID NO: 2189525 - RNA, 17 nt, Homo sapiens
cagacacacugaucuga

SEQ ID NO: 2189526 - RNA, 21 nt, Homo sapiens
gccgagauaucgccacugcac

SEQ ID NO: 2189527 - RNA, 18 nt, Homo sapiens
uaaauauuuagucugcau

SEQ ID NO: 2189528 - RNA, 18 nt, Homo sapiens
accuuaagagacacucca

SEQ ID NO: 2189529 - RNA, 16 nt, Homo sapiens
aauaaaaucuaauuaa

SEQ ID NO: 2189530 - RNA, 14 nt, Homo sapiens
ugaauauuacuccu

SEQ ID NO: 2189531 - RNA, 18 nt, Homo sapiens
augacuguuacagcuuuc

SEQ ID NO: 2189532 - RNA, 23 nt, Homo sapiens
uuugaggauaggaguucacuuca

SEQ ID NO: 2189533 - RNA, 19 nt, Homo sapiens
ccauagcaagauugcuuaa

SEQ ID NO: 2189534 - RNA, 17 nt, Homo sapiens
ucaggagaaaccccuga

SEQ ID NO: 2189535 - RNA, 16 nt, Homo sapiens
acuugaaauucuuuca

SEQ ID NO: 2189536 - RNA, 19 nt, Homo sapiens
aagcugggauaaucacauu

SEQ ID NO: 2189537 - RNA, 16 nt, Homo sapiens
uuugauucuacucuua

SEQ ID NO: 2189538 - RNA, 16 nt, Homo sapiens
ggccucccaccaggaa

SEQ ID NO: 2189539 - RNA, 19 nt, Homo sapiens
cagcucuuccgaaaaccag

SEQ ID NO: 2189540 - RNA, 16 nt, Homo sapiens
ggcauugcacagggag

SEQ ID NO: 2189541 - RNA, 10 nt, Homo sapiens
cuuuccucag

SEQ ID NO: 2189542 - RNA, 23 nt, Homo sapiens
aacucucugucuucucuccacuu

SEQ ID NO: 2189543 - RNA, 12 nt, Homo sapiens
uuauacugcacu

SEQ ID NO: 2189544 - RNA, 14 nt, Homo sapiens
uacugaaaaucugg

SEQ ID NO: 2189545 - RNA, 16 nt, Homo sapiens
gaguuggcaugacucu

SEQ ID NO: 2189546 - RNA, 19 nt, Homo sapiens
uaauucugucauuccuaaa

SEQ ID NO: 2189547 - RNA, 13 nt, Homo sapiens
uuugcucauggca

SEQ ID NO: 2189548 - RNA, 19 nt, Homo sapiens
cugucaugcccagcuugga

SEQ ID NO: 2189549 - RNA, 15 nt, Homo sapiens
cagaucccacuggaa

SEQ ID NO: 2189550 - RNA, 17 nt, Homo sapiens
ucgugcuccccaaauca

SEQ ID NO: 2189551 - RNA, 20 nt, Homo sapiens
acauagugugagaacuucca

SEQ ID NO: 2189552 - RNA, 16 nt, Homo sapiens
caccucuaaaaaccaa

SEQ ID NO: 2189553 - RNA, 18 nt, Homo sapiens
ccuagaccaugucagaua

SEQ ID NO: 2189554 - RNA, 20 nt, Homo sapiens
uaaucaugugggugagccag

SEQ ID NO: 2189555 - RNA, 11 nt, Homo sapiens
aaauaaauuca

SEQ ID NO: 2189556 - RNA, 17 nt, Homo sapiens
aguuaggucauuacuaa

SEQ ID NO: 2189557 - RNA, 17 nt, Homo sapiens
gcgcaguuguucagagc

SEQ ID NO: 2189558 - RNA, 22 nt, Homo sapiens
gacaaguguuaaggcaacauuc

SEQ ID NO: 2189559 - RNA, 18 nt, Homo sapiens
gggaccaaccugaccuaa

SEQ ID NO: 2189560 - RNA, 20 nt, Homo sapiens
uaaagcaaggccuugagcaa

SEQ ID NO: 2189561 - RNA, 22 nt, Homo sapiens
cuccccacuccacccuguuagu

SEQ ID NO: 2189562 - RNA, 23 nt, Homo sapiens
agagaggagguaguuaagggaug

SEQ ID NO: 2189563 - RNA, 17 nt, Homo sapiens
uaguucccucaguguga

SEQ ID NO: 2189564 - RNA, 13 nt, Homo sapiens
acuggaaaccuaa

SEQ ID NO: 2189565 - RNA, 17 nt, Homo sapiens
gccuuggccugaccugg

SEQ ID NO: 2189566 - RNA, 19 nt, Homo sapiens
uggcaaaugccugacucag

SEQ ID NO: 2189567 - RNA, 20 nt, Homo sapiens
cugccaucauuguaacauga

SEQ ID NO: 2189568 - RNA, 19 nt, Homo sapiens
ccacacucuccugugaaca

SEQ ID NO: 2189569 - RNA, 21 nt, Homo sapiens
uuucuuccuuucuguagguuu

SEQ ID NO: 2189570 - RNA, 17 nt, Homo sapiens
acagcuuggcuguucca

SEQ ID NO: 2189571 - RNA, 13 nt, Homo sapiens
uucuugcagauca

SEQ ID NO: 2189572 - RNA, 17 nt, Homo sapiens
gacaagcagcuggugcu

SEQ ID NO: 2189573 - RNA, 17 nt, Homo sapiens
aacaaaagaaucuucca

SEQ ID NO: 2189574 - RNA, 21 nt, Homo sapiens
gugggaagaacuugucccuca

SEQ ID NO: 2189575 - RNA, 12 nt, Homo sapiens
uuaaaaugauua

SEQ ID NO: 2189576 - RNA, 17 nt, Homo sapiens
ggucaugcuuuugccac

SEQ ID NO: 2189577 - RNA, 23 nt, Homo sapiens
acacucugccugaaggcucacac

SEQ ID NO: 2189578 - RNA, 19 nt, Homo sapiens
gggcacugagcccuuccca

SEQ ID NO: 2189579 - RNA, 19 nt, Homo sapiens
agucucucucuuccucaca

SEQ ID NO: 2189580 - RNA, 15 nt, Homo sapiens
ugaggcccacucugu

SEQ ID NO: 2189581 - RNA, 16 nt, Homo sapiens
ggagcuuaaacagcug

SEQ ID NO: 2189582 - RNA, 18 nt, Homo sapiens
cccuuugccacacugugg

SEQ ID NO: 2189583 - RNA, 15 nt, Homo sapiens
guguuaguucccaac

SEQ ID NO: 2189584 - RNA, 12 nt, Homo sapiens
auuaacauauag

SEQ ID NO: 2189585 - RNA, 20 nt, Homo sapiens
agucaugugagccucguguc

SEQ ID NO: 2189586 - RNA, 22 nt, Homo sapiens
cucucagugcuucuuacuauua

SEQ ID NO: 2189587 - RNA, 13 nt, Homo sapiens
acaauuuaccagc

SEQ ID NO: 2189588 - RNA, 19 nt, Homo sapiens
agcuacacaaggaaggcau

SEQ ID NO: 2189589 - RNA, 17 nt, Homo sapiens
uauucugauuccacuuu

SEQ ID NO: 2189590 - RNA, 18 nt, Homo sapiens
aucuuacagccagaggaa

SEQ ID NO: 2189591 - RNA, 18 nt, Homo sapiens
aacaccacgucacuucau

SEQ ID NO: 2189592 - RNA, 22 nt, Homo sapiens
uuaagaauguauaucaggguuu

SEQ ID NO: 2189593 - RNA, 18 nt, Homo sapiens
agccaguuuccacaggca

SEQ ID NO: 2189594 - RNA, 21 nt, Homo sapiens
aaaacaguucucagaaauguc

SEQ ID NO: 2189595 - RNA, 17 nt, Homo sapiens
caaauuccauagcucaa

SEQ ID NO: 2189596 - RNA, 16 nt, Homo sapiens
cagagugacagucaua

SEQ ID NO: 2189597 - RNA, 16 nt, Homo sapiens
cuugaggccugugcuc

SEQ ID NO: 2189598 - RNA, 17 nt, Homo sapiens
ccaauccuggacaugaa

SEQ ID NO: 2189599 - RNA, 22 nt, Homo sapiens
cuucaugugguucagugccuuc

SEQ ID NO: 2189600 - RNA, 15 nt, Homo sapiens
ggcuccuuaguuuau

SEQ ID NO: 2189601 - RNA, 22 nt, Homo sapiens
gagcagccucaucccaggcagu

SEQ ID NO: 2189602 - RNA, 17 nt, Homo sapiens
ccugggguaccaagaga

SEQ ID NO: 2189603 - RNA, 17 nt, Homo sapiens
ugugaagacccaggaga

SEQ ID NO: 2189604 - RNA, 20 nt, Homo sapiens
ccauaaagccauucuuacuc

SEQ ID NO: 2189605 - RNA, 17 nt, Homo sapiens
augaaggacgugucuca

SEQ ID NO: 2189606 - RNA, 20 nt, Homo sapiens
aaguggacuuguuaccuuaa

SEQ ID NO: 2189607 - RNA, 18 nt, Homo sapiens
cugucaaaauauuucuca

SEQ ID NO: 2189608 - RNA, 22 nt, Homo sapiens
aagauucacuaaagcagcacau

SEQ ID NO: 2189609 - RNA, 16 nt, Homo sapiens
uuaccuugcaucucac

SEQ ID NO: 2189610 - RNA, 22 nt, Homo sapiens
gccuugugcgguuguguucuca

SEQ ID NO: 2189611 - RNA, 16 nt, Homo sapiens
uggccaucccugugag

SEQ ID NO: 2189612 - RNA, 22 nt, Homo sapiens
auugagggcucuaaacaggauu

SEQ ID NO: 2189613 - RNA, 13 nt, Homo sapiens
auuucaacuucag

SEQ ID NO: 2189614 - RNA, 13 nt, Homo sapiens
cagcaacacaaag

SEQ ID NO: 2189615 - RNA, 17 nt, Homo sapiens
agagaaugcccagugac

SEQ ID NO: 2189616 - RNA, 17 nt, Homo sapiens
gugggcauggagccagu

SEQ ID NO: 2189617 - RNA, 23 nt, Homo sapiens
gaccagugaaagaguagugcauu

SEQ ID NO: 2189618 - RNA, 23 nt, Homo sapiens
gaaacaguaagaaauuggaguga

SEQ ID NO: 2189619 - RNA, 19 nt, Homo sapiens
cuugaugacauuucacuga

SEQ ID NO: 2189620 - RNA, 23 nt, Homo sapiens
cuaagugaaauaagccagacauc

SEQ ID NO: 2189621 - RNA, 17 nt, Homo sapiens
ucagaaggaaaccgaaa

SEQ ID NO: 2189622 - RNA, 15 nt, Homo sapiens
aaucugguaccaguu

SEQ ID NO: 2189623 - RNA, 21 nt, Homo sapiens
aauguccccggacgguucugg

SEQ ID NO: 2189624 - RNA, 17 nt, Homo sapiens
cuguuuaaaguggcaau

SEQ ID NO: 2189625 - RNA, 18 nt, Homo sapiens
uggcagcugcaacagugg

SEQ ID NO: 2189626 - RNA, 14 nt, Homo sapiens
gcucagugccaaag

SEQ ID NO: 2189627 - RNA, 15 nt, Homo sapiens
guauuaauaccaaag

SEQ ID NO: 2189628 - RNA, 21 nt, Homo sapiens
guaugcuugcucuaagucaaa

SEQ ID NO: 2189629 - RNA, 17 nt, Homo sapiens
caauggaagauuugccc

SEQ ID NO: 2189630 - RNA, 13 nt, Homo sapiens
cccuucacaaagc

SEQ ID NO: 2189631 - RNA, 16 nt, Homo sapiens
uuacagaaaugaauaa

SEQ ID NO: 2189632 - RNA, 19 nt, Homo sapiens
ccaggggucucccugagcc

SEQ ID NO: 2189633 - RNA, 18 nt, Homo sapiens
aggcauucuggaccucug

SEQ ID NO: 2189634 - RNA, 17 nt, Homo sapiens
guucgauuucuaccuca

SEQ ID NO: 2189635 - RNA, 20 nt, Homo sapiens
ugcguguguacaugugcacu

SEQ ID NO: 2189636 - RNA, 20 nt, Homo sapiens
ggaugggggucaggggcuag

SEQ ID NO: 2189637 - RNA, 16 nt, Homo sapiens
uauccacaucuaagaa

SEQ ID NO: 2189638 - RNA, 19 nt, Homo sapiens
cauuugggagaagaucuca

SEQ ID NO: 2189639 - RNA, 16 nt, Homo sapiens
ggcauccacccagugc

SEQ ID NO: 2189640 - RNA, 17 nt, Homo sapiens
gccagcaggcucucagg

SEQ ID NO: 2189641 - RNA, 13 nt, Homo sapiens
caaagacuacuaa

SEQ ID NO: 2189642 - RNA, 15 nt, Homo sapiens
aagacacaugauuaa

SEQ ID NO: 2189643 - RNA, 16 nt, Homo sapiens
ugcuuaugugugaagc

SEQ ID NO: 2189644 - RNA, 16 nt, Homo sapiens
ugccuugcuucuguau

SEQ ID NO: 2189645 - RNA, 19 nt, Homo sapiens
uuucauagagauuugucua

SEQ ID NO: 2189646 - RNA, 18 nt, Homo sapiens
cuugccacccauucuucc

SEQ ID NO: 2189647 - RNA, 13 nt, Homo sapiens
uucauaugaguuc

SEQ ID NO: 2189648 - RNA, 21 nt, Homo sapiens
uugacuuucuguguaccacug

SEQ ID NO: 2189649 - RNA, 23 nt, Homo sapiens
gugagacuuugaggguguauauu

SEQ ID NO: 2189650 - RNA, 20 nt, Homo sapiens
ccguccccugggccacccuu

SEQ ID NO: 2189651 - RNA, 16 nt, Homo sapiens
ucaaggaaggaaaaua

SEQ ID NO: 2189652 - RNA, 14 nt, Homo sapiens
uguagaagcaugaa

SEQ ID NO: 2189653 - RNA, 12 nt, Homo sapiens
auaacagguuau

SEQ ID NO: 2189654 - RNA, 19 nt, Homo sapiens
uucucuguaugaaugugau

SEQ ID NO: 2189655 - RNA, 14 nt, Homo sapiens
acaaagaaguguau

SEQ ID NO: 2189656 - RNA, 23 nt, Homo sapiens
cagcaaggccagaugcacauccc

SEQ ID NO: 2189657 - RNA, 12 nt, Homo sapiens
gugagugacaaa

SEQ ID NO: 2189658 - RNA, 18 nt, Homo sapiens
ugaaaaauaaaaaccaua

SEQ ID NO: 2189659 - RNA, 16 nt, Homo sapiens
gguguucuucuuccca

SEQ ID NO: 2189660 - RNA, 19 nt, Homo sapiens
cugccgcucagaguguaga

SEQ ID NO: 2189661 - RNA, 14 nt, Homo sapiens
gaaaauuauuugca

SEQ ID NO: 2189662 - RNA, 21 nt, Homo sapiens
gguaggcacaaauacauuccu

SEQ ID NO: 2189663 - RNA, 20 nt, Homo sapiens
auuccagagaagccaggaag

SEQ ID NO: 2189664 - RNA, 17 nt, Homo sapiens
uaucaccugaauuauua

SEQ ID NO: 2189665 - RNA, 24 nt, Homo sapiens
cagaccaccugccagccaucacaa

SEQ ID NO: 2189666 - RNA, 20 nt, Homo sapiens
cauggaugugucucaggcac

SEQ ID NO: 2189667 - RNA, 17 nt, Homo sapiens
gcaucauuuaacugaac

SEQ ID NO: 2189668 - RNA, 15 nt, Homo sapiens
aggucuaucuacuaa

SEQ ID NO: 2189669 - RNA, 12 nt, Homo sapiens
caggacuagcug

SEQ ID NO: 2189670 - RNA, 17 nt, Homo sapiens
gcuucaaggacauuggu

SEQ ID NO: 2189671 - RNA, 17 nt, Homo sapiens
ggaggcaaauggcacug

SEQ ID NO: 2189672 - RNA, 22 nt, Homo sapiens
acuucaguggugagacuguauc

SEQ ID NO: 2189673 - RNA, 16 nt, Homo sapiens
guuugauauaccaaau

SEQ ID NO: 2189674 - RNA, 21 nt, Homo sapiens
ugguggaacccccaucucuac

SEQ ID NO: 2189675 - RNA, 12 nt, Homo sapiens
gacaaccaaaac

SEQ ID NO: 2189676 - RNA, 20 nt, Homo sapiens
ucuuagacggucuucacugu

SEQ ID NO: 2189677 - RNA, 15 nt, Homo sapiens
gaaauugguaccuug

SEQ ID NO: 2189678 - RNA, 21 nt, Homo sapiens
uuagugacagcucugccuguu

SEQ ID NO: 2189679 - RNA, 13 nt, Homo sapiens
ugaaaucagaagc

SEQ ID NO: 2189680 - RNA, 14 nt, Homo sapiens
aaaaagccagggcu

SEQ ID NO: 2189681 - RNA, 16 nt, Homo sapiens
acagacuucacuuccc

SEQ ID NO: 2189682 - RNA, 20 nt, Homo sapiens
ucuugaucucaaagcacaau

SEQ ID NO: 2189683 - RNA, 16 nt, Homo sapiens
ggaauuccucuaugaa

SEQ ID NO: 2189684 - RNA, 14 nt, Homo sapiens
uuugaaguuuacau

SEQ ID NO: 2189685 - RNA, 14 nt, Homo sapiens
ccuccuguccagca

SEQ ID NO: 2189686 - RNA, 21 nt, Homo sapiens
ucacauuucugaguguucucc

SEQ ID NO: 2189687 - RNA, 22 nt, Homo sapiens
ccuggcauucuuguacagugua

SEQ ID NO: 2189688 - RNA, 19 nt, Homo sapiens
ucagacaucuccagugugc

SEQ ID NO: 2189689 - RNA, 14 nt, Homo sapiens
gcaacuacagaauu

SEQ ID NO: 2189690 - RNA, 13 nt, Homo sapiens
ucaucaacacaau

SEQ ID NO: 2189691 - RNA, 13 nt, Homo sapiens
uugacaacauguu

SEQ ID NO: 2189692 - RNA, 13 nt, Homo sapiens
aguucaacuguau

SEQ ID NO: 2189693 - RNA, 14 nt, Homo sapiens
uggcacauugcccc

SEQ ID NO: 2189694 - RNA, 18 nt, Homo sapiens
aguauaaagggacuugaa

SEQ ID NO: 2189695 - RNA, 15 nt, Homo sapiens
aggaaaauaagcuua

SEQ ID NO: 2189696 - RNA, 22 nt, Homo sapiens
ccaacugcaggaaugcugacaa

SEQ ID NO: 2189697 - RNA, 18 nt, Homo sapiens
cuauuaaaguaacauuua

SEQ ID NO: 2189698 - RNA, 23 nt, Homo sapiens
auaaaguuucuguugauaaucau

SEQ ID NO: 2189699 - RNA, 21 nt, Homo sapiens
gucucgaacuccugaccucaa

SEQ ID NO: 2189700 - RNA, 21 nt, Homo sapiens
ucucccaucagaaagauucau

SEQ ID NO: 2189701 - RNA, 19 nt, Homo sapiens
acuuuucggagacagugac

SEQ ID NO: 2189702 - RNA, 22 nt, Homo sapiens
cagccaaguuuuauaauccuua

SEQ ID NO: 2189703 - RNA, 17 nt, Homo sapiens
auugcuuauaacaagca

SEQ ID NO: 2189704 - RNA, 17 nt, Homo sapiens
cacggcguuuuuuuaca

SEQ ID NO: 2189705 - RNA, 18 nt, Homo sapiens
auguuugcacuugugcuu

SEQ ID NO: 2189706 - RNA, 16 nt, Homo sapiens
uaaauaaaagcacaag

SEQ ID NO: 2189707 - RNA, 17 nt, Homo sapiens
augaguaauacaucaaa

SEQ ID NO: 2189708 - RNA, 18 nt, Homo sapiens
ccauagccaccccagaaa

SEQ ID NO: 2189709 - RNA, 17 nt, Homo sapiens
acaaacaaggcauucau

SEQ ID NO: 2189710 - RNA, 17 nt, Homo sapiens
gacagacacugcugaac

SEQ ID NO: 2189711 - RNA, 15 nt, Homo sapiens
auuaauacuaugcaa

SEQ ID NO: 2189712 - RNA, 22 nt, Homo sapiens
aaugaaaguauuggcauucaaa

SEQ ID NO: 2189713 - RNA, 22 nt, Homo sapiens
aaguccaggacacccagugggg

SEQ ID NO: 2189714 - RNA, 13 nt, Homo sapiens
uaaucacuacugu

SEQ ID NO: 2189715 - RNA, 22 nt, Homo sapiens
agaaucuccuuuggaaggugac

SEQ ID NO: 2189716 - RNA, 21 nt, Homo sapiens
ugacuuugggaaagagggacc

SEQ ID NO: 2189717 - RNA, 15 nt, Homo sapiens
aguguuuacccugaa

SEQ ID NO: 2189718 - RNA, 23 nt, Homo sapiens
auuuuauguaaaauuuugccuaa

SEQ ID NO: 2189719 - RNA, 21 nt, Homo sapiens
ccuccaaagggcagugggugg

SEQ ID NO: 2189720 - RNA, 17 nt, Homo sapiens
ucacaggccccaggaaa

SEQ ID NO: 2189721 - RNA, 22 nt, Homo sapiens
auaucaauuaauuugaaaacau

SEQ ID NO: 2189722 - RNA, 22 nt, Homo sapiens
cucagccuguugcggaucuuca

SEQ ID NO: 2189723 - RNA, 21 nt, Homo sapiens
gaagcaucacauaaaaaugau

SEQ ID NO: 2189724 - RNA, 19 nt, Homo sapiens
uuuucaaauaggaugcauu

SEQ ID NO: 2189725 - RNA, 23 nt, Homo sapiens
guauguuugggagacugcugagu

SEQ ID NO: 2189726 - RNA, 16 nt, Homo sapiens
gauuuguagcacugag

SEQ ID NO: 2189727 - RNA, 22 nt, Homo sapiens
gaaaaaccaaugauucauaaca

SEQ ID NO: 2189728 - RNA, 17 nt, Homo sapiens
cuucagauaccaugcaa

SEQ ID NO: 2189729 - RNA, 12 nt, Homo sapiens
gccaggacacca

SEQ ID NO: 2189730 - RNA, 15 nt, Homo sapiens
ugcuuucacucuuua

SEQ ID NO: 2189731 - RNA, 15 nt, Homo sapiens
ugaguggacuggagu

SEQ ID NO: 2189732 - RNA, 19 nt, Homo sapiens
gaaggcucccuaacacaca

SEQ ID NO: 2189733 - RNA, 19 nt, Homo sapiens
uggaguugugaucauccca

SEQ ID NO: 2189734 - RNA, 17 nt, Homo sapiens
gaaugaaugagccaaag

SEQ ID NO: 2189735 - RNA, 14 nt, Homo sapiens
cuuacauuagugau

SEQ ID NO: 2189736 - RNA, 15 nt, Homo sapiens
cuggggcaagaugag

SEQ ID NO: 2189737 - RNA, 22 nt, Homo sapiens
ugagccuuuuauuaacauauau

SEQ ID NO: 2189738 - RNA, 13 nt, Homo sapiens
ucuggaaccuuau

SEQ ID NO: 2189739 - RNA, 19 nt, Homo sapiens
ucuacuguggcaaaugcca

SEQ ID NO: 2189740 - RNA, 15 nt, Homo sapiens
ccccagccugggcca

SEQ ID NO: 2189741 - RNA, 13 nt, Homo sapiens
gacacacccaagg

SEQ ID NO: 2189742 - RNA, 21 nt, Homo sapiens
acccacugcuuuuggucugug

SEQ ID NO: 2189743 - RNA, 18 nt, Homo sapiens
ugaauaaagccacauaac

SEQ ID NO: 2189744 - RNA, 17 nt, Homo sapiens
gcggaaagcccugugcu

SEQ ID NO: 2189745 - RNA, 16 nt, Homo sapiens
uaccauugcuguucua

SEQ ID NO: 2189746 - RNA, 19 nt, Homo sapiens
uuguacauuccugauacug

SEQ ID NO: 2189747 - RNA, 17 nt, Homo sapiens
cagcauacacagaugaa

SEQ ID NO: 2189748 - RNA, 15 nt, Homo sapiens
uucacaucugucacg

SEQ ID NO: 2189749 - RNA, 15 nt, Homo sapiens
uuucaaucaaccaaa

SEQ ID NO: 2189750 - RNA, 17 nt, Homo sapiens
uagcgugugccaggcag

SEQ ID NO: 2189751 - RNA, 18 nt, Homo sapiens
cagcaaaauaauaaaaua

SEQ ID NO: 2189752 - RNA, 14 nt, Homo sapiens
gcgucauguaaggg

SEQ ID NO: 2189753 - RNA, 19 nt, Homo sapiens
auagcaacuccccuacauc

SEQ ID NO: 2189754 - RNA, 18 nt, Homo sapiens
gacuuuguguucauuuca

SEQ ID NO: 2189755 - RNA, 16 nt, Homo sapiens
aggcaugcagcugccu

SEQ ID NO: 2189756 - RNA, 14 nt, Homo sapiens
auguuaccuucaca

SEQ ID NO: 2189757 - RNA, 15 nt, Homo sapiens
acauucacacacuca

SEQ ID NO: 2189758 - RNA, 15 nt, Homo sapiens
ugccaugcugcuaug

SEQ ID NO: 2189759 - RNA, 21 nt, Homo sapiens
agagagagggccugcuggaga

SEQ ID NO: 2189760 - RNA, 19 nt, Homo sapiens
ucuagccuuguguuauaga

SEQ ID NO: 2189761 - RNA, 15 nt, Homo sapiens
aucacaaggucaaga

SEQ ID NO: 2189762 - RNA, 15 nt, Homo sapiens
acuucuaguuucacg

SEQ ID NO: 2189763 - RNA, 19 nt, Homo sapiens
cuguuugauacaguauuau

SEQ ID NO: 2189764 - RNA, 18 nt, Homo sapiens
gcaagucccaugauuucu

SEQ ID NO: 2189765 - RNA, 17 nt, Homo sapiens
ucacuccaaugucugcu

SEQ ID NO: 2189766 - RNA, 18 nt, Homo sapiens
cugccugggccuguucac

SEQ ID NO: 2189767 - RNA, 19 nt, Homo sapiens
gucuaagguucagccugaa

SEQ ID NO: 2189768 - RNA, 16 nt, Homo sapiens
aucucaacaacauguc

SEQ ID NO: 2189769 - RNA, 13 nt, Homo sapiens
auugcgcucucaa

SEQ ID NO: 2189770 - RNA, 15 nt, Homo sapiens
ucaaaucaaaccuca

SEQ ID NO: 2189771 - RNA, 16 nt, Homo sapiens
gguugacuuaugggcc

SEQ ID NO: 2189772 - RNA, 14 nt, Homo sapiens
aggcaugaacacac

SEQ ID NO: 2189773 - RNA, 15 nt, Homo sapiens
gcaggcuacugucag

SEQ ID NO: 2189774 - RNA, 15 nt, Homo sapiens
ugccaccaagcucac

SEQ ID NO: 2189775 - RNA, 19 nt, Homo sapiens
cugagucucugaggggcua

SEQ ID NO: 2189776 - RNA, 16 nt, Homo sapiens
auauuuuuuuaacugu

SEQ ID NO: 2189777 - RNA, 19 nt, Homo sapiens
ccucaauuuuugucucaga

SEQ ID NO: 2189778 - RNA, 18 nt, Homo sapiens
gacuuacagauccugcag

SEQ ID NO: 2189779 - RNA, 16 nt, Homo sapiens
uaggaagaucucugca

SEQ ID NO: 2189780 - RNA, 23 nt, Homo sapiens
acagaaaaguaauguaaaaucca

SEQ ID NO: 2189781 - RNA, 14 nt, Homo sapiens
gcaaauauguuugc

SEQ ID NO: 2189782 - RNA, 14 nt, Homo sapiens
acaaacauauuugu

SEQ ID NO: 2189783 - RNA, 15 nt, Homo sapiens
aacccucuucuuccc

SEQ ID NO: 2189784 - RNA, 14 nt, Homo sapiens
ucauauccaguuua

SEQ ID NO: 2189785 - RNA, 19 nt, Homo sapiens
aacuuggucuggcuuuaag

SEQ ID NO: 2189786 - RNA, 15 nt, Homo sapiens
ucaggccagccuguc

SEQ ID NO: 2189787 - RNA, 18 nt, Homo sapiens
cuaauuuacaagcacgau

SEQ ID NO: 2189788 - RNA, 21 nt, Homo sapiens
cuaugccaggcugugcuagca

SEQ ID NO: 2189789 - RNA, 17 nt, Homo sapiens
gcugucuucacauguau

SEQ ID NO: 2189790 - RNA, 19 nt, Homo sapiens
aagacacuuuuuggacuca

SEQ ID NO: 2189791 - RNA, 16 nt, Homo sapiens
cuuuccugcagcaguc

SEQ ID NO: 2189792 - RNA, 13 nt, Homo sapiens
ugggaaugcacuu

SEQ ID NO: 2189793 - RNA, 19 nt, Homo sapiens
guucgauguuagcguuuac

SEQ ID NO: 2189794 - RNA, 22 nt, Homo sapiens
uuuguagccaaagaaauuucaa

SEQ ID NO: 2189795 - RNA, 20 nt, Homo sapiens
uauaccuaccugugugguac

SEQ ID NO: 2189796 - RNA, 17 nt, Homo sapiens
aaugggcauugagaucu

SEQ ID NO: 2189797 - RNA, 13 nt, Homo sapiens
uaaaccuuuccau

SEQ ID NO: 2189798 - RNA, 17 nt, Homo sapiens
caggaagaagugcgagu

SEQ ID NO: 2189799 - RNA, 14 nt, Homo sapiens
uaccauggcacuga

SEQ ID NO: 2189800 - RNA, 18 nt, Homo sapiens
ccugcuuaaugucagucu

SEQ ID NO: 2189801 - RNA, 17 nt, Homo sapiens
cugguugauacaguuca

SEQ ID NO: 2189802 - RNA, 23 nt, Homo sapiens
gagggguuuuuuuguacuuugua

SEQ ID NO: 2189803 - RNA, 13 nt, Homo sapiens
cucucucagcaca

SEQ ID NO: 2189804 - RNA, 13 nt, Homo sapiens
uaggcaugugcaa

SEQ ID NO: 2189805 - RNA, 13 nt, Homo sapiens
cugaauaguguca

SEQ ID NO: 2189806 - RNA, 16 nt, Homo sapiens
cuccaccucaggggag

SEQ ID NO: 2189807 - RNA, 13 nt, Homo sapiens
gauggcugugaaa

SEQ ID NO: 2189808 - RNA, 17 nt, Homo sapiens
acuaaaaaguauugcau

SEQ ID NO: 2189809 - RNA, 18 nt, Homo sapiens
ccagcagaugccacauaa

SEQ ID NO: 2189810 - RNA, 15 nt, Homo sapiens
guccuuucagucuga

SEQ ID NO: 2189811 - RNA, 13 nt, Homo sapiens
caaauugaucaag

SEQ ID NO: 2189812 - RNA, 15 nt, Homo sapiens
uugugggauacuauu

SEQ ID NO: 2189813 - RNA, 18 nt, Homo sapiens
uggcaucucuuucugcaa

SEQ ID NO: 2189814 - RNA, 10 nt, Homo sapiens
cuugcugaug

SEQ ID NO: 2189815 - RNA, 20 nt, Homo sapiens
caaagaagaccacaaauagu

SEQ ID NO: 2189816 - RNA, 15 nt, Homo sapiens
uaaaaugcuuacauu

SEQ ID NO: 2189817 - RNA, 14 nt, Homo sapiens
auuuuaugcugcug

SEQ ID NO: 2189818 - RNA, 22 nt, Homo sapiens
cuguuaaaauguacacuggaua

SEQ ID NO: 2189819 - RNA, 20 nt, Homo sapiens
uaauauaguuauugcacaag

SEQ ID NO: 2189820 - RNA, 13 nt, Homo sapiens
cacagaggcagug

SEQ ID NO: 2189821 - RNA, 13 nt, Homo sapiens
agauguggggaaa

SEQ ID NO: 2189822 - RNA, 18 nt, Homo sapiens
agacucuauuuaagauuc

SEQ ID NO: 2189823 - RNA, 16 nt, Homo sapiens
uacccuucuuguccaa

SEQ ID NO: 2189824 - RNA, 15 nt, Homo sapiens
aauacauuuauaauc

SEQ ID NO: 2189825 - RNA, 22 nt, Homo sapiens
caugugugcgagugugugcaug

SEQ ID NO: 2189826 - RNA, 11 nt, Homo sapiens
caaacuggccg

SEQ ID NO: 2189827 - RNA, 23 nt, Homo sapiens
uuaaacuuuuuaccaaguacaaa

SEQ ID NO: 2189828 - RNA, 20 nt, Homo sapiens
gacaaaguuuugcucuuguc

SEQ ID NO: 2189829 - RNA, 19 nt, Homo sapiens
acacuaaugcagccacgau

SEQ ID NO: 2189830 - RNA, 17 nt, Homo sapiens
aaccugcgucauuucag

SEQ ID NO: 2189831 - RNA, 21 nt, Homo sapiens
ugcagccccggcugacaccug

SEQ ID NO: 2189832 - RNA, 16 nt, Homo sapiens
cgugguugccgucucu

SEQ ID NO: 2189833 - RNA, 20 nt, Homo sapiens
augaaggcuguacacugcac

SEQ ID NO: 2189834 - RNA, 17 nt, Homo sapiens
agucuuacucugucacc

SEQ ID NO: 2189835 - RNA, 13 nt, Homo sapiens
ugcuggucuucaa

SEQ ID NO: 2189836 - RNA, 18 nt, Homo sapiens
uaauuccagucauuuugg

SEQ ID NO: 2189837 - RNA, 23 nt, Homo sapiens
cacuuaaacuugcacauuugaau

SEQ ID NO: 2189838 - RNA, 23 nt, Homo sapiens
cugcucacuuaaacaauguccuc

SEQ ID NO: 2189839 - RNA, 10 nt, Homo sapiens
ggagcucaag

SEQ ID NO: 2189840 - RNA, 14 nt, Homo sapiens
gcuccgaccucucu

SEQ ID NO: 2189841 - RNA, 15 nt, Homo sapiens
aagaaagauugcuau

SEQ ID NO: 2189842 - RNA, 15 nt, Homo sapiens
ccacgcagcacccuu

SEQ ID NO: 2189843 - RNA, 21 nt, Homo sapiens
ggcacaauaugggcacuuuaa

SEQ ID NO: 2189844 - RNA, 19 nt, Homo sapiens
auaaauguaauagccaaac

SEQ ID NO: 2189845 - RNA, 18 nt, Homo sapiens
uggcaauucuucuucuca

SEQ ID NO: 2189846 - RNA, 23 nt, Homo sapiens
uugguaauagauuuaauuaugaa

SEQ ID NO: 2189847 - RNA, 13 nt, Homo sapiens
auaaaacugaugu

SEQ ID NO: 2189848 - RNA, 12 nt, Homo sapiens
caaaacaauuaa

SEQ ID NO: 2189849 - RNA, 21 nt, Homo sapiens
uuggagaguuugccuguucua

SEQ ID NO: 2189850 - RNA, 21 nt, Homo sapiens
cagaucccccuucucuccugc

SEQ ID NO: 2189851 - RNA, 16 nt, Homo sapiens
agugggcugacaucaa

SEQ ID NO: 2189852 - RNA, 18 nt, Homo sapiens
acauuuuuguagaccacu

SEQ ID NO: 2189853 - RNA, 20 nt, Homo sapiens
gccccaacuccuuccagcua

SEQ ID NO: 2189854 - RNA, 21 nt, Homo sapiens
ucugagucuauguucaaagac

SEQ ID NO: 2189855 - RNA, 21 nt, Homo sapiens
ucuggcacuugcaagucccau

SEQ ID NO: 2189856 - RNA, 14 nt, Homo sapiens
cauagaaacugcuu

SEQ ID NO: 2189857 - RNA, 21 nt, Homo sapiens
cugugucacuguaugugaaag

SEQ ID NO: 2189858 - RNA, 16 nt, Homo sapiens
aaugcagucagucaca

SEQ ID NO: 2189859 - RNA, 19 nt, Homo sapiens
ugccaagcacugugcucag

SEQ ID NO: 2189860 - RNA, 15 nt, Homo sapiens
ccacagagugcugga

SEQ ID NO: 2189861 - RNA, 18 nt, Homo sapiens
auauucuauacacacccu

SEQ ID NO: 2189862 - RNA, 19 nt, Homo sapiens
cugagcccaaggcacugag

SEQ ID NO: 2189863 - RNA, 18 nt, Homo sapiens
cagugcuucuuacuauua

SEQ ID NO: 2189864 - RNA, 19 nt, Homo sapiens
cagcgccaacgagcagugc

SEQ ID NO: 2189865 - RNA, 14 nt, Homo sapiens
acauucagggcuau

SEQ ID NO: 2189866 - RNA, 16 nt, Homo sapiens
cagacucuggucuucu

SEQ ID NO: 2189867 - RNA, 18 nt, Homo sapiens
aucuauggaaaugugaga

SEQ ID NO: 2189868 - RNA, 14 nt, Homo sapiens
ugauuccauuuuaa

SEQ ID NO: 2189869 - RNA, 19 nt, Homo sapiens
aaacacccuuuccaaagca

SEQ ID NO: 2189870 - RNA, 17 nt, Homo sapiens
guuuaacucagaucacu

SEQ ID NO: 2189871 - RNA, 18 nt, Homo sapiens
caagguucccaagacaau

SEQ ID NO: 2189872 - RNA, 20 nt, Homo sapiens
aaugcuuacggccaucucuu

SEQ ID NO: 2189873 - RNA, 20 nt, Homo sapiens
aaugcuucuguugaucucag

SEQ ID NO: 2189874 - RNA, 20 nt, Homo sapiens
accagagaggcucugagaaa

SEQ ID NO: 2189875 - RNA, 17 nt, Homo sapiens
aucacacaacaaauaau

SEQ ID NO: 2189876 - RNA, 15 nt, Homo sapiens
ccuccuuacauuaaa

SEQ ID NO: 2189877 - RNA, 17 nt, Homo sapiens
augugaaaacaucucaa

SEQ ID NO: 2189878 - RNA, 18 nt, Homo sapiens
ugaacaauucggugguaa

SEQ ID NO: 2189879 - RNA, 16 nt, Homo sapiens
ucauuauuaccacuua

SEQ ID NO: 2189880 - RNA, 12 nt, Homo sapiens
uccacucagguu

SEQ ID NO: 2189881 - RNA, 19 nt, Homo sapiens
uagugauuuccacagugac

SEQ ID NO: 2189882 - RNA, 14 nt, Homo sapiens
aguauugugaaagu

SEQ ID NO: 2189883 - RNA, 17 nt, Homo sapiens
ccucugcacuacugaca

SEQ ID NO: 2189884 - RNA, 14 nt, Homo sapiens
uggaaacagaugaa

SEQ ID NO: 2189885 - RNA, 14 nt, Homo sapiens
aaugcauguuuccu

SEQ ID NO: 2189886 - RNA, 17 nt, Homo sapiens
acccaggaguguggcca

SEQ ID NO: 2189887 - RNA, 23 nt, Homo sapiens
gauauguuacauuagagugagag

SEQ ID NO: 2189888 - RNA, 14 nt, Homo sapiens
cuggagccugcaau

SEQ ID NO: 2189889 - RNA, 16 nt, Homo sapiens
gcccacguguccugag

SEQ ID NO: 2189890 - RNA, 20 nt, Homo sapiens
auugugcuuuguaucaguca

SEQ ID NO: 2189891 - RNA, 22 nt, Homo sapiens
cugucccaggagcaaaugcugg

SEQ ID NO: 2189892 - RNA, 15 nt, Homo sapiens
cagagacccccgugc

SEQ ID NO: 2189893 - RNA, 15 nt, Homo sapiens
uuuuucaacuuggaa

SEQ ID NO: 2189894 - RNA, 14 nt, Homo sapiens
acacaucuuaccuc

SEQ ID NO: 2189895 - RNA, 16 nt, Homo sapiens
cucccauagcaaagag

SEQ ID NO: 2189896 - RNA, 23 nt, Homo sapiens
cacugccuaggaggcuggccaag

SEQ ID NO: 2189897 - RNA, 16 nt, Homo sapiens
acuguauuacauaaau

SEQ ID NO: 2189898 - RNA, 19 nt, Homo sapiens
aguuuugucuuucucaggg

SEQ ID NO: 2189899 - RNA, 14 nt, Homo sapiens
caaccucacaggau

SEQ ID NO: 2189900 - RNA, 18 nt, Homo sapiens
ucaaggagugaaguaauu

SEQ ID NO: 2189901 - RNA, 15 nt, Homo sapiens
uaauguaacuuccuc

SEQ ID NO: 2189902 - RNA, 14 nt, Homo sapiens
uucacgcaacuuga

SEQ ID NO: 2189903 - RNA, 18 nt, Homo sapiens
agccucacggagggccgu

SEQ ID NO: 2189904 - RNA, 13 nt, Homo sapiens
cugcugacagugu

SEQ ID NO: 2189905 - RNA, 15 nt, Homo sapiens
cugcagguccgggga

SEQ ID NO: 2189906 - RNA, 16 nt, Homo sapiens
cugauguuccacucca

SEQ ID NO: 2189907 - RNA, 19 nt, Homo sapiens
aacaauguuuuaaacauuc

SEQ ID NO: 2189908 - RNA, 21 nt, Homo sapiens
gaaagcucucuauaccaaaga

SEQ ID NO: 2189909 - RNA, 15 nt, Homo sapiens
uauacaacuguaaag

SEQ ID NO: 2189910 - RNA, 17 nt, Homo sapiens
uggcuaugaaaaugagc

SEQ ID NO: 2189911 - RNA, 21 nt, Homo sapiens
cccaucccuggcugaccugcu

SEQ ID NO: 2189912 - RNA, 22 nt, Homo sapiens
cgaucaggcacaggucaggggu

SEQ ID NO: 2189913 - RNA, 17 nt, Homo sapiens
cucugccuuuguucacu

SEQ ID NO: 2189914 - RNA, 15 nt, Homo sapiens
guguguaugugcauu

SEQ ID NO: 2189915 - RNA, 20 nt, Homo sapiens
caucggaauccaagcuaauu

SEQ ID NO: 2189916 - RNA, 15 nt, Homo sapiens
guauacaaguguuuc

SEQ ID NO: 2189917 - RNA, 21 nt, Homo sapiens
gugacauugugucaguuucag

SEQ ID NO: 2189918 - RNA, 14 nt, Homo sapiens
acuuggucugugag

SEQ ID NO: 2189919 - RNA, 13 nt, Homo sapiens
ugagacuccucag

SEQ ID NO: 2189920 - RNA, 18 nt, Homo sapiens
uaaacuauuagaguauuu

SEQ ID NO: 2189921 - RNA, 16 nt, Homo sapiens
agcagugguauuaaua

SEQ ID NO: 2189922 - RNA, 14 nt, Homo sapiens
ugguugacauugua

SEQ ID NO: 2189923 - RNA, 22 nt, Homo sapiens
cucuaaauaaagacgacuacag

SEQ ID NO: 2189924 - RNA, 20 nt, Homo sapiens
aaauguucugguaugcauuc

SEQ ID NO: 2189925 - RNA, 17 nt, Homo sapiens
cgcaggagaucaucuga

SEQ ID NO: 2189926 - RNA, 18 nt, Homo sapiens
caagcuauaaaagcagga

SEQ ID NO: 2189927 - RNA, 15 nt, Homo sapiens
aguacuccacacugc

SEQ ID NO: 2189928 - RNA, 21 nt, Homo sapiens
aaauggaaauuuaaaugacau

SEQ ID NO: 2189929 - RNA, 15 nt, Homo sapiens
aggaacugagccaga

SEQ ID NO: 2189930 - RNA, 23 nt, Homo sapiens
cuccucagccucccuuugccagc

SEQ ID NO: 2189931 - RNA, 15 nt, Homo sapiens
aaaauucauaccuga

SEQ ID NO: 2189932 - RNA, 18 nt, Homo sapiens
aagggaguugcucacuca

SEQ ID NO: 2189933 - RNA, 23 nt, Homo sapiens
uuauaccugcucuuguucuacug

SEQ ID NO: 2189934 - RNA, 23 nt, Homo sapiens
aauuaauuugugaauuugcaaca

SEQ ID NO: 2189935 - RNA, 22 nt, Homo sapiens
aggugccgguaccagccugacu

SEQ ID NO: 2189936 - RNA, 23 nt, Homo sapiens
auuaugcgcuguggccacuccaa

SEQ ID NO: 2189937 - RNA, 21 nt, Homo sapiens
uggagauaccagagacucuga

SEQ ID NO: 2189938 - RNA, 13 nt, Homo sapiens
ugcuaagagccag

SEQ ID NO: 2189939 - RNA, 23 nt, Homo sapiens
ugauagguuguuaaauacauuua

SEQ ID NO: 2189940 - RNA, 22 nt, Homo sapiens
caggcugggccauguccaaaga

SEQ ID NO: 2189941 - RNA, 16 nt, Homo sapiens
cauaccccuggccaag

SEQ ID NO: 2189942 - RNA, 15 nt, Homo sapiens
uuguaaauaggauuu

SEQ ID NO: 2189943 - RNA, 21 nt, Homo sapiens
ucucuggguuggcuguggcau

SEQ ID NO: 2189944 - RNA, 15 nt, Homo sapiens
ugacuaauucaggga

SEQ ID NO: 2189945 - RNA, 15 nt, Homo sapiens
cagguuagccuuugc

SEQ ID NO: 2189946 - RNA, 17 nt, Homo sapiens
agaauguaaaugucuca

SEQ ID NO: 2189947 - RNA, 20 nt, Homo sapiens
gaaugcacagugaaggguga

SEQ ID NO: 2189948 - RNA, 22 nt, Homo sapiens
agccucacugcaagcacugcau

SEQ ID NO: 2189949 - RNA, 20 nt, Homo sapiens
agaugcagggguggggagcg

SEQ ID NO: 2189950 - RNA, 22 nt, Homo sapiens
acaacgccugucacagaguaga

SEQ ID NO: 2189951 - RNA, 21 nt, Homo sapiens
auuuuuaauguuuguacacaa

SEQ ID NO: 2189952 - RNA, 16 nt, Homo sapiens
cugaccuguguucccu

SEQ ID NO: 2189953 - RNA, 20 nt, Homo sapiens
gguuucuguacaacuaccuc

SEQ ID NO: 2189954 - RNA, 23 nt, Homo sapiens
cacuguacaaaaaaaucuuccaa

SEQ ID NO: 2189955 - RNA, 17 nt, Homo sapiens
cucccuggccaucucaa

SEQ ID NO: 2189956 - RNA, 14 nt, Homo sapiens
cagagcucccuucc

SEQ ID NO: 2189957 - RNA, 14 nt, Homo sapiens
ucuagagucacuga

SEQ ID NO: 2189958 - RNA, 15 nt, Homo sapiens
uccuuuccauuguag

SEQ ID NO: 2189959 - RNA, 16 nt, Homo sapiens
ccaagcuagacugugu

SEQ ID NO: 2189960 - RNA, 23 nt, Homo sapiens
gcaucauuuaacugaacugugaa

SEQ ID NO: 2189961 - RNA, 15 nt, Homo sapiens
uucuccaguguaaca

SEQ ID NO: 2189962 - RNA, 17 nt, Homo sapiens
auuagaauuucauauga

SEQ ID NO: 2189963 - RNA, 15 nt, Homo sapiens
aaaaauggcagugac

SEQ ID NO: 2189964 - RNA, 18 nt, Homo sapiens
agacuugagcuugaccua

SEQ ID NO: 2189965 - RNA, 18 nt, Homo sapiens
caggagguuggugacuga

SEQ ID NO: 2189966 - RNA, 13 nt, Homo sapiens
uuucaaacacaaa

SEQ ID NO: 2189967 - RNA, 22 nt, Homo sapiens
augacauaaaaacaacuuuaua

SEQ ID NO: 2189968 - RNA, 16 nt, Homo sapiens
ucacugccagugcaga

SEQ ID NO: 2189969 - RNA, 11 nt, Homo sapiens
ggaagucucca

SEQ ID NO: 2189970 - RNA, 15 nt, Homo sapiens
uaccuuaaacugugu

SEQ ID NO: 2189971 - RNA, 20 nt, Homo sapiens
ucuucuccauccuaccacaa

SEQ ID NO: 2189972 - RNA, 16 nt, Homo sapiens
uccccucucagaacau

SEQ ID NO: 2189973 - RNA, 22 nt, Homo sapiens
cugagaauauguaacagccaaa

SEQ ID NO: 2189974 - RNA, 16 nt, Homo sapiens
caacuccuccuugccu

SEQ ID NO: 2189975 - RNA, 20 nt, Homo sapiens
gaacauaaaaaggacaucag

SEQ ID NO: 2189976 - RNA, 21 nt, Homo sapiens
acagaaaaguaggaaugcauu

SEQ ID NO: 2189977 - RNA, 23 nt, Homo sapiens
cgaggaaaagaacaaacaaaacu

SEQ ID NO: 2189978 - RNA, 18 nt, Homo sapiens
aaauaugaaauuccagca

SEQ ID NO: 2189979 - RNA, 18 nt, Homo sapiens
ucuguagaggagccugga

SEQ ID NO: 2189980 - RNA, 19 nt, Homo sapiens
aagcacuggacuacaaggg

SEQ ID NO: 2189981 - RNA, 13 nt, Homo sapiens
auguauguaucau

SEQ ID NO: 2189982 - RNA, 14 nt, Homo sapiens
uugucagcacugua

SEQ ID NO: 2189983 - RNA, 13 nt, Homo sapiens
ucuacaggucucu

SEQ ID NO: 2189984 - RNA, 18 nt, Homo sapiens
auacaauacaguacucag

SEQ ID NO: 2189985 - RNA, 20 nt, Homo sapiens
guguucucggggaugcauag

SEQ ID NO: 2189986 - RNA, 21 nt, Homo sapiens
uuuagaggauuuuggcuuaaa

SEQ ID NO: 2189987 - RNA, 21 nt, Homo sapiens
cguuaaggagaugggccuuuu

SEQ ID NO: 2189988 - RNA, 20 nt, Homo sapiens
ccaguccuguuugcagggaa

SEQ ID NO: 2189989 - RNA, 17 nt, Homo sapiens
aggaguacaaugcccag

SEQ ID NO: 2189990 - RNA, 12 nt, Homo sapiens
cauaacuugaaa

SEQ ID NO: 2189991 - RNA, 13 nt, Homo sapiens
ccaucugcuccug

SEQ ID NO: 2189992 - RNA, 13 nt, Homo sapiens
ccaacugcuccag

SEQ ID NO: 2189993 - RNA, 22 nt, Homo sapiens
ggucgucuuuugaaaagcucac

SEQ ID NO: 2189994 - RNA, 22 nt, Homo sapiens
cuuugggagaguuguuggcaag

SEQ ID NO: 2189995 - RNA, 13 nt, Homo sapiens
caccugcucuuuc

SEQ ID NO: 2189996 - RNA, 21 nt, Homo sapiens
gugguugauuuuaaugaaugc

SEQ ID NO: 2189997 - RNA, 18 nt, Homo sapiens
aauaccguguggcccaag

SEQ ID NO: 2189998 - RNA, 15 nt, Homo sapiens
ccgggagacucugaa

SEQ ID NO: 2189999 - RNA, 16 nt, Homo sapiens
cuaaggugaccagagu

SEQ ID NO: 2190000 - RNA, 19 nt, Homo sapiens
uuguuuugacggaugauug

SEQ ID NO: 2190001 - RNA, 20 nt, Homo sapiens
gacugacugaggcaguuuga

SEQ ID NO: 2190002 - RNA, 15 nt, Homo sapiens
gaaugaaacaagcag

SEQ ID NO: 2190003 - RNA, 15 nt, Homo sapiens
aagagcuugucagca

SEQ ID NO: 2190004 - RNA, 19 nt, Homo sapiens
ugaucacucuggaaaugca

SEQ ID NO: 2190005 - RNA, 14 nt, Homo sapiens
ugcuggugaaccag

SEQ ID NO: 2190006 - RNA, 18 nt, Homo sapiens
auuaaagaaaauugccaa

SEQ ID NO: 2190007 - RNA, 14 nt, Homo sapiens
uaauuccucagugg

SEQ ID NO: 2190008 - RNA, 16 nt, Homo sapiens
agguguagaccagagu

SEQ ID NO: 2190009 - RNA, 20 nt, Homo sapiens
aaaucuuaauucaacuagua

SEQ ID NO: 2190010 - RNA, 12 nt, Homo sapiens
cugugugcagug

SEQ ID NO: 2190011 - RNA, 14 nt, Homo sapiens
gucaccgcucuuuu

SEQ ID NO: 2190012 - RNA, 22 nt, Homo sapiens
ugcuuauuuuaaaaugacagug

SEQ ID NO: 2190013 - RNA, 13 nt, Homo sapiens
ugaucucugggag

SEQ ID NO: 2190014 - RNA, 14 nt, Homo sapiens
auaaacucagucaa

SEQ ID NO: 2190015 - RNA, 20 nt, Homo sapiens
gcuguggagcuccacugcca

SEQ ID NO: 2190016 - RNA, 13 nt, Homo sapiens
uaaggugggucca

SEQ ID NO: 2190017 - RNA, 18 nt, Homo sapiens
ugucuuauggucuugauc

SEQ ID NO: 2190018 - RNA, 22 nt, Homo sapiens
cauuuguguggaaaucauacca

SEQ ID NO: 2190019 - RNA, 13 nt, Homo sapiens
uugauagcugucc

SEQ ID NO: 2190020 - RNA, 23 nt, Homo sapiens
uuccauaaccccaggcaucccau

SEQ ID NO: 2190021 - RNA, 15 nt, Homo sapiens
cucucuugacccugu

SEQ ID NO: 2190022 - RNA, 23 nt, Homo sapiens
guuuccaaugccaauucaucuca

SEQ ID NO: 2190023 - RNA, 23 nt, Homo sapiens
auauuucucuaguguauuaucac

SEQ ID NO: 2190024 - RNA, 23 nt, Homo sapiens
auuuaaauguguacaauguacac

SEQ ID NO: 2190025 - RNA, 19 nt, Homo sapiens
acuucacgaaguguugcau

SEQ ID NO: 2190026 - RNA, 17 nt, Homo sapiens
cccaucuccauugcauu

SEQ ID NO: 2190027 - RNA, 22 nt, Homo sapiens
guaaucauauuguuacugguac

SEQ ID NO: 2190028 - RNA, 18 nt, Homo sapiens
uguaagaaggcaauauua

SEQ ID NO: 2190029 - RNA, 11 nt, Homo sapiens
uccaccugcua

SEQ ID NO: 2190030 - RNA, 20 nt, Homo sapiens
uucagaggcucagauuguaa

SEQ ID NO: 2190031 - RNA, 17 nt, Homo sapiens
uauggcucuacuuucag

SEQ ID NO: 2190032 - RNA, 16 nt, Homo sapiens
caggcuccaggccuca

SEQ ID NO: 2190033 - RNA, 15 nt, Homo sapiens
acccaagaccucagg

SEQ ID NO: 2190034 - RNA, 21 nt, Homo sapiens
auuuuguaauaaacucucuag

SEQ ID NO: 2190035 - RNA, 17 nt, Homo sapiens
uagccccugaaagccau

SEQ ID NO: 2190036 - RNA, 12 nt, Homo sapiens
uacagugcaguu

SEQ ID NO: 2190037 - RNA, 16 nt, Homo sapiens
ucagcccucaguuccu

SEQ ID NO: 2190038 - RNA, 19 nt, Homo sapiens
gagagcucaggauggcuca

SEQ ID NO: 2190039 - RNA, 18 nt, Homo sapiens
uccuucuaaucugcuaug

SEQ ID NO: 2190040 - RNA, 16 nt, Homo sapiens
cucgcccucgccagug

SEQ ID NO: 2190041 - RNA, 22 nt, Homo sapiens
guggccacagcagcuuuguaca

SEQ ID NO: 2190042 - RNA, 20 nt, Homo sapiens
uauggagagaaaacagaccu

SEQ ID NO: 2190043 - RNA, 18 nt, Homo sapiens
cagauuagcuaggggaca

SEQ ID NO: 2190044 - RNA, 20 nt, Homo sapiens
ucaaguauaacaacuuugaa

SEQ ID NO: 2190045 - RNA, 19 nt, Homo sapiens
uuucuguguaagcuuuuaa

SEQ ID NO: 2190046 - RNA, 12 nt, Homo sapiens
cagaaccacaga

SEQ ID NO: 2190047 - RNA, 12 nt, Homo sapiens
aagaaccaaaga

SEQ ID NO: 2190048 - RNA, 19 nt, Homo sapiens
uggcugguaacaguucaug

SEQ ID NO: 2190049 - RNA, 18 nt, Homo sapiens
aacauaaucuaguuuaca

SEQ ID NO: 2190050 - RNA, 23 nt, Homo sapiens
aguccaaggaaaccacagcugcu

SEQ ID NO: 2190051 - RNA, 12 nt, Homo sapiens
ugcuggugauuu

SEQ ID NO: 2190052 - RNA, 18 nt, Homo sapiens
gcucuugaacuccugacc

SEQ ID NO: 2190053 - RNA, 14 nt, Homo sapiens
guauuucagccaug

SEQ ID NO: 2190054 - RNA, 22 nt, Homo sapiens
gaacuuucuuauccuagcacau

SEQ ID NO: 2190055 - RNA, 20 nt, Homo sapiens
ugucauagaaagugccagaa

SEQ ID NO: 2190056 - RNA, 18 nt, Homo sapiens
ggccagggacccaaagca

SEQ ID NO: 2190057 - RNA, 15 nt, Homo sapiens
guugaugccugugaa

SEQ ID NO: 2190058 - RNA, 12 nt, Homo sapiens
cuuuccaugcag

SEQ ID NO: 2190059 - RNA, 17 nt, Homo sapiens
auaaagcgaauggacca

SEQ ID NO: 2190060 - RNA, 16 nt, Homo sapiens
aagcagggacugugaa

SEQ ID NO: 2190061 - RNA, 15 nt, Homo sapiens
aaauguaaagacaaa

SEQ ID NO: 2190062 - RNA, 15 nt, Homo sapiens
aacugacaagccauc

SEQ ID NO: 2190063 - RNA, 19 nt, Homo sapiens
gccucagggcgcucagacg

SEQ ID NO: 2190064 - RNA, 14 nt, Homo sapiens
aacacaguguuuca

SEQ ID NO: 2190065 - RNA, 13 nt, Homo sapiens
aggcuaccucaag

SEQ ID NO: 2190066 - RNA, 23 nt, Homo sapiens
ugccuaaaucccaagaaauggaa

SEQ ID NO: 2190067 - RNA, 16 nt, Homo sapiens
agcaacaaccaucuca

SEQ ID NO: 2190068 - RNA, 15 nt, Homo sapiens
ugaaauaaaugacaa

SEQ ID NO: 2190069 - RNA, 19 nt, Homo sapiens
aagaaagcaacuuuacuga

SEQ ID NO: 2190070 - RNA, 23 nt, Homo sapiens
uccacugagucuuucuuagauua

SEQ ID NO: 2190071 - RNA, 23 nt, Homo sapiens
uguuuuucagauacacugugaua

SEQ ID NO: 2190072 - RNA, 19 nt, Homo sapiens
agcucaagucuucccugau

SEQ ID NO: 2190073 - RNA, 22 nt, Homo sapiens
auuuuucauggcaacaucagcu

SEQ ID NO: 2190074 - RNA, 16 nt, Homo sapiens
accaugcgcugcucaa

SEQ ID NO: 2190075 - RNA, 21 nt, Homo sapiens
agggcaaccaauaaaaguguc

SEQ ID NO: 2190076 - RNA, 14 nt, Homo sapiens
caucuuacuugagc

SEQ ID NO: 2190077 - RNA, 23 nt, Homo sapiens
ucaaauacauaccuacugacuga

SEQ ID NO: 2190078 - RNA, 14 nt, Homo sapiens
agguucagccugaa

SEQ ID NO: 2190079 - RNA, 20 nt, Homo sapiens
uuuuaaucuuuaauuuuaca

SEQ ID NO: 2190080 - RNA, 15 nt, Homo sapiens
acaauggaguauucu

SEQ ID NO: 2190081 - RNA, 22 nt, Homo sapiens
cauguuggccaggcuggucuca

SEQ ID NO: 2190082 - RNA, 15 nt, Homo sapiens
cuuaugaaacuaaga

SEQ ID NO: 2190083 - RNA, 14 nt, Homo sapiens
cuggacugugggac

SEQ ID NO: 2190084 - RNA, 14 nt, Homo sapiens
ugcuuaugcucuua

SEQ ID NO: 2190085 - RNA, 14 nt, Homo sapiens
gcucacauucugag

SEQ ID NO: 2190086 - RNA, 11 nt, Homo sapiens
augagcauuua

SEQ ID NO: 2190087 - RNA, 18 nt, Homo sapiens
caguuuauauuguggaau

SEQ ID NO: 2190088 - RNA, 21 nt, Homo sapiens
caguccauuuccuaauguaua

SEQ ID NO: 2190089 - RNA, 22 nt, Homo sapiens
gucucaaaccuccaaaagcccu

SEQ ID NO: 2190090 - RNA, 18 nt, Homo sapiens
gguacuuguaaauuauua

SEQ ID NO: 2190091 - RNA, 20 nt, Homo sapiens
auaugggguguuuguuccca

SEQ ID NO: 2190092 - RNA, 16 nt, Homo sapiens
gacaugugcagugcug

SEQ ID NO: 2190093 - RNA, 15 nt, Homo sapiens
aagaaaaauuaucuu

SEQ ID NO: 2190094 - RNA, 19 nt, Homo sapiens
agaaauauggaacuuacau

SEQ ID NO: 2190095 - RNA, 13 nt, Homo sapiens
cuuuacaguuaca

SEQ ID NO: 2190096 - RNA, 19 nt, Homo sapiens
acaguggauaugcuagcau

SEQ ID NO: 2190097 - RNA, 19 nt, Homo sapiens
gaaucauuguuaaccacag

SEQ ID NO: 2190098 - RNA, 19 nt, Homo sapiens
cacugaacaugcucaugug

SEQ ID NO: 2190099 - RNA, 11 nt, Homo sapiens
ccagugucugu

SEQ ID NO: 2190100 - RNA, 18 nt, Homo sapiens
ucacaccuuacaaagcca

SEQ ID NO: 2190101 - RNA, 12 nt, Homo sapiens
ccagccuacccc

SEQ ID NO: 2190102 - RNA, 15 nt, Homo sapiens
ucgaaaucaaaccac

SEQ ID NO: 2190103 - RNA, 23 nt, Homo sapiens
cgggugagcugagcuuggcguuu

SEQ ID NO: 2190104 - RNA, 17 nt, Homo sapiens
gcugccuuggcucagac

SEQ ID NO: 2190105 - RNA, 18 nt, Homo sapiens
agggcaguaccugggaaa

SEQ ID NO: 2190106 - RNA, 18 nt, Homo sapiens
uauauuaacaucaucuua

SEQ ID NO: 2190107 - RNA, 17 nt, Homo sapiens
gaaaaaaaaacagccac

SEQ ID NO: 2190108 - RNA, 21 nt, Homo sapiens
gggccagcacuuccaugggaa

SEQ ID NO: 2190109 - RNA, 18 nt, Homo sapiens
caguggugagacuguauc

SEQ ID NO: 2190110 - RNA, 16 nt, Homo sapiens
gaaaucaaaaagggaa

SEQ ID NO: 2190111 - RNA, 16 nt, Homo sapiens
caggaccaugugauaa

SEQ ID NO: 2190112 - RNA, 16 nt, Homo sapiens
uaucaaaacauaucaa

SEQ ID NO: 2190113 - RNA, 12 nt, Homo sapiens
auagcacuuuga

SEQ ID NO: 2190114 - RNA, 21 nt, Homo sapiens
uucugucagaaugcuauugaa

SEQ ID NO: 2190115 - RNA, 15 nt, Homo sapiens
gaggagaagcaaugg

SEQ ID NO: 2190116 - RNA, 23 nt, Homo sapiens
augugcuauugaacugagccaaa

SEQ ID NO: 2190117 - RNA, 14 nt, Homo sapiens
caccccagggccaa

SEQ ID NO: 2190118 - RNA, 18 nt, Homo sapiens
ccugccuuuucauugccc

SEQ ID NO: 2190119 - RNA, 19 nt, Homo sapiens
uccuaauauuuugauucau

SEQ ID NO: 2190120 - RNA, 18 nt, Homo sapiens
acucuuuaagugaaggau

SEQ ID NO: 2190121 - RNA, 13 nt, Homo sapiens
gcacauggugugg

SEQ ID NO: 2190122 - RNA, 21 nt, Homo sapiens
uguaaaauauuguuacuagag

SEQ ID NO: 2190123 - RNA, 22 nt, Homo sapiens
uaauuaagcauuuugugauguu

SEQ ID NO: 2190124 - RNA, 15 nt, Homo sapiens
aguguguaugugcau

SEQ ID NO: 2190125 - RNA, 21 nt, Homo sapiens
cauaaaaugucucgaguccua

SEQ ID NO: 2190126 - RNA, 18 nt, Homo sapiens
ucagagauggacagagaa

SEQ ID NO: 2190127 - RNA, 18 nt, Homo sapiens
uggacuugcugaauucuc

SEQ ID NO: 2190128 - RNA, 13 nt, Homo sapiens
ccuugaaagggaa

SEQ ID NO: 2190129 - RNA, 15 nt, Homo sapiens
uaaaauuuggugcuu

SEQ ID NO: 2190130 - RNA, 23 nt, Homo sapiens
uuccugauaaacagaguaacuga

SEQ ID NO: 2190131 - RNA, 20 nt, Homo sapiens
ccucaggcacaccuugcaga

SEQ ID NO: 2190132 - RNA, 19 nt, Homo sapiens
cauccucacugcugucaac

SEQ ID NO: 2190133 - RNA, 17 nt, Homo sapiens
ccucuauauaccaaagc

SEQ ID NO: 2190134 - RNA, 17 nt, Homo sapiens
gugacuauuuguucuau

SEQ ID NO: 2190135 - RNA, 21 nt, Homo sapiens
aagcuuguauauacauauuau

SEQ ID NO: 2190136 - RNA, 15 nt, Homo sapiens
uaagcauuuguauau

SEQ ID NO: 2190137 - RNA, 15 nt, Homo sapiens
aaugcaauagaauaa

SEQ ID NO: 2190138 - RNA, 22 nt, Homo sapiens
ucccuuuugcuagagcugacag

SEQ ID NO: 2190139 - RNA, 14 nt, Homo sapiens
auauuuuaucucaa

SEQ ID NO: 2190140 - RNA, 22 nt, Homo sapiens
ggguauauuucuggguucucaa

SEQ ID NO: 2190141 - RNA, 16 nt, Homo sapiens
gaaacaacacaguuuu

SEQ ID NO: 2190142 - RNA, 22 nt, Homo sapiens
gaauaccaaaugauagaaacag

SEQ ID NO: 2190143 - RNA, 18 nt, Homo sapiens
acaaaauauuuaagugaa

SEQ ID NO: 2190144 - RNA, 23 nt, Homo sapiens
aggugcuguugucauugcuuuac

SEQ ID NO: 2190145 - RNA, 14 nt, Homo sapiens
ccaucguguuugca

SEQ ID NO: 2190146 - RNA, 11 nt, Homo sapiens
gauuacaggug

SEQ ID NO: 2190147 - RNA, 15 nt, Homo sapiens
ccuucguguugccau

SEQ ID NO: 2190148 - RNA, 18 nt, Homo sapiens
ucuauugccaugaaccau

SEQ ID NO: 2190149 - RNA, 17 nt, Homo sapiens
uuacaucugugugguau

SEQ ID NO: 2190150 - RNA, 15 nt, Homo sapiens
aauggcuaguacugu

SEQ ID NO: 2190151 - RNA, 15 nt, Homo sapiens
aacuagcaaaaggau

SEQ ID NO: 2190152 - RNA, 19 nt, Homo sapiens
auaucuuuuguaagacauu

SEQ ID NO: 2190153 - RNA, 18 nt, Homo sapiens
gacuacagcacacgucau

SEQ ID NO: 2190154 - RNA, 17 nt, Homo sapiens
ccaggauggcgcaggaa

SEQ ID NO: 2190155 - RNA, 20 nt, Homo sapiens
aaccucuaccuccuggguuc

SEQ ID NO: 2190156 - RNA, 22 nt, Homo sapiens
ugaggcuacagggaguguagua

SEQ ID NO: 2190157 - RNA, 17 nt, Homo sapiens
ccugcucccagguugag

SEQ ID NO: 2190158 - RNA, 20 nt, Homo sapiens
guggagcuggcaccauucag

SEQ ID NO: 2190159 - RNA, 15 nt, Homo sapiens
gacagacccucugcc

SEQ ID NO: 2190160 - RNA, 10 nt, Homo sapiens
ucuuuuccau

SEQ ID NO: 2190161 - RNA, 20 nt, Homo sapiens
aucagugucuguuucagaau

SEQ ID NO: 2190162 - RNA, 22 nt, Homo sapiens
uuggaagagggcgaguucagca

SEQ ID NO: 2190163 - RNA, 17 nt, Homo sapiens
caauaguggcauaccaa

SEQ ID NO: 2190164 - RNA, 15 nt, Homo sapiens
ccaccugugcccuca

SEQ ID NO: 2190165 - RNA, 20 nt, Homo sapiens
uggaagaagaggaggaagac

SEQ ID NO: 2190166 - RNA, 20 nt, Homo sapiens
cagguaccaucuuguauaca

SEQ ID NO: 2190167 - RNA, 17 nt, Homo sapiens
uucauauuuuaauuuca

SEQ ID NO: 2190168 - RNA, 22 nt, Homo sapiens
uagaguaucacucccacuuccu

SEQ ID NO: 2190169 - RNA, 20 nt, Homo sapiens
guauucuccuuugcacuguu

SEQ ID NO: 2190170 - RNA, 22 nt, Homo sapiens
agucauuugauagaaagaugag

SEQ ID NO: 2190171 - RNA, 22 nt, Homo sapiens
cccgagaguggguguuggacag

SEQ ID NO: 2190172 - RNA, 21 nt, Homo sapiens
uuggauuaugaagugacucuc

SEQ ID NO: 2190173 - RNA, 18 nt, Homo sapiens
uuguguuugaacagggca

SEQ ID NO: 2190174 - RNA, 15 nt, Homo sapiens
cuccuggggagcucc

SEQ ID NO: 2190175 - RNA, 19 nt, Homo sapiens
cagagagaaacgguccuuu

SEQ ID NO: 2190176 - RNA, 18 nt, Homo sapiens
aucguuaagcacaagaca

SEQ ID NO: 2190177 - RNA, 12 nt, Homo sapiens
ggacagagggug

SEQ ID NO: 2190178 - RNA, 19 nt, Homo sapiens
ccaguuacgacugaaguca

SEQ ID NO: 2190179 - RNA, 21 nt, Homo sapiens
ggcgcagaugugugucagaag

SEQ ID NO: 2190180 - RNA, 10 nt, Homo sapiens
acccucacaa

SEQ ID NO: 2190181 - RNA, 18 nt, Homo sapiens
acacagcaagacuccguc

SEQ ID NO: 2190182 - RNA, 16 nt, Homo sapiens
uuauuugaaggccagc

SEQ ID NO: 2190183 - RNA, 20 nt, Homo sapiens
cuacacacauaccuucaugu

SEQ ID NO: 2190184 - RNA, 20 nt, Homo sapiens
uuuaacuucuuucuauuuga

SEQ ID NO: 2190185 - RNA, 16 nt, Homo sapiens
gacaugggccuggacg

SEQ ID NO: 2190186 - RNA, 15 nt, Homo sapiens
aguuaccucaugccg

SEQ ID NO: 2190187 - RNA, 19 nt, Homo sapiens
gcuuuacccucaggugcua

SEQ ID NO: 2190188 - RNA, 15 nt, Homo sapiens
gucuauuuucagagc

SEQ ID NO: 2190189 - RNA, 18 nt, Homo sapiens
ccaaaggaagcacaugcc

SEQ ID NO: 2190190 - RNA, 16 nt, Homo sapiens
gcuuacuaaugcugcc

SEQ ID NO: 2190191 - RNA, 19 nt, Homo sapiens
ugcugcaaaugcauuguga

SEQ ID NO: 2190192 - RNA, 15 nt, Homo sapiens
auacauucauaagga

SEQ ID NO: 2190193 - RNA, 22 nt, Homo sapiens
cacuacaguauuacucuuacaa

SEQ ID NO: 2190194 - RNA, 15 nt, Homo sapiens
ucaauagaucuccag

SEQ ID NO: 2190195 - RNA, 15 nt, Homo sapiens
guauuaccuauucaa

SEQ ID NO: 2190196 - RNA, 13 nt, Homo sapiens
gcgccugugcuga

SEQ ID NO: 2190197 - RNA, 21 nt, Homo sapiens
caguccaguccucacaugccc

SEQ ID NO: 2190198 - RNA, 16 nt, Homo sapiens
auuuuugauaucucaa

SEQ ID NO: 2190199 - RNA, 17 nt, Homo sapiens
accacaucccacucaca

SEQ ID NO: 2190200 - RNA, 18 nt, Homo sapiens
acugugcuguuguucucg

SEQ ID NO: 2190201 - RNA, 18 nt, Homo sapiens
agucagcucuucaucugc

SEQ ID NO: 2190202 - RNA, 16 nt, Homo sapiens
uaaaaagguuggccuu

SEQ ID NO: 2190203 - RNA, 13 nt, Homo sapiens
aagaagcaugagg

SEQ ID NO: 2190204 - RNA, 23 nt, Homo sapiens
ucaaugaucuagguuuaacucag

SEQ ID NO: 2190205 - RNA, 15 nt, Homo sapiens
ucccuuuucuguucu

SEQ ID NO: 2190206 - RNA, 17 nt, Homo sapiens
cauauauuuccacuucu

SEQ ID NO: 2190207 - RNA, 17 nt, Homo sapiens
uucaccuguuaaggugg

SEQ ID NO: 2190208 - RNA, 16 nt, Homo sapiens
agccgccggcugugca

SEQ ID NO: 2190209 - RNA, 16 nt, Homo sapiens
ucuaaaauaacuagua

SEQ ID NO: 2190210 - RNA, 12 nt, Homo sapiens
ccagcaucugca

SEQ ID NO: 2190211 - RNA, 23 nt, Homo sapiens
uucauaacuuuucuugauaucuu

SEQ ID NO: 2190212 - RNA, 14 nt, Homo sapiens
cugauucacagucu

SEQ ID NO: 2190213 - RNA, 18 nt, Homo sapiens
ucugaagugucuaaugca

SEQ ID NO: 2190214 - RNA, 15 nt, Homo sapiens
aaggaaaaaagcaag

SEQ ID NO: 2190215 - RNA, 15 nt, Homo sapiens
aaaccagaaaagcaa

SEQ ID NO: 2190216 - RNA, 15 nt, Homo sapiens
gcuguuccuguucag

SEQ ID NO: 2190217 - RNA, 20 nt, Homo sapiens
uagggauauuuaacuggagc

SEQ ID NO: 2190218 - RNA, 15 nt, Homo sapiens
uccagaagaucugaa

SEQ ID NO: 2190219 - RNA, 15 nt, Homo sapiens
auuuuaugucuauau

SEQ ID NO: 2190220 - RNA, 16 nt, Homo sapiens
aacccucuccaucucc

SEQ ID NO: 2190221 - RNA, 16 nt, Homo sapiens
uaugaacucuugauaa

SEQ ID NO: 2190222 - RNA, 12 nt, Homo sapiens
ccuucagugaca

SEQ ID NO: 2190223 - RNA, 15 nt, Homo sapiens
cuuuuccccaaccac

SEQ ID NO: 2190224 - RNA, 15 nt, Homo sapiens
aaauucccauuccac

SEQ ID NO: 2190225 - RNA, 15 nt, Homo sapiens
ugagggcauggguaa

SEQ ID NO: 2190226 - RNA, 22 nt, Homo sapiens
cuggacggcaggcucacugcca

SEQ ID NO: 2190227 - RNA, 13 nt, Homo sapiens
gcauguccuuugc

SEQ ID NO: 2190228 - RNA, 16 nt, Homo sapiens
agauguuauuacuguu

SEQ ID NO: 2190229 - RNA, 15 nt, Homo sapiens
cuccuucagacaccc

SEQ ID NO: 2190230 - RNA, 19 nt, Homo sapiens
uggccugcugcucucucaa

SEQ ID NO: 2190231 - RNA, 22 nt, Homo sapiens
accuccugugacccgugaaugu

SEQ ID NO: 2190232 - RNA, 14 nt, Homo sapiens
acacggaggcaucc

SEQ ID NO: 2190233 - RNA, 21 nt, Homo sapiens
cccugggacguggcuagucau

SEQ ID NO: 2190234 - RNA, 17 nt, Homo sapiens
auagccuacguuaaccc

SEQ ID NO: 2190235 - RNA, 15 nt, Homo sapiens
auaccuuccccacau

SEQ ID NO: 2190236 - RNA, 18 nt, Homo sapiens
agacacucccaccagcac

SEQ ID NO: 2190237 - RNA, 19 nt, Homo sapiens
accucaguuucccucugua

SEQ ID NO: 2190238 - RNA, 10 nt, Homo sapiens
ccacagcagg

SEQ ID NO: 2190239 - RNA, 19 nt, Homo sapiens
cuucuuuccagaaaccaaa

SEQ ID NO: 2190240 - RNA, 19 nt, Homo sapiens
ccuucaaguuagcucagga

SEQ ID NO: 2190241 - RNA, 14 nt, Homo sapiens
ugauuccuucuugc

SEQ ID NO: 2190242 - RNA, 14 nt, Homo sapiens
uggugaacuccacc

SEQ ID NO: 2190243 - RNA, 14 nt, Homo sapiens
cagaaguccagagu

SEQ ID NO: 2190244 - RNA, 22 nt, Homo sapiens
gcacuacaggaggaaugcacca

SEQ ID NO: 2190245 - RNA, 13 nt, Homo sapiens
auugguuauucaa

SEQ ID NO: 2190246 - RNA, 21 nt, Homo sapiens
uggauaucccuaccuugaaag

SEQ ID NO: 2190247 - RNA, 22 nt, Homo sapiens
cacugccaaauaaacagcuauu

SEQ ID NO: 2190248 - RNA, 15 nt, Homo sapiens
uggaaugaauacagc

SEQ ID NO: 2190249 - RNA, 20 nt, Homo sapiens
ccaaaauucagggcuuuaaa

SEQ ID NO: 2190250 - RNA, 12 nt, Homo sapiens
uggggaccaaga

SEQ ID NO: 2190251 - RNA, 19 nt, Homo sapiens
aauuuuuuugaaucuuucg

SEQ ID NO: 2190252 - RNA, 14 nt, Homo sapiens
ucaaauagcauaag

SEQ ID NO: 2190253 - RNA, 19 nt, Homo sapiens
auuagccaguaauccugua

SEQ ID NO: 2190254 - RNA, 16 nt, Homo sapiens
ucuuucagacuugcca

SEQ ID NO: 2190255 - RNA, 22 nt, Homo sapiens
cauaugugugugugugcauaug

SEQ ID NO: 2190256 - RNA, 22 nt, Homo sapiens
ugcauaugugugugugugcaua

SEQ ID NO: 2190257 - RNA, 22 nt, Homo sapiens
gggcugagcccuggcaggauga

SEQ ID NO: 2190258 - RNA, 12 nt, Homo sapiens
auuuaauaacau

SEQ ID NO: 2190259 - RNA, 13 nt, Homo sapiens
cugaaauugcauc

SEQ ID NO: 2190260 - RNA, 12 nt, Homo sapiens
uuagaauaucug

SEQ ID NO: 2190261 - RNA, 11 nt, Homo sapiens
cuuggagacag

SEQ ID NO: 2190262 - RNA, 16 nt, Homo sapiens
gugcaggacagcucuu

SEQ ID NO: 2190263 - RNA, 17 nt, Homo sapiens
ucccaaguccaguguga

SEQ ID NO: 2190264 - RNA, 14 nt, Homo sapiens
gugaaaaucuguca

SEQ ID NO: 2190265 - RNA, 14 nt, Homo sapiens
cucaacaugucucc

SEQ ID NO: 2190266 - RNA, 17 nt, Homo sapiens
acuuccaagucauucuc

SEQ ID NO: 2190267 - RNA, 22 nt, Homo sapiens
cuggcgagucugcuuucuucua

SEQ ID NO: 2190268 - RNA, 18 nt, Homo sapiens
cuaaaaaugagcuugauu

SEQ ID NO: 2190269 - RNA, 15 nt, Homo sapiens
guccugaucugugau

SEQ ID NO: 2190270 - RNA, 20 nt, Homo sapiens
ucaggaccuuuuggucuuca

SEQ ID NO: 2190271 - RNA, 13 nt, Homo sapiens
uacucuagugaau

SEQ ID NO: 2190272 - RNA, 13 nt, Homo sapiens
agcaagaugcaaa

SEQ ID NO: 2190273 - RNA, 20 nt, Homo sapiens
uccucacagcaucucuauga

SEQ ID NO: 2190274 - RNA, 22 nt, Homo sapiens
ugacuuacaagugggaagcagu

SEQ ID NO: 2190275 - RNA, 15 nt, Homo sapiens
aauguuuguucauua

SEQ ID NO: 2190276 - RNA, 17 nt, Homo sapiens
aaggcugauuacugaaa

SEQ ID NO: 2190277 - RNA, 15 nt, Homo sapiens
ucagguguuuuuacc

SEQ ID NO: 2190278 - RNA, 22 nt, Homo sapiens
agaugggggaaagcacaggugg

SEQ ID NO: 2190279 - RNA, 20 nt, Homo sapiens
agcauuucaccuuucugcaa

SEQ ID NO: 2190280 - RNA, 22 nt, Homo sapiens
ucuuaccagugacgcugcugac

SEQ ID NO: 2190281 - RNA, 19 nt, Homo sapiens
guuucaaacuguaaaccaa

SEQ ID NO: 2190282 - RNA, 20 nt, Homo sapiens
gaccccugugugacaucaca

SEQ ID NO: 2190283 - RNA, 15 nt, Homo sapiens
cccuggcugcccugg

SEQ ID NO: 2190284 - RNA, 15 nt, Homo sapiens
aaaggcugguggcaa

SEQ ID NO: 2190285 - RNA, 18 nt, Homo sapiens
uaucuguaagaguguuua

SEQ ID NO: 2190286 - RNA, 21 nt, Homo sapiens
ugugauucaaacuucugugua

SEQ ID NO: 2190287 - RNA, 15 nt, Homo sapiens
uuaccaggugagaag

SEQ ID NO: 2190288 - RNA, 19 nt, Homo sapiens
cuucccaacguacuccuca

SEQ ID NO: 2190289 - RNA, 18 nt, Homo sapiens
uguucucagaaucccuua

SEQ ID NO: 2190290 - RNA, 20 nt, Homo sapiens
accagcgcccccacuccucc

SEQ ID NO: 2190291 - RNA, 16 nt, Homo sapiens
cucuuuccuauuucag

SEQ ID NO: 2190292 - RNA, 14 nt, Homo sapiens
agcuguuucuugau

SEQ ID NO: 2190293 - RNA, 19 nt, Homo sapiens
gauuuccacacgccaagcu

SEQ ID NO: 2190294 - RNA, 19 nt, Homo sapiens
agucccaaaugucaucagg

SEQ ID NO: 2190295 - RNA, 15 nt, Homo sapiens
ucuuggcaguauucc

SEQ ID NO: 2190296 - RNA, 20 nt, Homo sapiens
uucuccuuugcacuguuuau

SEQ ID NO: 2190297 - RNA, 20 nt, Homo sapiens
auuguaaacuaguacuauua

SEQ ID NO: 2190298 - RNA, 21 nt, Homo sapiens
gacucagcuuaagucauggaa

SEQ ID NO: 2190299 - RNA, 18 nt, Homo sapiens
uuguuucugaucuaauau

SEQ ID NO: 2190300 - RNA, 16 nt, Homo sapiens
uccagaggugagggag

SEQ ID NO: 2190301 - RNA, 20 nt, Homo sapiens
ugggugacagagcaagugag

SEQ ID NO: 2190302 - RNA, 20 nt, Homo sapiens
caagugauucucaugccuca

SEQ ID NO: 2190303 - RNA, 11 nt, Homo sapiens
acacugugacc

SEQ ID NO: 2190304 - RNA, 23 nt, Homo sapiens
agccuccguucccaccucugagg

SEQ ID NO: 2190305 - RNA, 22 nt, Homo sapiens
ggaucaagaaggggacagcgcc

SEQ ID NO: 2190306 - RNA, 22 nt, Homo sapiens
agguuccauccaccaccuugcc

SEQ ID NO: 2190307 - RNA, 21 nt, Homo sapiens
ucaaucuuuggaggcuuuuaa

SEQ ID NO: 2190308 - RNA, 13 nt, Homo sapiens
agguuagaaccua

SEQ ID NO: 2190309 - RNA, 13 nt, Homo sapiens
auucugcacucag

SEQ ID NO: 2190310 - RNA, 20 nt, Homo sapiens
aacccaaucugcacacucca

SEQ ID NO: 2190311 - RNA, 23 nt, Homo sapiens
ggucuguuuucugugcacuguag

SEQ ID NO: 2190312 - RNA, 15 nt, Homo sapiens
caucugcaaaauggg

SEQ ID NO: 2190313 - RNA, 23 nt, Homo sapiens
aacuugguacuaucuuauucuga

SEQ ID NO: 2190314 - RNA, 19 nt, Homo sapiens
gacucagggccccagcacu

SEQ ID NO: 2190315 - RNA, 21 nt, Homo sapiens
ucaccccagcccccacagccc

SEQ ID NO: 2190316 - RNA, 22 nt, Homo sapiens
acacagcccuggccucugcuca

SEQ ID NO: 2190317 - RNA, 16 nt, Homo sapiens
acuugacagacaaaga

SEQ ID NO: 2190318 - RNA, 13 nt, Homo sapiens
uccuuaguguaua

SEQ ID NO: 2190319 - RNA, 17 nt, Homo sapiens
uuuucaaaaaacauuaa

SEQ ID NO: 2190320 - RNA, 19 nt, Homo sapiens
acaaacucauucauuaguc

SEQ ID NO: 2190321 - RNA, 16 nt, Homo sapiens
acagacuccaaaaggc

SEQ ID NO: 2190322 - RNA, 13 nt, Homo sapiens
augcaaaugcuca

SEQ ID NO: 2190323 - RNA, 16 nt, Homo sapiens
gugacugugcauuuga

SEQ ID NO: 2190324 - RNA, 16 nt, Homo sapiens
guaucauagcgauauu

SEQ ID NO: 2190325 - RNA, 13 nt, Homo sapiens
auuggaaauggau

SEQ ID NO: 2190326 - RNA, 15 nt, Homo sapiens
ccauucacaccagcu

SEQ ID NO: 2190327 - RNA, 16 nt, Homo sapiens
ccuugcccccauuuca

SEQ ID NO: 2190328 - RNA, 16 nt, Homo sapiens
aauaauggcccuuaau

SEQ ID NO: 2190329 - RNA, 16 nt, Homo sapiens
guccaaauccaaccuc

SEQ ID NO: 2190330 - RNA, 22 nt, Homo sapiens
ugaaauaaaaugcuaucucaaa

SEQ ID NO: 2190331 - RNA, 19 nt, Homo sapiens
agcuccuugucugucucca

SEQ ID NO: 2190332 - RNA, 13 nt, Homo sapiens
gguuaaagcuaaa

SEQ ID NO: 2190333 - RNA, 22 nt, Homo sapiens
ucucaaacacaguuacacuugu

SEQ ID NO: 2190334 - RNA, 19 nt, Homo sapiens
aaaaaaugcucacacucca

SEQ ID NO: 2190335 - RNA, 22 nt, Homo sapiens
cucacauacugacuucaguggg

SEQ ID NO: 2190336 - RNA, 15 nt, Homo sapiens
uuuuaacaauuccca

SEQ ID NO: 2190337 - RNA, 13 nt, Homo sapiens
uuucauccuccuu

SEQ ID NO: 2190338 - RNA, 13 nt, Homo sapiens
uccuuuccuuuca

SEQ ID NO: 2190339 - RNA, 15 nt, Homo sapiens
aauccaauaccucuu

SEQ ID NO: 2190340 - RNA, 11 nt, Homo sapiens
ugauaugcuuc

SEQ ID NO: 2190341 - RNA, 14 nt, Homo sapiens
gaccacaggugcac

SEQ ID NO: 2190342 - RNA, 19 nt, Homo sapiens
uguccccagccuaccucuc

SEQ ID NO: 2190343 - RNA, 16 nt, Homo sapiens
aauuccuguuacuuua

SEQ ID NO: 2190344 - RNA, 21 nt, Homo sapiens
aaugauauugacacugucccu

SEQ ID NO: 2190345 - RNA, 15 nt, Homo sapiens
uaaaacuguguaaac

SEQ ID NO: 2190346 - RNA, 18 nt, Homo sapiens
aagcugaaggcugaggca

SEQ ID NO: 2190347 - RNA, 17 nt, Homo sapiens
aaaacugaaaauacuua

SEQ ID NO: 2190348 - RNA, 23 nt, Homo sapiens
uucaaaauauuauguuaacaugu

SEQ ID NO: 2190349 - RNA, 10 nt, Homo sapiens
uccugggcug

SEQ ID NO: 2190350 - RNA, 17 nt, Homo sapiens
aaaggaacuugcccuga

SEQ ID NO: 2190351 - RNA, 21 nt, Homo sapiens
gcaucugccaggacacugccu

SEQ ID NO: 2190352 - RNA, 13 nt, Homo sapiens
uuucuauauucuc

SEQ ID NO: 2190353 - RNA, 21 nt, Homo sapiens
cauaacuuuguaaauauuacc

SEQ ID NO: 2190354 - RNA, 16 nt, Homo sapiens
ccuugacuucuuugag

SEQ ID NO: 2190355 - RNA, 16 nt, Homo sapiens
cauaauaaauaucugu

SEQ ID NO: 2190356 - RNA, 14 nt, Homo sapiens
agccuccucagggg

SEQ ID NO: 2190357 - RNA, 24 nt, Homo sapiens
aggugaccuggccagagccaagaa

SEQ ID NO: 2190358 - RNA, 20 nt, Homo sapiens
acugaguuuuguuucacuuu

SEQ ID NO: 2190359 - RNA, 20 nt, Homo sapiens
auguauuugucaaugcauca

SEQ ID NO: 2190360 - RNA, 22 nt, Homo sapiens
accccucccagcugacaguccu

SEQ ID NO: 2190361 - RNA, 22 nt, Homo sapiens
aaguucuuggauuacuuuacac

SEQ ID NO: 2190362 - RNA, 13 nt, Homo sapiens
ugcuugacuauca

SEQ ID NO: 2190363 - RNA, 12 nt, Homo sapiens
gacaagggauuu

SEQ ID NO: 2190364 - RNA, 14 nt, Homo sapiens
aauuugaaucucaa

SEQ ID NO: 2190365 - RNA, 22 nt, Homo sapiens
cccagccuguggccucagcauc

SEQ ID NO: 2190366 - RNA, 22 nt, Homo sapiens
caucuaugugagaccauuuagc

SEQ ID NO: 2190367 - RNA, 20 nt, Homo sapiens
caccgggcuggcugcuugca

SEQ ID NO: 2190368 - RNA, 19 nt, Homo sapiens
gugaaaauuacaguccaaa

SEQ ID NO: 2190369 - RNA, 15 nt, Homo sapiens
accaacccucagagc

SEQ ID NO: 2190370 - RNA, 14 nt, Homo sapiens
agccacuguuacau

SEQ ID NO: 2190371 - RNA, 20 nt, Homo sapiens
ucuuuagcuauggugacuau

SEQ ID NO: 2190372 - RNA, 20 nt, Homo sapiens
gauugugccccugcacucca

SEQ ID NO: 2190373 - RNA, 17 nt, Homo sapiens
ugugccauggaucugau

SEQ ID NO: 2190374 - RNA, 17 nt, Homo sapiens
aucauggcugcuugauu

SEQ ID NO: 2190375 - RNA, 15 nt, Homo sapiens
uugaauuaaaacagc

SEQ ID NO: 2190376 - RNA, 19 nt, Homo sapiens
uggacugccuuauugcugu

SEQ ID NO: 2190377 - RNA, 15 nt, Homo sapiens
auuuaugagcucuuc

SEQ ID NO: 2190378 - RNA, 22 nt, Homo sapiens
acuaggguaaucugacuucuca

SEQ ID NO: 2190379 - RNA, 13 nt, Homo sapiens
gcuuuguaauauu

SEQ ID NO: 2190380 - RNA, 22 nt, Homo sapiens
caaagcauuuugccuaccuggg

SEQ ID NO: 2190381 - RNA, 17 nt, Homo sapiens
augaugggcuguucuaa

SEQ ID NO: 2190382 - RNA, 16 nt, Homo sapiens
agggcaggggugcugu

SEQ ID NO: 2190383 - RNA, 11 nt, Homo sapiens
uuauucacuuu

SEQ ID NO: 2190384 - RNA, 16 nt, Homo sapiens
agugacuaauggcaug

SEQ ID NO: 2190385 - RNA, 14 nt, Homo sapiens
agaaggaacaauaa

SEQ ID NO: 2190386 - RNA, 22 nt, Homo sapiens
acuugccugugcuacaauucau

SEQ ID NO: 2190387 - RNA, 12 nt, Homo sapiens
ccaaucugcaag

SEQ ID NO: 2190388 - RNA, 20 nt, Homo sapiens
ugugcagagcagacaggcua

SEQ ID NO: 2190389 - RNA, 16 nt, Homo sapiens
aaaauccaaaacucuu

SEQ ID NO: 2190390 - RNA, 16 nt, Homo sapiens
gagcacuugagaacca

SEQ ID NO: 2190391 - RNA, 15 nt, Homo sapiens
ggggcuuugggccga

SEQ ID NO: 2190392 - RNA, 13 nt, Homo sapiens
ugaguuuuuagug

SEQ ID NO: 2190393 - RNA, 15 nt, Homo sapiens
cguucugugcacaaa

SEQ ID NO: 2190394 - RNA, 22 nt, Homo sapiens
cugaggcacucaucuacugaau

SEQ ID NO: 2190395 - RNA, 15 nt, Homo sapiens
uacucaugaaugaaa

SEQ ID NO: 2190396 - RNA, 16 nt, Homo sapiens
ccaucucuccugcuca

SEQ ID NO: 2190397 - RNA, 16 nt, Homo sapiens
caugcccucaauccca

SEQ ID NO: 2190398 - RNA, 16 nt, Homo sapiens
auaucaaaauugcaau

SEQ ID NO: 2190399 - RNA, 13 nt, Homo sapiens
aagggaggggaga

SEQ ID NO: 2190400 - RNA, 14 nt, Homo sapiens
gaugcagaguaagu

SEQ ID NO: 2190401 - RNA, 13 nt, Homo sapiens
ccugugucagggc

SEQ ID NO: 2190402 - RNA, 16 nt, Homo sapiens
ggaaaccgcugccuuu

SEQ ID NO: 2190403 - RNA, 17 nt, Homo sapiens
gaguaacaggugccuuc

SEQ ID NO: 2190404 - RNA, 21 nt, Homo sapiens
aggauuuucacauucuuggcu

SEQ ID NO: 2190405 - RNA, 11 nt, Homo sapiens
uagaauaucuu

SEQ ID NO: 2190406 - RNA, 19 nt, Homo sapiens
uggaguacuauauuuacaa

SEQ ID NO: 2190407 - RNA, 17 nt, Homo sapiens
agugccaauauuucuga

SEQ ID NO: 2190408 - RNA, 18 nt, Homo sapiens
ugggagcaaucuggaaaa

SEQ ID NO: 2190409 - RNA, 15 nt, Homo sapiens
gcuuauuucccucau

SEQ ID NO: 2190410 - RNA, 14 nt, Homo sapiens
aacaccuaugcaaa

SEQ ID NO: 2190411 - RNA, 17 nt, Homo sapiens
ucaggauaaaguuugcu

SEQ ID NO: 2190412 - RNA, 16 nt, Homo sapiens
acaaauucaagccuua

SEQ ID NO: 2190413 - RNA, 15 nt, Homo sapiens
gacucuuccaccaga

SEQ ID NO: 2190414 - RNA, 20 nt, Homo sapiens
uauaaaaacagcuccucuau

SEQ ID NO: 2190415 - RNA, 18 nt, Homo sapiens
ugugcaaggaaauuugca

SEQ ID NO: 2190416 - RNA, 16 nt, Homo sapiens
gaagccuguccucacc

SEQ ID NO: 2190417 - RNA, 20 nt, Homo sapiens
ggacuauggguacauuccac

SEQ ID NO: 2190418 - RNA, 15 nt, Homo sapiens
aggagcgcuacccac

SEQ ID NO: 2190419 - RNA, 16 nt, Homo sapiens
gccuguugacugcugg

SEQ ID NO: 2190420 - RNA, 14 nt, Homo sapiens
ugcuuaguaucuca

SEQ ID NO: 2190421 - RNA, 18 nt, Homo sapiens
gacugcuaccucugagaa

SEQ ID NO: 2190422 - RNA, 12 nt, Homo sapiens
agccuagacaac

SEQ ID NO: 2190423 - RNA, 16 nt, Homo sapiens
acccacauuacaggau

SEQ ID NO: 2190424 - RNA, 17 nt, Homo sapiens
agccccagcuuccugug

SEQ ID NO: 2190425 - RNA, 23 nt, Homo sapiens
uggacaaacagccucacuccuca

SEQ ID NO: 2190426 - RNA, 16 nt, Homo sapiens
aagaagaaaccuucau

SEQ ID NO: 2190427 - RNA, 15 nt, Homo sapiens
ucaccccaagccaua

SEQ ID NO: 2190428 - RNA, 19 nt, Homo sapiens
acuuguauuauuaaugcca

SEQ ID NO: 2190429 - RNA, 15 nt, Homo sapiens
gcuuccuauucucaa

SEQ ID NO: 2190430 - RNA, 17 nt, Homo sapiens
ucgaaacugacaguauu

SEQ ID NO: 2190431 - RNA, 16 nt, Homo sapiens
guuguggugugccaug

SEQ ID NO: 2190432 - RNA, 16 nt, Homo sapiens
uccucuaacauuugca

SEQ ID NO: 2190433 - RNA, 22 nt, Homo sapiens
ucugaaacccuccuccacagcu

SEQ ID NO: 2190434 - RNA, 20 nt, Homo sapiens
aacggaugaccauaugcaca

SEQ ID NO: 2190435 - RNA, 23 nt, Homo sapiens
cagucagcuguggggaacacagc

SEQ ID NO: 2190436 - RNA, 18 nt, Homo sapiens
uuucacacacgugagaau

SEQ ID NO: 2190437 - RNA, 19 nt, Homo sapiens
guuggucaggcuggucuca

SEQ ID NO: 2190438 - RNA, 16 nt, Homo sapiens
agccaaugucuccucc

SEQ ID NO: 2190439 - RNA, 20 nt, Homo sapiens
agcauauacaauaauguaau

SEQ ID NO: 2190440 - RNA, 16 nt, Homo sapiens
aacuuagcucacaccu

SEQ ID NO: 2190441 - RNA, 17 nt, Homo sapiens
ccuuggguagugagcag

SEQ ID NO: 2190442 - RNA, 15 nt, Homo sapiens
agucugcaguauuga

SEQ ID NO: 2190443 - RNA, 15 nt, Homo sapiens
ucuuagaaaugaagg

SEQ ID NO: 2190444 - RNA, 14 nt, Homo sapiens
aguaacauaauaca

SEQ ID NO: 2190445 - RNA, 19 nt, Homo sapiens
ucacuugugccaacacuca

SEQ ID NO: 2190446 - RNA, 20 nt, Homo sapiens
gauagucagcuguaccaagc

SEQ ID NO: 2190447 - RNA, 13 nt, Homo sapiens
ccggacagagggg

SEQ ID NO: 2190448 - RNA, 13 nt, Homo sapiens
ucaaaaugaauag

SEQ ID NO: 2190449 - RNA, 18 nt, Homo sapiens
ugugugugccaugucaca

SEQ ID NO: 2190450 - RNA, 15 nt, Homo sapiens
auuagggaugcucaa

SEQ ID NO: 2190451 - RNA, 19 nt, Homo sapiens
ucuaaugccuuuugaauac

SEQ ID NO: 2190452 - RNA, 17 nt, Homo sapiens
agagucauuuucacuuu

SEQ ID NO: 2190453 - RNA, 13 nt, Homo sapiens
aauuugagacaaa

SEQ ID NO: 2190454 - RNA, 17 nt, Homo sapiens
uacuccaggagacccac

SEQ ID NO: 2190455 - RNA, 13 nt, Homo sapiens
gacggaaggcaaa

SEQ ID NO: 2190456 - RNA, 17 nt, Homo sapiens
guagcugcaacaacagg

SEQ ID NO: 2190457 - RNA, 21 nt, Homo sapiens
cagaacggguucaguuuuaga

SEQ ID NO: 2190458 - RNA, 21 nt, Homo sapiens
acucuccacaaaaacucuuau

SEQ ID NO: 2190459 - RNA, 18 nt, Homo sapiens
gaggacacaucucccacc

SEQ ID NO: 2190460 - RNA, 21 nt, Homo sapiens
cuggaugccagcuguguccuu

SEQ ID NO: 2190461 - RNA, 21 nt, Homo sapiens
aauuuugccauaaagucaaau

SEQ ID NO: 2190462 - RNA, 18 nt, Homo sapiens
uucuguucucccugggaa

SEQ ID NO: 2190463 - RNA, 15 nt, Homo sapiens
uugaaguacuuaaca

SEQ ID NO: 2190464 - RNA, 17 nt, Homo sapiens
aaccuccacaguagcau

SEQ ID NO: 2190465 - RNA, 22 nt, Homo sapiens
uuuaagggcaugccuugugcug

SEQ ID NO: 2190466 - RNA, 14 nt, Homo sapiens
acaugaacccaaaa

SEQ ID NO: 2190467 - RNA, 14 nt, Homo sapiens
cccucucacugugu

SEQ ID NO: 2190468 - RNA, 23 nt, Homo sapiens
aaauuuggggguuucucaaauaa

SEQ ID NO: 2190469 - RNA, 22 nt, Homo sapiens
ccucaaccuugacuucugccca

SEQ ID NO: 2190470 - RNA, 17 nt, Homo sapiens
aguggcaucaucucagc

SEQ ID NO: 2190471 - RNA, 21 nt, Homo sapiens
uggaggaacagggcuggaaag

SEQ ID NO: 2190472 - RNA, 22 nt, Homo sapiens
uccauuuugugaauugugacau

SEQ ID NO: 2190473 - RNA, 15 nt, Homo sapiens
caugaaaugcuucca

SEQ ID NO: 2190474 - RNA, 21 nt, Homo sapiens
gccuauaauuggagggaaaaa

SEQ ID NO: 2190475 - RNA, 18 nt, Homo sapiens
aaacaccuggacauuccc

SEQ ID NO: 2190476 - RNA, 21 nt, Homo sapiens
agguccugaaagucugugucc

SEQ ID NO: 2190477 - RNA, 17 nt, Homo sapiens
auuugguagaugacaaa

SEQ ID NO: 2190478 - RNA, 16 nt, Homo sapiens
cucaugcugaucuucu

SEQ ID NO: 2190479 - RNA, 19 nt, Homo sapiens
uaucauuucaugcuuugau

SEQ ID NO: 2190480 - RNA, 23 nt, Homo sapiens
ccuacuguucggacaaaaaaagu

SEQ ID NO: 2190481 - RNA, 16 nt, Homo sapiens
ugaugguaagacugua

SEQ ID NO: 2190482 - RNA, 22 nt, Homo sapiens
aguuuuaccucuucucucucag

SEQ ID NO: 2190483 - RNA, 19 nt, Homo sapiens
uuaugguaccucugucuau

SEQ ID NO: 2190484 - RNA, 17 nt, Homo sapiens
aaggauaaugaaauaau

SEQ ID NO: 2190485 - RNA, 15 nt, Homo sapiens
gaaaacaucucauca

SEQ ID NO: 2190486 - RNA, 15 nt, Homo sapiens
gaagcaacuaaguua

SEQ ID NO: 2190487 - RNA, 15 nt, Homo sapiens
cgcagccuccagggc

SEQ ID NO: 2190488 - RNA, 15 nt, Homo sapiens
gccaguuaauuuuaa

SEQ ID NO: 2190489 - RNA, 16 nt, Homo sapiens
uccuccugcugcucac

SEQ ID NO: 2190490 - RNA, 22 nt, Homo sapiens
acccaggggaaacgagcugugu

SEQ ID NO: 2190491 - RNA, 19 nt, Homo sapiens
caucuucaaagcuugaaga

SEQ ID NO: 2190492 - RNA, 15 nt, Homo sapiens
cccaccgguccagcu

SEQ ID NO: 2190493 - RNA, 13 nt, Homo sapiens
aacaagugcucuu

SEQ ID NO: 2190494 - RNA, 19 nt, Homo sapiens
cccuuggggguucagggaa

SEQ ID NO: 2190495 - RNA, 22 nt, Homo sapiens
agccagugccauuccacuccac

SEQ ID NO: 2190496 - RNA, 20 nt, Homo sapiens
ccagccucuuccauucccuu

SEQ ID NO: 2190497 - RNA, 14 nt, Homo sapiens
uuagggugcaagaa

SEQ ID NO: 2190498 - RNA, 21 nt, Homo sapiens
cuguuuuaaaaaccuguucaa

SEQ ID NO: 2190499 - RNA, 16 nt, Homo sapiens
gucccaucucuacccc

SEQ ID NO: 2190500 - RNA, 15 nt, Homo sapiens
ucucaugaaccucaa

SEQ ID NO: 2190501 - RNA, 19 nt, Homo sapiens
uucccaagagcuauucauu

SEQ ID NO: 2190502 - RNA, 13 nt, Homo sapiens
uaaucuuccauuc

SEQ ID NO: 2190503 - RNA, 15 nt, Homo sapiens
cucccuccccagcuc

SEQ ID NO: 2190504 - RNA, 24 nt, Homo sapiens
uuugaaggaaaauuaaaccaauga

SEQ ID NO: 2190505 - RNA, 17 nt, Homo sapiens
uauuuuaauaccuuuaa

SEQ ID NO: 2190506 - RNA, 15 nt, Homo sapiens
augcauacacacaca

SEQ ID NO: 2190507 - RNA, 14 nt, Homo sapiens
ggcccguccggcgg

SEQ ID NO: 2190508 - RNA, 21 nt, Homo sapiens
cuaaguguacuucauaagaua

SEQ ID NO: 2190509 - RNA, 16 nt, Homo sapiens
ccaccaucauagcuca

SEQ ID NO: 2190510 - RNA, 23 nt, Homo sapiens
gggauuaaggcgugagccacugc

SEQ ID NO: 2190511 - RNA, 22 nt, Homo sapiens
uucguuuaccaaauaggauuaa

SEQ ID NO: 2190512 - RNA, 19 nt, Homo sapiens
auuucggagcgcaaugcca

SEQ ID NO: 2190513 - RNA, 15 nt, Homo sapiens
uguacuaagcaguaa

SEQ ID NO: 2190514 - RNA, 17 nt, Homo sapiens
cucccuuaauaaacuca

SEQ ID NO: 2190515 - RNA, 17 nt, Homo sapiens
ugaucagaggcauuuga

SEQ ID NO: 2190516 - RNA, 14 nt, Homo sapiens
uguugucaccagau

SEQ ID NO: 2190517 - RNA, 15 nt, Homo sapiens
uggcacuaacacugg

SEQ ID NO: 2190518 - RNA, 18 nt, Homo sapiens
acccuagccagagaauag

SEQ ID NO: 2190519 - RNA, 14 nt, Homo sapiens
ugcuggagacacuc

SEQ ID NO: 2190520 - RNA, 17 nt, Homo sapiens
cgccaggagagucuccc

SEQ ID NO: 2190521 - RNA, 16 nt, Homo sapiens
uuuaccugcugggacc

SEQ ID NO: 2190522 - RNA, 23 nt, Homo sapiens
cucucacuuaauuuucccaauga

SEQ ID NO: 2190523 - RNA, 19 nt, Homo sapiens
auuguauauuguaauuuaa

SEQ ID NO: 2190524 - RNA, 23 nt, Homo sapiens
gcuccagucagugugcaggggac

SEQ ID NO: 2190525 - RNA, 14 nt, Homo sapiens
agguuuacauucau

SEQ ID NO: 2190526 - RNA, 18 nt, Homo sapiens
caaugaagggaagugcau

SEQ ID NO: 2190527 - RNA, 17 nt, Homo sapiens
caaugugacauguugcu

SEQ ID NO: 2190528 - RNA, 14 nt, Homo sapiens
uccaaauacucuga

SEQ ID NO: 2190529 - RNA, 22 nt, Homo sapiens
cucgggaaccucacucuugcca

SEQ ID NO: 2190530 - RNA, 12 nt, Homo sapiens
gcuaaauuccac

SEQ ID NO: 2190531 - RNA, 12 nt, Homo sapiens
caccgucuuccu

SEQ ID NO: 2190532 - RNA, 14 nt, Homo sapiens
ugucucgaguccua

SEQ ID NO: 2190533 - RNA, 22 nt, Homo sapiens
acaacuugucacccaaagccug

SEQ ID NO: 2190534 - RNA, 18 nt, Homo sapiens
ugauucccuguggugaua

SEQ ID NO: 2190535 - RNA, 17 nt, Homo sapiens
augaacuuggauauuca

SEQ ID NO: 2190536 - RNA, 14 nt, Homo sapiens
aagauacaacagcu

SEQ ID NO: 2190537 - RNA, 21 nt, Homo sapiens
guguuucuuguuaagugcuuu

SEQ ID NO: 2190538 - RNA, 23 nt, Homo sapiens
acccauaggucuuaagaugcaaa

SEQ ID NO: 2190539 - RNA, 20 nt, Homo sapiens
gccaacaagguuauaugaau

SEQ ID NO: 2190540 - RNA, 17 nt, Homo sapiens
cuuugcuucauuccaaa

SEQ ID NO: 2190541 - RNA, 14 nt, Homo sapiens
uuacagaacuacuu

SEQ ID NO: 2190542 - RNA, 13 nt, Homo sapiens
gaugcucauucau

SEQ ID NO: 2190543 - RNA, 20 nt, Homo sapiens
ugugaccugaaccaaucacu

SEQ ID NO: 2190544 - RNA, 17 nt, Homo sapiens
aucuaccuuuugcuacu

SEQ ID NO: 2190545 - RNA, 17 nt, Homo sapiens
gaguggucacugucagu

SEQ ID NO: 2190546 - RNA, 19 nt, Homo sapiens
auuugugucaaugggcaau

SEQ ID NO: 2190547 - RNA, 15 nt, Homo sapiens
cugucugcccuaggg

SEQ ID NO: 2190548 - RNA, 17 nt, Homo sapiens
uuugauguggugucaua

SEQ ID NO: 2190549 - RNA, 22 nt, Homo sapiens
ugagucucuaugaucuuggcac

SEQ ID NO: 2190550 - RNA, 16 nt, Homo sapiens
augugaugcaagccag

SEQ ID NO: 2190551 - RNA, 19 nt, Homo sapiens
uaccucuauauaccaaagc

SEQ ID NO: 2190552 - RNA, 23 nt, Homo sapiens
ugaugagagaauggagacagagu

SEQ ID NO: 2190553 - RNA, 17 nt, Homo sapiens
gaggccugugcuugugu

SEQ ID NO: 2190554 - RNA, 22 nt, Homo sapiens
ucagagguuugcuuccucagua

SEQ ID NO: 2190555 - RNA, 17 nt, Homo sapiens
cuuauauuaagcaaaca

SEQ ID NO: 2190556 - RNA, 17 nt, Homo sapiens
augaaauacugccuugg

SEQ ID NO: 2190557 - RNA, 21 nt, Homo sapiens
gccccgcaccuguacagugga

SEQ ID NO: 2190558 - RNA, 13 nt, Homo sapiens
cccuacugagaaa

SEQ ID NO: 2190559 - RNA, 12 nt, Homo sapiens
ucacagccucaa

SEQ ID NO: 2190560 - RNA, 21 nt, Homo sapiens
ucccaacuuguauuaaagaca

SEQ ID NO: 2190561 - RNA, 13 nt, Homo sapiens
uucagcaugucca

SEQ ID NO: 2190562 - RNA, 15 nt, Homo sapiens
cugugcugaccaaag

SEQ ID NO: 2190563 - RNA, 17 nt, Homo sapiens
cuauagaauaaagccuc

SEQ ID NO: 2190564 - RNA, 14 nt, Homo sapiens
caaguugcagugag

SEQ ID NO: 2190565 - RNA, 12 nt, Homo sapiens
aucugcuguucu

SEQ ID NO: 2190566 - RNA, 15 nt, Homo sapiens
guaagugccuuccau

SEQ ID NO: 2190567 - RNA, 17 nt, Homo sapiens
aauuuucauuggaugca

SEQ ID NO: 2190568 - RNA, 13 nt, Homo sapiens
uacacaagcaaug

SEQ ID NO: 2190569 - RNA, 20 nt, Homo sapiens
guuuuguaaauguacuggua

SEQ ID NO: 2190570 - RNA, 23 nt, Homo sapiens
uauacagauagaguuccauauau

SEQ ID NO: 2190571 - RNA, 17 nt, Homo sapiens
ugggagcaguccaugca

SEQ ID NO: 2190572 - RNA, 20 nt, Homo sapiens
uugaauaggcaaacccaaau

SEQ ID NO: 2190573 - RNA, 13 nt, Homo sapiens
uguagccagacag

SEQ ID NO: 2190574 - RNA, 19 nt, Homo sapiens
cugugcccuagaugcacgu

SEQ ID NO: 2190575 - RNA, 19 nt, Homo sapiens
cuuguaaagacacaucuua

SEQ ID NO: 2190576 - RNA, 22 nt, Homo sapiens
aauuugaccagaaaauaugaua

SEQ ID NO: 2190577 - RNA, 21 nt, Homo sapiens
ggaugugcccacagggaccaa

SEQ ID NO: 2190578 - RNA, 15 nt, Homo sapiens
acaaugcuuugcccc

SEQ ID NO: 2190579 - RNA, 17 nt, Homo sapiens
auccuggcuaacacagu

SEQ ID NO: 2190580 - RNA, 13 nt, Homo sapiens
gcuccuccagggu

SEQ ID NO: 2190581 - RNA, 14 nt, Homo sapiens
uuugaaacuuugaa

SEQ ID NO: 2190582 - RNA, 14 nt, Homo sapiens
caucugaccaucug

SEQ ID NO: 2190583 - RNA, 14 nt, Homo sapiens
auauacacauauac

SEQ ID NO: 2190584 - RNA, 14 nt, Homo sapiens
ugggggacuggggg

SEQ ID NO: 2190585 - RNA, 14 nt, Homo sapiens
auacauacauacau

SEQ ID NO: 2190586 - RNA, 14 nt, Homo sapiens
caaagaaccaaaga

SEQ ID NO: 2190587 - RNA, 14 nt, Homo sapiens
ccaaauacccaaau

SEQ ID NO: 2190588 - RNA, 15 nt, Homo sapiens
uccugagagcugcuu

SEQ ID NO: 2190589 - RNA, 12 nt, Homo sapiens
cugaucauucac

SEQ ID NO: 2190590 - RNA, 16 nt, Homo sapiens
ggccaggaaguagcac

SEQ ID NO: 2190591 - RNA, 12 nt, Homo sapiens
ggcacuguguuu

SEQ ID NO: 2190592 - RNA, 15 nt, Homo sapiens
gagggaacauccugc

SEQ ID NO: 2190593 - RNA, 18 nt, Homo sapiens
ggcccucccuuuucccau

SEQ ID NO: 2190594 - RNA, 21 nt, Homo sapiens
ucuguggugagaaauuugccu

SEQ ID NO: 2190595 - RNA, 21 nt, Homo sapiens
ugacuucuugcuuguacauau

SEQ ID NO: 2190596 - RNA, 18 nt, Homo sapiens
aggagucucaacaugugu

SEQ ID NO: 2190597 - RNA, 23 nt, Homo sapiens
uauuguuccaagacauugucaau

SEQ ID NO: 2190598 - RNA, 15 nt, Homo sapiens
aaccuucacccagca

SEQ ID NO: 2190599 - RNA, 11 nt, Homo sapiens
ucccugagaaa

SEQ ID NO: 2190600 - RNA, 22 nt, Homo sapiens
uuuuuauucaugugaaguguau

SEQ ID NO: 2190601 - RNA, 23 nt, Homo sapiens
aaaacucccaauggauaaaucag

SEQ ID NO: 2190602 - RNA, 16 nt, Homo sapiens
aguuccaaaagcacag

SEQ ID NO: 2190603 - RNA, 17 nt, Homo sapiens
cacaugugcacaugcac

SEQ ID NO: 2190604 - RNA, 18 nt, Homo sapiens
ccuguagacuagugccgu

SEQ ID NO: 2190605 - RNA, 21 nt, Homo sapiens
caugaacccucuugccauccu

SEQ ID NO: 2190606 - RNA, 16 nt, Homo sapiens
ccuuuaggguucugcc

SEQ ID NO: 2190607 - RNA, 15 nt, Homo sapiens
cuguuagcugcucac

SEQ ID NO: 2190608 - RNA, 20 nt, Homo sapiens
cagcaucagagagacuguua

SEQ ID NO: 2190609 - RNA, 15 nt, Homo sapiens
aaaccggauccuguu

SEQ ID NO: 2190610 - RNA, 15 nt, Homo sapiens
ccucagugcugcaau

SEQ ID NO: 2190611 - RNA, 13 nt, Homo sapiens
aucuaucacccag

SEQ ID NO: 2190612 - RNA, 20 nt, Homo sapiens
aagugcagggauuacaggca

SEQ ID NO: 2190613 - RNA, 18 nt, Homo sapiens
uaauauucaacaauuaua

SEQ ID NO: 2190614 - RNA, 17 nt, Homo sapiens
gacacuccccacgggaa

SEQ ID NO: 2190615 - RNA, 18 nt, Homo sapiens
uugccaagcagugcacau

SEQ ID NO: 2190616 - RNA, 15 nt, Homo sapiens
uuucaugugaucuau

SEQ ID NO: 2190617 - RNA, 22 nt, Homo sapiens
aguaauagagcaaaauugaugu

SEQ ID NO: 2190618 - RNA, 13 nt, Homo sapiens
guuuucugacuaa

SEQ ID NO: 2190619 - RNA, 16 nt, Homo sapiens
ccccagggacugcaag

SEQ ID NO: 2190620 - RNA, 16 nt, Homo sapiens
gcaagcaaucaaauaa

SEQ ID NO: 2190621 - RNA, 22 nt, Homo sapiens
agccugucucuuuccacuuugu

SEQ ID NO: 2190622 - RNA, 19 nt, Homo sapiens
agcaccagggacuaugaau

SEQ ID NO: 2190623 - RNA, 22 nt, Homo sapiens
uuguguuuguagucuugucuua

SEQ ID NO: 2190624 - RNA, 19 nt, Homo sapiens
ugugagccccaggcacuuu

SEQ ID NO: 2190625 - RNA, 16 nt, Homo sapiens
auuaagguguggcuuu

SEQ ID NO: 2190626 - RNA, 18 nt, Homo sapiens
cgaggggcucucagcuca

SEQ ID NO: 2190627 - RNA, 21 nt, Homo sapiens
gaaccagcuucugauaaacac

SEQ ID NO: 2190628 - RNA, 15 nt, Homo sapiens
uucagcugguugagg

SEQ ID NO: 2190629 - RNA, 18 nt, Homo sapiens
augaccaguuuaccugaa

SEQ ID NO: 2190630 - RNA, 22 nt, Homo sapiens
cuuugaaggauuuacugcaaga

SEQ ID NO: 2190631 - RNA, 18 nt, Homo sapiens
auucuaaauaaugcaaac

SEQ ID NO: 2190632 - RNA, 20 nt, Homo sapiens
ucuuuacaauaaacauagcu

SEQ ID NO: 2190633 - RNA, 19 nt, Homo sapiens
caagguuuuggagucagua

SEQ ID NO: 2190634 - RNA, 20 nt, Homo sapiens
aucaugauccucccuaucaa

SEQ ID NO: 2190635 - RNA, 15 nt, Homo sapiens
agucauuuaucuaau

SEQ ID NO: 2190636 - RNA, 15 nt, Homo sapiens
aggugagaaaaccau

SEQ ID NO: 2190637 - RNA, 22 nt, Homo sapiens
agugagacaaaaagcacuagua

SEQ ID NO: 2190638 - RNA, 17 nt, Homo sapiens
cucacagggacucucca

SEQ ID NO: 2190639 - RNA, 22 nt, Homo sapiens
agaucaccaguguguggcuuuc

SEQ ID NO: 2190640 - RNA, 17 nt, Homo sapiens
aaggaaauaacauugca

SEQ ID NO: 2190641 - RNA, 20 nt, Homo sapiens
gauccuagugaccaaauuca

SEQ ID NO: 2190642 - RNA, 22 nt, Homo sapiens
cauuucucaaaugcacaucuca

SEQ ID NO: 2190643 - RNA, 21 nt, Homo sapiens
uccuuaaauuuuuagccauuu

SEQ ID NO: 2190644 - RNA, 19 nt, Homo sapiens
auucuagguuugcaagaaa

SEQ ID NO: 2190645 - RNA, 19 nt, Homo sapiens
ccaaugacuaacuuuuuga

SEQ ID NO: 2190646 - RNA, 20 nt, Homo sapiens
agaauuuaaaccuauacuca

SEQ ID NO: 2190647 - RNA, 19 nt, Homo sapiens
cacuguuaauauucuauua

SEQ ID NO: 2190648 - RNA, 20 nt, Homo sapiens
auuauuaaagucuaaacaaa

SEQ ID NO: 2190649 - RNA, 18 nt, Homo sapiens
uguauuuauggagugccu

SEQ ID NO: 2190650 - RNA, 21 nt, Homo sapiens
uucucacauggaaugaggguu

SEQ ID NO: 2190651 - RNA, 23 nt, Homo sapiens
caguuucuaucccuuaccugcuu

SEQ ID NO: 2190652 - RNA, 16 nt, Homo sapiens
caccccccugugccug

SEQ ID NO: 2190653 - RNA, 21 nt, Homo sapiens
cagccagcgucccuuggugag

SEQ ID NO: 2190654 - RNA, 19 nt, Homo sapiens
aagcugccugugccaugcc

SEQ ID NO: 2190655 - RNA, 22 nt, Homo sapiens
gacuuauaugagggcagauuca

SEQ ID NO: 2190656 - RNA, 23 nt, Homo sapiens
augguacuuccucugugaacugu

SEQ ID NO: 2190657 - RNA, 20 nt, Homo sapiens
cagagcuccacagaagacac

SEQ ID NO: 2190658 - RNA, 21 nt, Homo sapiens
uuaaagacaggagacaaaaga

SEQ ID NO: 2190659 - RNA, 22 nt, Homo sapiens
aacagaauugauaacugagcaa

SEQ ID NO: 2190660 - RNA, 18 nt, Homo sapiens
ugcacagauuaaacuuca

SEQ ID NO: 2190661 - RNA, 22 nt, Homo sapiens
guccucucucuuggggcgccca

SEQ ID NO: 2190662 - RNA, 18 nt, Homo sapiens
cuugauaugacuaauuca

SEQ ID NO: 2190663 - RNA, 22 nt, Homo sapiens
cucuuguaagucaucuacuuaa

SEQ ID NO: 2190664 - RNA, 22 nt, Homo sapiens
uacaguccuagagaauuccucu

SEQ ID NO: 2190665 - RNA, 21 nt, Homo sapiens
gucucaaagcauaaaauggaa

SEQ ID NO: 2190666 - RNA, 18 nt, Homo sapiens
uuugaagguagaauguuu

SEQ ID NO: 2190667 - RNA, 18 nt, Homo sapiens
aguuaugauguaaucucu

SEQ ID NO: 2190668 - RNA, 14 nt, Homo sapiens
ccagguguucuaca

SEQ ID NO: 2190669 - RNA, 20 nt, Homo sapiens
cauuguuguuuuaaccuccc

SEQ ID NO: 2190670 - RNA, 17 nt, Homo sapiens
ugaaacuccagaugcca

SEQ ID NO: 2190671 - RNA, 20 nt, Homo sapiens
guuuggaaaccacagucagu

SEQ ID NO: 2190672 - RNA, 19 nt, Homo sapiens
uucugccaaugaccaaaca

SEQ ID NO: 2190673 - RNA, 13 nt, Homo sapiens
gcccuuggcuuua

SEQ ID NO: 2190674 - RNA, 12 nt, Homo sapiens
acauagcacaga

SEQ ID NO: 2190675 - RNA, 20 nt, Homo sapiens
caugcaccucagggccaagc

SEQ ID NO: 2190676 - RNA, 14 nt, Homo sapiens
aaguuacuucacuu

SEQ ID NO: 2190677 - RNA, 19 nt, Homo sapiens
gaaugaaagaguaaaggaa

SEQ ID NO: 2190678 - RNA, 17 nt, Homo sapiens
ucaaagacuguauuuag

SEQ ID NO: 2190679 - RNA, 16 nt, Homo sapiens
cauuaugagaggcaau

SEQ ID NO: 2190680 - RNA, 21 nt, Homo sapiens
accaccaccucuaaugccucu

SEQ ID NO: 2190681 - RNA, 23 nt, Homo sapiens
ugaucucuucuuuuggcuuccau

SEQ ID NO: 2190682 - RNA, 18 nt, Homo sapiens
acccagcagccaacuggc

SEQ ID NO: 2190683 - RNA, 21 nt, Homo sapiens
cuuuuuaauuuuuugauugga

SEQ ID NO: 2190684 - RNA, 15 nt, Homo sapiens
ccgaauggggcagca

SEQ ID NO: 2190685 - RNA, 20 nt, Homo sapiens
cagagaaggcuuccuccagc

SEQ ID NO: 2190686 - RNA, 19 nt, Homo sapiens
cacgugggccucacauucc

SEQ ID NO: 2190687 - RNA, 13 nt, Homo sapiens
uagcaauuccagg

SEQ ID NO: 2190688 - RNA, 17 nt, Homo sapiens
uuccacuucuaacucca

SEQ ID NO: 2190689 - RNA, 17 nt, Homo sapiens
gcccucaaguaaaagaa

SEQ ID NO: 2190690 - RNA, 22 nt, Homo sapiens
ggagccugaaaaggcuccacau

SEQ ID NO: 2190691 - RNA, 13 nt, Homo sapiens
gaggcaucaguug

SEQ ID NO: 2190692 - RNA, 20 nt, Homo sapiens
cacauaaggacguguguaaa

SEQ ID NO: 2190693 - RNA, 12 nt, Homo sapiens
ugcaagccuguc

SEQ ID NO: 2190694 - RNA, 23 nt, Homo sapiens
acauggggcauagaaacugagga

SEQ ID NO: 2190695 - RNA, 11 nt, Homo sapiens
uauuucaugau

SEQ ID NO: 2190696 - RNA, 15 nt, Homo sapiens
ccuuccacggacuca

SEQ ID NO: 2190697 - RNA, 19 nt, Homo sapiens
gucacuuuacuguccccau

SEQ ID NO: 2190698 - RNA, 13 nt, Homo sapiens
uugucugcaaugg

SEQ ID NO: 2190699 - RNA, 16 nt, Homo sapiens
uaauugaagaacugca

SEQ ID NO: 2190700 - RNA, 12 nt, Homo sapiens
cuuuauuguaca

SEQ ID NO: 2190701 - RNA, 18 nt, Homo sapiens
uccugugacauguaacag

SEQ ID NO: 2190702 - RNA, 12 nt, Homo sapiens
caugaagugaau

SEQ ID NO: 2190703 - RNA, 12 nt, Homo sapiens
gaauaagucaug

SEQ ID NO: 2190704 - RNA, 20 nt, Homo sapiens
gcacauaucuccucuugggc

SEQ ID NO: 2190705 - RNA, 19 nt, Homo sapiens
agcuuuuauugucacagau

SEQ ID NO: 2190706 - RNA, 22 nt, Homo sapiens
acucuacaaaauauagcuuuca

SEQ ID NO: 2190707 - RNA, 18 nt, Homo sapiens
cuacucacagcugaagaa

SEQ ID NO: 2190708 - RNA, 11 nt, Homo sapiens
cugugacuccu

SEQ ID NO: 2190709 - RNA, 22 nt, Homo sapiens
cuuaaauuuuuagccauuucuc

SEQ ID NO: 2190710 - RNA, 21 nt, Homo sapiens
aagcauccuccccaccagagc

SEQ ID NO: 2190711 - RNA, 10 nt, Homo sapiens
guuaaugugc

SEQ ID NO: 2190712 - RNA, 21 nt, Homo sapiens
agguggccacagugucacugg

SEQ ID NO: 2190713 - RNA, 23 nt, Homo sapiens
ucucugccaccaucaacccccca

SEQ ID NO: 2190714 - RNA, 19 nt, Homo sapiens
ggagccugggggcuccuca

SEQ ID NO: 2190715 - RNA, 22 nt, Homo sapiens
cuggugauguugaaauaugcau

SEQ ID NO: 2190716 - RNA, 19 nt, Homo sapiens
cuccauguuuuuggggaca

SEQ ID NO: 2190717 - RNA, 18 nt, Homo sapiens
gaacgcccucaugcucag

SEQ ID NO: 2190718 - RNA, 18 nt, Homo sapiens
ugucagcagcagugacca

SEQ ID NO: 2190719 - RNA, 15 nt, Homo sapiens
acaauuugaaacaaa

SEQ ID NO: 2190720 - RNA, 15 nt, Homo sapiens
aagaugaagguuuaa

SEQ ID NO: 2190721 - RNA, 23 nt, Homo sapiens
gucucugcauccauuugaacaca

SEQ ID NO: 2190722 - RNA, 18 nt, Homo sapiens
aauuuccuccacauucau

SEQ ID NO: 2190723 - RNA, 16 nt, Homo sapiens
uguauggaaaaaccau

SEQ ID NO: 2190724 - RNA, 13 nt, Homo sapiens
cugacuucucacu

SEQ ID NO: 2190725 - RNA, 16 nt, Homo sapiens
uguucacugaagguga

SEQ ID NO: 2190726 - RNA, 15 nt, Homo sapiens
caugcuacaguuauu

SEQ ID NO: 2190727 - RNA, 13 nt, Homo sapiens
gaaucuaacuggu

SEQ ID NO: 2190728 - RNA, 16 nt, Homo sapiens
uauuaucuguugccuu

SEQ ID NO: 2190729 - RNA, 23 nt, Homo sapiens
cagcgauaagcuuucaauagugg

SEQ ID NO: 2190730 - RNA, 13 nt, Homo sapiens
aucaccaccucag

SEQ ID NO: 2190731 - RNA, 15 nt, Homo sapiens
aaugaauucaguuuc

SEQ ID NO: 2190732 - RNA, 13 nt, Homo sapiens
uguaaacugugua

SEQ ID NO: 2190733 - RNA, 21 nt, Homo sapiens
uaauggaaacauuuacaauaa

SEQ ID NO: 2190734 - RNA, 15 nt, Homo sapiens
caccuguagucccag

SEQ ID NO: 2190735 - RNA, 20 nt, Homo sapiens
ugacccucaggcacaccuug

SEQ ID NO: 2190736 - RNA, 15 nt, Homo sapiens
cagcugugagccaug

SEQ ID NO: 2190737 - RNA, 22 nt, Homo sapiens
ccaggguagagcaaaggagaca

SEQ ID NO: 2190738 - RNA, 16 nt, Homo sapiens
gugaaauuacuucugg

SEQ ID NO: 2190739 - RNA, 17 nt, Homo sapiens
uacaauaaaaagaaauu

SEQ ID NO: 2190740 - RNA, 21 nt, Homo sapiens
cacaucuuuuuccaagcagug

SEQ ID NO: 2190741 - RNA, 19 nt, Homo sapiens
cuauggauuugaaguuugc

SEQ ID NO: 2190742 - RNA, 23 nt, Homo sapiens
ggugaaacgacucaaaaugacag

SEQ ID NO: 2190743 - RNA, 14 nt, Homo sapiens
aauaaacagucacu

SEQ ID NO: 2190744 - RNA, 22 nt, Homo sapiens
agcccuaacauagugucugcug

SEQ ID NO: 2190745 - RNA, 16 nt, Homo sapiens
ggcagcaaacugcugc

SEQ ID NO: 2190746 - RNA, 17 nt, Homo sapiens
gcccuccuugacccuga

SEQ ID NO: 2190747 - RNA, 18 nt, Homo sapiens
gguaaaaguaccacacaa

SEQ ID NO: 2190748 - RNA, 19 nt, Homo sapiens
ucuacuaaaaguuuaggga

SEQ ID NO: 2190749 - RNA, 19 nt, Homo sapiens
uuucuuguaaacauugccu

SEQ ID NO: 2190750 - RNA, 14 nt, Homo sapiens
gaagaacucaccag

SEQ ID NO: 2190751 - RNA, 16 nt, Homo sapiens
ucuccguaauuagcau

SEQ ID NO: 2190752 - RNA, 17 nt, Homo sapiens
ucaagaauaaaguacua

SEQ ID NO: 2190753 - RNA, 21 nt, Homo sapiens
aagaaaugcaagggacccaga

SEQ ID NO: 2190754 - RNA, 15 nt, Homo sapiens
cugaaaacaagccau

SEQ ID NO: 2190755 - RNA, 15 nt, Homo sapiens
ccaggccgacccaag

SEQ ID NO: 2190756 - RNA, 12 nt, Homo sapiens
ccguccacccuu

SEQ ID NO: 2190757 - RNA, 16 nt, Homo sapiens
caguugcauuuagcuu

SEQ ID NO: 2190758 - RNA, 13 nt, Homo sapiens
agcagcacuggaa

SEQ ID NO: 2190759 - RNA, 19 nt, Homo sapiens
agggugaggcugacacagc

SEQ ID NO: 2190760 - RNA, 23 nt, Homo sapiens
gcaauguacucuuccgauguuug

SEQ ID NO: 2190761 - RNA, 19 nt, Homo sapiens
uccaagaggucuccaucau

SEQ ID NO: 2190762 - RNA, 16 nt, Homo sapiens
uccccuccuucccaag

SEQ ID NO: 2190763 - RNA, 19 nt, Homo sapiens
guuccaagagauccaucaa

SEQ ID NO: 2190764 - RNA, 16 nt, Homo sapiens
agugagcugugaucac

SEQ ID NO: 2190765 - RNA, 15 nt, Homo sapiens
cuguccugcccguga

SEQ ID NO: 2190766 - RNA, 12 nt, Homo sapiens
acugaaaccuag

SEQ ID NO: 2190767 - RNA, 13 nt, Homo sapiens
cuuggcacauccg

SEQ ID NO: 2190768 - RNA, 21 nt, Homo sapiens
ucugagucuggggugagauaa

SEQ ID NO: 2190769 - RNA, 23 nt, Homo sapiens
acuucuagacucaccuguucuca

SEQ ID NO: 2190770 - RNA, 15 nt, Homo sapiens
gugcuuccucaguua

SEQ ID NO: 2190771 - RNA, 21 nt, Homo sapiens
ccgguuggaggcucucauguc

SEQ ID NO: 2190772 - RNA, 20 nt, Homo sapiens
auuggauaaaauaaaugcaa

SEQ ID NO: 2190773 - RNA, 14 nt, Homo sapiens
ucugucagcugcaa

SEQ ID NO: 2190774 - RNA, 23 nt, Homo sapiens
cuucgcagaaaagagucggauua

SEQ ID NO: 2190775 - RNA, 14 nt, Homo sapiens
ugauuuaaaucagc

SEQ ID NO: 2190776 - RNA, 20 nt, Homo sapiens
augggaaccuaguacucucu

SEQ ID NO: 2190777 - RNA, 16 nt, Homo sapiens
caggugagaaaaccau

SEQ ID NO: 2190778 - RNA, 22 nt, Homo sapiens
uuuuuaucuccccuucacaugc

SEQ ID NO: 2190779 - RNA, 18 nt, Homo sapiens
aguaacucaucugucacc

SEQ ID NO: 2190780 - RNA, 19 nt, Homo sapiens
aguuugcuuuguaugcacu

SEQ ID NO: 2190781 - RNA, 13 nt, Homo sapiens
acuucugaacuug

SEQ ID NO: 2190782 - RNA, 22 nt, Homo sapiens
aaugggcuuuucaggaagugaa

SEQ ID NO: 2190783 - RNA, 17 nt, Homo sapiens
caaggcugcagugagcc

SEQ ID NO: 2190784 - RNA, 16 nt, Homo sapiens
auguagcaaucagauu

SEQ ID NO: 2190785 - RNA, 14 nt, Homo sapiens
cucagcacugggau

SEQ ID NO: 2190786 - RNA, 17 nt, Homo sapiens
gaccacauguguucucu

SEQ ID NO: 2190787 - RNA, 19 nt, Homo sapiens
ggaguccacuuuccucucu

SEQ ID NO: 2190788 - RNA, 22 nt, Homo sapiens
acuaaggaguaaucuguguaca

SEQ ID NO: 2190789 - RNA, 12 nt, Homo sapiens
uacuagacuuug

SEQ ID NO: 2190790 - RNA, 19 nt, Homo sapiens
aauacugaauuucuuugau

SEQ ID NO: 2190791 - RNA, 17 nt, Homo sapiens
guuguaagcacugacug

SEQ ID NO: 2190792 - RNA, 18 nt, Homo sapiens
uuuauuaaugaacuguga

SEQ ID NO: 2190793 - RNA, 14 nt, Homo sapiens
uaauguacaauaaa

SEQ ID NO: 2190794 - RNA, 19 nt, Homo sapiens
gcaccccacuccucaguaa

SEQ ID NO: 2190795 - RNA, 14 nt, Homo sapiens
cucugcugaucuca

SEQ ID NO: 2190796 - RNA, 14 nt, Homo sapiens
cuuucaugauuugc

SEQ ID NO: 2190797 - RNA, 18 nt, Homo sapiens
uuggcaacaggacagagu

SEQ ID NO: 2190798 - RNA, 18 nt, Homo sapiens
guuuagcuuccuccagag

SEQ ID NO: 2190799 - RNA, 16 nt, Homo sapiens
uaugauaccaaagaca

SEQ ID NO: 2190800 - RNA, 19 nt, Homo sapiens
accaaggucucacacuccu

SEQ ID NO: 2190801 - RNA, 14 nt, Homo sapiens
ugaaucauccagac

SEQ ID NO: 2190802 - RNA, 22 nt, Homo sapiens
auauaugccuggcacagcuuuu

SEQ ID NO: 2190803 - RNA, 20 nt, Homo sapiens
aaauuaaacauauucaagga

SEQ ID NO: 2190804 - RNA, 12 nt, Homo sapiens
aaaaaacccagc

SEQ ID NO: 2190805 - RNA, 17 nt, Homo sapiens
gagaagggggcagaguc

SEQ ID NO: 2190806 - RNA, 15 nt, Homo sapiens
aaguucagcaacugu

SEQ ID NO: 2190807 - RNA, 17 nt, Homo sapiens
acagccuugcaacccaa

SEQ ID NO: 2190808 - RNA, 15 nt, Homo sapiens
agggacaaacucacu

SEQ ID NO: 2190809 - RNA, 16 nt, Homo sapiens
uuuauuuccacuaaaa

SEQ ID NO: 2190810 - RNA, 18 nt, Homo sapiens
uaaauaccaguacuugag

SEQ ID NO: 2190811 - RNA, 23 nt, Homo sapiens
agucauggauuucucugcucaca

SEQ ID NO: 2190812 - RNA, 17 nt, Homo sapiens
gcagcccagccuaguca

SEQ ID NO: 2190813 - RNA, 23 nt, Homo sapiens
aucuuggccaggcuggucuugaa

SEQ ID NO: 2190814 - RNA, 17 nt, Homo sapiens
ucaaagugucucauucu

SEQ ID NO: 2190815 - RNA, 21 nt, Homo sapiens
gaggcugacggcgcaagacca

SEQ ID NO: 2190816 - RNA, 17 nt, Homo sapiens
ggccuaacacugggcug

SEQ ID NO: 2190817 - RNA, 17 nt, Homo sapiens
ucacaggugucagccau

SEQ ID NO: 2190818 - RNA, 18 nt, Homo sapiens
gcagccuuucacaggacu

SEQ ID NO: 2190819 - RNA, 16 nt, Homo sapiens
uggaggcagcagcucc

SEQ ID NO: 2190820 - RNA, 16 nt, Homo sapiens
uacauuaucucacuua

SEQ ID NO: 2190821 - RNA, 15 nt, Homo sapiens
ccagagaaaagaguc

SEQ ID NO: 2190822 - RNA, 18 nt, Homo sapiens
gucuacuugaguuagcau

SEQ ID NO: 2190823 - RNA, 22 nt, Homo sapiens
aaagaacuguauuuagugauua

SEQ ID NO: 2190824 - RNA, 22 nt, Homo sapiens
aagaacauuauucaucucuccu

SEQ ID NO: 2190825 - RNA, 14 nt, Homo sapiens
auuugcugaccaca

SEQ ID NO: 2190826 - RNA, 14 nt, Homo sapiens
gccuuaccuugaaa

SEQ ID NO: 2190827 - RNA, 20 nt, Homo sapiens
uguagucguacuuaccaagc

SEQ ID NO: 2190828 - RNA, 19 nt, Homo sapiens
auaaucauuucuacuucaa

SEQ ID NO: 2190829 - RNA, 14 nt, Homo sapiens
gaaauucugaugag

SEQ ID NO: 2190830 - RNA, 21 nt, Homo sapiens
acaguaaaagcaggagcgaga

SEQ ID NO: 2190831 - RNA, 15 nt, Homo sapiens
agcacccaagccagg

SEQ ID NO: 2190832 - RNA, 17 nt, Homo sapiens
gcuucucuacagacucc

SEQ ID NO: 2190833 - RNA, 20 nt, Homo sapiens
ccugugagccccaggcacuu

SEQ ID NO: 2190834 - RNA, 17 nt, Homo sapiens
aggggucucauguccug

SEQ ID NO: 2190835 - RNA, 23 nt, Homo sapiens
aggacucucuuaguucuuaccuu

SEQ ID NO: 2190836 - RNA, 13 nt, Homo sapiens
uuagaaugugauu

SEQ ID NO: 2190837 - RNA, 17 nt, Homo sapiens
ggagggcaguggcacga

SEQ ID NO: 2190838 - RNA, 14 nt, Homo sapiens
caauguguucuuaa

SEQ ID NO: 2190839 - RNA, 16 nt, Homo sapiens
ugcaacuucaugucaa

SEQ ID NO: 2190840 - RNA, 15 nt, Homo sapiens
gucuauaugucuagc

SEQ ID NO: 2190841 - RNA, 13 nt, Homo sapiens
ccuucaaugcugc

SEQ ID NO: 2190842 - RNA, 20 nt, Homo sapiens
cgcccaggcuggagugcaau

SEQ ID NO: 2190843 - RNA, 17 nt, Homo sapiens
uucuccaccugccaggg

SEQ ID NO: 2190844 - RNA, 20 nt, Homo sapiens
agcagcccuggaugguggcc

SEQ ID NO: 2190845 - RNA, 20 nt, Homo sapiens
uuccaugccgcagacaugaa

SEQ ID NO: 2190846 - RNA, 21 nt, Homo sapiens
agugcaguggcgugaucucag

SEQ ID NO: 2190847 - RNA, 16 nt, Homo sapiens
caggaaggucuucaau

SEQ ID NO: 2190848 - RNA, 19 nt, Homo sapiens
uauuuggaaaccuuuucac

SEQ ID NO: 2190849 - RNA, 21 nt, Homo sapiens
aagacauaaacccaguugcca

SEQ ID NO: 2190850 - RNA, 14 nt, Homo sapiens
gccccacaacuuua

SEQ ID NO: 2190851 - RNA, 16 nt, Homo sapiens
caucuacuacagggug

SEQ ID NO: 2190852 - RNA, 20 nt, Homo sapiens
ggcucgccaggccaaaucac

SEQ ID NO: 2190853 - RNA, 15 nt, Homo sapiens
agcucugguauauaa

SEQ ID NO: 2190854 - RNA, 20 nt, Homo sapiens
uagccuauuaaacuauuuua

SEQ ID NO: 2190855 - RNA, 22 nt, Homo sapiens
aguucaugggcaccucauggac

SEQ ID NO: 2190856 - RNA, 19 nt, Homo sapiens
uccccucuggaaugcacug

SEQ ID NO: 2190857 - RNA, 18 nt, Homo sapiens
gagaagcuccucucccca

SEQ ID NO: 2190858 - RNA, 18 nt, Homo sapiens
uccuucuggcuguagaua

SEQ ID NO: 2190859 - RNA, 18 nt, Homo sapiens
aaggaauauccagucaaa

SEQ ID NO: 2190860 - RNA, 15 nt, Homo sapiens
caaagagauggugcu

SEQ ID NO: 2190861 - RNA, 19 nt, Homo sapiens
aacaaugauuaaauugaau

SEQ ID NO: 2190862 - RNA, 23 nt, Homo sapiens
cuuuguuaggucauuuucaguga

SEQ ID NO: 2190863 - RNA, 16 nt, Homo sapiens
ucuggcuuagugccac

SEQ ID NO: 2190864 - RNA, 23 nt, Homo sapiens
agccagaaucuucguccugcccc

SEQ ID NO: 2190865 - RNA, 16 nt, Homo sapiens
augggaagggcuccca

SEQ ID NO: 2190866 - RNA, 16 nt, Homo sapiens
cauaaacuucagggau

SEQ ID NO: 2190867 - RNA, 23 nt, Homo sapiens
acagcgguuguaaauacaauuca

SEQ ID NO: 2190868 - RNA, 10 nt, Homo sapiens
cgcucuggac

SEQ ID NO: 2190869 - RNA, 15 nt, Homo sapiens
agauaaauauuuugc

SEQ ID NO: 2190870 - RNA, 11 nt, Homo sapiens
ggaggacaaaa

SEQ ID NO: 2190871 - RNA, 20 nt, Homo sapiens
aagacaaaugggccugccaa

SEQ ID NO: 2190872 - RNA, 19 nt, Homo sapiens
acuuaccugacagcucuua

SEQ ID NO: 2190873 - RNA, 22 nt, Homo sapiens
aaugauaauucagucuugccuu

SEQ ID NO: 2190874 - RNA, 17 nt, Homo sapiens
aauuauuucacaaauaa

SEQ ID NO: 2190875 - RNA, 13 nt, Homo sapiens
aaagcuguuuuau

SEQ ID NO: 2190876 - RNA, 17 nt, Homo sapiens
uugcccagagaugccuc

SEQ ID NO: 2190877 - RNA, 17 nt, Homo sapiens
gauuuaaaaacuggaac

SEQ ID NO: 2190878 - RNA, 13 nt, Homo sapiens
ccaucuccaggga

SEQ ID NO: 2190879 - RNA, 22 nt, Homo sapiens
agccccuggucccucugcaguc

SEQ ID NO: 2190880 - RNA, 15 nt, Homo sapiens
ggaugcacagcucaa

SEQ ID NO: 2190881 - RNA, 13 nt, Homo sapiens
ucagggucccugg

SEQ ID NO: 2190882 - RNA, 20 nt, Homo sapiens
gucagcggggcuacaguccu

SEQ ID NO: 2190883 - RNA, 12 nt, Homo sapiens
guugcaggugac

SEQ ID NO: 2190884 - RNA, 17 nt, Homo sapiens
uuaauuacaacugcuau

SEQ ID NO: 2190885 - RNA, 21 nt, Homo sapiens
uaacacauuuuuuaacuaaua

SEQ ID NO: 2190886 - RNA, 18 nt, Homo sapiens
ucucaguauccacugucu

SEQ ID NO: 2190887 - RNA, 14 nt, Homo sapiens
aaugaagugcaaua

SEQ ID NO: 2190888 - RNA, 18 nt, Homo sapiens
gagauucuugugccucag

SEQ ID NO: 2190889 - RNA, 18 nt, Homo sapiens
ugaguuaccucaugccgc

SEQ ID NO: 2190890 - RNA, 16 nt, Homo sapiens
cagugacaaauuguaa

SEQ ID NO: 2190891 - RNA, 17 nt, Homo sapiens
auaagugguguguguau

SEQ ID NO: 2190892 - RNA, 14 nt, Homo sapiens
acauuaaagcaauc

SEQ ID NO: 2190893 - RNA, 14 nt, Homo sapiens
auuauaaaguuuuc

SEQ ID NO: 2190894 - RNA, 21 nt, Homo sapiens
uucuauuuauauguacaugag

SEQ ID NO: 2190895 - RNA, 22 nt, Homo sapiens
gagguggaaguggagcccagug

SEQ ID NO: 2190896 - RNA, 22 nt, Homo sapiens
ggcacucccuccagcacaaaca

SEQ ID NO: 2190897 - RNA, 15 nt, Homo sapiens
cuugaguauaagaua

SEQ ID NO: 2190898 - RNA, 13 nt, Homo sapiens
agcaaacugcugc

SEQ ID NO: 2190899 - RNA, 16 nt, Homo sapiens
ccuuauucuacauuuc

SEQ ID NO: 2190900 - RNA, 14 nt, Homo sapiens
agauuauaugaagu

SEQ ID NO: 2190901 - RNA, 21 nt, Homo sapiens
ucucuaacguccacuagcuua

SEQ ID NO: 2190902 - RNA, 19 nt, Homo sapiens
uuuacauuuauuccuucca

SEQ ID NO: 2190903 - RNA, 15 nt, Homo sapiens
uuugcucuugccaaa

SEQ ID NO: 2190904 - RNA, 20 nt, Homo sapiens
agaauuuaaaauaacacuug

SEQ ID NO: 2190905 - RNA, 21 nt, Homo sapiens
ccuucuauuuggggcuugaug

SEQ ID NO: 2190906 - RNA, 16 nt, Homo sapiens
cuuuguauaugcauuc

SEQ ID NO: 2190907 - RNA, 22 nt, Homo sapiens
gcccugagaauagcauggggcu

SEQ ID NO: 2190908 - RNA, 20 nt, Homo sapiens
uguuccucaagguccauuau

SEQ ID NO: 2190909 - RNA, 22 nt, Homo sapiens
agaccaaggaacaaaaaaacca

SEQ ID NO: 2190910 - RNA, 12 nt, Homo sapiens
ugcugacguguu

SEQ ID NO: 2190911 - RNA, 20 nt, Homo sapiens
caugcccucggucacugagu

SEQ ID NO: 2190912 - RNA, 15 nt, Homo sapiens
auggaauuacaugua

SEQ ID NO: 2190913 - RNA, 20 nt, Homo sapiens
aguacucacuaaaaguucuc

SEQ ID NO: 2190914 - RNA, 21 nt, Homo sapiens
uacagcucuuggcauuuuccu

SEQ ID NO: 2190915 - RNA, 21 nt, Homo sapiens
cagacaaaguaauuccucuca

SEQ ID NO: 2190916 - RNA, 20 nt, Homo sapiens
agcuuuaggcagagccauaa

SEQ ID NO: 2190917 - RNA, 15 nt, Homo sapiens
cauaucagaacugug

SEQ ID NO: 2190918 - RNA, 16 nt, Homo sapiens
gaggugacacuguugg

SEQ ID NO: 2190919 - RNA, 12 nt, Homo sapiens
caucucaugccc

SEQ ID NO: 2190920 - RNA, 15 nt, Homo sapiens
uacaagacugcugag

SEQ ID NO: 2190921 - RNA, 19 nt, Homo sapiens
acucugguuguuuaugcaa

SEQ ID NO: 2190922 - RNA, 16 nt, Homo sapiens
gucuccucucuuggca

SEQ ID NO: 2190923 - RNA, 20 nt, Homo sapiens
auaugaaauuuuuaaaggag

SEQ ID NO: 2190924 - RNA, 12 nt, Homo sapiens
gcauuuugcaaa

SEQ ID NO: 2190925 - RNA, 18 nt, Homo sapiens
aguccgacaaagcuacuu

SEQ ID NO: 2190926 - RNA, 15 nt, Homo sapiens
ugccuuuauuugcug

SEQ ID NO: 2190927 - RNA, 20 nt, Homo sapiens
cugcaaaaugucuuaaugca

SEQ ID NO: 2190928 - RNA, 22 nt, Homo sapiens
ugcacaaaagcagauacuugag

SEQ ID NO: 2190929 - RNA, 14 nt, Homo sapiens
uauugagauuuacc

SEQ ID NO: 2190930 - RNA, 18 nt, Homo sapiens
cgccuuuuguauacaucc

SEQ ID NO: 2190931 - RNA, 21 nt, Homo sapiens
uauauacccccccaugcaguc

SEQ ID NO: 2190932 - RNA, 18 nt, Homo sapiens
agcccaagugccauccca

SEQ ID NO: 2190933 - RNA, 15 nt, Homo sapiens
cugaacuacacugca

SEQ ID NO: 2190934 - RNA, 16 nt, Homo sapiens
auaaguguguuugcaa

SEQ ID NO: 2190935 - RNA, 22 nt, Homo sapiens
auggcaccacugcacuccagcc

SEQ ID NO: 2190936 - RNA, 19 nt, Homo sapiens
uccuaaugguuugggagca

SEQ ID NO: 2190937 - RNA, 16 nt, Homo sapiens
gaaacaucugauuuga

SEQ ID NO: 2190938 - RNA, 20 nt, Homo sapiens
gagucauucaggugaccucc

SEQ ID NO: 2190939 - RNA, 21 nt, Homo sapiens
ccucagaaagggauugcuuug

SEQ ID NO: 2190940 - RNA, 18 nt, Homo sapiens
acaaacggagccccugaa

SEQ ID NO: 2190941 - RNA, 19 nt, Homo sapiens
cuauaaagcuuuuguucac

SEQ ID NO: 2190942 - RNA, 13 nt, Homo sapiens
uccuuucuugcag

SEQ ID NO: 2190943 - RNA, 13 nt, Homo sapiens
auagcccagacac

SEQ ID NO: 2190944 - RNA, 19 nt, Homo sapiens
uuccucuaacucacugccu

SEQ ID NO: 2190945 - RNA, 14 nt, Homo sapiens
auugagaacugaca

SEQ ID NO: 2190946 - RNA, 20 nt, Homo sapiens
ugucugagauacgucuguga

SEQ ID NO: 2190947 - RNA, 13 nt, Homo sapiens
gacagccuugcaa

SEQ ID NO: 2190948 - RNA, 21 nt, Homo sapiens
guuccaccuccccucagacua

SEQ ID NO: 2190949 - RNA, 19 nt, Homo sapiens
aacuugauuaacuccuccu

SEQ ID NO: 2190950 - RNA, 18 nt, Homo sapiens
auucccugucacuacaca

SEQ ID NO: 2190951 - RNA, 14 nt, Homo sapiens
acaggaauuuucau

SEQ ID NO: 2190952 - RNA, 16 nt, Homo sapiens
uugcagggcgugagac

SEQ ID NO: 2190953 - RNA, 20 nt, Homo sapiens
aacuuccaacaagccucaaa

SEQ ID NO: 2190954 - RNA, 16 nt, Homo sapiens
cuugauuuuuauaugu

SEQ ID NO: 2190955 - RNA, 20 nt, Homo sapiens
aaauacuuagagcagugaag

SEQ ID NO: 2190956 - RNA, 16 nt, Homo sapiens
aucuguccauccuccu

SEQ ID NO: 2190957 - RNA, 18 nt, Homo sapiens
gcaaaaaguagacuuggu

SEQ ID NO: 2190958 - RNA, 21 nt, Homo sapiens
gcuacaaaaguuaaugaauau

SEQ ID NO: 2190959 - RNA, 18 nt, Homo sapiens
accccucacugugacuga

SEQ ID NO: 2190960 - RNA, 17 nt, Homo sapiens
cuuccuuaccugaaagg

SEQ ID NO: 2190961 - RNA, 12 nt, Homo sapiens
caaggugaucaa

SEQ ID NO: 2190962 - RNA, 14 nt, Homo sapiens
uuuccccucagagc

SEQ ID NO: 2190963 - RNA, 13 nt, Homo sapiens
ucugcaaacauua

SEQ ID NO: 2190964 - RNA, 20 nt, Homo sapiens
cagcugagcagauguaauag

SEQ ID NO: 2190965 - RNA, 19 nt, Homo sapiens
acggaguuuugcucuugua

SEQ ID NO: 2190966 - RNA, 21 nt, Homo sapiens
cacaucucucuggaguuuucu

SEQ ID NO: 2190967 - RNA, 23 nt, Homo sapiens
aggcugguaagggaccuucaggg

SEQ ID NO: 2190968 - RNA, 16 nt, Homo sapiens
ugugcaagggcaguga

SEQ ID NO: 2190969 - RNA, 22 nt, Homo sapiens
accccagugguauccugugaca

SEQ ID NO: 2190970 - RNA, 15 nt, Homo sapiens
aauacuuugaguaaa

SEQ ID NO: 2190971 - RNA, 20 nt, Homo sapiens
auauuuuucaucaaacauug

SEQ ID NO: 2190972 - RNA, 21 nt, Homo sapiens
cacuaaaaaguggauuacaaa

SEQ ID NO: 2190973 - RNA, 15 nt, Homo sapiens
uaggccuguguguau

SEQ ID NO: 2190974 - RNA, 17 nt, Homo sapiens
aauucccccaagcagaa

SEQ ID NO: 2190975 - RNA, 19 nt, Homo sapiens
augaggacgugucuguuau

SEQ ID NO: 2190976 - RNA, 22 nt, Homo sapiens
aauggaaaguuaccuuacugaa

SEQ ID NO: 2190977 - RNA, 21 nt, Homo sapiens
gcacaagauaaauugagcuag

SEQ ID NO: 2190978 - RNA, 20 nt, Homo sapiens
uugggauugagucugugcca

SEQ ID NO: 2190979 - RNA, 22 nt, Homo sapiens
gcaugacggcucaugccuguaa

SEQ ID NO: 2190980 - RNA, 14 nt, Homo sapiens
ucaaaauuguuaca

SEQ ID NO: 2190981 - RNA, 23 nt, Homo sapiens
acaggaagguagaaauaucugaa

SEQ ID NO: 2190982 - RNA, 22 nt, Homo sapiens
uggacacggaucugcugggcuc

SEQ ID NO: 2190983 - RNA, 15 nt, Homo sapiens
gaaacaaacaucuaa

SEQ ID NO: 2190984 - RNA, 14 nt, Homo sapiens
uuccguucaucuga

SEQ ID NO: 2190985 - RNA, 13 nt, Homo sapiens
auucucuuugaua

SEQ ID NO: 2190986 - RNA, 22 nt, Homo sapiens
aaagggucucccucuguugcca

SEQ ID NO: 2190987 - RNA, 17 nt, Homo sapiens
ccuugcuggaugcugcu

SEQ ID NO: 2190988 - RNA, 23 nt, Homo sapiens
aauuauccacaugaaaauaaaga

SEQ ID NO: 2190989 - RNA, 12 nt, Homo sapiens
cucaaacacauc

SEQ ID NO: 2190990 - RNA, 20 nt, Homo sapiens
ucuccccaugcugggcucac

SEQ ID NO: 2190991 - RNA, 18 nt, Homo sapiens
uuaauuauuguacauuua

SEQ ID NO: 2190992 - RNA, 18 nt, Homo sapiens
uuacugaauuugcuaaua

SEQ ID NO: 2190993 - RNA, 22 nt, Homo sapiens
augcugucauuaguauuucaca

SEQ ID NO: 2190994 - RNA, 14 nt, Homo sapiens
gaagguacacccca

SEQ ID NO: 2190995 - RNA, 13 nt, Homo sapiens
acaggucuaagag

SEQ ID NO: 2190996 - RNA, 21 nt, Homo sapiens
ccagcuacucaagaggcugag

SEQ ID NO: 2190997 - RNA, 17 nt, Homo sapiens
acccuucuuuugaagga

SEQ ID NO: 2190998 - RNA, 14 nt, Homo sapiens
ucccccauagccac

SEQ ID NO: 2190999 - RNA, 11 nt, Homo sapiens
ucacaccagcc

SEQ ID NO: 2191000 - RNA, 14 nt, Homo sapiens
cuccccuccaaaga

SEQ ID NO: 2191001 - RNA, 12 nt, Homo sapiens
ucccuuugcaug

SEQ ID NO: 2191002 - RNA, 16 nt, Homo sapiens
ugaagugcauccaaag

SEQ ID NO: 2191003 - RNA, 21 nt, Homo sapiens
gauuuccuuuauacugugaag

SEQ ID NO: 2191004 - RNA, 15 nt, Homo sapiens
aaagauaccauucuu

SEQ ID NO: 2191005 - RNA, 20 nt, Homo sapiens
cacuauaauguaagcucuac

SEQ ID NO: 2191006 - RNA, 14 nt, Homo sapiens
uucaauggaauaca

SEQ ID NO: 2191007 - RNA, 16 nt, Homo sapiens
gauacuuguaacuuuu

SEQ ID NO: 2191008 - RNA, 15 nt, Homo sapiens
gcuccuugucaauac

SEQ ID NO: 2191009 - RNA, 20 nt, Homo sapiens
gauggaauaaagcccuugaa

SEQ ID NO: 2191010 - RNA, 16 nt, Homo sapiens
uccacccccaccucaa

SEQ ID NO: 2191011 - RNA, 14 nt, Homo sapiens
acagucucuugucc

SEQ ID NO: 2191012 - RNA, 19 nt, Homo sapiens
auauuuucaaagagacuau

SEQ ID NO: 2191013 - RNA, 17 nt, Homo sapiens
ugagaaauggccaaaua

SEQ ID NO: 2191014 - RNA, 15 nt, Homo sapiens
uccucugaaacagcu

SEQ ID NO: 2191015 - RNA, 17 nt, Homo sapiens
ugcuuuaauaaaucacu

SEQ ID NO: 2191016 - RNA, 13 nt, Homo sapiens
uggacacugagag

SEQ ID NO: 2191017 - RNA, 18 nt, Homo sapiens
cauaugcaaaauacugua

SEQ ID NO: 2191018 - RNA, 13 nt, Homo sapiens
uggagcagcagcc

SEQ ID NO: 2191019 - RNA, 14 nt, Homo sapiens
acuuaaaacuguaa

SEQ ID NO: 2191020 - RNA, 16 nt, Homo sapiens
uucuaaaggugcuauu

SEQ ID NO: 2191021 - RNA, 22 nt, Homo sapiens
acugucuguguccuuccuugaa

SEQ ID NO: 2191022 - RNA, 19 nt, Homo sapiens
cugcacgcucaaugcccag

SEQ ID NO: 2191023 - RNA, 12 nt, Homo sapiens
ugugacuacuga

SEQ ID NO: 2191024 - RNA, 21 nt, Homo sapiens
ucauuccagaauucauucccc

SEQ ID NO: 2191025 - RNA, 16 nt, Homo sapiens
aaucagcauuuagucu

SEQ ID NO: 2191026 - RNA, 14 nt, Homo sapiens
ccagcugcucugcc

SEQ ID NO: 2191027 - RNA, 20 nt, Homo sapiens
aaggcguggagcugccugau

SEQ ID NO: 2191028 - RNA, 18 nt, Homo sapiens
auucuaccugaggccagg

SEQ ID NO: 2191029 - RNA, 22 nt, Homo sapiens
cauuaaagaugaccuacagugc

SEQ ID NO: 2191030 - RNA, 12 nt, Homo sapiens
cccuguucuucg

SEQ ID NO: 2191031 - RNA, 17 nt, Homo sapiens
aagacucuugaagacaa

SEQ ID NO: 2191032 - RNA, 19 nt, Homo sapiens
aaucagccauaagaaagca

SEQ ID NO: 2191033 - RNA, 14 nt, Homo sapiens
gcaggagaaucacu

SEQ ID NO: 2191034 - RNA, 18 nt, Homo sapiens
cacaguaaagaaauucuu

SEQ ID NO: 2191035 - RNA, 20 nt, Homo sapiens
gacuacaguagcucacguua

SEQ ID NO: 2191036 - RNA, 16 nt, Homo sapiens
aaucccagcuaccuca

SEQ ID NO: 2191037 - RNA, 16 nt, Homo sapiens
gugaggggcugugaca

SEQ ID NO: 2191038 - RNA, 15 nt, Homo sapiens
caaacaaaaacuguu

SEQ ID NO: 2191039 - RNA, 12 nt, Homo sapiens
gcaguguggaaa

SEQ ID NO: 2191040 - RNA, 21 nt, Homo sapiens
guccccagcccuucacauuuu

SEQ ID NO: 2191041 - RNA, 18 nt, Homo sapiens
gucauuggaaacacugcc

SEQ ID NO: 2191042 - RNA, 21 nt, Homo sapiens
uuuucacucccauaccuuuaa

SEQ ID NO: 2191043 - RNA, 20 nt, Homo sapiens
cucccacacugaaaccaaaa

SEQ ID NO: 2191044 - RNA, 17 nt, Homo sapiens
uucucucucccuuuuca

SEQ ID NO: 2191045 - RNA, 17 nt, Homo sapiens
gcucuaugccugcacug

SEQ ID NO: 2191046 - RNA, 21 nt, Homo sapiens
uggagaaggaaggcuccaucu

SEQ ID NO: 2191047 - RNA, 18 nt, Homo sapiens
acaccacagguucucacu

SEQ ID NO: 2191048 - RNA, 16 nt, Homo sapiens
acccgauuuauuucuc

SEQ ID NO: 2191049 - RNA, 23 nt, Homo sapiens
aucagcaacaaccagcaucccuu

SEQ ID NO: 2191050 - RNA, 20 nt, Homo sapiens
aaugugacauuauaugcacu

SEQ ID NO: 2191051 - RNA, 16 nt, Homo sapiens
uucuuugcugcaguca

SEQ ID NO: 2191052 - RNA, 23 nt, Homo sapiens
agaaggaaaaaauaaaagaucuu

SEQ ID NO: 2191053 - RNA, 19 nt, Homo sapiens
cagucucccagauguugca

SEQ ID NO: 2191054 - RNA, 18 nt, Homo sapiens
uaggaaaaaaauaguaaa

SEQ ID NO: 2191055 - RNA, 17 nt, Homo sapiens
uaauucaucaaguaauc

SEQ ID NO: 2191056 - RNA, 14 nt, Homo sapiens
uagaacuacuuuga

SEQ ID NO: 2191057 - RNA, 19 nt, Homo sapiens
ugcguuccucauccaugca

SEQ ID NO: 2191058 - RNA, 19 nt, Homo sapiens
uaccugccccacuuguccu

SEQ ID NO: 2191059 - RNA, 14 nt, Homo sapiens
ucucccaguccaag

SEQ ID NO: 2191060 - RNA, 17 nt, Homo sapiens
gaaauacauggacaaua

SEQ ID NO: 2191061 - RNA, 19 nt, Homo sapiens
auuaaacuugucagaauuu

SEQ ID NO: 2191062 - RNA, 22 nt, Homo sapiens
ucauucuuuuauacucagcuuu

SEQ ID NO: 2191063 - RNA, 16 nt, Homo sapiens
aagucuguuuacugca

SEQ ID NO: 2191064 - RNA, 20 nt, Homo sapiens
auucacguuuuucuggacca

SEQ ID NO: 2191065 - RNA, 13 nt, Homo sapiens
ugcaguacuugau

SEQ ID NO: 2191066 - RNA, 14 nt, Homo sapiens
auguuccaguggau

SEQ ID NO: 2191067 - RNA, 14 nt, Homo sapiens
ccagggcugucauc

SEQ ID NO: 2191068 - RNA, 15 nt, Homo sapiens
aucaguguaugcgaa

SEQ ID NO: 2191069 - RNA, 20 nt, Homo sapiens
ugcauauauacuacaugaga

SEQ ID NO: 2191070 - RNA, 18 nt, Homo sapiens
cauggaagguuagguuug

SEQ ID NO: 2191071 - RNA, 18 nt, Homo sapiens
aucugcauuuaccacugu

SEQ ID NO: 2191072 - RNA, 22 nt, Homo sapiens
aaugugguuauuuuacauuaag

SEQ ID NO: 2191073 - RNA, 20 nt, Homo sapiens
aaucaaucuuugugccucaa

SEQ ID NO: 2191074 - RNA, 15 nt, Homo sapiens
cucuagaagugccau

SEQ ID NO: 2191075 - RNA, 18 nt, Homo sapiens
gagcuucaguauaaaaga

SEQ ID NO: 2191076 - RNA, 24 nt, Homo sapiens
acccucacaggagcaucuccucaa

SEQ ID NO: 2191077 - RNA, 18 nt, Homo sapiens
cugccuucacccugaaca

SEQ ID NO: 2191078 - RNA, 18 nt, Homo sapiens
ugauggaagugggccagu

SEQ ID NO: 2191079 - RNA, 18 nt, Homo sapiens
agaccagccugggcaaca

SEQ ID NO: 2191080 - RNA, 19 nt, Homo sapiens
ugcuaccaaucugugagaa

SEQ ID NO: 2191081 - RNA, 14 nt, Homo sapiens
augaggguggcaug

SEQ ID NO: 2191082 - RNA, 16 nt, Homo sapiens
aaaaauuuaacuccau

SEQ ID NO: 2191083 - RNA, 15 nt, Homo sapiens
cgguuuggaguaauc

SEQ ID NO: 2191084 - RNA, 14 nt, Homo sapiens
uugcagacaggcaa

SEQ ID NO: 2191085 - RNA, 14 nt, Homo sapiens
aaacagacaagcaa

SEQ ID NO: 2191086 - RNA, 14 nt, Homo sapiens
agggaagccgugaa

SEQ ID NO: 2191087 - RNA, 18 nt, Homo sapiens
auacuuuaauguuuuaac

SEQ ID NO: 2191088 - RNA, 14 nt, Homo sapiens
gcuuaauguuuauu

SEQ ID NO: 2191089 - RNA, 18 nt, Homo sapiens
ccucaucucucugcccaa

SEQ ID NO: 2191090 - RNA, 15 nt, Homo sapiens
gcuuaaaauguaauu

SEQ ID NO: 2191091 - RNA, 20 nt, Homo sapiens
uuuccuuugcauucaucucu

SEQ ID NO: 2191092 - RNA, 19 nt, Homo sapiens
ugucucgaugccauaauca

SEQ ID NO: 2191093 - RNA, 19 nt, Homo sapiens
ggccacgacaaagcagaaa

SEQ ID NO: 2191094 - RNA, 20 nt, Homo sapiens
aggaggugaccaaaucagug

SEQ ID NO: 2191095 - RNA, 16 nt, Homo sapiens
ugcauggaguguuuga

SEQ ID NO: 2191096 - RNA, 17 nt, Homo sapiens
auuuccaaaccaucagc

SEQ ID NO: 2191097 - RNA, 15 nt, Homo sapiens
caggcgggacagugc

SEQ ID NO: 2191098 - RNA, 21 nt, Homo sapiens
uaucaguugauuuuucuuauu

SEQ ID NO: 2191099 - RNA, 15 nt, Homo sapiens
aggcuggaaaguaag

SEQ ID NO: 2191100 - RNA, 22 nt, Homo sapiens
cccagcauggaaucugaugaaa

SEQ ID NO: 2191101 - RNA, 18 nt, Homo sapiens
uuauuucuaacacuagcu

SEQ ID NO: 2191102 - RNA, 14 nt, Homo sapiens
cagucaucuacuuu

SEQ ID NO: 2191103 - RNA, 20 nt, Homo sapiens
caaggggaugcucugugcag

SEQ ID NO: 2191104 - RNA, 17 nt, Homo sapiens
gacacacgugagccaca

SEQ ID NO: 2191105 - RNA, 19 nt, Homo sapiens
aguucaugcagcuguggca

SEQ ID NO: 2191106 - RNA, 16 nt, Homo sapiens
caacaucaauccuuua

SEQ ID NO: 2191107 - RNA, 19 nt, Homo sapiens
gaacccacccucuccacac

SEQ ID NO: 2191108 - RNA, 20 nt, Homo sapiens
agguggaaaagcaacauuca

SEQ ID NO: 2191109 - RNA, 14 nt, Homo sapiens
cuggggcucaagca

SEQ ID NO: 2191110 - RNA, 21 nt, Homo sapiens
caaacacauuaagccuuccac

SEQ ID NO: 2191111 - RNA, 17 nt, Homo sapiens
ggaaaaacaacaucauu

SEQ ID NO: 2191112 - RNA, 16 nt, Homo sapiens
uuuguuuccagcauga

SEQ ID NO: 2191113 - RNA, 14 nt, Homo sapiens
gggacaaagcaaaa

SEQ ID NO: 2191114 - RNA, 14 nt, Homo sapiens
ugcuuucucucuca

SEQ ID NO: 2191115 - RNA, 14 nt, Homo sapiens
gcauauccuuuuag

SEQ ID NO: 2191116 - RNA, 21 nt, Homo sapiens
aacugcuuuguuuuggcugcu

SEQ ID NO: 2191117 - RNA, 23 nt, Homo sapiens
ugauucacugccuuccucucucu

SEQ ID NO: 2191118 - RNA, 15 nt, Homo sapiens
cuucuauuucuugga

SEQ ID NO: 2191119 - RNA, 22 nt, Homo sapiens
ccagaucacugccacacucucc

SEQ ID NO: 2191120 - RNA, 20 nt, Homo sapiens
cucucuuacugcuucaugua

SEQ ID NO: 2191121 - RNA, 22 nt, Homo sapiens
ccuuucguugauggccaaagca

SEQ ID NO: 2191122 - RNA, 23 nt, Homo sapiens
uacccuccauguaccuuguguac

SEQ ID NO: 2191123 - RNA, 22 nt, Homo sapiens
gauucuguuuucugguguuaua

SEQ ID NO: 2191124 - RNA, 17 nt, Homo sapiens
gguuuuuuaauugagau

SEQ ID NO: 2191125 - RNA, 20 nt, Homo sapiens
cagagccccuuaaagcugcu

SEQ ID NO: 2191126 - RNA, 13 nt, Homo sapiens
aaaugaugugaaa

SEQ ID NO: 2191127 - RNA, 13 nt, Homo sapiens
uguuaaugaauag

SEQ ID NO: 2191128 - RNA, 17 nt, Homo sapiens
cagcaggaacugagcca

SEQ ID NO: 2191129 - RNA, 19 nt, Homo sapiens
guccuuagaauacuguauu

SEQ ID NO: 2191130 - RNA, 19 nt, Homo sapiens
uauggagaaacaaaauccu

SEQ ID NO: 2191131 - RNA, 20 nt, Homo sapiens
caucauuccccgacacugcc

SEQ ID NO: 2191132 - RNA, 19 nt, Homo sapiens
uggauauuagucauagaag

SEQ ID NO: 2191133 - RNA, 16 nt, Homo sapiens
uacagcccucagcaau

SEQ ID NO: 2191134 - RNA, 16 nt, Homo sapiens
ucccaaauugaaucac

SEQ ID NO: 2191135 - RNA, 15 nt, Homo sapiens
augaaacaaacuacu

SEQ ID NO: 2191136 - RNA, 15 nt, Homo sapiens
uauugacuucaauga

SEQ ID NO: 2191137 - RNA, 21 nt, Homo sapiens
ccuguuucaccaguguuuuac

SEQ ID NO: 2191138 - RNA, 15 nt, Homo sapiens
cucccauaccuuuaa

SEQ ID NO: 2191139 - RNA, 22 nt, Homo sapiens
gaugcuaugauguuaguuuucc

SEQ ID NO: 2191140 - RNA, 22 nt, Homo sapiens
uaacucaucuuuagagcaacag

SEQ ID NO: 2191141 - RNA, 15 nt, Homo sapiens
uuauuuuggcuucag

SEQ ID NO: 2191142 - RNA, 12 nt, Homo sapiens
auaaugaugaug

SEQ ID NO: 2191143 - RNA, 22 nt, Homo sapiens
cccaauggcaacaucuugcaaa

SEQ ID NO: 2191144 - RNA, 14 nt, Homo sapiens
ugcuucaucugugg

SEQ ID NO: 2191145 - RNA, 22 nt, Homo sapiens
guuaucacuucauuuaucuuaa

SEQ ID NO: 2191146 - RNA, 21 nt, Homo sapiens
cccaagauuuuuucauuucaa

SEQ ID NO: 2191147 - RNA, 23 nt, Homo sapiens
gauucugccucagccuccagagu

SEQ ID NO: 2191148 - RNA, 19 nt, Homo sapiens
cagcugugauacuuguaga

SEQ ID NO: 2191149 - RNA, 17 nt, Homo sapiens
aaaauuccaaauucaug

SEQ ID NO: 2191150 - RNA, 17 nt, Homo sapiens
uuccuauaacacuguga

SEQ ID NO: 2191151 - RNA, 15 nt, Homo sapiens
accccuaugaacucu

SEQ ID NO: 2191152 - RNA, 20 nt, Homo sapiens
cuuccagaaggcagcaaaga

SEQ ID NO: 2191153 - RNA, 22 nt, Homo sapiens
gcagcaugauuauaagccaaac

SEQ ID NO: 2191154 - RNA, 19 nt, Homo sapiens
gcuugugucccuccuggga

SEQ ID NO: 2191155 - RNA, 17 nt, Homo sapiens
ccuauguugugguccau

SEQ ID NO: 2191156 - RNA, 14 nt, Homo sapiens
ucccccacucccuc

SEQ ID NO: 2191157 - RNA, 16 nt, Homo sapiens
caccacacugauccag

SEQ ID NO: 2191158 - RNA, 17 nt, Homo sapiens
aagucagaauugcucaa

SEQ ID NO: 2191159 - RNA, 21 nt, Homo sapiens
uucuaaaucaaaccaggugca

SEQ ID NO: 2191160 - RNA, 18 nt, Homo sapiens
aagaggagcacuuccaaa

SEQ ID NO: 2191161 - RNA, 22 nt, Homo sapiens
gggucccugcaaaacuccaggc

SEQ ID NO: 2191162 - RNA, 17 nt, Homo sapiens
uucagugcaagagacuu

SEQ ID NO: 2191163 - RNA, 22 nt, Homo sapiens
aucaguggggccccaaagccca

SEQ ID NO: 2191164 - RNA, 13 nt, Homo sapiens
cuucugugcugug

SEQ ID NO: 2191165 - RNA, 17 nt, Homo sapiens
augucuaauagcccaua

SEQ ID NO: 2191166 - RNA, 19 nt, Homo sapiens
gugccuacagggcugggcc

SEQ ID NO: 2191167 - RNA, 11 nt, Homo sapiens
caagugcugca

SEQ ID NO: 2191168 - RNA, 14 nt, Homo sapiens
ugaagagauuucaa

SEQ ID NO: 2191169 - RNA, 17 nt, Homo sapiens
agcaaagcuccugccuc

SEQ ID NO: 2191170 - RNA, 14 nt, Homo sapiens
acaggggacacuga

SEQ ID NO: 2191171 - RNA, 16 nt, Homo sapiens
cucucagcugaccauc

SEQ ID NO: 2191172 - RNA, 16 nt, Homo sapiens
aaauuaacaugucaca

SEQ ID NO: 2191173 - RNA, 15 nt, Homo sapiens
caucagaaugagaaa

SEQ ID NO: 2191174 - RNA, 21 nt, Homo sapiens
aaagauggcugugccucugcc

SEQ ID NO: 2191175 - RNA, 19 nt, Homo sapiens
gauuuuaaguaacauaacu

SEQ ID NO: 2191176 - RNA, 17 nt, Homo sapiens
guggcagcucaccucuc

SEQ ID NO: 2191177 - RNA, 15 nt, Homo sapiens
cuuucaaauuuacug

SEQ ID NO: 2191178 - RNA, 15 nt, Homo sapiens
ugucuuucaaugaca

SEQ ID NO: 2191179 - RNA, 16 nt, Homo sapiens
uacacaccagggaaua

SEQ ID NO: 2191180 - RNA, 17 nt, Homo sapiens
aauucuaccuggcuaca

SEQ ID NO: 2191181 - RNA, 18 nt, Homo sapiens
cuccucaaaccacuugcc

SEQ ID NO: 2191182 - RNA, 14 nt, Homo sapiens
uagauuuuugcucu

SEQ ID NO: 2191183 - RNA, 19 nt, Homo sapiens
cccagugccuagaugcaug

SEQ ID NO: 2191184 - RNA, 17 nt, Homo sapiens
cacuggguguugaucuu

SEQ ID NO: 2191185 - RNA, 14 nt, Homo sapiens
ggauuuaguguuuc

SEQ ID NO: 2191186 - RNA, 23 nt, Homo sapiens
uaguugagccagcagacauuguc

SEQ ID NO: 2191187 - RNA, 18 nt, Homo sapiens
gacucuggucaagaagca

SEQ ID NO: 2191188 - RNA, 20 nt, Homo sapiens
uauacauauguaugugugag

SEQ ID NO: 2191189 - RNA, 22 nt, Homo sapiens
ucugaccaguuuaaccugaugc

SEQ ID NO: 2191190 - RNA, 22 nt, Homo sapiens
cuguauuagagcgccagcuccu

SEQ ID NO: 2191191 - RNA, 18 nt, Homo sapiens
gaaggcaguggcagggga

SEQ ID NO: 2191192 - RNA, 11 nt, Homo sapiens
ccuucagucuu

SEQ ID NO: 2191193 - RNA, 18 nt, Homo sapiens
cuaacccucacaagcaug

SEQ ID NO: 2191194 - RNA, 17 nt, Homo sapiens
gauuuauuuuguaugaa

SEQ ID NO: 2191195 - RNA, 19 nt, Homo sapiens
gcuguguugggugguugcc

SEQ ID NO: 2191196 - RNA, 16 nt, Homo sapiens
uauuuuguacguguua

SEQ ID NO: 2191197 - RNA, 16 nt, Homo sapiens
uauuacauauuuacac

SEQ ID NO: 2191198 - RNA, 17 nt, Homo sapiens
guccucagagcaggggc

SEQ ID NO: 2191199 - RNA, 19 nt, Homo sapiens
augaagcagagaggcacgu

SEQ ID NO: 2191200 - RNA, 20 nt, Homo sapiens
uuacagcacuguauguguug

SEQ ID NO: 2191201 - RNA, 15 nt, Homo sapiens
cucugugccuugguc

SEQ ID NO: 2191202 - RNA, 17 nt, Homo sapiens
ucagcccguuucagaag

SEQ ID NO: 2191203 - RNA, 18 nt, Homo sapiens
guuagcacugaacugcuu

SEQ ID NO: 2191204 - RNA, 19 nt, Homo sapiens
ucucacuagcugucucagg

SEQ ID NO: 2191205 - RNA, 23 nt, Homo sapiens
cuuugagaaggauaggccuucau

SEQ ID NO: 2191206 - RNA, 17 nt, Homo sapiens
cccuggucccucugcag

SEQ ID NO: 2191207 - RNA, 12 nt, Homo sapiens
ucuuaccuggca

SEQ ID NO: 2191208 - RNA, 22 nt, Homo sapiens
ugccuuaaauuauaccaaagau

SEQ ID NO: 2191209 - RNA, 21 nt, Homo sapiens
ucuccuaagcuggagugcagu

SEQ ID NO: 2191210 - RNA, 14 nt, Homo sapiens
gaacuucagagcau

SEQ ID NO: 2191211 - RNA, 16 nt, Homo sapiens
guagaagucucuucca

SEQ ID NO: 2191212 - RNA, 21 nt, Homo sapiens
ucccuaccccauuugugguca

SEQ ID NO: 2191213 - RNA, 13 nt, Homo sapiens
ugaauagcuuguu

SEQ ID NO: 2191214 - RNA, 19 nt, Homo sapiens
cccgaguggucuccucuca

SEQ ID NO: 2191215 - RNA, 17 nt, Homo sapiens
uguugacuguaagccuu

SEQ ID NO: 2191216 - RNA, 13 nt, Homo sapiens
acccaucuuccac

SEQ ID NO: 2191217 - RNA, 14 nt, Homo sapiens
ucacugguugcacu

SEQ ID NO: 2191218 - RNA, 18 nt, Homo sapiens
guauguguguagacugua

SEQ ID NO: 2191219 - RNA, 19 nt, Homo sapiens
gcaguuggacucucaggga

SEQ ID NO: 2191220 - RNA, 18 nt, Homo sapiens
uuucacacuuccaccagc

SEQ ID NO: 2191221 - RNA, 20 nt, Homo sapiens
uggcuaagauacugcugaug

SEQ ID NO: 2191222 - RNA, 15 nt, Homo sapiens
auggaggagaaauaa

SEQ ID NO: 2191223 - RNA, 16 nt, Homo sapiens
caccuuggccucccaa

SEQ ID NO: 2191224 - RNA, 13 nt, Homo sapiens
uggaucuugccac

SEQ ID NO: 2191225 - RNA, 18 nt, Homo sapiens
uuguaguauaauucuugg

SEQ ID NO: 2191226 - RNA, 14 nt, Homo sapiens
cagugccuugcucg

SEQ ID NO: 2191227 - RNA, 21 nt, Homo sapiens
gcccccaccggaacugggcug

SEQ ID NO: 2191228 - RNA, 22 nt, Homo sapiens
gggacguugcugagccagcugc

SEQ ID NO: 2191229 - RNA, 17 nt, Homo sapiens
ugauccacccaccucag

SEQ ID NO: 2191230 - RNA, 13 nt, Homo sapiens
ugauggaagacag

SEQ ID NO: 2191231 - RNA, 13 nt, Homo sapiens
ugcuagaagaaaa

SEQ ID NO: 2191232 - RNA, 16 nt, Homo sapiens
cugcucacagacauug

SEQ ID NO: 2191233 - RNA, 17 nt, Homo sapiens
gaaaacuaaguucucua

SEQ ID NO: 2191234 - RNA, 14 nt, Homo sapiens
cuaauugcuuucug

SEQ ID NO: 2191235 - RNA, 18 nt, Homo sapiens
auuaaaacuugggcacca

SEQ ID NO: 2191236 - RNA, 16 nt, Homo sapiens
cgugacuguggcacac

SEQ ID NO: 2191237 - RNA, 19 nt, Homo sapiens
uaauggccccuccauuuau

SEQ ID NO: 2191238 - RNA, 18 nt, Homo sapiens
acuacagagaaggcugcc

SEQ ID NO: 2191239 - RNA, 22 nt, Homo sapiens
cacauggaggacccaacaggag

SEQ ID NO: 2191240 - RNA, 21 nt, Homo sapiens
augcuuugaaagcuuauuuga

SEQ ID NO: 2191241 - RNA, 23 nt, Homo sapiens
uuggcaauucuucuucucaagca

SEQ ID NO: 2191242 - RNA, 16 nt, Homo sapiens
ucagaagaaauucugc

SEQ ID NO: 2191243 - RNA, 13 nt, Homo sapiens
caacaugagucaa

SEQ ID NO: 2191244 - RNA, 21 nt, Homo sapiens
accaucgucuucuuggccaug

SEQ ID NO: 2191245 - RNA, 16 nt, Homo sapiens
gucauguucugugcau

SEQ ID NO: 2191246 - RNA, 22 nt, Homo sapiens
guauaacaugucgauguucgau

SEQ ID NO: 2191247 - RNA, 23 nt, Homo sapiens
auuagucaccuaacccucuguca

SEQ ID NO: 2191248 - RNA, 21 nt, Homo sapiens
auaucaagguuccugauucag

SEQ ID NO: 2191249 - RNA, 14 nt, Homo sapiens
gaugcuacugcugc

SEQ ID NO: 2191250 - RNA, 14 nt, Homo sapiens
uaccugggugauua

SEQ ID NO: 2191251 - RNA, 18 nt, Homo sapiens
aaacuuguacaccaaugu

SEQ ID NO: 2191252 - RNA, 15 nt, Homo sapiens
cugagacaucccuca

SEQ ID NO: 2191253 - RNA, 11 nt, Homo sapiens
uucuacccuga

SEQ ID NO: 2191254 - RNA, 17 nt, Homo sapiens
uguguauucacauaguc

SEQ ID NO: 2191255 - RNA, 22 nt, Homo sapiens
ucagccacuugccugugcuaca

SEQ ID NO: 2191256 - RNA, 14 nt, Homo sapiens
ugagauuuguaaau

SEQ ID NO: 2191257 - RNA, 17 nt, Homo sapiens
uggagaucccacauauu

SEQ ID NO: 2191258 - RNA, 14 nt, Homo sapiens
acauuuucauugau

SEQ ID NO: 2191259 - RNA, 21 nt, Homo sapiens
cauccagagucccugccugga

SEQ ID NO: 2191260 - RNA, 23 nt, Homo sapiens
aaaccaucucugugauuaccucu

SEQ ID NO: 2191261 - RNA, 16 nt, Homo sapiens
uacucuggggugcugc

SEQ ID NO: 2191262 - RNA, 10 nt, Homo sapiens
cauacaggag

SEQ ID NO: 2191263 - RNA, 12 nt, Homo sapiens
gugagacccagc

SEQ ID NO: 2191264 - RNA, 20 nt, Homo sapiens
uuugggacauuugcauucaa

SEQ ID NO: 2191265 - RNA, 20 nt, Homo sapiens
guccuguguuuuuucugcca

SEQ ID NO: 2191266 - RNA, 14 nt, Homo sapiens
cucacccagccugg

SEQ ID NO: 2191267 - RNA, 17 nt, Homo sapiens
gccaaagcagcuacaau

SEQ ID NO: 2191268 - RNA, 23 nt, Homo sapiens
agccauguguuggggagacauca

SEQ ID NO: 2191269 - RNA, 22 nt, Homo sapiens
aaaggaauccucugugucuuca

SEQ ID NO: 2191270 - RNA, 13 nt, Homo sapiens
aaagugaugacau

SEQ ID NO: 2191271 - RNA, 23 nt, Homo sapiens
caccacggggucugcagcaauga

SEQ ID NO: 2191272 - RNA, 19 nt, Homo sapiens
ucaugcauguccuguaaag

SEQ ID NO: 2191273 - RNA, 21 nt, Homo sapiens
cuagaggcuuccuucauuucc

SEQ ID NO: 2191274 - RNA, 14 nt, Homo sapiens
uaccaccugacauu

SEQ ID NO: 2191275 - RNA, 19 nt, Homo sapiens
agcucagcauuuccacacc

SEQ ID NO: 2191276 - RNA, 23 nt, Homo sapiens
uaaaaacuuccuucaaucuucau

SEQ ID NO: 2191277 - RNA, 18 nt, Homo sapiens
ugcucucggugcuuccaa

SEQ ID NO: 2191278 - RNA, 21 nt, Homo sapiens
uucguagauauuggacaaaga

SEQ ID NO: 2191279 - RNA, 22 nt, Homo sapiens
ggggcacaagugucugugcaug

SEQ ID NO: 2191280 - RNA, 16 nt, Homo sapiens
cuggcaucuagucaag

SEQ ID NO: 2191281 - RNA, 16 nt, Homo sapiens
acaccuguggucccag

SEQ ID NO: 2191282 - RNA, 16 nt, Homo sapiens
uucuacuaugaucaga

SEQ ID NO: 2191283 - RNA, 21 nt, Homo sapiens
cucucaucccccauuaaccag

SEQ ID NO: 2191284 - RNA, 17 nt, Homo sapiens
gggcaggaaccagacaa

SEQ ID NO: 2191285 - RNA, 23 nt, Homo sapiens
uuaagaucuuuaaacugcuuuau

SEQ ID NO: 2191286 - RNA, 20 nt, Homo sapiens
uaauaaauugcuuacugaua

SEQ ID NO: 2191287 - RNA, 16 nt, Homo sapiens
ugcuugagcccagaag

SEQ ID NO: 2191288 - RNA, 13 nt, Homo sapiens
agggaauccuccu

SEQ ID NO: 2191289 - RNA, 13 nt, Homo sapiens
aaauauuucccau

SEQ ID NO: 2191290 - RNA, 22 nt, Homo sapiens
ugaccaggcgcccgggauccag

SEQ ID NO: 2191291 - RNA, 14 nt, Homo sapiens
cugaaugcaauuuu

SEQ ID NO: 2191292 - RNA, 18 nt, Homo sapiens
aaguagaucuuuucuuga

SEQ ID NO: 2191293 - RNA, 20 nt, Homo sapiens
uacuggcaaggagaagagca

SEQ ID NO: 2191294 - RNA, 16 nt, Homo sapiens
uaaaauguuaagcugc

SEQ ID NO: 2191295 - RNA, 12 nt, Homo sapiens
caaaauugcaau

SEQ ID NO: 2191296 - RNA, 15 nt, Homo sapiens
guacauaguggucau

SEQ ID NO: 2191297 - RNA, 17 nt, Homo sapiens
gggagauugaaccacua

SEQ ID NO: 2191298 - RNA, 21 nt, Homo sapiens
auuauucaggcuuuaggcaua

SEQ ID NO: 2191299 - RNA, 13 nt, Homo sapiens
cugugcacacuaa

SEQ ID NO: 2191300 - RNA, 21 nt, Homo sapiens
uguuuaaaaaaccacauggca

SEQ ID NO: 2191301 - RNA, 15 nt, Homo sapiens
uuaacggcacugugg

SEQ ID NO: 2191302 - RNA, 19 nt, Homo sapiens
ucucccucucugcaccugu

SEQ ID NO: 2191303 - RNA, 21 nt, Homo sapiens
cuccuugcccuagaugagccc

SEQ ID NO: 2191304 - RNA, 20 nt, Homo sapiens
cuugaggaggggcaccugcc

SEQ ID NO: 2191305 - RNA, 13 nt, Homo sapiens
cguuuuagugucu

SEQ ID NO: 2191306 - RNA, 16 nt, Homo sapiens
agagaggccacacuac

SEQ ID NO: 2191307 - RNA, 15 nt, Homo sapiens
ucugagccaaagaga

SEQ ID NO: 2191308 - RNA, 21 nt, Homo sapiens
aaggcuuuuugguguauagaa

SEQ ID NO: 2191309 - RNA, 20 nt, Homo sapiens
gaaaaagaccuaugagcaca

SEQ ID NO: 2191310 - RNA, 19 nt, Homo sapiens
uuguuaguuaaaggcuuaa

SEQ ID NO: 2191311 - RNA, 14 nt, Homo sapiens
auagaaacauacac

SEQ ID NO: 2191312 - RNA, 14 nt, Homo sapiens
aagaaaucaugaua

SEQ ID NO: 2191313 - RNA, 17 nt, Homo sapiens
ggauaccagauauuuga

SEQ ID NO: 2191314 - RNA, 21 nt, Homo sapiens
agggggaaguucagaaggugu

SEQ ID NO: 2191315 - RNA, 13 nt, Homo sapiens
cagagccauccac

SEQ ID NO: 2191316 - RNA, 13 nt, Homo sapiens
cugcuagcuauug

SEQ ID NO: 2191317 - RNA, 14 nt, Homo sapiens
acugcgaacacuga

SEQ ID NO: 2191318 - RNA, 14 nt, Homo sapiens
aggagggcacugga

SEQ ID NO: 2191319 - RNA, 14 nt, Homo sapiens
aaaauguacauacu

SEQ ID NO: 2191320 - RNA, 19 nt, Homo sapiens
caucccgugcaaaacaugc

SEQ ID NO: 2191321 - RNA, 23 nt, Homo sapiens
uaaacuauacacuuaaugauaca

SEQ ID NO: 2191322 - RNA, 13 nt, Homo sapiens
gccucccaccaga

SEQ ID NO: 2191323 - RNA, 19 nt, Homo sapiens
cguguggacacagauccca

SEQ ID NO: 2191324 - RNA, 17 nt, Homo sapiens
aguucugggcccagcgc

SEQ ID NO: 2191325 - RNA, 19 nt, Homo sapiens
caauguuuagcagauuuaa

SEQ ID NO: 2191326 - RNA, 18 nt, Homo sapiens
ccuucucuuuaaucucau

SEQ ID NO: 2191327 - RNA, 23 nt, Homo sapiens
agucaaggacugguaaaauacau

SEQ ID NO: 2191328 - RNA, 17 nt, Homo sapiens
ucugccugaagucacac

SEQ ID NO: 2191329 - RNA, 19 nt, Homo sapiens
caaauuaauauuugugcuu

SEQ ID NO: 2191330 - RNA, 20 nt, Homo sapiens
acucauacucagagcauuau

SEQ ID NO: 2191331 - RNA, 16 nt, Homo sapiens
gcucacacucauccac

SEQ ID NO: 2191332 - RNA, 17 nt, Homo sapiens
aaaggagaacuauccaa

SEQ ID NO: 2191333 - RNA, 20 nt, Homo sapiens
gaacugggaccuuuaguggu

SEQ ID NO: 2191334 - RNA, 23 nt, Homo sapiens
uagaaaaacuuuuaaacaugaga

SEQ ID NO: 2191335 - RNA, 20 nt, Homo sapiens
auuuccuaguagaacucaca

SEQ ID NO: 2191336 - RNA, 19 nt, Homo sapiens
uccaagucuagcuuuccuu

SEQ ID NO: 2191337 - RNA, 17 nt, Homo sapiens
gagcccagcuuccugaa

SEQ ID NO: 2191338 - RNA, 22 nt, Homo sapiens
cugugggaagcucccagaguuu

SEQ ID NO: 2191339 - RNA, 18 nt, Homo sapiens
agugaggugacacuccag

SEQ ID NO: 2191340 - RNA, 15 nt, Homo sapiens
uauaaaucuguuaua

SEQ ID NO: 2191341 - RNA, 11 nt, Homo sapiens
auucuaugagg

SEQ ID NO: 2191342 - RNA, 16 nt, Homo sapiens
aaaaacaauauaugua

SEQ ID NO: 2191343 - RNA, 16 nt, Homo sapiens
gaagcacgauccgcca

SEQ ID NO: 2191344 - RNA, 17 nt, Homo sapiens
ugcuucaggauaccaua

SEQ ID NO: 2191345 - RNA, 13 nt, Homo sapiens
uagugaacuugaa

SEQ ID NO: 2191346 - RNA, 13 nt, Homo sapiens
cuuugaaccauaa

SEQ ID NO: 2191347 - RNA, 13 nt, Homo sapiens
accaauaauguau

SEQ ID NO: 2191348 - RNA, 20 nt, Homo sapiens
acaccucaccagaauugugc

SEQ ID NO: 2191349 - RNA, 23 nt, Homo sapiens
acacacccugccccugcaaagac

SEQ ID NO: 2191350 - RNA, 22 nt, Homo sapiens
cacaaaagguucuucuggugag

SEQ ID NO: 2191351 - RNA, 22 nt, Homo sapiens
aagcccaugggacaaauugcac

SEQ ID NO: 2191352 - RNA, 15 nt, Homo sapiens
uauauauauaugccu

SEQ ID NO: 2191353 - RNA, 15 nt, Homo sapiens
cauguaaacauacca

SEQ ID NO: 2191354 - RNA, 16 nt, Homo sapiens
gcugcuccugagagag

SEQ ID NO: 2191355 - RNA, 24 nt, Homo sapiens
aggcugugggguggagcacuggac

SEQ ID NO: 2191356 - RNA, 18 nt, Homo sapiens
uguucuaauggcacuuau

SEQ ID NO: 2191357 - RNA, 19 nt, Homo sapiens
aaucauacaaacucucacc

SEQ ID NO: 2191358 - RNA, 16 nt, Homo sapiens
aggggcauuaguuuca

SEQ ID NO: 2191359 - RNA, 18 nt, Homo sapiens
cuuugcauucaucucuca

SEQ ID NO: 2191360 - RNA, 23 nt, Homo sapiens
agauuaguauuuuccacgucacu

SEQ ID NO: 2191361 - RNA, 19 nt, Homo sapiens
cuuugguuggcagcauucc

SEQ ID NO: 2191362 - RNA, 19 nt, Homo sapiens
uaaaccaaaaacugaaagu

SEQ ID NO: 2191363 - RNA, 16 nt, Homo sapiens
ucacccucuucaagcu

SEQ ID NO: 2191364 - RNA, 20 nt, Homo sapiens
uguuacgcacacguacuuaa

SEQ ID NO: 2191365 - RNA, 18 nt, Homo sapiens
ccuggggccugugcacug

SEQ ID NO: 2191366 - RNA, 13 nt, Homo sapiens
guguacucuuuau

SEQ ID NO: 2191367 - RNA, 21 nt, Homo sapiens
gucaagugaggugacacucca

SEQ ID NO: 2191368 - RNA, 15 nt, Homo sapiens
cugccagcucaggau

SEQ ID NO: 2191369 - RNA, 15 nt, Homo sapiens
cuaaaacuccaaguu

SEQ ID NO: 2191370 - RNA, 17 nt, Homo sapiens
auucuacccagagccuu

SEQ ID NO: 2191371 - RNA, 15 nt, Homo sapiens
agccgugaugcucag

SEQ ID NO: 2191372 - RNA, 14 nt, Homo sapiens
aucacugucaauau

SEQ ID NO: 2191373 - RNA, 14 nt, Homo sapiens
ggguagaaaccugc

SEQ ID NO: 2191374 - RNA, 23 nt, Homo sapiens
uuacagcugugcuccacacucag

SEQ ID NO: 2191375 - RNA, 13 nt, Homo sapiens
guuuuaagccagg

SEQ ID NO: 2191376 - RNA, 18 nt, Homo sapiens
accauuuguuaacuguac

SEQ ID NO: 2191377 - RNA, 23 nt, Homo sapiens
cccaggcuggaguacaauggcgu

SEQ ID NO: 2191378 - RNA, 14 nt, Homo sapiens
gccuggccaccagc

SEQ ID NO: 2191379 - RNA, 13 nt, Homo sapiens
cauucugcuccuu

SEQ ID NO: 2191380 - RNA, 18 nt, Homo sapiens
gccugugcuuuuggagcu

SEQ ID NO: 2191381 - RNA, 18 nt, Homo sapiens
auuuaaaagcagagcauu

SEQ ID NO: 2191382 - RNA, 21 nt, Homo sapiens
uuaacuagguugcuacuuuau

SEQ ID NO: 2191383 - RNA, 14 nt, Homo sapiens
acugucaucuucaa

SEQ ID NO: 2191384 - RNA, 14 nt, Homo sapiens
acaaggaaccaccg

SEQ ID NO: 2191385 - RNA, 13 nt, Homo sapiens
uuaaaacauuucu

SEQ ID NO: 2191386 - RNA, 19 nt, Homo sapiens
ucagcuccagaauaccuuc

SEQ ID NO: 2191387 - RNA, 15 nt, Homo sapiens
gauaugaaggauuac

SEQ ID NO: 2191388 - RNA, 18 nt, Homo sapiens
acauucccaugaauauca

SEQ ID NO: 2191389 - RNA, 17 nt, Homo sapiens
aagccucugaucuggca

SEQ ID NO: 2191390 - RNA, 16 nt, Homo sapiens
gaccugccaccaggga

SEQ ID NO: 2191391 - RNA, 14 nt, Homo sapiens
cuuuguucuuguca

SEQ ID NO: 2191392 - RNA, 14 nt, Homo sapiens
ugcccuucagccuu

SEQ ID NO: 2191393 - RNA, 10 nt, Homo sapiens
gaagugcaga

SEQ ID NO: 2191394 - RNA, 19 nt, Homo sapiens
ugcaucaugcaugcacucu

SEQ ID NO: 2191395 - RNA, 16 nt, Homo sapiens
auaaguagaaagaauu

SEQ ID NO: 2191396 - RNA, 16 nt, Homo sapiens
uaugugcuauacacac

SEQ ID NO: 2191397 - RNA, 16 nt, Homo sapiens
uguucccuaaguccaa

SEQ ID NO: 2191398 - RNA, 16 nt, Homo sapiens
aagugaauuguugaca

SEQ ID NO: 2191399 - RNA, 18 nt, Homo sapiens
agccugucagauccagga

SEQ ID NO: 2191400 - RNA, 13 nt, Homo sapiens
aaaauaguaaugu

SEQ ID NO: 2191401 - RNA, 18 nt, Homo sapiens
uugaagauaucuugaaau

SEQ ID NO: 2191402 - RNA, 19 nt, Homo sapiens
aggcggcaaagauccagcg

SEQ ID NO: 2191403 - RNA, 19 nt, Homo sapiens
ggguuguucacaccacagg

SEQ ID NO: 2191404 - RNA, 15 nt, Homo sapiens
auaucucacacaguu

SEQ ID NO: 2191405 - RNA, 19 nt, Homo sapiens
ugugguuucagaugugcaa

SEQ ID NO: 2191406 - RNA, 13 nt, Homo sapiens
uggucugugagau

SEQ ID NO: 2191407 - RNA, 23 nt, Homo sapiens
ccccaggucucuccacugcucuc

SEQ ID NO: 2191408 - RNA, 13 nt, Homo sapiens
ggaaaucucuauu

SEQ ID NO: 2191409 - RNA, 16 nt, Homo sapiens
ucagacuccugugcaa

SEQ ID NO: 2191410 - RNA, 20 nt, Homo sapiens
uauuagcaacugugcuacac

SEQ ID NO: 2191411 - RNA, 17 nt, Homo sapiens
aaggucuaagaagucau

SEQ ID NO: 2191412 - RNA, 19 nt, Homo sapiens
gcacugaggaagaacgggg

SEQ ID NO: 2191413 - RNA, 11 nt, Homo sapiens
uuuuguacugg

SEQ ID NO: 2191414 - RNA, 23 nt, Homo sapiens
ugaaaaaagguuguguagcugug

SEQ ID NO: 2191415 - RNA, 12 nt, Homo sapiens
ggcacaaccaga

SEQ ID NO: 2191416 - RNA, 15 nt, Homo sapiens
ggacgggaugaccuc

SEQ ID NO: 2191417 - RNA, 20 nt, Homo sapiens
uaauaaaaagcuucagggaa

SEQ ID NO: 2191418 - RNA, 15 nt, Homo sapiens
aucucugaacauuuc

SEQ ID NO: 2191419 - RNA, 21 nt, Homo sapiens
ugggauauuaaaacacaaagu

SEQ ID NO: 2191420 - RNA, 17 nt, Homo sapiens
guugcuguaagcaccug

SEQ ID NO: 2191421 - RNA, 12 nt, Homo sapiens
uucaacuuugag

SEQ ID NO: 2191422 - RNA, 12 nt, Homo sapiens
guaaucuacacc

SEQ ID NO: 2191423 - RNA, 18 nt, Homo sapiens
ucuaggcuaccagaagag

SEQ ID NO: 2191424 - RNA, 19 nt, Homo sapiens
aagagcuggcaaagguggc

SEQ ID NO: 2191425 - RNA, 20 nt, Homo sapiens
cagcaacuucuucuccaucc

SEQ ID NO: 2191426 - RNA, 14 nt, Homo sapiens
uaagguuugcaaau

SEQ ID NO: 2191427 - RNA, 16 nt, Homo sapiens
aggcuugagucaccau

SEQ ID NO: 2191428 - RNA, 21 nt, Homo sapiens
gaaacagcagcugaagccagc

SEQ ID NO: 2191429 - RNA, 21 nt, Homo sapiens
ccuugcuucuuggacuucuug

SEQ ID NO: 2191430 - RNA, 20 nt, Homo sapiens
uucaauuauacuaaaccuca

SEQ ID NO: 2191431 - RNA, 14 nt, Homo sapiens
cugcugggaccuug

SEQ ID NO: 2191432 - RNA, 16 nt, Homo sapiens
uguuuuaagacugaau

SEQ ID NO: 2191433 - RNA, 22 nt, Homo sapiens
gccaguggcggaagugaccgca

SEQ ID NO: 2191434 - RNA, 18 nt, Homo sapiens
acaacgaggaagcccuaa

SEQ ID NO: 2191435 - RNA, 18 nt, Homo sapiens
aagaaguugauuccuuca

SEQ ID NO: 2191436 - RNA, 13 nt, Homo sapiens
gagcaggcuucuu

SEQ ID NO: 2191437 - RNA, 21 nt, Homo sapiens
uuguauguuaaagcaucagag

SEQ ID NO: 2191438 - RNA, 21 nt, Homo sapiens
acuugcugaauucucugcuca

SEQ ID NO: 2191439 - RNA, 16 nt, Homo sapiens
acagucccuacaauau

SEQ ID NO: 2191440 - RNA, 14 nt, Homo sapiens
ugagggaggcacaa

SEQ ID NO: 2191441 - RNA, 16 nt, Homo sapiens
augaugauaaugauga

SEQ ID NO: 2191442 - RNA, 22 nt, Homo sapiens
cuuuaaaucacucuucuguaaa

SEQ ID NO: 2191443 - RNA, 15 nt, Homo sapiens
uaagcagaauggagu

SEQ ID NO: 2191444 - RNA, 13 nt, Homo sapiens
caauaaaccuccg

SEQ ID NO: 2191445 - RNA, 17 nt, Homo sapiens
agccuggacaccucuca

SEQ ID NO: 2191446 - RNA, 13 nt, Homo sapiens
aaaaaaacuucca

SEQ ID NO: 2191447 - RNA, 15 nt, Homo sapiens
ccuuucucuucucug

SEQ ID NO: 2191448 - RNA, 15 nt, Homo sapiens
cacuguggucgucaa

SEQ ID NO: 2191449 - RNA, 14 nt, Homo sapiens
guaguaccucccag

SEQ ID NO: 2191450 - RNA, 10 nt, Homo sapiens
caucuuguca

SEQ ID NO: 2191451 - RNA, 22 nt, Homo sapiens
auucccuaaagacuaacuugaa

SEQ ID NO: 2191452 - RNA, 20 nt, Homo sapiens
uugcuuagccugugcuggac

SEQ ID NO: 2191453 - RNA, 13 nt, Homo sapiens
caaggaagucaaa

SEQ ID NO: 2191454 - RNA, 17 nt, Homo sapiens
agaacaacaaggacaac

SEQ ID NO: 2191455 - RNA, 20 nt, Homo sapiens
ccauuugugugugugcaagu

SEQ ID NO: 2191456 - RNA, 15 nt, Homo sapiens
aaaaauaggugugau

SEQ ID NO: 2191457 - RNA, 22 nt, Homo sapiens
ggggccucuuucugugcuucuc

SEQ ID NO: 2191458 - RNA, 18 nt, Homo sapiens
uuucuuuuuauaacucau

SEQ ID NO: 2191459 - RNA, 17 nt, Homo sapiens
cccugcagagcacaaac

SEQ ID NO: 2191460 - RNA, 16 nt, Homo sapiens
gauugguaacugccug

SEQ ID NO: 2191461 - RNA, 17 nt, Homo sapiens
auuccaccacagugccc

SEQ ID NO: 2191462 - RNA, 17 nt, Homo sapiens
uuggaaagagucuccag

SEQ ID NO: 2191463 - RNA, 22 nt, Homo sapiens
aguuccgggagcggauggagaa

SEQ ID NO: 2191464 - RNA, 15 nt, Homo sapiens
ucccuuaauaaacuc

SEQ ID NO: 2191465 - RNA, 17 nt, Homo sapiens
ccucuuagaaaaaccac

SEQ ID NO: 2191466 - RNA, 24 nt, Homo sapiens
acauuccugaacaggauauucuca

SEQ ID NO: 2191467 - RNA, 21 nt, Homo sapiens
augaaccuugcuaucaagaaa

SEQ ID NO: 2191468 - RNA, 13 nt, Homo sapiens
uccauagauuucg

SEQ ID NO: 2191469 - RNA, 18 nt, Homo sapiens
uucaaaaccugcaguuaa

SEQ ID NO: 2191470 - RNA, 15 nt, Homo sapiens
aaguuucuagaauuu

SEQ ID NO: 2191471 - RNA, 22 nt, Homo sapiens
ucugccugccucaugcucucua

SEQ ID NO: 2191472 - RNA, 22 nt, Homo sapiens
aucgcaccuuuuauaccagaga

SEQ ID NO: 2191473 - RNA, 19 nt, Homo sapiens
caguuguccagaucacuga

SEQ ID NO: 2191474 - RNA, 12 nt, Homo sapiens
uguaaguagcaa

SEQ ID NO: 2191475 - RNA, 14 nt, Homo sapiens
aaaaaacaacggug

SEQ ID NO: 2191476 - RNA, 16 nt, Homo sapiens
uaguguccgaagaccg

SEQ ID NO: 2191477 - RNA, 18 nt, Homo sapiens
cuuuaauacucaccuccu

SEQ ID NO: 2191478 - RNA, 21 nt, Homo sapiens
ggauauucuccucggacugug

SEQ ID NO: 2191479 - RNA, 16 nt, Homo sapiens
uuccaucugccugcca

SEQ ID NO: 2191480 - RNA, 14 nt, Homo sapiens
aacauaucucugcc

SEQ ID NO: 2191481 - RNA, 13 nt, Homo sapiens
ugggcuugaccag

SEQ ID NO: 2191482 - RNA, 18 nt, Homo sapiens
cacauaguucuguaauaa

SEQ ID NO: 2191483 - RNA, 20 nt, Homo sapiens
augucuguguauacauaugu

SEQ ID NO: 2191484 - RNA, 19 nt, Homo sapiens
gauacgcaaacacaccgau

SEQ ID NO: 2191485 - RNA, 12 nt, Homo sapiens
cugaaaggccag

SEQ ID NO: 2191486 - RNA, 18 nt, Homo sapiens
acagauguuuuccacuga

SEQ ID NO: 2191487 - RNA, 21 nt, Homo sapiens
aauccugaggggauaucccua

SEQ ID NO: 2191488 - RNA, 22 nt, Homo sapiens
cugccuaggaggcuggccaagg

SEQ ID NO: 2191489 - RNA, 17 nt, Homo sapiens
accucggcacacacugu

SEQ ID NO: 2191490 - RNA, 19 nt, Homo sapiens
gugccccagcagugccuug

SEQ ID NO: 2191491 - RNA, 22 nt, Homo sapiens
gaaaugaauuuacagaacaguu

SEQ ID NO: 2191492 - RNA, 21 nt, Homo sapiens
agcgcugcucuuaugccauuu

SEQ ID NO: 2191493 - RNA, 14 nt, Homo sapiens
aaagcagugcagua

SEQ ID NO: 2191494 - RNA, 21 nt, Homo sapiens
ccugggaccaguggcagggac

SEQ ID NO: 2191495 - RNA, 16 nt, Homo sapiens
auuaaccaccaaucca

SEQ ID NO: 2191496 - RNA, 17 nt, Homo sapiens
cugcauuagucucaugu

SEQ ID NO: 2191497 - RNA, 16 nt, Homo sapiens
gagcuaugggaaggcc

SEQ ID NO: 2191498 - RNA, 20 nt, Homo sapiens
agccgggcugggaaugggga

SEQ ID NO: 2191499 - RNA, 20 nt, Homo sapiens
ucugccaaaguaaaacaaua

SEQ ID NO: 2191500 - RNA, 17 nt, Homo sapiens
cucauguucuuaacuuu

SEQ ID NO: 2191501 - RNA, 18 nt, Homo sapiens
caaggaaaacaguaacua

SEQ ID NO: 2191502 - RNA, 15 nt, Homo sapiens
uuguguguugugucc

SEQ ID NO: 2191503 - RNA, 17 nt, Homo sapiens
guggcugccccaccugc

SEQ ID NO: 2191504 - RNA, 17 nt, Homo sapiens
auauacauaauacauga

SEQ ID NO: 2191505 - RNA, 16 nt, Homo sapiens
uguccauucaucucau

SEQ ID NO: 2191506 - RNA, 18 nt, Homo sapiens
uauuuauuuuuaccugcu

SEQ ID NO: 2191507 - RNA, 22 nt, Homo sapiens
cugcuccuggaucucccugaga

SEQ ID NO: 2191508 - RNA, 13 nt, Homo sapiens
uacuagguuuauc

SEQ ID NO: 2191509 - RNA, 17 nt, Homo sapiens
ccugcgccccagacucc

SEQ ID NO: 2191510 - RNA, 23 nt, Homo sapiens
ccaggaaacaaggggucugagga

SEQ ID NO: 2191511 - RNA, 15 nt, Homo sapiens
aucccaguggccuca

SEQ ID NO: 2191512 - RNA, 20 nt, Homo sapiens
uauguauuuuugucauagca

SEQ ID NO: 2191513 - RNA, 13 nt, Homo sapiens
cugacuguauaca

SEQ ID NO: 2191514 - RNA, 19 nt, Homo sapiens
agcugagaggaagaugaag

SEQ ID NO: 2191515 - RNA, 21 nt, Homo sapiens
cauucuuuuccacuuguuaaa

SEQ ID NO: 2191516 - RNA, 19 nt, Homo sapiens
uaagaaaaaaagcacaaag

SEQ ID NO: 2191517 - RNA, 17 nt, Homo sapiens
uccaucucaagugccau

SEQ ID NO: 2191518 - RNA, 17 nt, Homo sapiens
ucuccaaaugagaucua

SEQ ID NO: 2191519 - RNA, 18 nt, Homo sapiens
gaaaaugcaucacaugau

SEQ ID NO: 2191520 - RNA, 17 nt, Homo sapiens
aucuuaaaagcuaucuu

SEQ ID NO: 2191521 - RNA, 17 nt, Homo sapiens
acaaucuuggagucaaa

SEQ ID NO: 2191522 - RNA, 12 nt, Homo sapiens
cucauccagaac

SEQ ID NO: 2191523 - RNA, 22 nt, Homo sapiens
cacacccaugcacacucaugca

SEQ ID NO: 2191524 - RNA, 14 nt, Homo sapiens
cccaucccgugcaa

SEQ ID NO: 2191525 - RNA, 12 nt, Homo sapiens
agcaauccuccu

SEQ ID NO: 2191526 - RNA, 19 nt, Homo sapiens
acuuuucaauuugucaugu

SEQ ID NO: 2191527 - RNA, 12 nt, Homo sapiens
uccucugugaaa

SEQ ID NO: 2191528 - RNA, 11 nt, Homo sapiens
uguucaaagac

SEQ ID NO: 2191529 - RNA, 11 nt, Homo sapiens
ugcucaaagau

SEQ ID NO: 2191530 - RNA, 21 nt, Homo sapiens
auuugcagguauuauaccauu

SEQ ID NO: 2191531 - RNA, 11 nt, Homo sapiens
auucacaccac

SEQ ID NO: 2191532 - RNA, 16 nt, Homo sapiens
cuaaucaucugcaguu

SEQ ID NO: 2191533 - RNA, 16 nt, Homo sapiens
agaaagugaggcucag

SEQ ID NO: 2191534 - RNA, 18 nt, Homo sapiens
aggcuuggggaugcccuu

SEQ ID NO: 2191535 - RNA, 14 nt, Homo sapiens
uaaauuuguacuau

SEQ ID NO: 2191536 - RNA, 19 nt, Homo sapiens
aucacugacucugacucau

SEQ ID NO: 2191537 - RNA, 15 nt, Homo sapiens
cucuuuaaugucaca

SEQ ID NO: 2191538 - RNA, 14 nt, Homo sapiens
uuucagaauguuga

SEQ ID NO: 2191539 - RNA, 13 nt, Homo sapiens
cccccagccaucu

SEQ ID NO: 2191540 - RNA, 16 nt, Homo sapiens
gucuauguguauauau

SEQ ID NO: 2191541 - RNA, 20 nt, Homo sapiens
aagugaucuguccaccucgg

SEQ ID NO: 2191542 - RNA, 15 nt, Homo sapiens
gaaucuguuaccaga

SEQ ID NO: 2191543 - RNA, 18 nt, Homo sapiens
uuauauaugaaaacuaag

SEQ ID NO: 2191544 - RNA, 15 nt, Homo sapiens
acagccaucaaggga

SEQ ID NO: 2191545 - RNA, 16 nt, Homo sapiens
aauuauuuuagcacaa

SEQ ID NO: 2191546 - RNA, 19 nt, Homo sapiens
cuccuggacugccuugaau

SEQ ID NO: 2191547 - RNA, 16 nt, Homo sapiens
gugugcguguuugcac

SEQ ID NO: 2191548 - RNA, 22 nt, Homo sapiens
ccuuaaaauuuauauguaucca

SEQ ID NO: 2191549 - RNA, 15 nt, Homo sapiens
uauaugguucuccaa

SEQ ID NO: 2191550 - RNA, 22 nt, Homo sapiens
gauucuuauuuuaccuucucau

SEQ ID NO: 2191551 - RNA, 22 nt, Homo sapiens
gaaacacaaaccacaacugaca

SEQ ID NO: 2191552 - RNA, 14 nt, Homo sapiens
uggaagcuggaaga

SEQ ID NO: 2191553 - RNA, 12 nt, Homo sapiens
gacaaugaaggg

SEQ ID NO: 2191554 - RNA, 15 nt, Homo sapiens
caagaugggcacaug

SEQ ID NO: 2191555 - RNA, 13 nt, Homo sapiens
cauuuauguguga

SEQ ID NO: 2191556 - RNA, 16 nt, Homo sapiens
cugcugacauucccau

SEQ ID NO: 2191557 - RNA, 18 nt, Homo sapiens
ucuguuucaaagcacaau

SEQ ID NO: 2191558 - RNA, 21 nt, Homo sapiens
guaacauauucuguaugaacu

SEQ ID NO: 2191559 - RNA, 13 nt, Homo sapiens
uaauuacugugug

SEQ ID NO: 2191560 - RNA, 13 nt, Homo sapiens
uaaagacugugau

SEQ ID NO: 2191561 - RNA, 15 nt, Homo sapiens
gcugccauccucacc

SEQ ID NO: 2191562 - RNA, 22 nt, Homo sapiens
cuuaaauauauauuucuaauau

SEQ ID NO: 2191563 - RNA, 16 nt, Homo sapiens
caugcauucaccugcc

SEQ ID NO: 2191564 - RNA, 18 nt, Homo sapiens
agccggggguggugacau

SEQ ID NO: 2191565 - RNA, 17 nt, Homo sapiens
aaaauuuaacuucuuca

SEQ ID NO: 2191566 - RNA, 23 nt, Homo sapiens
accacccccuguucccuguucug

SEQ ID NO: 2191567 - RNA, 19 nt, Homo sapiens
gggccuugcggaagccaua

SEQ ID NO: 2191568 - RNA, 22 nt, Homo sapiens
gcugcucacuguccacauguga

SEQ ID NO: 2191569 - RNA, 19 nt, Homo sapiens
gcaauuccccuacaucaaa

SEQ ID NO: 2191570 - RNA, 18 nt, Homo sapiens
accacuguggccuucuca

SEQ ID NO: 2191571 - RNA, 17 nt, Homo sapiens
aaagcugcugacagugu

SEQ ID NO: 2191572 - RNA, 14 nt, Homo sapiens
ccuuucuugcacug

SEQ ID NO: 2191573 - RNA, 18 nt, Homo sapiens
auggaaaaauaaacacua

SEQ ID NO: 2191574 - RNA, 13 nt, Homo sapiens
caaauauccucca

SEQ ID NO: 2191575 - RNA, 16 nt, Homo sapiens
auggggaguacauuca

SEQ ID NO: 2191576 - RNA, 19 nt, Homo sapiens
gacugcaacauacaggugc

SEQ ID NO: 2191577 - RNA, 15 nt, Homo sapiens
ucaaucaacaucucu

SEQ ID NO: 2191578 - RNA, 15 nt, Homo sapiens
ucaaaauacaucaaa

SEQ ID NO: 2191579 - RNA, 14 nt, Homo sapiens
accaagaacugcau

SEQ ID NO: 2191580 - RNA, 20 nt, Homo sapiens
gguccuagaugccaaagggg

SEQ ID NO: 2191581 - RNA, 22 nt, Homo sapiens
ugauccacaaaaacaacuuauu

SEQ ID NO: 2191582 - RNA, 16 nt, Homo sapiens
ucccaagguccucuca

SEQ ID NO: 2191583 - RNA, 16 nt, Homo sapiens
agaauucauuaugcug

SEQ ID NO: 2191584 - RNA, 16 nt, Homo sapiens
cuaccacacacagccu

SEQ ID NO: 2191585 - RNA, 19 nt, Homo sapiens
ggauguccacagaugccuc

SEQ ID NO: 2191586 - RNA, 19 nt, Homo sapiens
ugagaucguccacugucaa

SEQ ID NO: 2191587 - RNA, 19 nt, Homo sapiens
aucuguaauucacuaggcu

SEQ ID NO: 2191588 - RNA, 19 nt, Homo sapiens
gagugaaacuccgucucaa

SEQ ID NO: 2191589 - RNA, 17 nt, Homo sapiens
cccaaauggcagggaua

SEQ ID NO: 2191590 - RNA, 13 nt, Homo sapiens
ugcacucuuguac

SEQ ID NO: 2191591 - RNA, 20 nt, Homo sapiens
auucaugcuaccugauucau

SEQ ID NO: 2191592 - RNA, 15 nt, Homo sapiens
uccuaacugugauuu

SEQ ID NO: 2191593 - RNA, 20 nt, Homo sapiens
cuguuuuagauaucccuuac

SEQ ID NO: 2191594 - RNA, 18 nt, Homo sapiens
ucacuccucucuagggca

SEQ ID NO: 2191595 - RNA, 15 nt, Homo sapiens
agguuuguagugaaa

SEQ ID NO: 2191596 - RNA, 22 nt, Homo sapiens
acuacuccgugaaggcuucucu

SEQ ID NO: 2191597 - RNA, 15 nt, Homo sapiens
acacgcaacuggcuc

SEQ ID NO: 2191598 - RNA, 16 nt, Homo sapiens
gccugauagaagugca

SEQ ID NO: 2191599 - RNA, 15 nt, Homo sapiens
guuuaucaacucaag

SEQ ID NO: 2191600 - RNA, 15 nt, Homo sapiens
aauccaguggugggu

SEQ ID NO: 2191601 - RNA, 14 nt, Homo sapiens
uaagcauacuuugu

SEQ ID NO: 2191602 - RNA, 18 nt, Homo sapiens
uaaaggcagcugccucug

SEQ ID NO: 2191603 - RNA, 23 nt, Homo sapiens
aaaaauagguuuguagugaaaua

SEQ ID NO: 2191604 - RNA, 15 nt, Homo sapiens
uaauugcaugacaaa

SEQ ID NO: 2191605 - RNA, 15 nt, Homo sapiens
caaggaaacucgaau

SEQ ID NO: 2191606 - RNA, 13 nt, Homo sapiens
aacagaagggaua

SEQ ID NO: 2191607 - RNA, 23 nt, Homo sapiens
ugagcuuuccauguugcugccaa

SEQ ID NO: 2191608 - RNA, 21 nt, Homo sapiens
acauacauugccaauuuucca

SEQ ID NO: 2191609 - RNA, 23 nt, Homo sapiens
cauuguaaauaaauuuugugcaa

SEQ ID NO: 2191610 - RNA, 21 nt, Homo sapiens
ucuaacugauagaacguuacu

SEQ ID NO: 2191611 - RNA, 23 nt, Homo sapiens
cucuucaccccacacccaugugu

SEQ ID NO: 2191612 - RNA, 21 nt, Homo sapiens
acagcagcagcaaacaaauaa

SEQ ID NO: 2191613 - RNA, 16 nt, Homo sapiens
cagggaagucacuuca

SEQ ID NO: 2191614 - RNA, 22 nt, Homo sapiens
uagcaaaaaaaacccauguggu

SEQ ID NO: 2191615 - RNA, 15 nt, Homo sapiens
gcgugugauaagcaa

SEQ ID NO: 2191616 - RNA, 23 nt, Homo sapiens
uuuacacauacaacuucauauaa

SEQ ID NO: 2191617 - RNA, 16 nt, Homo sapiens
auauuuuuaaauggac

SEQ ID NO: 2191618 - RNA, 14 nt, Homo sapiens
cccagcccaaguga

SEQ ID NO: 2191619 - RNA, 21 nt, Homo sapiens
cauaauuauuauuuccagugu

SEQ ID NO: 2191620 - RNA, 23 nt, Homo sapiens
uaaaacaccuuuccuuaugucuc

SEQ ID NO: 2191621 - RNA, 22 nt, Homo sapiens
aaauauauccuguguaccucac

SEQ ID NO: 2191622 - RNA, 16 nt, Homo sapiens
ugcggucccuucuuac

SEQ ID NO: 2191623 - RNA, 14 nt, Homo sapiens
ccuuuugugugaug

SEQ ID NO: 2191624 - RNA, 18 nt, Homo sapiens
acagcagauacuuuguca

SEQ ID NO: 2191625 - RNA, 14 nt, Homo sapiens
ccuguacuggagag

SEQ ID NO: 2191626 - RNA, 16 nt, Homo sapiens
aaguaucacucuaaaa

SEQ ID NO: 2191627 - RNA, 22 nt, Homo sapiens
cuccuaaaucgugauauugaaa

SEQ ID NO: 2191628 - RNA, 15 nt, Homo sapiens
auuguccagugcaac

SEQ ID NO: 2191629 - RNA, 21 nt, Homo sapiens
guaaaacaaucuguuuuggcu

SEQ ID NO: 2191630 - RNA, 17 nt, Homo sapiens
cuucucccaucuagugg

SEQ ID NO: 2191631 - RNA, 22 nt, Homo sapiens
acuauuaaaacuaauaaucacc

SEQ ID NO: 2191632 - RNA, 17 nt, Homo sapiens
gggcucagcaaggccac

SEQ ID NO: 2191633 - RNA, 18 nt, Homo sapiens
aaagcugaguguuucaca

SEQ ID NO: 2191634 - RNA, 21 nt, Homo sapiens
ucccucacccaggcacugggc

SEQ ID NO: 2191635 - RNA, 19 nt, Homo sapiens
acgcauguggcaaagcuca

SEQ ID NO: 2191636 - RNA, 21 nt, Homo sapiens
ucccuugggaagggcagggaa

SEQ ID NO: 2191637 - RNA, 16 nt, Homo sapiens
uguuucugaaccauua

SEQ ID NO: 2191638 - RNA, 18 nt, Homo sapiens
caugugccuuuaguccac

SEQ ID NO: 2191639 - RNA, 14 nt, Homo sapiens
gcgccuaaagucau

SEQ ID NO: 2191640 - RNA, 11 nt, Homo sapiens
gcgugugacag

SEQ ID NO: 2191641 - RNA, 14 nt, Homo sapiens
ccucuauugccaug

SEQ ID NO: 2191642 - RNA, 16 nt, Homo sapiens
auugaaagaaccagag

SEQ ID NO: 2191643 - RNA, 17 nt, Homo sapiens
gcucuucccccaugugc

SEQ ID NO: 2191644 - RNA, 14 nt, Homo sapiens
caagaaucagucua

SEQ ID NO: 2191645 - RNA, 21 nt, Homo sapiens
agaacaaauuuuaacaaaagg

SEQ ID NO: 2191646 - RNA, 12 nt, Homo sapiens
aggacaaccaug

SEQ ID NO: 2191647 - RNA, 16 nt, Homo sapiens
cugccuugguucuggc

SEQ ID NO: 2191648 - RNA, 20 nt, Homo sapiens
ccugaagugucgaguccagu

SEQ ID NO: 2191649 - RNA, 14 nt, Homo sapiens
caaaucucacugua

SEQ ID NO: 2191650 - RNA, 19 nt, Homo sapiens
acagugaaacuccaucuca

SEQ ID NO: 2191651 - RNA, 20 nt, Homo sapiens
gaggcagguugaucaccuga

SEQ ID NO: 2191652 - RNA, 14 nt, Homo sapiens
accaagguauacau

SEQ ID NO: 2191653 - RNA, 14 nt, Homo sapiens
uuccggguucaagu

SEQ ID NO: 2191654 - RNA, 20 nt, Homo sapiens
uguagaacuuguugcugauu

SEQ ID NO: 2191655 - RNA, 14 nt, Homo sapiens
uuaaaauaacuaac

SEQ ID NO: 2191656 - RNA, 15 nt, Homo sapiens
aauuuuacuuaucau

SEQ ID NO: 2191657 - RNA, 19 nt, Homo sapiens
gccugacugccaagccaug

SEQ ID NO: 2191658 - RNA, 17 nt, Homo sapiens
auaauuccauaugcugu

SEQ ID NO: 2191659 - RNA, 20 nt, Homo sapiens
uugaccucaucucccgagca

SEQ ID NO: 2191660 - RNA, 19 nt, Homo sapiens
uucaugauuagcaaguuac

SEQ ID NO: 2191661 - RNA, 18 nt, Homo sapiens
ccuucggagccaacaaga

SEQ ID NO: 2191662 - RNA, 21 nt, Homo sapiens
agagccuuggcgagggcagca

SEQ ID NO: 2191663 - RNA, 22 nt, Homo sapiens
cuggcagcaggaugcucaguga

SEQ ID NO: 2191664 - RNA, 21 nt, Homo sapiens
uuccuaagguuaacuuugaau

SEQ ID NO: 2191665 - RNA, 20 nt, Homo sapiens
guugagccaggccucucuca

SEQ ID NO: 2191666 - RNA, 22 nt, Homo sapiens
ucaugagccuguuuauugccau

SEQ ID NO: 2191667 - RNA, 23 nt, Homo sapiens
uuacugaacaaucaaagcacuug

SEQ ID NO: 2191668 - RNA, 23 nt, Homo sapiens
uuuuaaaaacuccuuuugguuua

SEQ ID NO: 2191669 - RNA, 21 nt, Homo sapiens
gaaaaucuuuccucuucucau

SEQ ID NO: 2191670 - RNA, 22 nt, Homo sapiens
caggauucuccuuuuuaccccu

SEQ ID NO: 2191671 - RNA, 16 nt, Homo sapiens
ucaauggaaccaaaua

SEQ ID NO: 2191672 - RNA, 22 nt, Homo sapiens
gacacaacagcagucuccuuca

SEQ ID NO: 2191673 - RNA, 14 nt, Homo sapiens
ccuuuccucagugu

SEQ ID NO: 2191674 - RNA, 18 nt, Homo sapiens
uccauguuugcugccuua

SEQ ID NO: 2191675 - RNA, 13 nt, Homo sapiens
caguuuagugcau

SEQ ID NO: 2191676 - RNA, 11 nt, Homo sapiens
gccucauucua

SEQ ID NO: 2191677 - RNA, 16 nt, Homo sapiens
uguggccuuggucuaa

SEQ ID NO: 2191678 - RNA, 15 nt, Homo sapiens
ugcagguuguuguca

SEQ ID NO: 2191679 - RNA, 14 nt, Homo sapiens
ugauaaaauacuaa

SEQ ID NO: 2191680 - RNA, 18 nt, Homo sapiens
guuuuagaguaugcaaga

SEQ ID NO: 2191681 - RNA, 16 nt, Homo sapiens
gaacuguucacacugc

SEQ ID NO: 2191682 - RNA, 14 nt, Homo sapiens
guuauuauuuacug

SEQ ID NO: 2191683 - RNA, 22 nt, Homo sapiens
cugaaaccuguucuaccaauua

SEQ ID NO: 2191684 - RNA, 17 nt, Homo sapiens
guugcuuuagucacuaa

SEQ ID NO: 2191685 - RNA, 17 nt, Homo sapiens
ccuaagcauguguccca

SEQ ID NO: 2191686 - RNA, 21 nt, Homo sapiens
gccugucccauggacacucca

SEQ ID NO: 2191687 - RNA, 21 nt, Homo sapiens
uaugguuuuucaccugggaag

SEQ ID NO: 2191688 - RNA, 12 nt, Homo sapiens
aacccaaaaaga

SEQ ID NO: 2191689 - RNA, 12 nt, Homo sapiens
ggcacaaagggc

SEQ ID NO: 2191690 - RNA, 20 nt, Homo sapiens
cuggagaacuagagaaggac

SEQ ID NO: 2191691 - RNA, 17 nt, Homo sapiens
aaucucguuuagugcca

SEQ ID NO: 2191692 - RNA, 18 nt, Homo sapiens
gaucugaaucuguuucua

SEQ ID NO: 2191693 - RNA, 12 nt, Homo sapiens
caagcucuguca

SEQ ID NO: 2191694 - RNA, 12 nt, Homo sapiens
uuucaguauuag

SEQ ID NO: 2191695 - RNA, 14 nt, Homo sapiens
gggcugacugggac

SEQ ID NO: 2191696 - RNA, 22 nt, Homo sapiens
ucucuacaaauuuuucuguggu

SEQ ID NO: 2191697 - RNA, 20 nt, Homo sapiens
ucaagcuuucaaauccuccc

SEQ ID NO: 2191698 - RNA, 15 nt, Homo sapiens
uaagaaaacauguaa

SEQ ID NO: 2191699 - RNA, 15 nt, Homo sapiens
acacuugcugucaau

SEQ ID NO: 2191700 - RNA, 18 nt, Homo sapiens
aguggcucgccaggccaa

SEQ ID NO: 2191701 - RNA, 14 nt, Homo sapiens
guccaccaccaccu

SEQ ID NO: 2191702 - RNA, 19 nt, Homo sapiens
uuuuguccuguacccagug

SEQ ID NO: 2191703 - RNA, 23 nt, Homo sapiens
aucugggcauagaugcaggugag

SEQ ID NO: 2191704 - RNA, 19 nt, Homo sapiens
ugaacucgcuucucuguga

SEQ ID NO: 2191705 - RNA, 18 nt, Homo sapiens
aggaaaaucacaucucca

SEQ ID NO: 2191706 - RNA, 18 nt, Homo sapiens
cccagccacgacugccau

SEQ ID NO: 2191707 - RNA, 23 nt, Homo sapiens
guagugucacucaaggcggugcu

SEQ ID NO: 2191708 - RNA, 13 nt, Homo sapiens
ggcaugugugccu

SEQ ID NO: 2191709 - RNA, 22 nt, Homo sapiens
uggaaaacuuaguuugugaauu

SEQ ID NO: 2191710 - RNA, 21 nt, Homo sapiens
agguugucugaagucacugca

SEQ ID NO: 2191711 - RNA, 15 nt, Homo sapiens
ggagagcccagccau

SEQ ID NO: 2191712 - RNA, 18 nt, Homo sapiens
uccucaguccacugcuga

SEQ ID NO: 2191713 - RNA, 23 nt, Homo sapiens
gacguuccaccuggggcuucccu

SEQ ID NO: 2191714 - RNA, 17 nt, Homo sapiens
uuguaaguuuaugcaua

SEQ ID NO: 2191715 - RNA, 18 nt, Homo sapiens
ucacucuaggacucugca

SEQ ID NO: 2191716 - RNA, 22 nt, Homo sapiens
gcuuggugguuaugucccauga

SEQ ID NO: 2191717 - RNA, 16 nt, Homo sapiens
aagaaauuaugucagc

SEQ ID NO: 2191718 - RNA, 18 nt, Homo sapiens
aaguacagucccagcaca

SEQ ID NO: 2191719 - RNA, 20 nt, Homo sapiens
aguucuccuucccugcagag

SEQ ID NO: 2191720 - RNA, 23 nt, Homo sapiens
auuucauacaacagaaaccagaa

SEQ ID NO: 2191721 - RNA, 22 nt, Homo sapiens
cuuaauggcucaugaccuggaa

SEQ ID NO: 2191722 - RNA, 19 nt, Homo sapiens
ucacaaaucaguaaaugug

SEQ ID NO: 2191723 - RNA, 18 nt, Homo sapiens
ccuaaauugaacugccaa

SEQ ID NO: 2191724 - RNA, 20 nt, Homo sapiens
gugacagacuccugaggaca

SEQ ID NO: 2191725 - RNA, 21 nt, Homo sapiens
aagauuaugauauuauuugau

SEQ ID NO: 2191726 - RNA, 22 nt, Homo sapiens
uugcacuaggucaaaacauuca

SEQ ID NO: 2191727 - RNA, 23 nt, Homo sapiens
guuuuuggacacugugcuacuga

SEQ ID NO: 2191728 - RNA, 13 nt, Homo sapiens
gugagccaaauaa

SEQ ID NO: 2191729 - RNA, 20 nt, Homo sapiens
auugucagaugcugugcaaa

SEQ ID NO: 2191730 - RNA, 20 nt, Homo sapiens
ccugaggcaagccauggagu

SEQ ID NO: 2191731 - RNA, 13 nt, Homo sapiens
aaugugauuuugg

SEQ ID NO: 2191732 - RNA, 20 nt, Homo sapiens
agccccagagaaacugccac

SEQ ID NO: 2191733 - RNA, 14 nt, Homo sapiens
ugcacaagccaggg

SEQ ID NO: 2191734 - RNA, 21 nt, Homo sapiens
agccccagagaugccagcccu

SEQ ID NO: 2191735 - RNA, 23 nt, Homo sapiens
ccucugguuuuccucugcuccuc

SEQ ID NO: 2191736 - RNA, 16 nt, Homo sapiens
agauauuucaugugcu

SEQ ID NO: 2191737 - RNA, 14 nt, Homo sapiens
uccuaccuccaaag

SEQ ID NO: 2191738 - RNA, 17 nt, Homo sapiens
aagauuucucugagauc

SEQ ID NO: 2191739 - RNA, 16 nt, Homo sapiens
aggcugagcugcaucc

SEQ ID NO: 2191740 - RNA, 17 nt, Homo sapiens
caccacccccacuggug

SEQ ID NO: 2191741 - RNA, 19 nt, Homo sapiens
uuuaucuucagcaccaaau

SEQ ID NO: 2191742 - RNA, 22 nt, Homo sapiens
ccaugcgugccgccugcuccuc

SEQ ID NO: 2191743 - RNA, 18 nt, Homo sapiens
cugggaaaggaaaaccag

SEQ ID NO: 2191744 - RNA, 17 nt, Homo sapiens
uacauggagcucagguu

SEQ ID NO: 2191745 - RNA, 22 nt, Homo sapiens
cuugagaaggucacuacugcau

SEQ ID NO: 2191746 - RNA, 19 nt, Homo sapiens
agagacagauaacucuccu

SEQ ID NO: 2191747 - RNA, 16 nt, Homo sapiens
uuggauaauauccacu

SEQ ID NO: 2191748 - RNA, 13 nt, Homo sapiens
aagacccagugua

SEQ ID NO: 2191749 - RNA, 15 nt, Homo sapiens
uggaccacagcauga

SEQ ID NO: 2191750 - RNA, 18 nt, Homo sapiens
ugaaauguuuccaggcau

SEQ ID NO: 2191751 - RNA, 14 nt, Homo sapiens
uaaccuguuuaaga

SEQ ID NO: 2191752 - RNA, 16 nt, Homo sapiens
ggaugacccacugucc

SEQ ID NO: 2191753 - RNA, 22 nt, Homo sapiens
gccugagacagcugucuuguga

SEQ ID NO: 2191754 - RNA, 12 nt, Homo sapiens
agcuuaagucau

SEQ ID NO: 2191755 - RNA, 19 nt, Homo sapiens
aguuccaggagaauaaaag

SEQ ID NO: 2191756 - RNA, 22 nt, Homo sapiens
aagaaggaaaaaauaaaagauc

SEQ ID NO: 2191757 - RNA, 21 nt, Homo sapiens
ucccaaagugcugggaauuac

SEQ ID NO: 2191758 - RNA, 14 nt, Homo sapiens
cuugacucuacuau

SEQ ID NO: 2191759 - RNA, 13 nt, Homo sapiens
cccuaaugcugca

SEQ ID NO: 2191760 - RNA, 20 nt, Homo sapiens
aguucuaugagggcuaauau

SEQ ID NO: 2191761 - RNA, 20 nt, Homo sapiens
auguggcuuuugcaauucac

SEQ ID NO: 2191762 - RNA, 15 nt, Homo sapiens
aucacccccuacccc

SEQ ID NO: 2191763 - RNA, 23 nt, Homo sapiens
uaaacaucacagaacauccugga

SEQ ID NO: 2191764 - RNA, 13 nt, Homo sapiens
uuccaaaggccau

SEQ ID NO: 2191765 - RNA, 23 nt, Homo sapiens
aguuugucuuccucuuguuuacg

SEQ ID NO: 2191766 - RNA, 22 nt, Homo sapiens
uuaucaggaaauguuuucuuaa

SEQ ID NO: 2191767 - RNA, 16 nt, Homo sapiens
gcuucuggagcccuug

SEQ ID NO: 2191768 - RNA, 16 nt, Homo sapiens
uguaagaaagcauaga

SEQ ID NO: 2191769 - RNA, 14 nt, Homo sapiens
cauucuuugcaaua

SEQ ID NO: 2191770 - RNA, 18 nt, Homo sapiens
aaugcaaaauccugguga

SEQ ID NO: 2191771 - RNA, 16 nt, Homo sapiens
auggcgcaggaacuca

SEQ ID NO: 2191772 - RNA, 15 nt, Homo sapiens
cagcuuccugaagca

SEQ ID NO: 2191773 - RNA, 24 nt, Homo sapiens
caaaauaagucccgcauauacuuu

SEQ ID NO: 2191774 - RNA, 24 nt, Homo sapiens
aacuaguggggcuuaaugaagguc

SEQ ID NO: 2191775 - RNA, 12 nt, Homo sapiens
cacuagcagcuu

SEQ ID NO: 2191776 - RNA, 13 nt, Homo sapiens
cagcucacugcaa

SEQ ID NO: 2191777 - RNA, 15 nt, Homo sapiens
caugccccaucccau

SEQ ID NO: 2191778 - RNA, 15 nt, Homo sapiens
uaccaaaugcuuuaa

SEQ ID NO: 2191779 - RNA, 16 nt, Homo sapiens
guaucagaaguguuaa

SEQ ID NO: 2191780 - RNA, 19 nt, Homo sapiens
ggucacuuugcguguguca

SEQ ID NO: 2191781 - RNA, 22 nt, Homo sapiens
agauuccaggcgaugugcaagu

SEQ ID NO: 2191782 - RNA, 16 nt, Homo sapiens
ccacauugagacuuuc

SEQ ID NO: 2191783 - RNA, 12 nt, Homo sapiens
accgcgugccau

SEQ ID NO: 2191784 - RNA, 15 nt, Homo sapiens
gacaaggucuugcua

SEQ ID NO: 2191785 - RNA, 16 nt, Homo sapiens
ccaugaaucaaagaca

SEQ ID NO: 2191786 - RNA, 21 nt, Homo sapiens
ucaccaaccaaagggggacag

SEQ ID NO: 2191787 - RNA, 18 nt, Homo sapiens
auaccugugugucuccau

SEQ ID NO: 2191788 - RNA, 19 nt, Homo sapiens
gaacagcuuggcuguucca

SEQ ID NO: 2191789 - RNA, 18 nt, Homo sapiens
ugacauucuucacugucu

SEQ ID NO: 2191790 - RNA, 12 nt, Homo sapiens
gacucacugugu

SEQ ID NO: 2191791 - RNA, 18 nt, Homo sapiens
aggaauggugcguggcuu

SEQ ID NO: 2191792 - RNA, 12 nt, Homo sapiens
cuagagugcagg

SEQ ID NO: 2191793 - RNA, 16 nt, Homo sapiens
acagaaaccaagccau

SEQ ID NO: 2191794 - RNA, 15 nt, Homo sapiens
gggccuggacaccca

SEQ ID NO: 2191795 - RNA, 12 nt, Homo sapiens
uagccucuugug

SEQ ID NO: 2191796 - RNA, 14 nt, Homo sapiens
gaacgauucaccug

SEQ ID NO: 2191797 - RNA, 17 nt, Homo sapiens
ggaucccguguugccau

SEQ ID NO: 2191798 - RNA, 13 nt, Homo sapiens
augugaagcugaa

SEQ ID NO: 2191799 - RNA, 22 nt, Homo sapiens
ucccccuauuuauugacuuuga

SEQ ID NO: 2191800 - RNA, 21 nt, Homo sapiens
caguguguguuuaacauucac

SEQ ID NO: 2191801 - RNA, 19 nt, Homo sapiens
agagcugagaccuugcuuu

SEQ ID NO: 2191802 - RNA, 16 nt, Homo sapiens
auguuuucaaguugca

SEQ ID NO: 2191803 - RNA, 19 nt, Homo sapiens
augucuauguagcugaaaa

SEQ ID NO: 2191804 - RNA, 22 nt, Homo sapiens
guuuaagaaacaggcacuuuuu

SEQ ID NO: 2191805 - RNA, 22 nt, Homo sapiens
aauguacagaaaauagcuuuua

SEQ ID NO: 2191806 - RNA, 18 nt, Homo sapiens
ucagaaguucaagcuaaa

SEQ ID NO: 2191807 - RNA, 21 nt, Homo sapiens
cuagcuggagccugggauuuc

SEQ ID NO: 2191808 - RNA, 22 nt, Homo sapiens
cuauugaccgagcacauaccau

SEQ ID NO: 2191809 - RNA, 16 nt, Homo sapiens
aaggggcugucuccca

SEQ ID NO: 2191810 - RNA, 23 nt, Homo sapiens
cuucuuuccauuucucucuccag

SEQ ID NO: 2191811 - RNA, 19 nt, Homo sapiens
ggaauaaugcggacacuuu

SEQ ID NO: 2191812 - RNA, 16 nt, Homo sapiens
cuagugucuuuugccu

SEQ ID NO: 2191813 - RNA, 22 nt, Homo sapiens
cagaggcagcccgcacaccugc

SEQ ID NO: 2191814 - RNA, 21 nt, Homo sapiens
acaccacuuggagaucuuugc

SEQ ID NO: 2191815 - RNA, 14 nt, Homo sapiens
acacuuacccaagg

SEQ ID NO: 2191816 - RNA, 19 nt, Homo sapiens
gccaucagaugaggcuccu

SEQ ID NO: 2191817 - RNA, 23 nt, Homo sapiens
guguauagcuguguguguguuca

SEQ ID NO: 2191818 - RNA, 15 nt, Homo sapiens
cugcuucuccuccca

SEQ ID NO: 2191819 - RNA, 16 nt, Homo sapiens
gccaggcgcugcaggg

SEQ ID NO: 2191820 - RNA, 15 nt, Homo sapiens
gcaagcuaacugcuu

SEQ ID NO: 2191821 - RNA, 13 nt, Homo sapiens
ucaggccauucag

SEQ ID NO: 2191822 - RNA, 23 nt, Homo sapiens
uguggacacagaucccacuggaa

SEQ ID NO: 2191823 - RNA, 19 nt, Homo sapiens
cggacucaccaacuugcca

SEQ ID NO: 2191824 - RNA, 22 nt, Homo sapiens
uagaucagaauuguugacuugc

SEQ ID NO: 2191825 - RNA, 15 nt, Homo sapiens
uaaaguacguguuua

SEQ ID NO: 2191826 - RNA, 20 nt, Homo sapiens
ccuuauuagagugucuuucc

SEQ ID NO: 2191827 - RNA, 22 nt, Homo sapiens
aauccauguaaauugcaaauaa

SEQ ID NO: 2191828 - RNA, 17 nt, Homo sapiens
uaucuccagauggaaug

SEQ ID NO: 2191829 - RNA, 14 nt, Homo sapiens
acauuaguauacgu

SEQ ID NO: 2191830 - RNA, 21 nt, Homo sapiens
ucuuagcucuuaauuguucau

SEQ ID NO: 2191831 - RNA, 16 nt, Homo sapiens
accaugcuaauguuac

SEQ ID NO: 2191832 - RNA, 13 nt, Homo sapiens
agaacuaaagcug

SEQ ID NO: 2191833 - RNA, 14 nt, Homo sapiens
ugaaaccugugaag

SEQ ID NO: 2191834 - RNA, 14 nt, Homo sapiens
auuuuagccuuuau

SEQ ID NO: 2191835 - RNA, 19 nt, Homo sapiens
caguggcuugcuuucuucu

SEQ ID NO: 2191836 - RNA, 12 nt, Homo sapiens
uguuaccagacu

SEQ ID NO: 2191837 - RNA, 16 nt, Homo sapiens
cucgauuagacuccau

SEQ ID NO: 2191838 - RNA, 20 nt, Homo sapiens
uaucuuuguaauaaaacugc

SEQ ID NO: 2191839 - RNA, 20 nt, Homo sapiens
ugggagcccccaccacaaac

SEQ ID NO: 2191840 - RNA, 13 nt, Homo sapiens
aauacaguucugc

SEQ ID NO: 2191841 - RNA, 13 nt, Homo sapiens
aauauaguucugu

SEQ ID NO: 2191842 - RNA, 14 nt, Homo sapiens
ugaauggacucaaa

SEQ ID NO: 2191843 - RNA, 17 nt, Homo sapiens
gacacagucaauucuga

SEQ ID NO: 2191844 - RNA, 20 nt, Homo sapiens
gaaauuauauuuuagccuuu

SEQ ID NO: 2191845 - RNA, 21 nt, Homo sapiens
ugcauuggaagaccccaccca

SEQ ID NO: 2191846 - RNA, 21 nt, Homo sapiens
ugaacaucuuuaggagacuaa

SEQ ID NO: 2191847 - RNA, 15 nt, Homo sapiens
uacgcugcucucaua

SEQ ID NO: 2191848 - RNA, 20 nt, Homo sapiens
uccaacuuuuaccuggcugc

SEQ ID NO: 2191849 - RNA, 14 nt, Homo sapiens
cuggaucaggguug

SEQ ID NO: 2191850 - RNA, 17 nt, Homo sapiens
ccacucagcucaccucu

SEQ ID NO: 2191851 - RNA, 19 nt, Homo sapiens
gacauuccuucuacaugua

SEQ ID NO: 2191852 - RNA, 21 nt, Homo sapiens
aguccaagggguagucugccu

SEQ ID NO: 2191853 - RNA, 20 nt, Homo sapiens
ugcaguuuccucaucuguca

SEQ ID NO: 2191854 - RNA, 20 nt, Homo sapiens
ccgcaggccugccuucucag

SEQ ID NO: 2191855 - RNA, 16 nt, Homo sapiens
gcaggacccagcauaa

SEQ ID NO: 2191856 - RNA, 13 nt, Homo sapiens
gcugauuuagacc

SEQ ID NO: 2191857 - RNA, 15 nt, Homo sapiens
uccaaacucuucccu

SEQ ID NO: 2191858 - RNA, 19 nt, Homo sapiens
gaaaugagaacaaucucaa

SEQ ID NO: 2191859 - RNA, 22 nt, Homo sapiens
agcucuggggacagcuuccuca

SEQ ID NO: 2191860 - RNA, 22 nt, Homo sapiens
gccuguaaucccaacacuuugg

SEQ ID NO: 2191861 - RNA, 16 nt, Homo sapiens
ucagcuccuugguucc

SEQ ID NO: 2191862 - RNA, 21 nt, Homo sapiens
guuccauauagacaccaagga

SEQ ID NO: 2191863 - RNA, 23 nt, Homo sapiens
auuucagguuaaauuaaaccaag

SEQ ID NO: 2191864 - RNA, 21 nt, Homo sapiens
aggaagacccaacacauggga

SEQ ID NO: 2191865 - RNA, 13 nt, Homo sapiens
aaacaaacaugac

SEQ ID NO: 2191866 - RNA, 14 nt, Homo sapiens
cugugucauuccaa

SEQ ID NO: 2191867 - RNA, 14 nt, Homo sapiens
ugguccucacacuc

SEQ ID NO: 2191868 - RNA, 16 nt, Homo sapiens
cucucaccuccuaaag

SEQ ID NO: 2191869 - RNA, 15 nt, Homo sapiens
caacaaccaugccag

SEQ ID NO: 2191870 - RNA, 18 nt, Homo sapiens
caggaaggugccuggcca

SEQ ID NO: 2191871 - RNA, 14 nt, Homo sapiens
aauauuuccauuaa

SEQ ID NO: 2191872 - RNA, 14 nt, Homo sapiens
cauuuuucaauaaa

SEQ ID NO: 2191873 - RNA, 14 nt, Homo sapiens
uccuggcuuuuauu

SEQ ID NO: 2191874 - RNA, 22 nt, Homo sapiens
gguuccuuuuucaacuuggaaa

SEQ ID NO: 2191875 - RNA, 16 nt, Homo sapiens
ccuccucugcuugcau

SEQ ID NO: 2191876 - RNA, 20 nt, Homo sapiens
caagccuuugaccuguucag

SEQ ID NO: 2191877 - RNA, 12 nt, Homo sapiens
aggaaagacaca

SEQ ID NO: 2191878 - RNA, 17 nt, Homo sapiens
ugcauucuucugagcac

SEQ ID NO: 2191879 - RNA, 13 nt, Homo sapiens
agucuucuuccau

SEQ ID NO: 2191880 - RNA, 15 nt, Homo sapiens
uaaauauuauuuauc

SEQ ID NO: 2191881 - RNA, 17 nt, Homo sapiens
acauguauucuguucuu

SEQ ID NO: 2191882 - RNA, 18 nt, Homo sapiens
gcucauguaccucugauu

SEQ ID NO: 2191883 - RNA, 22 nt, Homo sapiens
ucauaaauuggcuccuuuccca

SEQ ID NO: 2191884 - RNA, 15 nt, Homo sapiens
ucucuugcauuguga

SEQ ID NO: 2191885 - RNA, 12 nt, Homo sapiens
guacaugugcac

SEQ ID NO: 2191886 - RNA, 21 nt, Homo sapiens
auuaugcuguuaaaacuacuu

SEQ ID NO: 2191887 - RNA, 22 nt, Homo sapiens
ccaucuucuaaacccaauccaa

SEQ ID NO: 2191888 - RNA, 16 nt, Homo sapiens
aaacagggauuuugaa

SEQ ID NO: 2191889 - RNA, 19 nt, Homo sapiens
acagugccacgacauggcu

SEQ ID NO: 2191890 - RNA, 20 nt, Homo sapiens
gaaaagaaaccagagucaaa

SEQ ID NO: 2191891 - RNA, 16 nt, Homo sapiens
gcaaugagaaggccag

SEQ ID NO: 2191892 - RNA, 15 nt, Homo sapiens
acuggguucccauuc

SEQ ID NO: 2191893 - RNA, 15 nt, Homo sapiens
aagagugaaugccau

SEQ ID NO: 2191894 - RNA, 18 nt, Homo sapiens
gaaaguuuauaucuugau

SEQ ID NO: 2191895 - RNA, 16 nt, Homo sapiens
uucuaccuauaugcag

SEQ ID NO: 2191896 - RNA, 18 nt, Homo sapiens
uuucuaccuugaggucuu

SEQ ID NO: 2191897 - RNA, 22 nt, Homo sapiens
agugcuuggaacauacuguuca

SEQ ID NO: 2191898 - RNA, 19 nt, Homo sapiens
ccaguugugauacaauaaa

SEQ ID NO: 2191899 - RNA, 14 nt, Homo sapiens
uagugauuaccaaa

SEQ ID NO: 2191900 - RNA, 12 nt, Homo sapiens
aucaucacugua

SEQ ID NO: 2191901 - RNA, 18 nt, Homo sapiens
gauggagaggggguacaa

SEQ ID NO: 2191902 - RNA, 18 nt, Homo sapiens
ugguaccuauuugacuua

SEQ ID NO: 2191903 - RNA, 23 nt, Homo sapiens
aguguccagaccauugucuucca

SEQ ID NO: 2191904 - RNA, 21 nt, Homo sapiens
uacucugugccagagccuggg

SEQ ID NO: 2191905 - RNA, 20 nt, Homo sapiens
agugucuggagcggcugcuc

SEQ ID NO: 2191906 - RNA, 23 nt, Homo sapiens
aauguuuucgcaaauguugcucu

SEQ ID NO: 2191907 - RNA, 19 nt, Homo sapiens
uuauucuuauucaaagaaa

SEQ ID NO: 2191908 - RNA, 19 nt, Homo sapiens
cagccugugcuguggcaua

SEQ ID NO: 2191909 - RNA, 17 nt, Homo sapiens
auguguuuggaagacaa

SEQ ID NO: 2191910 - RNA, 15 nt, Homo sapiens
ccaacagcacccucu

SEQ ID NO: 2191911 - RNA, 16 nt, Homo sapiens
caaauauuccagagac

SEQ ID NO: 2191912 - RNA, 22 nt, Homo sapiens
uacugcaauaaauuauggcucu

SEQ ID NO: 2191913 - RNA, 19 nt, Homo sapiens
cuugucuaauuuucacaca

SEQ ID NO: 2191914 - RNA, 18 nt, Homo sapiens
ccccuucugacugagcaa

SEQ ID NO: 2191915 - RNA, 13 nt, Homo sapiens
uuguguguggaag

SEQ ID NO: 2191916 - RNA, 19 nt, Homo sapiens
ucccaggcccgagauguga

SEQ ID NO: 2191917 - RNA, 21 nt, Homo sapiens
aucaaggcaggagaugcagca

SEQ ID NO: 2191918 - RNA, 13 nt, Homo sapiens
auccugaauucca

SEQ ID NO: 2191919 - RNA, 16 nt, Homo sapiens
uguucugaacacuuua

SEQ ID NO: 2191920 - RNA, 14 nt, Homo sapiens
aaaagugucacuaa

SEQ ID NO: 2191921 - RNA, 14 nt, Homo sapiens
aucccagcuacuca

SEQ ID NO: 2191922 - RNA, 19 nt, Homo sapiens
gucgccacauuucucugca

SEQ ID NO: 2191923 - RNA, 21 nt, Homo sapiens
gacaagagcuguuaugcuguu

SEQ ID NO: 2191924 - RNA, 16 nt, Homo sapiens
cgcucgcucucucgua

SEQ ID NO: 2191925 - RNA, 15 nt, Homo sapiens
cugauucacugcaug

SEQ ID NO: 2191926 - RNA, 20 nt, Homo sapiens
cgggcuuggggcuggccaau

SEQ ID NO: 2191927 - RNA, 16 nt, Homo sapiens
auauguuuauacacac

SEQ ID NO: 2191928 - RNA, 17 nt, Homo sapiens
cccuguaaucaggcaag

SEQ ID NO: 2191929 - RNA, 24 nt, Homo sapiens
cuuccauuaacuuagcauguguug

SEQ ID NO: 2191930 - RNA, 22 nt, Homo sapiens
cagaucacuucaggucaggagu

SEQ ID NO: 2191931 - RNA, 17 nt, Homo sapiens
ccaaacacacuguaaau

SEQ ID NO: 2191932 - RNA, 16 nt, Homo sapiens
gauggcuuugccagcu

SEQ ID NO: 2191933 - RNA, 23 nt, Homo sapiens
uuuauaauaaaaagcuucaggga

SEQ ID NO: 2191934 - RNA, 15 nt, Homo sapiens
agaacuugucccuca

SEQ ID NO: 2191935 - RNA, 22 nt, Homo sapiens
ugcagguuccgauguuauuaga

SEQ ID NO: 2191936 - RNA, 19 nt, Homo sapiens
gggacuaucuuugcugcag

SEQ ID NO: 2191937 - RNA, 17 nt, Homo sapiens
cccagcuccccaagaaa

SEQ ID NO: 2191938 - RNA, 17 nt, Homo sapiens
aucuaagaaaaggggag

SEQ ID NO: 2191939 - RNA, 17 nt, Homo sapiens
uaaaaaucacacuguaa

SEQ ID NO: 2191940 - RNA, 23 nt, Homo sapiens
auucaugaaaacuguuuuuacua

SEQ ID NO: 2191941 - RNA, 13 nt, Homo sapiens
gcuuuugcaacau

SEQ ID NO: 2191942 - RNA, 15 nt, Homo sapiens
acgcccuccccagac

SEQ ID NO: 2191943 - RNA, 13 nt, Homo sapiens
aagagggcuuccu

SEQ ID NO: 2191944 - RNA, 21 nt, Homo sapiens
uuugauuauauacuauguaug

SEQ ID NO: 2191945 - RNA, 22 nt, Homo sapiens
ugacaguuggagggaaagccag

SEQ ID NO: 2191946 - RNA, 15 nt, Homo sapiens
ggccaauaaauauga

SEQ ID NO: 2191947 - RNA, 15 nt, Homo sapiens
cuccccaacaugccc

SEQ ID NO: 2191948 - RNA, 16 nt, Homo sapiens
gccuuccccagggugu

SEQ ID NO: 2191949 - RNA, 14 nt, Homo sapiens
aucucaaagcacaa

SEQ ID NO: 2191950 - RNA, 18 nt, Homo sapiens
uuuuccauccuucaaaua

SEQ ID NO: 2191951 - RNA, 20 nt, Homo sapiens
guauuugaaauaagaauuca

SEQ ID NO: 2191952 - RNA, 11 nt, Homo sapiens
uggccaugaau

SEQ ID NO: 2191953 - RNA, 11 nt, Homo sapiens
aguaauuuugc

SEQ ID NO: 2191954 - RNA, 19 nt, Homo sapiens
ccagaggaaguuauggcag

SEQ ID NO: 2191955 - RNA, 22 nt, Homo sapiens
gcagcuaccagguguucuacac

SEQ ID NO: 2191956 - RNA, 21 nt, Homo sapiens
gagauggugcuaaaccauuca

SEQ ID NO: 2191957 - RNA, 14 nt, Homo sapiens
acaagaauugcuaa

SEQ ID NO: 2191958 - RNA, 19 nt, Homo sapiens
acuagaugacucucaaagg

SEQ ID NO: 2191959 - RNA, 13 nt, Homo sapiens
uucacaucuguau

SEQ ID NO: 2191960 - RNA, 23 nt, Homo sapiens
uauuguagcucaauacaauguga

SEQ ID NO: 2191961 - RNA, 14 nt, Homo sapiens
guucuaacagugaa

SEQ ID NO: 2191962 - RNA, 19 nt, Homo sapiens
accuucaaguauccaauuc

SEQ ID NO: 2191963 - RNA, 15 nt, Homo sapiens
uucaaaacauuccaa

SEQ ID NO: 2191964 - RNA, 15 nt, Homo sapiens
uucucucuucucuca

SEQ ID NO: 2191965 - RNA, 23 nt, Homo sapiens
aggaaggugcuugccugggacca

SEQ ID NO: 2191966 - RNA, 14 nt, Homo sapiens
cagcucauuucacu

SEQ ID NO: 2191967 - RNA, 18 nt, Homo sapiens
uauguagcuaaacauugu

SEQ ID NO: 2191968 - RNA, 15 nt, Homo sapiens
uaguucucacugucu

SEQ ID NO: 2191969 - RNA, 20 nt, Homo sapiens
cucuuaaguuucucagcucc

SEQ ID NO: 2191970 - RNA, 12 nt, Homo sapiens
cagcaggugcca

SEQ ID NO: 2191971 - RNA, 12 nt, Homo sapiens
augaugcaaauu

SEQ ID NO: 2191972 - RNA, 21 nt, Homo sapiens
ugcaguguaacgaugcacuuu

SEQ ID NO: 2191973 - RNA, 14 nt, Homo sapiens
guggcagucgcagg

SEQ ID NO: 2191974 - RNA, 16 nt, Homo sapiens
ugaguuacagccuguu

SEQ ID NO: 2191975 - RNA, 12 nt, Homo sapiens
gugucauagaau

SEQ ID NO: 2191976 - RNA, 22 nt, Homo sapiens
ccagccucaaaaacgcccucaa

SEQ ID NO: 2191977 - RNA, 20 nt, Homo sapiens
gccaacuuucucugcaacua

SEQ ID NO: 2191978 - RNA, 18 nt, Homo sapiens
caccaaaggagacauauc

SEQ ID NO: 2191979 - RNA, 19 nt, Homo sapiens
cuaagaaauguuaucuuuu

SEQ ID NO: 2191980 - RNA, 19 nt, Homo sapiens
agcccauaaagucugagaa

SEQ ID NO: 2191981 - RNA, 18 nt, Homo sapiens
ugcaauaaacucagucaa

SEQ ID NO: 2191982 - RNA, 16 nt, Homo sapiens
cgccuggccccugggc

SEQ ID NO: 2191983 - RNA, 18 nt, Homo sapiens
cuucuaugagcccagauc

SEQ ID NO: 2191984 - RNA, 14 nt, Homo sapiens
ggccccucugcaac

SEQ ID NO: 2191985 - RNA, 19 nt, Homo sapiens
agggacacacgugagccac

SEQ ID NO: 2191986 - RNA, 11 nt, Homo sapiens
ugacacuauuc

SEQ ID NO: 2191987 - RNA, 14 nt, Homo sapiens
cagacaauccacuc

SEQ ID NO: 2191988 - RNA, 20 nt, Homo sapiens
gacaaguuuuguuuccucau

SEQ ID NO: 2191989 - RNA, 13 nt, Homo sapiens
cauauaucuauua

SEQ ID NO: 2191990 - RNA, 12 nt, Homo sapiens
uccccaaagggu

SEQ ID NO: 2191991 - RNA, 21 nt, Homo sapiens
gacugcugcagucacaucaca

SEQ ID NO: 2191992 - RNA, 23 nt, Homo sapiens
ccugcauguuggcccagaccuca

SEQ ID NO: 2191993 - RNA, 18 nt, Homo sapiens
agccacacacccgcucca

SEQ ID NO: 2191994 - RNA, 19 nt, Homo sapiens
auucugccaaaccugugua

SEQ ID NO: 2191995 - RNA, 13 nt, Homo sapiens
auccccaccuacu

SEQ ID NO: 2191996 - RNA, 21 nt, Homo sapiens
acucauccagaccccaugccu

SEQ ID NO: 2191997 - RNA, 18 nt, Homo sapiens
cguuaccgccacacuuga

SEQ ID NO: 2191998 - RNA, 13 nt, Homo sapiens
uuccuuacuugca

SEQ ID NO: 2191999 - RNA, 16 nt, Homo sapiens
gaagaaggaaacaccg

SEQ ID NO: 2192000 - RNA, 22 nt, Homo sapiens
guaccacacuagaauucaugug

SEQ ID NO: 2192001 - RNA, 20 nt, Homo sapiens
guaggagcugagcuuuccag

SEQ ID NO: 2192002 - RNA, 14 nt, Homo sapiens
aacugggaccugag

SEQ ID NO: 2192003 - RNA, 20 nt, Homo sapiens
guugugacagucacugcauu

SEQ ID NO: 2192004 - RNA, 22 nt, Homo sapiens
aagcaggcauugcuuugcccug

SEQ ID NO: 2192005 - RNA, 17 nt, Homo sapiens
ggaaaacagaguauuuc

SEQ ID NO: 2192006 - RNA, 18 nt, Homo sapiens
gaagucaccuuucugggc

SEQ ID NO: 2192007 - RNA, 16 nt, Homo sapiens
gagaagaccucuguga

SEQ ID NO: 2192008 - RNA, 21 nt, Homo sapiens
caacacugucacuagucucac

SEQ ID NO: 2192009 - RNA, 15 nt, Homo sapiens
cagauuuaccauaau

SEQ ID NO: 2192010 - RNA, 14 nt, Homo sapiens
uugcugaacucagc

SEQ ID NO: 2192011 - RNA, 19 nt, Homo sapiens
auuauaagacaaugcugcu

SEQ ID NO: 2192012 - RNA, 21 nt, Homo sapiens
uuguaaauguaagaaagcaua

SEQ ID NO: 2192013 - RNA, 20 nt, Homo sapiens
uacaggaacagaagaggaaa

SEQ ID NO: 2192014 - RNA, 14 nt, Homo sapiens
cuccaaaugucuac

SEQ ID NO: 2192015 - RNA, 20 nt, Homo sapiens
caggcgugagccaccgcgcc

SEQ ID NO: 2192016 - RNA, 19 nt, Homo sapiens
uggauuauaaacaacagaa

SEQ ID NO: 2192017 - RNA, 16 nt, Homo sapiens
aagaagugaccaagga

SEQ ID NO: 2192018 - RNA, 20 nt, Homo sapiens
ccaugucugacuucaaggaa

SEQ ID NO: 2192019 - RNA, 16 nt, Homo sapiens
ucugucuuuucuggga

SEQ ID NO: 2192020 - RNA, 12 nt, Homo sapiens
auguuacuuugg

SEQ ID NO: 2192021 - RNA, 23 nt, Homo sapiens
gucaccugaccucugaagagcug

SEQ ID NO: 2192022 - RNA, 20 nt, Homo sapiens
gcgcguucuggcgacagggg

SEQ ID NO: 2192023 - RNA, 17 nt, Homo sapiens
gaaaaggcugcugugaa

SEQ ID NO: 2192024 - RNA, 15 nt, Homo sapiens
ucucauauacccuau

SEQ ID NO: 2192025 - RNA, 13 nt, Homo sapiens
uacaauacaucug

SEQ ID NO: 2192026 - RNA, 20 nt, Homo sapiens
cuucccaccucucuaccuaa

SEQ ID NO: 2192027 - RNA, 20 nt, Homo sapiens
ccaugccacccuguuuucag

SEQ ID NO: 2192028 - RNA, 22 nt, Homo sapiens
auuuaaagucuugaauguugaa

SEQ ID NO: 2192029 - RNA, 14 nt, Homo sapiens
ucagcacucagaga

SEQ ID NO: 2192030 - RNA, 14 nt, Homo sapiens
ccaacacuuaggga

SEQ ID NO: 2192031 - RNA, 11 nt, Homo sapiens
uauacauuccu

SEQ ID NO: 2192032 - RNA, 17 nt, Homo sapiens
aacccucagcacuguua

SEQ ID NO: 2192033 - RNA, 22 nt, Homo sapiens
uggauaagucacuuaaacucau

SEQ ID NO: 2192034 - RNA, 21 nt, Homo sapiens
ugaccugcccuacauaucuaa

SEQ ID NO: 2192035 - RNA, 20 nt, Homo sapiens
gaugucaucacacucuccau

SEQ ID NO: 2192036 - RNA, 15 nt, Homo sapiens
uugcuuuacauauga

SEQ ID NO: 2192037 - RNA, 23 nt, Homo sapiens
auucacuuauggcagaggaauau

SEQ ID NO: 2192038 - RNA, 15 nt, Homo sapiens
ggaacuuacaaaggg

SEQ ID NO: 2192039 - RNA, 20 nt, Homo sapiens
aguuuaauaaauagcaucua

SEQ ID NO: 2192040 - RNA, 24 nt, Homo sapiens
ugcacuucaagaagucacugucag

SEQ ID NO: 2192041 - RNA, 17 nt, Homo sapiens
ugccaugucuuguucag

SEQ ID NO: 2192042 - RNA, 21 nt, Homo sapiens
agaguucuccuuguacuugaa

SEQ ID NO: 2192043 - RNA, 20 nt, Homo sapiens
cugggccuggagggggagca

SEQ ID NO: 2192044 - RNA, 20 nt, Homo sapiens
aucaaguauuuuugacauuu

SEQ ID NO: 2192045 - RNA, 18 nt, Homo sapiens
cugaagucugagcccauu

SEQ ID NO: 2192046 - RNA, 23 nt, Homo sapiens
acagcucuccuccagcccugggc

SEQ ID NO: 2192047 - RNA, 13 nt, Homo sapiens
cuuaauuuggaaa

SEQ ID NO: 2192048 - RNA, 17 nt, Homo sapiens
ugucuuaaccucaggga

SEQ ID NO: 2192049 - RNA, 18 nt, Homo sapiens
cacaaagcccuuccaugu

SEQ ID NO: 2192050 - RNA, 15 nt, Homo sapiens
cagggagcuugccac

SEQ ID NO: 2192051 - RNA, 17 nt, Homo sapiens
ucaaaaaaucugaccaa

SEQ ID NO: 2192052 - RNA, 14 nt, Homo sapiens
auuuagucacugaa

SEQ ID NO: 2192053 - RNA, 22 nt, Homo sapiens
cccaugccgacggggacugcuu

SEQ ID NO: 2192054 - RNA, 23 nt, Homo sapiens
cuaguuugcucauacuacauuga

SEQ ID NO: 2192055 - RNA, 12 nt, Homo sapiens
cacaagucuccu

SEQ ID NO: 2192056 - RNA, 15 nt, Homo sapiens
acugacauggugcug

SEQ ID NO: 2192057 - RNA, 16 nt, Homo sapiens
gcucuucugacauuua

SEQ ID NO: 2192058 - RNA, 18 nt, Homo sapiens
aauauuaaaaaacuucau

SEQ ID NO: 2192059 - RNA, 20 nt, Homo sapiens
gaggagccggugcucuggaa

SEQ ID NO: 2192060 - RNA, 16 nt, Homo sapiens
gaauauaauguguuag

SEQ ID NO: 2192061 - RNA, 17 nt, Homo sapiens
acucucaggcauggaug

SEQ ID NO: 2192062 - RNA, 15 nt, Homo sapiens
cagcgcuguauuuac

SEQ ID NO: 2192063 - RNA, 18 nt, Homo sapiens
agcacacucccuguggga

SEQ ID NO: 2192064 - RNA, 17 nt, Homo sapiens
cuuagucccucaugcaa

SEQ ID NO: 2192065 - RNA, 18 nt, Homo sapiens
aacuaauaaaaccucuaa

SEQ ID NO: 2192066 - RNA, 22 nt, Homo sapiens
uagacgaggccacagcugccau

SEQ ID NO: 2192067 - RNA, 18 nt, Homo sapiens
auggcaacaaacacauug

SEQ ID NO: 2192068 - RNA, 15 nt, Homo sapiens
aucauugcaccugca

SEQ ID NO: 2192069 - RNA, 10 nt, Homo sapiens
ugaccaaaua

SEQ ID NO: 2192070 - RNA, 19 nt, Homo sapiens
uaaaacauuggcauuugaa

SEQ ID NO: 2192071 - RNA, 22 nt, Homo sapiens
cugcuggugccagggugggugu

SEQ ID NO: 2192072 - RNA, 18 nt, Homo sapiens
auccaacuuucacaguga

SEQ ID NO: 2192073 - RNA, 13 nt, Homo sapiens
ccuaccugacugc

SEQ ID NO: 2192074 - RNA, 15 nt, Homo sapiens
cuaccacagugucug

SEQ ID NO: 2192075 - RNA, 12 nt, Homo sapiens
cgcccucagggg

SEQ ID NO: 2192076 - RNA, 17 nt, Homo sapiens
acagccucacuccucag

SEQ ID NO: 2192077 - RNA, 19 nt, Homo sapiens
uuacuauauucuuacccua

SEQ ID NO: 2192078 - RNA, 20 nt, Homo sapiens
ggcuggaguguaguggcaca

SEQ ID NO: 2192079 - RNA, 21 nt, Homo sapiens
aaucccagggaaggacuugga

SEQ ID NO: 2192080 - RNA, 17 nt, Homo sapiens
ugaauaaaguacuacau

SEQ ID NO: 2192081 - RNA, 23 nt, Homo sapiens
aaggauguuauuuauauauucuu

SEQ ID NO: 2192082 - RNA, 18 nt, Homo sapiens
auccuggcuaacacguga

SEQ ID NO: 2192083 - RNA, 20 nt, Homo sapiens
cugauuagaaaugaccaaua

SEQ ID NO: 2192084 - RNA, 17 nt, Homo sapiens
auaacagccucuugccc

SEQ ID NO: 2192085 - RNA, 17 nt, Homo sapiens
ugccucucugcuccaga

SEQ ID NO: 2192086 - RNA, 16 nt, Homo sapiens
aaauaauugauuucaa

SEQ ID NO: 2192087 - RNA, 15 nt, Homo sapiens
auauguccuauucau

SEQ ID NO: 2192088 - RNA, 16 nt, Homo sapiens
gugacacucuauaaga

SEQ ID NO: 2192089 - RNA, 19 nt, Homo sapiens
uagcccaaccuacauucca

SEQ ID NO: 2192090 - RNA, 14 nt, Homo sapiens
acuuuguacauuug

SEQ ID NO: 2192091 - RNA, 17 nt, Homo sapiens
aucugugaugacauucc

SEQ ID NO: 2192092 - RNA, 16 nt, Homo sapiens
gcgggaggcaccagcu

SEQ ID NO: 2192093 - RNA, 13 nt, Homo sapiens
ucugcuauggaau

SEQ ID NO: 2192094 - RNA, 18 nt, Homo sapiens
uugaacuacagcuugaga

SEQ ID NO: 2192095 - RNA, 15 nt, Homo sapiens
guuucuccacaacag

SEQ ID NO: 2192096 - RNA, 23 nt, Homo sapiens
ugaucagaaaaauaauuccauaa

SEQ ID NO: 2192097 - RNA, 15 nt, Homo sapiens
cauaacuucucaugu

SEQ ID NO: 2192098 - RNA, 18 nt, Homo sapiens
ugaaaaucaguuauauuc

SEQ ID NO: 2192099 - RNA, 21 nt, Homo sapiens
gugcuuaccugugacagcagc

SEQ ID NO: 2192100 - RNA, 13 nt, Homo sapiens
caggcaccugcca

SEQ ID NO: 2192101 - RNA, 20 nt, Homo sapiens
uuuuauggaggcuuugcaua

SEQ ID NO: 2192102 - RNA, 23 nt, Homo sapiens
ccugcccaggguuggcaugacug

SEQ ID NO: 2192103 - RNA, 16 nt, Homo sapiens
auauuguuuucagugu

SEQ ID NO: 2192104 - RNA, 13 nt, Homo sapiens
aacugaacuguaa

SEQ ID NO: 2192105 - RNA, 23 nt, Homo sapiens
ccauucgguguggugcaguguga

SEQ ID NO: 2192106 - RNA, 21 nt, Homo sapiens
aaaaaugguuuaaauggucaa

SEQ ID NO: 2192107 - RNA, 14 nt, Homo sapiens
agucucacaugucc

SEQ ID NO: 2192108 - RNA, 14 nt, Homo sapiens
augcuaacaguuca

SEQ ID NO: 2192109 - RNA, 23 nt, Homo sapiens
auuuuuuucccuugguguugccc

SEQ ID NO: 2192110 - RNA, 13 nt, Homo sapiens
aggaaacaaccau

SEQ ID NO: 2192111 - RNA, 13 nt, Homo sapiens
ggcgagcacuuuc

SEQ ID NO: 2192112 - RNA, 14 nt, Homo sapiens
ucaaaucucuucca

SEQ ID NO: 2192113 - RNA, 19 nt, Homo sapiens
gccaggcucccacugcccc

SEQ ID NO: 2192114 - RNA, 13 nt, Homo sapiens
gcuccuguuucca

SEQ ID NO: 2192115 - RNA, 11 nt, Homo sapiens
cugcugugaau

SEQ ID NO: 2192116 - RNA, 19 nt, Homo sapiens
gcacgggcccgugacaucc

SEQ ID NO: 2192117 - RNA, 13 nt, Homo sapiens
uucccuacuccau

SEQ ID NO: 2192118 - RNA, 15 nt, Homo sapiens
agagccaauggugca

SEQ ID NO: 2192119 - RNA, 13 nt, Homo sapiens
uaaaugacaauuu

SEQ ID NO: 2192120 - RNA, 16 nt, Homo sapiens
cuuuaacagcuuucuc

SEQ ID NO: 2192121 - RNA, 15 nt, Homo sapiens
uuaggugucuguccu

SEQ ID NO: 2192122 - RNA, 18 nt, Homo sapiens
ugauuuguagcacugagg

SEQ ID NO: 2192123 - RNA, 23 nt, Homo sapiens
augaauuugggauacuaaaguag

SEQ ID NO: 2192124 - RNA, 14 nt, Homo sapiens
acacugacuugaga

SEQ ID NO: 2192125 - RNA, 20 nt, Homo sapiens
ucuauuacaccuuuaucuca

SEQ ID NO: 2192126 - RNA, 22 nt, Homo sapiens
gacacacuggagaaaaggcagu

SEQ ID NO: 2192127 - RNA, 14 nt, Homo sapiens
cugaaguacuuaaa

SEQ ID NO: 2192128 - RNA, 14 nt, Homo sapiens
uagcaauauaucag

SEQ ID NO: 2192129 - RNA, 19 nt, Homo sapiens
acuggcaggaaaguccuug

SEQ ID NO: 2192130 - RNA, 12 nt, Homo sapiens
agagugaauuau

SEQ ID NO: 2192131 - RNA, 19 nt, Homo sapiens
gcaguuggccaagcagaaa

SEQ ID NO: 2192132 - RNA, 13 nt, Homo sapiens
cuuuuuccacaag

SEQ ID NO: 2192133 - RNA, 16 nt, Homo sapiens
uuaucacuaagaaaga

SEQ ID NO: 2192134 - RNA, 19 nt, Homo sapiens
ccccagcccccuggcaugu

SEQ ID NO: 2192135 - RNA, 16 nt, Homo sapiens
aaaaauguuugucuca

SEQ ID NO: 2192136 - RNA, 18 nt, Homo sapiens
augggcagggaaggaauc

SEQ ID NO: 2192137 - RNA, 16 nt, Homo sapiens
acuaugugaugccucu

SEQ ID NO: 2192138 - RNA, 16 nt, Homo sapiens
cagcaggcucucaggc

SEQ ID NO: 2192139 - RNA, 14 nt, Homo sapiens
uaauuaaaugcuca

SEQ ID NO: 2192140 - RNA, 11 nt, Homo sapiens
cuuuugcacau

SEQ ID NO: 2192141 - RNA, 12 nt, Homo sapiens
ggugaauaugca

SEQ ID NO: 2192142 - RNA, 20 nt, Homo sapiens
ucaguuucaauucagugcug

SEQ ID NO: 2192143 - RNA, 16 nt, Homo sapiens
ugucacuuugcuacag

SEQ ID NO: 2192144 - RNA, 19 nt, Homo sapiens
cugauuuagccaugugaaa

SEQ ID NO: 2192145 - RNA, 22 nt, Homo sapiens
ccucccagauggcuucggaggg

SEQ ID NO: 2192146 - RNA, 17 nt, Homo sapiens
gagaaaagaaaccagag

SEQ ID NO: 2192147 - RNA, 22 nt, Homo sapiens
caaccaagaggauuucuucaaa

SEQ ID NO: 2192148 - RNA, 17 nt, Homo sapiens
gaugaaauuaaccauuu

SEQ ID NO: 2192149 - RNA, 23 nt, Homo sapiens
cacgcagucugcuucagugcagu

SEQ ID NO: 2192150 - RNA, 23 nt, Homo sapiens
ugguccacacaccacagaagcuu

SEQ ID NO: 2192151 - RNA, 14 nt, Homo sapiens
gaauaaagccuuuu

SEQ ID NO: 2192152 - RNA, 15 nt, Homo sapiens
uacauuuucagugag

SEQ ID NO: 2192153 - RNA, 13 nt, Homo sapiens
gccaagggggacc

SEQ ID NO: 2192154 - RNA, 18 nt, Homo sapiens
ccuguccugccuccucau

SEQ ID NO: 2192155 - RNA, 13 nt, Homo sapiens
ucuucagcauuua

SEQ ID NO: 2192156 - RNA, 12 nt, Homo sapiens
auucaaaugcau

SEQ ID NO: 2192157 - RNA, 22 nt, Homo sapiens
uaacuguauuuucuuucacuuu

SEQ ID NO: 2192158 - RNA, 18 nt, Homo sapiens
cucacaccuguccuucuc

SEQ ID NO: 2192159 - RNA, 19 nt, Homo sapiens
cuuuggcaggccucccuuu

SEQ ID NO: 2192160 - RNA, 20 nt, Homo sapiens
aagcaguaagcuaucuucaa

SEQ ID NO: 2192161 - RNA, 17 nt, Homo sapiens
uggcuucaaauuguaag

SEQ ID NO: 2192162 - RNA, 15 nt, Homo sapiens
cucuaggauggggca

SEQ ID NO: 2192163 - RNA, 18 nt, Homo sapiens
agaccccuuuaaacuguc

SEQ ID NO: 2192164 - RNA, 17 nt, Homo sapiens
uuuggucuccucuucca

SEQ ID NO: 2192165 - RNA, 13 nt, Homo sapiens
ccacuucacaguu

SEQ ID NO: 2192166 - RNA, 23 nt, Homo sapiens
agccacacugcgcgcggggcccg

SEQ ID NO: 2192167 - RNA, 23 nt, Homo sapiens
agguaguagaaucucagcacuuu

SEQ ID NO: 2192168 - RNA, 21 nt, Homo sapiens
ucugcaguucucaugacuccu

SEQ ID NO: 2192169 - RNA, 22 nt, Homo sapiens
acuguccaagugccacaugccu

SEQ ID NO: 2192170 - RNA, 15 nt, Homo sapiens
gcuagaaggcaaagu

SEQ ID NO: 2192171 - RNA, 15 nt, Homo sapiens
acaaaaugacuagga

SEQ ID NO: 2192172 - RNA, 15 nt, Homo sapiens
aaagcauucuucccu

SEQ ID NO: 2192173 - RNA, 15 nt, Homo sapiens
ccaaccucuggagca

SEQ ID NO: 2192174 - RNA, 11 nt, Homo sapiens
ugcuguagaag

SEQ ID NO: 2192175 - RNA, 13 nt, Homo sapiens
cugugcugugagu

SEQ ID NO: 2192176 - RNA, 18 nt, Homo sapiens
gccugcuggccgacccac

SEQ ID NO: 2192177 - RNA, 14 nt, Homo sapiens
cugccacucaggcc

SEQ ID NO: 2192178 - RNA, 14 nt, Homo sapiens
cuagaacagucucu

SEQ ID NO: 2192179 - RNA, 13 nt, Homo sapiens
ugcugcucucuca

SEQ ID NO: 2192180 - RNA, 13 nt, Homo sapiens
acuugcucagcca

SEQ ID NO: 2192181 - RNA, 22 nt, Homo sapiens
gaccuuuaggucaaacucccua

SEQ ID NO: 2192182 - RNA, 15 nt, Homo sapiens
uuauagcaacuuuaa

SEQ ID NO: 2192183 - RNA, 18 nt, Homo sapiens
uccuguggagacacugag

SEQ ID NO: 2192184 - RNA, 19 nt, Homo sapiens
uugaagaaaggaaccuggg

SEQ ID NO: 2192185 - RNA, 19 nt, Homo sapiens
ugauagcuugggauuuaaa

SEQ ID NO: 2192186 - RNA, 20 nt, Homo sapiens
aauucuguggcaguuuuaaa

SEQ ID NO: 2192187 - RNA, 20 nt, Homo sapiens
aucgucacugcuuaacuuca

SEQ ID NO: 2192188 - RNA, 12 nt, Homo sapiens
auucaguacaac

SEQ ID NO: 2192189 - RNA, 20 nt, Homo sapiens
agucaagggugugugcagca

SEQ ID NO: 2192190 - RNA, 20 nt, Homo sapiens
uccagugccagcaaugacau

SEQ ID NO: 2192191 - RNA, 22 nt, Homo sapiens
aguuguauucagcguacuugaa

SEQ ID NO: 2192192 - RNA, 12 nt, Homo sapiens
auguuucacugu

SEQ ID NO: 2192193 - RNA, 12 nt, Homo sapiens
aagguucacagg

SEQ ID NO: 2192194 - RNA, 13 nt, Homo sapiens
acauaauucuucc

SEQ ID NO: 2192195 - RNA, 16 nt, Homo sapiens
gcaccaccucugucac

SEQ ID NO: 2192196 - RNA, 15 nt, Homo sapiens
aggaauacauugcaa

SEQ ID NO: 2192197 - RNA, 23 nt, Homo sapiens
ccauaguggagagaacugaauaa

SEQ ID NO: 2192198 - RNA, 20 nt, Homo sapiens
gggaaaagauuacugaaaua

SEQ ID NO: 2192199 - RNA, 17 nt, Homo sapiens
gcuaguccucacuucua

SEQ ID NO: 2192200 - RNA, 14 nt, Homo sapiens
uaugugcaaguuua

SEQ ID NO: 2192201 - RNA, 17 nt, Homo sapiens
gaaauuuaagacuagau

SEQ ID NO: 2192202 - RNA, 12 nt, Homo sapiens
aaguacuuucuu

SEQ ID NO: 2192203 - RNA, 20 nt, Homo sapiens
gacauuacaauccugcauug

SEQ ID NO: 2192204 - RNA, 16 nt, Homo sapiens
ggcccaggguguuugc

SEQ ID NO: 2192205 - RNA, 12 nt, Homo sapiens
aguaacauuugc

SEQ ID NO: 2192206 - RNA, 15 nt, Homo sapiens
ucucagcugaaauua

SEQ ID NO: 2192207 - RNA, 15 nt, Homo sapiens
acacaagugcacaga

SEQ ID NO: 2192208 - RNA, 23 nt, Homo sapiens
gaaacugagguauggccaugccc

SEQ ID NO: 2192209 - RNA, 15 nt, Homo sapiens
caaaaauuaguaaua

SEQ ID NO: 2192210 - RNA, 18 nt, Homo sapiens
ggucaccaugccaaugaa

SEQ ID NO: 2192211 - RNA, 16 nt, Homo sapiens
uuuuggcucucccacc

SEQ ID NO: 2192212 - RNA, 18 nt, Homo sapiens
ggccugccuucucaggga

SEQ ID NO: 2192213 - RNA, 16 nt, Homo sapiens
uccuccacacaaggga

SEQ ID NO: 2192214 - RNA, 17 nt, Homo sapiens
cauaaaugaaucaucaa

SEQ ID NO: 2192215 - RNA, 20 nt, Homo sapiens
uccagaacuaccaccugaca

SEQ ID NO: 2192216 - RNA, 19 nt, Homo sapiens
gcaaccaauaaaaguguca

SEQ ID NO: 2192217 - RNA, 19 nt, Homo sapiens
acccugggcuuccugagcc

SEQ ID NO: 2192218 - RNA, 14 nt, Homo sapiens
aaaacauaaacuga

SEQ ID NO: 2192219 - RNA, 17 nt, Homo sapiens
caccacugcacuccagc

SEQ ID NO: 2192220 - RNA, 23 nt, Homo sapiens
ccaagcccuggagccaacugcug

SEQ ID NO: 2192221 - RNA, 16 nt, Homo sapiens
ugauugaaccagcuca

SEQ ID NO: 2192222 - RNA, 21 nt, Homo sapiens
auuuuauacacagauucugcc

SEQ ID NO: 2192223 - RNA, 21 nt, Homo sapiens
uuguaaaaacaaagugcuaaa

SEQ ID NO: 2192224 - RNA, 16 nt, Homo sapiens
ccucaacaugguccuu

SEQ ID NO: 2192225 - RNA, 17 nt, Homo sapiens
auucuuuaauuuuggaa

SEQ ID NO: 2192226 - RNA, 16 nt, Homo sapiens
ucauaauucagcacuu

SEQ ID NO: 2192227 - RNA, 15 nt, Homo sapiens
cacgucacaaagacc

SEQ ID NO: 2192228 - RNA, 17 nt, Homo sapiens
acguggcucagccagca

SEQ ID NO: 2192229 - RNA, 17 nt, Homo sapiens
gacagaucacaggguga

SEQ ID NO: 2192230 - RNA, 15 nt, Homo sapiens
ucuuggagaauauca

SEQ ID NO: 2192231 - RNA, 22 nt, Homo sapiens
gggcagagccuuccacagugaa

SEQ ID NO: 2192232 - RNA, 18 nt, Homo sapiens
cuuagaugggcauggugg

SEQ ID NO: 2192233 - RNA, 13 nt, Homo sapiens
gggcacacacugu

SEQ ID NO: 2192234 - RNA, 17 nt, Homo sapiens
auguccauaugcaucua

SEQ ID NO: 2192235 - RNA, 20 nt, Homo sapiens
ucccaagcuagacugugucu

SEQ ID NO: 2192236 - RNA, 14 nt, Homo sapiens
cuuuugacauuuua

SEQ ID NO: 2192237 - RNA, 14 nt, Homo sapiens
caggggacaaggga

SEQ ID NO: 2192238 - RNA, 13 nt, Homo sapiens
uucuucugggaac

SEQ ID NO: 2192239 - RNA, 20 nt, Homo sapiens
gcccacccacuccuuauauu

SEQ ID NO: 2192240 - RNA, 18 nt, Homo sapiens
ggccggugcgacccaguu

SEQ ID NO: 2192241 - RNA, 19 nt, Homo sapiens
gacucuuuugagugguaau

SEQ ID NO: 2192242 - RNA, 15 nt, Homo sapiens
caucugacacugaca

SEQ ID NO: 2192243 - RNA, 12 nt, Homo sapiens
auaauacuguau

SEQ ID NO: 2192244 - RNA, 21 nt, Homo sapiens
cuaaccgacauuccugaaaua

SEQ ID NO: 2192245 - RNA, 23 nt, Homo sapiens
gacacauuagccuugaacaacca

SEQ ID NO: 2192246 - RNA, 22 nt, Homo sapiens
cugacacaggccagccuuggca

SEQ ID NO: 2192247 - RNA, 18 nt, Homo sapiens
uuaaaauagcuuugcagu

SEQ ID NO: 2192248 - RNA, 15 nt, Homo sapiens
uccagagaugacuau

SEQ ID NO: 2192249 - RNA, 20 nt, Homo sapiens
ucugcaacaaaaagucauuu

SEQ ID NO: 2192250 - RNA, 13 nt, Homo sapiens
uggaugaucucaa

SEQ ID NO: 2192251 - RNA, 21 nt, Homo sapiens
ugcccaaggccuaccccaguu

SEQ ID NO: 2192252 - RNA, 14 nt, Homo sapiens
caugaauuugugaa

SEQ ID NO: 2192253 - RNA, 21 nt, Homo sapiens
ggugauuggccacacacugag

SEQ ID NO: 2192254 - RNA, 19 nt, Homo sapiens
ccucaaccaacaacaaugu

SEQ ID NO: 2192255 - RNA, 11 nt, Homo sapiens
cagcccauucc

SEQ ID NO: 2192256 - RNA, 21 nt, Homo sapiens
uuguaaugccacucauacuca

SEQ ID NO: 2192257 - RNA, 13 nt, Homo sapiens
uaucauagauuua

SEQ ID NO: 2192258 - RNA, 18 nt, Homo sapiens
acuaauagaaaaguaugu

SEQ ID NO: 2192259 - RNA, 20 nt, Homo sapiens
cucaaauuggugaacagugu

SEQ ID NO: 2192260 - RNA, 20 nt, Homo sapiens
aguuugagacaggagaccug

SEQ ID NO: 2192261 - RNA, 22 nt, Homo sapiens
accuagguggggccugggguag

SEQ ID NO: 2192262 - RNA, 19 nt, Homo sapiens
cuucucuuauucuuuacaa

SEQ ID NO: 2192263 - RNA, 12 nt, Homo sapiens
uaaccccauuca

SEQ ID NO: 2192264 - RNA, 22 nt, Homo sapiens
cuucaaggcucuucuuccucac

SEQ ID NO: 2192265 - RNA, 14 nt, Homo sapiens
cagugaacaguuug

SEQ ID NO: 2192266 - RNA, 15 nt, Homo sapiens
cuguguacuuuucaa

SEQ ID NO: 2192267 - RNA, 21 nt, Homo sapiens
uuacaguggaauugugaauaa

SEQ ID NO: 2192268 - RNA, 20 nt, Homo sapiens
agcucgggcccucugugaga

SEQ ID NO: 2192269 - RNA, 22 nt, Homo sapiens
cugagaccacccccaaacacaa

SEQ ID NO: 2192270 - RNA, 15 nt, Homo sapiens
agcagcugcagcuca

SEQ ID NO: 2192271 - RNA, 21 nt, Homo sapiens
ugcuaaagcccgggcacccgc

SEQ ID NO: 2192272 - RNA, 20 nt, Homo sapiens
gcuccucccucugacccaga

SEQ ID NO: 2192273 - RNA, 22 nt, Homo sapiens
guuaaaaauaaaaaacauauac

SEQ ID NO: 2192274 - RNA, 19 nt, Homo sapiens
gcucccguacugucugugu

SEQ ID NO: 2192275 - RNA, 21 nt, Homo sapiens
cuucaugguccgccugccuca

SEQ ID NO: 2192276 - RNA, 22 nt, Homo sapiens
ugccagggcuggaagcuuucau

SEQ ID NO: 2192277 - RNA, 15 nt, Homo sapiens
cuggaagcauuuguu

SEQ ID NO: 2192278 - RNA, 22 nt, Homo sapiens
uguaauuuaagugacacagaca

SEQ ID NO: 2192279 - RNA, 13 nt, Homo sapiens
aguuguguugaca

SEQ ID NO: 2192280 - RNA, 16 nt, Homo sapiens
gcuuuugugucccauu

SEQ ID NO: 2192281 - RNA, 17 nt, Homo sapiens
aaccacagcacuugagu

SEQ ID NO: 2192282 - RNA, 20 nt, Homo sapiens
uugugauuuuuauaauacaa

SEQ ID NO: 2192283 - RNA, 20 nt, Homo sapiens
gcaaaauuugaugccaggac

SEQ ID NO: 2192284 - RNA, 13 nt, Homo sapiens
ccaaauacaagua

SEQ ID NO: 2192285 - RNA, 18 nt, Homo sapiens
ugucuuggacccaccuga

SEQ ID NO: 2192286 - RNA, 20 nt, Homo sapiens
uauuauaauaagcaaaaaga

SEQ ID NO: 2192287 - RNA, 18 nt, Homo sapiens
guuuaaugggcacagggu

SEQ ID NO: 2192288 - RNA, 20 nt, Homo sapiens
aaacaacuucaauauccaaa

SEQ ID NO: 2192289 - RNA, 10 nt, Homo sapiens
uugggcucca

SEQ ID NO: 2192290 - RNA, 16 nt, Homo sapiens
uggcuuccugcugagu

SEQ ID NO: 2192291 - RNA, 22 nt, Homo sapiens
aguaccacacugaguucuauca

SEQ ID NO: 2192292 - RNA, 20 nt, Homo sapiens
augagucacuuacuucauau

SEQ ID NO: 2192293 - RNA, 14 nt, Homo sapiens
guugaaaaccacag

SEQ ID NO: 2192294 - RNA, 19 nt, Homo sapiens
uaaggauguagcuuuucac

SEQ ID NO: 2192295 - RNA, 14 nt, Homo sapiens
ucuagccuuuccua

SEQ ID NO: 2192296 - RNA, 16 nt, Homo sapiens
gaacagcuaauuguac

SEQ ID NO: 2192297 - RNA, 15 nt, Homo sapiens
cuucauuccaaucua

SEQ ID NO: 2192298 - RNA, 21 nt, Homo sapiens
uaccccgauccguuugcaaga

SEQ ID NO: 2192299 - RNA, 13 nt, Homo sapiens
guuaauugcaguc

SEQ ID NO: 2192300 - RNA, 22 nt, Homo sapiens
ucuaaaaaaauaaacaaaguga

SEQ ID NO: 2192301 - RNA, 20 nt, Homo sapiens
aggcugacaugcucacacau

SEQ ID NO: 2192302 - RNA, 16 nt, Homo sapiens
cuacuguucuugacaa

SEQ ID NO: 2192303 - RNA, 21 nt, Homo sapiens
uccugggggcccauucugcau

SEQ ID NO: 2192304 - RNA, 11 nt, Homo sapiens
cagagcugcca

SEQ ID NO: 2192305 - RNA, 22 nt, Homo sapiens
ucuuugcaggaggcccaaccuc

SEQ ID NO: 2192306 - RNA, 14 nt, Homo sapiens
aaaccaaggcuaga

SEQ ID NO: 2192307 - RNA, 21 nt, Homo sapiens
agcaaugcuucuaucaaauac

SEQ ID NO: 2192308 - RNA, 18 nt, Homo sapiens
caagauccuuaaugcaga

SEQ ID NO: 2192309 - RNA, 13 nt, Homo sapiens
gcccccaaagagu

SEQ ID NO: 2192310 - RNA, 19 nt, Homo sapiens
cauauguagaaacauuuag

SEQ ID NO: 2192311 - RNA, 14 nt, Homo sapiens
auaugauugugcac

SEQ ID NO: 2192312 - RNA, 21 nt, Homo sapiens
auguagaauauauuuccuuau

SEQ ID NO: 2192313 - RNA, 16 nt, Homo sapiens
gcggggaucaucugcc

SEQ ID NO: 2192314 - RNA, 12 nt, Homo sapiens
aagaaaguuuau

SEQ ID NO: 2192315 - RNA, 18 nt, Homo sapiens
ggaggcaccaaacaccca

SEQ ID NO: 2192316 - RNA, 22 nt, Homo sapiens
caguccaggaugcuaacaucua

SEQ ID NO: 2192317 - RNA, 21 nt, Homo sapiens
auuauggaaguuuucuucuau

SEQ ID NO: 2192318 - RNA, 19 nt, Homo sapiens
agaacuuuucuuacuagcu

SEQ ID NO: 2192319 - RNA, 22 nt, Homo sapiens
uuaaguaaucuuuuuacaguug

SEQ ID NO: 2192320 - RNA, 16 nt, Homo sapiens
auuugugucacuguac

SEQ ID NO: 2192321 - RNA, 13 nt, Homo sapiens
ccugcuggagaaa

SEQ ID NO: 2192322 - RNA, 13 nt, Homo sapiens
uccaagaacaauu

SEQ ID NO: 2192323 - RNA, 13 nt, Homo sapiens
ugcagaaccagca

SEQ ID NO: 2192324 - RNA, 16 nt, Homo sapiens
ucuauauccuugacac

SEQ ID NO: 2192325 - RNA, 13 nt, Homo sapiens
aggggcaguggcc

SEQ ID NO: 2192326 - RNA, 15 nt, Homo sapiens
gauagucucauucug

SEQ ID NO: 2192327 - RNA, 13 nt, Homo sapiens
ccguccauucuuc

SEQ ID NO: 2192328 - RNA, 22 nt, Homo sapiens
guaaaauagucaugauucuaug

SEQ ID NO: 2192329 - RNA, 18 nt, Homo sapiens
aaguagguuuacauucau

SEQ ID NO: 2192330 - RNA, 14 nt, Homo sapiens
ccaucuagccauuu

SEQ ID NO: 2192331 - RNA, 17 nt, Homo sapiens
cugggcuggaugagcuc

SEQ ID NO: 2192332 - RNA, 21 nt, Homo sapiens
uaaaggaaaauaauguuugau

SEQ ID NO: 2192333 - RNA, 20 nt, Homo sapiens
cgggaggaggaggagcaccu

SEQ ID NO: 2192334 - RNA, 18 nt, Homo sapiens
acuucuccccucaagaaa

SEQ ID NO: 2192335 - RNA, 14 nt, Homo sapiens
ccuccaaggggcuu

SEQ ID NO: 2192336 - RNA, 14 nt, Homo sapiens
ucucccaaagccau

SEQ ID NO: 2192337 - RNA, 18 nt, Homo sapiens
cuccuuccagcacugacu

SEQ ID NO: 2192338 - RNA, 16 nt, Homo sapiens
cuuggaaccuaagguu

SEQ ID NO: 2192339 - RNA, 23 nt, Homo sapiens
accugcugagaaaacaugccucu

SEQ ID NO: 2192340 - RNA, 13 nt, Homo sapiens
caaaauaccagcu

SEQ ID NO: 2192341 - RNA, 15 nt, Homo sapiens
aauauucugaaucac

SEQ ID NO: 2192342 - RNA, 11 nt, Homo sapiens
auuaugcagcu

SEQ ID NO: 2192343 - RNA, 20 nt, Homo sapiens
uacaugugugggugcugaua

SEQ ID NO: 2192344 - RNA, 14 nt, Homo sapiens
cucuccuugccugg

SEQ ID NO: 2192345 - RNA, 21 nt, Homo sapiens
ccucuuccgugacgucacugg

SEQ ID NO: 2192346 - RNA, 15 nt, Homo sapiens
ugcugcaugcgacag

SEQ ID NO: 2192347 - RNA, 12 nt, Homo sapiens
cuaucagcaaug

SEQ ID NO: 2192348 - RNA, 17 nt, Homo sapiens
cacagcuggcucugaca

SEQ ID NO: 2192349 - RNA, 13 nt, Homo sapiens
uccuuaauccuga

SEQ ID NO: 2192350 - RNA, 17 nt, Homo sapiens
agguauuggauuuucac

SEQ ID NO: 2192351 - RNA, 22 nt, Homo sapiens
gcuucaugcaauccuuccaaau

SEQ ID NO: 2192352 - RNA, 22 nt, Homo sapiens
uugaccacguuuauguuuaaau

SEQ ID NO: 2192353 - RNA, 15 nt, Homo sapiens
ucccucuacugggag

SEQ ID NO: 2192354 - RNA, 18 nt, Homo sapiens
ucaccuuuucccuuucau

SEQ ID NO: 2192355 - RNA, 21 nt, Homo sapiens
aaucacauguaauccaaagac

SEQ ID NO: 2192356 - RNA, 22 nt, Homo sapiens
aaagcaguguuuucaccucaua

SEQ ID NO: 2192357 - RNA, 18 nt, Homo sapiens
agcaguaccggccaagca

SEQ ID NO: 2192358 - RNA, 22 nt, Homo sapiens
gaggucccugcugccagcuuca

SEQ ID NO: 2192359 - RNA, 16 nt, Homo sapiens
ccagcccugggaacca

SEQ ID NO: 2192360 - RNA, 17 nt, Homo sapiens
agauuuacugggccuga

SEQ ID NO: 2192361 - RNA, 13 nt, Homo sapiens
agaggaauuccuc

SEQ ID NO: 2192362 - RNA, 16 nt, Homo sapiens
uugagugucuucuaac

SEQ ID NO: 2192363 - RNA, 21 nt, Homo sapiens
gccaggucccuuucauuugcu

SEQ ID NO: 2192364 - RNA, 16 nt, Homo sapiens
agugcuuccacuucua

SEQ ID NO: 2192365 - RNA, 16 nt, Homo sapiens
caugcuaugugcacag

SEQ ID NO: 2192366 - RNA, 16 nt, Homo sapiens
uuccagcucaguccca

SEQ ID NO: 2192367 - RNA, 22 nt, Homo sapiens
agcagccuguacuagcuuuuga

SEQ ID NO: 2192368 - RNA, 11 nt, Homo sapiens
acucugaagaa

SEQ ID NO: 2192369 - RNA, 22 nt, Homo sapiens
acugaaaaugauuccuggacau

SEQ ID NO: 2192370 - RNA, 14 nt, Homo sapiens
cccagaaguggcua

SEQ ID NO: 2192371 - RNA, 21 nt, Homo sapiens
auggaaauaguacuaaaggcu

SEQ ID NO: 2192372 - RNA, 20 nt, Homo sapiens
ucaaugugauauaaacagcu

SEQ ID NO: 2192373 - RNA, 19 nt, Homo sapiens
gaggggucuauagguuugu

SEQ ID NO: 2192374 - RNA, 21 nt, Homo sapiens
acucauuucaaguuaugauuc

SEQ ID NO: 2192375 - RNA, 22 nt, Homo sapiens
gcucuaacaaugacauuuauau

SEQ ID NO: 2192376 - RNA, 18 nt, Homo sapiens
gagugcccccaacagcac

SEQ ID NO: 2192377 - RNA, 19 nt, Homo sapiens
cucuuguaaauacaugucc

SEQ ID NO: 2192378 - RNA, 18 nt, Homo sapiens
gacaagcgccgcugugag

SEQ ID NO: 2192379 - RNA, 11 nt, Homo sapiens
aaaugucacuu

SEQ ID NO: 2192380 - RNA, 21 nt, Homo sapiens
ucugccuccccuucacuccca

SEQ ID NO: 2192381 - RNA, 22 nt, Homo sapiens
uuuucaccauggcaaaccuaaa

SEQ ID NO: 2192382 - RNA, 21 nt, Homo sapiens
gucacugugcacugcccuguu

SEQ ID NO: 2192383 - RNA, 15 nt, Homo sapiens
gaaguuaagaaccug

SEQ ID NO: 2192384 - RNA, 14 nt, Homo sapiens
ucuaaccauguauc

SEQ ID NO: 2192385 - RNA, 21 nt, Homo sapiens
cccuccuuggcuuuaugcaaa

SEQ ID NO: 2192386 - RNA, 14 nt, Homo sapiens
gccauaugccuugg

SEQ ID NO: 2192387 - RNA, 23 nt, Homo sapiens
ucuuaaaaucacucagcacucca

SEQ ID NO: 2192388 - RNA, 16 nt, Homo sapiens
caaggaguguaaaaug

SEQ ID NO: 2192389 - RNA, 17 nt, Homo sapiens
cuccuugcuacccagaa

SEQ ID NO: 2192390 - RNA, 20 nt, Homo sapiens
caagggcuccccacugccua

SEQ ID NO: 2192391 - RNA, 13 nt, Homo sapiens
uacgucauuacaa

SEQ ID NO: 2192392 - RNA, 14 nt, Homo sapiens
acucaggcuuucag

SEQ ID NO: 2192393 - RNA, 14 nt, Homo sapiens
ucacaugcauacau

SEQ ID NO: 2192394 - RNA, 22 nt, Homo sapiens
ucugugccugacucugugcuga

SEQ ID NO: 2192395 - RNA, 22 nt, Homo sapiens
aacagagggaguuuaauacagg

SEQ ID NO: 2192396 - RNA, 19 nt, Homo sapiens
uuaagauuuuacaaaagag

SEQ ID NO: 2192397 - RNA, 20 nt, Homo sapiens
uuccuaguagaacucacaga

SEQ ID NO: 2192398 - RNA, 23 nt, Homo sapiens
cauguuaugcuuuacugcgaaua

SEQ ID NO: 2192399 - RNA, 16 nt, Homo sapiens
gaccccacccaagcuu

SEQ ID NO: 2192400 - RNA, 22 nt, Homo sapiens
acucauucccauguugucaaua

SEQ ID NO: 2192401 - RNA, 20 nt, Homo sapiens
ccucaagaagaaaguguuca

SEQ ID NO: 2192402 - RNA, 19 nt, Homo sapiens
uuccaaaacuguccagggc

SEQ ID NO: 2192403 - RNA, 14 nt, Homo sapiens
auaaaacauugaca

SEQ ID NO: 2192404 - RNA, 14 nt, Homo sapiens
gauugucaacacaa

SEQ ID NO: 2192405 - RNA, 15 nt, Homo sapiens
gaaucagcugggaug

SEQ ID NO: 2192406 - RNA, 14 nt, Homo sapiens
acaaugauaugcaa

SEQ ID NO: 2192407 - RNA, 19 nt, Homo sapiens
caaccugggacuuccuaaa

SEQ ID NO: 2192408 - RNA, 13 nt, Homo sapiens
gaacacaaccaga

SEQ ID NO: 2192409 - RNA, 21 nt, Homo sapiens
auguuucaagaaaauggauuu

SEQ ID NO: 2192410 - RNA, 15 nt, Homo sapiens
uaagggggugcagca

SEQ ID NO: 2192411 - RNA, 16 nt, Homo sapiens
agcuauuagccaggau

SEQ ID NO: 2192412 - RNA, 17 nt, Homo sapiens
cuuagggaaguugucuc

SEQ ID NO: 2192413 - RNA, 17 nt, Homo sapiens
ucauaagagccacaggu

SEQ ID NO: 2192414 - RNA, 13 nt, Homo sapiens
ugguaacuuuauu

SEQ ID NO: 2192415 - RNA, 20 nt, Homo sapiens
acugugcuccucacuuccuc

SEQ ID NO: 2192416 - RNA, 18 nt, Homo sapiens
aaacauggccacauccaa

SEQ ID NO: 2192417 - RNA, 11 nt, Homo sapiens
ugguucugcuu

SEQ ID NO: 2192418 - RNA, 17 nt, Homo sapiens
cagguguuggaagccag

SEQ ID NO: 2192419 - RNA, 21 nt, Homo sapiens
caaugcaugcccaccuguuga

SEQ ID NO: 2192420 - RNA, 20 nt, Homo sapiens
agguuccuuaucugucacac

SEQ ID NO: 2192421 - RNA, 23 nt, Homo sapiens
gcuagacuaggagguuccggugu

SEQ ID NO: 2192422 - RNA, 16 nt, Homo sapiens
gcuagacagaaaccaa

SEQ ID NO: 2192423 - RNA, 16 nt, Homo sapiens
agcuuuuuguccugua

SEQ ID NO: 2192424 - RNA, 16 nt, Homo sapiens
aagaaccuugccugaa

SEQ ID NO: 2192425 - RNA, 18 nt, Homo sapiens
aaauagaaaccauuuuca

SEQ ID NO: 2192426 - RNA, 15 nt, Homo sapiens
cugcagcauguugcu

SEQ ID NO: 2192427 - RNA, 12 nt, Homo sapiens
gauucagcaaaa

SEQ ID NO: 2192428 - RNA, 16 nt, Homo sapiens
ugccucuugucugagg

SEQ ID NO: 2192429 - RNA, 17 nt, Homo sapiens
uuauuuuuguucauaua

SEQ ID NO: 2192430 - RNA, 16 nt, Homo sapiens
agugacaaaccaucca

SEQ ID NO: 2192431 - RNA, 12 nt, Homo sapiens
ucacacagugaa

SEQ ID NO: 2192432 - RNA, 21 nt, Homo sapiens
uuuguaaagcccuugcacagc

SEQ ID NO: 2192433 - RNA, 15 nt, Homo sapiens
aaaccaacaaaaaga

SEQ ID NO: 2192434 - RNA, 15 nt, Homo sapiens
uaaacaacaccuccu

SEQ ID NO: 2192435 - RNA, 21 nt, Homo sapiens
cauguauuuuuaauauaugca

SEQ ID NO: 2192436 - RNA, 13 nt, Homo sapiens
ugauacaaaccac

SEQ ID NO: 2192437 - RNA, 21 nt, Homo sapiens
uagguuuuccuuccaagcacc

SEQ ID NO: 2192438 - RNA, 17 nt, Homo sapiens
uuagagaaugauuucaa

SEQ ID NO: 2192439 - RNA, 14 nt, Homo sapiens
cuguggauucuaua

SEQ ID NO: 2192440 - RNA, 13 nt, Homo sapiens
gcugcucucugag

SEQ ID NO: 2192441 - RNA, 12 nt, Homo sapiens
gugaaaccacua

SEQ ID NO: 2192442 - RNA, 23 nt, Homo sapiens
ggguucccccucccugugugaaa

SEQ ID NO: 2192443 - RNA, 15 nt, Homo sapiens
accagcuuggcucag

SEQ ID NO: 2192444 - RNA, 14 nt, Homo sapiens
guggaugacuguug

SEQ ID NO: 2192445 - RNA, 21 nt, Homo sapiens
auuugacauagucuggcugua

SEQ ID NO: 2192446 - RNA, 15 nt, Homo sapiens
acaaaccuaccaaaa

SEQ ID NO: 2192447 - RNA, 13 nt, Homo sapiens
ucuucuuacugua

SEQ ID NO: 2192448 - RNA, 18 nt, Homo sapiens
uuguucuucaaugugaaa

SEQ ID NO: 2192449 - RNA, 19 nt, Homo sapiens
acuuuuaaaaaauacucug

SEQ ID NO: 2192450 - RNA, 16 nt, Homo sapiens
caauugacuuccucca

SEQ ID NO: 2192451 - RNA, 13 nt, Homo sapiens
aucccuguaauau

SEQ ID NO: 2192452 - RNA, 18 nt, Homo sapiens
ggccgcucgaugccuuug

SEQ ID NO: 2192453 - RNA, 15 nt, Homo sapiens
guaagaugcacugaa

SEQ ID NO: 2192454 - RNA, 20 nt, Homo sapiens
auuggcugguaaauugccau

SEQ ID NO: 2192455 - RNA, 15 nt, Homo sapiens
gaaaugguacuucau

SEQ ID NO: 2192456 - RNA, 15 nt, Homo sapiens
uacaauaaaaccaaa

SEQ ID NO: 2192457 - RNA, 19 nt, Homo sapiens
ugucuguaaugacaaauaa

SEQ ID NO: 2192458 - RNA, 18 nt, Homo sapiens
uauaccagguuaccucac

SEQ ID NO: 2192459 - RNA, 23 nt, Homo sapiens
uaacacucaagacuauguucucc

SEQ ID NO: 2192460 - RNA, 17 nt, Homo sapiens
cccuucagaccuugcaa

SEQ ID NO: 2192461 - RNA, 21 nt, Homo sapiens
ggcucuaacaaugacauuuau

SEQ ID NO: 2192462 - RNA, 20 nt, Homo sapiens
agucucuucuaagcaaaauu

SEQ ID NO: 2192463 - RNA, 12 nt, Homo sapiens
cucacucuucaa

SEQ ID NO: 2192464 - RNA, 12 nt, Homo sapiens
cacucugucauc

SEQ ID NO: 2192465 - RNA, 12 nt, Homo sapiens
cauucugucacc

SEQ ID NO: 2192466 - RNA, 15 nt, Homo sapiens
cuuguguguuuugag

SEQ ID NO: 2192467 - RNA, 13 nt, Homo sapiens
accacacauauug

SEQ ID NO: 2192468 - RNA, 14 nt, Homo sapiens
agauugaguuauua

SEQ ID NO: 2192469 - RNA, 19 nt, Homo sapiens
accccagucccagcuaacu

SEQ ID NO: 2192470 - RNA, 21 nt, Homo sapiens
gugccaugcccuuacacgugc

SEQ ID NO: 2192471 - RNA, 20 nt, Homo sapiens
uguuucagcccgaagcugcu

SEQ ID NO: 2192472 - RNA, 20 nt, Homo sapiens
gugcucgcccacaaacugau

SEQ ID NO: 2192473 - RNA, 21 nt, Homo sapiens
agccggcccaacccaaccacu

SEQ ID NO: 2192474 - RNA, 17 nt, Homo sapiens
gaguguccuugcucuag

SEQ ID NO: 2192475 - RNA, 15 nt, Homo sapiens
agacuucccacucua

SEQ ID NO: 2192476 - RNA, 21 nt, Homo sapiens
uauauagggaucaaccagcua

SEQ ID NO: 2192477 - RNA, 20 nt, Homo sapiens
cugauuucuucagaauuaga

SEQ ID NO: 2192478 - RNA, 11 nt, Homo sapiens
ccagcugucau

SEQ ID NO: 2192479 - RNA, 23 nt, Homo sapiens
aguuuuuuuuuauacacuguaau

SEQ ID NO: 2192480 - RNA, 14 nt, Homo sapiens
aauuuuuaauugaa

SEQ ID NO: 2192481 - RNA, 16 nt, Homo sapiens
uauuguggucauuucc

SEQ ID NO: 2192482 - RNA, 18 nt, Homo sapiens
caacaguggaauucaccu

SEQ ID NO: 2192483 - RNA, 16 nt, Homo sapiens
acugguagaaaaaccc

SEQ ID NO: 2192484 - RNA, 16 nt, Homo sapiens
auuucgagcauaagaa

SEQ ID NO: 2192485 - RNA, 14 nt, Homo sapiens
ucuugcacauggau

SEQ ID NO: 2192486 - RNA, 20 nt, Homo sapiens
ggccaguuugaagccugugc

SEQ ID NO: 2192487 - RNA, 13 nt, Homo sapiens
ccccacugaagaa

SEQ ID NO: 2192488 - RNA, 16 nt, Homo sapiens
aauguaaaacagagcc

SEQ ID NO: 2192489 - RNA, 19 nt, Homo sapiens
uccacaguuuugccuuaaa

SEQ ID NO: 2192490 - RNA, 17 nt, Homo sapiens
agcuuuaucugucuuga

SEQ ID NO: 2192491 - RNA, 17 nt, Homo sapiens
ucuauggcauauugaua

SEQ ID NO: 2192492 - RNA, 16 nt, Homo sapiens
cagucaugcacucaca

SEQ ID NO: 2192493 - RNA, 21 nt, Homo sapiens
gaccauauaacugugaugaaa

SEQ ID NO: 2192494 - RNA, 19 nt, Homo sapiens
ugucugagacagaaucuca

SEQ ID NO: 2192495 - RNA, 15 nt, Homo sapiens
cuugagcgugaaucu

SEQ ID NO: 2192496 - RNA, 13 nt, Homo sapiens
gaaugaagaccac

SEQ ID NO: 2192497 - RNA, 21 nt, Homo sapiens
cuuuuauguguugaugacuca

SEQ ID NO: 2192498 - RNA, 15 nt, Homo sapiens
cccaacaaacuuuaa

SEQ ID NO: 2192499 - RNA, 16 nt, Homo sapiens
ugauaaaguuccuuaa

SEQ ID NO: 2192500 - RNA, 13 nt, Homo sapiens
ggauauugacaag

SEQ ID NO: 2192501 - RNA, 20 nt, Homo sapiens
aaaaucaaacaauucaggga

SEQ ID NO: 2192502 - RNA, 13 nt, Homo sapiens
caagacucagggg

SEQ ID NO: 2192503 - RNA, 15 nt, Homo sapiens
ucaguucacuguuca

SEQ ID NO: 2192504 - RNA, 17 nt, Homo sapiens
ugaggaaucacuuuuaa

SEQ ID NO: 2192505 - RNA, 17 nt, Homo sapiens
ggcuauggaggguccuc

SEQ ID NO: 2192506 - RNA, 19 nt, Homo sapiens
cuagcugucucaggaguag

SEQ ID NO: 2192507 - RNA, 17 nt, Homo sapiens
ggauacaucugcugugu

SEQ ID NO: 2192508 - RNA, 14 nt, Homo sapiens
uacaugcauuacug

SEQ ID NO: 2192509 - RNA, 14 nt, Homo sapiens
cuaaacugguguuu

SEQ ID NO: 2192510 - RNA, 12 nt, Homo sapiens
uugccacaaagc

SEQ ID NO: 2192511 - RNA, 12 nt, Homo sapiens
uuuacacaaaua

SEQ ID NO: 2192512 - RNA, 20 nt, Homo sapiens
caggcagaucccacuugcag

SEQ ID NO: 2192513 - RNA, 22 nt, Homo sapiens
cuaaauagaaauaaaugauccc

SEQ ID NO: 2192514 - RNA, 18 nt, Homo sapiens
ucaugccgacgcuugcac

SEQ ID NO: 2192515 - RNA, 21 nt, Homo sapiens
ggcugcucgaagaacaauguc

SEQ ID NO: 2192516 - RNA, 14 nt, Homo sapiens
ccgugcacucccua

SEQ ID NO: 2192517 - RNA, 19 nt, Homo sapiens
gacagaaggaacacugcuu

SEQ ID NO: 2192518 - RNA, 14 nt, Homo sapiens
gauugugucccauu

SEQ ID NO: 2192519 - RNA, 22 nt, Homo sapiens
ucggaaggacgcggaaccuggg

SEQ ID NO: 2192520 - RNA, 15 nt, Homo sapiens
guauucauauuacca

SEQ ID NO: 2192521 - RNA, 18 nt, Homo sapiens
ccugccccccucaucuca

SEQ ID NO: 2192522 - RNA, 19 nt, Homo sapiens
cccagccucccccaggcug

SEQ ID NO: 2192523 - RNA, 12 nt, Homo sapiens
guguugauacug

SEQ ID NO: 2192524 - RNA, 19 nt, Homo sapiens
caggugcacgccaccacac

SEQ ID NO: 2192525 - RNA, 20 nt, Homo sapiens
agaaagcucauggcuguguc

SEQ ID NO: 2192526 - RNA, 22 nt, Homo sapiens
caugccacgagaucaacacaca

SEQ ID NO: 2192527 - RNA, 18 nt, Homo sapiens
agggaugaguacccaaaa

SEQ ID NO: 2192528 - RNA, 18 nt, Homo sapiens
aaggccagaaacuccuuu

SEQ ID NO: 2192529 - RNA, 16 nt, Homo sapiens
auugcuggaugcauuu

SEQ ID NO: 2192530 - RNA, 23 nt, Homo sapiens
ugggcauagguaagcugugccuu

SEQ ID NO: 2192531 - RNA, 14 nt, Homo sapiens
augaagaccaugcc

SEQ ID NO: 2192532 - RNA, 12 nt, Homo sapiens
caguguguuucu

SEQ ID NO: 2192533 - RNA, 14 nt, Homo sapiens
acaaacuccaucca

SEQ ID NO: 2192534 - RNA, 15 nt, Homo sapiens
ucuaugagcccagau

SEQ ID NO: 2192535 - RNA, 14 nt, Homo sapiens
ggaggcucuguucu

SEQ ID NO: 2192536 - RNA, 14 nt, Homo sapiens
gcuucuucucaggc

SEQ ID NO: 2192537 - RNA, 13 nt, Homo sapiens
agugguucuucaa

SEQ ID NO: 2192538 - RNA, 13 nt, Homo sapiens
aucuuaaaacuaa

SEQ ID NO: 2192539 - RNA, 23 nt, Homo sapiens
aggcaacugaggcagacagcagc

SEQ ID NO: 2192540 - RNA, 15 nt, Homo sapiens
aaauuguauuacaaa

SEQ ID NO: 2192541 - RNA, 19 nt, Homo sapiens
cugcguucaacaaugcugc

SEQ ID NO: 2192542 - RNA, 18 nt, Homo sapiens
aagagugacuaguacaaa

SEQ ID NO: 2192543 - RNA, 16 nt, Homo sapiens
cuuuacagacaggaaa

SEQ ID NO: 2192544 - RNA, 12 nt, Homo sapiens
gcauugcagcuc

SEQ ID NO: 2192545 - RNA, 15 nt, Homo sapiens
uauccucgcugguga

SEQ ID NO: 2192546 - RNA, 13 nt, Homo sapiens
cugaauguugcau

SEQ ID NO: 2192547 - RNA, 12 nt, Homo sapiens
gagcgaggucag

SEQ ID NO: 2192548 - RNA, 12 nt, Homo sapiens
ccugguccuucc

SEQ ID NO: 2192549 - RNA, 23 nt, Homo sapiens
cuuguguuaaacuaaaaauuuac

SEQ ID NO: 2192550 - RNA, 15 nt, Homo sapiens
cuaucauagauuuac

SEQ ID NO: 2192551 - RNA, 17 nt, Homo sapiens
acuggaaagagugccag

SEQ ID NO: 2192552 - RNA, 13 nt, Homo sapiens
guguuuagcuauu

SEQ ID NO: 2192553 - RNA, 19 nt, Homo sapiens
aaaaucaugccauugcacu

SEQ ID NO: 2192554 - RNA, 13 nt, Homo sapiens
ggaguaaucugug

SEQ ID NO: 2192555 - RNA, 17 nt, Homo sapiens
uaugguccucagauccc

SEQ ID NO: 2192556 - RNA, 14 nt, Homo sapiens
cuucuaccagagau

SEQ ID NO: 2192557 - RNA, 18 nt, Homo sapiens
cuuaagguggaaaguguu

SEQ ID NO: 2192558 - RNA, 21 nt, Homo sapiens
auucuacuuuaagcacuacau

SEQ ID NO: 2192559 - RNA, 22 nt, Homo sapiens
aaaucuccccacuccagaagca

SEQ ID NO: 2192560 - RNA, 23 nt, Homo sapiens
acuuacuauaauuugacuugaau

SEQ ID NO: 2192561 - RNA, 15 nt, Homo sapiens
ugguuuuuacauuca

SEQ ID NO: 2192562 - RNA, 22 nt, Homo sapiens
cuuuaccugcaggcuccaugca

SEQ ID NO: 2192563 - RNA, 13 nt, Homo sapiens
ccacacaauggau

SEQ ID NO: 2192564 - RNA, 16 nt, Homo sapiens
cuagucauucuucccu

SEQ ID NO: 2192565 - RNA, 21 nt, Homo sapiens
agaggcugagaaaugcagaga

SEQ ID NO: 2192566 - RNA, 14 nt, Homo sapiens
acuauaaacuacug

SEQ ID NO: 2192567 - RNA, 15 nt, Homo sapiens
cucacuguccuguga

SEQ ID NO: 2192568 - RNA, 18 nt, Homo sapiens
gccccauuauucauucuc

SEQ ID NO: 2192569 - RNA, 14 nt, Homo sapiens
ugaugaaucacugu

SEQ ID NO: 2192570 - RNA, 22 nt, Homo sapiens
gcccagcaccugcucccagugg

SEQ ID NO: 2192571 - RNA, 21 nt, Homo sapiens
ccggcucccaccggugccaaa

SEQ ID NO: 2192572 - RNA, 14 nt, Homo sapiens
ucuguaauguaggc

SEQ ID NO: 2192573 - RNA, 16 nt, Homo sapiens
ccgagugaggccauag

SEQ ID NO: 2192574 - RNA, 17 nt, Homo sapiens
acuuacacaucuuccac

SEQ ID NO: 2192575 - RNA, 13 nt, Homo sapiens
acaauaaagcaau

SEQ ID NO: 2192576 - RNA, 19 nt, Homo sapiens
augauuucagaaauguuaa

SEQ ID NO: 2192577 - RNA, 14 nt, Homo sapiens
agauauguauuuaa

SEQ ID NO: 2192578 - RNA, 18 nt, Homo sapiens
gcaacagguuuguucuca

SEQ ID NO: 2192579 - RNA, 15 nt, Homo sapiens
uauaccagaggaaag

SEQ ID NO: 2192580 - RNA, 13 nt, Homo sapiens
acaaaacaaacuc

SEQ ID NO: 2192581 - RNA, 13 nt, Homo sapiens
gaaucacagccaa

SEQ ID NO: 2192582 - RNA, 21 nt, Homo sapiens
agucuuaagggucacuggccu

SEQ ID NO: 2192583 - RNA, 16 nt, Homo sapiens
aagaacaucuuuaugg

SEQ ID NO: 2192584 - RNA, 22 nt, Homo sapiens
ccaccacauuuagaacuuuggc

SEQ ID NO: 2192585 - RNA, 21 nt, Homo sapiens
uucauaccuguuguacacuug

SEQ ID NO: 2192586 - RNA, 13 nt, Homo sapiens
ucaagcaauccac

SEQ ID NO: 2192587 - RNA, 21 nt, Homo sapiens
gugucuacagacaagcauuuu

SEQ ID NO: 2192588 - RNA, 21 nt, Homo sapiens
cugggaggagauaaacaccaa

SEQ ID NO: 2192589 - RNA, 18 nt, Homo sapiens
aucugcuacugugucagg

SEQ ID NO: 2192590 - RNA, 23 nt, Homo sapiens
uuacagagagcuugcugugacua

SEQ ID NO: 2192591 - RNA, 20 nt, Homo sapiens
uucacaacuuugacguaauu

SEQ ID NO: 2192592 - RNA, 15 nt, Homo sapiens
aaccuacauauucca

SEQ ID NO: 2192593 - RNA, 21 nt, Homo sapiens
uguguccuguccuuucuugca

SEQ ID NO: 2192594 - RNA, 15 nt, Homo sapiens
ucccaagcugugcug

SEQ ID NO: 2192595 - RNA, 14 nt, Homo sapiens
guaaaacaaucugu

SEQ ID NO: 2192596 - RNA, 20 nt, Homo sapiens
agaagggaagccuuuugcaa

SEQ ID NO: 2192597 - RNA, 16 nt, Homo sapiens
uauuuccucuccuucc

SEQ ID NO: 2192598 - RNA, 15 nt, Homo sapiens
gccaccucacccagc

SEQ ID NO: 2192599 - RNA, 21 nt, Homo sapiens
uccaccccagcaggacaguga

SEQ ID NO: 2192600 - RNA, 14 nt, Homo sapiens
aauaguugcuguca

SEQ ID NO: 2192601 - RNA, 16 nt, Homo sapiens
uucuaaaggcuaccuu

SEQ ID NO: 2192602 - RNA, 14 nt, Homo sapiens
acuacugugaucag

SEQ ID NO: 2192603 - RNA, 20 nt, Homo sapiens
caccaaaucaucucucauca

SEQ ID NO: 2192604 - RNA, 22 nt, Homo sapiens
ggaugcccccuguggaugcugc

SEQ ID NO: 2192605 - RNA, 21 nt, Homo sapiens
acagagucccuggcuccucua

SEQ ID NO: 2192606 - RNA, 22 nt, Homo sapiens
uaauuagcauggccccagucca

SEQ ID NO: 2192607 - RNA, 14 nt, Homo sapiens
agcugggagcacug

SEQ ID NO: 2192608 - RNA, 12 nt, Homo sapiens
aaaaagguuuaa

SEQ ID NO: 2192609 - RNA, 15 nt, Homo sapiens
uugaucuagaugucu

SEQ ID NO: 2192610 - RNA, 14 nt, Homo sapiens
aucugcagcuaacu

SEQ ID NO: 2192611 - RNA, 20 nt, Homo sapiens
gccucauaggcuucugggau

SEQ ID NO: 2192612 - RNA, 20 nt, Homo sapiens
uagagccaaauucauccucu

SEQ ID NO: 2192613 - RNA, 15 nt, Homo sapiens
cccaaucaccuuucc

SEQ ID NO: 2192614 - RNA, 15 nt, Homo sapiens
gcagcaggaugcuca

SEQ ID NO: 2192615 - RNA, 23 nt, Homo sapiens
guuuccuuuguuggagucaaaaa

SEQ ID NO: 2192616 - RNA, 20 nt, Homo sapiens
uuccugguugauacaguuca

SEQ ID NO: 2192617 - RNA, 21 nt, Homo sapiens
guagucacuuuggagcuuuag

SEQ ID NO: 2192618 - RNA, 22 nt, Homo sapiens
gaauccuaguuuaugcacauga

SEQ ID NO: 2192619 - RNA, 16 nt, Homo sapiens
acacaggggacacuga

SEQ ID NO: 2192620 - RNA, 19 nt, Homo sapiens
aaucauuaggaaacacuga

SEQ ID NO: 2192621 - RNA, 15 nt, Homo sapiens
ccaauaaaccuguaa

SEQ ID NO: 2192622 - RNA, 14 nt, Homo sapiens
cauguaaguagcaa

SEQ ID NO: 2192623 - RNA, 19 nt, Homo sapiens
aauuuucuuucauacauua

SEQ ID NO: 2192624 - RNA, 19 nt, Homo sapiens
gucuaaaacauguuugcac

SEQ ID NO: 2192625 - RNA, 19 nt, Homo sapiens
gguguugguguauuugcca

SEQ ID NO: 2192626 - RNA, 12 nt, Homo sapiens
gcucaaacaccc

SEQ ID NO: 2192627 - RNA, 16 nt, Homo sapiens
caaaauuuuacaguaa

SEQ ID NO: 2192628 - RNA, 22 nt, Homo sapiens
gagaguuacauguuaacugagg

SEQ ID NO: 2192629 - RNA, 20 nt, Homo sapiens
acaccacaccugauuccugu

SEQ ID NO: 2192630 - RNA, 15 nt, Homo sapiens
aacuuggauggacuu

SEQ ID NO: 2192631 - RNA, 22 nt, Homo sapiens
cuugauaaugggaugaauggaa

SEQ ID NO: 2192632 - RNA, 18 nt, Homo sapiens
ucacuucauuuaucuuaa

SEQ ID NO: 2192633 - RNA, 19 nt, Homo sapiens
gcaucuauaaugucagcuu

SEQ ID NO: 2192634 - RNA, 18 nt, Homo sapiens
cacugcugaggcuucaua

SEQ ID NO: 2192635 - RNA, 17 nt, Homo sapiens
gaaauggauauuugccu

SEQ ID NO: 2192636 - RNA, 18 nt, Homo sapiens
accccucuucugcuccuu

SEQ ID NO: 2192637 - RNA, 13 nt, Homo sapiens
uccaaacaugcau

SEQ ID NO: 2192638 - RNA, 20 nt, Homo sapiens
guugcccuugugcuccaguc

SEQ ID NO: 2192639 - RNA, 15 nt, Homo sapiens
aaaacaggcaaauuc

SEQ ID NO: 2192640 - RNA, 20 nt, Homo sapiens
ucacagcaguacuugcucaa

SEQ ID NO: 2192641 - RNA, 19 nt, Homo sapiens
cuaauccuccaagucuuca

SEQ ID NO: 2192642 - RNA, 17 nt, Homo sapiens
ggcagggaccaggccag

SEQ ID NO: 2192643 - RNA, 19 nt, Homo sapiens
cauagccugccugaucccu

SEQ ID NO: 2192644 - RNA, 17 nt, Homo sapiens
cuuccccagacucagcu

SEQ ID NO: 2192645 - RNA, 18 nt, Homo sapiens
cacaucagaagcaguaua

SEQ ID NO: 2192646 - RNA, 20 nt, Homo sapiens
aaaguagaggaauccaugua

SEQ ID NO: 2192647 - RNA, 19 nt, Homo sapiens
uauagcuuuagccguguca

SEQ ID NO: 2192648 - RNA, 22 nt, Homo sapiens
uacuucuacauccaauguauga

SEQ ID NO: 2192649 - RNA, 16 nt, Homo sapiens
gcccugcggccagggu

SEQ ID NO: 2192650 - RNA, 14 nt, Homo sapiens
auuuguuugugcau

SEQ ID NO: 2192651 - RNA, 20 nt, Homo sapiens
guuuuaaaaagggaaaguuu

SEQ ID NO: 2192652 - RNA, 18 nt, Homo sapiens
acaaaguuggugccaagc

SEQ ID NO: 2192653 - RNA, 20 nt, Homo sapiens
auuuucuaagaaccaaaaaa

SEQ ID NO: 2192654 - RNA, 22 nt, Homo sapiens
uaaaguauucaacaauuucaau

SEQ ID NO: 2192655 - RNA, 14 nt, Homo sapiens
ugccuuucacuuua

SEQ ID NO: 2192656 - RNA, 23 nt, Homo sapiens
gcauauaaucaagaaauaaccau

SEQ ID NO: 2192657 - RNA, 18 nt, Homo sapiens
gaaugagagguuccuaag

SEQ ID NO: 2192658 - RNA, 18 nt, Homo sapiens
ucgagucacaaaaauuca

SEQ ID NO: 2192659 - RNA, 21 nt, Homo sapiens
cuggagugcaguggugcaauc

SEQ ID NO: 2192660 - RNA, 11 nt, Homo sapiens
guuuauuccaa

SEQ ID NO: 2192661 - RNA, 11 nt, Homo sapiens
guauauuccau

SEQ ID NO: 2192662 - RNA, 21 nt, Homo sapiens
gugaaaccccaucucuacuaa

SEQ ID NO: 2192663 - RNA, 18 nt, Homo sapiens
cagggauuaaccucugca

SEQ ID NO: 2192664 - RNA, 20 nt, Homo sapiens
aagggggugaccucuugccu

SEQ ID NO: 2192665 - RNA, 17 nt, Homo sapiens
uaaacucuggaugauuc

SEQ ID NO: 2192666 - RNA, 16 nt, Homo sapiens
uugaacacaauugaua

SEQ ID NO: 2192667 - RNA, 16 nt, Homo sapiens
ugugcggcugaacuga

SEQ ID NO: 2192668 - RNA, 16 nt, Homo sapiens
uaugagcugcuggcag

SEQ ID NO: 2192669 - RNA, 23 nt, Homo sapiens
cccaguaaggucaugugcuucca

SEQ ID NO: 2192670 - RNA, 22 nt, Homo sapiens
aaaaugccagucucauugucac

SEQ ID NO: 2192671 - RNA, 19 nt, Homo sapiens
uauucauguucaugugauu

SEQ ID NO: 2192672 - RNA, 18 nt, Homo sapiens
ucacugcaacuucugccu

SEQ ID NO: 2192673 - RNA, 17 nt, Homo sapiens
gccauauucugugauca

SEQ ID NO: 2192674 - RNA, 15 nt, Homo sapiens
cuuuuaaacuuugau

SEQ ID NO: 2192675 - RNA, 16 nt, Homo sapiens
uuuuaugaacuggaga

SEQ ID NO: 2192676 - RNA, 16 nt, Homo sapiens
agauuggaaagacagg

SEQ ID NO: 2192677 - RNA, 21 nt, Homo sapiens
cucaggaugggaagaaaaagg

SEQ ID NO: 2192678 - RNA, 17 nt, Homo sapiens
cuuguguuauauagcca

SEQ ID NO: 2192679 - RNA, 11 nt, Homo sapiens
uuaagugcagu

SEQ ID NO: 2192680 - RNA, 12 nt, Homo sapiens
cgaaaugagcuc

SEQ ID NO: 2192681 - RNA, 15 nt, Homo sapiens
gcccgccaccuguga

SEQ ID NO: 2192682 - RNA, 18 nt, Homo sapiens
uggcaccaucuuggcuca

SEQ ID NO: 2192683 - RNA, 17 nt, Homo sapiens
ggugguuccuguucuca

SEQ ID NO: 2192684 - RNA, 19 nt, Homo sapiens
ugguuucaauaaaccuaau

SEQ ID NO: 2192685 - RNA, 23 nt, Homo sapiens
uaugcacacacacggaugcacac

SEQ ID NO: 2192686 - RNA, 22 nt, Homo sapiens
ucugucaucaccccgugaagca

SEQ ID NO: 2192687 - RNA, 19 nt, Homo sapiens
ugccugguuuuauuuauau

SEQ ID NO: 2192688 - RNA, 23 nt, Homo sapiens
ugggggaagacuuuaaaccaccu

SEQ ID NO: 2192689 - RNA, 14 nt, Homo sapiens
gccgguacacagcc

SEQ ID NO: 2192690 - RNA, 19 nt, Homo sapiens
agugcaagcagaugacaaa

SEQ ID NO: 2192691 - RNA, 17 nt, Homo sapiens
cucuuacaauaagcuaa

SEQ ID NO: 2192692 - RNA, 19 nt, Homo sapiens
caaccgcgggggcugugag

SEQ ID NO: 2192693 - RNA, 15 nt, Homo sapiens
agggccacagcccug

SEQ ID NO: 2192694 - RNA, 20 nt, Homo sapiens
cucaguuuuuaucaggcuuu

SEQ ID NO: 2192695 - RNA, 18 nt, Homo sapiens
acuugaggucuggaguuu

SEQ ID NO: 2192696 - RNA, 20 nt, Homo sapiens
cugaaguuugugggggccaa

SEQ ID NO: 2192697 - RNA, 12 nt, Homo sapiens
auauuaauugag

SEQ ID NO: 2192698 - RNA, 23 nt, Homo sapiens
cguuuucauuguucacuucuaaa

SEQ ID NO: 2192699 - RNA, 22 nt, Homo sapiens
uauguaauggaacuuagccauu

SEQ ID NO: 2192700 - RNA, 16 nt, Homo sapiens
agauauguuaagcaug

SEQ ID NO: 2192701 - RNA, 19 nt, Homo sapiens
auauaccuuuuugugucaa

SEQ ID NO: 2192702 - RNA, 21 nt, Homo sapiens
cauuuguagcucuggaccugu

SEQ ID NO: 2192703 - RNA, 21 nt, Homo sapiens
ccuauggagagcccugggacc

SEQ ID NO: 2192704 - RNA, 12 nt, Homo sapiens
cuauuaagguga

SEQ ID NO: 2192705 - RNA, 11 nt, Homo sapiens
cgguacagggc

SEQ ID NO: 2192706 - RNA, 14 nt, Homo sapiens
agaggcuuccaguc

SEQ ID NO: 2192707 - RNA, 15 nt, Homo sapiens
uccaggcagauccag

SEQ ID NO: 2192708 - RNA, 18 nt, Homo sapiens
gaaagcuucaaacugcau

SEQ ID NO: 2192709 - RNA, 21 nt, Homo sapiens
ucuuugcugugggaccucaga

SEQ ID NO: 2192710 - RNA, 15 nt, Homo sapiens
auuccuugguucugu

SEQ ID NO: 2192711 - RNA, 17 nt, Homo sapiens
augcuuuuuugcaauaa

SEQ ID NO: 2192712 - RNA, 15 nt, Homo sapiens
aggaggcagcucagg

SEQ ID NO: 2192713 - RNA, 22 nt, Homo sapiens
ucagauaagguaaaaugccaug

SEQ ID NO: 2192714 - RNA, 13 nt, Homo sapiens
agagaugugcaau

SEQ ID NO: 2192715 - RNA, 13 nt, Homo sapiens
cagcugacagaua

SEQ ID NO: 2192716 - RNA, 18 nt, Homo sapiens
auguuuuuuauacuucaa

SEQ ID NO: 2192717 - RNA, 21 nt, Homo sapiens
ccaaucaccuuuccuguucca

SEQ ID NO: 2192718 - RNA, 21 nt, Homo sapiens
gaggccugggugugaccugac

SEQ ID NO: 2192719 - RNA, 13 nt, Homo sapiens
ucaaccaacugua

SEQ ID NO: 2192720 - RNA, 19 nt, Homo sapiens
aguccaugaucccacugac

SEQ ID NO: 2192721 - RNA, 15 nt, Homo sapiens
cauuaauguuaauuc

SEQ ID NO: 2192722 - RNA, 20 nt, Homo sapiens
ucccuccccaguucauugca

SEQ ID NO: 2192723 - RNA, 11 nt, Homo sapiens
aaagggagaag

SEQ ID NO: 2192724 - RNA, 16 nt, Homo sapiens
auaaagaaauaauacc

SEQ ID NO: 2192725 - RNA, 16 nt, Homo sapiens
cuccaaaacuccugcc

SEQ ID NO: 2192726 - RNA, 18 nt, Homo sapiens
cuuauaaagcauugcaac

SEQ ID NO: 2192727 - RNA, 15 nt, Homo sapiens
gguccucuggggccu

SEQ ID NO: 2192728 - RNA, 14 nt, Homo sapiens
agggaaugacuugg

SEQ ID NO: 2192729 - RNA, 21 nt, Homo sapiens
uacgaagaccauacauaauaa

SEQ ID NO: 2192730 - RNA, 22 nt, Homo sapiens
caagaagaccaugaucucaaua

SEQ ID NO: 2192731 - RNA, 22 nt, Homo sapiens
gcauaauuuuguguuguacaau

SEQ ID NO: 2192732 - RNA, 13 nt, Homo sapiens
caauaaacuccua

SEQ ID NO: 2192733 - RNA, 18 nt, Homo sapiens
auacuuugcauauugucu

SEQ ID NO: 2192734 - RNA, 20 nt, Homo sapiens
caggaagaccccagcacaga

SEQ ID NO: 2192735 - RNA, 11 nt, Homo sapiens
agcggacacac

SEQ ID NO: 2192736 - RNA, 11 nt, Homo sapiens
agaggacacaa

SEQ ID NO: 2192737 - RNA, 12 nt, Homo sapiens
aaggaaagcaca

SEQ ID NO: 2192738 - RNA, 22 nt, Homo sapiens
ucucccacacuagcuugcagaa

SEQ ID NO: 2192739 - RNA, 13 nt, Homo sapiens
guccaugugcaaa

SEQ ID NO: 2192740 - RNA, 13 nt, Homo sapiens
uucauuguucacu

SEQ ID NO: 2192741 - RNA, 21 nt, Homo sapiens
ggaccagauugacuacccugu

SEQ ID NO: 2192742 - RNA, 16 nt, Homo sapiens
cacuuguuucuacuca

SEQ ID NO: 2192743 - RNA, 15 nt, Homo sapiens
gagcacuuuccacuu

SEQ ID NO: 2192744 - RNA, 17 nt, Homo sapiens
caccuuguacagaacca

SEQ ID NO: 2192745 - RNA, 15 nt, Homo sapiens
ugauggcagagccag

SEQ ID NO: 2192746 - RNA, 15 nt, Homo sapiens
cuccuuucucaucuu

SEQ ID NO: 2192747 - RNA, 17 nt, Homo sapiens
gaccaaauaaaguacca

SEQ ID NO: 2192748 - RNA, 13 nt, Homo sapiens
gcccaggcagcua

SEQ ID NO: 2192749 - RNA, 18 nt, Homo sapiens
gaaugucuuacugugauc

SEQ ID NO: 2192750 - RNA, 15 nt, Homo sapiens
ucaagcuagaaggcc

SEQ ID NO: 2192751 - RNA, 18 nt, Homo sapiens
auguuguaagaaagacaa

SEQ ID NO: 2192752 - RNA, 15 nt, Homo sapiens
uggauuucauuugua

SEQ ID NO: 2192753 - RNA, 18 nt, Homo sapiens
ccuugcuuucggagcucc

SEQ ID NO: 2192754 - RNA, 20 nt, Homo sapiens
ggaaaaaaguuuugaugaaa

SEQ ID NO: 2192755 - RNA, 19 nt, Homo sapiens
auaaauagugucucuucaa

SEQ ID NO: 2192756 - RNA, 22 nt, Homo sapiens
cugugccccagcagugccuugu

SEQ ID NO: 2192757 - RNA, 15 nt, Homo sapiens
cuacagaguaacaaa

SEQ ID NO: 2192758 - RNA, 12 nt, Homo sapiens
ucaguguugcau

SEQ ID NO: 2192759 - RNA, 21 nt, Homo sapiens
cugcauacuggccgagcugcu

SEQ ID NO: 2192760 - RNA, 16 nt, Homo sapiens
agagcuagucuuucac

SEQ ID NO: 2192761 - RNA, 21 nt, Homo sapiens
ccuaacguuuucuacuuugaa

SEQ ID NO: 2192762 - RNA, 14 nt, Homo sapiens
gguguggcuuggaa

SEQ ID NO: 2192763 - RNA, 23 nt, Homo sapiens
uauucuuuuuggaaauaaaauac

SEQ ID NO: 2192764 - RNA, 19 nt, Homo sapiens
cacacagauuugagcucag

SEQ ID NO: 2192765 - RNA, 20 nt, Homo sapiens
cauuuauuuacaucuaugua

SEQ ID NO: 2192766 - RNA, 23 nt, Homo sapiens
gaagacacugcagugaccacuua

SEQ ID NO: 2192767 - RNA, 15 nt, Homo sapiens
aaaagauuauauauc

SEQ ID NO: 2192768 - RNA, 20 nt, Homo sapiens
augguuaucuuugagaccau

SEQ ID NO: 2192769 - RNA, 18 nt, Homo sapiens
augccauauacaaaaauu

SEQ ID NO: 2192770 - RNA, 14 nt, Homo sapiens
agauccgcuccagc

SEQ ID NO: 2192771 - RNA, 18 nt, Homo sapiens
gcaccagugugacaucua

SEQ ID NO: 2192772 - RNA, 22 nt, Homo sapiens
uuaaucuggacacacuguuaca

SEQ ID NO: 2192773 - RNA, 15 nt, Homo sapiens
uugaucuuuuaguuu

SEQ ID NO: 2192774 - RNA, 14 nt, Homo sapiens
ccacagcagcauuu

SEQ ID NO: 2192775 - RNA, 18 nt, Homo sapiens
aauugcggggcccaccuu

SEQ ID NO: 2192776 - RNA, 16 nt, Homo sapiens
cuucccccacauuggg

SEQ ID NO: 2192777 - RNA, 16 nt, Homo sapiens
uaauaaaccaguucug

SEQ ID NO: 2192778 - RNA, 14 nt, Homo sapiens
uauuucaugauaga

SEQ ID NO: 2192779 - RNA, 12 nt, Homo sapiens
agaacucuccau

SEQ ID NO: 2192780 - RNA, 19 nt, Homo sapiens
accauucaccaagagccaa

SEQ ID NO: 2192781 - RNA, 21 nt, Homo sapiens
ugagacagagagccaagcuaa

SEQ ID NO: 2192782 - RNA, 23 nt, Homo sapiens
augauagugguggaguuaaucuu

SEQ ID NO: 2192783 - RNA, 20 nt, Homo sapiens
acaaucauuguuuugaauau

SEQ ID NO: 2192784 - RNA, 13 nt, Homo sapiens
cccccugcaagaa

SEQ ID NO: 2192785 - RNA, 24 nt, Homo sapiens
gugccucuuuucaguagugagcag

SEQ ID NO: 2192786 - RNA, 14 nt, Homo sapiens
uacuggaaggcuuc

SEQ ID NO: 2192787 - RNA, 21 nt, Homo sapiens
aagaaaauuagggcaaggugu

SEQ ID NO: 2192788 - RNA, 17 nt, Homo sapiens
gagcuggcaaagguggc

SEQ ID NO: 2192789 - RNA, 22 nt, Homo sapiens
aaacuuuuuuucaaaaaaagca

SEQ ID NO: 2192790 - RNA, 12 nt, Homo sapiens
aggaagauuccc

SEQ ID NO: 2192791 - RNA, 19 nt, Homo sapiens
uuaucugguuuaagaguaa

SEQ ID NO: 2192792 - RNA, 16 nt, Homo sapiens
guccugaucugugaua

SEQ ID NO: 2192793 - RNA, 13 nt, Homo sapiens
auaauagcagauu

SEQ ID NO: 2192794 - RNA, 13 nt, Homo sapiens
ccaagugggaaug

SEQ ID NO: 2192795 - RNA, 21 nt, Homo sapiens
cagugaaaaagauguacagaa

SEQ ID NO: 2192796 - RNA, 19 nt, Homo sapiens
caaauuguaguucuugucu

SEQ ID NO: 2192797 - RNA, 14 nt, Homo sapiens
ucuauaaacaggcu

SEQ ID NO: 2192798 - RNA, 18 nt, Homo sapiens
acuuuuauguuaaugcuc

SEQ ID NO: 2192799 - RNA, 19 nt, Homo sapiens
ggccacugaauuaugccag

SEQ ID NO: 2192800 - RNA, 20 nt, Homo sapiens
aguccucagugguuggcaau

SEQ ID NO: 2192801 - RNA, 20 nt, Homo sapiens
cugggccauucuccacagca

SEQ ID NO: 2192802 - RNA, 14 nt, Homo sapiens
aguauauaaccuca

SEQ ID NO: 2192803 - RNA, 14 nt, Homo sapiens
aucuaccuuccagu

SEQ ID NO: 2192804 - RNA, 13 nt, Homo sapiens
gggccuccaugcc

SEQ ID NO: 2192805 - RNA, 22 nt, Homo sapiens
uuacugaaaaaugcaaauugca

SEQ ID NO: 2192806 - RNA, 20 nt, Homo sapiens
cuaaauaaagacgacuacag

SEQ ID NO: 2192807 - RNA, 13 nt, Homo sapiens
ucugcacugccca

SEQ ID NO: 2192808 - RNA, 13 nt, Homo sapiens
uccccacugcuga

SEQ ID NO: 2192809 - RNA, 12 nt, Homo sapiens
cucccaccaggc

SEQ ID NO: 2192810 - RNA, 19 nt, Homo sapiens
uggaaauuacccacuguca

SEQ ID NO: 2192811 - RNA, 12 nt, Homo sapiens
auccaauacugc

SEQ ID NO: 2192812 - RNA, 16 nt, Homo sapiens
ugccuuuuaccuucag

SEQ ID NO: 2192813 - RNA, 15 nt, Homo sapiens
aauuugaugcgaucu

SEQ ID NO: 2192814 - RNA, 15 nt, Homo sapiens
accuagugaaacuuu

SEQ ID NO: 2192815 - RNA, 16 nt, Homo sapiens
uccucugaggcacuca

SEQ ID NO: 2192816 - RNA, 12 nt, Homo sapiens
uaaaggcagcug

SEQ ID NO: 2192817 - RNA, 20 nt, Homo sapiens
gcaaagcucaccaucuucac

SEQ ID NO: 2192818 - RNA, 21 nt, Homo sapiens
uccaucagccaggacagucag

SEQ ID NO: 2192819 - RNA, 13 nt, Homo sapiens
uggagccugcaau

SEQ ID NO: 2192820 - RNA, 14 nt, Homo sapiens
gaaaauaacaaagc

SEQ ID NO: 2192821 - RNA, 12 nt, Homo sapiens
ugcacacacaga

SEQ ID NO: 2192822 - RNA, 12 nt, Homo sapiens
cacacacaugga

SEQ ID NO: 2192823 - RNA, 13 nt, Homo sapiens
cuuaaaucugccu

SEQ ID NO: 2192824 - RNA, 12 nt, Homo sapiens
uaaggugcuauc

SEQ ID NO: 2192825 - RNA, 19 nt, Homo sapiens
aauaugcuuguugaugcug

SEQ ID NO: 2192826 - RNA, 16 nt, Homo sapiens
agguggccacaaauuc

SEQ ID NO: 2192827 - RNA, 18 nt, Homo sapiens
agacccacagcccugaaa

SEQ ID NO: 2192828 - RNA, 14 nt, Homo sapiens
gguagguugggaga

SEQ ID NO: 2192829 - RNA, 15 nt, Homo sapiens
uaggccacauugaca

SEQ ID NO: 2192830 - RNA, 19 nt, Homo sapiens
ugaauggcuuugucuugaa

SEQ ID NO: 2192831 - RNA, 20 nt, Homo sapiens
ugcagcuggcccacugcugg

SEQ ID NO: 2192832 - RNA, 13 nt, Homo sapiens
gugaagagcauuu

SEQ ID NO: 2192833 - RNA, 23 nt, Homo sapiens
uacugauucaagaacaagcaaug

SEQ ID NO: 2192834 - RNA, 22 nt, Homo sapiens
uugaagcucuggugacaccagc

SEQ ID NO: 2192835 - RNA, 15 nt, Homo sapiens
cuacuaaaaaugcaa

SEQ ID NO: 2192836 - RNA, 22 nt, Homo sapiens
cuuaaugugugugccaauggug

SEQ ID NO: 2192837 - RNA, 17 nt, Homo sapiens
ucaugcccccucaguga

SEQ ID NO: 2192838 - RNA, 17 nt, Homo sapiens
ugcuggaacacugcuga

SEQ ID NO: 2192839 - RNA, 17 nt, Homo sapiens
gcaauaauaaaguacuu

SEQ ID NO: 2192840 - RNA, 18 nt, Homo sapiens
uguaauuccagcacuuca

SEQ ID NO: 2192841 - RNA, 23 nt, Homo sapiens
auuugaagacccuugugcauugu

SEQ ID NO: 2192842 - RNA, 13 nt, Homo sapiens
agaggcagagaaa

SEQ ID NO: 2192843 - RNA, 12 nt, Homo sapiens
acucugugcuca

SEQ ID NO: 2192844 - RNA, 22 nt, Homo sapiens
ccuaaaugaugccuuugucugu

SEQ ID NO: 2192845 - RNA, 13 nt, Homo sapiens
ccucccuuugaug

SEQ ID NO: 2192846 - RNA, 15 nt, Homo sapiens
ugcuaacccccaaau

SEQ ID NO: 2192847 - RNA, 18 nt, Homo sapiens
aaaugucuggucugucca

SEQ ID NO: 2192848 - RNA, 14 nt, Homo sapiens
cagaaccacuccug

SEQ ID NO: 2192849 - RNA, 13 nt, Homo sapiens
cacauacuaccua

SEQ ID NO: 2192850 - RNA, 17 nt, Homo sapiens
cacauuggaacagugaa

SEQ ID NO: 2192851 - RNA, 13 nt, Homo sapiens
gccuuacaucugg

SEQ ID NO: 2192852 - RNA, 13 nt, Homo sapiens
agucuagcauucu

SEQ ID NO: 2192853 - RNA, 13 nt, Homo sapiens
uguaaagcuuuaa

SEQ ID NO: 2192854 - RNA, 17 nt, Homo sapiens
cucguucaaaacauucc

SEQ ID NO: 2192855 - RNA, 21 nt, Homo sapiens
gaacccugcuugcacuuugua

SEQ ID NO: 2192856 - RNA, 15 nt, Homo sapiens
uuuacuccaugaagg

SEQ ID NO: 2192857 - RNA, 13 nt, Homo sapiens
guacuacauaccu

SEQ ID NO: 2192858 - RNA, 13 nt, Homo sapiens
gucagacauaaag

SEQ ID NO: 2192859 - RNA, 18 nt, Homo sapiens
cuggaaucuuccccaagg

SEQ ID NO: 2192860 - RNA, 14 nt, Homo sapiens
uauaacaugcaaac

SEQ ID NO: 2192861 - RNA, 14 nt, Homo sapiens
aaucccacuuauca

SEQ ID NO: 2192862 - RNA, 20 nt, Homo sapiens
cuuagcguucuguuucacca

SEQ ID NO: 2192863 - RNA, 14 nt, Homo sapiens
cauugacugucaca

SEQ ID NO: 2192864 - RNA, 14 nt, Homo sapiens
cagcacuccucauc

SEQ ID NO: 2192865 - RNA, 12 nt, Homo sapiens
cucaccuugugu

SEQ ID NO: 2192866 - RNA, 17 nt, Homo sapiens
agaccucagcagggcau

SEQ ID NO: 2192867 - RNA, 21 nt, Homo sapiens
cugaagaaacuucccaagugu

SEQ ID NO: 2192868 - RNA, 18 nt, Homo sapiens
aacauggcaaguacagua

SEQ ID NO: 2192869 - RNA, 22 nt, Homo sapiens
uuagcauuuuucaaaugaucuu

SEQ ID NO: 2192870 - RNA, 14 nt, Homo sapiens
uagcaugcugugau

SEQ ID NO: 2192871 - RNA, 18 nt, Homo sapiens
augcaccuagcugugcaa

SEQ ID NO: 2192872 - RNA, 20 nt, Homo sapiens
ucacccaggcuggagugcaa

SEQ ID NO: 2192873 - RNA, 14 nt, Homo sapiens
uauugcgauggcgu

SEQ ID NO: 2192874 - RNA, 21 nt, Homo sapiens
guaaacuuaaaauuacuauaa

SEQ ID NO: 2192875 - RNA, 16 nt, Homo sapiens
gcuucgggcuaugcaa

SEQ ID NO: 2192876 - RNA, 22 nt, Homo sapiens
uaaagaugcccuaaguguugaa

SEQ ID NO: 2192877 - RNA, 15 nt, Homo sapiens
ggugcucaugcugcu

SEQ ID NO: 2192878 - RNA, 17 nt, Homo sapiens
ucccagcucagugccaa

SEQ ID NO: 2192879 - RNA, 12 nt, Homo sapiens
ggacgggaugag

SEQ ID NO: 2192880 - RNA, 18 nt, Homo sapiens
ugcuaucgcaaaucacaa

SEQ ID NO: 2192881 - RNA, 16 nt, Homo sapiens
ucccauggaucaucaa

SEQ ID NO: 2192882 - RNA, 17 nt, Homo sapiens
cuguauaaaaugcaaaa

SEQ ID NO: 2192883 - RNA, 20 nt, Homo sapiens
ugguuaggcagcaagcuuug

SEQ ID NO: 2192884 - RNA, 17 nt, Homo sapiens
cccuccaugugagaaua

SEQ ID NO: 2192885 - RNA, 16 nt, Homo sapiens
cuucucuuccuuggga

SEQ ID NO: 2192886 - RNA, 17 nt, Homo sapiens
agccugcuccagcuguu

SEQ ID NO: 2192887 - RNA, 14 nt, Homo sapiens
cccagugaccugac

SEQ ID NO: 2192888 - RNA, 17 nt, Homo sapiens
auucaguuuucauuugg

SEQ ID NO: 2192889 - RNA, 13 nt, Homo sapiens
uucagucugacaa

SEQ ID NO: 2192890 - RNA, 21 nt, Homo sapiens
gaaaggggcccaguccuggcc

SEQ ID NO: 2192891 - RNA, 15 nt, Homo sapiens
agcaguguuagcuua

SEQ ID NO: 2192892 - RNA, 12 nt, Homo sapiens
uccccagggugc

SEQ ID NO: 2192893 - RNA, 14 nt, Homo sapiens
uggcgccucugcaa

SEQ ID NO: 2192894 - RNA, 14 nt, Homo sapiens
cucagccuugcaaa

SEQ ID NO: 2192895 - RNA, 20 nt, Homo sapiens
ggaguucgaggcugcaguca

SEQ ID NO: 2192896 - RNA, 15 nt, Homo sapiens
uuuauauugaacugu

SEQ ID NO: 2192897 - RNA, 22 nt, Homo sapiens
agagguggcaggaauacuucac

SEQ ID NO: 2192898 - RNA, 22 nt, Homo sapiens
gcucuucagacuuaaagcacug

SEQ ID NO: 2192899 - RNA, 19 nt, Homo sapiens
gaucaagguuaacaaagaa

SEQ ID NO: 2192900 - RNA, 23 nt, Homo sapiens
ccauacuccuaugaucugaguca

SEQ ID NO: 2192901 - RNA, 22 nt, Homo sapiens
aaacauuuguuuguggucuaua

SEQ ID NO: 2192902 - RNA, 17 nt, Homo sapiens
aaggacuuuccagugag

SEQ ID NO: 2192903 - RNA, 17 nt, Homo sapiens
aaacacagagcuauaaa

SEQ ID NO: 2192904 - RNA, 13 nt, Homo sapiens
uauaaacacagua

SEQ ID NO: 2192905 - RNA, 22 nt, Homo sapiens
aagagcccccuugacaccgggg

SEQ ID NO: 2192906 - RNA, 23 nt, Homo sapiens
ugcaggguuucucgccacugggg

SEQ ID NO: 2192907 - RNA, 12 nt, Homo sapiens
ccuucugaucuc

SEQ ID NO: 2192908 - RNA, 17 nt, Homo sapiens
ucccccacuccucccua

SEQ ID NO: 2192909 - RNA, 21 nt, Homo sapiens
gcccagcaaagucugcaucug

SEQ ID NO: 2192910 - RNA, 17 nt, Homo sapiens
caggugcccgccaccac

SEQ ID NO: 2192911 - RNA, 21 nt, Homo sapiens
ugaagcuuuaagaacuaaaau

SEQ ID NO: 2192912 - RNA, 14 nt, Homo sapiens
gacuaacaaaggca

SEQ ID NO: 2192913 - RNA, 17 nt, Homo sapiens
uauucacugagucucau

SEQ ID NO: 2192914 - RNA, 17 nt, Homo sapiens
cccaccaucugcugucu

SEQ ID NO: 2192915 - RNA, 21 nt, Homo sapiens
uccugcagcuuauuggcuuaa

SEQ ID NO: 2192916 - RNA, 17 nt, Homo sapiens
aauaaaacugauguuac

SEQ ID NO: 2192917 - RNA, 19 nt, Homo sapiens
agcaggggccaagcaggca

SEQ ID NO: 2192918 - RNA, 15 nt, Homo sapiens
cauccuuuacguguu

SEQ ID NO: 2192919 - RNA, 15 nt, Homo sapiens
ucacucauccauccc

SEQ ID NO: 2192920 - RNA, 23 nt, Homo sapiens
ccuaauaaauauuuagucugcau

SEQ ID NO: 2192921 - RNA, 18 nt, Homo sapiens
augaaauguccucuugaa

SEQ ID NO: 2192922 - RNA, 16 nt, Homo sapiens
agaugcugucacuuaa

SEQ ID NO: 2192923 - RNA, 19 nt, Homo sapiens
aaacuuggaauucucucac

SEQ ID NO: 2192924 - RNA, 15 nt, Homo sapiens
gcaaacagauggcag

SEQ ID NO: 2192925 - RNA, 17 nt, Homo sapiens
acuggagcucaucugca

SEQ ID NO: 2192926 - RNA, 15 nt, Homo sapiens
caagcaaagugcuuu

SEQ ID NO: 2192927 - RNA, 18 nt, Homo sapiens
cagugagucugaauguca

SEQ ID NO: 2192928 - RNA, 16 nt, Homo sapiens
agcaggggcuccagca

SEQ ID NO: 2192929 - RNA, 18 nt, Homo sapiens
agugcuggucacuaacca

SEQ ID NO: 2192930 - RNA, 14 nt, Homo sapiens
ccgcauagcacuug

SEQ ID NO: 2192931 - RNA, 24 nt, Homo sapiens
ccagcuggaguucaugucgcaaca

SEQ ID NO: 2192932 - RNA, 11 nt, Homo sapiens
guuuucacuaa

SEQ ID NO: 2192933 - RNA, 18 nt, Homo sapiens
cacugugggacugggaca

SEQ ID NO: 2192934 - RNA, 17 nt, Homo sapiens
ugcuucuuaauucaguu

SEQ ID NO: 2192935 - RNA, 17 nt, Homo sapiens
agugaaccuagauugca

SEQ ID NO: 2192936 - RNA, 9 nt, Homo sapiens
aaagugcaa

SEQ ID NO: 2192937 - RNA, 17 nt, Homo sapiens
ugagaaacccaccagcc

SEQ ID NO: 2192938 - RNA, 14 nt, Homo sapiens
ucuaagauucuaau

SEQ ID NO: 2192939 - RNA, 14 nt, Homo sapiens
gccucgaugccucu

SEQ ID NO: 2192940 - RNA, 14 nt, Homo sapiens
cugcaucucaaaaa

SEQ ID NO: 2192941 - RNA, 13 nt, Homo sapiens
caacccacaccaa

SEQ ID NO: 2192942 - RNA, 13 nt, Homo sapiens
acucauucagucc

SEQ ID NO: 2192943 - RNA, 14 nt, Homo sapiens
gcuuccagcaguau

SEQ ID NO: 2192944 - RNA, 14 nt, Homo sapiens
aagagccacugcca

SEQ ID NO: 2192945 - RNA, 12 nt, Homo sapiens
cuaguuacacau

SEQ ID NO: 2192946 - RNA, 12 nt, Homo sapiens
acuucucugagu

SEQ ID NO: 2192947 - RNA, 12 nt, Homo sapiens
cuucgcacacac

SEQ ID NO: 2192948 - RNA, 23 nt, Homo sapiens
uguggucuccagcuccucuccag

SEQ ID NO: 2192949 - RNA, 18 nt, Homo sapiens
aguuuugugaaggugauu

SEQ ID NO: 2192950 - RNA, 19 nt, Homo sapiens
uuccaaggguacuaaggaa

SEQ ID NO: 2192951 - RNA, 14 nt, Homo sapiens
cugaagaaaccugg

SEQ ID NO: 2192952 - RNA, 17 nt, Homo sapiens
acaaaacacagccaagg

SEQ ID NO: 2192953 - RNA, 15 nt, Homo sapiens
acaugaauaaagccu

SEQ ID NO: 2192954 - RNA, 12 nt, Homo sapiens
augccucugagg

SEQ ID NO: 2192955 - RNA, 21 nt, Homo sapiens
cucuuaccagggagauuugcu

SEQ ID NO: 2192956 - RNA, 20 nt, Homo sapiens
ugaauauuuauauuucacua

SEQ ID NO: 2192957 - RNA, 15 nt, Homo sapiens
uaguuaaaacacaua

SEQ ID NO: 2192958 - RNA, 19 nt, Homo sapiens
agucaccuccugcuccuuu

SEQ ID NO: 2192959 - RNA, 22 nt, Homo sapiens
uugccuaaaauauauuccugag

SEQ ID NO: 2192960 - RNA, 18 nt, Homo sapiens
guaguuugggguguauac

SEQ ID NO: 2192961 - RNA, 23 nt, Homo sapiens
guuugugcugguguaugugugaa

SEQ ID NO: 2192962 - RNA, 14 nt, Homo sapiens
uaccaccuacugau

SEQ ID NO: 2192963 - RNA, 19 nt, Homo sapiens
aagcuuaugcuuaaauuca

SEQ ID NO: 2192964 - RNA, 23 nt, Homo sapiens
aauaccugcccugacaugcacac

SEQ ID NO: 2192965 - RNA, 19 nt, Homo sapiens
cagaugugugcaauguggc

SEQ ID NO: 2192966 - RNA, 13 nt, Homo sapiens
gcugauggugugg

SEQ ID NO: 2192967 - RNA, 20 nt, Homo sapiens
uaaagaauguucuauuucug

SEQ ID NO: 2192968 - RNA, 22 nt, Homo sapiens
gccacgcacaggugcugaccua

SEQ ID NO: 2192969 - RNA, 16 nt, Homo sapiens
cucaauuaccaauaug

SEQ ID NO: 2192970 - RNA, 20 nt, Homo sapiens
gcccaggguccugugccugg

SEQ ID NO: 2192971 - RNA, 14 nt, Homo sapiens
ugcccaaagccauc

SEQ ID NO: 2192972 - RNA, 24 nt, Homo sapiens
aacaaauguuuauuaagcaucaga

SEQ ID NO: 2192973 - RNA, 15 nt, Homo sapiens
gcaaaucgugccuug

SEQ ID NO: 2192974 - RNA, 15 nt, Homo sapiens
uggacacgagccaca

SEQ ID NO: 2192975 - RNA, 14 nt, Homo sapiens
gguuuaugcucaau

SEQ ID NO: 2192976 - RNA, 13 nt, Homo sapiens
cucugcuauggaa

SEQ ID NO: 2192977 - RNA, 15 nt, Homo sapiens
uucuuacucugaaac

SEQ ID NO: 2192978 - RNA, 18 nt, Homo sapiens
uggcacauguauacauau

SEQ ID NO: 2192979 - RNA, 12 nt, Homo sapiens
ucugagacagaa

SEQ ID NO: 2192980 - RNA, 11 nt, Homo sapiens
gggcugagggu

SEQ ID NO: 2192981 - RNA, 16 nt, Homo sapiens
aacuggauagaaccac

SEQ ID NO: 2192982 - RNA, 13 nt, Homo sapiens
aucucuaugugga

SEQ ID NO: 2192983 - RNA, 14 nt, Homo sapiens
aacuuagagaggua

SEQ ID NO: 2192984 - RNA, 19 nt, Homo sapiens
aggaucaguugaggccagg

SEQ ID NO: 2192985 - RNA, 13 nt, Homo sapiens
augaacuuuguca

SEQ ID NO: 2192986 - RNA, 16 nt, Homo sapiens
ugggagguggaagaag

SEQ ID NO: 2192987 - RNA, 22 nt, Homo sapiens
gccaagcuuugaggcucuguca

SEQ ID NO: 2192988 - RNA, 21 nt, Homo sapiens
agcccauggcccccaauaaag

SEQ ID NO: 2192989 - RNA, 17 nt, Homo sapiens
cagugaagaugcagguu

SEQ ID NO: 2192990 - RNA, 13 nt, Homo sapiens
acaugcauuucaa

SEQ ID NO: 2192991 - RNA, 16 nt, Homo sapiens
aaauuaagacagcauu

SEQ ID NO: 2192992 - RNA, 12 nt, Homo sapiens
uggaagcucucc

SEQ ID NO: 2192993 - RNA, 20 nt, Homo sapiens
cuggguuggcgcacccuccc

SEQ ID NO: 2192994 - RNA, 18 nt, Homo sapiens
ugucaaugaguaauucau

SEQ ID NO: 2192995 - RNA, 19 nt, Homo sapiens
uaaaagcaggcuucuauga

SEQ ID NO: 2192996 - RNA, 15 nt, Homo sapiens
aauuuguaaugucuu

SEQ ID NO: 2192997 - RNA, 16 nt, Homo sapiens
ugagacuggcuugccc

SEQ ID NO: 2192998 - RNA, 15 nt, Homo sapiens
guacuacauuugcau

SEQ ID NO: 2192999 - RNA, 16 nt, Homo sapiens
gccacgugucuggaau

SEQ ID NO: 2193000 - RNA, 17 nt, Homo sapiens
gaaaaggccuucuuccc

SEQ ID NO: 2193001 - RNA, 17 nt, Homo sapiens
gucccgggcacugucau

SEQ ID NO: 2193002 - RNA, 12 nt, Homo sapiens
ugauacguguau

SEQ ID NO: 2193003 - RNA, 20 nt, Homo sapiens
gguuucuauuuucucugaua

SEQ ID NO: 2193004 - RNA, 22 nt, Homo sapiens
ugagucuuccagagccuaagaa

SEQ ID NO: 2193005 - RNA, 14 nt, Homo sapiens
ucaguauacugugu

SEQ ID NO: 2193006 - RNA, 23 nt, Homo sapiens
accagccucccucccugugccag

SEQ ID NO: 2193007 - RNA, 20 nt, Homo sapiens
cuucccaaguagcugagauu

SEQ ID NO: 2193008 - RNA, 20 nt, Homo sapiens
gcagugaaugcuagacagaa

SEQ ID NO: 2193009 - RNA, 18 nt, Homo sapiens
gugguaaagugaacaaaa

SEQ ID NO: 2193010 - RNA, 21 nt, Homo sapiens
uagcuaacguguccgaaacca

SEQ ID NO: 2193011 - RNA, 21 nt, Homo sapiens
gaauuuuaugucauauaucaa

SEQ ID NO: 2193012 - RNA, 22 nt, Homo sapiens
caguagacaucguuuuaugaaa

SEQ ID NO: 2193013 - RNA, 16 nt, Homo sapiens
cagcaucaaagagaug

SEQ ID NO: 2193014 - RNA, 23 nt, Homo sapiens
agggcuagaaccuggagagcuag

SEQ ID NO: 2193015 - RNA, 21 nt, Homo sapiens
ucaccaaguaaauuuguauaa

SEQ ID NO: 2193016 - RNA, 13 nt, Homo sapiens
uuaauauugcagu

SEQ ID NO: 2193017 - RNA, 20 nt, Homo sapiens
ugucauucgcucccacauuc

SEQ ID NO: 2193018 - RNA, 21 nt, Homo sapiens
gaggcgcagcccgaagcccag

SEQ ID NO: 2193019 - RNA, 19 nt, Homo sapiens
cuccccguguaaaaagccu

SEQ ID NO: 2193020 - RNA, 20 nt, Homo sapiens
gaccuccuuauguauucuca

SEQ ID NO: 2193021 - RNA, 20 nt, Homo sapiens
aguccuauuuuucaauggga

SEQ ID NO: 2193022 - RNA, 20 nt, Homo sapiens
ucauuuuuacacuauuguga

SEQ ID NO: 2193023 - RNA, 14 nt, Homo sapiens
ucaccccugcacuu

SEQ ID NO: 2193024 - RNA, 20 nt, Homo sapiens
cuuacaagaggauuguaaaa

SEQ ID NO: 2193025 - RNA, 15 nt, Homo sapiens
gugaccuugcaaugu

SEQ ID NO: 2193026 - RNA, 18 nt, Homo sapiens
ucuuugacugucagcaag

SEQ ID NO: 2193027 - RNA, 14 nt, Homo sapiens
ccuccgucauccau

SEQ ID NO: 2193028 - RNA, 21 nt, Homo sapiens
aaauaagaauugaaugucaau

SEQ ID NO: 2193029 - RNA, 16 nt, Homo sapiens
cggcacgggcugggga

SEQ ID NO: 2193030 - RNA, 19 nt, Homo sapiens
acaaauaaagugcaguuua

SEQ ID NO: 2193031 - RNA, 20 nt, Homo sapiens
gccuuaaugagaacauuuac

SEQ ID NO: 2193032 - RNA, 20 nt, Homo sapiens
ugacacacagcagcacugca

SEQ ID NO: 2193033 - RNA, 22 nt, Homo sapiens
gaagauuagagguuugucaaca

SEQ ID NO: 2193034 - RNA, 19 nt, Homo sapiens
ccaguggaagcagguguau

SEQ ID NO: 2193035 - RNA, 19 nt, Homo sapiens
auauauuccuuacuagaaa

SEQ ID NO: 2193036 - RNA, 19 nt, Homo sapiens
uccuguacauugugggaug

SEQ ID NO: 2193037 - RNA, 14 nt, Homo sapiens
ucuaaugugucucu

SEQ ID NO: 2193038 - RNA, 20 nt, Homo sapiens
caauaaauuuuuauuacuua

SEQ ID NO: 2193039 - RNA, 14 nt, Homo sapiens
aguuucaucaguca

SEQ ID NO: 2193040 - RNA, 17 nt, Homo sapiens
gaacuuauucucuguag

SEQ ID NO: 2193041 - RNA, 20 nt, Homo sapiens
acuagggcuuauccaugccu

SEQ ID NO: 2193042 - RNA, 16 nt, Homo sapiens
uuacaccaacuccuaa

SEQ ID NO: 2193043 - RNA, 15 nt, Homo sapiens
aguauuuuugccaaa

SEQ ID NO: 2193044 - RNA, 14 nt, Homo sapiens
uaugaagggccuug

SEQ ID NO: 2193045 - RNA, 15 nt, Homo sapiens
aguacuuacaucagg

SEQ ID NO: 2193046 - RNA, 12 nt, Homo sapiens
ugccaagccagg

SEQ ID NO: 2193047 - RNA, 16 nt, Homo sapiens
cuucauguaaggacag

SEQ ID NO: 2193048 - RNA, 16 nt, Homo sapiens
ugaaaauuuaaucuua

SEQ ID NO: 2193049 - RNA, 17 nt, Homo sapiens
aggccaccucagucuca

SEQ ID NO: 2193050 - RNA, 17 nt, Homo sapiens
cugccucagccuuccaa

SEQ ID NO: 2193051 - RNA, 17 nt, Homo sapiens
ucacuggggaagccagu

SEQ ID NO: 2193052 - RNA, 17 nt, Homo sapiens
aaaccaaccaugaauga

SEQ ID NO: 2193053 - RNA, 14 nt, Homo sapiens
caauaaagcaaugu

SEQ ID NO: 2193054 - RNA, 12 nt, Homo sapiens
cagcuccuagua

SEQ ID NO: 2193055 - RNA, 14 nt, Homo sapiens
auucuuacauauga

SEQ ID NO: 2193056 - RNA, 18 nt, Homo sapiens
agccuguggccccgaggc

SEQ ID NO: 2193057 - RNA, 17 nt, Homo sapiens
ucuaguuaccacggcaa

SEQ ID NO: 2193058 - RNA, 21 nt, Homo sapiens
acccugggagccaguccucca

SEQ ID NO: 2193059 - RNA, 21 nt, Homo sapiens
cuauuccuuaugggaucauuu

SEQ ID NO: 2193060 - RNA, 13 nt, Homo sapiens
aaaagcagaauuu

SEQ ID NO: 2193061 - RNA, 16 nt, Homo sapiens
auuuuggcgaaucuca

SEQ ID NO: 2193062 - RNA, 16 nt, Homo sapiens
gcuuagugcacaagca

SEQ ID NO: 2193063 - RNA, 21 nt, Homo sapiens
gacaaaccagagcagagagca

SEQ ID NO: 2193064 - RNA, 15 nt, Homo sapiens
gaacucuagccaaau

SEQ ID NO: 2193065 - RNA, 16 nt, Homo sapiens
ucugugcucauguuug

SEQ ID NO: 2193066 - RNA, 21 nt, Homo sapiens
agugcuuuaagaaugaacaca

SEQ ID NO: 2193067 - RNA, 13 nt, Homo sapiens
ugaccccuaggca

SEQ ID NO: 2193068 - RNA, 12 nt, Homo sapiens
acuggaucccag

SEQ ID NO: 2193069 - RNA, 17 nt, Homo sapiens
aauuagccaaccaggcu

SEQ ID NO: 2193070 - RNA, 14 nt, Homo sapiens
gccaggagugggcu

SEQ ID NO: 2193071 - RNA, 14 nt, Homo sapiens
aauugacagggaaa

SEQ ID NO: 2193072 - RNA, 13 nt, Homo sapiens
gugcauugauaca

SEQ ID NO: 2193073 - RNA, 18 nt, Homo sapiens
uugcugacaggugaugcu

SEQ ID NO: 2193074 - RNA, 23 nt, Homo sapiens
ugcucugguuguuucuguuccaa

SEQ ID NO: 2193075 - RNA, 20 nt, Homo sapiens
guuagguaucaaaauguugu

SEQ ID NO: 2193076 - RNA, 23 nt, Homo sapiens
uauuaagaggcagaaaauugcac

SEQ ID NO: 2193077 - RNA, 23 nt, Homo sapiens
aaauaacagaaagccugggugac

SEQ ID NO: 2193078 - RNA, 16 nt, Homo sapiens
cccagccccaaagaca

SEQ ID NO: 2193079 - RNA, 23 nt, Homo sapiens
aaagcuaagugaauuuuugcaca

SEQ ID NO: 2193080 - RNA, 13 nt, Homo sapiens
uguccauugacau

SEQ ID NO: 2193081 - RNA, 21 nt, Homo sapiens
aauuucaguccuguaguuuua

SEQ ID NO: 2193082 - RNA, 13 nt, Homo sapiens
auaauaccucaau

SEQ ID NO: 2193083 - RNA, 21 nt, Homo sapiens
ccaucucuauuaaaauacaaa

SEQ ID NO: 2193084 - RNA, 19 nt, Homo sapiens
aggaaaacacuauuuccaa

SEQ ID NO: 2193085 - RNA, 14 nt, Homo sapiens
caaaccucaucuuu

SEQ ID NO: 2193086 - RNA, 14 nt, Homo sapiens
caaauuucaucucc

SEQ ID NO: 2193087 - RNA, 21 nt, Homo sapiens
ucauucccuucgacagcauuu

SEQ ID NO: 2193088 - RNA, 17 nt, Homo sapiens
agaauaaauucuaccuc

SEQ ID NO: 2193089 - RNA, 14 nt, Homo sapiens
aaccucccuagguc

SEQ ID NO: 2193090 - RNA, 14 nt, Homo sapiens
auggauccuuccau

SEQ ID NO: 2193091 - RNA, 21 nt, Homo sapiens
gcuuauacacuuacacuuuau

SEQ ID NO: 2193092 - RNA, 17 nt, Homo sapiens
ugaauagcucucugugu

SEQ ID NO: 2193093 - RNA, 20 nt, Homo sapiens
aucucucaaaacaauauuac

SEQ ID NO: 2193094 - RNA, 14 nt, Homo sapiens
ucucacuccagcca

SEQ ID NO: 2193095 - RNA, 12 nt, Homo sapiens
uucuuacucucc

SEQ ID NO: 2193096 - RNA, 12 nt, Homo sapiens
ucuuuacuccuc

SEQ ID NO: 2193097 - RNA, 16 nt, Homo sapiens
gagaugaguugcaguu

SEQ ID NO: 2193098 - RNA, 22 nt, Homo sapiens
acauggcuggcacugagcagua

SEQ ID NO: 2193099 - RNA, 14 nt, Homo sapiens
uagagaugugcaau

SEQ ID NO: 2193100 - RNA, 23 nt, Homo sapiens
ucaccugaaauaauacauugcag

SEQ ID NO: 2193101 - RNA, 21 nt, Homo sapiens
ggugaugcucuggcuugcccc

SEQ ID NO: 2193102 - RNA, 15 nt, Homo sapiens
uggaaaaacaggaua

SEQ ID NO: 2193103 - RNA, 15 nt, Homo sapiens
cgagugcacugcauu

SEQ ID NO: 2193104 - RNA, 15 nt, Homo sapiens
aauaagcccaacaga

SEQ ID NO: 2193105 - RNA, 20 nt, Homo sapiens
uuaugcagagacagcuguuu

SEQ ID NO: 2193106 - RNA, 14 nt, Homo sapiens
gccaaaaauagcua

SEQ ID NO: 2193107 - RNA, 15 nt, Homo sapiens
guuacuggugauguu

SEQ ID NO: 2193108 - RNA, 22 nt, Homo sapiens
ccugcugccggaagucauccca

SEQ ID NO: 2193109 - RNA, 12 nt, Homo sapiens
cucgccaccugc

SEQ ID NO: 2193110 - RNA, 17 nt, Homo sapiens
acuuuaaaacugcucau

SEQ ID NO: 2193111 - RNA, 15 nt, Homo sapiens
aguggaagaagggaa

SEQ ID NO: 2193112 - RNA, 12 nt, Homo sapiens
gaaggagaaaau

SEQ ID NO: 2193113 - RNA, 17 nt, Homo sapiens
cacagccuuugcuucca

SEQ ID NO: 2193114 - RNA, 17 nt, Homo sapiens
gggcuuggcuuuucaca

SEQ ID NO: 2193115 - RNA, 14 nt, Homo sapiens
gggguccugacuca

SEQ ID NO: 2193116 - RNA, 22 nt, Homo sapiens
auugccuugcuuuuaucacuua

SEQ ID NO: 2193117 - RNA, 22 nt, Homo sapiens
uuauuugggagggaaaagggaa

SEQ ID NO: 2193118 - RNA, 20 nt, Homo sapiens
cugaaaaaugcucaaucuca

SEQ ID NO: 2193119 - RNA, 19 nt, Homo sapiens
acuuuguggcaaucugugg

SEQ ID NO: 2193120 - RNA, 21 nt, Homo sapiens
acuuuuuuagaaaugcaaaau

SEQ ID NO: 2193121 - RNA, 14 nt, Homo sapiens
ggcucacucacaga

SEQ ID NO: 2193122 - RNA, 14 nt, Homo sapiens
aaaauuugacauua

SEQ ID NO: 2193123 - RNA, 17 nt, Homo sapiens
uuggccacacacugagu

SEQ ID NO: 2193124 - RNA, 15 nt, Homo sapiens
gaugggggaugcuuc

SEQ ID NO: 2193125 - RNA, 18 nt, Homo sapiens
agcccugcagucacagcu

SEQ ID NO: 2193126 - RNA, 17 nt, Homo sapiens
uucugcaccacaccugg

SEQ ID NO: 2193127 - RNA, 14 nt, Homo sapiens
ugaugagcugugca

SEQ ID NO: 2193128 - RNA, 19 nt, Homo sapiens
cgggcacucagaagacacu

SEQ ID NO: 2193129 - RNA, 22 nt, Homo sapiens
ggccacguguucucacacuggu

SEQ ID NO: 2193130 - RNA, 13 nt, Homo sapiens
guuaaaugaacuu

SEQ ID NO: 2193131 - RNA, 13 nt, Homo sapiens
gauuaaugaucau

SEQ ID NO: 2193132 - RNA, 21 nt, Homo sapiens
auuuagacuuacuauuacaua

SEQ ID NO: 2193133 - RNA, 22 nt, Homo sapiens
gcaauucuaacuuuuuugcuau

SEQ ID NO: 2193134 - RNA, 18 nt, Homo sapiens
cagcuuccugucaagcaa

SEQ ID NO: 2193135 - RNA, 13 nt, Homo sapiens
uucuuguugauag

SEQ ID NO: 2193136 - RNA, 13 nt, Homo sapiens
aaauauuucucaa

SEQ ID NO: 2193137 - RNA, 17 nt, Homo sapiens
auucucaaaaacaaaga

SEQ ID NO: 2193138 - RNA, 14 nt, Homo sapiens
ggaauaaguguuua

SEQ ID NO: 2193139 - RNA, 16 nt, Homo sapiens
ucugaccuccuccuuc

SEQ ID NO: 2193140 - RNA, 16 nt, Homo sapiens
uaaaaaucuagcacac

SEQ ID NO: 2193141 - RNA, 22 nt, Homo sapiens
aucaucagagccuuuccucaaa

SEQ ID NO: 2193142 - RNA, 17 nt, Homo sapiens
cauaagaggugaucucu

SEQ ID NO: 2193143 - RNA, 15 nt, Homo sapiens
uauuaagaauaucua

SEQ ID NO: 2193144 - RNA, 15 nt, Homo sapiens
caguagagccagcuu

SEQ ID NO: 2193145 - RNA, 19 nt, Homo sapiens
ccagguugggggcaguguu

SEQ ID NO: 2193146 - RNA, 14 nt, Homo sapiens
ggacagacacuguu

SEQ ID NO: 2193147 - RNA, 15 nt, Homo sapiens
cuccccggcaucauu

SEQ ID NO: 2193148 - RNA, 16 nt, Homo sapiens
guuuaacccuggauaa

SEQ ID NO: 2193149 - RNA, 16 nt, Homo sapiens
augacaguauuccauu

SEQ ID NO: 2193150 - RNA, 16 nt, Homo sapiens
cugacucaacauggag

SEQ ID NO: 2193151 - RNA, 20 nt, Homo sapiens
aacuugcaguauaucacaga

SEQ ID NO: 2193152 - RNA, 13 nt, Homo sapiens
caucuugugagug

SEQ ID NO: 2193153 - RNA, 13 nt, Homo sapiens
cuguguguguucu

SEQ ID NO: 2193154 - RNA, 17 nt, Homo sapiens
ggacauucucuuugaua

SEQ ID NO: 2193155 - RNA, 20 nt, Homo sapiens
ugaucccuaggucuugggag

SEQ ID NO: 2193156 - RNA, 19 nt, Homo sapiens
uuauacuguggcuaugcaa

SEQ ID NO: 2193157 - RNA, 18 nt, Homo sapiens
gauccacccaccucggcc

SEQ ID NO: 2193158 - RNA, 19 nt, Homo sapiens
uugcccaaccaaugcacac

SEQ ID NO: 2193159 - RNA, 21 nt, Homo sapiens
cuaguaccacagaaguucaau

SEQ ID NO: 2193160 - RNA, 16 nt, Homo sapiens
uacacuuugaaguauu

SEQ ID NO: 2193161 - RNA, 20 nt, Homo sapiens
ucaugaauaaaaacuuugca

SEQ ID NO: 2193162 - RNA, 19 nt, Homo sapiens
uagaagcagcgagugcaug

SEQ ID NO: 2193163 - RNA, 19 nt, Homo sapiens
uagaacuuuucuauuaacu

SEQ ID NO: 2193164 - RNA, 18 nt, Homo sapiens
cuaaggugaagaaucuuu

SEQ ID NO: 2193165 - RNA, 19 nt, Homo sapiens
ucccaaagugaacucucaa

SEQ ID NO: 2193166 - RNA, 16 nt, Homo sapiens
aucuuuaagcugugau

SEQ ID NO: 2193167 - RNA, 16 nt, Homo sapiens
ccuagguucacuuugg

SEQ ID NO: 2193168 - RNA, 18 nt, Homo sapiens
uggacugugcuggugcau

SEQ ID NO: 2193169 - RNA, 21 nt, Homo sapiens
gguggaugccugguggcagcu

SEQ ID NO: 2193170 - RNA, 23 nt, Homo sapiens
cuucaugcuuuugcuugcaaugu

SEQ ID NO: 2193171 - RNA, 23 nt, Homo sapiens
cuccccaccccacacacacuggc

SEQ ID NO: 2193172 - RNA, 12 nt, Homo sapiens
aagcugcugcuu

SEQ ID NO: 2193173 - RNA, 17 nt, Homo sapiens
auuuccuuuuccuucaa

SEQ ID NO: 2193174 - RNA, 19 nt, Homo sapiens
guuuuccagucucuuguac

SEQ ID NO: 2193175 - RNA, 17 nt, Homo sapiens
gaacagccgacuuugag

SEQ ID NO: 2193176 - RNA, 16 nt, Homo sapiens
uuccgauacaaagugu

SEQ ID NO: 2193177 - RNA, 23 nt, Homo sapiens
uggaaaagccuucuuauaucuga

SEQ ID NO: 2193178 - RNA, 16 nt, Homo sapiens
aauaauguacaucugg

SEQ ID NO: 2193179 - RNA, 19 nt, Homo sapiens
cugcaauauagagacugug

SEQ ID NO: 2193180 - RNA, 13 nt, Homo sapiens
cauaggucccuga

SEQ ID NO: 2193181 - RNA, 16 nt, Homo sapiens
gaccagccugggcaac

SEQ ID NO: 2193182 - RNA, 20 nt, Homo sapiens
uaucacugucuuugacugug

SEQ ID NO: 2193183 - RNA, 19 nt, Homo sapiens
uaggaauguccaccaugaa

SEQ ID NO: 2193184 - RNA, 16 nt, Homo sapiens
uacuugggccauagcu

SEQ ID NO: 2193185 - RNA, 22 nt, Homo sapiens
acuggauuggccaaacaucaga

SEQ ID NO: 2193186 - RNA, 14 nt, Homo sapiens
aaguuuaaccuaaa

SEQ ID NO: 2193187 - RNA, 15 nt, Homo sapiens
ggcacaacaucaagc

SEQ ID NO: 2193188 - RNA, 20 nt, Homo sapiens
cuggcuguggccuaaccugc

SEQ ID NO: 2193189 - RNA, 19 nt, Homo sapiens
gacuaauuuuaaagaggaa

SEQ ID NO: 2193190 - RNA, 14 nt, Homo sapiens
uaacgcgucuuccu

SEQ ID NO: 2193191 - RNA, 18 nt, Homo sapiens
caauuaaaaugacaagca

SEQ ID NO: 2193192 - RNA, 22 nt, Homo sapiens
agagguuacagguuacagugag

SEQ ID NO: 2193193 - RNA, 16 nt, Homo sapiens
aucugaaaggccagca

SEQ ID NO: 2193194 - RNA, 13 nt, Homo sapiens
uucaucugggaca

SEQ ID NO: 2193195 - RNA, 16 nt, Homo sapiens
cugcuccguuggucag

SEQ ID NO: 2193196 - RNA, 15 nt, Homo sapiens
agcugagauuccugg

SEQ ID NO: 2193197 - RNA, 14 nt, Homo sapiens
gauucccaucugau

SEQ ID NO: 2193198 - RNA, 15 nt, Homo sapiens
agcgucccagucucu

SEQ ID NO: 2193199 - RNA, 20 nt, Homo sapiens
cagcccauuuuaucuuugaa

SEQ ID NO: 2193200 - RNA, 14 nt, Homo sapiens
uguacagauuuuau

SEQ ID NO: 2193201 - RNA, 13 nt, Homo sapiens
uucacauucugaa

SEQ ID NO: 2193202 - RNA, 21 nt, Homo sapiens
agguccucccgggagcacaga

SEQ ID NO: 2193203 - RNA, 21 nt, Homo sapiens
cugcccuccagcugcugcucu

SEQ ID NO: 2193204 - RNA, 22 nt, Homo sapiens
agggucuuuuacccugugucag

SEQ ID NO: 2193205 - RNA, 21 nt, Homo sapiens
caaaaaaaaaaaaaaucacaa

SEQ ID NO: 2193206 - RNA, 13 nt, Homo sapiens
ucuugaggagcuc

SEQ ID NO: 2193207 - RNA, 23 nt, Homo sapiens
acagaaggaucgugucugcugac

SEQ ID NO: 2193208 - RNA, 14 nt, Homo sapiens
cagaggcagggcag

SEQ ID NO: 2193209 - RNA, 16 nt, Homo sapiens
agcauacguacacauu

SEQ ID NO: 2193210 - RNA, 23 nt, Homo sapiens
aagauauucagguggccagaaga

SEQ ID NO: 2193211 - RNA, 18 nt, Homo sapiens
uccuaagagagagagaca

SEQ ID NO: 2193212 - RNA, 16 nt, Homo sapiens
uucucacacacuggcu

SEQ ID NO: 2193213 - RNA, 17 nt, Homo sapiens
uaagaguagauugauuc

SEQ ID NO: 2193214 - RNA, 22 nt, Homo sapiens
aggccaccccuaggaacucagu

SEQ ID NO: 2193215 - RNA, 18 nt, Homo sapiens
gcucuuccuggacaguga

SEQ ID NO: 2193216 - RNA, 13 nt, Homo sapiens
uccaggaaaaagg

SEQ ID NO: 2193217 - RNA, 18 nt, Homo sapiens
aaauaaaacaauguuaac

SEQ ID NO: 2193218 - RNA, 21 nt, Homo sapiens
gggcaggcaagguuuacacug

SEQ ID NO: 2193219 - RNA, 19 nt, Homo sapiens
caacaggaaggaaccagaa

SEQ ID NO: 2193220 - RNA, 17 nt, Homo sapiens
caggcacccucccaguu

SEQ ID NO: 2193221 - RNA, 20 nt, Homo sapiens
agcuacuggacuaugcugau

SEQ ID NO: 2193222 - RNA, 17 nt, Homo sapiens
aacauaguaacuuuaca

SEQ ID NO: 2193223 - RNA, 22 nt, Homo sapiens
acuuuagguaguagaaucucag

SEQ ID NO: 2193224 - RNA, 22 nt, Homo sapiens
accauaagcagccagacccaca

SEQ ID NO: 2193225 - RNA, 12 nt, Homo sapiens
aucuacauucac

SEQ ID NO: 2193226 - RNA, 22 nt, Homo sapiens
aaacuauaugccauaaaccuca

SEQ ID NO: 2193227 - RNA, 19 nt, Homo sapiens
ccucagccucccuuugcca

SEQ ID NO: 2193228 - RNA, 22 nt, Homo sapiens
aaauccaaaaagaaaugauguu

SEQ ID NO: 2193229 - RNA, 15 nt, Homo sapiens
auggacaagauuacc

SEQ ID NO: 2193230 - RNA, 17 nt, Homo sapiens
uguuccuguugaaucuu

SEQ ID NO: 2193231 - RNA, 19 nt, Homo sapiens
gacacuuugacauuuccua

SEQ ID NO: 2193232 - RNA, 18 nt, Homo sapiens
guaacuugggcuguaaag

SEQ ID NO: 2193233 - RNA, 12 nt, Homo sapiens
cauugagaucac

SEQ ID NO: 2193234 - RNA, 14 nt, Homo sapiens
acacugaaaggaaa

SEQ ID NO: 2193235 - RNA, 14 nt, Homo sapiens
auuauuuugcacug

SEQ ID NO: 2193236 - RNA, 18 nt, Homo sapiens
ccugcuuucuaauuaaaa

SEQ ID NO: 2193237 - RNA, 14 nt, Homo sapiens
cgacacauuuacca

SEQ ID NO: 2193238 - RNA, 22 nt, Homo sapiens
uucaacagaugaccguguacaa

SEQ ID NO: 2193239 - RNA, 16 nt, Homo sapiens
gaaaaacaacccagcg

SEQ ID NO: 2193240 - RNA, 13 nt, Homo sapiens
ugggaccaggaua

SEQ ID NO: 2193241 - RNA, 22 nt, Homo sapiens
uuggugccaccaaaagugcucc

SEQ ID NO: 2193242 - RNA, 18 nt, Homo sapiens
gauguugcuggacuguca

SEQ ID NO: 2193243 - RNA, 16 nt, Homo sapiens
agcauuuaauccaaac

SEQ ID NO: 2193244 - RNA, 12 nt, Homo sapiens
ccaaaacacugu

SEQ ID NO: 2193245 - RNA, 20 nt, Homo sapiens
aagguucucagguguugcca

SEQ ID NO: 2193246 - RNA, 18 nt, Homo sapiens
gaaaugagaggcauuucc

SEQ ID NO: 2193247 - RNA, 13 nt, Homo sapiens
aucuuaaacaaug

SEQ ID NO: 2193248 - RNA, 17 nt, Homo sapiens
cuuugucccggggcucc

SEQ ID NO: 2193249 - RNA, 15 nt, Homo sapiens
auugaaugcgcuuua

SEQ ID NO: 2193250 - RNA, 22 nt, Homo sapiens
ugcagccaggccucgccugccc

SEQ ID NO: 2193251 - RNA, 18 nt, Homo sapiens
ccuccagagacacugagc

SEQ ID NO: 2193252 - RNA, 22 nt, Homo sapiens
gugcucauacguaucugcucau

SEQ ID NO: 2193253 - RNA, 13 nt, Homo sapiens
ucaaaacuaguuc

SEQ ID NO: 2193254 - RNA, 12 nt, Homo sapiens
gaaaguucuuaa

SEQ ID NO: 2193255 - RNA, 17 nt, Homo sapiens
ccacacuagcuugcaga

SEQ ID NO: 2193256 - RNA, 13 nt, Homo sapiens
uaaugaacaugug

SEQ ID NO: 2193257 - RNA, 12 nt, Homo sapiens
acaagauaccaa

SEQ ID NO: 2193258 - RNA, 15 nt, Homo sapiens
uccauccccaguugg

SEQ ID NO: 2193259 - RNA, 15 nt, Homo sapiens
acauguuaucaaauc

SEQ ID NO: 2193260 - RNA, 16 nt, Homo sapiens
uacagcaggugcucaa

SEQ ID NO: 2193261 - RNA, 14 nt, Homo sapiens
uguugacugugauu

SEQ ID NO: 2193262 - RNA, 19 nt, Homo sapiens
uccagccacuggcugcuaa

SEQ ID NO: 2193263 - RNA, 15 nt, Homo sapiens
aacucuaucugucau

SEQ ID NO: 2193264 - RNA, 17 nt, Homo sapiens
gaugauuuguggaaaag

SEQ ID NO: 2193265 - RNA, 14 nt, Homo sapiens
ucuucaucugugac

SEQ ID NO: 2193266 - RNA, 13 nt, Homo sapiens
cacugaguacaaa

SEQ ID NO: 2193267 - RNA, 17 nt, Homo sapiens
gcaaaauauuugacuau

SEQ ID NO: 2193268 - RNA, 16 nt, Homo sapiens
cuaauguacuuucacu

SEQ ID NO: 2193269 - RNA, 16 nt, Homo sapiens
cucagagcuguccuca

SEQ ID NO: 2193270 - RNA, 22 nt, Homo sapiens
caccaaggaaacgcuaccucuc

SEQ ID NO: 2193271 - RNA, 19 nt, Homo sapiens
caaaagcagauacuugagg

SEQ ID NO: 2193272 - RNA, 22 nt, Homo sapiens
gaaauguaccggcuuccauccu

SEQ ID NO: 2193273 - RNA, 18 nt, Homo sapiens
cauuagcaguugcucaca

SEQ ID NO: 2193274 - RNA, 16 nt, Homo sapiens
cauccuccauugcucc

SEQ ID NO: 2193275 - RNA, 23 nt, Homo sapiens
augaccaguuguuauuuacagcu

SEQ ID NO: 2193276 - RNA, 20 nt, Homo sapiens
cuucuccaucccucuaauga

SEQ ID NO: 2193277 - RNA, 21 nt, Homo sapiens
gcugaccuagaccaguuugca

SEQ ID NO: 2193278 - RNA, 17 nt, Homo sapiens
ugguuguauaaagcaaa

SEQ ID NO: 2193279 - RNA, 12 nt, Homo sapiens
cucuugccccuu

SEQ ID NO: 2193280 - RNA, 19 nt, Homo sapiens
aacucauccguuugccaau

SEQ ID NO: 2193281 - RNA, 23 nt, Homo sapiens
uaaccuaugauaauuauuuacaa

SEQ ID NO: 2193282 - RNA, 17 nt, Homo sapiens
uaguggucucuacugug

SEQ ID NO: 2193283 - RNA, 14 nt, Homo sapiens
gcagcuuauucaca

SEQ ID NO: 2193284 - RNA, 23 nt, Homo sapiens
gaccuggagacugacaaccucau

SEQ ID NO: 2193285 - RNA, 20 nt, Homo sapiens
agaugccuccucuguccuca

SEQ ID NO: 2193286 - RNA, 20 nt, Homo sapiens
uaaaaaguuaagcugcuaua

SEQ ID NO: 2193287 - RNA, 19 nt, Homo sapiens
uuuuuuaaauaaaagcagc

SEQ ID NO: 2193288 - RNA, 22 nt, Homo sapiens
gcaaugcuaagcuguuugcuca

SEQ ID NO: 2193289 - RNA, 22 nt, Homo sapiens
gucccagggaagguggggcccu

SEQ ID NO: 2193290 - RNA, 23 nt, Homo sapiens
auuccuuugucuucaaacuguga

SEQ ID NO: 2193291 - RNA, 15 nt, Homo sapiens
ucacgccauugcacu

SEQ ID NO: 2193292 - RNA, 20 nt, Homo sapiens
ugaaaacaguguguaaacaa

SEQ ID NO: 2193293 - RNA, 21 nt, Homo sapiens
gaucgugggccgcacuggggc

SEQ ID NO: 2193294 - RNA, 14 nt, Homo sapiens
cuguaaacuuccaa

SEQ ID NO: 2193295 - RNA, 19 nt, Homo sapiens
caugggccaccgcccagcu

SEQ ID NO: 2193296 - RNA, 19 nt, Homo sapiens
auucagaacugagggcucu

SEQ ID NO: 2193297 - RNA, 18 nt, Homo sapiens
ucucauuguuuucuuuga

SEQ ID NO: 2193298 - RNA, 17 nt, Homo sapiens
aucaagaaacauucaga

SEQ ID NO: 2193299 - RNA, 13 nt, Homo sapiens
ugcagccagcuca

SEQ ID NO: 2193300 - RNA, 13 nt, Homo sapiens
cagaacagccauu

SEQ ID NO: 2193301 - RNA, 22 nt, Homo sapiens
gauacugucucuccagugaaau

SEQ ID NO: 2193302 - RNA, 14 nt, Homo sapiens
ggaaucgacuguau

SEQ ID NO: 2193303 - RNA, 19 nt, Homo sapiens
acugaaucugcuaccaaaa

SEQ ID NO: 2193304 - RNA, 22 nt, Homo sapiens
uguguaaauacaguggaucuca

SEQ ID NO: 2193305 - RNA, 20 nt, Homo sapiens
uugcucugaauguccugaca

SEQ ID NO: 2193306 - RNA, 14 nt, Homo sapiens
gaagguuaucagug

SEQ ID NO: 2193307 - RNA, 12 nt, Homo sapiens
aaauguccaaaa

SEQ ID NO: 2193308 - RNA, 20 nt, Homo sapiens
uggucuuauagaaagcacua

SEQ ID NO: 2193309 - RNA, 15 nt, Homo sapiens
acaagcuuuaugugg

SEQ ID NO: 2193310 - RNA, 14 nt, Homo sapiens
agacuuaaaagagc

SEQ ID NO: 2193311 - RNA, 18 nt, Homo sapiens
cuucuagcgucagugcug

SEQ ID NO: 2193312 - RNA, 18 nt, Homo sapiens
caacaaaugaauuuucca

SEQ ID NO: 2193313 - RNA, 17 nt, Homo sapiens
aacaaugccaugaacaa

SEQ ID NO: 2193314 - RNA, 13 nt, Homo sapiens
ucccaugcaacac

SEQ ID NO: 2193315 - RNA, 16 nt, Homo sapiens
ccggacagagcacguu

SEQ ID NO: 2193316 - RNA, 23 nt, Homo sapiens
agcauuugguagaaggacugaac

SEQ ID NO: 2193317 - RNA, 15 nt, Homo sapiens
ucccauucacagaua

SEQ ID NO: 2193318 - RNA, 15 nt, Homo sapiens
acagacacucccacu

SEQ ID NO: 2193319 - RNA, 22 nt, Homo sapiens
auggacacuacacuggggcccu

SEQ ID NO: 2193320 - RNA, 22 nt, Homo sapiens
ggaggugcuuaagcagaagcau

SEQ ID NO: 2193321 - RNA, 18 nt, Homo sapiens
cagguacaggcuggagau

SEQ ID NO: 2193322 - RNA, 21 nt, Homo sapiens
gcagucagguccaugugcacu

SEQ ID NO: 2193323 - RNA, 18 nt, Homo sapiens
agcaaagguuggccuuac

SEQ ID NO: 2193324 - RNA, 22 nt, Homo sapiens
uuauaggcacuugcuacuucag

SEQ ID NO: 2193325 - RNA, 17 nt, Homo sapiens
caaaaaaacagacccac

SEQ ID NO: 2193326 - RNA, 18 nt, Homo sapiens
acagcaugugcaauaugc

SEQ ID NO: 2193327 - RNA, 18 nt, Homo sapiens
gggccagggucuguguga

SEQ ID NO: 2193328 - RNA, 15 nt, Homo sapiens
aagcugacauugcca

SEQ ID NO: 2193329 - RNA, 18 nt, Homo sapiens
ugcacuccucacacagaa

SEQ ID NO: 2193330 - RNA, 11 nt, Homo sapiens
uuuuuguggau

SEQ ID NO: 2193331 - RNA, 15 nt, Homo sapiens
uuaucacuuuggggu

SEQ ID NO: 2193332 - RNA, 13 nt, Homo sapiens
cauuaaaugcaaa

SEQ ID NO: 2193333 - RNA, 16 nt, Homo sapiens
agagcaguacucugaa

SEQ ID NO: 2193334 - RNA, 17 nt, Homo sapiens
cuuauuuuaccuucuca

SEQ ID NO: 2193335 - RNA, 15 nt, Homo sapiens
aaagggaacagugag

SEQ ID NO: 2193336 - RNA, 16 nt, Homo sapiens
cccucgacauuuucuc

SEQ ID NO: 2193337 - RNA, 13 nt, Homo sapiens
caggaugcuccag

SEQ ID NO: 2193338 - RNA, 18 nt, Homo sapiens
uaagguuugccuguguac

SEQ ID NO: 2193339 - RNA, 17 nt, Homo sapiens
auauggacacuacacug

SEQ ID NO: 2193340 - RNA, 14 nt, Homo sapiens
ucuaagaucuugcc

SEQ ID NO: 2193341 - RNA, 14 nt, Homo sapiens
cagcagugccuugu

SEQ ID NO: 2193342 - RNA, 9 nt, Homo sapiens
uuagcucau

SEQ ID NO: 2193343 - RNA, 20 nt, Homo sapiens
uacucaguaacagugcagua

SEQ ID NO: 2193344 - RNA, 18 nt, Homo sapiens
aaguucuuaguugcugua

SEQ ID NO: 2193345 - RNA, 21 nt, Homo sapiens
caauggggauguuguguuucu

SEQ ID NO: 2193346 - RNA, 18 nt, Homo sapiens
gcucggauucaacuaccu

SEQ ID NO: 2193347 - RNA, 16 nt, Homo sapiens
ccuggacauauuccca

SEQ ID NO: 2193348 - RNA, 23 nt, Homo sapiens
uuguguguucacuaaacucugaa

SEQ ID NO: 2193349 - RNA, 12 nt, Homo sapiens
aggaagccaaag

SEQ ID NO: 2193350 - RNA, 13 nt, Homo sapiens
gagcaacagccua

SEQ ID NO: 2193351 - RNA, 21 nt, Homo sapiens
ucuguuuauaaacauuguaua

SEQ ID NO: 2193352 - RNA, 23 nt, Homo sapiens
cccccgaagaaggaccagugaag

SEQ ID NO: 2193353 - RNA, 13 nt, Homo sapiens
caggcugugccaa

SEQ ID NO: 2193354 - RNA, 20 nt, Homo sapiens
auccuuucaagacagaaaga

SEQ ID NO: 2193355 - RNA, 18 nt, Homo sapiens
ucacaacagucaccucac

SEQ ID NO: 2193356 - RNA, 18 nt, Homo sapiens
uacccccaguaaaaucaa

SEQ ID NO: 2193357 - RNA, 20 nt, Homo sapiens
cuccacugaaagaaguggga

SEQ ID NO: 2193358 - RNA, 23 nt, Homo sapiens
ggaagggggugcaaagacucuga

SEQ ID NO: 2193359 - RNA, 16 nt, Homo sapiens
ucuauacuuaaucuca

SEQ ID NO: 2193360 - RNA, 14 nt, Homo sapiens
uguaguuuaguucu

SEQ ID NO: 2193361 - RNA, 20 nt, Homo sapiens
guuuaccuaccguagcuuuu

SEQ ID NO: 2193362 - RNA, 15 nt, Homo sapiens
ugucccagaaaagca

SEQ ID NO: 2193363 - RNA, 13 nt, Homo sapiens
cuaucaacaaaga

SEQ ID NO: 2193364 - RNA, 16 nt, Homo sapiens
agaguggccugugagc

SEQ ID NO: 2193365 - RNA, 13 nt, Homo sapiens
aucagagaacuuu

SEQ ID NO: 2193366 - RNA, 22 nt, Homo sapiens
aggggccaauucguucucugcc

SEQ ID NO: 2193367 - RNA, 20 nt, Homo sapiens
caauaagaaaugaacaaaag

SEQ ID NO: 2193368 - RNA, 16 nt, Homo sapiens
uggaauuacagacuca

SEQ ID NO: 2193369 - RNA, 20 nt, Homo sapiens
aguuaauucucaccauuccu

SEQ ID NO: 2193370 - RNA, 19 nt, Homo sapiens
uaagcccccucaacuacca

SEQ ID NO: 2193371 - RNA, 17 nt, Homo sapiens
cagaaaaguagaauuau

SEQ ID NO: 2193372 - RNA, 12 nt, Homo sapiens
agccaagcaaaa

SEQ ID NO: 2193373 - RNA, 13 nt, Homo sapiens
agcauauggaauu

SEQ ID NO: 2193374 - RNA, 20 nt, Homo sapiens
aguaacaauacaaauggauu

SEQ ID NO: 2193375 - RNA, 23 nt, Homo sapiens
gccgguccuucccucucaugacu

SEQ ID NO: 2193376 - RNA, 15 nt, Homo sapiens
gcuccuugcccucaa

SEQ ID NO: 2193377 - RNA, 17 nt, Homo sapiens
accuggaaucagugaag

SEQ ID NO: 2193378 - RNA, 22 nt, Homo sapiens
caucuuguccccaacaccccac

SEQ ID NO: 2193379 - RNA, 22 nt, Homo sapiens
guagugggugccuguaauccca

SEQ ID NO: 2193380 - RNA, 12 nt, Homo sapiens
cgcuauugauuu

SEQ ID NO: 2193381 - RNA, 17 nt, Homo sapiens
gaacuugaauuucugga

SEQ ID NO: 2193382 - RNA, 18 nt, Homo sapiens
cuccucgaagucccggcu

SEQ ID NO: 2193383 - RNA, 12 nt, Homo sapiens
gacaaagcaaaa

SEQ ID NO: 2193384 - RNA, 12 nt, Homo sapiens
ggcaaagcagaa

SEQ ID NO: 2193385 - RNA, 15 nt, Homo sapiens
caggaaaaucugcac

SEQ ID NO: 2193386 - RNA, 18 nt, Homo sapiens
acacuugcaaaugaaugc

SEQ ID NO: 2193387 - RNA, 17 nt, Homo sapiens
uaauuuuguuuaugcug

SEQ ID NO: 2193388 - RNA, 20 nt, Homo sapiens
cuaggaguuaacuacccuac

SEQ ID NO: 2193389 - RNA, 15 nt, Homo sapiens
ucagagcuugaacac

SEQ ID NO: 2193390 - RNA, 14 nt, Homo sapiens
aguuaagauauccc

SEQ ID NO: 2193391 - RNA, 23 nt, Homo sapiens
aguucuagaaaaacaggcacuug

SEQ ID NO: 2193392 - RNA, 18 nt, Homo sapiens
agugucccugagcagcuu

SEQ ID NO: 2193393 - RNA, 12 nt, Homo sapiens
aauucaaccacu

SEQ ID NO: 2193394 - RNA, 11 nt, Homo sapiens
uucuaggcauc

SEQ ID NO: 2193395 - RNA, 11 nt, Homo sapiens
ucuuaggcacu

SEQ ID NO: 2193396 - RNA, 15 nt, Homo sapiens
cacgggacugacgca

SEQ ID NO: 2193397 - RNA, 15 nt, Homo sapiens
aaaccugauuggcca

SEQ ID NO: 2193398 - RNA, 14 nt, Homo sapiens
uugggaggccaagg

SEQ ID NO: 2193399 - RNA, 15 nt, Homo sapiens
cacgggucacuugaa

SEQ ID NO: 2193400 - RNA, 17 nt, Homo sapiens
agguguggcggcgagca

SEQ ID NO: 2193401 - RNA, 18 nt, Homo sapiens
aucaaaagcuuauucauc

SEQ ID NO: 2193402 - RNA, 12 nt, Homo sapiens
auagcaagugaa

SEQ ID NO: 2193403 - RNA, 13 nt, Homo sapiens
agauccaaaugua

SEQ ID NO: 2193404 - RNA, 16 nt, Homo sapiens
cggcccaauccaaggu

SEQ ID NO: 2193405 - RNA, 16 nt, Homo sapiens
ggagcagagagguggc

SEQ ID NO: 2193406 - RNA, 15 nt, Homo sapiens
auuauuaacacugaa

SEQ ID NO: 2193407 - RNA, 21 nt, Homo sapiens
aagucccagccgcacugggag

SEQ ID NO: 2193408 - RNA, 16 nt, Homo sapiens
cuucuaaaccaaaaau

SEQ ID NO: 2193409 - RNA, 23 nt, Homo sapiens
ugucaccggccuugugacauuca

SEQ ID NO: 2193410 - RNA, 17 nt, Homo sapiens
ggcacaagcagggcacu

SEQ ID NO: 2193411 - RNA, 20 nt, Homo sapiens
cuccauugcuguuguugcag

SEQ ID NO: 2193412 - RNA, 23 nt, Homo sapiens
cucccaccuuugguccuaagucc

SEQ ID NO: 2193413 - RNA, 18 nt, Homo sapiens
gcucuugaggcauuucca

SEQ ID NO: 2193414 - RNA, 15 nt, Homo sapiens
uaaaaucuggcaaag

SEQ ID NO: 2193415 - RNA, 20 nt, Homo sapiens
ggcggguggaucacaagguc

SEQ ID NO: 2193416 - RNA, 21 nt, Homo sapiens
ucuccuuggaaauacuuuauc

SEQ ID NO: 2193417 - RNA, 14 nt, Homo sapiens
cuuuggaacacuac

SEQ ID NO: 2193418 - RNA, 14 nt, Homo sapiens
ggcuauuauuuauu

SEQ ID NO: 2193419 - RNA, 14 nt, Homo sapiens
guuauuuaugcuau

SEQ ID NO: 2193420 - RNA, 23 nt, Homo sapiens
ccaaggaaacccccaguguaaua

SEQ ID NO: 2193421 - RNA, 13 nt, Homo sapiens
gacaucuaccucc

SEQ ID NO: 2193422 - RNA, 13 nt, Homo sapiens
guggccaucuccu

SEQ ID NO: 2193423 - RNA, 12 nt, Homo sapiens
cagccuugcaca

SEQ ID NO: 2193424 - RNA, 21 nt, Homo sapiens
uacaaauaaagucccagguua

SEQ ID NO: 2193425 - RNA, 17 nt, Homo sapiens
uguauccgacucuaagc

SEQ ID NO: 2193426 - RNA, 15 nt, Homo sapiens
uccccacccaccacc

SEQ ID NO: 2193427 - RNA, 18 nt, Homo sapiens
gacucuucacuccaaaaa

SEQ ID NO: 2193428 - RNA, 15 nt, Homo sapiens
ugugccuuacuuaag

SEQ ID NO: 2193429 - RNA, 17 nt, Homo sapiens
ccuugcuaaaagauuau

SEQ ID NO: 2193430 - RNA, 21 nt, Homo sapiens
aacauggugccuauaucugag

SEQ ID NO: 2193431 - RNA, 21 nt, Homo sapiens
uuggagucccagaauugcuga

SEQ ID NO: 2193432 - RNA, 14 nt, Homo sapiens
gagcugagccucuc

SEQ ID NO: 2193433 - RNA, 15 nt, Homo sapiens
gaagggagucucucu

SEQ ID NO: 2193434 - RNA, 23 nt, Homo sapiens
gcauuaaaacuugggcaccagcu

SEQ ID NO: 2193435 - RNA, 15 nt, Homo sapiens
aggauguaaggccuu

SEQ ID NO: 2193436 - RNA, 15 nt, Homo sapiens
ugcaugcaugcccuc

SEQ ID NO: 2193437 - RNA, 16 nt, Homo sapiens
gagugcaccaaagaga

SEQ ID NO: 2193438 - RNA, 20 nt, Homo sapiens
uuuuagaaaccccucuguag

SEQ ID NO: 2193439 - RNA, 17 nt, Homo sapiens
accuuugucugccauug

SEQ ID NO: 2193440 - RNA, 13 nt, Homo sapiens
uauacagcuguau

SEQ ID NO: 2193441 - RNA, 20 nt, Homo sapiens
ucauggucugaguggggcuu

SEQ ID NO: 2193442 - RNA, 22 nt, Homo sapiens
agccuuaccuugaaaugcuguu

SEQ ID NO: 2193443 - RNA, 23 nt, Homo sapiens
uuugcaaagaccuucgucuuuga

SEQ ID NO: 2193444 - RNA, 14 nt, Homo sapiens
cauaugaaugcagc

SEQ ID NO: 2193445 - RNA, 22 nt, Homo sapiens
uacaaauagguagagucauuca

SEQ ID NO: 2193446 - RNA, 17 nt, Homo sapiens
ugguuacaaucauugcu

SEQ ID NO: 2193447 - RNA, 15 nt, Homo sapiens
uaagaagaugacuuc

SEQ ID NO: 2193448 - RNA, 18 nt, Homo sapiens
uuccaagugugugugcaa

SEQ ID NO: 2193449 - RNA, 12 nt, Homo sapiens
caauaggccaug

SEQ ID NO: 2193450 - RNA, 23 nt, Homo sapiens
agcugcuucucccacuuggccaa

SEQ ID NO: 2193451 - RNA, 12 nt, Homo sapiens
ccacugauaucc

SEQ ID NO: 2193452 - RNA, 22 nt, Homo sapiens
cuaguguguccugugacaacac

SEQ ID NO: 2193453 - RNA, 22 nt, Homo sapiens
cuucccggcgucccuaccuccu

SEQ ID NO: 2193454 - RNA, 19 nt, Homo sapiens
agugcgcagaucugugccu

SEQ ID NO: 2193455 - RNA, 18 nt, Homo sapiens
cuccuagguucacuuugg

SEQ ID NO: 2193456 - RNA, 20 nt, Homo sapiens
auuacuuaugauuuauggua

SEQ ID NO: 2193457 - RNA, 17 nt, Homo sapiens
aucccauucugcgucau

SEQ ID NO: 2193458 - RNA, 20 nt, Homo sapiens
aacaguccauaacuuaccuc

SEQ ID NO: 2193459 - RNA, 21 nt, Homo sapiens
gcguggaucuacccucuaguu

SEQ ID NO: 2193460 - RNA, 16 nt, Homo sapiens
uuugcagaaaucacaa

SEQ ID NO: 2193461 - RNA, 23 nt, Homo sapiens
uagcaccgcuuauccccucagaa

SEQ ID NO: 2193462 - RNA, 16 nt, Homo sapiens
ccugccucacuucuuc

SEQ ID NO: 2193463 - RNA, 17 nt, Homo sapiens
aaaguucugcagauaaa

SEQ ID NO: 2193464 - RNA, 13 nt, Homo sapiens
gugaagauuucau

SEQ ID NO: 2193465 - RNA, 18 nt, Homo sapiens
ccugcaucugucugcucu

SEQ ID NO: 2193466 - RNA, 23 nt, Homo sapiens
uccaaugaugaaauauaaucaga

SEQ ID NO: 2193467 - RNA, 15 nt, Homo sapiens
cuauuuuuucuugac

SEQ ID NO: 2193468 - RNA, 12 nt, Homo sapiens
uaauucuucacc

SEQ ID NO: 2193469 - RNA, 22 nt, Homo sapiens
ccaaagcuggcccaguugucca

SEQ ID NO: 2193470 - RNA, 18 nt, Homo sapiens
ugucauugacaaagcugu

SEQ ID NO: 2193471 - RNA, 16 nt, Homo sapiens
guuccuggugacuccu

SEQ ID NO: 2193472 - RNA, 23 nt, Homo sapiens
cccagugucuggcccagccaugg

SEQ ID NO: 2193473 - RNA, 17 nt, Homo sapiens
agcgauucucaugccuc

SEQ ID NO: 2193474 - RNA, 20 nt, Homo sapiens
uauggguuggacaaccucau

SEQ ID NO: 2193475 - RNA, 14 nt, Homo sapiens
uuccccacuugaga

SEQ ID NO: 2193476 - RNA, 23 nt, Homo sapiens
aucugccuggggccucaccugcu

SEQ ID NO: 2193477 - RNA, 12 nt, Homo sapiens
ugaaauaagaaa

SEQ ID NO: 2193478 - RNA, 18 nt, Homo sapiens
aguaauucugcugucuca

SEQ ID NO: 2193479 - RNA, 22 nt, Homo sapiens
gcaguguaacccaagcauuugu

SEQ ID NO: 2193480 - RNA, 16 nt, Homo sapiens
ccuccucugcccggga

SEQ ID NO: 2193481 - RNA, 20 nt, Homo sapiens
auggcgaccgggcaagcuuu

SEQ ID NO: 2193482 - RNA, 12 nt, Homo sapiens
auaaaguaccac

SEQ ID NO: 2193483 - RNA, 14 nt, Homo sapiens
uccaaucuugcuuu

SEQ ID NO: 2193484 - RNA, 18 nt, Homo sapiens
gcuaaaacuggcccuguu

SEQ ID NO: 2193485 - RNA, 17 nt, Homo sapiens
auaauacccacauuaca

SEQ ID NO: 2193486 - RNA, 19 nt, Homo sapiens
uuuguuuaaaaaccaaaua

SEQ ID NO: 2193487 - RNA, 23 nt, Homo sapiens
uaagggccacaucccacugccac

SEQ ID NO: 2193488 - RNA, 14 nt, Homo sapiens
caucucuuguauau

SEQ ID NO: 2193489 - RNA, 15 nt, Homo sapiens
caggugugugugaac

SEQ ID NO: 2193490 - RNA, 18 nt, Homo sapiens
cguauagaaaaagcacag

SEQ ID NO: 2193491 - RNA, 16 nt, Homo sapiens
cugguccccuccuucc

SEQ ID NO: 2193492 - RNA, 21 nt, Homo sapiens
ggauggaauccuacagccucc

SEQ ID NO: 2193493 - RNA, 14 nt, Homo sapiens
uaauuuaaagcuua

SEQ ID NO: 2193494 - RNA, 14 nt, Homo sapiens
aggacacagcagug

SEQ ID NO: 2193495 - RNA, 23 nt, Homo sapiens
agcccauaugcuaccaccagcug

SEQ ID NO: 2193496 - RNA, 18 nt, Homo sapiens
uccccagccugcucccua

SEQ ID NO: 2193497 - RNA, 19 nt, Homo sapiens
cacaacuuagaaaccaaau

SEQ ID NO: 2193498 - RNA, 21 nt, Homo sapiens
gacucgggauuaguacacacu

SEQ ID NO: 2193499 - RNA, 15 nt, Homo sapiens
cccuugcccacccca

SEQ ID NO: 2193500 - RNA, 21 nt, Homo sapiens
ccaguaggguuugacauuuca

SEQ ID NO: 2193501 - RNA, 13 nt, Homo sapiens
cccugugugauau

SEQ ID NO: 2193502 - RNA, 15 nt, Homo sapiens
ucagcccuuccccau

SEQ ID NO: 2193503 - RNA, 18 nt, Homo sapiens
gguggggggcauugagua

SEQ ID NO: 2193504 - RNA, 22 nt, Homo sapiens
ccuagggguggcgcucagaccc

SEQ ID NO: 2193505 - RNA, 17 nt, Homo sapiens
aaggggacaauggcaga

SEQ ID NO: 2193506 - RNA, 17 nt, Homo sapiens
uuucugagaugcucacu

SEQ ID NO: 2193507 - RNA, 18 nt, Homo sapiens
uggaggccagagggguca

SEQ ID NO: 2193508 - RNA, 18 nt, Homo sapiens
ugcaagccauaacgugcc

SEQ ID NO: 2193509 - RNA, 18 nt, Homo sapiens
guggcccagggaagccaa

SEQ ID NO: 2193510 - RNA, 18 nt, Homo sapiens
caccauguuggccaggcu

SEQ ID NO: 2193511 - RNA, 22 nt, Homo sapiens
cuagugucuuauggucuugauc

SEQ ID NO: 2193512 - RNA, 18 nt, Homo sapiens
agucucauuacagauuua

SEQ ID NO: 2193513 - RNA, 13 nt, Homo sapiens
aauugcaugacuu

SEQ ID NO: 2193514 - RNA, 20 nt, Homo sapiens
uuggauaucaaaagcaaaua

SEQ ID NO: 2193515 - RNA, 15 nt, Homo sapiens
gcucucuuugcccag

SEQ ID NO: 2193516 - RNA, 19 nt, Homo sapiens
cuccacaccuaccacgacc

SEQ ID NO: 2193517 - RNA, 14 nt, Homo sapiens
cuccauuggaucuu

SEQ ID NO: 2193518 - RNA, 14 nt, Homo sapiens
cacaggauuuguaa

SEQ ID NO: 2193519 - RNA, 19 nt, Homo sapiens
gaaagccugggugacauuu

SEQ ID NO: 2193520 - RNA, 18 nt, Homo sapiens
agaagacauauaaauuaa

SEQ ID NO: 2193521 - RNA, 23 nt, Homo sapiens
cucccacuaaagggguuccaaau

SEQ ID NO: 2193522 - RNA, 18 nt, Homo sapiens
uuuaauggcauaacaaag

SEQ ID NO: 2193523 - RNA, 18 nt, Homo sapiens
uaucacagugaaugcacu

SEQ ID NO: 2193524 - RNA, 14 nt, Homo sapiens
gaggggacgcugag

SEQ ID NO: 2193525 - RNA, 19 nt, Homo sapiens
agaaagcagaggcuggccu

SEQ ID NO: 2193526 - RNA, 13 nt, Homo sapiens
aguggauucccag

SEQ ID NO: 2193527 - RNA, 20 nt, Homo sapiens
uccugguggauacuguagaa

SEQ ID NO: 2193528 - RNA, 11 nt, Homo sapiens
guuacugcuga

SEQ ID NO: 2193529 - RNA, 11 nt, Homo sapiens
guaacugcugu

SEQ ID NO: 2193530 - RNA, 23 nt, Homo sapiens
gcuuccgcccccggauuugcuca

SEQ ID NO: 2193531 - RNA, 19 nt, Homo sapiens
ccuacaauguuguauuugu

SEQ ID NO: 2193532 - RNA, 16 nt, Homo sapiens
cuuagaagaaauauga

SEQ ID NO: 2193533 - RNA, 14 nt, Homo sapiens
caaacaucacaaaa

SEQ ID NO: 2193534 - RNA, 16 nt, Homo sapiens
ccaaauaaaaccucag

SEQ ID NO: 2193535 - RNA, 18 nt, Homo sapiens
uuauuaaaaccagucuca

SEQ ID NO: 2193536 - RNA, 18 nt, Homo sapiens
ugugucacgugacccugu

SEQ ID NO: 2193537 - RNA, 17 nt, Homo sapiens
acucuggaggcugagau

SEQ ID NO: 2193538 - RNA, 19 nt, Homo sapiens
aagugagacuccgucacaa

SEQ ID NO: 2193539 - RNA, 14 nt, Homo sapiens
cgccacacagacca

SEQ ID NO: 2193540 - RNA, 17 nt, Homo sapiens
agcuccuccccugcuac

SEQ ID NO: 2193541 - RNA, 19 nt, Homo sapiens
ucucccuuuugacacaguu

SEQ ID NO: 2193542 - RNA, 19 nt, Homo sapiens
uugaaauuuugcaccagcg

SEQ ID NO: 2193543 - RNA, 21 nt, Homo sapiens
aauauuauguuaugaaaaccc

SEQ ID NO: 2193544 - RNA, 22 nt, Homo sapiens
gaguugcagccagggccagugg

SEQ ID NO: 2193545 - RNA, 22 nt, Homo sapiens
cacguuacuagcagucacuuga

SEQ ID NO: 2193546 - RNA, 13 nt, Homo sapiens
uccccagccucuu

SEQ ID NO: 2193547 - RNA, 13 nt, Homo sapiens
cucccagcuccuu

SEQ ID NO: 2193548 - RNA, 11 nt, Homo sapiens
gaugcauuuaa

SEQ ID NO: 2193549 - RNA, 16 nt, Homo sapiens
gcuacccuagaugaau

SEQ ID NO: 2193550 - RNA, 21 nt, Homo sapiens
aaucaggguggaauuggacuc

SEQ ID NO: 2193551 - RNA, 21 nt, Homo sapiens
auuagcccacugccuggaaag

SEQ ID NO: 2193552 - RNA, 13 nt, Homo sapiens
ugcugcacugccc

SEQ ID NO: 2193553 - RNA, 22 nt, Homo sapiens
cauaacugccuugaaccuguga

SEQ ID NO: 2193554 - RNA, 15 nt, Homo sapiens
gcauaaaagacuuuu

SEQ ID NO: 2193555 - RNA, 17 nt, Homo sapiens
aaagcuuuauugagaua

SEQ ID NO: 2193556 - RNA, 18 nt, Homo sapiens
accguuguuguuuuacau

SEQ ID NO: 2193557 - RNA, 12 nt, Homo sapiens
guuugauguaug

SEQ ID NO: 2193558 - RNA, 14 nt, Homo sapiens
accuggagacuguc

SEQ ID NO: 2193559 - RNA, 20 nt, Homo sapiens
auucauuuuuuucacuggag

SEQ ID NO: 2193560 - RNA, 13 nt, Homo sapiens
guauaauacauua

SEQ ID NO: 2193561 - RNA, 20 nt, Homo sapiens
cugucaauguccuacugaga

SEQ ID NO: 2193562 - RNA, 15 nt, Homo sapiens
auuuuauaccaaagg

SEQ ID NO: 2193563 - RNA, 23 nt, Homo sapiens
ugucagcaugacaaaagugacag

SEQ ID NO: 2193564 - RNA, 18 nt, Homo sapiens
ugaauacaguuacuuaau

SEQ ID NO: 2193565 - RNA, 15 nt, Homo sapiens
uacauauguagacua

SEQ ID NO: 2193566 - RNA, 19 nt, Homo sapiens
cacauucaauagcauauca

SEQ ID NO: 2193567 - RNA, 16 nt, Homo sapiens
uucaggcuugcauuaa

SEQ ID NO: 2193568 - RNA, 17 nt, Homo sapiens
cuuugacugugauuuua

SEQ ID NO: 2193569 - RNA, 13 nt, Homo sapiens
uauuugucuuuga

SEQ ID NO: 2193570 - RNA, 22 nt, Homo sapiens
gccacagguguugauuguuaua

SEQ ID NO: 2193571 - RNA, 18 nt, Homo sapiens
ggguuauguaucagaaga

SEQ ID NO: 2193572 - RNA, 12 nt, Homo sapiens
uucauguaaaac

SEQ ID NO: 2193573 - RNA, 11 nt, Homo sapiens
guuacaaagac

SEQ ID NO: 2193574 - RNA, 12 nt, Homo sapiens
cgcugcugccac

SEQ ID NO: 2193575 - RNA, 19 nt, Homo sapiens
cuugaguaguuuuuaucug

SEQ ID NO: 2193576 - RNA, 18 nt, Homo sapiens
aucccacauuagcuuguu

SEQ ID NO: 2193577 - RNA, 14 nt, Homo sapiens
aaaccucaagccag

SEQ ID NO: 2193578 - RNA, 21 nt, Homo sapiens
agaacucaaauggggccagau

SEQ ID NO: 2193579 - RNA, 17 nt, Homo sapiens
cacuaacacaugcacac

SEQ ID NO: 2193580 - RNA, 14 nt, Homo sapiens
gccagcaucugccu

SEQ ID NO: 2193581 - RNA, 10 nt, Homo sapiens
uuauucuuga

SEQ ID NO: 2193582 - RNA, 12 nt, Homo sapiens
aaugugacucag

SEQ ID NO: 2193583 - RNA, 19 nt, Homo sapiens
ucuuacccuguacauaugu

SEQ ID NO: 2193584 - RNA, 22 nt, Homo sapiens
caguuuguaacuugggcuguaa

SEQ ID NO: 2193585 - RNA, 17 nt, Homo sapiens
aaaugauggaaguucau

SEQ ID NO: 2193586 - RNA, 13 nt, Homo sapiens
aagcacuguggau

SEQ ID NO: 2193587 - RNA, 15 nt, Homo sapiens
uggacagcacucugc

SEQ ID NO: 2193588 - RNA, 19 nt, Homo sapiens
ugauuccaucaaagagaag

SEQ ID NO: 2193589 - RNA, 14 nt, Homo sapiens
uuauuuaaagaaga

SEQ ID NO: 2193590 - RNA, 12 nt, Homo sapiens
ccugaccaaaga

SEQ ID NO: 2193591 - RNA, 20 nt, Homo sapiens
ucaggaaaacuguuccaauc

SEQ ID NO: 2193592 - RNA, 19 nt, Homo sapiens
ugagcaggucaggacucag

SEQ ID NO: 2193593 - RNA, 22 nt, Homo sapiens
acaacauaaggagaauguaucu

SEQ ID NO: 2193594 - RNA, 21 nt, Homo sapiens
ggaaauauuaagaaagacuau

SEQ ID NO: 2193595 - RNA, 23 nt, Homo sapiens
acauucaacccuggagaguucaa

SEQ ID NO: 2193596 - RNA, 15 nt, Homo sapiens
cuuagcgucaagaca

SEQ ID NO: 2193597 - RNA, 14 nt, Homo sapiens
cugaacucugacaa

SEQ ID NO: 2193598 - RNA, 18 nt, Homo sapiens
agcacgagcuggaaccca

SEQ ID NO: 2193599 - RNA, 23 nt, Homo sapiens
ucaagucagcaacagagcaaaau

SEQ ID NO: 2193600 - RNA, 18 nt, Homo sapiens
agguuccacagaggacac

SEQ ID NO: 2193601 - RNA, 20 nt, Homo sapiens
cuauuuaaggugugcaauuu

SEQ ID NO: 2193602 - RNA, 13 nt, Homo sapiens
uuuaugaggaaac

SEQ ID NO: 2193603 - RNA, 16 nt, Homo sapiens
acuacaggcaccugcc

SEQ ID NO: 2193604 - RNA, 16 nt, Homo sapiens
caaaaaacugcaguga

SEQ ID NO: 2193605 - RNA, 14 nt, Homo sapiens
accugggaggucaa

SEQ ID NO: 2193606 - RNA, 16 nt, Homo sapiens
cuugacuuagaccuau

SEQ ID NO: 2193607 - RNA, 13 nt, Homo sapiens
agucacagccacc

SEQ ID NO: 2193608 - RNA, 13 nt, Homo sapiens
agucccagccaca

SEQ ID NO: 2193609 - RNA, 18 nt, Homo sapiens
uacuaguucagacacuuu

SEQ ID NO: 2193610 - RNA, 17 nt, Homo sapiens
ccauugugaaccaaugc

SEQ ID NO: 2193611 - RNA, 23 nt, Homo sapiens
aagcauaccauugaaacaugcca

SEQ ID NO: 2193612 - RNA, 17 nt, Homo sapiens
uguuugacuuuagacug

SEQ ID NO: 2193613 - RNA, 13 nt, Homo sapiens
aaagacucugacc

SEQ ID NO: 2193614 - RNA, 16 nt, Homo sapiens
gggauuuuucauucuu

SEQ ID NO: 2193615 - RNA, 16 nt, Homo sapiens
acuaauuuucucccaa

SEQ ID NO: 2193616 - RNA, 19 nt, Homo sapiens
caggugugugccaccacac

SEQ ID NO: 2193617 - RNA, 16 nt, Homo sapiens
uacuagagaaagacaa

SEQ ID NO: 2193618 - RNA, 22 nt, Homo sapiens
aauguuuugcccgguuuuucuc

SEQ ID NO: 2193619 - RNA, 22 nt, Homo sapiens
auuaauuucuucccccaaagcc

SEQ ID NO: 2193620 - RNA, 16 nt, Homo sapiens
cuccugccucagccuu

SEQ ID NO: 2193621 - RNA, 21 nt, Homo sapiens
ugccgacucccccaaccaagg

SEQ ID NO: 2193622 - RNA, 21 nt, Homo sapiens
gccuuguuucaccuuccaugu

SEQ ID NO: 2193623 - RNA, 19 nt, Homo sapiens
ucucuguguuacccaguaa

SEQ ID NO: 2193624 - RNA, 20 nt, Homo sapiens
ugguggacgagaaggugcuu

SEQ ID NO: 2193625 - RNA, 13 nt, Homo sapiens
agcugaagcguua

SEQ ID NO: 2193626 - RNA, 17 nt, Homo sapiens
gacucaaguuucuucaa

SEQ ID NO: 2193627 - RNA, 19 nt, Homo sapiens
guaccaccaugcacuguaa

SEQ ID NO: 2193628 - RNA, 17 nt, Homo sapiens
uaaaugcauguccucaa

SEQ ID NO: 2193629 - RNA, 17 nt, Homo sapiens
aguacuuaaaacuguaa

SEQ ID NO: 2193630 - RNA, 21 nt, Homo sapiens
cugccucugccacugacugca

SEQ ID NO: 2193631 - RNA, 18 nt, Homo sapiens
uccuugagcacccggaaa

SEQ ID NO: 2193632 - RNA, 12 nt, Homo sapiens
gauaucuuguaa

SEQ ID NO: 2193633 - RNA, 15 nt, Homo sapiens
ugccugccucaaagg

SEQ ID NO: 2193634 - RNA, 16 nt, Homo sapiens
aaacauauguucuccc

SEQ ID NO: 2193635 - RNA, 16 nt, Homo sapiens
aauugauguuacugua

SEQ ID NO: 2193636 - RNA, 16 nt, Homo sapiens
cacauaguguuuguaa

SEQ ID NO: 2193637 - RNA, 21 nt, Homo sapiens
guccuaacccccuuacugugc

SEQ ID NO: 2193638 - RNA, 18 nt, Homo sapiens
aagcaauccaccuuccuc

SEQ ID NO: 2193639 - RNA, 15 nt, Homo sapiens
uuggagucuguucua

SEQ ID NO: 2193640 - RNA, 20 nt, Homo sapiens
caggaagcccacacuaugca

SEQ ID NO: 2193641 - RNA, 21 nt, Homo sapiens
caucaugucaguuccaaugag

SEQ ID NO: 2193642 - RNA, 22 nt, Homo sapiens
ugcuccacccaugaugcaucuc

SEQ ID NO: 2193643 - RNA, 15 nt, Homo sapiens
acagaagucuccuca

SEQ ID NO: 2193644 - RNA, 16 nt, Homo sapiens
ugaggguuugugcuac

SEQ ID NO: 2193645 - RNA, 11 nt, Homo sapiens
aaaucaaggau

SEQ ID NO: 2193646 - RNA, 20 nt, Homo sapiens
uguguaaacagaagccuguu

SEQ ID NO: 2193647 - RNA, 20 nt, Homo sapiens
gaagcucucccuuguuuacu

SEQ ID NO: 2193648 - RNA, 12 nt, Homo sapiens
gugagagugcag

SEQ ID NO: 2193649 - RNA, 19 nt, Homo sapiens
cuguacaggaaggugccug

SEQ ID NO: 2193650 - RNA, 13 nt, Homo sapiens
gggcagacaauaa

SEQ ID NO: 2193651 - RNA, 12 nt, Homo sapiens
aaaugcaugaua

SEQ ID NO: 2193652 - RNA, 18 nt, Homo sapiens
gucaaugcaggacaacuc

SEQ ID NO: 2193653 - RNA, 14 nt, Homo sapiens
ucauauuagauuac

SEQ ID NO: 2193654 - RNA, 18 nt, Homo sapiens
caggaguuugugugucuu

SEQ ID NO: 2193655 - RNA, 16 nt, Homo sapiens
aaagguugaagcacca

SEQ ID NO: 2193656 - RNA, 13 nt, Homo sapiens
auuuacaccacac

SEQ ID NO: 2193657 - RNA, 17 nt, Homo sapiens
uccuuaucaaaggacac

SEQ ID NO: 2193658 - RNA, 14 nt, Homo sapiens
gacagccaagggca

SEQ ID NO: 2193659 - RNA, 23 nt, Homo sapiens
gugagaaauuugccuuguucaau

SEQ ID NO: 2193660 - RNA, 15 nt, Homo sapiens
uuuggaauauuccac

SEQ ID NO: 2193661 - RNA, 16 nt, Homo sapiens
ggccucagcaagccau

SEQ ID NO: 2193662 - RNA, 20 nt, Homo sapiens
cccagcagugucacucugua

SEQ ID NO: 2193663 - RNA, 20 nt, Homo sapiens
cuccaggacuccacuggaca

SEQ ID NO: 2193664 - RNA, 23 nt, Homo sapiens
gauuugagggacgaggucaagga

SEQ ID NO: 2193665 - RNA, 19 nt, Homo sapiens
ugguggcgggcgccuguag

SEQ ID NO: 2193666 - RNA, 13 nt, Homo sapiens
cccuccauguacc

SEQ ID NO: 2193667 - RNA, 18 nt, Homo sapiens
uuuacagugcuauuuacu

SEQ ID NO: 2193668 - RNA, 12 nt, Homo sapiens
agcagcacuuau

SEQ ID NO: 2193669 - RNA, 23 nt, Homo sapiens
uucugucaagcuggugcuacugu

SEQ ID NO: 2193670 - RNA, 22 nt, Homo sapiens
uacagauugggcggggcuucuc

SEQ ID NO: 2193671 - RNA, 17 nt, Homo sapiens
ccagccugggcaacaaa

SEQ ID NO: 2193672 - RNA, 23 nt, Homo sapiens
uauaauauuguaacuugcaugua

SEQ ID NO: 2193673 - RNA, 14 nt, Homo sapiens
auuuacaguuucca

SEQ ID NO: 2193674 - RNA, 22 nt, Homo sapiens
cuuccauuuucccccacuacug

SEQ ID NO: 2193675 - RNA, 20 nt, Homo sapiens
gcuguguacaacaaugcuuu

SEQ ID NO: 2193676 - RNA, 16 nt, Homo sapiens
uaacagcagaugccaa

SEQ ID NO: 2193677 - RNA, 18 nt, Homo sapiens
cuucuccccuccaaguga

SEQ ID NO: 2193678 - RNA, 17 nt, Homo sapiens
ugcgugugucuguguug

SEQ ID NO: 2193679 - RNA, 15 nt, Homo sapiens
auggaaaacauuuca

SEQ ID NO: 2193680 - RNA, 14 nt, Homo sapiens
gucggauccuguga

SEQ ID NO: 2193681 - RNA, 15 nt, Homo sapiens
agaaucauggagaaa

SEQ ID NO: 2193682 - RNA, 15 nt, Homo sapiens
ccagugagacugugu

SEQ ID NO: 2193683 - RNA, 15 nt, Homo sapiens
cugugaccugcugag

SEQ ID NO: 2193684 - RNA, 22 nt, Homo sapiens
ucaaugcaggacaacucuguaa

SEQ ID NO: 2193685 - RNA, 22 nt, Homo sapiens
gucuggugggaggacggugcaa

SEQ ID NO: 2193686 - RNA, 17 nt, Homo sapiens
aucccaucuaagcugca

SEQ ID NO: 2193687 - RNA, 15 nt, Homo sapiens
cuuuuaaaugcauaa

SEQ ID NO: 2193688 - RNA, 17 nt, Homo sapiens
auaaagaaaaccuuucu

SEQ ID NO: 2193689 - RNA, 21 nt, Homo sapiens
auuuuacucauauguggaauc

SEQ ID NO: 2193690 - RNA, 16 nt, Homo sapiens
ccagccccugccagcu

SEQ ID NO: 2193691 - RNA, 19 nt, Homo sapiens
ugaaaucaguuacucuuca

SEQ ID NO: 2193692 - RNA, 21 nt, Homo sapiens
auuugauguaaguuacugaca

SEQ ID NO: 2193693 - RNA, 23 nt, Homo sapiens
ucccuagccagaggcucuaaugu

SEQ ID NO: 2193694 - RNA, 20 nt, Homo sapiens
acagaagugcuuucuucucc

SEQ ID NO: 2193695 - RNA, 22 nt, Homo sapiens
caccacugaaacccugcacuua

SEQ ID NO: 2193696 - RNA, 22 nt, Homo sapiens
aagcaggagaauagcugagaag

SEQ ID NO: 2193697 - RNA, 18 nt, Homo sapiens
caaugccaggcagugcag

SEQ ID NO: 2193698 - RNA, 23 nt, Homo sapiens
aaaguugguuuuguaaaauucca

SEQ ID NO: 2193699 - RNA, 16 nt, Homo sapiens
aaguguacaauaccac

SEQ ID NO: 2193700 - RNA, 16 nt, Homo sapiens
agauuaacaacacugc

SEQ ID NO: 2193701 - RNA, 18 nt, Homo sapiens
ccaauuccaaagccagac

SEQ ID NO: 2193702 - RNA, 13 nt, Homo sapiens
guaagaguguuua

SEQ ID NO: 2193703 - RNA, 20 nt, Homo sapiens
acucagcacucuggacucca

SEQ ID NO: 2193704 - RNA, 21 nt, Homo sapiens
ugguguccugcauguaugcca

SEQ ID NO: 2193705 - RNA, 16 nt, Homo sapiens
gaagguaucaguuaua

SEQ ID NO: 2193706 - RNA, 12 nt, Homo sapiens
aguuucaggcaa

SEQ ID NO: 2193707 - RNA, 14 nt, Homo sapiens
cgccuuaguuugaa

SEQ ID NO: 2193708 - RNA, 15 nt, Homo sapiens
cgagcagcugagcag

SEQ ID NO: 2193709 - RNA, 23 nt, Homo sapiens
uaagauguuaucaaugacaaugg

SEQ ID NO: 2193710 - RNA, 16 nt, Homo sapiens
ugcccgcacacccuca

SEQ ID NO: 2193711 - RNA, 20 nt, Homo sapiens
caugucugcauggcagaagc

SEQ ID NO: 2193712 - RNA, 18 nt, Homo sapiens
uuccauaggacauacugc

SEQ ID NO: 2193713 - RNA, 22 nt, Homo sapiens
uucaaaacauugugccauguca

SEQ ID NO: 2193714 - RNA, 20 nt, Homo sapiens
ugcuuugggcagaggcagcu

SEQ ID NO: 2193715 - RNA, 17 nt, Homo sapiens
agugucaccaauuccac

SEQ ID NO: 2193716 - RNA, 17 nt, Homo sapiens
uuaggaaagaauaaaga

SEQ ID NO: 2193717 - RNA, 15 nt, Homo sapiens
ggaagagcauuagcu

SEQ ID NO: 2193718 - RNA, 18 nt, Homo sapiens
uccagacauacaaacaua

SEQ ID NO: 2193719 - RNA, 18 nt, Homo sapiens
gggaauauuuuauucaag

SEQ ID NO: 2193720 - RNA, 21 nt, Homo sapiens
ugcaguggcgugaucuuggcu

SEQ ID NO: 2193721 - RNA, 17 nt, Homo sapiens
uucuuaaagaguucuua

SEQ ID NO: 2193722 - RNA, 15 nt, Homo sapiens
gucaacuccuuucuc

SEQ ID NO: 2193723 - RNA, 20 nt, Homo sapiens
ccaaaacuggaccaccagag

SEQ ID NO: 2193724 - RNA, 20 nt, Homo sapiens
cauaguggccuuguccaaug

SEQ ID NO: 2193725 - RNA, 22 nt, Homo sapiens
ggccuguucccugaggaccugc

SEQ ID NO: 2193726 - RNA, 20 nt, Homo sapiens
uaaugcacuaaaaguaguau

SEQ ID NO: 2193727 - RNA, 21 nt, Homo sapiens
uauguguaaggugaaauuuau

SEQ ID NO: 2193728 - RNA, 17 nt, Homo sapiens
ucucauguauaaaacua

SEQ ID NO: 2193729 - RNA, 17 nt, Homo sapiens
uuucagccgacucagca

SEQ ID NO: 2193730 - RNA, 13 nt, Homo sapiens
gaagcugugaaua

SEQ ID NO: 2193731 - RNA, 20 nt, Homo sapiens
cuucucagcucuuccaugau

SEQ ID NO: 2193732 - RNA, 22 nt, Homo sapiens
uguguuuuuucugccaccaaag

SEQ ID NO: 2193733 - RNA, 20 nt, Homo sapiens
aaagaccugacaccuuucau

SEQ ID NO: 2193734 - RNA, 18 nt, Homo sapiens
uuccacuuagagaacaaa

SEQ ID NO: 2193735 - RNA, 14 nt, Homo sapiens
uccuggacagugag

SEQ ID NO: 2193736 - RNA, 17 nt, Homo sapiens
aggaaagaugaugcaag

SEQ ID NO: 2193737 - RNA, 19 nt, Homo sapiens
agagcccagggaagacaca

SEQ ID NO: 2193738 - RNA, 17 nt, Homo sapiens
gaagacccuugugcauu

SEQ ID NO: 2193739 - RNA, 14 nt, Homo sapiens
acgccuccauccac

SEQ ID NO: 2193740 - RNA, 18 nt, Homo sapiens
cccuugagaagcugccau

SEQ ID NO: 2193741 - RNA, 14 nt, Homo sapiens
uagauguaucauua

SEQ ID NO: 2193742 - RNA, 21 nt, Homo sapiens
cagacaagcgccgcugugagg

SEQ ID NO: 2193743 - RNA, 23 nt, Homo sapiens
uaaugaauaaacauuuguagcau

SEQ ID NO: 2193744 - RNA, 22 nt, Homo sapiens
aauccaagugauccucccaccu

SEQ ID NO: 2193745 - RNA, 14 nt, Homo sapiens
uuguuggucagagg

SEQ ID NO: 2193746 - RNA, 23 nt, Homo sapiens
aauccaggcccggugaggccaag

SEQ ID NO: 2193747 - RNA, 12 nt, Homo sapiens
cugaguugcaca

SEQ ID NO: 2193748 - RNA, 18 nt, Homo sapiens
gcaguuugggaggcugag

SEQ ID NO: 2193749 - RNA, 18 nt, Homo sapiens
aaucaugugcuucauaga

SEQ ID NO: 2193750 - RNA, 21 nt, Homo sapiens
cccucaaucccagcuacucaa

SEQ ID NO: 2193751 - RNA, 22 nt, Homo sapiens
uuguauccucugaccuacauac

SEQ ID NO: 2193752 - RNA, 22 nt, Homo sapiens
uaagacaacaaagagaagcaga

SEQ ID NO: 2193753 - RNA, 24 nt, Homo sapiens
aaauuuaagugcguguguagaguu

SEQ ID NO: 2193754 - RNA, 16 nt, Homo sapiens
caugacaaaguuacaa

SEQ ID NO: 2193755 - RNA, 15 nt, Homo sapiens
acauuaucaucugaa

SEQ ID NO: 2193756 - RNA, 13 nt, Homo sapiens
agccugccuuuaa

SEQ ID NO: 2193757 - RNA, 18 nt, Homo sapiens
caggcccaauucugccac

SEQ ID NO: 2193758 - RNA, 16 nt, Homo sapiens
uggaucagcaacucca

SEQ ID NO: 2193759 - RNA, 22 nt, Homo sapiens
cuguauguuugaucacacagcc

SEQ ID NO: 2193760 - RNA, 22 nt, Homo sapiens
ggggccagcauacuccgugagg

SEQ ID NO: 2193761 - RNA, 12 nt, Homo sapiens
cccuaaguacaa

SEQ ID NO: 2193762 - RNA, 15 nt, Homo sapiens
aaaaaucccaaauuc

SEQ ID NO: 2193763 - RNA, 23 nt, Homo sapiens
ugggguacuggaguuagaucucu

SEQ ID NO: 2193764 - RNA, 23 nt, Homo sapiens
auagcaguugaaacaagaagcca

SEQ ID NO: 2193765 - RNA, 20 nt, Homo sapiens
ugacgucaucaucacauuca

SEQ ID NO: 2193766 - RNA, 16 nt, Homo sapiens
cuacuuccccaaauga

SEQ ID NO: 2193767 - RNA, 11 nt, Homo sapiens
cuuggcacugu

SEQ ID NO: 2193768 - RNA, 13 nt, Homo sapiens
cuuagacacugug

SEQ ID NO: 2193769 - RNA, 13 nt, Homo sapiens
aaaggaucacaga

SEQ ID NO: 2193770 - RNA, 19 nt, Homo sapiens
gaacuucuuugaauuuacu

SEQ ID NO: 2193771 - RNA, 16 nt, Homo sapiens
ucucccuccucugccc

SEQ ID NO: 2193772 - RNA, 24 nt, Homo sapiens
acagacucugauucuacagugaug

SEQ ID NO: 2193773 - RNA, 17 nt, Homo sapiens
ugcagggauauugccuu

SEQ ID NO: 2193774 - RNA, 18 nt, Homo sapiens
uccccacaaaacaaagca

SEQ ID NO: 2193775 - RNA, 15 nt, Homo sapiens
gcuuauucuugagca

SEQ ID NO: 2193776 - RNA, 19 nt, Homo sapiens
gcacugugacccccagcuc

SEQ ID NO: 2193777 - RNA, 23 nt, Homo sapiens
aaaauaguucccuuugccaacag

SEQ ID NO: 2193778 - RNA, 20 nt, Homo sapiens
ucuuguguuggcuguggcag

SEQ ID NO: 2193779 - RNA, 15 nt, Homo sapiens
ggaagcucuaccgca

SEQ ID NO: 2193780 - RNA, 15 nt, Homo sapiens
cauuauccauuccca

SEQ ID NO: 2193781 - RNA, 20 nt, Homo sapiens
caccucccauuacuuugaua

SEQ ID NO: 2193782 - RNA, 18 nt, Homo sapiens
ucauauugcuaccaaaaa

SEQ ID NO: 2193783 - RNA, 16 nt, Homo sapiens
aaggguucaacaaagg

SEQ ID NO: 2193784 - RNA, 23 nt, Homo sapiens
uagguaguagaaucucagcacuu

SEQ ID NO: 2193785 - RNA, 13 nt, Homo sapiens
caaucuuugccuu

SEQ ID NO: 2193786 - RNA, 16 nt, Homo sapiens
uucacagcacuuacaa

SEQ ID NO: 2193787 - RNA, 11 nt, Homo sapiens
uaacaucucac

SEQ ID NO: 2193788 - RNA, 18 nt, Homo sapiens
ggaaugaauacagcauuu

SEQ ID NO: 2193789 - RNA, 13 nt, Homo sapiens
caacauuguacaa

SEQ ID NO: 2193790 - RNA, 15 nt, Homo sapiens
caggacuucugugca

SEQ ID NO: 2193791 - RNA, 17 nt, Homo sapiens
ggcccgguggccggcau

SEQ ID NO: 2193792 - RNA, 21 nt, Homo sapiens
gcauauccaccaccucccuca

SEQ ID NO: 2193793 - RNA, 15 nt, Homo sapiens
cuguuugucuucucc

SEQ ID NO: 2193794 - RNA, 18 nt, Homo sapiens
uaauuacccacagaagga

SEQ ID NO: 2193795 - RNA, 21 nt, Homo sapiens
ucauguuuuuucugcaaugac

SEQ ID NO: 2193796 - RNA, 14 nt, Homo sapiens
acaaauacauucau

SEQ ID NO: 2193797 - RNA, 13 nt, Homo sapiens
uuauuagcaguag

SEQ ID NO: 2193798 - RNA, 21 nt, Homo sapiens
gaacaaaagaagcagcaacuu

SEQ ID NO: 2193799 - RNA, 16 nt, Homo sapiens
ccugccuucaaagcca

SEQ ID NO: 2193800 - RNA, 16 nt, Homo sapiens
uaaaaucaaaugugca

SEQ ID NO: 2193801 - RNA, 16 nt, Homo sapiens
ugaaagcaaguguuca

SEQ ID NO: 2193802 - RNA, 19 nt, Homo sapiens
accagucugucuacugugg

SEQ ID NO: 2193803 - RNA, 23 nt, Homo sapiens
uagacccuucaucucuuacuuga

SEQ ID NO: 2193804 - RNA, 14 nt, Homo sapiens
ccaccggggaaccc

SEQ ID NO: 2193805 - RNA, 14 nt, Homo sapiens
ccacccgaagccaa

SEQ ID NO: 2193806 - RNA, 15 nt, Homo sapiens
gccucugccaugccc

SEQ ID NO: 2193807 - RNA, 17 nt, Homo sapiens
cacagcucuucauucca

SEQ ID NO: 2193808 - RNA, 22 nt, Homo sapiens
gaauauacuaaacaucauugau

SEQ ID NO: 2193809 - RNA, 15 nt, Homo sapiens
cuucuuccauuccca

SEQ ID NO: 2193810 - RNA, 22 nt, Homo sapiens
acuuccuugcaggagugacuca

SEQ ID NO: 2193811 - RNA, 21 nt, Homo sapiens
uauuucauauucauauuucaa

SEQ ID NO: 2193812 - RNA, 15 nt, Homo sapiens
aggaccuucccaagu

SEQ ID NO: 2193813 - RNA, 11 nt, Homo sapiens
uuuuaauuucu

SEQ ID NO: 2193814 - RNA, 13 nt, Homo sapiens
ccaaugcaugcag

SEQ ID NO: 2193815 - RNA, 16 nt, Homo sapiens
ugcagccaaccaagau

SEQ ID NO: 2193816 - RNA, 14 nt, Homo sapiens
gcauuguguggaau

SEQ ID NO: 2193817 - RNA, 15 nt, Homo sapiens
gagcuccauguugcu

SEQ ID NO: 2193818 - RNA, 21 nt, Homo sapiens
agcagcuucaguuguuuuccc

SEQ ID NO: 2193819 - RNA, 19 nt, Homo sapiens
uaaaugaauaaaacauuug

SEQ ID NO: 2193820 - RNA, 18 nt, Homo sapiens
ccucucucgcuugcucuc

SEQ ID NO: 2193821 - RNA, 21 nt, Homo sapiens
ucuuacuuuguaaauucugau

SEQ ID NO: 2193822 - RNA, 17 nt, Homo sapiens
gauggugggcuucaggg

SEQ ID NO: 2193823 - RNA, 16 nt, Homo sapiens
uacagcacuacucugu

SEQ ID NO: 2193824 - RNA, 21 nt, Homo sapiens
aaaacuaaugaguaugaacuu

SEQ ID NO: 2193825 - RNA, 15 nt, Homo sapiens
uugagguaucacugc

SEQ ID NO: 2193826 - RNA, 22 nt, Homo sapiens
aauugacuaccguuguuugcaa

SEQ ID NO: 2193827 - RNA, 21 nt, Homo sapiens
caacagaagcaaaaauucaca

SEQ ID NO: 2193828 - RNA, 21 nt, Homo sapiens
aaucuucagggcacugcugcu

SEQ ID NO: 2193829 - RNA, 18 nt, Homo sapiens
cgcaggcuucugugugcu

SEQ ID NO: 2193830 - RNA, 18 nt, Homo sapiens
cuuggauuugcucagugu

SEQ ID NO: 2193831 - RNA, 21 nt, Homo sapiens
auuaacuguauuuucuuucac

SEQ ID NO: 2193832 - RNA, 13 nt, Homo sapiens
acguggcacuggu

SEQ ID NO: 2193833 - RNA, 16 nt, Homo sapiens
ucauugacaaagcugu

SEQ ID NO: 2193834 - RNA, 20 nt, Homo sapiens
acccaagugccaagacacag

SEQ ID NO: 2193835 - RNA, 17 nt, Homo sapiens
ccaggccagagugcagu

SEQ ID NO: 2193836 - RNA, 17 nt, Homo sapiens
uguuguccugaacugug

SEQ ID NO: 2193837 - RNA, 19 nt, Homo sapiens
aguuuccaaucccauagau

SEQ ID NO: 2193838 - RNA, 14 nt, Homo sapiens
cguggaugaccucc

SEQ ID NO: 2193839 - RNA, 14 nt, Homo sapiens
cagugagugcugcu

SEQ ID NO: 2193840 - RNA, 16 nt, Homo sapiens
uccauaaacaugaaaa

SEQ ID NO: 2193841 - RNA, 16 nt, Homo sapiens
uucaacugaaguucua

SEQ ID NO: 2193842 - RNA, 19 nt, Homo sapiens
ugauuggccacacacugag

SEQ ID NO: 2193843 - RNA, 13 nt, Homo sapiens
ucaagugaucuuc

SEQ ID NO: 2193844 - RNA, 16 nt, Homo sapiens
ucggagagaauggggu

SEQ ID NO: 2193845 - RNA, 18 nt, Homo sapiens
ucagcaagacaaugacac

SEQ ID NO: 2193846 - RNA, 12 nt, Homo sapiens
acaccuccuucc

SEQ ID NO: 2193847 - RNA, 12 nt, Homo sapiens
ucugcugaggag

SEQ ID NO: 2193848 - RNA, 12 nt, Homo sapiens
ucaccugagguc

SEQ ID NO: 2193849 - RNA, 13 nt, Homo sapiens
ccaagggacaggu

SEQ ID NO: 2193850 - RNA, 16 nt, Homo sapiens
ggcccuccuucccucc

SEQ ID NO: 2193851 - RNA, 22 nt, Homo sapiens
agucacaacagagugaaaaauc

SEQ ID NO: 2193852 - RNA, 17 nt, Homo sapiens
ccuuaaacuguacagaa

SEQ ID NO: 2193853 - RNA, 17 nt, Homo sapiens
uuuuaacugauuuaaca

SEQ ID NO: 2193854 - RNA, 16 nt, Homo sapiens
augggacaagaagccu

SEQ ID NO: 2193855 - RNA, 22 nt, Homo sapiens
agcucugauugcagcacagagc

SEQ ID NO: 2193856 - RNA, 16 nt, Homo sapiens
gauucuuccugcuuag

SEQ ID NO: 2193857 - RNA, 15 nt, Homo sapiens
ugagggcagcacugg

SEQ ID NO: 2193858 - RNA, 23 nt, Homo sapiens
cugagaacuaagagaugagggag

SEQ ID NO: 2193859 - RNA, 17 nt, Homo sapiens
uaagaaauagacagcau

SEQ ID NO: 2193860 - RNA, 19 nt, Homo sapiens
guccugggagccacuggga

SEQ ID NO: 2193861 - RNA, 19 nt, Homo sapiens
cuuccuuucuuucucucuc

SEQ ID NO: 2193862 - RNA, 12 nt, Homo sapiens
gccuucacccau

SEQ ID NO: 2193863 - RNA, 21 nt, Homo sapiens
agccauaagaaagcacuauua

SEQ ID NO: 2193864 - RNA, 12 nt, Homo sapiens
ccugauuacaau

SEQ ID NO: 2193865 - RNA, 16 nt, Homo sapiens
augguuucagcacuag

SEQ ID NO: 2193866 - RNA, 21 nt, Homo sapiens
agcccgaggaggugucucagg

SEQ ID NO: 2193867 - RNA, 16 nt, Homo sapiens
gauucucuugccucaa

SEQ ID NO: 2193868 - RNA, 15 nt, Homo sapiens
guacacugcuguacc

SEQ ID NO: 2193869 - RNA, 18 nt, Homo sapiens
ugacuuuccccaccagau

SEQ ID NO: 2193870 - RNA, 15 nt, Homo sapiens
agggcuuauggccag

SEQ ID NO: 2193871 - RNA, 14 nt, Homo sapiens
uaauucuauacugu

SEQ ID NO: 2193872 - RNA, 12 nt, Homo sapiens
ccagccugacca

SEQ ID NO: 2193873 - RNA, 18 nt, Homo sapiens
uguauacugaguuggaag

SEQ ID NO: 2193874 - RNA, 18 nt, Homo sapiens
cuaaguuauuuuguacau

SEQ ID NO: 2193875 - RNA, 20 nt, Homo sapiens
aaauacuguaacacuguaua

SEQ ID NO: 2193876 - RNA, 14 nt, Homo sapiens
ggcuaacaucccac

SEQ ID NO: 2193877 - RNA, 13 nt, Homo sapiens
ugagaugcuggag

SEQ ID NO: 2193878 - RNA, 15 nt, Homo sapiens
auuccacacccucac

SEQ ID NO: 2193879 - RNA, 14 nt, Homo sapiens
ugcguggacucugc

SEQ ID NO: 2193880 - RNA, 14 nt, Homo sapiens
gcccagacaagauu

SEQ ID NO: 2193881 - RNA, 23 nt, Homo sapiens
uuucagugaauuugcacuguuua

SEQ ID NO: 2193882 - RNA, 13 nt, Homo sapiens
aacagagacugga

SEQ ID NO: 2193883 - RNA, 15 nt, Homo sapiens
aaacuugcauuuuaa

SEQ ID NO: 2193884 - RNA, 20 nt, Homo sapiens
augggcuccugccccuuuca

SEQ ID NO: 2193885 - RNA, 18 nt, Homo sapiens
acacuggggacuuggccu

SEQ ID NO: 2193886 - RNA, 13 nt, Homo sapiens
cuccugugugcug

SEQ ID NO: 2193887 - RNA, 14 nt, Homo sapiens
gugacuguggcaca

SEQ ID NO: 2193888 - RNA, 17 nt, Homo sapiens
uccuccaugauguuaau

SEQ ID NO: 2193889 - RNA, 20 nt, Homo sapiens
uaaagaaguaaauuugucca

SEQ ID NO: 2193890 - RNA, 22 nt, Homo sapiens
uuuggugacuguguaacuuucu

SEQ ID NO: 2193891 - RNA, 18 nt, Homo sapiens
cuuauauaaauguacagu

SEQ ID NO: 2193892 - RNA, 13 nt, Homo sapiens
cuucuaggugccc

SEQ ID NO: 2193893 - RNA, 23 nt, Homo sapiens
aaccaaggccccgagcucagggc

SEQ ID NO: 2193894 - RNA, 18 nt, Homo sapiens
acgugucugcacaggguc

SEQ ID NO: 2193895 - RNA, 13 nt, Homo sapiens
uaauuucaugaaa

SEQ ID NO: 2193896 - RNA, 14 nt, Homo sapiens
ggcccaagagcaga

SEQ ID NO: 2193897 - RNA, 19 nt, Homo sapiens
aggaagggagaauugagaa

SEQ ID NO: 2193898 - RNA, 21 nt, Homo sapiens
guauugcaccuuugaaaugca

SEQ ID NO: 2193899 - RNA, 13 nt, Homo sapiens
acuuaagaaauaa

SEQ ID NO: 2193900 - RNA, 18 nt, Homo sapiens
augaaagaacccaagaca

SEQ ID NO: 2193901 - RNA, 21 nt, Homo sapiens
acccccugaauuucucacaaa

SEQ ID NO: 2193902 - RNA, 12 nt, Homo sapiens
auguacagcucu

SEQ ID NO: 2193903 - RNA, 20 nt, Homo sapiens
ugcccccugcugccaugugg

SEQ ID NO: 2193904 - RNA, 23 nt, Homo sapiens
ucuaacaccaacauaagguacua

SEQ ID NO: 2193905 - RNA, 17 nt, Homo sapiens
aaggagaaucaucagga

SEQ ID NO: 2193906 - RNA, 15 nt, Homo sapiens
ucaguuuccucacca

SEQ ID NO: 2193907 - RNA, 16 nt, Homo sapiens
gacuuguucuugauag

SEQ ID NO: 2193908 - RNA, 17 nt, Homo sapiens
ugguuccggcucugcac

SEQ ID NO: 2193909 - RNA, 14 nt, Homo sapiens
aacuccucaugucu

SEQ ID NO: 2193910 - RNA, 14 nt, Homo sapiens
cuccccuccagccu

SEQ ID NO: 2193911 - RNA, 15 nt, Homo sapiens
uauagugaagcaauu

SEQ ID NO: 2193912 - RNA, 19 nt, Homo sapiens
auuucuucucccuccuccc

SEQ ID NO: 2193913 - RNA, 15 nt, Homo sapiens
gcuugcaugcuugca

SEQ ID NO: 2193914 - RNA, 15 nt, Homo sapiens
cucucugucucucug

SEQ ID NO: 2193915 - RNA, 15 nt, Homo sapiens
acauacauacauaca

SEQ ID NO: 2193916 - RNA, 15 nt, Homo sapiens
gcugaccugcugacc

SEQ ID NO: 2193917 - RNA, 15 nt, Homo sapiens
gauuucaugauuuca

SEQ ID NO: 2193918 - RNA, 22 nt, Homo sapiens
gaugacuuuuuauacuuuguaa

SEQ ID NO: 2193919 - RNA, 22 nt, Homo sapiens
ccaagagaagggcuuacaggca

SEQ ID NO: 2193920 - RNA, 21 nt, Homo sapiens
agaacugcuaaauacuguaca

SEQ ID NO: 2193921 - RNA, 19 nt, Homo sapiens
auucccucuccugcccaga

SEQ ID NO: 2193922 - RNA, 20 nt, Homo sapiens
uuuucugugauaacucugca

SEQ ID NO: 2193923 - RNA, 22 nt, Homo sapiens
aagucacggcugcgcacugugu

SEQ ID NO: 2193924 - RNA, 21 nt, Homo sapiens
gacagugcccuuggugcgagg

SEQ ID NO: 2193925 - RNA, 11 nt, Homo sapiens
cuuuagccaua

SEQ ID NO: 2193926 - RNA, 13 nt, Homo sapiens
caaugcaugauga

SEQ ID NO: 2193927 - RNA, 17 nt, Homo sapiens
uggggccucaccugcug

SEQ ID NO: 2193928 - RNA, 18 nt, Homo sapiens
uuuuguucuacaugagga

SEQ ID NO: 2193929 - RNA, 14 nt, Homo sapiens
ucugccuguacuga

SEQ ID NO: 2193930 - RNA, 17 nt, Homo sapiens
aacuguaaaauacuucu

SEQ ID NO: 2193931 - RNA, 18 nt, Homo sapiens
acgcuaguuaucaugcau

SEQ ID NO: 2193932 - RNA, 22 nt, Homo sapiens
ucauuuguuaauaaaauacuga

SEQ ID NO: 2193933 - RNA, 12 nt, Homo sapiens
auacagugucug

SEQ ID NO: 2193934 - RNA, 13 nt, Homo sapiens
agaagacacugca

SEQ ID NO: 2193935 - RNA, 18 nt, Homo sapiens
agcuucucuacagacucc

SEQ ID NO: 2193936 - RNA, 20 nt, Homo sapiens
gugguauggcuaauaccugu

SEQ ID NO: 2193937 - RNA, 18 nt, Homo sapiens
aaguaacugaauuauuuc

SEQ ID NO: 2193938 - RNA, 16 nt, Homo sapiens
caacugugugauuaaa

SEQ ID NO: 2193939 - RNA, 20 nt, Homo sapiens
aguuacaauuuggagcauaa

SEQ ID NO: 2193940 - RNA, 12 nt, Homo sapiens
gaaggugugcua

SEQ ID NO: 2193941 - RNA, 17 nt, Homo sapiens
gaaauuaagaaggcaaa

SEQ ID NO: 2193942 - RNA, 20 nt, Homo sapiens
cugacuggauucauucucau

SEQ ID NO: 2193943 - RNA, 17 nt, Homo sapiens
cuugaggagcuuucucc

SEQ ID NO: 2193944 - RNA, 20 nt, Homo sapiens
ucuuucaggacucuaccuca

SEQ ID NO: 2193945 - RNA, 19 nt, Homo sapiens
uugaagacacguucuugcc

SEQ ID NO: 2193946 - RNA, 22 nt, Homo sapiens
ucugaaauuugugauggaauca

SEQ ID NO: 2193947 - RNA, 19 nt, Homo sapiens
guccuggaaucacauucuu

SEQ ID NO: 2193948 - RNA, 17 nt, Homo sapiens
ugcauagcaagugaaag

SEQ ID NO: 2193949 - RNA, 17 nt, Homo sapiens
gaaaaugagagcagaaa

SEQ ID NO: 2193950 - RNA, 13 nt, Homo sapiens
gagagugcacugc

SEQ ID NO: 2193951 - RNA, 23 nt, Homo sapiens
aguuuccaaguuccugcacucca

SEQ ID NO: 2193952 - RNA, 17 nt, Homo sapiens
ggccugcaccgaccccg

SEQ ID NO: 2193953 - RNA, 20 nt, Homo sapiens
agcucccacucccuuuccaa

SEQ ID NO: 2193954 - RNA, 15 nt, Homo sapiens
uagaugucauuacaa

SEQ ID NO: 2193955 - RNA, 13 nt, Homo sapiens
auaaaauugcuau

SEQ ID NO: 2193956 - RNA, 19 nt, Homo sapiens
uggggcaggccaccuggcu

SEQ ID NO: 2193957 - RNA, 21 nt, Homo sapiens
agaacagguguuggugacaau

SEQ ID NO: 2193958 - RNA, 11 nt, Homo sapiens
aggucuuccaa

SEQ ID NO: 2193959 - RNA, 14 nt, Homo sapiens
ugguguaauaugaa

SEQ ID NO: 2193960 - RNA, 12 nt, Homo sapiens
agagagaacuuu

SEQ ID NO: 2193961 - RNA, 22 nt, Homo sapiens
gacuugcaaagaccuaccucca

SEQ ID NO: 2193962 - RNA, 20 nt, Homo sapiens
caagacaagacuauaccuua

SEQ ID NO: 2193963 - RNA, 20 nt, Homo sapiens
ccugacuccucuaagccacu

SEQ ID NO: 2193964 - RNA, 13 nt, Homo sapiens
ugacauguuguca

SEQ ID NO: 2193965 - RNA, 18 nt, Homo sapiens
guaaagucaacauaugca

SEQ ID NO: 2193966 - RNA, 13 nt, Homo sapiens
gcagcugugcugc

SEQ ID NO: 2193967 - RNA, 13 nt, Homo sapiens
uaacauguuauca

SEQ ID NO: 2193968 - RNA, 17 nt, Homo sapiens
augcuaagggcagcccu

SEQ ID NO: 2193969 - RNA, 21 nt, Homo sapiens
cacccgugagcgccugugcac

SEQ ID NO: 2193970 - RNA, 15 nt, Homo sapiens
acuaagcuuugccag

SEQ ID NO: 2193971 - RNA, 16 nt, Homo sapiens
ucaccaucaauccuga

SEQ ID NO: 2193972 - RNA, 20 nt, Homo sapiens
uuggagucugacugugccca

SEQ ID NO: 2193973 - RNA, 22 nt, Homo sapiens
auacagaauguucuauugucau

SEQ ID NO: 2193974 - RNA, 22 nt, Homo sapiens
auggaagauuagagguuuguca

SEQ ID NO: 2193975 - RNA, 17 nt, Homo sapiens
ggcugccugacacugag

SEQ ID NO: 2193976 - RNA, 20 nt, Homo sapiens
aaaugcuuuuccaacccaug

SEQ ID NO: 2193977 - RNA, 22 nt, Homo sapiens
agaacucagcuguccagcugca

SEQ ID NO: 2193978 - RNA, 15 nt, Homo sapiens
ugccuagaggugcuc

SEQ ID NO: 2193979 - RNA, 20 nt, Homo sapiens
accaaauacuuuaauguaua

SEQ ID NO: 2193980 - RNA, 15 nt, Homo sapiens
uuacuacuaagagaa

SEQ ID NO: 2193981 - RNA, 23 nt, Homo sapiens
ugcauucguaaacaccaaauacc

SEQ ID NO: 2193982 - RNA, 16 nt, Homo sapiens
gaccauaguauaauca

SEQ ID NO: 2193983 - RNA, 15 nt, Homo sapiens
ugcauauuuagcuuu

SEQ ID NO: 2193984 - RNA, 23 nt, Homo sapiens
cuccauccucgucugucaaugac

SEQ ID NO: 2193985 - RNA, 15 nt, Homo sapiens
auaugauuuguguau

SEQ ID NO: 2193986 - RNA, 18 nt, Homo sapiens
acucuuggucccuggaag

SEQ ID NO: 2193987 - RNA, 14 nt, Homo sapiens
gauugcaccaacag

SEQ ID NO: 2193988 - RNA, 22 nt, Homo sapiens
ugcgagcaccaaguacaaggac

SEQ ID NO: 2193989 - RNA, 20 nt, Homo sapiens
acccaggcuggagugcggug

SEQ ID NO: 2193990 - RNA, 23 nt, Homo sapiens
acugacgcucaguaaccaugcaa

SEQ ID NO: 2193991 - RNA, 20 nt, Homo sapiens
gcccaggcuagagugcaaug

SEQ ID NO: 2193992 - RNA, 20 nt, Homo sapiens
gcccaggcuggagugcagug

SEQ ID NO: 2193993 - RNA, 18 nt, Homo sapiens
ugcccaaugagacucuag

SEQ ID NO: 2193994 - RNA, 18 nt, Homo sapiens
augguaccuccuaggagu

SEQ ID NO: 2193995 - RNA, 13 nt, Homo sapiens
uuaggcaugccua

SEQ ID NO: 2193996 - RNA, 23 nt, Homo sapiens
cuuguggagagcuuauacagagc

SEQ ID NO: 2193997 - RNA, 18 nt, Homo sapiens
guuaccugaucaaugaca

SEQ ID NO: 2193998 - RNA, 13 nt, Homo sapiens
gacuuuguguuca

SEQ ID NO: 2193999 - RNA, 14 nt, Homo sapiens
caaucaguaauuaa

SEQ ID NO: 2194000 - RNA, 14 nt, Homo sapiens
cccagccaaucaca

SEQ ID NO: 2194001 - RNA, 16 nt, Homo sapiens
uuaagguggaaagugu

SEQ ID NO: 2194002 - RNA, 19 nt, Homo sapiens
ucacaguuagguagcuuua

SEQ ID NO: 2194003 - RNA, 15 nt, Homo sapiens
cuuggcagugggaau

SEQ ID NO: 2194004 - RNA, 22 nt, Homo sapiens
ccauuaaauagggaaaaaacau

SEQ ID NO: 2194005 - RNA, 14 nt, Homo sapiens
acauagcagacuuu

SEQ ID NO: 2194006 - RNA, 17 nt, Homo sapiens
guaacaugccagcuucc

SEQ ID NO: 2194007 - RNA, 18 nt, Homo sapiens
aguguaaauucagucuuu

SEQ ID NO: 2194008 - RNA, 11 nt, Homo sapiens
auaacuccuaa

SEQ ID NO: 2194009 - RNA, 15 nt, Homo sapiens
cccgaagaauggaga

SEQ ID NO: 2194010 - RNA, 16 nt, Homo sapiens
gccgccaccacggcau

SEQ ID NO: 2194011 - RNA, 17 nt, Homo sapiens
ccacgugggguggaauu

SEQ ID NO: 2194012 - RNA, 13 nt, Homo sapiens
caagucaaagacu

SEQ ID NO: 2194013 - RNA, 19 nt, Homo sapiens
uuggaauacuugaaaaccu

SEQ ID NO: 2194014 - RNA, 21 nt, Homo sapiens
uuguuacucaggaaccucacc

SEQ ID NO: 2194015 - RNA, 22 nt, Homo sapiens
auaaauugcuuacugauauuau

SEQ ID NO: 2194016 - RNA, 19 nt, Homo sapiens
uaagucacuuaaacucauc

SEQ ID NO: 2194017 - RNA, 18 nt, Homo sapiens
cccacuguggccuggcau

SEQ ID NO: 2194018 - RNA, 14 nt, Homo sapiens
acaaagugccaaag

SEQ ID NO: 2194019 - RNA, 14 nt, Homo sapiens
aacacaugcacaca

SEQ ID NO: 2194020 - RNA, 14 nt, Homo sapiens
caugaaugaaugaa

SEQ ID NO: 2194021 - RNA, 20 nt, Homo sapiens
gaaauuugcaacucacugau

SEQ ID NO: 2194022 - RNA, 20 nt, Homo sapiens
uggauucaacacugugcacg

SEQ ID NO: 2194023 - RNA, 16 nt, Homo sapiens
uuuauagaacguuucc

SEQ ID NO: 2194024 - RNA, 18 nt, Homo sapiens
gcccugggacaucaggag

SEQ ID NO: 2194025 - RNA, 17 nt, Homo sapiens
uuguuugcuuauacuuc

SEQ ID NO: 2194026 - RNA, 19 nt, Homo sapiens
uaaagaaagaaugcauucc

SEQ ID NO: 2194027 - RNA, 15 nt, Homo sapiens
cccugguguguuucc

SEQ ID NO: 2194028 - RNA, 11 nt, Homo sapiens
auaaugaacac

SEQ ID NO: 2194029 - RNA, 15 nt, Homo sapiens
acccaggcaccugca

SEQ ID NO: 2194030 - RNA, 19 nt, Homo sapiens
uugcgauucugcagccaca

SEQ ID NO: 2194031 - RNA, 14 nt, Homo sapiens
ugaccugguacuga

SEQ ID NO: 2194032 - RNA, 15 nt, Homo sapiens
auuucauggacacug

SEQ ID NO: 2194033 - RNA, 15 nt, Homo sapiens
aauaaaagcauuuaa

SEQ ID NO: 2194034 - RNA, 13 nt, Homo sapiens
gauaggaguucac

SEQ ID NO: 2194035 - RNA, 16 nt, Homo sapiens
cagguguuacuuacag

SEQ ID NO: 2194036 - RNA, 20 nt, Homo sapiens
ccccaguuccucccccaguu

SEQ ID NO: 2194037 - RNA, 16 nt, Homo sapiens
gucaaacugaaauuca

SEQ ID NO: 2194038 - RNA, 18 nt, Homo sapiens
aagcaaggcuuuaaauga

SEQ ID NO: 2194039 - RNA, 13 nt, Homo sapiens
ugagugcacugac

SEQ ID NO: 2194040 - RNA, 13 nt, Homo sapiens
ccucuuuccaaga

SEQ ID NO: 2194041 - RNA, 17 nt, Homo sapiens
uucugggugcagcugag

SEQ ID NO: 2194042 - RNA, 16 nt, Homo sapiens
ugccgugagcaugcac

SEQ ID NO: 2194043 - RNA, 16 nt, Homo sapiens
acuugaacccaggucu

SEQ ID NO: 2194044 - RNA, 17 nt, Homo sapiens
ugccacuugacauuccu

SEQ ID NO: 2194045 - RNA, 20 nt, Homo sapiens
cuguugugugucaugccagu

SEQ ID NO: 2194046 - RNA, 18 nt, Homo sapiens
cccauggugacaucacuc

SEQ ID NO: 2194047 - RNA, 14 nt, Homo sapiens
cuacauacaagcau

SEQ ID NO: 2194048 - RNA, 20 nt, Homo sapiens
gaaguuauuuagaaauaucc

SEQ ID NO: 2194049 - RNA, 16 nt, Homo sapiens
cuaucgcaaaucacaa

SEQ ID NO: 2194050 - RNA, 21 nt, Homo sapiens
aaauccuuauuuauauaucag

SEQ ID NO: 2194051 - RNA, 14 nt, Homo sapiens
cccaucugcaccga

SEQ ID NO: 2194052 - RNA, 15 nt, Homo sapiens
aaguggagacauauu

SEQ ID NO: 2194053 - RNA, 22 nt, Homo sapiens
uguaugcacgugugcacacaca

SEQ ID NO: 2194054 - RNA, 20 nt, Homo sapiens
uggcaacauuguacaaguca

SEQ ID NO: 2194055 - RNA, 21 nt, Homo sapiens
aucaauucuauuacgugcaau

SEQ ID NO: 2194056 - RNA, 12 nt, Homo sapiens
aaguguacagaa

SEQ ID NO: 2194057 - RNA, 16 nt, Homo sapiens
cucuaggucaguauua

SEQ ID NO: 2194058 - RNA, 16 nt, Homo sapiens
ccuguuuauugccauu

SEQ ID NO: 2194059 - RNA, 15 nt, Homo sapiens
ucucuauagagccaa

SEQ ID NO: 2194060 - RNA, 15 nt, Homo sapiens
agguaaggugaggga

SEQ ID NO: 2194061 - RNA, 11 nt, Homo sapiens
gggugugcugu

SEQ ID NO: 2194062 - RNA, 19 nt, Homo sapiens
uccuggagcacuguaaaaa

SEQ ID NO: 2194063 - RNA, 21 nt, Homo sapiens
agaucacgcuccccgccuguu

SEQ ID NO: 2194064 - RNA, 15 nt, Homo sapiens
augucugauaaugau

SEQ ID NO: 2194065 - RNA, 18 nt, Homo sapiens
gaacaaaagaagcagcaa

SEQ ID NO: 2194066 - RNA, 18 nt, Homo sapiens
gaagccuuugccagccau

SEQ ID NO: 2194067 - RNA, 19 nt, Homo sapiens
ggcagcucgagcaugcccu

SEQ ID NO: 2194068 - RNA, 22 nt, Homo sapiens
uauucugaucaguugccaaaga

SEQ ID NO: 2194069 - RNA, 12 nt, Homo sapiens
aaagacaucagu

SEQ ID NO: 2194070 - RNA, 16 nt, Homo sapiens
cugaacaggaaagagc

SEQ ID NO: 2194071 - RNA, 23 nt, Homo sapiens
aauaauuuuuaccuaaucuccac

SEQ ID NO: 2194072 - RNA, 17 nt, Homo sapiens
aaaugcuacaaacauau

SEQ ID NO: 2194073 - RNA, 22 nt, Homo sapiens
cuuuucccagaagagucuuuga

SEQ ID NO: 2194074 - RNA, 21 nt, Homo sapiens
caguuaaaucuccuguggagu

SEQ ID NO: 2194075 - RNA, 20 nt, Homo sapiens
agacccagcugauugcacua

SEQ ID NO: 2194076 - RNA, 16 nt, Homo sapiens
aaaugaaacuuggcca

SEQ ID NO: 2194077 - RNA, 23 nt, Homo sapiens
aaacugucuuuuuccucaaugaa

SEQ ID NO: 2194078 - RNA, 17 nt, Homo sapiens
caaagaauuccaaagca

SEQ ID NO: 2194079 - RNA, 17 nt, Homo sapiens
agaguguggauuguaua

SEQ ID NO: 2194080 - RNA, 18 nt, Homo sapiens
aaucgacuuguucuugau

SEQ ID NO: 2194081 - RNA, 14 nt, Homo sapiens
accaagcucugucc

SEQ ID NO: 2194082 - RNA, 19 nt, Homo sapiens
uuauauguagccuuuacug

SEQ ID NO: 2194083 - RNA, 22 nt, Homo sapiens
gacagcccuggcaaaugccuga

SEQ ID NO: 2194084 - RNA, 22 nt, Homo sapiens
ucauccuggcacgcccuacucc

SEQ ID NO: 2194085 - RNA, 19 nt, Homo sapiens
aauugcuuauaacaagcau

SEQ ID NO: 2194086 - RNA, 15 nt, Homo sapiens
uguacagacauauuu

SEQ ID NO: 2194087 - RNA, 21 nt, Homo sapiens
gaucacuggcuggccugagca

SEQ ID NO: 2194088 - RNA, 16 nt, Homo sapiens
aaacugucacaaguug

SEQ ID NO: 2194089 - RNA, 14 nt, Homo sapiens
ucagcaucuguccu

SEQ ID NO: 2194090 - RNA, 13 nt, Homo sapiens
agcacaaacauuu

SEQ ID NO: 2194091 - RNA, 16 nt, Homo sapiens
uaauuuuccugugaca

SEQ ID NO: 2194092 - RNA, 13 nt, Homo sapiens
ccuuaguuucaaa

SEQ ID NO: 2194093 - RNA, 16 nt, Homo sapiens
caaguuuuugguaaug

SEQ ID NO: 2194094 - RNA, 18 nt, Homo sapiens
ggacauugaaagugaaau

SEQ ID NO: 2194095 - RNA, 14 nt, Homo sapiens
caggagucugucuc

SEQ ID NO: 2194096 - RNA, 18 nt, Homo sapiens
agaaaccugccaaggagc

SEQ ID NO: 2194097 - RNA, 17 nt, Homo sapiens
ugucaaucacagucuca

SEQ ID NO: 2194098 - RNA, 16 nt, Homo sapiens
ugaaaauguauuugug

SEQ ID NO: 2194099 - RNA, 22 nt, Homo sapiens
gagaaacaaguauuuugcuaua

SEQ ID NO: 2194100 - RNA, 23 nt, Homo sapiens
acuggaaauuccaggaaccaaaa

SEQ ID NO: 2194101 - RNA, 14 nt, Homo sapiens
acauauaaagcacu

SEQ ID NO: 2194102 - RNA, 20 nt, Homo sapiens
cugagaguuggcucaggcag

SEQ ID NO: 2194103 - RNA, 13 nt, Homo sapiens
gaaagaggccaaa

SEQ ID NO: 2194104 - RNA, 21 nt, Homo sapiens
ucacagggacucuccauaugu

SEQ ID NO: 2194105 - RNA, 19 nt, Homo sapiens
uccucagccuugccagaga

SEQ ID NO: 2194106 - RNA, 13 nt, Homo sapiens
cgccaaugcacac

SEQ ID NO: 2194107 - RNA, 15 nt, Homo sapiens
aucucuuuccuccua

SEQ ID NO: 2194108 - RNA, 13 nt, Homo sapiens
gguuuuccgccca

SEQ ID NO: 2194109 - RNA, 21 nt, Homo sapiens
cccaguucauugcacuuugau

SEQ ID NO: 2194110 - RNA, 16 nt, Homo sapiens
uguuagugucugucca

SEQ ID NO: 2194111 - RNA, 23 nt, Homo sapiens
caguaauuauguucuacagaaua

SEQ ID NO: 2194112 - RNA, 21 nt, Homo sapiens
gcaacaagaguaaaacucugu

SEQ ID NO: 2194113 - RNA, 22 nt, Homo sapiens
ucaucuuugacguggagcugcu

SEQ ID NO: 2194114 - RNA, 18 nt, Homo sapiens
cucguuugugauucuucc

SEQ ID NO: 2194115 - RNA, 12 nt, Homo sapiens
gcacacacaugg

SEQ ID NO: 2194116 - RNA, 18 nt, Homo sapiens
auaaacaugaagcacaaa

SEQ ID NO: 2194117 - RNA, 22 nt, Homo sapiens
ugucccaggccgacccaaggga

SEQ ID NO: 2194118 - RNA, 21 nt, Homo sapiens
cuuggaaaaaaaccacagcca

SEQ ID NO: 2194119 - RNA, 19 nt, Homo sapiens
cuuaaccucaaaacuguau

SEQ ID NO: 2194120 - RNA, 15 nt, Homo sapiens
ucacuuaauccuuug

SEQ ID NO: 2194121 - RNA, 24 nt, Homo sapiens
ucuuugcucaacagaacauauguu

SEQ ID NO: 2194122 - RNA, 14 nt, Homo sapiens
caccacuagccuca

SEQ ID NO: 2194123 - RNA, 18 nt, Homo sapiens
aacccagccacugccaag

SEQ ID NO: 2194124 - RNA, 21 nt, Homo sapiens
gccuuagccgcccaugcacug

SEQ ID NO: 2194125 - RNA, 17 nt, Homo sapiens
aggguuuguaauacuuu

SEQ ID NO: 2194126 - RNA, 23 nt, Homo sapiens
gauuccccuggaccacaccuccg

SEQ ID NO: 2194127 - RNA, 16 nt, Homo sapiens
cucgaggccugcaaac

SEQ ID NO: 2194128 - RNA, 20 nt, Homo sapiens
ugcuaaaaaaagugcaugau

SEQ ID NO: 2194129 - RNA, 22 nt, Homo sapiens
ugccauagaauggcacauguca

SEQ ID NO: 2194130 - RNA, 16 nt, Homo sapiens
ccccaaaaaacaauua

SEQ ID NO: 2194131 - RNA, 14 nt, Homo sapiens
cuuuagaacaggga

SEQ ID NO: 2194132 - RNA, 14 nt, Homo sapiens
cacaagugugcauu

SEQ ID NO: 2194133 - RNA, 18 nt, Homo sapiens
agauuauauggacuuucu

SEQ ID NO: 2194134 - RNA, 18 nt, Homo sapiens
aagucacaacaaaaggaa

SEQ ID NO: 2194135 - RNA, 19 nt, Homo sapiens
ucuuccaucugauugugau

SEQ ID NO: 2194136 - RNA, 17 nt, Homo sapiens
aauuggcaguguaacau

SEQ ID NO: 2194137 - RNA, 20 nt, Homo sapiens
uuuucaaaugucagcuuaaa

SEQ ID NO: 2194138 - RNA, 18 nt, Homo sapiens
cuaggaguugaguacagu

SEQ ID NO: 2194139 - RNA, 18 nt, Homo sapiens
ucuucaauuuggauauuu

SEQ ID NO: 2194140 - RNA, 18 nt, Homo sapiens
acugaauuuugucuuuau

SEQ ID NO: 2194141 - RNA, 12 nt, Homo sapiens
gcauuucuuauu

SEQ ID NO: 2194142 - RNA, 21 nt, Homo sapiens
ccuuguguacaguuauuuaug

SEQ ID NO: 2194143 - RNA, 22 nt, Homo sapiens
cuucauagaugaaugaaacccu

SEQ ID NO: 2194144 - RNA, 21 nt, Homo sapiens
gaacugacauuaaaauaacua

SEQ ID NO: 2194145 - RNA, 11 nt, Homo sapiens
ugcaguagcac

SEQ ID NO: 2194146 - RNA, 22 nt, Homo sapiens
auuuccaagaaauauuccuuaa

SEQ ID NO: 2194147 - RNA, 13 nt, Homo sapiens
cucagccuguucc

SEQ ID NO: 2194148 - RNA, 15 nt, Homo sapiens
uauccacuggcauuu

SEQ ID NO: 2194149 - RNA, 20 nt, Homo sapiens
caaaucucuuccacaugggu

SEQ ID NO: 2194150 - RNA, 21 nt, Homo sapiens
auagacggguugaaagacauc

SEQ ID NO: 2194151 - RNA, 13 nt, Homo sapiens
auuccugugauuu

SEQ ID NO: 2194152 - RNA, 19 nt, Homo sapiens
uauagagaauaaggcacaa

SEQ ID NO: 2194153 - RNA, 19 nt, Homo sapiens
agaccaagacacagaucac

SEQ ID NO: 2194154 - RNA, 14 nt, Homo sapiens
cuuggugaugcugg

SEQ ID NO: 2194155 - RNA, 14 nt, Homo sapiens
uccucuuccugccu

SEQ ID NO: 2194156 - RNA, 19 nt, Homo sapiens
aggcucucgcacaccucug

SEQ ID NO: 2194157 - RNA, 18 nt, Homo sapiens
acgcacgcucgcugccau

SEQ ID NO: 2194158 - RNA, 19 nt, Homo sapiens
cuaaggcuuggaaacagaa

SEQ ID NO: 2194159 - RNA, 17 nt, Homo sapiens
ucaacuguauguacaua

SEQ ID NO: 2194160 - RNA, 17 nt, Homo sapiens
cuaacuuaucaucacac

SEQ ID NO: 2194161 - RNA, 19 nt, Homo sapiens
gcguuguugcauguuugaa

SEQ ID NO: 2194162 - RNA, 17 nt, Homo sapiens
ucuggacauucagaaca

SEQ ID NO: 2194163 - RNA, 14 nt, Homo sapiens
cucaucugcuccua

SEQ ID NO: 2194164 - RNA, 16 nt, Homo sapiens
uggaagacggauuugc

SEQ ID NO: 2194165 - RNA, 23 nt, Homo sapiens
aaguguguacaagcauucaagaa

SEQ ID NO: 2194166 - RNA, 12 nt, Homo sapiens
acuugcauuuau

SEQ ID NO: 2194167 - RNA, 18 nt, Homo sapiens
uaacuuauuuuauuucca

SEQ ID NO: 2194168 - RNA, 22 nt, Homo sapiens
uguaaguuuaugcauacaguaa

SEQ ID NO: 2194169 - RNA, 16 nt, Homo sapiens
ugccugucccagagag

SEQ ID NO: 2194170 - RNA, 19 nt, Homo sapiens
ccaugccuauuuacuggaa

SEQ ID NO: 2194171 - RNA, 17 nt, Homo sapiens
uuccauauuaguuuuac

SEQ ID NO: 2194172 - RNA, 15 nt, Homo sapiens
uucugauucuucaaa

SEQ ID NO: 2194173 - RNA, 22 nt, Homo sapiens
ugccauccuaggcuuaaaugca

SEQ ID NO: 2194174 - RNA, 14 nt, Homo sapiens
ugucuucuacagau

SEQ ID NO: 2194175 - RNA, 18 nt, Homo sapiens
ucaggaguuccuaaccag

SEQ ID NO: 2194176 - RNA, 19 nt, Homo sapiens
gcugagugagugaugaauc

SEQ ID NO: 2194177 - RNA, 20 nt, Homo sapiens
ugauucacauccucucaagu

SEQ ID NO: 2194178 - RNA, 21 nt, Homo sapiens
accaaguuucauaccaaauau

SEQ ID NO: 2194179 - RNA, 16 nt, Homo sapiens
ggguccuguccaugcc

SEQ ID NO: 2194180 - RNA, 13 nt, Homo sapiens
gguuuacugcugu

SEQ ID NO: 2194181 - RNA, 15 nt, Homo sapiens
ggaaaagcagcucaa

SEQ ID NO: 2194182 - RNA, 21 nt, Homo sapiens
acaaauaaguggaaaccgugu

SEQ ID NO: 2194183 - RNA, 14 nt, Homo sapiens
uuuauacauaguca

SEQ ID NO: 2194184 - RNA, 18 nt, Homo sapiens
auugaagcuuuacuuuag

SEQ ID NO: 2194185 - RNA, 20 nt, Homo sapiens
ucccucuguuagguccauuu

SEQ ID NO: 2194186 - RNA, 22 nt, Homo sapiens
acagggaggggcugauccugcc

SEQ ID NO: 2194187 - RNA, 22 nt, Homo sapiens
acauucuuuuuucuauucaaua

SEQ ID NO: 2194188 - RNA, 23 nt, Homo sapiens
aaguugaaaaucauaggcaccuu

SEQ ID NO: 2194189 - RNA, 14 nt, Homo sapiens
cugcaaacugggaa

SEQ ID NO: 2194190 - RNA, 18 nt, Homo sapiens
caauggcgcgaucuuggc

SEQ ID NO: 2194191 - RNA, 20 nt, Homo sapiens
ugaggucaggaguucgagac

SEQ ID NO: 2194192 - RNA, 18 nt, Homo sapiens
uaguccuauucuauugca

SEQ ID NO: 2194193 - RNA, 23 nt, Homo sapiens
ggaauagugcuugcuggccacaa

SEQ ID NO: 2194194 - RNA, 23 nt, Homo sapiens
ugccugccaagcucacacagcag

SEQ ID NO: 2194195 - RNA, 18 nt, Homo sapiens
cgaguuccggaaagccuu

SEQ ID NO: 2194196 - RNA, 19 nt, Homo sapiens
gaauuuuuugaauaugccu

SEQ ID NO: 2194197 - RNA, 22 nt, Homo sapiens
aauucauugagcaguuagcuca

SEQ ID NO: 2194198 - RNA, 11 nt, Homo sapiens
accuguagucc

SEQ ID NO: 2194199 - RNA, 20 nt, Homo sapiens
aaugugaagauggacuucau

SEQ ID NO: 2194200 - RNA, 14 nt, Homo sapiens
uuaaucacuuuuga

SEQ ID NO: 2194201 - RNA, 14 nt, Homo sapiens
aggauguguccuag

SEQ ID NO: 2194202 - RNA, 22 nt, Homo sapiens
agcuggagauacugauuauuga

SEQ ID NO: 2194203 - RNA, 23 nt, Homo sapiens
uauccugcgaccuugcaaccuca

SEQ ID NO: 2194204 - RNA, 21 nt, Homo sapiens
uuaagauuccauuuuggaaaa

SEQ ID NO: 2194205 - RNA, 17 nt, Homo sapiens
aggcucaauauuccuga

SEQ ID NO: 2194206 - RNA, 17 nt, Homo sapiens
auguaaaauccauccaa

SEQ ID NO: 2194207 - RNA, 11 nt, Homo sapiens
ccagagcucag

SEQ ID NO: 2194208 - RNA, 14 nt, Homo sapiens
ucaauuucucccca

SEQ ID NO: 2194209 - RNA, 21 nt, Homo sapiens
cuggggccgaaagaacagucc

SEQ ID NO: 2194210 - RNA, 20 nt, Homo sapiens
cauuaucaguugacagugua

SEQ ID NO: 2194211 - RNA, 15 nt, Homo sapiens
augcuuuuugaucug

SEQ ID NO: 2194212 - RNA, 18 nt, Homo sapiens
aauuugaaucugagugaa

SEQ ID NO: 2194213 - RNA, 18 nt, Homo sapiens
ucuuugcugccagccacu

SEQ ID NO: 2194214 - RNA, 15 nt, Homo sapiens
gcuucaaggcuucca

SEQ ID NO: 2194215 - RNA, 15 nt, Homo sapiens
uauaucuguauauau

SEQ ID NO: 2194216 - RNA, 20 nt, Homo sapiens
uauaaaccgaucuucgugau

SEQ ID NO: 2194217 - RNA, 17 nt, Homo sapiens
cgucuaagucaugagcu

SEQ ID NO: 2194218 - RNA, 14 nt, Homo sapiens
augugaaggacaug

SEQ ID NO: 2194219 - RNA, 14 nt, Homo sapiens
ugccugguccucac

SEQ ID NO: 2194220 - RNA, 15 nt, Homo sapiens
ccucaaagucugcaa

SEQ ID NO: 2194221 - RNA, 13 nt, Homo sapiens
uauccugggaccu

SEQ ID NO: 2194222 - RNA, 15 nt, Homo sapiens
uacuugaacaaaagg

SEQ ID NO: 2194223 - RNA, 14 nt, Homo sapiens
aaauauuuuugcca

SEQ ID NO: 2194224 - RNA, 15 nt, Homo sapiens
auguuagauacacaa

SEQ ID NO: 2194225 - RNA, 20 nt, Homo sapiens
ugguuccgccaggcgcugca

SEQ ID NO: 2194226 - RNA, 12 nt, Homo sapiens
acuaagccagac

SEQ ID NO: 2194227 - RNA, 21 nt, Homo sapiens
aaaaggacucugcuucagucc

SEQ ID NO: 2194228 - RNA, 19 nt, Homo sapiens
acagaaccauaaagcauau

SEQ ID NO: 2194229 - RNA, 11 nt, Homo sapiens
gggugccugua

SEQ ID NO: 2194230 - RNA, 17 nt, Homo sapiens
aauaaaaauuguagcuu

SEQ ID NO: 2194231 - RNA, 19 nt, Homo sapiens
gcugccaggggcagugaag

SEQ ID NO: 2194232 - RNA, 14 nt, Homo sapiens
uugcucaaguucac

SEQ ID NO: 2194233 - RNA, 21 nt, Homo sapiens
acacgccugcaaacgcugccu

SEQ ID NO: 2194234 - RNA, 14 nt, Homo sapiens
gcauccuggccaac

SEQ ID NO: 2194235 - RNA, 19 nt, Homo sapiens
gaagggacacacaagaaga

SEQ ID NO: 2194236 - RNA, 21 nt, Homo sapiens
uaaucguguccugaaaauccu

SEQ ID NO: 2194237 - RNA, 14 nt, Homo sapiens
guguaaacaggauu

SEQ ID NO: 2194238 - RNA, 15 nt, Homo sapiens
aaaauaaagccauuu

SEQ ID NO: 2194239 - RNA, 20 nt, Homo sapiens
ucaggagaucuggcugugag

SEQ ID NO: 2194240 - RNA, 22 nt, Homo sapiens
aacagaaagccugggugacauu

SEQ ID NO: 2194241 - RNA, 12 nt, Homo sapiens
ugcuuucuuggc

SEQ ID NO: 2194242 - RNA, 18 nt, Homo sapiens
aauaaaaugaaauacuaa

SEQ ID NO: 2194243 - RNA, 13 nt, Homo sapiens
aacuccaguguuc

SEQ ID NO: 2194244 - RNA, 15 nt, Homo sapiens
cucuggauggcacca

SEQ ID NO: 2194245 - RNA, 13 nt, Homo sapiens
agucagacacgau

SEQ ID NO: 2194246 - RNA, 18 nt, Homo sapiens
accaugguuuuggcucuc

SEQ ID NO: 2194247 - RNA, 17 nt, Homo sapiens
ccaaccccccaccugcc

SEQ ID NO: 2194248 - RNA, 13 nt, Homo sapiens
uaugaggugggau

SEQ ID NO: 2194249 - RNA, 16 nt, Homo sapiens
uaacaggcagauacag

SEQ ID NO: 2194250 - RNA, 18 nt, Homo sapiens
cacacaugaauaaagccu

SEQ ID NO: 2194251 - RNA, 22 nt, Homo sapiens
gaacuguuggcugcuccccacc

SEQ ID NO: 2194252 - RNA, 19 nt, Homo sapiens
cccuucaaugcugcaggau

SEQ ID NO: 2194253 - RNA, 17 nt, Homo sapiens
acaaguuccaugggaua

SEQ ID NO: 2194254 - RNA, 15 nt, Homo sapiens
cauuagaaaggauuu

SEQ ID NO: 2194255 - RNA, 14 nt, Homo sapiens
aauuuuuaccuaau

SEQ ID NO: 2194256 - RNA, 14 nt, Homo sapiens
aauucuuagaauau

SEQ ID NO: 2194257 - RNA, 22 nt, Homo sapiens
auauauuuccacuucuucauuc

SEQ ID NO: 2194258 - RNA, 15 nt, Homo sapiens
aucagagcccaggga

SEQ ID NO: 2194259 - RNA, 16 nt, Homo sapiens
cugggccagaugcugg

SEQ ID NO: 2194260 - RNA, 14 nt, Homo sapiens
uaaaacacaacauc

SEQ ID NO: 2194261 - RNA, 13 nt, Homo sapiens
uucaugcagguga

SEQ ID NO: 2194262 - RNA, 17 nt, Homo sapiens
aaaguggcguuguucau

SEQ ID NO: 2194263 - RNA, 20 nt, Homo sapiens
agccauauauuuucugagua

SEQ ID NO: 2194264 - RNA, 12 nt, Homo sapiens
aagccacugccu

SEQ ID NO: 2194265 - RNA, 13 nt, Homo sapiens
aggguuucaccau

SEQ ID NO: 2194266 - RNA, 18 nt, Homo sapiens
ugccucuccccagagcau

SEQ ID NO: 2194267 - RNA, 20 nt, Homo sapiens
ugcuuuauuugcaaaucacc

SEQ ID NO: 2194268 - RNA, 16 nt, Homo sapiens
cacugcccaccaaagg

SEQ ID NO: 2194269 - RNA, 20 nt, Homo sapiens
aaaccugaugcagugcucca

SEQ ID NO: 2194270 - RNA, 18 nt, Homo sapiens
cugcaaaaaaaugugcau

SEQ ID NO: 2194271 - RNA, 20 nt, Homo sapiens
uguagaugggggaacuguga

SEQ ID NO: 2194272 - RNA, 22 nt, Homo sapiens
cugucuucggccgagcugguuu

SEQ ID NO: 2194273 - RNA, 19 nt, Homo sapiens
agaaacacucuuauuccca

SEQ ID NO: 2194274 - RNA, 13 nt, Homo sapiens
aaacaaacuucca

SEQ ID NO: 2194275 - RNA, 13 nt, Homo sapiens
aaaauaacuucau

SEQ ID NO: 2194276 - RNA, 16 nt, Homo sapiens
uucugagcuccugucc

SEQ ID NO: 2194277 - RNA, 17 nt, Homo sapiens
agauugcgccacugcac

SEQ ID NO: 2194278 - RNA, 16 nt, Homo sapiens
gaggaggaaccaggcu

SEQ ID NO: 2194279 - RNA, 17 nt, Homo sapiens
uguauuaauuauaccag

SEQ ID NO: 2194280 - RNA, 14 nt, Homo sapiens
gcugauaacauuuu

SEQ ID NO: 2194281 - RNA, 15 nt, Homo sapiens
cuguugucauugcug

SEQ ID NO: 2194282 - RNA, 15 nt, Homo sapiens
gaaccaggcaacuug

SEQ ID NO: 2194283 - RNA, 22 nt, Homo sapiens
aucagaguugcuuuucuaaucu

SEQ ID NO: 2194284 - RNA, 15 nt, Homo sapiens
uccugacacucaaua

SEQ ID NO: 2194285 - RNA, 16 nt, Homo sapiens
uguuucuuuugcuuag

SEQ ID NO: 2194286 - RNA, 14 nt, Homo sapiens
ucaucauggccagc

SEQ ID NO: 2194287 - RNA, 16 nt, Homo sapiens
cccuccaaaagcacuu

SEQ ID NO: 2194288 - RNA, 13 nt, Homo sapiens
cuguugacaaaug

SEQ ID NO: 2194289 - RNA, 22 nt, Homo sapiens
cauucuccucucucuaucccug

SEQ ID NO: 2194290 - RNA, 21 nt, Homo sapiens
cacccagaucacaaacagccu

SEQ ID NO: 2194291 - RNA, 23 nt, Homo sapiens
auggagcccagccccgcccucca

SEQ ID NO: 2194292 - RNA, 15 nt, Homo sapiens
cacugcccaucccac

SEQ ID NO: 2194293 - RNA, 15 nt, Homo sapiens
gccccuauuagcucu

SEQ ID NO: 2194294 - RNA, 17 nt, Homo sapiens
augucugacuucaagga

SEQ ID NO: 2194295 - RNA, 14 nt, Homo sapiens
caugugaucuauua

SEQ ID NO: 2194296 - RNA, 24 nt, Homo sapiens
acucugccagaguagugaagcuaa

SEQ ID NO: 2194297 - RNA, 16 nt, Homo sapiens
guagguuaacacugaa

SEQ ID NO: 2194298 - RNA, 17 nt, Homo sapiens
acagugcccagcuaauu

SEQ ID NO: 2194299 - RNA, 16 nt, Homo sapiens
accugaccucugcaag

SEQ ID NO: 2194300 - RNA, 20 nt, Homo sapiens
uacaugagaggacugaugaa

SEQ ID NO: 2194301 - RNA, 15 nt, Homo sapiens
uuccucuuacugggg

SEQ ID NO: 2194302 - RNA, 14 nt, Homo sapiens
ucauuugcucuaau

SEQ ID NO: 2194303 - RNA, 16 nt, Homo sapiens
ugugugguauuuuggc

SEQ ID NO: 2194304 - RNA, 16 nt, Homo sapiens
ucauuugugugcucau

SEQ ID NO: 2194305 - RNA, 17 nt, Homo sapiens
aaaagcuucugcaauau

SEQ ID NO: 2194306 - RNA, 16 nt, Homo sapiens
cuuauucuagaggucu

SEQ ID NO: 2194307 - RNA, 13 nt, Homo sapiens
aguaauugcucua

SEQ ID NO: 2194308 - RNA, 24 nt, Homo sapiens
ucuuuaccuugcauuuuagcuaau

SEQ ID NO: 2194309 - RNA, 14 nt, Homo sapiens
aggcagucccggga

SEQ ID NO: 2194310 - RNA, 15 nt, Homo sapiens
cuuaccaacuuucug

SEQ ID NO: 2194311 - RNA, 15 nt, Homo sapiens
gacaucaagacuuug

SEQ ID NO: 2194312 - RNA, 15 nt, Homo sapiens
cgaucucuccuggcc

SEQ ID NO: 2194313 - RNA, 17 nt, Homo sapiens
aggaaacuguagccuga

SEQ ID NO: 2194314 - RNA, 17 nt, Homo sapiens
ucaccuuccuaaucacc

SEQ ID NO: 2194315 - RNA, 17 nt, Homo sapiens
aguuucuaggagcacaa

SEQ ID NO: 2194316 - RNA, 17 nt, Homo sapiens
uauuucuagaagcacau

SEQ ID NO: 2194317 - RNA, 14 nt, Homo sapiens
auuucuuaguccau

SEQ ID NO: 2194318 - RNA, 23 nt, Homo sapiens
cuguagaaggaaauauaccuuaa

SEQ ID NO: 2194319 - RNA, 15 nt, Homo sapiens
augaugcagagcuuu

SEQ ID NO: 2194320 - RNA, 19 nt, Homo sapiens
gcuauuaacugccaaaaca

SEQ ID NO: 2194321 - RNA, 18 nt, Homo sapiens
caacuuauuuuuguucau

SEQ ID NO: 2194322 - RNA, 12 nt, Homo sapiens
gacauggcuccc

SEQ ID NO: 2194323 - RNA, 18 nt, Homo sapiens
cauugggcuacuguagau

SEQ ID NO: 2194324 - RNA, 23 nt, Homo sapiens
aaucacacaugcuuuucuuccua

SEQ ID NO: 2194325 - RNA, 14 nt, Homo sapiens
uuaagaaaaauuca

SEQ ID NO: 2194326 - RNA, 21 nt, Homo sapiens
accuauguguccucuaaguca

SEQ ID NO: 2194327 - RNA, 20 nt, Homo sapiens
augauggcuuuaccuuuauu

SEQ ID NO: 2194328 - RNA, 10 nt, Homo sapiens
ucccaaagug

SEQ ID NO: 2194329 - RNA, 23 nt, Homo sapiens
gggaggccgaagcuaacagggaa

SEQ ID NO: 2194330 - RNA, 19 nt, Homo sapiens
gauaugacccacacugcca

SEQ ID NO: 2194331 - RNA, 14 nt, Homo sapiens
aaaaaccugccuaa

SEQ ID NO: 2194332 - RNA, 18 nt, Homo sapiens
aaaacccaggacaucucc

SEQ ID NO: 2194333 - RNA, 23 nt, Homo sapiens
cauacaaagcaguuuauuuuaga

SEQ ID NO: 2194334 - RNA, 20 nt, Homo sapiens
aacugaguuagaauguugaa

SEQ ID NO: 2194335 - RNA, 18 nt, Homo sapiens
agaacaaauaaaugagcc

SEQ ID NO: 2194336 - RNA, 22 nt, Homo sapiens
aggauuucucaacuuugauacu

SEQ ID NO: 2194337 - RNA, 13 nt, Homo sapiens
ccucuuaggcaga

SEQ ID NO: 2194338 - RNA, 17 nt, Homo sapiens
gucucaaacuccugacc

SEQ ID NO: 2194339 - RNA, 18 nt, Homo sapiens
uccaagccucauguccac

SEQ ID NO: 2194340 - RNA, 21 nt, Homo sapiens
cugugaggggcucucucauga

SEQ ID NO: 2194341 - RNA, 13 nt, Homo sapiens
caacacacacugu

SEQ ID NO: 2194342 - RNA, 16 nt, Homo sapiens
cucagcccugcucccu

SEQ ID NO: 2194343 - RNA, 14 nt, Homo sapiens
acuauggaagccac

SEQ ID NO: 2194344 - RNA, 19 nt, Homo sapiens
uagguccuggcuucuagau

SEQ ID NO: 2194345 - RNA, 15 nt, Homo sapiens
agaaauaaagcacau

SEQ ID NO: 2194346 - RNA, 13 nt, Homo sapiens
acccagcaaagag

SEQ ID NO: 2194347 - RNA, 19 nt, Homo sapiens
cuugaagugaucauuucac

SEQ ID NO: 2194348 - RNA, 17 nt, Homo sapiens
agugcaggugcaguuuc

SEQ ID NO: 2194349 - RNA, 12 nt, Homo sapiens
gggcucagagag

SEQ ID NO: 2194350 - RNA, 20 nt, Homo sapiens
aaugucucgggacuuggguc

SEQ ID NO: 2194351 - RNA, 20 nt, Homo sapiens
acugugaagauucaguucaa

SEQ ID NO: 2194352 - RNA, 20 nt, Homo sapiens
uuguaaaauauuuaugagaa

SEQ ID NO: 2194353 - RNA, 15 nt, Homo sapiens
aagugguucagucua

SEQ ID NO: 2194354 - RNA, 19 nt, Homo sapiens
aaaucaagugguauuuucc

SEQ ID NO: 2194355 - RNA, 20 nt, Homo sapiens
ugaggagucuugugugcauu

SEQ ID NO: 2194356 - RNA, 21 nt, Homo sapiens
cugaugacacaggcugacuca

SEQ ID NO: 2194357 - RNA, 23 nt, Homo sapiens
aaucuuuaagcagagaagggcau

SEQ ID NO: 2194358 - RNA, 12 nt, Homo sapiens
gcagauuuccau

SEQ ID NO: 2194359 - RNA, 23 nt, Homo sapiens
ccugaucucugaccucugcugag

SEQ ID NO: 2194360 - RNA, 19 nt, Homo sapiens
ggaauuucuguucuuccau

SEQ ID NO: 2194361 - RNA, 18 nt, Homo sapiens
ucacuuuuuuccugucaa

SEQ ID NO: 2194362 - RNA, 17 nt, Homo sapiens
gagauuguuguuugcca

SEQ ID NO: 2194363 - RNA, 22 nt, Homo sapiens
auauuuucagcaaaacuuucca

SEQ ID NO: 2194364 - RNA, 21 nt, Homo sapiens
ggauggcaucaaacagggcaa

SEQ ID NO: 2194365 - RNA, 19 nt, Homo sapiens
gccuggaugaggcacuucu

SEQ ID NO: 2194366 - RNA, 12 nt, Homo sapiens
cacuucucagga

SEQ ID NO: 2194367 - RNA, 20 nt, Homo sapiens
ccuagaagaagcuaugucaa

SEQ ID NO: 2194368 - RNA, 22 nt, Homo sapiens
gccaccacccuacuucauuuuc

SEQ ID NO: 2194369 - RNA, 18 nt, Homo sapiens
ccaacagucaaaacagag

SEQ ID NO: 2194370 - RNA, 13 nt, Homo sapiens
aaucuacaugugu

SEQ ID NO: 2194371 - RNA, 14 nt, Homo sapiens
cccagacaaggaga

SEQ ID NO: 2194372 - RNA, 15 nt, Homo sapiens
auucuccugccuuag

SEQ ID NO: 2194373 - RNA, 12 nt, Homo sapiens
accauuacugua

SEQ ID NO: 2194374 - RNA, 22 nt, Homo sapiens
ucauuucuggaaagugcaauua

SEQ ID NO: 2194375 - RNA, 14 nt, Homo sapiens
uaaagugcuugcuu

SEQ ID NO: 2194376 - RNA, 21 nt, Homo sapiens
guugagggcccuucacuucca

SEQ ID NO: 2194377 - RNA, 24 nt, Homo sapiens
gaugggauggcuuggggggcucca

SEQ ID NO: 2194378 - RNA, 16 nt, Homo sapiens
uccacuugguucaggu

SEQ ID NO: 2194379 - RNA, 19 nt, Homo sapiens
ucugaaauccauaaacuaa

SEQ ID NO: 2194380 - RNA, 14 nt, Homo sapiens
gccccagcucugag

SEQ ID NO: 2194381 - RNA, 16 nt, Homo sapiens
gaauucuucuguucuc

SEQ ID NO: 2194382 - RNA, 18 nt, Homo sapiens
uauccuccaugaauauca

SEQ ID NO: 2194383 - RNA, 17 nt, Homo sapiens
uggucuggguggaugug

SEQ ID NO: 2194384 - RNA, 21 nt, Homo sapiens
ggauaacuggcacccagagaa

SEQ ID NO: 2194385 - RNA, 15 nt, Homo sapiens
caccagaggcugcaa

SEQ ID NO: 2194386 - RNA, 19 nt, Homo sapiens
uuaauauuuccaaugugaa

SEQ ID NO: 2194387 - RNA, 12 nt, Homo sapiens
gaggcuauuaaa

SEQ ID NO: 2194388 - RNA, 12 nt, Homo sapiens
agaaaacgggaa

SEQ ID NO: 2194389 - RNA, 14 nt, Homo sapiens
aaugaaaacagugu

SEQ ID NO: 2194390 - RNA, 13 nt, Homo sapiens
aauaccaaaaauu

SEQ ID NO: 2194391 - RNA, 15 nt, Homo sapiens
cuggugacagccuug

SEQ ID NO: 2194392 - RNA, 12 nt, Homo sapiens
ugaauguucaau

SEQ ID NO: 2194393 - RNA, 23 nt, Homo sapiens
cgcuguccaaguguuucuuguua

SEQ ID NO: 2194394 - RNA, 18 nt, Homo sapiens
augaaagaugauuugcaa

SEQ ID NO: 2194395 - RNA, 12 nt, Homo sapiens
auuuugacuuaa

SEQ ID NO: 2194396 - RNA, 15 nt, Homo sapiens
aacaucuuuauuuuc

SEQ ID NO: 2194397 - RNA, 20 nt, Homo sapiens
ccuuuuccaggaguucugaa

SEQ ID NO: 2194398 - RNA, 21 nt, Homo sapiens
uccucuccccaugauguuuag

SEQ ID NO: 2194399 - RNA, 15 nt, Homo sapiens
cagcaugccuucaaa

SEQ ID NO: 2194400 - RNA, 18 nt, Homo sapiens
ccucagcaaacccaaaga

SEQ ID NO: 2194401 - RNA, 19 nt, Homo sapiens
aaaguuacugaucacagga

SEQ ID NO: 2194402 - RNA, 15 nt, Homo sapiens
ugcacaaugucaugu

SEQ ID NO: 2194403 - RNA, 19 nt, Homo sapiens
agggaagcuggccgagggu

SEQ ID NO: 2194404 - RNA, 14 nt, Homo sapiens
gguaugauauugca

SEQ ID NO: 2194405 - RNA, 14 nt, Homo sapiens
uucuguuuggugug

SEQ ID NO: 2194406 - RNA, 14 nt, Homo sapiens
aauaucgacuuccc

SEQ ID NO: 2194407 - RNA, 19 nt, Homo sapiens
gaauuaaagucuacacugc

SEQ ID NO: 2194408 - RNA, 23 nt, Homo sapiens
ugggauauccuuucacucugcau

SEQ ID NO: 2194409 - RNA, 20 nt, Homo sapiens
cagaccgggguucaagccau

SEQ ID NO: 2194410 - RNA, 20 nt, Homo sapiens
uacaaucagcccagugcaaa

SEQ ID NO: 2194411 - RNA, 12 nt, Homo sapiens
aggccugucagc

SEQ ID NO: 2194412 - RNA, 17 nt, Homo sapiens
aacugaaaagcaguuua

SEQ ID NO: 2194413 - RNA, 16 nt, Homo sapiens
cuccaaaaauucacau

SEQ ID NO: 2194414 - RNA, 19 nt, Homo sapiens
ccggaaggaaugucagggc

SEQ ID NO: 2194415 - RNA, 12 nt, Homo sapiens
uuccuugcucuc

SEQ ID NO: 2194416 - RNA, 16 nt, Homo sapiens
cacucccauuuuuacu

SEQ ID NO: 2194417 - RNA, 16 nt, Homo sapiens
gcccccuccucuccca

SEQ ID NO: 2194418 - RNA, 21 nt, Homo sapiens
uacugaggugcuaugaagcca

SEQ ID NO: 2194419 - RNA, 20 nt, Homo sapiens
aaacuuccacuaccuuuaaa

SEQ ID NO: 2194420 - RNA, 17 nt, Homo sapiens
agugcaguggcucaaug

SEQ ID NO: 2194421 - RNA, 11 nt, Homo sapiens
cugcuugccau

SEQ ID NO: 2194422 - RNA, 21 nt, Homo sapiens
cuuaauaaaaugcuaaauguc

SEQ ID NO: 2194423 - RNA, 19 nt, Homo sapiens
ucuuuuuauuaacaguaua

SEQ ID NO: 2194424 - RNA, 18 nt, Homo sapiens
auuaugaugugugaaaac

SEQ ID NO: 2194425 - RNA, 21 nt, Homo sapiens
gacuugagcccagagugaaca

SEQ ID NO: 2194426 - RNA, 13 nt, Homo sapiens
caguaauuugcaa

SEQ ID NO: 2194427 - RNA, 13 nt, Homo sapiens
agcucaguaugug

SEQ ID NO: 2194428 - RNA, 19 nt, Homo sapiens
cuuucagccacaugcccca

SEQ ID NO: 2194429 - RNA, 18 nt, Homo sapiens
augaccuuauaguguuaa

SEQ ID NO: 2194430 - RNA, 20 nt, Homo sapiens
gcagggcugguuuguucuga

SEQ ID NO: 2194431 - RNA, 20 nt, Homo sapiens
ccaccauuuccccugugguu

SEQ ID NO: 2194432 - RNA, 12 nt, Homo sapiens
uccuucugugaa

SEQ ID NO: 2194433 - RNA, 20 nt, Homo sapiens
uucccagcuagaauucacuc

SEQ ID NO: 2194434 - RNA, 14 nt, Homo sapiens
auggaaggugcuac

SEQ ID NO: 2194435 - RNA, 15 nt, Homo sapiens
ugugcuaaaccaagu

SEQ ID NO: 2194436 - RNA, 18 nt, Homo sapiens
guugcuaaugacagugga

SEQ ID NO: 2194437 - RNA, 16 nt, Homo sapiens
ggcuggagugcaaugg

SEQ ID NO: 2194438 - RNA, 22 nt, Homo sapiens
acugggggcaauugacuuccuc

SEQ ID NO: 2194439 - RNA, 13 nt, Homo sapiens
ugauugaaguauc

SEQ ID NO: 2194440 - RNA, 21 nt, Homo sapiens
cuaagcugugguguguucccc

SEQ ID NO: 2194441 - RNA, 14 nt, Homo sapiens
uggagaaagagcug

SEQ ID NO: 2194442 - RNA, 20 nt, Homo sapiens
uuagaccugccagccacugu

SEQ ID NO: 2194443 - RNA, 18 nt, Homo sapiens
ugcaugcauugagcugcc

SEQ ID NO: 2194444 - RNA, 15 nt, Homo sapiens
uaacugugacaaaga

SEQ ID NO: 2194445 - RNA, 22 nt, Homo sapiens
caucuccuaauuuguuucuucu

SEQ ID NO: 2194446 - RNA, 17 nt, Homo sapiens
ucacuuuaacucaggag

SEQ ID NO: 2194447 - RNA, 17 nt, Homo sapiens
cagccucccuuugauga

SEQ ID NO: 2194448 - RNA, 16 nt, Homo sapiens
acccaaucagaugccu

SEQ ID NO: 2194449 - RNA, 20 nt, Homo sapiens
uccaacauuucucacugaaa

SEQ ID NO: 2194450 - RNA, 15 nt, Homo sapiens
ccggguucuccugau

SEQ ID NO: 2194451 - RNA, 19 nt, Homo sapiens
aguuauugugaaaacagaa

SEQ ID NO: 2194452 - RNA, 11 nt, Homo sapiens
uaaauucugug

SEQ ID NO: 2194453 - RNA, 15 nt, Homo sapiens
aggacauacugcaug

SEQ ID NO: 2194454 - RNA, 21 nt, Homo sapiens
cauaauccagagauaauugcc

SEQ ID NO: 2194455 - RNA, 19 nt, Homo sapiens
uucgcgcuggaauccagaa

SEQ ID NO: 2194456 - RNA, 16 nt, Homo sapiens
cuauugacuucaauga

SEQ ID NO: 2194457 - RNA, 23 nt, Homo sapiens
aucaucacauugagcugauauaa

SEQ ID NO: 2194458 - RNA, 21 nt, Homo sapiens
acaauuuauccaaagcauugc

SEQ ID NO: 2194459 - RNA, 22 nt, Homo sapiens
ccacaacccaagcaacauuugu

SEQ ID NO: 2194460 - RNA, 14 nt, Homo sapiens
cgccgccgcugccc

SEQ ID NO: 2194461 - RNA, 16 nt, Homo sapiens
gggggcugucuuugca

SEQ ID NO: 2194462 - RNA, 19 nt, Homo sapiens
gcugaaaccccaucuccac

SEQ ID NO: 2194463 - RNA, 22 nt, Homo sapiens
aaaauucugauguuucugugaa

SEQ ID NO: 2194464 - RNA, 15 nt, Homo sapiens
cucccugaaauugca

SEQ ID NO: 2194465 - RNA, 22 nt, Homo sapiens
gaaaaugcagcagggaugcccu

SEQ ID NO: 2194466 - RNA, 19 nt, Homo sapiens
uucugaggacaccagugaa

SEQ ID NO: 2194467 - RNA, 23 nt, Homo sapiens
uacagacaaccuaucauuuauuc

SEQ ID NO: 2194468 - RNA, 23 nt, Homo sapiens
ggcuuuaugcaaauacaaucagc

SEQ ID NO: 2194469 - RNA, 23 nt, Homo sapiens
cugugccucgcuccccacucugc

SEQ ID NO: 2194470 - RNA, 19 nt, Homo sapiens
cucagcagcaaaugccacu

SEQ ID NO: 2194471 - RNA, 18 nt, Homo sapiens
uuucacuaaaagugugug

SEQ ID NO: 2194472 - RNA, 12 nt, Homo sapiens
ccauauuuucac

SEQ ID NO: 2194473 - RNA, 22 nt, Homo sapiens
auucuucccuuuuaaacacauu

SEQ ID NO: 2194474 - RNA, 15 nt, Homo sapiens
ugcccaggcacugca

SEQ ID NO: 2194475 - RNA, 14 nt, Homo sapiens
ucagaaaaguaauu

SEQ ID NO: 2194476 - RNA, 21 nt, Homo sapiens
aaugcgaggaaaugucuuuag

SEQ ID NO: 2194477 - RNA, 22 nt, Homo sapiens
cuguaaaacgcaccaaucagca

SEQ ID NO: 2194478 - RNA, 15 nt, Homo sapiens
ccuaaucacucugag

SEQ ID NO: 2194479 - RNA, 15 nt, Homo sapiens
cuuugcccacacaca

SEQ ID NO: 2194480 - RNA, 13 nt, Homo sapiens
ugcuucugggaag

SEQ ID NO: 2194481 - RNA, 13 nt, Homo sapiens
ugcugcugggaau

SEQ ID NO: 2194482 - RNA, 15 nt, Homo sapiens
uucauguccagugag

SEQ ID NO: 2194483 - RNA, 23 nt, Homo sapiens
ugggacagacgagacaacagcac

SEQ ID NO: 2194484 - RNA, 17 nt, Homo sapiens
ccuggcccagaugauau

SEQ ID NO: 2194485 - RNA, 13 nt, Homo sapiens
uaccaagugacca

SEQ ID NO: 2194486 - RNA, 13 nt, Homo sapiens
guacaaguuuaca

SEQ ID NO: 2194487 - RNA, 17 nt, Homo sapiens
ugcaaccucugccuccc

SEQ ID NO: 2194488 - RNA, 17 nt, Homo sapiens
cuguuucaguagccaau

SEQ ID NO: 2194489 - RNA, 14 nt, Homo sapiens
uuuuuucaguauua

SEQ ID NO: 2194490 - RNA, 14 nt, Homo sapiens
cugaauaguuaaaa

SEQ ID NO: 2194491 - RNA, 16 nt, Homo sapiens
guuuuuuguucuugcg

SEQ ID NO: 2194492 - RNA, 14 nt, Homo sapiens
auaauucucugucu

SEQ ID NO: 2194493 - RNA, 18 nt, Homo sapiens
auauacuuugccacugcu

SEQ ID NO: 2194494 - RNA, 16 nt, Homo sapiens
ugaaugagcuugucaa

SEQ ID NO: 2194495 - RNA, 21 nt, Homo sapiens
uaaauuguuguaauugcauua

SEQ ID NO: 2194496 - RNA, 20 nt, Homo sapiens
agauacuaguuuugcugaaa

SEQ ID NO: 2194497 - RNA, 18 nt, Homo sapiens
agaaaacuguuugggaaa

SEQ ID NO: 2194498 - RNA, 20 nt, Homo sapiens
ccacagggcuagaagcacag

SEQ ID NO: 2194499 - RNA, 15 nt, Homo sapiens
uucaugauuucaaga

SEQ ID NO: 2194500 - RNA, 23 nt, Homo sapiens
uaacccaauggagacuuucugau

SEQ ID NO: 2194501 - RNA, 20 nt, Homo sapiens
gcuggaguacagugguguga

SEQ ID NO: 2194502 - RNA, 20 nt, Homo sapiens
ugacuuucuguguaccacug

SEQ ID NO: 2194503 - RNA, 18 nt, Homo sapiens
ucaucugaccuucaccuu

SEQ ID NO: 2194504 - RNA, 16 nt, Homo sapiens
caugccaacuugugac

SEQ ID NO: 2194505 - RNA, 19 nt, Homo sapiens
auguaacuucagauguuuc

SEQ ID NO: 2194506 - RNA, 16 nt, Homo sapiens
cccagcaucagccugu

SEQ ID NO: 2194507 - RNA, 16 nt, Homo sapiens
cucucaagacuucucc

SEQ ID NO: 2194508 - RNA, 17 nt, Homo sapiens
ugagugccaugcuuuuu

SEQ ID NO: 2194509 - RNA, 19 nt, Homo sapiens
uauuacuagacugccacaa

SEQ ID NO: 2194510 - RNA, 17 nt, Homo sapiens
gguuccccacagugaca

SEQ ID NO: 2194511 - RNA, 19 nt, Homo sapiens
ugcaaaagguuaagccaua

SEQ ID NO: 2194512 - RNA, 16 nt, Homo sapiens
caaaggagcauugcag

SEQ ID NO: 2194513 - RNA, 12 nt, Homo sapiens
augccugugucu

SEQ ID NO: 2194514 - RNA, 16 nt, Homo sapiens
guugcacaucauucau

SEQ ID NO: 2194515 - RNA, 11 nt, Homo sapiens
uucaaacuaga

SEQ ID NO: 2194516 - RNA, 22 nt, Homo sapiens
acagauucuuuucuauaaugug

SEQ ID NO: 2194517 - RNA, 19 nt, Homo sapiens
cagcugacuaaaggccaca

SEQ ID NO: 2194518 - RNA, 22 nt, Homo sapiens
uagcauacuggcuucaccauca

SEQ ID NO: 2194519 - RNA, 13 nt, Homo sapiens
acuuaaugcacag

SEQ ID NO: 2194520 - RNA, 12 nt, Homo sapiens
ucuaagugauau

SEQ ID NO: 2194521 - RNA, 23 nt, Homo sapiens
agaaguugugcuaaaccaaguua

SEQ ID NO: 2194522 - RNA, 18 nt, Homo sapiens
gaaagaauuugccuucuc

SEQ ID NO: 2194523 - RNA, 20 nt, Homo sapiens
guacagacgucucaagacug

SEQ ID NO: 2194524 - RNA, 23 nt, Homo sapiens
uggaacacauaagaacugugcag

SEQ ID NO: 2194525 - RNA, 15 nt, Homo sapiens
ugugcuggacacugu

SEQ ID NO: 2194526 - RNA, 18 nt, Homo sapiens
uacauucuuccugauuau

SEQ ID NO: 2194527 - RNA, 19 nt, Homo sapiens
cagaaagaacgugaucucc

SEQ ID NO: 2194528 - RNA, 22 nt, Homo sapiens
aagcacucuuaaagcaaaaaau

SEQ ID NO: 2194529 - RNA, 17 nt, Homo sapiens
ccuacugcaucgaguca

SEQ ID NO: 2194530 - RNA, 17 nt, Homo sapiens
caguucaguguugcaug

SEQ ID NO: 2194531 - RNA, 19 nt, Homo sapiens
uaaaauugaagcaacuaca

SEQ ID NO: 2194532 - RNA, 20 nt, Homo sapiens
gccauguauguugcaugaau

SEQ ID NO: 2194533 - RNA, 16 nt, Homo sapiens
cucaaccucuacaggg

SEQ ID NO: 2194534 - RNA, 17 nt, Homo sapiens
cucacucuuucuucucu

SEQ ID NO: 2194535 - RNA, 16 nt, Homo sapiens
gcugucgacuucauga

SEQ ID NO: 2194536 - RNA, 12 nt, Homo sapiens
agaacagucucu

SEQ ID NO: 2194537 - RNA, 14 nt, Homo sapiens
ucucagcaagugua

SEQ ID NO: 2194538 - RNA, 22 nt, Homo sapiens
cacaagaagugggagugggaga

SEQ ID NO: 2194539 - RNA, 15 nt, Homo sapiens
ucaguaguucacuuu

SEQ ID NO: 2194540 - RNA, 21 nt, Homo sapiens
gagaaggggugcagaguguuu

SEQ ID NO: 2194541 - RNA, 23 nt, Homo sapiens
ugcuacccacagcgucauuuuga

SEQ ID NO: 2194542 - RNA, 20 nt, Homo sapiens
gucuccaagggcaucacugg

SEQ ID NO: 2194543 - RNA, 22 nt, Homo sapiens
aaccacuucagcugacuuuucu

SEQ ID NO: 2194544 - RNA, 15 nt, Homo sapiens
aggacuaacacucag

SEQ ID NO: 2194545 - RNA, 22 nt, Homo sapiens
augcugcugcucaaaaugccac

SEQ ID NO: 2194546 - RNA, 16 nt, Homo sapiens
agucuucucuucugcc

SEQ ID NO: 2194547 - RNA, 15 nt, Homo sapiens
auaaagugccuauaa

SEQ ID NO: 2194548 - RNA, 14 nt, Homo sapiens
cuagggaucccuca

SEQ ID NO: 2194549 - RNA, 15 nt, Homo sapiens
agaucauugugaaau

SEQ ID NO: 2194550 - RNA, 18 nt, Homo sapiens
gcucccgcccgugguguu

SEQ ID NO: 2194551 - RNA, 21 nt, Homo sapiens
aaauucacaugaugcacuuca

SEQ ID NO: 2194552 - RNA, 22 nt, Homo sapiens
cugcaccucauuccaacuccua

SEQ ID NO: 2194553 - RNA, 21 nt, Homo sapiens
auuuuaagauccagaaauacu

SEQ ID NO: 2194554 - RNA, 18 nt, Homo sapiens
uugagcaguuagcucauu

SEQ ID NO: 2194555 - RNA, 19 nt, Homo sapiens
aaacucucuucucuuucuc

SEQ ID NO: 2194556 - RNA, 14 nt, Homo sapiens
aauuagggcccaau

SEQ ID NO: 2194557 - RNA, 12 nt, Homo sapiens
cguuucuggaac

SEQ ID NO: 2194558 - RNA, 14 nt, Homo sapiens
uggcaggauucuaa

SEQ ID NO: 2194559 - RNA, 14 nt, Homo sapiens
cagugccauuucag

SEQ ID NO: 2194560 - RNA, 15 nt, Homo sapiens
gaaacuauucaugaa

SEQ ID NO: 2194561 - RNA, 19 nt, Homo sapiens
gguaauaaguacuguguac

SEQ ID NO: 2194562 - RNA, 23 nt, Homo sapiens
cuaugauacugucucuccaguga

SEQ ID NO: 2194563 - RNA, 23 nt, Homo sapiens
ccaagaaaaauccgcuuuucugc

SEQ ID NO: 2194564 - RNA, 20 nt, Homo sapiens
acgguggcucacaccuguaa

SEQ ID NO: 2194565 - RNA, 17 nt, Homo sapiens
acauccugugccuccau

SEQ ID NO: 2194566 - RNA, 14 nt, Homo sapiens
ugcugaccaauugu

SEQ ID NO: 2194567 - RNA, 23 nt, Homo sapiens
ccuccccuuuuaugcacuucaaa

SEQ ID NO: 2194568 - RNA, 19 nt, Homo sapiens
cgaaacacagaacucagcc

SEQ ID NO: 2194569 - RNA, 14 nt, Homo sapiens
acaaaaaccaaaug

SEQ ID NO: 2194570 - RNA, 17 nt, Homo sapiens
ccugggccguggcacag

SEQ ID NO: 2194571 - RNA, 20 nt, Homo sapiens
gaggauugcuucuugugaaa

SEQ ID NO: 2194572 - RNA, 21 nt, Homo sapiens
ucgucauuuucuuucccagaa

SEQ ID NO: 2194573 - RNA, 17 nt, Homo sapiens
aaagugcagcaggagaa

SEQ ID NO: 2194574 - RNA, 23 nt, Homo sapiens
aaaaggauaugcaguaugcuuaa

SEQ ID NO: 2194575 - RNA, 22 nt, Homo sapiens
aaauuuguugucauguguauga

SEQ ID NO: 2194576 - RNA, 16 nt, Homo sapiens
gagcuacaugguggag

SEQ ID NO: 2194577 - RNA, 22 nt, Homo sapiens
ugaauaaaccaucaucuugcca

SEQ ID NO: 2194578 - RNA, 18 nt, Homo sapiens
uuaaggcauauacuuugu

SEQ ID NO: 2194579 - RNA, 18 nt, Homo sapiens
ucagaaggccccagagag

SEQ ID NO: 2194580 - RNA, 21 nt, Homo sapiens
cgagauugcaccauugcgcuc

SEQ ID NO: 2194581 - RNA, 21 nt, Homo sapiens
accugccuuaacacacacacc

SEQ ID NO: 2194582 - RNA, 21 nt, Homo sapiens
cgagauugcgccauugcacuc

SEQ ID NO: 2194583 - RNA, 22 nt, Homo sapiens
ccgacggugggcauuugugagg

SEQ ID NO: 2194584 - RNA, 15 nt, Homo sapiens
cuuugccuuuaucuc

SEQ ID NO: 2194585 - RNA, 18 nt, Homo sapiens
uugcaaccuaguacuuua

SEQ ID NO: 2194586 - RNA, 16 nt, Homo sapiens
auaccuagcacuuuau

SEQ ID NO: 2194587 - RNA, 15 nt, Homo sapiens
cuaagaaguggggca

SEQ ID NO: 2194588 - RNA, 16 nt, Homo sapiens
uucccucugcucagcc

SEQ ID NO: 2194589 - RNA, 15 nt, Homo sapiens
gcaugugcguggaag

SEQ ID NO: 2194590 - RNA, 16 nt, Homo sapiens
acuuuguugaguauua

SEQ ID NO: 2194591 - RNA, 14 nt, Homo sapiens
uagaguguagccua

SEQ ID NO: 2194592 - RNA, 16 nt, Homo sapiens
accucagacacucuga

SEQ ID NO: 2194593 - RNA, 15 nt, Homo sapiens
agugagaucuucaau

SEQ ID NO: 2194594 - RNA, 18 nt, Homo sapiens
cuaaucacaugugcugca

SEQ ID NO: 2194595 - RNA, 22 nt, Homo sapiens
aaacaccuagcuuuauucuuca

SEQ ID NO: 2194596 - RNA, 14 nt, Homo sapiens
ugcucccacagaac

SEQ ID NO: 2194597 - RNA, 14 nt, Homo sapiens
augauacuauucag

SEQ ID NO: 2194598 - RNA, 15 nt, Homo sapiens
aauauaaauguugcu

SEQ ID NO: 2194599 - RNA, 23 nt, Homo sapiens
ggcuccacaccuccaaugcugcc

SEQ ID NO: 2194600 - RNA, 19 nt, Homo sapiens
aucuuuccuugucucucau

SEQ ID NO: 2194601 - RNA, 15 nt, Homo sapiens
cauguucuggcagca

SEQ ID NO: 2194602 - RNA, 21 nt, Homo sapiens
uggaugggguugugaccaaga

SEQ ID NO: 2194603 - RNA, 13 nt, Homo sapiens
augcacauguauu

SEQ ID NO: 2194604 - RNA, 13 nt, Homo sapiens
uguauguggguuu

SEQ ID NO: 2194605 - RNA, 20 nt, Homo sapiens
auuagaaauaaagcaucuca

SEQ ID NO: 2194606 - RNA, 23 nt, Homo sapiens
cugaaacaugugccccugccaag

SEQ ID NO: 2194607 - RNA, 21 nt, Homo sapiens
ugcacaccagagacaagcaga

SEQ ID NO: 2194608 - RNA, 13 nt, Homo sapiens
gucagaacuagaa

SEQ ID NO: 2194609 - RNA, 13 nt, Homo sapiens
caaaccuauggaa

SEQ ID NO: 2194610 - RNA, 21 nt, Homo sapiens
cuuauaucaucagcauaccuu

SEQ ID NO: 2194611 - RNA, 17 nt, Homo sapiens
aucugcucuguacauca

SEQ ID NO: 2194612 - RNA, 15 nt, Homo sapiens
auaaagagugcuaca

SEQ ID NO: 2194613 - RNA, 14 nt, Homo sapiens
aaaacaaaccaucu

SEQ ID NO: 2194614 - RNA, 14 nt, Homo sapiens
ugggaucucgccaa

SEQ ID NO: 2194615 - RNA, 19 nt, Homo sapiens
cuuuucuguacuuccugag

SEQ ID NO: 2194616 - RNA, 21 nt, Homo sapiens
auuuuuuuagguuaaaguuaa

SEQ ID NO: 2194617 - RNA, 16 nt, Homo sapiens
uguucccagagcacuu

SEQ ID NO: 2194618 - RNA, 19 nt, Homo sapiens
cuuauauuguucacuucuu

SEQ ID NO: 2194619 - RNA, 18 nt, Homo sapiens
guaaucccaacacuuugg

SEQ ID NO: 2194620 - RNA, 14 nt, Homo sapiens
acaugggugcaauc

SEQ ID NO: 2194621 - RNA, 20 nt, Homo sapiens
aucguugcccccauuucuga

SEQ ID NO: 2194622 - RNA, 20 nt, Homo sapiens
cagguauuacacaagccaaa

SEQ ID NO: 2194623 - RNA, 21 nt, Homo sapiens
uccaccccgcaagcaccaucc

SEQ ID NO: 2194624 - RNA, 16 nt, Homo sapiens
uacuguauauacuuug

SEQ ID NO: 2194625 - RNA, 19 nt, Homo sapiens
ccagacaccagugcgugcu

SEQ ID NO: 2194626 - RNA, 15 nt, Homo sapiens
ugacaugucucacag

SEQ ID NO: 2194627 - RNA, 19 nt, Homo sapiens
uuugugauagcacuuucua

SEQ ID NO: 2194628 - RNA, 22 nt, Homo sapiens
guauuaauguguuaagugcagg

SEQ ID NO: 2194629 - RNA, 21 nt, Homo sapiens
uaggacuauggguacauucca

SEQ ID NO: 2194630 - RNA, 13 nt, Homo sapiens
aauuccaaagcaa

SEQ ID NO: 2194631 - RNA, 21 nt, Homo sapiens
uagcacaugcccuaaugucug

SEQ ID NO: 2194632 - RNA, 15 nt, Homo sapiens
uaaagaggacuugaa

SEQ ID NO: 2194633 - RNA, 19 nt, Homo sapiens
uucucuggcgacaguuuuc

SEQ ID NO: 2194634 - RNA, 21 nt, Homo sapiens
agccugggugagaauccugcc

SEQ ID NO: 2194635 - RNA, 14 nt, Homo sapiens
ucaggaauugaaaa

SEQ ID NO: 2194636 - RNA, 14 nt, Homo sapiens
aguggaauacuaaa

SEQ ID NO: 2194637 - RNA, 20 nt, Homo sapiens
aaccgcauggaacagugcag

SEQ ID NO: 2194638 - RNA, 15 nt, Homo sapiens
cugggccaggucucc

SEQ ID NO: 2194639 - RNA, 14 nt, Homo sapiens
ccuggcuuugccca

SEQ ID NO: 2194640 - RNA, 23 nt, Homo sapiens
aaggggcugcuucuggggcuccc

SEQ ID NO: 2194641 - RNA, 21 nt, Homo sapiens
uugggcaccucgacuugugaa

SEQ ID NO: 2194642 - RNA, 19 nt, Homo sapiens
uccccggggcccaggggag

SEQ ID NO: 2194643 - RNA, 22 nt, Homo sapiens
agacaaggugcaccgguuucau

SEQ ID NO: 2194644 - RNA, 16 nt, Homo sapiens
gcagccaugagaacaa

SEQ ID NO: 2194645 - RNA, 20 nt, Homo sapiens
caccauuaggucacuuaaga

SEQ ID NO: 2194646 - RNA, 17 nt, Homo sapiens
agcccugagcucaggcu

SEQ ID NO: 2194647 - RNA, 14 nt, Homo sapiens
uucuacaggccagc

SEQ ID NO: 2194648 - RNA, 21 nt, Homo sapiens
accuggcuacaauuacuuuga

SEQ ID NO: 2194649 - RNA, 23 nt, Homo sapiens
ggaucauguaaaugcucaaagau

SEQ ID NO: 2194650 - RNA, 16 nt, Homo sapiens
uugggguugguuccua

SEQ ID NO: 2194651 - RNA, 18 nt, Homo sapiens
cacugcacacagugacuu

SEQ ID NO: 2194652 - RNA, 20 nt, Homo sapiens
augaucucccucuaagcaca

SEQ ID NO: 2194653 - RNA, 21 nt, Homo sapiens
gaggccuucagaaaagacacu

SEQ ID NO: 2194654 - RNA, 19 nt, Homo sapiens
agaaauuaacaaaugugcu

SEQ ID NO: 2194655 - RNA, 14 nt, Homo sapiens
ugaucagaccuugg

SEQ ID NO: 2194656 - RNA, 15 nt, Homo sapiens
ccuucuuacuugcca

SEQ ID NO: 2194657 - RNA, 13 nt, Homo sapiens
uguggccaguuua

SEQ ID NO: 2194658 - RNA, 13 nt, Homo sapiens
uaaagcccuugaa

SEQ ID NO: 2194659 - RNA, 14 nt, Homo sapiens
uuaguaaauccuua

SEQ ID NO: 2194660 - RNA, 14 nt, Homo sapiens
gucuaaaagcagaa

SEQ ID NO: 2194661 - RNA, 18 nt, Homo sapiens
guaggaaacucaucuccu

SEQ ID NO: 2194662 - RNA, 16 nt, Homo sapiens
uccauguaguuacuuc

SEQ ID NO: 2194663 - RNA, 20 nt, Homo sapiens
ccaacuaaauaaaaaauuca

SEQ ID NO: 2194664 - RNA, 23 nt, Homo sapiens
gcguguguccaugugugugcaag

SEQ ID NO: 2194665 - RNA, 22 nt, Homo sapiens
gucaaaauaaagauucucacau

SEQ ID NO: 2194666 - RNA, 19 nt, Homo sapiens
cugccugugggcuggggag

SEQ ID NO: 2194667 - RNA, 21 nt, Homo sapiens
acauuguacaaggaaugaaag

SEQ ID NO: 2194668 - RNA, 13 nt, Homo sapiens
ccgcagaauggac

SEQ ID NO: 2194669 - RNA, 21 nt, Homo sapiens
cuacugcuucuaccaacugga

SEQ ID NO: 2194670 - RNA, 18 nt, Homo sapiens
augcgggccagugcucca

SEQ ID NO: 2194671 - RNA, 21 nt, Homo sapiens
uuggacugauaaucucuuuaa

SEQ ID NO: 2194672 - RNA, 12 nt, Homo sapiens
cugagagucuag

SEQ ID NO: 2194673 - RNA, 11 nt, Homo sapiens
acugaucucag

SEQ ID NO: 2194674 - RNA, 18 nt, Homo sapiens
ucccaccccucauaccua

SEQ ID NO: 2194675 - RNA, 11 nt, Homo sapiens
auacagugaag

SEQ ID NO: 2194676 - RNA, 20 nt, Homo sapiens
uaguagaaagacaucugccu

SEQ ID NO: 2194677 - RNA, 20 nt, Homo sapiens
caacuccaaacaauucugau

SEQ ID NO: 2194678 - RNA, 15 nt, Homo sapiens
caugguguccagaca

SEQ ID NO: 2194679 - RNA, 19 nt, Homo sapiens
gaaugugguccagacguca

SEQ ID NO: 2194680 - RNA, 12 nt, Homo sapiens
auucacauuuag

SEQ ID NO: 2194681 - RNA, 16 nt, Homo sapiens
guuuaauuuugcagug

SEQ ID NO: 2194682 - RNA, 18 nt, Homo sapiens
gccacaguucacaugcca

SEQ ID NO: 2194683 - RNA, 12 nt, Homo sapiens
auuuuugcaaua

SEQ ID NO: 2194684 - RNA, 20 nt, Homo sapiens
auugagacauauuacuggaa

SEQ ID NO: 2194685 - RNA, 18 nt, Homo sapiens
guggccgaggacuuugau

SEQ ID NO: 2194686 - RNA, 20 nt, Homo sapiens
acugacuauaccaacugggc

SEQ ID NO: 2194687 - RNA, 15 nt, Homo sapiens
ucuccucacugaaaa

SEQ ID NO: 2194688 - RNA, 14 nt, Homo sapiens
ucacucuagucaau

SEQ ID NO: 2194689 - RNA, 21 nt, Homo sapiens
aggugggccuugcuaccucaa

SEQ ID NO: 2194690 - RNA, 16 nt, Homo sapiens
acugaaccaggccaga

SEQ ID NO: 2194691 - RNA, 15 nt, Homo sapiens
ggccugugugugugc

SEQ ID NO: 2194692 - RNA, 20 nt, Homo sapiens
cagaaaacaagaugagauug

SEQ ID NO: 2194693 - RNA, 20 nt, Homo sapiens
ugaccugaacucugcaacug

SEQ ID NO: 2194694 - RNA, 14 nt, Homo sapiens
ccuucucuacccau

SEQ ID NO: 2194695 - RNA, 15 nt, Homo sapiens
cagagaccugaggca

SEQ ID NO: 2194696 - RNA, 22 nt, Homo sapiens
cucagguuauucguuacucuaa

SEQ ID NO: 2194697 - RNA, 20 nt, Homo sapiens
ucccauuuccugagaccaca

SEQ ID NO: 2194698 - RNA, 20 nt, Homo sapiens
ggaacccuccuccugucaau

SEQ ID NO: 2194699 - RNA, 18 nt, Homo sapiens
cucuuaugugugccuuug

SEQ ID NO: 2194700 - RNA, 21 nt, Homo sapiens
aaaaggccuuugggauuugcc

SEQ ID NO: 2194701 - RNA, 16 nt, Homo sapiens
acccucucaaguccau

SEQ ID NO: 2194702 - RNA, 22 nt, Homo sapiens
cccacacgcccuccccagacuc

SEQ ID NO: 2194703 - RNA, 17 nt, Homo sapiens
uggacaggcagccuccu

SEQ ID NO: 2194704 - RNA, 20 nt, Homo sapiens
cuaugggguggggugggugu

SEQ ID NO: 2194705 - RNA, 15 nt, Homo sapiens
aaaaacuaauugagc

SEQ ID NO: 2194706 - RNA, 14 nt, Homo sapiens
uuuguugaauaaua

SEQ ID NO: 2194707 - RNA, 13 nt, Homo sapiens
acgaauugagaua

SEQ ID NO: 2194708 - RNA, 23 nt, Homo sapiens
ccuggcuuagcguucuguuucac

SEQ ID NO: 2194709 - RNA, 21 nt, Homo sapiens
ggaagcuuccaguccaaucuc

SEQ ID NO: 2194710 - RNA, 22 nt, Homo sapiens
caugaguggaaagucaccuaca

SEQ ID NO: 2194711 - RNA, 19 nt, Homo sapiens
ggaauaauagacacugggg

SEQ ID NO: 2194712 - RNA, 23 nt, Homo sapiens
gcauaaaguaaauacaugcauau

SEQ ID NO: 2194713 - RNA, 18 nt, Homo sapiens
ucauucacaaaguauaac

SEQ ID NO: 2194714 - RNA, 20 nt, Homo sapiens
ugaaugugucccaugcauaa

SEQ ID NO: 2194715 - RNA, 20 nt, Homo sapiens
cacaauaaaggcugagcucu

SEQ ID NO: 2194716 - RNA, 19 nt, Homo sapiens
uuugcuaaaugugaaugau

SEQ ID NO: 2194717 - RNA, 15 nt, Homo sapiens
cagccucuggcucca

SEQ ID NO: 2194718 - RNA, 14 nt, Homo sapiens
auggccuuguuuca

SEQ ID NO: 2194719 - RNA, 14 nt, Homo sapiens
auaaagcaaugugg

SEQ ID NO: 2194720 - RNA, 14 nt, Homo sapiens
caaaaacacaguga

SEQ ID NO: 2194721 - RNA, 17 nt, Homo sapiens
acugaagcagagucaag

SEQ ID NO: 2194722 - RNA, 16 nt, Homo sapiens
acacauucacacuggg

SEQ ID NO: 2194723 - RNA, 23 nt, Homo sapiens
aucaauaggaaagcauaugcagc

SEQ ID NO: 2194724 - RNA, 15 nt, Homo sapiens
acuccagcugugaag

SEQ ID NO: 2194725 - RNA, 16 nt, Homo sapiens
uaagcccaggaucucu

SEQ ID NO: 2194726 - RNA, 20 nt, Homo sapiens
aaccuccgccucccggguuc

SEQ ID NO: 2194727 - RNA, 18 nt, Homo sapiens
cugcuuugguuaaucucu

SEQ ID NO: 2194728 - RNA, 22 nt, Homo sapiens
auuacaaggcuuuaucucaggg

SEQ ID NO: 2194729 - RNA, 18 nt, Homo sapiens
aagaauuacaaguagaau

SEQ ID NO: 2194730 - RNA, 17 nt, Homo sapiens
cauuucuuugcauucca

SEQ ID NO: 2194731 - RNA, 20 nt, Homo sapiens
uaaaauugccauauugcaca

SEQ ID NO: 2194732 - RNA, 20 nt, Homo sapiens
acagcaaguacgcaagaaau

SEQ ID NO: 2194733 - RNA, 23 nt, Homo sapiens
acagcugguacugauguucaccu

SEQ ID NO: 2194734 - RNA, 19 nt, Homo sapiens
gagugagaccauguuucaa

SEQ ID NO: 2194735 - RNA, 13 nt, Homo sapiens
ucgugcuguagag

SEQ ID NO: 2194736 - RNA, 22 nt, Homo sapiens
acgcagcugggugcagaagcug

SEQ ID NO: 2194737 - RNA, 18 nt, Homo sapiens
cccauuccucccuccggc

SEQ ID NO: 2194738 - RNA, 20 nt, Homo sapiens
cuggacuggaaagcacaaga

SEQ ID NO: 2194739 - RNA, 16 nt, Homo sapiens
agaaaaagaagugccu

SEQ ID NO: 2194740 - RNA, 12 nt, Homo sapiens
ccuggcauuugg

SEQ ID NO: 2194741 - RNA, 18 nt, Homo sapiens
aauuaucgggaacagugu

SEQ ID NO: 2194742 - RNA, 17 nt, Homo sapiens
cagauguuuguuuucaa

SEQ ID NO: 2194743 - RNA, 15 nt, Homo sapiens
augcuuuucugaaag

SEQ ID NO: 2194744 - RNA, 23 nt, Homo sapiens
agaaagagauuuucacccaucca

SEQ ID NO: 2194745 - RNA, 16 nt, Homo sapiens
gcaggugcuacaacau

SEQ ID NO: 2194746 - RNA, 19 nt, Homo sapiens
acaaaggaaaacucuuggc

SEQ ID NO: 2194747 - RNA, 17 nt, Homo sapiens
cugacaauaaagauauu

SEQ ID NO: 2194748 - RNA, 18 nt, Homo sapiens
uagaaugcuuuuguuaaa

SEQ ID NO: 2194749 - RNA, 17 nt, Homo sapiens
cccaaucagcacugaaa

SEQ ID NO: 2194750 - RNA, 15 nt, Homo sapiens
ugaucauccaggccu

SEQ ID NO: 2194751 - RNA, 22 nt, Homo sapiens
ucaauauauaguuagcuuuauu

SEQ ID NO: 2194752 - RNA, 20 nt, Homo sapiens
cuuaccaagagugggcuuug

SEQ ID NO: 2194753 - RNA, 15 nt, Homo sapiens
guagaauagauaucc

SEQ ID NO: 2194754 - RNA, 23 nt, Homo sapiens
auuuuagggcuguagacuuacuu

SEQ ID NO: 2194755 - RNA, 22 nt, Homo sapiens
uuuaaagccuucuggauccaug

SEQ ID NO: 2194756 - RNA, 16 nt, Homo sapiens
aucccagcaucucaga

SEQ ID NO: 2194757 - RNA, 22 nt, Homo sapiens
guauaauagagauaaguccauu

SEQ ID NO: 2194758 - RNA, 16 nt, Homo sapiens
cuguaaaaaauggagc

SEQ ID NO: 2194759 - RNA, 14 nt, Homo sapiens
cauauucauaugca

SEQ ID NO: 2194760 - RNA, 16 nt, Homo sapiens
aggcuugccaccgggg

SEQ ID NO: 2194761 - RNA, 19 nt, Homo sapiens
ggugaucuaccugccucag

SEQ ID NO: 2194762 - RNA, 15 nt, Homo sapiens
cugggccucagccuc

SEQ ID NO: 2194763 - RNA, 15 nt, Homo sapiens
ugacugccaaaaagg

SEQ ID NO: 2194764 - RNA, 18 nt, Homo sapiens
auuauuugucuccaugau

SEQ ID NO: 2194765 - RNA, 17 nt, Homo sapiens
uauggacuuggcuguau

SEQ ID NO: 2194766 - RNA, 23 nt, Homo sapiens
caugaaaaauaauccaaauccau

SEQ ID NO: 2194767 - RNA, 17 nt, Homo sapiens
gacagaugaccaaagcc

SEQ ID NO: 2194768 - RNA, 16 nt, Homo sapiens
ggaggugacacuuaag

SEQ ID NO: 2194769 - RNA, 20 nt, Homo sapiens
agaagacucgucuuggcaca

SEQ ID NO: 2194770 - RNA, 15 nt, Homo sapiens
acuuuaccucucugu

SEQ ID NO: 2194771 - RNA, 17 nt, Homo sapiens
ugacaaggccccagaga

SEQ ID NO: 2194772 - RNA, 14 nt, Homo sapiens
acucauccauuaau

SEQ ID NO: 2194773 - RNA, 15 nt, Homo sapiens
aggcagggucucacu

SEQ ID NO: 2194774 - RNA, 22 nt, Homo sapiens
uuuucagaaaauauuauguguu

SEQ ID NO: 2194775 - RNA, 12 nt, Homo sapiens
ugcgucugugug

SEQ ID NO: 2194776 - RNA, 20 nt, Homo sapiens
gagacuugugcucaaggaau

SEQ ID NO: 2194777 - RNA, 21 nt, Homo sapiens
cagaccuuuacugauacuaca

SEQ ID NO: 2194778 - RNA, 16 nt, Homo sapiens
acaaaaguaaaagaga

SEQ ID NO: 2194779 - RNA, 22 nt, Homo sapiens
ucccagugaccccugaccucac

SEQ ID NO: 2194780 - RNA, 13 nt, Homo sapiens
agucaaagacauu

SEQ ID NO: 2194781 - RNA, 22 nt, Homo sapiens
auagagcccuggccagcccuuc

SEQ ID NO: 2194782 - RNA, 19 nt, Homo sapiens
uuucagaugugaaccauua

SEQ ID NO: 2194783 - RNA, 15 nt, Homo sapiens
auuuuuguagcacug

SEQ ID NO: 2194784 - RNA, 14 nt, Homo sapiens
cauggccuaagggc

SEQ ID NO: 2194785 - RNA, 14 nt, Homo sapiens
cuucaacuaugcaa

SEQ ID NO: 2194786 - RNA, 16 nt, Homo sapiens
cucucaaugaauaauu

SEQ ID NO: 2194787 - RNA, 14 nt, Homo sapiens
aauucuuacuguag

SEQ ID NO: 2194788 - RNA, 19 nt, Homo sapiens
ucucccaggacccaucacg

SEQ ID NO: 2194789 - RNA, 23 nt, Homo sapiens
uguugcugcaucuccccucagau

SEQ ID NO: 2194790 - RNA, 19 nt, Homo sapiens
uguugugauauagaacaaa

SEQ ID NO: 2194791 - RNA, 19 nt, Homo sapiens
gguggacuuugggaccugc

SEQ ID NO: 2194792 - RNA, 21 nt, Homo sapiens
agcccagccuagcgugcccug

SEQ ID NO: 2194793 - RNA, 13 nt, Homo sapiens
ggcugcuggcgcc

SEQ ID NO: 2194794 - RNA, 16 nt, Homo sapiens
ugaggucucuugaggg

SEQ ID NO: 2194795 - RNA, 17 nt, Homo sapiens
agguugagcaauuuccc

SEQ ID NO: 2194796 - RNA, 19 nt, Homo sapiens
ucuagaagugccaucucaa

SEQ ID NO: 2194797 - RNA, 18 nt, Homo sapiens
ccccucacucuguuuccu

SEQ ID NO: 2194798 - RNA, 13 nt, Homo sapiens
ucuccacagggac

SEQ ID NO: 2194799 - RNA, 17 nt, Homo sapiens
aaaaaugaugcgcauca

SEQ ID NO: 2194800 - RNA, 21 nt, Homo sapiens
cuuucauguaaaaagugcagu

SEQ ID NO: 2194801 - RNA, 14 nt, Homo sapiens
uccuccauggugua

SEQ ID NO: 2194802 - RNA, 21 nt, Homo sapiens
ccauguuuagugaaugacuuu

SEQ ID NO: 2194803 - RNA, 19 nt, Homo sapiens
cccaggagaacaucuuuga

SEQ ID NO: 2194804 - RNA, 16 nt, Homo sapiens
uggucuccacugggga

SEQ ID NO: 2194805 - RNA, 15 nt, Homo sapiens
auuucuuaacuucuu

SEQ ID NO: 2194806 - RNA, 15 nt, Homo sapiens
auacuguaacacugu

SEQ ID NO: 2194807 - RNA, 15 nt, Homo sapiens
acaacacaauaacac

SEQ ID NO: 2194808 - RNA, 15 nt, Homo sapiens
acuacuuaauuacuu

SEQ ID NO: 2194809 - RNA, 16 nt, Homo sapiens
accacaccucccugaa

SEQ ID NO: 2194810 - RNA, 16 nt, Homo sapiens
uagacagaaacauguc

SEQ ID NO: 2194811 - RNA, 20 nt, Homo sapiens
aguaauuuuuuacauuuucc

SEQ ID NO: 2194812 - RNA, 23 nt, Homo sapiens
ugagcaaguuuucaccuaucugg

SEQ ID NO: 2194813 - RNA, 12 nt, Homo sapiens
uguugauuccac

SEQ ID NO: 2194814 - RNA, 19 nt, Homo sapiens
ccacacuggucacaggcaa

SEQ ID NO: 2194815 - RNA, 13 nt, Homo sapiens
gcaaugcugugaa

SEQ ID NO: 2194816 - RNA, 14 nt, Homo sapiens
guuuuuaaacuaau

SEQ ID NO: 2194817 - RNA, 14 nt, Homo sapiens
aucaaaaagccuua

SEQ ID NO: 2194818 - RNA, 18 nt, Homo sapiens
auccucacaggagcagac

SEQ ID NO: 2194819 - RNA, 17 nt, Homo sapiens
gaugcugaugcuguuaa

SEQ ID NO: 2194820 - RNA, 15 nt, Homo sapiens
acucgagaacuuuca

SEQ ID NO: 2194821 - RNA, 14 nt, Homo sapiens
agggacccaaagca

SEQ ID NO: 2194822 - RNA, 18 nt, Homo sapiens
gugccuacgacuaucugg

SEQ ID NO: 2194823 - RNA, 15 nt, Homo sapiens
aagggaccccagaua

SEQ ID NO: 2194824 - RNA, 20 nt, Homo sapiens
gcuauggugagaugcagcug

SEQ ID NO: 2194825 - RNA, 22 nt, Homo sapiens
gggcuugguguuuguaagaaaa

SEQ ID NO: 2194826 - RNA, 19 nt, Homo sapiens
uacggaggacgcuggggaa

SEQ ID NO: 2194827 - RNA, 19 nt, Homo sapiens
acccacaauugaacuucca

SEQ ID NO: 2194828 - RNA, 20 nt, Homo sapiens
uugaucuuuuuuaauucagu

SEQ ID NO: 2194829 - RNA, 21 nt, Homo sapiens
acccucgggccccauccucau

SEQ ID NO: 2194830 - RNA, 13 nt, Homo sapiens
uuacacaucucag

SEQ ID NO: 2194831 - RNA, 17 nt, Homo sapiens
guuacaaguuugcuaaa

SEQ ID NO: 2194832 - RNA, 15 nt, Homo sapiens
uccuguuugucuaca

SEQ ID NO: 2194833 - RNA, 17 nt, Homo sapiens
aacaccacgucacuuca

SEQ ID NO: 2194834 - RNA, 16 nt, Homo sapiens
aguucguaccuggcuu

SEQ ID NO: 2194835 - RNA, 22 nt, Homo sapiens
ccucagccucccaaagugcugg

SEQ ID NO: 2194836 - RNA, 20 nt, Homo sapiens
caccaaaugaugccacuucc

SEQ ID NO: 2194837 - RNA, 15 nt, Homo sapiens
cugcucccaccacca

SEQ ID NO: 2194838 - RNA, 17 nt, Homo sapiens
uaccuccacucucugcc

SEQ ID NO: 2194839 - RNA, 17 nt, Homo sapiens
aggacuuguuuacaaag

SEQ ID NO: 2194840 - RNA, 18 nt, Homo sapiens
uuugguuagaaggguuac

SEQ ID NO: 2194841 - RNA, 14 nt, Homo sapiens
agcuuuagcuucau

SEQ ID NO: 2194842 - RNA, 23 nt, Homo sapiens
augcauggugccccaggaccagc

SEQ ID NO: 2194843 - RNA, 16 nt, Homo sapiens
ugaaauuguaucucag

SEQ ID NO: 2194844 - RNA, 18 nt, Homo sapiens
ccuccagcuaaacaccaa

SEQ ID NO: 2194845 - RNA, 21 nt, Homo sapiens
uaucacuucauucacauucag

SEQ ID NO: 2194846 - RNA, 19 nt, Homo sapiens
ggaaguuauguuguucaaa

SEQ ID NO: 2194847 - RNA, 16 nt, Homo sapiens
agauaagaugaaucau

SEQ ID NO: 2194848 - RNA, 17 nt, Homo sapiens
aggagggcccugaggaa

SEQ ID NO: 2194849 - RNA, 20 nt, Homo sapiens
uguaaauaaauagauuugau

SEQ ID NO: 2194850 - RNA, 19 nt, Homo sapiens
uaauauacaaaacaauuaa

SEQ ID NO: 2194851 - RNA, 21 nt, Homo sapiens
aaugagacugaacugugugaa

SEQ ID NO: 2194852 - RNA, 22 nt, Homo sapiens
ugaugaaccagaguuucuuggu

SEQ ID NO: 2194853 - RNA, 18 nt, Homo sapiens
caugcauguccuguaaag

SEQ ID NO: 2194854 - RNA, 16 nt, Homo sapiens
ugaaauuuucuguaca

SEQ ID NO: 2194855 - RNA, 19 nt, Homo sapiens
auggccuggcugccuggug

SEQ ID NO: 2194856 - RNA, 21 nt, Homo sapiens
gcccuggagcagccaccccau

SEQ ID NO: 2194857 - RNA, 15 nt, Homo sapiens
uauuucuacauggaa

SEQ ID NO: 2194858 - RNA, 13 nt, Homo sapiens
guuggaagcuugu

SEQ ID NO: 2194859 - RNA, 18 nt, Homo sapiens
gcacaucaacugaucuca

SEQ ID NO: 2194860 - RNA, 15 nt, Homo sapiens
ccagccacagcauuu

SEQ ID NO: 2194861 - RNA, 21 nt, Homo sapiens
cccaguuauaaagaggucaca

SEQ ID NO: 2194862 - RNA, 13 nt, Homo sapiens
agaaguuucugcc

SEQ ID NO: 2194863 - RNA, 18 nt, Homo sapiens
gcccgagaugugacccac

SEQ ID NO: 2194864 - RNA, 15 nt, Homo sapiens
cugcuggaugucacc

SEQ ID NO: 2194865 - RNA, 16 nt, Homo sapiens
uguugauacauuccca

SEQ ID NO: 2194866 - RNA, 16 nt, Homo sapiens
accaauuacccauaaa

SEQ ID NO: 2194867 - RNA, 19 nt, Homo sapiens
ucaaagugucucauucuca

SEQ ID NO: 2194868 - RNA, 20 nt, Homo sapiens
cuguacaauaaguuacuuga

SEQ ID NO: 2194869 - RNA, 22 nt, Homo sapiens
gccuaaauuuaaugcugccuuu

SEQ ID NO: 2194870 - RNA, 22 nt, Homo sapiens
cuggagcuugaaauagugucug

SEQ ID NO: 2194871 - RNA, 22 nt, Homo sapiens
gauggaccggcccacacuccca

SEQ ID NO: 2194872 - RNA, 16 nt, Homo sapiens
caaggcucacaugcuc

SEQ ID NO: 2194873 - RNA, 14 nt, Homo sapiens
agaugaugaugauc

SEQ ID NO: 2194874 - RNA, 21 nt, Homo sapiens
uugauaauauuagugauucug

SEQ ID NO: 2194875 - RNA, 23 nt, Homo sapiens
uuuguggaagcacaggcaagagu

SEQ ID NO: 2194876 - RNA, 21 nt, Homo sapiens
ggacaguaauaagaauggaaa

SEQ ID NO: 2194877 - RNA, 16 nt, Homo sapiens
aagucuguaccucaaa

SEQ ID NO: 2194878 - RNA, 16 nt, Homo sapiens
guggggggaagcacau

SEQ ID NO: 2194879 - RNA, 23 nt, Homo sapiens
ccuagucuacuugaggcugcaau

SEQ ID NO: 2194880 - RNA, 13 nt, Homo sapiens
uaaauguagaaag

SEQ ID NO: 2194881 - RNA, 21 nt, Homo sapiens
gugggcuguguugacugcugc

SEQ ID NO: 2194882 - RNA, 22 nt, Homo sapiens
agcaagauagucuucaguuuca

SEQ ID NO: 2194883 - RNA, 17 nt, Homo sapiens
auauauacccacaugua

SEQ ID NO: 2194884 - RNA, 19 nt, Homo sapiens
uuggaccuguucaaaaagg

SEQ ID NO: 2194885 - RNA, 20 nt, Homo sapiens
ugcaccucccuccccagcuc

SEQ ID NO: 2194886 - RNA, 20 nt, Homo sapiens
gaagugaaugaaacacucag

SEQ ID NO: 2194887 - RNA, 23 nt, Homo sapiens
acuugaggcugcaaucacacuga

SEQ ID NO: 2194888 - RNA, 14 nt, Homo sapiens
uacauauugaauag

SEQ ID NO: 2194889 - RNA, 14 nt, Homo sapiens
auauuccaccagga

SEQ ID NO: 2194890 - RNA, 14 nt, Homo sapiens
ucucuuagugguua

SEQ ID NO: 2194891 - RNA, 14 nt, Homo sapiens
aguuccaccaagaa

SEQ ID NO: 2194892 - RNA, 14 nt, Homo sapiens
uaagucugauucuc

SEQ ID NO: 2194893 - RNA, 20 nt, Homo sapiens
caaaaugauauguuugagua

SEQ ID NO: 2194894 - RNA, 16 nt, Homo sapiens
uuguuuguggucuaua

SEQ ID NO: 2194895 - RNA, 21 nt, Homo sapiens
aguguuauuucagagagcaaa

SEQ ID NO: 2194896 - RNA, 16 nt, Homo sapiens
agcacuugucucagga

SEQ ID NO: 2194897 - RNA, 19 nt, Homo sapiens
aaaagaaauauaucuguga

SEQ ID NO: 2194898 - RNA, 22 nt, Homo sapiens
cucuagccugggccacagggcg

SEQ ID NO: 2194899 - RNA, 15 nt, Homo sapiens
uuugcuuaaugccag

SEQ ID NO: 2194900 - RNA, 19 nt, Homo sapiens
gagaguuugccuguucuau

SEQ ID NO: 2194901 - RNA, 22 nt, Homo sapiens
auaaguguuauguuuguagaua

SEQ ID NO: 2194902 - RNA, 19 nt, Homo sapiens
uacccaggcuuuagcauua

SEQ ID NO: 2194903 - RNA, 16 nt, Homo sapiens
aguuuaucaugaagcc

SEQ ID NO: 2194904 - RNA, 15 nt, Homo sapiens
agggaguuccaguca

SEQ ID NO: 2194905 - RNA, 14 nt, Homo sapiens
caggggcaaagggc

SEQ ID NO: 2194906 - RNA, 15 nt, Homo sapiens
cacauggugugaguc

SEQ ID NO: 2194907 - RNA, 17 nt, Homo sapiens
cugcucuccuugcccug

SEQ ID NO: 2194908 - RNA, 22 nt, Homo sapiens
gaagcaaaaguaaucacuuaaa

SEQ ID NO: 2194909 - RNA, 14 nt, Homo sapiens
gcaaguugcucuga

SEQ ID NO: 2194910 - RNA, 13 nt, Homo sapiens
caagacaagagcu

SEQ ID NO: 2194911 - RNA, 15 nt, Homo sapiens
caaacucagauccuu

SEQ ID NO: 2194912 - RNA, 15 nt, Homo sapiens
gaaaacuggaaaucu

SEQ ID NO: 2194913 - RNA, 15 nt, Homo sapiens
cuuuaaugcuuuuau

SEQ ID NO: 2194914 - RNA, 17 nt, Homo sapiens
gugggcugcugcaguga

SEQ ID NO: 2194915 - RNA, 23 nt, Homo sapiens
cagcuuuauaacaaauguggcuc

SEQ ID NO: 2194916 - RNA, 19 nt, Homo sapiens
aaaaagaguuacacuggaa

SEQ ID NO: 2194917 - RNA, 14 nt, Homo sapiens
aagaugacuucuuu

SEQ ID NO: 2194918 - RNA, 16 nt, Homo sapiens
aagagaucuuucuuuc

SEQ ID NO: 2194919 - RNA, 14 nt, Homo sapiens
gcaugugucaugaa

SEQ ID NO: 2194920 - RNA, 22 nt, Homo sapiens
gguugggcuggugcucacagcu

SEQ ID NO: 2194921 - RNA, 16 nt, Homo sapiens
cucuagcuucuacccu

SEQ ID NO: 2194922 - RNA, 13 nt, Homo sapiens
acuacuguacucc

SEQ ID NO: 2194923 - RNA, 13 nt, Homo sapiens
caccuugucacau

SEQ ID NO: 2194924 - RNA, 15 nt, Homo sapiens
auuaaaaaccacuga

SEQ ID NO: 2194925 - RNA, 19 nt, Homo sapiens
acacucaguccuuccacac

SEQ ID NO: 2194926 - RNA, 12 nt, Homo sapiens
cugucaaugcag

SEQ ID NO: 2194927 - RNA, 19 nt, Homo sapiens
agugcaguggcaugaucau

SEQ ID NO: 2194928 - RNA, 17 nt, Homo sapiens
uuuguaaacgacaagaa

SEQ ID NO: 2194929 - RNA, 16 nt, Homo sapiens
acugacuccucagucc

SEQ ID NO: 2194930 - RNA, 20 nt, Homo sapiens
aguucuagaaauagauuuaa

SEQ ID NO: 2194931 - RNA, 13 nt, Homo sapiens
auaauucagcucu

SEQ ID NO: 2194932 - RNA, 18 nt, Homo sapiens
acccugggguaaguggag

SEQ ID NO: 2194933 - RNA, 16 nt, Homo sapiens
auccuuguggcacauu

SEQ ID NO: 2194934 - RNA, 13 nt, Homo sapiens
aaaccugcaguuu

SEQ ID NO: 2194935 - RNA, 23 nt, Homo sapiens
uuuauagagcagaacccuagucu

SEQ ID NO: 2194936 - RNA, 12 nt, Homo sapiens
ugggaaccaagc

SEQ ID NO: 2194937 - RNA, 14 nt, Homo sapiens
ggagacaauuacaa

SEQ ID NO: 2194938 - RNA, 16 nt, Homo sapiens
agcccuauauauucaa

SEQ ID NO: 2194939 - RNA, 22 nt, Homo sapiens
aaaguccaauuccaaagccaga

SEQ ID NO: 2194940 - RNA, 14 nt, Homo sapiens
auuaacccuauuaa

SEQ ID NO: 2194941 - RNA, 21 nt, Homo sapiens
ucugucccagguuaucugggc

SEQ ID NO: 2194942 - RNA, 18 nt, Homo sapiens
ucaaaccucugcaucucu

SEQ ID NO: 2194943 - RNA, 13 nt, Homo sapiens
uaaagugcucuua

SEQ ID NO: 2194944 - RNA, 15 nt, Homo sapiens
uuaacaucacugucu

SEQ ID NO: 2194945 - RNA, 17 nt, Homo sapiens
caauugcugcuuguaca

SEQ ID NO: 2194946 - RNA, 18 nt, Homo sapiens
acacauucuuauugacaa

SEQ ID NO: 2194947 - RNA, 20 nt, Homo sapiens
ggagacagccagguggcacc

SEQ ID NO: 2194948 - RNA, 20 nt, Homo sapiens
gggaagcggagcuugcagug

SEQ ID NO: 2194949 - RNA, 13 nt, Homo sapiens
gcaaaaaaagccu

SEQ ID NO: 2194950 - RNA, 15 nt, Homo sapiens
ccuaguucuucaucc

SEQ ID NO: 2194951 - RNA, 16 nt, Homo sapiens
uaaagucuacacugcc

SEQ ID NO: 2194952 - RNA, 15 nt, Homo sapiens
ggucuuaggaauuga

SEQ ID NO: 2194953 - RNA, 22 nt, Homo sapiens
cagccuuuugggaauaauagca

SEQ ID NO: 2194954 - RNA, 18 nt, Homo sapiens
cuugauggaaauugacca

SEQ ID NO: 2194955 - RNA, 17 nt, Homo sapiens
aggagugggucgcccac

SEQ ID NO: 2194956 - RNA, 14 nt, Homo sapiens
ucucuuaccuguua

SEQ ID NO: 2194957 - RNA, 16 nt, Homo sapiens
acauuaauucuacuaa

SEQ ID NO: 2194958 - RNA, 13 nt, Homo sapiens
ucuuagaccaugc

SEQ ID NO: 2194959 - RNA, 23 nt, Homo sapiens
acaauaggucuuucucucaguga

SEQ ID NO: 2194960 - RNA, 18 nt, Homo sapiens
aauuauugcuguauguaa

SEQ ID NO: 2194961 - RNA, 13 nt, Homo sapiens
guaggacauacca

SEQ ID NO: 2194962 - RNA, 21 nt, Homo sapiens
uaaauaaaauucauuucuaca

SEQ ID NO: 2194963 - RNA, 14 nt, Homo sapiens
cccagccaugguga

SEQ ID NO: 2194964 - RNA, 16 nt, Homo sapiens
aucuucucauuuugca

SEQ ID NO: 2194965 - RNA, 16 nt, Homo sapiens
gugauagaacaaaaga

SEQ ID NO: 2194966 - RNA, 14 nt, Homo sapiens
aauauuaugaauuc

SEQ ID NO: 2194967 - RNA, 14 nt, Homo sapiens
aggacaccauccaa

SEQ ID NO: 2194968 - RNA, 21 nt, Homo sapiens
ucagugguugaugaaagccaa

SEQ ID NO: 2194969 - RNA, 20 nt, Homo sapiens
uuuuauaaauaucaugcaca

SEQ ID NO: 2194970 - RNA, 16 nt, Homo sapiens
ugcagauaacagcugg

SEQ ID NO: 2194971 - RNA, 20 nt, Homo sapiens
ugcaggaaccagcaaugaga

SEQ ID NO: 2194972 - RNA, 19 nt, Homo sapiens
auaguuauuaaauguuuca

SEQ ID NO: 2194973 - RNA, 19 nt, Homo sapiens
augguggugugugccugua

SEQ ID NO: 2194974 - RNA, 23 nt, Homo sapiens
cauacuucuaaauuauaccauga

SEQ ID NO: 2194975 - RNA, 18 nt, Homo sapiens
cugacauauucaagugau

SEQ ID NO: 2194976 - RNA, 13 nt, Homo sapiens
cuccuuagacuga

SEQ ID NO: 2194977 - RNA, 13 nt, Homo sapiens
uggaacaacagcu

SEQ ID NO: 2194978 - RNA, 15 nt, Homo sapiens
accugaugccauaaa

SEQ ID NO: 2194979 - RNA, 14 nt, Homo sapiens
cuuggccucagcag

SEQ ID NO: 2194980 - RNA, 19 nt, Homo sapiens
ugaagguggaacaagcaca

SEQ ID NO: 2194981 - RNA, 14 nt, Homo sapiens
cuagagguggcaug

SEQ ID NO: 2194982 - RNA, 19 nt, Homo sapiens
aauuaguuaugacagccau

SEQ ID NO: 2194983 - RNA, 22 nt, Homo sapiens
uugucucaauucaaauccauag

SEQ ID NO: 2194984 - RNA, 23 nt, Homo sapiens
aaaagaaucccuguucauuguaa

SEQ ID NO: 2194985 - RNA, 17 nt, Homo sapiens
gcgcggcgagggcaaag

SEQ ID NO: 2194986 - RNA, 12 nt, Homo sapiens
cuccaaauggaa

SEQ ID NO: 2194987 - RNA, 15 nt, Homo sapiens
cucagcccugacccu

SEQ ID NO: 2194988 - RNA, 12 nt, Homo sapiens
ucaccucaugga

SEQ ID NO: 2194989 - RNA, 17 nt, Homo sapiens
gcaacauacaggugccu

SEQ ID NO: 2194990 - RNA, 22 nt, Homo sapiens
cuaaauuaugugaauuuugcca

SEQ ID NO: 2194991 - RNA, 19 nt, Homo sapiens
uaugauaaaacacugcccu

SEQ ID NO: 2194992 - RNA, 22 nt, Homo sapiens
gggacagcgccaccucuuguca

SEQ ID NO: 2194993 - RNA, 17 nt, Homo sapiens
gaauauacuaaacauca

SEQ ID NO: 2194994 - RNA, 16 nt, Homo sapiens
ucccuguccuagucuu

SEQ ID NO: 2194995 - RNA, 14 nt, Homo sapiens
uaucaugugucuuc

SEQ ID NO: 2194996 - RNA, 13 nt, Homo sapiens
aaaguacauguau

SEQ ID NO: 2194997 - RNA, 20 nt, Homo sapiens
aauuuuacuccauaaacaga

SEQ ID NO: 2194998 - RNA, 14 nt, Homo sapiens
ggcaucggggccau

SEQ ID NO: 2194999 - RNA, 20 nt, Homo sapiens
auuugggaaccaagcuauuc

SEQ ID NO: 2195000 - RNA, 20 nt, Homo sapiens
gauucucuacaugcucuuuu

SEQ ID NO: 2195001 - RNA, 24 nt, Homo sapiens
uucuuaaaguggcuuucaacuuca

SEQ ID NO: 2195002 - RNA, 15 nt, Homo sapiens
uuccuguucagugag

SEQ ID NO: 2195003 - RNA, 14 nt, Homo sapiens
caccaaccaaaggg

SEQ ID NO: 2195004 - RNA, 14 nt, Homo sapiens
auacuuugcauaaa

SEQ ID NO: 2195005 - RNA, 12 nt, Homo sapiens
uaauuguguaca

SEQ ID NO: 2195006 - RNA, 16 nt, Homo sapiens
acaaaaagacauggaa

SEQ ID NO: 2195007 - RNA, 16 nt, Homo sapiens
guugaggccaaggaau

SEQ ID NO: 2195008 - RNA, 11 nt, Homo sapiens
uaucugagauu

SEQ ID NO: 2195009 - RNA, 16 nt, Homo sapiens
uuggcccucacugcag

SEQ ID NO: 2195010 - RNA, 14 nt, Homo sapiens
caggaaaaaaacuu

SEQ ID NO: 2195011 - RNA, 15 nt, Homo sapiens
ugacauaauuuacau

SEQ ID NO: 2195012 - RNA, 22 nt, Homo sapiens
ccuuuaacuuucagaggcaaua

SEQ ID NO: 2195013 - RNA, 22 nt, Homo sapiens
aucucccuuggucuuccauggg

SEQ ID NO: 2195014 - RNA, 20 nt, Homo sapiens
uacccugaaugugugcccua

SEQ ID NO: 2195015 - RNA, 13 nt, Homo sapiens
guccauucaucuc

SEQ ID NO: 2195016 - RNA, 19 nt, Homo sapiens
ugguaaagccucagcaaca

SEQ ID NO: 2195017 - RNA, 14 nt, Homo sapiens
cuuaauaugaucug

SEQ ID NO: 2195018 - RNA, 22 nt, Homo sapiens
ucuuauauuuuuugaguugagu

SEQ ID NO: 2195019 - RNA, 13 nt, Homo sapiens
aguucacucuccg

SEQ ID NO: 2195020 - RNA, 21 nt, Homo sapiens
uacugaauuucuuugauuuaa

SEQ ID NO: 2195021 - RNA, 14 nt, Homo sapiens
uacuuaguucaagc

SEQ ID NO: 2195022 - RNA, 23 nt, Homo sapiens
cuaaaauuaaugcagauuucucu

SEQ ID NO: 2195023 - RNA, 20 nt, Homo sapiens
auucaugguuuuaaagcuaa

SEQ ID NO: 2195024 - RNA, 20 nt, Homo sapiens
guagcugggacuacaggugc

SEQ ID NO: 2195025 - RNA, 19 nt, Homo sapiens
auuuaaauguaaagacaaa

SEQ ID NO: 2195026 - RNA, 18 nt, Homo sapiens
guaaggccuuagccauga

SEQ ID NO: 2195027 - RNA, 20 nt, Homo sapiens
acuggcuguuaaucuuucaa

SEQ ID NO: 2195028 - RNA, 15 nt, Homo sapiens
cuggaggaacacuug

SEQ ID NO: 2195029 - RNA, 20 nt, Homo sapiens
aaucugaucguucuuucuag

SEQ ID NO: 2195030 - RNA, 15 nt, Homo sapiens
acucuacacagcuca

SEQ ID NO: 2195031 - RNA, 19 nt, Homo sapiens
cccaggaauucaagguugg

SEQ ID NO: 2195032 - RNA, 14 nt, Homo sapiens
cggaggccccggcg

SEQ ID NO: 2195033 - RNA, 13 nt, Homo sapiens
cugcaaacagugu

SEQ ID NO: 2195034 - RNA, 15 nt, Homo sapiens
auuaauggcacugau

SEQ ID NO: 2195035 - RNA, 23 nt, Homo sapiens
ucaugaagaaccuugacggcauu

SEQ ID NO: 2195036 - RNA, 20 nt, Homo sapiens
uauucaaaauauuauguuaa

SEQ ID NO: 2195037 - RNA, 14 nt, Homo sapiens
accuuccuucccug

SEQ ID NO: 2195038 - RNA, 22 nt, Homo sapiens
ggauucuagccugcacuuuggg

SEQ ID NO: 2195039 - RNA, 17 nt, Homo sapiens
aucuucaaugcuuccuc

SEQ ID NO: 2195040 - RNA, 22 nt, Homo sapiens
ggcccagggcccgggcacccac

SEQ ID NO: 2195041 - RNA, 16 nt, Homo sapiens
uuuaauaaauauucau

SEQ ID NO: 2195042 - RNA, 15 nt, Homo sapiens
accucaucccaugag

SEQ ID NO: 2195043 - RNA, 24 nt, Homo sapiens
ccaguaagguuauaacuguggcua

SEQ ID NO: 2195044 - RNA, 14 nt, Homo sapiens
cuuccccauccugg

SEQ ID NO: 2195045 - RNA, 13 nt, Homo sapiens
guacuagaauuca

SEQ ID NO: 2195046 - RNA, 24 nt, Homo sapiens
aagacauucuaauuccagucauuu

SEQ ID NO: 2195047 - RNA, 20 nt, Homo sapiens
uauaccggagcuccaguuuc

SEQ ID NO: 2195048 - RNA, 13 nt, Homo sapiens
cuugccagcauuu

SEQ ID NO: 2195049 - RNA, 15 nt, Homo sapiens
caacucuguacaaag

SEQ ID NO: 2195050 - RNA, 22 nt, Homo sapiens
cugccccauuuauccaccucca

SEQ ID NO: 2195051 - RNA, 18 nt, Homo sapiens
uuggugcaagugugcaug

SEQ ID NO: 2195052 - RNA, 17 nt, Homo sapiens
gcuucuucaucuuuaaa

SEQ ID NO: 2195053 - RNA, 15 nt, Homo sapiens
cucccucauuccacc

SEQ ID NO: 2195054 - RNA, 21 nt, Homo sapiens
aaaaguugaaccauuauacuu

SEQ ID NO: 2195055 - RNA, 18 nt, Homo sapiens
uugugaauuaggcuguaa

SEQ ID NO: 2195056 - RNA, 22 nt, Homo sapiens
cuagaaggcugaguaccauggg

SEQ ID NO: 2195057 - RNA, 16 nt, Homo sapiens
auugcacaccuuggaa

SEQ ID NO: 2195058 - RNA, 13 nt, Homo sapiens
gaacuccuaccug

SEQ ID NO: 2195059 - RNA, 14 nt, Homo sapiens
uccuuccaauauaa

SEQ ID NO: 2195060 - RNA, 19 nt, Homo sapiens
cagcaaggucauggucuga

SEQ ID NO: 2195061 - RNA, 14 nt, Homo sapiens
ucuaugccaaagau

SEQ ID NO: 2195062 - RNA, 15 nt, Homo sapiens
gcaaauccuauguga

SEQ ID NO: 2195063 - RNA, 11 nt, Homo sapiens
cgacccauuca

SEQ ID NO: 2195064 - RNA, 15 nt, Homo sapiens
augaaaggucauuaa

SEQ ID NO: 2195065 - RNA, 16 nt, Homo sapiens
uauuguauaaagcauu

SEQ ID NO: 2195066 - RNA, 19 nt, Homo sapiens
aguccccaaccugcacucu

SEQ ID NO: 2195067 - RNA, 14 nt, Homo sapiens
ucuucacugccagg

SEQ ID NO: 2195068 - RNA, 16 nt, Homo sapiens
cuccccagagcacugg

SEQ ID NO: 2195069 - RNA, 16 nt, Homo sapiens
ccuguucuaugccuuu

SEQ ID NO: 2195070 - RNA, 14 nt, Homo sapiens
cccauguauggcca

SEQ ID NO: 2195071 - RNA, 18 nt, Homo sapiens
cagagaaaggacugugga

SEQ ID NO: 2195072 - RNA, 18 nt, Homo sapiens
acaucuaguaggugcuug

SEQ ID NO: 2195073 - RNA, 15 nt, Homo sapiens
gcucucucaccugcu

SEQ ID NO: 2195074 - RNA, 22 nt, Homo sapiens
auggaugcggugacaaauggca

SEQ ID NO: 2195075 - RNA, 17 nt, Homo sapiens
cuuaaggagguguuccu

SEQ ID NO: 2195076 - RNA, 16 nt, Homo sapiens
uauuuucuauuuuccc

SEQ ID NO: 2195077 - RNA, 16 nt, Homo sapiens
uucucuccaacucccu

SEQ ID NO: 2195078 - RNA, 22 nt, Homo sapiens
uauaacacagacgagccccaga

SEQ ID NO: 2195079 - RNA, 16 nt, Homo sapiens
ccaugcccucccugcu

SEQ ID NO: 2195080 - RNA, 20 nt, Homo sapiens
ggaugaaaaaauaacacugu

SEQ ID NO: 2195081 - RNA, 17 nt, Homo sapiens
aagugaguguaauccag

SEQ ID NO: 2195082 - RNA, 16 nt, Homo sapiens
cuggcucaugccucag

SEQ ID NO: 2195083 - RNA, 12 nt, Homo sapiens
cuuugcugccag

SEQ ID NO: 2195084 - RNA, 19 nt, Homo sapiens
uagugaaauggccacuacu

SEQ ID NO: 2195085 - RNA, 16 nt, Homo sapiens
uccaucuuucacuauc

SEQ ID NO: 2195086 - RNA, 17 nt, Homo sapiens
ucaagauucagacucca

SEQ ID NO: 2195087 - RNA, 22 nt, Homo sapiens
cacugggcuucuagaaccaggc

SEQ ID NO: 2195088 - RNA, 21 nt, Homo sapiens
guucaucccggcccauguuga

SEQ ID NO: 2195089 - RNA, 22 nt, Homo sapiens
aaaaaauguucauucuaugaca

SEQ ID NO: 2195090 - RNA, 11 nt, Homo sapiens
aaauacuucuu

SEQ ID NO: 2195091 - RNA, 14 nt, Homo sapiens
ucuacuguggcaaa

SEQ ID NO: 2195092 - RNA, 16 nt, Homo sapiens
ugaaagguuaauucuc

SEQ ID NO: 2195093 - RNA, 16 nt, Homo sapiens
caaugcucaccucuuc

SEQ ID NO: 2195094 - RNA, 22 nt, Homo sapiens
aggugaggucagcacaucucaa

SEQ ID NO: 2195095 - RNA, 19 nt, Homo sapiens
aucagaauagccacauuug

SEQ ID NO: 2195096 - RNA, 21 nt, Homo sapiens
gggcaggcugggccaugucca

SEQ ID NO: 2195097 - RNA, 14 nt, Homo sapiens
cuacuuugcagaug

SEQ ID NO: 2195098 - RNA, 14 nt, Homo sapiens
caaaugugcugcuu

SEQ ID NO: 2195099 - RNA, 22 nt, Homo sapiens
gccuaagaagaaggccagagag

SEQ ID NO: 2195100 - RNA, 23 nt, Homo sapiens
agcugcugugccaggacugugac

SEQ ID NO: 2195101 - RNA, 12 nt, Homo sapiens
auaacuugcaua

SEQ ID NO: 2195102 - RNA, 16 nt, Homo sapiens
ggccccugcccggcug

SEQ ID NO: 2195103 - RNA, 15 nt, Homo sapiens
guucuuugggccaga

SEQ ID NO: 2195104 - RNA, 22 nt, Homo sapiens
cuucuauagugaugaugaucuc

SEQ ID NO: 2195105 - RNA, 20 nt, Homo sapiens
accuccucccaagcacuuca

SEQ ID NO: 2195106 - RNA, 19 nt, Homo sapiens
cauaggaagggaucugaga

SEQ ID NO: 2195107 - RNA, 19 nt, Homo sapiens
gagugcugaggggcacucu

SEQ ID NO: 2195108 - RNA, 15 nt, Homo sapiens
guagaaagugaucca

SEQ ID NO: 2195109 - RNA, 21 nt, Homo sapiens
caccuagagcuagaugugucu

SEQ ID NO: 2195110 - RNA, 21 nt, Homo sapiens
acucuucugagcaccuacuua

SEQ ID NO: 2195111 - RNA, 17 nt, Homo sapiens
ucugaacuacacugcau

SEQ ID NO: 2195112 - RNA, 16 nt, Homo sapiens
cuagccagaggcucua

SEQ ID NO: 2195113 - RNA, 17 nt, Homo sapiens
aggaaguagaccucuuu

SEQ ID NO: 2195114 - RNA, 21 nt, Homo sapiens
uucuuccuaaugucagaacag

SEQ ID NO: 2195115 - RNA, 14 nt, Homo sapiens
uggucaccaaacag

SEQ ID NO: 2195116 - RNA, 15 nt, Homo sapiens
cccuucugacuguuu

SEQ ID NO: 2195117 - RNA, 18 nt, Homo sapiens
ucuaagcuuauuucuaac

SEQ ID NO: 2195118 - RNA, 15 nt, Homo sapiens
cagcugcaccugcca

SEQ ID NO: 2195119 - RNA, 17 nt, Homo sapiens
uaaaagagguccauuaa

SEQ ID NO: 2195120 - RNA, 15 nt, Homo sapiens
ccacauagcacacau

SEQ ID NO: 2195121 - RNA, 23 nt, Homo sapiens
cauauucuuauguaugugaaagu

SEQ ID NO: 2195122 - RNA, 18 nt, Homo sapiens
uguccagugcaaccacac

SEQ ID NO: 2195123 - RNA, 16 nt, Homo sapiens
uaaaggucauaugcac

SEQ ID NO: 2195124 - RNA, 16 nt, Homo sapiens
ucuguggagggcauuu

SEQ ID NO: 2195125 - RNA, 16 nt, Homo sapiens
uggcugcuuugacaag

SEQ ID NO: 2195126 - RNA, 18 nt, Homo sapiens
uaaauuucuuaugugaca

SEQ ID NO: 2195127 - RNA, 19 nt, Homo sapiens
auucuuucccaacaccucu

SEQ ID NO: 2195128 - RNA, 20 nt, Homo sapiens
cucugaaacaaaaguauuua

SEQ ID NO: 2195129 - RNA, 16 nt, Homo sapiens
ggacucaacauuacau

SEQ ID NO: 2195130 - RNA, 15 nt, Homo sapiens
augugcaauaagauu

SEQ ID NO: 2195131 - RNA, 20 nt, Homo sapiens
caagugucuaaaauacuuga

SEQ ID NO: 2195132 - RNA, 21 nt, Homo sapiens
ucaagagauagagaccaucuu

SEQ ID NO: 2195133 - RNA, 20 nt, Homo sapiens
gaaaggaccaaauugcuuua

SEQ ID NO: 2195134 - RNA, 17 nt, Homo sapiens
aggcaguagaucauuuu

SEQ ID NO: 2195135 - RNA, 15 nt, Homo sapiens
aaacacauauucaaa

SEQ ID NO: 2195136 - RNA, 17 nt, Homo sapiens
caaauaaguaauaucuu

SEQ ID NO: 2195137 - RNA, 17 nt, Homo sapiens
cgauucucuugccucag

SEQ ID NO: 2195138 - RNA, 18 nt, Homo sapiens
uggagcccagggugcugg

SEQ ID NO: 2195139 - RNA, 13 nt, Homo sapiens
ugugcacugcauu

SEQ ID NO: 2195140 - RNA, 18 nt, Homo sapiens
cuuuaguguuaaaauaca

SEQ ID NO: 2195141 - RNA, 15 nt, Homo sapiens
uuucuagagacacau

SEQ ID NO: 2195142 - RNA, 22 nt, Homo sapiens
aucaccuaccuucaccaucugu

SEQ ID NO: 2195143 - RNA, 13 nt, Homo sapiens
uacagcccagugg

SEQ ID NO: 2195144 - RNA, 20 nt, Homo sapiens
uaacccgcucaucacuggau

SEQ ID NO: 2195145 - RNA, 19 nt, Homo sapiens
uacauuaaaucacuugaau

SEQ ID NO: 2195146 - RNA, 16 nt, Homo sapiens
aaauacugcuguauaa

SEQ ID NO: 2195147 - RNA, 15 nt, Homo sapiens
ccucaaagcaccuga

SEQ ID NO: 2195148 - RNA, 16 nt, Homo sapiens
aggacagccaccaaga

SEQ ID NO: 2195149 - RNA, 16 nt, Homo sapiens
cuucccccauccucca

SEQ ID NO: 2195150 - RNA, 20 nt, Homo sapiens
gcuugccaccggggaaccca

SEQ ID NO: 2195151 - RNA, 19 nt, Homo sapiens
agaaaaaguugcagucuca

SEQ ID NO: 2195152 - RNA, 20 nt, Homo sapiens
auuuugcaaacacugugauu

SEQ ID NO: 2195153 - RNA, 19 nt, Homo sapiens
acuuguugaugacauuugg

SEQ ID NO: 2195154 - RNA, 15 nt, Homo sapiens
uauuacuaauucuau

SEQ ID NO: 2195155 - RNA, 16 nt, Homo sapiens
cuucaggaauaugcau

SEQ ID NO: 2195156 - RNA, 13 nt, Homo sapiens
cauuacacacaaa

SEQ ID NO: 2195157 - RNA, 20 nt, Homo sapiens
caaccaguuugcccauucuc

SEQ ID NO: 2195158 - RNA, 21 nt, Homo sapiens
gagaggggccugcaggugagc

SEQ ID NO: 2195159 - RNA, 19 nt, Homo sapiens
caaacucuugguuucuuca

SEQ ID NO: 2195160 - RNA, 20 nt, Homo sapiens
agcuaaaaccuuccauguca

SEQ ID NO: 2195161 - RNA, 14 nt, Homo sapiens
uaauuuaucagauu

SEQ ID NO: 2195162 - RNA, 17 nt, Homo sapiens
gucuaguuaacauuuca

SEQ ID NO: 2195163 - RNA, 17 nt, Homo sapiens
uuguaagugagugugcu

SEQ ID NO: 2195164 - RNA, 22 nt, Homo sapiens
uucccgacacccggagcucuac

SEQ ID NO: 2195165 - RNA, 20 nt, Homo sapiens
uacucuaggcagugacagug

SEQ ID NO: 2195166 - RNA, 16 nt, Homo sapiens
cuagaugcaucacugg

SEQ ID NO: 2195167 - RNA, 21 nt, Homo sapiens
augccauuacagaaccaaauc

SEQ ID NO: 2195168 - RNA, 14 nt, Homo sapiens
cacacugcuagcaa

SEQ ID NO: 2195169 - RNA, 15 nt, Homo sapiens
caugcccauaauccc

SEQ ID NO: 2195170 - RNA, 19 nt, Homo sapiens
aaggacucugcuucagucc

SEQ ID NO: 2195171 - RNA, 21 nt, Homo sapiens
cuaaaauauuuuagauguuau

SEQ ID NO: 2195172 - RNA, 12 nt, Homo sapiens
agucucuaugau

SEQ ID NO: 2195173 - RNA, 13 nt, Homo sapiens
uggccuaugcaca

SEQ ID NO: 2195174 - RNA, 17 nt, Homo sapiens
cuucuuggggauucaaa

SEQ ID NO: 2195175 - RNA, 14 nt, Homo sapiens
cagugucuguucau

SEQ ID NO: 2195176 - RNA, 21 nt, Homo sapiens
ucucucugccuagucuacagu

SEQ ID NO: 2195177 - RNA, 11 nt, Homo sapiens
gaccauuccag

SEQ ID NO: 2195178 - RNA, 14 nt, Homo sapiens
cuguuuugccuuca

SEQ ID NO: 2195179 - RNA, 14 nt, Homo sapiens
gcucuuuggugcca

SEQ ID NO: 2195180 - RNA, 17 nt, Homo sapiens
cacucggcuuccaggga

SEQ ID NO: 2195181 - RNA, 12 nt, Homo sapiens
acucaccucccc

SEQ ID NO: 2195182 - RNA, 14 nt, Homo sapiens
gaaaaaugcugcuu

SEQ ID NO: 2195183 - RNA, 16 nt, Homo sapiens
aaugcucuaacuggac

SEQ ID NO: 2195184 - RNA, 14 nt, Homo sapiens
ucauugacuucauu

SEQ ID NO: 2195185 - RNA, 17 nt, Homo sapiens
auugauggguuaauuaa

SEQ ID NO: 2195186 - RNA, 17 nt, Homo sapiens
gaacucugcccaggugu

SEQ ID NO: 2195187 - RNA, 17 nt, Homo sapiens
acagugagaaagggcau

SEQ ID NO: 2195188 - RNA, 19 nt, Homo sapiens
gaaucaagaagcugugaca

SEQ ID NO: 2195189 - RNA, 20 nt, Homo sapiens
gacuuuuuuuaaauaguaaa

SEQ ID NO: 2195190 - RNA, 16 nt, Homo sapiens
cacugcacuccaggcu

SEQ ID NO: 2195191 - RNA, 20 nt, Homo sapiens
agggauuaggagcagcucuu

SEQ ID NO: 2195192 - RNA, 21 nt, Homo sapiens
uugcggaagcuguuggaugau

SEQ ID NO: 2195193 - RNA, 15 nt, Homo sapiens
auuucccacacccca

SEQ ID NO: 2195194 - RNA, 12 nt, Homo sapiens
uaugacugcuga

SEQ ID NO: 2195195 - RNA, 14 nt, Homo sapiens
gcauagccauggaa

SEQ ID NO: 2195196 - RNA, 19 nt, Homo sapiens
cccucaccugguaccugga

SEQ ID NO: 2195197 - RNA, 23 nt, Homo sapiens
uggacagucacugccacuuugca

SEQ ID NO: 2195198 - RNA, 22 nt, Homo sapiens
ugcauaacagcaggguaccuga

SEQ ID NO: 2195199 - RNA, 13 nt, Homo sapiens
auuuuccugaaaa

SEQ ID NO: 2195200 - RNA, 23 nt, Homo sapiens
auggcuacucugcucacaugcac

SEQ ID NO: 2195201 - RNA, 21 nt, Homo sapiens
acucagccuuuugaugucuuu

SEQ ID NO: 2195202 - RNA, 13 nt, Homo sapiens
uuuucuauaauca

SEQ ID NO: 2195203 - RNA, 13 nt, Homo sapiens
caacauggcacau

SEQ ID NO: 2195204 - RNA, 12 nt, Homo sapiens
caaaaacuuugg

SEQ ID NO: 2195205 - RNA, 17 nt, Homo sapiens
aaacacgaaacuuguua

SEQ ID NO: 2195206 - RNA, 15 nt, Homo sapiens
caggcugguuugcaa

SEQ ID NO: 2195207 - RNA, 19 nt, Homo sapiens
ucauuguauuccuccugag

SEQ ID NO: 2195208 - RNA, 18 nt, Homo sapiens
gggaacauuauuccugca

SEQ ID NO: 2195209 - RNA, 16 nt, Homo sapiens
uacucaggcagugcag

SEQ ID NO: 2195210 - RNA, 16 nt, Homo sapiens
cccuacaacuccagcc

SEQ ID NO: 2195211 - RNA, 20 nt, Homo sapiens
uuacuauuucaauacuuaca

SEQ ID NO: 2195212 - RNA, 16 nt, Homo sapiens
aggucaguagacugug

SEQ ID NO: 2195213 - RNA, 12 nt, Homo sapiens
gcccagcauuug

SEQ ID NO: 2195214 - RNA, 21 nt, Homo sapiens
gaauagaagaagcuacugcau

SEQ ID NO: 2195215 - RNA, 20 nt, Homo sapiens
ccgggucaucuguaccucug

SEQ ID NO: 2195216 - RNA, 23 nt, Homo sapiens
cuuugaccacaucgcucuaggau

SEQ ID NO: 2195217 - RNA, 17 nt, Homo sapiens
uaaacaagucaaagacu

SEQ ID NO: 2195218 - RNA, 18 nt, Homo sapiens
uauucuaauuuuagguuc

SEQ ID NO: 2195219 - RNA, 18 nt, Homo sapiens
acuucucaggacacaggc

SEQ ID NO: 2195220 - RNA, 20 nt, Homo sapiens
gaaucugaccacagacacuc

SEQ ID NO: 2195221 - RNA, 20 nt, Homo sapiens
gacaccagaguguaugcaua

SEQ ID NO: 2195222 - RNA, 13 nt, Homo sapiens
ugcuuaaugccag

SEQ ID NO: 2195223 - RNA, 13 nt, Homo sapiens
acaagacaagcuc

SEQ ID NO: 2195224 - RNA, 19 nt, Homo sapiens
gaaacaauaugcaauguga

SEQ ID NO: 2195225 - RNA, 19 nt, Homo sapiens
ugcucuggaagaccugaaa

SEQ ID NO: 2195226 - RNA, 19 nt, Homo sapiens
cuggggagaaugaagagcu

SEQ ID NO: 2195227 - RNA, 13 nt, Homo sapiens
gaaguuaugggaa

SEQ ID NO: 2195228 - RNA, 20 nt, Homo sapiens
cauugauuuugaugauuaaa

SEQ ID NO: 2195229 - RNA, 13 nt, Homo sapiens
acaggaagcugcc

SEQ ID NO: 2195230 - RNA, 19 nt, Homo sapiens
uagccucugggaucugcca

SEQ ID NO: 2195231 - RNA, 18 nt, Homo sapiens
gcauggcuaauagggcca

SEQ ID NO: 2195232 - RNA, 14 nt, Homo sapiens
uggaguuaacauca

SEQ ID NO: 2195233 - RNA, 14 nt, Homo sapiens
gccagccucagaag

SEQ ID NO: 2195234 - RNA, 20 nt, Homo sapiens
gcauuuaaaucaagucccaa

SEQ ID NO: 2195235 - RNA, 17 nt, Homo sapiens
auaacuugaagaacagg

SEQ ID NO: 2195236 - RNA, 12 nt, Homo sapiens
ucgcaccuacca

SEQ ID NO: 2195237 - RNA, 14 nt, Homo sapiens
ucccuggaccucag

SEQ ID NO: 2195238 - RNA, 21 nt, Homo sapiens
uguaacacagucauucuagga

SEQ ID NO: 2195239 - RNA, 21 nt, Homo sapiens
gaucuugccugucuggcucag

SEQ ID NO: 2195240 - RNA, 21 nt, Homo sapiens
cauguuuaauaauauguacaa

SEQ ID NO: 2195241 - RNA, 21 nt, Homo sapiens
caguuacugaugcuccugaac

SEQ ID NO: 2195242 - RNA, 13 nt, Homo sapiens
augcacaucucau

SEQ ID NO: 2195243 - RNA, 14 nt, Homo sapiens
ucaccauguacaua

SEQ ID NO: 2195244 - RNA, 14 nt, Homo sapiens
gcuccccccagugg

SEQ ID NO: 2195245 - RNA, 12 nt, Homo sapiens
auaaagccuuuu

SEQ ID NO: 2195246 - RNA, 16 nt, Homo sapiens
uggucggugggacccu

SEQ ID NO: 2195247 - RNA, 12 nt, Homo sapiens
uguucuuuggaa

SEQ ID NO: 2195248 - RNA, 14 nt, Homo sapiens
caugaccacugccc

SEQ ID NO: 2195249 - RNA, 15 nt, Homo sapiens
ucaccugggcuguga

SEQ ID NO: 2195250 - RNA, 12 nt, Homo sapiens
gagcguuugcac

SEQ ID NO: 2195251 - RNA, 14 nt, Homo sapiens
ucguuaaaaacaga

SEQ ID NO: 2195252 - RNA, 16 nt, Homo sapiens
caaacuucccagagag

SEQ ID NO: 2195253 - RNA, 19 nt, Homo sapiens
cugaaggacagaacauugc

SEQ ID NO: 2195254 - RNA, 21 nt, Homo sapiens
ugguuaaaucaauucugauac

SEQ ID NO: 2195255 - RNA, 15 nt, Homo sapiens
cuugagugugugaac

SEQ ID NO: 2195256 - RNA, 19 nt, Homo sapiens
acauagacaaaaaauuuga

SEQ ID NO: 2195257 - RNA, 16 nt, Homo sapiens
cuuuuuuaauuuccag

SEQ ID NO: 2195258 - RNA, 23 nt, Homo sapiens
cugagccccgccucacacccacc

SEQ ID NO: 2195259 - RNA, 15 nt, Homo sapiens
gauucuucucuuaau

SEQ ID NO: 2195260 - RNA, 15 nt, Homo sapiens
gacagaaaugcaauc

SEQ ID NO: 2195261 - RNA, 17 nt, Homo sapiens
accauucccugccuugc

SEQ ID NO: 2195262 - RNA, 17 nt, Homo sapiens
caguugaauucauguga

SEQ ID NO: 2195263 - RNA, 15 nt, Homo sapiens
guagcuuuacacugc

SEQ ID NO: 2195264 - RNA, 23 nt, Homo sapiens
cagccugcucccuagccagaggc

SEQ ID NO: 2195265 - RNA, 13 nt, Homo sapiens
gaagcaaaugcua

SEQ ID NO: 2195266 - RNA, 15 nt, Homo sapiens
ucaggaaaccaaaua

SEQ ID NO: 2195267 - RNA, 14 nt, Homo sapiens
gccugugugcagug

SEQ ID NO: 2195268 - RNA, 17 nt, Homo sapiens
aggaaaagauuccuguc

SEQ ID NO: 2195269 - RNA, 20 nt, Homo sapiens
cuccauggggugggggugga

SEQ ID NO: 2195270 - RNA, 19 nt, Homo sapiens
cagccucccgaauagcugg

SEQ ID NO: 2195271 - RNA, 23 nt, Homo sapiens
aguugcauugauucaguauuaca

SEQ ID NO: 2195272 - RNA, 22 nt, Homo sapiens
caggaaacaguugcauguagua

SEQ ID NO: 2195273 - RNA, 14 nt, Homo sapiens
gcuuuuugcuuucu

SEQ ID NO: 2195274 - RNA, 21 nt, Homo sapiens
gagacuccaccucuaccaaaa

SEQ ID NO: 2195275 - RNA, 21 nt, Homo sapiens
ccacuuuccccgugggccaug

SEQ ID NO: 2195276 - RNA, 15 nt, Homo sapiens
agagauucuccugcc

SEQ ID NO: 2195277 - RNA, 22 nt, Homo sapiens
cuaguuugugagaaacaucuca

SEQ ID NO: 2195278 - RNA, 15 nt, Homo sapiens
aucagccacauucua

SEQ ID NO: 2195279 - RNA, 18 nt, Homo sapiens
acaacuguggucaauccg

SEQ ID NO: 2195280 - RNA, 18 nt, Homo sapiens
ugcccacccgucuucaau

SEQ ID NO: 2195281 - RNA, 18 nt, Homo sapiens
ggaccaccuccucugcca

SEQ ID NO: 2195282 - RNA, 13 nt, Homo sapiens
gaaauaaaccugg

SEQ ID NO: 2195283 - RNA, 14 nt, Homo sapiens
caugugugugcaag

SEQ ID NO: 2195284 - RNA, 19 nt, Homo sapiens
cauauauaugccuuaugua

SEQ ID NO: 2195285 - RNA, 15 nt, Homo sapiens
cucccagucauuuaa

SEQ ID NO: 2195286 - RNA, 22 nt, Homo sapiens
caaaaggucuauggcucauguc

SEQ ID NO: 2195287 - RNA, 16 nt, Homo sapiens
ugauggagaugcaguc

SEQ ID NO: 2195288 - RNA, 12 nt, Homo sapiens
auuaagaucuca

SEQ ID NO: 2195289 - RNA, 19 nt, Homo sapiens
ccccagauacauggugaug

SEQ ID NO: 2195290 - RNA, 15 nt, Homo sapiens
ugggcaaggccuuug

SEQ ID NO: 2195291 - RNA, 17 nt, Homo sapiens
uuuaauuuuaaugcugu

SEQ ID NO: 2195292 - RNA, 23 nt, Homo sapiens
ugccccuauagaaacaccaguac

SEQ ID NO: 2195293 - RNA, 20 nt, Homo sapiens
gcagagguccacaacacaca

SEQ ID NO: 2195294 - RNA, 22 nt, Homo sapiens
ucauccagaugaaggaaaggaa

SEQ ID NO: 2195295 - RNA, 20 nt, Homo sapiens
uggguuauguguaugugcca

SEQ ID NO: 2195296 - RNA, 22 nt, Homo sapiens
aagccuugguaaaauaaucagu

SEQ ID NO: 2195297 - RNA, 12 nt, Homo sapiens
augccuuuccag

SEQ ID NO: 2195298 - RNA, 13 nt, Homo sapiens
cagaaaacagaga

SEQ ID NO: 2195299 - RNA, 22 nt, Homo sapiens
ucugaguagucuguagcuugag

SEQ ID NO: 2195300 - RNA, 13 nt, Homo sapiens
uaccuugugcuua

SEQ ID NO: 2195301 - RNA, 18 nt, Homo sapiens
ucuuucuuuuuauuuaca

SEQ ID NO: 2195302 - RNA, 21 nt, Homo sapiens
ccauuaaagguggaaaaucua

SEQ ID NO: 2195303 - RNA, 22 nt, Homo sapiens
gagguggauguuaugaacagcu

SEQ ID NO: 2195304 - RNA, 17 nt, Homo sapiens
caccagaguguaugcau

SEQ ID NO: 2195305 - RNA, 19 nt, Homo sapiens
auaucagcccaaaagucaa

SEQ ID NO: 2195306 - RNA, 22 nt, Homo sapiens
augauuuuacucauauguggaa

SEQ ID NO: 2195307 - RNA, 16 nt, Homo sapiens
aaggcaggaggccauu

SEQ ID NO: 2195308 - RNA, 17 nt, Homo sapiens
ucuaaaaagacuaaccu

SEQ ID NO: 2195309 - RNA, 18 nt, Homo sapiens
cccagagccacacauggg

SEQ ID NO: 2195310 - RNA, 18 nt, Homo sapiens
aggagcuucuuguuuccu

SEQ ID NO: 2195311 - RNA, 23 nt, Homo sapiens
augugacuuaaagucagaauagu

SEQ ID NO: 2195312 - RNA, 21 nt, Homo sapiens
acguaaaaagaaaaaaaccau

SEQ ID NO: 2195313 - RNA, 15 nt, Homo sapiens
cccucuuccugugau

SEQ ID NO: 2195314 - RNA, 11 nt, Homo sapiens
caucuugaugg

SEQ ID NO: 2195315 - RNA, 22 nt, Homo sapiens
augcauuuugaguguuuauaga

SEQ ID NO: 2195316 - RNA, 12 nt, Homo sapiens
gccagagucucc

SEQ ID NO: 2195317 - RNA, 20 nt, Homo sapiens
gagagcaaauaaagaccuga

SEQ ID NO: 2195318 - RNA, 17 nt, Homo sapiens
ucaccacaugugcacau

SEQ ID NO: 2195319 - RNA, 19 nt, Homo sapiens
ucuggcaagccugucuuca

SEQ ID NO: 2195320 - RNA, 16 nt, Homo sapiens
gccagcccaacuguga

SEQ ID NO: 2195321 - RNA, 21 nt, Homo sapiens
ccagccccagcaccucaugca

SEQ ID NO: 2195322 - RNA, 17 nt, Homo sapiens
uagaguauaccuguggu

SEQ ID NO: 2195323 - RNA, 20 nt, Homo sapiens
uuccaauccuuaaacugcca

SEQ ID NO: 2195324 - RNA, 21 nt, Homo sapiens
gcccgcagagcccaccuugag

SEQ ID NO: 2195325 - RNA, 19 nt, Homo sapiens
gucauuccaggugccagaa

SEQ ID NO: 2195326 - RNA, 21 nt, Homo sapiens
ucucuggggcaggcugcuuca

SEQ ID NO: 2195327 - RNA, 24 nt, Homo sapiens
gaucaaaaaugaaucacuucugaa

SEQ ID NO: 2195328 - RNA, 15 nt, Homo sapiens
ugggcacgugugcug

SEQ ID NO: 2195329 - RNA, 16 nt, Homo sapiens
agguugccaaauugcu

SEQ ID NO: 2195330 - RNA, 22 nt, Homo sapiens
ccaccacgcagaccaccagcau

SEQ ID NO: 2195331 - RNA, 14 nt, Homo sapiens
ucucccugcugcuc

SEQ ID NO: 2195332 - RNA, 13 nt, Homo sapiens
ucaagugucuuag

SEQ ID NO: 2195333 - RNA, 17 nt, Homo sapiens
uacaugcauuacugcau

SEQ ID NO: 2195334 - RNA, 22 nt, Homo sapiens
cauccuugucugggucuaccag

SEQ ID NO: 2195335 - RNA, 15 nt, Homo sapiens
cccagcucagucuuc

SEQ ID NO: 2195336 - RNA, 17 nt, Homo sapiens
acaggccucgcuacaag

SEQ ID NO: 2195337 - RNA, 23 nt, Homo sapiens
uugccacguucuggacugucuuc

SEQ ID NO: 2195338 - RNA, 21 nt, Homo sapiens
uccagaagccuccuuacauua

SEQ ID NO: 2195339 - RNA, 15 nt, Homo sapiens
ucauccccauuuaag

SEQ ID NO: 2195340 - RNA, 15 nt, Homo sapiens
ugccuguguccugau

SEQ ID NO: 2195341 - RNA, 16 nt, Homo sapiens
cucagccucgcuuuga

SEQ ID NO: 2195342 - RNA, 16 nt, Homo sapiens
ugcagguccagugcag

SEQ ID NO: 2195343 - RNA, 14 nt, Homo sapiens
uaauaaaaagccac

SEQ ID NO: 2195344 - RNA, 22 nt, Homo sapiens
cuuccugggaugaugugugaaa

SEQ ID NO: 2195345 - RNA, 13 nt, Homo sapiens
gacccacacaugu

SEQ ID NO: 2195346 - RNA, 11 nt, Homo sapiens
aaaguauucca

SEQ ID NO: 2195347 - RNA, 11 nt, Homo sapiens
ugucuguaaaa

SEQ ID NO: 2195348 - RNA, 10 nt, Homo sapiens
cuucucucac

SEQ ID NO: 2195349 - RNA, 14 nt, Homo sapiens
cucguccacagggg

SEQ ID NO: 2195350 - RNA, 21 nt, Homo sapiens
ucuguacuugguccaacugca

SEQ ID NO: 2195351 - RNA, 23 nt, Homo sapiens
auucagagcuaauaagugcuuuc

SEQ ID NO: 2195352 - RNA, 14 nt, Homo sapiens
aaugcuaucacugu

SEQ ID NO: 2195353 - RNA, 14 nt, Homo sapiens
cucccaacucccuu

SEQ ID NO: 2195354 - RNA, 22 nt, Homo sapiens
acacauagauuaauggcacuga

SEQ ID NO: 2195355 - RNA, 23 nt, Homo sapiens
ugacaaucaacucuaauagugcu

SEQ ID NO: 2195356 - RNA, 12 nt, Homo sapiens
ugaacaaacaau

SEQ ID NO: 2195357 - RNA, 10 nt, Homo sapiens
gacuuccuug

SEQ ID NO: 2195358 - RNA, 14 nt, Homo sapiens
caagauaaacacaa

SEQ ID NO: 2195359 - RNA, 16 nt, Homo sapiens
cauucacagauaccuc

SEQ ID NO: 2195360 - RNA, 20 nt, Homo sapiens
cuguaacuccccuccugucc

SEQ ID NO: 2195361 - RNA, 13 nt, Homo sapiens
gugaucaucccau

SEQ ID NO: 2195362 - RNA, 14 nt, Homo sapiens
uccgcaugccaacg

SEQ ID NO: 2195363 - RNA, 20 nt, Homo sapiens
uuauucugggggcugcaguu

SEQ ID NO: 2195364 - RNA, 15 nt, Homo sapiens
gacauguggggccag

SEQ ID NO: 2195365 - RNA, 18 nt, Homo sapiens
uacugucucuccagugaa

SEQ ID NO: 2195366 - RNA, 12 nt, Homo sapiens
gcaugugcugca

SEQ ID NO: 2195367 - RNA, 14 nt, Homo sapiens
auguaugcaugcac

SEQ ID NO: 2195368 - RNA, 13 nt, Homo sapiens
acucuguccuucg

SEQ ID NO: 2195369 - RNA, 14 nt, Homo sapiens
acacacgcacauau

SEQ ID NO: 2195370 - RNA, 15 nt, Homo sapiens
aaacaagcuguggua

SEQ ID NO: 2195371 - RNA, 18 nt, Homo sapiens
guccccauccccaccagc

SEQ ID NO: 2195372 - RNA, 21 nt, Homo sapiens
aaaauaaccaugaauacacuu

SEQ ID NO: 2195373 - RNA, 18 nt, Homo sapiens
uuaagagagucuauuuac

SEQ ID NO: 2195374 - RNA, 17 nt, Homo sapiens
ucucagugcuagcuuau

SEQ ID NO: 2195375 - RNA, 23 nt, Homo sapiens
augcuaaaagcuauccaggauuu

SEQ ID NO: 2195376 - RNA, 18 nt, Homo sapiens
acuccugcucucuaucca

SEQ ID NO: 2195377 - RNA, 20 nt, Homo sapiens
aaaugacuuugcaccugcaa

SEQ ID NO: 2195378 - RNA, 12 nt, Homo sapiens
aggagcacauua

SEQ ID NO: 2195379 - RNA, 12 nt, Homo sapiens
uguggcacuugg

SEQ ID NO: 2195380 - RNA, 23 nt, Homo sapiens
aguuacugcugcacuuucacuaa

SEQ ID NO: 2195381 - RNA, 14 nt, Homo sapiens
aaggauugugauau

SEQ ID NO: 2195382 - RNA, 21 nt, Homo sapiens
auaucauagguacaaucuuuc

SEQ ID NO: 2195383 - RNA, 18 nt, Homo sapiens
gaauccugguaauuaaaa

SEQ ID NO: 2195384 - RNA, 13 nt, Homo sapiens
uguuaaaaaccuu

SEQ ID NO: 2195385 - RNA, 21 nt, Homo sapiens
cagguugugugugugugcagu

SEQ ID NO: 2195386 - RNA, 12 nt, Homo sapiens
aucuacauuugu

SEQ ID NO: 2195387 - RNA, 12 nt, Homo sapiens
auguacauuucu

SEQ ID NO: 2195388 - RNA, 14 nt, Homo sapiens
ccacaaaucuauaa

SEQ ID NO: 2195389 - RNA, 15 nt, Homo sapiens
gcccagagcccagcu

SEQ ID NO: 2195390 - RNA, 17 nt, Homo sapiens
cagcacuguugguguuc

SEQ ID NO: 2195391 - RNA, 16 nt, Homo sapiens
cuuuaccuucauuuca

SEQ ID NO: 2195392 - RNA, 12 nt, Homo sapiens
caucacauaaag

SEQ ID NO: 2195393 - RNA, 19 nt, Homo sapiens
caacagagcaagacuccau

SEQ ID NO: 2195394 - RNA, 22 nt, Homo sapiens
caauuucgggagccuugucagu

SEQ ID NO: 2195395 - RNA, 17 nt, Homo sapiens
cgagcagaugaugccaa

SEQ ID NO: 2195396 - RNA, 15 nt, Homo sapiens
ccugucuuuaaggaa

SEQ ID NO: 2195397 - RNA, 16 nt, Homo sapiens
gaacugaaucacuuaa

SEQ ID NO: 2195398 - RNA, 16 nt, Homo sapiens
ucuguucagaugugca

SEQ ID NO: 2195399 - RNA, 16 nt, Homo sapiens
cucugaauaagcacuu

SEQ ID NO: 2195400 - RNA, 14 nt, Homo sapiens
aucucccacuccag

SEQ ID NO: 2195401 - RNA, 15 nt, Homo sapiens
aauuagugaguauaa

SEQ ID NO: 2195402 - RNA, 13 nt, Homo sapiens
uaguaaugcucug

SEQ ID NO: 2195403 - RNA, 17 nt, Homo sapiens
gcuacaguuauuaaucu

SEQ ID NO: 2195404 - RNA, 21 nt, Homo sapiens
aaacagagcuuucaaacacuc

SEQ ID NO: 2195405 - RNA, 15 nt, Homo sapiens
gucuuacuguugcau

SEQ ID NO: 2195406 - RNA, 13 nt, Homo sapiens
uaauuacaccaua

SEQ ID NO: 2195407 - RNA, 14 nt, Homo sapiens
ggcgugugcagugc

SEQ ID NO: 2195408 - RNA, 14 nt, Homo sapiens
agccaguuacauaa

SEQ ID NO: 2195409 - RNA, 19 nt, Homo sapiens
aauuucuaggacugaauua

SEQ ID NO: 2195410 - RNA, 16 nt, Homo sapiens
ugauauuauaguauuc

SEQ ID NO: 2195411 - RNA, 19 nt, Homo sapiens
gaaaccucugggucaucuc

SEQ ID NO: 2195412 - RNA, 19 nt, Homo sapiens
ucccgagcuacucucuugc

SEQ ID NO: 2195413 - RNA, 19 nt, Homo sapiens
cagacaccuaaccccaggg

SEQ ID NO: 2195414 - RNA, 14 nt, Homo sapiens
auauaauccuguga

SEQ ID NO: 2195415 - RNA, 16 nt, Homo sapiens
gucacugccacuuugc

SEQ ID NO: 2195416 - RNA, 16 nt, Homo sapiens
gagucagacugauaga

SEQ ID NO: 2195417 - RNA, 19 nt, Homo sapiens
uucuaaaaauaaaaguauu

SEQ ID NO: 2195418 - RNA, 15 nt, Homo sapiens
aaacuauuugggaua

SEQ ID NO: 2195419 - RNA, 19 nt, Homo sapiens
ucugcaccugucucauagc

SEQ ID NO: 2195420 - RNA, 11 nt, Homo sapiens
cuccaucucau

SEQ ID NO: 2195421 - RNA, 23 nt, Homo sapiens
uacauagcuuuagagaagccaua

SEQ ID NO: 2195422 - RNA, 21 nt, Homo sapiens
auaaaagguuuaaugucaggg

SEQ ID NO: 2195423 - RNA, 16 nt, Homo sapiens
auccggcuccugucau

SEQ ID NO: 2195424 - RNA, 11 nt, Homo sapiens
cucaugaucuu

SEQ ID NO: 2195425 - RNA, 23 nt, Homo sapiens
aguucauccuuugacugugcugg

SEQ ID NO: 2195426 - RNA, 12 nt, Homo sapiens
uuaagugugcag

SEQ ID NO: 2195427 - RNA, 22 nt, Homo sapiens
ugccuugcaauggaucagccaa

SEQ ID NO: 2195428 - RNA, 15 nt, Homo sapiens
augccacauuuugcu

SEQ ID NO: 2195429 - RNA, 13 nt, Homo sapiens
uagaccacugcca

SEQ ID NO: 2195430 - RNA, 14 nt, Homo sapiens
cuaguaacuccucu

SEQ ID NO: 2195431 - RNA, 23 nt, Homo sapiens
cuuaguaccagagcuaguuuuca

SEQ ID NO: 2195432 - RNA, 11 nt, Homo sapiens
uacaaccuggc

SEQ ID NO: 2195433 - RNA, 18 nt, Homo sapiens
ucacccuuccgacaggag

SEQ ID NO: 2195434 - RNA, 22 nt, Homo sapiens
ugaauacuuacuauaauuugac

SEQ ID NO: 2195435 - RNA, 16 nt, Homo sapiens
acuuccccagcucuca

SEQ ID NO: 2195436 - RNA, 12 nt, Homo sapiens
uaaggaaaugug

SEQ ID NO: 2195437 - RNA, 21 nt, Homo sapiens
gcaagugugugcacaugugug

SEQ ID NO: 2195438 - RNA, 23 nt, Homo sapiens
ggcguagacuugacaacauccca

SEQ ID NO: 2195439 - RNA, 18 nt, Homo sapiens
uaauuucagggugcagcc

SEQ ID NO: 2195440 - RNA, 18 nt, Homo sapiens
cuccagagauuugcucaa

SEQ ID NO: 2195441 - RNA, 16 nt, Homo sapiens
acagacacuuacaugg

SEQ ID NO: 2195442 - RNA, 18 nt, Homo sapiens
aaauuuucacugcugcuc

SEQ ID NO: 2195443 - RNA, 18 nt, Homo sapiens
uuauuuugauugcuggaa

SEQ ID NO: 2195444 - RNA, 23 nt, Homo sapiens
auacugacagaugguaucugcca

SEQ ID NO: 2195445 - RNA, 19 nt, Homo sapiens
gguggccccaaccacagga

SEQ ID NO: 2195446 - RNA, 14 nt, Homo sapiens
cuuggagggcucag

SEQ ID NO: 2195447 - RNA, 18 nt, Homo sapiens
gccagaggguagggcaca

SEQ ID NO: 2195448 - RNA, 13 nt, Homo sapiens
cugacuguucucu

SEQ ID NO: 2195449 - RNA, 14 nt, Homo sapiens
ccagacuuucuaca

SEQ ID NO: 2195450 - RNA, 20 nt, Homo sapiens
aguuggggacaugcugcuac

SEQ ID NO: 2195451 - RNA, 21 nt, Homo sapiens
ucccucaggauuccuuggcau

SEQ ID NO: 2195452 - RNA, 17 nt, Homo sapiens
cucagaaaaucaaagag

SEQ ID NO: 2195453 - RNA, 18 nt, Homo sapiens
uguaagauuucauucuga

SEQ ID NO: 2195454 - RNA, 14 nt, Homo sapiens
aacaagaauuggaa

SEQ ID NO: 2195455 - RNA, 20 nt, Homo sapiens
gugcugagaauaaaaccagc

SEQ ID NO: 2195456 - RNA, 21 nt, Homo sapiens
auguacugaauuccauaauac

SEQ ID NO: 2195457 - RNA, 19 nt, Homo sapiens
ucaagaccauagugaccaa

SEQ ID NO: 2195458 - RNA, 13 nt, Homo sapiens
ggaucacugccaa

SEQ ID NO: 2195459 - RNA, 15 nt, Homo sapiens
uuaagaguuacuuaa

SEQ ID NO: 2195460 - RNA, 21 nt, Homo sapiens
cuuuuuuccuccuguguacag

SEQ ID NO: 2195461 - RNA, 20 nt, Homo sapiens
uccagguggcaucagugucu

SEQ ID NO: 2195462 - RNA, 14 nt, Homo sapiens
cagcagcacucacc

SEQ ID NO: 2195463 - RNA, 15 nt, Homo sapiens
gugcagcuugacauu

SEQ ID NO: 2195464 - RNA, 16 nt, Homo sapiens
uaaaguuuaucagaua

SEQ ID NO: 2195465 - RNA, 15 nt, Homo sapiens
ucugucauguaacac

SEQ ID NO: 2195466 - RNA, 16 nt, Homo sapiens
ugacucucagcagcua

SEQ ID NO: 2195467 - RNA, 15 nt, Homo sapiens
ccagcugccuuggac

SEQ ID NO: 2195468 - RNA, 22 nt, Homo sapiens
ccacucugagcccccugaccuu

SEQ ID NO: 2195469 - RNA, 12 nt, Homo sapiens
ugacacugugua

SEQ ID NO: 2195470 - RNA, 12 nt, Homo sapiens
agaaacugaguc

SEQ ID NO: 2195471 - RNA, 12 nt, Homo sapiens
uaacacuguaua

SEQ ID NO: 2195472 - RNA, 19 nt, Homo sapiens
ccucuuuccucuguggcaa

SEQ ID NO: 2195473 - RNA, 22 nt, Homo sapiens
gccaugauaacugcaauuuuaa

SEQ ID NO: 2195474 - RNA, 21 nt, Homo sapiens
auugucuccuuccacaaugac

SEQ ID NO: 2195475 - RNA, 16 nt, Homo sapiens
guggccccagcuguga

SEQ ID NO: 2195476 - RNA, 19 nt, Homo sapiens
aaaugccucugccuugaug

SEQ ID NO: 2195477 - RNA, 13 nt, Homo sapiens
augcucagaaagg

SEQ ID NO: 2195478 - RNA, 12 nt, Homo sapiens
acagccagugac

SEQ ID NO: 2195479 - RNA, 15 nt, Homo sapiens
gcacguuuucaucuc

SEQ ID NO: 2195480 - RNA, 19 nt, Homo sapiens
gcaucugaccaucugugac

SEQ ID NO: 2195481 - RNA, 12 nt, Homo sapiens
cccugcaugcug

SEQ ID NO: 2195482 - RNA, 22 nt, Homo sapiens
uaucuaugggaaaaaucuaaaa

SEQ ID NO: 2195483 - RNA, 15 nt, Homo sapiens
uaaguuuuacuugag

SEQ ID NO: 2195484 - RNA, 16 nt, Homo sapiens
ucccacguccaaucau

SEQ ID NO: 2195485 - RNA, 18 nt, Homo sapiens
cuuaaccguggacucuuc

SEQ ID NO: 2195486 - RNA, 16 nt, Homo sapiens
auuucuccaaagccuu

SEQ ID NO: 2195487 - RNA, 14 nt, Homo sapiens
gggaaacgggguga

SEQ ID NO: 2195488 - RNA, 23 nt, Homo sapiens
aaugugguugaagagcaaugugu

SEQ ID NO: 2195489 - RNA, 23 nt, Homo sapiens
acuuugguccucugauuucacau

SEQ ID NO: 2195490 - RNA, 17 nt, Homo sapiens
ugaaaaacuaauugagc

SEQ ID NO: 2195491 - RNA, 22 nt, Homo sapiens
aucuacacagucacacaauuau

SEQ ID NO: 2195492 - RNA, 22 nt, Homo sapiens
gggcuccucuugggaaucagag

SEQ ID NO: 2195493 - RNA, 15 nt, Homo sapiens
auuuccuggucacau

SEQ ID NO: 2195494 - RNA, 13 nt, Homo sapiens
agccauaugcaau

SEQ ID NO: 2195495 - RNA, 14 nt, Homo sapiens
gcuuggagugccac

SEQ ID NO: 2195496 - RNA, 15 nt, Homo sapiens
aaauagaaaccugaa

SEQ ID NO: 2195497 - RNA, 15 nt, Homo sapiens
ggccagguccugugc

SEQ ID NO: 2195498 - RNA, 20 nt, Homo sapiens
uggcaagucuuccaugaccc

SEQ ID NO: 2195499 - RNA, 15 nt, Homo sapiens
acuaacagauaagca

SEQ ID NO: 2195500 - RNA, 14 nt, Homo sapiens
cuuagcaugcacaa

SEQ ID NO: 2195501 - RNA, 15 nt, Homo sapiens
gaauucuaaaccaau

SEQ ID NO: 2195502 - RNA, 15 nt, Homo sapiens
uuuggggagcagaga

SEQ ID NO: 2195503 - RNA, 13 nt, Homo sapiens
aacagaggccaca

SEQ ID NO: 2195504 - RNA, 23 nt, Homo sapiens
aggaugugucuuggggugggcac

SEQ ID NO: 2195505 - RNA, 18 nt, Homo sapiens
gaaaagauuaugaucuca

SEQ ID NO: 2195506 - RNA, 13 nt, Homo sapiens
uagggcugggaaa

SEQ ID NO: 2195507 - RNA, 11 nt, Homo sapiens
uuugcugucuc

SEQ ID NO: 2195508 - RNA, 22 nt, Homo sapiens
ggaaaacgguggaggccagggc

SEQ ID NO: 2195509 - RNA, 13 nt, Homo sapiens
uccugggcccucu

SEQ ID NO: 2195510 - RNA, 19 nt, Homo sapiens
uggaagagaagagaaagga

SEQ ID NO: 2195511 - RNA, 14 nt, Homo sapiens
aauacugagugccu

SEQ ID NO: 2195512 - RNA, 14 nt, Homo sapiens
auuuaccuuuaugu

SEQ ID NO: 2195513 - RNA, 19 nt, Homo sapiens
cccagugcuccugugcagg

SEQ ID NO: 2195514 - RNA, 19 nt, Homo sapiens
ugcuaauccggaaaucagc

SEQ ID NO: 2195515 - RNA, 16 nt, Homo sapiens
aagaugguucuagcau

SEQ ID NO: 2195516 - RNA, 16 nt, Homo sapiens
ucugauguggcaaaag

SEQ ID NO: 2195517 - RNA, 18 nt, Homo sapiens
gucacauugaaggugcug

SEQ ID NO: 2195518 - RNA, 13 nt, Homo sapiens
ucugucaaugaca

SEQ ID NO: 2195519 - RNA, 22 nt, Homo sapiens
ccuccugcuaacuccuagcuga

SEQ ID NO: 2195520 - RNA, 17 nt, Homo sapiens
agaguggucgagugaca

SEQ ID NO: 2195521 - RNA, 14 nt, Homo sapiens
ugccacuucccaga

SEQ ID NO: 2195522 - RNA, 18 nt, Homo sapiens
acuuuuuuuaaacugugg

SEQ ID NO: 2195523 - RNA, 12 nt, Homo sapiens
auauaaacaaug

SEQ ID NO: 2195524 - RNA, 18 nt, Homo sapiens
cuggcuguggucagcaga

SEQ ID NO: 2195525 - RNA, 14 nt, Homo sapiens
ucugguuucugugu

SEQ ID NO: 2195526 - RNA, 21 nt, Homo sapiens
caaaucagcugcuacuacucc

SEQ ID NO: 2195527 - RNA, 17 nt, Homo sapiens
uauugagugaagccuua

SEQ ID NO: 2195528 - RNA, 22 nt, Homo sapiens
ccauagggucggaggugcuguc

SEQ ID NO: 2195529 - RNA, 20 nt, Homo sapiens
ucuaguuaaccuagaaguau

SEQ ID NO: 2195530 - RNA, 21 nt, Homo sapiens
ugacuuugcccccuugcccau

SEQ ID NO: 2195531 - RNA, 13 nt, Homo sapiens
ccaagaacugcag

SEQ ID NO: 2195532 - RNA, 23 nt, Homo sapiens
guagguuuuuuauagcuauuaaa

SEQ ID NO: 2195533 - RNA, 16 nt, Homo sapiens
ugagaauuuguuuuca

SEQ ID NO: 2195534 - RNA, 19 nt, Homo sapiens
aagaacugccccaucuccu

SEQ ID NO: 2195535 - RNA, 15 nt, Homo sapiens
cauauuagcaucaug

SEQ ID NO: 2195536 - RNA, 19 nt, Homo sapiens
ucuaagcugugguguguuc

SEQ ID NO: 2195537 - RNA, 14 nt, Homo sapiens
acaaauagugcuaa

SEQ ID NO: 2195538 - RNA, 21 nt, Homo sapiens
cugguagaagggaaagcccau

SEQ ID NO: 2195539 - RNA, 22 nt, Homo sapiens
auuaaaauaagcacugugcuaa

SEQ ID NO: 2195540 - RNA, 15 nt, Homo sapiens
ugcauccaauuuauu

SEQ ID NO: 2195541 - RNA, 15 nt, Homo sapiens
gcaaaacuccgucuc

SEQ ID NO: 2195542 - RNA, 20 nt, Homo sapiens
acacugcugcuccagugcag

SEQ ID NO: 2195543 - RNA, 19 nt, Homo sapiens
augugacacugcagcagaa

SEQ ID NO: 2195544 - RNA, 18 nt, Homo sapiens
aauaaaggcagcugccuc

SEQ ID NO: 2195545 - RNA, 19 nt, Homo sapiens
gucugagagcaaagugacc

SEQ ID NO: 2195546 - RNA, 19 nt, Homo sapiens
gcauuugucaacaaaguca

SEQ ID NO: 2195547 - RNA, 16 nt, Homo sapiens
aaugccccacauuuua

SEQ ID NO: 2195548 - RNA, 23 nt, Homo sapiens
ccauaguaaugagugaguucuca

SEQ ID NO: 2195549 - RNA, 22 nt, Homo sapiens
cuguaguuuuuguucaccuucu

SEQ ID NO: 2195550 - RNA, 11 nt, Homo sapiens
aggcugugucu

SEQ ID NO: 2195551 - RNA, 15 nt, Homo sapiens
guuuguacgauuucu

SEQ ID NO: 2195552 - RNA, 17 nt, Homo sapiens
cuagaaagucucugaua

SEQ ID NO: 2195553 - RNA, 16 nt, Homo sapiens
aaucuaaaauguuuua

SEQ ID NO: 2195554 - RNA, 20 nt, Homo sapiens
cgcguuguguauauuacacc

SEQ ID NO: 2195555 - RNA, 20 nt, Homo sapiens
aaaauccaaggcaauuccug

SEQ ID NO: 2195556 - RNA, 19 nt, Homo sapiens
aauauuuuaagaauuucac

SEQ ID NO: 2195557 - RNA, 15 nt, Homo sapiens
uuuagagacuguaaa

SEQ ID NO: 2195558 - RNA, 18 nt, Homo sapiens
cuuccauuauacaucaau

SEQ ID NO: 2195559 - RNA, 19 nt, Homo sapiens
agucuggcgucuccagacu

SEQ ID NO: 2195560 - RNA, 22 nt, Homo sapiens
agaccucccuguucaaggcccc

SEQ ID NO: 2195561 - RNA, 15 nt, Homo sapiens
ucuccaagauagcau

SEQ ID NO: 2195562 - RNA, 23 nt, Homo sapiens
aguuugaacucuguaaaaccuca

SEQ ID NO: 2195563 - RNA, 20 nt, Homo sapiens
cuguguccaauuaugcacug

SEQ ID NO: 2195564 - RNA, 15 nt, Homo sapiens
ugaagaguccucuga

SEQ ID NO: 2195565 - RNA, 14 nt, Homo sapiens
cuauggaaagagua

SEQ ID NO: 2195566 - RNA, 14 nt, Homo sapiens
acugacacaugcug

SEQ ID NO: 2195567 - RNA, 19 nt, Homo sapiens
agcuaaccaguuaccacac

SEQ ID NO: 2195568 - RNA, 16 nt, Homo sapiens
uuauauuaaaauaugg

SEQ ID NO: 2195569 - RNA, 15 nt, Homo sapiens
cgcaucccgucagcu

SEQ ID NO: 2195570 - RNA, 14 nt, Homo sapiens
ucccucugcagucu

SEQ ID NO: 2195571 - RNA, 19 nt, Homo sapiens
cugccacucaggcccaaag

SEQ ID NO: 2195572 - RNA, 16 nt, Homo sapiens
ucacacuuuaauguac

SEQ ID NO: 2195573 - RNA, 17 nt, Homo sapiens
caugauuuccuugaaug

SEQ ID NO: 2195574 - RNA, 16 nt, Homo sapiens
agcaaaugaucagccu

SEQ ID NO: 2195575 - RNA, 15 nt, Homo sapiens
ugacccugaugaaaa

SEQ ID NO: 2195576 - RNA, 12 nt, Homo sapiens
aaagcagcccuu

SEQ ID NO: 2195577 - RNA, 19 nt, Homo sapiens
guacuuuuuuuaaacugug

SEQ ID NO: 2195578 - RNA, 20 nt, Homo sapiens
ucugggaaucccagaauguc

SEQ ID NO: 2195579 - RNA, 18 nt, Homo sapiens
uguuaacaugacauuuac

SEQ ID NO: 2195580 - RNA, 16 nt, Homo sapiens
agccccauguguaccu

SEQ ID NO: 2195581 - RNA, 22 nt, Homo sapiens
ggugagacccauggcuguguug

SEQ ID NO: 2195582 - RNA, 20 nt, Homo sapiens
augcaacucaucuucacaga

SEQ ID NO: 2195583 - RNA, 21 nt, Homo sapiens
caagugugcauuaccacacuc

SEQ ID NO: 2195584 - RNA, 11 nt, Homo sapiens
auucuacucaa

SEQ ID NO: 2195585 - RNA, 15 nt, Homo sapiens
aaaagaguauguagu

SEQ ID NO: 2195586 - RNA, 15 nt, Homo sapiens
cuauaggucagagau

SEQ ID NO: 2195587 - RNA, 13 nt, Homo sapiens
caagaaugcuuua

SEQ ID NO: 2195588 - RNA, 14 nt, Homo sapiens
gguuauacacagaa

SEQ ID NO: 2195589 - RNA, 18 nt, Homo sapiens
uuacacacugucuguaua

SEQ ID NO: 2195590 - RNA, 13 nt, Homo sapiens
uauaaaucuucaa

SEQ ID NO: 2195591 - RNA, 23 nt, Homo sapiens
ucaauaaauggcccggacauguc

SEQ ID NO: 2195592 - RNA, 16 nt, Homo sapiens
aaaauuucuggcaaau

SEQ ID NO: 2195593 - RNA, 19 nt, Homo sapiens
accccaggaagugggagaa

SEQ ID NO: 2195594 - RNA, 22 nt, Homo sapiens
ggauauaggucagugaggccca

SEQ ID NO: 2195595 - RNA, 20 nt, Homo sapiens
cuuccuccugauggccaaga

SEQ ID NO: 2195596 - RNA, 20 nt, Homo sapiens
ucacuaaaacacacaggugc

SEQ ID NO: 2195597 - RNA, 16 nt, Homo sapiens
uaacuguuaguauuaa

SEQ ID NO: 2195598 - RNA, 10 nt, Homo sapiens
acagacuccg

SEQ ID NO: 2195599 - RNA, 15 nt, Homo sapiens
uucauguuugcuuca

SEQ ID NO: 2195600 - RNA, 18 nt, Homo sapiens
ugugaaaauauacuugac

SEQ ID NO: 2195601 - RNA, 21 nt, Homo sapiens
cuuggagaaugugagaagcca

SEQ ID NO: 2195602 - RNA, 13 nt, Homo sapiens
augucccaugacc

SEQ ID NO: 2195603 - RNA, 15 nt, Homo sapiens
ugggccccacuggac

SEQ ID NO: 2195604 - RNA, 15 nt, Homo sapiens
ucuaccccaggagac

SEQ ID NO: 2195605 - RNA, 23 nt, Homo sapiens
guauuuuacuuugugcaauauga

SEQ ID NO: 2195606 - RNA, 17 nt, Homo sapiens
ccauguuauucucucac

SEQ ID NO: 2195607 - RNA, 17 nt, Homo sapiens
cuacacacucugagucu

SEQ ID NO: 2195608 - RNA, 18 nt, Homo sapiens
cuccucaguaaauguaca

SEQ ID NO: 2195609 - RNA, 22 nt, Homo sapiens
ucaacagaugaccguguacaau

SEQ ID NO: 2195610 - RNA, 20 nt, Homo sapiens
guacacacucagugacauuu

SEQ ID NO: 2195611 - RNA, 18 nt, Homo sapiens
uguuuacaacaucaccag

SEQ ID NO: 2195612 - RNA, 17 nt, Homo sapiens
ucaagaccaacagaaga

SEQ ID NO: 2195613 - RNA, 21 nt, Homo sapiens
auuuccuguuauguuuaacuu

SEQ ID NO: 2195614 - RNA, 17 nt, Homo sapiens
ugcacagcuaacaugga

SEQ ID NO: 2195615 - RNA, 18 nt, Homo sapiens
aaaauggcuugucuuugc

SEQ ID NO: 2195616 - RNA, 20 nt, Homo sapiens
ucuccuccuaccagagugaa

SEQ ID NO: 2195617 - RNA, 16 nt, Homo sapiens
cugguuagacaguacu

SEQ ID NO: 2195618 - RNA, 13 nt, Homo sapiens
uaauaacagugca

SEQ ID NO: 2195619 - RNA, 15 nt, Homo sapiens
uuuaaaaauacacau

SEQ ID NO: 2195620 - RNA, 18 nt, Homo sapiens
uucucgugacaccaccaa

SEQ ID NO: 2195621 - RNA, 11 nt, Homo sapiens
guuuguuguuu

SEQ ID NO: 2195622 - RNA, 18 nt, Homo sapiens
gcaggagaacuacuugaa

SEQ ID NO: 2195623 - RNA, 17 nt, Homo sapiens
uaugccacccugcaaua

SEQ ID NO: 2195624 - RNA, 18 nt, Homo sapiens
ucaugacaaauccuugaa

SEQ ID NO: 2195625 - RNA, 22 nt, Homo sapiens
cauaucuagauuuuucugugaa

SEQ ID NO: 2195626 - RNA, 15 nt, Homo sapiens
gccuggacuuuccug

SEQ ID NO: 2195627 - RNA, 17 nt, Homo sapiens
uaaacaugagcgcugau

SEQ ID NO: 2195628 - RNA, 20 nt, Homo sapiens
ccccuguagacuagugccgu

SEQ ID NO: 2195629 - RNA, 20 nt, Homo sapiens
ggcacauauuggagggaaau

SEQ ID NO: 2195630 - RNA, 12 nt, Homo sapiens
uggcccaucaac

SEQ ID NO: 2195631 - RNA, 16 nt, Homo sapiens
cacacacuucuuccaa

SEQ ID NO: 2195632 - RNA, 17 nt, Homo sapiens
gugcagccacacacaga

SEQ ID NO: 2195633 - RNA, 18 nt, Homo sapiens
acugugccaacuacuacu

SEQ ID NO: 2195634 - RNA, 12 nt, Homo sapiens
ugcuggggaccu

SEQ ID NO: 2195635 - RNA, 21 nt, Homo sapiens
gugggcucugugcagucacug

SEQ ID NO: 2195636 - RNA, 22 nt, Homo sapiens
gcucuuuagaauggaccacuga

SEQ ID NO: 2195637 - RNA, 23 nt, Homo sapiens
cauuugaaccagugauccauguc

SEQ ID NO: 2195638 - RNA, 14 nt, Homo sapiens
agugcuuguuagag

SEQ ID NO: 2195639 - RNA, 20 nt, Homo sapiens
uauuaauaguucaguguaug

SEQ ID NO: 2195640 - RNA, 21 nt, Homo sapiens
agggggcgaagggaucagccc

SEQ ID NO: 2195641 - RNA, 16 nt, Homo sapiens
ugcugguuccaugccu

SEQ ID NO: 2195642 - RNA, 16 nt, Homo sapiens
ucccugggcugugcua

SEQ ID NO: 2195643 - RNA, 15 nt, Homo sapiens
ugaaaguuaacauua

SEQ ID NO: 2195644 - RNA, 23 nt, Homo sapiens
ugaggauacgacaguacacuguc

SEQ ID NO: 2195645 - RNA, 16 nt, Homo sapiens
uuugaaauccaaagaa

SEQ ID NO: 2195646 - RNA, 19 nt, Homo sapiens
ccaggcgagccugacucug

SEQ ID NO: 2195647 - RNA, 15 nt, Homo sapiens
cuuuaaauuuugcac

SEQ ID NO: 2195648 - RNA, 15 nt, Homo sapiens
cagcauuaccacagc

SEQ ID NO: 2195649 - RNA, 14 nt, Homo sapiens
gaaacaacauuuau

SEQ ID NO: 2195650 - RNA, 19 nt, Homo sapiens
gcacagagucgaugcucaa

SEQ ID NO: 2195651 - RNA, 18 nt, Homo sapiens
uucaucccagaaacucca

SEQ ID NO: 2195652 - RNA, 21 nt, Homo sapiens
aagcaguuguaccaagugaaa

SEQ ID NO: 2195653 - RNA, 13 nt, Homo sapiens
uaaauacauuuau

SEQ ID NO: 2195654 - RNA, 15 nt, Homo sapiens
caucucccugcaguu

SEQ ID NO: 2195655 - RNA, 18 nt, Homo sapiens
agcucuggguugugcaca

SEQ ID NO: 2195656 - RNA, 13 nt, Homo sapiens
ccaucugcuccuc

SEQ ID NO: 2195657 - RNA, 23 nt, Homo sapiens
cuucaucaggagcuagagccauu

SEQ ID NO: 2195658 - RNA, 13 nt, Homo sapiens
acucaaggacagc

SEQ ID NO: 2195659 - RNA, 19 nt, Homo sapiens
ccuuuuauuuauuccuuau

SEQ ID NO: 2195660 - RNA, 21 nt, Homo sapiens
aaaguaaaaguuauaucuaac

SEQ ID NO: 2195661 - RNA, 20 nt, Homo sapiens
auugcaauacauuucuuccu

SEQ ID NO: 2195662 - RNA, 17 nt, Homo sapiens
uauuuuaagacgugaau

SEQ ID NO: 2195663 - RNA, 17 nt, Homo sapiens
uaagaaaagguuaucuu

SEQ ID NO: 2195664 - RNA, 17 nt, Homo sapiens
agaccauugucuuccaa

SEQ ID NO: 2195665 - RNA, 16 nt, Homo sapiens
uuccccgugggccaug

SEQ ID NO: 2195666 - RNA, 21 nt, Homo sapiens
acucgcuucccccauagccac

SEQ ID NO: 2195667 - RNA, 15 nt, Homo sapiens
cccagaaacaacaca

SEQ ID NO: 2195668 - RNA, 16 nt, Homo sapiens
ucaauggcuuguucau

SEQ ID NO: 2195669 - RNA, 15 nt, Homo sapiens
ccacccuaauuugcc

SEQ ID NO: 2195670 - RNA, 23 nt, Homo sapiens
uggccuggcggagaugcuucuaa

SEQ ID NO: 2195671 - RNA, 13 nt, Homo sapiens
aggugcaagccac

SEQ ID NO: 2195672 - RNA, 11 nt, Homo sapiens
aagaaccacuu

SEQ ID NO: 2195673 - RNA, 18 nt, Homo sapiens
ccaggauugaccuuugca

SEQ ID NO: 2195674 - RNA, 21 nt, Homo sapiens
agcuucucugggcugaaugua

SEQ ID NO: 2195675 - RNA, 18 nt, Homo sapiens
uugacaacaaccuaugca

SEQ ID NO: 2195676 - RNA, 12 nt, Homo sapiens
uguuacauagaa

SEQ ID NO: 2195677 - RNA, 21 nt, Homo sapiens
auaaaaauucauaaccaaaga

SEQ ID NO: 2195678 - RNA, 16 nt, Homo sapiens
aacaaagacauugaca

SEQ ID NO: 2195679 - RNA, 15 nt, Homo sapiens
gacugugugcaacgc

SEQ ID NO: 2195680 - RNA, 15 nt, Homo sapiens
ucuagaagacuguca

SEQ ID NO: 2195681 - RNA, 17 nt, Homo sapiens
augguugauggaaaaua

SEQ ID NO: 2195682 - RNA, 23 nt, Homo sapiens
cuaucuacuacaaacuucaaaga

SEQ ID NO: 2195683 - RNA, 16 nt, Homo sapiens
acuuuguauacuuuaa

SEQ ID NO: 2195684 - RNA, 20 nt, Homo sapiens
aacuucuccuuagacacuuu

SEQ ID NO: 2195685 - RNA, 15 nt, Homo sapiens
aaaaguagaaaggag

SEQ ID NO: 2195686 - RNA, 23 nt, Homo sapiens
caggaaggaaaugacaccaaaua

SEQ ID NO: 2195687 - RNA, 18 nt, Homo sapiens
aggucucucaacuucauc

SEQ ID NO: 2195688 - RNA, 15 nt, Homo sapiens
gaugaaagagccaga

SEQ ID NO: 2195689 - RNA, 16 nt, Homo sapiens
aaauaaaaaucucuuu

SEQ ID NO: 2195690 - RNA, 18 nt, Homo sapiens
uuaacccacugcaugcag

SEQ ID NO: 2195691 - RNA, 20 nt, Homo sapiens
aguaagguuauaacuguggc

SEQ ID NO: 2195692 - RNA, 15 nt, Homo sapiens
ccucucccucagucc

SEQ ID NO: 2195693 - RNA, 19 nt, Homo sapiens
aaaguuggccaauuucacc

SEQ ID NO: 2195694 - RNA, 21 nt, Homo sapiens
gccaaguggaagccacuggac

SEQ ID NO: 2195695 - RNA, 15 nt, Homo sapiens
aaaugcuaccucuga

SEQ ID NO: 2195696 - RNA, 14 nt, Homo sapiens
gagcuuccacuguc

SEQ ID NO: 2195697 - RNA, 12 nt, Homo sapiens
gacgugcacugu

SEQ ID NO: 2195698 - RNA, 11 nt, Homo sapiens
aaugacuguga

SEQ ID NO: 2195699 - RNA, 16 nt, Homo sapiens
cugcagaauccagcua

SEQ ID NO: 2195700 - RNA, 16 nt, Homo sapiens
ugaugucgaugcucac

SEQ ID NO: 2195701 - RNA, 16 nt, Homo sapiens
gaaaaauacaaugggg

SEQ ID NO: 2195702 - RNA, 16 nt, Homo sapiens
uaccccacugggccag

SEQ ID NO: 2195703 - RNA, 14 nt, Homo sapiens
ggcagugggaccca

SEQ ID NO: 2195704 - RNA, 20 nt, Homo sapiens
aagccucucuggcacuuuga

SEQ ID NO: 2195705 - RNA, 20 nt, Homo sapiens
uacacuuggaugcagugcgu

SEQ ID NO: 2195706 - RNA, 20 nt, Homo sapiens
aaugaaaauaagugaauaau

SEQ ID NO: 2195707 - RNA, 20 nt, Homo sapiens
aguaaagucaacauaugcaa

SEQ ID NO: 2195708 - RNA, 18 nt, Homo sapiens
ucugccugggcucuggaa

SEQ ID NO: 2195709 - RNA, 18 nt, Homo sapiens
cuggauggagcccaggcg

SEQ ID NO: 2195710 - RNA, 21 nt, Homo sapiens
ucccugaaucccccuugccac

SEQ ID NO: 2195711 - RNA, 15 nt, Homo sapiens
aaacugccuuugaua

SEQ ID NO: 2195712 - RNA, 15 nt, Homo sapiens
ucuccucucuuggca

SEQ ID NO: 2195713 - RNA, 16 nt, Homo sapiens
aaagucacaggaagaa

SEQ ID NO: 2195714 - RNA, 22 nt, Homo sapiens
uccucucccccuccuccaggga

SEQ ID NO: 2195715 - RNA, 17 nt, Homo sapiens
aguacuugagggaccaa

SEQ ID NO: 2195716 - RNA, 20 nt, Homo sapiens
aggcaaaaaaaucauauaag

SEQ ID NO: 2195717 - RNA, 15 nt, Homo sapiens
aacaacaacuuugga

SEQ ID NO: 2195718 - RNA, 19 nt, Homo sapiens
cgcuaaagggaccaucugc

SEQ ID NO: 2195719 - RNA, 20 nt, Homo sapiens
gguucugugugagugcucug

SEQ ID NO: 2195720 - RNA, 16 nt, Homo sapiens
uuaaauagucuagacu

SEQ ID NO: 2195721 - RNA, 19 nt, Homo sapiens
ugcucuggaggaaguucuc

SEQ ID NO: 2195722 - RNA, 23 nt, Homo sapiens
auuuccacuaagaacaccugcau

SEQ ID NO: 2195723 - RNA, 20 nt, Homo sapiens
ucuuaagaaaaugaugcugg

SEQ ID NO: 2195724 - RNA, 13 nt, Homo sapiens
uuugaaaugucau

SEQ ID NO: 2195725 - RNA, 19 nt, Homo sapiens
caccaguaauaaaaagcca

SEQ ID NO: 2195726 - RNA, 15 nt, Homo sapiens
aucugucaucucucu

SEQ ID NO: 2195727 - RNA, 13 nt, Homo sapiens
agaagcuggugcc

SEQ ID NO: 2195728 - RNA, 21 nt, Homo sapiens
gcaauuaggauuuugauguga

SEQ ID NO: 2195729 - RNA, 21 nt, Homo sapiens
uuacuuugauaucugaucaaa

SEQ ID NO: 2195730 - RNA, 15 nt, Homo sapiens
ucucucucugccaug

SEQ ID NO: 2195731 - RNA, 23 nt, Homo sapiens
aauuuaugacuccacuguggaaa

SEQ ID NO: 2195732 - RNA, 20 nt, Homo sapiens
ugccgccuccuugugcacaa

SEQ ID NO: 2195733 - RNA, 19 nt, Homo sapiens
caguagccguuugugguuu

SEQ ID NO: 2195734 - RNA, 12 nt, Homo sapiens
auucugccaaag

SEQ ID NO: 2195735 - RNA, 17 nt, Homo sapiens
uggacacguggugcauu

SEQ ID NO: 2195736 - RNA, 23 nt, Homo sapiens
agagucuaggcuaagcacuuuau

SEQ ID NO: 2195737 - RNA, 18 nt, Homo sapiens
acauggaauaacauguaa

SEQ ID NO: 2195738 - RNA, 13 nt, Homo sapiens
uuuaaaaagcagg

SEQ ID NO: 2195739 - RNA, 17 nt, Homo sapiens
aaggccuuccacugugg

SEQ ID NO: 2195740 - RNA, 14 nt, Homo sapiens
cagagacaccugca

SEQ ID NO: 2195741 - RNA, 18 nt, Homo sapiens
uaagagaaaugagcugca

SEQ ID NO: 2195742 - RNA, 19 nt, Homo sapiens
caguguccucuugcucaaa

SEQ ID NO: 2195743 - RNA, 18 nt, Homo sapiens
gcuggacggggacugggg

SEQ ID NO: 2195744 - RNA, 18 nt, Homo sapiens
accagaugggaugggcuu

SEQ ID NO: 2195745 - RNA, 13 nt, Homo sapiens
cucacauugagag

SEQ ID NO: 2195746 - RNA, 16 nt, Homo sapiens
uugcagaugacaaaaa

SEQ ID NO: 2195747 - RNA, 17 nt, Homo sapiens
ucagcuuugcuuuuccu

SEQ ID NO: 2195748 - RNA, 19 nt, Homo sapiens
gugcugccagcacagggcu

SEQ ID NO: 2195749 - RNA, 17 nt, Homo sapiens
gcguguacuaccccaga

SEQ ID NO: 2195750 - RNA, 20 nt, Homo sapiens
gaacuucaucugccacuggu

SEQ ID NO: 2195751 - RNA, 21 nt, Homo sapiens
uucccauuuguaauuuguaaa

SEQ ID NO: 2195752 - RNA, 16 nt, Homo sapiens
ggugaaggaaacagaa

SEQ ID NO: 2195753 - RNA, 13 nt, Homo sapiens
ccucgggacauca

SEQ ID NO: 2195754 - RNA, 18 nt, Homo sapiens
acaaaucauuuugaugua

SEQ ID NO: 2195755 - RNA, 22 nt, Homo sapiens
cccugagcccaaggcacugaga

SEQ ID NO: 2195756 - RNA, 13 nt, Homo sapiens
ugagaacuggaca

SEQ ID NO: 2195757 - RNA, 13 nt, Homo sapiens
auuauuucagugu

SEQ ID NO: 2195758 - RNA, 14 nt, Homo sapiens
acauagaacaugug

SEQ ID NO: 2195759 - RNA, 14 nt, Homo sapiens
cccugccaguugaa

SEQ ID NO: 2195760 - RNA, 13 nt, Homo sapiens
acaauucagucuu

SEQ ID NO: 2195761 - RNA, 17 nt, Homo sapiens
cauuccuguagucaaaa

SEQ ID NO: 2195762 - RNA, 20 nt, Homo sapiens
cgccgucccaccagcuucac

SEQ ID NO: 2195763 - RNA, 16 nt, Homo sapiens
acccaggguggggaca

SEQ ID NO: 2195764 - RNA, 19 nt, Homo sapiens
caucuggugccuuuccaca

SEQ ID NO: 2195765 - RNA, 23 nt, Homo sapiens
auuaaacuucauauguaaucucu

SEQ ID NO: 2195766 - RNA, 19 nt, Homo sapiens
cucuuggcuccacugggau

SEQ ID NO: 2195767 - RNA, 17 nt, Homo sapiens
uuuacagauaaccuaaa

SEQ ID NO: 2195768 - RNA, 14 nt, Homo sapiens
ucccaacugagugu

SEQ ID NO: 2195769 - RNA, 17 nt, Homo sapiens
cgcaccagacacucaca

SEQ ID NO: 2195770 - RNA, 13 nt, Homo sapiens
ccaggacagggaa

SEQ ID NO: 2195771 - RNA, 18 nt, Homo sapiens
cuuagcaacucagagaaa

SEQ ID NO: 2195772 - RNA, 17 nt, Homo sapiens
ucaacauuacauuugaa

SEQ ID NO: 2195773 - RNA, 22 nt, Homo sapiens
ugccuccuggacuguucacggc

SEQ ID NO: 2195774 - RNA, 20 nt, Homo sapiens
guccuuaucaccagccucac

SEQ ID NO: 2195775 - RNA, 19 nt, Homo sapiens
auagcaauuccccuacauc

SEQ ID NO: 2195776 - RNA, 20 nt, Homo sapiens
cagagcaagacuccauuuca

SEQ ID NO: 2195777 - RNA, 22 nt, Homo sapiens
cagaucuggucuaguuaaccua

SEQ ID NO: 2195778 - RNA, 12 nt, Homo sapiens
ccugggauucaa

SEQ ID NO: 2195779 - RNA, 14 nt, Homo sapiens
ggccaauauaccua

SEQ ID NO: 2195780 - RNA, 12 nt, Homo sapiens
gagaugucuucg

SEQ ID NO: 2195781 - RNA, 22 nt, Homo sapiens
aagacaucuguggccaacaauc

SEQ ID NO: 2195782 - RNA, 21 nt, Homo sapiens
guguuaaaguggucugaacug

SEQ ID NO: 2195783 - RNA, 13 nt, Homo sapiens
agggagggagcaa

SEQ ID NO: 2195784 - RNA, 13 nt, Homo sapiens
aacggucucucac

SEQ ID NO: 2195785 - RNA, 16 nt, Homo sapiens
cuucuucccagcacua

SEQ ID NO: 2195786 - RNA, 22 nt, Homo sapiens
cagagcauucagaaugucaaug

SEQ ID NO: 2195787 - RNA, 19 nt, Homo sapiens
gcagaagccaaucauuuca

SEQ ID NO: 2195788 - RNA, 16 nt, Homo sapiens
aauucuccugccuuag

SEQ ID NO: 2195789 - RNA, 22 nt, Homo sapiens
uauuuagaucuagaaacagauc

SEQ ID NO: 2195790 - RNA, 18 nt, Homo sapiens
uaaaagcucagaugacau

SEQ ID NO: 2195791 - RNA, 22 nt, Homo sapiens
uugcagugugcauaauuuugcc

SEQ ID NO: 2195792 - RNA, 16 nt, Homo sapiens
uuaguauuuuaauccu

SEQ ID NO: 2195793 - RNA, 13 nt, Homo sapiens
aaauuggucccaa

SEQ ID NO: 2195794 - RNA, 17 nt, Homo sapiens
cccacccugcaaaggga

SEQ ID NO: 2195795 - RNA, 18 nt, Homo sapiens
ggucuuacuuugugcaaa

SEQ ID NO: 2195796 - RNA, 19 nt, Homo sapiens
cuguucucuuccacucucc

SEQ ID NO: 2195797 - RNA, 18 nt, Homo sapiens
gaacucccagaaccacua

SEQ ID NO: 2195798 - RNA, 20 nt, Homo sapiens
ccaucucuacuaaaaauaca

SEQ ID NO: 2195799 - RNA, 21 nt, Homo sapiens
uugcuuuugugcauuggauaa

SEQ ID NO: 2195800 - RNA, 21 nt, Homo sapiens
ucuucacuguggucauccugc

SEQ ID NO: 2195801 - RNA, 13 nt, Homo sapiens
cuuuuucuggaaa

SEQ ID NO: 2195802 - RNA, 21 nt, Homo sapiens
cuuccugggcagccuuuccag

SEQ ID NO: 2195803 - RNA, 15 nt, Homo sapiens
cauccuguuuugcaa

SEQ ID NO: 2195804 - RNA, 21 nt, Homo sapiens
uaucuacuaguaauaauguaa

SEQ ID NO: 2195805 - RNA, 18 nt, Homo sapiens
cauuguaaaugaacauaa

SEQ ID NO: 2195806 - RNA, 20 nt, Homo sapiens
caauucacauucaucaucag

SEQ ID NO: 2195807 - RNA, 19 nt, Homo sapiens
ucucacucuguugaccagg

SEQ ID NO: 2195808 - RNA, 19 nt, Homo sapiens
agccgauggggaggggaug

SEQ ID NO: 2195809 - RNA, 15 nt, Homo sapiens
uauauuugauacaua

SEQ ID NO: 2195810 - RNA, 13 nt, Homo sapiens
ccucaagugccuu

SEQ ID NO: 2195811 - RNA, 17 nt, Homo sapiens
gaccuauggcagagcau

SEQ ID NO: 2195812 - RNA, 15 nt, Homo sapiens
gagacaaaaaggaaa

SEQ ID NO: 2195813 - RNA, 12 nt, Homo sapiens
aggaacagggaa

SEQ ID NO: 2195814 - RNA, 17 nt, Homo sapiens
uaauaauaauuugcacu

SEQ ID NO: 2195815 - RNA, 23 nt, Homo sapiens
ucuuauuuuuuucgccuucacug

SEQ ID NO: 2195816 - RNA, 17 nt, Homo sapiens
cuuccgcauccuagucu

SEQ ID NO: 2195817 - RNA, 21 nt, Homo sapiens
ugaagauauucuacuaugcau

SEQ ID NO: 2195818 - RNA, 18 nt, Homo sapiens
gcagacuggauugggaua

SEQ ID NO: 2195819 - RNA, 21 nt, Homo sapiens
gacuucaccuaacuagagaca

SEQ ID NO: 2195820 - RNA, 19 nt, Homo sapiens
acauucuuaaauauuucca

SEQ ID NO: 2195821 - RNA, 15 nt, Homo sapiens
acgccagcuccucuc

SEQ ID NO: 2195822 - RNA, 18 nt, Homo sapiens
gaaaggcaucuaagacau

SEQ ID NO: 2195823 - RNA, 22 nt, Homo sapiens
uacuccaguauaugcugaugga

SEQ ID NO: 2195824 - RNA, 16 nt, Homo sapiens
aguagagcacuuuuca

SEQ ID NO: 2195825 - RNA, 15 nt, Homo sapiens
ugucuuuggcuucag

SEQ ID NO: 2195826 - RNA, 14 nt, Homo sapiens
acagagcuccuggc

SEQ ID NO: 2195827 - RNA, 12 nt, Homo sapiens
ucacagaggcau

SEQ ID NO: 2195828 - RNA, 15 nt, Homo sapiens
cucugauaugggacu

SEQ ID NO: 2195829 - RNA, 16 nt, Homo sapiens
ugaaaggucaucucau

SEQ ID NO: 2195830 - RNA, 16 nt, Homo sapiens
agacuggaaaaggugg

SEQ ID NO: 2195831 - RNA, 13 nt, Homo sapiens
agaacaacuugcu

SEQ ID NO: 2195832 - RNA, 14 nt, Homo sapiens
ucugucacccagac

SEQ ID NO: 2195833 - RNA, 19 nt, Homo sapiens
ggacugagaaauuauacuu

SEQ ID NO: 2195834 - RNA, 19 nt, Homo sapiens
aaaugugcagcucccauuu

SEQ ID NO: 2195835 - RNA, 16 nt, Homo sapiens
cuuccuguccagagag

SEQ ID NO: 2195836 - RNA, 21 nt, Homo sapiens
augaacacagccugggaccag

SEQ ID NO: 2195837 - RNA, 13 nt, Homo sapiens
ggcuccugucauc

SEQ ID NO: 2195838 - RNA, 13 nt, Homo sapiens
agaaggugccgug

SEQ ID NO: 2195839 - RNA, 16 nt, Homo sapiens
uuuacuguccaaagac

SEQ ID NO: 2195840 - RNA, 15 nt, Homo sapiens
agaagauaaugacuu

SEQ ID NO: 2195841 - RNA, 13 nt, Homo sapiens
ccacccuucucag

SEQ ID NO: 2195842 - RNA, 11 nt, Homo sapiens
cuauacauucc

SEQ ID NO: 2195843 - RNA, 20 nt, Homo sapiens
ugccauucuucuggugcuac

SEQ ID NO: 2195844 - RNA, 17 nt, Homo sapiens
gcccugaggccuagacu

SEQ ID NO: 2195845 - RNA, 17 nt, Homo sapiens
caauucaccaacacagu

SEQ ID NO: 2195846 - RNA, 14 nt, Homo sapiens
uuuggcuuugcaaa

SEQ ID NO: 2195847 - RNA, 20 nt, Homo sapiens
aaagagcgucauguccuugg

SEQ ID NO: 2195848 - RNA, 12 nt, Homo sapiens
cugugcauuuau

SEQ ID NO: 2195849 - RNA, 13 nt, Homo sapiens
cuuuucucugaaa

SEQ ID NO: 2195850 - RNA, 15 nt, Homo sapiens
uuuugggaaaacugg

SEQ ID NO: 2195851 - RNA, 10 nt, Homo sapiens
aucauauuca

SEQ ID NO: 2195852 - RNA, 18 nt, Homo sapiens
cuuuuuccugugacaaaa

SEQ ID NO: 2195853 - RNA, 16 nt, Homo sapiens
aagcaauucugacugu

SEQ ID NO: 2195854 - RNA, 19 nt, Homo sapiens
cuagguggagguugugcau

SEQ ID NO: 2195855 - RNA, 21 nt, Homo sapiens
cagcgagggcaccuugugauc

SEQ ID NO: 2195856 - RNA, 13 nt, Homo sapiens
aaauucauaucca

SEQ ID NO: 2195857 - RNA, 13 nt, Homo sapiens
uuccacauuaauu

SEQ ID NO: 2195858 - RNA, 16 nt, Homo sapiens
cauccuucuaagacau

SEQ ID NO: 2195859 - RNA, 18 nt, Homo sapiens
uaugauauaacaugugua

SEQ ID NO: 2195860 - RNA, 22 nt, Homo sapiens
uccacuuguucauucugugacc

SEQ ID NO: 2195861 - RNA, 20 nt, Homo sapiens
caaagugcuagccacuggaa

SEQ ID NO: 2195862 - RNA, 19 nt, Homo sapiens
aaugccccuguucauguuu

SEQ ID NO: 2195863 - RNA, 17 nt, Homo sapiens
caauaaaccacaagcau

SEQ ID NO: 2195864 - RNA, 15 nt, Homo sapiens
uuuaaugugaacucu

SEQ ID NO: 2195865 - RNA, 16 nt, Homo sapiens
aucucagggaacugac

SEQ ID NO: 2195866 - RNA, 19 nt, Homo sapiens
uggggaccagagcugccac

SEQ ID NO: 2195867 - RNA, 20 nt, Homo sapiens
uuaaaggaauuaaacuaaaa

SEQ ID NO: 2195868 - RNA, 19 nt, Homo sapiens
uauccagaugaacugagaa

SEQ ID NO: 2195869 - RNA, 16 nt, Homo sapiens
uuucauuugccuauuc

SEQ ID NO: 2195870 - RNA, 14 nt, Homo sapiens
auauacaaauguau

SEQ ID NO: 2195871 - RNA, 19 nt, Homo sapiens
uuacagugaugccaugaag

SEQ ID NO: 2195872 - RNA, 21 nt, Homo sapiens
uggaaagacaaacugcacagg

SEQ ID NO: 2195873 - RNA, 17 nt, Homo sapiens
aagagacaggcagguga

SEQ ID NO: 2195874 - RNA, 20 nt, Homo sapiens
agagggggccuucacaguga

SEQ ID NO: 2195875 - RNA, 22 nt, Homo sapiens
uugagugugauuugaaugauuu

SEQ ID NO: 2195876 - RNA, 20 nt, Homo sapiens
gucagaacuauaacauucaa

SEQ ID NO: 2195877 - RNA, 17 nt, Homo sapiens
cucuucaugcuugacau

SEQ ID NO: 2195878 - RNA, 20 nt, Homo sapiens
agcccacuguuaauauucua

SEQ ID NO: 2195879 - RNA, 22 nt, Homo sapiens
acuugggugacggcagucgaug

SEQ ID NO: 2195880 - RNA, 15 nt, Homo sapiens
aauauaaauucacuu

SEQ ID NO: 2195881 - RNA, 15 nt, Homo sapiens
ucacgcaggagccau

SEQ ID NO: 2195882 - RNA, 20 nt, Homo sapiens
gguggaaaucaacccucucc

SEQ ID NO: 2195883 - RNA, 17 nt, Homo sapiens
aguacauaauacacuug

SEQ ID NO: 2195884 - RNA, 23 nt, Homo sapiens
gaaauguugagggcaagccacca

SEQ ID NO: 2195885 - RNA, 16 nt, Homo sapiens
cuggcaugacacucua

SEQ ID NO: 2195886 - RNA, 23 nt, Homo sapiens
gccguaguggaauuaacaggaaa

SEQ ID NO: 2195887 - RNA, 17 nt, Homo sapiens
auuuugaaaugaacuuu

SEQ ID NO: 2195888 - RNA, 16 nt, Homo sapiens
ggaccaccaauggauu

SEQ ID NO: 2195889 - RNA, 21 nt, Homo sapiens
cuguguucucaccgugaucaa

SEQ ID NO: 2195890 - RNA, 21 nt, Homo sapiens
agaaaugauaagugacaaaag

SEQ ID NO: 2195891 - RNA, 16 nt, Homo sapiens
cuaggauuucagccau

SEQ ID NO: 2195892 - RNA, 22 nt, Homo sapiens
cccucagauuugaugauuuccu

SEQ ID NO: 2195893 - RNA, 16 nt, Homo sapiens
cagguuauacuccucc

SEQ ID NO: 2195894 - RNA, 22 nt, Homo sapiens
agagccaccaaagucacaucca

SEQ ID NO: 2195895 - RNA, 12 nt, Homo sapiens
ugguaucucuuu

SEQ ID NO: 2195896 - RNA, 14 nt, Homo sapiens
ccccucucaccaaa

SEQ ID NO: 2195897 - RNA, 14 nt, Homo sapiens
auaaacuccuacua

SEQ ID NO: 2195898 - RNA, 14 nt, Homo sapiens
cauuguuggcagca

SEQ ID NO: 2195899 - RNA, 19 nt, Homo sapiens
aauccuucuuauguuucua

SEQ ID NO: 2195900 - RNA, 17 nt, Homo sapiens
uggccaugcuucuugcc

SEQ ID NO: 2195901 - RNA, 20 nt, Homo sapiens
acaccuuuuccccaaccaca

SEQ ID NO: 2195902 - RNA, 15 nt, Homo sapiens
guccuucuuuccucu

SEQ ID NO: 2195903 - RNA, 16 nt, Homo sapiens
ugacagggaaaacugc

SEQ ID NO: 2195904 - RNA, 22 nt, Homo sapiens
ccauuucagaugcaaucacuuu

SEQ ID NO: 2195905 - RNA, 21 nt, Homo sapiens
ugacacgugauggaccaaagc

SEQ ID NO: 2195906 - RNA, 16 nt, Homo sapiens
gaguucuuuauauuca

SEQ ID NO: 2195907 - RNA, 17 nt, Homo sapiens
gaucauagucgggcaua

SEQ ID NO: 2195908 - RNA, 18 nt, Homo sapiens
cuauauuuauuugacuca

SEQ ID NO: 2195909 - RNA, 18 nt, Homo sapiens
ugagagugucucugauaa

SEQ ID NO: 2195910 - RNA, 14 nt, Homo sapiens
acucugcugucuaa

SEQ ID NO: 2195911 - RNA, 17 nt, Homo sapiens
caaauugggccaaagaa

SEQ ID NO: 2195912 - RNA, 14 nt, Homo sapiens
acugcggaguccag

SEQ ID NO: 2195913 - RNA, 14 nt, Homo sapiens
auccaugagcugcu

SEQ ID NO: 2195914 - RNA, 18 nt, Homo sapiens
cauucuuuaucuugacau

SEQ ID NO: 2195915 - RNA, 15 nt, Homo sapiens
acaguguuucuggcu

SEQ ID NO: 2195916 - RNA, 16 nt, Homo sapiens
aacauggagaacuugc

SEQ ID NO: 2195917 - RNA, 19 nt, Homo sapiens
uucagaaagccuauuccau

SEQ ID NO: 2195918 - RNA, 13 nt, Homo sapiens
cccagaugcucuc

SEQ ID NO: 2195919 - RNA, 18 nt, Homo sapiens
aaugcuuuuugaguuuca

SEQ ID NO: 2195920 - RNA, 20 nt, Homo sapiens
uguuugugaaacaaaaaagu

SEQ ID NO: 2195921 - RNA, 22 nt, Homo sapiens
uugagcaacuaacuaaccacau

SEQ ID NO: 2195922 - RNA, 14 nt, Homo sapiens
caacagcaaaggaa

SEQ ID NO: 2195923 - RNA, 13 nt, Homo sapiens
ggcugcaagccca

SEQ ID NO: 2195924 - RNA, 15 nt, Homo sapiens
auauuuuguguauaa

SEQ ID NO: 2195925 - RNA, 23 nt, Homo sapiens
guauuucaccucuacauuugaaa

SEQ ID NO: 2195926 - RNA, 22 nt, Homo sapiens
agcuguagcucccgagcuacuc

SEQ ID NO: 2195927 - RNA, 20 nt, Homo sapiens
ugcuuucuccuucacagcua

SEQ ID NO: 2195928 - RNA, 22 nt, Homo sapiens
uccuccccauguacccaaggaa

SEQ ID NO: 2195929 - RNA, 13 nt, Homo sapiens
gauaaucugagca

SEQ ID NO: 2195930 - RNA, 15 nt, Homo sapiens
caguaaaaucaaaug

SEQ ID NO: 2195931 - RNA, 22 nt, Homo sapiens
acuauuuaagagaacaagcaaa

SEQ ID NO: 2195932 - RNA, 14 nt, Homo sapiens
cuuuguguuugcuu

SEQ ID NO: 2195933 - RNA, 23 nt, Homo sapiens
aacuaauuuuuauuuuugcugag

SEQ ID NO: 2195934 - RNA, 19 nt, Homo sapiens
cagcacagagcaguggcca

SEQ ID NO: 2195935 - RNA, 18 nt, Homo sapiens
aucaaucaagacugcaaa

SEQ ID NO: 2195936 - RNA, 21 nt, Homo sapiens
gcaggaagcaacgaagggaaa

SEQ ID NO: 2195937 - RNA, 20 nt, Homo sapiens
guuacuuuuucuuguauuca

SEQ ID NO: 2195938 - RNA, 12 nt, Homo sapiens
uccucuccagcu

SEQ ID NO: 2195939 - RNA, 12 nt, Homo sapiens
acuacuccugua

SEQ ID NO: 2195940 - RNA, 14 nt, Homo sapiens
cuuuggccaaaacc

SEQ ID NO: 2195941 - RNA, 23 nt, Homo sapiens
cagaaccauccauaguaguauga

SEQ ID NO: 2195942 - RNA, 21 nt, Homo sapiens
caacagaugaccguguacaau

SEQ ID NO: 2195943 - RNA, 14 nt, Homo sapiens
gaacaguagcuuug

SEQ ID NO: 2195944 - RNA, 12 nt, Homo sapiens
ccaggcucugcc

SEQ ID NO: 2195945 - RNA, 21 nt, Homo sapiens
accguuuugaagcuacugugu

SEQ ID NO: 2195946 - RNA, 20 nt, Homo sapiens
ggguugguauggaguuggca

SEQ ID NO: 2195947 - RNA, 18 nt, Homo sapiens
uacacauaugugcuucuc

SEQ ID NO: 2195948 - RNA, 18 nt, Homo sapiens
aguucuaaauacaggaaa

SEQ ID NO: 2195949 - RNA, 22 nt, Homo sapiens
ccgccgcgggccgucugcacuu

SEQ ID NO: 2195950 - RNA, 18 nt, Homo sapiens
uaaaauuauuacuaauga

SEQ ID NO: 2195951 - RNA, 21 nt, Homo sapiens
ucuaaaccaaaaauuaugugu

SEQ ID NO: 2195952 - RNA, 12 nt, Homo sapiens
uugcaaacuaug

SEQ ID NO: 2195953 - RNA, 20 nt, Homo sapiens
caauuauuaccaucucucca

SEQ ID NO: 2195954 - RNA, 13 nt, Homo sapiens
cacugcacuccag

SEQ ID NO: 2195955 - RNA, 13 nt, Homo sapiens
cacagcacuccug

SEQ ID NO: 2195956 - RNA, 20 nt, Homo sapiens
uuacguaaaccugaaauaua

SEQ ID NO: 2195957 - RNA, 17 nt, Homo sapiens
ccugaugaaaaauaugu

SEQ ID NO: 2195958 - RNA, 18 nt, Homo sapiens
ucuguaaguguagcucaa

SEQ ID NO: 2195959 - RNA, 14 nt, Homo sapiens
guuuaccuucaugg

SEQ ID NO: 2195960 - RNA, 14 nt, Homo sapiens
ccuuugucccccaa

SEQ ID NO: 2195961 - RNA, 20 nt, Homo sapiens
agcagguuuauccagaugaa

SEQ ID NO: 2195962 - RNA, 17 nt, Homo sapiens
uuaccuaguuugcacua

SEQ ID NO: 2195963 - RNA, 12 nt, Homo sapiens
cggaaagccuuc

SEQ ID NO: 2195964 - RNA, 21 nt, Homo sapiens
aggggccugcccucaucauca

SEQ ID NO: 2195965 - RNA, 21 nt, Homo sapiens
cccagcuccuuucuccuguga

SEQ ID NO: 2195966 - RNA, 18 nt, Homo sapiens
uccacaggcuccccaucu

SEQ ID NO: 2195967 - RNA, 12 nt, Homo sapiens
agaaucaaauac

SEQ ID NO: 2195968 - RNA, 17 nt, Homo sapiens
cucaggccaguaauccc

SEQ ID NO: 2195969 - RNA, 17 nt, Homo sapiens
ucuaauuagucuaucaa

SEQ ID NO: 2195970 - RNA, 14 nt, Homo sapiens
gcugucuaccugaa

SEQ ID NO: 2195971 - RNA, 20 nt, Homo sapiens
ucucaauucaaauccauaga

SEQ ID NO: 2195972 - RNA, 20 nt, Homo sapiens
uuaaucaguuguuuaauaau

SEQ ID NO: 2195973 - RNA, 16 nt, Homo sapiens
cacaugccuugcaaug

SEQ ID NO: 2195974 - RNA, 18 nt, Homo sapiens
caaaaucugggaccaaaa

SEQ ID NO: 2195975 - RNA, 18 nt, Homo sapiens
uaacucuaccugcacacu

SEQ ID NO: 2195976 - RNA, 16 nt, Homo sapiens
cugaaaggaagcugug

SEQ ID NO: 2195977 - RNA, 19 nt, Homo sapiens
auuguggagccaaagccga

SEQ ID NO: 2195978 - RNA, 18 nt, Homo sapiens
gccccuccuugcaaccag

SEQ ID NO: 2195979 - RNA, 20 nt, Homo sapiens
gagccaccacguccagcugg

SEQ ID NO: 2195980 - RNA, 19 nt, Homo sapiens
ugaauaagacaacaaagag

SEQ ID NO: 2195981 - RNA, 12 nt, Homo sapiens
uauagcauuaau

SEQ ID NO: 2195982 - RNA, 24 nt, Homo sapiens
auuuaaaaaaaaagucagagacag

SEQ ID NO: 2195983 - RNA, 15 nt, Homo sapiens
ccuagccaauucaca

SEQ ID NO: 2195984 - RNA, 14 nt, Homo sapiens
gcuucuccuggacc

SEQ ID NO: 2195985 - RNA, 16 nt, Homo sapiens
ccauucuccugccuca

SEQ ID NO: 2195986 - RNA, 19 nt, Homo sapiens
agcuuucaugaccauacaa

SEQ ID NO: 2195987 - RNA, 19 nt, Homo sapiens
auaaguaucacacuguaua

SEQ ID NO: 2195988 - RNA, 12 nt, Homo sapiens
gccccacuuuga

SEQ ID NO: 2195989 - RNA, 19 nt, Homo sapiens
ggccucuucucaacuuuuu

SEQ ID NO: 2195990 - RNA, 20 nt, Homo sapiens
uccuugauguacagauuuua

SEQ ID NO: 2195991 - RNA, 22 nt, Homo sapiens
cauauugcaaccuaguacuuua

SEQ ID NO: 2195992 - RNA, 22 nt, Homo sapiens
aaaaauggaacuguacacuugu

SEQ ID NO: 2195993 - RNA, 20 nt, Homo sapiens
ucugugauuacauagaucag

SEQ ID NO: 2195994 - RNA, 18 nt, Homo sapiens
accgaacaugaccaaaaa

SEQ ID NO: 2195995 - RNA, 15 nt, Homo sapiens
acucugaauccucau

SEQ ID NO: 2195996 - RNA, 21 nt, Homo sapiens
ccacaaggcugaaaagugcuu

SEQ ID NO: 2195997 - RNA, 14 nt, Homo sapiens
uauaauagaugaca

SEQ ID NO: 2195998 - RNA, 15 nt, Homo sapiens
cuuccucuccacugc

SEQ ID NO: 2195999 - RNA, 18 nt, Homo sapiens
aggaggccaccucuccaa

SEQ ID NO: 2196000 - RNA, 20 nt, Homo sapiens
ucuuuagugcuuucuuguca

SEQ ID NO: 2196001 - RNA, 22 nt, Homo sapiens
caguacuuugaauuuuagcaca

SEQ ID NO: 2196002 - RNA, 14 nt, Homo sapiens
uaugccacugaccg

SEQ ID NO: 2196003 - RNA, 14 nt, Homo sapiens
uuuuauuacucuca

SEQ ID NO: 2196004 - RNA, 13 nt, Homo sapiens
aggcaccaggaag

SEQ ID NO: 2196005 - RNA, 16 nt, Homo sapiens
caguacacucuggcca

SEQ ID NO: 2196006 - RNA, 19 nt, Homo sapiens
agcaacaugcuucaugaaa

SEQ ID NO: 2196007 - RNA, 11 nt, Homo sapiens
cuucuuaacau

SEQ ID NO: 2196008 - RNA, 16 nt, Homo sapiens
cugagaucagugccuc

SEQ ID NO: 2196009 - RNA, 17 nt, Homo sapiens
gucuagcaaagccacca

SEQ ID NO: 2196010 - RNA, 18 nt, Homo sapiens
ccgaccaacuccagacuu

SEQ ID NO: 2196011 - RNA, 13 nt, Homo sapiens
uaaauucauaucc

SEQ ID NO: 2196012 - RNA, 19 nt, Homo sapiens
caugagcaaguuuccuuga

SEQ ID NO: 2196013 - RNA, 18 nt, Homo sapiens
acagaacaugcuguuauu

SEQ ID NO: 2196014 - RNA, 14 nt, Homo sapiens
cuuccuggcuguaa

SEQ ID NO: 2196015 - RNA, 15 nt, Homo sapiens
ugccuguacuacucu

SEQ ID NO: 2196016 - RNA, 15 nt, Homo sapiens
cuaaucuaugcaugu

SEQ ID NO: 2196017 - RNA, 14 nt, Homo sapiens
uuuaaauagaccuc

SEQ ID NO: 2196018 - RNA, 18 nt, Homo sapiens
acaauuuucuaccacugg

SEQ ID NO: 2196019 - RNA, 21 nt, Homo sapiens
gugacuugaacuagauugcau

SEQ ID NO: 2196020 - RNA, 22 nt, Homo sapiens
auguuguguuucuguucaccuu

SEQ ID NO: 2196021 - RNA, 14 nt, Homo sapiens
uggcagcaugacuc

SEQ ID NO: 2196022 - RNA, 18 nt, Homo sapiens
uuuuagcgugcucacuga

SEQ ID NO: 2196023 - RNA, 16 nt, Homo sapiens
auccaauuaugugaca

SEQ ID NO: 2196024 - RNA, 22 nt, Homo sapiens
gucuggcaaugggacucugaga

SEQ ID NO: 2196025 - RNA, 14 nt, Homo sapiens
accagaaccaguua

SEQ ID NO: 2196026 - RNA, 23 nt, Homo sapiens
gccuccuguguacugugucauaa

SEQ ID NO: 2196027 - RNA, 15 nt, Homo sapiens
uuuaauugugaauua

SEQ ID NO: 2196028 - RNA, 15 nt, Homo sapiens
uuuuacugugauuca

SEQ ID NO: 2196029 - RNA, 14 nt, Homo sapiens
uuguaacugccuac

SEQ ID NO: 2196030 - RNA, 18 nt, Homo sapiens
ccucaccugguugaccca

SEQ ID NO: 2196031 - RNA, 15 nt, Homo sapiens
aaacuugcuuaucaa

SEQ ID NO: 2196032 - RNA, 22 nt, Homo sapiens
gugggucuaccucaucucugaa

SEQ ID NO: 2196033 - RNA, 20 nt, Homo sapiens
cucucaaguagcugggacua

SEQ ID NO: 2196034 - RNA, 17 nt, Homo sapiens
agggugaggcugacaca

SEQ ID NO: 2196035 - RNA, 18 nt, Homo sapiens
ggaacagaaggaugaaug

SEQ ID NO: 2196036 - RNA, 16 nt, Homo sapiens
ccugaacuaaucugau

SEQ ID NO: 2196037 - RNA, 15 nt, Homo sapiens
caaguaacacuuuaa

SEQ ID NO: 2196038 - RNA, 20 nt, Homo sapiens
accuccaacacagugcaucu

SEQ ID NO: 2196039 - RNA, 20 nt, Homo sapiens
aauaaaauuuaucuuguuca

SEQ ID NO: 2196040 - RNA, 18 nt, Homo sapiens
ucugaacucugacagauu

SEQ ID NO: 2196041 - RNA, 16 nt, Homo sapiens
auuuacauccagcuuc

SEQ ID NO: 2196042 - RNA, 17 nt, Homo sapiens
acaugcccuccuggaca

SEQ ID NO: 2196043 - RNA, 13 nt, Homo sapiens
aguggagccugaa

SEQ ID NO: 2196044 - RNA, 23 nt, Homo sapiens
ggaaggugccacuccagugccca

SEQ ID NO: 2196045 - RNA, 16 nt, Homo sapiens
caaaucugccaagaga

SEQ ID NO: 2196046 - RNA, 16 nt, Homo sapiens
ccauuauuaugcaaaa

SEQ ID NO: 2196047 - RNA, 14 nt, Homo sapiens
gccagcaaugacau

SEQ ID NO: 2196048 - RNA, 18 nt, Homo sapiens
aacguuugucauuccagu

SEQ ID NO: 2196049 - RNA, 22 nt, Homo sapiens
cugugacaaaacaucuuuucac

SEQ ID NO: 2196050 - RNA, 22 nt, Homo sapiens
caucuuuucuguugccccaucc

SEQ ID NO: 2196051 - RNA, 15 nt, Homo sapiens
ccaguccugguuggg

SEQ ID NO: 2196052 - RNA, 23 nt, Homo sapiens
ccuuucccucucccaguccauuu

SEQ ID NO: 2196053 - RNA, 17 nt, Homo sapiens
uugacaaauguaaacau

SEQ ID NO: 2196054 - RNA, 17 nt, Homo sapiens
gauaugaagaaucugcu

SEQ ID NO: 2196055 - RNA, 22 nt, Homo sapiens
ugugguaaccagcccugcacga

SEQ ID NO: 2196056 - RNA, 20 nt, Homo sapiens
gguacuucaggggcacuuca

SEQ ID NO: 2196057 - RNA, 17 nt, Homo sapiens
uccucuuaauguuucca

SEQ ID NO: 2196058 - RNA, 21 nt, Homo sapiens
cuuauguuuaguuucaauauu

SEQ ID NO: 2196059 - RNA, 17 nt, Homo sapiens
cugugcuguacugagca

SEQ ID NO: 2196060 - RNA, 13 nt, Homo sapiens
ccagugcagggaa

SEQ ID NO: 2196061 - RNA, 17 nt, Homo sapiens
uguaguucuugugcaug

SEQ ID NO: 2196062 - RNA, 16 nt, Homo sapiens
ccccugcagcugcaag

SEQ ID NO: 2196063 - RNA, 14 nt, Homo sapiens
ccuaaucuguaauc

SEQ ID NO: 2196064 - RNA, 19 nt, Homo sapiens
accccagggcccuggccag

SEQ ID NO: 2196065 - RNA, 14 nt, Homo sapiens
augcacguagcuga

SEQ ID NO: 2196066 - RNA, 13 nt, Homo sapiens
uggaugugcauuu

SEQ ID NO: 2196067 - RNA, 11 nt, Homo sapiens
agaaaaccaaa

SEQ ID NO: 2196068 - RNA, 16 nt, Homo sapiens
cuggcaucucacuuua

SEQ ID NO: 2196069 - RNA, 19 nt, Homo sapiens
guuagagcuggcaccagaa

SEQ ID NO: 2196070 - RNA, 14 nt, Homo sapiens
uggaacuuuaguga

SEQ ID NO: 2196071 - RNA, 15 nt, Homo sapiens
ucuuucuaaacuaca

SEQ ID NO: 2196072 - RNA, 22 nt, Homo sapiens
agcuccagugcuuuauccacau

SEQ ID NO: 2196073 - RNA, 13 nt, Homo sapiens
gcugaaaaucacu

SEQ ID NO: 2196074 - RNA, 15 nt, Homo sapiens
ccuaaggaaacugcu

SEQ ID NO: 2196075 - RNA, 14 nt, Homo sapiens
augaaggcuuguca

SEQ ID NO: 2196076 - RNA, 19 nt, Homo sapiens
caacuacagaaaaaccaga

SEQ ID NO: 2196077 - RNA, 19 nt, Homo sapiens
uugauauuuauuuuuugcc

SEQ ID NO: 2196078 - RNA, 19 nt, Homo sapiens
ucuggcccacacagaucug

SEQ ID NO: 2196079 - RNA, 19 nt, Homo sapiens
uacagaaaguggugcucag

SEQ ID NO: 2196080 - RNA, 23 nt, Homo sapiens
uuaauaugcuguggggcauagaa

SEQ ID NO: 2196081 - RNA, 19 nt, Homo sapiens
ucuucaauaguuuuaccua

SEQ ID NO: 2196082 - RNA, 18 nt, Homo sapiens
guaccugccauaacauaa

SEQ ID NO: 2196083 - RNA, 13 nt, Homo sapiens
agcacaucaccuc

SEQ ID NO: 2196084 - RNA, 19 nt, Homo sapiens
acucauuaaugaaucacau

SEQ ID NO: 2196085 - RNA, 18 nt, Homo sapiens
cuuguauuucuagcauua

SEQ ID NO: 2196086 - RNA, 16 nt, Homo sapiens
accagggaguggccau

SEQ ID NO: 2196087 - RNA, 23 nt, Homo sapiens
auaaacgaggaaaagguccuugc

SEQ ID NO: 2196088 - RNA, 19 nt, Homo sapiens
ccuugaagacauaucaugu

SEQ ID NO: 2196089 - RNA, 16 nt, Homo sapiens
uccuuggcaccaaaga

SEQ ID NO: 2196090 - RNA, 15 nt, Homo sapiens
uacuacugcucucaa

SEQ ID NO: 2196091 - RNA, 19 nt, Homo sapiens
guggcucugggguccucac

SEQ ID NO: 2196092 - RNA, 17 nt, Homo sapiens
aaccaccaccaaccacu

SEQ ID NO: 2196093 - RNA, 15 nt, Homo sapiens
uccagaaauaccugu

SEQ ID NO: 2196094 - RNA, 14 nt, Homo sapiens
caugugugcaaaaa

SEQ ID NO: 2196095 - RNA, 17 nt, Homo sapiens
cagacuuucuacaugca

SEQ ID NO: 2196096 - RNA, 13 nt, Homo sapiens
ccguuuaccuaga

SEQ ID NO: 2196097 - RNA, 15 nt, Homo sapiens
gcacuaaccccagcu

SEQ ID NO: 2196098 - RNA, 20 nt, Homo sapiens
aaccuugggaagauguauca

SEQ ID NO: 2196099 - RNA, 14 nt, Homo sapiens
aucuaugagcuucu

SEQ ID NO: 2196100 - RNA, 19 nt, Homo sapiens
aggagaaaagaaaugcacu

SEQ ID NO: 2196101 - RNA, 16 nt, Homo sapiens
gaaacuucgccagcug

SEQ ID NO: 2196102 - RNA, 15 nt, Homo sapiens
aaaucugagaucucc

SEQ ID NO: 2196103 - RNA, 14 nt, Homo sapiens
cggcuccugcaaaa

SEQ ID NO: 2196104 - RNA, 20 nt, Homo sapiens
auacaugcauacacucucaa

SEQ ID NO: 2196105 - RNA, 21 nt, Homo sapiens
cuuggccccucccucccggcu

SEQ ID NO: 2196106 - RNA, 17 nt, Homo sapiens
uccacagccaugcccuu

SEQ ID NO: 2196107 - RNA, 15 nt, Homo sapiens
aauuugcaccaguuu

SEQ ID NO: 2196108 - RNA, 19 nt, Homo sapiens
agaaaacaagguccaguaa

SEQ ID NO: 2196109 - RNA, 17 nt, Homo sapiens
uuaauagucauuccaaa

SEQ ID NO: 2196110 - RNA, 11 nt, Homo sapiens
aaaccaaagau

SEQ ID NO: 2196111 - RNA, 20 nt, Homo sapiens
aacacauugccuaacuacua

SEQ ID NO: 2196112 - RNA, 21 nt, Homo sapiens
cuuuuaguauuuuagugaacu

SEQ ID NO: 2196113 - RNA, 18 nt, Homo sapiens
uaaagagugcuacauggu

SEQ ID NO: 2196114 - RNA, 17 nt, Homo sapiens
guguuacugcuuugcaa

SEQ ID NO: 2196115 - RNA, 18 nt, Homo sapiens
caaaauuaugcugcauuu

SEQ ID NO: 2196116 - RNA, 17 nt, Homo sapiens
cuguuaaaauugcucau

SEQ ID NO: 2196117 - RNA, 18 nt, Homo sapiens
aaguauucugccuuugca

SEQ ID NO: 2196118 - RNA, 22 nt, Homo sapiens
uauuggcugauuuagaccaaaa

SEQ ID NO: 2196119 - RNA, 13 nt, Homo sapiens
caauuagcauuau

SEQ ID NO: 2196120 - RNA, 15 nt, Homo sapiens
cccaucucuacugaa

SEQ ID NO: 2196121 - RNA, 21 nt, Homo sapiens
uagaggaaggagauagggaaa

SEQ ID NO: 2196122 - RNA, 18 nt, Homo sapiens
aaacacuauuucuggaau

SEQ ID NO: 2196123 - RNA, 14 nt, Homo sapiens
acugaaagugaaag

SEQ ID NO: 2196124 - RNA, 16 nt, Homo sapiens
gacaccaucaccacgc

SEQ ID NO: 2196125 - RNA, 19 nt, Homo sapiens
gcaucaucugcacugccca

SEQ ID NO: 2196126 - RNA, 15 nt, Homo sapiens
cacacuguaucguga

SEQ ID NO: 2196127 - RNA, 22 nt, Homo sapiens
ucuugcgauaguuuacugagaa

SEQ ID NO: 2196128 - RNA, 16 nt, Homo sapiens
ugauggggccuggguu

SEQ ID NO: 2196129 - RNA, 12 nt, Homo sapiens
gaccgacugcac

SEQ ID NO: 2196130 - RNA, 18 nt, Homo sapiens
caacaacuucuccauccu

SEQ ID NO: 2196131 - RNA, 22 nt, Homo sapiens
uaaagaaugcaauccaugccau

SEQ ID NO: 2196132 - RNA, 21 nt, Homo sapiens
uucuaugugaccagacugcac

SEQ ID NO: 2196133 - RNA, 14 nt, Homo sapiens
cuuuccugcucugg

SEQ ID NO: 2196134 - RNA, 14 nt, Homo sapiens
uucuaaaguucuaa

SEQ ID NO: 2196135 - RNA, 14 nt, Homo sapiens
auuuaaagauuuaa

SEQ ID NO: 2196136 - RNA, 22 nt, Homo sapiens
auaagauuccaaaaagcacaua

SEQ ID NO: 2196137 - RNA, 18 nt, Homo sapiens
aaccugaauuaaagucua

SEQ ID NO: 2196138 - RNA, 18 nt, Homo sapiens
aguggugcaugcacuguc

SEQ ID NO: 2196139 - RNA, 22 nt, Homo sapiens
cuggagacccaccccaccugca

SEQ ID NO: 2196140 - RNA, 15 nt, Homo sapiens
uccugaucugugaua

SEQ ID NO: 2196141 - RNA, 22 nt, Homo sapiens
ugccauguguggagugugcuga

SEQ ID NO: 2196142 - RNA, 18 nt, Homo sapiens
cuauaccaauaaagugac

SEQ ID NO: 2196143 - RNA, 17 nt, Homo sapiens
aauaucagucacuguuc

SEQ ID NO: 2196144 - RNA, 18 nt, Homo sapiens
gguaucaaaauaguuuag

SEQ ID NO: 2196145 - RNA, 13 nt, Homo sapiens
aauugacaaugau

SEQ ID NO: 2196146 - RNA, 23 nt, Homo sapiens
caggucugaugccaaagcugcuu

SEQ ID NO: 2196147 - RNA, 21 nt, Homo sapiens
aagccuuggggcugaugcagu

SEQ ID NO: 2196148 - RNA, 12 nt, Homo sapiens
uugaaaauguuc

SEQ ID NO: 2196149 - RNA, 12 nt, Homo sapiens
cacccagcaaua

SEQ ID NO: 2196150 - RNA, 21 nt, Homo sapiens
agaaaaaccaaaauacuccaa

SEQ ID NO: 2196151 - RNA, 19 nt, Homo sapiens
agauguauuugaacacuug

SEQ ID NO: 2196152 - RNA, 22 nt, Homo sapiens
ggaugugaugguacacaguggg

SEQ ID NO: 2196153 - RNA, 15 nt, Homo sapiens
cucuggcuugcccca

SEQ ID NO: 2196154 - RNA, 20 nt, Homo sapiens
uauuugggcacaacacauca

SEQ ID NO: 2196155 - RNA, 15 nt, Homo sapiens
agcugcuucugugca

SEQ ID NO: 2196156 - RNA, 16 nt, Homo sapiens
gccaagccaaccgugg

SEQ ID NO: 2196157 - RNA, 20 nt, Homo sapiens
ugcccaaguuguggugcuga

SEQ ID NO: 2196158 - RNA, 21 nt, Homo sapiens
cccaaugggcucaaacuucua

SEQ ID NO: 2196159 - RNA, 19 nt, Homo sapiens
uaaacaucagcaagacuuu

SEQ ID NO: 2196160 - RNA, 20 nt, Homo sapiens
uaacucaccagccccacugc

SEQ ID NO: 2196161 - RNA, 22 nt, Homo sapiens
auguuccccaucuggugcucuu

SEQ ID NO: 2196162 - RNA, 21 nt, Homo sapiens
aacuucaagggacaaguauua

SEQ ID NO: 2196163 - RNA, 19 nt, Homo sapiens
ucaccaagcucacaguucc

SEQ ID NO: 2196164 - RNA, 20 nt, Homo sapiens
gagcucccccguggugccug

SEQ ID NO: 2196165 - RNA, 20 nt, Homo sapiens
ggcuacucugcccaccccag

SEQ ID NO: 2196166 - RNA, 19 nt, Homo sapiens
auuauaaaugaaauuugca

SEQ ID NO: 2196167 - RNA, 14 nt, Homo sapiens
gucccugcaagccc

SEQ ID NO: 2196168 - RNA, 14 nt, Homo sapiens
gugaagaggggcca

SEQ ID NO: 2196169 - RNA, 18 nt, Homo sapiens
gcaugaugaaugaccuga

SEQ ID NO: 2196170 - RNA, 22 nt, Homo sapiens
aagcuaaauccuuuacuguuag

SEQ ID NO: 2196171 - RNA, 14 nt, Homo sapiens
ucucaaaccuggca

SEQ ID NO: 2196172 - RNA, 14 nt, Homo sapiens
ucugccaccugcac

SEQ ID NO: 2196173 - RNA, 14 nt, Homo sapiens
gccuagaaauaucu

SEQ ID NO: 2196174 - RNA, 14 nt, Homo sapiens
gccacauaccucuc

SEQ ID NO: 2196175 - RNA, 23 nt, Homo sapiens
aacgcauaggaaaagaaucuccu

SEQ ID NO: 2196176 - RNA, 18 nt, Homo sapiens
cgaagaaugcuguucuga

SEQ ID NO: 2196177 - RNA, 12 nt, Homo sapiens
uuuacaccaguu

SEQ ID NO: 2196178 - RNA, 22 nt, Homo sapiens
gacaucagcccuuggggguccu

SEQ ID NO: 2196179 - RNA, 16 nt, Homo sapiens
auggaugcggugacaa

SEQ ID NO: 2196180 - RNA, 19 nt, Homo sapiens
augccgagguaaaaguucu

SEQ ID NO: 2196181 - RNA, 16 nt, Homo sapiens
ccaauauaacuaucuc

SEQ ID NO: 2196182 - RNA, 17 nt, Homo sapiens
ucuaagagagcugccau

SEQ ID NO: 2196183 - RNA, 22 nt, Homo sapiens
acccaggcccccugccaguuga

SEQ ID NO: 2196184 - RNA, 15 nt, Homo sapiens
cagaugucuucuugc

SEQ ID NO: 2196185 - RNA, 16 nt, Homo sapiens
uaaauaaccacacuga

SEQ ID NO: 2196186 - RNA, 17 nt, Homo sapiens
ugcuccccuuccugcca

SEQ ID NO: 2196187 - RNA, 21 nt, Homo sapiens
ugagccccuggaggcacugaa

SEQ ID NO: 2196188 - RNA, 14 nt, Homo sapiens
gagaugugcaacac

SEQ ID NO: 2196189 - RNA, 20 nt, Homo sapiens
cagaguaaaauuacagaaga

SEQ ID NO: 2196190 - RNA, 17 nt, Homo sapiens
aaacuaccuauauuccu

SEQ ID NO: 2196191 - RNA, 19 nt, Homo sapiens
uucccccaccgguccagcu

SEQ ID NO: 2196192 - RNA, 21 nt, Homo sapiens
acaaaaggaaagaaacuaccu

SEQ ID NO: 2196193 - RNA, 17 nt, Homo sapiens
uuucacuugcacaucau

SEQ ID NO: 2196194 - RNA, 18 nt, Homo sapiens
uaggaaagaggaagcaaa

SEQ ID NO: 2196195 - RNA, 21 nt, Homo sapiens
gugaauaagccuuacgggaaa

SEQ ID NO: 2196196 - RNA, 18 nt, Homo sapiens
cccaccagggagaugucu

SEQ ID NO: 2196197 - RNA, 23 nt, Homo sapiens
cagcugccagcccaacugugaga

SEQ ID NO: 2196198 - RNA, 17 nt, Homo sapiens
cacccacgagcacuuua

SEQ ID NO: 2196199 - RNA, 19 nt, Homo sapiens
uaagaucuuagauucucug

SEQ ID NO: 2196200 - RNA, 18 nt, Homo sapiens
gccugcauguaaacacgc

SEQ ID NO: 2196201 - RNA, 19 nt, Homo sapiens
auguuuauguaacauaguc

SEQ ID NO: 2196202 - RNA, 19 nt, Homo sapiens
guucuucuguucugcagac

SEQ ID NO: 2196203 - RNA, 13 nt, Homo sapiens
ccuuuguugcaca

SEQ ID NO: 2196204 - RNA, 22 nt, Homo sapiens
uaaagguuuugguugcauuauu

SEQ ID NO: 2196205 - RNA, 13 nt, Homo sapiens
gcuuuucuguauu

SEQ ID NO: 2196206 - RNA, 13 nt, Homo sapiens
ucacuucuuuucu

SEQ ID NO: 2196207 - RNA, 20 nt, Homo sapiens
uuuaugauggagcaacugaa

SEQ ID NO: 2196208 - RNA, 19 nt, Homo sapiens
ccuggguuggagggaacca

SEQ ID NO: 2196209 - RNA, 17 nt, Homo sapiens
gccccgugggcugugcc

SEQ ID NO: 2196210 - RNA, 19 nt, Homo sapiens
ugacccuggagcccggcag

SEQ ID NO: 2196211 - RNA, 15 nt, Homo sapiens
ucuugcuuguaaaaa

SEQ ID NO: 2196212 - RNA, 18 nt, Homo sapiens
ggcugcuucugccacugc

SEQ ID NO: 2196213 - RNA, 13 nt, Homo sapiens
aaguaaacuaaug

SEQ ID NO: 2196214 - RNA, 11 nt, Homo sapiens
uccaaugucaa

SEQ ID NO: 2196215 - RNA, 22 nt, Homo sapiens
acuguggcaaacaaaaccaauu

SEQ ID NO: 2196216 - RNA, 17 nt, Homo sapiens
uauccacaacuuuucaa

SEQ ID NO: 2196217 - RNA, 15 nt, Homo sapiens
caugaaacagaguuu

SEQ ID NO: 2196218 - RNA, 18 nt, Homo sapiens
ucauauuauuuuagugug

SEQ ID NO: 2196219 - RNA, 15 nt, Homo sapiens
aacaugaaaacaauu

SEQ ID NO: 2196220 - RNA, 19 nt, Homo sapiens
gucuugggucgcccuaccc

SEQ ID NO: 2196221 - RNA, 21 nt, Homo sapiens
caccacuuucccacacuguga

SEQ ID NO: 2196222 - RNA, 19 nt, Homo sapiens
uuaucuaacggcuacugaa

SEQ ID NO: 2196223 - RNA, 21 nt, Homo sapiens
gaauaauuguguacaaaguag

SEQ ID NO: 2196224 - RNA, 19 nt, Homo sapiens
ggccuccaccucugugcag

SEQ ID NO: 2196225 - RNA, 23 nt, Homo sapiens
aacgcugaagcggucagacugga

SEQ ID NO: 2196226 - RNA, 23 nt, Homo sapiens
ucccugaaaauguuuuucugcca

SEQ ID NO: 2196227 - RNA, 18 nt, Homo sapiens
aucugcagugaugcaaua

SEQ ID NO: 2196228 - RNA, 19 nt, Homo sapiens
aguuuaacuuccacuguua

SEQ ID NO: 2196229 - RNA, 22 nt, Homo sapiens
ggcuagaagugugaagugcaga

SEQ ID NO: 2196230 - RNA, 17 nt, Homo sapiens
ccaggucuuccagaccu

SEQ ID NO: 2196231 - RNA, 23 nt, Homo sapiens
ggaauuuuccacuucuggcauca

SEQ ID NO: 2196232 - RNA, 16 nt, Homo sapiens
aggcucacagcuggaa

SEQ ID NO: 2196233 - RNA, 18 nt, Homo sapiens
aauauuuucuaaaugucu

SEQ ID NO: 2196234 - RNA, 20 nt, Homo sapiens
uuccccagcugaucauguca

SEQ ID NO: 2196235 - RNA, 14 nt, Homo sapiens
aaugcaguugucuu

SEQ ID NO: 2196236 - RNA, 16 nt, Homo sapiens
auuucuuaccaugcau

SEQ ID NO: 2196237 - RNA, 19 nt, Homo sapiens
cauuaucuagauacuguau

SEQ ID NO: 2196238 - RNA, 18 nt, Homo sapiens
caguguuuuuauugcucg

SEQ ID NO: 2196239 - RNA, 15 nt, Homo sapiens
uucaagccuguuaua

SEQ ID NO: 2196240 - RNA, 19 nt, Homo sapiens
cuauggaaggguaauuuga

SEQ ID NO: 2196241 - RNA, 22 nt, Homo sapiens
cuccagggaugauucaagccau

SEQ ID NO: 2196242 - RNA, 14 nt, Homo sapiens
aagacuucuugggu

SEQ ID NO: 2196243 - RNA, 19 nt, Homo sapiens
acuuucauuaaagcauuua

SEQ ID NO: 2196244 - RNA, 13 nt, Homo sapiens
uguuaagugcagu

SEQ ID NO: 2196245 - RNA, 20 nt, Homo sapiens
agcguuuuuuaaauguauac

SEQ ID NO: 2196246 - RNA, 21 nt, Homo sapiens
gucagaauccuuuacauucaa

SEQ ID NO: 2196247 - RNA, 21 nt, Homo sapiens
aagcacauucgggccauuucc

SEQ ID NO: 2196248 - RNA, 15 nt, Homo sapiens
uagcuuagaccucag

SEQ ID NO: 2196249 - RNA, 22 nt, Homo sapiens
auucaggucccaguugcuguca

SEQ ID NO: 2196250 - RNA, 18 nt, Homo sapiens
aaaagauuccugaaugua

SEQ ID NO: 2196251 - RNA, 22 nt, Homo sapiens
gaauuuguacuucuuauugcaa

SEQ ID NO: 2196252 - RNA, 15 nt, Homo sapiens
gacccugacuguaua

SEQ ID NO: 2196253 - RNA, 13 nt, Homo sapiens
ucacugccccacu

SEQ ID NO: 2196254 - RNA, 23 nt, Homo sapiens
ugaacucgcuagguucuuaucaa

SEQ ID NO: 2196255 - RNA, 23 nt, Homo sapiens
agcugcuccgaggacccaggaaa

SEQ ID NO: 2196256 - RNA, 14 nt, Homo sapiens
cugggaucugagua

SEQ ID NO: 2196257 - RNA, 21 nt, Homo sapiens
cagagucucauucuguugccc

SEQ ID NO: 2196258 - RNA, 21 nt, Homo sapiens
ucagguaaucgaccugccucg

SEQ ID NO: 2196259 - RNA, 15 nt, Homo sapiens
ugcucuggugucaau

SEQ ID NO: 2196260 - RNA, 18 nt, Homo sapiens
ucuguguucccagaggca

SEQ ID NO: 2196261 - RNA, 18 nt, Homo sapiens
cagcgucccuagcaguga

SEQ ID NO: 2196262 - RNA, 18 nt, Homo sapiens
cauaaccacugcuuccau

SEQ ID NO: 2196263 - RNA, 15 nt, Homo sapiens
uuggacacugugcua

SEQ ID NO: 2196264 - RNA, 17 nt, Homo sapiens
aguguaaugugacuuca

SEQ ID NO: 2196265 - RNA, 20 nt, Homo sapiens
cacggaagggcucuuucaca

SEQ ID NO: 2196266 - RNA, 16 nt, Homo sapiens
guugguuccuuuccaa

SEQ ID NO: 2196267 - RNA, 20 nt, Homo sapiens
guuugaaggaggugagggau

SEQ ID NO: 2196268 - RNA, 22 nt, Homo sapiens
cacagcaggcugccagugccug

SEQ ID NO: 2196269 - RNA, 21 nt, Homo sapiens
accaguucuuggccuaugaua

SEQ ID NO: 2196270 - RNA, 22 nt, Homo sapiens
guccaguagggcaggcagucag

SEQ ID NO: 2196271 - RNA, 21 nt, Homo sapiens
gaguccccagaaccagcugca

SEQ ID NO: 2196272 - RNA, 20 nt, Homo sapiens
agagauguguguugauacug

SEQ ID NO: 2196273 - RNA, 16 nt, Homo sapiens
agaggagaaaguggaa

SEQ ID NO: 2196274 - RNA, 22 nt, Homo sapiens
ugggaggccccacccuucuccc

SEQ ID NO: 2196275 - RNA, 20 nt, Homo sapiens
auccagagaccaaauaauua

SEQ ID NO: 2196276 - RNA, 19 nt, Homo sapiens
ugucgccaggcuagagugc

SEQ ID NO: 2196277 - RNA, 19 nt, Homo sapiens
aguguggaagcauagugaa

SEQ ID NO: 2196278 - RNA, 12 nt, Homo sapiens
ccacauugagau

SEQ ID NO: 2196279 - RNA, 15 nt, Homo sapiens
guuucuuaauuugga

SEQ ID NO: 2196280 - RNA, 13 nt, Homo sapiens
uaccaaagugucu

SEQ ID NO: 2196281 - RNA, 19 nt, Homo sapiens
cugccuuaaaaccaaagag

SEQ ID NO: 2196282 - RNA, 23 nt, Homo sapiens
cuacucaggaggcugaggcagaa

SEQ ID NO: 2196283 - RNA, 14 nt, Homo sapiens
aaggaagauucuuc

SEQ ID NO: 2196284 - RNA, 13 nt, Homo sapiens
ugacuacagggcc

SEQ ID NO: 2196285 - RNA, 21 nt, Homo sapiens
ugaccuuguugcaugauguau

SEQ ID NO: 2196286 - RNA, 14 nt, Homo sapiens
auaaauuggcuccu

SEQ ID NO: 2196287 - RNA, 18 nt, Homo sapiens
cauguagcuucuucugaa

SEQ ID NO: 2196288 - RNA, 16 nt, Homo sapiens
ccagcaggucaaaaag

SEQ ID NO: 2196289 - RNA, 22 nt, Homo sapiens
aauuagccauuucacucucaaa

SEQ ID NO: 2196290 - RNA, 17 nt, Homo sapiens
cagccaaaugcagggag

SEQ ID NO: 2196291 - RNA, 15 nt, Homo sapiens
auuuccuuaaagcaa

SEQ ID NO: 2196292 - RNA, 19 nt, Homo sapiens
cauuuaaaacauugcaaau

SEQ ID NO: 2196293 - RNA, 15 nt, Homo sapiens
acuauguagucuguu

SEQ ID NO: 2196294 - RNA, 21 nt, Homo sapiens
cugauguuucucauccuuugc

SEQ ID NO: 2196295 - RNA, 17 nt, Homo sapiens
cuugauucugcaguaaa

SEQ ID NO: 2196296 - RNA, 22 nt, Homo sapiens
gccuggagaaaggauggcagcc

SEQ ID NO: 2196297 - RNA, 22 nt, Homo sapiens
gacaauaaaccuccgccaaugc

SEQ ID NO: 2196298 - RNA, 14 nt, Homo sapiens
ugcuguuccaccuc

SEQ ID NO: 2196299 - RNA, 20 nt, Homo sapiens
caugguuacaaacuacagac

SEQ ID NO: 2196300 - RNA, 15 nt, Homo sapiens
ucucccagccaaguc

SEQ ID NO: 2196301 - RNA, 14 nt, Homo sapiens
cagcgccuccugga

SEQ ID NO: 2196302 - RNA, 16 nt, Homo sapiens
acaccgcucaguauua

SEQ ID NO: 2196303 - RNA, 21 nt, Homo sapiens
cccugguggcuacccaauaga

SEQ ID NO: 2196304 - RNA, 19 nt, Homo sapiens
uguguuucuggagugauuc

SEQ ID NO: 2196305 - RNA, 16 nt, Homo sapiens
aguauuccaugagcug

SEQ ID NO: 2196306 - RNA, 13 nt, Homo sapiens
ccaugaugcacag

SEQ ID NO: 2196307 - RNA, 15 nt, Homo sapiens
agaaauguacuuucu

SEQ ID NO: 2196308 - RNA, 21 nt, Homo sapiens
ugggaagaccagcuuugcagu

SEQ ID NO: 2196309 - RNA, 14 nt, Homo sapiens
ugacugaaacauuc

SEQ ID NO: 2196310 - RNA, 17 nt, Homo sapiens
acgugauggaccaaagc

SEQ ID NO: 2196311 - RNA, 21 nt, Homo sapiens
aaaccugugaaagcugcacuc

SEQ ID NO: 2196312 - RNA, 14 nt, Homo sapiens
gguucacacucaga

SEQ ID NO: 2196313 - RNA, 17 nt, Homo sapiens
ccuccaggaaacaugaa

SEQ ID NO: 2196314 - RNA, 22 nt, Homo sapiens
agcuaaaagaggccuguucaua

SEQ ID NO: 2196315 - RNA, 13 nt, Homo sapiens
caggguaccucaa

SEQ ID NO: 2196316 - RNA, 20 nt, Homo sapiens
cuuccuaucaaaaagauauc

SEQ ID NO: 2196317 - RNA, 17 nt, Homo sapiens
cuugugcuuagcuuuca

SEQ ID NO: 2196318 - RNA, 20 nt, Homo sapiens
ugugauguuaugaauacauu

SEQ ID NO: 2196319 - RNA, 18 nt, Homo sapiens
aauaaugauuuucuugcc

SEQ ID NO: 2196320 - RNA, 14 nt, Homo sapiens
ugccguuucuuuca

SEQ ID NO: 2196321 - RNA, 14 nt, Homo sapiens
cuuaaaaaguauuu

SEQ ID NO: 2196322 - RNA, 20 nt, Homo sapiens
uggcuucucucucucuuuga

SEQ ID NO: 2196323 - RNA, 23 nt, Homo sapiens
ggugggaaaaugcacacauuucu

SEQ ID NO: 2196324 - RNA, 19 nt, Homo sapiens
cuugucuaacuuuugugaa

SEQ ID NO: 2196325 - RNA, 14 nt, Homo sapiens
aauagucaucuccu

SEQ ID NO: 2196326 - RNA, 15 nt, Homo sapiens
acuuccuccuaccug

SEQ ID NO: 2196327 - RNA, 17 nt, Homo sapiens
uauucauaaaguuacag

SEQ ID NO: 2196328 - RNA, 23 nt, Homo sapiens
augauuuguaguggaaacauuua

SEQ ID NO: 2196329 - RNA, 20 nt, Homo sapiens
aguuugcuuugcugaccaaa

SEQ ID NO: 2196330 - RNA, 19 nt, Homo sapiens
cccagcgcggacauccccu

SEQ ID NO: 2196331 - RNA, 15 nt, Homo sapiens
uauccuguuacugaa

SEQ ID NO: 2196332 - RNA, 21 nt, Homo sapiens
cuagcacccuggagagugcac

SEQ ID NO: 2196333 - RNA, 13 nt, Homo sapiens
aauauaaugaguc

SEQ ID NO: 2196334 - RNA, 21 nt, Homo sapiens
gccagucaaaacccaccaaaa

SEQ ID NO: 2196335 - RNA, 19 nt, Homo sapiens
ucucagcucaccucaaccu

SEQ ID NO: 2196336 - RNA, 18 nt, Homo sapiens
uuccuggggaaaagaagc

SEQ ID NO: 2196337 - RNA, 14 nt, Homo sapiens
gucuuggugcuauc

SEQ ID NO: 2196338 - RNA, 15 nt, Homo sapiens
cagacccagucccac

SEQ ID NO: 2196339 - RNA, 13 nt, Homo sapiens
uccuaagcacuuu

SEQ ID NO: 2196340 - RNA, 15 nt, Homo sapiens
ggaggguguggugcu

SEQ ID NO: 2196341 - RNA, 15 nt, Homo sapiens
ggauagagugggaca

SEQ ID NO: 2196342 - RNA, 20 nt, Homo sapiens
cucuuaaaccacagcacuau

SEQ ID NO: 2196343 - RNA, 12 nt, Homo sapiens
caaugaaaccuu

SEQ ID NO: 2196344 - RNA, 18 nt, Homo sapiens
agccugguuugcaaagac

SEQ ID NO: 2196345 - RNA, 13 nt, Homo sapiens
agaaggauuaccu

SEQ ID NO: 2196346 - RNA, 15 nt, Homo sapiens
uggaagugcuugaua

SEQ ID NO: 2196347 - RNA, 15 nt, Homo sapiens
gcagcgguaccccag

SEQ ID NO: 2196348 - RNA, 13 nt, Homo sapiens
gagucccuuccag

SEQ ID NO: 2196349 - RNA, 15 nt, Homo sapiens
aauguaaauacucau

SEQ ID NO: 2196350 - RNA, 13 nt, Homo sapiens
uuaccuucacuua

SEQ ID NO: 2196351 - RNA, 22 nt, Homo sapiens
agguuuguccuggucaugcaca

SEQ ID NO: 2196352 - RNA, 15 nt, Homo sapiens
ccucccaggccaccu

SEQ ID NO: 2196353 - RNA, 19 nt, Homo sapiens
acuggaggaacacagagaa

SEQ ID NO: 2196354 - RNA, 15 nt, Homo sapiens
auacaguagaagcuc

SEQ ID NO: 2196355 - RNA, 22 nt, Homo sapiens
cgucccgggcacugucaugccc

SEQ ID NO: 2196356 - RNA, 17 nt, Homo sapiens
acauaggaaaaugccau

SEQ ID NO: 2196357 - RNA, 18 nt, Homo sapiens
acugacagcaugugcccu

SEQ ID NO: 2196358 - RNA, 16 nt, Homo sapiens
aaaagcacagcucuca

SEQ ID NO: 2196359 - RNA, 17 nt, Homo sapiens
gcagaggacgcacgcuc

SEQ ID NO: 2196360 - RNA, 22 nt, Homo sapiens
caccgcccacucuccaccucac

SEQ ID NO: 2196361 - RNA, 19 nt, Homo sapiens
aggagguuuggggucugcc

SEQ ID NO: 2196362 - RNA, 16 nt, Homo sapiens
uaugcaucugcuacug

SEQ ID NO: 2196363 - RNA, 18 nt, Homo sapiens
ugccagcccguguuucuc

SEQ ID NO: 2196364 - RNA, 14 nt, Homo sapiens
aagcagcucuugcu

SEQ ID NO: 2196365 - RNA, 21 nt, Homo sapiens
gauacagacauucaaugaauu

SEQ ID NO: 2196366 - RNA, 18 nt, Homo sapiens
ccauacuuugucugaaaa

SEQ ID NO: 2196367 - RNA, 14 nt, Homo sapiens
aagaugcucuguga

SEQ ID NO: 2196368 - RNA, 22 nt, Homo sapiens
ucacaaauaaguaauaucuuuc

SEQ ID NO: 2196369 - RNA, 15 nt, Homo sapiens
caugagugccgugug

SEQ ID NO: 2196370 - RNA, 16 nt, Homo sapiens
cucuggcucucauggg

SEQ ID NO: 2196371 - RNA, 14 nt, Homo sapiens
uuguacugacccca

SEQ ID NO: 2196372 - RNA, 20 nt, Homo sapiens
aagugcucacuacucaguga

SEQ ID NO: 2196373 - RNA, 14 nt, Homo sapiens
augugucucaggca

SEQ ID NO: 2196374 - RNA, 18 nt, Homo sapiens
uucccuuggauguagucu

SEQ ID NO: 2196375 - RNA, 17 nt, Homo sapiens
acaaaguguguauuaaa

SEQ ID NO: 2196376 - RNA, 15 nt, Homo sapiens
cuaucgcaccacugu

SEQ ID NO: 2196377 - RNA, 19 nt, Homo sapiens
auuuaacucagacucugga

SEQ ID NO: 2196378 - RNA, 17 nt, Homo sapiens
gccccucccaacccagc

SEQ ID NO: 2196379 - RNA, 15 nt, Homo sapiens
aguucugucuggacu

SEQ ID NO: 2196380 - RNA, 17 nt, Homo sapiens
uguaucaagucauggca

SEQ ID NO: 2196381 - RNA, 19 nt, Homo sapiens
uccuggaggcacugggaag

SEQ ID NO: 2196382 - RNA, 20 nt, Homo sapiens
cuaugauggaccagcccuga

SEQ ID NO: 2196383 - RNA, 14 nt, Homo sapiens
aguccuuacugaag

SEQ ID NO: 2196384 - RNA, 17 nt, Homo sapiens
cucaugggucacugggg

SEQ ID NO: 2196385 - RNA, 14 nt, Homo sapiens
auaucacauuccca

SEQ ID NO: 2196386 - RNA, 17 nt, Homo sapiens
aaaggagacauugcucu

SEQ ID NO: 2196387 - RNA, 20 nt, Homo sapiens
acuggguagguucugaacag

SEQ ID NO: 2196388 - RNA, 22 nt, Homo sapiens
ggcgcucucccuaccuugccuc

SEQ ID NO: 2196389 - RNA, 16 nt, Homo sapiens
aauuauauuuccuuaa

SEQ ID NO: 2196390 - RNA, 18 nt, Homo sapiens
aggcggagcuugcaguga

SEQ ID NO: 2196391 - RNA, 19 nt, Homo sapiens
gcagaaauacagucuucca

SEQ ID NO: 2196392 - RNA, 13 nt, Homo sapiens
cugggucacuugc

SEQ ID NO: 2196393 - RNA, 14 nt, Homo sapiens
ccugccauagucuu

SEQ ID NO: 2196394 - RNA, 23 nt, Homo sapiens
uaagggcuuuaauacaaaaagca

SEQ ID NO: 2196395 - RNA, 21 nt, Homo sapiens
uuuugugauuucaauguagcu

SEQ ID NO: 2196396 - RNA, 21 nt, Homo sapiens
caagaucgcaccauugcacuc

SEQ ID NO: 2196397 - RNA, 22 nt, Homo sapiens
agucuagccuuguguuauagaa

SEQ ID NO: 2196398 - RNA, 20 nt, Homo sapiens
aacccaggagauggaaguug

SEQ ID NO: 2196399 - RNA, 20 nt, Homo sapiens
cuuaauuauaagcuauguca

SEQ ID NO: 2196400 - RNA, 17 nt, Homo sapiens
aauauauaauguugcca

SEQ ID NO: 2196401 - RNA, 13 nt, Homo sapiens
uaguauuggcaau

SEQ ID NO: 2196402 - RNA, 22 nt, Homo sapiens
uguuaucccugccugguccuca

SEQ ID NO: 2196403 - RNA, 12 nt, Homo sapiens
ggacccaaaaca

SEQ ID NO: 2196404 - RNA, 13 nt, Homo sapiens
cacagcuuucaaa

SEQ ID NO: 2196405 - RNA, 18 nt, Homo sapiens
aaccuugaaugcugccag

SEQ ID NO: 2196406 - RNA, 21 nt, Homo sapiens
agggacagaucauagauuucu

SEQ ID NO: 2196407 - RNA, 23 nt, Homo sapiens
uuaaaaucuugcauggcauuaau

SEQ ID NO: 2196408 - RNA, 13 nt, Homo sapiens
auuaaaauagcau

SEQ ID NO: 2196409 - RNA, 13 nt, Homo sapiens
uuucaaauugccu

SEQ ID NO: 2196410 - RNA, 15 nt, Homo sapiens
accacagucuuaggg

SEQ ID NO: 2196411 - RNA, 13 nt, Homo sapiens
agguacauuggaa

SEQ ID NO: 2196412 - RNA, 23 nt, Homo sapiens
ucugcagcuccagguacauauca

SEQ ID NO: 2196413 - RNA, 21 nt, Homo sapiens
aaacuaggaggaaaagacaga

SEQ ID NO: 2196414 - RNA, 12 nt, Homo sapiens
ggaaagcauaua

SEQ ID NO: 2196415 - RNA, 19 nt, Homo sapiens
acuuaagcacacuugacau

SEQ ID NO: 2196416 - RNA, 21 nt, Homo sapiens
ugucuguaauaauagacugua

SEQ ID NO: 2196417 - RNA, 14 nt, Homo sapiens
guaugucacucugg

SEQ ID NO: 2196418 - RNA, 17 nt, Homo sapiens
agagaccugaacugggc

SEQ ID NO: 2196419 - RNA, 14 nt, Homo sapiens
aaaccacaaaaaua

SEQ ID NO: 2196420 - RNA, 22 nt, Homo sapiens
cccacacugaccuguguucccu

SEQ ID NO: 2196421 - RNA, 13 nt, Homo sapiens
ugugaauugcugc

SEQ ID NO: 2196422 - RNA, 14 nt, Homo sapiens
ggagagcaaagguu

SEQ ID NO: 2196423 - RNA, 19 nt, Homo sapiens
gcccucugucuaccuggga

SEQ ID NO: 2196424 - RNA, 16 nt, Homo sapiens
aagugaaggagccagu

SEQ ID NO: 2196425 - RNA, 15 nt, Homo sapiens
augcugcgucuccca

SEQ ID NO: 2196426 - RNA, 18 nt, Homo sapiens
uaucucuguggggucuau

SEQ ID NO: 2196427 - RNA, 15 nt, Homo sapiens
ugacauagccuuugu

SEQ ID NO: 2196428 - RNA, 14 nt, Homo sapiens
aaaucuuucucuca

SEQ ID NO: 2196429 - RNA, 14 nt, Homo sapiens
aagaaacauucaga

SEQ ID NO: 2196430 - RNA, 19 nt, Homo sapiens
aaugcuucuuuccuguaua

SEQ ID NO: 2196431 - RNA, 18 nt, Homo sapiens
uggaguugcccugccauc

SEQ ID NO: 2196432 - RNA, 21 nt, Homo sapiens
cugucucuguguuugaaguuu

SEQ ID NO: 2196433 - RNA, 15 nt, Homo sapiens
cuaggguacaugucc

SEQ ID NO: 2196434 - RNA, 17 nt, Homo sapiens
cuaaacccuuaaccuaa

SEQ ID NO: 2196435 - RNA, 15 nt, Homo sapiens
agggcacaggagcua

SEQ ID NO: 2196436 - RNA, 22 nt, Homo sapiens
agcaucugucuugucauuccag

SEQ ID NO: 2196437 - RNA, 17 nt, Homo sapiens
uccccaauaaagccuuu

SEQ ID NO: 2196438 - RNA, 21 nt, Homo sapiens
uaguggugacugugggcucca

SEQ ID NO: 2196439 - RNA, 18 nt, Homo sapiens
cagcuaacuccagucucc

SEQ ID NO: 2196440 - RNA, 14 nt, Homo sapiens
auacuggguacaag

SEQ ID NO: 2196441 - RNA, 14 nt, Homo sapiens
auuuuugucuuaua

SEQ ID NO: 2196442 - RNA, 14 nt, Homo sapiens
aggggaaagagaga

SEQ ID NO: 2196443 - RNA, 14 nt, Homo sapiens
cauguucauugcaa

SEQ ID NO: 2196444 - RNA, 15 nt, Homo sapiens
ugaacuuagaacuau

SEQ ID NO: 2196445 - RNA, 13 nt, Homo sapiens
aaauacaugcaca

SEQ ID NO: 2196446 - RNA, 19 nt, Homo sapiens
ugccucccagguuccagca

SEQ ID NO: 2196447 - RNA, 12 nt, Homo sapiens
aacccaccugcu

SEQ ID NO: 2196448 - RNA, 18 nt, Homo sapiens
gcugugagcuuucugaua

SEQ ID NO: 2196449 - RNA, 15 nt, Homo sapiens
gucuuuacagaauca

SEQ ID NO: 2196450 - RNA, 11 nt, Homo sapiens
caaacuuuuca

SEQ ID NO: 2196451 - RNA, 18 nt, Homo sapiens
uaaaacuuuggguacuua

SEQ ID NO: 2196452 - RNA, 22 nt, Homo sapiens
agauuauccuauauuccuauca

SEQ ID NO: 2196453 - RNA, 14 nt, Homo sapiens
caggcugcauuugu

SEQ ID NO: 2196454 - RNA, 13 nt, Homo sapiens
cucagcugcugaa

SEQ ID NO: 2196455 - RNA, 12 nt, Homo sapiens
ugauaaaacugg

SEQ ID NO: 2196456 - RNA, 17 nt, Homo sapiens
aaugcuuuaggauguac

SEQ ID NO: 2196457 - RNA, 18 nt, Homo sapiens
cgagcgagaaccaggcug

SEQ ID NO: 2196458 - RNA, 19 nt, Homo sapiens
cauuuugccuaccuggguc

SEQ ID NO: 2196459 - RNA, 22 nt, Homo sapiens
ucucugggggacagcagucucu

SEQ ID NO: 2196460 - RNA, 14 nt, Homo sapiens
gagccgcugcugag

SEQ ID NO: 2196461 - RNA, 14 nt, Homo sapiens
uccucugcuugcca

SEQ ID NO: 2196462 - RNA, 21 nt, Homo sapiens
gcuaacuugcuuaaaugugaa

SEQ ID NO: 2196463 - RNA, 21 nt, Homo sapiens
uggacgacauagcgagacucc

SEQ ID NO: 2196464 - RNA, 12 nt, Homo sapiens
cuaacagcauaa

SEQ ID NO: 2196465 - RNA, 15 nt, Homo sapiens
cacacacaacagcca

SEQ ID NO: 2196466 - RNA, 19 nt, Homo sapiens
ugagagacagcaggucuca

SEQ ID NO: 2196467 - RNA, 20 nt, Homo sapiens
gggacaacagugcuuuguaa

SEQ ID NO: 2196468 - RNA, 19 nt, Homo sapiens
uugccaggcuggagugcag

SEQ ID NO: 2196469 - RNA, 15 nt, Homo sapiens
guaccaaaaauagac

SEQ ID NO: 2196470 - RNA, 16 nt, Homo sapiens
uugccauacagcuuca

SEQ ID NO: 2196471 - RNA, 20 nt, Homo sapiens
uuaugggaacaaguguacag

SEQ ID NO: 2196472 - RNA, 21 nt, Homo sapiens
ugcaagacauagaauaguguu

SEQ ID NO: 2196473 - RNA, 18 nt, Homo sapiens
gccaacgcaguucaugua

SEQ ID NO: 2196474 - RNA, 13 nt, Homo sapiens
uaaaaacuuuauu

SEQ ID NO: 2196475 - RNA, 17 nt, Homo sapiens
gaggugggucuaccuca

SEQ ID NO: 2196476 - RNA, 17 nt, Homo sapiens
aggaggggugugggcac

SEQ ID NO: 2196477 - RNA, 15 nt, Homo sapiens
cuauuuuuguagaag

SEQ ID NO: 2196478 - RNA, 15 nt, Homo sapiens
cauaauuuaaaaaua

SEQ ID NO: 2196479 - RNA, 18 nt, Homo sapiens
augauuuaccuauacauu

SEQ ID NO: 2196480 - RNA, 11 nt, Homo sapiens
aagaauggaga

SEQ ID NO: 2196481 - RNA, 16 nt, Homo sapiens
agaucacccacuccua

SEQ ID NO: 2196482 - RNA, 13 nt, Homo sapiens
gggacaaccccau

SEQ ID NO: 2196483 - RNA, 13 nt, Homo sapiens
ugccaccagucac

SEQ ID NO: 2196484 - RNA, 14 nt, Homo sapiens
uuuacaaaccauua

SEQ ID NO: 2196485 - RNA, 18 nt, Homo sapiens
gacauguuggaaauguag

SEQ ID NO: 2196486 - RNA, 13 nt, Homo sapiens
ucucgcucuggau

SEQ ID NO: 2196487 - RNA, 21 nt, Homo sapiens
gauucuguggagguauugccu

SEQ ID NO: 2196488 - RNA, 14 nt, Homo sapiens
cucaauacuugaau

SEQ ID NO: 2196489 - RNA, 17 nt, Homo sapiens
uggauacuauuaaagua

SEQ ID NO: 2196490 - RNA, 23 nt, Homo sapiens
cacucuagucaaugacaugaauu

SEQ ID NO: 2196491 - RNA, 17 nt, Homo sapiens
aaggaaacaaacucuca

SEQ ID NO: 2196492 - RNA, 16 nt, Homo sapiens
aagaccagcuuugcag

SEQ ID NO: 2196493 - RNA, 22 nt, Homo sapiens
uagccucugucuggcaaugcca

SEQ ID NO: 2196494 - RNA, 23 nt, Homo sapiens
cacugaacuccaccgaccaacug

SEQ ID NO: 2196495 - RNA, 16 nt, Homo sapiens
uuuguuauccuguaua

SEQ ID NO: 2196496 - RNA, 16 nt, Homo sapiens
uaggacauugugucag

SEQ ID NO: 2196497 - RNA, 12 nt, Homo sapiens
aggccagagcaa

SEQ ID NO: 2196498 - RNA, 17 nt, Homo sapiens
gcauccuggacaacaac

SEQ ID NO: 2196499 - RNA, 18 nt, Homo sapiens
uucugagcauacucaaca

SEQ ID NO: 2196500 - RNA, 18 nt, Homo sapiens
aaccuaggagcagugggc

SEQ ID NO: 2196501 - RNA, 19 nt, Homo sapiens
guuuagaccaaggaacaaa

SEQ ID NO: 2196502 - RNA, 17 nt, Homo sapiens
uaaaaaucauuguaugg

SEQ ID NO: 2196503 - RNA, 19 nt, Homo sapiens
auucucuugacguuuacau

SEQ ID NO: 2196504 - RNA, 17 nt, Homo sapiens
ccaauuauuacaguccu

SEQ ID NO: 2196505 - RNA, 16 nt, Homo sapiens
uugaaaucccaucagg

SEQ ID NO: 2196506 - RNA, 20 nt, Homo sapiens
augacagcuguuccacaggg

SEQ ID NO: 2196507 - RNA, 16 nt, Homo sapiens
aucacaguauuaucug

SEQ ID NO: 2196508 - RNA, 19 nt, Homo sapiens
cucugaaggguaauuauau

SEQ ID NO: 2196509 - RNA, 19 nt, Homo sapiens
aaaugugguuuuccugaaa

SEQ ID NO: 2196510 - RNA, 15 nt, Homo sapiens
agccccagucuuccu

SEQ ID NO: 2196511 - RNA, 20 nt, Homo sapiens
gaaauaaaaaaugaaaaaca

SEQ ID NO: 2196512 - RNA, 16 nt, Homo sapiens
augacuaauucuugca

SEQ ID NO: 2196513 - RNA, 21 nt, Homo sapiens
agaaauccacgcucaaucuca

SEQ ID NO: 2196514 - RNA, 22 nt, Homo sapiens
aaagcaaguguucacugcuccu

SEQ ID NO: 2196515 - RNA, 15 nt, Homo sapiens
cauauuugaaaacca

SEQ ID NO: 2196516 - RNA, 17 nt, Homo sapiens
gcagggccagggcaaug

SEQ ID NO: 2196517 - RNA, 18 nt, Homo sapiens
gaacucacagacugcugu

SEQ ID NO: 2196518 - RNA, 22 nt, Homo sapiens
agagugcuaauuuaguucucag

SEQ ID NO: 2196519 - RNA, 15 nt, Homo sapiens
caggugcugacaaua

SEQ ID NO: 2196520 - RNA, 14 nt, Homo sapiens
auauaagagcaaga

SEQ ID NO: 2196521 - RNA, 17 nt, Homo sapiens
aaacccagucucagaca

SEQ ID NO: 2196522 - RNA, 14 nt, Homo sapiens
gaugaaaaccugca

SEQ ID NO: 2196523 - RNA, 23 nt, Homo sapiens
agaacuucugaaaccucuggguc

SEQ ID NO: 2196524 - RNA, 22 nt, Homo sapiens
agaacugcagaccucacuguca

SEQ ID NO: 2196525 - RNA, 22 nt, Homo sapiens
ugacuggccuauuuaucugauc

SEQ ID NO: 2196526 - RNA, 13 nt, Homo sapiens
guguucccugggg

SEQ ID NO: 2196527 - RNA, 22 nt, Homo sapiens
gccaguacagagaaauucugug

SEQ ID NO: 2196528 - RNA, 16 nt, Homo sapiens
acucaaaagaacaaga

SEQ ID NO: 2196529 - RNA, 23 nt, Homo sapiens
uuaaguguuuagaaaucauagaa

SEQ ID NO: 2196530 - RNA, 14 nt, Homo sapiens
gagaggaguccuuu

SEQ ID NO: 2196531 - RNA, 13 nt, Homo sapiens
gguucaacaaagg

SEQ ID NO: 2196532 - RNA, 23 nt, Homo sapiens
ccuauagagucaaccaccacaga

SEQ ID NO: 2196533 - RNA, 13 nt, Homo sapiens
uggauaaauugca

SEQ ID NO: 2196534 - RNA, 19 nt, Homo sapiens
ucauuucauugcacuggaa

SEQ ID NO: 2196535 - RNA, 17 nt, Homo sapiens
cccuccuugaacuagga

SEQ ID NO: 2196536 - RNA, 17 nt, Homo sapiens
agccagacuugcuuccu

SEQ ID NO: 2196537 - RNA, 16 nt, Homo sapiens
cucauggaucugcaua

SEQ ID NO: 2196538 - RNA, 19 nt, Homo sapiens
ucauuauuuuucacugccc

SEQ ID NO: 2196539 - RNA, 18 nt, Homo sapiens
gugcacuggcaccaagug

SEQ ID NO: 2196540 - RNA, 22 nt, Homo sapiens
cccagcagcagagaaccaucaa

SEQ ID NO: 2196541 - RNA, 13 nt, Homo sapiens
caguguuuugcca

SEQ ID NO: 2196542 - RNA, 15 nt, Homo sapiens
uaaagauggcacuuu

SEQ ID NO: 2196543 - RNA, 13 nt, Homo sapiens
caagacucuagag

SEQ ID NO: 2196544 - RNA, 19 nt, Homo sapiens
agcacacacuucacaaagc

SEQ ID NO: 2196545 - RNA, 23 nt, Homo sapiens
aacacaccaaucagcgcucugua

SEQ ID NO: 2196546 - RNA, 15 nt, Homo sapiens
ggcccacucaggggu

SEQ ID NO: 2196547 - RNA, 22 nt, Homo sapiens
aagcugguaaacuauuugucuu

SEQ ID NO: 2196548 - RNA, 14 nt, Homo sapiens
auuagaaauaucuu

SEQ ID NO: 2196549 - RNA, 16 nt, Homo sapiens
gcuguacuaacccagu

SEQ ID NO: 2196550 - RNA, 14 nt, Homo sapiens
acauaugugccaau

SEQ ID NO: 2196551 - RNA, 18 nt, Homo sapiens
auccccagccccaaagac

SEQ ID NO: 2196552 - RNA, 16 nt, Homo sapiens
guccugcugaaacugc

SEQ ID NO: 2196553 - RNA, 11 nt, Homo sapiens
augaagcacaa

SEQ ID NO: 2196554 - RNA, 19 nt, Homo sapiens
uaacuagguaugaaguaua

SEQ ID NO: 2196555 - RNA, 14 nt, Homo sapiens
cagauggucaucca

SEQ ID NO: 2196556 - RNA, 18 nt, Homo sapiens
acugagcagggaucugcc

SEQ ID NO: 2196557 - RNA, 22 nt, Homo sapiens
uuguuccugccacuguguacug

SEQ ID NO: 2196558 - RNA, 14 nt, Homo sapiens
uuagagcuuccaaa

SEQ ID NO: 2196559 - RNA, 15 nt, Homo sapiens
aaugggcucuuccaa

SEQ ID NO: 2196560 - RNA, 14 nt, Homo sapiens
aucucucuaccucc

SEQ ID NO: 2196561 - RNA, 22 nt, Homo sapiens
gaugaauugucacaucuaucca

SEQ ID NO: 2196562 - RNA, 18 nt, Homo sapiens
accaguuaauuuuuccaa

SEQ ID NO: 2196563 - RNA, 15 nt, Homo sapiens
aaugggggugcauuu

SEQ ID NO: 2196564 - RNA, 19 nt, Homo sapiens
ucaggaccccugcauuuac

SEQ ID NO: 2196565 - RNA, 22 nt, Homo sapiens
acaaggggucaaugucauaaau

SEQ ID NO: 2196566 - RNA, 19 nt, Homo sapiens
cgcuguuuggauuuccuga

SEQ ID NO: 2196567 - RNA, 18 nt, Homo sapiens
cuucauucuuuucugaag

SEQ ID NO: 2196568 - RNA, 13 nt, Homo sapiens
caccagcuuuauu

SEQ ID NO: 2196569 - RNA, 13 nt, Homo sapiens
ccagauaacuuag

SEQ ID NO: 2196570 - RNA, 22 nt, Homo sapiens
uuaacguaacucuuucuaugcc

SEQ ID NO: 2196571 - RNA, 23 nt, Homo sapiens
augcuuguauuuuacuuuuccau

SEQ ID NO: 2196572 - RNA, 19 nt, Homo sapiens
gcuuagaaugcaucucauc

SEQ ID NO: 2196573 - RNA, 18 nt, Homo sapiens
ugaagccuaacucuugag

SEQ ID NO: 2196574 - RNA, 14 nt, Homo sapiens
ugcugugauuccac

SEQ ID NO: 2196575 - RNA, 20 nt, Homo sapiens
uguagccaaagaaauuucaa

SEQ ID NO: 2196576 - RNA, 19 nt, Homo sapiens
cuuuuaagaaacacagggu

SEQ ID NO: 2196577 - RNA, 16 nt, Homo sapiens
acagaacugaucucag

SEQ ID NO: 2196578 - RNA, 15 nt, Homo sapiens
gaagcagacuuuuca

SEQ ID NO: 2196579 - RNA, 18 nt, Homo sapiens
uugauuauauaagcaaaa

SEQ ID NO: 2196580 - RNA, 13 nt, Homo sapiens
guaaaaagggaau

SEQ ID NO: 2196581 - RNA, 13 nt, Homo sapiens
guaauaagggaaa

SEQ ID NO: 2196582 - RNA, 17 nt, Homo sapiens
aguuccggaaagccuuc

SEQ ID NO: 2196583 - RNA, 19 nt, Homo sapiens
acacugaggaggcugccuu

SEQ ID NO: 2196584 - RNA, 13 nt, Homo sapiens
acauaacaacauc

SEQ ID NO: 2196585 - RNA, 13 nt, Homo sapiens
aaccaacaaaccc

SEQ ID NO: 2196586 - RNA, 15 nt, Homo sapiens
uccccaguucagugu

SEQ ID NO: 2196587 - RNA, 14 nt, Homo sapiens
ugaaggcaucagaa

SEQ ID NO: 2196588 - RNA, 13 nt, Homo sapiens
aguguuuggugca

SEQ ID NO: 2196589 - RNA, 16 nt, Homo sapiens
aaaaugaagacacuca

SEQ ID NO: 2196590 - RNA, 21 nt, Homo sapiens
aaaguuuuaggguacaguuug

SEQ ID NO: 2196591 - RNA, 22 nt, Homo sapiens
uuugcaggaucugucugugcac

SEQ ID NO: 2196592 - RNA, 17 nt, Homo sapiens
uccagagacaggaaaga

SEQ ID NO: 2196593 - RNA, 19 nt, Homo sapiens
uagccuuguguucugagua

SEQ ID NO: 2196594 - RNA, 11 nt, Homo sapiens
aucuugcugac

SEQ ID NO: 2196595 - RNA, 20 nt, Homo sapiens
ggugugugccacucagagac

SEQ ID NO: 2196596 - RNA, 21 nt, Homo sapiens
acgcugcagaccccagguuca

SEQ ID NO: 2196597 - RNA, 21 nt, Homo sapiens
ccaacucuaacaggcacuuug

SEQ ID NO: 2196598 - RNA, 21 nt, Homo sapiens
ccugguccuggacaccuccca

SEQ ID NO: 2196599 - RNA, 16 nt, Homo sapiens
accacggugugggggg

SEQ ID NO: 2196600 - RNA, 13 nt, Homo sapiens
aucuggacuuccu

SEQ ID NO: 2196601 - RNA, 18 nt, Homo sapiens
acagagagucccacugcc

SEQ ID NO: 2196602 - RNA, 13 nt, Homo sapiens
ggcagucugcucu

SEQ ID NO: 2196603 - RNA, 20 nt, Homo sapiens
uggacccuggugaccuccug

SEQ ID NO: 2196604 - RNA, 20 nt, Homo sapiens
caaucugcccauucaucuuc

SEQ ID NO: 2196605 - RNA, 20 nt, Homo sapiens
acagagcgagauuccaucuc

SEQ ID NO: 2196606 - RNA, 16 nt, Homo sapiens
agucagggaccugcug

SEQ ID NO: 2196607 - RNA, 13 nt, Homo sapiens
caacggaagccag

SEQ ID NO: 2196608 - RNA, 21 nt, Homo sapiens
uggugauuccauuuuacuucc

SEQ ID NO: 2196609 - RNA, 14 nt, Homo sapiens
aagcuggaagcaca

SEQ ID NO: 2196610 - RNA, 17 nt, Homo sapiens
cuuuucccugcauucac

SEQ ID NO: 2196611 - RNA, 12 nt, Homo sapiens
gcacucagagac

SEQ ID NO: 2196612 - RNA, 18 nt, Homo sapiens
uaauuaaagaugccauag

SEQ ID NO: 2196613 - RNA, 20 nt, Homo sapiens
gcauucuucuuuuggcaaua

SEQ ID NO: 2196614 - RNA, 18 nt, Homo sapiens
cugagugggcccagcaca

SEQ ID NO: 2196615 - RNA, 21 nt, Homo sapiens
uuaggaauacugggugcuguc

SEQ ID NO: 2196616 - RNA, 15 nt, Homo sapiens
cccgaaugccuguca

SEQ ID NO: 2196617 - RNA, 21 nt, Homo sapiens
cauacucccuuucagggccag

SEQ ID NO: 2196618 - RNA, 17 nt, Homo sapiens
caugugcuggacacugu

SEQ ID NO: 2196619 - RNA, 13 nt, Homo sapiens
guaccagccugac

SEQ ID NO: 2196620 - RNA, 17 nt, Homo sapiens
cugaaagagaaaucaau

SEQ ID NO: 2196621 - RNA, 22 nt, Homo sapiens
auuguguuaggacagcauauaa

SEQ ID NO: 2196622 - RNA, 13 nt, Homo sapiens
aggcuuccuucug

SEQ ID NO: 2196623 - RNA, 23 nt, Homo sapiens
aaccugcucuccucuucuacuca

SEQ ID NO: 2196624 - RNA, 14 nt, Homo sapiens
cauguaauggacua

SEQ ID NO: 2196625 - RNA, 20 nt, Homo sapiens
auauaaaaauaaugucauag

SEQ ID NO: 2196626 - RNA, 13 nt, Homo sapiens
agucagacugaaa

SEQ ID NO: 2196627 - RNA, 21 nt, Homo sapiens
agagcugaguugggggugugg

SEQ ID NO: 2196628 - RNA, 18 nt, Homo sapiens
acuccagauaugugccaa

SEQ ID NO: 2196629 - RNA, 16 nt, Homo sapiens
ugcucuauauguaaua

SEQ ID NO: 2196630 - RNA, 16 nt, Homo sapiens
ucuuagacuuugcaag

SEQ ID NO: 2196631 - RNA, 18 nt, Homo sapiens
uccccucccccacucuau

SEQ ID NO: 2196632 - RNA, 23 nt, Homo sapiens
aguggaaggucuauuggccaaca

SEQ ID NO: 2196633 - RNA, 17 nt, Homo sapiens
ugacuaauucacaaaaa

SEQ ID NO: 2196634 - RNA, 18 nt, Homo sapiens
uaaucccagcacuuugau

SEQ ID NO: 2196635 - RNA, 21 nt, Homo sapiens
gccauagaggcccaggcacca

SEQ ID NO: 2196636 - RNA, 11 nt, Homo sapiens
cauucugacca

SEQ ID NO: 2196637 - RNA, 14 nt, Homo sapiens
auacacugugaaga

SEQ ID NO: 2196638 - RNA, 12 nt, Homo sapiens
cagacaggguuu

SEQ ID NO: 2196639 - RNA, 14 nt, Homo sapiens
cccuuggagcugcc

SEQ ID NO: 2196640 - RNA, 15 nt, Homo sapiens
accaauagcaucugu

SEQ ID NO: 2196641 - RNA, 16 nt, Homo sapiens
auaguacuaagcauuu

SEQ ID NO: 2196642 - RNA, 18 nt, Homo sapiens
uagaauuuacaacuuaua

SEQ ID NO: 2196643 - RNA, 19 nt, Homo sapiens
uaguaauaccaaagacuau

SEQ ID NO: 2196644 - RNA, 13 nt, Homo sapiens
gcuagccacugga

SEQ ID NO: 2196645 - RNA, 20 nt, Homo sapiens
agccuccugaguagcuggga

SEQ ID NO: 2196646 - RNA, 17 nt, Homo sapiens
uaggagacagucucaag

SEQ ID NO: 2196647 - RNA, 17 nt, Homo sapiens
acagaaugagagagaaa

SEQ ID NO: 2196648 - RNA, 20 nt, Homo sapiens
uagguaggggcccacuucac

SEQ ID NO: 2196649 - RNA, 18 nt, Homo sapiens
gagggaagaccagaauuc

SEQ ID NO: 2196650 - RNA, 16 nt, Homo sapiens
gaacaaaaaaaccaca

SEQ ID NO: 2196651 - RNA, 23 nt, Homo sapiens
uuaaauagcuuuuuucucugaua

SEQ ID NO: 2196652 - RNA, 18 nt, Homo sapiens
uguugcagggaagucuua

SEQ ID NO: 2196653 - RNA, 11 nt, Homo sapiens
cucauuuacug

SEQ ID NO: 2196654 - RNA, 16 nt, Homo sapiens
uuguaccagugugaau

SEQ ID NO: 2196655 - RNA, 17 nt, Homo sapiens
acuucaaauguuauuca

SEQ ID NO: 2196656 - RNA, 18 nt, Homo sapiens
gcauaucauuguaacuaa

SEQ ID NO: 2196657 - RNA, 14 nt, Homo sapiens
aaucugccagacuu

SEQ ID NO: 2196658 - RNA, 15 nt, Homo sapiens
auuccaugagcugcu

SEQ ID NO: 2196659 - RNA, 15 nt, Homo sapiens
auuccaggagcugcg

SEQ ID NO: 2196660 - RNA, 14 nt, Homo sapiens
gccuccucccugcc

SEQ ID NO: 2196661 - RNA, 15 nt, Homo sapiens
guauucaagcaaaca

SEQ ID NO: 2196662 - RNA, 17 nt, Homo sapiens
ucuuguuccccacugac

SEQ ID NO: 2196663 - RNA, 22 nt, Homo sapiens
uuccuaacaggauuagacaguc

SEQ ID NO: 2196664 - RNA, 18 nt, Homo sapiens
gggaguccacgauucuca

SEQ ID NO: 2196665 - RNA, 23 nt, Homo sapiens
caaaagguaaugcacauccucau

SEQ ID NO: 2196666 - RNA, 13 nt, Homo sapiens
aucgaacuucaca

SEQ ID NO: 2196667 - RNA, 22 nt, Homo sapiens
gaugugggaaucucccagacuu

SEQ ID NO: 2196668 - RNA, 12 nt, Homo sapiens
gugcauguguau

SEQ ID NO: 2196669 - RNA, 22 nt, Homo sapiens
caacaucuucauagaugaauga

SEQ ID NO: 2196670 - RNA, 12 nt, Homo sapiens
cugcugaccaaa

SEQ ID NO: 2196671 - RNA, 16 nt, Homo sapiens
gaugacuuggggacac

SEQ ID NO: 2196672 - RNA, 17 nt, Homo sapiens
guucauuuugaguauuu

SEQ ID NO: 2196673 - RNA, 15 nt, Homo sapiens
aucaagcugugagac

SEQ ID NO: 2196674 - RNA, 14 nt, Homo sapiens
auuccuguccuuca

SEQ ID NO: 2196675 - RNA, 11 nt, Homo sapiens
gacaaagccau

SEQ ID NO: 2196676 - RNA, 11 nt, Homo sapiens
gauaaagccac

SEQ ID NO: 2196677 - RNA, 21 nt, Homo sapiens
ucuuuagacaacccugaggua

SEQ ID NO: 2196678 - RNA, 15 nt, Homo sapiens
gaaacugacacaugc

SEQ ID NO: 2196679 - RNA, 21 nt, Homo sapiens
auuuagauuuuucucaucucc

SEQ ID NO: 2196680 - RNA, 14 nt, Homo sapiens
aagcauaaagcaau

SEQ ID NO: 2196681 - RNA, 13 nt, Homo sapiens
caaauugcugcuu

SEQ ID NO: 2196682 - RNA, 17 nt, Homo sapiens
agccugcccaccucucc

SEQ ID NO: 2196683 - RNA, 13 nt, Homo sapiens
acaagcaugaucu

SEQ ID NO: 2196684 - RNA, 15 nt, Homo sapiens
aaguugcuauuugaa

SEQ ID NO: 2196685 - RNA, 14 nt, Homo sapiens
acgcagcacaagcu

SEQ ID NO: 2196686 - RNA, 22 nt, Homo sapiens
auuucauguaaccaagaguauu

SEQ ID NO: 2196687 - RNA, 17 nt, Homo sapiens
aaaacaauauguuagau

SEQ ID NO: 2196688 - RNA, 14 nt, Homo sapiens
guugcuaaugacag

SEQ ID NO: 2196689 - RNA, 23 nt, Homo sapiens
cuccugggggcauaucucaguca

SEQ ID NO: 2196690 - RNA, 16 nt, Homo sapiens
aguccagauauuucac

SEQ ID NO: 2196691 - RNA, 20 nt, Homo sapiens
guuugaguuuuuccucccag

SEQ ID NO: 2196692 - RNA, 22 nt, Homo sapiens
uuaaaaaaucucaaauuuggau

SEQ ID NO: 2196693 - RNA, 23 nt, Homo sapiens
aaaugaauuuacagaacaguuua

SEQ ID NO: 2196694 - RNA, 21 nt, Homo sapiens
auguaaauuaacucaccagau

SEQ ID NO: 2196695 - RNA, 21 nt, Homo sapiens
aaacaaaacccucagcacugu

SEQ ID NO: 2196696 - RNA, 16 nt, Homo sapiens
gcuucacuggggcccu

SEQ ID NO: 2196697 - RNA, 22 nt, Homo sapiens
cauauguguguguggguaugug

SEQ ID NO: 2196698 - RNA, 21 nt, Homo sapiens
acaaguuguuaaaacauuuaa

SEQ ID NO: 2196699 - RNA, 18 nt, Homo sapiens
cuagcuucugcaauguuu

SEQ ID NO: 2196700 - RNA, 19 nt, Homo sapiens
ccacuggccagcucuggcu

SEQ ID NO: 2196701 - RNA, 20 nt, Homo sapiens
gagcugaugaaacucacaaa

SEQ ID NO: 2196702 - RNA, 22 nt, Homo sapiens
ucaacuaggaucagaauaucac

SEQ ID NO: 2196703 - RNA, 17 nt, Homo sapiens
aguguacaaaacuguaa

SEQ ID NO: 2196704 - RNA, 20 nt, Homo sapiens
acaaacccguuuuaugauuu

SEQ ID NO: 2196705 - RNA, 16 nt, Homo sapiens
gaaaaggagagcuguu

SEQ ID NO: 2196706 - RNA, 17 nt, Homo sapiens
caaugguacucuaauca

SEQ ID NO: 2196707 - RNA, 17 nt, Homo sapiens
uaaaaagcuucagggaa

SEQ ID NO: 2196708 - RNA, 23 nt, Homo sapiens
cucaucugaaauguuacaaaaau

SEQ ID NO: 2196709 - RNA, 22 nt, Homo sapiens
uaaacagauuagaaauguaaca

SEQ ID NO: 2196710 - RNA, 14 nt, Homo sapiens
acuuucauucaauu

SEQ ID NO: 2196711 - RNA, 17 nt, Homo sapiens
auaguaggcacuaaaua

SEQ ID NO: 2196712 - RNA, 14 nt, Homo sapiens
ggccucucucagga

SEQ ID NO: 2196713 - RNA, 14 nt, Homo sapiens
uuucauaguguuca

SEQ ID NO: 2196714 - RNA, 13 nt, Homo sapiens
auaaaaagaguau

SEQ ID NO: 2196715 - RNA, 18 nt, Homo sapiens
aggaccacucagccccua

SEQ ID NO: 2196716 - RNA, 19 nt, Homo sapiens
aguaucuaaagccaguggc

SEQ ID NO: 2196717 - RNA, 15 nt, Homo sapiens
ugcgcagcuccuucc

SEQ ID NO: 2196718 - RNA, 12 nt, Homo sapiens
ugaaucacagua

SEQ ID NO: 2196719 - RNA, 15 nt, Homo sapiens
uuguuuuugcaugaa

SEQ ID NO: 2196720 - RNA, 17 nt, Homo sapiens
aaugagagacacacuga

SEQ ID NO: 2196721 - RNA, 21 nt, Homo sapiens
cgugcugagaggcgagcuccu

SEQ ID NO: 2196722 - RNA, 18 nt, Homo sapiens
cauggcuggcacauuguu

SEQ ID NO: 2196723 - RNA, 20 nt, Homo sapiens
aacuucacuaccaagcagcu

SEQ ID NO: 2196724 - RNA, 22 nt, Homo sapiens
uucuguugcucucugugucuga

SEQ ID NO: 2196725 - RNA, 15 nt, Homo sapiens
ucucagaagcacaga

SEQ ID NO: 2196726 - RNA, 14 nt, Homo sapiens
ccugucgugccagu

SEQ ID NO: 2196727 - RNA, 22 nt, Homo sapiens
ggccucacccaccccugcacag

SEQ ID NO: 2196728 - RNA, 18 nt, Homo sapiens
guaacuuugaaagguaua

SEQ ID NO: 2196729 - RNA, 18 nt, Homo sapiens
acccuggaccauuccagg

SEQ ID NO: 2196730 - RNA, 17 nt, Homo sapiens
gcguggcauagcccaga

SEQ ID NO: 2196731 - RNA, 15 nt, Homo sapiens
accccccagaaccug

SEQ ID NO: 2196732 - RNA, 23 nt, Homo sapiens
cuggauuguagaacuuguugcug

SEQ ID NO: 2196733 - RNA, 12 nt, Homo sapiens
cuagaaauugcc

SEQ ID NO: 2196734 - RNA, 13 nt, Homo sapiens
cacugacugagau

SEQ ID NO: 2196735 - RNA, 13 nt, Homo sapiens
gccugcggacucc

SEQ ID NO: 2196736 - RNA, 21 nt, Homo sapiens
gaaugugcacucucugcuuag

SEQ ID NO: 2196737 - RNA, 23 nt, Homo sapiens
acggcuggugugucauacugugc

SEQ ID NO: 2196738 - RNA, 19 nt, Homo sapiens
caguuuaaaggggucccau

SEQ ID NO: 2196739 - RNA, 20 nt, Homo sapiens
aggugugagccacagugccu

SEQ ID NO: 2196740 - RNA, 12 nt, Homo sapiens
ugaauugucaau

SEQ ID NO: 2196741 - RNA, 15 nt, Homo sapiens
uaccagaugcuuucc

SEQ ID NO: 2196742 - RNA, 22 nt, Homo sapiens
uacagagaaggaaugucuuugg

SEQ ID NO: 2196743 - RNA, 14 nt, Homo sapiens
aauagacacauaca

SEQ ID NO: 2196744 - RNA, 14 nt, Homo sapiens
ccacacaccacaga

SEQ ID NO: 2196745 - RNA, 12 nt, Homo sapiens
gagcucuugaca

SEQ ID NO: 2196746 - RNA, 17 nt, Homo sapiens
caaguccaaacuggcaa

SEQ ID NO: 2196747 - RNA, 17 nt, Homo sapiens
aauugucaugacuuuca

SEQ ID NO: 2196748 - RNA, 20 nt, Homo sapiens
ucuucucagcuccacucuga

SEQ ID NO: 2196749 - RNA, 16 nt, Homo sapiens
aacacauuuuguauaa

SEQ ID NO: 2196750 - RNA, 15 nt, Homo sapiens
agugaucucagcuca

SEQ ID NO: 2196751 - RNA, 15 nt, Homo sapiens
aagcuccucgugaua

SEQ ID NO: 2196752 - RNA, 19 nt, Homo sapiens
cucacacuggccacaagga

SEQ ID NO: 2196753 - RNA, 13 nt, Homo sapiens
agucacccuguga

SEQ ID NO: 2196754 - RNA, 17 nt, Homo sapiens
uaaaauaaguauuucca

SEQ ID NO: 2196755 - RNA, 16 nt, Homo sapiens
gaagcauccugugcug

SEQ ID NO: 2196756 - RNA, 23 nt, Homo sapiens
aaaucugaauaaauaauucuucc

SEQ ID NO: 2196757 - RNA, 12 nt, Homo sapiens
cucaccgucucg

SEQ ID NO: 2196758 - RNA, 14 nt, Homo sapiens
gccuccaccucucc

SEQ ID NO: 2196759 - RNA, 15 nt, Homo sapiens
ucagggauccaauau

SEQ ID NO: 2196760 - RNA, 21 nt, Homo sapiens
agugaagcuaauuaaacacau

SEQ ID NO: 2196761 - RNA, 20 nt, Homo sapiens
agauucuagugagucaacau

SEQ ID NO: 2196762 - RNA, 17 nt, Homo sapiens
auaaaugccagagccaa

SEQ ID NO: 2196763 - RNA, 18 nt, Homo sapiens
uuuaaaguggcaaucuca

SEQ ID NO: 2196764 - RNA, 16 nt, Homo sapiens
cagcacuuguguuguc

SEQ ID NO: 2196765 - RNA, 20 nt, Homo sapiens
acccuuccaucugauuccag

SEQ ID NO: 2196766 - RNA, 17 nt, Homo sapiens
uagaacaccugagcugc

SEQ ID NO: 2196767 - RNA, 15 nt, Homo sapiens
uguaauccagcaaua

SEQ ID NO: 2196768 - RNA, 16 nt, Homo sapiens
gaagauuagaaacuac

SEQ ID NO: 2196769 - RNA, 13 nt, Homo sapiens
ggaaaauguuaug

SEQ ID NO: 2196770 - RNA, 18 nt, Homo sapiens
auguauuuugaaaacacu

SEQ ID NO: 2196771 - RNA, 23 nt, Homo sapiens
uuuuauggaggcuuugcauagau

SEQ ID NO: 2196772 - RNA, 11 nt, Homo sapiens
agcugguggcc

SEQ ID NO: 2196773 - RNA, 13 nt, Homo sapiens
acccgccugcucc

SEQ ID NO: 2196774 - RNA, 18 nt, Homo sapiens
gaauaucuaagaaucuuu

SEQ ID NO: 2196775 - RNA, 12 nt, Homo sapiens
augaccaaagau

SEQ ID NO: 2196776 - RNA, 16 nt, Homo sapiens
ucaucaguuccuuuga

SEQ ID NO: 2196777 - RNA, 19 nt, Homo sapiens
guugaaaaaguucugcaga

SEQ ID NO: 2196778 - RNA, 13 nt, Homo sapiens
gaaaggacccugu

SEQ ID NO: 2196779 - RNA, 15 nt, Homo sapiens
auuugcaacauuaga

SEQ ID NO: 2196780 - RNA, 21 nt, Homo sapiens
auaacauggugugcuucuuaa

SEQ ID NO: 2196781 - RNA, 22 nt, Homo sapiens
gagcaauggaguggcugccaug

SEQ ID NO: 2196782 - RNA, 11 nt, Homo sapiens
caaugaacuuu

SEQ ID NO: 2196783 - RNA, 18 nt, Homo sapiens
aaaauauuuucuacaucu

SEQ ID NO: 2196784 - RNA, 18 nt, Homo sapiens
cagggucucacucuguca

SEQ ID NO: 2196785 - RNA, 14 nt, Homo sapiens
gaaauaaaacaaug

SEQ ID NO: 2196786 - RNA, 12 nt, Homo sapiens
gaucacugccac

SEQ ID NO: 2196787 - RNA, 18 nt, Homo sapiens
gcaaaaccaacucucuac

SEQ ID NO: 2196788 - RNA, 20 nt, Homo sapiens
cugcauagcuuuucccuguc

SEQ ID NO: 2196789 - RNA, 20 nt, Homo sapiens
guggccugccuucaccccac

SEQ ID NO: 2196790 - RNA, 17 nt, Homo sapiens
cccagggccccugugac

SEQ ID NO: 2196791 - RNA, 18 nt, Homo sapiens
ccuuugcucucuggccac

SEQ ID NO: 2196792 - RNA, 19 nt, Homo sapiens
aaagguuuuggaucuugaa

SEQ ID NO: 2196793 - RNA, 16 nt, Homo sapiens
ccccuuucacacugga

SEQ ID NO: 2196794 - RNA, 19 nt, Homo sapiens
aauguucauauagccaggg

SEQ ID NO: 2196795 - RNA, 22 nt, Homo sapiens
caagacagugccuauacugccu

SEQ ID NO: 2196796 - RNA, 14 nt, Homo sapiens
cuuagguugcugac

SEQ ID NO: 2196797 - RNA, 13 nt, Homo sapiens
ugaaacugcauaa

SEQ ID NO: 2196798 - RNA, 18 nt, Homo sapiens
uuggauaucauacuucca

SEQ ID NO: 2196799 - RNA, 14 nt, Homo sapiens
uccauagcaccauu

SEQ ID NO: 2196800 - RNA, 14 nt, Homo sapiens
aaugaugcuaugaa

SEQ ID NO: 2196801 - RNA, 14 nt, Homo sapiens
uauaaugcaauaaa

SEQ ID NO: 2196802 - RNA, 14 nt, Homo sapiens
auaucugcuuauca

SEQ ID NO: 2196803 - RNA, 19 nt, Homo sapiens
acuuuuagcgguuugcaaa

SEQ ID NO: 2196804 - RNA, 17 nt, Homo sapiens
ugaaaguauaaugcagu

SEQ ID NO: 2196805 - RNA, 15 nt, Homo sapiens
guuaggauucaggca

SEQ ID NO: 2196806 - RNA, 16 nt, Homo sapiens
uggucaguugccaaag

SEQ ID NO: 2196807 - RNA, 14 nt, Homo sapiens
auuaacaucaaaga

SEQ ID NO: 2196808 - RNA, 16 nt, Homo sapiens
aggugcagacuucuua

SEQ ID NO: 2196809 - RNA, 22 nt, Homo sapiens
cuggauccccucugucuacaaa

SEQ ID NO: 2196810 - RNA, 13 nt, Homo sapiens
uucuuucuuccau

SEQ ID NO: 2196811 - RNA, 12 nt, Homo sapiens
aggacacaguga

SEQ ID NO: 2196812 - RNA, 12 nt, Homo sapiens
acagacuguggu

SEQ ID NO: 2196813 - RNA, 16 nt, Homo sapiens
caaaucugacauauua

SEQ ID NO: 2196814 - RNA, 14 nt, Homo sapiens
gaagcuccacuguc

SEQ ID NO: 2196815 - RNA, 19 nt, Homo sapiens
agaacauuauucaucucuc

SEQ ID NO: 2196816 - RNA, 15 nt, Homo sapiens
gaggagagaaggggg

SEQ ID NO: 2196817 - RNA, 15 nt, Homo sapiens
aagauaaagcuuuau

SEQ ID NO: 2196818 - RNA, 20 nt, Homo sapiens
aaccccauguccucagcauu

SEQ ID NO: 2196819 - RNA, 16 nt, Homo sapiens
ccaggagagagccagg

SEQ ID NO: 2196820 - RNA, 14 nt, Homo sapiens
cugucucucagggc

SEQ ID NO: 2196821 - RNA, 21 nt, Homo sapiens
ugcugggagaggggguagcua

SEQ ID NO: 2196822 - RNA, 19 nt, Homo sapiens
cagauuucggucauaaaga

SEQ ID NO: 2196823 - RNA, 23 nt, Homo sapiens
gaggccugggagucucuugacuc

SEQ ID NO: 2196824 - RNA, 21 nt, Homo sapiens
cggaaguacuucccucaggcc

SEQ ID NO: 2196825 - RNA, 21 nt, Homo sapiens
uucccacuacgggcaccuaaa

SEQ ID NO: 2196826 - RNA, 11 nt, Homo sapiens
ucaaacaaagc

SEQ ID NO: 2196827 - RNA, 20 nt, Homo sapiens
uucucaguaucaguauuuac

SEQ ID NO: 2196828 - RNA, 18 nt, Homo sapiens
uacccuaguucaaaacaa

SEQ ID NO: 2196829 - RNA, 16 nt, Homo sapiens
cccucauuaugacucu

SEQ ID NO: 2196830 - RNA, 22 nt, Homo sapiens
uuccaaagagugcuaagcauua

SEQ ID NO: 2196831 - RNA, 22 nt, Homo sapiens
ucaaaggcccucagugagauaa

SEQ ID NO: 2196832 - RNA, 17 nt, Homo sapiens
cugacgccuacuggggc

SEQ ID NO: 2196833 - RNA, 12 nt, Homo sapiens
agaauuaucuca

SEQ ID NO: 2196834 - RNA, 14 nt, Homo sapiens
cauuauuacuccuu

SEQ ID NO: 2196835 - RNA, 13 nt, Homo sapiens
uuauuuaugcuau

SEQ ID NO: 2196836 - RNA, 19 nt, Homo sapiens
cugguccccucuauauaua

SEQ ID NO: 2196837 - RNA, 20 nt, Homo sapiens
agauucuaguagaacucuag

SEQ ID NO: 2196838 - RNA, 17 nt, Homo sapiens
cauggcuggaugugcau

SEQ ID NO: 2196839 - RNA, 20 nt, Homo sapiens
caguauaccuaucugcugca

SEQ ID NO: 2196840 - RNA, 13 nt, Homo sapiens
aauggaagguugg

SEQ ID NO: 2196841 - RNA, 21 nt, Homo sapiens
uauuuuuuaagaaaaaaagcu

SEQ ID NO: 2196842 - RNA, 21 nt, Homo sapiens
cagagucucgcucuguugccc

SEQ ID NO: 2196843 - RNA, 13 nt, Homo sapiens
aguugcaaucugu

SEQ ID NO: 2196844 - RNA, 20 nt, Homo sapiens
acauuauaaaaauugacaau

SEQ ID NO: 2196845 - RNA, 18 nt, Homo sapiens
uuguuuuuaagcuucuag

SEQ ID NO: 2196846 - RNA, 16 nt, Homo sapiens
uaaaaagugaacaguu

SEQ ID NO: 2196847 - RNA, 13 nt, Homo sapiens
cacucuucacuug

SEQ ID NO: 2196848 - RNA, 15 nt, Homo sapiens
gcaacuccuguucuu

SEQ ID NO: 2196849 - RNA, 14 nt, Homo sapiens
ugcacugaccugua

SEQ ID NO: 2196850 - RNA, 16 nt, Homo sapiens
ccucacuaccagaaga

SEQ ID NO: 2196851 - RNA, 13 nt, Homo sapiens
augugacaguggc

SEQ ID NO: 2196852 - RNA, 19 nt, Homo sapiens
aacuggauugcagacuguu

SEQ ID NO: 2196853 - RNA, 21 nt, Homo sapiens
uccagugacacaacucaucca

SEQ ID NO: 2196854 - RNA, 13 nt, Homo sapiens
ucuuuacaucuau

SEQ ID NO: 2196855 - RNA, 17 nt, Homo sapiens
ucaacagucuugcugaa

SEQ ID NO: 2196856 - RNA, 20 nt, Homo sapiens
gacagaggcccugccacguc

SEQ ID NO: 2196857 - RNA, 12 nt, Homo sapiens
auuuuagcuuca

SEQ ID NO: 2196858 - RNA, 19 nt, Homo sapiens
gaacaccuggcauucugug

SEQ ID NO: 2196859 - RNA, 18 nt, Homo sapiens
agguugcacauucacuga

SEQ ID NO: 2196860 - RNA, 17 nt, Homo sapiens
auggauuguggaaaaug

SEQ ID NO: 2196861 - RNA, 23 nt, Homo sapiens
aagggcacaaacugcagcuguga

SEQ ID NO: 2196862 - RNA, 18 nt, Homo sapiens
caaaaaccuauuccacuu

SEQ ID NO: 2196863 - RNA, 19 nt, Homo sapiens
uggacaugggccccagaua

SEQ ID NO: 2196864 - RNA, 19 nt, Homo sapiens
gccucugaguuuugaugcu

SEQ ID NO: 2196865 - RNA, 16 nt, Homo sapiens
ccugcucuucccucau

SEQ ID NO: 2196866 - RNA, 22 nt, Homo sapiens
aaaaccugcccaaccuaccuca

SEQ ID NO: 2196867 - RNA, 13 nt, Homo sapiens
guguguauucaag

SEQ ID NO: 2196868 - RNA, 22 nt, Homo sapiens
aguacuguugguuaaaugacaa

SEQ ID NO: 2196869 - RNA, 16 nt, Homo sapiens
uuccucuauacaucuc

SEQ ID NO: 2196870 - RNA, 13 nt, Homo sapiens
aagucaucaucuc

SEQ ID NO: 2196871 - RNA, 15 nt, Homo sapiens
acuuccugugccuuu

SEQ ID NO: 2196872 - RNA, 17 nt, Homo sapiens
ugcuaauaauuugccau

SEQ ID NO: 2196873 - RNA, 20 nt, Homo sapiens
guggccuauuucaugcagag

SEQ ID NO: 2196874 - RNA, 13 nt, Homo sapiens
aaaagugggcaaa

SEQ ID NO: 2196875 - RNA, 18 nt, Homo sapiens
uaccacauaacaacaucu

SEQ ID NO: 2196876 - RNA, 19 nt, Homo sapiens
aaauuagugaaccaaaaau

SEQ ID NO: 2196877 - RNA, 17 nt, Homo sapiens
aucaaaucagucuugga

SEQ ID NO: 2196878 - RNA, 15 nt, Homo sapiens
uaccccaaacccauc

SEQ ID NO: 2196879 - RNA, 14 nt, Homo sapiens
ccugcacacuuggu

SEQ ID NO: 2196880 - RNA, 16 nt, Homo sapiens
aucuuguuacugcuga

SEQ ID NO: 2196881 - RNA, 16 nt, Homo sapiens
caauguucaaugccac

SEQ ID NO: 2196882 - RNA, 13 nt, Homo sapiens
uccucuuagcuca

SEQ ID NO: 2196883 - RNA, 11 nt, Homo sapiens
uccugcacugu

SEQ ID NO: 2196884 - RNA, 16 nt, Homo sapiens
ucugcucucauauaag

SEQ ID NO: 2196885 - RNA, 16 nt, Homo sapiens
ccucagaggacaguuu

SEQ ID NO: 2196886 - RNA, 21 nt, Homo sapiens
ucucuuaaaccacagcacuau

SEQ ID NO: 2196887 - RNA, 16 nt, Homo sapiens
agacccugaagauuuc

SEQ ID NO: 2196888 - RNA, 12 nt, Homo sapiens
acucaacaauaa

SEQ ID NO: 2196889 - RNA, 15 nt, Homo sapiens
aaaaggaaaagccaa

SEQ ID NO: 2196890 - RNA, 18 nt, Homo sapiens
uuccaagauaaaaccaga

SEQ ID NO: 2196891 - RNA, 22 nt, Homo sapiens
aacaaaguuucagaguauauug

SEQ ID NO: 2196892 - RNA, 17 nt, Homo sapiens
ccagcucccauguacca

SEQ ID NO: 2196893 - RNA, 17 nt, Homo sapiens
uugucaaagcuugccgu

SEQ ID NO: 2196894 - RNA, 16 nt, Homo sapiens
cuuuuauaaaccucua

SEQ ID NO: 2196895 - RNA, 18 nt, Homo sapiens
cuugaauagaaguuuucc

SEQ ID NO: 2196896 - RNA, 22 nt, Homo sapiens
cuccuugccuggaacucacuca

SEQ ID NO: 2196897 - RNA, 15 nt, Homo sapiens
caagacccaucucaa

SEQ ID NO: 2196898 - RNA, 17 nt, Homo sapiens
acauucaccaaccaaag

SEQ ID NO: 2196899 - RNA, 19 nt, Homo sapiens
uguugacuggcauccauaa

SEQ ID NO: 2196900 - RNA, 20 nt, Homo sapiens
acugagaagaggagugcaag

SEQ ID NO: 2196901 - RNA, 14 nt, Homo sapiens
aucccauucacuuc

SEQ ID NO: 2196902 - RNA, 20 nt, Homo sapiens
ugagauucagugaacuaauu

SEQ ID NO: 2196903 - RNA, 15 nt, Homo sapiens
uaggaagaguagcau

SEQ ID NO: 2196904 - RNA, 17 nt, Homo sapiens
uguuuagaaagaauauu

SEQ ID NO: 2196905 - RNA, 18 nt, Homo sapiens
ggcuaagaggcugcugaa

SEQ ID NO: 2196906 - RNA, 15 nt, Homo sapiens
gacccuguccugcag

SEQ ID NO: 2196907 - RNA, 20 nt, Homo sapiens
ucccuuucagugguuccuuc

SEQ ID NO: 2196908 - RNA, 19 nt, Homo sapiens
agugccuuuugguuucacc

SEQ ID NO: 2196909 - RNA, 19 nt, Homo sapiens
aauggcaguuuuaaucuua

SEQ ID NO: 2196910 - RNA, 21 nt, Homo sapiens
guauucuaaauuuuauaucuu

SEQ ID NO: 2196911 - RNA, 16 nt, Homo sapiens
gacuaagaaucccuaa

SEQ ID NO: 2196912 - RNA, 20 nt, Homo sapiens
ugccucucucucccaacugc

SEQ ID NO: 2196913 - RNA, 17 nt, Homo sapiens
aauacucaccuccuccc

SEQ ID NO: 2196914 - RNA, 13 nt, Homo sapiens
aacuuagagcuuu

SEQ ID NO: 2196915 - RNA, 22 nt, Homo sapiens
uggcugccccauuuauccaccu

SEQ ID NO: 2196916 - RNA, 13 nt, Homo sapiens
caucaaaccugag

SEQ ID NO: 2196917 - RNA, 23 nt, Homo sapiens
auucuuaaauauguggaguucau

SEQ ID NO: 2196918 - RNA, 15 nt, Homo sapiens
cuuuccuccccauac

SEQ ID NO: 2196919 - RNA, 14 nt, Homo sapiens
cucuguggccucca

SEQ ID NO: 2196920 - RNA, 17 nt, Homo sapiens
aaagcagcucaagaaca

SEQ ID NO: 2196921 - RNA, 22 nt, Homo sapiens
uucacagaggcgguuguaagag

SEQ ID NO: 2196922 - RNA, 16 nt, Homo sapiens
aucuaugccuaaaaag

SEQ ID NO: 2196923 - RNA, 12 nt, Homo sapiens
uuucauauugau

SEQ ID NO: 2196924 - RNA, 16 nt, Homo sapiens
gagagcaaaugcuauu

SEQ ID NO: 2196925 - RNA, 20 nt, Homo sapiens
gguaagggauuucuuagggg

SEQ ID NO: 2196926 - RNA, 15 nt, Homo sapiens
auugcuuuaacuuuu

SEQ ID NO: 2196927 - RNA, 21 nt, Homo sapiens
aucacagccccauggacaaca

SEQ ID NO: 2196928 - RNA, 14 nt, Homo sapiens
uaauguacaucugg

SEQ ID NO: 2196929 - RNA, 16 nt, Homo sapiens
gggagccucuccuugc

SEQ ID NO: 2196930 - RNA, 17 nt, Homo sapiens
cuaggggcagccugaau

SEQ ID NO: 2196931 - RNA, 17 nt, Homo sapiens
ugugcuacgugugaaau

SEQ ID NO: 2196932 - RNA, 19 nt, Homo sapiens
acuucccaccucucuaccu

SEQ ID NO: 2196933 - RNA, 15 nt, Homo sapiens
ucgccagcugaugac

SEQ ID NO: 2196934 - RNA, 19 nt, Homo sapiens
gcugucaaaacuacugaca

SEQ ID NO: 2196935 - RNA, 12 nt, Homo sapiens
aucuucauagau

SEQ ID NO: 2196936 - RNA, 21 nt, Homo sapiens
cuauauuuggauucacagccu

SEQ ID NO: 2196937 - RNA, 13 nt, Homo sapiens
uaagugugcaaaa

SEQ ID NO: 2196938 - RNA, 17 nt, Homo sapiens
cuaccaguuggccauga

SEQ ID NO: 2196939 - RNA, 14 nt, Homo sapiens
guuugaagugaauu

SEQ ID NO: 2196940 - RNA, 14 nt, Homo sapiens
acauuaucuuggau

SEQ ID NO: 2196941 - RNA, 23 nt, Homo sapiens
cuugaauacucugcccucuagag

SEQ ID NO: 2196942 - RNA, 17 nt, Homo sapiens
aauaagugcauuuguaa

SEQ ID NO: 2196943 - RNA, 21 nt, Homo sapiens
gcaugcuuaaauauugaauaa

SEQ ID NO: 2196944 - RNA, 21 nt, Homo sapiens
agaugaauggucuggcaauau

SEQ ID NO: 2196945 - RNA, 14 nt, Homo sapiens
agccaagaggcagu

SEQ ID NO: 2196946 - RNA, 22 nt, Homo sapiens
cgcuucuccuggcaaucuguca

SEQ ID NO: 2196947 - RNA, 19 nt, Homo sapiens
ucugggcacaguggacuca

SEQ ID NO: 2196948 - RNA, 23 nt, Homo sapiens
aaaagaguaguuauuaguucugc

SEQ ID NO: 2196949 - RNA, 13 nt, Homo sapiens
accuguaauccca

SEQ ID NO: 2196950 - RNA, 21 nt, Homo sapiens
ugccagcaucugcagccacuu

SEQ ID NO: 2196951 - RNA, 19 nt, Homo sapiens
cacucaggaacccuggaga

SEQ ID NO: 2196952 - RNA, 17 nt, Homo sapiens
ugcaaacccugguggua

SEQ ID NO: 2196953 - RNA, 13 nt, Homo sapiens
acgguugccugag

SEQ ID NO: 2196954 - RNA, 21 nt, Homo sapiens
aucaguuacucuucaguuaag

SEQ ID NO: 2196955 - RNA, 14 nt, Homo sapiens
auuaucaccagcag

SEQ ID NO: 2196956 - RNA, 19 nt, Homo sapiens
gagacuccaccucuaccaa

SEQ ID NO: 2196957 - RNA, 23 nt, Homo sapiens
acuauuaaguaugucaacagcca

SEQ ID NO: 2196958 - RNA, 14 nt, Homo sapiens
ggaugauaccauuu

SEQ ID NO: 2196959 - RNA, 14 nt, Homo sapiens
agcuauuacuggau

SEQ ID NO: 2196960 - RNA, 13 nt, Homo sapiens
auuucauugcacu

SEQ ID NO: 2196961 - RNA, 10 nt, Homo sapiens
ugcugcugaa

SEQ ID NO: 2196962 - RNA, 21 nt, Homo sapiens
agcaugcugcuuuuuguacuu

SEQ ID NO: 2196963 - RNA, 12 nt, Homo sapiens
uucccauccaua

SEQ ID NO: 2196964 - RNA, 17 nt, Homo sapiens
uguaucaaacuagugca

SEQ ID NO: 2196965 - RNA, 17 nt, Homo sapiens
gaaacccucuucuuccc

SEQ ID NO: 2196966 - RNA, 20 nt, Homo sapiens
uauugaagugaauuccugca

SEQ ID NO: 2196967 - RNA, 16 nt, Homo sapiens
cuggaaauaaaccugg

SEQ ID NO: 2196968 - RNA, 12 nt, Homo sapiens
auuuaagucugu

SEQ ID NO: 2196969 - RNA, 17 nt, Homo sapiens
acuggguaaaugcaaag

SEQ ID NO: 2196970 - RNA, 19 nt, Homo sapiens
ccaagauuuuuuauuugag

SEQ ID NO: 2196971 - RNA, 22 nt, Homo sapiens
cuuccccaauuggcucuaguca

SEQ ID NO: 2196972 - RNA, 14 nt, Homo sapiens
caccucacccagcc

SEQ ID NO: 2196973 - RNA, 14 nt, Homo sapiens
cacccuacccaguu

SEQ ID NO: 2196974 - RNA, 13 nt, Homo sapiens
cauauuuucacau

SEQ ID NO: 2196975 - RNA, 16 nt, Homo sapiens
uguaacaugauguuaa

SEQ ID NO: 2196976 - RNA, 22 nt, Homo sapiens
ucuacauuaaaaugacaaacau

SEQ ID NO: 2196977 - RNA, 20 nt, Homo sapiens
ucaagucuagaaaccaguau

SEQ ID NO: 2196978 - RNA, 20 nt, Homo sapiens
uaguuuuguuuaauuugcuu

SEQ ID NO: 2196979 - RNA, 21 nt, Homo sapiens
ccagggcguggagagcccuca

SEQ ID NO: 2196980 - RNA, 16 nt, Homo sapiens
aaucccagcuacucaa

SEQ ID NO: 2196981 - RNA, 14 nt, Homo sapiens
acugcucugagaau

SEQ ID NO: 2196982 - RNA, 19 nt, Homo sapiens
cugugacauauucugagga

SEQ ID NO: 2196983 - RNA, 23 nt, Homo sapiens
aagauguugaggcgagcagggca

SEQ ID NO: 2196984 - RNA, 19 nt, Homo sapiens
gcgcuuuugucugcaaugg

SEQ ID NO: 2196985 - RNA, 16 nt, Homo sapiens
uaaaacguuaucucau

SEQ ID NO: 2196986 - RNA, 19 nt, Homo sapiens
gagaagcuggaaaguguga

SEQ ID NO: 2196987 - RNA, 21 nt, Homo sapiens
gccucugaucguaggaauuga

SEQ ID NO: 2196988 - RNA, 21 nt, Homo sapiens
cgagagaaaaggaaaagccaa

SEQ ID NO: 2196989 - RNA, 17 nt, Homo sapiens
ucccacucuagggcagu

SEQ ID NO: 2196990 - RNA, 11 nt, Homo sapiens
caaaaaaagca

SEQ ID NO: 2196991 - RNA, 20 nt, Homo sapiens
gacugcugauuuucuggaau

SEQ ID NO: 2196992 - RNA, 17 nt, Homo sapiens
acccagaaaaucugaau

SEQ ID NO: 2196993 - RNA, 19 nt, Homo sapiens
cugugccagacauugcucu

SEQ ID NO: 2196994 - RNA, 15 nt, Homo sapiens
cauuagcuuccugcu

SEQ ID NO: 2196995 - RNA, 23 nt, Homo sapiens
cacuggauccaucuugagccaca

SEQ ID NO: 2196996 - RNA, 19 nt, Homo sapiens
aaucuaguacaaccuuguu

SEQ ID NO: 2196997 - RNA, 22 nt, Homo sapiens
accauuuguuaacuguacugaa

SEQ ID NO: 2196998 - RNA, 18 nt, Homo sapiens
aaucagggaaaaugcgca

SEQ ID NO: 2196999 - RNA, 13 nt, Homo sapiens
guucuuacuugac

SEQ ID NO: 2197000 - RNA, 15 nt, Homo sapiens
gaaauaucaaagugu

SEQ ID NO: 2197001 - RNA, 18 nt, Homo sapiens
ugagcccccugaccuucc

SEQ ID NO: 2197002 - RNA, 17 nt, Homo sapiens
gguuacauaucaaaaca

SEQ ID NO: 2197003 - RNA, 22 nt, Homo sapiens
uuaaacucuguuguaaguaaua

SEQ ID NO: 2197004 - RNA, 22 nt, Homo sapiens
guccuuucuuuugaaaugccac

SEQ ID NO: 2197005 - RNA, 14 nt, Homo sapiens
gaaaaugccaugaa

SEQ ID NO: 2197006 - RNA, 19 nt, Homo sapiens
uggagucagggcugugcuu

SEQ ID NO: 2197007 - RNA, 17 nt, Homo sapiens
ggcuguuccagacucag

SEQ ID NO: 2197008 - RNA, 21 nt, Homo sapiens
gaggacaagacccucucaggc

SEQ ID NO: 2197009 - RNA, 22 nt, Homo sapiens
ucaggggcuuugggcccaagaa

SEQ ID NO: 2197010 - RNA, 22 nt, Homo sapiens
aaauucaagcugcuuuggacaa

SEQ ID NO: 2197011 - RNA, 20 nt, Homo sapiens
gagccugauguuuacagugu

SEQ ID NO: 2197012 - RNA, 21 nt, Homo sapiens
auacaggugucuagacugcca

SEQ ID NO: 2197013 - RNA, 11 nt, Homo sapiens
cuaauucauuu

SEQ ID NO: 2197014 - RNA, 20 nt, Homo sapiens
cauccccauccuccagagaa

SEQ ID NO: 2197015 - RNA, 18 nt, Homo sapiens
aauaaugggcauugagau

SEQ ID NO: 2197016 - RNA, 16 nt, Homo sapiens
aguccugagugggugu

SEQ ID NO: 2197017 - RNA, 14 nt, Homo sapiens
ggaaaacgugcuuu

SEQ ID NO: 2197018 - RNA, 14 nt, Homo sapiens
uaaaauuuaacuca

SEQ ID NO: 2197019 - RNA, 19 nt, Homo sapiens
aucucuuuagauccaaaau

SEQ ID NO: 2197020 - RNA, 14 nt, Homo sapiens
agaaaggaaccugg

SEQ ID NO: 2197021 - RNA, 19 nt, Homo sapiens
accacauucugucucugcu

SEQ ID NO: 2197022 - RNA, 18 nt, Homo sapiens
cauguuuucuagccuuag

SEQ ID NO: 2197023 - RNA, 18 nt, Homo sapiens
ucccaagaaggcuuuauu

SEQ ID NO: 2197024 - RNA, 16 nt, Homo sapiens
gugaccucucucucug

SEQ ID NO: 2197025 - RNA, 22 nt, Homo sapiens
gaaacuuuuuuuuccuacuauc

SEQ ID NO: 2197026 - RNA, 12 nt, Homo sapiens
acucucugccau

SEQ ID NO: 2197027 - RNA, 17 nt, Homo sapiens
aaaaaugcucaaucuca

SEQ ID NO: 2197028 - RNA, 15 nt, Homo sapiens
uguaccguuuccuua

SEQ ID NO: 2197029 - RNA, 16 nt, Homo sapiens
aauuuagucacaccau

SEQ ID NO: 2197030 - RNA, 17 nt, Homo sapiens
aaaugcuucugcacaca

SEQ ID NO: 2197031 - RNA, 23 nt, Homo sapiens
cauauucugggcuccuggaacca

SEQ ID NO: 2197032 - RNA, 17 nt, Homo sapiens
uccaggagaccuuccac

SEQ ID NO: 2197033 - RNA, 16 nt, Homo sapiens
accaucagugacucau

SEQ ID NO: 2197034 - RNA, 20 nt, Homo sapiens
ugaugacuuccuauccauuc

SEQ ID NO: 2197035 - RNA, 17 nt, Homo sapiens
ucuuugucaaugcucua

SEQ ID NO: 2197036 - RNA, 19 nt, Homo sapiens
cagcccuugagucugucac

SEQ ID NO: 2197037 - RNA, 21 nt, Homo sapiens
aucuaacagcccugugcagca

SEQ ID NO: 2197038 - RNA, 14 nt, Homo sapiens
ugcucagagcuuua

SEQ ID NO: 2197039 - RNA, 18 nt, Homo sapiens
aggugcccagggccagug

SEQ ID NO: 2197040 - RNA, 15 nt, Homo sapiens
uaaguuuaagggaaa

SEQ ID NO: 2197041 - RNA, 14 nt, Homo sapiens
agggcccucugggg

SEQ ID NO: 2197042 - RNA, 20 nt, Homo sapiens
ugacuagaccccacccugag

SEQ ID NO: 2197043 - RNA, 18 nt, Homo sapiens
uggucauugccuugccaa

SEQ ID NO: 2197044 - RNA, 20 nt, Homo sapiens
ugacaccccacuuagccuuu

SEQ ID NO: 2197045 - RNA, 20 nt, Homo sapiens
gagcuuuggacacacacagc

SEQ ID NO: 2197046 - RNA, 17 nt, Homo sapiens
agaugaggcacuggaag

SEQ ID NO: 2197047 - RNA, 21 nt, Homo sapiens
ccuuaagcccuggcccccuga

SEQ ID NO: 2197048 - RNA, 23 nt, Homo sapiens
ucaaacaaaaauauuuugaucau

SEQ ID NO: 2197049 - RNA, 14 nt, Homo sapiens
aaauguuuuacuca

SEQ ID NO: 2197050 - RNA, 13 nt, Homo sapiens
agcaaaaccaaag

SEQ ID NO: 2197051 - RNA, 18 nt, Homo sapiens
cuuagugcuucagaguuu

SEQ ID NO: 2197052 - RNA, 16 nt, Homo sapiens
gcugagcacacaacag

SEQ ID NO: 2197053 - RNA, 18 nt, Homo sapiens
uuccugcuacacaaaagc

SEQ ID NO: 2197054 - RNA, 15 nt, Homo sapiens
ucacaugagucaaaa

SEQ ID NO: 2197055 - RNA, 17 nt, Homo sapiens
ucucccuuagggcccug

SEQ ID NO: 2197056 - RNA, 19 nt, Homo sapiens
guaaaucccagacugacag

SEQ ID NO: 2197057 - RNA, 15 nt, Homo sapiens
ggacagggaggugac

SEQ ID NO: 2197058 - RNA, 14 nt, Homo sapiens
uauuccuaugcugc

SEQ ID NO: 2197059 - RNA, 13 nt, Homo sapiens
cuccugacacugc

SEQ ID NO: 2197060 - RNA, 23 nt, Homo sapiens
ccuggagucaguagccagaguug

SEQ ID NO: 2197061 - RNA, 20 nt, Homo sapiens
guccuaacucuccucgcuga

SEQ ID NO: 2197062 - RNA, 21 nt, Homo sapiens
uguuucaaaauagacaaguuu

SEQ ID NO: 2197063 - RNA, 20 nt, Homo sapiens
auguguuuuucuccagugcu

SEQ ID NO: 2197064 - RNA, 13 nt, Homo sapiens
uuaaguuugaaaa

SEQ ID NO: 2197065 - RNA, 19 nt, Homo sapiens
auaaauauaucuaccccag

SEQ ID NO: 2197066 - RNA, 17 nt, Homo sapiens
caacuccuccuugccug

SEQ ID NO: 2197067 - RNA, 22 nt, Homo sapiens
cgacugagcuuuagacagcaga

SEQ ID NO: 2197068 - RNA, 15 nt, Homo sapiens
caaccucuacagggu

SEQ ID NO: 2197069 - RNA, 17 nt, Homo sapiens
uacaaaggaaauaucaa

SEQ ID NO: 2197070 - RNA, 20 nt, Homo sapiens
ucacucucugcauugacuua

SEQ ID NO: 2197071 - RNA, 16 nt, Homo sapiens
uugugcccuccaccua

SEQ ID NO: 2197072 - RNA, 15 nt, Homo sapiens
accuaccacauucac

SEQ ID NO: 2197073 - RNA, 22 nt, Homo sapiens
uaaacuuuauuuguaaaccauu

SEQ ID NO: 2197074 - RNA, 16 nt, Homo sapiens
guauuuagugucuuga

SEQ ID NO: 2197075 - RNA, 15 nt, Homo sapiens
auguuuuugacucuu

SEQ ID NO: 2197076 - RNA, 15 nt, Homo sapiens
aacagccagaucuca

SEQ ID NO: 2197077 - RNA, 21 nt, Homo sapiens
caguguggcucccacaggucu

SEQ ID NO: 2197078 - RNA, 19 nt, Homo sapiens
cauuucucaaaugcacauc

SEQ ID NO: 2197079 - RNA, 16 nt, Homo sapiens
agaagccuugccaucu

SEQ ID NO: 2197080 - RNA, 14 nt, Homo sapiens
acuuaaccuuuuaa

SEQ ID NO: 2197081 - RNA, 16 nt, Homo sapiens
ugagauuacaggcgca

SEQ ID NO: 2197082 - RNA, 13 nt, Homo sapiens
gaauaugacauac

SEQ ID NO: 2197083 - RNA, 19 nt, Homo sapiens
caucaucuuaccugugcuu

SEQ ID NO: 2197084 - RNA, 17 nt, Homo sapiens
gugcaugcagcaucuaa

SEQ ID NO: 2197085 - RNA, 22 nt, Homo sapiens
cagcagaucccagcucacguca

SEQ ID NO: 2197086 - RNA, 13 nt, Homo sapiens
gaaaacauuccau

SEQ ID NO: 2197087 - RNA, 20 nt, Homo sapiens
uugaggccugcccucaggga

SEQ ID NO: 2197088 - RNA, 23 nt, Homo sapiens
uugcuggggcucgugcccugcau

SEQ ID NO: 2197089 - RNA, 23 nt, Homo sapiens
ucuuacuuuuggauaauauccac

SEQ ID NO: 2197090 - RNA, 21 nt, Homo sapiens
aggacagcagcacucccgcug

SEQ ID NO: 2197091 - RNA, 17 nt, Homo sapiens
cuuccaaggcagaagca

SEQ ID NO: 2197092 - RNA, 21 nt, Homo sapiens
cuacauuuugaaggugaugca

SEQ ID NO: 2197093 - RNA, 21 nt, Homo sapiens
gaagcagucauaccugcuccu

SEQ ID NO: 2197094 - RNA, 22 nt, Homo sapiens
aaacugcugucccaaacaugca

SEQ ID NO: 2197095 - RNA, 14 nt, Homo sapiens
acuguaugaucaaa

SEQ ID NO: 2197096 - RNA, 19 nt, Homo sapiens
augcuacugaaacuuaccu

SEQ ID NO: 2197097 - RNA, 19 nt, Homo sapiens
acggcaccauuggucucug

SEQ ID NO: 2197098 - RNA, 15 nt, Homo sapiens
aaucauggcauucac

SEQ ID NO: 2197099 - RNA, 19 nt, Homo sapiens
gcagaacaugagugcugau

SEQ ID NO: 2197100 - RNA, 14 nt, Homo sapiens
acagaccuccguuc

SEQ ID NO: 2197101 - RNA, 21 nt, Homo sapiens
caauggagugggagaucagcc

SEQ ID NO: 2197102 - RNA, 21 nt, Homo sapiens
cuauugugcuuucuaucuaau

SEQ ID NO: 2197103 - RNA, 15 nt, Homo sapiens
gccuagacuguuacu

SEQ ID NO: 2197104 - RNA, 21 nt, Homo sapiens
uuaagauuuuacaaaagagga

SEQ ID NO: 2197105 - RNA, 21 nt, Homo sapiens
aaaggagaaguagcugugaac

SEQ ID NO: 2197106 - RNA, 18 nt, Homo sapiens
agcaacaaguagagauga

SEQ ID NO: 2197107 - RNA, 22 nt, Homo sapiens
auccucccaaucucaauacagc

SEQ ID NO: 2197108 - RNA, 14 nt, Homo sapiens
uaaaaaugccaaaa

SEQ ID NO: 2197109 - RNA, 17 nt, Homo sapiens
acuuucucaguuuucau

SEQ ID NO: 2197110 - RNA, 14 nt, Homo sapiens
uaccaaucgucuca

SEQ ID NO: 2197111 - RNA, 22 nt, Homo sapiens
agggagaauccucccuucccag

SEQ ID NO: 2197112 - RNA, 15 nt, Homo sapiens
gcccccgccccagag

SEQ ID NO: 2197113 - RNA, 23 nt, Homo sapiens
uaaaaaaaaugauaaggcucuga

SEQ ID NO: 2197114 - RNA, 16 nt, Homo sapiens
cugugcccacucccua

SEQ ID NO: 2197115 - RNA, 19 nt, Homo sapiens
cuucaguaggaacaagcug

SEQ ID NO: 2197116 - RNA, 11 nt, Homo sapiens
ucuauguuaau

SEQ ID NO: 2197117 - RNA, 13 nt, Homo sapiens
gacgcagacugac

SEQ ID NO: 2197118 - RNA, 17 nt, Homo sapiens
cugccucagccucccaa

SEQ ID NO: 2197119 - RNA, 18 nt, Homo sapiens
gcugcuugaccuagcucu

SEQ ID NO: 2197120 - RNA, 19 nt, Homo sapiens
uccaaauggcuuugcagaa

SEQ ID NO: 2197121 - RNA, 22 nt, Homo sapiens
aagcaagggcgccucaccugcu

SEQ ID NO: 2197122 - RNA, 20 nt, Homo sapiens
cagucagaguugugcacaug

SEQ ID NO: 2197123 - RNA, 18 nt, Homo sapiens
gcugugaaagaaccaaaa

SEQ ID NO: 2197124 - RNA, 13 nt, Homo sapiens
gaguugugaucau

SEQ ID NO: 2197125 - RNA, 19 nt, Homo sapiens
uuguuuguaaaugccucuu

SEQ ID NO: 2197126 - RNA, 16 nt, Homo sapiens
acaguugcagcccuug

SEQ ID NO: 2197127 - RNA, 12 nt, Homo sapiens
augacaugugac

SEQ ID NO: 2197128 - RNA, 18 nt, Homo sapiens
ucccccaucuccaucagg

SEQ ID NO: 2197129 - RNA, 21 nt, Homo sapiens
uucucucuggcucaggugugg

SEQ ID NO: 2197130 - RNA, 15 nt, Homo sapiens
ggaggugaagucccu

SEQ ID NO: 2197131 - RNA, 22 nt, Homo sapiens
auuuugaaaaauuaccuguaua

SEQ ID NO: 2197132 - RNA, 22 nt, Homo sapiens
ugcaccugggagaaagacuuug

SEQ ID NO: 2197133 - RNA, 23 nt, Homo sapiens
ugucaagauucagcuaguggcca

SEQ ID NO: 2197134 - RNA, 16 nt, Homo sapiens
cugccugggguggaca

SEQ ID NO: 2197135 - RNA, 18 nt, Homo sapiens
augaccuguauuuugcca

SEQ ID NO: 2197136 - RNA, 13 nt, Homo sapiens
ugcuucaaacccu

SEQ ID NO: 2197137 - RNA, 13 nt, Homo sapiens
cuugaacccugag

SEQ ID NO: 2197138 - RNA, 15 nt, Homo sapiens
guaaucaucuaaguc

SEQ ID NO: 2197139 - RNA, 18 nt, Homo sapiens
ggacccagccuucaguca

SEQ ID NO: 2197140 - RNA, 22 nt, Homo sapiens
guuuagaucccaugucaccuca

SEQ ID NO: 2197141 - RNA, 17 nt, Homo sapiens
aacugucuuccucaaaa

SEQ ID NO: 2197142 - RNA, 21 nt, Homo sapiens
guuguuaauaaaaguacaugu

SEQ ID NO: 2197143 - RNA, 17 nt, Homo sapiens
gcuugccgaaacuggaa

SEQ ID NO: 2197144 - RNA, 13 nt, Homo sapiens
aagauaaauccaa

SEQ ID NO: 2197145 - RNA, 14 nt, Homo sapiens
gaagggaagugcau

SEQ ID NO: 2197146 - RNA, 19 nt, Homo sapiens
auuugaauucaauucugau

SEQ ID NO: 2197147 - RNA, 17 nt, Homo sapiens
agguguuuucuguguaa

SEQ ID NO: 2197148 - RNA, 20 nt, Homo sapiens
aguuaaauguaucacauuga

SEQ ID NO: 2197149 - RNA, 18 nt, Homo sapiens
cacucugucacccaggcu

SEQ ID NO: 2197150 - RNA, 22 nt, Homo sapiens
uguucuuacaaaccauacugaa

SEQ ID NO: 2197151 - RNA, 22 nt, Homo sapiens
acuucaaggguuuguugaacaa

SEQ ID NO: 2197152 - RNA, 16 nt, Homo sapiens
uggcaucaucucagcu

SEQ ID NO: 2197153 - RNA, 18 nt, Homo sapiens
uggaggagagaagaauga

SEQ ID NO: 2197154 - RNA, 12 nt, Homo sapiens
ccccaaguucug

SEQ ID NO: 2197155 - RNA, 21 nt, Homo sapiens
cagaaaaccuaccacauucac

SEQ ID NO: 2197156 - RNA, 17 nt, Homo sapiens
ugaggccagaccaugga

SEQ ID NO: 2197157 - RNA, 23 nt, Homo sapiens
ucuuacuguaccuguuccuuaga

SEQ ID NO: 2197158 - RNA, 17 nt, Homo sapiens
aaaguccauaccuuaua

SEQ ID NO: 2197159 - RNA, 17 nt, Homo sapiens
gugaaaccucaucucua

SEQ ID NO: 2197160 - RNA, 16 nt, Homo sapiens
augcaguauucuugca

SEQ ID NO: 2197161 - RNA, 15 nt, Homo sapiens
aaacaguauugacuu

SEQ ID NO: 2197162 - RNA, 21 nt, Homo sapiens
ucugaagagcuagucuaucag

SEQ ID NO: 2197163 - RNA, 15 nt, Homo sapiens
agcgcuagugccuug

SEQ ID NO: 2197164 - RNA, 16 nt, Homo sapiens
auccuuaacauuucuc

SEQ ID NO: 2197165 - RNA, 20 nt, Homo sapiens
uuccagaacuaccaaaauga

SEQ ID NO: 2197166 - RNA, 23 nt, Homo sapiens
caacauuacauuugaacuauauc

SEQ ID NO: 2197167 - RNA, 23 nt, Homo sapiens
auuuuuggaagaggacuccuuaa

SEQ ID NO: 2197168 - RNA, 20 nt, Homo sapiens
ucgcaguguucaaggccauc

SEQ ID NO: 2197169 - RNA, 18 nt, Homo sapiens
gcauagugaacacacuga

SEQ ID NO: 2197170 - RNA, 16 nt, Homo sapiens
ugaccuuuagguauua

SEQ ID NO: 2197171 - RNA, 21 nt, Homo sapiens
gugauuggccacacacugagu

SEQ ID NO: 2197172 - RNA, 18 nt, Homo sapiens
acucuuccuggaaugcau

SEQ ID NO: 2197173 - RNA, 15 nt, Homo sapiens
uuggccuuacuguau

SEQ ID NO: 2197174 - RNA, 16 nt, Homo sapiens
cugggccauguccaaa

SEQ ID NO: 2197175 - RNA, 15 nt, Homo sapiens
aucacuccucuguca

SEQ ID NO: 2197176 - RNA, 14 nt, Homo sapiens
gucucugucucuca

SEQ ID NO: 2197177 - RNA, 14 nt, Homo sapiens
cacacugugacaca

SEQ ID NO: 2197178 - RNA, 14 nt, Homo sapiens
ccagcugugcagca

SEQ ID NO: 2197179 - RNA, 17 nt, Homo sapiens
acccaguguccuuccau

SEQ ID NO: 2197180 - RNA, 14 nt, Homo sapiens
ucacauugugccuu

SEQ ID NO: 2197181 - RNA, 22 nt, Homo sapiens
cuauaagaggacuguaguuuaa

SEQ ID NO: 2197182 - RNA, 18 nt, Homo sapiens
agacuccacacucaguag

SEQ ID NO: 2197183 - RNA, 18 nt, Homo sapiens
ucaagcugagauugagca

SEQ ID NO: 2197184 - RNA, 17 nt, Homo sapiens
cccccagagacacgguc

SEQ ID NO: 2197185 - RNA, 14 nt, Homo sapiens
aaagacucaaaaag

SEQ ID NO: 2197186 - RNA, 14 nt, Homo sapiens
ucaacgucucagcc

SEQ ID NO: 2197187 - RNA, 20 nt, Homo sapiens
gaaaaaagucaccugcccaa

SEQ ID NO: 2197188 - RNA, 19 nt, Homo sapiens
acugauccuguuucuugcu

SEQ ID NO: 2197189 - RNA, 15 nt, Homo sapiens
agaaaagcacuggga

SEQ ID NO: 2197190 - RNA, 17 nt, Homo sapiens
aacauuccuuagucuca

SEQ ID NO: 2197191 - RNA, 15 nt, Homo sapiens
cagaagcaguaauaa

SEQ ID NO: 2197192 - RNA, 24 nt, Homo sapiens
ggccuccccuggggcuggcagcuu

SEQ ID NO: 2197193 - RNA, 18 nt, Homo sapiens
cucucaccaugugacaca

SEQ ID NO: 2197194 - RNA, 12 nt, Homo sapiens
ucuugguauuau

SEQ ID NO: 2197195 - RNA, 14 nt, Homo sapiens
uucucugaaggaca

SEQ ID NO: 2197196 - RNA, 18 nt, Homo sapiens
guucuccugccaccaaga

SEQ ID NO: 2197197 - RNA, 13 nt, Homo sapiens
aguuuacaguauu

SEQ ID NO: 2197198 - RNA, 16 nt, Homo sapiens
ggagcagugcuuuuca

SEQ ID NO: 2197199 - RNA, 22 nt, Homo sapiens
auguacuuuuaaauuauacaau

SEQ ID NO: 2197200 - RNA, 22 nt, Homo sapiens
ugcaugugugcgagugugugca

SEQ ID NO: 2197201 - RNA, 19 nt, Homo sapiens
uccaaggccgcggcccaga

SEQ ID NO: 2197202 - RNA, 14 nt, Homo sapiens
cugcaguccuacuc

SEQ ID NO: 2197203 - RNA, 13 nt, Homo sapiens
aagcuuggcugcu

SEQ ID NO: 2197204 - RNA, 19 nt, Homo sapiens
ucuucaaugucaacagauc

SEQ ID NO: 2197205 - RNA, 12 nt, Homo sapiens
ucucucugggcu

SEQ ID NO: 2197206 - RNA, 18 nt, Homo sapiens
cuccagacucuagauguu

SEQ ID NO: 2197207 - RNA, 12 nt, Homo sapiens
cauuucaagaca

SEQ ID NO: 2197208 - RNA, 15 nt, Homo sapiens
ccuacaucuaacuca

SEQ ID NO: 2197209 - RNA, 18 nt, Homo sapiens
uuaaugcauauuccccuc

SEQ ID NO: 2197210 - RNA, 15 nt, Homo sapiens
aucuugaucugcuca

SEQ ID NO: 2197211 - RNA, 22 nt, Homo sapiens
aaagccagguuccacagaggac

SEQ ID NO: 2197212 - RNA, 23 nt, Homo sapiens
ccccauuguguuaagaacccagc

SEQ ID NO: 2197213 - RNA, 18 nt, Homo sapiens
ccuguuggcucacagggc

SEQ ID NO: 2197214 - RNA, 20 nt, Homo sapiens
ggccguuugcuuaaugccag

SEQ ID NO: 2197215 - RNA, 16 nt, Homo sapiens
uaggcauuaacacaaa

SEQ ID NO: 2197216 - RNA, 13 nt, Homo sapiens
caaaaaaaccaca

SEQ ID NO: 2197217 - RNA, 16 nt, Homo sapiens
uccuuucucaccagcc

SEQ ID NO: 2197218 - RNA, 20 nt, Homo sapiens
uaagacagugcagugcucag

SEQ ID NO: 2197219 - RNA, 20 nt, Homo sapiens
gcacuuugagaggcugaggu

SEQ ID NO: 2197220 - RNA, 18 nt, Homo sapiens
caaaagcuagacagaucc

SEQ ID NO: 2197221 - RNA, 15 nt, Homo sapiens
uacuuugccacugcu

SEQ ID NO: 2197222 - RNA, 19 nt, Homo sapiens
uugcuggaaaacugccaca

SEQ ID NO: 2197223 - RNA, 17 nt, Homo sapiens
ucuuccaacaugugaug

SEQ ID NO: 2197224 - RNA, 20 nt, Homo sapiens
guacguauaaaaagcaagaa

SEQ ID NO: 2197225 - RNA, 22 nt, Homo sapiens
uccauucacaagccuccuguac

SEQ ID NO: 2197226 - RNA, 16 nt, Homo sapiens
ccagucucugccagac

SEQ ID NO: 2197227 - RNA, 15 nt, Homo sapiens
ucucuaaaagcuuua

SEQ ID NO: 2197228 - RNA, 16 nt, Homo sapiens
uacacauaaagcacua

SEQ ID NO: 2197229 - RNA, 23 nt, Homo sapiens
ugaagaugucccccaggggccca

SEQ ID NO: 2197230 - RNA, 17 nt, Homo sapiens
uccacuuguuugcacug

SEQ ID NO: 2197231 - RNA, 22 nt, Homo sapiens
ucucauguugaagccacugccu

SEQ ID NO: 2197232 - RNA, 14 nt, Homo sapiens
ggaacugcugccac

SEQ ID NO: 2197233 - RNA, 19 nt, Homo sapiens
augcgccaauaaaccaaug

SEQ ID NO: 2197234 - RNA, 14 nt, Homo sapiens
acccacuaacaaag

SEQ ID NO: 2197235 - RNA, 14 nt, Homo sapiens
accuaccccagcca

SEQ ID NO: 2197236 - RNA, 15 nt, Homo sapiens
aaaucucacagaugu

SEQ ID NO: 2197237 - RNA, 21 nt, Homo sapiens
agacacuuuggaaucuaacca

SEQ ID NO: 2197238 - RNA, 15 nt, Homo sapiens
cgaaacuuguuauug

SEQ ID NO: 2197239 - RNA, 15 nt, Homo sapiens
uccuuugcauggcag

SEQ ID NO: 2197240 - RNA, 21 nt, Homo sapiens
ucuugggguuuucaguaugaa

SEQ ID NO: 2197241 - RNA, 18 nt, Homo sapiens
auccagccuccugcuaac

SEQ ID NO: 2197242 - RNA, 19 nt, Homo sapiens
agaaacacacuuuugcaca

SEQ ID NO: 2197243 - RNA, 21 nt, Homo sapiens
ugccuuugggaggcagcauca

SEQ ID NO: 2197244 - RNA, 19 nt, Homo sapiens
auaguuucauaauugugua

SEQ ID NO: 2197245 - RNA, 17 nt, Homo sapiens
gaauuaaaacuucuuaa

SEQ ID NO: 2197246 - RNA, 18 nt, Homo sapiens
ugcagcagggucaucugu

SEQ ID NO: 2197247 - RNA, 15 nt, Homo sapiens
ggacauucuaaggga

SEQ ID NO: 2197248 - RNA, 23 nt, Homo sapiens
cucuggcucuaggacccccagug

SEQ ID NO: 2197249 - RNA, 21 nt, Homo sapiens
aaguaaauugccuucuagaca

SEQ ID NO: 2197250 - RNA, 14 nt, Homo sapiens
uagaauaagccuuc

SEQ ID NO: 2197251 - RNA, 15 nt, Homo sapiens
aaugaaaagccaaau

SEQ ID NO: 2197252 - RNA, 18 nt, Homo sapiens
augccuuuaaaucuguga

SEQ ID NO: 2197253 - RNA, 22 nt, Homo sapiens
acauaccuggcccugugccuug

SEQ ID NO: 2197254 - RNA, 13 nt, Homo sapiens
gcgccagggccaa

SEQ ID NO: 2197255 - RNA, 14 nt, Homo sapiens
augccugacucagu

SEQ ID NO: 2197256 - RNA, 14 nt, Homo sapiens
caaauaaacuguaa

SEQ ID NO: 2197257 - RNA, 14 nt, Homo sapiens
caaauuaacuguau

SEQ ID NO: 2197258 - RNA, 13 nt, Homo sapiens
agguaacuacugc

SEQ ID NO: 2197259 - RNA, 16 nt, Homo sapiens
cuggcuuagacaccac

SEQ ID NO: 2197260 - RNA, 17 nt, Homo sapiens
uuuucauugauaugaaa

SEQ ID NO: 2197261 - RNA, 17 nt, Homo sapiens
gugcugauaacaacagg

SEQ ID NO: 2197262 - RNA, 15 nt, Homo sapiens
agcccaggacucuaa

SEQ ID NO: 2197263 - RNA, 12 nt, Homo sapiens
gccaagcccuuu

SEQ ID NO: 2197264 - RNA, 23 nt, Homo sapiens
acauguuaaugacaauauuccag

SEQ ID NO: 2197265 - RNA, 20 nt, Homo sapiens
ugggagccaggcccagaaag

SEQ ID NO: 2197266 - RNA, 20 nt, Homo sapiens
uucuaccucuuggcugccuu

SEQ ID NO: 2197267 - RNA, 14 nt, Homo sapiens
acaaauuucauugc

SEQ ID NO: 2197268 - RNA, 15 nt, Homo sapiens
acaagggcacaagcu

SEQ ID NO: 2197269 - RNA, 21 nt, Homo sapiens
guuucuaccaccgcauccuca

SEQ ID NO: 2197270 - RNA, 23 nt, Homo sapiens
aauacaaucagcccagugcaaac

SEQ ID NO: 2197271 - RNA, 20 nt, Homo sapiens
cugagcguuuaaaguacuga

SEQ ID NO: 2197272 - RNA, 12 nt, Homo sapiens
ugguauuuacug

SEQ ID NO: 2197273 - RNA, 17 nt, Homo sapiens
acuauuguaaggucuau

SEQ ID NO: 2197274 - RNA, 16 nt, Homo sapiens
uuguuguccuugcccc

SEQ ID NO: 2197275 - RNA, 22 nt, Homo sapiens
aauggcauuuagcacaguauuu

SEQ ID NO: 2197276 - RNA, 18 nt, Homo sapiens
uuggaaucuucaccucag

SEQ ID NO: 2197277 - RNA, 19 nt, Homo sapiens
aacugaugagauacauuug

SEQ ID NO: 2197278 - RNA, 21 nt, Homo sapiens
ugcgucaagucuaaaccaaga

SEQ ID NO: 2197279 - RNA, 14 nt, Homo sapiens
cacugagcugaggg

SEQ ID NO: 2197280 - RNA, 17 nt, Homo sapiens
uguugaugaagcacauu

SEQ ID NO: 2197281 - RNA, 16 nt, Homo sapiens
gccaaucuaaaauggc

SEQ ID NO: 2197282 - RNA, 18 nt, Homo sapiens
aaaauauauacuauauga

SEQ ID NO: 2197283 - RNA, 16 nt, Homo sapiens
uuggauucucugagaa

SEQ ID NO: 2197284 - RNA, 16 nt, Homo sapiens
ucugagacuuggauua

SEQ ID NO: 2197285 - RNA, 12 nt, Homo sapiens
aaauaaccacug

SEQ ID NO: 2197286 - RNA, 12 nt, Homo sapiens
acugaaccaaau

SEQ ID NO: 2197287 - RNA, 14 nt, Homo sapiens
aaucucagcacugc

SEQ ID NO: 2197288 - RNA, 18 nt, Homo sapiens
cacugcacugucugagaa

SEQ ID NO: 2197289 - RNA, 23 nt, Homo sapiens
cuauucaauaugugaaagacaau

SEQ ID NO: 2197290 - RNA, 12 nt, Homo sapiens
caucucuuugau

SEQ ID NO: 2197291 - RNA, 18 nt, Homo sapiens
auagagaucuuaugucaa

SEQ ID NO: 2197292 - RNA, 14 nt, Homo sapiens
gaucacagcugcuu

SEQ ID NO: 2197293 - RNA, 14 nt, Homo sapiens
gagcacagcuucuu

SEQ ID NO: 2197294 - RNA, 18 nt, Homo sapiens
aaaggaauguagcucaac

SEQ ID NO: 2197295 - RNA, 17 nt, Homo sapiens
caguuaucuaaguuaau

SEQ ID NO: 2197296 - RNA, 17 nt, Homo sapiens
aauuugauugcuuugcu

SEQ ID NO: 2197297 - RNA, 19 nt, Homo sapiens
ugagcuuuggugcaucuca

SEQ ID NO: 2197298 - RNA, 20 nt, Homo sapiens
agaggcagaacccuggugag

SEQ ID NO: 2197299 - RNA, 16 nt, Homo sapiens
auuuggaaagcacugg

SEQ ID NO: 2197300 - RNA, 15 nt, Homo sapiens
cacucccuccuaucg

SEQ ID NO: 2197301 - RNA, 19 nt, Homo sapiens
cuuuaaaaagaaaaucaag

SEQ ID NO: 2197302 - RNA, 21 nt, Homo sapiens
agcugaagcguuacuacagca

SEQ ID NO: 2197303 - RNA, 23 nt, Homo sapiens
caaaagugcagcaggagaacucu

SEQ ID NO: 2197304 - RNA, 23 nt, Homo sapiens
agucuucaaaaacgcacugcaag

SEQ ID NO: 2197305 - RNA, 14 nt, Homo sapiens
caggucugggcaag

SEQ ID NO: 2197306 - RNA, 22 nt, Homo sapiens
gucccucuucucuccucaguuu

SEQ ID NO: 2197307 - RNA, 17 nt, Homo sapiens
uauaccaucuccagcua

SEQ ID NO: 2197308 - RNA, 13 nt, Homo sapiens
aauuuauaccuca

SEQ ID NO: 2197309 - RNA, 15 nt, Homo sapiens
uagacacacauacau

SEQ ID NO: 2197310 - RNA, 21 nt, Homo sapiens
cugagaagaggagcccucauc

SEQ ID NO: 2197311 - RNA, 12 nt, Homo sapiens
aaaccagguggc

SEQ ID NO: 2197312 - RNA, 16 nt, Homo sapiens
guucugcucauucuaa

SEQ ID NO: 2197313 - RNA, 15 nt, Homo sapiens
caucauuacagauuc

SEQ ID NO: 2197314 - RNA, 16 nt, Homo sapiens
acaaacaagauacgua

SEQ ID NO: 2197315 - RNA, 14 nt, Homo sapiens
acugcguggugcuc

SEQ ID NO: 2197316 - RNA, 16 nt, Homo sapiens
agcuccucugagccau

SEQ ID NO: 2197317 - RNA, 22 nt, Homo sapiens
cugguuccuccagccaccucag

SEQ ID NO: 2197318 - RNA, 19 nt, Homo sapiens
accuguagucccagcacuu

SEQ ID NO: 2197319 - RNA, 15 nt, Homo sapiens
cuucccugacucuuc

SEQ ID NO: 2197320 - RNA, 23 nt, Homo sapiens
ugucugaacuugcauugugauug

SEQ ID NO: 2197321 - RNA, 13 nt, Homo sapiens
guuucacaguaca

SEQ ID NO: 2197322 - RNA, 17 nt, Homo sapiens
cuuucuuggagugccaa

SEQ ID NO: 2197323 - RNA, 17 nt, Homo sapiens
gacaacugcucccaccu

SEQ ID NO: 2197324 - RNA, 12 nt, Homo sapiens
uuagcucugaag

SEQ ID NO: 2197325 - RNA, 22 nt, Homo sapiens
uuagguuuuuuuuuuuuuuaac

SEQ ID NO: 2197326 - RNA, 16 nt, Homo sapiens
aucugggaccaaaaca

SEQ ID NO: 2197327 - RNA, 23 nt, Homo sapiens
uuggcucaggcagacaagagcug

SEQ ID NO: 2197328 - RNA, 12 nt, Homo sapiens
uuuggguccagu

SEQ ID NO: 2197329 - RNA, 16 nt, Homo sapiens
agccccuuauuugcac

SEQ ID NO: 2197330 - RNA, 18 nt, Homo sapiens
auguuuucacuguauuca

SEQ ID NO: 2197331 - RNA, 12 nt, Homo sapiens
agcauggcuguc

SEQ ID NO: 2197332 - RNA, 17 nt, Homo sapiens
gaaugucccaacccaga

SEQ ID NO: 2197333 - RNA, 11 nt, Homo sapiens
cagcaaaggga

SEQ ID NO: 2197334 - RNA, 17 nt, Homo sapiens
cgugcacgcacacuguc

SEQ ID NO: 2197335 - RNA, 15 nt, Homo sapiens
aagcagauacuugag

SEQ ID NO: 2197336 - RNA, 22 nt, Homo sapiens
accggaugcugugccuggccuc

SEQ ID NO: 2197337 - RNA, 19 nt, Homo sapiens
cauagaaauuguguuugcu

SEQ ID NO: 2197338 - RNA, 16 nt, Homo sapiens
aggcugcucagggcug

SEQ ID NO: 2197339 - RNA, 11 nt, Homo sapiens
uacaugacugc

SEQ ID NO: 2197340 - RNA, 15 nt, Homo sapiens
guggcccaggccaga

SEQ ID NO: 2197341 - RNA, 19 nt, Homo sapiens
cagccucgucucuuuacag

SEQ ID NO: 2197342 - RNA, 19 nt, Homo sapiens
acuucccucccccuagucc

SEQ ID NO: 2197343 - RNA, 14 nt, Homo sapiens
gcaaagacaucaaa

SEQ ID NO: 2197344 - RNA, 18 nt, Homo sapiens
uaacaacaauaacacugu

SEQ ID NO: 2197345 - RNA, 18 nt, Homo sapiens
aaucugcauuuagcacaa

SEQ ID NO: 2197346 - RNA, 19 nt, Homo sapiens
ugcuucaaauaaaggcaua

SEQ ID NO: 2197347 - RNA, 12 nt, Homo sapiens
uugaauaucauu

SEQ ID NO: 2197348 - RNA, 15 nt, Homo sapiens
cuggccacagacucc

SEQ ID NO: 2197349 - RNA, 19 nt, Homo sapiens
aaguuuuauugucaagaca

SEQ ID NO: 2197350 - RNA, 14 nt, Homo sapiens
augcuguaugaaua

SEQ ID NO: 2197351 - RNA, 22 nt, Homo sapiens
agucuuaacaacagcuucuugc

SEQ ID NO: 2197352 - RNA, 14 nt, Homo sapiens
cucaugcuguucca

SEQ ID NO: 2197353 - RNA, 15 nt, Homo sapiens
aaucauaguuacugu

SEQ ID NO: 2197354 - RNA, 14 nt, Homo sapiens
gcuaagggggacca

SEQ ID NO: 2197355 - RNA, 23 nt, Homo sapiens
uggcaaagccuucauugccuuaa

SEQ ID NO: 2197356 - RNA, 14 nt, Homo sapiens
aggaaauccgguca

SEQ ID NO: 2197357 - RNA, 15 nt, Homo sapiens
ccagccucagaucca

SEQ ID NO: 2197358 - RNA, 18 nt, Homo sapiens
acuuacgaucucuugaca

SEQ ID NO: 2197359 - RNA, 14 nt, Homo sapiens
ggccaugcugugug

SEQ ID NO: 2197360 - RNA, 18 nt, Homo sapiens
uaucauaauguaaugagg

SEQ ID NO: 2197361 - RNA, 23 nt, Homo sapiens
agcauuucugauacuuucuguca

SEQ ID NO: 2197362 - RNA, 16 nt, Homo sapiens
cugaaccgacuuuucu

SEQ ID NO: 2197363 - RNA, 17 nt, Homo sapiens
aagaaauuccuguagca

SEQ ID NO: 2197364 - RNA, 19 nt, Homo sapiens
uuggaagugugugaucugu

SEQ ID NO: 2197365 - RNA, 15 nt, Homo sapiens
gauugacagguuggc

SEQ ID NO: 2197366 - RNA, 17 nt, Homo sapiens
ugaaagcucuguugcaa

SEQ ID NO: 2197367 - RNA, 14 nt, Homo sapiens
cuaaacccaaauaa

SEQ ID NO: 2197368 - RNA, 13 nt, Homo sapiens
ugcagagccacag

SEQ ID NO: 2197369 - RNA, 22 nt, Homo sapiens
auauaauacuauauuuauacug

SEQ ID NO: 2197370 - RNA, 11 nt, Homo sapiens
uggguucaagc

SEQ ID NO: 2197371 - RNA, 12 nt, Homo sapiens
gcucuggugaua

SEQ ID NO: 2197372 - RNA, 23 nt, Homo sapiens
uggguguuuucuuaaccagauca

SEQ ID NO: 2197373 - RNA, 21 nt, Homo sapiens
ccucggacugugugcagguug

SEQ ID NO: 2197374 - RNA, 15 nt, Homo sapiens
cauugcagugaacuu

SEQ ID NO: 2197375 - RNA, 19 nt, Homo sapiens
augcacaaacaugugugua

SEQ ID NO: 2197376 - RNA, 17 nt, Homo sapiens
cauaccuaaguacugua

SEQ ID NO: 2197377 - RNA, 14 nt, Homo sapiens
auccauccauccaa

SEQ ID NO: 2197378 - RNA, 14 nt, Homo sapiens
auacacucucaaag

SEQ ID NO: 2197379 - RNA, 12 nt, Homo sapiens
aggcccaccauc

SEQ ID NO: 2197380 - RNA, 14 nt, Homo sapiens
cacugccagcaucu

SEQ ID NO: 2197381 - RNA, 18 nt, Homo sapiens
uaaauuuuauaaucauga

SEQ ID NO: 2197382 - RNA, 23 nt, Homo sapiens
cuucccucccugaggcaggugag

SEQ ID NO: 2197383 - RNA, 14 nt, Homo sapiens
cuaauagguacugc

SEQ ID NO: 2197384 - RNA, 21 nt, Homo sapiens
caucugagugggcccagcaca

SEQ ID NO: 2197385 - RNA, 13 nt, Homo sapiens
gcagugucuguca

SEQ ID NO: 2197386 - RNA, 18 nt, Homo sapiens
uccaucagcccaucucaa

SEQ ID NO: 2197387 - RNA, 11 nt, Homo sapiens
cccucuggaaa

SEQ ID NO: 2197388 - RNA, 14 nt, Homo sapiens
cgccagcucuacca

SEQ ID NO: 2197389 - RNA, 17 nt, Homo sapiens
agacucgcuagucagua

SEQ ID NO: 2197390 - RNA, 13 nt, Homo sapiens
gaaaacguaucac

SEQ ID NO: 2197391 - RNA, 12 nt, Homo sapiens
uccccaccagau

SEQ ID NO: 2197392 - RNA, 19 nt, Homo sapiens
gagccgccugcuucuucuc

SEQ ID NO: 2197393 - RNA, 16 nt, Homo sapiens
ccuucuauauccucaa

SEQ ID NO: 2197394 - RNA, 21 nt, Homo sapiens
uacggaaguaaaccugaacaa

SEQ ID NO: 2197395 - RNA, 19 nt, Homo sapiens
accagugaauuuuugcaau

SEQ ID NO: 2197396 - RNA, 16 nt, Homo sapiens
ccaucauacacuuccu

SEQ ID NO: 2197397 - RNA, 22 nt, Homo sapiens
aagaacggcuuggcagccaguc

SEQ ID NO: 2197398 - RNA, 18 nt, Homo sapiens
gaccucuuggccacagag

SEQ ID NO: 2197399 - RNA, 19 nt, Homo sapiens
aaauaugcaaccugugcaa

SEQ ID NO: 2197400 - RNA, 15 nt, Homo sapiens
caauacacucaagug

SEQ ID NO: 2197401 - RNA, 22 nt, Homo sapiens
uaaauaaaagcuagauacugga

SEQ ID NO: 2197402 - RNA, 16 nt, Homo sapiens
gucuucuggucugugu

SEQ ID NO: 2197403 - RNA, 18 nt, Homo sapiens
ccucuugcucagagcuag

SEQ ID NO: 2197404 - RNA, 19 nt, Homo sapiens
uauccaacagaaagcauag

SEQ ID NO: 2197405 - RNA, 16 nt, Homo sapiens
gacauauucaagugau

SEQ ID NO: 2197406 - RNA, 20 nt, Homo sapiens
gacacaugaagguaaauaaa

SEQ ID NO: 2197407 - RNA, 23 nt, Homo sapiens
cuguagaaaugaugauguggaag

SEQ ID NO: 2197408 - RNA, 17 nt, Homo sapiens
cauccuccuucuucagg

SEQ ID NO: 2197409 - RNA, 17 nt, Homo sapiens
uaauuucuuuaaaugug

SEQ ID NO: 2197410 - RNA, 22 nt, Homo sapiens
agccagcauccccaacugcgac

SEQ ID NO: 2197411 - RNA, 22 nt, Homo sapiens
ucuuggaaaaaaaccacagcca

SEQ ID NO: 2197412 - RNA, 13 nt, Homo sapiens
aaauugaugagag

SEQ ID NO: 2197413 - RNA, 17 nt, Homo sapiens
gauacuuuccugaaugu

SEQ ID NO: 2197414 - RNA, 14 nt, Homo sapiens
uaauaaauagcauc

SEQ ID NO: 2197415 - RNA, 11 nt, Homo sapiens
uugagggauaa

SEQ ID NO: 2197416 - RNA, 19 nt, Homo sapiens
cacauguuuucaaauggag

SEQ ID NO: 2197417 - RNA, 19 nt, Homo sapiens
gcaauaaccucaaagugac

SEQ ID NO: 2197418 - RNA, 14 nt, Homo sapiens
ucuaucaccuguca

SEQ ID NO: 2197419 - RNA, 14 nt, Homo sapiens
auuaaaauggauuu

SEQ ID NO: 2197420 - RNA, 16 nt, Homo sapiens
ugcagaguacaugaua

SEQ ID NO: 2197421 - RNA, 23 nt, Homo sapiens
ccuccaagaagcccuccuugcca

SEQ ID NO: 2197422 - RNA, 12 nt, Homo sapiens
cuuaucccauga

SEQ ID NO: 2197423 - RNA, 13 nt, Homo sapiens
uaguuuaucauuu

SEQ ID NO: 2197424 - RNA, 22 nt, Homo sapiens
uacaggugugagccacagcacu

SEQ ID NO: 2197425 - RNA, 13 nt, Homo sapiens
aauuaacuuuaca

SEQ ID NO: 2197426 - RNA, 13 nt, Homo sapiens
caagaauuguuac

SEQ ID NO: 2197427 - RNA, 18 nt, Homo sapiens
acuaaaugcacauuuuau

SEQ ID NO: 2197428 - RNA, 17 nt, Homo sapiens
uguuuauuuacaaggga

SEQ ID NO: 2197429 - RNA, 19 nt, Homo sapiens
ugacaaaugacgucuucac

SEQ ID NO: 2197430 - RNA, 17 nt, Homo sapiens
cuagggaaggguggugg

SEQ ID NO: 2197431 - RNA, 14 nt, Homo sapiens
gcaagaacauucaa

SEQ ID NO: 2197432 - RNA, 12 nt, Homo sapiens
aauggaucacaa

SEQ ID NO: 2197433 - RNA, 15 nt, Homo sapiens
aaaaggauaugcagu

SEQ ID NO: 2197434 - RNA, 18 nt, Homo sapiens
auggagcaucaagccacu

SEQ ID NO: 2197435 - RNA, 18 nt, Homo sapiens
cccaggcuggagugcagu

SEQ ID NO: 2197436 - RNA, 18 nt, Homo sapiens
cccaggcuagagugcaau

SEQ ID NO: 2197437 - RNA, 18 nt, Homo sapiens
gcaggcccccaggugcca

SEQ ID NO: 2197438 - RNA, 19 nt, Homo sapiens
gcaugauuuuauacauagu

SEQ ID NO: 2197439 - RNA, 17 nt, Homo sapiens
ggaaacacuccuugcau

SEQ ID NO: 2197440 - RNA, 19 nt, Homo sapiens
auuuuucuuaagacagagu

SEQ ID NO: 2197441 - RNA, 18 nt, Homo sapiens
agucuugauagcaagcgu

SEQ ID NO: 2197442 - RNA, 15 nt, Homo sapiens
cuaacucuugcucac

SEQ ID NO: 2197443 - RNA, 16 nt, Homo sapiens
ccugcagugggccauc

SEQ ID NO: 2197444 - RNA, 16 nt, Homo sapiens
gccaaugggagcucau

SEQ ID NO: 2197445 - RNA, 23 nt, Homo sapiens
aacuggagccagcaaccagcaca

SEQ ID NO: 2197446 - RNA, 17 nt, Homo sapiens
uacagauccgcaugugu

SEQ ID NO: 2197447 - RNA, 16 nt, Homo sapiens
uuggccucccaaagug

SEQ ID NO: 2197448 - RNA, 13 nt, Homo sapiens
uccugugaucucg

SEQ ID NO: 2197449 - RNA, 17 nt, Homo sapiens
accuuccuguauuucca

SEQ ID NO: 2197450 - RNA, 23 nt, Homo sapiens
gccaacuuuuuuuccuugugguu

SEQ ID NO: 2197451 - RNA, 23 nt, Homo sapiens
ucucaauuuaguauaauaugcag

SEQ ID NO: 2197452 - RNA, 21 nt, Homo sapiens
gacaaaaaaaggaauucugga

SEQ ID NO: 2197453 - RNA, 14 nt, Homo sapiens
gguauuaauaugcu

SEQ ID NO: 2197454 - RNA, 22 nt, Homo sapiens
ccaaauuuuauuaaaagaguag

SEQ ID NO: 2197455 - RNA, 16 nt, Homo sapiens
caaagacaaaggugag

SEQ ID NO: 2197456 - RNA, 13 nt, Homo sapiens
aauagccaaucau

SEQ ID NO: 2197457 - RNA, 22 nt, Homo sapiens
ugaagcaagcuguguuacuuga

SEQ ID NO: 2197458 - RNA, 21 nt, Homo sapiens
gcuauccaggauuuuguuucu

SEQ ID NO: 2197459 - RNA, 12 nt, Homo sapiens
cuuaaacuucca

SEQ ID NO: 2197460 - RNA, 17 nt, Homo sapiens
uauuauucuacuauacu

SEQ ID NO: 2197461 - RNA, 23 nt, Homo sapiens
aguaugguucucagaucuugaca

SEQ ID NO: 2197462 - RNA, 15 nt, Homo sapiens
cuuucccuuuaucag

SEQ ID NO: 2197463 - RNA, 22 nt, Homo sapiens
uaagcacucaauaaaucuuuga

SEQ ID NO: 2197464 - RNA, 23 nt, Homo sapiens
uggagauccagaagagaauuaga

SEQ ID NO: 2197465 - RNA, 21 nt, Homo sapiens
guccuccaccaugcacucacc

SEQ ID NO: 2197466 - RNA, 23 nt, Homo sapiens
uuccacucccuuugccagugccu

SEQ ID NO: 2197467 - RNA, 20 nt, Homo sapiens
auuacagaagaguuucuuaa

SEQ ID NO: 2197468 - RNA, 14 nt, Homo sapiens
uauauaaacuuaac

SEQ ID NO: 2197469 - RNA, 20 nt, Homo sapiens
cuagagccauuuaacauuuc

SEQ ID NO: 2197470 - RNA, 12 nt, Homo sapiens
aaacaccaccaa

SEQ ID NO: 2197471 - RNA, 14 nt, Homo sapiens
agguucuuuccaug

SEQ ID NO: 2197472 - RNA, 19 nt, Homo sapiens
agagcacuagaagcacagg

SEQ ID NO: 2197473 - RNA, 15 nt, Homo sapiens
aaaucuaccacugua

SEQ ID NO: 2197474 - RNA, 19 nt, Homo sapiens
ggaagaaaucuggucuaau

SEQ ID NO: 2197475 - RNA, 21 nt, Homo sapiens
auuaguuugagguacuaccua

SEQ ID NO: 2197476 - RNA, 15 nt, Homo sapiens
acugagcagaacuga

SEQ ID NO: 2197477 - RNA, 12 nt, Homo sapiens
ucucugcuccag

SEQ ID NO: 2197478 - RNA, 14 nt, Homo sapiens
augcugagacaucc

SEQ ID NO: 2197479 - RNA, 19 nt, Homo sapiens
cccuuccccugcugaccuu

SEQ ID NO: 2197480 - RNA, 19 nt, Homo sapiens
ugagcagggagaagccaga

SEQ ID NO: 2197481 - RNA, 22 nt, Homo sapiens
gagcacugagggucuggugcca

SEQ ID NO: 2197482 - RNA, 14 nt, Homo sapiens
gccucagggccagg

SEQ ID NO: 2197483 - RNA, 18 nt, Homo sapiens
cuggucaggcccacugca

SEQ ID NO: 2197484 - RNA, 12 nt, Homo sapiens
cccaucuugaua

SEQ ID NO: 2197485 - RNA, 18 nt, Homo sapiens
caguguuuuaaauucuga

SEQ ID NO: 2197486 - RNA, 16 nt, Homo sapiens
auacucccaucuguga

SEQ ID NO: 2197487 - RNA, 23 nt, Homo sapiens
ugggggugccgcuuucucugagg

SEQ ID NO: 2197488 - RNA, 21 nt, Homo sapiens
gucugaaggacacuuccugcc

SEQ ID NO: 2197489 - RNA, 16 nt, Homo sapiens
aagcaauaaaacugcu

SEQ ID NO: 2197490 - RNA, 17 nt, Homo sapiens
uaaacuguaaacuaaua

SEQ ID NO: 2197491 - RNA, 21 nt, Homo sapiens
uuacagaagaagcuccugaau

SEQ ID NO: 2197492 - RNA, 17 nt, Homo sapiens
ucugucuggugccccua

SEQ ID NO: 2197493 - RNA, 22 nt, Homo sapiens
cauucauaguggauuaaugcau

SEQ ID NO: 2197494 - RNA, 17 nt, Homo sapiens
acuuaauacaugcaaca

SEQ ID NO: 2197495 - RNA, 22 nt, Homo sapiens
augucauuauuuauuguuaaau

SEQ ID NO: 2197496 - RNA, 19 nt, Homo sapiens
ugcuuucacucuccuaugc

SEQ ID NO: 2197497 - RNA, 14 nt, Homo sapiens
aaugacaaagccau

SEQ ID NO: 2197498 - RNA, 12 nt, Homo sapiens
gggcaacaaagu

SEQ ID NO: 2197499 - RNA, 22 nt, Homo sapiens
ucuaugggguucguuaugccaa

SEQ ID NO: 2197500 - RNA, 17 nt, Homo sapiens
cuuacagucacuaauau

SEQ ID NO: 2197501 - RNA, 13 nt, Homo sapiens
auauuugaucuaa

SEQ ID NO: 2197502 - RNA, 14 nt, Homo sapiens
uccugccucaggcu

SEQ ID NO: 2197503 - RNA, 15 nt, Homo sapiens
ucggccuggcuucac

SEQ ID NO: 2197504 - RNA, 20 nt, Homo sapiens
acccuguaccucaucccaug

SEQ ID NO: 2197505 - RNA, 18 nt, Homo sapiens
caguauacacauacacaa

SEQ ID NO: 2197506 - RNA, 21 nt, Homo sapiens
ccucaccaagcucaacggcuc

SEQ ID NO: 2197507 - RNA, 18 nt, Homo sapiens
gaucaucuauguauucaa

SEQ ID NO: 2197508 - RNA, 19 nt, Homo sapiens
uacagaggggccaggggau

SEQ ID NO: 2197509 - RNA, 14 nt, Homo sapiens
gagcguguacuacc

SEQ ID NO: 2197510 - RNA, 18 nt, Homo sapiens
cuuuucuugccucugucc

SEQ ID NO: 2197511 - RNA, 20 nt, Homo sapiens
gaucaucuauguauucaagu

SEQ ID NO: 2197512 - RNA, 23 nt, Homo sapiens
gauacagacccacagagugccau

SEQ ID NO: 2197513 - RNA, 20 nt, Homo sapiens
uuaaagccuuuagagccagc

SEQ ID NO: 2197514 - RNA, 14 nt, Homo sapiens
gucagaacagccag

SEQ ID NO: 2197515 - RNA, 16 nt, Homo sapiens
agagcuauauccuuaa

SEQ ID NO: 2197516 - RNA, 15 nt, Homo sapiens
ugccuuaaaggaccu

SEQ ID NO: 2197517 - RNA, 18 nt, Homo sapiens
cagaaagggcagcuucag

SEQ ID NO: 2197518 - RNA, 12 nt, Homo sapiens
uguguagucaag

SEQ ID NO: 2197519 - RNA, 12 nt, Homo sapiens
caguggcacaau

SEQ ID NO: 2197520 - RNA, 20 nt, Homo sapiens
aaagcuuaccaaggggaaug

SEQ ID NO: 2197521 - RNA, 18 nt, Homo sapiens
cucugccccucagggggc

SEQ ID NO: 2197522 - RNA, 20 nt, Homo sapiens
guguccauugacauguacag

SEQ ID NO: 2197523 - RNA, 12 nt, Homo sapiens
aaugagccuuag

SEQ ID NO: 2197524 - RNA, 17 nt, Homo sapiens
aggcuuuuccaaaucaa

SEQ ID NO: 2197525 - RNA, 15 nt, Homo sapiens
ucccugccucaggcc

SEQ ID NO: 2197526 - RNA, 22 nt, Homo sapiens
augccuuccagcacccugcaaa

SEQ ID NO: 2197527 - RNA, 19 nt, Homo sapiens
augcaucucuuuagaucca

SEQ ID NO: 2197528 - RNA, 14 nt, Homo sapiens
uaagcaggcgcaag

SEQ ID NO: 2197529 - RNA, 15 nt, Homo sapiens
gaaaagccagaugac

SEQ ID NO: 2197530 - RNA, 12 nt, Homo sapiens
ugcaccaucuca

SEQ ID NO: 2197531 - RNA, 12 nt, Homo sapiens
aauccacucugc

SEQ ID NO: 2197532 - RNA, 15 nt, Homo sapiens
aagugaaaucugugc

SEQ ID NO: 2197533 - RNA, 20 nt, Homo sapiens
aaauucaucaaauggaagac

SEQ ID NO: 2197534 - RNA, 20 nt, Homo sapiens
aauguguuuuaucacuucau

SEQ ID NO: 2197535 - RNA, 17 nt, Homo sapiens
cauuuucuucucuguga

SEQ ID NO: 2197536 - RNA, 12 nt, Homo sapiens
ucugaauuccaa

SEQ ID NO: 2197537 - RNA, 23 nt, Homo sapiens
uagggcugcugcuucugcuccag

SEQ ID NO: 2197538 - RNA, 14 nt, Homo sapiens
uucggugugcugcc

SEQ ID NO: 2197539 - RNA, 20 nt, Homo sapiens
aaguaagcagaguucuuugc

SEQ ID NO: 2197540 - RNA, 18 nt, Homo sapiens
ugcuggaggaaaacugag

SEQ ID NO: 2197541 - RNA, 21 nt, Homo sapiens
gcagagcggggaggugccuga

SEQ ID NO: 2197542 - RNA, 15 nt, Homo sapiens
guuaggaaaugucau

SEQ ID NO: 2197543 - RNA, 23 nt, Homo sapiens
uccuguggguguucuuuccugcc

SEQ ID NO: 2197544 - RNA, 18 nt, Homo sapiens
ccacaguucugacgcuga

SEQ ID NO: 2197545 - RNA, 13 nt, Homo sapiens
ggaaaugggagac

SEQ ID NO: 2197546 - RNA, 19 nt, Homo sapiens
uuucuugcuuggaagccag

SEQ ID NO: 2197547 - RNA, 14 nt, Homo sapiens
cuuacagucccaga

SEQ ID NO: 2197548 - RNA, 17 nt, Homo sapiens
aagucaaguuuguggcu

SEQ ID NO: 2197549 - RNA, 14 nt, Homo sapiens
ugcuguuaaccaaa

SEQ ID NO: 2197550 - RNA, 22 nt, Homo sapiens
caagacuguaaauuccaaagau

SEQ ID NO: 2197551 - RNA, 17 nt, Homo sapiens
gaaucugugugcauauu

SEQ ID NO: 2197552 - RNA, 14 nt, Homo sapiens
uacacccaccagag

SEQ ID NO: 2197553 - RNA, 17 nt, Homo sapiens
ggccucacuaccagaag

SEQ ID NO: 2197554 - RNA, 17 nt, Homo sapiens
gcaaagcagcaauuaca

SEQ ID NO: 2197555 - RNA, 17 nt, Homo sapiens
guauggacugacugggu

SEQ ID NO: 2197556 - RNA, 14 nt, Homo sapiens
cuuuguacugauga

SEQ ID NO: 2197557 - RNA, 13 nt, Homo sapiens
acuccuuccuuca

SEQ ID NO: 2197558 - RNA, 23 nt, Homo sapiens
ggauaggagggugccccugggaa

SEQ ID NO: 2197559 - RNA, 13 nt, Homo sapiens
acugcaaccucca

SEQ ID NO: 2197560 - RNA, 19 nt, Homo sapiens
ugcuggguauaagcagaga

SEQ ID NO: 2197561 - RNA, 18 nt, Homo sapiens
uagggcuggaagcacaga

SEQ ID NO: 2197562 - RNA, 19 nt, Homo sapiens
acaugcuaguucaacagaa

SEQ ID NO: 2197563 - RNA, 19 nt, Homo sapiens
agcucuguuuuacaauaaa

SEQ ID NO: 2197564 - RNA, 13 nt, Homo sapiens
aaaccucaucucu

SEQ ID NO: 2197565 - RNA, 19 nt, Homo sapiens
guuuuuagagcuuccaaau

SEQ ID NO: 2197566 - RNA, 14 nt, Homo sapiens
cuaaugcacucugg

SEQ ID NO: 2197567 - RNA, 12 nt, Homo sapiens
caauacuaggaa

SEQ ID NO: 2197568 - RNA, 20 nt, Homo sapiens
cauagguuaaaaaaaaaagu

SEQ ID NO: 2197569 - RNA, 20 nt, Homo sapiens
gcagggccuugcccagagau

SEQ ID NO: 2197570 - RNA, 13 nt, Homo sapiens
agauauuacuuua

SEQ ID NO: 2197571 - RNA, 18 nt, Homo sapiens
uucuggcuuaaacaacac

SEQ ID NO: 2197572 - RNA, 19 nt, Homo sapiens
cuugaacacucaugcugaa

SEQ ID NO: 2197573 - RNA, 18 nt, Homo sapiens
cucugcuccuacauccag

SEQ ID NO: 2197574 - RNA, 17 nt, Homo sapiens
acagcaguguucucaca

SEQ ID NO: 2197575 - RNA, 12 nt, Homo sapiens
uagacuuaccuu

SEQ ID NO: 2197576 - RNA, 16 nt, Homo sapiens
augcacaaacaugugu

SEQ ID NO: 2197577 - RNA, 19 nt, Homo sapiens
caaacacugugauuacucu

SEQ ID NO: 2197578 - RNA, 13 nt, Homo sapiens
ccugaccagucag

SEQ ID NO: 2197579 - RNA, 21 nt, Homo sapiens
accugugcucauccucugccc

SEQ ID NO: 2197580 - RNA, 22 nt, Homo sapiens
ccuucuuuuccugggugcucag

SEQ ID NO: 2197581 - RNA, 13 nt, Homo sapiens
uaaaagacaaaua

SEQ ID NO: 2197582 - RNA, 13 nt, Homo sapiens
agcuggacugcag

SEQ ID NO: 2197583 - RNA, 22 nt, Homo sapiens
gacauauacuaagauguucacu

SEQ ID NO: 2197584 - RNA, 22 nt, Homo sapiens
ccaacaggcuguucugcacuga

SEQ ID NO: 2197585 - RNA, 14 nt, Homo sapiens
ccaacugucaggga

SEQ ID NO: 2197586 - RNA, 22 nt, Homo sapiens
ccuauaagcaugacauacuuuu

SEQ ID NO: 2197587 - RNA, 22 nt, Homo sapiens
cuuuaacaagacuucaaaguuu

SEQ ID NO: 2197588 - RNA, 14 nt, Homo sapiens
cuucauccagggaa

SEQ ID NO: 2197589 - RNA, 13 nt, Homo sapiens
cccaguagccauu

SEQ ID NO: 2197590 - RNA, 20 nt, Homo sapiens
cgugucucagacugcaugua

SEQ ID NO: 2197591 - RNA, 14 nt, Homo sapiens
cuauguaaaccaca

SEQ ID NO: 2197592 - RNA, 16 nt, Homo sapiens
uuguaagugcugcuau

SEQ ID NO: 2197593 - RNA, 15 nt, Homo sapiens
ucuccaucucaaaaa

SEQ ID NO: 2197594 - RNA, 23 nt, Homo sapiens
cuccaguauaugcugauggacca

SEQ ID NO: 2197595 - RNA, 12 nt, Homo sapiens
caccaaguacaa

SEQ ID NO: 2197596 - RNA, 16 nt, Homo sapiens
gucuauuuccacugaa

SEQ ID NO: 2197597 - RNA, 21 nt, Homo sapiens
cuauuugcaccuuaaaagaca

SEQ ID NO: 2197598 - RNA, 24 nt, Homo sapiens
ugaacacaucagcuagcaaaagaa

SEQ ID NO: 2197599 - RNA, 16 nt, Homo sapiens
cuucccaaaaacagcc

SEQ ID NO: 2197600 - RNA, 20 nt, Homo sapiens
aagugcguguaauuaaauac

SEQ ID NO: 2197601 - RNA, 12 nt, Homo sapiens
ggaauguguucg

SEQ ID NO: 2197602 - RNA, 14 nt, Homo sapiens
cugaaugauuuaga

SEQ ID NO: 2197603 - RNA, 21 nt, Homo sapiens
aucaggacucugacgucucuu

SEQ ID NO: 2197604 - RNA, 20 nt, Homo sapiens
uccuuccuuaucacugacac

SEQ ID NO: 2197605 - RNA, 14 nt, Homo sapiens
aacucgaugcacug

SEQ ID NO: 2197606 - RNA, 19 nt, Homo sapiens
aaacucuucaggcaccuga

SEQ ID NO: 2197607 - RNA, 21 nt, Homo sapiens
acagaugugaaggacaugaga

SEQ ID NO: 2197608 - RNA, 22 nt, Homo sapiens
cugauucagccuggccaucccc

SEQ ID NO: 2197609 - RNA, 16 nt, Homo sapiens
acauaaucacaaguaa

SEQ ID NO: 2197610 - RNA, 12 nt, Homo sapiens
uuaucagugcca

SEQ ID NO: 2197611 - RNA, 22 nt, Homo sapiens
cauauucuuccccgaaucacac

SEQ ID NO: 2197612 - RNA, 12 nt, Homo sapiens
ugaacacaucuu

SEQ ID NO: 2197613 - RNA, 14 nt, Homo sapiens
cagucacauuccaa

SEQ ID NO: 2197614 - RNA, 21 nt, Homo sapiens
acuaggauacugcugcgucau

SEQ ID NO: 2197615 - RNA, 17 nt, Homo sapiens
guuuaaaguacugagca

SEQ ID NO: 2197616 - RNA, 21 nt, Homo sapiens
aaauauuaucugaacuggacu

SEQ ID NO: 2197617 - RNA, 17 nt, Homo sapiens
caguauagguguuugcu

SEQ ID NO: 2197618 - RNA, 19 nt, Homo sapiens
uaaugaaaaccacauugga

SEQ ID NO: 2197619 - RNA, 12 nt, Homo sapiens
aggugagccaga

SEQ ID NO: 2197620 - RNA, 12 nt, Homo sapiens
uugauaccaugg

SEQ ID NO: 2197621 - RNA, 12 nt, Homo sapiens
acuauaccucug

SEQ ID NO: 2197622 - RNA, 18 nt, Homo sapiens
uucgaaggaugaagacga

SEQ ID NO: 2197623 - RNA, 17 nt, Homo sapiens
cagccuggaugccaucc

SEQ ID NO: 2197624 - RNA, 15 nt, Homo sapiens
cuaccugcugagcca

SEQ ID NO: 2197625 - RNA, 16 nt, Homo sapiens
uccaaugaaaucucag

SEQ ID NO: 2197626 - RNA, 15 nt, Homo sapiens
aggugaguucucacu

SEQ ID NO: 2197627 - RNA, 16 nt, Homo sapiens
cauuuacaaagcaaaa

SEQ ID NO: 2197628 - RNA, 20 nt, Homo sapiens
agcacagauaaaaaguggaa

SEQ ID NO: 2197629 - RNA, 16 nt, Homo sapiens
guuucaaguaccaaaa

SEQ ID NO: 2197630 - RNA, 13 nt, Homo sapiens
uucucaaucuccu

SEQ ID NO: 2197631 - RNA, 12 nt, Homo sapiens
auaaacugagcc

SEQ ID NO: 2197632 - RNA, 16 nt, Homo sapiens
ccccaucggagucuaa

SEQ ID NO: 2197633 - RNA, 15 nt, Homo sapiens
guuucuuucuguuau

SEQ ID NO: 2197634 - RNA, 12 nt, Homo sapiens
aacgugcaacug

SEQ ID NO: 2197635 - RNA, 11 nt, Homo sapiens
caucuuucaua

SEQ ID NO: 2197636 - RNA, 23 nt, Homo sapiens
uucuggaagcugauuaaaacaca

SEQ ID NO: 2197637 - RNA, 13 nt, Homo sapiens
aaccgggauggga

SEQ ID NO: 2197638 - RNA, 14 nt, Homo sapiens
gcucugcuugacaa

SEQ ID NO: 2197639 - RNA, 19 nt, Homo sapiens
ugaggccugagacacagcc

SEQ ID NO: 2197640 - RNA, 18 nt, Homo sapiens
ugccaaagaggggucacc

SEQ ID NO: 2197641 - RNA, 20 nt, Homo sapiens
cggcucuaguaccuuuucag

SEQ ID NO: 2197642 - RNA, 18 nt, Homo sapiens
agacuaacuuauuuugau

SEQ ID NO: 2197643 - RNA, 22 nt, Homo sapiens
agaacaucauuagaacaaagga

SEQ ID NO: 2197644 - RNA, 19 nt, Homo sapiens
cuugaguuuuuaguggaag

SEQ ID NO: 2197645 - RNA, 20 nt, Homo sapiens
ugucaccugcucacagggau

SEQ ID NO: 2197646 - RNA, 22 nt, Homo sapiens
aucucugauucugucaaugucu

SEQ ID NO: 2197647 - RNA, 21 nt, Homo sapiens
uaaaaucccucuaauuucuca

SEQ ID NO: 2197648 - RNA, 18 nt, Homo sapiens
aaagcaugcucaguauug

SEQ ID NO: 2197649 - RNA, 19 nt, Homo sapiens
uaaacauuucuuucaauaa

SEQ ID NO: 2197650 - RNA, 21 nt, Homo sapiens
aaggugcaguugaauucagug

SEQ ID NO: 2197651 - RNA, 15 nt, Homo sapiens
gccauuacaccagaa

SEQ ID NO: 2197652 - RNA, 19 nt, Homo sapiens
aaaauguccaugauggaau

SEQ ID NO: 2197653 - RNA, 15 nt, Homo sapiens
auuuuuacguuugaa

SEQ ID NO: 2197654 - RNA, 15 nt, Homo sapiens
uauuaagauguauaa

SEQ ID NO: 2197655 - RNA, 20 nt, Homo sapiens
cucugucugcucaaugccau

SEQ ID NO: 2197656 - RNA, 20 nt, Homo sapiens
uuccucacuaugacacugag

SEQ ID NO: 2197657 - RNA, 13 nt, Homo sapiens
uguucugggacac

SEQ ID NO: 2197658 - RNA, 23 nt, Homo sapiens
gaaggaacauggagcugucauca

SEQ ID NO: 2197659 - RNA, 20 nt, Homo sapiens
acugcacacaugguuuccaa

SEQ ID NO: 2197660 - RNA, 20 nt, Homo sapiens
aacucauuuacagucauaau

SEQ ID NO: 2197661 - RNA, 20 nt, Homo sapiens
cacucugaauaccaagugug

SEQ ID NO: 2197662 - RNA, 15 nt, Homo sapiens
cugaagcugccugcu

SEQ ID NO: 2197663 - RNA, 23 nt, Homo sapiens
acagcgcguccuucccuaaagac

SEQ ID NO: 2197664 - RNA, 22 nt, Homo sapiens
guccuuucccaccauuccugcc

SEQ ID NO: 2197665 - RNA, 12 nt, Homo sapiens
ccgccugucaau

SEQ ID NO: 2197666 - RNA, 14 nt, Homo sapiens
gauuguauuaacua

SEQ ID NO: 2197667 - RNA, 20 nt, Homo sapiens
guuaauaaagugcacugcca

SEQ ID NO: 2197668 - RNA, 15 nt, Homo sapiens
uuucuguagugugaa

SEQ ID NO: 2197669 - RNA, 22 nt, Homo sapiens
ugccucccguguucacaccauu

SEQ ID NO: 2197670 - RNA, 17 nt, Homo sapiens
uagaacagauaaucagu

SEQ ID NO: 2197671 - RNA, 16 nt, Homo sapiens
agcgauucuugugccu

SEQ ID NO: 2197672 - RNA, 14 nt, Homo sapiens
ugccuucacuacaa

SEQ ID NO: 2197673 - RNA, 16 nt, Homo sapiens
gggacagcaagugagc

SEQ ID NO: 2197674 - RNA, 20 nt, Homo sapiens
ugaguagauccaguauuuga

SEQ ID NO: 2197675 - RNA, 16 nt, Homo sapiens
gaaauuuugggggaaa

SEQ ID NO: 2197676 - RNA, 21 nt, Homo sapiens
uggaagauuagagguuuguca

SEQ ID NO: 2197677 - RNA, 21 nt, Homo sapiens
uacagaauguucuauugucau

SEQ ID NO: 2197678 - RNA, 13 nt, Homo sapiens
cuucuaccuggaa

SEQ ID NO: 2197679 - RNA, 18 nt, Homo sapiens
auuaaugauaaacucaga

SEQ ID NO: 2197680 - RNA, 21 nt, Homo sapiens
gcauauuggaaagugauuuua

SEQ ID NO: 2197681 - RNA, 18 nt, Homo sapiens
uggacuaaaacauuuuga

SEQ ID NO: 2197682 - RNA, 16 nt, Homo sapiens
uggaagcaacguguua

SEQ ID NO: 2197683 - RNA, 19 nt, Homo sapiens
cuguggacacuguggaaag

SEQ ID NO: 2197684 - RNA, 15 nt, Homo sapiens
ugucucuaaaagccc

SEQ ID NO: 2197685 - RNA, 20 nt, Homo sapiens
cuagaacccccacauuuacc

SEQ ID NO: 2197686 - RNA, 14 nt, Homo sapiens
caggcaacugaggc

SEQ ID NO: 2197687 - RNA, 16 nt, Homo sapiens
aaacacaauaccuaca

SEQ ID NO: 2197688 - RNA, 22 nt, Homo sapiens
agccuguuggacccgcucugga

SEQ ID NO: 2197689 - RNA, 22 nt, Homo sapiens
auuuuuguguauccaguaugca

SEQ ID NO: 2197690 - RNA, 22 nt, Homo sapiens
uuuccuguucagcauucuuagc

SEQ ID NO: 2197691 - RNA, 16 nt, Homo sapiens
guccuuccacugugca

SEQ ID NO: 2197692 - RNA, 16 nt, Homo sapiens
agagacugugccaugg

SEQ ID NO: 2197693 - RNA, 19 nt, Homo sapiens
augcauauuuauagaguua

SEQ ID NO: 2197694 - RNA, 16 nt, Homo sapiens
aaaugacugucccauu

SEQ ID NO: 2197695 - RNA, 20 nt, Homo sapiens
auacauauuuuguauuguuc

SEQ ID NO: 2197696 - RNA, 16 nt, Homo sapiens
cuaauguaggacugua

SEQ ID NO: 2197697 - RNA, 16 nt, Homo sapiens
gguaucaucuucucau

SEQ ID NO: 2197698 - RNA, 17 nt, Homo sapiens
caccaugaagacagggu

SEQ ID NO: 2197699 - RNA, 19 nt, Homo sapiens
cuuccuuauuuuaagcauu

SEQ ID NO: 2197700 - RNA, 22 nt, Homo sapiens
caaaucaauaaacugugucugu

SEQ ID NO: 2197701 - RNA, 17 nt, Homo sapiens
guucaaagugugacauu

SEQ ID NO: 2197702 - RNA, 20 nt, Homo sapiens
auaguuuuuagucuguguag

SEQ ID NO: 2197703 - RNA, 15 nt, Homo sapiens
cuguggccaaguucu

SEQ ID NO: 2197704 - RNA, 21 nt, Homo sapiens
ugguuuuuaucaaauuugcca

SEQ ID NO: 2197705 - RNA, 14 nt, Homo sapiens
gugcauacacaugc

SEQ ID NO: 2197706 - RNA, 15 nt, Homo sapiens
ccugaaaauucugua

SEQ ID NO: 2197707 - RNA, 13 nt, Homo sapiens
uacucagcaguaa

SEQ ID NO: 2197708 - RNA, 17 nt, Homo sapiens
uacaaguugugcaugca

SEQ ID NO: 2197709 - RNA, 18 nt, Homo sapiens
agcacacccgugugcaca

SEQ ID NO: 2197710 - RNA, 23 nt, Homo sapiens
uuugugccagaggaauccuggca

SEQ ID NO: 2197711 - RNA, 20 nt, Homo sapiens
augcgccaauaaaccaauga

SEQ ID NO: 2197712 - RNA, 15 nt, Homo sapiens
aauccuccuaccuca

SEQ ID NO: 2197713 - RNA, 12 nt, Homo sapiens
ggauaugcagua

SEQ ID NO: 2197714 - RNA, 17 nt, Homo sapiens
aacucaggaugccaagu

SEQ ID NO: 2197715 - RNA, 14 nt, Homo sapiens
uguuccucaaagcu

SEQ ID NO: 2197716 - RNA, 17 nt, Homo sapiens
aaugaaggugugcuaca

SEQ ID NO: 2197717 - RNA, 16 nt, Homo sapiens
gucccagccuggccac

SEQ ID NO: 2197718 - RNA, 22 nt, Homo sapiens
uuccagaaagcaaggacugccc

SEQ ID NO: 2197719 - RNA, 13 nt, Homo sapiens
uuuaggcacuguu

SEQ ID NO: 2197720 - RNA, 19 nt, Homo sapiens
aguuucauuuacaauuuca

SEQ ID NO: 2197721 - RNA, 19 nt, Homo sapiens
uucacucuggcauaugauu

SEQ ID NO: 2197722 - RNA, 22 nt, Homo sapiens
aguauauuuuugcaggugcuuu

SEQ ID NO: 2197723 - RNA, 14 nt, Homo sapiens
caauauuugaucua

SEQ ID NO: 2197724 - RNA, 18 nt, Homo sapiens
gagcccagauugugccac

SEQ ID NO: 2197725 - RNA, 14 nt, Homo sapiens
uccugcaaaauccu

SEQ ID NO: 2197726 - RNA, 22 nt, Homo sapiens
aaaaugccucaauucacauaga

SEQ ID NO: 2197727 - RNA, 19 nt, Homo sapiens
ucgccagcugaugacucaa

SEQ ID NO: 2197728 - RNA, 12 nt, Homo sapiens
gaccccaucuca

SEQ ID NO: 2197729 - RNA, 16 nt, Homo sapiens
uguccaucagaugaca

SEQ ID NO: 2197730 - RNA, 22 nt, Homo sapiens
ggcuucggacagugcccaugca

SEQ ID NO: 2197731 - RNA, 23 nt, Homo sapiens
aagaaagaaacacucaacaauaa

SEQ ID NO: 2197732 - RNA, 21 nt, Homo sapiens
uuuccccauuggaacuaguca

SEQ ID NO: 2197733 - RNA, 16 nt, Homo sapiens
aauacauuacauguaa

SEQ ID NO: 2197734 - RNA, 22 nt, Homo sapiens
caaacacccaagcacaaacugu

SEQ ID NO: 2197735 - RNA, 13 nt, Homo sapiens
gacaggcacucca

SEQ ID NO: 2197736 - RNA, 19 nt, Homo sapiens
cugaagcgaacaucuucau

SEQ ID NO: 2197737 - RNA, 17 nt, Homo sapiens
uucucaucuccccacgc

SEQ ID NO: 2197738 - RNA, 18 nt, Homo sapiens
aauaaauuaaaacaugca

SEQ ID NO: 2197739 - RNA, 19 nt, Homo sapiens
guuccaaugucaaugugaa

SEQ ID NO: 2197740 - RNA, 22 nt, Homo sapiens
aaguucuugucuuuaggaugac

SEQ ID NO: 2197741 - RNA, 20 nt, Homo sapiens
uuccacaagaugcugcaaug

SEQ ID NO: 2197742 - RNA, 21 nt, Homo sapiens
ugaagaaaucgggagugcacu

SEQ ID NO: 2197743 - RNA, 21 nt, Homo sapiens
ugaagacuaguuauauauucc

SEQ ID NO: 2197744 - RNA, 16 nt, Homo sapiens
agaucaggagugacag

SEQ ID NO: 2197745 - RNA, 22 nt, Homo sapiens
gauuuaauuuccaggguugcuu

SEQ ID NO: 2197746 - RNA, 14 nt, Homo sapiens
caguacuguuucaa

SEQ ID NO: 2197747 - RNA, 14 nt, Homo sapiens
uugcucugcauuua

SEQ ID NO: 2197748 - RNA, 17 nt, Homo sapiens
caauuuuaaagacauuc

SEQ ID NO: 2197749 - RNA, 19 nt, Homo sapiens
cauacaccacaaaaaccaa

SEQ ID NO: 2197750 - RNA, 18 nt, Homo sapiens
ggcucugaggaguggagu

SEQ ID NO: 2197751 - RNA, 18 nt, Homo sapiens
ucucaaguuaucagggua

SEQ ID NO: 2197752 - RNA, 16 nt, Homo sapiens
aucagaaacuugugaa

SEQ ID NO: 2197753 - RNA, 16 nt, Homo sapiens
cucuguccagccagcu

SEQ ID NO: 2197754 - RNA, 16 nt, Homo sapiens
cauuuaaucaaucuuu

SEQ ID NO: 2197755 - RNA, 20 nt, Homo sapiens
cuccuuggcuuuaugcaaau

SEQ ID NO: 2197756 - RNA, 16 nt, Homo sapiens
aaaggaauccacauca

SEQ ID NO: 2197757 - RNA, 16 nt, Homo sapiens
uuugggcagacccuga

SEQ ID NO: 2197758 - RNA, 20 nt, Homo sapiens
caaacagccccagucuuccu

SEQ ID NO: 2197759 - RNA, 14 nt, Homo sapiens
cugucuugucuuca

SEQ ID NO: 2197760 - RNA, 13 nt, Homo sapiens
ggacugugacuca

SEQ ID NO: 2197761 - RNA, 12 nt, Homo sapiens
aggagaaacugc

SEQ ID NO: 2197762 - RNA, 14 nt, Homo sapiens
aaugaagaccaugc

SEQ ID NO: 2197763 - RNA, 19 nt, Homo sapiens
acuuuuuguuguucauuau

SEQ ID NO: 2197764 - RNA, 19 nt, Homo sapiens
acuucuuucacucacaucu

SEQ ID NO: 2197765 - RNA, 18 nt, Homo sapiens
ugcuguguggaguggaca

SEQ ID NO: 2197766 - RNA, 13 nt, Homo sapiens
caugucacauuua

SEQ ID NO: 2197767 - RNA, 22 nt, Homo sapiens
auuuuagcacaaagaugugcaa

SEQ ID NO: 2197768 - RNA, 18 nt, Homo sapiens
ccgguguuuaagacauuu

SEQ ID NO: 2197769 - RNA, 12 nt, Homo sapiens
gaacccugagag

SEQ ID NO: 2197770 - RNA, 18 nt, Homo sapiens
cccagagacauacuugaa

SEQ ID NO: 2197771 - RNA, 17 nt, Homo sapiens
agcacauagcuugccua

SEQ ID NO: 2197772 - RNA, 22 nt, Homo sapiens
cuuagguuggagaugacagaaa

SEQ ID NO: 2197773 - RNA, 22 nt, Homo sapiens
ggcugggguugccagaggcccu

SEQ ID NO: 2197774 - RNA, 22 nt, Homo sapiens
aucauugcuuaugucaaaugga

SEQ ID NO: 2197775 - RNA, 15 nt, Homo sapiens
acauuuggagugugu

SEQ ID NO: 2197776 - RNA, 23 nt, Homo sapiens
guuaagugccauuacuacuguac

SEQ ID NO: 2197777 - RNA, 19 nt, Homo sapiens
aagucucugacucuugccu

SEQ ID NO: 2197778 - RNA, 14 nt, Homo sapiens
auauacucgaauca

SEQ ID NO: 2197779 - RNA, 16 nt, Homo sapiens
auacuucuaccaacau

SEQ ID NO: 2197780 - RNA, 16 nt, Homo sapiens
gaccucugaagagcug

SEQ ID NO: 2197781 - RNA, 20 nt, Homo sapiens
gccgggcacagcugugguga

SEQ ID NO: 2197782 - RNA, 20 nt, Homo sapiens
agcacggccaccucucaggg

SEQ ID NO: 2197783 - RNA, 14 nt, Homo sapiens
acaugcacagucau

SEQ ID NO: 2197784 - RNA, 18 nt, Homo sapiens
caagucagcucuucucca

SEQ ID NO: 2197785 - RNA, 16 nt, Homo sapiens
gcaccauuccucaaga

SEQ ID NO: 2197786 - RNA, 15 nt, Homo sapiens
cugccuuucuuccau

SEQ ID NO: 2197787 - RNA, 17 nt, Homo sapiens
cuaagcucaaauguaua

SEQ ID NO: 2197788 - RNA, 19 nt, Homo sapiens
ugcagcagaggcacugggg

SEQ ID NO: 2197789 - RNA, 16 nt, Homo sapiens
agcuugaucaaaggca

SEQ ID NO: 2197790 - RNA, 16 nt, Homo sapiens
aaugcugauguccuca

SEQ ID NO: 2197791 - RNA, 22 nt, Homo sapiens
ggccuaaucacucugagucaca

SEQ ID NO: 2197792 - RNA, 14 nt, Homo sapiens
ugaaagaucuucuu

SEQ ID NO: 2197793 - RNA, 16 nt, Homo sapiens
caggagaagugcuccc

SEQ ID NO: 2197794 - RNA, 19 nt, Homo sapiens
uauucgccacacaguauuu

SEQ ID NO: 2197795 - RNA, 13 nt, Homo sapiens
gcaucucugacca

SEQ ID NO: 2197796 - RNA, 19 nt, Homo sapiens
uuucagcuuuaagauaucu

SEQ ID NO: 2197797 - RNA, 18 nt, Homo sapiens
ucauacaaucgucuuaag

SEQ ID NO: 2197798 - RNA, 21 nt, Homo sapiens
agaccuggcuccacucuugau

SEQ ID NO: 2197799 - RNA, 15 nt, Homo sapiens
ucuaacaucuagccc

SEQ ID NO: 2197800 - RNA, 16 nt, Homo sapiens
cuaaagaaaaaugccu

SEQ ID NO: 2197801 - RNA, 18 nt, Homo sapiens
aaguacauaaaguacaua

SEQ ID NO: 2197802 - RNA, 20 nt, Homo sapiens
aaucaugauccuuguguuca

SEQ ID NO: 2197803 - RNA, 14 nt, Homo sapiens
uucauuuuaacaga

SEQ ID NO: 2197804 - RNA, 12 nt, Homo sapiens
gaaaagcaguuu

SEQ ID NO: 2197805 - RNA, 16 nt, Homo sapiens
uggucuccuugcacuu

SEQ ID NO: 2197806 - RNA, 14 nt, Homo sapiens
gcaguugaucucca

SEQ ID NO: 2197807 - RNA, 15 nt, Homo sapiens
cagcagugaucucag

SEQ ID NO: 2197808 - RNA, 17 nt, Homo sapiens
accuggagaugaugaug

SEQ ID NO: 2197809 - RNA, 19 nt, Homo sapiens
agccuagucaugugccuug

SEQ ID NO: 2197810 - RNA, 20 nt, Homo sapiens
cugguuucuguucuguugau

SEQ ID NO: 2197811 - RNA, 17 nt, Homo sapiens
gcaggcucccccugagg

SEQ ID NO: 2197812 - RNA, 23 nt, Homo sapiens
gcccuccuuaauagccauaugca

SEQ ID NO: 2197813 - RNA, 21 nt, Homo sapiens
agaaccugaaagggcauuuug

SEQ ID NO: 2197814 - RNA, 22 nt, Homo sapiens
ccauaaccauuaugcaaguguu

SEQ ID NO: 2197815 - RNA, 20 nt, Homo sapiens
aucuagcaagaagauucuaa

SEQ ID NO: 2197816 - RNA, 16 nt, Homo sapiens
uauagaauuagcuuuu

SEQ ID NO: 2197817 - RNA, 16 nt, Homo sapiens
uuuaaaagcauacucu

SEQ ID NO: 2197818 - RNA, 16 nt, Homo sapiens
gccauaccuucuccca

SEQ ID NO: 2197819 - RNA, 23 nt, Homo sapiens
cuaugaucugagucagagccaug

SEQ ID NO: 2197820 - RNA, 19 nt, Homo sapiens
aaugcauuuggaaccaaag

SEQ ID NO: 2197821 - RNA, 13 nt, Homo sapiens
aaagaagguuuca

SEQ ID NO: 2197822 - RNA, 20 nt, Homo sapiens
gaauagagauggucaauuaa

SEQ ID NO: 2197823 - RNA, 19 nt, Homo sapiens
ggcccuuuggcuucugauu

SEQ ID NO: 2197824 - RNA, 12 nt, Homo sapiens
auuuugauucag

SEQ ID NO: 2197825 - RNA, 14 nt, Homo sapiens
aaguugugauuuga

SEQ ID NO: 2197826 - RNA, 18 nt, Homo sapiens
cuagugacaccucaguca

SEQ ID NO: 2197827 - RNA, 19 nt, Homo sapiens
uccagagauaaaaaucaua

SEQ ID NO: 2197828 - RNA, 12 nt, Homo sapiens
ccaguacuggga

SEQ ID NO: 2197829 - RNA, 21 nt, Homo sapiens
uuaagcaaauacuuagcaaaa

SEQ ID NO: 2197830 - RNA, 23 nt, Homo sapiens
uucacaaaaaggcauaugcaaua

SEQ ID NO: 2197831 - RNA, 13 nt, Homo sapiens
cugugcaucuggc

SEQ ID NO: 2197832 - RNA, 13 nt, Homo sapiens
accagaggacaaa

SEQ ID NO: 2197833 - RNA, 18 nt, Homo sapiens
ccagcugcagaagggugg

SEQ ID NO: 2197834 - RNA, 19 nt, Homo sapiens
ugguaaucauaugugucuu

SEQ ID NO: 2197835 - RNA, 18 nt, Homo sapiens
cagugccaugacugagaa

SEQ ID NO: 2197836 - RNA, 14 nt, Homo sapiens
aguaauaugcacac

SEQ ID NO: 2197837 - RNA, 19 nt, Homo sapiens
uacuguaaucgugcuauuu

SEQ ID NO: 2197838 - RNA, 13 nt, Homo sapiens
cuaccuugccucc

SEQ ID NO: 2197839 - RNA, 23 nt, Homo sapiens
acagaaauccacgcucaaucuca

SEQ ID NO: 2197840 - RNA, 20 nt, Homo sapiens
auccuuaacacauucaauag

SEQ ID NO: 2197841 - RNA, 14 nt, Homo sapiens
ucucuacugaucaa

SEQ ID NO: 2197842 - RNA, 19 nt, Homo sapiens
ucugcacuguucaaaccuc

SEQ ID NO: 2197843 - RNA, 22 nt, Homo sapiens
accugugagcccagcuggguca

SEQ ID NO: 2197844 - RNA, 17 nt, Homo sapiens
uauaaaagaauugcacg

SEQ ID NO: 2197845 - RNA, 17 nt, Homo sapiens
cccgcuaaggugaaaag

SEQ ID NO: 2197846 - RNA, 17 nt, Homo sapiens
ggccaugagcuccagac

SEQ ID NO: 2197847 - RNA, 20 nt, Homo sapiens
cuuugaaaaaucacuugauu

SEQ ID NO: 2197848 - RNA, 15 nt, Homo sapiens
guaggaagacuuugg

SEQ ID NO: 2197849 - RNA, 21 nt, Homo sapiens
ugagcacacccgugugcacac

SEQ ID NO: 2197850 - RNA, 16 nt, Homo sapiens
uucugucuggagugac

SEQ ID NO: 2197851 - RNA, 16 nt, Homo sapiens
ucccaccggugccaaa

SEQ ID NO: 2197852 - RNA, 18 nt, Homo sapiens
cuggcacuuagcccaaga

SEQ ID NO: 2197853 - RNA, 15 nt, Homo sapiens
gugugaacguguaug

SEQ ID NO: 2197854 - RNA, 19 nt, Homo sapiens
ugcaauaauacuucucaaa

SEQ ID NO: 2197855 - RNA, 16 nt, Homo sapiens
aaaaugccuccauggc

SEQ ID NO: 2197856 - RNA, 19 nt, Homo sapiens
uccagaguaggugggucuu

SEQ ID NO: 2197857 - RNA, 21 nt, Homo sapiens
cacagaugaugaagaaaugau

SEQ ID NO: 2197858 - RNA, 23 nt, Homo sapiens
aaacuagauucauggcuuuaaca

SEQ ID NO: 2197859 - RNA, 19 nt, Homo sapiens
caggggcuucccacuuugg

SEQ ID NO: 2197860 - RNA, 20 nt, Homo sapiens
ucaauguuuguccuguauaa

SEQ ID NO: 2197861 - RNA, 22 nt, Homo sapiens
caaaggcgcuuugaaacagggg

SEQ ID NO: 2197862 - RNA, 15 nt, Homo sapiens
ccaacuacagaaaga

SEQ ID NO: 2197863 - RNA, 20 nt, Homo sapiens
gacccaccccugugcuccgu

SEQ ID NO: 2197864 - RNA, 15 nt, Homo sapiens
caugugauugugauu

SEQ ID NO: 2197865 - RNA, 14 nt, Homo sapiens
uaaaagcacacuca

SEQ ID NO: 2197866 - RNA, 15 nt, Homo sapiens
uuuaaucuuccaugg

SEQ ID NO: 2197867 - RNA, 16 nt, Homo sapiens
ugcugaagacuugccc

SEQ ID NO: 2197868 - RNA, 21 nt, Homo sapiens
caauguccugaaacaugaacc

SEQ ID NO: 2197869 - RNA, 23 nt, Homo sapiens
ugucaugugcgaacacagugaca

SEQ ID NO: 2197870 - RNA, 13 nt, Homo sapiens
aauuugccuuugc

SEQ ID NO: 2197871 - RNA, 22 nt, Homo sapiens
uaugagaugguuaaaaaggcca

SEQ ID NO: 2197872 - RNA, 17 nt, Homo sapiens
ucccucgggugugcuau

SEQ ID NO: 2197873 - RNA, 21 nt, Homo sapiens
ugcaacucaaggacuuugcag

SEQ ID NO: 2197874 - RNA, 12 nt, Homo sapiens
gagacaguccag

SEQ ID NO: 2197875 - RNA, 12 nt, Homo sapiens
caggcagugcaa

SEQ ID NO: 2197876 - RNA, 12 nt, Homo sapiens
uugaggagcauu

SEQ ID NO: 2197877 - RNA, 20 nt, Homo sapiens
auuugcucuucauccaggga

SEQ ID NO: 2197878 - RNA, 15 nt, Homo sapiens
aggggccccauggca

SEQ ID NO: 2197879 - RNA, 16 nt, Homo sapiens
gugcaaaaucuguuau

SEQ ID NO: 2197880 - RNA, 15 nt, Homo sapiens
ucuccgcacuuggaa

SEQ ID NO: 2197881 - RNA, 20 nt, Homo sapiens
aucuauguaucuaccaucua

SEQ ID NO: 2197882 - RNA, 20 nt, Homo sapiens
aaggaggcaugccucugaua

SEQ ID NO: 2197883 - RNA, 18 nt, Homo sapiens
ucagucuuggugguucua

SEQ ID NO: 2197884 - RNA, 15 nt, Homo sapiens
cuuaaggacaguguu

SEQ ID NO: 2197885 - RNA, 14 nt, Homo sapiens
cuccuccagagccu

SEQ ID NO: 2197886 - RNA, 13 nt, Homo sapiens
accuucacuuaaa

SEQ ID NO: 2197887 - RNA, 15 nt, Homo sapiens
aaugcuucugccuca

SEQ ID NO: 2197888 - RNA, 13 nt, Homo sapiens
gaauccacagcuc

SEQ ID NO: 2197889 - RNA, 13 nt, Homo sapiens
aauaaaucuuccu

SEQ ID NO: 2197890 - RNA, 14 nt, Homo sapiens
ggaggucucuguaa

SEQ ID NO: 2197891 - RNA, 17 nt, Homo sapiens
ucuccugacaugucuca

SEQ ID NO: 2197892 - RNA, 16 nt, Homo sapiens
uuucaguuucuaucaa

SEQ ID NO: 2197893 - RNA, 14 nt, Homo sapiens
aggggagaguccag

SEQ ID NO: 2197894 - RNA, 17 nt, Homo sapiens
ucaugacagucagcaac

SEQ ID NO: 2197895 - RNA, 16 nt, Homo sapiens
uggacuguacaauaag

SEQ ID NO: 2197896 - RNA, 23 nt, Homo sapiens
gcccugacccccaucgcucugag

SEQ ID NO: 2197897 - RNA, 23 nt, Homo sapiens
uuccaagacaguuguaucacaaa

SEQ ID NO: 2197898 - RNA, 14 nt, Homo sapiens
agcuuuuccugcau

SEQ ID NO: 2197899 - RNA, 19 nt, Homo sapiens
gaaucauuccacuauacaa

SEQ ID NO: 2197900 - RNA, 20 nt, Homo sapiens
cugauugcgcaaaacugaaa

SEQ ID NO: 2197901 - RNA, 13 nt, Homo sapiens
uuaacuggagcuc

SEQ ID NO: 2197902 - RNA, 23 nt, Homo sapiens
aggaucucugagaccacagaggc

SEQ ID NO: 2197903 - RNA, 20 nt, Homo sapiens
caguggcugggggacugcuu

SEQ ID NO: 2197904 - RNA, 12 nt, Homo sapiens
cugucuaccuga

SEQ ID NO: 2197905 - RNA, 12 nt, Homo sapiens
guguugauccca

SEQ ID NO: 2197906 - RNA, 16 nt, Homo sapiens
cagaagacacugcaaa

SEQ ID NO: 2197907 - RNA, 16 nt, Homo sapiens
cccugaaccacgaggc

SEQ ID NO: 2197908 - RNA, 14 nt, Homo sapiens
ccccuugggugacc

SEQ ID NO: 2197909 - RNA, 14 nt, Homo sapiens
ucacaguaaugugu

SEQ ID NO: 2197910 - RNA, 13 nt, Homo sapiens
cuucugcucccau

SEQ ID NO: 2197911 - RNA, 21 nt, Homo sapiens
acaugccaggccucagggauc

SEQ ID NO: 2197912 - RNA, 12 nt, Homo sapiens
uguucacaguua

SEQ ID NO: 2197913 - RNA, 14 nt, Homo sapiens
ggcuuugcauuucu

SEQ ID NO: 2197914 - RNA, 23 nt, Homo sapiens
agaaauguuaaagguucacaggg

SEQ ID NO: 2197915 - RNA, 23 nt, Homo sapiens
uggaaaaaaacaaaaacagaauu

SEQ ID NO: 2197916 - RNA, 19 nt, Homo sapiens
ccauaugcaguuuacuuug

SEQ ID NO: 2197917 - RNA, 13 nt, Homo sapiens
ccuuagugcuaua

SEQ ID NO: 2197918 - RNA, 13 nt, Homo sapiens
ucaaaguguuuaa

SEQ ID NO: 2197919 - RNA, 15 nt, Homo sapiens
agguccugcauuucu

SEQ ID NO: 2197920 - RNA, 15 nt, Homo sapiens
cuccuggaaccuugc

SEQ ID NO: 2197921 - RNA, 17 nt, Homo sapiens
gaauaucauugauuuua

SEQ ID NO: 2197922 - RNA, 22 nt, Homo sapiens
cugcugaacaaaauuaaacuuc

SEQ ID NO: 2197923 - RNA, 18 nt, Homo sapiens
auccauugaacuaaaaua

SEQ ID NO: 2197924 - RNA, 12 nt, Homo sapiens
uuugucaccuca

SEQ ID NO: 2197925 - RNA, 16 nt, Homo sapiens
cuggaaagacauagcc

SEQ ID NO: 2197926 - RNA, 22 nt, Homo sapiens
cccauaggcccacacacaggug

SEQ ID NO: 2197927 - RNA, 22 nt, Homo sapiens
gaacuggagccaugggcacaaa

SEQ ID NO: 2197928 - RNA, 18 nt, Homo sapiens
auauuguaaucacauucc

SEQ ID NO: 2197929 - RNA, 20 nt, Homo sapiens
cuauaccgcuucgacuggaa

SEQ ID NO: 2197930 - RNA, 15 nt, Homo sapiens
uguggcccaagacaa

SEQ ID NO: 2197931 - RNA, 14 nt, Homo sapiens
ucccuuaggaauau

SEQ ID NO: 2197932 - RNA, 16 nt, Homo sapiens
augaagcaaacacauu

SEQ ID NO: 2197933 - RNA, 21 nt, Homo sapiens
uacgaccgggagguccaccug

SEQ ID NO: 2197934 - RNA, 19 nt, Homo sapiens
uugcgacaccucaaggugu

SEQ ID NO: 2197935 - RNA, 13 nt, Homo sapiens
aagacccucccau

SEQ ID NO: 2197936 - RNA, 12 nt, Homo sapiens
ggcuuuaugcaa

SEQ ID NO: 2197937 - RNA, 14 nt, Homo sapiens
ugaauuaagccauc

SEQ ID NO: 2197938 - RNA, 17 nt, Homo sapiens
ugggugcugucaugccc

SEQ ID NO: 2197939 - RNA, 22 nt, Homo sapiens
gcagucuuuugugucagugucu

SEQ ID NO: 2197940 - RNA, 16 nt, Homo sapiens
caccacgucacuucau

SEQ ID NO: 2197941 - RNA, 21 nt, Homo sapiens
cugagccaaagagaaugccau

SEQ ID NO: 2197942 - RNA, 17 nt, Homo sapiens
acugcccugucuagguc

SEQ ID NO: 2197943 - RNA, 16 nt, Homo sapiens
auguuugccuucugca

SEQ ID NO: 2197944 - RNA, 19 nt, Homo sapiens
gagccaugaucaugccacu

SEQ ID NO: 2197945 - RNA, 15 nt, Homo sapiens
ugcaggccaccagcu

SEQ ID NO: 2197946 - RNA, 17 nt, Homo sapiens
cucugccuccucuucaa

SEQ ID NO: 2197947 - RNA, 13 nt, Homo sapiens
aacaaggugcaca

SEQ ID NO: 2197948 - RNA, 17 nt, Homo sapiens
augacaaaaaggugcag

SEQ ID NO: 2197949 - RNA, 20 nt, Homo sapiens
ugcauaaguucuuaauguca

SEQ ID NO: 2197950 - RNA, 16 nt, Homo sapiens
uaaauguauaggcaga

SEQ ID NO: 2197951 - RNA, 14 nt, Homo sapiens
uaagcuuuucauua

SEQ ID NO: 2197952 - RNA, 14 nt, Homo sapiens
uaaaauauucacuc

SEQ ID NO: 2197953 - RNA, 22 nt, Homo sapiens
cuuauccuguucuauaacaguu

SEQ ID NO: 2197954 - RNA, 20 nt, Homo sapiens
ucauggggaagcuuccauga

SEQ ID NO: 2197955 - RNA, 21 nt, Homo sapiens
cugccggucgggcagccagca

SEQ ID NO: 2197956 - RNA, 19 nt, Homo sapiens
agcuguccugucaguuccc

SEQ ID NO: 2197957 - RNA, 21 nt, Homo sapiens
agcauuagcuuuaauuaagcu

SEQ ID NO: 2197958 - RNA, 23 nt, Homo sapiens
cacuauguguguuguuuccauag

SEQ ID NO: 2197959 - RNA, 19 nt, Homo sapiens
uuuauggagaccucuccuu

SEQ ID NO: 2197960 - RNA, 23 nt, Homo sapiens
auguccggcugaaggcugagugu

SEQ ID NO: 2197961 - RNA, 19 nt, Homo sapiens
gccagacccacaaggccag

SEQ ID NO: 2197962 - RNA, 14 nt, Homo sapiens
ggacuaugcaugug

SEQ ID NO: 2197963 - RNA, 13 nt, Homo sapiens
uccuccaacagcu

SEQ ID NO: 2197964 - RNA, 23 nt, Homo sapiens
ccuuggcauccuggcauucucaa

SEQ ID NO: 2197965 - RNA, 15 nt, Homo sapiens
auaagcuguuuuuau

SEQ ID NO: 2197966 - RNA, 15 nt, Homo sapiens
caucaucuaagguga

SEQ ID NO: 2197967 - RNA, 16 nt, Homo sapiens
cacacacaaccacaaa

SEQ ID NO: 2197968 - RNA, 13 nt, Homo sapiens
aaucauacaguaa

SEQ ID NO: 2197969 - RNA, 13 nt, Homo sapiens
ugcaacauaacaa

SEQ ID NO: 2197970 - RNA, 13 nt, Homo sapiens
aacaucauugcau

SEQ ID NO: 2197971 - RNA, 13 nt, Homo sapiens
aaugccauugugc

SEQ ID NO: 2197972 - RNA, 14 nt, Homo sapiens
ucuucauccaggga

SEQ ID NO: 2197973 - RNA, 20 nt, Homo sapiens
augagcaucccaggaucgca

SEQ ID NO: 2197974 - RNA, 14 nt, Homo sapiens
uaaacacagggaag

SEQ ID NO: 2197975 - RNA, 15 nt, Homo sapiens
ggguagcacugggaa

SEQ ID NO: 2197976 - RNA, 18 nt, Homo sapiens
auggacgaacaggggcca

SEQ ID NO: 2197977 - RNA, 15 nt, Homo sapiens
cacaaccugcaucuu

SEQ ID NO: 2197978 - RNA, 19 nt, Homo sapiens
uaucaaaauguuguccuuu

SEQ ID NO: 2197979 - RNA, 13 nt, Homo sapiens
gccgggaaccaag

SEQ ID NO: 2197980 - RNA, 13 nt, Homo sapiens
ccagagaagccaa

SEQ ID NO: 2197981 - RNA, 15 nt, Homo sapiens
auuccacuccacuca

SEQ ID NO: 2197982 - RNA, 12 nt, Homo sapiens
ccucagauucca

SEQ ID NO: 2197983 - RNA, 14 nt, Homo sapiens
gagcagcauggauu

SEQ ID NO: 2197984 - RNA, 18 nt, Homo sapiens
acuugucuuguucaccuu

SEQ ID NO: 2197985 - RNA, 13 nt, Homo sapiens
agaccauugcaau

SEQ ID NO: 2197986 - RNA, 19 nt, Homo sapiens
cacuguaccccagcucucu

SEQ ID NO: 2197987 - RNA, 17 nt, Homo sapiens
uaaggggugaaucuccu

SEQ ID NO: 2197988 - RNA, 15 nt, Homo sapiens
uaaacuuucucugca

SEQ ID NO: 2197989 - RNA, 12 nt, Homo sapiens
uaaaauuuugca

SEQ ID NO: 2197990 - RNA, 19 nt, Homo sapiens
cccuggccuccccugccac

SEQ ID NO: 2197991 - RNA, 22 nt, Homo sapiens
acuacuuaaaaugauucucuac

SEQ ID NO: 2197992 - RNA, 12 nt, Homo sapiens
gugauuuuggcc

SEQ ID NO: 2197993 - RNA, 15 nt, Homo sapiens
uuguggccucauuca

SEQ ID NO: 2197994 - RNA, 15 nt, Homo sapiens
acccuaagugacaca

SEQ ID NO: 2197995 - RNA, 19 nt, Homo sapiens
guaauagaucagcauccaa

SEQ ID NO: 2197996 - RNA, 12 nt, Homo sapiens
ccucacucagcu

SEQ ID NO: 2197997 - RNA, 21 nt, Homo sapiens
cauugccauagcugacuacaa

SEQ ID NO: 2197998 - RNA, 14 nt, Homo sapiens
uacagggcuaggca

SEQ ID NO: 2197999 - RNA, 21 nt, Homo sapiens
uuaaaaugucaagacagggaa

SEQ ID NO: 2198000 - RNA, 18 nt, Homo sapiens
cuucacgaacagcguuuu

SEQ ID NO: 2198001 - RNA, 21 nt, Homo sapiens
ucugaaagagaaaucaaugaa

SEQ ID NO: 2198002 - RNA, 18 nt, Homo sapiens
gauugaaguggcuggaaa

SEQ ID NO: 2198003 - RNA, 15 nt, Homo sapiens
uaaaagcuugaugaa

SEQ ID NO: 2198004 - RNA, 21 nt, Homo sapiens
uccauuuugugucugugaaca

SEQ ID NO: 2198005 - RNA, 15 nt, Homo sapiens
uucaagaaugcagua

SEQ ID NO: 2198006 - RNA, 19 nt, Homo sapiens
gcuccucggcagaugcugu

SEQ ID NO: 2198007 - RNA, 16 nt, Homo sapiens
uuacuaagcuuugcca

SEQ ID NO: 2198008 - RNA, 18 nt, Homo sapiens
cauuaaaaugacaaacau

SEQ ID NO: 2198009 - RNA, 11 nt, Homo sapiens
cagugaaggcu

SEQ ID NO: 2198010 - RNA, 16 nt, Homo sapiens
gugacaaaauguugau

SEQ ID NO: 2198011 - RNA, 18 nt, Homo sapiens
uuugauugcuuugcugca

SEQ ID NO: 2198012 - RNA, 23 nt, Homo sapiens
aggucauccaaagaacaucugca

SEQ ID NO: 2198013 - RNA, 14 nt, Homo sapiens
auaauaacagcagu

SEQ ID NO: 2198014 - RNA, 19 nt, Homo sapiens
gauucagcucccacacaca

SEQ ID NO: 2198015 - RNA, 21 nt, Homo sapiens
cccuggcauguuucaccacaa

SEQ ID NO: 2198016 - RNA, 19 nt, Homo sapiens
gagugaguacaugcacacu

SEQ ID NO: 2198017 - RNA, 14 nt, Homo sapiens
agcaggagcagcug

SEQ ID NO: 2198018 - RNA, 22 nt, Homo sapiens
gugugauuugaauucugugaua

SEQ ID NO: 2198019 - RNA, 20 nt, Homo sapiens
uuccaccuccaccacaucug

SEQ ID NO: 2198020 - RNA, 17 nt, Homo sapiens
cuacacacauccacgca

SEQ ID NO: 2198021 - RNA, 17 nt, Homo sapiens
aacccagacaaccaaaa

SEQ ID NO: 2198022 - RNA, 17 nt, Homo sapiens
uaaauaaacacauagau

SEQ ID NO: 2198023 - RNA, 20 nt, Homo sapiens
cuaauucuuguagaugcauu

SEQ ID NO: 2198024 - RNA, 21 nt, Homo sapiens
aggugcccccaggugagacag

SEQ ID NO: 2198025 - RNA, 21 nt, Homo sapiens
ccuccacgggcucuccugggc

SEQ ID NO: 2198026 - RNA, 14 nt, Homo sapiens
cccugcucuugcag

SEQ ID NO: 2198027 - RNA, 13 nt, Homo sapiens
uggugcaugccug

SEQ ID NO: 2198028 - RNA, 14 nt, Homo sapiens
aaauugauguugau

SEQ ID NO: 2198029 - RNA, 17 nt, Homo sapiens
ucucugaucacaacuuu

SEQ ID NO: 2198030 - RNA, 22 nt, Homo sapiens
uuaaaaauacggacguacuuug

SEQ ID NO: 2198031 - RNA, 12 nt, Homo sapiens
acgaacuuucca

SEQ ID NO: 2198032 - RNA, 19 nt, Homo sapiens
gccaaaaugacuuugaacu

SEQ ID NO: 2198033 - RNA, 23 nt, Homo sapiens
acuucagauugaacuuacuguag

SEQ ID NO: 2198034 - RNA, 16 nt, Homo sapiens
agcucucacaugcaca

SEQ ID NO: 2198035 - RNA, 14 nt, Homo sapiens
ugcaguagugucac

SEQ ID NO: 2198036 - RNA, 20 nt, Homo sapiens
agcaguuagaaauacauuau

SEQ ID NO: 2198037 - RNA, 20 nt, Homo sapiens
uuagcaagcaacugagauuu

SEQ ID NO: 2198038 - RNA, 22 nt, Homo sapiens
ccuuccgugggucaucccagca

SEQ ID NO: 2198039 - RNA, 12 nt, Homo sapiens
ugcacuucaaaa

SEQ ID NO: 2198040 - RNA, 16 nt, Homo sapiens
ccauuucaggacucuc

SEQ ID NO: 2198041 - RNA, 23 nt, Homo sapiens
agggucuuaccucucugggaccu

SEQ ID NO: 2198042 - RNA, 23 nt, Homo sapiens
aaugcagcaggaaggaacaaaga

SEQ ID NO: 2198043 - RNA, 15 nt, Homo sapiens
agaagggcacuguaa

SEQ ID NO: 2198044 - RNA, 23 nt, Homo sapiens
cuucauccccuuuggcuaccuga

SEQ ID NO: 2198045 - RNA, 20 nt, Homo sapiens
uaccucugagaagacacaag

SEQ ID NO: 2198046 - RNA, 18 nt, Homo sapiens
aauugcucuuucacaggu

SEQ ID NO: 2198047 - RNA, 15 nt, Homo sapiens
aacuuucaagaacuu

SEQ ID NO: 2198048 - RNA, 12 nt, Homo sapiens
cagauauuucac

SEQ ID NO: 2198049 - RNA, 18 nt, Homo sapiens
aaagcagaaugugauauc

SEQ ID NO: 2198050 - RNA, 23 nt, Homo sapiens
gacucgccucugcuccugugguc

SEQ ID NO: 2198051 - RNA, 17 nt, Homo sapiens
auaccaguucuugcaau

SEQ ID NO: 2198052 - RNA, 17 nt, Homo sapiens
gaggucaggccccacuc

SEQ ID NO: 2198053 - RNA, 20 nt, Homo sapiens
agcaucagugcccuccagga

SEQ ID NO: 2198054 - RNA, 14 nt, Homo sapiens
aaaggauucucuaa

SEQ ID NO: 2198055 - RNA, 13 nt, Homo sapiens
gaaacugcacugu

SEQ ID NO: 2198056 - RNA, 16 nt, Homo sapiens
augcaaucuuggcuca

SEQ ID NO: 2198057 - RNA, 14 nt, Homo sapiens
aggugaaacccagu

SEQ ID NO: 2198058 - RNA, 17 nt, Homo sapiens
ccagaaaaccuccagua

SEQ ID NO: 2198059 - RNA, 20 nt, Homo sapiens
aguuucauuaacuggugaau

SEQ ID NO: 2198060 - RNA, 12 nt, Homo sapiens
uacccuuugaau

SEQ ID NO: 2198061 - RNA, 16 nt, Homo sapiens
ucgguggcucaugccu

SEQ ID NO: 2198062 - RNA, 21 nt, Homo sapiens
uaaaagcaagauuuugucaaa

SEQ ID NO: 2198063 - RNA, 19 nt, Homo sapiens
uaugugcgugugugcaagu

SEQ ID NO: 2198064 - RNA, 13 nt, Homo sapiens
aauucauauucuu

SEQ ID NO: 2198065 - RNA, 13 nt, Homo sapiens
aauuuauauucuc

SEQ ID NO: 2198066 - RNA, 19 nt, Homo sapiens
aacuuuggugaacaguuuu

SEQ ID NO: 2198067 - RNA, 19 nt, Homo sapiens
uaauuuaccugaagucuuu

SEQ ID NO: 2198068 - RNA, 20 nt, Homo sapiens
gugaucgcacaaccugcauc

SEQ ID NO: 2198069 - RNA, 21 nt, Homo sapiens
auuguuugguaaauguuucuu

SEQ ID NO: 2198070 - RNA, 17 nt, Homo sapiens
cagugcaacagcacugg

SEQ ID NO: 2198071 - RNA, 14 nt, Homo sapiens
ugaaagauucagug

SEQ ID NO: 2198072 - RNA, 14 nt, Homo sapiens
gcuccugcaucuca

SEQ ID NO: 2198073 - RNA, 17 nt, Homo sapiens
caaccucagcccugaaa

SEQ ID NO: 2198074 - RNA, 20 nt, Homo sapiens
ucuagggaaugggacuguga

SEQ ID NO: 2198075 - RNA, 22 nt, Homo sapiens
cccaacuccccuccgucuguga

SEQ ID NO: 2198076 - RNA, 23 nt, Homo sapiens
aauacccacugccagacaugcca

SEQ ID NO: 2198077 - RNA, 17 nt, Homo sapiens
gccucucuuuuugggcu

SEQ ID NO: 2198078 - RNA, 16 nt, Homo sapiens
gucccaagcccaggga

SEQ ID NO: 2198079 - RNA, 16 nt, Homo sapiens
gcauaaaaacauuuua

SEQ ID NO: 2198080 - RNA, 20 nt, Homo sapiens
aguaauuuugugaaagaagg

SEQ ID NO: 2198081 - RNA, 19 nt, Homo sapiens
gauuucaaagcaagucaac

SEQ ID NO: 2198082 - RNA, 16 nt, Homo sapiens
aucucuagagugagaa

SEQ ID NO: 2198083 - RNA, 23 nt, Homo sapiens
cauugguuggaagcuaccagagc

SEQ ID NO: 2198084 - RNA, 16 nt, Homo sapiens
gcaggccccagccaag

SEQ ID NO: 2198085 - RNA, 16 nt, Homo sapiens
auuaaaauaaaccaaa

SEQ ID NO: 2198086 - RNA, 18 nt, Homo sapiens
guaacagugcaguacuca

SEQ ID NO: 2198087 - RNA, 19 nt, Homo sapiens
acggugcagucugggugcu

SEQ ID NO: 2198088 - RNA, 13 nt, Homo sapiens
uaauaacauaaca

SEQ ID NO: 2198089 - RNA, 16 nt, Homo sapiens
ucccucucaugguacc

SEQ ID NO: 2198090 - RNA, 12 nt, Homo sapiens
caagaacuucua

SEQ ID NO: 2198091 - RNA, 13 nt, Homo sapiens
ugcaccaaaucau

SEQ ID NO: 2198092 - RNA, 11 nt, Homo sapiens
uuccucugcau

SEQ ID NO: 2198093 - RNA, 22 nt, Homo sapiens
uuuaauuauaaucucuucuuau

SEQ ID NO: 2198094 - RNA, 17 nt, Homo sapiens
guaaaaagggggcugca

SEQ ID NO: 2198095 - RNA, 13 nt, Homo sapiens
gcgugguggcaca

SEQ ID NO: 2198096 - RNA, 13 nt, Homo sapiens
cuacagugcugug

SEQ ID NO: 2198097 - RNA, 20 nt, Homo sapiens
acugccagcucuuccuagcu

SEQ ID NO: 2198098 - RNA, 14 nt, Homo sapiens
cuguggcugacgaa

SEQ ID NO: 2198099 - RNA, 13 nt, Homo sapiens
ccuguguccucca

SEQ ID NO: 2198100 - RNA, 18 nt, Homo sapiens
ucagagucuggccugcca

SEQ ID NO: 2198101 - RNA, 22 nt, Homo sapiens
ugauucgcccaccucagccucc

SEQ ID NO: 2198102 - RNA, 21 nt, Homo sapiens
ugaauuuggccugcacuaauu

SEQ ID NO: 2198103 - RNA, 21 nt, Homo sapiens
auugcuucaauaauauuagcu

SEQ ID NO: 2198104 - RNA, 20 nt, Homo sapiens
guuuuagagacuauggagcc

SEQ ID NO: 2198105 - RNA, 18 nt, Homo sapiens
aguaaaagagagcugccc

SEQ ID NO: 2198106 - RNA, 17 nt, Homo sapiens
guacuuuggaugcaauu

SEQ ID NO: 2198107 - RNA, 20 nt, Homo sapiens
ugagccuugcauguacuuga

SEQ ID NO: 2198108 - RNA, 19 nt, Homo sapiens
uaagccaagagagccucuu

SEQ ID NO: 2198109 - RNA, 19 nt, Homo sapiens
gaauguuuacuacauuucc

SEQ ID NO: 2198110 - RNA, 23 nt, Homo sapiens
agaucccacauauuucaaaaaca

SEQ ID NO: 2198111 - RNA, 14 nt, Homo sapiens
cacugccaccagca

SEQ ID NO: 2198112 - RNA, 13 nt, Homo sapiens
agguguccggggg

SEQ ID NO: 2198113 - RNA, 20 nt, Homo sapiens
uccuacagugacucccuggg

SEQ ID NO: 2198114 - RNA, 15 nt, Homo sapiens
gaaaagcuguuccca

SEQ ID NO: 2198115 - RNA, 15 nt, Homo sapiens
auguggguuuuacac

SEQ ID NO: 2198116 - RNA, 18 nt, Homo sapiens
ccugggaggguguggugc

SEQ ID NO: 2198117 - RNA, 15 nt, Homo sapiens
uguguaccacuuccu

SEQ ID NO: 2198118 - RNA, 22 nt, Homo sapiens
ugaugcccucuucuccuugccu

SEQ ID NO: 2198119 - RNA, 18 nt, Homo sapiens
cuaggggagucccugugg

SEQ ID NO: 2198120 - RNA, 18 nt, Homo sapiens
uacaguugaaagcuguau

SEQ ID NO: 2198121 - RNA, 17 nt, Homo sapiens
gcccgagccugaacuga

SEQ ID NO: 2198122 - RNA, 21 nt, Homo sapiens
caggugcuuuuauuuucacag

SEQ ID NO: 2198123 - RNA, 21 nt, Homo sapiens
cuaauuugcacuaauguguua

SEQ ID NO: 2198124 - RNA, 14 nt, Homo sapiens
acuuaaaagauuca

SEQ ID NO: 2198125 - RNA, 14 nt, Homo sapiens
aaugcaaagcugaa

SEQ ID NO: 2198126 - RNA, 11 nt, Homo sapiens
uggcugugagg

SEQ ID NO: 2198127 - RNA, 11 nt, Homo sapiens
uuccugugauc

SEQ ID NO: 2198128 - RNA, 23 nt, Homo sapiens
aggaauccuggcagcccagagac

SEQ ID NO: 2198129 - RNA, 22 nt, Homo sapiens
ccugguaaaagggauacacagg

SEQ ID NO: 2198130 - RNA, 15 nt, Homo sapiens
uuaggcuauucacaa

SEQ ID NO: 2198131 - RNA, 22 nt, Homo sapiens
auuuucucucacugaugcccuu

SEQ ID NO: 2198132 - RNA, 15 nt, Homo sapiens
cugcaugucucaggc

SEQ ID NO: 2198133 - RNA, 18 nt, Homo sapiens
gucugacacaugcucuca

SEQ ID NO: 2198134 - RNA, 22 nt, Homo sapiens
cgaguguccagccaagggcuga

SEQ ID NO: 2198135 - RNA, 15 nt, Homo sapiens
guacuuggaguaauu

SEQ ID NO: 2198136 - RNA, 22 nt, Homo sapiens
uggggagucagucaugucacug

SEQ ID NO: 2198137 - RNA, 16 nt, Homo sapiens
cuuuacaauuucacuu

SEQ ID NO: 2198138 - RNA, 15 nt, Homo sapiens
cuagagcacugccac

SEQ ID NO: 2198139 - RNA, 14 nt, Homo sapiens
aaugaaggugccau

SEQ ID NO: 2198140 - RNA, 16 nt, Homo sapiens
cgauucucuugccuca

SEQ ID NO: 2198141 - RNA, 16 nt, Homo sapiens
ugauucuccugccuca

SEQ ID NO: 2198142 - RNA, 18 nt, Homo sapiens
uuggagaacaacaaggac

SEQ ID NO: 2198143 - RNA, 17 nt, Homo sapiens
uuuccuuuucugucucu

SEQ ID NO: 2198144 - RNA, 22 nt, Homo sapiens
cauuggacccugacuguauaca

SEQ ID NO: 2198145 - RNA, 15 nt, Homo sapiens
ucugauacguguaug

SEQ ID NO: 2198146 - RNA, 20 nt, Homo sapiens
gcaaacuuggugaaacuaca

SEQ ID NO: 2198147 - RNA, 14 nt, Homo sapiens
augugccaagaaua

SEQ ID NO: 2198148 - RNA, 19 nt, Homo sapiens
caagucacacagcuaguga

SEQ ID NO: 2198149 - RNA, 22 nt, Homo sapiens
cccuccugcccaggacugcauu

SEQ ID NO: 2198150 - RNA, 16 nt, Homo sapiens
ucaaauacaugcacag

SEQ ID NO: 2198151 - RNA, 19 nt, Homo sapiens
gcaugggaaaaauguugga

SEQ ID NO: 2198152 - RNA, 14 nt, Homo sapiens
augccacagccaag

SEQ ID NO: 2198153 - RNA, 17 nt, Homo sapiens
uuaauauuuuaagcacu

SEQ ID NO: 2198154 - RNA, 14 nt, Homo sapiens
cuaccacucaggaa

SEQ ID NO: 2198155 - RNA, 13 nt, Homo sapiens
ugcaucuacucag

SEQ ID NO: 2198156 - RNA, 15 nt, Homo sapiens
cacuccuccgugagc

SEQ ID NO: 2198157 - RNA, 19 nt, Homo sapiens
aauuucuucuuuuccugca

SEQ ID NO: 2198158 - RNA, 17 nt, Homo sapiens
uauaaacccauuuuggu

SEQ ID NO: 2198159 - RNA, 17 nt, Homo sapiens
uauguuuacuucucacc

SEQ ID NO: 2198160 - RNA, 23 nt, Homo sapiens
ugaccuguuagaugugacacauu

SEQ ID NO: 2198161 - RNA, 20 nt, Homo sapiens
caucuguaaaauagucucau

SEQ ID NO: 2198162 - RNA, 20 nt, Homo sapiens
ugcucacccauugucucauu

SEQ ID NO: 2198163 - RNA, 20 nt, Homo sapiens
acauugcauucuauugccuu

SEQ ID NO: 2198164 - RNA, 17 nt, Homo sapiens
aguuuauuuacucacuu

SEQ ID NO: 2198165 - RNA, 19 nt, Homo sapiens
agaauaaaaugcagugaaa

SEQ ID NO: 2198166 - RNA, 21 nt, Homo sapiens
ugaacgucauugcgauuuauc

SEQ ID NO: 2198167 - RNA, 17 nt, Homo sapiens
gccaugauuuuagcaau

SEQ ID NO: 2198168 - RNA, 19 nt, Homo sapiens
ugcccucccuguuucucca

SEQ ID NO: 2198169 - RNA, 18 nt, Homo sapiens
aguaccuuguuuugccau

SEQ ID NO: 2198170 - RNA, 19 nt, Homo sapiens
ggcaggcacugccaaaaca

SEQ ID NO: 2198171 - RNA, 20 nt, Homo sapiens
auguuuaaauucucuuucac

SEQ ID NO: 2198172 - RNA, 17 nt, Homo sapiens
aagacaugcuuacuuuu

SEQ ID NO: 2198173 - RNA, 14 nt, Homo sapiens
uccagggaugccau

SEQ ID NO: 2198174 - RNA, 13 nt, Homo sapiens
agguuugcaaaga

SEQ ID NO: 2198175 - RNA, 21 nt, Homo sapiens
aucaggugcaggucagacucu

SEQ ID NO: 2198176 - RNA, 20 nt, Homo sapiens
ggccaggcaggggugggaga

SEQ ID NO: 2198177 - RNA, 13 nt, Homo sapiens
uaccacuuaacag

SEQ ID NO: 2198178 - RNA, 13 nt, Homo sapiens
auuacugcaugca

SEQ ID NO: 2198179 - RNA, 13 nt, Homo sapiens
cauggcucauggg

SEQ ID NO: 2198180 - RNA, 13 nt, Homo sapiens
auguucuccauuu

SEQ ID NO: 2198181 - RNA, 17 nt, Homo sapiens
gaacugcagcaaucaca

SEQ ID NO: 2198182 - RNA, 16 nt, Homo sapiens
aaguuuagaaauuaca

SEQ ID NO: 2198183 - RNA, 15 nt, Homo sapiens
aacucugcugagggu

SEQ ID NO: 2198184 - RNA, 18 nt, Homo sapiens
uaccaccacgcccggcua

SEQ ID NO: 2198185 - RNA, 17 nt, Homo sapiens
uacaacuguaaagcaaa

SEQ ID NO: 2198186 - RNA, 13 nt, Homo sapiens
cacaagccagacc

SEQ ID NO: 2198187 - RNA, 17 nt, Homo sapiens
gacaauuugugauaucu

SEQ ID NO: 2198188 - RNA, 22 nt, Homo sapiens
aacuuugcuucuccaaauacaa

SEQ ID NO: 2198189 - RNA, 17 nt, Homo sapiens
aguuuuuauuaaacuca

SEQ ID NO: 2198190 - RNA, 17 nt, Homo sapiens
uguucccagguaccuca

SEQ ID NO: 2198191 - RNA, 24 nt, Homo sapiens
aaagaggagaaggaaaacaugcug

SEQ ID NO: 2198192 - RNA, 19 nt, Homo sapiens
augauccuuaugaugucca

SEQ ID NO: 2198193 - RNA, 22 nt, Homo sapiens
uaaaaauaaaagcuauuacuug

SEQ ID NO: 2198194 - RNA, 12 nt, Homo sapiens
ucuagcaguugu

SEQ ID NO: 2198195 - RNA, 20 nt, Homo sapiens
agcucgcgggacccgacccc

SEQ ID NO: 2198196 - RNA, 16 nt, Homo sapiens
auacuguacugagaca

SEQ ID NO: 2198197 - RNA, 23 nt, Homo sapiens
acaaaccuugggaagauguauca

SEQ ID NO: 2198198 - RNA, 15 nt, Homo sapiens
agaaagcauugccag

SEQ ID NO: 2198199 - RNA, 13 nt, Homo sapiens
uauuuugcauucc

SEQ ID NO: 2198200 - RNA, 22 nt, Homo sapiens
gcccauggcuuuagcuaccuca

SEQ ID NO: 2198201 - RNA, 12 nt, Homo sapiens
uaaaauguuuaa

SEQ ID NO: 2198202 - RNA, 19 nt, Homo sapiens
ggcccaagccccaucucau

SEQ ID NO: 2198203 - RNA, 18 nt, Homo sapiens
agguuuguauaaguaauu

SEQ ID NO: 2198204 - RNA, 21 nt, Homo sapiens
gaaaauuguuuagugauauua

SEQ ID NO: 2198205 - RNA, 13 nt, Homo sapiens
uuuggcaaagcca

SEQ ID NO: 2198206 - RNA, 22 nt, Homo sapiens
aaaugaaauacugccuuggcua

SEQ ID NO: 2198207 - RNA, 17 nt, Homo sapiens
cuguugggacagccauu

SEQ ID NO: 2198208 - RNA, 14 nt, Homo sapiens
cucaguuggugcug

SEQ ID NO: 2198209 - RNA, 19 nt, Homo sapiens
uagccaguuccugccuuaa

SEQ ID NO: 2198210 - RNA, 13 nt, Homo sapiens
gcucauguguaca

SEQ ID NO: 2198211 - RNA, 19 nt, Homo sapiens
uuaucauuaaaaauuaccu

SEQ ID NO: 2198212 - RNA, 18 nt, Homo sapiens
cuccuuccuugaccagca

SEQ ID NO: 2198213 - RNA, 21 nt, Homo sapiens
acacagacuggcaauaaacuc

SEQ ID NO: 2198214 - RNA, 20 nt, Homo sapiens
gaauccaucaggacuuggga

SEQ ID NO: 2198215 - RNA, 21 nt, Homo sapiens
cccaugucacugcagauugag

SEQ ID NO: 2198216 - RNA, 21 nt, Homo sapiens
gcagaacugaaaaauuacuua

SEQ ID NO: 2198217 - RNA, 14 nt, Homo sapiens
auuucucuccucac

SEQ ID NO: 2198218 - RNA, 22 nt, Homo sapiens
cuaauuagagagcaucugcaac

SEQ ID NO: 2198219 - RNA, 21 nt, Homo sapiens
ccagagcucccucugccccag

SEQ ID NO: 2198220 - RNA, 21 nt, Homo sapiens
augcagauggcagugcagcaa

SEQ ID NO: 2198221 - RNA, 23 nt, Homo sapiens
uuuaauccuguaccaaaucugac

SEQ ID NO: 2198222 - RNA, 17 nt, Homo sapiens
agucuguguguagccag

SEQ ID NO: 2198223 - RNA, 16 nt, Homo sapiens
uuuaaugaagugcaau

SEQ ID NO: 2198224 - RNA, 14 nt, Homo sapiens
ugccaaaaacaaca

SEQ ID NO: 2198225 - RNA, 22 nt, Homo sapiens
caagacagugcugagauuggaa

SEQ ID NO: 2198226 - RNA, 17 nt, Homo sapiens
ggccguccuugucucug

SEQ ID NO: 2198227 - RNA, 14 nt, Homo sapiens
ggcucaagcugucc

SEQ ID NO: 2198228 - RNA, 23 nt, Homo sapiens
aagccauggagugagacccagga

SEQ ID NO: 2198229 - RNA, 22 nt, Homo sapiens
uaggaaguguuacuaucuugau

SEQ ID NO: 2198230 - RNA, 18 nt, Homo sapiens
ucuuauuuuucuagucag

SEQ ID NO: 2198231 - RNA, 23 nt, Homo sapiens
cauuugagaaguggcuugacaau

SEQ ID NO: 2198232 - RNA, 21 nt, Homo sapiens
ucaaauuuccuuucauaccuu

SEQ ID NO: 2198233 - RNA, 13 nt, Homo sapiens
agcuuugcucagc

SEQ ID NO: 2198234 - RNA, 17 nt, Homo sapiens
ggcaccugauacuucug

SEQ ID NO: 2198235 - RNA, 18 nt, Homo sapiens
aagacaaaccacuguaca

SEQ ID NO: 2198236 - RNA, 20 nt, Homo sapiens
guuuaagaguaacaguuuga

SEQ ID NO: 2198237 - RNA, 21 nt, Homo sapiens
acuuuaagaacaaacucugaa

SEQ ID NO: 2198238 - RNA, 17 nt, Homo sapiens
uucugauuggugauuca

SEQ ID NO: 2198239 - RNA, 16 nt, Homo sapiens
uggccagccagugcca

SEQ ID NO: 2198240 - RNA, 19 nt, Homo sapiens
caucucaggccucccucaa

SEQ ID NO: 2198241 - RNA, 20 nt, Homo sapiens
aguuguuguaaaaauaaaag

SEQ ID NO: 2198242 - RNA, 15 nt, Homo sapiens
uguuugucaaaaagu

SEQ ID NO: 2198243 - RNA, 17 nt, Homo sapiens
caguaaggcagugcagu

SEQ ID NO: 2198244 - RNA, 12 nt, Homo sapiens
acauuaccaaaa

SEQ ID NO: 2198245 - RNA, 18 nt, Homo sapiens
gacucugucuggccaggg

SEQ ID NO: 2198246 - RNA, 20 nt, Homo sapiens
acaugauuuaaagacuacaa

SEQ ID NO: 2198247 - RNA, 21 nt, Homo sapiens
gaacaagguaaaacaacuaca

SEQ ID NO: 2198248 - RNA, 19 nt, Homo sapiens
auaaccugaugccauaaau

SEQ ID NO: 2198249 - RNA, 19 nt, Homo sapiens
aaucuaacgggcauucaca

SEQ ID NO: 2198250 - RNA, 14 nt, Homo sapiens
auguugcccaggca

SEQ ID NO: 2198251 - RNA, 19 nt, Homo sapiens
uaaaaaccaagaagauguc

SEQ ID NO: 2198252 - RNA, 12 nt, Homo sapiens
gguggagccaag

SEQ ID NO: 2198253 - RNA, 19 nt, Homo sapiens
uacacaguucaucauugcu

SEQ ID NO: 2198254 - RNA, 22 nt, Homo sapiens
cugaaauagacccacaagaggc

SEQ ID NO: 2198255 - RNA, 23 nt, Homo sapiens
caaaucguccaaagaucucaaag

SEQ ID NO: 2198256 - RNA, 18 nt, Homo sapiens
gagguugcagugagccau

SEQ ID NO: 2198257 - RNA, 21 nt, Homo sapiens
aguauuaacuauuaguguuaa

SEQ ID NO: 2198258 - RNA, 15 nt, Homo sapiens
ucugucuaucuguga

SEQ ID NO: 2198259 - RNA, 16 nt, Homo sapiens
aaugcauauacuuuaa

SEQ ID NO: 2198260 - RNA, 20 nt, Homo sapiens
ccacacauaacuguuuugca

SEQ ID NO: 2198261 - RNA, 14 nt, Homo sapiens
agaggcugccucag

SEQ ID NO: 2198262 - RNA, 14 nt, Homo sapiens
agaaucaacaguga

SEQ ID NO: 2198263 - RNA, 19 nt, Homo sapiens
cuauacuugguuugcuacc

SEQ ID NO: 2198264 - RNA, 15 nt, Homo sapiens
auggcuggcacauug

SEQ ID NO: 2198265 - RNA, 22 nt, Homo sapiens
auuccagugcaguagugccaaa

SEQ ID NO: 2198266 - RNA, 23 nt, Homo sapiens
caguaucccaacugcagguccag

SEQ ID NO: 2198267 - RNA, 16 nt, Homo sapiens
uaaucauuccauuuau

SEQ ID NO: 2198268 - RNA, 18 nt, Homo sapiens
augcuguaugucauuaaa

SEQ ID NO: 2198269 - RNA, 18 nt, Homo sapiens
auguggacuuuuuuguac

SEQ ID NO: 2198270 - RNA, 16 nt, Homo sapiens
gucgaacaauucauau

SEQ ID NO: 2198271 - RNA, 20 nt, Homo sapiens
cugaguauguucauugccac

SEQ ID NO: 2198272 - RNA, 17 nt, Homo sapiens
cuucugcaccaacucac

SEQ ID NO: 2198273 - RNA, 21 nt, Homo sapiens
ugcagcucccuccucagggau

SEQ ID NO: 2198274 - RNA, 15 nt, Homo sapiens
aaaauuccacucaaa

SEQ ID NO: 2198275 - RNA, 22 nt, Homo sapiens
aaacauuggcaaucacguugaa

SEQ ID NO: 2198276 - RNA, 15 nt, Homo sapiens
augguggcucaugcc

SEQ ID NO: 2198277 - RNA, 16 nt, Homo sapiens
caggauugucacucca

SEQ ID NO: 2198278 - RNA, 19 nt, Homo sapiens
agauguggcaaagugcugu

SEQ ID NO: 2198279 - RNA, 13 nt, Homo sapiens
ggcaaagaucuca

SEQ ID NO: 2198280 - RNA, 15 nt, Homo sapiens
uagguggcugagcau

SEQ ID NO: 2198281 - RNA, 13 nt, Homo sapiens
agggacucuccau

SEQ ID NO: 2198282 - RNA, 19 nt, Homo sapiens
uauaaauguuugucuggau

SEQ ID NO: 2198283 - RNA, 15 nt, Homo sapiens
uaauuguaaucugaa

SEQ ID NO: 2198284 - RNA, 17 nt, Homo sapiens
uguuucccccacaguuu

SEQ ID NO: 2198285 - RNA, 14 nt, Homo sapiens
cuacacugccuuug

SEQ ID NO: 2198286 - RNA, 14 nt, Homo sapiens
cuuuucugccacag

SEQ ID NO: 2198287 - RNA, 19 nt, Homo sapiens
ugccuuacagacagaauau

SEQ ID NO: 2198288 - RNA, 19 nt, Homo sapiens
accccaaacaacucagcuu

SEQ ID NO: 2198289 - RNA, 18 nt, Homo sapiens
uaaaauucuacuguaugg

SEQ ID NO: 2198290 - RNA, 22 nt, Homo sapiens
gcgauucuccugccucagucuc

SEQ ID NO: 2198291 - RNA, 15 nt, Homo sapiens
gagggagaugccaug

SEQ ID NO: 2198292 - RNA, 18 nt, Homo sapiens
uugcauggcuccagaaau

SEQ ID NO: 2198293 - RNA, 22 nt, Homo sapiens
uauaaaguuuuauuugaaugaa

SEQ ID NO: 2198294 - RNA, 20 nt, Homo sapiens
uaaauaaaaggacugugauu

SEQ ID NO: 2198295 - RNA, 20 nt, Homo sapiens
ucugcagcugcuuuugcauu

SEQ ID NO: 2198296 - RNA, 19 nt, Homo sapiens
cuguccccaagacacuucc

SEQ ID NO: 2198297 - RNA, 17 nt, Homo sapiens
gaaaggucauccaaaga

SEQ ID NO: 2198298 - RNA, 14 nt, Homo sapiens
auuauuauugucau

SEQ ID NO: 2198299 - RNA, 14 nt, Homo sapiens
auaaauauugacuu

SEQ ID NO: 2198300 - RNA, 17 nt, Homo sapiens
aaauaaagucaucagca

SEQ ID NO: 2198301 - RNA, 21 nt, Homo sapiens
cacacggaugcacacacagau

SEQ ID NO: 2198302 - RNA, 21 nt, Homo sapiens
gcacaaagcccauagcacugg

SEQ ID NO: 2198303 - RNA, 21 nt, Homo sapiens
uguguuccuuuuuaugaggca

SEQ ID NO: 2198304 - RNA, 20 nt, Homo sapiens
auccugggcagcuugggcug

SEQ ID NO: 2198305 - RNA, 11 nt, Homo sapiens
cccuuccccau

SEQ ID NO: 2198306 - RNA, 15 nt, Homo sapiens
ugcuguauuugcugc

SEQ ID NO: 2198307 - RNA, 16 nt, Homo sapiens
auuuauucuucacuga

SEQ ID NO: 2198308 - RNA, 21 nt, Homo sapiens
uuguaaaccaucgcgugcaau

SEQ ID NO: 2198309 - RNA, 23 nt, Homo sapiens
gcuuuuuuuuuuuuuaacugacg

SEQ ID NO: 2198310 - RNA, 16 nt, Homo sapiens
cuuuaugacuaugcac

SEQ ID NO: 2198311 - RNA, 18 nt, Homo sapiens
agacuccgucucaaaaga

SEQ ID NO: 2198312 - RNA, 17 nt, Homo sapiens
augauccuuuuuuguca

SEQ ID NO: 2198313 - RNA, 15 nt, Homo sapiens
caccccuuccaauga

SEQ ID NO: 2198314 - RNA, 16 nt, Homo sapiens
caggccugggacccag

SEQ ID NO: 2198315 - RNA, 22 nt, Homo sapiens
gugcauuugagaauaguuuucc

SEQ ID NO: 2198316 - RNA, 17 nt, Homo sapiens
cuuaagauuuugcaccu

SEQ ID NO: 2198317 - RNA, 14 nt, Homo sapiens
cacaaauagaaacc

SEQ ID NO: 2198318 - RNA, 15 nt, Homo sapiens
gcggaaccauagcug

SEQ ID NO: 2198319 - RNA, 13 nt, Homo sapiens
ggcugcagguguu

SEQ ID NO: 2198320 - RNA, 17 nt, Homo sapiens
uuacauauuaaauaugu

SEQ ID NO: 2198321 - RNA, 19 nt, Homo sapiens
ggaaaaugcacacauuucu

SEQ ID NO: 2198322 - RNA, 22 nt, Homo sapiens
gaaaccuacuuuuuaugugcua

SEQ ID NO: 2198323 - RNA, 17 nt, Homo sapiens
gcucccagggccaugaa

SEQ ID NO: 2198324 - RNA, 16 nt, Homo sapiens
gaacuggacucaggau

SEQ ID NO: 2198325 - RNA, 16 nt, Homo sapiens
guagcccucacacugu

SEQ ID NO: 2198326 - RNA, 13 nt, Homo sapiens
aacccaguggcug

SEQ ID NO: 2198327 - RNA, 21 nt, Homo sapiens
cgccugcccgucucucuccca

SEQ ID NO: 2198328 - RNA, 22 nt, Homo sapiens
aucugugucucuggaacccagg

SEQ ID NO: 2198329 - RNA, 19 nt, Homo sapiens
agccuuucccuaauucugc

SEQ ID NO: 2198330 - RNA, 20 nt, Homo sapiens
gaaguaugagugcugauuca

SEQ ID NO: 2198331 - RNA, 22 nt, Homo sapiens
ucuuacccccaccacuaagaga

SEQ ID NO: 2198332 - RNA, 14 nt, Homo sapiens
accugccugcauuc

SEQ ID NO: 2198333 - RNA, 14 nt, Homo sapiens
gugacuuacagugc

SEQ ID NO: 2198334 - RNA, 18 nt, Homo sapiens
ugucucucacugcauuug

SEQ ID NO: 2198335 - RNA, 19 nt, Homo sapiens
gaaauaccaguucugggca

SEQ ID NO: 2198336 - RNA, 22 nt, Homo sapiens
gcaauuucauaugcuguauauc

SEQ ID NO: 2198337 - RNA, 19 nt, Homo sapiens
agggcagaccacauugcuu

SEQ ID NO: 2198338 - RNA, 17 nt, Homo sapiens
ugcaugauuuacucuua

SEQ ID NO: 2198339 - RNA, 10 nt, Homo sapiens
uuuguuguuu

SEQ ID NO: 2198340 - RNA, 19 nt, Homo sapiens
uaaaucuucagcauagaag

SEQ ID NO: 2198341 - RNA, 15 nt, Homo sapiens
augaucaaaaacugc

SEQ ID NO: 2198342 - RNA, 22 nt, Homo sapiens
ggcuucaaagugugugugugca

SEQ ID NO: 2198343 - RNA, 20 nt, Homo sapiens
acacuucuaaaugaagugca

SEQ ID NO: 2198344 - RNA, 20 nt, Homo sapiens
gcgucaagucuaaaccaaga

SEQ ID NO: 2198345 - RNA, 21 nt, Homo sapiens
cugcugagggggcucuuuccc

SEQ ID NO: 2198346 - RNA, 15 nt, Homo sapiens
cuugcugcugcugca

SEQ ID NO: 2198347 - RNA, 11 nt, Homo sapiens
uaaaauuguga

SEQ ID NO: 2198348 - RNA, 14 nt, Homo sapiens
cagaugacacccua

SEQ ID NO: 2198349 - RNA, 14 nt, Homo sapiens
aagaaaaucauauu

SEQ ID NO: 2198350 - RNA, 13 nt, Homo sapiens
auauuaugccuga

SEQ ID NO: 2198351 - RNA, 21 nt, Homo sapiens
ccaauguccugaaacaugaac

SEQ ID NO: 2198352 - RNA, 20 nt, Homo sapiens
uaggugucucugggccugug

SEQ ID NO: 2198353 - RNA, 20 nt, Homo sapiens
uguuucugcagccacuauug

SEQ ID NO: 2198354 - RNA, 17 nt, Homo sapiens
uccauacuccacuccaa

SEQ ID NO: 2198355 - RNA, 11 nt, Homo sapiens
acaaacagggc

SEQ ID NO: 2198356 - RNA, 18 nt, Homo sapiens
guugagugcacugacugu

SEQ ID NO: 2198357 - RNA, 23 nt, Homo sapiens
ucauucaagaggaauuccagcau

SEQ ID NO: 2198358 - RNA, 17 nt, Homo sapiens
aucagugaagaugccag

SEQ ID NO: 2198359 - RNA, 15 nt, Homo sapiens
cauuauuuucuguca

SEQ ID NO: 2198360 - RNA, 15 nt, Homo sapiens
ggagcggggaucuga

SEQ ID NO: 2198361 - RNA, 17 nt, Homo sapiens
guccugggaggcugcag

SEQ ID NO: 2198362 - RNA, 23 nt, Homo sapiens
aaugccugacuagggagccaugu

SEQ ID NO: 2198363 - RNA, 22 nt, Homo sapiens
ugacaaagcccaucccaggaga

SEQ ID NO: 2198364 - RNA, 15 nt, Homo sapiens
aagucuuacuacaga

SEQ ID NO: 2198365 - RNA, 16 nt, Homo sapiens
ugaggcugacacagcc

SEQ ID NO: 2198366 - RNA, 20 nt, Homo sapiens
cugucauuucagauauucca

SEQ ID NO: 2198367 - RNA, 18 nt, Homo sapiens
cucucauuuaaugcacac

SEQ ID NO: 2198368 - RNA, 17 nt, Homo sapiens
aggcugggacacugugu

SEQ ID NO: 2198369 - RNA, 22 nt, Homo sapiens
auggacucagaaacuccaugau

SEQ ID NO: 2198370 - RNA, 16 nt, Homo sapiens
agagcagcuccacaac

SEQ ID NO: 2198371 - RNA, 22 nt, Homo sapiens
ucugagggggugggggugcugc

SEQ ID NO: 2198372 - RNA, 23 nt, Homo sapiens
agagguaccaaaaaagaaaguuu

SEQ ID NO: 2198373 - RNA, 17 nt, Homo sapiens
ugaggcaggaggaucac

SEQ ID NO: 2198374 - RNA, 16 nt, Homo sapiens
cuaguugaacaucuca

SEQ ID NO: 2198375 - RNA, 16 nt, Homo sapiens
gagcccggcagugcac

SEQ ID NO: 2198376 - RNA, 21 nt, Homo sapiens
gcuacuuuucagaauugaagg

SEQ ID NO: 2198377 - RNA, 21 nt, Homo sapiens
acuuccuccaauccccacucc

SEQ ID NO: 2198378 - RNA, 17 nt, Homo sapiens
aauccuacacaccuaag

SEQ ID NO: 2198379 - RNA, 14 nt, Homo sapiens
uuggggccagggaa

SEQ ID NO: 2198380 - RNA, 20 nt, Homo sapiens
caaauggaagacacauugaa

SEQ ID NO: 2198381 - RNA, 23 nt, Homo sapiens
ucauuagagcuuaaauugucaga

SEQ ID NO: 2198382 - RNA, 20 nt, Homo sapiens
uguaaaggucacuuuucaca

SEQ ID NO: 2198383 - RNA, 17 nt, Homo sapiens
aucagcacaaagacaua

SEQ ID NO: 2198384 - RNA, 14 nt, Homo sapiens
agacagugacuggu

SEQ ID NO: 2198385 - RNA, 21 nt, Homo sapiens
uuuuaccuuucagaagguguu

SEQ ID NO: 2198386 - RNA, 17 nt, Homo sapiens
ugauacuggagucuuau

SEQ ID NO: 2198387 - RNA, 14 nt, Homo sapiens
ugacaacuuccaga

SEQ ID NO: 2198388 - RNA, 20 nt, Homo sapiens
augcauauuguauuacuaga

SEQ ID NO: 2198389 - RNA, 11 nt, Homo sapiens
ugguugccaag

SEQ ID NO: 2198390 - RNA, 21 nt, Homo sapiens
aaauguuuaauaaagcuuuau

SEQ ID NO: 2198391 - RNA, 16 nt, Homo sapiens
ugggauccacacugag

SEQ ID NO: 2198392 - RNA, 17 nt, Homo sapiens
cggcaagcgagcacagu

SEQ ID NO: 2198393 - RNA, 15 nt, Homo sapiens
gcaucaaauauuugu

SEQ ID NO: 2198394 - RNA, 21 nt, Homo sapiens
auuguacuuaaaccuccugcu

SEQ ID NO: 2198395 - RNA, 15 nt, Homo sapiens
cuagcugugcaagac

SEQ ID NO: 2198396 - RNA, 18 nt, Homo sapiens
auuaagaaagacuaucua

SEQ ID NO: 2198397 - RNA, 18 nt, Homo sapiens
agucuuugaacugcagca

SEQ ID NO: 2198398 - RNA, 17 nt, Homo sapiens
uaugcauugucugcaau

SEQ ID NO: 2198399 - RNA, 15 nt, Homo sapiens
aggacuugaacaaaa

SEQ ID NO: 2198400 - RNA, 21 nt, Homo sapiens
auaaaguuaaauugcacgugc

SEQ ID NO: 2198401 - RNA, 13 nt, Homo sapiens
gcucuaguucaaa

SEQ ID NO: 2198402 - RNA, 22 nt, Homo sapiens
gucuaaauaaaugaaguauuuc

SEQ ID NO: 2198403 - RNA, 15 nt, Homo sapiens
uguugagccuaauau

SEQ ID NO: 2198404 - RNA, 11 nt, Homo sapiens
uaagugaugcu

SEQ ID NO: 2198405 - RNA, 15 nt, Homo sapiens
aguuacuugcuauaa

SEQ ID NO: 2198406 - RNA, 18 nt, Homo sapiens
ugcagccuccgcuucccu

SEQ ID NO: 2198407 - RNA, 22 nt, Homo sapiens
gccacugugucuuaugaggaau

SEQ ID NO: 2198408 - RNA, 12 nt, Homo sapiens
acagcagguggg

SEQ ID NO: 2198409 - RNA, 19 nt, Homo sapiens
cugucugagacucacagga

SEQ ID NO: 2198410 - RNA, 14 nt, Homo sapiens
gcaaaaugcagcuu

SEQ ID NO: 2198411 - RNA, 19 nt, Homo sapiens
cucccacccuguaccucau

SEQ ID NO: 2198412 - RNA, 17 nt, Homo sapiens
cuaaauuuaaugcugcc

SEQ ID NO: 2198413 - RNA, 22 nt, Homo sapiens
aaauaugauucuccucucccaa

SEQ ID NO: 2198414 - RNA, 17 nt, Homo sapiens
ccugaucuggacccuug

SEQ ID NO: 2198415 - RNA, 18 nt, Homo sapiens
aauuccuguagcaucuuc

SEQ ID NO: 2198416 - RNA, 12 nt, Homo sapiens
acacagagccug

SEQ ID NO: 2198417 - RNA, 19 nt, Homo sapiens
cauuucucauaccuucccc

SEQ ID NO: 2198418 - RNA, 21 nt, Homo sapiens
cauacauugauucaugucuca

SEQ ID NO: 2198419 - RNA, 15 nt, Homo sapiens
gaaugagagacacac

SEQ ID NO: 2198420 - RNA, 16 nt, Homo sapiens
acauuuaaagauuuaa

SEQ ID NO: 2198421 - RNA, 16 nt, Homo sapiens
agcaucugaccaucug

SEQ ID NO: 2198422 - RNA, 20 nt, Homo sapiens
cuaaauggguauuuguucaa

SEQ ID NO: 2198423 - RNA, 20 nt, Homo sapiens
gguccugaaaguaacucaua

SEQ ID NO: 2198424 - RNA, 18 nt, Homo sapiens
cauuaagguuaugcacug

SEQ ID NO: 2198425 - RNA, 21 nt, Homo sapiens
ucccugcugggaaugcuccca

SEQ ID NO: 2198426 - RNA, 15 nt, Homo sapiens
cagccaggcugcuaa

SEQ ID NO: 2198427 - RNA, 22 nt, Homo sapiens
ucaaucucguuuagugccaaug

SEQ ID NO: 2198428 - RNA, 14 nt, Homo sapiens
agcucugcuugccg

SEQ ID NO: 2198429 - RNA, 18 nt, Homo sapiens
cagcugggcucugcaauu

SEQ ID NO: 2198430 - RNA, 18 nt, Homo sapiens
ggagaaggccagugccca

SEQ ID NO: 2198431 - RNA, 20 nt, Homo sapiens
auucucuuugugaggacaaa

SEQ ID NO: 2198432 - RNA, 20 nt, Homo sapiens
gacucugauucuacagugau

SEQ ID NO: 2198433 - RNA, 13 nt, Homo sapiens
ugggaccacagac

SEQ ID NO: 2198434 - RNA, 16 nt, Homo sapiens
aucugucacaccagcc

SEQ ID NO: 2198435 - RNA, 12 nt, Homo sapiens
caacaaccaagc

SEQ ID NO: 2198436 - RNA, 22 nt, Homo sapiens
acacuguucugaaagugacuca

SEQ ID NO: 2198437 - RNA, 14 nt, Homo sapiens
cagaaaaucacugu

SEQ ID NO: 2198438 - RNA, 14 nt, Homo sapiens
caguauaucacaga

SEQ ID NO: 2198439 - RNA, 16 nt, Homo sapiens
aaagucacccaaacac

SEQ ID NO: 2198440 - RNA, 19 nt, Homo sapiens
caagaaauaaaaaucaacu

SEQ ID NO: 2198441 - RNA, 23 nt, Homo sapiens
agcuaaugucacaacauggugcu

SEQ ID NO: 2198442 - RNA, 17 nt, Homo sapiens
agcaucuauagcacaua

SEQ ID NO: 2198443 - RNA, 17 nt, Homo sapiens
aacuauuuauugaauga

SEQ ID NO: 2198444 - RNA, 18 nt, Homo sapiens
ggagagucucacuuugga

SEQ ID NO: 2198445 - RNA, 18 nt, Homo sapiens
ugugaugaugcugugaca

SEQ ID NO: 2198446 - RNA, 12 nt, Homo sapiens
cuugcagcuuua

SEQ ID NO: 2198447 - RNA, 17 nt, Homo sapiens
aagccgucucaugcaga

SEQ ID NO: 2198448 - RNA, 14 nt, Homo sapiens
aaacacucaucucc

SEQ ID NO: 2198449 - RNA, 19 nt, Homo sapiens
gacaccagcccugcugcuu

SEQ ID NO: 2198450 - RNA, 14 nt, Homo sapiens
aggaaacaauauaa

SEQ ID NO: 2198451 - RNA, 21 nt, Homo sapiens
aguccacuuguucuguacuug

SEQ ID NO: 2198452 - RNA, 13 nt, Homo sapiens
ugccauucauccu

SEQ ID NO: 2198453 - RNA, 21 nt, Homo sapiens
augcacucuucauguaaucac

SEQ ID NO: 2198454 - RNA, 20 nt, Homo sapiens
gacguggagcgggguaugaa

SEQ ID NO: 2198455 - RNA, 18 nt, Homo sapiens
gguaaaauggcaguuuga

SEQ ID NO: 2198456 - RNA, 14 nt, Homo sapiens
acagcuggacaccc

SEQ ID NO: 2198457 - RNA, 23 nt, Homo sapiens
ugggguuggagguuucacuugca

SEQ ID NO: 2198458 - RNA, 16 nt, Homo sapiens
acccaugaaucaaaga

SEQ ID NO: 2198459 - RNA, 20 nt, Homo sapiens
ccguuuuuuucuuuccugua

SEQ ID NO: 2198460 - RNA, 19 nt, Homo sapiens
uggaccuauguccuaagga

SEQ ID NO: 2198461 - RNA, 13 nt, Homo sapiens
uucuuaauaaacu

SEQ ID NO: 2198462 - RNA, 21 nt, Homo sapiens
acagcuuccuguuacugagau

SEQ ID NO: 2198463 - RNA, 12 nt, Homo sapiens
gaucauucucag

SEQ ID NO: 2198464 - RNA, 23 nt, Homo sapiens
caggggcaucucugggcugagcc

SEQ ID NO: 2198465 - RNA, 18 nt, Homo sapiens
cacaugagggggugcccu

SEQ ID NO: 2198466 - RNA, 13 nt, Homo sapiens
auuaaaaccugau

SEQ ID NO: 2198467 - RNA, 14 nt, Homo sapiens
aucuaguucauuga

SEQ ID NO: 2198468 - RNA, 22 nt, Homo sapiens
aaggccuuuggaaagacuugaa

SEQ ID NO: 2198469 - RNA, 17 nt, Homo sapiens
uuugguuacugugccau

SEQ ID NO: 2198470 - RNA, 22 nt, Homo sapiens
guuugagaauaugaucauguaa

SEQ ID NO: 2198471 - RNA, 20 nt, Homo sapiens
aucugucacuugcauuccac

SEQ ID NO: 2198472 - RNA, 22 nt, Homo sapiens
cuggcuuuacauggguucaauu

SEQ ID NO: 2198473 - RNA, 19 nt, Homo sapiens
ugccauaccgcuggggaac

SEQ ID NO: 2198474 - RNA, 19 nt, Homo sapiens
cuacaaucugugucauaua

SEQ ID NO: 2198475 - RNA, 16 nt, Homo sapiens
gugauauaaacagcuu

SEQ ID NO: 2198476 - RNA, 23 nt, Homo sapiens
acagccacuuuuagcuacugcua

SEQ ID NO: 2198477 - RNA, 19 nt, Homo sapiens
caccaagcuuagaagccac

SEQ ID NO: 2198478 - RNA, 16 nt, Homo sapiens
acccuuucugugguaa

SEQ ID NO: 2198479 - RNA, 14 nt, Homo sapiens
gcacacacauauau

SEQ ID NO: 2198480 - RNA, 18 nt, Homo sapiens
aaccucggggagugccac

SEQ ID NO: 2198481 - RNA, 15 nt, Homo sapiens
ccugggcucagcauu

SEQ ID NO: 2198482 - RNA, 19 nt, Homo sapiens
ucuguuuuguuuugcugaa

SEQ ID NO: 2198483 - RNA, 21 nt, Homo sapiens
agcagaaaauacagcuggauu

SEQ ID NO: 2198484 - RNA, 23 nt, Homo sapiens
uauugucauaggauuaagcaguu

SEQ ID NO: 2198485 - RNA, 14 nt, Homo sapiens
acaccauuuaucua

SEQ ID NO: 2198486 - RNA, 13 nt, Homo sapiens
uaaagaagcugca

SEQ ID NO: 2198487 - RNA, 17 nt, Homo sapiens
ccucccaggccaggcuc

SEQ ID NO: 2198488 - RNA, 22 nt, Homo sapiens
gcaccaccgaccaacuccagac

SEQ ID NO: 2198489 - RNA, 22 nt, Homo sapiens
cugagaacuggacaguggcagg

SEQ ID NO: 2198490 - RNA, 17 nt, Homo sapiens
augguuuaaagucacag

SEQ ID NO: 2198491 - RNA, 20 nt, Homo sapiens
ucucaguucguguuugauuc

SEQ ID NO: 2198492 - RNA, 17 nt, Homo sapiens
agaaaguggcuugaaau

SEQ ID NO: 2198493 - RNA, 22 nt, Homo sapiens
ccccaucuagagucuagacaga

SEQ ID NO: 2198494 - RNA, 11 nt, Homo sapiens
aggucccaagg

SEQ ID NO: 2198495 - RNA, 19 nt, Homo sapiens
uuuaucuauuagauaauca

SEQ ID NO: 2198496 - RNA, 15 nt, Homo sapiens
cucucucuugcuuac

SEQ ID NO: 2198497 - RNA, 16 nt, Homo sapiens
cugugucaaaagccag

SEQ ID NO: 2198498 - RNA, 16 nt, Homo sapiens
ccagaaccaauuauuu

SEQ ID NO: 2198499 - RNA, 21 nt, Homo sapiens
uaauaaaacaacaacaaaaac

SEQ ID NO: 2198500 - RNA, 13 nt, Homo sapiens
auuaauauguacu

SEQ ID NO: 2198501 - RNA, 11 nt, Homo sapiens
gacugacauuu

SEQ ID NO: 2198502 - RNA, 20 nt, Homo sapiens
acuuaauuuugugaccacag

SEQ ID NO: 2198503 - RNA, 17 nt, Homo sapiens
uauuugugcuauaguau

SEQ ID NO: 2198504 - RNA, 22 nt, Homo sapiens
acuggaggcaggacuccugggu

SEQ ID NO: 2198505 - RNA, 23 nt, Homo sapiens
aaaaugaagguggaacaagcaca

SEQ ID NO: 2198506 - RNA, 20 nt, Homo sapiens
gcuauggagaggacucuccc

SEQ ID NO: 2198507 - RNA, 19 nt, Homo sapiens
auucuauuuuuguccuugc

SEQ ID NO: 2198508 - RNA, 15 nt, Homo sapiens
acaacugccagcucu

SEQ ID NO: 2198509 - RNA, 22 nt, Homo sapiens
caucauuguauuaacgcaaaua

SEQ ID NO: 2198510 - RNA, 12 nt, Homo sapiens
uugaaacuaacu

SEQ ID NO: 2198511 - RNA, 13 nt, Homo sapiens
uaaacacagucca

SEQ ID NO: 2198512 - RNA, 17 nt, Homo sapiens
ugaaagaaagggaccca

SEQ ID NO: 2198513 - RNA, 14 nt, Homo sapiens
acuuaccucugcuu

SEQ ID NO: 2198514 - RNA, 20 nt, Homo sapiens
ugcuuuuugugauaugcaca

SEQ ID NO: 2198515 - RNA, 18 nt, Homo sapiens
uaauuuucagcugcaagg

SEQ ID NO: 2198516 - RNA, 14 nt, Homo sapiens
caacuuuaccucuu

SEQ ID NO: 2198517 - RNA, 14 nt, Homo sapiens
acauaauaaauuaa

SEQ ID NO: 2198518 - RNA, 19 nt, Homo sapiens
aaagucaggugcaguccca

SEQ ID NO: 2198519 - RNA, 17 nt, Homo sapiens
ugggagacaaagcaaua

SEQ ID NO: 2198520 - RNA, 19 nt, Homo sapiens
auuaacaacaauaacacug

SEQ ID NO: 2198521 - RNA, 20 nt, Homo sapiens
aguugcguggacucugcaca

SEQ ID NO: 2198522 - RNA, 21 nt, Homo sapiens
gggucuuuuucuagggucccu

SEQ ID NO: 2198523 - RNA, 20 nt, Homo sapiens
cagcaccugcgggagcugca

SEQ ID NO: 2198524 - RNA, 13 nt, Homo sapiens
uggggaagccagu

SEQ ID NO: 2198525 - RNA, 16 nt, Homo sapiens
uuucugguauucacag

SEQ ID NO: 2198526 - RNA, 22 nt, Homo sapiens
aaaagaucuugaauagucucau

SEQ ID NO: 2198527 - RNA, 18 nt, Homo sapiens
uuccaaggcuacuacaga

SEQ ID NO: 2198528 - RNA, 19 nt, Homo sapiens
acaaggcuuuaucucaggg

SEQ ID NO: 2198529 - RNA, 17 nt, Homo sapiens
gcauugcuuugcccugg

SEQ ID NO: 2198530 - RNA, 23 nt, Homo sapiens
aguauacacacuuuccaaguacu

SEQ ID NO: 2198531 - RNA, 21 nt, Homo sapiens
uggaggagaggagaaaugucc

SEQ ID NO: 2198532 - RNA, 16 nt, Homo sapiens
uuaguucuaucugaau

SEQ ID NO: 2198533 - RNA, 23 nt, Homo sapiens
ugaucggagccuccucucucaaa

SEQ ID NO: 2198534 - RNA, 21 nt, Homo sapiens
aacauacaagcaacagcaaaa

SEQ ID NO: 2198535 - RNA, 17 nt, Homo sapiens
gacuaugaaugggcaaa

SEQ ID NO: 2198536 - RNA, 15 nt, Homo sapiens
cuggccacagccuuc

SEQ ID NO: 2198537 - RNA, 19 nt, Homo sapiens
cuguuguaaaugaccaaga

SEQ ID NO: 2198538 - RNA, 18 nt, Homo sapiens
agaauaaaagaugauuuc

SEQ ID NO: 2198539 - RNA, 19 nt, Homo sapiens
aguucccgcucugcauugc

SEQ ID NO: 2198540 - RNA, 13 nt, Homo sapiens
cccaacauauaaa

SEQ ID NO: 2198541 - RNA, 14 nt, Homo sapiens
uaagagacacucca

SEQ ID NO: 2198542 - RNA, 15 nt, Homo sapiens
uuugaccccagcagc

SEQ ID NO: 2198543 - RNA, 16 nt, Homo sapiens
ccagugagcuuaucau

SEQ ID NO: 2198544 - RNA, 14 nt, Homo sapiens
gguggagcuugcaa

SEQ ID NO: 2198545 - RNA, 15 nt, Homo sapiens
ucauucaagucagcu

SEQ ID NO: 2198546 - RNA, 17 nt, Homo sapiens
auaccaaccaaaccaau

SEQ ID NO: 2198547 - RNA, 19 nt, Homo sapiens
uggcccugcaaaaauauaa

SEQ ID NO: 2198548 - RNA, 16 nt, Homo sapiens
cuguccgacagucaag

SEQ ID NO: 2198549 - RNA, 18 nt, Homo sapiens
guccaguuucccaaaaac

SEQ ID NO: 2198550 - RNA, 17 nt, Homo sapiens
aucucuagaugcaaaua

SEQ ID NO: 2198551 - RNA, 21 nt, Homo sapiens
uacuauuauggaauuacucua

SEQ ID NO: 2198552 - RNA, 19 nt, Homo sapiens
ggucaaacuaauucucaca

SEQ ID NO: 2198553 - RNA, 16 nt, Homo sapiens
cccgugggcaucucaa

SEQ ID NO: 2198554 - RNA, 15 nt, Homo sapiens
ucagccaagugcaga

SEQ ID NO: 2198555 - RNA, 11 nt, Homo sapiens
ucccucucuug

SEQ ID NO: 2198556 - RNA, 16 nt, Homo sapiens
cgcuuaaccuuuccag

SEQ ID NO: 2198557 - RNA, 15 nt, Homo sapiens
ggggaagaggacugu

SEQ ID NO: 2198558 - RNA, 22 nt, Homo sapiens
ucacaguaaagaguacacucag

SEQ ID NO: 2198559 - RNA, 18 nt, Homo sapiens
uguguuuugaaagcccaa

SEQ ID NO: 2198560 - RNA, 17 nt, Homo sapiens
aucguuuuuguuuacug

SEQ ID NO: 2198561 - RNA, 22 nt, Homo sapiens
uucaagucagugaggaguaaaa

SEQ ID NO: 2198562 - RNA, 11 nt, Homo sapiens
cgggucacugc

SEQ ID NO: 2198563 - RNA, 15 nt, Homo sapiens
gaugcccucaacuca

SEQ ID NO: 2198564 - RNA, 16 nt, Homo sapiens
aaguggaagugacauu

SEQ ID NO: 2198565 - RNA, 15 nt, Homo sapiens
gcuuaucagggaguu

SEQ ID NO: 2198566 - RNA, 20 nt, Homo sapiens
agauggaaaacaaaccaucu

SEQ ID NO: 2198567 - RNA, 23 nt, Homo sapiens
aaaacugaaagugaaaguccaga

SEQ ID NO: 2198568 - RNA, 15 nt, Homo sapiens
uccccuggcaacugc

SEQ ID NO: 2198569 - RNA, 21 nt, Homo sapiens
gaauaaaaaauagacauguag

SEQ ID NO: 2198570 - RNA, 15 nt, Homo sapiens
ugcaccugugcauuu

SEQ ID NO: 2198571 - RNA, 19 nt, Homo sapiens
aaugguuucaaagauucaa

SEQ ID NO: 2198572 - RNA, 14 nt, Homo sapiens
guuguauugcauau

SEQ ID NO: 2198573 - RNA, 14 nt, Homo sapiens
guuuauuugcagua

SEQ ID NO: 2198574 - RNA, 17 nt, Homo sapiens
auagguaaaaacuggaa

SEQ ID NO: 2198575 - RNA, 21 nt, Homo sapiens
aguauuuaauucauguugccu

SEQ ID NO: 2198576 - RNA, 20 nt, Homo sapiens
aucaguuugcuaacauauuu

SEQ ID NO: 2198577 - RNA, 23 nt, Homo sapiens
cagggcugucuucguauucccau

SEQ ID NO: 2198578 - RNA, 20 nt, Homo sapiens
aauaccuaagucauuccucc

SEQ ID NO: 2198579 - RNA, 14 nt, Homo sapiens
gaagagaagcugcu

SEQ ID NO: 2198580 - RNA, 21 nt, Homo sapiens
cagugccuuucuucucuccag

SEQ ID NO: 2198581 - RNA, 23 nt, Homo sapiens
agcagaccaccccgccugcccuc

SEQ ID NO: 2198582 - RNA, 19 nt, Homo sapiens
ucuaauaaauauacuauga

SEQ ID NO: 2198583 - RNA, 20 nt, Homo sapiens
aauucuuacccuguacauau

SEQ ID NO: 2198584 - RNA, 23 nt, Homo sapiens
ggugcacagggcuagaacgagag

SEQ ID NO: 2198585 - RNA, 18 nt, Homo sapiens
uggcuuagaaaguccaau

SEQ ID NO: 2198586 - RNA, 22 nt, Homo sapiens
cccuggacgaaggucugaaucc

SEQ ID NO: 2198587 - RNA, 22 nt, Homo sapiens
ucugaauuugcaaaguacugua

SEQ ID NO: 2198588 - RNA, 21 nt, Homo sapiens
ccugugcugggccaguggcug

SEQ ID NO: 2198589 - RNA, 13 nt, Homo sapiens
uuuaaccuguaua

SEQ ID NO: 2198590 - RNA, 15 nt, Homo sapiens
caaacccaggcuauu

SEQ ID NO: 2198591 - RNA, 17 nt, Homo sapiens
gaauguauguaaugugu

SEQ ID NO: 2198592 - RNA, 16 nt, Homo sapiens
uagcauuaacuaaucu

SEQ ID NO: 2198593 - RNA, 20 nt, Homo sapiens
caggcagccuccgggcgugu

SEQ ID NO: 2198594 - RNA, 20 nt, Homo sapiens
gauuuauaaauuugagcuau

SEQ ID NO: 2198595 - RNA, 16 nt, Homo sapiens
uauaguaaguuucuau

SEQ ID NO: 2198596 - RNA, 22 nt, Homo sapiens
uauauguauguuuuaaguaguc

SEQ ID NO: 2198597 - RNA, 21 nt, Homo sapiens
aagaguguggagucauucuca

SEQ ID NO: 2198598 - RNA, 19 nt, Homo sapiens
cucuggccaagggccagac

SEQ ID NO: 2198599 - RNA, 22 nt, Homo sapiens
aaguuaaauugcacgugcaaua

SEQ ID NO: 2198600 - RNA, 15 nt, Homo sapiens
gcucccaagggaugg

SEQ ID NO: 2198601 - RNA, 19 nt, Homo sapiens
gcuagagugcaguggcaug

SEQ ID NO: 2198602 - RNA, 13 nt, Homo sapiens
ucauagugcucag

SEQ ID NO: 2198603 - RNA, 19 nt, Homo sapiens
aucuuuauaguucuacucc

SEQ ID NO: 2198604 - RNA, 20 nt, Homo sapiens
agaccagguggaauuacuua

SEQ ID NO: 2198605 - RNA, 19 nt, Homo sapiens
cccuguuucucuugaagaa

SEQ ID NO: 2198606 - RNA, 17 nt, Homo sapiens
aauuucucuuuacuuga

SEQ ID NO: 2198607 - RNA, 19 nt, Homo sapiens
caauggccuuuaucaucua

SEQ ID NO: 2198608 - RNA, 19 nt, Homo sapiens
cuucaaggcccucagagau

SEQ ID NO: 2198609 - RNA, 18 nt, Homo sapiens
acuacuuagcacugcccu

SEQ ID NO: 2198610 - RNA, 13 nt, Homo sapiens
ucacuugcaauug

SEQ ID NO: 2198611 - RNA, 20 nt, Homo sapiens
cucacugccacuaaaaucca

SEQ ID NO: 2198612 - RNA, 16 nt, Homo sapiens
cuaaguaccuuuccua

SEQ ID NO: 2198613 - RNA, 23 nt, Homo sapiens
auaaccuuccuucuaaacauuuu

SEQ ID NO: 2198614 - RNA, 15 nt, Homo sapiens
cacucccaccagcac

SEQ ID NO: 2198615 - RNA, 17 nt, Homo sapiens
gaguugagcagccuuuc

SEQ ID NO: 2198616 - RNA, 16 nt, Homo sapiens
aucacaaacucaucca

SEQ ID NO: 2198617 - RNA, 21 nt, Homo sapiens
acauuauguggcccucuggau

SEQ ID NO: 2198618 - RNA, 12 nt, Homo sapiens
uccuuacuugca

SEQ ID NO: 2198619 - RNA, 18 nt, Homo sapiens
ucaaauuccaaggaacua

SEQ ID NO: 2198620 - RNA, 22 nt, Homo sapiens
gaucagaacucuccuaucugaa

SEQ ID NO: 2198621 - RNA, 22 nt, Homo sapiens
uugugacagucacugcauuugc

SEQ ID NO: 2198622 - RNA, 14 nt, Homo sapiens
cugcugguucucau

SEQ ID NO: 2198623 - RNA, 16 nt, Homo sapiens
ucauugagaaacuggg

SEQ ID NO: 2198624 - RNA, 13 nt, Homo sapiens
aggaaguacugca

SEQ ID NO: 2198625 - RNA, 16 nt, Homo sapiens
aggaagccugauuaaa

SEQ ID NO: 2198626 - RNA, 12 nt, Homo sapiens
uuccagcaugca

SEQ ID NO: 2198627 - RNA, 22 nt, Homo sapiens
cucaucuuagguuggcaaaaag

SEQ ID NO: 2198628 - RNA, 13 nt, Homo sapiens
augagugacugcc

SEQ ID NO: 2198629 - RNA, 14 nt, Homo sapiens
cuucucagccacaa

SEQ ID NO: 2198630 - RNA, 21 nt, Homo sapiens
ugccugcuuuugaugaugucu

SEQ ID NO: 2198631 - RNA, 17 nt, Homo sapiens
caccaaucauaguguac

SEQ ID NO: 2198632 - RNA, 22 nt, Homo sapiens
cacuggcuuuggguagugccau

SEQ ID NO: 2198633 - RNA, 14 nt, Homo sapiens
ccucaggucuccac

SEQ ID NO: 2198634 - RNA, 13 nt, Homo sapiens
auccuacuucucc

SEQ ID NO: 2198635 - RNA, 21 nt, Homo sapiens
aacagcacuuucuguaguaau

SEQ ID NO: 2198636 - RNA, 23 nt, Homo sapiens
uuucccugcacccaucugcucac

SEQ ID NO: 2198637 - RNA, 14 nt, Homo sapiens
caucguggagacag

SEQ ID NO: 2198638 - RNA, 23 nt, Homo sapiens
cgacacugggaggccagugagcc

SEQ ID NO: 2198639 - RNA, 16 nt, Homo sapiens
aguaagaaaugcugcc

SEQ ID NO: 2198640 - RNA, 17 nt, Homo sapiens
uaauaguacauaaucuu

SEQ ID NO: 2198641 - RNA, 15 nt, Homo sapiens
ugaaaccgucccuga

SEQ ID NO: 2198642 - RNA, 17 nt, Homo sapiens
aaaugcaguugucuugu

SEQ ID NO: 2198643 - RNA, 15 nt, Homo sapiens
auauuucaaaccaca

SEQ ID NO: 2198644 - RNA, 22 nt, Homo sapiens
uacuggaagcugcagaucuuug

SEQ ID NO: 2198645 - RNA, 13 nt, Homo sapiens
agccuugcaugac

SEQ ID NO: 2198646 - RNA, 22 nt, Homo sapiens
ggacauuucucaagggccaugu

SEQ ID NO: 2198647 - RNA, 18 nt, Homo sapiens
aguuccccugucuguccc

SEQ ID NO: 2198648 - RNA, 14 nt, Homo sapiens
agccggguaccuca

SEQ ID NO: 2198649 - RNA, 18 nt, Homo sapiens
caagucagcacuaccucc

SEQ ID NO: 2198650 - RNA, 23 nt, Homo sapiens
uuuaucagagucaugaugaauca

SEQ ID NO: 2198651 - RNA, 18 nt, Homo sapiens
gccuuaguugagauuuca

SEQ ID NO: 2198652 - RNA, 23 nt, Homo sapiens
cuccagggaugauucaagccauu

SEQ ID NO: 2198653 - RNA, 16 nt, Homo sapiens
cuggaaggcuuccacu

SEQ ID NO: 2198654 - RNA, 13 nt, Homo sapiens
ccauggggcagca

SEQ ID NO: 2198655 - RNA, 12 nt, Homo sapiens
agcaucagcuca

SEQ ID NO: 2198656 - RNA, 18 nt, Homo sapiens
agggccuuaaaagccauc

SEQ ID NO: 2198657 - RNA, 14 nt, Homo sapiens
auaaaccucaaguu

SEQ ID NO: 2198658 - RNA, 21 nt, Homo sapiens
ccuguucuguguugcaagaua

SEQ ID NO: 2198659 - RNA, 16 nt, Homo sapiens
ugauccucuacugugc

SEQ ID NO: 2198660 - RNA, 17 nt, Homo sapiens
acacuacaugaugacuc

SEQ ID NO: 2198661 - RNA, 13 nt, Homo sapiens
cuguuauucuugu

SEQ ID NO: 2198662 - RNA, 22 nt, Homo sapiens
auucccuuccucugauuugaag

SEQ ID NO: 2198663 - RNA, 16 nt, Homo sapiens
uagggucuuguguugc

SEQ ID NO: 2198664 - RNA, 20 nt, Homo sapiens
ucuaaagucaucaugaacug

SEQ ID NO: 2198665 - RNA, 17 nt, Homo sapiens
cgaccgggcaagcuuuc

SEQ ID NO: 2198666 - RNA, 20 nt, Homo sapiens
uaccuucaagaaccaggcag

SEQ ID NO: 2198667 - RNA, 21 nt, Homo sapiens
guuuacugacauggugcugug

SEQ ID NO: 2198668 - RNA, 22 nt, Homo sapiens
uaucagcagacacuccaguuug

SEQ ID NO: 2198669 - RNA, 16 nt, Homo sapiens
gugaacacacucagca

SEQ ID NO: 2198670 - RNA, 16 nt, Homo sapiens
aaauauguauaugaca

SEQ ID NO: 2198671 - RNA, 13 nt, Homo sapiens
auuuuaauuaucu

SEQ ID NO: 2198672 - RNA, 13 nt, Homo sapiens
uagucaauaugcc

SEQ ID NO: 2198673 - RNA, 17 nt, Homo sapiens
auaauaauuugcacuua

SEQ ID NO: 2198674 - RNA, 17 nt, Homo sapiens
gcccuugugcuccaguc

SEQ ID NO: 2198675 - RNA, 16 nt, Homo sapiens
ggccuuugagccugau

SEQ ID NO: 2198676 - RNA, 22 nt, Homo sapiens
agggaguaagugacacuuugaa

SEQ ID NO: 2198677 - RNA, 20 nt, Homo sapiens
gugucagaaacccuggucuc

SEQ ID NO: 2198678 - RNA, 19 nt, Homo sapiens
cacuccauggagucuggaa

SEQ ID NO: 2198679 - RNA, 23 nt, Homo sapiens
uuuaaaaaagaaauuaucuuuag

SEQ ID NO: 2198680 - RNA, 14 nt, Homo sapiens
caauaaaacauucc

SEQ ID NO: 2198681 - RNA, 20 nt, Homo sapiens
ucauaaccacccuagcuuua

SEQ ID NO: 2198682 - RNA, 19 nt, Homo sapiens
aagacugaugaagaaauuu

SEQ ID NO: 2198683 - RNA, 18 nt, Homo sapiens
uuccguggguucugucau

SEQ ID NO: 2198684 - RNA, 20 nt, Homo sapiens
cuaaagguccacaggucuag

SEQ ID NO: 2198685 - RNA, 21 nt, Homo sapiens
aguuaacccugucugagaugc

SEQ ID NO: 2198686 - RNA, 23 nt, Homo sapiens
agcuguagaccaccuaauaucaa

SEQ ID NO: 2198687 - RNA, 20 nt, Homo sapiens
aaucucgucaggcugccaga

SEQ ID NO: 2198688 - RNA, 23 nt, Homo sapiens
aucugacauauuucauaagcaca

SEQ ID NO: 2198689 - RNA, 19 nt, Homo sapiens
uuucucuguggccauuugu

SEQ ID NO: 2198690 - RNA, 18 nt, Homo sapiens
uagggauauuuaacugga

SEQ ID NO: 2198691 - RNA, 21 nt, Homo sapiens
cuauggucgagacuguaggga

SEQ ID NO: 2198692 - RNA, 15 nt, Homo sapiens
auguuaucaguauua

SEQ ID NO: 2198693 - RNA, 17 nt, Homo sapiens
gcugcacccacccagga

SEQ ID NO: 2198694 - RNA, 22 nt, Homo sapiens
cuggcauaucucuguucaguua

SEQ ID NO: 2198695 - RNA, 22 nt, Homo sapiens
gaaaauucucucaagacuucuc

SEQ ID NO: 2198696 - RNA, 21 nt, Homo sapiens
acuuccaucuagucacaaaga

SEQ ID NO: 2198697 - RNA, 12 nt, Homo sapiens
aaaucuuguaca

SEQ ID NO: 2198698 - RNA, 12 nt, Homo sapiens
ugaucuugagca

SEQ ID NO: 2198699 - RNA, 22 nt, Homo sapiens
uccuugaacccaggccaugugg

SEQ ID NO: 2198700 - RNA, 22 nt, Homo sapiens
ucuggucaaccccacaagcacc

SEQ ID NO: 2198701 - RNA, 22 nt, Homo sapiens
ucccacugaccuacucuugccu

SEQ ID NO: 2198702 - RNA, 21 nt, Homo sapiens
agaacaucuggauuucauccu

SEQ ID NO: 2198703 - RNA, 14 nt, Homo sapiens
gucuuaaccuaccu

SEQ ID NO: 2198704 - RNA, 17 nt, Homo sapiens
ugcccugaacccacugc

SEQ ID NO: 2198705 - RNA, 22 nt, Homo sapiens
ucuuccagagucaucuaccuga

SEQ ID NO: 2198706 - RNA, 17 nt, Homo sapiens
ccugacucgucugacug

SEQ ID NO: 2198707 - RNA, 21 nt, Homo sapiens
uguuuuguguguaaggaguau

SEQ ID NO: 2198708 - RNA, 23 nt, Homo sapiens
gcucccgccgcggcuguugcuca

SEQ ID NO: 2198709 - RNA, 14 nt, Homo sapiens
aguucaaauugccu

SEQ ID NO: 2198710 - RNA, 20 nt, Homo sapiens
cuugaggaucauaugaauua

SEQ ID NO: 2198711 - RNA, 13 nt, Homo sapiens
auuuauguacaaa

SEQ ID NO: 2198712 - RNA, 15 nt, Homo sapiens
cuaucaaaauugccu

SEQ ID NO: 2198713 - RNA, 22 nt, Homo sapiens
agccuccacagcgagggcagcu

SEQ ID NO: 2198714 - RNA, 17 nt, Homo sapiens
cccuaggggacacuucc

SEQ ID NO: 2198715 - RNA, 17 nt, Homo sapiens
gccacgugaacuaugca

SEQ ID NO: 2198716 - RNA, 17 nt, Homo sapiens
gcagaggucagacuaag

SEQ ID NO: 2198717 - RNA, 17 nt, Homo sapiens
aaagagagcucuaacca

SEQ ID NO: 2198718 - RNA, 22 nt, Homo sapiens
gcuccuuggcacccccaugcug

SEQ ID NO: 2198719 - RNA, 15 nt, Homo sapiens
cugaauaucuguuca

SEQ ID NO: 2198720 - RNA, 22 nt, Homo sapiens
aaguaaauuuguccaauggcug

SEQ ID NO: 2198721 - RNA, 22 nt, Homo sapiens
ucuauugaaaacagugucuuga

SEQ ID NO: 2198722 - RNA, 20 nt, Homo sapiens
gauaaggggccuugcucuga

SEQ ID NO: 2198723 - RNA, 19 nt, Homo sapiens
acagcuccgcgcucggggc

SEQ ID NO: 2198724 - RNA, 21 nt, Homo sapiens
uaagauaucccuaaggaauuu

SEQ ID NO: 2198725 - RNA, 21 nt, Homo sapiens
acuccucauccccacaaucug

SEQ ID NO: 2198726 - RNA, 19 nt, Homo sapiens
ugauuuuuuuucucucucu

SEQ ID NO: 2198727 - RNA, 19 nt, Homo sapiens
ccagaggccccaggucacc

SEQ ID NO: 2198728 - RNA, 17 nt, Homo sapiens
uauuuuugucacggaaa

SEQ ID NO: 2198729 - RNA, 11 nt, Homo sapiens
ggaaacuaaua

SEQ ID NO: 2198730 - RNA, 15 nt, Homo sapiens
uaacaucacugucuu

SEQ ID NO: 2198731 - RNA, 14 nt, Homo sapiens
acaaccuuccagcu

SEQ ID NO: 2198732 - RNA, 17 nt, Homo sapiens
gaaagcaguaaccaaga

SEQ ID NO: 2198733 - RNA, 16 nt, Homo sapiens
aaauggaggaauauga

SEQ ID NO: 2198734 - RNA, 15 nt, Homo sapiens
acccccucuggagaa

SEQ ID NO: 2198735 - RNA, 22 nt, Homo sapiens
auuggcagcacccacucagcca

SEQ ID NO: 2198736 - RNA, 12 nt, Homo sapiens
auguuccacucc

SEQ ID NO: 2198737 - RNA, 19 nt, Homo sapiens
auguuaaacguuacuuuca

SEQ ID NO: 2198738 - RNA, 13 nt, Homo sapiens
ccacacacauuau

SEQ ID NO: 2198739 - RNA, 16 nt, Homo sapiens
aauguaccugauguac

SEQ ID NO: 2198740 - RNA, 16 nt, Homo sapiens
agaguaaauauuguca

SEQ ID NO: 2198741 - RNA, 21 nt, Homo sapiens
cgggagucuccucacugccac

SEQ ID NO: 2198742 - RNA, 23 nt, Homo sapiens
caggagcuugggcagugccccag

SEQ ID NO: 2198743 - RNA, 17 nt, Homo sapiens
guuuagugugauuguga

SEQ ID NO: 2198744 - RNA, 19 nt, Homo sapiens
agaacucaaauggggccag

SEQ ID NO: 2198745 - RNA, 22 nt, Homo sapiens
cccagucucuggggucaggaag

SEQ ID NO: 2198746 - RNA, 11 nt, Homo sapiens
aagcaccaucc

SEQ ID NO: 2198747 - RNA, 14 nt, Homo sapiens
aucgagacugcaau

SEQ ID NO: 2198748 - RNA, 14 nt, Homo sapiens
uuuaauacagugag

SEQ ID NO: 2198749 - RNA, 16 nt, Homo sapiens
caauacggaacacugu

SEQ ID NO: 2198750 - RNA, 16 nt, Homo sapiens
uuaaaaaucuguaaau

SEQ ID NO: 2198751 - RNA, 23 nt, Homo sapiens
ucaugaacuauuuacauuuucca

SEQ ID NO: 2198752 - RNA, 15 nt, Homo sapiens
agaccaaccuuccau

SEQ ID NO: 2198753 - RNA, 22 nt, Homo sapiens
uguguugucuucagcagucaau

SEQ ID NO: 2198754 - RNA, 21 nt, Homo sapiens
gcugagcacacaacaggcugu

SEQ ID NO: 2198755 - RNA, 15 nt, Homo sapiens
ucuaacugcuguuaa

SEQ ID NO: 2198756 - RNA, 18 nt, Homo sapiens
uaaggacaagacacugag

SEQ ID NO: 2198757 - RNA, 21 nt, Homo sapiens
ccuuuggcuucugauuuuucu

SEQ ID NO: 2198758 - RNA, 23 nt, Homo sapiens
ccacuccaaaaaucagugcauuu

SEQ ID NO: 2198759 - RNA, 14 nt, Homo sapiens
aaauaaaacugaau

SEQ ID NO: 2198760 - RNA, 15 nt, Homo sapiens
uaaggugcuuaccuc

SEQ ID NO: 2198761 - RNA, 17 nt, Homo sapiens
ucgccagucacugcugc

SEQ ID NO: 2198762 - RNA, 14 nt, Homo sapiens
ucugaaggagauuu

SEQ ID NO: 2198763 - RNA, 15 nt, Homo sapiens
uccuuagcaacagcc

SEQ ID NO: 2198764 - RNA, 14 nt, Homo sapiens
gcacauuucaaaac

SEQ ID NO: 2198765 - RNA, 20 nt, Homo sapiens
ccacaauuggccagggcaac

SEQ ID NO: 2198766 - RNA, 19 nt, Homo sapiens
agacaauaaacccucagag

SEQ ID NO: 2198767 - RNA, 21 nt, Homo sapiens
cagagccuggggauuccagcu

SEQ ID NO: 2198768 - RNA, 23 nt, Homo sapiens
guuuggccgggugcgguggcuca

SEQ ID NO: 2198769 - RNA, 21 nt, Homo sapiens
uccuaaguuuaauuacaacag

SEQ ID NO: 2198770 - RNA, 11 nt, Homo sapiens
ggcuccagaaa

SEQ ID NO: 2198771 - RNA, 21 nt, Homo sapiens
aacaauauuguauacuaccau

SEQ ID NO: 2198772 - RNA, 18 nt, Homo sapiens
cugcaugcacuucuuaca

SEQ ID NO: 2198773 - RNA, 21 nt, Homo sapiens
gugcuuaagcagaagcauuaa

SEQ ID NO: 2198774 - RNA, 23 nt, Homo sapiens
cugacauauuucauaagcacauc

SEQ ID NO: 2198775 - RNA, 19 nt, Homo sapiens
cuuuuggaccuugggauca

SEQ ID NO: 2198776 - RNA, 14 nt, Homo sapiens
aagccuucccccag

SEQ ID NO: 2198777 - RNA, 21 nt, Homo sapiens
ccuggccuuauaucauuucau

SEQ ID NO: 2198778 - RNA, 14 nt, Homo sapiens
gguugguguucuca

SEQ ID NO: 2198779 - RNA, 17 nt, Homo sapiens
augagccuuuguugcua

SEQ ID NO: 2198780 - RNA, 17 nt, Homo sapiens
aagaacccuagcacaaa

SEQ ID NO: 2198781 - RNA, 16 nt, Homo sapiens
ggucauacuacauaca

SEQ ID NO: 2198782 - RNA, 20 nt, Homo sapiens
uucguccuuagaauacugua

SEQ ID NO: 2198783 - RNA, 22 nt, Homo sapiens
accgcaagcuuugagugggaca

SEQ ID NO: 2198784 - RNA, 17 nt, Homo sapiens
uaaauuuaauauacugc

SEQ ID NO: 2198785 - RNA, 20 nt, Homo sapiens
gcucugcagacugcugcuag

SEQ ID NO: 2198786 - RNA, 14 nt, Homo sapiens
ucuaaaaugaaaua

SEQ ID NO: 2198787 - RNA, 20 nt, Homo sapiens
aaagauauaugaauaugaca

SEQ ID NO: 2198788 - RNA, 19 nt, Homo sapiens
cucuagguccccauacucc

SEQ ID NO: 2198789 - RNA, 17 nt, Homo sapiens
cacauugagucuaucaa

SEQ ID NO: 2198790 - RNA, 20 nt, Homo sapiens
uggaaaauacaucuguucca

SEQ ID NO: 2198791 - RNA, 13 nt, Homo sapiens
guacugccuuaaa

SEQ ID NO: 2198792 - RNA, 17 nt, Homo sapiens
cacugggacccucagcc

SEQ ID NO: 2198793 - RNA, 16 nt, Homo sapiens
agguguugucaaguga

SEQ ID NO: 2198794 - RNA, 16 nt, Homo sapiens
cgaacuccugaccuua

SEQ ID NO: 2198795 - RNA, 18 nt, Homo sapiens
ucugaaaggugcuuucuc

SEQ ID NO: 2198796 - RNA, 12 nt, Homo sapiens
aaaacuuuccaa

SEQ ID NO: 2198797 - RNA, 15 nt, Homo sapiens
agagaacuuccagau

SEQ ID NO: 2198798 - RNA, 12 nt, Homo sapiens
cacauuccugac

SEQ ID NO: 2198799 - RNA, 22 nt, Homo sapiens
gcucucuucuccccacugugcc

SEQ ID NO: 2198800 - RNA, 22 nt, Homo sapiens
aauuauacagauagaguuccau

SEQ ID NO: 2198801 - RNA, 21 nt, Homo sapiens
ucugugauguucccaccugcu

SEQ ID NO: 2198802 - RNA, 19 nt, Homo sapiens
agugucauguucugugcau

SEQ ID NO: 2198803 - RNA, 23 nt, Homo sapiens
uauuaaagugcuaagguucuaag

SEQ ID NO: 2198804 - RNA, 14 nt, Homo sapiens
aguccaacugucaa

SEQ ID NO: 2198805 - RNA, 21 nt, Homo sapiens
gacagugccugggaauguauu

SEQ ID NO: 2198806 - RNA, 17 nt, Homo sapiens
gagccagcggcuccaac

SEQ ID NO: 2198807 - RNA, 12 nt, Homo sapiens
auuaguaaccag

SEQ ID NO: 2198808 - RNA, 22 nt, Homo sapiens
cuuggaaguguguggaaggcag

SEQ ID NO: 2198809 - RNA, 13 nt, Homo sapiens
cagccuccaagaa

SEQ ID NO: 2198810 - RNA, 19 nt, Homo sapiens
gacuuccucgccucuccca

SEQ ID NO: 2198811 - RNA, 11 nt, Homo sapiens
guuuuccugug

SEQ ID NO: 2198812 - RNA, 11 nt, Homo sapiens
cuuuuccucug

SEQ ID NO: 2198813 - RNA, 18 nt, Homo sapiens
uaagcuguaaauuacaua

SEQ ID NO: 2198814 - RNA, 14 nt, Homo sapiens
aaauccuuacuucc

SEQ ID NO: 2198815 - RNA, 18 nt, Homo sapiens
caguuugagacuccaagc

SEQ ID NO: 2198816 - RNA, 23 nt, Homo sapiens
cucuggaggaaguucuccagcuu

SEQ ID NO: 2198817 - RNA, 21 nt, Homo sapiens
gaggggggggugggugagaga

SEQ ID NO: 2198818 - RNA, 12 nt, Homo sapiens
ugauagugcuuc

SEQ ID NO: 2198819 - RNA, 16 nt, Homo sapiens
uacauguuaacugagg

SEQ ID NO: 2198820 - RNA, 23 nt, Homo sapiens
cuuaaaggaagguucugguguga

SEQ ID NO: 2198821 - RNA, 18 nt, Homo sapiens
aaaaccuacccuguccua

SEQ ID NO: 2198822 - RNA, 13 nt, Homo sapiens
gaugggaucccag

SEQ ID NO: 2198823 - RNA, 13 nt, Homo sapiens
cacaggaugcugg

SEQ ID NO: 2198824 - RNA, 17 nt, Homo sapiens
agcaagaugaaacaggg

SEQ ID NO: 2198825 - RNA, 19 nt, Homo sapiens
cugccuaaauccacucugc

SEQ ID NO: 2198826 - RNA, 14 nt, Homo sapiens
caccucuccagagg

SEQ ID NO: 2198827 - RNA, 19 nt, Homo sapiens
cccugcaagacacaggcuc

SEQ ID NO: 2198828 - RNA, 23 nt, Homo sapiens
agcuccaccuuacuucuucucau

SEQ ID NO: 2198829 - RNA, 17 nt, Homo sapiens
ugccaccacugggcaaa

SEQ ID NO: 2198830 - RNA, 15 nt, Homo sapiens
agaaguccacagaca

SEQ ID NO: 2198831 - RNA, 22 nt, Homo sapiens
cuccugccucagccuccugagc

SEQ ID NO: 2198832 - RNA, 17 nt, Homo sapiens
uaggcuaagcacuuuau

SEQ ID NO: 2198833 - RNA, 18 nt, Homo sapiens
cauuuuucucuugccauu

SEQ ID NO: 2198834 - RNA, 22 nt, Homo sapiens
aguguuuuagagagagaacuuu

SEQ ID NO: 2198835 - RNA, 17 nt, Homo sapiens
acuggcguucaccuccc

SEQ ID NO: 2198836 - RNA, 12 nt, Homo sapiens
gcauccuagucu

SEQ ID NO: 2198837 - RNA, 22 nt, Homo sapiens
acagauccaaugggaguccaug

SEQ ID NO: 2198838 - RNA, 14 nt, Homo sapiens
gauaucaugcaaau

SEQ ID NO: 2198839 - RNA, 15 nt, Homo sapiens
acauagacagaagaa

SEQ ID NO: 2198840 - RNA, 15 nt, Homo sapiens
agccuugcacugugg

SEQ ID NO: 2198841 - RNA, 15 nt, Homo sapiens
auguaagugggccca

SEQ ID NO: 2198842 - RNA, 14 nt, Homo sapiens
aauaguacuauuaa

SEQ ID NO: 2198843 - RNA, 19 nt, Homo sapiens
ugacagaucaagcugugag

SEQ ID NO: 2198844 - RNA, 23 nt, Homo sapiens
caagagccacaguauauuucccu

SEQ ID NO: 2198845 - RNA, 13 nt, Homo sapiens
acccauuugccag

SEQ ID NO: 2198846 - RNA, 21 nt, Homo sapiens
accacaccuggcccuugcaau

SEQ ID NO: 2198847 - RNA, 21 nt, Homo sapiens
aauaagauauuuaguaauauu

SEQ ID NO: 2198848 - RNA, 16 nt, Homo sapiens
uguaauuuuaguauua

SEQ ID NO: 2198849 - RNA, 21 nt, Homo sapiens
agagaugauucggauuugaca

SEQ ID NO: 2198850 - RNA, 14 nt, Homo sapiens
aacauuuacaugua

SEQ ID NO: 2198851 - RNA, 14 nt, Homo sapiens
acuugucauaucac

SEQ ID NO: 2198852 - RNA, 20 nt, Homo sapiens
uaggauuaaacacacacaaa

SEQ ID NO: 2198853 - RNA, 21 nt, Homo sapiens
gugaguuacagcgagaggcag

SEQ ID NO: 2198854 - RNA, 14 nt, Homo sapiens
uucuauauuuacug

SEQ ID NO: 2198855 - RNA, 19 nt, Homo sapiens
acuauaaugguuggaacua

SEQ ID NO: 2198856 - RNA, 14 nt, Homo sapiens
uacucucucucuuu

SEQ ID NO: 2198857 - RNA, 20 nt, Homo sapiens
agacgguaccaauucagugu

SEQ ID NO: 2198858 - RNA, 17 nt, Homo sapiens
cacuuacuguuguccua

SEQ ID NO: 2198859 - RNA, 15 nt, Homo sapiens
uuuaaauugauagca

SEQ ID NO: 2198860 - RNA, 17 nt, Homo sapiens
acugugugagauuguga

SEQ ID NO: 2198861 - RNA, 20 nt, Homo sapiens
uguaaagaaaaaagcaccaa

SEQ ID NO: 2198862 - RNA, 15 nt, Homo sapiens
uauagucgcagcuac

SEQ ID NO: 2198863 - RNA, 12 nt, Homo sapiens
gacagcucuuau

SEQ ID NO: 2198864 - RNA, 14 nt, Homo sapiens
uuguauaacugaaa

SEQ ID NO: 2198865 - RNA, 14 nt, Homo sapiens
ucauguaaccaaga

SEQ ID NO: 2198866 - RNA, 15 nt, Homo sapiens
uuugaaagacugugc

SEQ ID NO: 2198867 - RNA, 15 nt, Homo sapiens
caugucacugaaauu

SEQ ID NO: 2198868 - RNA, 18 nt, Homo sapiens
gucccuugagugaggcag

SEQ ID NO: 2198869 - RNA, 14 nt, Homo sapiens
agauauacauauca

SEQ ID NO: 2198870 - RNA, 18 nt, Homo sapiens
gcccaggcuggagugcaa

SEQ ID NO: 2198871 - RNA, 13 nt, Homo sapiens
aauuucugucaaa

SEQ ID NO: 2198872 - RNA, 15 nt, Homo sapiens
auugcuaccaaaaac

SEQ ID NO: 2198873 - RNA, 14 nt, Homo sapiens
cgugagacccagug

SEQ ID NO: 2198874 - RNA, 14 nt, Homo sapiens
ucaaauacuguauu

SEQ ID NO: 2198875 - RNA, 14 nt, Homo sapiens
auaaacuaguauga

SEQ ID NO: 2198876 - RNA, 17 nt, Homo sapiens
ugccuauagucgcagcu

SEQ ID NO: 2198877 - RNA, 14 nt, Homo sapiens
uagcaugaacgcca

SEQ ID NO: 2198878 - RNA, 17 nt, Homo sapiens
auccaauaugacucaga

SEQ ID NO: 2198879 - RNA, 22 nt, Homo sapiens
augcauuagaagucagccagcg

SEQ ID NO: 2198880 - RNA, 12 nt, Homo sapiens
agaacacuguga

SEQ ID NO: 2198881 - RNA, 12 nt, Homo sapiens
agaggcuccagc

SEQ ID NO: 2198882 - RNA, 20 nt, Homo sapiens
ccaugcauuuaaaguauucu

SEQ ID NO: 2198883 - RNA, 18 nt, Homo sapiens
cuuuugaagagcaaaggg

SEQ ID NO: 2198884 - RNA, 12 nt, Homo sapiens
guucgaccaaac

SEQ ID NO: 2198885 - RNA, 17 nt, Homo sapiens
agcuggauauaauguau

SEQ ID NO: 2198886 - RNA, 23 nt, Homo sapiens
uacaaacaauggaaacugaaugc

SEQ ID NO: 2198887 - RNA, 22 nt, Homo sapiens
agcgguggaggaaggcucuguc

SEQ ID NO: 2198888 - RNA, 23 nt, Homo sapiens
gaccauaaaggcauggcauuugu

SEQ ID NO: 2198889 - RNA, 22 nt, Homo sapiens
caaugugaaaaaugugucugua

SEQ ID NO: 2198890 - RNA, 12 nt, Homo sapiens
aaguuucauccg

SEQ ID NO: 2198891 - RNA, 12 nt, Homo sapiens
agccaauggugc

SEQ ID NO: 2198892 - RNA, 16 nt, Homo sapiens
gguccuuccaccucag

SEQ ID NO: 2198893 - RNA, 22 nt, Homo sapiens
gcaggcgccucaacucugcuga

SEQ ID NO: 2198894 - RNA, 23 nt, Homo sapiens
ccugacugcugugggcugcucac

SEQ ID NO: 2198895 - RNA, 16 nt, Homo sapiens
cuuucuucuucuucua

SEQ ID NO: 2198896 - RNA, 21 nt, Homo sapiens
uuguaucuuuaaagacuugau

SEQ ID NO: 2198897 - RNA, 21 nt, Homo sapiens
acugcacagaagacagcagca

SEQ ID NO: 2198898 - RNA, 14 nt, Homo sapiens
ggaagagcaaggga

SEQ ID NO: 2198899 - RNA, 21 nt, Homo sapiens
agaggugugugccuagugaug

SEQ ID NO: 2198900 - RNA, 18 nt, Homo sapiens
accaggagggcacuggag

SEQ ID NO: 2198901 - RNA, 14 nt, Homo sapiens
caacaauccaaaaa

SEQ ID NO: 2198902 - RNA, 17 nt, Homo sapiens
ggcuauuuggacucagg

SEQ ID NO: 2198903 - RNA, 21 nt, Homo sapiens
uuccucuaggaaaagggauac

SEQ ID NO: 2198904 - RNA, 18 nt, Homo sapiens
gacauuuuuuuguuccaa

SEQ ID NO: 2198905 - RNA, 14 nt, Homo sapiens
uugacguuugcuca

SEQ ID NO: 2198906 - RNA, 22 nt, Homo sapiens
uuccccagugacuccaggguga

SEQ ID NO: 2198907 - RNA, 16 nt, Homo sapiens
cauagagauaugcaca

SEQ ID NO: 2198908 - RNA, 22 nt, Homo sapiens
ucuaggcccugugagcacaaag

SEQ ID NO: 2198909 - RNA, 15 nt, Homo sapiens
aucuauauucauuuc

SEQ ID NO: 2198910 - RNA, 20 nt, Homo sapiens
uauuuucuucuccagugguc

SEQ ID NO: 2198911 - RNA, 16 nt, Homo sapiens
cuaccugggauuccag

SEQ ID NO: 2198912 - RNA, 16 nt, Homo sapiens
auaucaguaguguaca

SEQ ID NO: 2198913 - RNA, 17 nt, Homo sapiens
acauauucaaugcaagu

SEQ ID NO: 2198914 - RNA, 21 nt, Homo sapiens
ggagucuucagacccagagaa

SEQ ID NO: 2198915 - RNA, 23 nt, Homo sapiens
ucaauuuguaauuuuaguauuaa

SEQ ID NO: 2198916 - RNA, 17 nt, Homo sapiens
agcauuuaaccaaccua

SEQ ID NO: 2198917 - RNA, 21 nt, Homo sapiens
cagggccuggccugguccagg

SEQ ID NO: 2198918 - RNA, 14 nt, Homo sapiens
cauucauagccaga

SEQ ID NO: 2198919 - RNA, 21 nt, Homo sapiens
auauguauuacaaauggugaa

SEQ ID NO: 2198920 - RNA, 17 nt, Homo sapiens
ucacuuguguguguacc

SEQ ID NO: 2198921 - RNA, 19 nt, Homo sapiens
auacgacagcucucugugc

SEQ ID NO: 2198922 - RNA, 13 nt, Homo sapiens
agaggaagccacg

SEQ ID NO: 2198923 - RNA, 18 nt, Homo sapiens
ggugccaguccaucucaa

SEQ ID NO: 2198924 - RNA, 14 nt, Homo sapiens
uguugaggugugaa

SEQ ID NO: 2198925 - RNA, 16 nt, Homo sapiens
gacacugacaaaguca

SEQ ID NO: 2198926 - RNA, 13 nt, Homo sapiens
ucuguggccacuc

SEQ ID NO: 2198927 - RNA, 16 nt, Homo sapiens
cgguuccugucccugc

SEQ ID NO: 2198928 - RNA, 17 nt, Homo sapiens
gcugacuucuuucacaa

SEQ ID NO: 2198929 - RNA, 21 nt, Homo sapiens
gccugucucuuuccacuuugu

SEQ ID NO: 2198930 - RNA, 14 nt, Homo sapiens
aggcaccagcagca

SEQ ID NO: 2198931 - RNA, 15 nt, Homo sapiens
aggggcuuccucuag

SEQ ID NO: 2198932 - RNA, 23 nt, Homo sapiens
ugugcauggcuggggacuucuca

SEQ ID NO: 2198933 - RNA, 24 nt, Homo sapiens
uucuucuagaguaauuaucuguga

SEQ ID NO: 2198934 - RNA, 18 nt, Homo sapiens
cccguggagguucuguau

SEQ ID NO: 2198935 - RNA, 16 nt, Homo sapiens
uccugggugcugucau

SEQ ID NO: 2198936 - RNA, 17 nt, Homo sapiens
cuaauaauaaauuaaua

SEQ ID NO: 2198937 - RNA, 21 nt, Homo sapiens
caggaaugcagcacaguacuc

SEQ ID NO: 2198938 - RNA, 14 nt, Homo sapiens
gauucgaaugacac

SEQ ID NO: 2198939 - RNA, 16 nt, Homo sapiens
caugaaauucuuccua

SEQ ID NO: 2198940 - RNA, 15 nt, Homo sapiens
uucuguaaauggaac

SEQ ID NO: 2198941 - RNA, 16 nt, Homo sapiens
gacucaaucuacaggc

SEQ ID NO: 2198942 - RNA, 18 nt, Homo sapiens
cgccuguaauuccagcua

SEQ ID NO: 2198943 - RNA, 14 nt, Homo sapiens
cugugccucuucag

SEQ ID NO: 2198944 - RNA, 16 nt, Homo sapiens
uuucuuccccuugugu

SEQ ID NO: 2198945 - RNA, 19 nt, Homo sapiens
cucauaucaugguagucac

SEQ ID NO: 2198946 - RNA, 18 nt, Homo sapiens
cacccuaacucuugcuca

SEQ ID NO: 2198947 - RNA, 20 nt, Homo sapiens
cacuacgugacuguggcaca

SEQ ID NO: 2198948 - RNA, 15 nt, Homo sapiens
gcauugauccaggag

SEQ ID NO: 2198949 - RNA, 15 nt, Homo sapiens
acagacuggcaauaa

SEQ ID NO: 2198950 - RNA, 16 nt, Homo sapiens
agcagaaaauacagcu

SEQ ID NO: 2198951 - RNA, 22 nt, Homo sapiens
caaacaaaaauguuaagcaucu

SEQ ID NO: 2198952 - RNA, 22 nt, Homo sapiens
gccccuuaaauuucugcccuga

SEQ ID NO: 2198953 - RNA, 15 nt, Homo sapiens
uauacuugacucuaa

SEQ ID NO: 2198954 - RNA, 14 nt, Homo sapiens
gccagugcugugag

SEQ ID NO: 2198955 - RNA, 22 nt, Homo sapiens
gccuggacuguuuucucucggc

SEQ ID NO: 2198956 - RNA, 12 nt, Homo sapiens
ucaucauaaaua

SEQ ID NO: 2198957 - RNA, 16 nt, Homo sapiens
aucuuucugauuccgc

SEQ ID NO: 2198958 - RNA, 16 nt, Homo sapiens
uucuucccaaggccag

SEQ ID NO: 2198959 - RNA, 20 nt, Homo sapiens
cauccauucagaaagcauuu

SEQ ID NO: 2198960 - RNA, 13 nt, Homo sapiens
uaaacaugaauua

SEQ ID NO: 2198961 - RNA, 16 nt, Homo sapiens
ggcgccugggaucuga

SEQ ID NO: 2198962 - RNA, 14 nt, Homo sapiens
ggauuacuauugca

SEQ ID NO: 2198963 - RNA, 18 nt, Homo sapiens
gaacacucuacuacaugu

SEQ ID NO: 2198964 - RNA, 23 nt, Homo sapiens
gccccauuugccagauugcccca

SEQ ID NO: 2198965 - RNA, 17 nt, Homo sapiens
gaauguucaucucucca

SEQ ID NO: 2198966 - RNA, 18 nt, Homo sapiens
aauaaaaauguucuuaca

SEQ ID NO: 2198967 - RNA, 15 nt, Homo sapiens
gcuuuuguacguuaa

SEQ ID NO: 2198968 - RNA, 16 nt, Homo sapiens
guauccacaggauauu

SEQ ID NO: 2198969 - RNA, 19 nt, Homo sapiens
uccugcccuccaucucagc

SEQ ID NO: 2198970 - RNA, 20 nt, Homo sapiens
uaaaaagaagagacugcuac

SEQ ID NO: 2198971 - RNA, 14 nt, Homo sapiens
ggcuucucagucuc

SEQ ID NO: 2198972 - RNA, 21 nt, Homo sapiens
uauagagggcuuaugauucag

SEQ ID NO: 2198973 - RNA, 15 nt, Homo sapiens
gacagagauggcaga

SEQ ID NO: 2198974 - RNA, 22 nt, Homo sapiens
cucccugguuugcagcuguuuu

SEQ ID NO: 2198975 - RNA, 16 nt, Homo sapiens
agggaaggaucccaug

SEQ ID NO: 2198976 - RNA, 13 nt, Homo sapiens
aaucugccuaugu

SEQ ID NO: 2198977 - RNA, 17 nt, Homo sapiens
cauaacugaaggcauau

SEQ ID NO: 2198978 - RNA, 17 nt, Homo sapiens
uuaaaagacacacuugu

SEQ ID NO: 2198979 - RNA, 17 nt, Homo sapiens
aggcuagucucuucuca

SEQ ID NO: 2198980 - RNA, 19 nt, Homo sapiens
caugagaucuaggugagga

SEQ ID NO: 2198981 - RNA, 14 nt, Homo sapiens
uguugcuuauacug

SEQ ID NO: 2198982 - RNA, 19 nt, Homo sapiens
gugaacuagggaagcucag

SEQ ID NO: 2198983 - RNA, 22 nt, Homo sapiens
aacuaacccuuaaaaaugcaca

SEQ ID NO: 2198984 - RNA, 18 nt, Homo sapiens
uaaacuggcaucugcucu

SEQ ID NO: 2198985 - RNA, 22 nt, Homo sapiens
acaguuuucugcuuuaauuuca

SEQ ID NO: 2198986 - RNA, 15 nt, Homo sapiens
uugcagcucaguagu

SEQ ID NO: 2198987 - RNA, 21 nt, Homo sapiens
aaugcaagggggacacaugaa

SEQ ID NO: 2198988 - RNA, 17 nt, Homo sapiens
aauagauuuaacccuuc

SEQ ID NO: 2198989 - RNA, 13 nt, Homo sapiens
cauuaucagucca

SEQ ID NO: 2198990 - RNA, 21 nt, Homo sapiens
gcagucccccgagagguggga

SEQ ID NO: 2198991 - RNA, 21 nt, Homo sapiens
guaguauaugguggagccaac

SEQ ID NO: 2198992 - RNA, 15 nt, Homo sapiens
uaguucuucauccca

SEQ ID NO: 2198993 - RNA, 22 nt, Homo sapiens
uacacucauggggaagcuucca

SEQ ID NO: 2198994 - RNA, 12 nt, Homo sapiens
gcucgugcagua

SEQ ID NO: 2198995 - RNA, 19 nt, Homo sapiens
gcggggacccuuaccugaa

SEQ ID NO: 2198996 - RNA, 16 nt, Homo sapiens
cagcucucugugcacu

SEQ ID NO: 2198997 - RNA, 21 nt, Homo sapiens
ugggaggacaugcguguguca

SEQ ID NO: 2198998 - RNA, 21 nt, Homo sapiens
acgucacuucaugcaggugaa

SEQ ID NO: 2198999 - RNA, 15 nt, Homo sapiens
auugauucauguuca

SEQ ID NO: 2199000 - RNA, 14 nt, Homo sapiens
auguugccuugcau

SEQ ID NO: 2199001 - RNA, 17 nt, Homo sapiens
aaugaccccaucgagau

SEQ ID NO: 2199002 - RNA, 15 nt, Homo sapiens
ggaacauagacucac

SEQ ID NO: 2199003 - RNA, 13 nt, Homo sapiens
augcuuagaaagu

SEQ ID NO: 2199004 - RNA, 22 nt, Homo sapiens
gaagaggggcauaaacuuuccu

SEQ ID NO: 2199005 - RNA, 11 nt, Homo sapiens
gcccagugcau

SEQ ID NO: 2199006 - RNA, 18 nt, Homo sapiens
cucuggcuuagggugaua

SEQ ID NO: 2199007 - RNA, 14 nt, Homo sapiens
aauucccaauccca

SEQ ID NO: 2199008 - RNA, 18 nt, Homo sapiens
caaucuggcuuagugcca

SEQ ID NO: 2199009 - RNA, 19 nt, Homo sapiens
uagaaaguguucuguuaca

SEQ ID NO: 2199010 - RNA, 21 nt, Homo sapiens
auucacagcccagaaccacag

SEQ ID NO: 2199011 - RNA, 14 nt, Homo sapiens
uuuccacaaacaga

SEQ ID NO: 2199012 - RNA, 13 nt, Homo sapiens
uugauacuguugc

SEQ ID NO: 2199013 - RNA, 22 nt, Homo sapiens
uggggaggggaauauacacauu

SEQ ID NO: 2199014 - RNA, 23 nt, Homo sapiens
ucaggcaguggcccagggaauca

SEQ ID NO: 2199015 - RNA, 13 nt, Homo sapiens
cucuggcuucuca

SEQ ID NO: 2199016 - RNA, 15 nt, Homo sapiens
uguagcugugucaug

SEQ ID NO: 2199017 - RNA, 23 nt, Homo sapiens
auucaugucucuacccacuaugc

SEQ ID NO: 2199018 - RNA, 14 nt, Homo sapiens
acauacuucagcuc

SEQ ID NO: 2199019 - RNA, 20 nt, Homo sapiens
gugcaguggcaucaucucag

SEQ ID NO: 2199020 - RNA, 19 nt, Homo sapiens
gacccaaaaaaucaucuca

SEQ ID NO: 2199021 - RNA, 22 nt, Homo sapiens
caaacacuagcucuguauuaau

SEQ ID NO: 2199022 - RNA, 13 nt, Homo sapiens
guucaaagcacag

SEQ ID NO: 2199023 - RNA, 21 nt, Homo sapiens
agcccuuccucccauuuccca

SEQ ID NO: 2199024 - RNA, 21 nt, Homo sapiens
cauuucuagacucaaaaccug

SEQ ID NO: 2199025 - RNA, 17 nt, Homo sapiens
acgccucuuuucccucu

SEQ ID NO: 2199026 - RNA, 20 nt, Homo sapiens
cuugaguguaauguuuguua

SEQ ID NO: 2199027 - RNA, 20 nt, Homo sapiens
auauucuuaaugacauuuca

SEQ ID NO: 2199028 - RNA, 22 nt, Homo sapiens
ucauauauauacauacaugcau

SEQ ID NO: 2199029 - RNA, 16 nt, Homo sapiens
ccaccugacauguccu

SEQ ID NO: 2199030 - RNA, 20 nt, Homo sapiens
agacaaagggagccgagacc

SEQ ID NO: 2199031 - RNA, 21 nt, Homo sapiens
cccucuguugggaugccaguu

SEQ ID NO: 2199032 - RNA, 13 nt, Homo sapiens
gcaauuuuuccau

SEQ ID NO: 2199033 - RNA, 14 nt, Homo sapiens
uaaccauauucaca

SEQ ID NO: 2199034 - RNA, 20 nt, Homo sapiens
uacaauguagaaaaugagga

SEQ ID NO: 2199035 - RNA, 18 nt, Homo sapiens
uagaggcuugaucaugaa

SEQ ID NO: 2199036 - RNA, 12 nt, Homo sapiens
ccaggacugugu

SEQ ID NO: 2199037 - RNA, 13 nt, Homo sapiens
uccuggagugaua

SEQ ID NO: 2199038 - RNA, 16 nt, Homo sapiens
agcaccauaacuuugu

SEQ ID NO: 2199039 - RNA, 13 nt, Homo sapiens
aaguacuccuuaa

SEQ ID NO: 2199040 - RNA, 22 nt, Homo sapiens
auucauaucacuaugaacuugg

SEQ ID NO: 2199041 - RNA, 11 nt, Homo sapiens
cuuaacagccc

SEQ ID NO: 2199042 - RNA, 19 nt, Homo sapiens
caaucucuguuuguaugug

SEQ ID NO: 2199043 - RNA, 12 nt, Homo sapiens
cagcugggacac

SEQ ID NO: 2199044 - RNA, 16 nt, Homo sapiens
cuuugcuaugugcucc

SEQ ID NO: 2199045 - RNA, 18 nt, Homo sapiens
ugacugcaaaaacugggu

SEQ ID NO: 2199046 - RNA, 14 nt, Homo sapiens
caggaguccaagac

SEQ ID NO: 2199047 - RNA, 20 nt, Homo sapiens
ugauucaggcuuauaacaaa

SEQ ID NO: 2199048 - RNA, 16 nt, Homo sapiens
gcugagaaccacggug

SEQ ID NO: 2199049 - RNA, 20 nt, Homo sapiens
cacaaauuugggagggugag

SEQ ID NO: 2199050 - RNA, 23 nt, Homo sapiens
aacuaacucuccuccauguugcc

SEQ ID NO: 2199051 - RNA, 18 nt, Homo sapiens
agcaccuuagacaguccc

SEQ ID NO: 2199052 - RNA, 17 nt, Homo sapiens
guauuuuuauagccaua

SEQ ID NO: 2199053 - RNA, 17 nt, Homo sapiens
guugccuuuuuuuuauu

SEQ ID NO: 2199054 - RNA, 19 nt, Homo sapiens
gagcaaagggaacagugag

SEQ ID NO: 2199055 - RNA, 23 nt, Homo sapiens
ccaaaugacaagucacacccucc

SEQ ID NO: 2199056 - RNA, 16 nt, Homo sapiens
ccauaauguugcuucu

SEQ ID NO: 2199057 - RNA, 10 nt, Homo sapiens
uuaaaugcag

SEQ ID NO: 2199058 - RNA, 21 nt, Homo sapiens
gagucucacuuugacacccag

SEQ ID NO: 2199059 - RNA, 14 nt, Homo sapiens
auaagcaaacuuau

SEQ ID NO: 2199060 - RNA, 20 nt, Homo sapiens
uggcauagagcagcacuaaa

SEQ ID NO: 2199061 - RNA, 22 nt, Homo sapiens
uaauuccagugguccauggaau

SEQ ID NO: 2199062 - RNA, 19 nt, Homo sapiens
ggcucuaauguacaauaaa

SEQ ID NO: 2199063 - RNA, 14 nt, Homo sapiens
gaagauaucaugaa

SEQ ID NO: 2199064 - RNA, 13 nt, Homo sapiens
gagucgggacuaa

SEQ ID NO: 2199065 - RNA, 14 nt, Homo sapiens
ucccauuucccaaa

SEQ ID NO: 2199066 - RNA, 15 nt, Homo sapiens
ugauaaagcacagcu

SEQ ID NO: 2199067 - RNA, 14 nt, Homo sapiens
cagacagaaagaga

SEQ ID NO: 2199068 - RNA, 14 nt, Homo sapiens
cugacagaaugaga

SEQ ID NO: 2199069 - RNA, 16 nt, Homo sapiens
aucacaguguuuuuau

SEQ ID NO: 2199070 - RNA, 14 nt, Homo sapiens
gaauuaagcagaaa

SEQ ID NO: 2199071 - RNA, 22 nt, Homo sapiens
uuccccgagugacucuggauuu

SEQ ID NO: 2199072 - RNA, 15 nt, Homo sapiens
augugaagccuuccc

SEQ ID NO: 2199073 - RNA, 19 nt, Homo sapiens
accaugacaaaaaggccaa

SEQ ID NO: 2199074 - RNA, 18 nt, Homo sapiens
aaaucaugguuguaguga

SEQ ID NO: 2199075 - RNA, 19 nt, Homo sapiens
uacugcugcacuuucacua

SEQ ID NO: 2199076 - RNA, 15 nt, Homo sapiens
cuugucacaaaguga

SEQ ID NO: 2199077 - RNA, 13 nt, Homo sapiens
auuucuguuaacc

SEQ ID NO: 2199078 - RNA, 22 nt, Homo sapiens
agcaccaauuguacauucccug

SEQ ID NO: 2199079 - RNA, 16 nt, Homo sapiens
cugugugaacguguau

SEQ ID NO: 2199080 - RNA, 21 nt, Homo sapiens
cagaaagugcauuaaacugaa

SEQ ID NO: 2199081 - RNA, 15 nt, Homo sapiens
aaaauaguaagccuc

SEQ ID NO: 2199082 - RNA, 22 nt, Homo sapiens
uguuacucucuuccacauguua

SEQ ID NO: 2199083 - RNA, 17 nt, Homo sapiens
acagaucaucuuggaac

SEQ ID NO: 2199084 - RNA, 17 nt, Homo sapiens
cagaaguuugcaucucg

SEQ ID NO: 2199085 - RNA, 17 nt, Homo sapiens
auggggcuccuggaaag

SEQ ID NO: 2199086 - RNA, 17 nt, Homo sapiens
aggugcuacaaaaacac

SEQ ID NO: 2199087 - RNA, 20 nt, Homo sapiens
ugggccuugcaagaugggag

SEQ ID NO: 2199088 - RNA, 21 nt, Homo sapiens
cuuuguccacugucaggguug

SEQ ID NO: 2199089 - RNA, 22 nt, Homo sapiens
auuaaaagaacauaaguuauca

SEQ ID NO: 2199090 - RNA, 23 nt, Homo sapiens
gcuauauuuauuucuccgaauaa

SEQ ID NO: 2199091 - RNA, 23 nt, Homo sapiens
accccagagauucccaagccaaa

SEQ ID NO: 2199092 - RNA, 12 nt, Homo sapiens
gacacacuuguc

SEQ ID NO: 2199093 - RNA, 12 nt, Homo sapiens
uauaagcauuua

SEQ ID NO: 2199094 - RNA, 18 nt, Homo sapiens
ugagcaaugucugugcua

SEQ ID NO: 2199095 - RNA, 15 nt, Homo sapiens
caccuccacucagca

SEQ ID NO: 2199096 - RNA, 16 nt, Homo sapiens
gcaaagccagugcugu

SEQ ID NO: 2199097 - RNA, 16 nt, Homo sapiens
cuggcacccaauguuu

SEQ ID NO: 2199098 - RNA, 16 nt, Homo sapiens
ucaccuuggagccuga

SEQ ID NO: 2199099 - RNA, 21 nt, Homo sapiens
agugugcuaaccucacugccu

SEQ ID NO: 2199100 - RNA, 21 nt, Homo sapiens
ugugagguuaaaccaguuugc

SEQ ID NO: 2199101 - RNA, 20 nt, Homo sapiens
ugauccuaaugaaugcauaa

SEQ ID NO: 2199102 - RNA, 23 nt, Homo sapiens
agccuggcaccuuuaugucaaca

SEQ ID NO: 2199103 - RNA, 14 nt, Homo sapiens
cccaauugccacau

SEQ ID NO: 2199104 - RNA, 14 nt, Homo sapiens
uuacauuguucaau

SEQ ID NO: 2199105 - RNA, 16 nt, Homo sapiens
ccaugcugugcugugu

SEQ ID NO: 2199106 - RNA, 23 nt, Homo sapiens
ccugugggggcggcuguggggga

SEQ ID NO: 2199107 - RNA, 13 nt, Homo sapiens
cucuucuuuaugu

SEQ ID NO: 2199108 - RNA, 15 nt, Homo sapiens
ucugucccacuuggc

SEQ ID NO: 2199109 - RNA, 22 nt, Homo sapiens
cuguuaacuaugacagauauau

SEQ ID NO: 2199110 - RNA, 22 nt, Homo sapiens
accgggagccucccccucagau

SEQ ID NO: 2199111 - RNA, 19 nt, Homo sapiens
uacacuacaaauguuaaag

SEQ ID NO: 2199112 - RNA, 20 nt, Homo sapiens
uuccuggcagucucagucca

SEQ ID NO: 2199113 - RNA, 23 nt, Homo sapiens
aaguuuguuauagucuaugugau

SEQ ID NO: 2199114 - RNA, 17 nt, Homo sapiens
uuuuucuccagacccca

SEQ ID NO: 2199115 - RNA, 14 nt, Homo sapiens
gauugucacuccaa

SEQ ID NO: 2199116 - RNA, 20 nt, Homo sapiens
ccaagaggagcacacuuugg

SEQ ID NO: 2199117 - RNA, 17 nt, Homo sapiens
uauaacuggauugcaga

SEQ ID NO: 2199118 - RNA, 22 nt, Homo sapiens
uucauuagcgauccauguaauc

SEQ ID NO: 2199119 - RNA, 22 nt, Homo sapiens
uucacaaauagccauugaacaa

SEQ ID NO: 2199120 - RNA, 19 nt, Homo sapiens
gggaugagccgcugugagc

SEQ ID NO: 2199121 - RNA, 18 nt, Homo sapiens
ucaauuuauuacugaaaa

SEQ ID NO: 2199122 - RNA, 17 nt, Homo sapiens
ugcuuuuaaaauccacu

SEQ ID NO: 2199123 - RNA, 21 nt, Homo sapiens
aucuucagggaacugcauaga

SEQ ID NO: 2199124 - RNA, 20 nt, Homo sapiens
ccaaauagaaacaccuucca

SEQ ID NO: 2199125 - RNA, 19 nt, Homo sapiens
ugcugccaguccucugcau

SEQ ID NO: 2199126 - RNA, 16 nt, Homo sapiens
gaagcaucaccaugca

SEQ ID NO: 2199127 - RNA, 22 nt, Homo sapiens
ucuuaaaauauaagaccucugg

SEQ ID NO: 2199128 - RNA, 15 nt, Homo sapiens
aaagcuaaauuccac

SEQ ID NO: 2199129 - RNA, 19 nt, Homo sapiens
aaauauggaaagcaccuca

SEQ ID NO: 2199130 - RNA, 17 nt, Homo sapiens
cagggucuaaaauuaca

SEQ ID NO: 2199131 - RNA, 22 nt, Homo sapiens
auauagauacccaauuguuuca

SEQ ID NO: 2199132 - RNA, 21 nt, Homo sapiens
guacuauucaaucuuuacaca

SEQ ID NO: 2199133 - RNA, 16 nt, Homo sapiens
cuuuguuaucuuccac

SEQ ID NO: 2199134 - RNA, 21 nt, Homo sapiens
gcuauuuucuuauccuuugua

SEQ ID NO: 2199135 - RNA, 20 nt, Homo sapiens
uggccagucuuccucuuagc

SEQ ID NO: 2199136 - RNA, 23 nt, Homo sapiens
uccccugcccuuccuccugaugg

SEQ ID NO: 2199137 - RNA, 12 nt, Homo sapiens
aggccucugugc

SEQ ID NO: 2199138 - RNA, 12 nt, Homo sapiens
aucucucuggcu

SEQ ID NO: 2199139 - RNA, 24 nt, Homo sapiens
cuucauguuugccuucugcacaua

SEQ ID NO: 2199140 - RNA, 20 nt, Homo sapiens
acuguuucauucacugugca

SEQ ID NO: 2199141 - RNA, 16 nt, Homo sapiens
cccagccugagugcac

SEQ ID NO: 2199142 - RNA, 21 nt, Homo sapiens
acuauuuaaagccuccucauc

SEQ ID NO: 2199143 - RNA, 11 nt, Homo sapiens
uuagugccuuu

SEQ ID NO: 2199144 - RNA, 11 nt, Homo sapiens
aaugugccaaa

SEQ ID NO: 2199145 - RNA, 13 nt, Homo sapiens
aauagccauaaag

SEQ ID NO: 2199146 - RNA, 18 nt, Homo sapiens
agccagcucccagccaca

SEQ ID NO: 2199147 - RNA, 16 nt, Homo sapiens
acuccauuacuaaaga

SEQ ID NO: 2199148 - RNA, 14 nt, Homo sapiens
uggaaaauauacaa

SEQ ID NO: 2199149 - RNA, 13 nt, Homo sapiens
ccgaagcccaguu

SEQ ID NO: 2199150 - RNA, 17 nt, Homo sapiens
aauuuuguaaaguuucu

SEQ ID NO: 2199151 - RNA, 13 nt, Homo sapiens
cagacaagcacua

SEQ ID NO: 2199152 - RNA, 14 nt, Homo sapiens
gaauccaugaucaa

SEQ ID NO: 2199153 - RNA, 14 nt, Homo sapiens
auaccaauauuuac

SEQ ID NO: 2199154 - RNA, 16 nt, Homo sapiens
caagcagugucuguca

SEQ ID NO: 2199155 - RNA, 19 nt, Homo sapiens
agcugugacuucuccaggu

SEQ ID NO: 2199156 - RNA, 12 nt, Homo sapiens
uauacacugugu

SEQ ID NO: 2199157 - RNA, 20 nt, Homo sapiens
ggaccacuccugaaugagac

SEQ ID NO: 2199158 - RNA, 17 nt, Homo sapiens
aagguugaacuuugcca

SEQ ID NO: 2199159 - RNA, 13 nt, Homo sapiens
guaauauuuagcu

SEQ ID NO: 2199160 - RNA, 13 nt, Homo sapiens
acaagucaccucc

SEQ ID NO: 2199161 - RNA, 10 nt, Homo sapiens
gccuuauauu

SEQ ID NO: 2199162 - RNA, 12 nt, Homo sapiens
gugaacaucccc

SEQ ID NO: 2199163 - RNA, 12 nt, Homo sapiens
ccuuuacuauca

SEQ ID NO: 2199164 - RNA, 19 nt, Homo sapiens
acuacuuuguaucaaucca

SEQ ID NO: 2199165 - RNA, 17 nt, Homo sapiens
acugcaaacacaccuug

SEQ ID NO: 2199166 - RNA, 15 nt, Homo sapiens
agauuuuaccuaucc

SEQ ID NO: 2199167 - RNA, 21 nt, Homo sapiens
uauagauugauuuaccuuugg

SEQ ID NO: 2199168 - RNA, 16 nt, Homo sapiens
gccucaggacugggag

SEQ ID NO: 2199169 - RNA, 15 nt, Homo sapiens
ucuucuucauucuau

SEQ ID NO: 2199170 - RNA, 15 nt, Homo sapiens
acaugcccaucccag

SEQ ID NO: 2199171 - RNA, 21 nt, Homo sapiens
gucucacaugauuccagccau

SEQ ID NO: 2199172 - RNA, 15 nt, Homo sapiens
cugccaacuccaugu

SEQ ID NO: 2199173 - RNA, 19 nt, Homo sapiens
accuggaggaacugcuugu

SEQ ID NO: 2199174 - RNA, 19 nt, Homo sapiens
aacuccuuuuccacuuuaa

SEQ ID NO: 2199175 - RNA, 19 nt, Homo sapiens
cuaucuuuaaacauuucaa

SEQ ID NO: 2199176 - RNA, 21 nt, Homo sapiens
ccccacaccucccaccugcau

SEQ ID NO: 2199177 - RNA, 16 nt, Homo sapiens
gcgcagagcugacccc

SEQ ID NO: 2199178 - RNA, 19 nt, Homo sapiens
aguacagagccaugacuca

SEQ ID NO: 2199179 - RNA, 15 nt, Homo sapiens
ugccucauagcauag

SEQ ID NO: 2199180 - RNA, 18 nt, Homo sapiens
acccaguucuucauuugg

SEQ ID NO: 2199181 - RNA, 23 nt, Homo sapiens
cgagugcaugggcuaauuaucau

SEQ ID NO: 2199182 - RNA, 20 nt, Homo sapiens
gcagaaaccuaucucaggga

SEQ ID NO: 2199183 - RNA, 14 nt, Homo sapiens
agacccaguggacu

SEQ ID NO: 2199184 - RNA, 17 nt, Homo sapiens
cucagguaguacuggga

SEQ ID NO: 2199185 - RNA, 18 nt, Homo sapiens
gcguacgcuggugcugag

SEQ ID NO: 2199186 - RNA, 19 nt, Homo sapiens
ugcccaaggccuaccccag

SEQ ID NO: 2199187 - RNA, 15 nt, Homo sapiens
cucuuucucugagaa

SEQ ID NO: 2199188 - RNA, 22 nt, Homo sapiens
acauauccuuucaagacagaaa

SEQ ID NO: 2199189 - RNA, 20 nt, Homo sapiens
ugaaggacagaacauugccu

SEQ ID NO: 2199190 - RNA, 12 nt, Homo sapiens
aguaaacugugc

SEQ ID NO: 2199191 - RNA, 23 nt, Homo sapiens
ugaauaagcagaacauacuguuc

SEQ ID NO: 2199192 - RNA, 13 nt, Homo sapiens
cucugaccuguac

SEQ ID NO: 2199193 - RNA, 15 nt, Homo sapiens
gaaagaugaaugcaa

SEQ ID NO: 2199194 - RNA, 19 nt, Homo sapiens
aggaaguucagucuugucu

SEQ ID NO: 2199195 - RNA, 19 nt, Homo sapiens
aacugcaaguucauuuuaa

SEQ ID NO: 2199196 - RNA, 23 nt, Homo sapiens
ugcgcccuugaggggccccagcg

SEQ ID NO: 2199197 - RNA, 22 nt, Homo sapiens
ugcauacauauauauuuuuggc

SEQ ID NO: 2199198 - RNA, 15 nt, Homo sapiens
ucauaccacuugaau

SEQ ID NO: 2199199 - RNA, 11 nt, Homo sapiens
uggagcaauaa

SEQ ID NO: 2199200 - RNA, 13 nt, Homo sapiens
uaaguuuuuccaa

SEQ ID NO: 2199201 - RNA, 14 nt, Homo sapiens
caauugacaacagu

SEQ ID NO: 2199202 - RNA, 14 nt, Homo sapiens
aacaauguugagaa

SEQ ID NO: 2199203 - RNA, 22 nt, Homo sapiens
ggaccuaaaaaggucuguuaau

SEQ ID NO: 2199204 - RNA, 15 nt, Homo sapiens
acacaaaacucucug

SEQ ID NO: 2199205 - RNA, 13 nt, Homo sapiens
ccucucugccagc

SEQ ID NO: 2199206 - RNA, 16 nt, Homo sapiens
cuaaauuuuucauaga

SEQ ID NO: 2199207 - RNA, 20 nt, Homo sapiens
cccauuuaaaaauaucugaa

SEQ ID NO: 2199208 - RNA, 21 nt, Homo sapiens
ucuaacagcuccauacuucuu

SEQ ID NO: 2199209 - RNA, 21 nt, Homo sapiens
agguccuuauguccugucaua

SEQ ID NO: 2199210 - RNA, 16 nt, Homo sapiens
auaccuucugaugaag

SEQ ID NO: 2199211 - RNA, 23 nt, Homo sapiens
auucccagguaggccaagguguc

SEQ ID NO: 2199212 - RNA, 21 nt, Homo sapiens
uagcuuggguagcgcacucuu

SEQ ID NO: 2199213 - RNA, 23 nt, Homo sapiens
caauuaauucuuaauaggcuuua

SEQ ID NO: 2199214 - RNA, 17 nt, Homo sapiens
ccaggggccggccagug

SEQ ID NO: 2199215 - RNA, 19 nt, Homo sapiens
uuggcaaguaacuucugac

SEQ ID NO: 2199216 - RNA, 16 nt, Homo sapiens
acagagauaugcacac

SEQ ID NO: 2199217 - RNA, 12 nt, Homo sapiens
uuacuaaauccu

SEQ ID NO: 2199218 - RNA, 20 nt, Homo sapiens
ugcauagcuuugcacuucaa

SEQ ID NO: 2199219 - RNA, 17 nt, Homo sapiens
ccuguagguucuugaua

SEQ ID NO: 2199220 - RNA, 15 nt, Homo sapiens
gcuauagcucaggac

SEQ ID NO: 2199221 - RNA, 18 nt, Homo sapiens
uggcccgcuggauuccca

SEQ ID NO: 2199222 - RNA, 21 nt, Homo sapiens
accucccuaccaaaaauugcc

SEQ ID NO: 2199223 - RNA, 16 nt, Homo sapiens
agugcagucugaucca

SEQ ID NO: 2199224 - RNA, 15 nt, Homo sapiens
aagaaagcucuagac

SEQ ID NO: 2199225 - RNA, 17 nt, Homo sapiens
cagugcaaccacacacc

SEQ ID NO: 2199226 - RNA, 18 nt, Homo sapiens
agccagguuagccuuugc

SEQ ID NO: 2199227 - RNA, 22 nt, Homo sapiens
gagugagguguugcagcccaaa

SEQ ID NO: 2199228 - RNA, 18 nt, Homo sapiens
uggucagagggcccagug

SEQ ID NO: 2199229 - RNA, 16 nt, Homo sapiens
agggcucccuaaacuu

SEQ ID NO: 2199230 - RNA, 21 nt, Homo sapiens
caugcagcucuucaacaugac

SEQ ID NO: 2199231 - RNA, 16 nt, Homo sapiens
gcccgucggagcugcc

SEQ ID NO: 2199232 - RNA, 19 nt, Homo sapiens
aguaaaacggauaccaagu

SEQ ID NO: 2199233 - RNA, 14 nt, Homo sapiens
cugcuacacaaaag

SEQ ID NO: 2199234 - RNA, 20 nt, Homo sapiens
gaaccggagagccagcuaag

SEQ ID NO: 2199235 - RNA, 13 nt, Homo sapiens
uuaaguacccgag

SEQ ID NO: 2199236 - RNA, 23 nt, Homo sapiens
aauccugaauaaaccaguaucgu

SEQ ID NO: 2199237 - RNA, 19 nt, Homo sapiens
acucaaggucacacaguga

SEQ ID NO: 2199238 - RNA, 16 nt, Homo sapiens
accccccuugcccaug

SEQ ID NO: 2199239 - RNA, 16 nt, Homo sapiens
auggaauauacaugua

SEQ ID NO: 2199240 - RNA, 23 nt, Homo sapiens
aaauuuaauguuuuuuaaacuag

SEQ ID NO: 2199241 - RNA, 18 nt, Homo sapiens
auuuacaacuuccagauu

SEQ ID NO: 2199242 - RNA, 14 nt, Homo sapiens
cucccacagaggag

SEQ ID NO: 2199243 - RNA, 14 nt, Homo sapiens
uagagaguuaugaa

SEQ ID NO: 2199244 - RNA, 18 nt, Homo sapiens
ucccucugcagucucuau

SEQ ID NO: 2199245 - RNA, 16 nt, Homo sapiens
uaauacauuacaugua

SEQ ID NO: 2199246 - RNA, 23 nt, Homo sapiens
ugagauguugagaggaacaagaa

SEQ ID NO: 2199247 - RNA, 17 nt, Homo sapiens
uucaguguuaagguaau

SEQ ID NO: 2199248 - RNA, 15 nt, Homo sapiens
agacuacaauuccug

SEQ ID NO: 2199249 - RNA, 12 nt, Homo sapiens
agcucugucuga

SEQ ID NO: 2199250 - RNA, 16 nt, Homo sapiens
guugaagcucugguga

SEQ ID NO: 2199251 - RNA, 20 nt, Homo sapiens
aagaguaacagucaucauuu

SEQ ID NO: 2199252 - RNA, 20 nt, Homo sapiens
ggccuuaucugaaaggccag

SEQ ID NO: 2199253 - RNA, 13 nt, Homo sapiens
cguccuggagcug

SEQ ID NO: 2199254 - RNA, 13 nt, Homo sapiens
aaaagccaugugu

SEQ ID NO: 2199255 - RNA, 13 nt, Homo sapiens
gccacugcacucu

SEQ ID NO: 2199256 - RNA, 23 nt, Homo sapiens
ucacuugccaaaauccaaggcaa

SEQ ID NO: 2199257 - RNA, 17 nt, Homo sapiens
ccacucggcaccucucc

SEQ ID NO: 2199258 - RNA, 14 nt, Homo sapiens
ucaugucuauucca

SEQ ID NO: 2199259 - RNA, 19 nt, Homo sapiens
ccuguaagcccagcauuug

SEQ ID NO: 2199260 - RNA, 20 nt, Homo sapiens
ucucaaacggcaacauuccu

SEQ ID NO: 2199261 - RNA, 22 nt, Homo sapiens
aguaaaaauccacuauuuccau

SEQ ID NO: 2199262 - RNA, 17 nt, Homo sapiens
caggucuagacuuucuc

SEQ ID NO: 2199263 - RNA, 17 nt, Homo sapiens
uucuaggcuuuguggua

SEQ ID NO: 2199264 - RNA, 15 nt, Homo sapiens
ccgagcaauggcgcc

SEQ ID NO: 2199265 - RNA, 23 nt, Homo sapiens
aauacuacuuucucaaaauggaa

SEQ ID NO: 2199266 - RNA, 16 nt, Homo sapiens
cccuagccaauucaca

SEQ ID NO: 2199267 - RNA, 16 nt, Homo sapiens
ccauuugccuugcaau

SEQ ID NO: 2199268 - RNA, 20 nt, Homo sapiens
uaucaaacccagacuugcuu

SEQ ID NO: 2199269 - RNA, 15 nt, Homo sapiens
gcccgcggcggugga

SEQ ID NO: 2199270 - RNA, 19 nt, Homo sapiens
uauggaauuuugcaaagau

SEQ ID NO: 2199271 - RNA, 18 nt, Homo sapiens
acagcaaaacuccaucuc

SEQ ID NO: 2199272 - RNA, 17 nt, Homo sapiens
aaagucaccugcccaag

SEQ ID NO: 2199273 - RNA, 19 nt, Homo sapiens
guugagugcaucccagcau

SEQ ID NO: 2199274 - RNA, 14 nt, Homo sapiens
uugugcacaucucg

SEQ ID NO: 2199275 - RNA, 22 nt, Homo sapiens
uaaaauaaauuuguaugcucaa

SEQ ID NO: 2199276 - RNA, 21 nt, Homo sapiens
gggcgccaccgccacccgcag

SEQ ID NO: 2199277 - RNA, 15 nt, Homo sapiens
gaaacaaggcugcca

SEQ ID NO: 2199278 - RNA, 18 nt, Homo sapiens
ugaauuguggcuguucac

SEQ ID NO: 2199279 - RNA, 17 nt, Homo sapiens
cauuacuuuaauacuca

SEQ ID NO: 2199280 - RNA, 18 nt, Homo sapiens
gaaaugauaugaccaaaa

SEQ ID NO: 2199281 - RNA, 12 nt, Homo sapiens
uauauaaccaau

SEQ ID NO: 2199282 - RNA, 16 nt, Homo sapiens
uccuuuuggccugggg

SEQ ID NO: 2199283 - RNA, 13 nt, Homo sapiens
ugucuuagucaaa

SEQ ID NO: 2199284 - RNA, 21 nt, Homo sapiens
guuaguuaccaagccugccau

SEQ ID NO: 2199285 - RNA, 15 nt, Homo sapiens
uacagguuagaagca

SEQ ID NO: 2199286 - RNA, 22 nt, Homo sapiens
caauugagggcauuaguacuuu

SEQ ID NO: 2199287 - RNA, 20 nt, Homo sapiens
agggcugggcgccucugucc

SEQ ID NO: 2199288 - RNA, 19 nt, Homo sapiens
acugaguuuauacucaccu

SEQ ID NO: 2199289 - RNA, 13 nt, Homo sapiens
agaauaagccuuc

SEQ ID NO: 2199290 - RNA, 21 nt, Homo sapiens
aucauucauucauucaccuaa

SEQ ID NO: 2199291 - RNA, 23 nt, Homo sapiens
aaacugcaggagcaguuugccac

SEQ ID NO: 2199292 - RNA, 21 nt, Homo sapiens
aucugucaaagaaaacuucca

SEQ ID NO: 2199293 - RNA, 19 nt, Homo sapiens
ucccuuaagagucauccag

SEQ ID NO: 2199294 - RNA, 19 nt, Homo sapiens
cucuagccccagcgccaaa

SEQ ID NO: 2199295 - RNA, 13 nt, Homo sapiens
cauucuucacugu

SEQ ID NO: 2199296 - RNA, 12 nt, Homo sapiens
aguagcauauau

SEQ ID NO: 2199297 - RNA, 12 nt, Homo sapiens
uuaagcauuguu

SEQ ID NO: 2199298 - RNA, 11 nt, Homo sapiens
uuacagcugcc

SEQ ID NO: 2199299 - RNA, 23 nt, Homo sapiens
agggcaaaaugaacuaacugcca

SEQ ID NO: 2199300 - RNA, 17 nt, Homo sapiens
accccaggacaguuuau

SEQ ID NO: 2199301 - RNA, 15 nt, Homo sapiens
augcaugagcaccuu

SEQ ID NO: 2199302 - RNA, 15 nt, Homo sapiens
auuuaacacuaaaaa

SEQ ID NO: 2199303 - RNA, 15 nt, Homo sapiens
uaacaauguuuguca

SEQ ID NO: 2199304 - RNA, 16 nt, Homo sapiens
gaaguugaaaaucaua

SEQ ID NO: 2199305 - RNA, 19 nt, Homo sapiens
guggaauagccucccugua

SEQ ID NO: 2199306 - RNA, 19 nt, Homo sapiens
ugauauuuaagcagcuuga

SEQ ID NO: 2199307 - RNA, 17 nt, Homo sapiens
ugcaccuucacucucca

SEQ ID NO: 2199308 - RNA, 23 nt, Homo sapiens
ugggcacucccuugguggcaaga

SEQ ID NO: 2199309 - RNA, 14 nt, Homo sapiens
uaaugucaccaccu

SEQ ID NO: 2199310 - RNA, 14 nt, Homo sapiens
acuaacuucuccaa

SEQ ID NO: 2199311 - RNA, 22 nt, Homo sapiens
augcagaacagugagccaaaua

SEQ ID NO: 2199312 - RNA, 18 nt, Homo sapiens
cugaccuccuggacugua

SEQ ID NO: 2199313 - RNA, 19 nt, Homo sapiens
agagagggccugcuggaga

SEQ ID NO: 2199314 - RNA, 20 nt, Homo sapiens
cauucacagcccagaaccac

SEQ ID NO: 2199315 - RNA, 14 nt, Homo sapiens
ccuaccacuuuucu

SEQ ID NO: 2199316 - RNA, 14 nt, Homo sapiens
caagccugcagcga

SEQ ID NO: 2199317 - RNA, 16 nt, Homo sapiens
ucuggagaccaggacu

SEQ ID NO: 2199318 - RNA, 20 nt, Homo sapiens
cugugugaaaauacuggaau

SEQ ID NO: 2199319 - RNA, 14 nt, Homo sapiens
cgauaauuuuuaga

SEQ ID NO: 2199320 - RNA, 22 nt, Homo sapiens
cauguccuaaugcuugcugcug

SEQ ID NO: 2199321 - RNA, 16 nt, Homo sapiens
cagccccgcccgccug

SEQ ID NO: 2199322 - RNA, 14 nt, Homo sapiens
aggauugccaggua

SEQ ID NO: 2199323 - RNA, 15 nt, Homo sapiens
ugacuggccaaaaau

SEQ ID NO: 2199324 - RNA, 21 nt, Homo sapiens
aauaaugcuuugaaauugaac

SEQ ID NO: 2199325 - RNA, 19 nt, Homo sapiens
aguuugcaaauaggcagaa

SEQ ID NO: 2199326 - RNA, 21 nt, Homo sapiens
agcgcagggcuggcacgugac

SEQ ID NO: 2199327 - RNA, 17 nt, Homo sapiens
cuucaagcacccuguuc

SEQ ID NO: 2199328 - RNA, 15 nt, Homo sapiens
aggcagaaggaggga

SEQ ID NO: 2199329 - RNA, 17 nt, Homo sapiens
uaggccugaaaugacau

SEQ ID NO: 2199330 - RNA, 21 nt, Homo sapiens
cagcuccuguaacauacuggc

SEQ ID NO: 2199331 - RNA, 20 nt, Homo sapiens
acuugggaggcugagccagg

SEQ ID NO: 2199332 - RNA, 24 nt, Homo sapiens
ucacagccuuucugaacugacuga

SEQ ID NO: 2199333 - RNA, 19 nt, Homo sapiens
ggcucccaccggugccaaa

SEQ ID NO: 2199334 - RNA, 16 nt, Homo sapiens
aagucagguccaauuu

SEQ ID NO: 2199335 - RNA, 14 nt, Homo sapiens
cagccagcacccac

SEQ ID NO: 2199336 - RNA, 18 nt, Homo sapiens
ugaucuacucauuugcug

SEQ ID NO: 2199337 - RNA, 13 nt, Homo sapiens
acuuccacuccaa

SEQ ID NO: 2199338 - RNA, 13 nt, Homo sapiens
aauaccacuacua

SEQ ID NO: 2199339 - RNA, 23 nt, Homo sapiens
cuggaucaaaaaugaaucacuuc

SEQ ID NO: 2199340 - RNA, 14 nt, Homo sapiens
ccugucccaugcag

SEQ ID NO: 2199341 - RNA, 14 nt, Homo sapiens
agccugugggagaa

SEQ ID NO: 2199342 - RNA, 20 nt, Homo sapiens
aaacauuauaaaaauugaca

SEQ ID NO: 2199343 - RNA, 11 nt, Homo sapiens
ccucaaaagac

SEQ ID NO: 2199344 - RNA, 22 nt, Homo sapiens
ccaucaugaguggugacuuaag

SEQ ID NO: 2199345 - RNA, 23 nt, Homo sapiens
auaccgggaacaugaagccaggu

SEQ ID NO: 2199346 - RNA, 18 nt, Homo sapiens
acuucauucacauucaga

SEQ ID NO: 2199347 - RNA, 12 nt, Homo sapiens
uccacucugagc

SEQ ID NO: 2199348 - RNA, 14 nt, Homo sapiens
gauaaggcucugaa

SEQ ID NO: 2199349 - RNA, 18 nt, Homo sapiens
cuuucuuaucccagugau

SEQ ID NO: 2199350 - RNA, 14 nt, Homo sapiens
cugacuaacagccu

SEQ ID NO: 2199351 - RNA, 22 nt, Homo sapiens
cuuuuacaagugguuaaaacau

SEQ ID NO: 2199352 - RNA, 15 nt, Homo sapiens
cagagguugugguga

SEQ ID NO: 2199353 - RNA, 19 nt, Homo sapiens
cuguuuauucugggaaaug

SEQ ID NO: 2199354 - RNA, 20 nt, Homo sapiens
cucugugccccucaugcuga

SEQ ID NO: 2199355 - RNA, 20 nt, Homo sapiens
aggcaucauacuaaacuuca

SEQ ID NO: 2199356 - RNA, 16 nt, Homo sapiens
caccaugcacucaaua

SEQ ID NO: 2199357 - RNA, 16 nt, Homo sapiens
cccagcgcuggcucca

SEQ ID NO: 2199358 - RNA, 13 nt, Homo sapiens
cgugcguggcacu

SEQ ID NO: 2199359 - RNA, 17 nt, Homo sapiens
agggagcacuguucaca

SEQ ID NO: 2199360 - RNA, 21 nt, Homo sapiens
ccugucaaacaaagccagaag

SEQ ID NO: 2199361 - RNA, 14 nt, Homo sapiens
aggaguuuuguucc

SEQ ID NO: 2199362 - RNA, 20 nt, Homo sapiens
aauguaguuagcuccauaaa

SEQ ID NO: 2199363 - RNA, 21 nt, Homo sapiens
uacugguuauccugugcuaca

SEQ ID NO: 2199364 - RNA, 22 nt, Homo sapiens
gcccugccgcauuuccuuucag

SEQ ID NO: 2199365 - RNA, 12 nt, Homo sapiens
auaagcuuuauu

SEQ ID NO: 2199366 - RNA, 22 nt, Homo sapiens
aggaugugucuuggggugggca

SEQ ID NO: 2199367 - RNA, 14 nt, Homo sapiens
gacuacacaggaug

SEQ ID NO: 2199368 - RNA, 11 nt, Homo sapiens
cacagugcaag

SEQ ID NO: 2199369 - RNA, 19 nt, Homo sapiens
guuggcuagacuagucuca

SEQ ID NO: 2199370 - RNA, 21 nt, Homo sapiens
ccaguuuauggauaugcugcu

SEQ ID NO: 2199371 - RNA, 18 nt, Homo sapiens
aucuugauuaauguacuu

SEQ ID NO: 2199372 - RNA, 16 nt, Homo sapiens
ucuuuccuccucauga

SEQ ID NO: 2199373 - RNA, 20 nt, Homo sapiens
uccaugguguauaugugcca

SEQ ID NO: 2199374 - RNA, 16 nt, Homo sapiens
acaaaauaacauuuga

SEQ ID NO: 2199375 - RNA, 13 nt, Homo sapiens
gcaugugucaugc

SEQ ID NO: 2199376 - RNA, 21 nt, Homo sapiens
caagaacuuuucccccaaaga

SEQ ID NO: 2199377 - RNA, 18 nt, Homo sapiens
gagacaguugguuuugca

SEQ ID NO: 2199378 - RNA, 23 nt, Homo sapiens
cucaucuaacaaacacaauccau

SEQ ID NO: 2199379 - RNA, 15 nt, Homo sapiens
agaggauacauuuaa

SEQ ID NO: 2199380 - RNA, 14 nt, Homo sapiens
uaaaucagugcagu

SEQ ID NO: 2199381 - RNA, 19 nt, Homo sapiens
augcuguauccacaaauca

SEQ ID NO: 2199382 - RNA, 14 nt, Homo sapiens
gcaucuuaguuuac

SEQ ID NO: 2199383 - RNA, 20 nt, Homo sapiens
uacaaagacccacauguaaa

SEQ ID NO: 2199384 - RNA, 23 nt, Homo sapiens
ucgccuccucuacaauuugccau

SEQ ID NO: 2199385 - RNA, 18 nt, Homo sapiens
aaacauauuggaauguac

SEQ ID NO: 2199386 - RNA, 16 nt, Homo sapiens
ucuuuugguugccuua

SEQ ID NO: 2199387 - RNA, 21 nt, Homo sapiens
uggcauugucccugugccuaa

SEQ ID NO: 2199388 - RNA, 18 nt, Homo sapiens
auuuuucucucucucucg

SEQ ID NO: 2199389 - RNA, 17 nt, Homo sapiens
uuagaauggggcuucca

SEQ ID NO: 2199390 - RNA, 16 nt, Homo sapiens
guuuugcuagagcuaa

SEQ ID NO: 2199391 - RNA, 17 nt, Homo sapiens
ugcuugggcugacccag

SEQ ID NO: 2199392 - RNA, 21 nt, Homo sapiens
cacugaaacagccagaucuca

SEQ ID NO: 2199393 - RNA, 15 nt, Homo sapiens
cugaaagaauaaaaa

SEQ ID NO: 2199394 - RNA, 19 nt, Homo sapiens
uaucaaacuagugcaugaa

SEQ ID NO: 2199395 - RNA, 21 nt, Homo sapiens
ggaccaccguucagucauuuu

SEQ ID NO: 2199396 - RNA, 22 nt, Homo sapiens
ucuaaaaauucuuaacuuuuaa

SEQ ID NO: 2199397 - RNA, 15 nt, Homo sapiens
aaaucaauucuaguc

SEQ ID NO: 2199398 - RNA, 22 nt, Homo sapiens
uacauuuuuuucuuugucuuau

SEQ ID NO: 2199399 - RNA, 22 nt, Homo sapiens
uacauuaggaagauaucaugaa

SEQ ID NO: 2199400 - RNA, 18 nt, Homo sapiens
caggaggcugaggcacca

SEQ ID NO: 2199401 - RNA, 14 nt, Homo sapiens
cagcccuuccuccc

SEQ ID NO: 2199402 - RNA, 13 nt, Homo sapiens
ggccagauccagc

SEQ ID NO: 2199403 - RNA, 18 nt, Homo sapiens
auugagauaacauuucca

SEQ ID NO: 2199404 - RNA, 23 nt, Homo sapiens
acccccauggugacaucacucua

SEQ ID NO: 2199405 - RNA, 19 nt, Homo sapiens
caccaacuauagaauguau

SEQ ID NO: 2199406 - RNA, 22 nt, Homo sapiens
ccucaucugcaaagcauggaga

SEQ ID NO: 2199407 - RNA, 14 nt, Homo sapiens
gccaagcuccucaa

SEQ ID NO: 2199408 - RNA, 21 nt, Homo sapiens
ugaaaagagaaugaugcucaa

SEQ ID NO: 2199409 - RNA, 13 nt, Homo sapiens
accucgugaucua

SEQ ID NO: 2199410 - RNA, 15 nt, Homo sapiens
auguccuacaacagc

SEQ ID NO: 2199411 - RNA, 13 nt, Homo sapiens
agagcuggaggca

SEQ ID NO: 2199412 - RNA, 14 nt, Homo sapiens
ucagucaacaacuu

SEQ ID NO: 2199413 - RNA, 13 nt, Homo sapiens
ccagcacauggcc

SEQ ID NO: 2199414 - RNA, 19 nt, Homo sapiens
cagacaccuggacugagcc

SEQ ID NO: 2199415 - RNA, 17 nt, Homo sapiens
acagcugccucugccac

SEQ ID NO: 2199416 - RNA, 18 nt, Homo sapiens
ugcagaagcaguguuucu

SEQ ID NO: 2199417 - RNA, 16 nt, Homo sapiens
auauugugaacauuug

SEQ ID NO: 2199418 - RNA, 16 nt, Homo sapiens
uaagucacaaagaguu

SEQ ID NO: 2199419 - RNA, 19 nt, Homo sapiens
uaaaaaaaaaauuacuucc

SEQ ID NO: 2199420 - RNA, 16 nt, Homo sapiens
ccagucucugcuccac

SEQ ID NO: 2199421 - RNA, 16 nt, Homo sapiens
acagcuccuuuuccag

SEQ ID NO: 2199422 - RNA, 23 nt, Homo sapiens
gaauaccaguguuauuaaugaca

SEQ ID NO: 2199423 - RNA, 13 nt, Homo sapiens
aagucaaaugcca

SEQ ID NO: 2199424 - RNA, 18 nt, Homo sapiens
caaugccgccguguuucc

SEQ ID NO: 2199425 - RNA, 19 nt, Homo sapiens
gaggagcuuccagugcaug

SEQ ID NO: 2199426 - RNA, 16 nt, Homo sapiens
ugguaaauaacuguga

SEQ ID NO: 2199427 - RNA, 19 nt, Homo sapiens
aacgguuccuggugacucc

SEQ ID NO: 2199428 - RNA, 18 nt, Homo sapiens
gugcuguuuuuguucuac

SEQ ID NO: 2199429 - RNA, 12 nt, Homo sapiens
aagcaacugagu

SEQ ID NO: 2199430 - RNA, 21 nt, Homo sapiens
aagagagaacaacuacuguga

SEQ ID NO: 2199431 - RNA, 16 nt, Homo sapiens
ccuccucccaucuccu

SEQ ID NO: 2199432 - RNA, 18 nt, Homo sapiens
auuggcuggagauggaaa

SEQ ID NO: 2199433 - RNA, 19 nt, Homo sapiens
aaucugauguuaaccaaug

SEQ ID NO: 2199434 - RNA, 13 nt, Homo sapiens
ucguaacuuuaug

SEQ ID NO: 2199435 - RNA, 14 nt, Homo sapiens
uggauacacucucu

SEQ ID NO: 2199436 - RNA, 13 nt, Homo sapiens
cuaguacuauuac

SEQ ID NO: 2199437 - RNA, 17 nt, Homo sapiens
cacuggcccucuuugaa

SEQ ID NO: 2199438 - RNA, 21 nt, Homo sapiens
auagcauggggccccuggccc

SEQ ID NO: 2199439 - RNA, 20 nt, Homo sapiens
aaucuaccaagaacagaguc

SEQ ID NO: 2199440 - RNA, 16 nt, Homo sapiens
aguuagggcuguugau

SEQ ID NO: 2199441 - RNA, 16 nt, Homo sapiens
cccacagccacauuuc

SEQ ID NO: 2199442 - RNA, 20 nt, Homo sapiens
aaucagcaaaaugguccugu

SEQ ID NO: 2199443 - RNA, 15 nt, Homo sapiens
acugcuaccuuccua

SEQ ID NO: 2199444 - RNA, 18 nt, Homo sapiens
uuuaaaacgcgucugccu

SEQ ID NO: 2199445 - RNA, 17 nt, Homo sapiens
gaaguuaaaagcacaaa

SEQ ID NO: 2199446 - RNA, 18 nt, Homo sapiens
aagcaaauuucauuaucu

SEQ ID NO: 2199447 - RNA, 20 nt, Homo sapiens
uccagaaaacaaaacugcau

SEQ ID NO: 2199448 - RNA, 15 nt, Homo sapiens
gcuccccuuccugcc

SEQ ID NO: 2199449 - RNA, 16 nt, Homo sapiens
caucuggaggagcucu

SEQ ID NO: 2199450 - RNA, 20 nt, Homo sapiens
cuaaagcacuuugcacuuaa

SEQ ID NO: 2199451 - RNA, 20 nt, Homo sapiens
agaauauacuaaauuaacuu

SEQ ID NO: 2199452 - RNA, 13 nt, Homo sapiens
cucucugggaugc

SEQ ID NO: 2199453 - RNA, 14 nt, Homo sapiens
cccacaaacuccag

SEQ ID NO: 2199454 - RNA, 23 nt, Homo sapiens
uguaauuuuaaauaaaagugauc

SEQ ID NO: 2199455 - RNA, 19 nt, Homo sapiens
acucagaaaagaaaaccau

SEQ ID NO: 2199456 - RNA, 19 nt, Homo sapiens
uauagaaaauaaccuuuua

SEQ ID NO: 2199457 - RNA, 17 nt, Homo sapiens
ccaugccaaugaaggaa

SEQ ID NO: 2199458 - RNA, 13 nt, Homo sapiens
aauuucauugcac

SEQ ID NO: 2199459 - RNA, 16 nt, Homo sapiens
caaauaacugaucuca

SEQ ID NO: 2199460 - RNA, 17 nt, Homo sapiens
agcaccccuagcaugaa

SEQ ID NO: 2199461 - RNA, 21 nt, Homo sapiens
cuguaauccuagcacuuuggg

SEQ ID NO: 2199462 - RNA, 16 nt, Homo sapiens
ccuggggacaccugcc

SEQ ID NO: 2199463 - RNA, 22 nt, Homo sapiens
ucaaacuggagagaagcaagcc

SEQ ID NO: 2199464 - RNA, 22 nt, Homo sapiens
aaaccuaauauucaaugaacuu

SEQ ID NO: 2199465 - RNA, 15 nt, Homo sapiens
ccaggccugggaaug

SEQ ID NO: 2199466 - RNA, 15 nt, Homo sapiens
aacacuaagcucucu

SEQ ID NO: 2199467 - RNA, 16 nt, Homo sapiens
cauccauaauugugau

SEQ ID NO: 2199468 - RNA, 24 nt, Homo sapiens
agccacuuucugccagcaucugca

SEQ ID NO: 2199469 - RNA, 23 nt, Homo sapiens
agagguuuuguauugagggccag

SEQ ID NO: 2199470 - RNA, 22 nt, Homo sapiens
ugccuguugcuuucuuccugca

SEQ ID NO: 2199471 - RNA, 18 nt, Homo sapiens
aauagucauuccaaauau

SEQ ID NO: 2199472 - RNA, 13 nt, Homo sapiens
uucucagccuuag

SEQ ID NO: 2199473 - RNA, 14 nt, Homo sapiens
aaagguugacucaa

SEQ ID NO: 2199474 - RNA, 18 nt, Homo sapiens
agaguuucaaccaugaag

SEQ ID NO: 2199475 - RNA, 19 nt, Homo sapiens
uccuuacugauauuuauag

SEQ ID NO: 2199476 - RNA, 15 nt, Homo sapiens
agcuccaaccugcaa

SEQ ID NO: 2199477 - RNA, 21 nt, Homo sapiens
ggcuguagcaacccuuuccaa

SEQ ID NO: 2199478 - RNA, 17 nt, Homo sapiens
acagagcagaacuuuca

SEQ ID NO: 2199479 - RNA, 17 nt, Homo sapiens
cugcccucuauuuauua

SEQ ID NO: 2199480 - RNA, 15 nt, Homo sapiens
caagcaacugagauu

SEQ ID NO: 2199481 - RNA, 13 nt, Homo sapiens
ccuccaaaagccc

SEQ ID NO: 2199482 - RNA, 18 nt, Homo sapiens
uguguccugaaacgcucc

SEQ ID NO: 2199483 - RNA, 11 nt, Homo sapiens
gauacaguauu

SEQ ID NO: 2199484 - RNA, 13 nt, Homo sapiens
aaacuaacuugau

SEQ ID NO: 2199485 - RNA, 17 nt, Homo sapiens
uagcuaugagcuuuuaa

SEQ ID NO: 2199486 - RNA, 16 nt, Homo sapiens
uaccagcgcucuaaaa

SEQ ID NO: 2199487 - RNA, 14 nt, Homo sapiens
ucccugauggggga

SEQ ID NO: 2199488 - RNA, 12 nt, Homo sapiens
agccuuugccau

SEQ ID NO: 2199489 - RNA, 14 nt, Homo sapiens
ucgaaagugaggag

SEQ ID NO: 2199490 - RNA, 14 nt, Homo sapiens
acuccagaugccac

SEQ ID NO: 2199491 - RNA, 13 nt, Homo sapiens
cucaucugugauu

SEQ ID NO: 2199492 - RNA, 21 nt, Homo sapiens
guacauuuuuuaacuuucuag

SEQ ID NO: 2199493 - RNA, 21 nt, Homo sapiens
ccaggaggugcagacuucuua

SEQ ID NO: 2199494 - RNA, 16 nt, Homo sapiens
cuucugguugcuucag

SEQ ID NO: 2199495 - RNA, 14 nt, Homo sapiens
uuauagguuuccac

SEQ ID NO: 2199496 - RNA, 18 nt, Homo sapiens
ugcucuuuugcacaagga

SEQ ID NO: 2199497 - RNA, 11 nt, Homo sapiens
aucaauuuugu

SEQ ID NO: 2199498 - RNA, 16 nt, Homo sapiens
ucuccaagaaugcuga

SEQ ID NO: 2199499 - RNA, 15 nt, Homo sapiens
gaucagcagggcagu

SEQ ID NO: 2199500 - RNA, 15 nt, Homo sapiens
gccaugcuucuugcc

SEQ ID NO: 2199501 - RNA, 21 nt, Homo sapiens
ggaagcccauccugaccagcu

SEQ ID NO: 2199502 - RNA, 15 nt, Homo sapiens
acuuauuuaugaaca

SEQ ID NO: 2199503 - RNA, 16 nt, Homo sapiens
cuccauaaaaguccug

SEQ ID NO: 2199504 - RNA, 14 nt, Homo sapiens
uuccuguagccuuc

SEQ ID NO: 2199505 - RNA, 20 nt, Homo sapiens
aggugaaacccagucacugu

SEQ ID NO: 2199506 - RNA, 15 nt, Homo sapiens
uggcugaaaaucacu

SEQ ID NO: 2199507 - RNA, 22 nt, Homo sapiens
cuuagaaaauucaagcauuuag

SEQ ID NO: 2199508 - RNA, 14 nt, Homo sapiens
uguugggaggacag

SEQ ID NO: 2199509 - RNA, 12 nt, Homo sapiens
uuuuugugucaa

SEQ ID NO: 2199510 - RNA, 20 nt, Homo sapiens
ccgguccccuucccaggggc

SEQ ID NO: 2199511 - RNA, 14 nt, Homo sapiens
gcuugcuuuugccu

SEQ ID NO: 2199512 - RNA, 14 nt, Homo sapiens
aaauuaaguacuua

SEQ ID NO: 2199513 - RNA, 20 nt, Homo sapiens
caaucccaacguuuuacaua

SEQ ID NO: 2199514 - RNA, 19 nt, Homo sapiens
agcccugguccuagacaua

SEQ ID NO: 2199515 - RNA, 17 nt, Homo sapiens
uaucaaauacaucucca

SEQ ID NO: 2199516 - RNA, 21 nt, Homo sapiens
caguuuuccaugguguauuca

SEQ ID NO: 2199517 - RNA, 23 nt, Homo sapiens
aaucuagcucuccauacuuugaa

SEQ ID NO: 2199518 - RNA, 16 nt, Homo sapiens
cauauauauguauaua

SEQ ID NO: 2199519 - RNA, 16 nt, Homo sapiens
ugaaugaacaaaugaa

SEQ ID NO: 2199520 - RNA, 16 nt, Homo sapiens
caagauggguggcacc

SEQ ID NO: 2199521 - RNA, 23 nt, Homo sapiens
accagacuuuucucuagaagcug

SEQ ID NO: 2199522 - RNA, 14 nt, Homo sapiens
cuggaauuccaguc

SEQ ID NO: 2199523 - RNA, 17 nt, Homo sapiens
uucuguuggggaggggu

SEQ ID NO: 2199524 - RNA, 16 nt, Homo sapiens
agcauucaauuuauuc

SEQ ID NO: 2199525 - RNA, 13 nt, Homo sapiens
aagcccugaccca

SEQ ID NO: 2199526 - RNA, 20 nt, Homo sapiens
caagaagaaugggagcugca

SEQ ID NO: 2199527 - RNA, 17 nt, Homo sapiens
cuuucuuccuccagucu

SEQ ID NO: 2199528 - RNA, 14 nt, Homo sapiens
gacaaugauaugca

SEQ ID NO: 2199529 - RNA, 16 nt, Homo sapiens
ugugcuccgugccucc

SEQ ID NO: 2199530 - RNA, 12 nt, Homo sapiens
acagaucuccug

SEQ ID NO: 2199531 - RNA, 20 nt, Homo sapiens
cucuucagccucauucacug

SEQ ID NO: 2199532 - RNA, 16 nt, Homo sapiens
aaauaccucauucgcc

SEQ ID NO: 2199533 - RNA, 21 nt, Homo sapiens
gagguguuuaacggcacugug

SEQ ID NO: 2199534 - RNA, 14 nt, Homo sapiens
cuuauaacaagcau

SEQ ID NO: 2199535 - RNA, 17 nt, Homo sapiens
cacagggcccgcagugc

SEQ ID NO: 2199536 - RNA, 23 nt, Homo sapiens
cuggaggaacugcuugugcacug

SEQ ID NO: 2199537 - RNA, 17 nt, Homo sapiens
uuaccaaacagcaaacc

SEQ ID NO: 2199538 - RNA, 22 nt, Homo sapiens
agaauccucugggguucaucua

SEQ ID NO: 2199539 - RNA, 12 nt, Homo sapiens
gcugcugccagg

SEQ ID NO: 2199540 - RNA, 16 nt, Homo sapiens
ccucccuccuggggaa

SEQ ID NO: 2199541 - RNA, 13 nt, Homo sapiens
aguuuuccucaau

SEQ ID NO: 2199542 - RNA, 15 nt, Homo sapiens
acaugcauuuuauca

SEQ ID NO: 2199543 - RNA, 19 nt, Homo sapiens
aggcucccagacccagggc

SEQ ID NO: 2199544 - RNA, 14 nt, Homo sapiens
aucuggauucuaca

SEQ ID NO: 2199545 - RNA, 16 nt, Homo sapiens
gcaagcccacagauga

SEQ ID NO: 2199546 - RNA, 18 nt, Homo sapiens
cugacagcgccaugugug

SEQ ID NO: 2199547 - RNA, 20 nt, Homo sapiens
uagggacacuuucacagucc

SEQ ID NO: 2199548 - RNA, 17 nt, Homo sapiens
gaacccaggacagccac

SEQ ID NO: 2199549 - RNA, 14 nt, Homo sapiens
uuuuaucaguagaa

SEQ ID NO: 2199550 - RNA, 19 nt, Homo sapiens
agauuggcucacacugaga

SEQ ID NO: 2199551 - RNA, 16 nt, Homo sapiens
uccauaaggugcagua

SEQ ID NO: 2199552 - RNA, 13 nt, Homo sapiens
cauaaaucugucu

SEQ ID NO: 2199553 - RNA, 15 nt, Homo sapiens
uuccuuagacuuacu

SEQ ID NO: 2199554 - RNA, 16 nt, Homo sapiens
gagccaaaggcaucca

SEQ ID NO: 2199555 - RNA, 15 nt, Homo sapiens
uuaugagcugugaga

SEQ ID NO: 2199556 - RNA, 16 nt, Homo sapiens
uuuaucauuaccauua

SEQ ID NO: 2199557 - RNA, 22 nt, Homo sapiens
gaucacgccauugcacuccagc

SEQ ID NO: 2199558 - RNA, 20 nt, Homo sapiens
acgaccgggagguccaccug

SEQ ID NO: 2199559 - RNA, 17 nt, Homo sapiens
gcccccucacaguauug

SEQ ID NO: 2199560 - RNA, 15 nt, Homo sapiens
cucacaagcaugaag

SEQ ID NO: 2199561 - RNA, 22 nt, Homo sapiens
auuuaaaaauaaagcuacugaa

SEQ ID NO: 2199562 - RNA, 12 nt, Homo sapiens
cuuuccaguucc

SEQ ID NO: 2199563 - RNA, 17 nt, Homo sapiens
gcgugggagacgguggg

SEQ ID NO: 2199564 - RNA, 23 nt, Homo sapiens
cgcuuugucugucggugacuccu

SEQ ID NO: 2199565 - RNA, 13 nt, Homo sapiens
uaccaacuggaag

SEQ ID NO: 2199566 - RNA, 19 nt, Homo sapiens
auuguuacaguacuguucc

SEQ ID NO: 2199567 - RNA, 20 nt, Homo sapiens
cuuuuaggagaauucacaga

SEQ ID NO: 2199568 - RNA, 20 nt, Homo sapiens
cuuacuuccagcaaaaucca

SEQ ID NO: 2199569 - RNA, 17 nt, Homo sapiens
uuuccaucuaucacugc

SEQ ID NO: 2199570 - RNA, 22 nt, Homo sapiens
uucauguuggucugacaucaag

SEQ ID NO: 2199571 - RNA, 18 nt, Homo sapiens
uguucucuaauauguaaa

SEQ ID NO: 2199572 - RNA, 16 nt, Homo sapiens
acuucccuaaugaagu

SEQ ID NO: 2199573 - RNA, 17 nt, Homo sapiens
agcuaucaagaggcuga

SEQ ID NO: 2199574 - RNA, 20 nt, Homo sapiens
aaucacauuuuaauugccac

SEQ ID NO: 2199575 - RNA, 18 nt, Homo sapiens
aggcccugucucuggcua

SEQ ID NO: 2199576 - RNA, 19 nt, Homo sapiens
ucaucuuugccaccaccug

SEQ ID NO: 2199577 - RNA, 19 nt, Homo sapiens
caaacucuucccucucuca

SEQ ID NO: 2199578 - RNA, 20 nt, Homo sapiens
gaauuauauucaaugcauuu

SEQ ID NO: 2199579 - RNA, 13 nt, Homo sapiens
ugaaaaguuuccu

SEQ ID NO: 2199580 - RNA, 20 nt, Homo sapiens
cauauguauacaugugccau

SEQ ID NO: 2199581 - RNA, 17 nt, Homo sapiens
gccugucuguacuucau

SEQ ID NO: 2199582 - RNA, 22 nt, Homo sapiens
uuggggaaaccuucaucugaaa

SEQ ID NO: 2199583 - RNA, 20 nt, Homo sapiens
auuauauauuccgcacucaa

SEQ ID NO: 2199584 - RNA, 19 nt, Homo sapiens
cggcucacugcaaccucca

SEQ ID NO: 2199585 - RNA, 16 nt, Homo sapiens
uaaauaaaagauagca

SEQ ID NO: 2199586 - RNA, 22 nt, Homo sapiens
caggauuacuagucaaacaaaa

SEQ ID NO: 2199587 - RNA, 13 nt, Homo sapiens
agguaaggccuuu

SEQ ID NO: 2199588 - RNA, 23 nt, Homo sapiens
ugcccuuaaugugaggguuugua

SEQ ID NO: 2199589 - RNA, 13 nt, Homo sapiens
uauucugccaugg

SEQ ID NO: 2199590 - RNA, 20 nt, Homo sapiens
agcuuuggacacacacagcu

SEQ ID NO: 2199591 - RNA, 20 nt, Homo sapiens
ugagacagagucuugcucug

SEQ ID NO: 2199592 - RNA, 16 nt, Homo sapiens
cacaagccugagaacu

SEQ ID NO: 2199593 - RNA, 19 nt, Homo sapiens
agggaaucacuggugcuau

SEQ ID NO: 2199594 - RNA, 18 nt, Homo sapiens
cugccuaaguggcugcug

SEQ ID NO: 2199595 - RNA, 18 nt, Homo sapiens
ccauguuaauauuugaau

SEQ ID NO: 2199596 - RNA, 13 nt, Homo sapiens
aagugucuguuau

SEQ ID NO: 2199597 - RNA, 15 nt, Homo sapiens
augaagacccagugu

SEQ ID NO: 2199598 - RNA, 10 nt, Homo sapiens
acgccuccau

SEQ ID NO: 2199599 - RNA, 16 nt, Homo sapiens
uaaaacuauauucuca

SEQ ID NO: 2199600 - RNA, 17 nt, Homo sapiens
uacauuguauaggccau

SEQ ID NO: 2199601 - RNA, 16 nt, Homo sapiens
agaaacaagcugugca

SEQ ID NO: 2199602 - RNA, 22 nt, Homo sapiens
aaaagaaauuuugccugccauu

SEQ ID NO: 2199603 - RNA, 16 nt, Homo sapiens
accaucugcugcaguu

SEQ ID NO: 2199604 - RNA, 18 nt, Homo sapiens
cagacauuuugugugaga

SEQ ID NO: 2199605 - RNA, 18 nt, Homo sapiens
caauguuuuaaacagagu

SEQ ID NO: 2199606 - RNA, 15 nt, Homo sapiens
ugcaguucugagcac

SEQ ID NO: 2199607 - RNA, 16 nt, Homo sapiens
ugaaauaacauggccu

SEQ ID NO: 2199608 - RNA, 21 nt, Homo sapiens
caguauaccuaucugcugcac

SEQ ID NO: 2199609 - RNA, 13 nt, Homo sapiens
uucacgcaugugu

SEQ ID NO: 2199610 - RNA, 15 nt, Homo sapiens
aaaaaucuuuaggga

SEQ ID NO: 2199611 - RNA, 13 nt, Homo sapiens
uucugaaaacuga

SEQ ID NO: 2199612 - RNA, 15 nt, Homo sapiens
ugggucaagggggcu

SEQ ID NO: 2199613 - RNA, 17 nt, Homo sapiens
cuauaggaacauaugaa

SEQ ID NO: 2199614 - RNA, 13 nt, Homo sapiens
ggaggaagugaua

SEQ ID NO: 2199615 - RNA, 22 nt, Homo sapiens
uccagccugucggccacacccc

SEQ ID NO: 2199616 - RNA, 23 nt, Homo sapiens
cuguagggugcugcgcagcaucc

SEQ ID NO: 2199617 - RNA, 19 nt, Homo sapiens
gugaccuggcaucuuggaa

SEQ ID NO: 2199618 - RNA, 20 nt, Homo sapiens
cacaaaggaccucagcugcu

SEQ ID NO: 2199619 - RNA, 17 nt, Homo sapiens
cgcaccaauaaagccuu

SEQ ID NO: 2199620 - RNA, 22 nt, Homo sapiens
caugcucugcaaaaggagagac

SEQ ID NO: 2199621 - RNA, 17 nt, Homo sapiens
gcuucuagaaccaggca

SEQ ID NO: 2199622 - RNA, 20 nt, Homo sapiens
aagcauuugacuuucugucu

SEQ ID NO: 2199623 - RNA, 15 nt, Homo sapiens
uucuacuaugaucag

SEQ ID NO: 2199624 - RNA, 15 nt, Homo sapiens
auaugcuuuuuugca

SEQ ID NO: 2199625 - RNA, 14 nt, Homo sapiens
uuguaauccuguac

SEQ ID NO: 2199626 - RNA, 14 nt, Homo sapiens
cucaaucuagaaca

SEQ ID NO: 2199627 - RNA, 18 nt, Homo sapiens
aggacgccuccaagcccg

SEQ ID NO: 2199628 - RNA, 18 nt, Homo sapiens
auucagcccucagaagaa

SEQ ID NO: 2199629 - RNA, 16 nt, Homo sapiens
ugaggggaugcaacaa

SEQ ID NO: 2199630 - RNA, 15 nt, Homo sapiens
gcucuaaaguagcaa

SEQ ID NO: 2199631 - RNA, 18 nt, Homo sapiens
acucaggcgccuggcaca

SEQ ID NO: 2199632 - RNA, 22 nt, Homo sapiens
agaggacagagcuggcugucuu

SEQ ID NO: 2199633 - RNA, 13 nt, Homo sapiens
ccucuuucaucca

SEQ ID NO: 2199634 - RNA, 17 nt, Homo sapiens
uuccauauccauaguga

SEQ ID NO: 2199635 - RNA, 13 nt, Homo sapiens
agcagcacugggg

SEQ ID NO: 2199636 - RNA, 15 nt, Homo sapiens
aaauagacacuugag

SEQ ID NO: 2199637 - RNA, 18 nt, Homo sapiens
aguuacucauucagggau

SEQ ID NO: 2199638 - RNA, 18 nt, Homo sapiens
gccaaagugacacagagc

SEQ ID NO: 2199639 - RNA, 17 nt, Homo sapiens
aagacaaucacugccaa

SEQ ID NO: 2199640 - RNA, 19 nt, Homo sapiens
cuuuguauauuacauacau

SEQ ID NO: 2199641 - RNA, 18 nt, Homo sapiens
aaauaagcauguuuucac

SEQ ID NO: 2199642 - RNA, 14 nt, Homo sapiens
uuuugaugagcuua

SEQ ID NO: 2199643 - RNA, 14 nt, Homo sapiens
uauucuaagccaag

SEQ ID NO: 2199644 - RNA, 20 nt, Homo sapiens
uccugacuucaugauccacc

SEQ ID NO: 2199645 - RNA, 18 nt, Homo sapiens
uaacucguguuuggagcu

SEQ ID NO: 2199646 - RNA, 18 nt, Homo sapiens
gagugaucucagcucacu

SEQ ID NO: 2199647 - RNA, 16 nt, Homo sapiens
acucacucugcugcug

SEQ ID NO: 2199648 - RNA, 15 nt, Homo sapiens
aacaaguguucugua

SEQ ID NO: 2199649 - RNA, 14 nt, Homo sapiens
gcugcauaaacugu

SEQ ID NO: 2199650 - RNA, 13 nt, Homo sapiens
uuuaagcuguaca

SEQ ID NO: 2199651 - RNA, 14 nt, Homo sapiens
uaucugauuuccua

SEQ ID NO: 2199652 - RNA, 23 nt, Homo sapiens
gaaaagagauaugggaacacugg

SEQ ID NO: 2199653 - RNA, 16 nt, Homo sapiens
auauuuuacauacacu

SEQ ID NO: 2199654 - RNA, 20 nt, Homo sapiens
auccugaguaguaaucucac

SEQ ID NO: 2199655 - RNA, 15 nt, Homo sapiens
ccaagcaagacugag

SEQ ID NO: 2199656 - RNA, 23 nt, Homo sapiens
ggagcccggggcagagcucagag

SEQ ID NO: 2199657 - RNA, 14 nt, Homo sapiens
ucccugacuguaaa

SEQ ID NO: 2199658 - RNA, 20 nt, Homo sapiens
ggccuugguggagcagccag

SEQ ID NO: 2199659 - RNA, 23 nt, Homo sapiens
aucaggaaauuuggggcagauuu

SEQ ID NO: 2199660 - RNA, 21 nt, Homo sapiens
guaacacuguauaacauuuaa

SEQ ID NO: 2199661 - RNA, 17 nt, Homo sapiens
cauuaaauucacaugca

SEQ ID NO: 2199662 - RNA, 16 nt, Homo sapiens
gugcaugugccgaggu

SEQ ID NO: 2199663 - RNA, 20 nt, Homo sapiens
uguccauuuaaaaaugaucu

SEQ ID NO: 2199664 - RNA, 19 nt, Homo sapiens
cacuagucuguguaacuuu

SEQ ID NO: 2199665 - RNA, 22 nt, Homo sapiens
aacugacugaaggaaaagcaag

SEQ ID NO: 2199666 - RNA, 14 nt, Homo sapiens
ugacacaugcugaa

SEQ ID NO: 2199667 - RNA, 19 nt, Homo sapiens
uuugccuuggcuuugccag

SEQ ID NO: 2199668 - RNA, 19 nt, Homo sapiens
uacuuugccuuuugcaaac

SEQ ID NO: 2199669 - RNA, 19 nt, Homo sapiens
cauccucacaugugacaaa

SEQ ID NO: 2199670 - RNA, 21 nt, Homo sapiens
ucagcaauugucuacauucag

SEQ ID NO: 2199671 - RNA, 18 nt, Homo sapiens
gaugcacaugagcuggcg

SEQ ID NO: 2199672 - RNA, 18 nt, Homo sapiens
ugaagugcagcucaggag

SEQ ID NO: 2199673 - RNA, 22 nt, Homo sapiens
ugagaugaaggaaggacuauga

SEQ ID NO: 2199674 - RNA, 15 nt, Homo sapiens
guggggggacugccu

SEQ ID NO: 2199675 - RNA, 21 nt, Homo sapiens
aucugauaugaccccaguuca

SEQ ID NO: 2199676 - RNA, 21 nt, Homo sapiens
agauguguguugauacuguug

SEQ ID NO: 2199677 - RNA, 17 nt, Homo sapiens
cugaggcccccaucucc

SEQ ID NO: 2199678 - RNA, 13 nt, Homo sapiens
cugucacacaggg

SEQ ID NO: 2199679 - RNA, 14 nt, Homo sapiens
cacaggaguguccu

SEQ ID NO: 2199680 - RNA, 15 nt, Homo sapiens
cucagcacagagaug

SEQ ID NO: 2199681 - RNA, 13 nt, Homo sapiens
cuccaaacccucg

SEQ ID NO: 2199682 - RNA, 20 nt, Homo sapiens
caaagaauuuuuuuuaacau

SEQ ID NO: 2199683 - RNA, 20 nt, Homo sapiens
accacguccucgaauucuca

SEQ ID NO: 2199684 - RNA, 13 nt, Homo sapiens
uguaaucccagca

SEQ ID NO: 2199685 - RNA, 18 nt, Homo sapiens
cugccucagccuccugag

SEQ ID NO: 2199686 - RNA, 18 nt, Homo sapiens
cccaggccucugugggcc

SEQ ID NO: 2199687 - RNA, 16 nt, Homo sapiens
ccugcugugcuguggc

SEQ ID NO: 2199688 - RNA, 21 nt, Homo sapiens
uguucuuagcugaacaaugaa

SEQ ID NO: 2199689 - RNA, 15 nt, Homo sapiens
agacucaaugugcuc

SEQ ID NO: 2199690 - RNA, 20 nt, Homo sapiens
uucucacuccuaccugguaa

SEQ ID NO: 2199691 - RNA, 22 nt, Homo sapiens
ucauaauguuaacuaaauaacu

SEQ ID NO: 2199692 - RNA, 23 nt, Homo sapiens
ccgaaaugaaaauggcugaagaa

SEQ ID NO: 2199693 - RNA, 23 nt, Homo sapiens
uuuagaaaaaaguuuacaacaua

SEQ ID NO: 2199694 - RNA, 20 nt, Homo sapiens
uuuuugagguggagucucau

SEQ ID NO: 2199695 - RNA, 18 nt, Homo sapiens
ugggugacagagcgagac

SEQ ID NO: 2199696 - RNA, 16 nt, Homo sapiens
aaaaguaacaucuccu

SEQ ID NO: 2199697 - RNA, 17 nt, Homo sapiens
ugccauccacauuuuaa

SEQ ID NO: 2199698 - RNA, 17 nt, Homo sapiens
aauaaauaaaaauauuc

SEQ ID NO: 2199699 - RNA, 12 nt, Homo sapiens
ugaaaaugauua

SEQ ID NO: 2199700 - RNA, 12 nt, Homo sapiens
ugucaaugauac

SEQ ID NO: 2199701 - RNA, 23 nt, Homo sapiens
cucuaggccucuccaguuugcac

SEQ ID NO: 2199702 - RNA, 18 nt, Homo sapiens
uaugcacacacagaugca

SEQ ID NO: 2199703 - RNA, 12 nt, Homo sapiens
uccccugagguc

SEQ ID NO: 2199704 - RNA, 12 nt, Homo sapiens
gccucugauguu

SEQ ID NO: 2199705 - RNA, 19 nt, Homo sapiens
gggaccuggggaagcaaaa

SEQ ID NO: 2199706 - RNA, 17 nt, Homo sapiens
uuuuuccaaaagccagu

SEQ ID NO: 2199707 - RNA, 22 nt, Homo sapiens
agcagcacaccucagccccacu

SEQ ID NO: 2199708 - RNA, 13 nt, Homo sapiens
agccuacauucac

SEQ ID NO: 2199709 - RNA, 16 nt, Homo sapiens
guaucuccagccacuc

SEQ ID NO: 2199710 - RNA, 22 nt, Homo sapiens
ggcugucaggauucuucaagga

SEQ ID NO: 2199711 - RNA, 15 nt, Homo sapiens
cucuuacacauagca

SEQ ID NO: 2199712 - RNA, 20 nt, Homo sapiens
ucugggauucccaccaaggu

SEQ ID NO: 2199713 - RNA, 22 nt, Homo sapiens
aguuaucuuagcuggauauaau

SEQ ID NO: 2199714 - RNA, 18 nt, Homo sapiens
uaaccugggcauuguuga

SEQ ID NO: 2199715 - RNA, 18 nt, Homo sapiens
uagcucucacaugcacag

SEQ ID NO: 2199716 - RNA, 16 nt, Homo sapiens
agguaaaaugccauga

SEQ ID NO: 2199717 - RNA, 18 nt, Homo sapiens
uuucaaaaaauuauauga

SEQ ID NO: 2199718 - RNA, 16 nt, Homo sapiens
aauggaauucccaugc

SEQ ID NO: 2199719 - RNA, 21 nt, Homo sapiens
cuuauucugucuggcauuaca

SEQ ID NO: 2199720 - RNA, 22 nt, Homo sapiens
cugucuggauccuauccuccua

SEQ ID NO: 2199721 - RNA, 15 nt, Homo sapiens
acuaaugaauugaaa

SEQ ID NO: 2199722 - RNA, 11 nt, Homo sapiens
ggcccaagggc

SEQ ID NO: 2199723 - RNA, 16 nt, Homo sapiens
uccccuuuuucuuccu

SEQ ID NO: 2199724 - RNA, 20 nt, Homo sapiens
guccuuacucccccaccacu

SEQ ID NO: 2199725 - RNA, 13 nt, Homo sapiens
aagagucuucaaa

SEQ ID NO: 2199726 - RNA, 17 nt, Homo sapiens
aggagguuuaggucaag

SEQ ID NO: 2199727 - RNA, 19 nt, Homo sapiens
ugcgcacacacagauaugc

SEQ ID NO: 2199728 - RNA, 18 nt, Homo sapiens
aucaacaaugauuaauca

SEQ ID NO: 2199729 - RNA, 18 nt, Homo sapiens
cccucuugacguggcacu

SEQ ID NO: 2199730 - RNA, 15 nt, Homo sapiens
uauacuauacaacaa

SEQ ID NO: 2199731 - RNA, 17 nt, Homo sapiens
gcgauucuccccauggg

SEQ ID NO: 2199732 - RNA, 18 nt, Homo sapiens
cugccuccccagcucuau

SEQ ID NO: 2199733 - RNA, 16 nt, Homo sapiens
cacacuguaaauauga

SEQ ID NO: 2199734 - RNA, 16 nt, Homo sapiens
agcuuuccauguugcu

SEQ ID NO: 2199735 - RNA, 13 nt, Homo sapiens
gaagucuccucaa

SEQ ID NO: 2199736 - RNA, 13 nt, Homo sapiens
guaauacaaacua

SEQ ID NO: 2199737 - RNA, 22 nt, Homo sapiens
ugguggggcccauggaggagac

SEQ ID NO: 2199738 - RNA, 22 nt, Homo sapiens
cuuuuccuugcugauugcuaau

SEQ ID NO: 2199739 - RNA, 18 nt, Homo sapiens
caauuaaaaccauuaccu

SEQ ID NO: 2199740 - RNA, 16 nt, Homo sapiens
aagcugggagcacagg

SEQ ID NO: 2199741 - RNA, 19 nt, Homo sapiens
aaagggacuuuuguaaaau

SEQ ID NO: 2199742 - RNA, 16 nt, Homo sapiens
agacaguuauugcaag

SEQ ID NO: 2199743 - RNA, 21 nt, Homo sapiens
aagaugaagcugagcuuuuga

SEQ ID NO: 2199744 - RNA, 18 nt, Homo sapiens
ucugugcaguaagccugu

SEQ ID NO: 2199745 - RNA, 22 nt, Homo sapiens
ucaggcaugauggcccauacuu

SEQ ID NO: 2199746 - RNA, 16 nt, Homo sapiens
guccauugacauguac

SEQ ID NO: 2199747 - RNA, 14 nt, Homo sapiens
gcgugugucaggga

SEQ ID NO: 2199748 - RNA, 15 nt, Homo sapiens
gcucucuaauuccac

SEQ ID NO: 2199749 - RNA, 11 nt, Homo sapiens
ucucagaggac

SEQ ID NO: 2199750 - RNA, 18 nt, Homo sapiens
gaacacagugucuguuca

SEQ ID NO: 2199751 - RNA, 19 nt, Homo sapiens
ucaaauuccgagugcagaa

SEQ ID NO: 2199752 - RNA, 17 nt, Homo sapiens
agugagccgagaucaca

SEQ ID NO: 2199753 - RNA, 17 nt, Homo sapiens
gucucaucuucucucau

SEQ ID NO: 2199754 - RNA, 16 nt, Homo sapiens
aaugcagaauguaaaa

SEQ ID NO: 2199755 - RNA, 14 nt, Homo sapiens
gguggucacuggaa

SEQ ID NO: 2199756 - RNA, 21 nt, Homo sapiens
cucauggaugagacuacuuca

SEQ ID NO: 2199757 - RNA, 13 nt, Homo sapiens
gaucuacugggac

SEQ ID NO: 2199758 - RNA, 15 nt, Homo sapiens
uuuucuagucuucau

SEQ ID NO: 2199759 - RNA, 15 nt, Homo sapiens
acuuguagauuugau

SEQ ID NO: 2199760 - RNA, 15 nt, Homo sapiens
uuggaaugcacacag

SEQ ID NO: 2199761 - RNA, 22 nt, Homo sapiens
ccuuguucuauuuuucaaucau

SEQ ID NO: 2199762 - RNA, 20 nt, Homo sapiens
ugagcauuggauacagcagu

SEQ ID NO: 2199763 - RNA, 16 nt, Homo sapiens
ccucaagugaucugcc

SEQ ID NO: 2199764 - RNA, 14 nt, Homo sapiens
uuaguucccaacau

SEQ ID NO: 2199765 - RNA, 18 nt, Homo sapiens
cuuguccgcaagggguga

SEQ ID NO: 2199766 - RNA, 19 nt, Homo sapiens
cacugaacuagugcagggu

SEQ ID NO: 2199767 - RNA, 12 nt, Homo sapiens
gucugccucuuc

SEQ ID NO: 2199768 - RNA, 21 nt, Homo sapiens
ugaacaaaaacuguauggaau

SEQ ID NO: 2199769 - RNA, 15 nt, Homo sapiens
agcaacaagaccacc

SEQ ID NO: 2199770 - RNA, 11 nt, Homo sapiens
ucuauguaucu

SEQ ID NO: 2199771 - RNA, 11 nt, Homo sapiens
uauauguauau

SEQ ID NO: 2199772 - RNA, 17 nt, Homo sapiens
ccuucuagugagccugg

SEQ ID NO: 2199773 - RNA, 14 nt, Homo sapiens
ugugcuuucccuga

SEQ ID NO: 2199774 - RNA, 16 nt, Homo sapiens
gaucuguuguaauauc

SEQ ID NO: 2199775 - RNA, 17 nt, Homo sapiens
uucccuuuuccauccuc

SEQ ID NO: 2199776 - RNA, 17 nt, Homo sapiens
cuaauuccacacccuca

SEQ ID NO: 2199777 - RNA, 17 nt, Homo sapiens
uaggaaacccuucuuua

SEQ ID NO: 2199778 - RNA, 21 nt, Homo sapiens
ugcucuggucugugggucagu

SEQ ID NO: 2199779 - RNA, 22 nt, Homo sapiens
aaaugcuacgcacguggagcug

SEQ ID NO: 2199780 - RNA, 12 nt, Homo sapiens
auccaucucuca

SEQ ID NO: 2199781 - RNA, 21 nt, Homo sapiens
ugcucaguaaggcagugcaau

SEQ ID NO: 2199782 - RNA, 14 nt, Homo sapiens
cccuguguccccaa

SEQ ID NO: 2199783 - RNA, 20 nt, Homo sapiens
aagagaugggauuucaucau

SEQ ID NO: 2199784 - RNA, 17 nt, Homo sapiens
cucauugcagaucccag

SEQ ID NO: 2199785 - RNA, 12 nt, Homo sapiens
cuguccagauua

SEQ ID NO: 2199786 - RNA, 19 nt, Homo sapiens
uaaaguaugaauauuucau

SEQ ID NO: 2199787 - RNA, 13 nt, Homo sapiens
aacucuccaugau

SEQ ID NO: 2199788 - RNA, 13 nt, Homo sapiens
accucuacagggu

SEQ ID NO: 2199789 - RNA, 19 nt, Homo sapiens
cuuuaacauuuuguuucca

SEQ ID NO: 2199790 - RNA, 23 nt, Homo sapiens
acacacaugcauacuuacagacu

SEQ ID NO: 2199791 - RNA, 15 nt, Homo sapiens
gagaaggcucuugcc

SEQ ID NO: 2199792 - RNA, 21 nt, Homo sapiens
ccauccaggcugggaggggaa

SEQ ID NO: 2199793 - RNA, 14 nt, Homo sapiens
auguacuucucacc

SEQ ID NO: 2199794 - RNA, 17 nt, Homo sapiens
ugugcucuacuguuacu

SEQ ID NO: 2199795 - RNA, 14 nt, Homo sapiens
acagaccuucacag

SEQ ID NO: 2199796 - RNA, 14 nt, Homo sapiens
caauuucuaaauac

SEQ ID NO: 2199797 - RNA, 14 nt, Homo sapiens
auccuccucuccau

SEQ ID NO: 2199798 - RNA, 15 nt, Homo sapiens
uggacaggagucagu

SEQ ID NO: 2199799 - RNA, 19 nt, Homo sapiens
aaacacgucgauucugucc

SEQ ID NO: 2199800 - RNA, 17 nt, Homo sapiens
ggguccugccugcagua

SEQ ID NO: 2199801 - RNA, 14 nt, Homo sapiens
ccuaccacaguccg

SEQ ID NO: 2199802 - RNA, 24 nt, Homo sapiens
uuucuaccuuguuguguuucuauc

SEQ ID NO: 2199803 - RNA, 16 nt, Homo sapiens
uccuauccacugggca

SEQ ID NO: 2199804 - RNA, 17 nt, Homo sapiens
aagcccaagugaaauca

SEQ ID NO: 2199805 - RNA, 14 nt, Homo sapiens
gagcaaacugcaug

SEQ ID NO: 2199806 - RNA, 21 nt, Homo sapiens
uacuuacauguucccaaaaca

SEQ ID NO: 2199807 - RNA, 24 nt, Homo sapiens
cucagagcaccucugacgccugaa

SEQ ID NO: 2199808 - RNA, 20 nt, Homo sapiens
aaauucaaaaccugcaguua

SEQ ID NO: 2199809 - RNA, 16 nt, Homo sapiens
uagaugccaaugacau

SEQ ID NO: 2199810 - RNA, 16 nt, Homo sapiens
gcuugcaccacuuccg

SEQ ID NO: 2199811 - RNA, 18 nt, Homo sapiens
ccaagccaaccacuuuca

SEQ ID NO: 2199812 - RNA, 15 nt, Homo sapiens
uuauaaauagccuuc

SEQ ID NO: 2199813 - RNA, 22 nt, Homo sapiens
agaggcuauuauuuucacugua

SEQ ID NO: 2199814 - RNA, 21 nt, Homo sapiens
ccaggaggcggcagugcaaca

SEQ ID NO: 2199815 - RNA, 15 nt, Homo sapiens
aggagcuggacaccu

SEQ ID NO: 2199816 - RNA, 14 nt, Homo sapiens
agucaggugcaguc

SEQ ID NO: 2199817 - RNA, 23 nt, Homo sapiens
gaaaauggaauuacuccaaaaag

SEQ ID NO: 2199818 - RNA, 16 nt, Homo sapiens
uuaguauuguuguccu

SEQ ID NO: 2199819 - RNA, 13 nt, Homo sapiens
cccguccugauuc

SEQ ID NO: 2199820 - RNA, 22 nt, Homo sapiens
aagauccuagauccuaaggguc

SEQ ID NO: 2199821 - RNA, 19 nt, Homo sapiens
uagagcuuaaauugucaga

SEQ ID NO: 2199822 - RNA, 20 nt, Homo sapiens
uaaugccccugauuuuauca

SEQ ID NO: 2199823 - RNA, 18 nt, Homo sapiens
acucuaccagacugugua

SEQ ID NO: 2199824 - RNA, 22 nt, Homo sapiens
gagcccucuaugguguggcaaa

SEQ ID NO: 2199825 - RNA, 16 nt, Homo sapiens
cuuaaaaaaugaauua

SEQ ID NO: 2199826 - RNA, 22 nt, Homo sapiens
caugccuguaauccuagcacuu

SEQ ID NO: 2199827 - RNA, 22 nt, Homo sapiens
uguacagacagaaaaaacugag

SEQ ID NO: 2199828 - RNA, 22 nt, Homo sapiens
cugggugagcugagauggaguc

SEQ ID NO: 2199829 - RNA, 20 nt, Homo sapiens
uacacuuuuuggaagugaaa

SEQ ID NO: 2199830 - RNA, 21 nt, Homo sapiens
uguguccucuuccaccacaga

SEQ ID NO: 2199831 - RNA, 14 nt, Homo sapiens
gauagaaggcuaug

SEQ ID NO: 2199832 - RNA, 14 nt, Homo sapiens
gaaggaaggcagug

SEQ ID NO: 2199833 - RNA, 15 nt, Homo sapiens
uuuaggaacuuuaac

SEQ ID NO: 2199834 - RNA, 21 nt, Homo sapiens
uaauggaggucccagcccugg

SEQ ID NO: 2199835 - RNA, 13 nt, Homo sapiens
gacauauaucuau

SEQ ID NO: 2199836 - RNA, 24 nt, Homo sapiens
ucuguagaagcuaauaaauaauca

SEQ ID NO: 2199837 - RNA, 13 nt, Homo sapiens
agguaaaccaaac

SEQ ID NO: 2199838 - RNA, 17 nt, Homo sapiens
agcccccacccaugcca

SEQ ID NO: 2199839 - RNA, 15 nt, Homo sapiens
ugcaugaccugauca

SEQ ID NO: 2199840 - RNA, 13 nt, Homo sapiens
acacacacuggcc

SEQ ID NO: 2199841 - RNA, 15 nt, Homo sapiens
ucaccuguuauguau

SEQ ID NO: 2199842 - RNA, 14 nt, Homo sapiens
aaauaaaaauucaa

SEQ ID NO: 2199843 - RNA, 14 nt, Homo sapiens
cggucagugccuuu

SEQ ID NO: 2199844 - RNA, 15 nt, Homo sapiens
ucccauccagugucu

SEQ ID NO: 2199845 - RNA, 15 nt, Homo sapiens
cuccagacaggguuc

SEQ ID NO: 2199846 - RNA, 13 nt, Homo sapiens
ccauaaccauuau

SEQ ID NO: 2199847 - RNA, 21 nt, Homo sapiens
uaauaauuauguauguuaugg

SEQ ID NO: 2199848 - RNA, 14 nt, Homo sapiens
cagaagccuuggaa

SEQ ID NO: 2199849 - RNA, 21 nt, Homo sapiens
caccuguuauugccaauguuc

SEQ ID NO: 2199850 - RNA, 23 nt, Homo sapiens
uacaacuccaacuucuauguuua

SEQ ID NO: 2199851 - RNA, 15 nt, Homo sapiens
uaaauauuucaugau

SEQ ID NO: 2199852 - RNA, 17 nt, Homo sapiens
gauaacuagauggugcu

SEQ ID NO: 2199853 - RNA, 15 nt, Homo sapiens
cugccacccuugacg

SEQ ID NO: 2199854 - RNA, 14 nt, Homo sapiens
caguacaguacuca

SEQ ID NO: 2199855 - RNA, 11 nt, Homo sapiens
gucuagucaag

SEQ ID NO: 2199856 - RNA, 19 nt, Homo sapiens
ggcaggagaaucgcuugaa

SEQ ID NO: 2199857 - RNA, 18 nt, Homo sapiens
uuuuacucuuaugaucaa

SEQ ID NO: 2199858 - RNA, 23 nt, Homo sapiens
cagcugaacacaagcaaaccuuc

SEQ ID NO: 2199859 - RNA, 21 nt, Homo sapiens
uuucuuaauauuuuuacaugc

SEQ ID NO: 2199860 - RNA, 22 nt, Homo sapiens
gaacucauuccugccugucucc

SEQ ID NO: 2199861 - RNA, 20 nt, Homo sapiens
gaauauccuuuaaaauuuaa

SEQ ID NO: 2199862 - RNA, 12 nt, Homo sapiens
gccagcacagaa

SEQ ID NO: 2199863 - RNA, 21 nt, Homo sapiens
cauuagaugaaguuacuguug

SEQ ID NO: 2199864 - RNA, 21 nt, Homo sapiens
uaguagauauccucugcuuaa

SEQ ID NO: 2199865 - RNA, 22 nt, Homo sapiens
cuguucuugcuacccaugacuu

SEQ ID NO: 2199866 - RNA, 21 nt, Homo sapiens
ucuuaaaaaucuaugccuaaa

SEQ ID NO: 2199867 - RNA, 21 nt, Homo sapiens
ggcaucaguaugucacucugg

SEQ ID NO: 2199868 - RNA, 16 nt, Homo sapiens
aggcacugguggcauc

SEQ ID NO: 2199869 - RNA, 10 nt, Homo sapiens
cccacgcacg

SEQ ID NO: 2199870 - RNA, 19 nt, Homo sapiens
gguguagguugaaauucau

SEQ ID NO: 2199871 - RNA, 23 nt, Homo sapiens
uggaaaaugaccucaaggaagcu

SEQ ID NO: 2199872 - RNA, 21 nt, Homo sapiens
aguuuuccgagaggaccaucu

SEQ ID NO: 2199873 - RNA, 16 nt, Homo sapiens
cugugcauuguaggau

SEQ ID NO: 2199874 - RNA, 20 nt, Homo sapiens
gucacuugcuggcugugaaa

SEQ ID NO: 2199875 - RNA, 21 nt, Homo sapiens
gacagagccccacccucagau

SEQ ID NO: 2199876 - RNA, 17 nt, Homo sapiens
aauguacuacauuugca

SEQ ID NO: 2199877 - RNA, 13 nt, Homo sapiens
cuggguuccagca

SEQ ID NO: 2199878 - RNA, 19 nt, Homo sapiens
uuuacugcuuucugaaugu

SEQ ID NO: 2199879 - RNA, 21 nt, Homo sapiens
agaguggccuggccaggagcu

SEQ ID NO: 2199880 - RNA, 15 nt, Homo sapiens
auccuugcugauaaa

SEQ ID NO: 2199881 - RNA, 15 nt, Homo sapiens
uugacgaacuggcua

SEQ ID NO: 2199882 - RNA, 13 nt, Homo sapiens
ucugaacugcaca

SEQ ID NO: 2199883 - RNA, 14 nt, Homo sapiens
gccgauggagacac

SEQ ID NO: 2199884 - RNA, 14 nt, Homo sapiens
guuggcaguguuug

SEQ ID NO: 2199885 - RNA, 18 nt, Homo sapiens
uguuucaguccaugaucc

SEQ ID NO: 2199886 - RNA, 22 nt, Homo sapiens
cacauucuauuuuggguauuaa

SEQ ID NO: 2199887 - RNA, 14 nt, Homo sapiens
uaacugugaaguuu

SEQ ID NO: 2199888 - RNA, 20 nt, Homo sapiens
auucuucagauauacuggaa

SEQ ID NO: 2199889 - RNA, 17 nt, Homo sapiens
ugcauugccuguaacaa

SEQ ID NO: 2199890 - RNA, 18 nt, Homo sapiens
agcuuuaaaaccacagcu

SEQ ID NO: 2199891 - RNA, 16 nt, Homo sapiens
cccgacuccucaaaag

SEQ ID NO: 2199892 - RNA, 13 nt, Homo sapiens
guguuucuuuuga

SEQ ID NO: 2199893 - RNA, 15 nt, Homo sapiens
ccaacccaaccucau

SEQ ID NO: 2199894 - RNA, 15 nt, Homo sapiens
uuuaaguacuacaca

SEQ ID NO: 2199895 - RNA, 19 nt, Homo sapiens
caaaauggagagaauacaa

SEQ ID NO: 2199896 - RNA, 15 nt, Homo sapiens
ggcuggcuguguccu

SEQ ID NO: 2199897 - RNA, 22 nt, Homo sapiens
agcccaggcggucacugcccac

SEQ ID NO: 2199898 - RNA, 12 nt, Homo sapiens
aggacaaaauca

SEQ ID NO: 2199899 - RNA, 20 nt, Homo sapiens
aaauauugcugugucuucau

SEQ ID NO: 2199900 - RNA, 20 nt, Homo sapiens
guguaacaggauacagguga

SEQ ID NO: 2199901 - RNA, 15 nt, Homo sapiens
uccuggccuggcaca

SEQ ID NO: 2199902 - RNA, 17 nt, Homo sapiens
guugaaacaagugcaag

SEQ ID NO: 2199903 - RNA, 12 nt, Homo sapiens
cauuugccuugu

SEQ ID NO: 2199904 - RNA, 22 nt, Homo sapiens
uauuacaaauuuucacugcugc

SEQ ID NO: 2199905 - RNA, 23 nt, Homo sapiens
caggaguaaaagagucaagugac

SEQ ID NO: 2199906 - RNA, 16 nt, Homo sapiens
cuucugaacuuggaaa

SEQ ID NO: 2199907 - RNA, 14 nt, Homo sapiens
uccacgagcuauau

SEQ ID NO: 2199908 - RNA, 21 nt, Homo sapiens
ugccaggagugggugggacac

SEQ ID NO: 2199909 - RNA, 13 nt, Homo sapiens
aucauagcaauau

SEQ ID NO: 2199910 - RNA, 15 nt, Homo sapiens
ggccacuaguggggu

SEQ ID NO: 2199911 - RNA, 21 nt, Homo sapiens
cugugcaugacugauguuggg

SEQ ID NO: 2199912 - RNA, 13 nt, Homo sapiens
gcagcagcaaaca

SEQ ID NO: 2199913 - RNA, 17 nt, Homo sapiens
uagagugucucagggug

SEQ ID NO: 2199914 - RNA, 13 nt, Homo sapiens
gaaucagacugac

SEQ ID NO: 2199915 - RNA, 13 nt, Homo sapiens
uguccgugauaau

SEQ ID NO: 2199916 - RNA, 14 nt, Homo sapiens
aggaaggaugagca

SEQ ID NO: 2199917 - RNA, 21 nt, Homo sapiens
cuucuugcccuggggaucaaa

SEQ ID NO: 2199918 - RNA, 21 nt, Homo sapiens
gaaguauccuucagccugaaa

SEQ ID NO: 2199919 - RNA, 23 nt, Homo sapiens
gcuggaguuauugaagcagagug

SEQ ID NO: 2199920 - RNA, 19 nt, Homo sapiens
uuuauuuuauagagcagaa

SEQ ID NO: 2199921 - RNA, 22 nt, Homo sapiens
ugccuugggccuugcugcugcu

SEQ ID NO: 2199922 - RNA, 20 nt, Homo sapiens
uacuuauuaagagcaaacuu

SEQ ID NO: 2199923 - RNA, 20 nt, Homo sapiens
aaagacccuaaaucugagga

SEQ ID NO: 2199924 - RNA, 22 nt, Homo sapiens
auggaaaaaagccuucacuuca

SEQ ID NO: 2199925 - RNA, 15 nt, Homo sapiens
ccacccuaccacagu

SEQ ID NO: 2199926 - RNA, 14 nt, Homo sapiens
uacccuauacaucc

SEQ ID NO: 2199927 - RNA, 17 nt, Homo sapiens
aaggcaggaaggaacuc

SEQ ID NO: 2199928 - RNA, 21 nt, Homo sapiens
uacuuauguugcacaaugaga

SEQ ID NO: 2199929 - RNA, 23 nt, Homo sapiens
aagaaagugaaaaaaacaaccua

SEQ ID NO: 2199930 - RNA, 18 nt, Homo sapiens
aguucgaggcgagccugg

SEQ ID NO: 2199931 - RNA, 17 nt, Homo sapiens
auguggccugcauguac

SEQ ID NO: 2199932 - RNA, 12 nt, Homo sapiens
ucagguggaccc

SEQ ID NO: 2199933 - RNA, 23 nt, Homo sapiens
uugcauugaauuuagucauuauu

SEQ ID NO: 2199934 - RNA, 16 nt, Homo sapiens
agcaaaccaaugcuau

SEQ ID NO: 2199935 - RNA, 18 nt, Homo sapiens
auguccuccaccacaaga

SEQ ID NO: 2199936 - RNA, 13 nt, Homo sapiens
aaauaauugcauc

SEQ ID NO: 2199937 - RNA, 23 nt, Homo sapiens
aaguuaagcagccuuucugugga

SEQ ID NO: 2199938 - RNA, 16 nt, Homo sapiens
ugucuuccuugaccaa

SEQ ID NO: 2199939 - RNA, 23 nt, Homo sapiens
acuucuucuguaauauuuacaau

SEQ ID NO: 2199940 - RNA, 21 nt, Homo sapiens
ucugcagucucuauaccaaua

SEQ ID NO: 2199941 - RNA, 22 nt, Homo sapiens
gcagacucaccaccuauucuga

SEQ ID NO: 2199942 - RNA, 21 nt, Homo sapiens
agaaguccccuuccaucccag

SEQ ID NO: 2199943 - RNA, 23 nt, Homo sapiens
ccuuuaaaucugugaugauccuc

SEQ ID NO: 2199944 - RNA, 17 nt, Homo sapiens
aaucaaugaucaucuca

SEQ ID NO: 2199945 - RNA, 19 nt, Homo sapiens
ugaggacgcaccgccgcca

SEQ ID NO: 2199946 - RNA, 21 nt, Homo sapiens
uugcucaaguugaugaaucau

SEQ ID NO: 2199947 - RNA, 14 nt, Homo sapiens
uuccaccaucaaau

SEQ ID NO: 2199948 - RNA, 16 nt, Homo sapiens
agaugcuacuggacuu

SEQ ID NO: 2199949 - RNA, 20 nt, Homo sapiens
gacuuaaaacauggugccua

SEQ ID NO: 2199950 - RNA, 13 nt, Homo sapiens
cuuccccaucuca

SEQ ID NO: 2199951 - RNA, 20 nt, Homo sapiens
cuuccucuuuggacugaaua

SEQ ID NO: 2199952 - RNA, 22 nt, Homo sapiens
cacgugugugugugugcacauc

SEQ ID NO: 2199953 - RNA, 16 nt, Homo sapiens
aaaccugcccaugugu

SEQ ID NO: 2199954 - RNA, 14 nt, Homo sapiens
gggcaacaacagca

SEQ ID NO: 2199955 - RNA, 20 nt, Homo sapiens
cuucuuaucacacuugcaaa

SEQ ID NO: 2199956 - RNA, 17 nt, Homo sapiens
gaacucuugacagcuau

SEQ ID NO: 2199957 - RNA, 20 nt, Homo sapiens
uauugauguuuucacaaaga

SEQ ID NO: 2199958 - RNA, 21 nt, Homo sapiens
gcacugugcuaauaacagugc

SEQ ID NO: 2199959 - RNA, 13 nt, Homo sapiens
cuuccuaccaaau

SEQ ID NO: 2199960 - RNA, 15 nt, Homo sapiens
ccuccgcccugccac

SEQ ID NO: 2199961 - RNA, 16 nt, Homo sapiens
guugacauagccuuug

SEQ ID NO: 2199962 - RNA, 16 nt, Homo sapiens
cauggcacauguauac

SEQ ID NO: 2199963 - RNA, 20 nt, Homo sapiens
auuauauuuacaaaugggaa

SEQ ID NO: 2199964 - RNA, 18 nt, Homo sapiens
cauuccaagacucuagag

SEQ ID NO: 2199965 - RNA, 21 nt, Homo sapiens
uaggguagaggggaagucaga

SEQ ID NO: 2199966 - RNA, 18 nt, Homo sapiens
gaaguaauuuucuucuca

SEQ ID NO: 2199967 - RNA, 15 nt, Homo sapiens
aaaguugcagucuca

SEQ ID NO: 2199968 - RNA, 21 nt, Homo sapiens
ccuccaacaacgacacauuca

SEQ ID NO: 2199969 - RNA, 19 nt, Homo sapiens
uagcaagaauugaggaaga

SEQ ID NO: 2199970 - RNA, 18 nt, Homo sapiens
ggaccagggcaagugcau

SEQ ID NO: 2199971 - RNA, 21 nt, Homo sapiens
cagaaaugucuaaaugcugaa

SEQ ID NO: 2199972 - RNA, 17 nt, Homo sapiens
cccagccacaacugcca

SEQ ID NO: 2199973 - RNA, 20 nt, Homo sapiens
uauccuuccucucugugaug

SEQ ID NO: 2199974 - RNA, 13 nt, Homo sapiens
uuaggugugcaaa

SEQ ID NO: 2199975 - RNA, 12 nt, Homo sapiens
aagaaacuugaa

SEQ ID NO: 2199976 - RNA, 18 nt, Homo sapiens
cauagguaacaguuauau

SEQ ID NO: 2199977 - RNA, 17 nt, Homo sapiens
aggugcagccccagggc

SEQ ID NO: 2199978 - RNA, 15 nt, Homo sapiens
augguguguucugca

SEQ ID NO: 2199979 - RNA, 13 nt, Homo sapiens
cugucaagcauau

SEQ ID NO: 2199980 - RNA, 22 nt, Homo sapiens
aaguuggcaaaacagacaucau

SEQ ID NO: 2199981 - RNA, 11 nt, Homo sapiens
augacugugaa

SEQ ID NO: 2199982 - RNA, 14 nt, Homo sapiens
accccagggacugc

SEQ ID NO: 2199983 - RNA, 19 nt, Homo sapiens
agacaguuuaccauccuca

SEQ ID NO: 2199984 - RNA, 17 nt, Homo sapiens
cacugaaagacaccauu

SEQ ID NO: 2199985 - RNA, 21 nt, Homo sapiens
cugaaaccgaagggacuggau

SEQ ID NO: 2199986 - RNA, 20 nt, Homo sapiens
gaagauaacuugagcaccgu

SEQ ID NO: 2199987 - RNA, 18 nt, Homo sapiens
agucacauuuuuuaaaca

SEQ ID NO: 2199988 - RNA, 20 nt, Homo sapiens
acaaauaucguuaaguuaaa

SEQ ID NO: 2199989 - RNA, 19 nt, Homo sapiens
uaaacauaaguugcauuua

SEQ ID NO: 2199990 - RNA, 13 nt, Homo sapiens
ugaaaggcuuuga

SEQ ID NO: 2199991 - RNA, 14 nt, Homo sapiens
gaguaaucugugua

SEQ ID NO: 2199992 - RNA, 13 nt, Homo sapiens
guuguuucuugcc

SEQ ID NO: 2199993 - RNA, 10 nt, Homo sapiens
gaggcccaaa

SEQ ID NO: 2199994 - RNA, 19 nt, Homo sapiens
ccucugcaucuugcucugu

SEQ ID NO: 2199995 - RNA, 21 nt, Homo sapiens
cagaaguugaaguagcuuuua

SEQ ID NO: 2199996 - RNA, 21 nt, Homo sapiens
caagaucauagcucauugcaa

SEQ ID NO: 2199997 - RNA, 22 nt, Homo sapiens
aaucuggugccucucucuugcu

SEQ ID NO: 2199998 - RNA, 22 nt, Homo sapiens
aacagauaccccccuacuuaau

SEQ ID NO: 2199999 - RNA, 15 nt, Homo sapiens
cuccccccacaagaa

SEQ ID NO: 2200000 - RNA, 14 nt, Homo sapiens
caaauggcauauga

SEQ ID NO: 2200001 - RNA, 20 nt, Homo sapiens
ugcaguggcaucaucucagc

SEQ ID NO: 2200002 - RNA, 14 nt, Homo sapiens
cccuuuuucaauga

SEQ ID NO: 2200003 - RNA, 15 nt, Homo sapiens
uacccuguccuuugc

SEQ ID NO: 2200004 - RNA, 22 nt, Homo sapiens
guacuucauucaaaaagccaaa

SEQ ID NO: 2200005 - RNA, 18 nt, Homo sapiens
cuucagggcugaguucug

SEQ ID NO: 2200006 - RNA, 14 nt, Homo sapiens
uccugaagccucug

SEQ ID NO: 2200007 - RNA, 11 nt, Homo sapiens
guaccuaugug

SEQ ID NO: 2200008 - RNA, 16 nt, Homo sapiens
cuugcccugaccuccc

SEQ ID NO: 2200009 - RNA, 18 nt, Homo sapiens
ugauguuugcuuuucuaa

SEQ ID NO: 2200010 - RNA, 19 nt, Homo sapiens
aggcagugugccaguuuaa

SEQ ID NO: 2200011 - RNA, 14 nt, Homo sapiens
aucaguagugcuau

SEQ ID NO: 2200012 - RNA, 18 nt, Homo sapiens
cacaaucaccgaugcaaa

SEQ ID NO: 2200013 - RNA, 15 nt, Homo sapiens
aaccucgaguacugu

SEQ ID NO: 2200014 - RNA, 17 nt, Homo sapiens
gaauuucccagugaaau

SEQ ID NO: 2200015 - RNA, 12 nt, Homo sapiens
aagaaaugcaaa

SEQ ID NO: 2200016 - RNA, 19 nt, Homo sapiens
ugcaaaggcgucugaaugu

SEQ ID NO: 2200017 - RNA, 18 nt, Homo sapiens
cagggcaaaaugaacuaa

SEQ ID NO: 2200018 - RNA, 23 nt, Homo sapiens
augcugaaaaucaaaguaaaaaa

SEQ ID NO: 2200019 - RNA, 23 nt, Homo sapiens
ucauuuuugguaggcuuaucaaa

SEQ ID NO: 2200020 - RNA, 20 nt, Homo sapiens
accaggauuuauacauacag

SEQ ID NO: 2200021 - RNA, 19 nt, Homo sapiens
aucugaaaaacuaaacuac

SEQ ID NO: 2200022 - RNA, 15 nt, Homo sapiens
aagaguaacugguag

SEQ ID NO: 2200023 - RNA, 14 nt, Homo sapiens
ggaugguggcacag

SEQ ID NO: 2200024 - RNA, 15 nt, Homo sapiens
caauucuuguaacuu

SEQ ID NO: 2200025 - RNA, 17 nt, Homo sapiens
aguccuuaucaccagcc

SEQ ID NO: 2200026 - RNA, 21 nt, Homo sapiens
ucucuaauaaaauucagaauu

SEQ ID NO: 2200027 - RNA, 15 nt, Homo sapiens
uccaccccaggguca

SEQ ID NO: 2200028 - RNA, 13 nt, Homo sapiens
gaguggaaacaaa

SEQ ID NO: 2200029 - RNA, 16 nt, Homo sapiens
gaacugaaaggacugu

SEQ ID NO: 2200030 - RNA, 20 nt, Homo sapiens
uccccggcgggacugucaau

SEQ ID NO: 2200031 - RNA, 20 nt, Homo sapiens
ugugaaggaguaaugggaua

SEQ ID NO: 2200032 - RNA, 20 nt, Homo sapiens
acuaauuuguauaacccaua

SEQ ID NO: 2200033 - RNA, 14 nt, Homo sapiens
acaacuugcuccuu

SEQ ID NO: 2200034 - RNA, 19 nt, Homo sapiens
gacugugauuagaucacau

SEQ ID NO: 2200035 - RNA, 16 nt, Homo sapiens
auugugaauuccuuaa

SEQ ID NO: 2200036 - RNA, 20 nt, Homo sapiens
ccugaauuucucacaaagga

SEQ ID NO: 2200037 - RNA, 19 nt, Homo sapiens
gcacccuccuuucucacca

SEQ ID NO: 2200038 - RNA, 22 nt, Homo sapiens
ucuucaacaugucacacuggcu

SEQ ID NO: 2200039 - RNA, 13 nt, Homo sapiens
uaaauauucauau

SEQ ID NO: 2200040 - RNA, 13 nt, Homo sapiens
uaaaaauucauaa

SEQ ID NO: 2200041 - RNA, 15 nt, Homo sapiens
uaguuccauuugguc

SEQ ID NO: 2200042 - RNA, 21 nt, Homo sapiens
cucaugccacagugguacucu

SEQ ID NO: 2200043 - RNA, 21 nt, Homo sapiens
aaauuucacuuaauaaugugu

SEQ ID NO: 2200044 - RNA, 16 nt, Homo sapiens
gaagacucacugugug

SEQ ID NO: 2200045 - RNA, 18 nt, Homo sapiens
auggagaacaaguuguua

SEQ ID NO: 2200046 - RNA, 13 nt, Homo sapiens
cauauuuugccac

SEQ ID NO: 2200047 - RNA, 14 nt, Homo sapiens
caucuuucauaguu

SEQ ID NO: 2200048 - RNA, 15 nt, Homo sapiens
ucuaucccuuaccug

SEQ ID NO: 2200049 - RNA, 21 nt, Homo sapiens
caaguuccaaaagcacagacu

SEQ ID NO: 2200050 - RNA, 20 nt, Homo sapiens
agcuuauuuaaucuguacua

SEQ ID NO: 2200051 - RNA, 18 nt, Homo sapiens
caugugacuaaaaaugca

SEQ ID NO: 2200052 - RNA, 17 nt, Homo sapiens
uccauaugucauugcua

SEQ ID NO: 2200053 - RNA, 21 nt, Homo sapiens
agccuacuuucacacuaagaa

SEQ ID NO: 2200054 - RNA, 21 nt, Homo sapiens
gugaagacuugauuguacaaa

SEQ ID NO: 2200055 - RNA, 17 nt, Homo sapiens
cuguuaugucauugugu

SEQ ID NO: 2200056 - RNA, 15 nt, Homo sapiens
ucuccugggcagcug

SEQ ID NO: 2200057 - RNA, 15 nt, Homo sapiens
ugugcccgggacccc

SEQ ID NO: 2200058 - RNA, 18 nt, Homo sapiens
auauacaaaacaauuaau

SEQ ID NO: 2200059 - RNA, 21 nt, Homo sapiens
cagaagagauggauauugaaa

SEQ ID NO: 2200060 - RNA, 12 nt, Homo sapiens
gccacuucucac

SEQ ID NO: 2200061 - RNA, 21 nt, Homo sapiens
aguagugcaccaucucacugc

SEQ ID NO: 2200062 - RNA, 13 nt, Homo sapiens
caacauucuuugc

SEQ ID NO: 2200063 - RNA, 20 nt, Homo sapiens
cuugcaccccaaagcuuucc

SEQ ID NO: 2200064 - RNA, 20 nt, Homo sapiens
ucaccauuuggcaaugccau

SEQ ID NO: 2200065 - RNA, 23 nt, Homo sapiens
acuggacagacccaggucuucca

SEQ ID NO: 2200066 - RNA, 18 nt, Homo sapiens
cgacuguggugugcagug

SEQ ID NO: 2200067 - RNA, 15 nt, Homo sapiens
cuaaaccuuacaugu

SEQ ID NO: 2200068 - RNA, 20 nt, Homo sapiens
cccacacacaggugguguca

SEQ ID NO: 2200069 - RNA, 18 nt, Homo sapiens
gacacuguuugcccagug

SEQ ID NO: 2200070 - RNA, 21 nt, Homo sapiens
agaauuuucagcaaaguacaa

SEQ ID NO: 2200071 - RNA, 23 nt, Homo sapiens
agugccccuauuauuaacaauuc

SEQ ID NO: 2200072 - RNA, 24 nt, Homo sapiens
aggcuugcccaggagcaagugagg

SEQ ID NO: 2200073 - RNA, 19 nt, Homo sapiens
uucagugaaauuuucaggu

SEQ ID NO: 2200074 - RNA, 18 nt, Homo sapiens
gcuacacaaaagccaaaa

SEQ ID NO: 2200075 - RNA, 19 nt, Homo sapiens
aggcaagagagcgugccac

SEQ ID NO: 2200076 - RNA, 13 nt, Homo sapiens
aucuaacucuguc

SEQ ID NO: 2200077 - RNA, 23 nt, Homo sapiens
aacugcccuacugggagacuggg

SEQ ID NO: 2200078 - RNA, 23 nt, Homo sapiens
aauucauggaagccaccagugag

SEQ ID NO: 2200079 - RNA, 14 nt, Homo sapiens
accaauacauuugu

SEQ ID NO: 2200080 - RNA, 22 nt, Homo sapiens
ugcgagugguuucuugugcacu

SEQ ID NO: 2200081 - RNA, 12 nt, Homo sapiens
aaggacaccucc

SEQ ID NO: 2200082 - RNA, 23 nt, Homo sapiens
agagugucuucacggcaggacaa

SEQ ID NO: 2200083 - RNA, 19 nt, Homo sapiens
cauuucucugcuuacccuu

SEQ ID NO: 2200084 - RNA, 12 nt, Homo sapiens
uucaguuacuaa

SEQ ID NO: 2200085 - RNA, 14 nt, Homo sapiens
cuuggcacuguuag

SEQ ID NO: 2200086 - RNA, 15 nt, Homo sapiens
aaacaaacaaaucaa

SEQ ID NO: 2200087 - RNA, 13 nt, Homo sapiens
ugcuuugccaaaa

SEQ ID NO: 2200088 - RNA, 13 nt, Homo sapiens
caaaaugcugcuu

SEQ ID NO: 2200089 - RNA, 23 nt, Homo sapiens
aaguuggggacaugcugcuacaa

SEQ ID NO: 2200090 - RNA, 23 nt, Homo sapiens
aagcuaaaaugaaaaauagugug

SEQ ID NO: 2200091 - RNA, 14 nt, Homo sapiens
cuagccuugcuugu

SEQ ID NO: 2200092 - RNA, 18 nt, Homo sapiens
accuugaugugccuguga

SEQ ID NO: 2200093 - RNA, 14 nt, Homo sapiens
acuuuccagcagua

SEQ ID NO: 2200094 - RNA, 17 nt, Homo sapiens
guauaagguggucauaa

SEQ ID NO: 2200095 - RNA, 21 nt, Homo sapiens
accuggggcacaguccaggaa

SEQ ID NO: 2200096 - RNA, 15 nt, Homo sapiens
agcuggacugaccaa

SEQ ID NO: 2200097 - RNA, 20 nt, Homo sapiens
aguuucauuuaugauacaaa

SEQ ID NO: 2200098 - RNA, 16 nt, Homo sapiens
accaggccaccucccc

SEQ ID NO: 2200099 - RNA, 21 nt, Homo sapiens
ggaaaaggaaaaaaagcaaaa

SEQ ID NO: 2200100 - RNA, 15 nt, Homo sapiens
cuaaaaaucugagaa

SEQ ID NO: 2200101 - RNA, 20 nt, Homo sapiens
gacaccuuuacuaacucugg

SEQ ID NO: 2200102 - RNA, 15 nt, Homo sapiens
uucuaacucugaugu

SEQ ID NO: 2200103 - RNA, 17 nt, Homo sapiens
uaaagcgaauggaccau

SEQ ID NO: 2200104 - RNA, 14 nt, Homo sapiens
uaauaauuauucau

SEQ ID NO: 2200105 - RNA, 16 nt, Homo sapiens
aguaaugugucauauc

SEQ ID NO: 2200106 - RNA, 17 nt, Homo sapiens
agagugaaaccaugacu

SEQ ID NO: 2200107 - RNA, 14 nt, Homo sapiens
gaacaaacucugaa

SEQ ID NO: 2200108 - RNA, 15 nt, Homo sapiens
gauuccugcugccug

SEQ ID NO: 2200109 - RNA, 18 nt, Homo sapiens
ccuggcccccaaccucag

SEQ ID NO: 2200110 - RNA, 17 nt, Homo sapiens
aaacauacgugugcaug

SEQ ID NO: 2200111 - RNA, 14 nt, Homo sapiens
gucuccagcaaacg

SEQ ID NO: 2200112 - RNA, 14 nt, Homo sapiens
gucuggagcaaagc

SEQ ID NO: 2200113 - RNA, 19 nt, Homo sapiens
cucaugagcuguguucaca

SEQ ID NO: 2200114 - RNA, 19 nt, Homo sapiens
uaaacaagaaaucugacaa

SEQ ID NO: 2200115 - RNA, 21 nt, Homo sapiens
agccccuuccuggguauuuau

SEQ ID NO: 2200116 - RNA, 18 nt, Homo sapiens
gcauuccuuacuugcacu

SEQ ID NO: 2200117 - RNA, 15 nt, Homo sapiens
ccaucccugauggca

SEQ ID NO: 2200118 - RNA, 19 nt, Homo sapiens
cuaagaaauaugcacaaua

SEQ ID NO: 2200119 - RNA, 12 nt, Homo sapiens
gccauucauuca

SEQ ID NO: 2200120 - RNA, 16 nt, Homo sapiens
ccugggaucuggcaca

SEQ ID NO: 2200121 - RNA, 13 nt, Homo sapiens
auuaauguagcug

SEQ ID NO: 2200122 - RNA, 15 nt, Homo sapiens
aggaugugagccuga

SEQ ID NO: 2200123 - RNA, 19 nt, Homo sapiens
cuaaaauguaucuaagaau

SEQ ID NO: 2200124 - RNA, 19 nt, Homo sapiens
gacagaaugagaccaaacg

SEQ ID NO: 2200125 - RNA, 16 nt, Homo sapiens
gaucagcaucugugau

SEQ ID NO: 2200126 - RNA, 18 nt, Homo sapiens
guaacuucagauguuucc

SEQ ID NO: 2200127 - RNA, 21 nt, Homo sapiens
ugauggucuuaaggaacaucu

SEQ ID NO: 2200128 - RNA, 15 nt, Homo sapiens
ugcacuuggccucag

SEQ ID NO: 2200129 - RNA, 17 nt, Homo sapiens
cauucuaaaacacaaca

SEQ ID NO: 2200130 - RNA, 19 nt, Homo sapiens
auagauuguccuuuugcaa

SEQ ID NO: 2200131 - RNA, 17 nt, Homo sapiens
augcugggcucuguucu

SEQ ID NO: 2200132 - RNA, 21 nt, Homo sapiens
uccaucucucauccuccagua

SEQ ID NO: 2200133 - RNA, 14 nt, Homo sapiens
cugccccuguugag

SEQ ID NO: 2200134 - RNA, 16 nt, Homo sapiens
ucaguauguccccaua

SEQ ID NO: 2200135 - RNA, 18 nt, Homo sapiens
caguguuaauaaauggau

SEQ ID NO: 2200136 - RNA, 23 nt, Homo sapiens
uccauuuuacuuccaugauacuu

SEQ ID NO: 2200137 - RNA, 20 nt, Homo sapiens
cauaauucaggaagcagcuu

SEQ ID NO: 2200138 - RNA, 16 nt, Homo sapiens
cuggagcgggugggaa

SEQ ID NO: 2200139 - RNA, 23 nt, Homo sapiens
aauguucucuggguagguguuga

SEQ ID NO: 2200140 - RNA, 17 nt, Homo sapiens
ucccgaagccugagcuc

SEQ ID NO: 2200141 - RNA, 17 nt, Homo sapiens
cccaggaaugcaagugg

SEQ ID NO: 2200142 - RNA, 22 nt, Homo sapiens
caggggauccagcucaagggag

SEQ ID NO: 2200143 - RNA, 17 nt, Homo sapiens
ccccugcgggcgcgggc

SEQ ID NO: 2200144 - RNA, 21 nt, Homo sapiens
uccauagggccuccuuagauc

SEQ ID NO: 2200145 - RNA, 17 nt, Homo sapiens
guauauuugguacugua

SEQ ID NO: 2200146 - RNA, 17 nt, Homo sapiens
gccuggaacaccagcag

SEQ ID NO: 2200147 - RNA, 13 nt, Homo sapiens
aggaaguaacuuu

SEQ ID NO: 2200148 - RNA, 21 nt, Homo sapiens
cuccagagauuugcuuuaccu

SEQ ID NO: 2200149 - RNA, 18 nt, Homo sapiens
auucuagaggucucucug

SEQ ID NO: 2200150 - RNA, 13 nt, Homo sapiens
aggauaaugagau

SEQ ID NO: 2200151 - RNA, 13 nt, Homo sapiens
agcuuaaugacuu

SEQ ID NO: 2200152 - RNA, 16 nt, Homo sapiens
uuauuacaucuuuauu

SEQ ID NO: 2200153 - RNA, 19 nt, Homo sapiens
aagcugagaagaagcugag

SEQ ID NO: 2200154 - RNA, 17 nt, Homo sapiens
ugcgagugcucauuuca

SEQ ID NO: 2200155 - RNA, 19 nt, Homo sapiens
aguauugcuguuagcaagu

SEQ ID NO: 2200156 - RNA, 20 nt, Homo sapiens
guuaauguuuauuguucaau

SEQ ID NO: 2200157 - RNA, 12 nt, Homo sapiens
ugacugguggaa

SEQ ID NO: 2200158 - RNA, 23 nt, Homo sapiens
caaauuguuaagaguaucaugua

SEQ ID NO: 2200159 - RNA, 18 nt, Homo sapiens
uaucguaaagcuguucaa

SEQ ID NO: 2200160 - RNA, 18 nt, Homo sapiens
cuugaaaaaugugcaaaa

SEQ ID NO: 2200161 - RNA, 16 nt, Homo sapiens
cugugcaucaguggga

SEQ ID NO: 2200162 - RNA, 16 nt, Homo sapiens
ccacuggacucaccuc

SEQ ID NO: 2200163 - RNA, 19 nt, Homo sapiens
acagaaggaaggagccagc

SEQ ID NO: 2200164 - RNA, 23 nt, Homo sapiens
gacacugguuuuaccuccaggaa

SEQ ID NO: 2200165 - RNA, 15 nt, Homo sapiens
gcgagucacugccuc

SEQ ID NO: 2200166 - RNA, 20 nt, Homo sapiens
cauuuacucuauaaucugca

SEQ ID NO: 2200167 - RNA, 10 nt, Homo sapiens
aauagaucuc

SEQ ID NO: 2200168 - RNA, 22 nt, Homo sapiens
cuaauuuguuuucccuucuuac

SEQ ID NO: 2200169 - RNA, 20 nt, Homo sapiens
uauugccucugaaaugccuc

SEQ ID NO: 2200170 - RNA, 15 nt, Homo sapiens
aaaacaaaaccaagc

SEQ ID NO: 2200171 - RNA, 21 nt, Homo sapiens
cuggucccggggccagcacuu

SEQ ID NO: 2200172 - RNA, 22 nt, Homo sapiens
ucaaaaaaaaaaaaaaaagccu

SEQ ID NO: 2200173 - RNA, 15 nt, Homo sapiens
agucaugcaucucag

SEQ ID NO: 2200174 - RNA, 20 nt, Homo sapiens
acccaguccuggccauuuuc

SEQ ID NO: 2200175 - RNA, 17 nt, Homo sapiens
ucacugcccccagcucu

SEQ ID NO: 2200176 - RNA, 22 nt, Homo sapiens
ccuacgguggucggugggaccc

SEQ ID NO: 2200177 - RNA, 12 nt, Homo sapiens
ccuuuacaugaa

SEQ ID NO: 2200178 - RNA, 13 nt, Homo sapiens
uucagugcaucau

SEQ ID NO: 2200179 - RNA, 16 nt, Homo sapiens
gccagcagggcaucuu

SEQ ID NO: 2200180 - RNA, 12 nt, Homo sapiens
aggcuugccaag

SEQ ID NO: 2200181 - RNA, 18 nt, Homo sapiens
ccagacugguuagacagu

SEQ ID NO: 2200182 - RNA, 22 nt, Homo sapiens
gcugaaugacggcaaacucagu

SEQ ID NO: 2200183 - RNA, 14 nt, Homo sapiens
uucaggaaaccaga

SEQ ID NO: 2200184 - RNA, 20 nt, Homo sapiens
aauacaugcugcuaauucaa

SEQ ID NO: 2200185 - RNA, 21 nt, Homo sapiens
cauagagaucauccuuuccag

SEQ ID NO: 2200186 - RNA, 14 nt, Homo sapiens
uugaaggcaaaaau

SEQ ID NO: 2200187 - RNA, 16 nt, Homo sapiens
aggcaguuaauucuca

SEQ ID NO: 2200188 - RNA, 19 nt, Homo sapiens
ugcagggguccccccucaa

SEQ ID NO: 2200189 - RNA, 16 nt, Homo sapiens
auaaagggacuugaag

SEQ ID NO: 2200190 - RNA, 13 nt, Homo sapiens
gccuggccagucc

SEQ ID NO: 2200191 - RNA, 14 nt, Homo sapiens
cgcauauuuaacuc

SEQ ID NO: 2200192 - RNA, 22 nt, Homo sapiens
uguuugaaauucuagagccagc

SEQ ID NO: 2200193 - RNA, 21 nt, Homo sapiens
uguggauucuucccacacaga

SEQ ID NO: 2200194 - RNA, 16 nt, Homo sapiens
ugaaggcuugucagca

SEQ ID NO: 2200195 - RNA, 24 nt, Homo sapiens
acauuaaaucuaugaaguauauaa

SEQ ID NO: 2200196 - RNA, 13 nt, Homo sapiens
ucugccucuggaa

SEQ ID NO: 2200197 - RNA, 15 nt, Homo sapiens
aggcaccugugguga

SEQ ID NO: 2200198 - RNA, 23 nt, Homo sapiens
guaaguugaauggccugccuuga

SEQ ID NO: 2200199 - RNA, 21 nt, Homo sapiens
uugugcugcaccuggucauac

SEQ ID NO: 2200200 - RNA, 21 nt, Homo sapiens
gccacaggcaccucuccugcc

SEQ ID NO: 2200201 - RNA, 16 nt, Homo sapiens
aaggcucugugccuug

SEQ ID NO: 2200202 - RNA, 23 nt, Homo sapiens
aagcucuguuccaugcaacugga
